United States Patent 7,777,022 (BIOINFORMATICALLY DETECTABLE GROUP OF NOVEL REGULATORY VIRAL AND VIRAL ASSOCIATED OLIGONUCLEOTIDES AND USES THEREOF) - sequence listing, part 38

SEQ ID NO: 1690319 - RNA, 19 nt, Human
ucaccugucuugccuuuuu

SEQ ID NO: 1690320 - RNA, 12 nt, Human
ucaacugggcug

SEQ ID NO: 1690321 - RNA, 18 nt, Human
acauguauuuguuugcau

SEQ ID NO: 1690322 - RNA, 17 nt, Human
acauguauuuguuugca

SEQ ID NO: 1690323 - RNA, 19 nt, Human
acauguauuuguuugcaua

SEQ ID NO: 1690324 - RNA, 17 nt, Human
ucaaccaccuuucagau

SEQ ID NO: 1690325 - RNA, 18 nt, Human
ucaacugggcugaacacu

SEQ ID NO: 1690326 - RNA, 20 nt, Human
ucagcaaaaauauuuuauga

SEQ ID NO: 1690327 - RNA, 19 nt, Human
ucagcaaaaauauuuuaug

SEQ ID NO: 1690328 - RNA, 23 nt, Human
ucagauuuuauuauguaaauccc

SEQ ID NO: 1690329 - RNA, 19 nt, Human
accauaaccccggaagcca

SEQ ID NO: 1690330 - RNA, 14 nt, Human
acggaugauuucua

SEQ ID NO: 1690331 - RNA, 13 nt, Human
acggaugauuucu

SEQ ID NO: 1690332 - RNA, 16 nt, Human
acuaaacuuucacacc

SEQ ID NO: 1690333 - RNA, 15 nt, Human
acuaaacuuucacac

SEQ ID NO: 1690334 - RNA, 16 nt, Human
acggugaauggcuuug

SEQ ID NO: 1690335 - RNA, 20 nt, Human
acggugaauggcuuuguaua

SEQ ID NO: 1690336 - RNA, 19 nt, Human
acggugaauggcuuuguau

SEQ ID NO: 1690337 - RNA, 15 nt, Human
acucaauuuuaacaa

SEQ ID NO: 1690338 - RNA, 12 nt, Human
acucaauuuuaa

SEQ ID NO: 1690339 - RNA, 22 nt, Human
uccugcaaugaagucucugaag

SEQ ID NO: 1690340 - RNA, 20 nt, Human
agaaggcaaaugacuuugga

SEQ ID NO: 1690341 - RNA, 15 nt, Human
agaaggcaaaugacu

SEQ ID NO: 1690342 - RNA, 14 nt, Human
agaaggcaaaugac

SEQ ID NO: 1690343 - RNA, 23 nt, Human
agaaugguccgugcuaaggacuu

SEQ ID NO: 1690344 - RNA, 21 nt, Human
agaaugguccgugcuaaggac

SEQ ID NO: 1690345 - RNA, 18 nt, Human
ucugugaacuugaaauuu

SEQ ID NO: 1690346 - RNA, 17 nt, Human
ucugugaacuugaaauu

SEQ ID NO: 1690347 - RNA, 14 nt, Human
ucugugaacuugaa

SEQ ID NO: 1690348 - RNA, 12 nt, Human
agaauucuguau

SEQ ID NO: 1690349 - RNA, 14 nt, Human
agaauucuguauag

SEQ ID NO: 1690350 - RNA, 20 nt, Human
ucugugagcaucacaguuuu

SEQ ID NO: 1690351 - RNA, 11 nt, Human
ucugauccagu

SEQ ID NO: 1690352 - RNA, 21 nt, Human
ucugauccaguuuuguuugga

SEQ ID NO: 1690353 - RNA, 14 nt, Human
ucugauccaguuuu

SEQ ID NO: 1690354 - RNA, 21 nt, Human
acuguuauuuauaaucacuuu

SEQ ID NO: 1690355 - RNA, 20 nt, Human
acuguuauuuauaaucacuu

SEQ ID NO: 1690356 - RNA, 17 nt, Human
acuguuauuuauaauca

SEQ ID NO: 1690357 - RNA, 15 nt, Human
acuguuauuuauaau

SEQ ID NO: 1690358 - RNA, 13 nt, Human
acuuguguaaaua

SEQ ID NO: 1690359 - RNA, 23 nt, Human
ucucagauuuuauuauguaaauc

SEQ ID NO: 1690360 - RNA, 22 nt, Human
ucucagauuuuauuauguaaau

SEQ ID NO: 1690361 - RNA, 16 nt, Human
ucucauuuaauccucu

SEQ ID NO: 1690362 - RNA, 12 nt, Human
acuuuggauaau

SEQ ID NO: 1690363 - RNA, 19 nt, Human
acuuuggauaauaaggaaa

SEQ ID NO: 1690364 - RNA, 17 nt, Human
acuuuggauaauaagga

SEQ ID NO: 1690365 - RNA, 21 nt, Human
agauuagagaguguugaaacg

SEQ ID NO: 1690366 - RNA, 23 nt, Human
agauuagaauucuguauagauua

SEQ ID NO: 1690367 - RNA, 22 nt, Human
agauuagaauucuguauagauu

SEQ ID NO: 1690368 - RNA, 16 nt, Human
agauuagaauucugua

SEQ ID NO: 1690369 - RNA, 15 nt, Human
agauuagaauucugu

SEQ ID NO: 1690370 - RNA, 16 nt, Human
ugaaauacuguuugag

SEQ ID NO: 1690371 - RNA, 14 nt, Human
ugaaauacuguuug

SEQ ID NO: 1690372 - RNA, 20 nt, Human
ugaaauuguaauuauaucug

SEQ ID NO: 1690373 - RNA, 19 nt, Human
ugaaauuguaauuauaucu

SEQ ID NO: 1690374 - RNA, 16 nt, Human
ugaaauuguaauuaua

SEQ ID NO: 1690375 - RNA, 15 nt, Human
ugaaauuguaauuau

SEQ ID NO: 1690376 - RNA, 14 nt, Human
ugaaauuguaauua

SEQ ID NO: 1690377 - RNA, 13 nt, Human
ugaaauuguaauu

SEQ ID NO: 1690378 - RNA, 19 nt, Human
ugaacuaaacuuucacacc

SEQ ID NO: 1690379 - RNA, 17 nt, Human
ugaacuaaacuuucaca

SEQ ID NO: 1690380 - RNA, 22 nt, Human
agagguuuuucuuaaauaauaa

SEQ ID NO: 1690381 - RNA, 12 nt, Human
agagguuuuucu

SEQ ID NO: 1690382 - RNA, 22 nt, Human
ugaaacugcuuguuuccuagca

SEQ ID NO: 1690383 - RNA, 20 nt, Human
ugaaacugcuuguuuccuag

SEQ ID NO: 1690384 - RNA, 15 nt, Human
agagaguguugaaac

SEQ ID NO: 1690385 - RNA, 16 nt, Human
agagaguguugaaacg

SEQ ID NO: 1690386 - RNA, 19 nt, Human
ugaaacugcuuguuuccua

SEQ ID NO: 1690387 - RNA, 18 nt, Human
ugaaacugcuuguuuccu

SEQ ID NO: 1690388 - RNA, 17 nt, Human
ucuuugucuacaccauu

SEQ ID NO: 1690389 - RNA, 21 nt, Human
agacuggugacugauucuuca

SEQ ID NO: 1690390 - RNA, 20 nt, Human
agacuggugacugauucuuc

SEQ ID NO: 1690391 - RNA, 17 nt, Human
agucagaucugccuaag

SEQ ID NO: 1690392 - RNA, 20 nt, Human
agucagaucugccuaaggac

SEQ ID NO: 1690393 - RNA, 22 nt, Human
agucagaucugccuaaggacuu

SEQ ID NO: 1690394 - RNA, 21 nt, Human
agucagaucugccuaaggacu

SEQ ID NO: 1690395 - RNA, 23 nt, Human
agucagaucugccuaaggacuuc

SEQ ID NO: 1690396 - RNA, 11 nt, Human
aguauuguaca

SEQ ID NO: 1690397 - RNA, 23 nt, Human
aguauuguacaaaguauuaagca

SEQ ID NO: 1690398 - RNA, 22 nt, Human
aguauuguacaaaguauuaagc

SEQ ID NO: 1690399 - RNA, 20 nt, Human
aguauuguacaaaguauuaa

SEQ ID NO: 1690400 - RNA, 15 nt, Human
aguauuguacaaagu

SEQ ID NO: 1690401 - RNA, 16 nt, Human
uguauuaagaaugaaa

SEQ ID NO: 1690402 - RNA, 12 nt, Human
uguauuaagaau

SEQ ID NO: 1690403 - RNA, 13 nt, Human
uguaugugugaag

SEQ ID NO: 1690404 - RNA, 12 nt, Human
uguaugugugaa

SEQ ID NO: 1690405 - RNA, 18 nt, Human
ugugagcaucacaguuuu

SEQ ID NO: 1690406 - RNA, 19 nt, Human
agucucugaagugaaacug

SEQ ID NO: 1690407 - RNA, 18 nt, Human
agucucugaagugaaacu

SEQ ID NO: 1690408 - RNA, 18 nt, Human
agucuguuuuaugacuuc

SEQ ID NO: 1690409 - RNA, 17 nt, Human
agucuguuuuaugacuu

SEQ ID NO: 1690410 - RNA, 14 nt, Human
agucuguuuuauga

SEQ ID NO: 1690411 - RNA, 13 nt, Human
agucuguuuuaug

SEQ ID NO: 1690412 - RNA, 22 nt, Human
ugucuucauaccuacauguauu

SEQ ID NO: 1690413 - RNA, 20 nt, Human
ugugaacuaaacuuucacac

SEQ ID NO: 1690414 - RNA, 19 nt, Human
ugugaacuaaacuuucaca

SEQ ID NO: 1690415 - RNA, 14 nt, Human
ugugaacuaaacuu

SEQ ID NO: 1690416 - RNA, 21 nt, Human
ugucuugccuuuuucauuauu

SEQ ID NO: 1690417 - RNA, 17 nt, Human
ugucuugccuuuuucau

SEQ ID NO: 1690418 - RNA, 16 nt, Human
ugucuugccuuuuuca

SEQ ID NO: 1690419 - RNA, 15 nt, Human
ugucuugccuuuuuc

SEQ ID NO: 1690420 - RNA, 14 nt, Human
uguacaaaguauua

SEQ ID NO: 1690421 - RNA, 13 nt, Human
uguacaaaguauu

SEQ ID NO: 1690422 - RNA, 19 nt, Human
uguaaauacaauuuuguuu

SEQ ID NO: 1690423 - RNA, 18 nt, Human
uguaaauacaauuuuguu

SEQ ID NO: 1690424 - RNA, 17 nt, Human
uguaaauacaauuuugu

SEQ ID NO: 1690425 - RNA, 16 nt, Human
uguaaauacaauuuug

SEQ ID NO: 1690426 - RNA, 10 nt, Human
uguaaauccc

SEQ ID NO: 1690427 - RNA, 21 nt, Human
uguaaauacaauuuuguuucu

SEQ ID NO: 1690428 - RNA, 15 nt, Human
ugguuaagucuguuu

SEQ ID NO: 1690429 - RNA, 18 nt, Human
ugguuaagucuguuuuau

SEQ ID NO: 1690430 - RNA, 22 nt, Human
auaauaaggaaaaguuuaauau

SEQ ID NO: 1690431 - RNA, 19 nt, Human
auaauaaggaaaaguuuaa

SEQ ID NO: 1690432 - RNA, 18 nt, Human
auaauaaggaaaaguuua

SEQ ID NO: 1690433 - RNA, 17 nt, Human
auaauaaggaaaaguuu

SEQ ID NO: 1690434 - RNA, 16 nt, Human
auaauaaggaaaaguu

SEQ ID NO: 1690435 - RNA, 19 nt, Human
auaaucacuuuuuuccaca

SEQ ID NO: 1690436 - RNA, 19 nt, Human
auaauuauaugcuauuucu

SEQ ID NO: 1690437 - RNA, 17 nt, Human
auaauuauaugcuauuu

SEQ ID NO: 1690438 - RNA, 23 nt, Human
auaauuauaugcuauuucuauau

SEQ ID NO: 1690439 - RNA, 21 nt, Human
auaauuauaugcuauuucuau

SEQ ID NO: 1690440 - RNA, 18 nt, Human
uuauaaaucgcuuuugau

SEQ ID NO: 1690441 - RNA, 17 nt, Human
uuauaaaucgcuuuuga

SEQ ID NO: 1690442 - RNA, 14 nt, Human
uuauaaaucgcuuu

SEQ ID NO: 1690443 - RNA, 21 nt, Human
uguuguacucaauuuuaacaa

SEQ ID NO: 1690444 - RNA, 19 nt, Human
aguuugugcugguguaugu

SEQ ID NO: 1690445 - RNA, 16 nt, Human
ugauuucuaugcugag

SEQ ID NO: 1690446 - RNA, 15 nt, Human
ugauuucuaugcuga

SEQ ID NO: 1690447 - RNA, 12 nt, Human
ugauuucuaugc

SEQ ID NO: 1690448 - RNA, 20 nt, Human
aggauuuuaugcuuuaaaca

SEQ ID NO: 1690449 - RNA, 17 nt, Human
aggacuuguuagaucua

SEQ ID NO: 1690450 - RNA, 16 nt, Human
aggacuuguuagaucu

SEQ ID NO: 1690451 - RNA, 14 nt, Human
aggacuuguuagau

SEQ ID NO: 1690452 - RNA, 13 nt, Human
ugcuauuucuaua

SEQ ID NO: 1690453 - RNA, 12 nt, Human
ugcuauuucuau

SEQ ID NO: 1690454 - RNA, 21 nt, Human
ugcuauuucuauauuuucauu

SEQ ID NO: 1690455 - RNA, 20 nt, Human
ugcuauuucuauauuuucau

SEQ ID NO: 1690456 - RNA, 14 nt, Human
ugcuauuucuauau

SEQ ID NO: 1690457 - RNA, 19 nt, Human
uucuuaaauaauaaagauc

SEQ ID NO: 1690458 - RNA, 15 nt, Human
uucuuaaauaauaaa

SEQ ID NO: 1690459 - RNA, 13 nt, Human
uucuuaaaguuga

SEQ ID NO: 1690460 - RNA, 19 nt, Human
uugauaaucaacugggcug

SEQ ID NO: 1690461 - RNA, 14 nt, Human
uugacauagucugg

SEQ ID NO: 1690462 - RNA, 17 nt, Human
uugacauagucuggcug

SEQ ID NO: 1690463 - RNA, 12 nt, Human
auauuaaagcca

SEQ ID NO: 1690464 - RNA, 19 nt, Human
aucaacugggcugaacacu

SEQ ID NO: 1690465 - RNA, 13 nt, Human
auauauuuuuaua

SEQ ID NO: 1690466 - RNA, 20 nt, Human
uucauggaacgcguugaaau

SEQ ID NO: 1690467 - RNA, 19 nt, Human
uucauggaacgcguugaaa

SEQ ID NO: 1690468 - RNA, 21 nt, Human
uucauuaauaauaaauucccu

SEQ ID NO: 1690469 - RNA, 18 nt, Human
uucauuaauaauaaauuc

SEQ ID NO: 1690470 - RNA, 15 nt, Human
uucauuaauaauaaa

SEQ ID NO: 1690471 - RNA, 22 nt, Human
uucauggaacgcguugaaauug

SEQ ID NO: 1690472 - RNA, 21 nt, Human
uucauggaacgcguugaaauu

SEQ ID NO: 1690473 - RNA, 22 nt, Human
uucauuauuuuauuaugaaacu

SEQ ID NO: 1690474 - RNA, 19 nt, Human
uucagcaaaaauauuuuau

SEQ ID NO: 1690475 - RNA, 17 nt, Human
uucagcaaaaauauuuu

SEQ ID NO: 1690476 - RNA, 13 nt, Human
uuuauuaugaaac

SEQ ID NO: 1690477 - RNA, 21 nt, Human
uuuauuaugaaacuuguguaa

SEQ ID NO: 1690478 - RNA, 23 nt, Human
uuuagcuacuauauaugugauga

SEQ ID NO: 1690479 - RNA, 17 nt, Human
uuuacuaaaauggacug

SEQ ID NO: 1690480 - RNA, 15 nt, Human
uuuacuaaaauggac

SEQ ID NO: 1690481 - RNA, 21 nt, Human
uuucuaugcugaguuugugcu

SEQ ID NO: 1690482 - RNA, 13 nt, Human
uuucuauauuuuc

SEQ ID NO: 1690483 - RNA, 18 nt, Human
uuucuauauuuucauucu

SEQ ID NO: 1690484 - RNA, 15 nt, Human
uuucuauauuuucau

SEQ ID NO: 1690485 - RNA, 23 nt, Human
augaucuaccagccucccuauuu

SEQ ID NO: 1690486 - RNA, 17 nt, Human
uuuaaaaaaaaaauugg

SEQ ID NO: 1690487 - RNA, 18 nt, Human
uugguuaagucuguuuua

SEQ ID NO: 1690488 - RNA, 16 nt, Human
uugguuaagucuguuu

SEQ ID NO: 1690489 - RNA, 15 nt, Human
uuguaauuauaucug

SEQ ID NO: 1690490 - RNA, 17 nt, Human
auuuuccuccuuucucu

SEQ ID NO: 1690491 - RNA, 13 nt, Human
auuuuccuccuuu

SEQ ID NO: 1690492 - RNA, 21 nt, Human
auuuuauuauguaaaucccau

SEQ ID NO: 1690493 - RNA, 20 nt, Human
auuuuauuauguaaauccca

SEQ ID NO: 1690494 - RNA, 19 nt, Human
auuuuauuauguaaauccc

SEQ ID NO: 1690495 - RNA, 18 nt, Human
auuuuauuauguaaaucc

SEQ ID NO: 1690496 - RNA, 17 nt, Human
auuuuauuauguaaauc

SEQ ID NO: 1690497 - RNA, 16 nt, Human
auuuuauuauguaaau

SEQ ID NO: 1690498 - RNA, 18 nt, Human
auucuuaaaguugaauuu

SEQ ID NO: 1690499 - RNA, 23 nt, Human
auucuucagcaaaaauauuuuau

SEQ ID NO: 1690500 - RNA, 15 nt, Human
auucuucagcaaaaa

SEQ ID NO: 1690501 - RNA, 21 nt, Human
auucuguauagauuagaauuc

SEQ ID NO: 1690502 - RNA, 16 nt, Human
auucuuaaaguugaau

SEQ ID NO: 1690503 - RNA, 15 nt, Human
auucuuaaaguugaa

SEQ ID NO: 1690504 - RNA, 14 nt, Human
auucuuaaaguuga

SEQ ID NO: 1690505 - RNA, 13 nt, Human
auucuuaaaguug

SEQ ID NO: 1690506 - RNA, 23 nt, Human
auugguguuguacucaauuuuaa

SEQ ID NO: 1690507 - RNA, 22 nt, Human
auugguguuguacucaauuuua

SEQ ID NO: 1690508 - RNA, 14 nt, Human
auugguguuguacu

SEQ ID NO: 1690509 - RNA, 21 nt, Human
auucuccuaucaccugucuug

SEQ ID NO: 1690510 - RNA, 19 nt, Human
auucccuggccuuucauau

SEQ ID NO: 1690511 - RNA, 13 nt, Human
auucccuggccuu

SEQ ID NO: 1690512 - RNA, 21 nt, Human
auucccuggccuuucauauuu

SEQ ID NO: 1690513 - RNA, 15 nt, Human
uuuucugauccaguu

SEQ ID NO: 1690514 - RNA, 22 nt, Human
uuuuauuaugaaacuuguguaa

SEQ ID NO: 1690515 - RNA, 21 nt, Human
uuuuauuaugaaacuugugua

SEQ ID NO: 1690516 - RNA, 12 nt, Human
uuuuauuaugaa

SEQ ID NO: 1690517 - RNA, 20 nt, Human
auguuaaaccaugggauaaa

SEQ ID NO: 1690518 - RNA, 13 nt, Human
auguuaaaccaug

SEQ ID NO: 1690519 - RNA, 12 nt, Human
auguuaaaccau

SEQ ID NO: 1690520 - RNA, 15 nt, Human
auuaauaauaaauuc

SEQ ID NO: 1690521 - RNA, 12 nt, Human
auuagaauucug

SEQ ID NO: 1690522 - RNA, 14 nt, Human
auuagaauucugua

SEQ ID NO: 1690523 - RNA, 13 nt, Human
auuagaauucugu

SEQ ID NO: 1690524 - RNA, 18 nt, Human
auuagaauucuguauaga

SEQ ID NO: 1690525 - RNA, 17 nt, Human
auuagaauucuguauag

SEQ ID NO: 1690526 - RNA, 16 nt, Human
auuagaauucuguaua

SEQ ID NO: 1690527 - RNA, 15 nt, Human
auuagaauucuguau

SEQ ID NO: 1690528 - RNA, 21 nt, Human
auuagaauucuguauagauua

SEQ ID NO: 1690529 - RNA, 11 nt, Human
auuaaagccau

SEQ ID NO: 1690530 - RNA, 21 nt, Human
auuaagcauauauuuuuauau

SEQ ID NO: 1690531 - RNA, 15 nt, Human
auuaagcauauauuu

SEQ ID NO: 1690532 - RNA, 14 nt, Human
auuaagcauauauu

SEQ ID NO: 1690533 - RNA, 18 nt, Human
uuuuguuguuuguuuagu

SEQ ID NO: 1690534 - RNA, 12 nt, Human
uuuuguuucugu

SEQ ID NO: 1690535 - RNA, 22 nt, Human
uuuuguuuggaccaaaaaccag

SEQ ID NO: 1690536 - RNA, 12 nt, Human
uuuuguuuggac

SEQ ID NO: 1690537 - RNA, 13 nt, Human
uuuuguuucugua

SEQ ID NO: 1690538 - RNA, 23 nt, Human
uuuuguuuggaccaaaaaccagu

SEQ ID NO: 1690539 - RNA, 18 nt, Human
caaaaaccaguauuguac

SEQ ID NO: 1690540 - RNA, 20 nt, Human
caaaaaccaguauuguacaa

SEQ ID NO: 1690541 - RNA, 19 nt, Human
caaaaaccaguauuguaca

SEQ ID NO: 1690542 - RNA, 23 nt, Human
caaaaauauuuuaugauccagca

SEQ ID NO: 1690543 - RNA, 22 nt, Human
caaaaauauuuuaugauccagc

SEQ ID NO: 1690544 - RNA, 21 nt, Human
caaaaauauuuuaugauccag

SEQ ID NO: 1690545 - RNA, 17 nt, Human
caaaaauauuuuaugau

SEQ ID NO: 1690546 - RNA, 15 nt, Human
caaaaauauuuuaug

SEQ ID NO: 1690547 - RNA, 14 nt, Human
caaaaauauuuuau

SEQ ID NO: 1690548 - RNA, 23 nt, Human
cacugauuugacauagucuggcu

SEQ ID NO: 1690549 - RNA, 21 nt, Human
cacugauuugacauagucugg

SEQ ID NO: 1690550 - RNA, 17 nt, Human
caccugucuugccuuuu

SEQ ID NO: 1690551 - RNA, 20 nt, Human
caccugucuugccuuuuuca

SEQ ID NO: 1690552 - RNA, 23 nt, Human
cacggugaauggcuuuguauaga

SEQ ID NO: 1690553 - RNA, 20 nt, Human
cacggugaauggcuuuguau

SEQ ID NO: 1690554 - RNA, 17 nt, Human
cacucuccauuuaauaa

SEQ ID NO: 1690555 - RNA, 15 nt, Human
cacucuccauuuaau

SEQ ID NO: 1690556 - RNA, 19 nt, Human
cagauaacuguuauuuaua

SEQ ID NO: 1690557 - RNA, 16 nt, Human
cagauaacuguuauuu

SEQ ID NO: 1690558 - RNA, 14 nt, Human
cagauaacuguuau

SEQ ID NO: 1690559 - RNA, 21 nt, Human
cagauaacuguuauuuauaau

SEQ ID NO: 1690560 - RNA, 20 nt, Human
cagauaacuguuauuuauaa

SEQ ID NO: 1690561 - RNA, 14 nt, Human
cagaucugccuaag

SEQ ID NO: 1690562 - RNA, 17 nt, Human
cagaucugccuaaggac

SEQ ID NO: 1690563 - RNA, 16 nt, Human
cagaucugccuaagga

SEQ ID NO: 1690564 - RNA, 23 nt, Human
cagaucugccuaaggacuucuuu

SEQ ID NO: 1690565 - RNA, 21 nt, Human
cagaucugccuaaggacuucu

SEQ ID NO: 1690566 - RNA, 20 nt, Human
cagaucugccuaaggacuuc

SEQ ID NO: 1690567 - RNA, 19 nt, Human
cagaucugccuaaggacuu

SEQ ID NO: 1690568 - RNA, 12 nt, Human
cacuuuuuucca

SEQ ID NO: 1690569 - RNA, 14 nt, Human
cacuuuuuuccaca

SEQ ID NO: 1690570 - RNA, 22 nt, Human
cacuuuugguuaagucuguuuu

SEQ ID NO: 1690571 - RNA, 20 nt, Human
cagaaggcaaaugacuuugg

SEQ ID NO: 1690572 - RNA, 19 nt, Human
cagaaggcaaaugacuuug

SEQ ID NO: 1690573 - RNA, 18 nt, Human
cagaaggcaaaugacuuu

SEQ ID NO: 1690574 - RNA, 23 nt, Human
cagauuauucacugauuugacau

SEQ ID NO: 1690575 - RNA, 18 nt, Human
cagauuauucacugauuu

SEQ ID NO: 1690576 - RNA, 12 nt, Human
cagauuauucac

SEQ ID NO: 1690577 - RNA, 17 nt, Human
cagcaaaaauauuuuau

SEQ ID NO: 1690578 - RNA, 22 nt, Human
cagauuuuauuauguaaauccc

SEQ ID NO: 1690579 - RNA, 21 nt, Human
cagauuuuauuauguaaaucc

SEQ ID NO: 1690580 - RNA, 20 nt, Human
cagauuuuauuauguaaauc

SEQ ID NO: 1690581 - RNA, 18 nt, Human
cagauuuuauuauguaaa

SEQ ID NO: 1690582 - RNA, 16 nt, Human
cagauuuuauuaugua

SEQ ID NO: 1690583 - RNA, 15 nt, Human
cagauuuuauuaugu

SEQ ID NO: 1690584 - RNA, 13 nt, Human
cagauuuuauuau

SEQ ID NO: 1690585 - RNA, 19 nt, Human
cagcagauuauucacugau

SEQ ID NO: 1690586 - RNA, 15 nt, Human
cagcagauuauucac

SEQ ID NO: 1690587 - RNA, 14 nt, Human
cagcagauuauuca

SEQ ID NO: 1690588 - RNA, 23 nt, Human
caggaauggagccugcacgguga

SEQ ID NO: 1690589 - RNA, 17 nt, Human
caggaauggagccugca

SEQ ID NO: 1690590 - RNA, 18 nt, Human
cagcuggugcccugcuuu

SEQ ID NO: 1690591 - RNA, 23 nt, Human
cagcuggugcccugcuuucagau

SEQ ID NO: 1690592 - RNA, 21 nt, Human
cagcuggugcccugcuuucag

SEQ ID NO: 1690593 - RNA, 20 nt, Human
cagcuggugcccugcuuuca

SEQ ID NO: 1690594 - RNA, 19 nt, Human
cagcuggugcccugcuuuc

SEQ ID NO: 1690595 - RNA, 21 nt, Human
cagccucccuauuuuuuuucu

SEQ ID NO: 1690596 - RNA, 21 nt, Human
caguauaauuaacauguuaaa

SEQ ID NO: 1690597 - RNA, 17 nt, Human
caguauaauuaacaugu

SEQ ID NO: 1690598 - RNA, 15 nt, Human
caguauaauuaacau

SEQ ID NO: 1690599 - RNA, 14 nt, Human
caguauaauuaaca

SEQ ID NO: 1690600 - RNA, 22 nt, Human
caucucugcaaucuucucagaa

SEQ ID NO: 1690601 - RNA, 15 nt, Human
caucucugcaaucuu

SEQ ID NO: 1690602 - RNA, 22 nt, Human
cauauauuuuuauauuuacuaa

SEQ ID NO: 1690603 - RNA, 21 nt, Human
cauauauuuuuauauuuacua

SEQ ID NO: 1690604 - RNA, 20 nt, Human
cauauauuuuuauauuuacu

SEQ ID NO: 1690605 - RNA, 18 nt, Human
cauauauuuuuauauuua

SEQ ID NO: 1690606 - RNA, 19 nt, Human
cauagucuggcuguaccca

SEQ ID NO: 1690607 - RNA, 22 nt, Human
caucaguauugaagcauuuuau

SEQ ID NO: 1690608 - RNA, 20 nt, Human
caucaguauugaagcauuuu

SEQ ID NO: 1690609 - RNA, 16 nt, Human
caucaguauugaagca

SEQ ID NO: 1690610 - RNA, 13 nt, Human
cauguuaaaccau

SEQ ID NO: 1690611 - RNA, 23 nt, Human
cauguuuauuacaguauaauuaa

SEQ ID NO: 1690612 - RNA, 22 nt, Human
cauguuaaaccaugggauaaau

SEQ ID NO: 1690613 - RNA, 17 nt, Human
caugggauaaaugccau

SEQ ID NO: 1690614 - RNA, 16 nt, Human
caugggauaaaugcca

SEQ ID NO: 1690615 - RNA, 23 nt, Human
caugggauaaaugccaucaauaa

SEQ ID NO: 1690616 - RNA, 18 nt, Human
caugggauaaaugccauc

SEQ ID NO: 1690617 - RNA, 22 nt, Human
cauuuggaaaucuuuaaaaaaa

SEQ ID NO: 1690618 - RNA, 11 nt, Human
cauuuggaaau

SEQ ID NO: 1690619 - RNA, 18 nt, Human
cauuuggaaaucuuuaaa

SEQ ID NO: 1690620 - RNA, 17 nt, Human
cauuuggaaaucuuuaa

SEQ ID NO: 1690621 - RNA, 14 nt, Human
cauuaauaauaaau

SEQ ID NO: 1690622 - RNA, 22 nt, Human
cauuauucaaaguugccuaaau

SEQ ID NO: 1690623 - RNA, 21 nt, Human
cauuauucaaaguugccuaaa

SEQ ID NO: 1690624 - RNA, 18 nt, Human
cauuauucaaaguugccu

SEQ ID NO: 1690625 - RNA, 17 nt, Human
cauuauuuuauuaugaa

SEQ ID NO: 1690626 - RNA, 13 nt, Human
ccaugggauaaau

SEQ ID NO: 1690627 - RNA, 17 nt, Human
ccaugggauaaaugcca

SEQ ID NO: 1690628 - RNA, 22 nt, Human
ccauuauucaaaguugccuaaa

SEQ ID NO: 1690629 - RNA, 17 nt, Human
ccauuauucaaaguugc

SEQ ID NO: 1690630 - RNA, 20 nt, Human
ccauguuuauuacaguauaa

SEQ ID NO: 1690631 - RNA, 13 nt, Human
ccauguuuauuac

SEQ ID NO: 1690632 - RNA, 14 nt, Human
ccauuauucaaagu

SEQ ID NO: 1690633 - RNA, 19 nt, Human
ccugcaaugaagucucuga

SEQ ID NO: 1690634 - RNA, 21 nt, Human
ccugcaaugaagucucugaag

SEQ ID NO: 1690635 - RNA, 21 nt, Human
ccugcacggugaauggcuuug

SEQ ID NO: 1690636 - RNA, 20 nt, Human
ccugcaaugaagucucugaa

SEQ ID NO: 1690637 - RNA, 20 nt, Human
ccugcacggugaauggcuuu

SEQ ID NO: 1690638 - RNA, 12 nt, Human
ccuuaaaggaag

SEQ ID NO: 1690639 - RNA, 14 nt, Human
ccgugcuaaggacu

SEQ ID NO: 1690640 - RNA, 16 nt, Human
ccgugcuaaggacuug

SEQ ID NO: 1690641 - RNA, 15 nt, Human
ccgugcuaaggacuu

SEQ ID NO: 1690642 - RNA, 12 nt, Human
ccuaaauccauu

SEQ ID NO: 1690643 - RNA, 18 nt, Human
ccuaaauccauuuggaaa

SEQ ID NO: 1690644 - RNA, 17 nt, Human
ccuaaauccauuuggaa

SEQ ID NO: 1690645 - RNA, 14 nt, Human
cccugcuuucagau

SEQ ID NO: 1690646 - RNA, 17 nt, Human
cccugcuuucagauacu

SEQ ID NO: 1690647 - RNA, 23 nt, Human
cugucuugccuuuuucauuauuu

SEQ ID NO: 1690648 - RNA, 21 nt, Human
cugucuugccuuuuucauuau

SEQ ID NO: 1690649 - RNA, 12 nt, Human
cuguggugacuu

SEQ ID NO: 1690650 - RNA, 14 nt, Human
cuguggugacuuug

SEQ ID NO: 1690651 - RNA, 13 nt, Human
cuguggugacuuu

SEQ ID NO: 1690652 - RNA, 23 nt, Human
cuguggugacuuuggauaauaag

SEQ ID NO: 1690653 - RNA, 20 nt, Human
cuguggugacuuuggauaau

SEQ ID NO: 1690654 - RNA, 18 nt, Human
cuguggugacuuuggaua

SEQ ID NO: 1690655 - RNA, 17 nt, Human
cuguggugacuuuggau

SEQ ID NO: 1690656 - RNA, 15 nt, Human
cuguggugacuuugg

SEQ ID NO: 1690657 - RNA, 18 nt, Human
cugggcugaacacuccaa

SEQ ID NO: 1690658 - RNA, 14 nt, Human
cugggguuaucuga

SEQ ID NO: 1690659 - RNA, 17 nt, Human
cuggugugaacuaaacu

SEQ ID NO: 1690660 - RNA, 16 nt, Human
cuggugugaacuaaac

SEQ ID NO: 1690661 - RNA, 15 nt, Human
cugguguauguguga

SEQ ID NO: 1690662 - RNA, 22 nt, Human
cuucucagaaggcaaaugacuu

SEQ ID NO: 1690663 - RNA, 16 nt, Human
cuucucagaaggcaaa

SEQ ID NO: 1690664 - RNA, 17 nt, Human
cuucagcaaaaauauuu

SEQ ID NO: 1690665 - RNA, 23 nt, Human
cuucagcaaaaauauuuuaugau

SEQ ID NO: 1690666 - RNA, 20 nt, Human
cuucagcaaaaauauuuuau

SEQ ID NO: 1690667 - RNA, 17 nt, Human
cuucauuaauaauaaau

SEQ ID NO: 1690668 - RNA, 16 nt, Human
cuucauuaauaauaaa

SEQ ID NO: 1690669 - RNA, 17 nt, Human
cuuuaaaaaaaaaauug

SEQ ID NO: 1690670 - RNA, 14 nt, Human
cuuucauauuuuag

SEQ ID NO: 1690671 - RNA, 22 nt, Human
cuuuugauaaucaacugggcug

SEQ ID NO: 1690672 - RNA, 14 nt, Human
cuuuucugauagag

SEQ ID NO: 1690673 - RNA, 11 nt, Human
cuuuucugaua

SEQ ID NO: 1690674 - RNA, 14 nt, Human
gaaggcaaaugacu

SEQ ID NO: 1690675 - RNA, 20 nt, Human
gaagguucuggugugaacua

SEQ ID NO: 1690676 - RNA, 16 nt, Human
gaagguucugguguga

SEQ ID NO: 1690677 - RNA, 16 nt, Human
gaaggcaaaugacuuu

SEQ ID NO: 1690678 - RNA, 15 nt, Human
gaaggcaaaugacuu

SEQ ID NO: 1690679 - RNA, 16 nt, Human
gaacgcguugaaauug

SEQ ID NO: 1690680 - RNA, 19 nt, Human
gaaauacuguuugagguuu

SEQ ID NO: 1690681 - RNA, 15 nt, Human
gaaauacuguuugag

SEQ ID NO: 1690682 - RNA, 17 nt, Human
gaaauuguaauuauauc

SEQ ID NO: 1690683 - RNA, 21 nt, Human
cugauuugacauagucuggcu

SEQ ID NO: 1690684 - RNA, 23 nt, Human
cugauuugacauagucuggcugu

SEQ ID NO: 1690685 - RNA, 22 nt, Human
cugauuugacauagucuggcug

SEQ ID NO: 1690686 - RNA, 18 nt, Human
cugaguuugugcuggugu

SEQ ID NO: 1690687 - RNA, 13 nt, Human
cugaguuugugcu

SEQ ID NO: 1690688 - RNA, 23 nt, Human
cucuuugucuacaccauuaugug

SEQ ID NO: 1690689 - RNA, 23 nt, Human
cucugaagugaaacugcuuguuu

SEQ ID NO: 1690690 - RNA, 19 nt, Human
cucugaagugaaacugcuu

SEQ ID NO: 1690691 - RNA, 20 nt, Human
cuccaauuaaggauuuuaug

SEQ ID NO: 1690692 - RNA, 17 nt, Human
cuccaauuaaggauuuu

SEQ ID NO: 1690693 - RNA, 22 nt, Human
cuccaauuaaggauuuuaugcu

SEQ ID NO: 1690694 - RNA, 15 nt, Human
cuauauuuucauucu

SEQ ID NO: 1690695 - RNA, 19 nt, Human
cuauauuuucauucuccua

SEQ ID NO: 1690696 - RNA, 13 nt, Human
cucagauuuuauu

SEQ ID NO: 1690697 - RNA, 22 nt, Human
cucagauuuuauuauguaaauc

SEQ ID NO: 1690698 - RNA, 18 nt, Human
cucagauuuuauuaugua

SEQ ID NO: 1690699 - RNA, 17 nt, Human
cucagauuuuauuaugu

SEQ ID NO: 1690700 - RNA, 15 nt, Human
cucagauuuuauuau

SEQ ID NO: 1690701 - RNA, 18 nt, Human
cuauuucuauauuuucau

SEQ ID NO: 1690702 - RNA, 16 nt, Human
cuauuucuauauuuuc

SEQ ID NO: 1690703 - RNA, 14 nt, Human
cuauuucuauauuu

SEQ ID NO: 1690704 - RNA, 22 nt, Human
gagccugcacggugaauggcuu

SEQ ID NO: 1690705 - RNA, 17 nt, Human
gagccugcacggugaau

SEQ ID NO: 1690706 - RNA, 23 nt, Human
gagccugcacggugaauggcuuu

SEQ ID NO: 1690707 - RNA, 14 nt, Human
gaggaauucuguau

SEQ ID NO: 1690708 - RNA, 17 nt, Human
gaggaauucuguauaga

SEQ ID NO: 1690709 - RNA, 16 nt, Human
gaggaauucuguauag

SEQ ID NO: 1690710 - RNA, 14 nt, Human
gauagaggaagccu

SEQ ID NO: 1690711 - RNA, 22 nt, Human
gauagaggaagccugauuaaag

SEQ ID NO: 1690712 - RNA, 21 nt, Human
gauagaggaagccugauuaaa

SEQ ID NO: 1690713 - RNA, 15 nt, Human
gauagaggaagccug

SEQ ID NO: 1690714 - RNA, 16 nt, Human
gcagauuauucacuga

SEQ ID NO: 1690715 - RNA, 13 nt, Human
gcagauuauucac

SEQ ID NO: 1690716 - RNA, 21 nt, Human
gcugguguaugugugaaguga

SEQ ID NO: 1690717 - RNA, 22 nt, Human
gcuuuaaacauugguucuugua

SEQ ID NO: 1690718 - RNA, 23 nt, Human
gcuuguuuccuagcacacacuuu

SEQ ID NO: 1690719 - RNA, 15 nt, Human
gcuuguuuccuagca

SEQ ID NO: 1690720 - RNA, 20 nt, Human
gcuuuguauagaaccucuuu

SEQ ID NO: 1690721 - RNA, 14 nt, Human
gcuuuguauagaac

SEQ ID NO: 1690722 - RNA, 13 nt, Human
gcuuuguauagaa

SEQ ID NO: 1690723 - RNA, 12 nt, Human
gcuuuguauaga

SEQ ID NO: 1690724 - RNA, 15 nt, Human
ggcuuuguauagaac

SEQ ID NO: 1690725 - RNA, 13 nt, Human
ggauucuuaaagu

SEQ ID NO: 1690726 - RNA, 14 nt, Human
ggaccaaaaaccag

SEQ ID NO: 1690727 - RNA, 14 nt, Human
ucaucaguauugaa

SEQ ID NO: 1690728 - RNA, 16 nt, Human
ucauaccuacauguau

SEQ ID NO: 1690729 - RNA, 15 nt, Human
ucauaccuacaugua

SEQ ID NO: 1690730 - RNA, 23 nt, Human
ucauuauuuuauuaugaaacuug

SEQ ID NO: 1690731 - RNA, 13 nt, Human
uauuaagaaugaa

SEQ ID NO: 1690732 - RNA, 16 nt, Human
uauuaagaaugaaaua

SEQ ID NO: 1690733 - RNA, 12 nt, Human
uauguaaauccc

SEQ ID NO: 1690734 - RNA, 23 nt, Human
uauguaaaucccauuauucaaag

SEQ ID NO: 1690735 - RNA, 21 nt, Human
uauguaaaucccauuauucaa

SEQ ID NO: 1690736 - RNA, 20 nt, Human
uauguaaaucccauuauuca

SEQ ID NO: 1690737 - RNA, 19 nt, Human
uauguaaaucccauuauuc

SEQ ID NO: 1690738 - RNA, 15 nt, Human
uauguaaaucccauu

SEQ ID NO: 1690739 - RNA, 14 nt, Human
uauuacaguauaau

SEQ ID NO: 1690740 - RNA, 13 nt, Human
uauuacaguauaa

SEQ ID NO: 1690741 - RNA, 12 nt, Human
uauuacaguaua

SEQ ID NO: 1690742 - RNA, 23 nt, Human
ucacaccccagacgaugucuuca

SEQ ID NO: 1690743 - RNA, 15 nt, Human
uauuuucauucuccu

SEQ ID NO: 1690744 - RNA, 17 nt, Human
uauuuauaaucacuuuu

SEQ ID NO: 1690745 - RNA, 13 nt, Human
uauuuuauuauga

SEQ ID NO: 1690746 - RNA, 23 nt, Human
uauuuuauuaugaaacuugugua

SEQ ID NO: 1690747 - RNA, 18 nt, Human
uauuuuauuaugaaacuu

SEQ ID NO: 1690748 - RNA, 14 nt, Human
uauuuuuuuucugu

SEQ ID NO: 1690749 - RNA, 21 nt, Human
ucuucauaccuacauguauuu

SEQ ID NO: 1690750 - RNA, 18 nt, Human
ucuucauaccuacaugua

SEQ ID NO: 1690751 - RNA, 23 nt, Human
ucuucagcaaaaauauuuuauga

SEQ ID NO: 1690752 - RNA, 22 nt, Human
ucuucagcaaaaauauuuuaug

SEQ ID NO: 1690753 - RNA, 21 nt, Human
ucuucagcaaaaauauuuuau

SEQ ID NO: 1690754 - RNA, 12 nt, Human
ucuuaaaguuga

SEQ ID NO: 1690755 - RNA, 14 nt, Human
ucuuaaaguugaau

SEQ ID NO: 1690756 - RNA, 13 nt, Human
ucuuaaaguugaa

SEQ ID NO: 1690757 - RNA, 19 nt, Human
ucuuaaauaauaaagauca

SEQ ID NO: 1690758 - RNA, 15 nt, Human
ucuuaaauaauaaag

SEQ ID NO: 1690759 - RNA, 22 nt, Human
ucuuaaaguugaauuuauuggc

SEQ ID NO: 1690760 - RNA, 21 nt, Human
ucuuaaaguugaauuuauugg

SEQ ID NO: 1690761 - RNA, 20 nt, Human
ucuuaaaguugaauuuauug

SEQ ID NO: 1690762 - RNA, 19 nt, Human
ucuuaaaguugaauuuauu

SEQ ID NO: 1690763 - RNA, 16 nt, Human
ucuuaaaguugaauuu

SEQ ID NO: 1690764 - RNA, 14 nt, Human
ucugaggaauucug

SEQ ID NO: 1690765 - RNA, 19 nt, Human
ucugaggaauucuguauag

SEQ ID NO: 1690766 - RNA, 18 nt, Human
ucugaggaauucuguaua

SEQ ID NO: 1690767 - RNA, 17 nt, Human
ucugaggaauucuguau

SEQ ID NO: 1690768 - RNA, 16 nt, Human
ucugaggaauucugua

SEQ ID NO: 1690769 - RNA, 15 nt, Human
ucugaggaauucugu

SEQ ID NO: 1690770 - RNA, 15 nt, Human
ucugacaucucugca

SEQ ID NO: 1690771 - RNA, 14 nt, Human
ucugacaucucugc

SEQ ID NO: 1690772 - RNA, 12 nt, Human
ucugacaucucu

SEQ ID NO: 1690773 - RNA, 16 nt, Human
ucucugaagugaaacu

SEQ ID NO: 1690774 - RNA, 16 nt, Human
ucuaugcugaguuugu

SEQ ID NO: 1690775 - RNA, 20 nt, Human
ucuaugcugaguuugugcug

SEQ ID NO: 1690776 - RNA, 11 nt, Human
ucccuggccuu

SEQ ID NO: 1690777 - RNA, 15 nt, Human
ucccuggccuuucau

SEQ ID NO: 1690778 - RNA, 21 nt, Human
uguacaaaguauuaagcauau

SEQ ID NO: 1690779 - RNA, 15 nt, Human
uguacaaaguauuaa

SEQ ID NO: 1690780 - RNA, 20 nt, Human
uguacaaaguauuaagcaua

SEQ ID NO: 1690781 - RNA, 19 nt, Human
uguacaaaguauuaagcau

SEQ ID NO: 1690782 - RNA, 18 nt, Human
uguacaaaguauuaagca

SEQ ID NO: 1690783 - RNA, 17 nt, Human
uguacaaaguauuaagc

SEQ ID NO: 1690784 - RNA, 18 nt, Human
ugguugcuuuaauaucau

SEQ ID NO: 1690785 - RNA, 14 nt, Human
ugguugcuuuaaua

SEQ ID NO: 1690786 - RNA, 15 nt, Human
uggugacuuuggaua

SEQ ID NO: 1690787 - RNA, 23 nt, Human
uggugacuuuggauaauaaggaa

SEQ ID NO: 1690788 - RNA, 19 nt, Human
uggugacuuuggauaauaa

SEQ ID NO: 1690789 - RNA, 18 nt, Human
uggugacuuuggauaaua

SEQ ID NO: 1690790 - RNA, 16 nt, Human
uggugacuuuggauaa

SEQ ID NO: 1690791 - RNA, 18 nt, Human
ugguucuuguauuaagaa

SEQ ID NO: 1690792 - RNA, 14 nt, Human
ugguucuuguauua

SEQ ID NO: 1690793 - RNA, 19 nt, Human
ugguucuuguauuaagaau

SEQ ID NO: 1690794 - RNA, 23 nt, Human
uguauagauuagagaguguugaa

SEQ ID NO: 1690795 - RNA, 21 nt, Human
uguauagauuagaauucugua

SEQ ID NO: 1690796 - RNA, 15 nt, Human
uguauagauuagaau

SEQ ID NO: 1690797 - RNA, 23 nt, Human
uguauagaaccucuuugucuaca

SEQ ID NO: 1690798 - RNA, 15 nt, Human
uguauuuguuugcau

SEQ ID NO: 1690799 - RNA, 22 nt, Human
ugucucagauuuuauuauguaa

SEQ ID NO: 1690800 - RNA, 20 nt, Human
ugucucagauuuuauuaugu

SEQ ID NO: 1690801 - RNA, 16 nt, Human
ugucucagauuuuauu

SEQ ID NO: 1690802 - RNA, 18 nt, Human
ugucuacaccauuaugug

SEQ ID NO: 1690803 - RNA, 17 nt, Human
ugucuacaccauuaugu

SEQ ID NO: 1690804 - RNA, 17 nt, Human
uggaacgcguugaaauu

SEQ ID NO: 1690805 - RNA, 16 nt, Human
uggaacgcguugaaau

SEQ ID NO: 1690806 - RNA, 15 nt, Human
uggaacgcguugaaa

SEQ ID NO: 1690807 - RNA, 14 nt, Human
uggaacgcguugaa

SEQ ID NO: 1690808 - RNA, 15 nt, Human
uggaccaaaaaccag

SEQ ID NO: 1690809 - RNA, 13 nt, Human
uggcuuuucugau

SEQ ID NO: 1690810 - RNA, 12 nt, Human
ugggauaaaugc

SEQ ID NO: 1690811 - RNA, 14 nt, Human
ugggauaaaugcca

SEQ ID NO: 1690812 - RNA, 13 nt, Human
ugggauaaaugcc

SEQ ID NO: 1690813 - RNA, 23 nt, Human
ugggguuaucugaagucagaucu

SEQ ID NO: 1690814 - RNA, 21 nt, Human
ugaugccaaguuguuugagaa

SEQ ID NO: 1690815 - RNA, 15 nt, Human
ugaugccaaguuguu

SEQ ID NO: 1690816 - RNA, 19 nt, Human
ugaugccaaguuguuugag

SEQ ID NO: 1690817 - RNA, 17 nt, Human
ugacugauucuucagca

SEQ ID NO: 1690818 - RNA, 16 nt, Human
ugacugauucuucagc

SEQ ID NO: 1690819 - RNA, 15 nt, Human
ugacugauucuucag

SEQ ID NO: 1690820 - RNA, 14 nt, Human
ugacugauucuuca

SEQ ID NO: 1690821 - RNA, 13 nt, Human
ugacugauucuuc

SEQ ID NO: 1690822 - RNA, 13 nt, Human
ugagaaauuaagu

SEQ ID NO: 1690823 - RNA, 14 nt, Human
ugagaaauuaagua

SEQ ID NO: 1690824 - RNA, 17 nt, Human
ugagcaucacaguuuug

SEQ ID NO: 1690825 - RNA, 22 nt, Human
ugcaaugaagucucugaaguga

SEQ ID NO: 1690826 - RNA, 18 nt, Human
ugcaaugaagucucugaa

SEQ ID NO: 1690827 - RNA, 15 nt, Human
ugcaaugaagucucu

SEQ ID NO: 1690828 - RNA, 17 nt, Human
ugcccugcuuucagaua

SEQ ID NO: 1690829 - RNA, 16 nt, Human
ugcccugcuuucagau

SEQ ID NO: 1690830 - RNA, 12 nt, Human
ugcccugcuuuc

SEQ ID NO: 1690831 - RNA, 21 nt, Human
ugccuaaggacuucuuuaauu

SEQ ID NO: 1690832 - RNA, 13 nt, Human
ugccuaaggacuu

SEQ ID NO: 1690833 - RNA, 12 nt, Human
ugccuaaggacu

SEQ ID NO: 1690834 - RNA, 20 nt, Human
ugccuaaggacuucuuuaau

SEQ ID NO: 1690835 - RNA, 16 nt, Human
ugccuaaggacuucuu

SEQ ID NO: 1690836 - RNA, 15 nt, Human
ugccuaaggacuucu

SEQ ID NO: 1690837 - RNA, 14 nt, Human
ugccuaaggacuuc

SEQ ID NO: 1690838 - RNA, 13 nt, Human
uuuuauauuuacu

SEQ ID NO: 1690839 - RNA, 21 nt, Human
uuuuaugacuucauuaauaau

SEQ ID NO: 1690840 - RNA, 20 nt, Human
uuuuaugacuucauuaauaa

SEQ ID NO: 1690841 - RNA, 20 nt, Human
uuuccacauaaggaaacugg

SEQ ID NO: 1690842 - RNA, 23 nt, Human
uuuccacauaaggaaacuggguu

SEQ ID NO: 1690843 - RNA, 22 nt, Human
uuuggaccaaaaaccaguauug

SEQ ID NO: 1690844 - RNA, 21 nt, Human
uuuggaccaaaaaccaguauu

SEQ ID NO: 1690845 - RNA, 18 nt, Human
uuuggaccaaaaaccagu

SEQ ID NO: 1690846 - RNA, 15 nt, Human
uuuggaaaucuuuaa

SEQ ID NO: 1690847 - RNA, 24 nt, Human
uuuggaccaaaaaccaguauugua

SEQ ID NO: 1690848 - RNA, 21 nt, Human
uuuuuccacauaaggaaacug

SEQ ID NO: 1690849 - RNA, 22 nt, Human
uuuuucauuauuuuauuaugaa

SEQ ID NO: 1690850 - RNA, 13 nt, Human
uuuuucauuauuu

SEQ ID NO: 1690851 - RNA, 23 nt, Human
uugugcgcuaaacuuuucugaua

SEQ ID NO: 1690852 - RNA, 22 nt, Human
uugugcgcuaaacuuuucugau

SEQ ID NO: 1690853 - RNA, 19 nt, Human
uugugcugggguuaucuga

SEQ ID NO: 1690854 - RNA, 21 nt, Human
uuguuugagaaauuaaguauc

SEQ ID NO: 1690855 - RNA, 15 nt, Human
uuguuugagaaauua

SEQ ID NO: 1690856 - RNA, 17 nt, Human
uuguuguuuguuuaguc

SEQ ID NO: 1690857 - RNA, 17 nt, Human
uuguuagaucuaguuca

SEQ ID NO: 1690858 - RNA, 14 nt, Human
uuguacucaauuuu

SEQ ID NO: 1690859 - RNA, 15 nt, Human
uuguacucaauuuua

SEQ ID NO: 1690860 - RNA, 18 nt, Human
uuguauuaagaaugaaau

SEQ ID NO: 1690861 - RNA, 13 nt, Human
uuguauuaagaau

SEQ ID NO: 1690862 - RNA, 12 nt, Human
uuguauuaagaa

SEQ ID NO: 1690863 - RNA, 19 nt, Human
uugucuacaccauuaugug

SEQ ID NO: 1690864 - RNA, 20 nt, Human
uugucuacaccauuaugugc

SEQ ID NO: 1690865 - RNA, 13 nt, Human
uugucucagauuu

SEQ ID NO: 1690866 - RNA, 20 nt, Human
uugucucagauuuuauuaug

SEQ ID NO: 1690867 - RNA, 16 nt, Human
uugucucagauuuuau

SEQ ID NO: 1690868 - RNA, 22 nt, Human
uugucucagauuuuauuaugua

SEQ ID NO: 1690869 - RNA, 16 nt, Human
uuggguguauugugcg

SEQ ID NO: 1690870 - RNA, 15 nt, Human
uuggguguauugugc

SEQ ID NO: 1690871 - RNA, 13 nt, Human
uuggguguauugu

SEQ ID NO: 1690872 - RNA, 21 nt, Human
uuguuuggaccaaaaaccagu

SEQ ID NO: 1690873 - RNA, 16 nt, Human
uuuaacaacagcuggu

SEQ ID NO: 1690874 - RNA, 18 nt, Human
uuuaauaauuauaugcua

SEQ ID NO: 1690875 - RNA, 21 nt, Human
uuuaauaauuauaugcuauuu

SEQ ID NO: 1690876 - RNA, 14 nt, Human
uuuauuauguaaau

SEQ ID NO: 1690877 - RNA, 17 nt, Human
uuuauuauguaaauccc

SEQ ID NO: 1690878 - RNA, 16 nt, Human
uuuauuauguaaaucc

SEQ ID NO: 1690879 - RNA, 21 nt, Human
uuucagauacuggauuguacu

SEQ ID NO: 1690880 - RNA, 13 nt, Human
uuucagauacugg

SEQ ID NO: 1690881 - RNA, 21 nt, Human
uuccugcaaugaagucucuga

SEQ ID NO: 1690882 - RNA, 13 nt, Human
uuccugcaaugaa

SEQ ID NO: 1690883 - RNA, 21 nt, Human
uucugauagaggaagccugau

SEQ ID NO: 1690884 - RNA, 13 nt, Human
uucugauagagga

SEQ ID NO: 1690885 - RNA, 22 nt, Human
uugaauuuauuggcuuuucuga

SEQ ID NO: 1690886 - RNA, 18 nt, Human
uugaauuuauuggcuuuu

SEQ ID NO: 1690887 - RNA, 15 nt, Human
uugaauuuauuggcu

SEQ ID NO: 1690888 - RNA, 21 nt, Human
uugaauuuuguguuagagauu

SEQ ID NO: 1690889 - RNA, 17 nt, Human
uugaauuuuguguuaga

SEQ ID NO: 1690890 - RNA, 20 nt, Human
uuauuuuauuaugaaacuug

SEQ ID NO: 1690891 - RNA, 14 nt, Human
uuauuuuauuauga

SEQ ID NO: 1690892 - RNA, 16 nt, Human
uuauuuuauuaugaaa

SEQ ID NO: 1690893 - RNA, 15 nt, Human
uuauuuuauuaugaa

SEQ ID NO: 1690894 - RNA, 20 nt, Human
uucagauacuggauuguacu

SEQ ID NO: 1690895 - RNA, 16 nt, Human
uucagauacuggauug

SEQ ID NO: 1690896 - RNA, 16 nt, Human
uuauaugcuauuucua

SEQ ID NO: 1690897 - RNA, 18 nt, Human
uuauaugcuauuucuaua

SEQ ID NO: 1690898 - RNA, 23 nt, Human
uuauaucugaggaauucuguaua

SEQ ID NO: 1690899 - RNA, 22 nt, Human
uuauaucugaggaauucuguau

SEQ ID NO: 1690900 - RNA, 14 nt, Human
uuauaucugaggaa

SEQ ID NO: 1690901 - RNA, 21 nt, Human
uuauaucugaggaauucugua

SEQ ID NO: 1690902 - RNA, 20 nt, Human
uuauaucugaggaauucugu

SEQ ID NO: 1690903 - RNA, 13 nt, Human
uuauaaucacuuu

SEQ ID NO: 1690904 - RNA, 16 nt, Human
uuauuacaguauaauu

SEQ ID NO: 1690905 - RNA, 20 nt, Human
cacauugguguuguacucaa

SEQ ID NO: 1690906 - RNA, 22 nt, Human
caauuaaggauuuuaugcuuua

SEQ ID NO: 1690907 - RNA, 21 nt, Human
caauuaaggauuuuaugcuuu

SEQ ID NO: 1690908 - RNA, 23 nt, Human
caauuaaggauuuuaugcuuuaa

SEQ ID NO: 1690909 - RNA, 20 nt, Human
caauuaaggauuuuaugcuu

SEQ ID NO: 1690910 - RNA, 15 nt, Human
caauuaaggauuuua

SEQ ID NO: 1690911 - RNA, 13 nt, Human
caauuaaggauuu

SEQ ID NO: 1690912 - RNA, 19 nt, Human
caaaguugccuaaauccau

SEQ ID NO: 1690913 - RNA, 15 nt, Human
cacccacccuuuuuu

SEQ ID NO: 1690914 - RNA, 20 nt, Human
aaaaaccaguauuguacaaa

SEQ ID NO: 1690915 - RNA, 18 nt, Human
aaaaaauuggggauucuu

SEQ ID NO: 1690916 - RNA, 16 nt, Human
acuggugacugauucu

SEQ ID NO: 1690917 - RNA, 14 nt, Human
acuggugacugauu

SEQ ID NO: 1690918 - RNA, 18 nt, Human
acuguuugagguuuuuaa

SEQ ID NO: 1690919 - RNA, 23 nt, Human
acuguuugagguuuuuaagccuu

SEQ ID NO: 1690920 - RNA, 15 nt, Human
aauuuuguuucugua

SEQ ID NO: 1690921 - RNA, 14 nt, Human
aauuuuguuucugu

SEQ ID NO: 1690922 - RNA, 13 nt, Human
aauuuuguuucug

SEQ ID NO: 1690923 - RNA, 15 nt, Human
aaaccaugggauaaa

SEQ ID NO: 1690924 - RNA, 20 nt, Human
aaaccaugggauaaaugcca

SEQ ID NO: 1690925 - RNA, 10 nt, Human
aaauaaauaa

SEQ ID NO: 1690926 - RNA, 18 nt, Human
aaaucugugaacuugaaa

SEQ ID NO: 1690927 - RNA, 16 nt, Human
aaaucugugaacuuga

SEQ ID NO: 1690928 - RNA, 15 nt, Human
aaaucugugaacuug

SEQ ID NO: 1690929 - RNA, 18 nt, Human
aaauagcuagacugguga

SEQ ID NO: 1690930 - RNA, 17 nt, Human
aacggaugauuucuaug

SEQ ID NO: 1690931 - RNA, 16 nt, Human
aacggaugauuucuau

SEQ ID NO: 1690932 - RNA, 15 nt, Human
aacggaugauuucua

SEQ ID NO: 1690933 - RNA, 14 nt, Human
aacggaugauuucu

SEQ ID NO: 1690934 - RNA, 21 nt, Human
aacagcuggugcccugcuuuc

SEQ ID NO: 1690935 - RNA, 20 nt, Human
aacagcuggugcccugcuuu

SEQ ID NO: 1690936 - RNA, 19 nt, Human
aacagcuggugcccugcuu

SEQ ID NO: 1690937 - RNA, 21 nt, Human
aaggacuucuuuaauuuugga

SEQ ID NO: 1690938 - RNA, 20 nt, Human
aaggacuucuuuaauuuugg

SEQ ID NO: 1690939 - RNA, 15 nt, Human
aaggacuucuuuaau

SEQ ID NO: 1690940 - RNA, 14 nt, Human
aaggacuucuuuaa

SEQ ID NO: 1690941 - RNA, 12 nt, Human
aaguugccuaaa

SEQ ID NO: 1690942 - RNA, 14 nt, Human
aagucuguuuuaug

SEQ ID NO: 1690943 - RNA, 13 nt, Human
aagucuguuuuau

SEQ ID NO: 1690944 - RNA, 12 nt, Human
aagucuguuuua

SEQ ID NO: 1690945 - RNA, 13 nt, Human
aaugguuaaaaga

SEQ ID NO: 1690946 - RNA, 12 nt, Human
aauauuaaagcc

SEQ ID NO: 1690947 - RNA, 19 nt, Human
aaguugccuaaauccauuu

SEQ ID NO: 1690948 - RNA, 18 nt, Human
aaguugccuaaauccauu

SEQ ID NO: 1690949 - RNA, 17 nt, Human
aaguugccuaaauccau

SEQ ID NO: 1690950 - RNA, 16 nt, Human
aaguugccuaaaucca

SEQ ID NO: 1690951 - RNA, 15 nt, Human
aaguugccuaaaucc

SEQ ID NO: 1690952 - RNA, 13 nt, Human
aaugaaauacugu

SEQ ID NO: 1690953 - RNA, 16 nt, Human
aaugaagucucugaag

SEQ ID NO: 1690954 - RNA, 14 nt, Human
aaugaagucucuga

SEQ ID NO: 1690955 - RNA, 23 nt, Human
aaugaagucucugaagugaaacu

SEQ ID NO: 1690956 - RNA, 13 nt, Human
agaguguugaaac

SEQ ID NO: 1690957 - RNA, 14 nt, Human
auguauuuguuugc

SEQ ID NO: 1690958 - RNA, 21 nt, Human
augguccgugcuaaggacuug

SEQ ID NO: 1690959 - RNA, 20 nt, Human
augguccgugcuaaggacuu

SEQ ID NO: 1690960 - RNA, 19 nt, Human
augguccgugcuaaggacu

SEQ ID NO: 1690961 - RNA, 22 nt, Human
augucuucauaccuacauguau

SEQ ID NO: 1690962 - RNA, 21 nt, Human
augucuucauaccuacaugua

SEQ ID NO: 1690963 - RNA, 13 nt, Human
augugugaaguga

SEQ ID NO: 1690964 - RNA, 20 nt, Human
auauuuacuaaaauggacug

SEQ ID NO: 1690965 - RNA, 18 nt, Human
auauuuacuaaaauggac

SEQ ID NO: 1690966 - RNA, 23 nt, Human
auaugcuauuucuauauuuucau

SEQ ID NO: 1690967 - RNA, 22 nt, Human
auaugcuauuucuauauuuuca

SEQ ID NO: 1690968 - RNA, 15 nt, Human
auaugcuauuucuau

SEQ ID NO: 1690969 - RNA, 21 nt, Human
auaugcuauuucuauauuuuc

SEQ ID NO: 1690970 - RNA, 19 nt, Human
auaugcuauuucuauauuu

SEQ ID NO: 1690971 - RNA, 18 nt, Human
auaugcuauuucuauauu

SEQ ID NO: 1690972 - RNA, 16 nt, Human
auaugcuauuucuaua

SEQ ID NO: 1690973 - RNA, 22 nt, Human
auaucaucaguauugaagcauu

SEQ ID NO: 1690974 - RNA, 17 nt, Human
auaauuaacauguuaaa

SEQ ID NO: 1690975 - RNA, 15 nt, Human
auaauuaacauguua

SEQ ID NO: 1690976 - RNA, 15 nt, Human
auaaggaaaaguuua

SEQ ID NO: 1690977 - RNA, 16 nt, Human
auaaggaaaaguuuaa

SEQ ID NO: 1690978 - RNA, 21 nt, Human
auaccuacauguauuuguuug

SEQ ID NO: 1690979 - RNA, 15 nt, Human
auaacauaaaucugu

SEQ ID NO: 1690980 - RNA, 14 nt, Human
auaacauaaaucug

SEQ ID NO: 1690981 - RNA, 19 nt, Human
auaacauaaaucugugaac

SEQ ID NO: 1690982 - RNA, 18 nt, Human
auaacauaaaucugugaa

SEQ ID NO: 1690983 - RNA, 17 nt, Human
auaacauaaaucuguga

SEQ ID NO: 1690984 - RNA, 23 nt, Human
gucuucauaccuacauguauuug

SEQ ID NO: 1690985 - RNA, 14 nt, Human
aacauaaaucugug

SEQ ID NO: 1690986 - RNA, 12 nt, Human
aacauaaaucug

SEQ ID NO: 1690987 - RNA, 15 nt, Human
aacauaaaucuguga

SEQ ID NO: 1690988 - RNA, 23 nt, Human
aacauguuaaaccaugggauaaa

SEQ ID NO: 1690989 - RNA, 23 nt, Human
guguugaaacggaugauuucuau

SEQ ID NO: 1690990 - RNA, 21 nt, Human
guguugaaacggaugauuucu

SEQ ID NO: 1690991 - RNA, 20 nt, Human
aacuuguguaaauacaauuu

SEQ ID NO: 1690992 - RNA, 15 nt, Human
aacuuguguaaauac

SEQ ID NO: 1690993 - RNA, 14 nt, Human
aacuuguguaaaua

SEQ ID NO: 1690994 - RNA, 22 nt, Human
gugcugggguuaucugaaguca

SEQ ID NO: 1690995 - RNA, 19 nt, Human
gugcugguguaugugugaa

SEQ ID NO: 1690996 - RNA, 14 nt, Human
aauaaaaaauuaug

SEQ ID NO: 1690997 - RNA, 16 nt, Human
aauaaaaaauuaugac

SEQ ID NO: 1690998 - RNA, 15 nt, Human
aauaaaaaauuauga

SEQ ID NO: 1690999 - RNA, 21 nt, Human
aauaaauagcuagacugguga

SEQ ID NO: 1691000 - RNA, 15 nt, Human
aauaaggaaaaguuu

SEQ ID NO: 1691001 - RNA, 13 nt, Human
aauaaggaaaagu

SEQ ID NO: 1691002 - RNA, 22 nt, Human
aauaaggaaaaguuuaauauua

SEQ ID NO: 1691003 - RNA, 19 nt, Human
aauaaggaaaaguuuaaua

SEQ ID NO: 1691004 - RNA, 16 nt, Human
aauaaggaaaaguuua

SEQ ID NO: 1691005 - RNA, 23 nt, Human
aauaauuauaugcuauuucuaua

SEQ ID NO: 1691006 - RNA, 22 nt, Human
aauaauuauaugcuauuucuau

SEQ ID NO: 1691007 - RNA, 21 nt, Human
aauaauuauaugcuauuucua

SEQ ID NO: 1691008 - RNA, 20 nt, Human
aauaauuauaugcuauuucu

SEQ ID NO: 1691009 - RNA, 15 nt, Human
aauaauuauaugcua

SEQ ID NO: 1691010 - RNA, 14 nt, Human
aauaauuauaugcu

SEQ ID NO: 1691011 - RNA, 23 nt, Human
uaaaucccauuauucaaaguugc

SEQ ID NO: 1691012 - RNA, 19 nt, Human
uaaaucgcuuuugauaauc

SEQ ID NO: 1691013 - RNA, 18 nt, Human
uaaaucgcuuuugauaau

SEQ ID NO: 1691014 - RNA, 23 nt, Human
uaaauagcuagacuggugacuga

SEQ ID NO: 1691015 - RNA, 19 nt, Human
uaaauagcuagacugguga

SEQ ID NO: 1691016 - RNA, 23 nt, Human
uaaauacaauuuuguuucuguac

SEQ ID NO: 1691017 - RNA, 22 nt, Human
uaaauacaauuuuguuucugua

SEQ ID NO: 1691018 - RNA, 15 nt, Human
uaaauacaauuuugu

SEQ ID NO: 1691019 - RNA, 13 nt, Human
uaaauacaauuuu

SEQ ID NO: 1691020 - RNA, 23 nt, Human
aauacaauuuuguuucuguacuu

SEQ ID NO: 1691021 - RNA, 22 nt, Human
aauacaauuuuguuucuguacu

SEQ ID NO: 1691022 - RNA, 13 nt, Human
aauacaauuuugu

SEQ ID NO: 1691023 - RNA, 12 nt, Human
aauacaauuuug

SEQ ID NO: 1691024 - RNA, 20 nt, Human
aauacaauuuuguuucugua

SEQ ID NO: 1691025 - RNA, 18 nt, Human
aauacaauuuuguuucug

SEQ ID NO: 1691026 - RNA, 17 nt, Human
aauacaauuuuguuucu

SEQ ID NO: 1691027 - RNA, 15 nt, Human
aauacaauuuuguuu

SEQ ID NO: 1691028 - RNA, 16 nt, Human
uaacaacagcuggugc

SEQ ID NO: 1691029 - RNA, 22 nt, Human
uaaaccaugggauaaaugccau

SEQ ID NO: 1691030 - RNA, 21 nt, Human
uaaaccaugggauaaaugcca

SEQ ID NO: 1691031 - RNA, 20 nt, Human
uaaaccaugggauaaaugcc

SEQ ID NO: 1691032 - RNA, 18 nt, Human
uaaaccaugggauaaaug

SEQ ID NO: 1691033 - RNA, 21 nt, Human
aaguuuaauauuaaagccaug

SEQ ID NO: 1691034 - RNA, 20 nt, Human
aaguuuaauauuaaagccau

SEQ ID NO: 1691035 - RNA, 19 nt, Human
aaguuuaauauuaaagcca

SEQ ID NO: 1691036 - RNA, 23 nt, Human
aaggcugaugccaaguuguuuga

SEQ ID NO: 1691037 - RNA, 10 nt, Human
guuucuguac

SEQ ID NO: 1691038 - RNA, 14 nt, Human
guuugcauagguga

SEQ ID NO: 1691039 - RNA, 15 nt, Human
guuucuguacuuuuu

SEQ ID NO: 1691040 - RNA, 14 nt, Human
aaguauuaagcaua

SEQ ID NO: 1691041 - RNA, 13 nt, Human
aaguauuaagcau

SEQ ID NO: 1691042 - RNA, 16 nt, Human
aaggaagguucuggug

SEQ ID NO: 1691043 - RNA, 22 nt, Human
aauuaaggauuuuaugcuuuaa

SEQ ID NO: 1691044 - RNA, 20 nt, Human
aauuaaggauuuuaugcuuu

SEQ ID NO: 1691045 - RNA, 16 nt, Human
aauuaaggauuuuaug

SEQ ID NO: 1691046 - RNA, 18 nt, Human
aauuaacauguuaaacca

SEQ ID NO: 1691047 - RNA, 14 nt, Human
aauuaacauguuaa

SEQ ID NO: 1691048 - RNA, 13 nt, Human
aauuaacauguua

SEQ ID NO: 1691049 - RNA, 17 nt, Human
uaauuauaucugaggaa

SEQ ID NO: 1691050 - RNA, 13 nt, Human
uaauuauaucuga

SEQ ID NO: 1691051 - RNA, 21 nt, Human
uaauuauaugcuauuucuaua

SEQ ID NO: 1691052 - RNA, 14 nt, Human
uagaaccucuuugu

SEQ ID NO: 1691053 - RNA, 21 nt, Human
uagaggaagccugauuaaaga

SEQ ID NO: 1691054 - RNA, 14 nt, Human
uacucaauuuuaac

SEQ ID NO: 1691055 - RNA, 13 nt, Human
uacucaauuuuaa

SEQ ID NO: 1691056 - RNA, 12 nt, Human
uacucaauuuua

SEQ ID NO: 1691057 - RNA, 18 nt, Human
aauuugaauuuuguguua

SEQ ID NO: 1691058 - RNA, 16 nt, Human
aauuugaauuuugugu

SEQ ID NO: 1691059 - RNA, 13 nt, Human
aauuugaauuuug

SEQ ID NO: 1691060 - RNA, 22 nt, Human
uauucacugauuugacauaguc

SEQ ID NO: 1691061 - RNA, 19 nt, Human
uauucacugauuugacaua

SEQ ID NO: 1691062 - RNA, 13 nt, Human
uauucacugauuu

SEQ ID NO: 1691063 - RNA, 23 nt, Human
uauucaaaguugccuaaauccau

SEQ ID NO: 1691064 - RNA, 22 nt, Human
uauucaaaguugccuaaaucca

SEQ ID NO: 1691065 - RNA, 21 nt, Human
uauucaaaguugccuaaaucc

SEQ ID NO: 1691066 - RNA, 18 nt, Human
uauucaaaguugccuaaa

SEQ ID NO: 1691067 - RNA, 12 nt, Human
uauuaaagccau

SEQ ID NO: 1691068 - RNA, 14 nt, Human
uauuaaagccaugu

SEQ ID NO: 1691069 - RNA, 13 nt, Human
uauuaaagccaug

SEQ ID NO: 1691070 - RNA, 21 nt, Human
uauuacaguauaauuaacaug

SEQ ID NO: 1691071 - RNA, 20 nt, Human
uauuacaguauaauuaacau

SEQ ID NO: 1691072 - RNA, 18 nt, Human
uauuacaguauaauuaac

SEQ ID NO: 1691073 - RNA, 16 nt, Human
uauuacaguauaauua

SEQ ID NO: 1691074 - RNA, 20 nt, Human
uauuaaagccauguuuauua

SEQ ID NO: 1691075 - RNA, 18 nt, Human
uauuaaagccauguuuau

SEQ ID NO: 1691076 - RNA, 17 nt, Human
uauuaaagccauguuua

SEQ ID NO: 1691077 - RNA, 20 nt, Human
acagcuggugcccugcuuuc

SEQ ID NO: 1691078 - RNA, 17 nt, Human
acagcuggugcccugcu

SEQ ID NO: 1691079 - RNA, 23 nt, Human
acaguauaauuaacauguuaaac

SEQ ID NO: 1691080 - RNA, 21 nt, Human
acaguauaauuaacauguuaa

SEQ ID NO: 1691081 - RNA, 18 nt, Human
uauuuacuaaaauggacu

SEQ ID NO: 1691082 - RNA, 23 nt, Human
uauuguacaaaguauuaagcaua

SEQ ID NO: 1691083 - RNA, 22 nt, Human
uauuguacaaaguauuaagcau

SEQ ID NO: 1691084 - RNA, 21 nt, Human
uauuguacaaaguauuaagca

SEQ ID NO: 1691085 - RNA, 16 nt, Human
uauuguacaaaguauu

SEQ ID NO: 1691086 - RNA, 15 nt, Human
uauuguacaaaguau

SEQ ID NO: 1691087 - RNA, 19 nt, Human
uauugaagcauuuuauaaa

SEQ ID NO: 1691088 - RNA, 17 nt, Human
uauugaagcauuuuaua

SEQ ID NO: 1691089 - RNA, 16 nt, Human
uauugaagcauuuuau

SEQ ID NO: 1691090 - RNA, 15 nt, Human
uauugaagcauuuua

SEQ ID NO: 1691091 - RNA, 13 nt, Human
uauugaagcauuu

SEQ ID NO: 1691092 - RNA, 12 nt, Human
uauugaagcauu

SEQ ID NO: 1691093 - RNA, 22 nt, Human
uauuggcuuuucugauccaguu

SEQ ID NO: 1691094 - RNA, 21 nt, Human
uauuggcuuuucugauccagu

SEQ ID NO: 1691095 - RNA, 14 nt, Human
uauuggcuuuucug

SEQ ID NO: 1691096 - RNA, 18 nt, Human
uauuggcuuuucugaucc

SEQ ID NO: 1691097 - RNA, 17 nt, Human
uauuggcuuuucugauc

SEQ ID NO: 1691098 - RNA, 16 nt, Human
uauuggcuuuucugau

SEQ ID NO: 1691099 - RNA, 15 nt, Human
uauuggcuuuucuga

SEQ ID NO: 1691100 - RNA, 17 nt, Human
acacuccaauuaaggau

SEQ ID NO: 1691101 - RNA, 16 nt, Human
acacuccaauuaagga

SEQ ID NO: 1691102 - RNA, 15 nt, Human
acacuccaauuaagg

SEQ ID NO: 1691103 - RNA, 20 nt, Human
uauagauuagaauucuguau

SEQ ID NO: 1691104 - RNA, 22 nt, Human
uauagauuagagaguguugaaa

SEQ ID NO: 1691105 - RNA, 19 nt, Human
uauagauuagagaguguug

SEQ ID NO: 1691106 - RNA, 20 nt, Human
uaucaccugucuugccuuuu

SEQ ID NO: 1691107 - RNA, 10 nt, Human
uaugauccag

SEQ ID NO: 1691108 - RNA, 19 nt, Human
uaugauccagcagauuauu

SEQ ID NO: 1691109 - RNA, 11 nt, Human
uaugauccagc

SEQ ID NO: 1691110 - RNA, 15 nt, Human
uaugcugaguuugug

SEQ ID NO: 1691111 - RNA, 22 nt, Human
uaugauccagcagauuauucac

SEQ ID NO: 1691112 - RNA, 21 nt, Human
uaugauccagcagauuauuca

SEQ ID NO: 1691113 - RNA, 20 nt, Human
uaugauccagcagauuauuc

SEQ ID NO: 1691114 - RNA, 22 nt, Human
ucccuauuuuuuuucuguuaua

SEQ ID NO: 1691115 - RNA, 21 nt, Human
ucccuauuuuuuuucuguuau

SEQ ID NO: 1691116 - RNA, 13 nt, Human
acuauauauguga

SEQ ID NO: 1691117 - RNA, 21 nt, Human
acuccaauuaaggauuuuaug

SEQ ID NO: 1691118 - RNA, 17 nt, Human
acuccaauuaaggauuu

SEQ ID NO: 1691119 - RNA, 15 nt, Human
uccgugcuaaggacu

SEQ ID NO: 1691120 - RNA, 14 nt, Human
uccgugcuaaggac

SEQ ID NO: 1691121 - RNA, 19 nt, Human
uccuagcacacacuuuugg

SEQ ID NO: 1691122 - RNA, 18 nt, Human
uccuagcacacacuuuug

SEQ ID NO: 1691123 - RNA, 17 nt, Human
uccuagcacacacuuuu

SEQ ID NO: 1691124 - RNA, 22 nt, Human
acucuccauuuaauaauuauau

SEQ ID NO: 1691125 - RNA, 13 nt, Human
acuggauuguacu

SEQ ID NO: 1691126 - RNA, 16 nt, Human
acuggauuguacuuug

SEQ ID NO: 1691127 - RNA, 20 nt, Human
uccugcaaugaagucucuga

SEQ ID NO: 1691128 - RNA, 18 nt, Human
uccugcaaugaagucucu

SEQ ID NO: 1691129 - RNA, 15 nt, Human
uccugcaaugaaguc

SEQ ID NO: 1691130 - RNA, 21 nt, Human
uccugcaaugaagucucugaa

SEQ ID NO: 1691131 - RNA, 18 nt, Human
uccacauaaggaaacugg

SEQ ID NO: 1691132 - RNA, 21 nt, Human
ucagaucugccuaaggacuuc

SEQ ID NO: 1691133 - RNA, 13 nt, Human
ucagauuuuauua

SEQ ID NO: 1691134 - RNA, 15 nt, Human
ucagauuuuauuaug

SEQ ID NO: 1691135 - RNA, 14 nt, Human
ucagauuuuauuau

SEQ ID NO: 1691136 - RNA, 22 nt, Human
ucagauuuuauuauguaaaucc

SEQ ID NO: 1691137 - RNA, 20 nt, Human
ucagauuuuauuauguaaau

SEQ ID NO: 1691138 - RNA, 19 nt, Human
ucagauuuuauuauguaaa

SEQ ID NO: 1691139 - RNA, 16 nt, Human
ucagauuuuauuaugu

SEQ ID NO: 1691140 - RNA, 14 nt, Human
agcagauuauucac

SEQ ID NO: 1691141 - RNA, 16 nt, Human
agcagauuauucacug

SEQ ID NO: 1691142 - RNA, 15 nt, Human
agcagauuauucacu

SEQ ID NO: 1691143 - RNA, 20 nt, Human
agcagauuauucacugauuu

SEQ ID NO: 1691144 - RNA, 19 nt, Human
agcagauuauucacugauu

SEQ ID NO: 1691145 - RNA, 16 nt, Human
ugaggaauucuguaua

SEQ ID NO: 1691146 - RNA, 15 nt, Human
ugaggaauucuguau

SEQ ID NO: 1691147 - RNA, 14 nt, Human
ugaggaauucugua

SEQ ID NO: 1691148 - RNA, 19 nt, Human
ugaggaauucuguauagau

SEQ ID NO: 1691149 - RNA, 18 nt, Human
ugaggaauucuguauaga

SEQ ID NO: 1691150 - RNA, 22 nt, Human
agauuuuauuauguaaauccca

SEQ ID NO: 1691151 - RNA, 21 nt, Human
agauuuuauuauguaaauccc

SEQ ID NO: 1691152 - RNA, 23 nt, Human
agcaaaaauauuuuaugauccag

SEQ ID NO: 1691153 - RNA, 19 nt, Human
agcaaaaauauuuuaugau

SEQ ID NO: 1691154 - RNA, 18 nt, Human
agcaaaaauauuuuauga

SEQ ID NO: 1691155 - RNA, 17 nt, Human
agcaaaaauauuuuaug

SEQ ID NO: 1691156 - RNA, 15 nt, Human
agcaaaaauauuuua

SEQ ID NO: 1691157 - RNA, 22 nt, Human
ugacuucauuaauaauaaauuc

SEQ ID NO: 1691158 - RNA, 16 nt, Human
agauuauucacugauu

SEQ ID NO: 1691159 - RNA, 16 nt, Human
ugaauuuauuggcuuu

SEQ ID NO: 1691160 - RNA, 15 nt, Human
ugaauuuauuggcuu

SEQ ID NO: 1691161 - RNA, 12 nt, Human
ugaauuuauugg

SEQ ID NO: 1691162 - RNA, 17 nt, Human
ucuguauagauuagaau

SEQ ID NO: 1691163 - RNA, 16 nt, Human
ucuguauagauuagag

SEQ ID NO: 1691164 - RNA, 13 nt, Human
ucuuuaauuuugg

SEQ ID NO: 1691165 - RNA, 18 nt, Human
ucuuuaauuuuggaauuu

SEQ ID NO: 1691166 - RNA, 17 nt, Human
ucuuuaauuuuggaauu

SEQ ID NO: 1691167 - RNA, 16 nt, Human
ucuuuaauuuuggaau

SEQ ID NO: 1691168 - RNA, 15 nt, Human
ucuuuaauuuuggaa

SEQ ID NO: 1691169 - RNA, 14 nt, Human
ucuuuaauuuugga

SEQ ID NO: 1691170 - RNA, 19 nt, Human
ucuccauuuaauaauuaua

SEQ ID NO: 1691171 - RNA, 16 nt, Human
ucuccauuuaauaauu

SEQ ID NO: 1691172 - RNA, 12 nt, Human
ucuccauuuaau

SEQ ID NO: 1691173 - RNA, 23 nt, Human
acuuguguaaauacaauuuuguu

SEQ ID NO: 1691174 - RNA, 22 nt, Human
acuuguguaaauacaauuuugu

SEQ ID NO: 1691175 - RNA, 21 nt, Human
acuuguguaaauacaauuuug

SEQ ID NO: 1691176 - RNA, 13 nt, Human
acuuuuuuccaca

SEQ ID NO: 1691177 - RNA, 22 nt, Human
acuuuugguuaagucuguuuua

SEQ ID NO: 1691178 - RNA, 20 nt, Human
acuuuugguuaagucuguuu

SEQ ID NO: 1691179 - RNA, 16 nt, Human
acuuuugguuaagucu

SEQ ID NO: 1691180 - RNA, 22 nt, Human
agaaccucuuugucuacaccau

SEQ ID NO: 1691181 - RNA, 13 nt, Human
ucugccuaaggac

SEQ ID NO: 1691182 - RNA, 16 nt, Human
ucugccuaaggacuuc

SEQ ID NO: 1691183 - RNA, 15 nt, Human
ucugccuaaggacuu

SEQ ID NO: 1691184 - RNA, 14 nt, Human
ucugccuaaggacu

SEQ ID NO: 1691185 - RNA, 14 nt, Human
agccugauuaaaga

SEQ ID NO: 1691186 - RNA, 16 nt, Human
agccugcacggugaau

SEQ ID NO: 1691187 - RNA, 18 nt, Human
agccugcacggugaaugg

SEQ ID NO: 1691188 - RNA, 21 nt, Human
ugccuuuuucauuauuuuauu

SEQ ID NO: 1691189 - RNA, 17 nt, Human
ugccuuuuucauuauuu

SEQ ID NO: 1691190 - RNA, 16 nt, Human
ugccuuuuucauuauu

SEQ ID NO: 1691191 - RNA, 15 nt, Human
ugccuuuuucauuau

SEQ ID NO: 1691192 - RNA, 14 nt, Human
ugccuuuuucauua

SEQ ID NO: 1691193 - RNA, 13 nt, Human
ugccuuuuucauu

SEQ ID NO: 1691194 - RNA, 19 nt, Human
aggaaacuggguuccugca

SEQ ID NO: 1691195 - RNA, 21 nt, Human
aggaaaaguuuaauauuaaag

SEQ ID NO: 1691196 - RNA, 24 nt, Human
aggaaaaguuuaauauuaaagcca

SEQ ID NO: 1691197 - RNA, 23 nt, Human
aggaaaaguuuaauauuaaagcc

SEQ ID NO: 1691198 - RNA, 23 nt, Human
aggaauucuguauagauuagaau

SEQ ID NO: 1691199 - RNA, 16 nt, Human
aggaauucuguauaga

SEQ ID NO: 1691200 - RNA, 22 nt, Human
aggaauucuguauagauuagaa

SEQ ID NO: 1691201 - RNA, 17 nt, Human
aggaauucuguauagau

SEQ ID NO: 1691202 - RNA, 15 nt, Human
aggauuuuaugcuuu

SEQ ID NO: 1691203 - RNA, 14 nt, Human
aggauuuuaugcuu

SEQ ID NO: 1691204 - RNA, 11 nt, Human
aggauuuuaug

SEQ ID NO: 1691205 - RNA, 17 nt, Human
aggauuuuaugcuuuaa

SEQ ID NO: 1691206 - RNA, 16 nt, Human
aggauuuuaugcuuua

SEQ ID NO: 1691207 - RNA, 21 nt, Human
uggaauuuuccuccuuucucu

SEQ ID NO: 1691208 - RNA, 17 nt, Human
uggaauuuuccuccuuu

SEQ ID NO: 1691209 - RNA, 23 nt, Human
uggagccugcacggugaauggcu

SEQ ID NO: 1691210 - RNA, 14 nt, Human
aguauuaagcauau

SEQ ID NO: 1691211 - RNA, 12 nt, Human
aguauuaagcau

SEQ ID NO: 1691212 - RNA, 23 nt, Human
aguauaauuaacauguuaaacca

SEQ ID NO: 1691213 - RNA, 16 nt, Human
aguauaauuaacaugu

SEQ ID NO: 1691214 - RNA, 14 nt, Human
aguauaauuaacau

SEQ ID NO: 1691215 - RNA, 13 nt, Human
aguauaauuaaca

SEQ ID NO: 1691216 - RNA, 16 nt, Human
uguguuagagauuuuu

SEQ ID NO: 1691217 - RNA, 21 nt, Human
agucuugucucagauuuuauu

SEQ ID NO: 1691218 - RNA, 20 nt, Human
agucuugucucagauuuuau

SEQ ID NO: 1691219 - RNA, 16 nt, Human
agucuugucucagauu

SEQ ID NO: 1691220 - RNA, 19 nt, Human
agucuugucucagauuuua

SEQ ID NO: 1691221 - RNA, 17 nt, Human
agucuugucucagauuu

SEQ ID NO: 1691222 - RNA, 21 nt, Human
agugaguuggguguauugugc

SEQ ID NO: 1691223 - RNA, 20 nt, Human
ugugcugguguaugugugaa

SEQ ID NO: 1691224 - RNA, 19 nt, Human
ugugcugggguuaucugaa

SEQ ID NO: 1691225 - RNA, 22 nt, Human
auagaggaagccugauuaaaga

SEQ ID NO: 1691226 - RNA, 21 nt, Human
auagaggaagccugauuaaag

SEQ ID NO: 1691227 - RNA, 21 nt, Human
auagauuagagaguguugaaa

SEQ ID NO: 1691228 - RNA, 16 nt, Human
auagauuagaauucug

SEQ ID NO: 1691229 - RNA, 15 nt, Human
auagauuagaauucu

SEQ ID NO: 1691230 - RNA, 13 nt, Human
auagauuagaauu

SEQ ID NO: 1691231 - RNA, 22 nt, Human
auagauuagagaguguugaaac

SEQ ID NO: 1691232 - RNA, 20 nt, Human
auagaaccucuuugucuaca

SEQ ID NO: 1691233 - RNA, 14 nt, Human
auagaaccucuuug

SEQ ID NO: 1691234 - RNA, 11 nt, Human
uuauuaugaaa

SEQ ID NO: 1691235 - RNA, 23 nt, Human
uuauuaugaaacuuguguaaaua

SEQ ID NO: 1691236 - RNA, 22 nt, Human
uuauuaugaaacuuguguaaau

SEQ ID NO: 1691237 - RNA, 21 nt, Human
uuauuaugaaacuuguguaaa

SEQ ID NO: 1691238 - RNA, 20 nt, Human
uuauuaugaaacuuguguaa

SEQ ID NO: 1691239 - RNA, 17 nt, Human
uuauuaugaaacuugug

SEQ ID NO: 1691240 - RNA, 14 nt, Human
uuauuauguaaauc

SEQ ID NO: 1691241 - RNA, 13 nt, Human
uuauuauguaaau

SEQ ID NO: 1691242 - RNA, 22 nt, Human
uuauuauguaaaucccauuauu

SEQ ID NO: 1691243 - RNA, 16 nt, Human
uuauuauguaaauccc

SEQ ID NO: 1691244 - RNA, 19 nt, Human
uuauucaaaguugccuaaa

SEQ ID NO: 1691245 - RNA, 15 nt, Human
uuauucaaaguugcc

SEQ ID NO: 1691246 - RNA, 13 nt, Human
uuauucaaaguug

SEQ ID NO: 1691247 - RNA, 14 nt, Human
uuauucacugauuu

SEQ ID NO: 1691248 - RNA, 15 nt, Human
auacuggauuguacu

SEQ ID NO: 1691249 - RNA, 22 nt, Human
uuaugacuucauuaauaauaaa

SEQ ID NO: 1691250 - RNA, 19 nt, Human
uuaugacuucauuaauaau

SEQ ID NO: 1691251 - RNA, 18 nt, Human
uuaugauccagcagauua

SEQ ID NO: 1691252 - RNA, 13 nt, Human
uuaugauccagca

SEQ ID NO: 1691253 - RNA, 19 nt, Human
uuaugaaacuuguguaaau

SEQ ID NO: 1691254 - RNA, 13 nt, Human
uuaugaaacuugu

SEQ ID NO: 1691255 - RNA, 18 nt, Human
uuaugaaacuuguguaaa

SEQ ID NO: 1691256 - RNA, 16 nt, Human
uuaugaaacuugugua

SEQ ID NO: 1691257 - RNA, 23 nt, Human
uuaugauccagcagauuauucac

SEQ ID NO: 1691258 - RNA, 22 nt, Human
uuaugauccagcagauuauuca

SEQ ID NO: 1691259 - RNA, 23 nt, Human
uuauguaaaucccauuauucaaa

SEQ ID NO: 1691260 - RNA, 22 nt, Human
uuauguaaaucccauuauucaa

SEQ ID NO: 1691261 - RNA, 21 nt, Human
uuauguaaaucccauuauuca

SEQ ID NO: 1691262 - RNA, 19 nt, Human
uuauguaaaucccauuauu

SEQ ID NO: 1691263 - RNA, 13 nt, Human
uuauguaaauccc

SEQ ID NO: 1691264 - RNA, 12 nt, Human
uuauguaaaucc

SEQ ID NO: 1691265 - RNA, 11 nt, Human
uuauguaaauc

SEQ ID NO: 1691266 - RNA, 16 nt, Human
uuaugugcgcugauaa

SEQ ID NO: 1691267 - RNA, 23 nt, Human
uuaaaccaugggauaaaugccau

SEQ ID NO: 1691268 - RNA, 22 nt, Human
uuaaaccaugggauaaaugcca

SEQ ID NO: 1691269 - RNA, 21 nt, Human
uuaaaccaugggauaaaugcc

SEQ ID NO: 1691270 - RNA, 22 nt, Human
uuaaaguugaauuuauuggcuu

SEQ ID NO: 1691271 - RNA, 17 nt, Human
uuaaaguugaauuuauu

SEQ ID NO: 1691272 - RNA, 16 nt, Human
uuaaaguugaauuuau

SEQ ID NO: 1691273 - RNA, 13 nt, Human
uuaaaguugaauu

SEQ ID NO: 1691274 - RNA, 20 nt, Human
uuaaacauugguucuuguau

SEQ ID NO: 1691275 - RNA, 18 nt, Human
uuaaacauugguucuugu

SEQ ID NO: 1691276 - RNA, 22 nt, Human
uuaaacauugguucuuguauua

SEQ ID NO: 1691277 - RNA, 17 nt, Human
uuaaaccaugggauaaa

SEQ ID NO: 1691278 - RNA, 12 nt, Human
aguuuuguuugg

SEQ ID NO: 1691279 - RNA, 16 nt, Human
aguuuuguuuggacca

SEQ ID NO: 1691280 - RNA, 14 nt, Human
aguuuuguuuggac

SEQ ID NO: 1691281 - RNA, 18 nt, Human
aguuuuguuuggaccaaa

SEQ ID NO: 1691282 - RNA, 22 nt, Human
uuaagaaugaaauacuguuuga

SEQ ID NO: 1691283 - RNA, 20 nt, Human
uuaagaaugaaauacuguuu

SEQ ID NO: 1691284 - RNA, 14 nt, Human
uuaagaaugaaaua

SEQ ID NO: 1691285 - RNA, 13 nt, Human
uuaauuuuggaau

SEQ ID NO: 1691286 - RNA, 15 nt, Human
uuaauuuuggaauuu

SEQ ID NO: 1691287 - RNA, 14 nt, Human
uuaauuuuggaauu

SEQ ID NO: 1691288 - RNA, 21 nt, Human
auaaaucgcuuuugauaauca

SEQ ID NO: 1691289 - RNA, 19 nt, Human
auaaaucgcuuuugauaau

SEQ ID NO: 1691290 - RNA, 16 nt, Human
auaaaucgcuuuugau

SEQ ID NO: 1691291 - RNA, 14 nt, Human
auaaaucgcuuuug

SEQ ID NO: 1691292 - RNA, 18 nt, Human
auaaaugccaucaauaaa

SEQ ID NO: 1691293 - RNA, 17 nt, Human
auaaaugccaucaauaa

SEQ ID NO: 1691294 - RNA, 19 nt, Human
auaaaucugugaacuugaa

SEQ ID NO: 1691295 - RNA, 16 nt, Human
auaaaucugugaacuu

SEQ ID NO: 1691296 - RNA, 15 nt, Human
auaaaucugugaacu

SEQ ID NO: 1691297 - RNA, 17 nt, Human
uuagaauucuguauaga

SEQ ID NO: 1691298 - RNA, 15 nt, Human
uuagaauucuguaua

SEQ ID NO: 1691299 - RNA, 14 nt, Human
uuagaauucuguau

SEQ ID NO: 1691300 - RNA, 23 nt, Human
aucugccuaaggacuucuuuaau

SEQ ID NO: 1691301 - RNA, 22 nt, Human
aucugccuaaggacuucuuuaa

SEQ ID NO: 1691302 - RNA, 21 nt, Human
aucugccuaaggacuucuuua

SEQ ID NO: 1691303 - RNA, 11 nt, Human
aucugccuaag

SEQ ID NO: 1691304 - RNA, 23 nt, Human
uugaagcauuuuauaaaucgcuu

SEQ ID NO: 1691305 - RNA, 20 nt, Human
auccucucaaccaccuuuca

SEQ ID NO: 1691306 - RNA, 20 nt, Human
aucugacaucucugcaaucu

SEQ ID NO: 1691307 - RNA, 16 nt, Human
aucugacaucucugca

SEQ ID NO: 1691308 - RNA, 15 nt, Human
aucugacaucucugc

SEQ ID NO: 1691309 - RNA, 23 nt, Human
aucaccugucuugccuuuuucau

SEQ ID NO: 1691310 - RNA, 17 nt, Human
uugaaauuguaauuaua

SEQ ID NO: 1691311 - RNA, 15 nt, Human
uugaaauuguaauua

SEQ ID NO: 1691312 - RNA, 14 nt, Human
uugaaauuguaauu

SEQ ID NO: 1691313 - RNA, 13 nt, Human
uugaaauuguaau

SEQ ID NO: 1691314 - RNA, 17 nt, Human
auccaguuuuguuugga

SEQ ID NO: 1691315 - RNA, 21 nt, Human
auccauuuggaaaucuuuaaa

SEQ ID NO: 1691316 - RNA, 20 nt, Human
auccauuuggaaaucuuuaa

SEQ ID NO: 1691317 - RNA, 13 nt, Human
uuuauauuuacua

SEQ ID NO: 1691318 - RNA, 16 nt, Human
uuuauauuuacuaaaa

SEQ ID NO: 1691319 - RNA, 11 nt, Human
augcuauuucu

SEQ ID NO: 1691320 - RNA, 20 nt, Human
augcuauuucuauauuuuca

SEQ ID NO: 1691321 - RNA, 15 nt, Human
augcuauuucuauau

SEQ ID NO: 1691322 - RNA, 14 nt, Human
augcuauuucuaua

SEQ ID NO: 1691323 - RNA, 13 nt, Human
augcuauuucuau

SEQ ID NO: 1691324 - RNA, 23 nt, Human
augcuauuucuauauuuucauuc

SEQ ID NO: 1691325 - RNA, 22 nt, Human
augcuauuucuauauuuucauu

SEQ ID NO: 1691326 - RNA, 21 nt, Human
augcuauuucuauauuuucau

SEQ ID NO: 1691327 - RNA, 18 nt, Human
uuuauuacaguauaauua

SEQ ID NO: 1691328 - RNA, 14 nt, Human
uuuauuacaguaua

SEQ ID NO: 1691329 - RNA, 19 nt, Human
auggaacgcguugaaauug

SEQ ID NO: 1691330 - RNA, 18 nt, Human
auggaacgcguugaaauu

SEQ ID NO: 1691331 - RNA, 17 nt, Human
auggaacgcguugaaau

SEQ ID NO: 1691332 - RNA, 16 nt, Human
auggaacgcguugaaa

SEQ ID NO: 1691333 - RNA, 15 nt, Human
auggaacgcguugaa

SEQ ID NO: 1691334 - RNA, 15 nt, Human
uuucauuauuuuauu

SEQ ID NO: 1691335 - RNA, 13 nt, Human
uuucauuauuuua

SEQ ID NO: 1691336 - RNA, 20 nt, Human
uuucauuauuuuauuaugaa

SEQ ID NO: 1691337 - RNA, 19 nt, Human
uuucauuauuuuauuauga

SEQ ID NO: 1691338 - RNA, 22 nt, Human
auggacuguggugacuuuggau

SEQ ID NO: 1691339 - RNA, 17 nt, Human
auggacuguggugacuu

SEQ ID NO: 1691340 - RNA, 16 nt, Human
auggacuguggugacu

SEQ ID NO: 1691341 - RNA, 14 nt, Human
augggauaaaugcc

SEQ ID NO: 1691342 - RNA, 22 nt, Human
augauccagcagauuauucacu

SEQ ID NO: 1691343 - RNA, 20 nt, Human
augauccagcagauuauuca

SEQ ID NO: 1691344 - RNA, 19 nt, Human
augauccagcagauuauuc

SEQ ID NO: 1691345 - RNA, 10 nt, Human
augauccagc

SEQ ID NO: 1691346 - RNA, 21 nt, Human
uuuaaauaaauaaauagcuag

SEQ ID NO: 1691347 - RNA, 19 nt, Human
uuugugcugguguaugugu

SEQ ID NO: 1691348 - RNA, 20 nt, Human
uuuggcauaacauaaaucug

SEQ ID NO: 1691349 - RNA, 21 nt, Human
uuuggcauaacauaaaucugu

SEQ ID NO: 1691350 - RNA, 23 nt, Human
auguaaaucccauuauucaaagu

SEQ ID NO: 1691351 - RNA, 22 nt, Human
auguaaaucccauuauucaaag

SEQ ID NO: 1691352 - RNA, 20 nt, Human
auguaaaucccauuauucaa

SEQ ID NO: 1691353 - RNA, 14 nt, Human
auguaaaucccauu

SEQ ID NO: 1691354 - RNA, 20 nt, Human
augggauaaaugccaucaau

SEQ ID NO: 1691355 - RNA, 16 nt, Human
augggauaaaugccau

SEQ ID NO: 1691356 - RNA, 15 nt, Human
augggauaaaugcca

SEQ ID NO: 1691357 - RNA, 19 nt, Human
uuucuguuauauaaauggu

SEQ ID NO: 1691358 - RNA, 19 nt, Human
uuucuguacuuuuuggcau

SEQ ID NO: 1691359 - RNA, 20 nt, Human
uuucuguacuuuuuggcaua

SEQ ID NO: 1691360 - RNA, 13 nt, Human
auuauucaaaguu

SEQ ID NO: 1691361 - RNA, 15 nt, Human
auuauucaaaguugc

SEQ ID NO: 1691362 - RNA, 14 nt, Human
auuauucaaaguug

SEQ ID NO: 1691363 - RNA, 17 nt, Human
auuauucaaaguugccu

SEQ ID NO: 1691364 - RNA, 13 nt, Human
auucuguauagau

SEQ ID NO: 1691365 - RNA, 12 nt, Human
auucuguauaga

SEQ ID NO: 1691366 - RNA, 11 nt, Human
auucuguauag

SEQ ID NO: 1691367 - RNA, 22 nt, Human
auugaagcauuuuauaaaucgc

SEQ ID NO: 1691368 - RNA, 20 nt, Human
auucuuaaaguugaauuuau

SEQ ID NO: 1691369 - RNA, 19 nt, Human
auucuuaaaguugaauuua

SEQ ID NO: 1691370 - RNA, 15 nt, Human
auucuguauagauua

SEQ ID NO: 1691371 - RNA, 21 nt, Human
auucuuaaaguugaauuuauu

SEQ ID NO: 1691372 - RNA, 15 nt, Human
auuuuguuucuguac

SEQ ID NO: 1691373 - RNA, 14 nt, Human
auuuuguuucugua

SEQ ID NO: 1691374 - RNA, 11 nt, Human
auuuuguuucu

SEQ ID NO: 1691375 - RNA, 12 nt, Human
auuuuggaauuu

SEQ ID NO: 1691376 - RNA, 16 nt, Human
auugguucuuguauua

SEQ ID NO: 1691377 - RNA, 15 nt, Human
auugguucuuguauu

SEQ ID NO: 1691378 - RNA, 20 nt, Human
auuggcuuuucugauccagu

SEQ ID NO: 1691379 - RNA, 19 nt, Human
auuggcuuuucugauccag

SEQ ID NO: 1691380 - RNA, 16 nt, Human
auuggcuuuucugauc

SEQ ID NO: 1691381 - RNA, 15 nt, Human
auuggcuuuucugau

SEQ ID NO: 1691382 - RNA, 13 nt, Human
auuggcuuuucug

SEQ ID NO: 1691383 - RNA, 21 nt, Human
auuugacauagucuggcugua

SEQ ID NO: 1691384 - RNA, 17 nt, Human
auuugacauagucuggc

SEQ ID NO: 1691385 - RNA, 16 nt, Human
auuugacauagucugg

SEQ ID NO: 1691386 - RNA, 14 nt, Human
gcugggguuaucug

SEQ ID NO: 1691387 - RNA, 23 nt, Human
gcugggguuaucugaagucagau

SEQ ID NO: 1691388 - RNA, 22 nt, Human
gcugggguuaucugaagucaga

SEQ ID NO: 1691389 - RNA, 15 nt, Human
ggacuuguuagaucu

SEQ ID NO: 1691390 - RNA, 18 nt, Human
ggacuucuuuaauuuugg

SEQ ID NO: 1691391 - RNA, 21 nt, Human
ggacuucuuuaauuuuggaau

SEQ ID NO: 1691392 - RNA, 22 nt, Human
ggacuucuuuaauuuuggaauu

SEQ ID NO: 1691393 - RNA, 17 nt, Human
ggcauaacauaaaucug

SEQ ID NO: 1691394 - RNA, 16 nt, Human
ggcauaacauaaaucu

SEQ ID NO: 1691395 - RNA, 17 nt, Human
aaaaccaguauuguaca

SEQ ID NO: 1691396 - RNA, 15 nt, Human
ggcuguacccaggaa

SEQ ID NO: 1691397 - RNA, 20 nt, Human
aaaggaagguucugguguga

SEQ ID NO: 1691398 - RNA, 12 nt, Human
aaacuuuucuga

SEQ ID NO: 1691399 - RNA, 11 nt, Human
aaacuuuucug

SEQ ID NO: 1691400 - RNA, 15 nt, Human
aaacuuguguaaaua

SEQ ID NO: 1691401 - RNA, 22 nt, Human
aaacugcuuguuuccuagcaca

SEQ ID NO: 1691402 - RNA, 19 nt, Human
aaacugcuuguuuccuagc

SEQ ID NO: 1691403 - RNA, 17 nt, Human
aaacugcuuguuuccua

SEQ ID NO: 1691404 - RNA, 14 nt, Human
aaacugcuuguuuc

SEQ ID NO: 1691405 - RNA, 13 nt, Human
aaacugcuuguuu

SEQ ID NO: 1691406 - RNA, 15 nt, Human
aaaccucugugagca

SEQ ID NO: 1691407 - RNA, 22 nt, Human
aaauacaauuuuguuucuguac

SEQ ID NO: 1691408 - RNA, 21 nt, Human
aaauacaauuuuguuucugua

SEQ ID NO: 1691409 - RNA, 20 nt, Human
aaauacaauuuuguuucugu

SEQ ID NO: 1691410 - RNA, 18 nt, Human
aaauacaauuuuguuucu

SEQ ID NO: 1691411 - RNA, 17 nt, Human
aaauacaauuuuguuuc

SEQ ID NO: 1691412 - RNA, 14 nt, Human
aaauacaauuuugu

SEQ ID NO: 1691413 - RNA, 13 nt, Human
aaauacaauuuug

SEQ ID NO: 1691414 - RNA, 23 nt, Human
aaaguugccuaaauccauuugga

SEQ ID NO: 1691415 - RNA, 17 nt, Human
aaaguugccuaaaucca

SEQ ID NO: 1691416 - RNA, 16 nt, Human
aaaguugccuaaaucc

SEQ ID NO: 1691417 - RNA, 14 nt, Human
aaaguuuaauauua

SEQ ID NO: 1691418 - RNA, 12 nt, Human
aaaguuuaauau

SEQ ID NO: 1691419 - RNA, 14 nt, Human
aaaguugccuaaau

SEQ ID NO: 1691420 - RNA, 13 nt, Human
aaaguugccuaaa

SEQ ID NO: 1691421 - RNA, 20 nt, Human
aaaguauuaagcauauauuu

SEQ ID NO: 1691422 - RNA, 19 nt, Human
aaaguauuaagcauauauu

SEQ ID NO: 1691423 - RNA, 18 nt, Human
aaaguauuaagcauauau

SEQ ID NO: 1691424 - RNA, 13 nt, Human
aaaguauuaagca

SEQ ID NO: 1691425 - RNA, 19 nt, Human
gacuuuggauaauaaggaa

SEQ ID NO: 1691426 - RNA, 18 nt, Human
gaugucuucauaccuaca

SEQ ID NO: 1691427 - RNA, 14 nt, Human
gaugucuucauacc

SEQ ID NO: 1691428 - RNA, 15 nt, Human
gauucuuaaaguuga

SEQ ID NO: 1691429 - RNA, 17 nt, Human
gauucuuaaaguugaau

SEQ ID NO: 1691430 - RNA, 16 nt, Human
gauucuuaaaguugaa

SEQ ID NO: 1691431 - RNA, 21 nt, Human
gauucuuaaaguugaauuuau

SEQ ID NO: 1691432 - RNA, 16 nt, Human
gcaaaaauauuuuaug

SEQ ID NO: 1691433 - RNA, 23 nt, Human
gcaaaaauauuuuaugauccagc

SEQ ID NO: 1691434 - RNA, 22 nt, Human
gcaaaaauauuuuaugauccag

SEQ ID NO: 1691435 - RNA, 17 nt, Human
gcaaaaauauuuuauga

SEQ ID NO: 1691436 - RNA, 15 nt, Human
gcauaacauaaaucu

SEQ ID NO: 1691437 - RNA, 13 nt, Human
gcauaacauaaau

SEQ ID NO: 1691438 - RNA, 22 nt, Human
cuuucagauacuggauuguacu

SEQ ID NO: 1691439 - RNA, 17 nt, Human
cuuucagauacuggauu

SEQ ID NO: 1691440 - RNA, 15 nt, Human
cuuucagauacugga

SEQ ID NO: 1691441 - RNA, 14 nt, Human
cuuucagauacugg

SEQ ID NO: 1691442 - RNA, 18 nt, Human
cuugucucagauuuuauu

SEQ ID NO: 1691443 - RNA, 13 nt, Human
cuugucucagauu

SEQ ID NO: 1691444 - RNA, 17 nt, Human
cuugucucagauuuuau

SEQ ID NO: 1691445 - RNA, 14 nt, Human
cuugucucagauuu

SEQ ID NO: 1691446 - RNA, 17 nt, Human
gaaacuggguuccugca

SEQ ID NO: 1691447 - RNA, 21 nt, Human
gaaacugcuuguuuccuagca

SEQ ID NO: 1691448 - RNA, 15 nt, Human
gaaaucuuuaaaaaa

SEQ ID NO: 1691449 - RNA, 12 nt, Human
gaaaucuuuaaa

SEQ ID NO: 1691450 - RNA, 20 nt, Human
gaacacuccaauuaaggauu

SEQ ID NO: 1691451 - RNA, 18 nt, Human
gaacacuccaauuaagga

SEQ ID NO: 1691452 - RNA, 20 nt, Human
cuguuauuuauaaucacuuu

SEQ ID NO: 1691453 - RNA, 14 nt, Human
cuguuauuuauaau

SEQ ID NO: 1691454 - RNA, 18 nt, Human
cuuaaaguugaauuuauu

SEQ ID NO: 1691455 - RNA, 15 nt, Human
cuuaaaguugaauuu

SEQ ID NO: 1691456 - RNA, 14 nt, Human
cuuaaaguugaauu

SEQ ID NO: 1691457 - RNA, 22 nt, Human
cuuaaauaauaaagaucaugua

SEQ ID NO: 1691458 - RNA, 13 nt, Human
cuuaaauaauaaa

SEQ ID NO: 1691459 - RNA, 22 nt, Human
cuuaaaguugaauuuauuggcu

SEQ ID NO: 1691460 - RNA, 22 nt, Human
cauugguucuuguauuaagaau

SEQ ID NO: 1691461 - RNA, 18 nt, Human
cauugguucuuguauuaa

SEQ ID NO: 1691462 - RNA, 21 nt, Human
caguauuguacaaaguauuaa

SEQ ID NO: 1691463 - RNA, 13 nt, Human
caguauuguacaa

SEQ ID NO: 1691464 - RNA, 12 nt, Human
caguauuguaca

SEQ ID NO: 1691465 - RNA, 19 nt, Human
caguauuguacaaaguauu

SEQ ID NO: 1691466 - RNA, 18 nt, Human
caguauuguacaaaguau

SEQ ID NO: 1691467 - RNA, 17 nt, Human
caguauuguacaaagua

SEQ ID NO: 1691468 - RNA, 16 nt, Human
caguauuguacaaagu

SEQ ID NO: 1691469 - RNA, 19 nt, Human
auuguacaaaguauuaagc

SEQ ID NO: 1691470 - RNA, 17 nt, Human
auuguacaaaguauuaa

SEQ ID NO: 1691471 - RNA, 16 nt, Human
auuguacaaaguauua

SEQ ID NO: 1691472 - RNA, 21 nt, Human
auuguaauuauaucugaggaa

SEQ ID NO: 1691473 - RNA, 15 nt, Human
auuguaauuauaucu

SEQ ID NO: 1691474 - RNA, 17 nt, Human
auuguaauuauaucuga

SEQ ID NO: 1691475 - RNA, 16 nt, Human
auuguaauuauaucug

SEQ ID NO: 1691476 - RNA, 16 nt, Human
auuucuauauuuucau

SEQ ID NO: 1691477 - RNA, 15 nt, Human
auuucuauauuuuca

SEQ ID NO: 1691478 - RNA, 18 nt, Human
auuucuauauuuucauuc

SEQ ID NO: 1691479 - RNA, 17 nt, Human
auuucuauauuuucauu

SEQ ID NO: 1691480 - RNA, 22 nt, Human
auuucuaugcugaguuugugcu

SEQ ID NO: 1691481 - RNA, 21 nt, Human
auuucuaugcugaguuugugc

SEQ ID NO: 1691482 - RNA, 19 nt, Human
auuucuaugcugaguuugu

SEQ ID NO: 1691483 - RNA, 19 nt, Human
auuucuauauuuucauucu

SEQ ID NO: 1691484 - RNA, 22 nt, Human
auuuauaaucacuuuuuuccac

SEQ ID NO: 1691485 - RNA, 13 nt, Human
auuuauaaucacu

SEQ ID NO: 1691486 - RNA, 15 nt, Human
auuuauaaucacuuu

SEQ ID NO: 1691487 - RNA, 12 nt, Human
auuauguaaauc

SEQ ID NO: 1691488 - RNA, 19 nt, Human
auuuuaugcuuuaaacauu

SEQ ID NO: 1691489 - RNA, 18 nt, Human
auuuuaugcuuuaaacau

SEQ ID NO: 1691490 - RNA, 18 nt, Human
auuuuagcuacuauauau

SEQ ID NO: 1691491 - RNA, 16 nt, Human
auuuuuauauuuacua

SEQ ID NO: 1691492 - RNA, 15 nt, Human
auuuuuauauuuacu

SEQ ID NO: 1691493 - RNA, 13 nt, Human
auuuuuuuguugu

SEQ ID NO: 1691494 - RNA, 18 nt, Human
auuuuuuuguuguuuguu

SEQ ID NO: 1691495 - RNA, 22 nt, Human
caccuuucagauaacuguuauu

SEQ ID NO: 1691496 - RNA, 21 nt, Human
caccuuucagauaacuguuau

SEQ ID NO: 1691497 - RNA, 23 nt, Human
caaguuguuugagaaauuaagua

SEQ ID NO: 1691498 - RNA, 21 nt, Human
caaguuguuugagaaauuaag

SEQ ID NO: 1691499 - RNA, 17 nt, Human
caaguuguuugagaaau

SEQ ID NO: 1691500 - RNA, 13 nt, Human
caaguuguuugag

SEQ ID NO: 1691501 - RNA, 20 nt, Human
cucagaaggcaaaugacuuu

SEQ ID NO: 1691502 - RNA, 14 nt, Human
cuacuauauaugug

SEQ ID NO: 1691503 - RNA, 16 nt, Human
cuaaacuuuucugaua

SEQ ID NO: 1691504 - RNA, 13 nt, Human
cuccuuucucuuu

SEQ ID NO: 1691505 - RNA, 16 nt, Human
cugaggaauucuguau

SEQ ID NO: 1691506 - RNA, 15 nt, Human
cugaggaauucugua

SEQ ID NO: 1691507 - RNA, 19 nt, Human
cugaggaauucuguauaga

SEQ ID NO: 1691508 - RNA, 18 nt, Human
cugaggaauucuguauag

SEQ ID NO: 1691509 - RNA, 13 nt, Human
ccauuuggaaauc

SEQ ID NO: 1691510 - RNA, 11 nt, Human
ccauuauucaa

SEQ ID NO: 1691511 - RNA, 16 nt, Human
ccccacccugccucac

SEQ ID NO: 1691512 - RNA, 23 nt, Human
cccauuauucaaaguugccuaaa

SEQ ID NO: 1691513 - RNA, 18 nt, Human
cccauuauucaaaguugc

SEQ ID NO: 1691514 - RNA, 21 nt, Human
cuaaaauggacuguggugacu

SEQ ID NO: 1691515 - RNA, 22 nt, Human
cuaaaauggacuguggugacuu

SEQ ID NO: 1691516 - RNA, 22 nt, Human
cuaaggacuucuuuaauuuugg

SEQ ID NO: 1691517 - RNA, 16 nt, Human
cuaaggacuucuuuaa

SEQ ID NO: 1691518 - RNA, 15 nt, Human
cuaaggacuucuuua

SEQ ID NO: 1691519 - RNA, 14 nt, Human
cuaaggacuucuuu

SEQ ID NO: 1691520 - RNA, 23 nt, Human
cuagacuggugacugauucuuca

SEQ ID NO: 1691521 - RNA, 22 nt, Human
cuagacuggugacugauucuuc

SEQ ID NO: 1691522 - RNA, 19 nt, Human
cuagacuggugacugauuc

SEQ ID NO: 1691523 - RNA, 18 nt, Human
cuagacuggugacugauu

SEQ ID NO: 1691524 - RNA, 17 nt, Human
cuagacuggugacugau

SEQ ID NO: 1691525 - RNA, 15 nt, Human
cuagacuggugacug

SEQ ID NO: 1691526 - RNA, 14 nt, Human
cuagacuggugacu

SEQ ID NO: 1691527 - RNA, 13 nt, Human
cuaugcugaguuu

SEQ ID NO: 1691528 - RNA, 15 nt, Human
cuaugcugaguuugu

SEQ ID NO: 1691529 - RNA, 14 nt, Human
cuaugcugaguuug

SEQ ID NO: 1691530 - RNA, 18 nt, Human
cuaugcugaguuugugcu

SEQ ID NO: 1691531 - RNA, 18 nt, Human
cucaaccaccuuucagau

SEQ ID NO: 1691532 - RNA, 20 nt, Human
cuauuucuauauuuucauuc

SEQ ID NO: 1691533 - RNA, 19 nt, Human
cuauuucuauauuuucauu

SEQ ID NO: 1691534 - RNA, 22 nt, Human
cucccuauuuuuuuucuguuau

SEQ ID NO: 1691535 - RNA, 20 nt, Human
cuccauuuaauaauuauaug

SEQ ID NO: 1691536 - RNA, 13 nt, Human
cuccauuuaauaa

SEQ ID NO: 1691537 - RNA, 23 nt, Human
cucagauuuuauuauguaaaucc

SEQ ID NO: 1691538 - RNA, 24 nt, Human
cgcguugaaauuguaauuauaucu

SEQ ID NO: 1691539 - RNA, 19 nt, Human
cgcuaaacuuuucugauag

SEQ ID NO: 1691540 - RNA, 18 nt, Human
cgcuaaacuuuucugaua

SEQ ID NO: 1691541 - RNA, 17 nt, Human
cgcuaaacuuuucugau

SEQ ID NO: 1691542 - RNA, 23 nt, Human
gaaaaguuuaauauuaaagccau

SEQ ID NO: 1691543 - RNA, 15 nt, Human
gaaaaguuuaauauu

SEQ ID NO: 1691544 - RNA, 22 nt, Human
gaaaaguuuaauauuaaagcca

SEQ ID NO: 1691545 - RNA, 21 nt, Human
gaaaaguuuaauauuaaagcc

SEQ ID NO: 1691546 - RNA, 20 nt, Human
gaaaaguuuaauauuaaagc

SEQ ID NO: 1691547 - RNA, 19 nt, Human
gaaaaguuuaauauuaaag

SEQ ID NO: 1691548 - RNA, 22 nt, Human
cuuuuuggcauaacauaaaucu

SEQ ID NO: 1691549 - RNA, 20 nt, Human
cuuuuuggcauaacauaaau

SEQ ID NO: 1691550 - RNA, 16 nt, Human
cuuuuuggcauaacau

SEQ ID NO: 1691551 - RNA, 18 nt, Human
gaaacggaugauuucuau

SEQ ID NO: 1691552 - RNA, 17 nt, Human
gaaacggaugauuucua

SEQ ID NO: 1691553 - RNA, 21 nt, Human
cuuuaaacauugguucuugua

SEQ ID NO: 1691554 - RNA, 22 nt, Human
cuuguuagaucuaguucacucu

SEQ ID NO: 1691555 - RNA, 12 nt, Human
cuuguguaaaua

SEQ ID NO: 1691556 - RNA, 21 nt, Human
cuuguguaaauacaauuuugu

SEQ ID NO: 1691557 - RNA, 16 nt, Human
cuuguguaaauacaau

SEQ ID NO: 1691558 - RNA, 14 nt, Human
cuuguguaaauaca

SEQ ID NO: 1691559 - RNA, 16 nt, Human
cuuucucuuucguuac

SEQ ID NO: 1691560 - RNA, 20 nt, Human
cuuugucuacaccauuaugu

SEQ ID NO: 1691561 - RNA, 23 nt, Human
cuuugucuacaccauuaugugcg

SEQ ID NO: 1691562 - RNA, 22 nt, Human
cuuugugcugggguuaucugaa

SEQ ID NO: 1691563 - RNA, 20 nt, Human
cuuugugcugggguuaucug

SEQ ID NO: 1691564 - RNA, 15 nt, Human
cuuugugcugggguu

SEQ ID NO: 1691565 - RNA, 18 nt, Human
cuucuuuaauuuuggaau

SEQ ID NO: 1691566 - RNA, 17 nt, Human
cuucuuuaauuuuggaa

SEQ ID NO: 1691567 - RNA, 16 nt, Human
cuucuuuaauuuugga

SEQ ID NO: 1691568 - RNA, 15 nt, Human
cuucuuuaauuuugg

SEQ ID NO: 1691569 - RNA, 19 nt, Human
cuucuuuaauuuuggaauu

SEQ ID NO: 1691570 - RNA, 16 nt, Human
cuguauagauuagaau

SEQ ID NO: 1691571 - RNA, 15 nt, Human
cugccuaaggacuuc

SEQ ID NO: 1691572 - RNA, 14 nt, Human
cugccuaaggacuu

SEQ ID NO: 1691573 - RNA, 13 nt, Human
cugccuaaggacu

SEQ ID NO: 1691574 - RNA, 12 nt, Human
cugccuaaggac

SEQ ID NO: 1691575 - RNA, 13 nt, Human
gagaguguugaaa

SEQ ID NO: 1691576 - RNA, 21 nt, Human
gacuucuuuaauuuuggaauu

SEQ ID NO: 1691577 - RNA, 20 nt, Human
gacuucuuuaauuuuggaau

SEQ ID NO: 1691578 - RNA, 19 nt, Human
gacuucuuuaauuuuggaa

SEQ ID NO: 1691579 - RNA, 18 nt, Human
gacuucuuuaauuuugga

SEQ ID NO: 1691580 - RNA, 17 nt, Human
gacuucuuuaauuuugg

SEQ ID NO: 1691581 - RNA, 16 nt, Human
gacuucuuuaauuuug

SEQ ID NO: 1691582 - RNA, 13 nt, Human
gaauucuguauag

SEQ ID NO: 1691583 - RNA, 22 nt, Human
gaauucuguauagauuagaauu

SEQ ID NO: 1691584 - RNA, 21 nt, Human
gaauucuguauagauuagaau

SEQ ID NO: 1691585 - RNA, 14 nt, Human
gaauucuguauaga

SEQ ID NO: 1691586 - RNA, 16 nt, Human
gaauggcuuuguauag

SEQ ID NO: 1691587 - RNA, 14 nt, Human
gaauggcuuuguau

SEQ ID NO: 1691588 - RNA, 21 nt, Human
gaauggcuuuguauagaaccu

SEQ ID NO: 1691589 - RNA, 17 nt, Human
gaauggcuuuguauaga

SEQ ID NO: 1691590 - RNA, 18 nt, Human
gaaugaaauacuguuuga

SEQ ID NO: 1691591 - RNA, 15 nt, Human
gaaugaaauacuguu

SEQ ID NO: 1691592 - RNA, 19 nt, Human
gaaugaaauacuguuugag

SEQ ID NO: 1691593 - RNA, 13 nt, Human
gauuuuaugcuuu

SEQ ID NO: 1691594 - RNA, 16 nt, Human
gaguguugaaacggau

SEQ ID NO: 1691595 - RNA, 20 nt, Human
gauaaaugccaucaauaaaa

SEQ ID NO: 1691596 - RNA, 15 nt, Human
gauaaaugccaucaa

SEQ ID NO: 1691597 - RNA, 11 nt, Human
gauaaaugcca

SEQ ID NO: 1691598 - RNA, 18 nt, Human
gauaacuguuauuuauaa

SEQ ID NO: 1691599 - RNA, 17 nt, Human
gauaacuguuauuuaua

SEQ ID NO: 1691600 - RNA, 17 nt, Human
ggaauucuguauagauu

SEQ ID NO: 1691601 - RNA, 15 nt, Human
ggaauucuguauaga

SEQ ID NO: 1691602 - RNA, 12 nt, Human
ggaauucuguau

SEQ ID NO: 1691603 - RNA, 16 nt, Human
ggaacgcguugaaauu

SEQ ID NO: 1691604 - RNA, 23 nt, Human
ggaccaaaaaccaguauuguaca

SEQ ID NO: 1691605 - RNA, 16 nt, Human
ggaccaaaaaccagua

SEQ ID NO: 1691606 - RNA, 14 nt, Human
ggacuguggugacu

SEQ ID NO: 1691607 - RNA, 22 nt, Human
ggacuguggugacuuuggauaa

SEQ ID NO: 1691608 - RNA, 21 nt, Human
ggacuguggugacuuuggaua

SEQ ID NO: 1691609 - RNA, 17 nt, Human
ggacuguggugacuuug

SEQ ID NO: 1691610 - RNA, 15 nt, Human
ggacuguggugacuu

SEQ ID NO: 1691611 - RNA, 23 nt, Human
gcuuucagauacuggauuguacu

SEQ ID NO: 1691612 - RNA, 18 nt, Human
gcuuucagauacuggauu

SEQ ID NO: 1691613 - RNA, 14 nt, Human
gcuuucagauacug

SEQ ID NO: 1691614 - RNA, 18 nt, Human
ggaaaaguuuaauauuaa

SEQ ID NO: 1691615 - RNA, 14 nt, Human
ggaaaaguuuaaua

SEQ ID NO: 1691616 - RNA, 16 nt, Human
ggauucuuaaaguuga

SEQ ID NO: 1691617 - RNA, 19 nt, Human
ggauucuuaaaguugaauu

SEQ ID NO: 1691618 - RNA, 18 nt, Human
ggauucuuaaaguugaau

SEQ ID NO: 1691619 - RNA, 20 nt, Human
ggauucuuaaaguugaauuu

SEQ ID NO: 1691620 - RNA, 23 nt, Human
gccugcacggugaauggcuuugu

SEQ ID NO: 1691621 - RNA, 16 nt, Human
gccugauuaaagaaug

SEQ ID NO: 1691622 - RNA, 13 nt, Human
gccugauuaaaga

SEQ ID NO: 1691623 - RNA, 21 nt, Human
guacuuuuuggcauaacauaa

SEQ ID NO: 1691624 - RNA, 12 nt, Human
guacuuuuuggc

SEQ ID NO: 1691625 - RNA, 13 nt, Human
guaauuauaucug

SEQ ID NO: 1691626 - RNA, 23 nt, Human
guaaauacaauuuuguuucugua

SEQ ID NO: 1691627 - RNA, 22 nt, Human
guaaauacaauuuuguuucugu

SEQ ID NO: 1691628 - RNA, 15 nt, Human
guaaaucccauuauu

SEQ ID NO: 1691629 - RNA, 21 nt, Human
guaaauacaauuuuguuucug

SEQ ID NO: 1691630 - RNA, 21 nt, Human
guaaaucccauuauucaaagu

SEQ ID NO: 1691631 - RNA, 20 nt, Human
guaaaucccauuauucaaag

SEQ ID NO: 1691632 - RNA, 19 nt, Human
guaaaucccauuauucaaa

SEQ ID NO: 1691633 - RNA, 18 nt, Human
guaaaucccauuauucaa

SEQ ID NO: 1691634 - RNA, 17 nt, Human
guaaaucccauuauuca

SEQ ID NO: 1691635 - RNA, 16 nt, Human
guaaaucccauuauuc

SEQ ID NO: 1691636 - RNA, 19 nt, Human
ggugcccugcuuucagaua

SEQ ID NO: 1691637 - RNA, 20 nt, Human
ggugaauggcuuuguauaga

SEQ ID NO: 1691638 - RNA, 17 nt, Human
ggugaauggcuuuguau

SEQ ID NO: 1691639 - RNA, 14 nt, Human
ggugaauggcuuug

SEQ ID NO: 1691640 - RNA, 18 nt, Human
gguccgugcuaaggacuu

SEQ ID NO: 1691641 - RNA, 17 nt, Human
gguccgugcuaaggacu

SEQ ID NO: 1691642 - RNA, 16 nt, Human
gguccgugcuaaggac

SEQ ID NO: 1691643 - RNA, 23 nt, Human
guauuuguuugcauaggugaucu

SEQ ID NO: 1691644 - RNA, 12 nt, Human
guauuuguuugc

SEQ ID NO: 1691645 - RNA, 13 nt, Human
gucucagauuuua

SEQ ID NO: 1691646 - RNA, 14 nt, Human
gugaauggcuuugu

SEQ ID NO: 1691647 - RNA, 13 nt, Human
gugaauggcuuug

SEQ ID NO: 1691648 - RNA, 19 nt, Human
gugaauggcuuuguauaga

SEQ ID NO: 1691649 - RNA, 18 nt, Human
gugaauggcuuuguauag

SEQ ID NO: 1691650 - RNA, 17 nt, Human
gugaauggcuuuguaua

SEQ ID NO: 1691651 - RNA, 21 nt, Human
gugaaacugcuuguuuccuag

SEQ ID NO: 1691652 - RNA, 20 nt, Human
gugaaacugcuuguuuccua

SEQ ID NO: 1691653 - RNA, 23 nt, Human
gugaaacugcuuguuuccuagca

SEQ ID NO: 1691654 - RNA, 17 nt, Human
uaucugaggaauucugu

SEQ ID NO: 1691655 - RNA, 22 nt, Human
uaucugaggaauucuguauaga

SEQ ID NO: 1691656 - RNA, 21 nt, Human
uaucugaggaauucuguauag

SEQ ID NO: 1691657 - RNA, 19 nt, Human
uaucugaggaauucuguau

SEQ ID NO: 1691658 - RNA, 18 nt, Human
uaucugaggaauucugua

SEQ ID NO: 1691659 - RNA, 15 nt, Human
uaugcuuuaaacauu

SEQ ID NO: 1691660 - RNA, 20 nt, Human
uaugacuucauuaauaauaa

SEQ ID NO: 1691661 - RNA, 16 nt, Human
uaugacuucauuaaua

SEQ ID NO: 1691662 - RNA, 21 nt, Human
uaggugaucucauuuaauccu

SEQ ID NO: 1691663 - RNA, 16 nt, Human
uauaugugaugaucua

SEQ ID NO: 1691664 - RNA, 18 nt, Human
uauauaaaugguuaaaag

SEQ ID NO: 1691665 - RNA, 22 nt, Human
uauaucugaggaauucuguaua

SEQ ID NO: 1691666 - RNA, 21 nt, Human
uauaucugaggaauucuguau

SEQ ID NO: 1691667 - RNA, 20 nt, Human
uauaucugaggaauucugua

SEQ ID NO: 1691668 - RNA, 19 nt, Human
uauaucugaggaauucugu

SEQ ID NO: 1691669 - RNA, 18 nt, Human
uauaucugaggaauucug

SEQ ID NO: 1691670 - RNA, 23 nt, Human
uauaaaucgcuuuugauaaucaa

SEQ ID NO: 1691671 - RNA, 22 nt, Human
uauaauuaacauguuaaaccau

SEQ ID NO: 1691672 - RNA, 20 nt, Human
uauaaucacuuuuuuccaca

SEQ ID NO: 1691673 - RNA, 12 nt, Human
uauaauuaacau

SEQ ID NO: 1691674 - RNA, 14 nt, Human
uauaauuaacaugu

SEQ ID NO: 1691675 - RNA, 13 nt, Human
uauaauuaacaug

SEQ ID NO: 1691676 - RNA, 19 nt, Human
uauaauuaacauguuaaac

SEQ ID NO: 1691677 - RNA, 18 nt, Human
uauaauuaacauguuaaa

SEQ ID NO: 1691678 - RNA, 16 nt, Human
uauaauuaacauguua

SEQ ID NO: 1691679 - RNA, 15 nt, Human
uauaauuaacauguu

SEQ ID NO: 1691680 - RNA, 13 nt, Human
ucaauaaaaaauu

SEQ ID NO: 1691681 - RNA, 16 nt, Human
ucaauaaaaaauuaug

SEQ ID NO: 1691682 - RNA, 14 nt, Human
ucaauaaaaaauua

SEQ ID NO: 1691683 - RNA, 18 nt, Human
ucacauugguguuguacu

SEQ ID NO: 1691684 - RNA, 19 nt, Human
ucaauaaaaaauuaugaca

SEQ ID NO: 1691685 - RNA, 23 nt, Human
uauugugcgcuaaacuuuucuga

SEQ ID NO: 1691686 - RNA, 22 nt, Human
uauugugcgcuaaacuuuucug

SEQ ID NO: 1691687 - RNA, 19 nt, Human
uauugugcgcuaaacuuuu

SEQ ID NO: 1691688 - RNA, 22 nt, Human
uauuauguaaaucccauuauuc

SEQ ID NO: 1691689 - RNA, 15 nt, Human
uauuauguaaauccc

SEQ ID NO: 1691690 - RNA, 12 nt, Human
uauuauguaaau

SEQ ID NO: 1691691 - RNA, 22 nt, Human
uauuaugaaacuuguguaaaua

SEQ ID NO: 1691692 - RNA, 21 nt, Human
uauuaugaaacuuguguaaau

SEQ ID NO: 1691693 - RNA, 20 nt, Human
uauuaugaaacuuguguaaa

SEQ ID NO: 1691694 - RNA, 12 nt, Human
uauuaugaaacu

SEQ ID NO: 1691695 - RNA, 16 nt, Human
uauuaagcauauauuu

SEQ ID NO: 1691696 - RNA, 22 nt, Human
ucauggaacgcguugaaauugu

SEQ ID NO: 1691697 - RNA, 21 nt, Human
ucauggaacgcguugaaauug

SEQ ID NO: 1691698 - RNA, 20 nt, Human
ucauggaacgcguugaaauu

SEQ ID NO: 1691699 - RNA, 23 nt, Human
ucaguauugaagcauuuuauaaa

SEQ ID NO: 1691700 - RNA, 17 nt, Human
uccaguuuuguuuggac

SEQ ID NO: 1691701 - RNA, 15 nt, Human
uccaguuuuguuugg

SEQ ID NO: 1691702 - RNA, 20 nt, Human
uccaguuuuguuuggaccaa

SEQ ID NO: 1691703 - RNA, 17 nt, Human
uccagcagauuauucac

SEQ ID NO: 1691704 - RNA, 16 nt, Human
uccagcagauuauuca

SEQ ID NO: 1691705 - RNA, 15 nt, Human
uccagcagauuauuc

SEQ ID NO: 1691706 - RNA, 14 nt, Human
uccagcagauuauu

SEQ ID NO: 1691707 - RNA, 19 nt, Human
ucccauuauucaaaguugc

SEQ ID NO: 1691708 - RNA, 18 nt, Human
ucccauuauucaaaguug

SEQ ID NO: 1691709 - RNA, 16 nt, Human
ucccauuauucaaagu

SEQ ID NO: 1691710 - RNA, 14 nt, Human
ucccauuauucaaa

SEQ ID NO: 1691711 - RNA, 13 nt, Human
ucccauuauucaa

SEQ ID NO: 1691712 - RNA, 20 nt, Human
uccuaucaccugucuugccu

SEQ ID NO: 1691713 - RNA, 16 nt, Human
ugacauagucuggcug

SEQ ID NO: 1691714 - RNA, 17 nt, Human
ugacauagucuggcugu

SEQ ID NO: 1691715 - RNA, 23 nt, Human
ugaagucagaucugccuaaggac

SEQ ID NO: 1691716 - RNA, 20 nt, Human
ugaagucagaucugccuaag

SEQ ID NO: 1691717 - RNA, 13 nt, Human
ugaagugaaacug

SEQ ID NO: 1691718 - RNA, 14 nt, Human
ugaagugaaacugc

SEQ ID NO: 1691719 - RNA, 17 nt, Human
ucuugccuuuuucauua

SEQ ID NO: 1691720 - RNA, 16 nt, Human
ucuugccuuuuucauu

SEQ ID NO: 1691721 - RNA, 19 nt, Human
ucuugccuuuuucauuauu

SEQ ID NO: 1691722 - RNA, 16 nt, Human
ugagcaucacaguuuu

SEQ ID NO: 1691723 - RNA, 14 nt, Human
ugagcaucacaguu

SEQ ID NO: 1691724 - RNA, 15 nt, Human
ugagcaucacaguuu

SEQ ID NO: 1691725 - RNA, 15 nt, Human
ugaucucauuuaauc

SEQ ID NO: 1691726 - RNA, 22 nt, Human
ugaucucauuuaauccucucaa

SEQ ID NO: 1691727 - RNA, 15 nt, Human
ugauagaggaagccu

SEQ ID NO: 1691728 - RNA, 21 nt, Human
ugauucuucagcaaaaauauu

SEQ ID NO: 1691729 - RNA, 20 nt, Human
ugcugggguuaucugaaguc

SEQ ID NO: 1691730 - RNA, 17 nt, Human
ugcugggguuaucugaa

SEQ ID NO: 1691731 - RNA, 13 nt, Human
ugcugguguaugu

SEQ ID NO: 1691732 - RNA, 22 nt, Human
ugcugguguaugugugaaguga

SEQ ID NO: 1691733 - RNA, 21 nt, Human
ugcgcuaaacuuuucugauag

SEQ ID NO: 1691734 - RNA, 20 nt, Human
ugcgcuaaacuuuucugaua

SEQ ID NO: 1691735 - RNA, 19 nt, Human
ugcgcuaaacuuuucugau

SEQ ID NO: 1691736 - RNA, 20 nt, Human
ugcauaggugaucucauuua

SEQ ID NO: 1691737 - RNA, 23 nt, Human
ugccucacccacccuuuuuuaaa

SEQ ID NO: 1691738 - RNA, 20 nt, Human
ugccucacccacccuuuuuu

SEQ ID NO: 1691739 - RNA, 23 nt, Human
ugccuaaauccauuuggaaaucu

SEQ ID NO: 1691740 - RNA, 22 nt, Human
ugccuaaauccauuuggaaauc

SEQ ID NO: 1691741 - RNA, 20 nt, Human
ugccuaaauccauuuggaaa

SEQ ID NO: 1691742 - RNA, 19 nt, Human
ugccuaaauccauuuggaa

SEQ ID NO: 1691743 - RNA, 15 nt, Human
ugccuaaauccauuu

SEQ ID NO: 1691744 - RNA, 13 nt, Human
ugccuaaauccau

SEQ ID NO: 1691745 - RNA, 20 nt, Human
ugguccgugcuaaggacuug

SEQ ID NO: 1691746 - RNA, 19 nt, Human
ugguccgugcuaaggacuu

SEQ ID NO: 1691747 - RNA, 18 nt, Human
ugguccgugcuaaggacu

SEQ ID NO: 1691748 - RNA, 17 nt, Human
ugguccgugcuaaggac

SEQ ID NO: 1691749 - RNA, 19 nt, Human
uggugacugauucuucagc

SEQ ID NO: 1691750 - RNA, 16 nt, Human
uggugacugauucuuc

SEQ ID NO: 1691751 - RNA, 15 nt, Human
uggugacugauucuu

SEQ ID NO: 1691752 - RNA, 20 nt, Human
uggauaauaaggaaaaguuu

SEQ ID NO: 1691753 - RNA, 22 nt, Human
uggaccaaaaaccaguauugua

SEQ ID NO: 1691754 - RNA, 17 nt, Human
uggaccaaaaaccagua

SEQ ID NO: 1691755 - RNA, 15 nt, Human
uuaauaucaucagua

SEQ ID NO: 1691756 - RNA, 22 nt, Human
uuaauauuaaagccauguuuau

SEQ ID NO: 1691757 - RNA, 21 nt, Human
uuaauauuaaagccauguuua

SEQ ID NO: 1691758 - RNA, 23 nt, Human
uuaagcauauauuuuuauauuua

SEQ ID NO: 1691759 - RNA, 19 nt, Human
uuaagcauauauuuuuaua

SEQ ID NO: 1691760 - RNA, 18 nt, Human
uuaagcauauauuuuuau

SEQ ID NO: 1691761 - RNA, 15 nt, Human
uuaagcauauauuuu

SEQ ID NO: 1691762 - RNA, 13 nt, Human
uuaagcauauauu

SEQ ID NO: 1691763 - RNA, 16 nt, Human
uuagcuacuauauaug

SEQ ID NO: 1691764 - RNA, 14 nt, Human
uuagaucuaguuca

SEQ ID NO: 1691765 - RNA, 13 nt, Human
uuagaucuaguuc

SEQ ID NO: 1691766 - RNA, 12 nt, Human
uuagagauuuuu

SEQ ID NO: 1691767 - RNA, 18 nt, Human
uuagagaguguugaaacg

SEQ ID NO: 1691768 - RNA, 17 nt, Human
uuagagaguguugaaac

SEQ ID NO: 1691769 - RNA, 16 nt, Human
uuagagaguguugaaa

SEQ ID NO: 1691770 - RNA, 14 nt, Human
uuagagaguguuga

SEQ ID NO: 1691771 - RNA, 12 nt, Human
uucccuggccuu

SEQ ID NO: 1691772 - RNA, 16 nt, Human
uucccuggccuuucau

SEQ ID NO: 1691773 - RNA, 17 nt, Human
uucccuggccuuucaua

SEQ ID NO: 1691774 - RNA, 14 nt, Human
uuauuacaguauaa

SEQ ID NO: 1691775 - RNA, 14 nt, Human
uuaugcuuuaaaca

SEQ ID NO: 1691776 - RNA, 13 nt, Human
uuaugcuuuaaac

SEQ ID NO: 1691777 - RNA, 17 nt, Human
uuaucugaagucagauc

SEQ ID NO: 1691778 - RNA, 22 nt, Human
uuauuggcuuuucugauccagu

SEQ ID NO: 1691779 - RNA, 18 nt, Human
uuauuggcuuuucugauc

SEQ ID NO: 1691780 - RNA, 16 nt, Human
uuauuggcuuuucuga

SEQ ID NO: 1691781 - RNA, 12 nt, Human
uuauuggcuuuu

SEQ ID NO: 1691782 - RNA, 13 nt, Human
uuauuuuauuaug

SEQ ID NO: 1691783 - RNA, 23 nt, Human
uucaaaguugccuaaauccauuu

SEQ ID NO: 1691784 - RNA, 17 nt, Human
uucaaaguugccuaaau

SEQ ID NO: 1691785 - RNA, 16 nt, Human
uucaaaguugccuaaa

SEQ ID NO: 1691786 - RNA, 15 nt, Human
uucaaaguugccuaa

SEQ ID NO: 1691787 - RNA, 11 nt, Human
uucaaaguugc

SEQ ID NO: 1691788 - RNA, 23 nt, Human
uucagauaacuguuauuuauaau

SEQ ID NO: 1691789 - RNA, 18 nt, Human
uucagauaacuguuauuu

SEQ ID NO: 1691790 - RNA, 17 nt, Human
uucagauaacuguuauu

SEQ ID NO: 1691791 - RNA, 21 nt, Human
uucacucuccauuuaauaauu

SEQ ID NO: 1691792 - RNA, 20 nt, Human
uuugauaaucaacugggcug

SEQ ID NO: 1691793 - RNA, 13 nt, Human
uuucuuaaauaau

SEQ ID NO: 1691794 - RNA, 12 nt, Human
uuucuuaaauaa

SEQ ID NO: 1691795 - RNA, 17 nt, Human
uuugguugcuuuaauau

SEQ ID NO: 1691796 - RNA, 18 nt, Human
uuugauaaucaacugggc

SEQ ID NO: 1691797 - RNA, 16 nt, Human
uuuaugcuuuaaacau

SEQ ID NO: 1691798 - RNA, 15 nt, Human
uuuaugcuuuaaaca

SEQ ID NO: 1691799 - RNA, 12 nt, Human
uuuaugcuuuaa

SEQ ID NO: 1691800 - RNA, 13 nt, Human
uuucugauccagu

SEQ ID NO: 1691801 - RNA, 22 nt, Human
uuucugauccaguuuuguuugg

SEQ ID NO: 1691802 - RNA, 20 nt, Human
uuucugauccaguuuuguuu

SEQ ID NO: 1691803 - RNA, 16 nt, Human
uuucugauccaguuuu

SEQ ID NO: 1691804 - RNA, 15 nt, Human
uuucugauccaguuu

SEQ ID NO: 1691805 - RNA, 20 nt, Human
uuuaugacuucauuaauaau

SEQ ID NO: 1691806 - RNA, 19 nt, Human
uuuauaaaucgcuuuugau

SEQ ID NO: 1691807 - RNA, 22 nt, Human
uuuauaaaucgcuuuugauaau

SEQ ID NO: 1691808 - RNA, 18 nt, Human
uuuauaaaucgcuuuuga

SEQ ID NO: 1691809 - RNA, 15 nt, Human
uuuauaaaucgcuuu

SEQ ID NO: 1691810 - RNA, 14 nt, Human
uuuaauauuaaagc

SEQ ID NO: 1691811 - RNA, 21 nt, Human
uuuaauauuaaagccauguuu

SEQ ID NO: 1691812 - RNA, 20 nt, Human
uuuaauauuaaagccauguu

SEQ ID NO: 1691813 - RNA, 17 nt, Human
uuuaauauuaaagccau

SEQ ID NO: 1691814 - RNA, 15 nt, Human
uuuaauauuaaagcc

SEQ ID NO: 1691815 - RNA, 14 nt, Human
uuuaauaauuauau

SEQ ID NO: 1691816 - RNA, 14 nt, Human
uuguuuguuuaguc

SEQ ID NO: 1691817 - RNA, 13 nt, Human
uuguuuguuuagu

SEQ ID NO: 1691818 - RNA, 14 nt, Human
uuguuucuguacuu

SEQ ID NO: 1691819 - RNA, 12 nt, Human
uuguuucuguac

SEQ ID NO: 1691820 - RNA, 18 nt, Human
uuggcauaacauaaaucu

SEQ ID NO: 1691821 - RNA, 23 nt, Human
uuggcauaacauaaaucugugaa

SEQ ID NO: 1691822 - RNA, 22 nt, Human
uuggcauaacauaaaucuguga

SEQ ID NO: 1691823 - RNA, 20 nt, Human
uuggcauaacauaaaucugu

SEQ ID NO: 1691824 - RNA, 19 nt, Human
uuggcauaacauaaaucug

SEQ ID NO: 1691825 - RNA, 17 nt, Human
uugccuuuuucauuauu

SEQ ID NO: 1691826 - RNA, 16 nt, Human
uugccuuuuucauuau

SEQ ID NO: 1691827 - RNA, 15 nt, Human
uugccuuuuucauua

SEQ ID NO: 1691828 - RNA, 14 nt, Human
uugccuuuuucauu

SEQ ID NO: 1691829 - RNA, 13 nt, Human
uugccuuuuucau

SEQ ID NO: 1691830 - RNA, 12 nt, Human
uugccuuuuuca

SEQ ID NO: 1691831 - RNA, 22 nt, Human
uugaagcauuuuauaaaucgcu

SEQ ID NO: 1691832 - RNA, 17 nt, Human
uugaagcauuuuauaaa

SEQ ID NO: 1691833 - RNA, 15 nt, Human
uugaagcauuuuaua

SEQ ID NO: 1691834 - RNA, 14 nt, Human
uugaagcauuuuau

SEQ ID NO: 1691835 - RNA, 13 nt, Human
uugaagcauuuua

SEQ ID NO: 1691836 - RNA, 20 nt, Human
uugaaacggaugauuucuau

SEQ ID NO: 1691837 - RNA, 12 nt, Human
uucuuuaauuuu

SEQ ID NO: 1691838 - RNA, 18 nt, Human
uucuuuaauuuuggaauu

SEQ ID NO: 1691839 - RNA, 17 nt, Human
uucuuuaauuuuggaau

SEQ ID NO: 1691840 - RNA, 19 nt, Human
uugaaacggaugauuucua

SEQ ID NO: 1691841 - RNA, 16 nt, Human
uugaaacggaugauuu

SEQ ID NO: 1691842 - RNA, 11 nt, Human
uucuguauaga

SEQ ID NO: 1691843 - RNA, 13 nt, Human
uucuguauagauu

SEQ ID NO: 1691844 - RNA, 14 nt, Human
uucuguauagauua

SEQ ID NO: 1691845 - RNA, 19 nt, Human
uucuuguauuaagaaugaa

SEQ ID NO: 1691846 - RNA, 23 nt, Human
caacagcuggugcccugcuuuca

SEQ ID NO: 1691847 - RNA, 18 nt, Human
augguccgugcuaaggac

SEQ ID NO: 1691848 - RNA, 15 nt, Human
augguccgugcuaag

SEQ ID NO: 1691849 - RNA, 20 nt, Human
augcugaguuugugcuggug

SEQ ID NO: 1691850 - RNA, 19 nt, Human
auggcuuuguauagaaccu

SEQ ID NO: 1691851 - RNA, 13 nt, Human
augcuuuaaacau

SEQ ID NO: 1691852 - RNA, 21 nt, Human
aucucugcaaucuucucagaa

SEQ ID NO: 1691853 - RNA, 18 nt, Human
aucucugcaaucuucuca

SEQ ID NO: 1691854 - RNA, 14 nt, Human
augaagucucugaa

SEQ ID NO: 1691855 - RNA, 21 nt, Human
aucacaguuuugguugcuuua

SEQ ID NO: 1691856 - RNA, 22 nt, Human
aucacaguuuugguugcuuuaa

SEQ ID NO: 1691857 - RNA, 15 nt, Human
aucacaguuuugguu

SEQ ID NO: 1691858 - RNA, 20 nt, Human
aucccauuauucaaaguugc

SEQ ID NO: 1691859 - RNA, 15 nt, Human
aucccauuauucaaa

SEQ ID NO: 1691860 - RNA, 14 nt, Human
aucccauuauucaa

SEQ ID NO: 1691861 - RNA, 17 nt, Human
auaucaucaguauugaa

SEQ ID NO: 1691862 - RNA, 13 nt, Human
auaucaucaguau

SEQ ID NO: 1691863 - RNA, 19 nt, Human
auauauuuuuauauuuacu

SEQ ID NO: 1691864 - RNA, 18 nt, Human
auauauuuuuauauuuac

SEQ ID NO: 1691865 - RNA, 20 nt, Human
auauauuuuuauauuuacua

SEQ ID NO: 1691866 - RNA, 12 nt, Human
agucuguuuuau

SEQ ID NO: 1691867 - RNA, 19 nt, Human
agaucugccuaaggacuuc

SEQ ID NO: 1691868 - RNA, 20 nt, Human
agcacacacuuuugguuaag

SEQ ID NO: 1691869 - RNA, 14 nt, Human
agcacacacuuuug

SEQ ID NO: 1691870 - RNA, 16 nt, Human
agccaaaccucuguga

SEQ ID NO: 1691871 - RNA, 19 nt, Human
agacgaugucuucauaccu

SEQ ID NO: 1691872 - RNA, 17 nt, Human
agacgaugucuucauac

SEQ ID NO: 1691873 - RNA, 20 nt, Human
agaaugaaauacuguuugag

SEQ ID NO: 1691874 - RNA, 19 nt, Human
agaaugaaauacuguuuga

SEQ ID NO: 1691875 - RNA, 16 nt, Human
agaaugaaauacuguu

SEQ ID NO: 1691876 - RNA, 22 nt, Human
aaaaguuuaauauuaaagccau

SEQ ID NO: 1691877 - RNA, 21 nt, Human
aaaaguuuaauauuaaagcca

SEQ ID NO: 1691878 - RNA, 23 nt, Human
aaaaguuuaauauuaaagccaug

SEQ ID NO: 1691879 - RNA, 20 nt, Human
aaaaguuuaauauuaaagcc

SEQ ID NO: 1691880 - RNA, 22 nt, Human
aacuguuauuuauaaucacuuu

SEQ ID NO: 1691881 - RNA, 20 nt, Human
aacuguuauuuauaaucacu

SEQ ID NO: 1691882 - RNA, 17 nt, Human
aacuguuauuuauaauc

SEQ ID NO: 1691883 - RNA, 16 nt, Human
aacuguuauuuauaau

SEQ ID NO: 1691884 - RNA, 15 nt, Human
aacuguuauuuauaa

SEQ ID NO: 1691885 - RNA, 17 nt, Human
aacgcguugaaauugua

SEQ ID NO: 1691886 - RNA, 15 nt, Human
aacgcguugaaauug

SEQ ID NO: 1691887 - RNA, 14 nt, Human
aacgcguugaaauu

SEQ ID NO: 1691888 - RNA, 13 nt, Human
aacgcguugaaau

SEQ ID NO: 1691889 - RNA, 14 nt, Human
aaccaguauuguac

SEQ ID NO: 1691890 - RNA, 13 nt, Human
aaccaguauugua

SEQ ID NO: 1691891 - RNA, 11 nt, Human
aaccaguauug

SEQ ID NO: 1691892 - RNA, 22 nt, Human
aaauuggggauucuuaaaguug

SEQ ID NO: 1691893 - RNA, 20 nt, Human
aaauuggggauucuuaaagu

SEQ ID NO: 1691894 - RNA, 19 nt, Human
aaauuggggauucuuaaag

SEQ ID NO: 1691895 - RNA, 18 nt, Human
aaauuggggauucuuaaa

SEQ ID NO: 1691896 - RNA, 23 nt, Human
aaauuggggauucuuaaaguuga

SEQ ID NO: 1691897 - RNA, 21 nt, Human
aaaucugugaacuugaaauuu

SEQ ID NO: 1691898 - RNA, 19 nt, Human
aaaucugugaacuugaaau

SEQ ID NO: 1691899 - RNA, 20 nt, Human
aaaucugugaacuugaaauu

SEQ ID NO: 1691900 - RNA, 13 nt, Human
aauaauaaagauc

SEQ ID NO: 1691901 - RNA, 21 nt, Human
aauaauaaagaucauguaaaa

SEQ ID NO: 1691902 - RNA, 20 nt, Human
aauauuaaagccauguuuau

SEQ ID NO: 1691903 - RNA, 19 nt, Human
aauauuaaagccauguuua

SEQ ID NO: 1691904 - RNA, 18 nt, Human
aauauuaaagccauguuu

SEQ ID NO: 1691905 - RNA, 16 nt, Human
aauauuaaagccaugu

SEQ ID NO: 1691906 - RNA, 15 nt, Human
aauauuaaagccaug

SEQ ID NO: 1691907 - RNA, 14 nt, Human
aauauuaaagccau

SEQ ID NO: 1691908 - RNA, 13 nt, Human
aauauuaaagcca

SEQ ID NO: 1691909 - RNA, 12 nt, Human
aauacuguuuga

SEQ ID NO: 1691910 - RNA, 22 nt, Human
aauauuaaagccauguuuauua

SEQ ID NO: 1691911 - RNA, 20 nt, Human
aaugguccgugcuaaggacu

SEQ ID NO: 1691912 - RNA, 16 nt, Human
aaggcaaaugacuuug

SEQ ID NO: 1691913 - RNA, 15 nt, Human
aaggcaaaugacuuu

SEQ ID NO: 1691914 - RNA, 14 nt, Human
aaggcaaaugacuu

SEQ ID NO: 1691915 - RNA, 14 nt, Human
accaccuuucagau

SEQ ID NO: 1691916 - RNA, 20 nt, Human
acaauuuuguuucuguacuu

SEQ ID NO: 1691917 - RNA, 11 nt, Human
aauuuuggaau

SEQ ID NO: 1691918 - RNA, 12 nt, Human
aauuuuggaauu

SEQ ID NO: 1691919 - RNA, 23 nt, Human
aauuuauuggcuuuucugaucca

SEQ ID NO: 1691920 - RNA, 21 nt, Human
aauuuauuggcuuuucugauc

SEQ ID NO: 1691921 - RNA, 20 nt, Human
aauuuauuggcuuuucugau

SEQ ID NO: 1691922 - RNA, 19 nt, Human
aauuuauuggcuuuucuga

SEQ ID NO: 1691923 - RNA, 17 nt, Human
aauuuauuggcuuuucu

SEQ ID NO: 1691924 - RNA, 16 nt, Human
aauuggggauucuuaa

SEQ ID NO: 1691925 - RNA, 21 nt, Human
aaugguccgugcuaaggacuu

SEQ ID NO: 1691926 - RNA, 20 nt, Human
aauuggggauucuuaaaguu

SEQ ID NO: 1691927 - RNA, 17 nt, Human
aauuggggauucuuaaa

SEQ ID NO: 1691928 - RNA, 13 nt, Human
acugauucuucag

SEQ ID NO: 1691929 - RNA, 12 nt, Human
acugauucuuca

SEQ ID NO: 1691930 - RNA, 22 nt, Human
acugauucuucagcaaaaauau

SEQ ID NO: 1691931 - RNA, 15 nt, Human
acugauucuucagca

SEQ ID NO: 1691932 - RNA, 22 nt, Human
accugucuugccuuuuucauua

SEQ ID NO: 1691933 - RNA, 21 nt, Human
accugucuugccuuuuucauu

SEQ ID NO: 1691934 - RNA, 19 nt, Human
accugucuugccuuuuuca

SEQ ID NO: 1691935 - RNA, 14 nt, Human
aacuggguuccugc

SEQ ID NO: 1691936 - RNA, 15 nt, Human
aacuggguuccugca

SEQ ID NO: 1691937 - RNA, 15 nt, Human
gugaacuugaaauuu

SEQ ID NO: 1691938 - RNA, 14 nt, Human
gugaacuugaaauu

SEQ ID NO: 1691939 - RNA, 17 nt, Human
aacugcuuguuuccuag

SEQ ID NO: 1691940 - RNA, 16 nt, Human
aacugggcugaacacu

SEQ ID NO: 1691941 - RNA, 14 nt, Human
aacugggcugaaca

SEQ ID NO: 1691942 - RNA, 16 nt, Human
aaccucuuugucuaca

SEQ ID NO: 1691943 - RNA, 15 nt, Human
aaauuguaauuauau

SEQ ID NO: 1691944 - RNA, 14 nt, Human
aaauuguaauuaua

SEQ ID NO: 1691945 - RNA, 11 nt, Human
aaaugguuaaa

SEQ ID NO: 1691946 - RNA, 19 nt, Human
aaaugguuaaaagagguuu

SEQ ID NO: 1691947 - RNA, 13 nt, Human
aaaugguuaaaag

SEQ ID NO: 1691948 - RNA, 10 nt, Human
guauaauuaa

SEQ ID NO: 1691949 - RNA, 20 nt, Human
guuuaauauuaaagccaugu

SEQ ID NO: 1691950 - RNA, 22 nt, Human
guugccuaaauccauuuggaaa

SEQ ID NO: 1691951 - RNA, 20 nt, Human
guuuuucuuaaauaauaaag

SEQ ID NO: 1691952 - RNA, 17 nt, Human
aaguauuaagcauauau

SEQ ID NO: 1691953 - RNA, 16 nt, Human
aaguauuaagcauaua

SEQ ID NO: 1691954 - RNA, 18 nt, Human
aaguauuaagcauauauu

SEQ ID NO: 1691955 - RNA, 15 nt, Human
aaguauuaagcauau

SEQ ID NO: 1691956 - RNA, 21 nt, Human
guuuuucuuaaauaauaaaga

SEQ ID NO: 1691957 - RNA, 17 nt, Human
aagccaaaccucuguga

SEQ ID NO: 1691958 - RNA, 21 nt, Human
aauagcuagacuggugacuga

SEQ ID NO: 1691959 - RNA, 20 nt, Human
aauagcuagacuggugacug

SEQ ID NO: 1691960 - RNA, 14 nt, Human
aauagcuagacugg

SEQ ID NO: 1691961 - RNA, 16 nt, Human
uaacauguuaaaccau

SEQ ID NO: 1691962 - RNA, 15 nt, Human
uaacauguuaaacca

SEQ ID NO: 1691963 - RNA, 12 nt, Human
uaacauguuaaa

SEQ ID NO: 1691964 - RNA, 16 nt, Human
aaucccauuauucaaa

SEQ ID NO: 1691965 - RNA, 14 nt, Human
aaucccauuauuca

SEQ ID NO: 1691966 - RNA, 21 nt, Human
aaucccauuauucaaaguugc

SEQ ID NO: 1691967 - RNA, 21 nt, Human
aauccucucaaccaccuuuca

SEQ ID NO: 1691968 - RNA, 19 nt, Human
uaaggacuuguuagaucua

SEQ ID NO: 1691969 - RNA, 16 nt, Human
uaaggacuuguuagau

SEQ ID NO: 1691970 - RNA, 15 nt, Human
uaaggacuuguuaga

SEQ ID NO: 1691971 - RNA, 13 nt, Human
uaaggacuuguua

SEQ ID NO: 1691972 - RNA, 16 nt, Human
uaagcauauauuuuua

SEQ ID NO: 1691973 - RNA, 13 nt, Human
uaagcauauauuu

SEQ ID NO: 1691974 - RNA, 19 nt, Human
uaaggaaacuggguuccug

SEQ ID NO: 1691975 - RNA, 14 nt, Human
uaaggaaacugggu

SEQ ID NO: 1691976 - RNA, 12 nt, Human
uaaggaaacugg

SEQ ID NO: 1691977 - RNA, 21 nt, Human
uaaggaaaaguuuaauauuaa

SEQ ID NO: 1691978 - RNA, 19 nt, Human
uaaggaaaaguuuaauauu

SEQ ID NO: 1691979 - RNA, 17 nt, Human
uaaggaaaaguuuaaua

SEQ ID NO: 1691980 - RNA, 22 nt, Human
uaaggacuucuuuaauuuugga

SEQ ID NO: 1691981 - RNA, 16 nt, Human
uaaggacuucuuuaau

SEQ ID NO: 1691982 - RNA, 15 nt, Human
uaaggacuucuuuaa

SEQ ID NO: 1691983 - RNA, 14 nt, Human
uaaggacuucuuua

SEQ ID NO: 1691984 - RNA, 23 nt, Human
uaauuauaucugaggaauucugu

SEQ ID NO: 1691985 - RNA, 22 nt, Human
uaauuauaucugaggaauucug

SEQ ID NO: 1691986 - RNA, 21 nt, Human
uaauuauaucugaggaauucu

SEQ ID NO: 1691987 - RNA, 19 nt, Human
uaauuauaucugaggaauu

SEQ ID NO: 1691988 - RNA, 20 nt, Human
uaauuauaugcuauuucuau

SEQ ID NO: 1691989 - RNA, 19 nt, Human
uaauuauaugcuauuucua

SEQ ID NO: 1691990 - RNA, 18 nt, Human
uaauuauaugcuauuucu

SEQ ID NO: 1691991 - RNA, 14 nt, Human
uaauuauaugcuau

SEQ ID NO: 1691992 - RNA, 14 nt, Human
aauuaaguaucuga

SEQ ID NO: 1691993 - RNA, 13 nt, Human
aauuaaguaucug

SEQ ID NO: 1691994 - RNA, 22 nt, Human
acacuuuugguuaagucuguuu

SEQ ID NO: 1691995 - RNA, 13 nt, Human
acacuuuugguua

SEQ ID NO: 1691996 - RNA, 19 nt, Human
uauagauuagaauucugua

SEQ ID NO: 1691997 - RNA, 18 nt, Human
uauagauuagaauucugu

SEQ ID NO: 1691998 - RNA, 21 nt, Human
uaugaaacuuguguaaauaca

SEQ ID NO: 1691999 - RNA, 19 nt, Human
uaugaaacuuguguaaaua

SEQ ID NO: 1692000 - RNA, 14 nt, Human
uaugaaacuugugu

SEQ ID NO: 1692001 - RNA, 23 nt, Human
uaugcuauuucuauauuuucauu

SEQ ID NO: 1692002 - RNA, 22 nt, Human
uaugcuauuucuauauuuucau

SEQ ID NO: 1692003 - RNA, 18 nt, Human
uaugcuauuucuauauuu

SEQ ID NO: 1692004 - RNA, 16 nt, Human
uaugcuauuucuauau

SEQ ID NO: 1692005 - RNA, 15 nt, Human
uaugcuauuucuaua

SEQ ID NO: 1692006 - RNA, 14 nt, Human
uaugcuauuucuau

SEQ ID NO: 1692007 - RNA, 18 nt, Human
uagcacacacuuuugguu

SEQ ID NO: 1692008 - RNA, 18 nt, Human
acaaaguauuaagcauau

SEQ ID NO: 1692009 - RNA, 13 nt, Human
acaaaguauuaag

SEQ ID NO: 1692010 - RNA, 16 nt, Human
acaaaguauuaagcau

SEQ ID NO: 1692011 - RNA, 15 nt, Human
acaaaguauuaagca

SEQ ID NO: 1692012 - RNA, 15 nt, Human
uccaauuaaggauuu

SEQ ID NO: 1692013 - RNA, 17 nt, Human
uccaauuaaggauuuua

SEQ ID NO: 1692014 - RNA, 16 nt, Human
uccaauuaaggauuuu

SEQ ID NO: 1692015 - RNA, 22 nt, Human
uccacauaaggaaacuggguuc

SEQ ID NO: 1692016 - RNA, 20 nt, Human
acgcguugaaauuguaauua

SEQ ID NO: 1692017 - RNA, 18 nt, Human
acgcguugaaauuguaau

SEQ ID NO: 1692018 - RNA, 14 nt, Human
acgcguugaaauug

SEQ ID NO: 1692019 - RNA, 13 nt, Human
acgcguugaaauu

SEQ ID NO: 1692020 - RNA, 15 nt, Human
acggaugauuucuau

SEQ ID NO: 1692021 - RNA, 12 nt, Human
uccauuuaauaa

SEQ ID NO: 1692022 - RNA, 20 nt, Human
uccauuuggaaaucuuuaaa

SEQ ID NO: 1692023 - RNA, 19 nt, Human
uccauuuggaaaucuuuaa

SEQ ID NO: 1692024 - RNA, 12 nt, Human
uccauuuggaaa

SEQ ID NO: 1692025 - RNA, 17 nt, Human
uccauuuaauaauuaua

SEQ ID NO: 1692026 - RNA, 18 nt, Human
uccgugcuaaggacuugu

SEQ ID NO: 1692027 - RNA, 17 nt, Human
uccgugcuaaggacuug

SEQ ID NO: 1692028 - RNA, 16 nt, Human
uccgugcuaaggacuu

SEQ ID NO: 1692029 - RNA, 23 nt, Human
uccgugcuaaggacuuguuagau

SEQ ID NO: 1692030 - RNA, 15 nt, Human
uauuuguuugcauag

SEQ ID NO: 1692031 - RNA, 15 nt, Human
ucaaaguugccuaaa

SEQ ID NO: 1692032 - RNA, 12 nt, Human
acauguauuugu

SEQ ID NO: 1692033 - RNA, 16 nt, Human
acauguauuuguuugc

SEQ ID NO: 1692034 - RNA, 23 nt, Human
acauugguucuuguauuaagaau

SEQ ID NO: 1692035 - RNA, 22 nt, Human
acauugguucuuguauuaagaa

SEQ ID NO: 1692036 - RNA, 21 nt, Human
acauugguucuuguauuaaga

SEQ ID NO: 1692037 - RNA, 18 nt, Human
acauugguucuuguauua

SEQ ID NO: 1692038 - RNA, 16 nt, Human
acauugguucuuguau

SEQ ID NO: 1692039 - RNA, 14 nt, Human
acauugguucuugu

SEQ ID NO: 1692040 - RNA, 23 nt, Human
acauugguguuguacucaauuuu

SEQ ID NO: 1692041 - RNA, 22 nt, Human
acauugguguuguacucaauuu

SEQ ID NO: 1692042 - RNA, 16 nt, Human
acauugguguuguacu

SEQ ID NO: 1692043 - RNA, 14 nt, Human
acauugguguugua

SEQ ID NO: 1692044 - RNA, 13 nt, Human
accaaaaaccagu

SEQ ID NO: 1692045 - RNA, 12 nt, Human
accaaaaaccag

SEQ ID NO: 1692046 - RNA, 13 nt, Human
ucagaucugccua

SEQ ID NO: 1692047 - RNA, 20 nt, Human
ucagaucugccuaaggacuu

SEQ ID NO: 1692048 - RNA, 18 nt, Human
ucagaucugccuaaggac

SEQ ID NO: 1692049 - RNA, 15 nt, Human
ucagaucugccuaag

SEQ ID NO: 1692050 - RNA, 18 nt, Human
accaugggauaaaugcca

SEQ ID NO: 1692051 - RNA, 17 nt, Human
accaugggauaaaugcc

SEQ ID NO: 1692052 - RNA, 18 nt, Human
ucaguauugaagcauuuu

SEQ ID NO: 1692053 - RNA, 17 nt, Human
ucaguauugaagcauuu

SEQ ID NO: 1692054 - RNA, 16 nt, Human
ucaguauugaagcauu

SEQ ID NO: 1692055 - RNA, 15 nt, Human
ucaguauugaagcau

SEQ ID NO: 1692056 - RNA, 14 nt, Human
ucaguauugaagca

SEQ ID NO: 1692057 - RNA, 22 nt, Human
ucaguauugaagcauuuuauaa

SEQ ID NO: 1692058 - RNA, 19 nt, Human
ucaguauugaagcauuuua

SEQ ID NO: 1692059 - RNA, 19 nt, Human
ucuaguucacucuccauuu

SEQ ID NO: 1692060 - RNA, 16 nt, Human
ucuaguucacucucca

SEQ ID NO: 1692061 - RNA, 12 nt, Human
ucuaguucacuc

SEQ ID NO: 1692062 - RNA, 17 nt, Human
acuucauuaauaauaaa

SEQ ID NO: 1692063 - RNA, 16 nt, Human
acuugaaauuugaauu

SEQ ID NO: 1692064 - RNA, 16 nt, Human
acugggcugaacacuc

SEQ ID NO: 1692065 - RNA, 21 nt, Human
acugggcugaacacuccaauu

SEQ ID NO: 1692066 - RNA, 22 nt, Human
acuuugugcugggguuaucuga

SEQ ID NO: 1692067 - RNA, 17 nt, Human
agaaauuaaguaucuga

SEQ ID NO: 1692068 - RNA, 13 nt, Human
agaaauuaaguau

SEQ ID NO: 1692069 - RNA, 22 nt, Human
ucugaagugaaacugcuuguuu

SEQ ID NO: 1692070 - RNA, 18 nt, Human
ucugaagugaaacugcuu

SEQ ID NO: 1692071 - RNA, 21 nt, Human
agaagccccacccugccucac

SEQ ID NO: 1692072 - RNA, 15 nt, Human
ugaaacggaugauuu

SEQ ID NO: 1692073 - RNA, 23 nt, Human
ugaaacuuguguaaauacaauuu

SEQ ID NO: 1692074 - RNA, 17 nt, Human
ugaaacuuguguaaaua

SEQ ID NO: 1692075 - RNA, 20 nt, Human
ugaaacggaugauuucuaug

SEQ ID NO: 1692076 - RNA, 19 nt, Human
ugaaacggaugauuucuau

SEQ ID NO: 1692077 - RNA, 18 nt, Human
ugaaacggaugauuucua

SEQ ID NO: 1692078 - RNA, 17 nt, Human
ugaaacggaugauuucu

SEQ ID NO: 1692079 - RNA, 14 nt, Human
ugaagcauuuuaua

SEQ ID NO: 1692080 - RNA, 22 nt, Human
ugaagcauuuuauaaaucgcuu

SEQ ID NO: 1692081 - RNA, 18 nt, Human
ugaagcauuuuauaaauc

SEQ ID NO: 1692082 - RNA, 17 nt, Human
ugaagcauuuuauaaau

SEQ ID NO: 1692083 - RNA, 16 nt, Human
ugaagcauuuuauaaa

SEQ ID NO: 1692084 - RNA, 15 nt, Human
ugaagcauuuuauaa

SEQ ID NO: 1692085 - RNA, 22 nt, Human
ugaauggcuuuguauagaaccu

SEQ ID NO: 1692086 - RNA, 19 nt, Human
ugaauggcuuuguauagaa

SEQ ID NO: 1692087 - RNA, 18 nt, Human
ugaauggcuuuguauaga

SEQ ID NO: 1692088 - RNA, 17 nt, Human
ugaauggcuuuguauag

SEQ ID NO: 1692089 - RNA, 11 nt, Human
ugaauggcuuu

SEQ ID NO: 1692090 - RNA, 15 nt, Human
ugaauggcuuuguau

SEQ ID NO: 1692091 - RNA, 12 nt, Human
ugaauggcuuug

SEQ ID NO: 1692092 - RNA, 20 nt, Human
agauaacuguuauuuauaau

SEQ ID NO: 1692093 - RNA, 19 nt, Human
agauaacuguuauuuauaa

SEQ ID NO: 1692094 - RNA, 16 nt, Human
agauaacuguuauuua

SEQ ID NO: 1692095 - RNA, 14 nt, Human
agauacuggauugu

SEQ ID NO: 1692096 - RNA, 17 nt, Human
agauacuggauuguacu

SEQ ID NO: 1692097 - RNA, 21 nt, Human
ugaauuuuguguuagagauuu

SEQ ID NO: 1692098 - RNA, 17 nt, Human
ugaauuuuguguuagag

SEQ ID NO: 1692099 - RNA, 20 nt, Human
agauuuuauuauguaaaucc

SEQ ID NO: 1692100 - RNA, 19 nt, Human
agauuuuauuauguaaauc

SEQ ID NO: 1692101 - RNA, 18 nt, Human
agauuuuauuauguaaau

SEQ ID NO: 1692102 - RNA, 17 nt, Human
agauuuuauuauguaaa

SEQ ID NO: 1692103 - RNA, 16 nt, Human
agauuuuauuauguaa

SEQ ID NO: 1692104 - RNA, 15 nt, Human
agauuuuauuaugua

SEQ ID NO: 1692105 - RNA, 14 nt, Human
agauuuuauuaugu

SEQ ID NO: 1692106 - RNA, 16 nt, Human
agauuuuuuuguuguu

SEQ ID NO: 1692107 - RNA, 15 nt, Human
agauuuuuuuguugu

SEQ ID NO: 1692108 - RNA, 23 nt, Human
agauuuuuuuguuguuuguuuag

SEQ ID NO: 1692109 - RNA, 19 nt, Human
agauuuuuuuguuguuugu

SEQ ID NO: 1692110 - RNA, 18 nt, Human
agauuuuuuuguuguuug

SEQ ID NO: 1692111 - RNA, 15 nt, Human
agcaucacaguuuug

SEQ ID NO: 1692112 - RNA, 17 nt, Human
agcaucacaguuuuggu

SEQ ID NO: 1692113 - RNA, 24 nt, Human
ugauaaucaacugggcugaacacu

SEQ ID NO: 1692114 - RNA, 18 nt, Human
ugauaaucaacugggcug

SEQ ID NO: 1692115 - RNA, 14 nt, Human
ugauaaucaacugg

SEQ ID NO: 1692116 - RNA, 15 nt, Human
ugagguuuuuaagcc

SEQ ID NO: 1692117 - RNA, 21 nt, Human
ugauccagcagauuauucacu

SEQ ID NO: 1692118 - RNA, 22 nt, Human
ugauccagcagauuauucacug

SEQ ID NO: 1692119 - RNA, 22 nt, Human
ugauccaguuuuguuuggacca

SEQ ID NO: 1692120 - RNA, 14 nt, Human
agccauguuuauua

SEQ ID NO: 1692121 - RNA, 13 nt, Human
agccauguuuauu

SEQ ID NO: 1692122 - RNA, 16 nt, Human
agccauguuuauuaca

SEQ ID NO: 1692123 - RNA, 17 nt, Human
agccauguuuauuacag

SEQ ID NO: 1692124 - RNA, 20 nt, Human
ugccaaguuguuugagaaau

SEQ ID NO: 1692125 - RNA, 19 nt, Human
ugccaaguuguuugagaaa

SEQ ID NO: 1692126 - RNA, 15 nt, Human
ugccaaguuguuuga

SEQ ID NO: 1692127 - RNA, 13 nt, Human
agcuagacuggug

SEQ ID NO: 1692128 - RNA, 21 nt, Human
agcuagacuggugacugauuc

SEQ ID NO: 1692129 - RNA, 17 nt, Human
agcuagacuggugacug

SEQ ID NO: 1692130 - RNA, 16 nt, Human
agcuagacuggugacu

SEQ ID NO: 1692131 - RNA, 14 nt, Human
agcuagacugguga

SEQ ID NO: 1692132 - RNA, 21 nt, Human
aggaagccugauuaaagaaug

SEQ ID NO: 1692133 - RNA, 18 nt, Human
aggaagccugauuaaaga

SEQ ID NO: 1692134 - RNA, 17 nt, Human
aggaagccugauuaaag

SEQ ID NO: 1692135 - RNA, 23 nt, Human
aggaauggagccugcacggugaa

SEQ ID NO: 1692136 - RNA, 22 nt, Human
ugcuaaggacuuguuagaucua

SEQ ID NO: 1692137 - RNA, 18 nt, Human
ugcuaaggacuuguuaga

SEQ ID NO: 1692138 - RNA, 13 nt, Human
ugcuaaggacuug

SEQ ID NO: 1692139 - RNA, 12 nt, Human
ugcuaaggacuu

SEQ ID NO: 1692140 - RNA, 22 nt, Human
uggcauaacauaaaucugugaa

SEQ ID NO: 1692141 - RNA, 21 nt, Human
uggcauaacauaaaucuguga

SEQ ID NO: 1692142 - RNA, 18 nt, Human
aggcaaaugacuuuggac

SEQ ID NO: 1692143 - RNA, 15 nt, Human
aggcaaaugacuuug

SEQ ID NO: 1692144 - RNA, 14 nt, Human
aggcaaaugacuuu

SEQ ID NO: 1692145 - RNA, 16 nt, Human
uggacuguggugacuu

SEQ ID NO: 1692146 - RNA, 15 nt, Human
uggacuguggugacu

SEQ ID NO: 1692147 - RNA, 22 nt, Human
uggacuguggugacuuuggaua

SEQ ID NO: 1692148 - RNA, 21 nt, Human
uggacuguggugacuuuggau

SEQ ID NO: 1692149 - RNA, 19 nt, Human
uggacuguggugacuuugg

SEQ ID NO: 1692150 - RNA, 17 nt, Human
uggacuguggugacuuu

SEQ ID NO: 1692151 - RNA, 15 nt, Human
uggaaaucuuuaaaa

SEQ ID NO: 1692152 - RNA, 14 nt, Human
uggaaaucuuuaaa

SEQ ID NO: 1692153 - RNA, 19 nt, Human
ugggcugaacacuccaauu

SEQ ID NO: 1692154 - RNA, 17 nt, Human
ugggcugaacacuccaa

SEQ ID NO: 1692155 - RNA, 17 nt, Human
uguacuuuuuggcauaa

SEQ ID NO: 1692156 - RNA, 16 nt, Human
uguacuuuuuggcaua

SEQ ID NO: 1692157 - RNA, 15 nt, Human
uguacuuuuuggcau

SEQ ID NO: 1692158 - RNA, 12 nt, Human
uguacuuuuugg

SEQ ID NO: 1692159 - RNA, 14 nt, Human
agguuuuuaagccu

SEQ ID NO: 1692160 - RNA, 13 nt, Human
uguaauuauaucu

SEQ ID NO: 1692161 - RNA, 15 nt, Human
uguaauuauaucuga

SEQ ID NO: 1692162 - RNA, 14 nt, Human
uguaauuauaucug

SEQ ID NO: 1692163 - RNA, 22 nt, Human
uguaaaucccauuauucaaagu

SEQ ID NO: 1692164 - RNA, 20 nt, Human
uguaaaucccauuauucaaa

SEQ ID NO: 1692165 - RNA, 19 nt, Human
uguaaaucccauuauucaa

SEQ ID NO: 1692166 - RNA, 18 nt, Human
uguaaaucccauuauuca

SEQ ID NO: 1692167 - RNA, 16 nt, Human
uguaaaucccauuauu

SEQ ID NO: 1692168 - RNA, 13 nt, Human
uguaaaucccauu

SEQ ID NO: 1692169 - RNA, 17 nt, Human
uguggugacuuuggaua

SEQ ID NO: 1692170 - RNA, 16 nt, Human
uguggugacuuuggau

SEQ ID NO: 1692171 - RNA, 20 nt, Human
uguuuagucuugucucagau

SEQ ID NO: 1692172 - RNA, 19 nt, Human
uguuuagucuugucucaga

SEQ ID NO: 1692173 - RNA, 18 nt, Human
uguuuagucuugucucag

SEQ ID NO: 1692174 - RNA, 17 nt, Human
uguuuagucuugucuca

SEQ ID NO: 1692175 - RNA, 13 nt, Human
uguuuagucuugu

SEQ ID NO: 1692176 - RNA, 24 nt, Human
aguucacucuccauuuaauaauua

SEQ ID NO: 1692177 - RNA, 22 nt, Human
aguucacucuccauuuaauaau

SEQ ID NO: 1692178 - RNA, 21 nt, Human
aguguugaaacggaugauuuc

SEQ ID NO: 1692179 - RNA, 21 nt, Human
uguuauuuauaaucacuuuuu

SEQ ID NO: 1692180 - RNA, 18 nt, Human
uguuauuuauaaucacuu

SEQ ID NO: 1692181 - RNA, 19 nt, Human
aguugccuaaauccauuug

SEQ ID NO: 1692182 - RNA, 17 nt, Human
aguugccuaaauccauu

SEQ ID NO: 1692183 - RNA, 16 nt, Human
aguugccuaaauccau

SEQ ID NO: 1692184 - RNA, 15 nt, Human
aguugccuaaaucca

SEQ ID NO: 1692185 - RNA, 11 nt, Human
aguugccuaaa

SEQ ID NO: 1692186 - RNA, 15 nt, Human
uuaagucuguuuuau

SEQ ID NO: 1692187 - RNA, 14 nt, Human
uuaagucuguuuua

SEQ ID NO: 1692188 - RNA, 17 nt, Human
uuaaguaucugacaucu

SEQ ID NO: 1692189 - RNA, 22 nt, Human
aguuuugguugcuuuaauauca

SEQ ID NO: 1692190 - RNA, 21 nt, Human
aguuuugguugcuuuaauauc

SEQ ID NO: 1692191 - RNA, 15 nt, Human
aguuuugguugcuuu

SEQ ID NO: 1692192 - RNA, 22 nt, Human
auaaauagcuagacuggugacu

SEQ ID NO: 1692193 - RNA, 22 nt, Human
auaacuguuauuuauaaucacu

SEQ ID NO: 1692194 - RNA, 20 nt, Human
auaacuguuauuuauaauca

SEQ ID NO: 1692195 - RNA, 18 nt, Human
auaacuguuauuuauaau

SEQ ID NO: 1692196 - RNA, 22 nt, Human
auaaauucccuggccuuucaua

SEQ ID NO: 1692197 - RNA, 21 nt, Human
auaaauucccuggccuuucau

SEQ ID NO: 1692198 - RNA, 23 nt, Human
auaauaaauucccuggccuuuca

SEQ ID NO: 1692199 - RNA, 15 nt, Human
uuugucuacaccauu

SEQ ID NO: 1692200 - RNA, 13 nt, Human
uuuguuucuguac

SEQ ID NO: 1692201 - RNA, 12 nt, Human
uuuguuucugua

SEQ ID NO: 1692202 - RNA, 18 nt, Human
uuuguuucuguacuuuuu

SEQ ID NO: 1692203 - RNA, 19 nt, Human
auuaacauguuaaaccaug

SEQ ID NO: 1692204 - RNA, 17 nt, Human
auuaacauguuaaacca

SEQ ID NO: 1692205 - RNA, 15 nt, Human
auuaacauguuaaac

SEQ ID NO: 1692206 - RNA, 14 nt, Human
auuaacauguuaaa

SEQ ID NO: 1692207 - RNA, 13 nt, Human
auuaacauguuaa

SEQ ID NO: 1692208 - RNA, 21 nt, Human
auuaaagccauguuuauuaca

SEQ ID NO: 1692209 - RNA, 17 nt, Human
auuaaagccauguuuau

SEQ ID NO: 1692210 - RNA, 16 nt, Human
auuaaagccauguuua

SEQ ID NO: 1692211 - RNA, 12 nt, Human
auuaaagccaug

SEQ ID NO: 1692212 - RNA, 22 nt, Human
auuaagaaugaaauacuguuug

SEQ ID NO: 1692213 - RNA, 21 nt, Human
auuaagaaugaaauacuguuu

SEQ ID NO: 1692214 - RNA, 20 nt, Human
auuaagaaugaaauacuguu

SEQ ID NO: 1692215 - RNA, 16 nt, Human
auuaagaaugaaauac

SEQ ID NO: 1692216 - RNA, 20 nt, Human
uuuuauaaaucgcuuuugau

SEQ ID NO: 1692217 - RNA, 12 nt, Human
uuuuauaaaucg

SEQ ID NO: 1692218 - RNA, 18 nt, Human
uuuuaugcuuuaaacauu

SEQ ID NO: 1692219 - RNA, 12 nt, Human
uuuuauuaugua

SEQ ID NO: 1692220 - RNA, 22 nt, Human
uuuucauucuccuaucaccugu

SEQ ID NO: 1692221 - RNA, 21 nt, Human
uuuucauuauuuuauuaugaa

SEQ ID NO: 1692222 - RNA, 15 nt, Human
uuuucauuauuuuau

SEQ ID NO: 1692223 - RNA, 14 nt, Human
uuuuauuauguaaa

SEQ ID NO: 1692224 - RNA, 13 nt, Human
uuuuauuauguaa

SEQ ID NO: 1692225 - RNA, 15 nt, Human
auuauuuuauuauga

SEQ ID NO: 1692226 - RNA, 19 nt, Human
auuagagaguguugaaacg

SEQ ID NO: 1692227 - RNA, 18 nt, Human
auuagagaguguugaaac

SEQ ID NO: 1692228 - RNA, 17 nt, Human
auuagagaguguugaaa

SEQ ID NO: 1692229 - RNA, 16 nt, Human
auuagagaguguugaa

SEQ ID NO: 1692230 - RNA, 15 nt, Human
auuagagaguguuga

SEQ ID NO: 1692231 - RNA, 22 nt, Human
auuauuuuauuaugaaacuugu

SEQ ID NO: 1692232 - RNA, 21 nt, Human
auuauuuuauuaugaaacuug

SEQ ID NO: 1692233 - RNA, 23 nt, Human
auugugcgcuaaacuuuucugau

SEQ ID NO: 1692234 - RNA, 17 nt, Human
auuuggaaaucuuuaaa

SEQ ID NO: 1692235 - RNA, 20 nt, Human
auuuggaaaucuuuaaaaaa

SEQ ID NO: 1692236 - RNA, 15 nt, Human
auuuacuaaaaugga

SEQ ID NO: 1692237 - RNA, 13 nt, Human
auuuuauuaugua

SEQ ID NO: 1692238 - RNA, 15 nt, Human
auuuuauuauguaaa

SEQ ID NO: 1692239 - RNA, 14 nt, Human
auuuuauuauguaa

SEQ ID NO: 1692240 - RNA, 21 nt, Human
auuuuauuaugaaacuugugu

SEQ ID NO: 1692241 - RNA, 18 nt, Human
auuuuauuaugaaacuug

SEQ ID NO: 1692242 - RNA, 12 nt, Human
auuuuauuauga

SEQ ID NO: 1692243 - RNA, 11 nt, Human
auuuuauuaug

SEQ ID NO: 1692244 - RNA, 14 nt, Human
auuuuauuaugaaa

SEQ ID NO: 1692245 - RNA, 13 nt, Human
auuuuauuaugaa

SEQ ID NO: 1692246 - RNA, 14 nt, Human
auauaugugaugau

SEQ ID NO: 1692247 - RNA, 13 nt, Human
auagucuggcugu

SEQ ID NO: 1692248 - RNA, 13 nt, Human
auccauuuggaaa

SEQ ID NO: 1692249 - RNA, 19 nt, Human
auccauuuggaaaucuuua

SEQ ID NO: 1692250 - RNA, 17 nt, Human
auccauuuggaaaucuu

SEQ ID NO: 1692251 - RNA, 18 nt, Human
auccaguuuuguuuggac

SEQ ID NO: 1692252 - RNA, 21 nt, Human
auccaguuuuguuuggaccaa

SEQ ID NO: 1692253 - RNA, 20 nt, Human
auccaguuuuguuuggacca

SEQ ID NO: 1692254 - RNA, 21 nt, Human
uucuggugugaacuaaacuuu

SEQ ID NO: 1692255 - RNA, 20 nt, Human
uucuggugugaacuaaacuu

SEQ ID NO: 1692256 - RNA, 19 nt, Human
uucuguacuuuuuggcaua

SEQ ID NO: 1692257 - RNA, 18 nt, Human
uucuguacuuuuuggcau

SEQ ID NO: 1692258 - RNA, 13 nt, Human
uucuguacuuuuu

SEQ ID NO: 1692259 - RNA, 18 nt, Human
aucaauaaaaaauuauga

SEQ ID NO: 1692260 - RNA, 17 nt, Human
aucaauaaaaaauuaug

SEQ ID NO: 1692261 - RNA, 15 nt, Human
aucaauaaaaaauua

SEQ ID NO: 1692262 - RNA, 22 nt, Human
uucucagaaggcaaaugacuuu

SEQ ID NO: 1692263 - RNA, 21 nt, Human
uucucagaaggcaaaugacuu

SEQ ID NO: 1692264 - RNA, 19 nt, Human
uucucagaaggcaaaugac

SEQ ID NO: 1692265 - RNA, 18 nt, Human
uucucagaaggcaaauga

SEQ ID NO: 1692266 - RNA, 14 nt, Human
aucacuuuuuucca

SEQ ID NO: 1692267 - RNA, 16 nt, Human
auauuuuuauauuuac

SEQ ID NO: 1692268 - RNA, 17 nt, Human
auauuuucauucuccua

SEQ ID NO: 1692269 - RNA, 19 nt, Human
uuguguaaauacaauuuug

SEQ ID NO: 1692270 - RNA, 16 nt, Human
augauuucuaugcuga

SEQ ID NO: 1692271 - RNA, 13 nt, Human
augauuucuaugc

SEQ ID NO: 1692272 - RNA, 12 nt, Human
augauuucuaug

SEQ ID NO: 1692273 - RNA, 17 nt, Human
uuuaauuuuggaauuuu

SEQ ID NO: 1692274 - RNA, 15 nt, Human
uuuaauuuuggaauu

SEQ ID NO: 1692275 - RNA, 14 nt, Human
uuuaauuuuggaau

SEQ ID NO: 1692276 - RNA, 23 nt, Human
augccaaguuguuugagaaauua

SEQ ID NO: 1692277 - RNA, 16 nt, Human
augccaaguuguuuga

SEQ ID NO: 1692278 - RNA, 14 nt, Human
augccaaguuguuu

SEQ ID NO: 1692279 - RNA, 21 nt, Human
uuucauauuuuagcuacuaua

SEQ ID NO: 1692280 - RNA, 13 nt, Human
uuucauauuuuag

SEQ ID NO: 1692281 - RNA, 23 nt, Human
uuuauuacaguauaauuaacaug

SEQ ID NO: 1692282 - RNA, 23 nt, Human
auggaacgcguugaaauuguaau

SEQ ID NO: 1692283 - RNA, 22 nt, Human
uuuauuacaguauaauuaacau

SEQ ID NO: 1692284 - RNA, 14 nt, Human
uuuagucuugucuc

SEQ ID NO: 1692285 - RNA, 22 nt, Human
uugccuaaauccauuuggaaau

SEQ ID NO: 1692286 - RNA, 15 nt, Human
uugccuaaauccauu

SEQ ID NO: 1692287 - RNA, 14 nt, Human
uugccuaaauccau

SEQ ID NO: 1692288 - RNA, 13 nt, Human
uugccuaaaucca

SEQ ID NO: 1692289 - RNA, 21 nt, Human
aucugaggaauucuguauaga

SEQ ID NO: 1692290 - RNA, 20 nt, Human
aucugaggaauucuguauag

SEQ ID NO: 1692291 - RNA, 18 nt, Human
aucugaggaauucuguau

SEQ ID NO: 1692292 - RNA, 17 nt, Human
aucugaggaauucugua

SEQ ID NO: 1692293 - RNA, 16 nt, Human
aucugaggaauucugu

SEQ ID NO: 1692294 - RNA, 15 nt, Human
aucugaggaauucug

SEQ ID NO: 1692295 - RNA, 20 nt, Human
aucugccuaaggacuucuuu

SEQ ID NO: 1692296 - RNA, 19 nt, Human
aucugccuaaggacuucuu

SEQ ID NO: 1692297 - RNA, 18 nt, Human
aucugccuaaggacuucu

SEQ ID NO: 1692298 - RNA, 13 nt, Human
aucugccuaagga

SEQ ID NO: 1692299 - RNA, 17 nt, Human
aucugccuaaggacuuc

SEQ ID NO: 1692300 - RNA, 16 nt, Human
aucugccuaaggacuu

SEQ ID NO: 1692301 - RNA, 15 nt, Human
aucugccuaaggacu

SEQ ID NO: 1692302 - RNA, 14 nt, Human
aucugccuaaggac

SEQ ID NO: 1692303 - RNA, 19 nt, Human
aucugugaacuugaaauuu

SEQ ID NO: 1692304 - RNA, 18 nt, Human
aucugugaacuugaaauu

SEQ ID NO: 1692305 - RNA, 17 nt, Human
aucugugaacuugaaau

SEQ ID NO: 1692306 - RNA, 13 nt, Human
aucugugaacuug

SEQ ID NO: 1692307 - RNA, 21 nt, Human
uuggauaauaaggaaaaguuu

SEQ ID NO: 1692308 - RNA, 19 nt, Human
uuggauaauaaggaaaagu

SEQ ID NO: 1692309 - RNA, 15 nt, Human
uuggauaauaaggaa

SEQ ID NO: 1692310 - RNA, 13 nt, Human
uuggggauucuua

SEQ ID NO: 1692311 - RNA, 15 nt, Human
uuggggauucuuaaa

SEQ ID NO: 1692312 - RNA, 12 nt, Human
augacuuuggac

SEQ ID NO: 1692313 - RNA, 11 nt, Human
augacuuugga

SEQ ID NO: 1692314 - RNA, 16 nt, Human
augacuucauuaauaa

SEQ ID NO: 1692315 - RNA, 22 nt, Human
uuguacaaaguauuaagcauau

SEQ ID NO: 1692316 - RNA, 21 nt, Human
uuguacaaaguauuaagcaua

SEQ ID NO: 1692317 - RNA, 20 nt, Human
uuguacaaaguauuaagcau

SEQ ID NO: 1692318 - RNA, 17 nt, Human
uuguacaaaguauuaag

SEQ ID NO: 1692319 - RNA, 15 nt, Human
uuguacaaaguauua

SEQ ID NO: 1692320 - RNA, 16 nt, Human
uugguugcuuuaauau

SEQ ID NO: 1692321 - RNA, 13 nt, Human
uugguugcuuuaa

SEQ ID NO: 1692322 - RNA, 14 nt, Human
uuguacaaaguauu

SEQ ID NO: 1692323 - RNA, 13 nt, Human
uuguacaaaguau

SEQ ID NO: 1692324 - RNA, 13 nt, Human
auuguaauuauau

SEQ ID NO: 1692325 - RNA, 14 nt, Human
auuguaauuauauc

SEQ ID NO: 1692326 - RNA, 21 nt, Human
auuaugaaacuuguguaaaua

SEQ ID NO: 1692327 - RNA, 20 nt, Human
auuaugaaacuuguguaaau

SEQ ID NO: 1692328 - RNA, 18 nt, Human
auuaugaaacuuguguaa

SEQ ID NO: 1692329 - RNA, 15 nt, Human
auuaugaaacuugug

SEQ ID NO: 1692330 - RNA, 14 nt, Human
auuaugaaacuugu

SEQ ID NO: 1692331 - RNA, 17 nt, Human
auucaaaguugccuaaa

SEQ ID NO: 1692332 - RNA, 22 nt, Human
auucaaaguugccuaaauccau

SEQ ID NO: 1692333 - RNA, 21 nt, Human
auucaaaguugccuaaaucca

SEQ ID NO: 1692334 - RNA, 20 nt, Human
auucaaaguugccuaaaucc

SEQ ID NO: 1692335 - RNA, 18 nt, Human
auucaaaguugccuaaau

SEQ ID NO: 1692336 - RNA, 16 nt, Human
auuacaguauaauuaa

SEQ ID NO: 1692337 - RNA, 15 nt, Human
auuacaguauaauua

SEQ ID NO: 1692338 - RNA, 14 nt, Human
auuacaguauaauu

SEQ ID NO: 1692339 - RNA, 12 nt, Human
auuacaguauaa

SEQ ID NO: 1692340 - RNA, 17 nt, Human
auuuuaugcuuuaaaca

SEQ ID NO: 1692341 - RNA, 12 nt, Human
auuuuaugcuuu

SEQ ID NO: 1692342 - RNA, 12 nt, Human
auuuggaaaucu

SEQ ID NO: 1692343 - RNA, 11 nt, Human
auuuggaaauc

SEQ ID NO: 1692344 - RNA, 13 nt, Human
auuuggaaaucuu

SEQ ID NO: 1692345 - RNA, 12 nt, Human
auuuguuugcau

SEQ ID NO: 1692346 - RNA, 16 nt, Human
auuuuaugauccagca

SEQ ID NO: 1692347 - RNA, 15 nt, Human
auuuuaugauccagc

SEQ ID NO: 1692348 - RNA, 14 nt, Human
auuuuaugauccag

SEQ ID NO: 1692349 - RNA, 15 nt, Human
cacuccaauuaagga

SEQ ID NO: 1692350 - RNA, 13 nt, Human
cacuccaauuaag

SEQ ID NO: 1692351 - RNA, 18 nt, Human
cacuccaauuaaggauuu

SEQ ID NO: 1692352 - RNA, 17 nt, Human
cacuccaauuaaggauu

SEQ ID NO: 1692353 - RNA, 20 nt, Human
ccaaaaaccaguauuguaca

SEQ ID NO: 1692354 - RNA, 19 nt, Human
ccaaaaaccaguauuguac

SEQ ID NO: 1692355 - RNA, 16 nt, Human
ccaaaaaccaguauug

SEQ ID NO: 1692356 - RNA, 21 nt, Human
cauucuccuaucaccugucuu

SEQ ID NO: 1692357 - RNA, 22 nt, Human
ccaauuaaggauuuuaugcuuu

SEQ ID NO: 1692358 - RNA, 18 nt, Human
ccaauuaaggauuuuaug

SEQ ID NO: 1692359 - RNA, 13 nt, Human
ccaauuaaggauu

SEQ ID NO: 1692360 - RNA, 13 nt, Human
cagauacuggauu

SEQ ID NO: 1692361 - RNA, 21 nt, Human
caguauugaagcauuuuauaa

SEQ ID NO: 1692362 - RNA, 20 nt, Human
caguauugaagcauuuuaua

SEQ ID NO: 1692363 - RNA, 17 nt, Human
caguauugaagcauuuu

SEQ ID NO: 1692364 - RNA, 16 nt, Human
caguauugaagcauuu

SEQ ID NO: 1692365 - RNA, 22 nt, Human
caguauuguacaaaguauuaag

SEQ ID NO: 1692366 - RNA, 15 nt, Human
caguauugaagcauu

SEQ ID NO: 1692367 - RNA, 14 nt, Human
caguauugaagcau

SEQ ID NO: 1692368 - RNA, 12 nt, Human
caguauugaagc

SEQ ID NO: 1692369 - RNA, 22 nt, Human
ccagcagauuauucacugauuu

SEQ ID NO: 1692370 - RNA, 21 nt, Human
ccagcagauuauucacugauu

SEQ ID NO: 1692371 - RNA, 17 nt, Human
ccuagcacacacuuuug

SEQ ID NO: 1692372 - RNA, 17 nt, Human
cccuggccuuucauauu

SEQ ID NO: 1692373 - RNA, 21 nt, Human
cccuauuuuuuuucuguuaua

SEQ ID NO: 1692374 - RNA, 20 nt, Human
cccuauuuuuuuucuguuau

SEQ ID NO: 1692375 - RNA, 13 nt, Human
cuaaacuuucaca

SEQ ID NO: 1692376 - RNA, 13 nt, Human
cuaaacuuuucug

SEQ ID NO: 1692377 - RNA, 14 nt, Human
cuaaacuuucacac

SEQ ID NO: 1692378 - RNA, 15 nt, Human
cuaaacuuuucugau

SEQ ID NO: 1692379 - RNA, 17 nt, Human
ccuuuuucauuauuuua

SEQ ID NO: 1692380 - RNA, 20 nt, Human
cucucaaccaccuuucagau

SEQ ID NO: 1692381 - RNA, 24 nt, Human
gccaucaauaaaaaauuaugacau

SEQ ID NO: 1692382 - RNA, 18 nt, Human
gcguugaaauuguaauua

SEQ ID NO: 1692383 - RNA, 24 nt, Human
gcguugaaauuguaauuauaucug

SEQ ID NO: 1692384 - RNA, 23 nt, Human
gcguugaaauuguaauuauaucu

SEQ ID NO: 1692385 - RNA, 11 nt, Human
gcuuuucugau

SEQ ID NO: 1692386 - RNA, 16 nt, Human
gcuuuucugauccagu

SEQ ID NO: 1692387 - RNA, 15 nt, Human
gcuuuucugauccag

SEQ ID NO: 1692388 - RNA, 12 nt, Human
gcuuuucugauc

SEQ ID NO: 1692389 - RNA, 22 nt, Human
ggauaauaaggaaaaguuuaau

SEQ ID NO: 1692390 - RNA, 12 nt, Human
ggauaaaugcca

SEQ ID NO: 1692391 - RNA, 14 nt, Human
aaaaauauuuuaug

SEQ ID NO: 1692392 - RNA, 22 nt, Human
aaaguugaauuuauuggcuuuu

SEQ ID NO: 1692393 - RNA, 16 nt, Human
aaaguugaauuuauug

SEQ ID NO: 1692394 - RNA, 13 nt, Human
aaaguugaauuua

SEQ ID NO: 1692395 - RNA, 12 nt, Human
aaaguugaauuu

SEQ ID NO: 1692396 - RNA, 19 nt, Human
aaaguuuaauauuaaagcc

SEQ ID NO: 1692397 - RNA, 16 nt, Human
aaaguuuaauauuaaa

SEQ ID NO: 1692398 - RNA, 22 nt, Human
aaaguuuaauauuaaagccaug

SEQ ID NO: 1692399 - RNA, 21 nt, Human
aaaguuuaauauuaaagccau

SEQ ID NO: 1692400 - RNA, 20 nt, Human
aaaguuuaauauuaaagcca

SEQ ID NO: 1692401 - RNA, 18 nt, Human
gguucuggugugaacuaa

SEQ ID NO: 1692402 - RNA, 22 nt, Human
gauccaguuuuguuuggaccaa

SEQ ID NO: 1692403 - RNA, 17 nt, Human
gauccaguuuuguuugg

SEQ ID NO: 1692404 - RNA, 11 nt, Human
gauccaguuuu

SEQ ID NO: 1692405 - RNA, 18 nt, Human
gauuagagaguguugaaa

SEQ ID NO: 1692406 - RNA, 14 nt, Human
gauuagagaguguu

SEQ ID NO: 1692407 - RNA, 21 nt, Human
gauuauucacugauuugacau

SEQ ID NO: 1692408 - RNA, 16 nt, Human
gauuauucacugauuu

SEQ ID NO: 1692409 - RNA, 15 nt, Human
gauuauucacugauu

SEQ ID NO: 1692410 - RNA, 13 nt, Human
gauuauucacuga

SEQ ID NO: 1692411 - RNA, 23 nt, Human
gauuagaauucuguauagauuag

SEQ ID NO: 1692412 - RNA, 15 nt, Human
gauuagaauucugua

SEQ ID NO: 1692413 - RNA, 14 nt, Human
gauuagaauucugu

SEQ ID NO: 1692414 - RNA, 23 nt, Human
gcauaacauaaaucugugaacuu

SEQ ID NO: 1692415 - RNA, 21 nt, Human
gcauaacauaaaucugugaac

SEQ ID NO: 1692416 - RNA, 14 nt, Human
gaagugaaacugcu

SEQ ID NO: 1692417 - RNA, 13 nt, Human
gaauuuuguguua

SEQ ID NO: 1692418 - RNA, 22 nt, Human
gaauuuuguguuagagauuuuu

SEQ ID NO: 1692419 - RNA, 16 nt, Human
gaauuuuguguuagag

SEQ ID NO: 1692420 - RNA, 12 nt, Human
gacuggugacug

SEQ ID NO: 1692421 - RNA, 18 nt, Human
gacuggugacugauucuu

SEQ ID NO: 1692422 - RNA, 15 nt, Human
gacuggugacugauu

SEQ ID NO: 1692423 - RNA, 20 nt, Human
cuuuguauagaaccucuuug

SEQ ID NO: 1692424 - RNA, 11 nt, Human
cuuuguauaga

SEQ ID NO: 1692425 - RNA, 20 nt, Human
cuuuugguuaagucuguuuu

SEQ ID NO: 1692426 - RNA, 16 nt, Human
cuuuugguuaagucug

SEQ ID NO: 1692427 - RNA, 15 nt, Human
cuugccuuuuucauu

SEQ ID NO: 1692428 - RNA, 14 nt, Human
cuugccuuuuucau

SEQ ID NO: 1692429 - RNA, 23 nt, Human
cuugccuuuuucauuauuuuauu

SEQ ID NO: 1692430 - RNA, 22 nt, Human
cuugccuuuuucauuauuuuau

SEQ ID NO: 1692431 - RNA, 20 nt, Human
cuugccuuuuucauuauuuu

SEQ ID NO: 1692432 - RNA, 20 nt, Human
cuucauaccuacauguauuu

SEQ ID NO: 1692433 - RNA, 13 nt, Human
cuggguuccugca

SEQ ID NO: 1692434 - RNA, 15 nt, Human
cuguacuuuuuggca

SEQ ID NO: 1692435 - RNA, 14 nt, Human
cuguacuuuuuggc

SEQ ID NO: 1692436 - RNA, 18 nt, Human
cugugaacuugaaauuug

SEQ ID NO: 1692437 - RNA, 13 nt, Human
cauauuuuagcua

SEQ ID NO: 1692438 - RNA, 22 nt, Human
caucacaguuuugguugcuuua

SEQ ID NO: 1692439 - RNA, 21 nt, Human
caucacaguuuugguugcuuu

SEQ ID NO: 1692440 - RNA, 13 nt, Human
caucacaguuuug

SEQ ID NO: 1692441 - RNA, 17 nt, Human
cauaaggaaacuggguu

SEQ ID NO: 1692442 - RNA, 21 nt, Human
cauaacauaaaucugugaacu

SEQ ID NO: 1692443 - RNA, 19 nt, Human
cauaacauaaaucugugaa

SEQ ID NO: 1692444 - RNA, 12 nt, Human
cauaacauaaau

SEQ ID NO: 1692445 - RNA, 14 nt, Human
cauaaaucugugaa

SEQ ID NO: 1692446 - RNA, 23 nt, Human
cauaaaucugugaacuugaaauu

SEQ ID NO: 1692447 - RNA, 22 nt, Human
cauaaaucugugaacuugaaau

SEQ ID NO: 1692448 - RNA, 18 nt, Human
cauaaaucugugaacuug

SEQ ID NO: 1692449 - RNA, 16 nt, Human
cauaaaucugugaacu

SEQ ID NO: 1692450 - RNA, 17 nt, Human
caguuuugguugcuuua

SEQ ID NO: 1692451 - RNA, 19 nt, Human
caguuuugguugcuuuaau

SEQ ID NO: 1692452 - RNA, 18 nt, Human
caguuuugguugcuuuaa

SEQ ID NO: 1692453 - RNA, 21 nt, Human
caguuuuguuuggaccaaaaa

SEQ ID NO: 1692454 - RNA, 15 nt, Human
cauaccuacauguau

SEQ ID NO: 1692455 - RNA, 23 nt, Human
cauggaacgcguugaaauuguaa

SEQ ID NO: 1692456 - RNA, 20 nt, Human
cauggaacgcguugaaauug

SEQ ID NO: 1692457 - RNA, 19 nt, Human
cauggaacgcguugaaauu

SEQ ID NO: 1692458 - RNA, 18 nt, Human
cauggaacgcguugaaau

SEQ ID NO: 1692459 - RNA, 11 nt, Human
cauuauuuuau

SEQ ID NO: 1692460 - RNA, 22 nt, Human
cauguuuauuacaguauaauua

SEQ ID NO: 1692461 - RNA, 20 nt, Human
cauguuuauuacaguauaau

SEQ ID NO: 1692462 - RNA, 19 nt, Human
cauguuuauuacaguauaa

SEQ ID NO: 1692463 - RNA, 18 nt, Human
cauguuuauuacaguaua

SEQ ID NO: 1692464 - RNA, 13 nt, Human
cauguuuauuaca

SEQ ID NO: 1692465 - RNA, 12 nt, Human
cauguuuauuac

SEQ ID NO: 1692466 - RNA, 17 nt, Human
ccaaaccucugugagca

SEQ ID NO: 1692467 - RNA, 16 nt, Human
cauuauuuuauuauga

SEQ ID NO: 1692468 - RNA, 14 nt, Human
cauuauuuuauuau

SEQ ID NO: 1692469 - RNA, 12 nt, Human
cauuauuuuauu

SEQ ID NO: 1692470 - RNA, 15 nt, Human
cccagacgaugucuu

SEQ ID NO: 1692471 - RNA, 17 nt, Human
cccagacgaugucuuca

SEQ ID NO: 1692472 - RNA, 12 nt, Human
cccauuauucaa

SEQ ID NO: 1692473 - RNA, 23 nt, Human
cccggaagccaaaccucugugag

SEQ ID NO: 1692474 - RNA, 19 nt, Human
ccuaaauccauuuggaaau

SEQ ID NO: 1692475 - RNA, 21 nt, Human
ccuaaauccauuuggaaaucu

SEQ ID NO: 1692476 - RNA, 20 nt, Human
ccuaaauccauuuggaaauc

SEQ ID NO: 1692477 - RNA, 22 nt, Human
ccuacauguauuuguuugcaua

SEQ ID NO: 1692478 - RNA, 11 nt, Human
cuaaggacuug

SEQ ID NO: 1692479 - RNA, 17 nt, Human
cuaaggacuuguuagau

SEQ ID NO: 1692480 - RNA, 16 nt, Human
cuaaggacuuguuaga

SEQ ID NO: 1692481 - RNA, 23 nt, Human
cuauauaugugaugaucuaccag

SEQ ID NO: 1692482 - RNA, 18 nt, Human
cuauauaugugaugaucu

SEQ ID NO: 1692483 - RNA, 12 nt, Human
cuaguucacucu

SEQ ID NO: 1692484 - RNA, 16 nt, Human
cuaaauccauuuggaa

SEQ ID NO: 1692485 - RNA, 20 nt, Human
cuaaauccauuuggaaaucu

SEQ ID NO: 1692486 - RNA, 19 nt, Human
cuaaauccauuuggaaauc

SEQ ID NO: 1692487 - RNA, 17 nt, Human
cuaaauccauuuggaaa

SEQ ID NO: 1692488 - RNA, 15 nt, Human
cgugcuaaggacuug

SEQ ID NO: 1692489 - RNA, 14 nt, Human
cgugcuaaggacuu

SEQ ID NO: 1692490 - RNA, 13 nt, Human
cgugcuaaggacu

SEQ ID NO: 1692491 - RNA, 12 nt, Human
cgugcuaaggac

SEQ ID NO: 1692492 - RNA, 16 nt, Human
cgugcuaaggacuugu

SEQ ID NO: 1692493 - RNA, 23 nt, Human
cguugaaauuguaauuauaucug

SEQ ID NO: 1692494 - RNA, 16 nt, Human
cggugaauggcuuugu

SEQ ID NO: 1692495 - RNA, 15 nt, Human
cggugaauggcuuug

SEQ ID NO: 1692496 - RNA, 14 nt, Human
cggugaauggcuuu

SEQ ID NO: 1692497 - RNA, 13 nt, Human
cggugaauggcuu

SEQ ID NO: 1692498 - RNA, 22 nt, Human
cggugaauggcuuuguauagaa

SEQ ID NO: 1692499 - RNA, 20 nt, Human
cggugaauggcuuuguauag

SEQ ID NO: 1692500 - RNA, 18 nt, Human
cggugaauggcuuuguau

SEQ ID NO: 1692501 - RNA, 17 nt, Human
cucccuauuuuuuuucu

SEQ ID NO: 1692502 - RNA, 21 nt, Human
cucccuauuuuuuuucuguua

SEQ ID NO: 1692503 - RNA, 20 nt, Human
cucccuauuuuuuuucuguu

SEQ ID NO: 1692504 - RNA, 19 nt, Human
cucccuauuuuuuuucugu

SEQ ID NO: 1692505 - RNA, 16 nt, Human
cugacaucucugcaau

SEQ ID NO: 1692506 - RNA, 15 nt, Human
cugacaucucugcaa

SEQ ID NO: 1692507 - RNA, 14 nt, Human
cugacaucucugca

SEQ ID NO: 1692508 - RNA, 21 nt, Human
cucugugagcaucacaguuuu

SEQ ID NO: 1692509 - RNA, 18 nt, Human
cucugugagcaucacagu

SEQ ID NO: 1692510 - RNA, 22 nt, Human
cucugugagcaucacaguuuug

SEQ ID NO: 1692511 - RNA, 23 nt, Human
cugaacacuccaauuaaggauuu

SEQ ID NO: 1692512 - RNA, 18 nt, Human
cugaacacuccaauuaag

SEQ ID NO: 1692513 - RNA, 16 nt, Human
cuguauagauuagaga

SEQ ID NO: 1692514 - RNA, 20 nt, Human
cuguauagauuagaauucug

SEQ ID NO: 1692515 - RNA, 15 nt, Human
cuguauagauuagag

SEQ ID NO: 1692516 - RNA, 14 nt, Human
cuggccuuucauau

SEQ ID NO: 1692517 - RNA, 13 nt, Human
cugcuuguuuccu

SEQ ID NO: 1692518 - RNA, 14 nt, Human
cugcuuguuuccua

SEQ ID NO: 1692519 - RNA, 16 nt, Human
cugcuuucagauacug

SEQ ID NO: 1692520 - RNA, 15 nt, Human
cugcuuucagauacu

SEQ ID NO: 1692521 - RNA, 12 nt, Human
cugcuuucagau

SEQ ID NO: 1692522 - RNA, 23 nt, Human
cuuuugauaaucaacugggcuga

SEQ ID NO: 1692523 - RNA, 20 nt, Human
cuugaaauuugaauuuugug

SEQ ID NO: 1692524 - RNA, 19 nt, Human
cuugaaauuugaauuuugu

SEQ ID NO: 1692525 - RNA, 15 nt, Human
cuuguauuaagaaug

SEQ ID NO: 1692526 - RNA, 14 nt, Human
cuuguauuaagaau

SEQ ID NO: 1692527 - RNA, 22 nt, Human
gaacuugaaauuugaauuuugu

SEQ ID NO: 1692528 - RNA, 15 nt, Human
gaacuugaaauuuga

SEQ ID NO: 1692529 - RNA, 13 nt, Human
gaacuugaaauuu

SEQ ID NO: 1692530 - RNA, 12 nt, Human
gaacuugaaauu

SEQ ID NO: 1692531 - RNA, 14 nt, Human
gaagucagaucugc

SEQ ID NO: 1692532 - RNA, 23 nt, Human
gaagucagaucugccuaaggacu

SEQ ID NO: 1692533 - RNA, 22 nt, Human
gaagucagaucugccuaaggac

SEQ ID NO: 1692534 - RNA, 13 nt, Human
gaagcauuuuaua

SEQ ID NO: 1692535 - RNA, 17 nt, Human
gaagcauuuuauaaauc

SEQ ID NO: 1692536 - RNA, 15 nt, Human
gaagcauuuuauaaa

SEQ ID NO: 1692537 - RNA, 18 nt, Human
gaagccaaaccucuguga

SEQ ID NO: 1692538 - RNA, 16 nt, Human
gaaacggaugauuucu

SEQ ID NO: 1692539 - RNA, 13 nt, Human
gaaauuugaauuu

SEQ ID NO: 1692540 - RNA, 24 nt, Human
gaaauuugaauuuuguguuagaga

SEQ ID NO: 1692541 - RNA, 16 nt, Human
gaaauuugaauuuugu

SEQ ID NO: 1692542 - RNA, 19 nt, Human
gaggaagccugauuaaaga

SEQ ID NO: 1692543 - RNA, 18 nt, Human
gaggaagccugauuaaag

SEQ ID NO: 1692544 - RNA, 12 nt, Human
gacuuguuagau

SEQ ID NO: 1692545 - RNA, 20 nt, Human
gaccaaaaaccaguauugua

SEQ ID NO: 1692546 - RNA, 19 nt, Human
gaccaaaaaccaguauugu

SEQ ID NO: 1692547 - RNA, 13 nt, Human
gaccaaaaaccag

SEQ ID NO: 1692548 - RNA, 16 nt, Human
gacauagucuggcugu

SEQ ID NO: 1692549 - RNA, 18 nt, Human
gcagauuauucacugauu

SEQ ID NO: 1692550 - RNA, 18 nt, Human
gcacggugaauggcuuug

SEQ ID NO: 1692551 - RNA, 20 nt, Human
gaugccaaguuguuugagaa

SEQ ID NO: 1692552 - RNA, 19 nt, Human
gauuuuaugcuuuaaacau

SEQ ID NO: 1692553 - RNA, 14 nt, Human
gauuuuaugcuuua

SEQ ID NO: 1692554 - RNA, 23 nt, Human
gauuuuauuauguaaaucccauu

SEQ ID NO: 1692555 - RNA, 20 nt, Human
gauuuuauuauguaaauccc

SEQ ID NO: 1692556 - RNA, 19 nt, Human
gauuuuauuauguaaaucc

SEQ ID NO: 1692557 - RNA, 18 nt, Human
gauuuuauuauguaaauc

SEQ ID NO: 1692558 - RNA, 15 nt, Human
gauuuuauuauguaa

SEQ ID NO: 1692559 - RNA, 13 nt, Human
gauuuuauuaugu

SEQ ID NO: 1692560 - RNA, 23 nt, Human
gccuuuuucauuauuuuauuaug

SEQ ID NO: 1692561 - RNA, 17 nt, Human
gcuaaacuuuucugaua

SEQ ID NO: 1692562 - RNA, 15 nt, Human
gcuaaacuuuucuga

SEQ ID NO: 1692563 - RNA, 13 nt, Human
gcuaaacuuuucu

SEQ ID NO: 1692564 - RNA, 16 nt, Human
gcccugcuuucagaua

SEQ ID NO: 1692565 - RNA, 14 nt, Human
gcccugcuuucaga

SEQ ID NO: 1692566 - RNA, 21 nt, Human
gccuaaauccauuuggaaauc

SEQ ID NO: 1692567 - RNA, 19 nt, Human
gccuaaauccauuuggaaa

SEQ ID NO: 1692568 - RNA, 13 nt, Human
gccuaaauccauu

SEQ ID NO: 1692569 - RNA, 12 nt, Human
gccuaaauccau

SEQ ID NO: 1692570 - RNA, 23 nt, Human
gccuaaauccauuuggaaaucuu

SEQ ID NO: 1692571 - RNA, 22 nt, Human
gccuaaauccauuuggaaaucu

SEQ ID NO: 1692572 - RNA, 15 nt, Human
uuuugguugcuuuaa

SEQ ID NO: 1692573 - RNA, 16 nt, Human
uuuugguugcuuuaau

SEQ ID NO: 1692574 - RNA, 21 nt, Human
uuuuggcauaacauaaaucug

SEQ ID NO: 1692575 - RNA, 18 nt, Human
uuuuuaagccuuaaagga

SEQ ID NO: 1692576 - RNA, 16 nt, Human
uuuggauaauaaggaa

SEQ ID NO: 1692577 - RNA, 22 nt, Human
uuuggaauuuuccuccuuucuc

SEQ ID NO: 1692578 - RNA, 14 nt, Human
guauaauuaacaug

SEQ ID NO: 1692579 - RNA, 13 nt, Human
guauaauuaacau

SEQ ID NO: 1692580 - RNA, 23 nt, Human
guauaauuaacauguuaaaccau

SEQ ID NO: 1692581 - RNA, 22 nt, Human
guauaauuaacauguuaaacca

SEQ ID NO: 1692582 - RNA, 19 nt, Human
guauaauuaacauguuaaa

SEQ ID NO: 1692583 - RNA, 17 nt, Human
guauaauuaacauguua

SEQ ID NO: 1692584 - RNA, 15 nt, Human
guauaauuaacaugu

SEQ ID NO: 1692585 - RNA, 14 nt, Human
guauagauuagaau

SEQ ID NO: 1692586 - RNA, 19 nt, Human
guauagaaccucuuugucu

SEQ ID NO: 1692587 - RNA, 21 nt, Human
guauuaagcauauauuuuuau

SEQ ID NO: 1692588 - RNA, 18 nt, Human
guauuaagcauauauuuu

SEQ ID NO: 1692589 - RNA, 16 nt, Human
guauuaagaaugaaau

SEQ ID NO: 1692590 - RNA, 15 nt, Human
guauuaagcauauau

SEQ ID NO: 1692591 - RNA, 17 nt, Human
guauuaagcauauauuu

SEQ ID NO: 1692592 - RNA, 16 nt, Human
guauuaagcauauauu

SEQ ID NO: 1692593 - RNA, 21 nt, Human
gucagaucugccuaaggacuu

SEQ ID NO: 1692594 - RNA, 20 nt, Human
gucagaucugccuaaggacu

SEQ ID NO: 1692595 - RNA, 19 nt, Human
gucagaucugccuaaggac

SEQ ID NO: 1692596 - RNA, 18 nt, Human
gucagaucugccuaagga

SEQ ID NO: 1692597 - RNA, 16 nt, Human
gucagaucugccuaag

SEQ ID NO: 1692598 - RNA, 21 nt, Human
gucucugaagugaaacugcuu

SEQ ID NO: 1692599 - RNA, 15 nt, Human
gucucugaagugaaa

SEQ ID NO: 1692600 - RNA, 14 nt, Human
gucucagauuuuau

SEQ ID NO: 1692601 - RNA, 16 nt, Human
gucucagauuuuauua

SEQ ID NO: 1692602 - RNA, 15 nt, Human
gucucagauuuuauu

SEQ ID NO: 1692603 - RNA, 21 nt, Human
gucucagauuuuauuauguaa

SEQ ID NO: 1692604 - RNA, 17 nt, Human
gucucagauuuuauuau

SEQ ID NO: 1692605 - RNA, 15 nt, Human
gucuguuuuaugacu

SEQ ID NO: 1692606 - RNA, 13 nt, Human
gucuguuuuauga

SEQ ID NO: 1692607 - RNA, 20 nt, Human
gucuugccuuuuucauuauu

SEQ ID NO: 1692608 - RNA, 18 nt, Human
gucuugccuuuuucauua

SEQ ID NO: 1692609 - RNA, 17 nt, Human
gucuugccuuuuucauu

SEQ ID NO: 1692610 - RNA, 16 nt, Human
gucuugccuuuuucau

SEQ ID NO: 1692611 - RNA, 15 nt, Human
gucuugccuuuuuca

SEQ ID NO: 1692612 - RNA, 22 nt, Human
gucuugucucagauuuuauuau

SEQ ID NO: 1692613 - RNA, 20 nt, Human
gucuugucucagauuuuauu

SEQ ID NO: 1692614 - RNA, 15 nt, Human
gucuugucucagauu

SEQ ID NO: 1692615 - RNA, 17 nt, Human
gugcgcuaaacuuuucu

SEQ ID NO: 1692616 - RNA, 21 nt, Human
gugcgcuaaacuuuucugaua

SEQ ID NO: 1692617 - RNA, 12 nt, Human
gugcuaaggacu

SEQ ID NO: 1692618 - RNA, 20 nt, Human
gugcuaaggacuuguuagau

SEQ ID NO: 1692619 - RNA, 14 nt, Human
gugcuaaggacuug

SEQ ID NO: 1692620 - RNA, 13 nt, Human
gugcuaaggacuu

SEQ ID NO: 1692621 - RNA, 16 nt, Human
guggugacuuuggaua

SEQ ID NO: 1692622 - RNA, 15 nt, Human
guggugacuuuggau

SEQ ID NO: 1692623 - RNA, 13 nt, Human
guggugacuuugg

SEQ ID NO: 1692624 - RNA, 14 nt, Human
guuaaaagagguuu

SEQ ID NO: 1692625 - RNA, 21 nt, Human
guuaaaagagguuuuucuuaa

SEQ ID NO: 1692626 - RNA, 20 nt, Human
guuaaaagagguuuuucuua

SEQ ID NO: 1692627 - RNA, 18 nt, Human
guuaaaccaugggauaaa

SEQ ID NO: 1692628 - RNA, 21 nt, Human
guuaaaccaugggauaaaugc

SEQ ID NO: 1692629 - RNA, 13 nt, Human
guuacagaagccc

SEQ ID NO: 1692630 - RNA, 13 nt, Human
guuauauaaaugg

SEQ ID NO: 1692631 - RNA, 12 nt, Human
guuauauaaaug

SEQ ID NO: 1692632 - RNA, 10 nt, Human
guuauauaaa

SEQ ID NO: 1692633 - RNA, 19 nt, Human
guuaucugaagucagaucu

SEQ ID NO: 1692634 - RNA, 19 nt, Human
guucacucuccauuuaaua

SEQ ID NO: 1692635 - RNA, 23 nt, Human
guucauggaacgcguugaaauug

SEQ ID NO: 1692636 - RNA, 22 nt, Human
guucauggaacgcguugaaauu

SEQ ID NO: 1692637 - RNA, 15 nt, Human
guuccugcaaugaag

SEQ ID NO: 1692638 - RNA, 22 nt, Human
guugaauuuauuggcuuuucug

SEQ ID NO: 1692639 - RNA, 21 nt, Human
guugaauuuauuggcuuuucu

SEQ ID NO: 1692640 - RNA, 14 nt, Human
guugaauuuauugg

SEQ ID NO: 1692641 - RNA, 15 nt, Human
guugaaauuguaauu

SEQ ID NO: 1692642 - RNA, 20 nt, Human
guugaaauuguaauuauauc

SEQ ID NO: 1692643 - RNA, 16 nt, Human
guugaaauuguaauua

SEQ ID NO: 1692644 - RNA, 22 nt, Human
guugaaacggaugauuucuaug

SEQ ID NO: 1692645 - RNA, 21 nt, Human
guugaaacggaugauuucuau

SEQ ID NO: 1692646 - RNA, 18 nt, Human
guuguuugagaaauuaag

SEQ ID NO: 1692647 - RNA, 16 nt, Human
guuuugguugcuuuaa

SEQ ID NO: 1692648 - RNA, 18 nt, Human
uaaaagagguuuuucuua

SEQ ID NO: 1692649 - RNA, 21 nt, Human
uaaaagagguuuuucuuaaau

SEQ ID NO: 1692650 - RNA, 19 nt, Human
uaaaagagguuuuucuuaa

SEQ ID NO: 1692651 - RNA, 20 nt, Human
uaaagccauguuuauuacag

SEQ ID NO: 1692652 - RNA, 15 nt, Human
uaaagccauguuuau

SEQ ID NO: 1692653 - RNA, 13 nt, Human
uaaagccauguuu

SEQ ID NO: 1692654 - RNA, 11 nt, Human
uaaagccaugu

SEQ ID NO: 1692655 - RNA, 21 nt, Human
uaaacauugguucuuguauua

SEQ ID NO: 1692656 - RNA, 19 nt, Human
uaaacauugguucuuguau

SEQ ID NO: 1692657 - RNA, 14 nt, Human
uaaaugguuaaaag

SEQ ID NO: 1692658 - RNA, 23 nt, Human
uaaaugccaucaauaaaaaauua

SEQ ID NO: 1692659 - RNA, 16 nt, Human
uaaaugccaucaauaa

SEQ ID NO: 1692660 - RNA, 17 nt, Human
uaacuguuauuuauaau

SEQ ID NO: 1692661 - RNA, 16 nt, Human
uaacuguuauuuauaa

SEQ ID NO: 1692662 - RNA, 18 nt, Human
uaauaaggaaaaguuuaa

SEQ ID NO: 1692663 - RNA, 16 nt, Human
uaauaaggaaaaguuu

SEQ ID NO: 1692664 - RNA, 21 nt, Human
uaagucuguuuuaugacuuca

SEQ ID NO: 1692665 - RNA, 20 nt, Human
uaagucuguuuuaugacuuc

SEQ ID NO: 1692666 - RNA, 19 nt, Human
uaagucuguuuuaugacuu

SEQ ID NO: 1692667 - RNA, 16 nt, Human
uaagucuguuuuauga

SEQ ID NO: 1692668 - RNA, 13 nt, Human
uaagucuguuuua

SEQ ID NO: 1692669 - RNA, 19 nt, Human
uaaggauuuuaugcuuuaa

SEQ ID NO: 1692670 - RNA, 17 nt, Human
uaaggauuuuaugcuuu

SEQ ID NO: 1692671 - RNA, 13 nt, Human
uaaggauuuuaug

SEQ ID NO: 1692672 - RNA, 12 nt, Human
uaaggauuuuau

SEQ ID NO: 1692673 - RNA, 22 nt, Human
uaaggauuuuaugcuuuaaaca

SEQ ID NO: 1692674 - RNA, 20 nt, Human
uaaggauuuuaugcuuuaaa

SEQ ID NO: 1692675 - RNA, 21 nt, Human
uaauuaacauguuaaaccaug

SEQ ID NO: 1692676 - RNA, 23 nt, Human
uaauaucaucaguauugaagcau

SEQ ID NO: 1692677 - RNA, 16 nt, Human
uaauauuaaagccaug

SEQ ID NO: 1692678 - RNA, 15 nt, Human
uaauauuaaagccau

SEQ ID NO: 1692679 - RNA, 21 nt, Human
uaauauuaaagccauguuuau

SEQ ID NO: 1692680 - RNA, 20 nt, Human
uaauauuaaagccauguuua

SEQ ID NO: 1692681 - RNA, 17 nt, Human
uaauauuaaagccaugu

SEQ ID NO: 1692682 - RNA, 23 nt, Human
uauaucugaggaauucuguauag

SEQ ID NO: 1692683 - RNA, 21 nt, Human
uauagaaccucuuugucuaca

SEQ ID NO: 1692684 - RNA, 20 nt, Human
uauagaaccucuuugucuac

SEQ ID NO: 1692685 - RNA, 16 nt, Human
uaucaucaguauugaa

SEQ ID NO: 1692686 - RNA, 15 nt, Human
uaucaucaguauuga

SEQ ID NO: 1692687 - RNA, 14 nt, Human
uaucaucaguauug

SEQ ID NO: 1692688 - RNA, 16 nt, Human
uauauuuucauucucc

SEQ ID NO: 1692689 - RNA, 15 nt, Human
uagauuagaauucug

SEQ ID NO: 1692690 - RNA, 14 nt, Human
uagauuagaauucu

SEQ ID NO: 1692691 - RNA, 20 nt, Human
uagauuagaauucuguauag

SEQ ID NO: 1692692 - RNA, 19 nt, Human
uagauuagaauucuguaua

SEQ ID NO: 1692693 - RNA, 17 nt, Human
uagauuagaauucugua

SEQ ID NO: 1692694 - RNA, 16 nt, Human
uagauuagaauucugu

SEQ ID NO: 1692695 - RNA, 20 nt, Human
uagauuagagaguguugaaa

SEQ ID NO: 1692696 - RNA, 21 nt, Human
uagaauucuguauagauuaga

SEQ ID NO: 1692697 - RNA, 16 nt, Human
uagaauucuguauaga

SEQ ID NO: 1692698 - RNA, 15 nt, Human
uagaauucuguauag

SEQ ID NO: 1692699 - RNA, 14 nt, Human
uagaauucuguaua

SEQ ID NO: 1692700 - RNA, 13 nt, Human
uagaauucuguau

SEQ ID NO: 1692701 - RNA, 11 nt, Human
uagaauucugu

SEQ ID NO: 1692702 - RNA, 20 nt, Human
uagacuggugacugauucuu

SEQ ID NO: 1692703 - RNA, 23 nt, Human
uagacuggugacugauucuucag

SEQ ID NO: 1692704 - RNA, 21 nt, Human
uagacuggugacugauucuuc

SEQ ID NO: 1692705 - RNA, 23 nt, Human
uaccuacauguauuuguuugcau

SEQ ID NO: 1692706 - RNA, 13 nt, Human
uaccuacauguau

SEQ ID NO: 1692707 - RNA, 23 nt, Human
uacuaaaauggacuguggugacu

SEQ ID NO: 1692708 - RNA, 15 nt, Human
uacuaaaauggacug

SEQ ID NO: 1692709 - RNA, 17 nt, Human
uacuaaaauggacugug

SEQ ID NO: 1692710 - RNA, 12 nt, Human
uacaaaguauua

SEQ ID NO: 1692711 - RNA, 14 nt, Human
uacaaaguauuaag

SEQ ID NO: 1692712 - RNA, 13 nt, Human
uacaaaguauuaa

SEQ ID NO: 1692713 - RNA, 19 nt, Human
uacaaaguauuaagcauau

SEQ ID NO: 1692714 - RNA, 18 nt, Human
uacaaaguauuaagcaua

SEQ ID NO: 1692715 - RNA, 16 nt, Human
uacaaaguauuaagca

SEQ ID NO: 1692716 - RNA, 15 nt, Human
uacaaaguauuaagc

SEQ ID NO: 1692717 - RNA, 17 nt, Human
uacaauuuuguuucugu

SEQ ID NO: 1692718 - RNA, 16 nt, Human
uacaauuuuguuucug

SEQ ID NO: 1692719 - RNA, 15 nt, Human
uacaauuuuguuucu

SEQ ID NO: 1692720 - RNA, 12 nt, Human
uacaauuuuguu

SEQ ID NO: 1692721 - RNA, 18 nt, Human
ugaacuugaaauuugaau

SEQ ID NO: 1692722 - RNA, 14 nt, Human
ugaacuugaaauuu

SEQ ID NO: 1692723 - RNA, 13 nt, Human
ugaacuugaaauu

SEQ ID NO: 1692724 - RNA, 23 nt, Human
ugacaucucugcaaucuucucag

SEQ ID NO: 1692725 - RNA, 14 nt, Human
ugacaucucugcaa

SEQ ID NO: 1692726 - RNA, 13 nt, Human
ugacaucucugca

SEQ ID NO: 1692727 - RNA, 22 nt, Human
ugacuuuggauaauaaggaaaa

SEQ ID NO: 1692728 - RNA, 20 nt, Human
ugacuuuggauaauaaggaa

SEQ ID NO: 1692729 - RNA, 16 nt, Human
ugacuuuggauaauaa

SEQ ID NO: 1692730 - RNA, 15 nt, Human
ugacuuuggauaaua

SEQ ID NO: 1692731 - RNA, 14 nt, Human
ugacuuuggauaau

SEQ ID NO: 1692732 - RNA, 13 nt, Human
ugacuuuggauaa

SEQ ID NO: 1692733 - RNA, 12 nt, Human
ugacuuuggaua

SEQ ID NO: 1692734 - RNA, 15 nt, Human
ucuuguauuaagaau

SEQ ID NO: 1692735 - RNA, 14 nt, Human
ucuuguauuaagaa

SEQ ID NO: 1692736 - RNA, 12 nt, Human
ucuugucucaga

SEQ ID NO: 1692737 - RNA, 15 nt, Human
ucuugucucagauuu

SEQ ID NO: 1692738 - RNA, 14 nt, Human
ucuugucucagauu

SEQ ID NO: 1692739 - RNA, 17 nt, Human
ucuugucucagauuuua

SEQ ID NO: 1692740 - RNA, 17 nt, Human
ucugcaaucuucucaga

SEQ ID NO: 1692741 - RNA, 14 nt, Human
ucugcaaucuucuc

SEQ ID NO: 1692742 - RNA, 21 nt, Human
ucugccuaaggacuucuuuaa

SEQ ID NO: 1692743 - RNA, 20 nt, Human
ucugccuaaggacuucuuua

SEQ ID NO: 1692744 - RNA, 23 nt, Human
ucugccuaaggacuucuuuaauu

SEQ ID NO: 1692745 - RNA, 20 nt, Human
ucagauacuggauuguacuu

SEQ ID NO: 1692746 - RNA, 19 nt, Human
ucagauacuggauuguacu

SEQ ID NO: 1692747 - RNA, 16 nt, Human
ucagauacuggauugu

SEQ ID NO: 1692748 - RNA, 15 nt, Human
ucagauacuggauug

SEQ ID NO: 1692749 - RNA, 14 nt, Human
ucagauacuggauu

SEQ ID NO: 1692750 - RNA, 22 nt, Human
ucagauaacuguuauuuauaau

SEQ ID NO: 1692751 - RNA, 23 nt, Human
ucaucaguauugaagcauuuuau

SEQ ID NO: 1692752 - RNA, 21 nt, Human
ucaucaguauugaagcauuuu

SEQ ID NO: 1692753 - RNA, 20 nt, Human
ucaucaguauugaagcauuu

SEQ ID NO: 1692754 - RNA, 16 nt, Human
ucaucaguauugaagc

SEQ ID NO: 1692755 - RNA, 13 nt, Human
ucucagauuuuau

SEQ ID NO: 1692756 - RNA, 15 nt, Human
ucucagauuuuauua

SEQ ID NO: 1692757 - RNA, 14 nt, Human
ucucagauuuuauu

SEQ ID NO: 1692758 - RNA, 19 nt, Human
ucucagauuuuauuaugua

SEQ ID NO: 1692759 - RNA, 18 nt, Human
ucucagauuuuauuaugu

SEQ ID NO: 1692760 - RNA, 17 nt, Human
ucucagauuuuauuaug

SEQ ID NO: 1692761 - RNA, 16 nt, Human
ucucagauuuuauuau

SEQ ID NO: 1692762 - RNA, 19 nt, Human
ucuauauuuucauucuccu

SEQ ID NO: 1692763 - RNA, 16 nt, Human
ucuauauuuucauucu

SEQ ID NO: 1692764 - RNA, 15 nt, Human
ucuauauuuucauuc

SEQ ID NO: 1692765 - RNA, 14 nt, Human
ucuauauuuucauu

SEQ ID NO: 1692766 - RNA, 13 nt, Human
ucuauauuuucau

SEQ ID NO: 1692767 - RNA, 15 nt, Human
ucgcuuuugauaauc

SEQ ID NO: 1692768 - RNA, 21 nt, Human
uccucucaaccaccuuucaga

SEQ ID NO: 1692769 - RNA, 20 nt, Human
uccucucaaccaccuuucag

SEQ ID NO: 1692770 - RNA, 18 nt, Human
uccucucaaccaccuuuc

SEQ ID NO: 1692771 - RNA, 16 nt, Human
ucccuggccuuucaua

SEQ ID NO: 1692772 - RNA, 24 nt, Human
ucccuggccuuucauauuuuagcu

SEQ ID NO: 1692773 - RNA, 18 nt, Human
uggaacgcguugaaauug

SEQ ID NO: 1692774 - RNA, 19 nt, Human
uggaacgcguugaaauugu

SEQ ID NO: 1692775 - RNA, 20 nt, Human
ugcuuuaauaucaucaguau

SEQ ID NO: 1692776 - RNA, 18 nt, Human
ugcuuuaauaucaucagu

SEQ ID NO: 1692777 - RNA, 15 nt, Human
ugcuuuaauaucauc

SEQ ID NO: 1692778 - RNA, 13 nt, Human
ugcuuuaauauca

SEQ ID NO: 1692779 - RNA, 19 nt, Human
uggcuuuucugauccaguu

SEQ ID NO: 1692780 - RNA, 18 nt, Human
uggcuuuucugauccagu

SEQ ID NO: 1692781 - RNA, 17 nt, Human
uggcuuuucugauccag

SEQ ID NO: 1692782 - RNA, 14 nt, Human
uggcuuuucugauc

SEQ ID NO: 1692783 - RNA, 20 nt, Human
uggggauucuuaaaguugaa

SEQ ID NO: 1692784 - RNA, 18 nt, Human
uggggauucuuaaaguug

SEQ ID NO: 1692785 - RNA, 16 nt, Human
uggggauucuuaaagu

SEQ ID NO: 1692786 - RNA, 13 nt, Human
uggggauucuuaa

SEQ ID NO: 1692787 - RNA, 12 nt, Human
uggggauucuua

SEQ ID NO: 1692788 - RNA, 19 nt, Human
ugcacggugaauggcuuug

SEQ ID NO: 1692789 - RNA, 18 nt, Human
ugcacggugaauggcuuu

SEQ ID NO: 1692790 - RNA, 14 nt, Human
ugcacggugaaugg

SEQ ID NO: 1692791 - RNA, 21 nt, Human
uguauugugcgcuaaacuuuu

SEQ ID NO: 1692792 - RNA, 16 nt, Human
uguuaaaccaugggau

SEQ ID NO: 1692793 - RNA, 23 nt, Human
uguuuccuagcacacacuuuugg

SEQ ID NO: 1692794 - RNA, 23 nt, Human
uguuucuguacuuuuuggcauaa

SEQ ID NO: 1692795 - RNA, 22 nt, Human
uguuucuguacuuuuuggcaua

SEQ ID NO: 1692796 - RNA, 11 nt, Human
uguuucuguac

SEQ ID NO: 1692797 - RNA, 15 nt, Human
uuaaaaaaaaaauug

SEQ ID NO: 1692798 - RNA, 20 nt, Human
uuaaagccauguuuauuaca

SEQ ID NO: 1692799 - RNA, 18 nt, Human
uuaaagccauguuuauua

SEQ ID NO: 1692800 - RNA, 14 nt, Human
uuaaagccauguuu

SEQ ID NO: 1692801 - RNA, 12 nt, Human
uuaaagccaugu

SEQ ID NO: 1692802 - RNA, 20 nt, Human
uuaauauuaaagccauguuu

SEQ ID NO: 1692803 - RNA, 19 nt, Human
uuaauauuaaagccauguu

SEQ ID NO: 1692804 - RNA, 18 nt, Human
uuaauauuaaagccaugu

SEQ ID NO: 1692805 - RNA, 12 nt, Human
uuacagaagccc

SEQ ID NO: 1692806 - RNA, 23 nt, Human
uuaauaauaaauucccuggccuu

SEQ ID NO: 1692807 - RNA, 14 nt, Human
uuaauaauaaauuc

SEQ ID NO: 1692808 - RNA, 11 nt, Human
uuaauauuaaa

SEQ ID NO: 1692809 - RNA, 17 nt, Human
uuaauauuaaagccaug

SEQ ID NO: 1692810 - RNA, 16 nt, Human
uuaauauuaaagccau

SEQ ID NO: 1692811 - RNA, 14 nt, Human
uuaauauuaaagcc

SEQ ID NO: 1692812 - RNA, 13 nt, Human
uuaauauuaaagc

SEQ ID NO: 1692813 - RNA, 19 nt, Human
cacaguuuugguugcuuua

SEQ ID NO: 1692814 - RNA, 23 nt, Human
cacaguuuugguugcuuuaauau

SEQ ID NO: 1692815 - RNA, 20 nt, Human
cacaguuuugguugcuuuaa

SEQ ID NO: 1692816 - RNA, 13 nt, Human
caauuuuguuucu

SEQ ID NO: 1692817 - RNA, 17 nt, Human
caauuuuguuucuguac

SEQ ID NO: 1692818 - RNA, 16 nt, Human
caauuuuguuucugua

SEQ ID NO: 1692819 - RNA, 14 nt, Human
caauuuuguuucug

SEQ ID NO: 1692820 - RNA, 12 nt, Human
cacacacuuuug

SEQ ID NO: 1692821 - RNA, 17 nt, Human
auuuuaacaacagcugg

SEQ ID NO: 1692822 - RNA, 14 nt, Human
caaaguugccuaaa

SEQ ID NO: 1692823 - RNA, 17 nt, Human
caaaguugccuaaaucc

SEQ ID NO: 1692824 - RNA, 15 nt, Human
caaaguugccuaaau

SEQ ID NO: 1692825 - RNA, 18 nt, Human
caaaguugccuaaaucca

SEQ ID NO: 1692826 - RNA, 18 nt, Human
auccagcagauuauucac

SEQ ID NO: 1692827 - RNA, 18 nt, Human
auggcuuuguauagaacc

SEQ ID NO: 1692828 - RNA, 16 nt, Human
auggcuuuguauagaa

SEQ ID NO: 1692829 - RNA, 15 nt, Human
auggcuuuguauaga

SEQ ID NO: 1692830 - RNA, 18 nt, Human
augaaacuuguguaaaua

SEQ ID NO: 1692831 - RNA, 21 nt, Human
agucuggcuguacccaggaau

SEQ ID NO: 1692832 - RNA, 19 nt, Human
agucuggcuguacccagga

SEQ ID NO: 1692833 - RNA, 16 nt, Human
auaaaaaauuaugaca

SEQ ID NO: 1692834 - RNA, 18 nt, Human
auacaauuuuguuucugu

SEQ ID NO: 1692835 - RNA, 17 nt, Human
auacaauuuuguuucug

SEQ ID NO: 1692836 - RNA, 16 nt, Human
auacaauuuuguuucu

SEQ ID NO: 1692837 - RNA, 14 nt, Human
auacaauuuuguuu

SEQ ID NO: 1692838 - RNA, 19 nt, Human
auaaagaucauguaaaagu

SEQ ID NO: 1692839 - RNA, 20 nt, Human
auacuguuugagguuuuuaa

SEQ ID NO: 1692840 - RNA, 16 nt, Human
auacuguuugagguuu

SEQ ID NO: 1692841 - RNA, 12 nt, Human
auacuguuugag

SEQ ID NO: 1692842 - RNA, 16 nt, Human
agacgaugucuucaua

SEQ ID NO: 1692843 - RNA, 18 nt, Human
agaucugccuaaggacuu

SEQ ID NO: 1692844 - RNA, 13 nt, Human
agaucugccuaag

SEQ ID NO: 1692845 - RNA, 21 nt, Human
aggaagguucuggugugaacu

SEQ ID NO: 1692846 - RNA, 16 nt, Human
aggaagguucuggugu

SEQ ID NO: 1692847 - RNA, 14 nt, Human
aggaagguucuggu

SEQ ID NO: 1692848 - RNA, 22 nt, Human
acugauuugacauagucuggcu

SEQ ID NO: 1692849 - RNA, 20 nt, Human
acuggugacugauucuucag

SEQ ID NO: 1692850 - RNA, 19 nt, Human
acuggugacugauucuuca

SEQ ID NO: 1692851 - RNA, 18 nt, Human
acuggugacugauucuuc

SEQ ID NO: 1692852 - RNA, 18 nt, Human
acuucuuuaauuuuggaa

SEQ ID NO: 1692853 - RNA, 20 nt, Human
acuucuuuaauuuuggaauu

SEQ ID NO: 1692854 - RNA, 19 nt, Human
acuucuuuaauuuuggaau

SEQ ID NO: 1692855 - RNA, 21 nt, Human
aauuauaugcuauuucuauau

SEQ ID NO: 1692856 - RNA, 20 nt, Human
aauuauaugcuauuucuaua

SEQ ID NO: 1692857 - RNA, 19 nt, Human
aauuauaugcuauuucuau

SEQ ID NO: 1692858 - RNA, 23 nt, Human
aauuauaucugaggaauucugua

SEQ ID NO: 1692859 - RNA, 22 nt, Human
aauuauaucugaggaauucugu

SEQ ID NO: 1692860 - RNA, 20 nt, Human
aauuauaucugaggaauucu

SEQ ID NO: 1692861 - RNA, 15 nt, Human
aauuggggauucuua

SEQ ID NO: 1692862 - RNA, 12 nt, Human
aauucuguauag

SEQ ID NO: 1692863 - RNA, 20 nt, Human
aauucuguauagauuagaga

SEQ ID NO: 1692864 - RNA, 14 nt, Human
aauucuguauagau

SEQ ID NO: 1692865 - RNA, 13 nt, Human
aauucuguauaga

SEQ ID NO: 1692866 - RNA, 14 nt, Human
aauuguaauuauau

SEQ ID NO: 1692867 - RNA, 16 nt, Human
aauuguaauuauaucu

SEQ ID NO: 1692868 - RNA, 15 nt, Human
aauuguaauuauauc

SEQ ID NO: 1692869 - RNA, 17 nt, Human
aauuguaauuauaucug

SEQ ID NO: 1692870 - RNA, 14 nt, Human
acauguuaaaccau

SEQ ID NO: 1692871 - RNA, 23 nt, Human
acauguuaaaccaugggauaaau

SEQ ID NO: 1692872 - RNA, 21 nt, Human
acauguuaaaccaugggauaa

SEQ ID NO: 1692873 - RNA, 16 nt, Human
acauguuaaaccaugg

SEQ ID NO: 1692874 - RNA, 19 nt, Human
aauaaagaucauguaaaag

SEQ ID NO: 1692875 - RNA, 14 nt, Human
aauaaagaucaugu

SEQ ID NO: 1692876 - RNA, 20 nt, Human
aauaaagaucauguaaaagu

SEQ ID NO: 1692877 - RNA, 17 nt, Human
aaguugaauuuauuggc

SEQ ID NO: 1692878 - RNA, 15 nt, Human
aaguugaauuuauug

SEQ ID NO: 1692879 - RNA, 14 nt, Human
aaguugaauuuauu

SEQ ID NO: 1692880 - RNA, 22 nt, Human
aaguuguuugagaaauuaagua

SEQ ID NO: 1692881 - RNA, 21 nt, Human
aaguuguuugagaaauuaagu

SEQ ID NO: 1692882 - RNA, 24 nt, Human
aaguugaauuuauuggcuuuucug

SEQ ID NO: 1692883 - RNA, 23 nt, Human
aaguugaauuuauuggcuuuucu

SEQ ID NO: 1692884 - RNA, 15 nt, Human
aaguuuaauauuaaa

SEQ ID NO: 1692885 - RNA, 18 nt, Human
aaguuuaauauuaaagcc

SEQ ID NO: 1692886 - RNA, 17 nt, Human
aaguuuaauauuaaagc

SEQ ID NO: 1692887 - RNA, 23 nt, Human
aaggacuucuuuaauuuuggaau

SEQ ID NO: 1692888 - RNA, 21 nt, Human
aaggacuuguuagaucuaguu

SEQ ID NO: 1692889 - RNA, 15 nt, Human
aaggacuuguuagau

SEQ ID NO: 1692890 - RNA, 23 nt, Human
aaggacuuguuagaucuaguuca

SEQ ID NO: 1692891 - RNA, 23 nt, Human
aaauggacuguggugacuuugga

SEQ ID NO: 1692892 - RNA, 20 nt, Human
aaauggacuguggugacuuu

SEQ ID NO: 1692893 - RNA, 21 nt, Human
aaauggacuguggugacuuug

SEQ ID NO: 1692894 - RNA, 15 nt, Human
aaagaucauguaaaa

SEQ ID NO: 1692895 - RNA, 16 nt, Human
aaagccauguuuauua

SEQ ID NO: 1692896 - RNA, 14 nt, Human
aaagccauguuuau

SEQ ID NO: 1692897 - RNA, 23 nt, Human
aaagccauguuuauuacaguaua

SEQ ID NO: 1692898 - RNA, 18 nt, Human
aaagccauguuuauuaca

SEQ ID NO: 1692899 - RNA, 17 nt, Human
aaagccauguuuauuac

SEQ ID NO: 1692900 - RNA, 22 nt, Human
aaaccaguauuguacaaaguau

SEQ ID NO: 1692901 - RNA, 18 nt, Human
aaaccaguauuguacaaa

SEQ ID NO: 1692902 - RNA, 17 nt, Human
aaaccaguauuguacaa

SEQ ID NO: 1692903 - RNA, 16 nt, Human
aaaccaguauuguaca

SEQ ID NO: 1692904 - RNA, 14 nt, Human
aaaccaguauugua

SEQ ID NO: 1692905 - RNA, 22 nt, Human
aaaagagguuuuucuuaaauaa

SEQ ID NO: 1692906 - RNA, 21 nt, Human
aaaagagguuuuucuuaaaua

SEQ ID NO: 1692907 - RNA, 17 nt, Human
aaaagagguuuuucuua

SEQ ID NO: 1692908 - RNA, 18 nt, Human
aaaaguuuaauauuaaag

SEQ ID NO: 1692909 - RNA, 16 nt, Human
aaaaguuuaauauuaa

SEQ ID NO: 1692910 - RNA, 14 nt, Human
aaaaguuuaauauu

SEQ ID NO: 1692911 - RNA, 15 nt, Human
aaauucccuggccuu

SEQ ID NO: 1692912 - RNA, 18 nt, Human
aaauucccuggccuuuca

SEQ ID NO: 1692913 - RNA, 21 nt, Human
guaugugugaagugagugagu

SEQ ID NO: 1692914 - RNA, 17 nt, Human
guaugugugaagugagu

SEQ ID NO: 1692915 - RNA, 13 nt, Human
guaugugugaagu

SEQ ID NO: 1692916 - RNA, 15 nt, Human
aaaucgcuuuugaua

SEQ ID NO: 1692917 - RNA, 14 nt, Human
aaaucgcuuuugau

SEQ ID NO: 1692918 - RNA, 13 nt, Human
aaaucgcuuuuga

SEQ ID NO: 1692919 - RNA, 22 nt, Human
aaaucccauuauucaaaguugc

SEQ ID NO: 1692920 - RNA, 21 nt, Human
aaaucccauuauucaaaguug

SEQ ID NO: 1692921 - RNA, 20 nt, Human
aaaucccauuauucaaaguu

SEQ ID NO: 1692922 - RNA, 19 nt, Human
aaaucccauuauucaaagu

SEQ ID NO: 1692923 - RNA, 17 nt, Human
aaaucccauuauucaaa

SEQ ID NO: 1692924 - RNA, 16 nt, Human
aaaucccauuauucaa

SEQ ID NO: 1692925 - RNA, 15 nt, Human
aaaucccauuauuca

SEQ ID NO: 1692926 - RNA, 13 nt, Human
aaaucccauuauu

SEQ ID NO: 1692927 - RNA, 23 nt, Human
aaauccauuuggaaaucuuuaaa

SEQ ID NO: 1692928 - RNA, 22 nt, Human
aaauccauuuggaaaucuuuaa

SEQ ID NO: 1692929 - RNA, 21 nt, Human
aaauccauuuggaaaucuuua

SEQ ID NO: 1692930 - RNA, 18 nt, Human
aaauccauuuggaaaucu

SEQ ID NO: 1692931 - RNA, 14 nt, Human
aaauccauuuggaa

SEQ ID NO: 1692932 - RNA, 16 nt, Human
aaauccauuuggaaau

SEQ ID NO: 1692933 - RNA, 15 nt, Human
aaauccauuuggaaa

SEQ ID NO: 1692934 - RNA, 21 nt, Human
aaccaugggauaaaugccauc

SEQ ID NO: 1692935 - RNA, 20 nt, Human
aaccaugggauaaaugccau

SEQ ID NO: 1692936 - RNA, 18 nt, Human
aaccaugggauaaaugcc

SEQ ID NO: 1692937 - RNA, 17 nt, Human
aaccaugggauaaaugc

SEQ ID NO: 1692938 - RNA, 15 nt, Human
aaccaugggauaaau

SEQ ID NO: 1692939 - RNA, 17 nt, Human
aacuaaacuuucacacc

SEQ ID NO: 1692940 - RNA, 15 nt, Human
aacuaaacuuucaca

SEQ ID NO: 1692941 - RNA, 13 nt, Human
aacuaaacuuuca

SEQ ID NO: 1692942 - RNA, 17 nt, Human
aacacuccaauuaagga

SEQ ID NO: 1692943 - RNA, 14 nt, Human
guuauuuauaauca

SEQ ID NO: 1692944 - RNA, 20 nt, Human
guuauuuauaaucacuuuuu

SEQ ID NO: 1692945 - RNA, 13 nt, Human
guuaagucuguuu

SEQ ID NO: 1692946 - RNA, 22 nt, Human
guuaagucuguuuuaugacuuc

SEQ ID NO: 1692947 - RNA, 15 nt, Human
guuaagucuguuuua

SEQ ID NO: 1692948 - RNA, 12 nt, Human
guuagaucuagu

SEQ ID NO: 1692949 - RNA, 18 nt, Human
guucuggugugaacuaaa

SEQ ID NO: 1692950 - RNA, 15 nt, Human
guucuggugugaacu

SEQ ID NO: 1692951 - RNA, 21 nt, Human
guucuuguauuaagaaugaaa

SEQ ID NO: 1692952 - RNA, 18 nt, Human
guucuuguauuaagaaug

SEQ ID NO: 1692953 - RNA, 17 nt, Human
guucuuguauuaagaau

SEQ ID NO: 1692954 - RNA, 17 nt, Human
guugccuaaauccauuu

SEQ ID NO: 1692955 - RNA, 14 nt, Human
guugccuaaaucca

SEQ ID NO: 1692956 - RNA, 16 nt, Human
guugccuaaauccauu

SEQ ID NO: 1692957 - RNA, 15 nt, Human
guugccuaaauccau

SEQ ID NO: 1692958 - RNA, 20 nt, Human
guuucuguacuuuuuggcau

SEQ ID NO: 1692959 - RNA, 19 nt, Human
guguuguacucaauuuuaa

SEQ ID NO: 1692960 - RNA, 16 nt, Human
aagagguuuuucuuaa

SEQ ID NO: 1692961 - RNA, 22 nt, Human
aagaaugguccgugcuaaggac

SEQ ID NO: 1692962 - RNA, 19 nt, Human
aagaaugguccgugcuaag

SEQ ID NO: 1692963 - RNA, 23 nt, Human
uacaguauaauuaacauguuaaa

SEQ ID NO: 1692964 - RNA, 19 nt, Human
uacaguauaauuaacaugu

SEQ ID NO: 1692965 - RNA, 18 nt, Human
uacaguauaauuaacaug

SEQ ID NO: 1692966 - RNA, 20 nt, Human
aauggacuguggugacuuug

SEQ ID NO: 1692967 - RNA, 14 nt, Human
uacaccauuaugug

SEQ ID NO: 1692968 - RNA, 14 nt, Human
uacaguauaauuaa

SEQ ID NO: 1692969 - RNA, 17 nt, Human
uacaguauaauuaacau

SEQ ID NO: 1692970 - RNA, 16 nt, Human
uacaguauaauuaaca

SEQ ID NO: 1692971 - RNA, 20 nt, Human
aaucuuuaaaaaaaaaauug

SEQ ID NO: 1692972 - RNA, 19 nt, Human
aaucuuuaaaaaaaaaauu

SEQ ID NO: 1692973 - RNA, 21 nt, Human
uaaucaacugggcugaacacu

SEQ ID NO: 1692974 - RNA, 16 nt, Human
uaaguaucugacaucu

SEQ ID NO: 1692975 - RNA, 15 nt, Human
uaaguaucugacauc

SEQ ID NO: 1692976 - RNA, 19 nt, Human
aaucugugaacuugaaauu

SEQ ID NO: 1692977 - RNA, 18 nt, Human
aaucugugaacuugaaau

SEQ ID NO: 1692978 - RNA, 17 nt, Human
aaucugugaacuugaaa

SEQ ID NO: 1692979 - RNA, 15 nt, Human
aaucugugaacuuga

SEQ ID NO: 1692980 - RNA, 13 nt, Human
aaucugugaacuu

SEQ ID NO: 1692981 - RNA, 18 nt, Human
aauaucaucaguauugaa

SEQ ID NO: 1692982 - RNA, 15 nt, Human
uaacauaaaucugug

SEQ ID NO: 1692983 - RNA, 20 nt, Human
uaacauaaaucugugaacuu

SEQ ID NO: 1692984 - RNA, 18 nt, Human
uaacauaaaucugugaac

SEQ ID NO: 1692985 - RNA, 17 nt, Human
uaacauaaaucugugaa

SEQ ID NO: 1692986 - RNA, 16 nt, Human
uaacauaaaucuguga

SEQ ID NO: 1692987 - RNA, 18 nt, Human
aauauuuuaugauccagc

SEQ ID NO: 1692988 - RNA, 17 nt, Human
aauauuuuaugauccag

SEQ ID NO: 1692989 - RNA, 21 nt, Human
uaagaaugaaauacuguuuga

SEQ ID NO: 1692990 - RNA, 15 nt, Human
uaagaaugaaauacu

SEQ ID NO: 1692991 - RNA, 13 nt, Human
uaagaaugaaaua

SEQ ID NO: 1692992 - RNA, 14 nt, Human
uaaauaaauagcua

SEQ ID NO: 1692993 - RNA, 17 nt, Human
uaaauaaauaaauagcu

SEQ ID NO: 1692994 - RNA, 18 nt, Human
uaaauagcuagacuggug

SEQ ID NO: 1692995 - RNA, 22 nt, Human
uaaaucugugaacuugaaauuu

SEQ ID NO: 1692996 - RNA, 21 nt, Human
uaaaucugugaacuugaaauu

SEQ ID NO: 1692997 - RNA, 19 nt, Human
uaaaucugugaacuugaaa

SEQ ID NO: 1692998 - RNA, 18 nt, Human
uaaaucugugaacuugaa

SEQ ID NO: 1692999 - RNA, 17 nt, Human
uaaaucugugaacuuga

SEQ ID NO: 1693000 - RNA, 16 nt, Human
uaaaucugugaacuug

SEQ ID NO: 1693001 - RNA, 15 nt, Human
uaaaucugugaacuu

SEQ ID NO: 1693002 - RNA, 18 nt, Human
uagcuagacuggugacug

SEQ ID NO: 1693003 - RNA, 15 nt, Human
uagcuagacugguga

SEQ ID NO: 1693004 - RNA, 15 nt, Human
acaacagcuggugcc

SEQ ID NO: 1693005 - RNA, 14 nt, Human
uagaucuaguucac

SEQ ID NO: 1693006 - RNA, 20 nt, Human
acaaaguauuaagcauauau

SEQ ID NO: 1693007 - RNA, 16 nt, Human
aauuuuguuucuguac

SEQ ID NO: 1693008 - RNA, 22 nt, Human
uacuuugugcugggguuaucug

SEQ ID NO: 1693009 - RNA, 16 nt, Human
uacuuugugcuggggu

SEQ ID NO: 1693010 - RNA, 14 nt, Human
uacuuuuuggcaua

SEQ ID NO: 1693011 - RNA, 20 nt, Human
uacuuuuuggcauaacauaa

SEQ ID NO: 1693012 - RNA, 19 nt, Human
uacuuuuuggcauaacaua

SEQ ID NO: 1693013 - RNA, 18 nt, Human
acacuccaauuaaggauu

SEQ ID NO: 1693014 - RNA, 21 nt, Human
acacuccaauuaaggauuuua

SEQ ID NO: 1693015 - RNA, 22 nt, Human
uagucuugucucagauuuuauu

SEQ ID NO: 1693016 - RNA, 17 nt, Human
uagucuugucucagauu

SEQ ID NO: 1693017 - RNA, 21 nt, Human
acaccccagacgaugucuuca

SEQ ID NO: 1693018 - RNA, 13 nt, Human
ucaauuuuaacaa

SEQ ID NO: 1693019 - RNA, 19 nt, Human
accaugggauaaaugccau

SEQ ID NO: 1693020 - RNA, 22 nt, Human
ucagaaggcaaaugacuuugga

SEQ ID NO: 1693021 - RNA, 19 nt, Human
ucagaaggcaaaugacuuu

SEQ ID NO: 1693022 - RNA, 18 nt, Human
ucagaaggcaaaugacuu

SEQ ID NO: 1693023 - RNA, 18 nt, Human
accccagacgaugucuuc

SEQ ID NO: 1693024 - RNA, 16 nt, Human
uauuuuuauauuuacu

SEQ ID NO: 1693025 - RNA, 21 nt, Human
ucaaaguugccuaaauccauu

SEQ ID NO: 1693026 - RNA, 19 nt, Human
ucaaaguugccuaaaucca

SEQ ID NO: 1693027 - RNA, 18 nt, Human
ucaaaguugccuaaaucc

SEQ ID NO: 1693028 - RNA, 22 nt, Human
ucaaaguugccuaaauccauuu

SEQ ID NO: 1693029 - RNA, 20 nt, Human
acauagucuggcuguaccca

SEQ ID NO: 1693030 - RNA, 15 nt, Human
acauagucuggcugu

SEQ ID NO: 1693031 - RNA, 14 nt, Human
acauagucuggcug

SEQ ID NO: 1693032 - RNA, 24 nt, Human
acaguuuugguugcuuuaauauca

SEQ ID NO: 1693033 - RNA, 19 nt, Human
acaguuuugguugcuuuaa

SEQ ID NO: 1693034 - RNA, 18 nt, Human
acaguuuugguugcuuua

SEQ ID NO: 1693035 - RNA, 18 nt, Human
uauuucuauauuuucauu

SEQ ID NO: 1693036 - RNA, 17 nt, Human
uauuucuauauuuucau

SEQ ID NO: 1693037 - RNA, 16 nt, Human
uauuucuauauuuuca

SEQ ID NO: 1693038 - RNA, 15 nt, Human
accuacauguauuug

SEQ ID NO: 1693039 - RNA, 14 nt, Human
accuacauguauuu

SEQ ID NO: 1693040 - RNA, 13 nt, Human
accuacauguauu

SEQ ID NO: 1693041 - RNA, 18 nt, Human
uccauuuaauaauuauau

SEQ ID NO: 1693042 - RNA, 22 nt, Human
ucuaccagccucccuauuuuuu

SEQ ID NO: 1693043 - RNA, 14 nt, Human
acuguuauuuauaa

SEQ ID NO: 1693044 - RNA, 13 nt, Human
acuguuauuuaua

SEQ ID NO: 1693045 - RNA, 15 nt, Human
acuguggugacuuug

SEQ ID NO: 1693046 - RNA, 14 nt, Human
acuguggugacuuu

SEQ ID NO: 1693047 - RNA, 12 nt, Human
acuguggugacu

SEQ ID NO: 1693048 - RNA, 21 nt, Human
acuguggugacuuuggauaau

SEQ ID NO: 1693049 - RNA, 20 nt, Human
acuguggugacuuuggauaa

SEQ ID NO: 1693050 - RNA, 18 nt, Human
acuguggugacuuuggau

SEQ ID NO: 1693051 - RNA, 16 nt, Human
acugcuuguuuccuag

SEQ ID NO: 1693052 - RNA, 13 nt, Human
acugcuuguuucc

SEQ ID NO: 1693053 - RNA, 16 nt, Human
ucugaagugaaacugc

SEQ ID NO: 1693054 - RNA, 19 nt, Human
ucugaagucagaucugccu

SEQ ID NO: 1693055 - RNA, 15 nt, Human
ucugaagucagaucu

SEQ ID NO: 1693056 - RNA, 19 nt, Human
acuugaaauuugaauuuug

SEQ ID NO: 1693057 - RNA, 20 nt, Human
acuugaaauuugaauuuugu

SEQ ID NO: 1693058 - RNA, 15 nt, Human
acuuguuagaucuag

SEQ ID NO: 1693059 - RNA, 14 nt, Human
acuuguuagaucua

SEQ ID NO: 1693060 - RNA, 23 nt, Human
acuuguuagaucuaguucacucu

SEQ ID NO: 1693061 - RNA, 19 nt, Human
ucugugaacuugaaauuug

SEQ ID NO: 1693062 - RNA, 22 nt, Human
ucugugaacuugaaauuugaau

SEQ ID NO: 1693063 - RNA, 13 nt, Human
ucuguacuuuuug

SEQ ID NO: 1693064 - RNA, 17 nt, Human
ucuguacuuuuuggcau

SEQ ID NO: 1693065 - RNA, 14 nt, Human
ucuguacuuuuugg

SEQ ID NO: 1693066 - RNA, 19 nt, Human
agacuggugacugauucuu

SEQ ID NO: 1693067 - RNA, 17 nt, Human
agacuggugacugauuc

SEQ ID NO: 1693068 - RNA, 16 nt, Human
agacuggugacugauu

SEQ ID NO: 1693069 - RNA, 14 nt, Human
agacuggugacuga

SEQ ID NO: 1693070 - RNA, 13 nt, Human
agacuggugacug

SEQ ID NO: 1693071 - RNA, 12 nt, Human
agacuggugacu

SEQ ID NO: 1693072 - RNA, 22 nt, Human
agagauuuuuuuguuguuuguu

SEQ ID NO: 1693073 - RNA, 23 nt, Human
agagauuuuuuuguuguuuguuu

SEQ ID NO: 1693074 - RNA, 21 nt, Human
ugaaauuguaauuauaucuga

SEQ ID NO: 1693075 - RNA, 16 nt, Human
ugaaauuugaauuuug

SEQ ID NO: 1693076 - RNA, 15 nt, Human
ugaaauuugaauuuu

SEQ ID NO: 1693077 - RNA, 14 nt, Human
ugaaauuugaauuu

SEQ ID NO: 1693078 - RNA, 17 nt, Human
ugaaauuugaauuuugu

SEQ ID NO: 1693079 - RNA, 21 nt, Human
ugaauuuauuggcuuuucuga

SEQ ID NO: 1693080 - RNA, 17 nt, Human
ugaauuuauuggcuuuu

SEQ ID NO: 1693081 - RNA, 23 nt, Human
ugaauuuauuggcuuuucugauc

SEQ ID NO: 1693082 - RNA, 22 nt, Human
ugaauuuauuggcuuuucugau

SEQ ID NO: 1693083 - RNA, 15 nt, Human
agcauauauuuuuau

SEQ ID NO: 1693084 - RNA, 22 nt, Human
agcauauauuuuuauauuuacu

SEQ ID NO: 1693085 - RNA, 20 nt, Human
agcauauauuuuuauauuua

SEQ ID NO: 1693086 - RNA, 18 nt, Human
agcauauauuuuuauauu

SEQ ID NO: 1693087 - RNA, 20 nt, Human
agcauuuuauaaaucgcuuu

SEQ ID NO: 1693088 - RNA, 15 nt, Human
agcauuuuauaaauc

SEQ ID NO: 1693089 - RNA, 14 nt, Human
agcauuuuauaaau

SEQ ID NO: 1693090 - RNA, 13 nt, Human
agcauuuuauaaa

SEQ ID NO: 1693091 - RNA, 19 nt, Human
ugauccagcagauuauuca

SEQ ID NO: 1693092 - RNA, 20 nt, Human
ugauccagcagauuauucac

SEQ ID NO: 1693093 - RNA, 23 nt, Human
ugauuugacauagucuggcugua

SEQ ID NO: 1693094 - RNA, 23 nt, Human
aggacuucuuuaauuuuggaauu

SEQ ID NO: 1693095 - RNA, 22 nt, Human
aggacuucuuuaauuuuggaau

SEQ ID NO: 1693096 - RNA, 21 nt, Human
aggacuucuuuaauuuuggaa

SEQ ID NO: 1693097 - RNA, 16 nt, Human
aggacuucuuuaauuu

SEQ ID NO: 1693098 - RNA, 14 nt, Human
aggacuucuuuaau

SEQ ID NO: 1693099 - RNA, 15 nt, Human
aggaauucuguauag

SEQ ID NO: 1693100 - RNA, 14 nt, Human
aggaauucuguaua

SEQ ID NO: 1693101 - RNA, 13 nt, Human
aggaauucuguau

SEQ ID NO: 1693102 - RNA, 22 nt, Human
ugccaucaauaaaaaauuauga

SEQ ID NO: 1693103 - RNA, 14 nt, Human
ugccaucaauaaaa

SEQ ID NO: 1693104 - RNA, 22 nt, Human
ugcuauuucuauauuuucauuc

SEQ ID NO: 1693105 - RNA, 15 nt, Human
uguaaauacaauuuu

SEQ ID NO: 1693106 - RNA, 17 nt, Human
agguucuggugugaacu

SEQ ID NO: 1693107 - RNA, 23 nt, Human
uggugugaacuaaacuuucacac

SEQ ID NO: 1693108 - RNA, 22 nt, Human
uggugugaacuaaacuuucaca

SEQ ID NO: 1693109 - RNA, 14 nt, Human
uggugugaacuaaa

SEQ ID NO: 1693110 - RNA, 14 nt, Human
uggugcccugcuuu

SEQ ID NO: 1693111 - RNA, 20 nt, Human
uggugcccugcuuucagaua

SEQ ID NO: 1693112 - RNA, 19 nt, Human
uggugcccugcuuucagau

SEQ ID NO: 1693113 - RNA, 16 nt, Human
uggugcccugcuuuca

SEQ ID NO: 1693114 - RNA, 21 nt, Human
aguauugaagcauuuuauaaa

SEQ ID NO: 1693115 - RNA, 20 nt, Human
aguauugaagcauuuuauaa

SEQ ID NO: 1693116 - RNA, 18 nt, Human
aguauugaagcauuuuau

SEQ ID NO: 1693117 - RNA, 15 nt, Human
aguauugaagcauuu

SEQ ID NO: 1693118 - RNA, 14 nt, Human
aguauugaagcauu

SEQ ID NO: 1693119 - RNA, 13 nt, Human
agguuuuucuuaa

SEQ ID NO: 1693120 - RNA, 20 nt, Human
uuaagucuguuuuaugacuu

SEQ ID NO: 1693121 - RNA, 18 nt, Human
uuaagucuguuuuaugac

SEQ ID NO: 1693122 - RNA, 17 nt, Human
uuaagucuguuuuauga

SEQ ID NO: 1693123 - RNA, 21 nt, Human
uuaagucuguuuuaugacuuc

SEQ ID NO: 1693124 - RNA, 16 nt, Human
auaaaugguuaaaaga

SEQ ID NO: 1693125 - RNA, 22 nt, Human
auaaaugguuaaaagagguuuu

SEQ ID NO: 1693126 - RNA, 13 nt, Human
uuacaguauaauu

SEQ ID NO: 1693127 - RNA, 17 nt, Human
uuacaguauaauuaaca

SEQ ID NO: 1693128 - RNA, 16 nt, Human
uuacaguauaauuaac

SEQ ID NO: 1693129 - RNA, 20 nt, Human
uuacaguauaauuaacaugu

SEQ ID NO: 1693130 - RNA, 19 nt, Human
uuacaguauaauuaacaug

SEQ ID NO: 1693131 - RNA, 18 nt, Human
uuacaguauaauuaacau

SEQ ID NO: 1693132 - RNA, 21 nt, Human
auaaauagcuagacuggugac

SEQ ID NO: 1693133 - RNA, 18 nt, Human
auaaauagcuagacuggu

SEQ ID NO: 1693134 - RNA, 16 nt, Human
auaaauagcuagacug

SEQ ID NO: 1693135 - RNA, 22 nt, Human
auaaaucugugaacuugaaauu

SEQ ID NO: 1693136 - RNA, 21 nt, Human
auaaaucugugaacuugaaau

SEQ ID NO: 1693137 - RNA, 20 nt, Human
auaaaucugugaacuugaaa

SEQ ID NO: 1693138 - RNA, 14 nt, Human
uguuugagaaauua

SEQ ID NO: 1693139 - RNA, 22 nt, Human
uguuugagguuuuuaagccuua

SEQ ID NO: 1693140 - RNA, 14 nt, Human
uguuuauuacagua

SEQ ID NO: 1693141 - RNA, 18 nt, Human
uguuuauuacaguauaau

SEQ ID NO: 1693142 - RNA, 22 nt, Human
uguuuagucuugucucagauuu

SEQ ID NO: 1693143 - RNA, 23 nt, Human
uguuuagucuugucucagauuuu

SEQ ID NO: 1693144 - RNA, 18 nt, Human
uguuuuaugacuucauua

SEQ ID NO: 1693145 - RNA, 19 nt, Human
uguuuggaccaaaaaccag

SEQ ID NO: 1693146 - RNA, 23 nt, Human
aguugccuaaauccauuuggaaa

SEQ ID NO: 1693147 - RNA, 22 nt, Human
aguugccuaaauccauuuggaa

SEQ ID NO: 1693148 - RNA, 16 nt, Human
aguuggguguauugug

SEQ ID NO: 1693149 - RNA, 20 nt, Human
aguuggguguauugugcgcu

SEQ ID NO: 1693150 - RNA, 17 nt, Human
aguuggguguauugugc

SEQ ID NO: 1693151 - RNA, 20 nt, Human
aguuuaauauuaaagccaug

SEQ ID NO: 1693152 - RNA, 19 nt, Human
aguuuaauauuaaagccau

SEQ ID NO: 1693153 - RNA, 18 nt, Human
aguuuaauauuaaagcca

SEQ ID NO: 1693154 - RNA, 16 nt, Human
aguuuaauauuaaagc

SEQ ID NO: 1693155 - RNA, 15 nt, Human
aguuuaauauuaaag

SEQ ID NO: 1693156 - RNA, 20 nt, Human
uuaaaggaagguucuggugu

SEQ ID NO: 1693157 - RNA, 22 nt, Human
uuaaaggaagguucugguguga

SEQ ID NO: 1693158 - RNA, 16 nt, Human
uuaaauaauaaagauc

SEQ ID NO: 1693159 - RNA, 14 nt, Human
uuaacaacagcugg

SEQ ID NO: 1693160 - RNA, 20 nt, Human
agugaguuggguguauugug

SEQ ID NO: 1693161 - RNA, 19 nt, Human
agugaguuggguguauugu

SEQ ID NO: 1693162 - RNA, 13 nt, Human
uguuauauaaaug

SEQ ID NO: 1693163 - RNA, 14 nt, Human
uguuauauaaaugg

SEQ ID NO: 1693164 - RNA, 12 nt, Human
ugugaacuugaa

SEQ ID NO: 1693165 - RNA, 16 nt, Human
ugugaacuugaaauuu

SEQ ID NO: 1693166 - RNA, 15 nt, Human
ugugaacuugaaauu

SEQ ID NO: 1693167 - RNA, 14 nt, Human
ugugaacuugaaau

SEQ ID NO: 1693168 - RNA, 24 nt, Human
agugaaacugcuuguuuccuagca

SEQ ID NO: 1693169 - RNA, 21 nt, Human
agugaaacugcuuguuuccua

SEQ ID NO: 1693170 - RNA, 13 nt, Human
agugaaacugcuu

SEQ ID NO: 1693171 - RNA, 18 nt, Human
ugugcugggguuaucuga

SEQ ID NO: 1693172 - RNA, 23 nt, Human
auauuaaagccauguuuauuaca

SEQ ID NO: 1693173 - RNA, 18 nt, Human
auauuaaagccauguuua

SEQ ID NO: 1693174 - RNA, 15 nt, Human
auauuaaagccaugu

SEQ ID NO: 1693175 - RNA, 14 nt, Human
auauuaaagccaug

SEQ ID NO: 1693176 - RNA, 13 nt, Human
auauuuucauucu

SEQ ID NO: 1693177 - RNA, 13 nt, Human
auauuuuaugauc

SEQ ID NO: 1693178 - RNA, 12 nt, Human
auauuuuaugau

SEQ ID NO: 1693179 - RNA, 22 nt, Human
auauuuuaugauccagcagauu

SEQ ID NO: 1693180 - RNA, 17 nt, Human
auauuuuaugauccagc

SEQ ID NO: 1693181 - RNA, 22 nt, Human
aucaguauugaagcauuuuaua

SEQ ID NO: 1693182 - RNA, 15 nt, Human
aucaguauugaagca

SEQ ID NO: 1693183 - RNA, 17 nt, Human
aucaucaguauugaagc

SEQ ID NO: 1693184 - RNA, 19 nt, Human
aucaucaguauugaagcau

SEQ ID NO: 1693185 - RNA, 15 nt, Human
aucaucaguauugaa

SEQ ID NO: 1693186 - RNA, 14 nt, Human
uucuggugugaacu

SEQ ID NO: 1693187 - RNA, 12 nt, Human
uucuggugugaa

SEQ ID NO: 1693188 - RNA, 17 nt, Human
uuauuuauaaucacuuu

SEQ ID NO: 1693189 - RNA, 16 nt, Human
auagcuagacugguga

SEQ ID NO: 1693190 - RNA, 15 nt, Human
auagcuagacuggug

SEQ ID NO: 1693191 - RNA, 14 nt, Human
auagcuagacuggu

SEQ ID NO: 1693192 - RNA, 23 nt, Human
auagcuagacuggugacugauuc

SEQ ID NO: 1693193 - RNA, 19 nt, Human
auagcuagacuggugacug

SEQ ID NO: 1693194 - RNA, 18 nt, Human
auagcuagacuggugacu

SEQ ID NO: 1693195 - RNA, 17 nt, Human
auauaaaugguuaaaag

SEQ ID NO: 1693196 - RNA, 21 nt, Human
uucagcaaaaauauuuuauga

SEQ ID NO: 1693197 - RNA, 18 nt, Human
auaucugaggaauucugu

SEQ ID NO: 1693198 - RNA, 17 nt, Human
auaucugaggaauucug

SEQ ID NO: 1693199 - RNA, 16 nt, Human
auaucugaggaauucu

SEQ ID NO: 1693200 - RNA, 15 nt, Human
auaucugaggaauuc

SEQ ID NO: 1693201 - RNA, 23 nt, Human
auaucugaggaauucuguauaga

SEQ ID NO: 1693202 - RNA, 22 nt, Human
auaucugaggaauucuguauag

SEQ ID NO: 1693203 - RNA, 21 nt, Human
auaucugaggaauucuguaua

SEQ ID NO: 1693204 - RNA, 20 nt, Human
auaucugaggaauucuguau

SEQ ID NO: 1693205 - RNA, 19 nt, Human
auaucugaggaauucugua

SEQ ID NO: 1693206 - RNA, 19 nt, Human
uucauaccuacauguauuu

SEQ ID NO: 1693207 - RNA, 16 nt, Human
uucauaccuacaugua

SEQ ID NO: 1693208 - RNA, 22 nt, Human
augaaauacuguuugagguuuu

SEQ ID NO: 1693209 - RNA, 23 nt, Human
aucugaagucagaucugccuaag

SEQ ID NO: 1693210 - RNA, 18 nt, Human
aucugaagucagaucugc

SEQ ID NO: 1693211 - RNA, 17 nt, Human
aucugaagucagaucug

SEQ ID NO: 1693212 - RNA, 16 nt, Human
aucugaagucagaucu

SEQ ID NO: 1693213 - RNA, 23 nt, Human
uuuagucuugucucagauuuuau

SEQ ID NO: 1693214 - RNA, 17 nt, Human
uuuagucuugucucaga

SEQ ID NO: 1693215 - RNA, 15 nt, Human
uuuagucuugucuca

SEQ ID NO: 1693216 - RNA, 14 nt, Human
augccaucaauaaa

SEQ ID NO: 1693217 - RNA, 13 nt, Human
auuugaauuuugu

SEQ ID NO: 1693218 - RNA, 15 nt, Human
auuugaauuuugugu

SEQ ID NO: 1693219 - RNA, 23 nt, Human
auuuauuggcuuuucugauccag

SEQ ID NO: 1693220 - RNA, 20 nt, Human
auuuauuggcuuuucugauc

SEQ ID NO: 1693221 - RNA, 18 nt, Human
auuuauuggcuuuucuga

SEQ ID NO: 1693222 - RNA, 14 nt, Human
auuuauuggcuuuu

SEQ ID NO: 1693223 - RNA, 15 nt, Human
auuguacuuugugcu

SEQ ID NO: 1693224 - RNA, 20 nt, Human
auuuacuaaaauggacugug

SEQ ID NO: 1693225 - RNA, 19 nt, Human
auuuacuaaaauggacugu

SEQ ID NO: 1693226 - RNA, 16 nt, Human
auuuacuaaaauggac

SEQ ID NO: 1693227 - RNA, 22 nt, Human
auuggggauucuuaaaguugaa

SEQ ID NO: 1693228 - RNA, 21 nt, Human
auuggggauucuuaaaguuga

SEQ ID NO: 1693229 - RNA, 20 nt, Human
auuggggauucuuaaaguug

SEQ ID NO: 1693230 - RNA, 16 nt, Human
auuggggauucuuaaa

SEQ ID NO: 1693231 - RNA, 15 nt, Human
auuggggauucuuaa

SEQ ID NO: 1693232 - RNA, 14 nt, Human
auuggggauucuua

SEQ ID NO: 1693233 - RNA, 24 nt, Human
uuuuuggcauaacauaaaucugug

SEQ ID NO: 1693234 - RNA, 23 nt, Human
uuuuuggcauaacauaaaucugu

SEQ ID NO: 1693235 - RNA, 17 nt, Human
auuaaguaucugacauc

SEQ ID NO: 1693236 - RNA, 20 nt, Human
auuaaggauuuuaugcuuua

SEQ ID NO: 1693237 - RNA, 17 nt, Human
auuaaggauuuuaugcu

SEQ ID NO: 1693238 - RNA, 15 nt, Human
auuaaggauuuuaug

SEQ ID NO: 1693239 - RNA, 15 nt, Human
uuuuggaauuuuccu

SEQ ID NO: 1693240 - RNA, 20 nt, Human
uuuuuauauuuacuaaaaug

SEQ ID NO: 1693241 - RNA, 17 nt, Human
auucacugauuugacau

SEQ ID NO: 1693242 - RNA, 12 nt, Human
auucacugauuu

SEQ ID NO: 1693243 - RNA, 19 nt, Human
auuauaugcuauuucuaua

SEQ ID NO: 1693244 - RNA, 17 nt, Human
auuauaugcuauuucua

SEQ ID NO: 1693245 - RNA, 18 nt, Human
auuauaugcuauuucuau

SEQ ID NO: 1693246 - RNA, 19 nt, Human
auuauucacugauuugaca

SEQ ID NO: 1693247 - RNA, 24 nt, Human
auuauucaaaguugccuaaaucca

SEQ ID NO: 1693248 - RNA, 18 nt, Human
auuauucaaaguugccua

SEQ ID NO: 1693249 - RNA, 22 nt, Human
auuauucaaaguugccuaaauc

SEQ ID NO: 1693250 - RNA, 19 nt, Human
auuauucaaaguugccuaa

SEQ ID NO: 1693251 - RNA, 19 nt, Human
auuauaucugaggaauucu

SEQ ID NO: 1693252 - RNA, 18 nt, Human
auuauaucugaggaauuc

SEQ ID NO: 1693253 - RNA, 16 nt, Human
auuauaugcuauuucu

SEQ ID NO: 1693254 - RNA, 22 nt, Human
auuauaucugaggaauucugua

SEQ ID NO: 1693255 - RNA, 21 nt, Human
auuauaucugaggaauucugu

SEQ ID NO: 1693256 - RNA, 20 nt, Human
auuauaucugaggaauucug

SEQ ID NO: 1693257 - RNA, 14 nt, Human
uuugaauuuugugu

SEQ ID NO: 1693258 - RNA, 12 nt, Human
uuugaauuuugu

SEQ ID NO: 1693259 - RNA, 16 nt, Human
uuugagaaauuaagua

SEQ ID NO: 1693260 - RNA, 12 nt, Human
auguuuauuaca

SEQ ID NO: 1693261 - RNA, 12 nt, Human
uuuucuguuaua

SEQ ID NO: 1693262 - RNA, 23 nt, Human
uuuucuuaaauaauaaagaucau

SEQ ID NO: 1693263 - RNA, 14 nt, Human
uuuucuuaaauaau

SEQ ID NO: 1693264 - RNA, 19 nt, Human
uuuucugauccaguuuugu

SEQ ID NO: 1693265 - RNA, 23 nt, Human
auguuuauuacaguauaauuaac

SEQ ID NO: 1693266 - RNA, 22 nt, Human
auguuuauuacaguauaauuaa

SEQ ID NO: 1693267 - RNA, 19 nt, Human
auguuuauuacaguauaau

SEQ ID NO: 1693268 - RNA, 18 nt, Human
auguuuauuacaguauaa

SEQ ID NO: 1693269 - RNA, 16 nt, Human
auguuuauuacaguau

SEQ ID NO: 1693270 - RNA, 15 nt, Human
auguuuauuacagua

SEQ ID NO: 1693271 - RNA, 22 nt, Human
cacuccaauuaaggauuuuaug

SEQ ID NO: 1693272 - RNA, 21 nt, Human
cacuccaauuaaggauuuuau

SEQ ID NO: 1693273 - RNA, 13 nt, Human
auuuaauaauuau

SEQ ID NO: 1693274 - RNA, 18 nt, Human
auuuaauaauuauaugcu

SEQ ID NO: 1693275 - RNA, 15 nt, Human
auuuaauaauuauau

SEQ ID NO: 1693276 - RNA, 17 nt, Human
auuuuuuuucuguuaua

SEQ ID NO: 1693277 - RNA, 15 nt, Human
auuuuuuuucuguua

SEQ ID NO: 1693278 - RNA, 19 nt, Human
auuuuuuuucuguuauaua

SEQ ID NO: 1693279 - RNA, 18 nt, Human
auuuuuuuucuguuauau

SEQ ID NO: 1693280 - RNA, 20 nt, Human
auuuuuuuucuguuauauaa

SEQ ID NO: 1693281 - RNA, 14 nt, Human
auuauguaaauccc

SEQ ID NO: 1693282 - RNA, 13 nt, Human
auuauguaaaucc

SEQ ID NO: 1693283 - RNA, 23 nt, Human
auuauguaaaucccauuauucaa

SEQ ID NO: 1693284 - RNA, 22 nt, Human
auuauguaaaucccauuauuca

SEQ ID NO: 1693285 - RNA, 17 nt, Human
auuauguaaaucccauu

SEQ ID NO: 1693286 - RNA, 15 nt, Human
auuauguaaauccca

SEQ ID NO: 1693287 - RNA, 16 nt, Human
cauaggugaucucauu

SEQ ID NO: 1693288 - RNA, 17 nt, Human
cauugguguuguacuca

SEQ ID NO: 1693289 - RNA, 15 nt, Human
cauugguucuuguau

SEQ ID NO: 1693290 - RNA, 14 nt, Human
cauugguucuugua

SEQ ID NO: 1693291 - RNA, 14 nt, Human
cauuauucaaaguu

SEQ ID NO: 1693292 - RNA, 16 nt, Human
cauuauucaaaguugc

SEQ ID NO: 1693293 - RNA, 15 nt, Human
cauuauucaaaguug

SEQ ID NO: 1693294 - RNA, 14 nt, Human
cagauacuggauug

SEQ ID NO: 1693295 - RNA, 18 nt, Human
cagauacuggauuguacu

SEQ ID NO: 1693296 - RNA, 20 nt, Human
ccagacgaugucuucauacc

SEQ ID NO: 1693297 - RNA, 13 nt, Human
ccagacgaugucu

SEQ ID NO: 1693298 - RNA, 14 nt, Human
ccaguauuguacaa

SEQ ID NO: 1693299 - RNA, 19 nt, Human
ccaugggauaaaugccauc

SEQ ID NO: 1693300 - RNA, 12 nt, Human
ccuaaggacuuc

SEQ ID NO: 1693301 - RNA, 11 nt, Human
ccuaaggacuu

SEQ ID NO: 1693302 - RNA, 23 nt, Human
ccuaaggacuucuuuaauuuugg

SEQ ID NO: 1693303 - RNA, 18 nt, Human
ccuaaggacuucuuuaau

SEQ ID NO: 1693304 - RNA, 17 nt, Human
ccuaaggacuucuuuaa

SEQ ID NO: 1693305 - RNA, 16 nt, Human
ccuaaggacuucuuua

SEQ ID NO: 1693306 - RNA, 19 nt, Human
cgcugauaagcguucaugg

SEQ ID NO: 1693307 - RNA, 21 nt, Human
cguucauggaacgcguugaaa

SEQ ID NO: 1693308 - RNA, 19 nt, Human
cucagaaggcaaaugacuu

SEQ ID NO: 1693309 - RNA, 23 nt, Human
gcugaacacuccaauuaaggauu

SEQ ID NO: 1693310 - RNA, 21 nt, Human
gcugaacacuccaauuaagga

SEQ ID NO: 1693311 - RNA, 20 nt, Human
gcugaacacuccaauuaagg

SEQ ID NO: 1693312 - RNA, 12 nt, Human
ggacuuguuaga

SEQ ID NO: 1693313 - RNA, 13 nt, Human
ggcaaaugacuuu

SEQ ID NO: 1693314 - RNA, 23 nt, Human
aaaauuggggauucuuaaaguug

SEQ ID NO: 1693315 - RNA, 21 nt, Human
aaaauuggggauucuuaaagu

SEQ ID NO: 1693316 - RNA, 22 nt, Human
aaaauggacuguggugacuuug

SEQ ID NO: 1693317 - RNA, 18 nt, Human
aaacggaugauuucuaug

SEQ ID NO: 1693318 - RNA, 16 nt, Human
aaacggaugauuucua

SEQ ID NO: 1693319 - RNA, 15 nt, Human
aaacuggguuccugc

SEQ ID NO: 1693320 - RNA, 16 nt, Human
aaacuggguuccugca

SEQ ID NO: 1693321 - RNA, 17 nt, Human
aaacauugguucuugua

SEQ ID NO: 1693322 - RNA, 21 nt, Human
aaacauugguucuuguauuaa

SEQ ID NO: 1693323 - RNA, 20 nt, Human
aaacauugguucuuguauua

SEQ ID NO: 1693324 - RNA, 18 nt, Human
aaacauugguucuuguau

SEQ ID NO: 1693325 - RNA, 17 nt, Human
aaacuuuucugauagag

SEQ ID NO: 1693326 - RNA, 16 nt, Human
aaacuuuucugauaga

SEQ ID NO: 1693327 - RNA, 14 nt, Human
aaacuuuucugaua

SEQ ID NO: 1693328 - RNA, 13 nt, Human
aaacuuuucugau

SEQ ID NO: 1693329 - RNA, 17 nt, Human
aaacuuguguaaauaca

SEQ ID NO: 1693330 - RNA, 23 nt, Human
aaaggaagguucuggugugaacu

SEQ ID NO: 1693331 - RNA, 20 nt, Human
gggauucuuaaaguugaauu

SEQ ID NO: 1693332 - RNA, 15 nt, Human
gggauucuuaaaguu

SEQ ID NO: 1693333 - RNA, 21 nt, Human
ggcugaacacuccaauuaagg

SEQ ID NO: 1693334 - RNA, 14 nt, Human
gacuguggugacuu

SEQ ID NO: 1693335 - RNA, 13 nt, Human
gacuguggugacu

SEQ ID NO: 1693336 - RNA, 17 nt, Human
gacuguggugacuuugg

SEQ ID NO: 1693337 - RNA, 21 nt, Human
gagugaguuggguguauugug

SEQ ID NO: 1693338 - RNA, 21 nt, Human
gauuuuuuuguuguuuguuua

SEQ ID NO: 1693339 - RNA, 18 nt, Human
gauuuuuuuguuguuugu

SEQ ID NO: 1693340 - RNA, 23 nt, Human
gauucuucagcaaaaauauuuua

SEQ ID NO: 1693341 - RNA, 22 nt, Human
gauuauucacugauuugacaua

SEQ ID NO: 1693342 - RNA, 23 nt, Human
gaucugccuaaggacuucuuuaa

SEQ ID NO: 1693343 - RNA, 21 nt, Human
gaucugccuaaggacuucuuu

SEQ ID NO: 1693344 - RNA, 20 nt, Human
gaucugccuaaggacuucuu

SEQ ID NO: 1693345 - RNA, 18 nt, Human
gaucugccuaaggacuuc

SEQ ID NO: 1693346 - RNA, 20 nt, Human
cuuucagauaacuguuauuu

SEQ ID NO: 1693347 - RNA, 13 nt, Human
cuuucagauacug

SEQ ID NO: 1693348 - RNA, 21 nt, Human
cuuuaauaucaucaguauuga

SEQ ID NO: 1693349 - RNA, 19 nt, Human
cuuuaauaucaucaguauu

SEQ ID NO: 1693350 - RNA, 18 nt, Human
cuuuaauaucaucaguau

SEQ ID NO: 1693351 - RNA, 16 nt, Human
cuuuaauuuuggaauu

SEQ ID NO: 1693352 - RNA, 13 nt, Human
cuuuaauuuugga

SEQ ID NO: 1693353 - RNA, 15 nt, Human
cuuuaauuuuggaau

SEQ ID NO: 1693354 - RNA, 14 nt, Human
cuuuaauuuuggaa

SEQ ID NO: 1693355 - RNA, 13 nt, Human
cuuaaaguugaau

SEQ ID NO: 1693356 - RNA, 11 nt, Human
cuuaaaguuga

SEQ ID NO: 1693357 - RNA, 19 nt, Human
cugaugccaaguuguuuga

SEQ ID NO: 1693358 - RNA, 20 nt, Human
cugcacggugaauggcuuug

SEQ ID NO: 1693359 - RNA, 17 nt, Human
cugcacggugaauggcu

SEQ ID NO: 1693360 - RNA, 15 nt, Human
cugcacggugaaugg

SEQ ID NO: 1693361 - RNA, 14 nt, Human
cugcacggugaaug

SEQ ID NO: 1693362 - RNA, 23 nt, Human
cauuuuauaaaucgcuuuugaua

SEQ ID NO: 1693363 - RNA, 21 nt, Human
cauuuuauaaaucgcuuuuga

SEQ ID NO: 1693364 - RNA, 18 nt, Human
cauuuuauaaaucgcuuu

SEQ ID NO: 1693365 - RNA, 17 nt, Human
cauuuuauaaaucgcuu

SEQ ID NO: 1693366 - RNA, 13 nt, Human
cauuuuauaaauc

SEQ ID NO: 1693367 - RNA, 11 nt, Human
cauuuuauaaa

SEQ ID NO: 1693368 - RNA, 23 nt, Human
cauuuaauaauuauaugcuauuu

SEQ ID NO: 1693369 - RNA, 14 nt, Human
cauuuaauaauuau

SEQ ID NO: 1693370 - RNA, 12 nt, Human
cauuuaauaauu

SEQ ID NO: 1693371 - RNA, 19 nt, Human
cauuuaauaauuauaugcu

SEQ ID NO: 1693372 - RNA, 17 nt, Human
cauuuaauaauuauaug

SEQ ID NO: 1693373 - RNA, 16 nt, Human
cauuuaauaauuauau

SEQ ID NO: 1693374 - RNA, 15 nt, Human
cauuuaauaauuaua

SEQ ID NO: 1693375 - RNA, 20 nt, Human
ccaggaauggagccugcacg

SEQ ID NO: 1693376 - RNA, 20 nt, Human
ccaucaauaaaaaauuauga

SEQ ID NO: 1693377 - RNA, 19 nt, Human
ccaucaauaaaaaauuaug

SEQ ID NO: 1693378 - RNA, 14 nt, Human
cggaugauuucuau

SEQ ID NO: 1693379 - RNA, 13 nt, Human
cggaugauuucua

SEQ ID NO: 1693380 - RNA, 16 nt, Human
ccuuucucuuucguua

SEQ ID NO: 1693381 - RNA, 21 nt, Human
cgcguugaaauuguaauuaua

SEQ ID NO: 1693382 - RNA, 17 nt, Human
cgcguugaaauuguaau

SEQ ID NO: 1693383 - RNA, 22 nt, Human
cgcguugaaauuguaauuauau

SEQ ID NO: 1693384 - RNA, 13 nt, Human
cgcguugaaauug

SEQ ID NO: 1693385 - RNA, 22 nt, Human
cguucauggaacgcguugaaau

SEQ ID NO: 1693386 - RNA, 23 nt, Human
cguucauggaacgcguugaaauu

SEQ ID NO: 1693387 - RNA, 18 nt, Human
cguugaaauuguaauuau

SEQ ID NO: 1693388 - RNA, 13 nt, Human
cguugaaauugua

SEQ ID NO: 1693389 - RNA, 15 nt, Human
ccuggccuuucauau

SEQ ID NO: 1693390 - RNA, 14 nt, Human
ccuggccuuucaua

SEQ ID NO: 1693391 - RNA, 21 nt, Human
ccugcuuucagauacuggauu

SEQ ID NO: 1693392 - RNA, 16 nt, Human
ccugcuuucagauacu

SEQ ID NO: 1693393 - RNA, 15 nt, Human
ccugcuuucagauac

SEQ ID NO: 1693394 - RNA, 13 nt, Human
ccugauuaaagaa

SEQ ID NO: 1693395 - RNA, 12 nt, Human
ccugauuaaaga

SEQ ID NO: 1693396 - RNA, 21 nt, Human
ccucacccacccuuuuuuaaa

SEQ ID NO: 1693397 - RNA, 22 nt, Human
ccggaagccaaaccucugugag

SEQ ID NO: 1693398 - RNA, 11 nt, Human
ccggaagccaa

SEQ ID NO: 1693399 - RNA, 13 nt, Human
ccgugcuaaggac

SEQ ID NO: 1693400 - RNA, 21 nt, Human
cugcaaugaagucucugaagu

SEQ ID NO: 1693401 - RNA, 18 nt, Human
cugcaaugaagucucuga

SEQ ID NO: 1693402 - RNA, 22 nt, Human
cugcaaucuucucagaaggcaa

SEQ ID NO: 1693403 - RNA, 15 nt, Human
cugauucuucagcaa

SEQ ID NO: 1693404 - RNA, 20 nt, Human
cugauagaggaagccugauu

SEQ ID NO: 1693405 - RNA, 20 nt, Human
cugauccaguuuuguuugga

SEQ ID NO: 1693406 - RNA, 21 nt, Human
cugccuaaggacuucuuuaau

SEQ ID NO: 1693407 - RNA, 20 nt, Human
cugccuaaggacuucuuuaa

SEQ ID NO: 1693408 - RNA, 22 nt, Human
cugccuaaggacuucuuuaauu

SEQ ID NO: 1693409 - RNA, 19 nt, Human
cugccuaaggacuucuuua

SEQ ID NO: 1693410 - RNA, 21 nt, Human
cugcuuucagauacuggauug

SEQ ID NO: 1693411 - RNA, 18 nt, Human
cugcuuucagauacugga

SEQ ID NO: 1693412 - RNA, 20 nt, Human
cuggauuguacuuugugcug

SEQ ID NO: 1693413 - RNA, 19 nt, Human
cuggauuguacuuugugcu

SEQ ID NO: 1693414 - RNA, 18 nt, Human
cuccuaucaccugucuug

SEQ ID NO: 1693415 - RNA, 18 nt, Human
cucugcaaucuucucaga

SEQ ID NO: 1693416 - RNA, 17 nt, Human
cucugcaaucuucucag

SEQ ID NO: 1693417 - RNA, 13 nt, Human
cucuccauuuaau

SEQ ID NO: 1693418 - RNA, 19 nt, Human
cugaagugaaacugcuugu

SEQ ID NO: 1693419 - RNA, 17 nt, Human
cugaagugaaacugcuu

SEQ ID NO: 1693420 - RNA, 13 nt, Human
cugaagugaaacu

SEQ ID NO: 1693421 - RNA, 21 nt, Human
cugaagucagaucugccuaag

SEQ ID NO: 1693422 - RNA, 16 nt, Human
cugaagucagaucugc

SEQ ID NO: 1693423 - RNA, 15 nt, Human
cugaagucagaucug

SEQ ID NO: 1693424 - RNA, 14 nt, Human
cugaagucagaucu

SEQ ID NO: 1693425 - RNA, 16 nt, Human
cuguuuuaugacuuca

SEQ ID NO: 1693426 - RNA, 15 nt, Human
cuguuuuaugacuuc

SEQ ID NO: 1693427 - RNA, 14 nt, Human
cuguuuuaugacuu

SEQ ID NO: 1693428 - RNA, 13 nt, Human
cuguuuuaugacu

SEQ ID NO: 1693429 - RNA, 12 nt, Human
cuguuuuaugac

SEQ ID NO: 1693430 - RNA, 18 nt, Human
cuuuucugauccaguuuu

SEQ ID NO: 1693431 - RNA, 16 nt, Human
cuuuucugauccaguu

SEQ ID NO: 1693432 - RNA, 11 nt, Human
cuuuucugauc

SEQ ID NO: 1693433 - RNA, 15 nt, Human
cuuuucugauccagu

SEQ ID NO: 1693434 - RNA, 14 nt, Human
cuuuucugauccag

SEQ ID NO: 1693435 - RNA, 15 nt, Human
cuuuuuuaaauaaau

SEQ ID NO: 1693436 - RNA, 21 nt, Human
cuuuuucauuauuuuauuaug

SEQ ID NO: 1693437 - RNA, 14 nt, Human
cuuuuucauuauuu

SEQ ID NO: 1693438 - RNA, 13 nt, Human
cuuuuucauuauu

SEQ ID NO: 1693439 - RNA, 12 nt, Human
cuuuuucauuau

SEQ ID NO: 1693440 - RNA, 14 nt, Human
cuuuggauaauaag

SEQ ID NO: 1693441 - RNA, 16 nt, Human
cuuuggauaauaagga

SEQ ID NO: 1693442 - RNA, 16 nt, Human
cuuguuagaucuaguu

SEQ ID NO: 1693443 - RNA, 13 nt, Human
cuuguuagaucua

SEQ ID NO: 1693444 - RNA, 16 nt, Human
gacugauucuucagca

SEQ ID NO: 1693445 - RNA, 13 nt, Human
gacugauucuuca

SEQ ID NO: 1693446 - RNA, 17 nt, Human
gaacuaaacuuucacac

SEQ ID NO: 1693447 - RNA, 18 nt, Human
gaacuaaacuuucacacc

SEQ ID NO: 1693448 - RNA, 16 nt, Human
gaacuaaacuuucaca

SEQ ID NO: 1693449 - RNA, 14 nt, Human
gaacuaaacuuuca

SEQ ID NO: 1693450 - RNA, 12 nt, Human
gaacuaaacuuu

SEQ ID NO: 1693451 - RNA, 15 nt, Human
gaacgcguugaaauu

SEQ ID NO: 1693452 - RNA, 21 nt, Human
gaagucucugaagugaaacug

SEQ ID NO: 1693453 - RNA, 16 nt, Human
gaagucucugaaguga

SEQ ID NO: 1693454 - RNA, 11 nt, Human
gaauucuguau

SEQ ID NO: 1693455 - RNA, 22 nt, Human
gaauuuauuggcuuuucugauc

SEQ ID NO: 1693456 - RNA, 21 nt, Human
gaauuuauuggcuuuucugau

SEQ ID NO: 1693457 - RNA, 20 nt, Human
gaauuuauuggcuuuucuga

SEQ ID NO: 1693458 - RNA, 16 nt, Human
gaauuuauuggcuuuu

SEQ ID NO: 1693459 - RNA, 14 nt, Human
gaauuuauuggcuu

SEQ ID NO: 1693460 - RNA, 23 nt, Human
gaaugguccgugcuaaggacuug

SEQ ID NO: 1693461 - RNA, 22 nt, Human
gaaugguccgugcuaaggacuu

SEQ ID NO: 1693462 - RNA, 20 nt, Human
gaaugguccgugcuaaggac

SEQ ID NO: 1693463 - RNA, 15 nt, Human
gacuucauuaauaau

SEQ ID NO: 1693464 - RNA, 12 nt, Human
gaguguugaaac

SEQ ID NO: 1693465 - RNA, 22 nt, Human
gauaauaaggaaaaguuuaaua

SEQ ID NO: 1693466 - RNA, 21 nt, Human
gauaauaaggaaaaguuuaau

SEQ ID NO: 1693467 - RNA, 20 nt, Human
gauaauaaggaaaaguuuaa

SEQ ID NO: 1693468 - RNA, 17 nt, Human
gauaaucaacugggcug

SEQ ID NO: 1693469 - RNA, 21 nt, Human
gauaaucaacugggcugaaca

SEQ ID NO: 1693470 - RNA, 17 nt, Human
gaucuaguucacucucc

SEQ ID NO: 1693471 - RNA, 19 nt, Human
gcaaugaagucucugaagu

SEQ ID NO: 1693472 - RNA, 17 nt, Human
gcaaugaagucucugaa

SEQ ID NO: 1693473 - RNA, 12 nt, Human
gcaaaugacuuu

SEQ ID NO: 1693474 - RNA, 13 nt, Human
gcaaaugacuuug

SEQ ID NO: 1693475 - RNA, 21 nt, Human
gcauaggugaucucauuuaau

SEQ ID NO: 1693476 - RNA, 20 nt, Human
gcauauauuuuuauauuuac

SEQ ID NO: 1693477 - RNA, 16 nt, Human
gcauauauuuuuauau

SEQ ID NO: 1693478 - RNA, 11 nt, Human
gcauauauuuu

SEQ ID NO: 1693479 - RNA, 15 nt, Human
gcauauauuuuuaua

SEQ ID NO: 1693480 - RNA, 14 nt, Human
gcauauauuuuuau

SEQ ID NO: 1693481 - RNA, 12 nt, Human
gcaucacaguuu

SEQ ID NO: 1693482 - RNA, 13 nt, Human
gcauuuuauaaau

SEQ ID NO: 1693483 - RNA, 11 nt, Human
gccuaaaucca

SEQ ID NO: 1693484 - RNA, 13 nt, Human
gccuaaggacuuc

SEQ ID NO: 1693485 - RNA, 12 nt, Human
gccuaaggacuu

SEQ ID NO: 1693486 - RNA, 18 nt, Human
gccuaaggacuucuuuaa

SEQ ID NO: 1693487 - RNA, 15 nt, Human
gccuaaggacuucuu

SEQ ID NO: 1693488 - RNA, 14 nt, Human
gccuaaggacuucu

SEQ ID NO: 1693489 - RNA, 22 nt, Human
gccuuuuucauuauuuuauuau

SEQ ID NO: 1693490 - RNA, 20 nt, Human
gccuuuuucauuauuuuauu

SEQ ID NO: 1693491 - RNA, 16 nt, Human
gccuuuuucauuauuu

SEQ ID NO: 1693492 - RNA, 12 nt, Human
gccuuuuucauu

SEQ ID NO: 1693493 - RNA, 22 nt, Human
gcuagacuggugacugauucuu

SEQ ID NO: 1693494 - RNA, 20 nt, Human
gcuagacuggugacugauuc

SEQ ID NO: 1693495 - RNA, 19 nt, Human
gcuagacuggugacugauu

SEQ ID NO: 1693496 - RNA, 16 nt, Human
gcuagacuggugacug

SEQ ID NO: 1693497 - RNA, 15 nt, Human
gcuagacuggugacu

SEQ ID NO: 1693498 - RNA, 13 nt, Human
gcuagacugguga

SEQ ID NO: 1693499 - RNA, 21 nt, Human
ggugacuuuggauaauaagga

SEQ ID NO: 1693500 - RNA, 20 nt, Human
ggugacuuuggauaauaagg

SEQ ID NO: 1693501 - RNA, 19 nt, Human
ggugacuuuggauaauaag

SEQ ID NO: 1693502 - RNA, 18 nt, Human
ggugacuuuggauaauaa

SEQ ID NO: 1693503 - RNA, 14 nt, Human
ggugacuuuggaua

SEQ ID NO: 1693504 - RNA, 16 nt, Human
gguguaugugugaagu

SEQ ID NO: 1693505 - RNA, 14 nt, Human
gguucuuguauuaa

SEQ ID NO: 1693506 - RNA, 22 nt, Human
gguucuuguauuaagaaugaaa

SEQ ID NO: 1693507 - RNA, 23 nt, Human
gguuaagucuguuuuaugacuuc

SEQ ID NO: 1693508 - RNA, 16 nt, Human
gguuaagucuguuuua

SEQ ID NO: 1693509 - RNA, 13 nt, Human
gguuaagucuguu

SEQ ID NO: 1693510 - RNA, 20 nt, Human
gguuaucugaagucagaucu

SEQ ID NO: 1693511 - RNA, 15 nt, Human
ggggauucuuaaagu

SEQ ID NO: 1693512 - RNA, 11 nt, Human
ggggauucuua

SEQ ID NO: 1693513 - RNA, 11 nt, Human
ggguuccugca

SEQ ID NO: 1693514 - RNA, 16 nt, Human
ggcuuuucugauccag

SEQ ID NO: 1693515 - RNA, 13 nt, Human
ggcuuuucugauc

SEQ ID NO: 1693516 - RNA, 12 nt, Human
ggcuuuucugau

SEQ ID NO: 1693517 - RNA, 17 nt, Human
ggcuuuucugauccagu

SEQ ID NO: 1693518 - RNA, 21 nt, Human
ggcugaugccaaguuguuuga

SEQ ID NO: 1693519 - RNA, 22 nt, Human
ggcugaugccaaguuguuugag

SEQ ID NO: 1693520 - RNA, 22 nt, Human
gcuggugcccugcuuucagaua

SEQ ID NO: 1693521 - RNA, 24 nt, Human
gcuggugcccugcuuucagauacu

SEQ ID NO: 1693522 - RNA, 23 nt, Human
gcuuuaauaucaucaguauugaa

SEQ ID NO: 1693523 - RNA, 22 nt, Human
gcuuuaauaucaucaguauuga

SEQ ID NO: 1693524 - RNA, 20 nt, Human
gcuuuaauaucaucaguauu

SEQ ID NO: 1693525 - RNA, 17 nt, Human
ggaacgcguugaaauug

SEQ ID NO: 1693526 - RNA, 21 nt, Human
ggaacgcguugaaauuguaau

SEQ ID NO: 1693527 - RNA, 19 nt, Human
ggaaaaguuuaauauuaaa

SEQ ID NO: 1693528 - RNA, 22 nt, Human
ggaagccaaaccucugugagca

SEQ ID NO: 1693529 - RNA, 20 nt, Human
uauaaaucgcuuuugauaau

SEQ ID NO: 1693530 - RNA, 19 nt, Human
uauaaaucgcuuuugauaa

SEQ ID NO: 1693531 - RNA, 18 nt, Human
uauaaaucgcuuuugaua

SEQ ID NO: 1693532 - RNA, 19 nt, Human
uauauuuuuauauuuacua

SEQ ID NO: 1693533 - RNA, 22 nt, Human
uaucaucaguauugaagcauuu

SEQ ID NO: 1693534 - RNA, 18 nt, Human
uauauuuuuauauuuacu

SEQ ID NO: 1693535 - RNA, 18 nt, Human
uauaugcuauuucuauau

SEQ ID NO: 1693536 - RNA, 16 nt, Human
uauaugcuauuucuau

SEQ ID NO: 1693537 - RNA, 14 nt, Human
uagagaguguugaa

SEQ ID NO: 1693538 - RNA, 15 nt, Human
uagagaguguugaaa

SEQ ID NO: 1693539 - RNA, 18 nt, Human
uagacuggugacugauuc

SEQ ID NO: 1693540 - RNA, 17 nt, Human
uagacuggugacugauu

SEQ ID NO: 1693541 - RNA, 14 nt, Human
uagacuggugacug

SEQ ID NO: 1693542 - RNA, 13 nt, Human
uagacuggugacu

SEQ ID NO: 1693543 - RNA, 13 nt, Human
uaauuuuggaauu

SEQ ID NO: 1693544 - RNA, 12 nt, Human
uaauuuuggaau

SEQ ID NO: 1693545 - RNA, 18 nt, Human
uacaauuuuguuucugua

SEQ ID NO: 1693546 - RNA, 21 nt, Human
uacaauuuuguuucuguacuu

SEQ ID NO: 1693547 - RNA, 19 nt, Human
uacaauuuuguuucuguac

SEQ ID NO: 1693548 - RNA, 20 nt, Human
uaauuaacauguuaaaccau

SEQ ID NO: 1693549 - RNA, 19 nt, Human
uaauuaacauguuaaacca

SEQ ID NO: 1693550 - RNA, 18 nt, Human
uaauuaacauguuaaacc

SEQ ID NO: 1693551 - RNA, 17 nt, Human
uaauuaacauguuaaac

SEQ ID NO: 1693552 - RNA, 15 nt, Human
uaauuaacauguuaa

SEQ ID NO: 1693553 - RNA, 14 nt, Human
uaauuaacauguua

SEQ ID NO: 1693554 - RNA, 12 nt, Human
uaauuaacaugu

SEQ ID NO: 1693555 - RNA, 20 nt, Human
uaauaaggaaaaguuuaaua

SEQ ID NO: 1693556 - RNA, 17 nt, Human
uaauaaagaucauguaa

SEQ ID NO: 1693557 - RNA, 16 nt, Human
uaauaaagaucaugua

SEQ ID NO: 1693558 - RNA, 23 nt, Human
uaauaauuauaugcuauuucuau

SEQ ID NO: 1693559 - RNA, 22 nt, Human
uaauaauuauaugcuauuucua

SEQ ID NO: 1693560 - RNA, 20 nt, Human
uaauaauuauaugcuauuuc

SEQ ID NO: 1693561 - RNA, 19 nt, Human
uaauaauuauaugcuauuu

SEQ ID NO: 1693562 - RNA, 16 nt, Human
uaauaauuauaugcua

SEQ ID NO: 1693563 - RNA, 15 nt, Human
uaauaauuauaugcu

SEQ ID NO: 1693564 - RNA, 23 nt, Human
uaauccucucaaccaccuuucag

SEQ ID NO: 1693565 - RNA, 14 nt, Human
uaauauuaaagcca

SEQ ID NO: 1693566 - RNA, 13 nt, Human
uaauauuaaagcc

SEQ ID NO: 1693567 - RNA, 12 nt, Human
uaauauuaaagc

SEQ ID NO: 1693568 - RNA, 23 nt, Human
uaagcauauauuuuuauauuuac

SEQ ID NO: 1693569 - RNA, 19 nt, Human
uaagcauauauuuuuauau

SEQ ID NO: 1693570 - RNA, 22 nt, Human
uaagcauauauuuuuauauuua

SEQ ID NO: 1693571 - RNA, 21 nt, Human
uaagcauauauuuuuauauuu

SEQ ID NO: 1693572 - RNA, 17 nt, Human
uaacauguuaaaccaug

SEQ ID NO: 1693573 - RNA, 18 nt, Human
uaacauguuaaaccaugg

SEQ ID NO: 1693574 - RNA, 19 nt, Human
uaaaucccauuauucaaag

SEQ ID NO: 1693575 - RNA, 17 nt, Human
uaaaucccauuauucaa

SEQ ID NO: 1693576 - RNA, 16 nt, Human
uaaaucccauuauuca

SEQ ID NO: 1693577 - RNA, 23 nt, Human
uaaauccauuuggaaaucuuuaa

SEQ ID NO: 1693578 - RNA, 22 nt, Human
uaaauccauuuggaaaucuuua

SEQ ID NO: 1693579 - RNA, 19 nt, Human
uaaauccauuuggaaaucu

SEQ ID NO: 1693580 - RNA, 18 nt, Human
uaaauccauuuggaaauc

SEQ ID NO: 1693581 - RNA, 14 nt, Human
uaaauccauuugga

SEQ ID NO: 1693582 - RNA, 16 nt, Human
uaaauccauuuggaaa

SEQ ID NO: 1693583 - RNA, 15 nt, Human
uaaauccauuuggaa

SEQ ID NO: 1693584 - RNA, 23 nt, Human
uaaaguugaauuuauuggcuuuu

SEQ ID NO: 1693585 - RNA, 21 nt, Human
uaaaguugaauuuauuggcuu

SEQ ID NO: 1693586 - RNA, 19 nt, Human
uaaaguugaauuuauuggc

SEQ ID NO: 1693587 - RNA, 17 nt, Human
uaaaguugaauuuauug

SEQ ID NO: 1693588 - RNA, 15 nt, Human
uaaaguugaauuuau

SEQ ID NO: 1693589 - RNA, 14 nt, Human
uaaaguugaauuua

SEQ ID NO: 1693590 - RNA, 13 nt, Human
uaaaguugaauuu

SEQ ID NO: 1693591 - RNA, 15 nt, Human
uaaacuuuucugaua

SEQ ID NO: 1693592 - RNA, 14 nt, Human
uaaacuuuucugau

SEQ ID NO: 1693593 - RNA, 13 nt, Human
uaaacuuuucuga

SEQ ID NO: 1693594 - RNA, 13 nt, Human
uaaacuuucacac

SEQ ID NO: 1693595 - RNA, 12 nt, Human
uaaacuuucaca

SEQ ID NO: 1693596 - RNA, 18 nt, Human
guuuagucuugucucaga

SEQ ID NO: 1693597 - RNA, 14 nt, Human
guuuagucuugucu

SEQ ID NO: 1693598 - RNA, 23 nt, Human
guuugugcugguguaugugugaa

SEQ ID NO: 1693599 - RNA, 19 nt, Human
guuugagguuuuuaagccu

SEQ ID NO: 1693600 - RNA, 16 nt, Human
guuugagguuuuuaag

SEQ ID NO: 1693601 - RNA, 12 nt, Human
guuuguuuaguc

SEQ ID NO: 1693602 - RNA, 13 nt, Human
ucauuauuuuauu

SEQ ID NO: 1693603 - RNA, 15 nt, Human
ucauuauuuuauuau

SEQ ID NO: 1693604 - RNA, 14 nt, Human
ucauuauuuuauua

SEQ ID NO: 1693605 - RNA, 22 nt, Human
ucauuauuuuauuaugaaacuu

SEQ ID NO: 1693606 - RNA, 19 nt, Human
ucauuauuuuauuaugaaa

SEQ ID NO: 1693607 - RNA, 18 nt, Human
ucauuauuuuauuaugaa

SEQ ID NO: 1693608 - RNA, 16 nt, Human
ucauuauuuuauuaug

SEQ ID NO: 1693609 - RNA, 22 nt, Human
uccagcagauuauucacugauu

SEQ ID NO: 1693610 - RNA, 20 nt, Human
uccagcagauuauucacuga

SEQ ID NO: 1693611 - RNA, 16 nt, Human
ucacuuuuuuccacau

SEQ ID NO: 1693612 - RNA, 15 nt, Human
ucacuuuuuuccaca

SEQ ID NO: 1693613 - RNA, 13 nt, Human
ucacuuuuuucca

SEQ ID NO: 1693614 - RNA, 13 nt, Human
ucagauaacuguu

SEQ ID NO: 1693615 - RNA, 15 nt, Human
ucagauaacuguuau

SEQ ID NO: 1693616 - RNA, 18 nt, Human
ucacucuccauuuaauaa

SEQ ID NO: 1693617 - RNA, 16 nt, Human
uaucugaggaauucug

SEQ ID NO: 1693618 - RNA, 18 nt, Human
uaucugacaucucugcaa

SEQ ID NO: 1693619 - RNA, 15 nt, Human
uaucugaggaauucu

SEQ ID NO: 1693620 - RNA, 18 nt, Human
uaucugaagucagaucug

SEQ ID NO: 1693621 - RNA, 17 nt, Human
uaucugaagucagaucu

SEQ ID NO: 1693622 - RNA, 12 nt, Human
uauuuuaugauc

SEQ ID NO: 1693623 - RNA, 17 nt, Human
ucucaaccaccuuucag

SEQ ID NO: 1693624 - RNA, 22 nt, Human
ucucagaaggcaaaugacuuug

SEQ ID NO: 1693625 - RNA, 21 nt, Human
ucucagaaggcaaaugacuuu

SEQ ID NO: 1693626 - RNA, 20 nt, Human
ucucagaaggcaaaugacuu

SEQ ID NO: 1693627 - RNA, 19 nt, Human
ucucagaaggcaaaugacu

SEQ ID NO: 1693628 - RNA, 19 nt, Human
ucucugcaaucuucucaga

SEQ ID NO: 1693629 - RNA, 20 nt, Human
ucugaggaauucuguauaga

SEQ ID NO: 1693630 - RNA, 16 nt, Human
ucugacaucucugcaa

SEQ ID NO: 1693631 - RNA, 23 nt, Human
ugaacacuccaauuaaggauuuu

SEQ ID NO: 1693632 - RNA, 22 nt, Human
ugaacacuccaauuaaggauuu

SEQ ID NO: 1693633 - RNA, 19 nt, Human
ugaacacuccaauuaagga

SEQ ID NO: 1693634 - RNA, 18 nt, Human
ugaacacuccaauuaagg

SEQ ID NO: 1693635 - RNA, 18 nt, Human
ucuguuauauaaaugguu

SEQ ID NO: 1693636 - RNA, 15 nt, Human
ucuguuauauaaaug

SEQ ID NO: 1693637 - RNA, 16 nt, Human
ucuguuuuaugacuuc

SEQ ID NO: 1693638 - RNA, 15 nt, Human
ucuguuuuaugacuu

SEQ ID NO: 1693639 - RNA, 13 nt, Human
ucuguuuuaugac

SEQ ID NO: 1693640 - RNA, 17 nt, Human
ucuguuuuaugacuuca

SEQ ID NO: 1693641 - RNA, 23 nt, Human
ucuucucagaaggcaaaugacuu

SEQ ID NO: 1693642 - RNA, 21 nt, Human
ucuucucagaaggcaaaugac

SEQ ID NO: 1693643 - RNA, 22 nt, Human
ucuuguauuaagaaugaaauac

SEQ ID NO: 1693644 - RNA, 15 nt, Human
ucuugccuuuuucau

SEQ ID NO: 1693645 - RNA, 19 nt, Human
ucuuuaaaaaaaaaauugg

SEQ ID NO: 1693646 - RNA, 18 nt, Human
ucuuuaaaaaaaaaauug

SEQ ID NO: 1693647 - RNA, 19 nt, Human
ucuugucucagauuuuauu

SEQ ID NO: 1693648 - RNA, 17 nt, Human
ugcugaguuugugcugg

SEQ ID NO: 1693649 - RNA, 15 nt, Human
ugcugaguuugugcu

SEQ ID NO: 1693650 - RNA, 23 nt, Human
ugccuaaggacuucuuuaauuuu

SEQ ID NO: 1693651 - RNA, 23 nt, Human
ugcacggugaauggcuuuguaua

SEQ ID NO: 1693652 - RNA, 22 nt, Human
ugcacggugaauggcuuuguau

SEQ ID NO: 1693653 - RNA, 19 nt, Human
ugaagucucugaagugaaa

SEQ ID NO: 1693654 - RNA, 12 nt, Human
ugaagugaaacu

SEQ ID NO: 1693655 - RNA, 17 nt, Human
uggcauaacauaaaucu

SEQ ID NO: 1693656 - RNA, 15 nt, Human
uggcauaacauaaau

SEQ ID NO: 1693657 - RNA, 12 nt, Human
ugcuuucagaua

SEQ ID NO: 1693658 - RNA, 21 nt, Human
ugcuuucagauacuggauugu

SEQ ID NO: 1693659 - RNA, 20 nt, Human
ugcuuucagauacuggauug

SEQ ID NO: 1693660 - RNA, 17 nt, Human
ugcuuucagauacugga

SEQ ID NO: 1693661 - RNA, 16 nt, Human
ugcuuucagauacugg

SEQ ID NO: 1693662 - RNA, 12 nt, Human
ugcuuuaaacau

SEQ ID NO: 1693663 - RNA, 14 nt, Human
ugcuuguuuccuag

SEQ ID NO: 1693664 - RNA, 20 nt, Human
uggccuuucauauuuuagcu

SEQ ID NO: 1693665 - RNA, 15 nt, Human
uggcuguacccagga

SEQ ID NO: 1693666 - RNA, 22 nt, Human
uggcuuuguauagaaccucuuu

SEQ ID NO: 1693667 - RNA, 14 nt, Human
uggcuuuguauaga

SEQ ID NO: 1693668 - RNA, 21 nt, Human
uguuuguuuagucuugucuca

SEQ ID NO: 1693669 - RNA, 12 nt, Human
uguuuguuuagu

SEQ ID NO: 1693670 - RNA, 19 nt, Human
uuaacauguuaaaccaugg

SEQ ID NO: 1693671 - RNA, 18 nt, Human
uuaacauguuaaaccaug

SEQ ID NO: 1693672 - RNA, 12 nt, Human
uuaacauguuaa

SEQ ID NO: 1693673 - RNA, 18 nt, Human
uuaauaauuauaugcuau

SEQ ID NO: 1693674 - RNA, 23 nt, Human
uuaauaauuauaugcuauuucua

SEQ ID NO: 1693675 - RNA, 20 nt, Human
uuaauaauuauaugcuauuu

SEQ ID NO: 1693676 - RNA, 20 nt, Human
uuaaggauuuuaugcuuuaa

SEQ ID NO: 1693677 - RNA, 18 nt, Human
uuaaggauuuuaugcuuu

SEQ ID NO: 1693678 - RNA, 15 nt, Human
uuaaggauuuuaugc

SEQ ID NO: 1693679 - RNA, 13 nt, Human
uuaaggauuuuau

SEQ ID NO: 1693680 - RNA, 18 nt, Human
uuaauaucaucaguauug

SEQ ID NO: 1693681 - RNA, 14 nt, Human
uguuguuuguuuag

SEQ ID NO: 1693682 - RNA, 23 nt, Human
uguugaaacggaugauuucuaug

SEQ ID NO: 1693683 - RNA, 22 nt, Human
uguugaaacggaugauuucuau

SEQ ID NO: 1693684 - RNA, 21 nt, Human
uguugaaacggaugauuucua

SEQ ID NO: 1693685 - RNA, 20 nt, Human
uguugaaacggaugauuucu

SEQ ID NO: 1693686 - RNA, 16 nt, Human
uguuagaucuaguuca

SEQ ID NO: 1693687 - RNA, 23 nt, Human
uguuaaaccaugggauaaaugcc

SEQ ID NO: 1693688 - RNA, 21 nt, Human
uguuaaaccaugggauaaaug

SEQ ID NO: 1693689 - RNA, 20 nt, Human
uguuaaaccaugggauaaau

SEQ ID NO: 1693690 - RNA, 18 nt, Human
uguuaaaccaugggauaa

SEQ ID NO: 1693691 - RNA, 17 nt, Human
ugugugaagugagugag

SEQ ID NO: 1693692 - RNA, 16 nt, Human
uguauagaaccucuuu

SEQ ID NO: 1693693 - RNA, 14 nt, Human
uguauuuguuugca

SEQ ID NO: 1693694 - RNA, 13 nt, Human
uguacucaauuuu

SEQ ID NO: 1693695 - RNA, 23 nt, Human
ugugcgcuaaacuuuucugauag

SEQ ID NO: 1693696 - RNA, 22 nt, Human
ugugcgcuaaacuuuucugaua

SEQ ID NO: 1693697 - RNA, 19 nt, Human
ugugcgcuaaacuuuucug

SEQ ID NO: 1693698 - RNA, 14 nt, Human
ugugcgcuaaacuu

SEQ ID NO: 1693699 - RNA, 21 nt, Human
uugaaacggaugauuucuaug

SEQ ID NO: 1693700 - RNA, 22 nt, Human
uugaaacggaugauuucuaugc

SEQ ID NO: 1693701 - RNA, 18 nt, Human
uucuuguauuaagaauga

SEQ ID NO: 1693702 - RNA, 13 nt, Human
uucuuguauuaag

SEQ ID NO: 1693703 - RNA, 12 nt, Human
uucuuguauuaa

SEQ ID NO: 1693704 - RNA, 15 nt, Human
uuggcuuuucugauc

SEQ ID NO: 1693705 - RNA, 22 nt, Human
uuggcuuuucugauccaguuuu

SEQ ID NO: 1693706 - RNA, 19 nt, Human
uuggcuuuucugauccagu

SEQ ID NO: 1693707 - RNA, 21 nt, Human
uuggaccaaaaaccaguauug

SEQ ID NO: 1693708 - RNA, 15 nt, Human
uuggaaaucuuuaaa

SEQ ID NO: 1693709 - RNA, 12 nt, Human
uuggaaaucuuu

SEQ ID NO: 1693710 - RNA, 11 nt, Human
uucacugauuu

SEQ ID NO: 1693711 - RNA, 15 nt, Human
uuacuaaaauggacu

SEQ ID NO: 1693712 - RNA, 18 nt, Human
uuacuaaaauggacugug

SEQ ID NO: 1693713 - RNA, 17 nt, Human
uuacuaaaauggacugu

SEQ ID NO: 1693714 - RNA, 16 nt, Human
uuacuaaaauggacug

SEQ ID NO: 1693715 - RNA, 19 nt, Human
uuccuagcacacacuuuug

SEQ ID NO: 1693716 - RNA, 17 nt, Human
uuccuagcacacacuuu

SEQ ID NO: 1693717 - RNA, 21 nt, Human
uucuauauuuucauucuccua

SEQ ID NO: 1693718 - RNA, 18 nt, Human
uucuauauuuucauucuc

SEQ ID NO: 1693719 - RNA, 16 nt, Human
uucuauauuuucauuc

SEQ ID NO: 1693720 - RNA, 15 nt, Human
uucuauauuuucauu

SEQ ID NO: 1693721 - RNA, 14 nt, Human
uucuauauuuucau

SEQ ID NO: 1693722 - RNA, 11 nt, Human
uucuauauuuu

SEQ ID NO: 1693723 - RNA, 17 nt, Human
uucuaugcugaguuugu

SEQ ID NO: 1693724 - RNA, 21 nt, Human
uuuauuggcuuuucugaucca

SEQ ID NO: 1693725 - RNA, 17 nt, Human
uuuauuggcuuuucuga

SEQ ID NO: 1693726 - RNA, 13 nt, Human
uuuaugauccagc

SEQ ID NO: 1693727 - RNA, 18 nt, Human
uuucagauaacuguuauu

SEQ ID NO: 1693728 - RNA, 21 nt, Human
uuuccuagcacacacuuuugg

SEQ ID NO: 1693729 - RNA, 18 nt, Human
uuuccuagcacacacuuu

SEQ ID NO: 1693730 - RNA, 14 nt, Human
uuucucuuucguua

SEQ ID NO: 1693731 - RNA, 13 nt, Human
uuuuaugauccag

SEQ ID NO: 1693732 - RNA, 15 nt, Human
uuuuaugauccagca

SEQ ID NO: 1693733 - RNA, 19 nt, Human
uuuguuguuuguuuagucu

SEQ ID NO: 1693734 - RNA, 14 nt, Human
uuuguuguuuguuu

SEQ ID NO: 1693735 - RNA, 12 nt, Human
uuuguuguuugu

SEQ ID NO: 1693736 - RNA, 12 nt, Human
uuuguguuagag

SEQ ID NO: 1693737 - RNA, 11 nt, Human
uuuguauagaa

SEQ ID NO: 1693738 - RNA, 20 nt, Human
uuugguuaagucuguuuuau

SEQ ID NO: 1693739 - RNA, 19 nt, Human
uuugguuaagucuguuuua

SEQ ID NO: 1693740 - RNA, 18 nt, Human
uuugguuaagucuguuuu

SEQ ID NO: 1693741 - RNA, 22 nt, Human
uuugguuaagucuguuuuauga

SEQ ID NO: 1693742 - RNA, 16 nt, Human
uuuggaaaucuuuaaa

SEQ ID NO: 1693743 - RNA, 22 nt, Human
uuugcauaggugaucucauuua

SEQ ID NO: 1693744 - RNA, 20 nt, Human
uuugagguuuuuaagccuua

SEQ ID NO: 1693745 - RNA, 23 nt, Human
uuuuucuuaaauaauaaagauca

SEQ ID NO: 1693746 - RNA, 14 nt, Human
uuuuucuguuauau

SEQ ID NO: 1693747 - RNA, 14 nt, Human
cugcacggugaaug

SEQ ID NO: 1693748 - RNA, 15 nt, Human
cugcacggugaaugg

SEQ ID NO: 1693749 - RNA, 17 nt, Human
cugcacggugaauggcu

SEQ ID NO: 1693750 - RNA, 20 nt, Human
cugcacggugaauggcuuug

SEQ ID NO: 1693751 - RNA, 19 nt, Human
cugaugccaaguuguuuga

SEQ ID NO: 1693752 - RNA, 11 nt, Human
cuuaaaguuga

SEQ ID NO: 1693753 - RNA, 13 nt, Human
cuuaaaguugaau

SEQ ID NO: 1693754 - RNA, 14 nt, Human
cuuuaauuuuggaa

SEQ ID NO: 1693755 - RNA, 15 nt, Human
cuuuaauuuuggaau

SEQ ID NO: 1693756 - RNA, 13 nt, Human
cuuuaauuuugga

SEQ ID NO: 1693757 - RNA, 16 nt, Human
cuuuaauuuuggaauu

SEQ ID NO: 1693758 - RNA, 18 nt, Human
cuuuaauaucaucaguau

SEQ ID NO: 1693759 - RNA, 19 nt, Human
cuuuaauaucaucaguauu

SEQ ID NO: 1693760 - RNA, 21 nt, Human
cuuuaauaucaucaguauuga

SEQ ID NO: 1693761 - RNA, 13 nt, Human
cuuucagauacug

SEQ ID NO: 1693762 - RNA, 20 nt, Human
cuuucagauaacuguuauuu

SEQ ID NO: 1693763 - RNA, 18 nt, Human
gaucugccuaaggacuuc

SEQ ID NO: 1693764 - RNA, 20 nt, Human
gaucugccuaaggacuucuu

SEQ ID NO: 1693765 - RNA, 21 nt, Human
gaucugccuaaggacuucuuu

SEQ ID NO: 1693766 - RNA, 23 nt, Human
gaucugccuaaggacuucuuuaa

SEQ ID NO: 1693767 - RNA, 22 nt, Human
gauuauucacugauuugacaua

SEQ ID NO: 1693768 - RNA, 23 nt, Human
gauucuucagcaaaaauauuuua

SEQ ID NO: 1693769 - RNA, 18 nt, Human
gauuuuuuuguuguuugu

SEQ ID NO: 1693770 - RNA, 21 nt, Human
gauuuuuuuguuguuuguuua

SEQ ID NO: 1693771 - RNA, 21 nt, Human
gagugaguuggguguauugug

SEQ ID NO: 1693772 - RNA, 17 nt, Human
gacuguggugacuuugg

SEQ ID NO: 1693773 - RNA, 13 nt, Human
gacuguggugacu

SEQ ID NO: 1693774 - RNA, 14 nt, Human
gacuguggugacuu

SEQ ID NO: 1693775 - RNA, 21 nt, Human
ggcugaacacuccaauuaagg

SEQ ID NO: 1693776 - RNA, 15 nt, Human
gggauucuuaaaguu

SEQ ID NO: 1693777 - RNA, 20 nt, Human
gggauucuuaaaguugaauu

SEQ ID NO: 1693778 - RNA, 23 nt, Human
aaaggaagguucuggugugaacu

SEQ ID NO: 1693779 - RNA, 17 nt, Human
aaacuuguguaaauaca

SEQ ID NO: 1693780 - RNA, 15 nt, Human
aaacuuguguaaaua

SEQ ID NO: 1693781 - RNA, 13 nt, Human
aaacuuuucugau

SEQ ID NO: 1693782 - RNA, 14 nt, Human
aaacuuuucugaua

SEQ ID NO: 1693783 - RNA, 12 nt, Human
aaacuuuucuga

SEQ ID NO: 1693784 - RNA, 16 nt, Human
aaacuuuucugauaga

SEQ ID NO: 1693785 - RNA, 17 nt, Human
aaacuuuucugauagag

SEQ ID NO: 1693786 - RNA, 18 nt, Human
aaacauugguucuuguau

SEQ ID NO: 1693787 - RNA, 20 nt, Human
aaacauugguucuuguauua

SEQ ID NO: 1693788 - RNA, 21 nt, Human
aaacauugguucuuguauuaa

SEQ ID NO: 1693789 - RNA, 17 nt, Human
aaacauugguucuugua

SEQ ID NO: 1693790 - RNA, 16 nt, Human
aaacuggguuccugca

SEQ ID NO: 1693791 - RNA, 15 nt, Human
aaacuggguuccugc

SEQ ID NO: 1693792 - RNA, 16 nt, Human
aaacggaugauuucua

SEQ ID NO: 1693793 - RNA, 18 nt, Human
aaacggaugauuucuaug

SEQ ID NO: 1693794 - RNA, 22 nt, Human
aaaauggacuguggugacuuug

SEQ ID NO: 1693795 - RNA, 21 nt, Human
aaaauuggggauucuuaaagu

SEQ ID NO: 1693796 - RNA, 23 nt, Human
aaaauuggggauucuuaaaguug

SEQ ID NO: 1693797 - RNA, 13 nt, Human
ggcaaaugacuuu

SEQ ID NO: 1693798 - RNA, 20 nt, Human
gcugaacacuccaauuaagg

SEQ ID NO: 1693799 - RNA, 21 nt, Human
gcugaacacuccaauuaagga

SEQ ID NO: 1693800 - RNA, 23 nt, Human
gcugaacacuccaauuaaggauu

SEQ ID NO: 1693801 - RNA, 19 nt, Human
cucagaaggcaaaugacuu

SEQ ID NO: 1693802 - RNA, 19 nt, Human
cgcugauaagcguucaugg

SEQ ID NO: 1693803 - RNA, 16 nt, Human
ccuaaggacuucuuua

SEQ ID NO: 1693804 - RNA, 17 nt, Human
ccuaaggacuucuuuaa

SEQ ID NO: 1693805 - RNA, 18 nt, Human
ccuaaggacuucuuuaau

SEQ ID NO: 1693806 - RNA, 23 nt, Human
ccuaaggacuucuuuaauuuugg

SEQ ID NO: 1693807 - RNA, 11 nt, Human
ccuaaggacuu

SEQ ID NO: 1693808 - RNA, 12 nt, Human
ccuaaggacuuc

SEQ ID NO: 1693809 - RNA, 19 nt, Human
ccaugggauaaaugccauc

SEQ ID NO: 1693810 - RNA, 14 nt, Human
ccaguauuguacaa

SEQ ID NO: 1693811 - RNA, 13 nt, Human
ccagacgaugucu

SEQ ID NO: 1693812 - RNA, 20 nt, Human
ccagacgaugucuucauacc

SEQ ID NO: 1693813 - RNA, 18 nt, Human
cagauacuggauuguacu

SEQ ID NO: 1693814 - RNA, 14 nt, Human
cagauacuggauug

SEQ ID NO: 1693815 - RNA, 15 nt, Human
cauuauucaaaguug

SEQ ID NO: 1693816 - RNA, 16 nt, Human
cauuauucaaaguugc

SEQ ID NO: 1693817 - RNA, 14 nt, Human
cauuauucaaaguu

SEQ ID NO: 1693818 - RNA, 14 nt, Human
cauugguucuugua

SEQ ID NO: 1693819 - RNA, 15 nt, Human
cauugguucuuguau

SEQ ID NO: 1693820 - RNA, 17 nt, Human
cauugguguuguacuca

SEQ ID NO: 1693821 - RNA, 16 nt, Human
cauaggugaucucauu

SEQ ID NO: 1693822 - RNA, 15 nt, Human
auuauguaaauccca

SEQ ID NO: 1693823 - RNA, 17 nt, Human
auuauguaaaucccauu

SEQ ID NO: 1693824 - RNA, 22 nt, Human
auuauguaaaucccauuauuca

SEQ ID NO: 1693825 - RNA, 23 nt, Human
auuauguaaaucccauuauucaa

SEQ ID NO: 1693826 - RNA, 13 nt, Human
auuauguaaaucc

SEQ ID NO: 1693827 - RNA, 14 nt, Human
auuauguaaauccc

SEQ ID NO: 1693828 - RNA, 20 nt, Human
auuuuuuuucuguuauauaa

SEQ ID NO: 1693829 - RNA, 18 nt, Human
auuuuuuuucuguuauau

SEQ ID NO: 1693830 - RNA, 19 nt, Human
auuuuuuuucuguuauaua

SEQ ID NO: 1693831 - RNA, 15 nt, Human
auuuuuuuucuguua

SEQ ID NO: 1693832 - RNA, 17 nt, Human
auuuuuuuucuguuaua

SEQ ID NO: 1693833 - RNA, 15 nt, Human
auuuaauaauuauau

SEQ ID NO: 1693834 - RNA, 18 nt, Human
auuuaauaauuauaugcu

SEQ ID NO: 1693835 - RNA, 13 nt, Human
auuuaauaauuau

SEQ ID NO: 1693836 - RNA, 21 nt, Human
cacuccaauuaaggauuuuau

SEQ ID NO: 1693837 - RNA, 22 nt, Human
cacuccaauuaaggauuuuaug

SEQ ID NO: 1693838 - RNA, 15 nt, Human
auguuuauuacagua

SEQ ID NO: 1693839 - RNA, 16 nt, Human
auguuuauuacaguau

SEQ ID NO: 1693840 - RNA, 18 nt, Human
auguuuauuacaguauaa

SEQ ID NO: 1693841 - RNA, 19 nt, Human
auguuuauuacaguauaau

SEQ ID NO: 1693842 - RNA, 22 nt, Human
auguuuauuacaguauaauuaa

SEQ ID NO: 1693843 - RNA, 23 nt, Human
auguuuauuacaguauaauuaac

SEQ ID NO: 1693844 - RNA, 19 nt, Human
uuuucugauccaguuuugu

SEQ ID NO: 1693845 - RNA, 14 nt, Human
uuuucuuaaauaau

SEQ ID NO: 1693846 - RNA, 23 nt, Human
uuuucuuaaauaauaaagaucau

SEQ ID NO: 1693847 - RNA, 12 nt, Human
uuuucuguuaua

SEQ ID NO: 1693848 - RNA, 12 nt, Human
auguuuauuaca

SEQ ID NO: 1693849 - RNA, 16 nt, Human
uuugagaaauuaagua

SEQ ID NO: 1693850 - RNA, 12 nt, Human
uuugaauuuugu

SEQ ID NO: 1693851 - RNA, 14 nt, Human
uuugaauuuugugu

SEQ ID NO: 1693852 - RNA, 20 nt, Human
auuauaucugaggaauucug

SEQ ID NO: 1693853 - RNA, 21 nt, Human
auuauaucugaggaauucugu

SEQ ID NO: 1693854 - RNA, 22 nt, Human
auuauaucugaggaauucugua

SEQ ID NO: 1693855 - RNA, 16 nt, Human
auuauaugcuauuucu

SEQ ID NO: 1693856 - RNA, 18 nt, Human
auuauaucugaggaauuc

SEQ ID NO: 1693857 - RNA, 19 nt, Human
auuauaucugaggaauucu

SEQ ID NO: 1693858 - RNA, 19 nt, Human
auuauucaaaguugccuaa

SEQ ID NO: 1693859 - RNA, 22 nt, Human
auuauucaaaguugccuaaauc

SEQ ID NO: 1693860 - RNA, 18 nt, Human
auuauucaaaguugccua

SEQ ID NO: 1693861 - RNA, 24 nt, Human
auuauucaaaguugccuaaaucca

SEQ ID NO: 1693862 - RNA, 19 nt, Human
auuauucacugauuugaca

SEQ ID NO: 1693863 - RNA, 18 nt, Human
auuauaugcuauuucuau

SEQ ID NO: 1693864 - RNA, 17 nt, Human
auuauaugcuauuucua

SEQ ID NO: 1693865 - RNA, 19 nt, Human
auuauaugcuauuucuaua

SEQ ID NO: 1693866 - RNA, 12 nt, Human
auucacugauuu

SEQ ID NO: 1693867 - RNA, 17 nt, Human
auucacugauuugacau

SEQ ID NO: 1693868 - RNA, 20 nt, Human
uuuuuauauuuacuaaaaug

SEQ ID NO: 1693869 - RNA, 15 nt, Human
uuuuggaauuuuccu

SEQ ID NO: 1693870 - RNA, 15 nt, Human
auuaaggauuuuaug

SEQ ID NO: 1693871 - RNA, 17 nt, Human
auuaaggauuuuaugcu

SEQ ID NO: 1693872 - RNA, 20 nt, Human
auuaaggauuuuaugcuuua

SEQ ID NO: 1693873 - RNA, 17 nt, Human
auuaaguaucugacauc

SEQ ID NO: 1693874 - RNA, 23 nt, Human
uuuuuggcauaacauaaaucugu

SEQ ID NO: 1693875 - RNA, 24 nt, Human
uuuuuggcauaacauaaaucugug

SEQ ID NO: 1693876 - RNA, 14 nt, Human
auuggggauucuua

SEQ ID NO: 1693877 - RNA, 15 nt, Human
auuggggauucuuaa

SEQ ID NO: 1693878 - RNA, 16 nt, Human
auuggggauucuuaaa

SEQ ID NO: 1693879 - RNA, 20 nt, Human
auuggggauucuuaaaguug

SEQ ID NO: 1693880 - RNA, 21 nt, Human
auuggggauucuuaaaguuga

SEQ ID NO: 1693881 - RNA, 22 nt, Human
auuggggauucuuaaaguugaa

SEQ ID NO: 1693882 - RNA, 16 nt, Human
auuuacuaaaauggac

SEQ ID NO: 1693883 - RNA, 19 nt, Human
auuuacuaaaauggacugu

SEQ ID NO: 1693884 - RNA, 20 nt, Human
auuuacuaaaauggacugug

SEQ ID NO: 1693885 - RNA, 15 nt, Human
auuguacuuugugcu

SEQ ID NO: 1693886 - RNA, 14 nt, Human
auuuauuggcuuuu

SEQ ID NO: 1693887 - RNA, 18 nt, Human
auuuauuggcuuuucuga

SEQ ID NO: 1693888 - RNA, 20 nt, Human
auuuauuggcuuuucugauc

SEQ ID NO: 1693889 - RNA, 23 nt, Human
auuuauuggcuuuucugauccag

SEQ ID NO: 1693890 - RNA, 13 nt, Human
auuugaauuuugu

SEQ ID NO: 1693891 - RNA, 14 nt, Human
augccaucaauaaa

SEQ ID NO: 1693892 - RNA, 15 nt, Human
uuuagucuugucuca

SEQ ID NO: 1693893 - RNA, 17 nt, Human
uuuagucuugucucaga

SEQ ID NO: 1693894 - RNA, 23 nt, Human
uuuagucuugucucagauuuuau

SEQ ID NO: 1693895 - RNA, 16 nt, Human
aucugaagucagaucu

SEQ ID NO: 1693896 - RNA, 17 nt, Human
aucugaagucagaucug

SEQ ID NO: 1693897 - RNA, 18 nt, Human
aucugaagucagaucugc

SEQ ID NO: 1693898 - RNA, 23 nt, Human
aucugaagucagaucugccuaag

SEQ ID NO: 1693899 - RNA, 22 nt, Human
augaaauacuguuugagguuuu

SEQ ID NO: 1693900 - RNA, 16 nt, Human
uucauaccuacaugua

SEQ ID NO: 1693901 - RNA, 19 nt, Human
uucauaccuacauguauuu

SEQ ID NO: 1693902 - RNA, 19 nt, Human
auaucugaggaauucugua

SEQ ID NO: 1693903 - RNA, 20 nt, Human
auaucugaggaauucuguau

SEQ ID NO: 1693904 - RNA, 21 nt, Human
auaucugaggaauucuguaua

SEQ ID NO: 1693905 - RNA, 22 nt, Human
auaucugaggaauucuguauag

SEQ ID NO: 1693906 - RNA, 23 nt, Human
auaucugaggaauucuguauaga

SEQ ID NO: 1693907 - RNA, 15 nt, Human
auaucugaggaauuc

SEQ ID NO: 1693908 - RNA, 16 nt, Human
auaucugaggaauucu

SEQ ID NO: 1693909 - RNA, 17 nt, Human
auaucugaggaauucug

SEQ ID NO: 1693910 - RNA, 18 nt, Human
auaucugaggaauucugu

SEQ ID NO: 1693911 - RNA, 21 nt, Human
uucagcaaaaauauuuuauga

SEQ ID NO: 1693912 - RNA, 17 nt, Human
auauaaaugguuaaaag

SEQ ID NO: 1693913 - RNA, 18 nt, Human
auagcuagacuggugacu

SEQ ID NO: 1693914 - RNA, 19 nt, Human
auagcuagacuggugacug

SEQ ID NO: 1693915 - RNA, 23 nt, Human
auagcuagacuggugacugauuc

SEQ ID NO: 1693916 - RNA, 14 nt, Human
auagcuagacuggu

SEQ ID NO: 1693917 - RNA, 15 nt, Human
auagcuagacuggug

SEQ ID NO: 1693918 - RNA, 16 nt, Human
auagcuagacugguga

SEQ ID NO: 1693919 - RNA, 17 nt, Human
uuauuuauaaucacuuu

SEQ ID NO: 1693920 - RNA, 12 nt, Human
uucuggugugaa

SEQ ID NO: 1693921 - RNA, 15 nt, Human
aucaucaguauugaa

SEQ ID NO: 1693922 - RNA, 19 nt, Human
aucaucaguauugaagcau

SEQ ID NO: 1693923 - RNA, 17 nt, Human
aucaucaguauugaagc

SEQ ID NO: 1693924 - RNA, 15 nt, Human
aucaguauugaagca

SEQ ID NO: 1693925 - RNA, 22 nt, Human
aucaguauugaagcauuuuaua

SEQ ID NO: 1693926 - RNA, 17 nt, Human
auauuuuaugauccagc

SEQ ID NO: 1693927 - RNA, 22 nt, Human
auauuuuaugauccagcagauu

SEQ ID NO: 1693928 - RNA, 12 nt, Human
auauuuuaugau

SEQ ID NO: 1693929 - RNA, 13 nt, Human
auauuuuaugauc

SEQ ID NO: 1693930 - RNA, 13 nt, Human
auauuuucauucu

SEQ ID NO: 1693931 - RNA, 14 nt, Human
auauuaaagccaug

SEQ ID NO: 1693932 - RNA, 15 nt, Human
auauuaaagccaugu

SEQ ID NO: 1693933 - RNA, 18 nt, Human
auauuaaagccauguuua

SEQ ID NO: 1693934 - RNA, 23 nt, Human
auauuaaagccauguuuauuaca

SEQ ID NO: 1693935 - RNA, 18 nt, Human
ugugcugggguuaucuga

SEQ ID NO: 1693936 - RNA, 13 nt, Human
agugaaacugcuu

SEQ ID NO: 1693937 - RNA, 21 nt, Human
agugaaacugcuuguuuccua

SEQ ID NO: 1693938 - RNA, 24 nt, Human
agugaaacugcuuguuuccuagca

SEQ ID NO: 1693939 - RNA, 14 nt, Human
ugugaacuugaaau

SEQ ID NO: 1693940 - RNA, 15 nt, Human
ugugaacuugaaauu

SEQ ID NO: 1693941 - RNA, 16 nt, Human
ugugaacuugaaauuu

SEQ ID NO: 1693942 - RNA, 12 nt, Human
ugugaacuugaa

SEQ ID NO: 1693943 - RNA, 14 nt, Human
uguuauauaaaugg

SEQ ID NO: 1693944 - RNA, 13 nt, Human
uguuauauaaaug

SEQ ID NO: 1693945 - RNA, 19 nt, Human
agugaguuggguguauugu

SEQ ID NO: 1693946 - RNA, 20 nt, Human
agugaguuggguguauugug

SEQ ID NO: 1693947 - RNA, 14 nt, Human
uuaacaacagcugg

SEQ ID NO: 1693948 - RNA, 16 nt, Human
uuaaauaauaaagauc

SEQ ID NO: 1693949 - RNA, 22 nt, Human
uuaaaggaagguucugguguga

SEQ ID NO: 1693950 - RNA, 20 nt, Human
uuaaaggaagguucuggugu

SEQ ID NO: 1693951 - RNA, 15 nt, Human
aguuuaauauuaaag

SEQ ID NO: 1693952 - RNA, 16 nt, Human
aguuuaauauuaaagc

SEQ ID NO: 1693953 - RNA, 18 nt, Human
aguuuaauauuaaagcca

SEQ ID NO: 1693954 - RNA, 19 nt, Human
aguuuaauauuaaagccau

SEQ ID NO: 1693955 - RNA, 20 nt, Human
aguuuaauauuaaagccaug

SEQ ID NO: 1693956 - RNA, 17 nt, Human
aguuggguguauugugc

SEQ ID NO: 1693957 - RNA, 20 nt, Human
aguuggguguauugugcgcu

SEQ ID NO: 1693958 - RNA, 16 nt, Human
aguuggguguauugug

SEQ ID NO: 1693959 - RNA, 22 nt, Human
aguugccuaaauccauuuggaa

SEQ ID NO: 1693960 - RNA, 23 nt, Human
aguugccuaaauccauuuggaaa

SEQ ID NO: 1693961 - RNA, 19 nt, Human
uguuuggaccaaaaaccag

SEQ ID NO: 1693962 - RNA, 18 nt, Human
uguuuuaugacuucauua

SEQ ID NO: 1693963 - RNA, 23 nt, Human
uguuuagucuugucucagauuuu

SEQ ID NO: 1693964 - RNA, 22 nt, Human
uguuuagucuugucucagauuu

SEQ ID NO: 1693965 - RNA, 18 nt, Human
uguuuauuacaguauaau

SEQ ID NO: 1693966 - RNA, 14 nt, Human
uguuuauuacagua

SEQ ID NO: 1693967 - RNA, 22 nt, Human
uguuugagguuuuuaagccuua

SEQ ID NO: 1693968 - RNA, 14 nt, Human
uguuugagaaauua

SEQ ID NO: 1693969 - RNA, 20 nt, Human
auaaaucugugaacuugaaa

SEQ ID NO: 1693970 - RNA, 21 nt, Human
auaaaucugugaacuugaaau

SEQ ID NO: 1693971 - RNA, 22 nt, Human
auaaaucugugaacuugaaauu

SEQ ID NO: 1693972 - RNA, 16 nt, Human
auaaauagcuagacug

SEQ ID NO: 1693973 - RNA, 18 nt, Human
auaaauagcuagacuggu

SEQ ID NO: 1693974 - RNA, 21 nt, Human
auaaauagcuagacuggugac

SEQ ID NO: 1693975 - RNA, 18 nt, Human
uuacaguauaauuaacau

SEQ ID NO: 1693976 - RNA, 19 nt, Human
uuacaguauaauuaacaug

SEQ ID NO: 1693977 - RNA, 20 nt, Human
uuacaguauaauuaacaugu

SEQ ID NO: 1693978 - RNA, 16 nt, Human
uuacaguauaauuaac

SEQ ID NO: 1693979 - RNA, 17 nt, Human
uuacaguauaauuaaca

SEQ ID NO: 1693980 - RNA, 13 nt, Human
uuacaguauaauu

SEQ ID NO: 1693981 - RNA, 22 nt, Human
auaaaugguuaaaagagguuuu

SEQ ID NO: 1693982 - RNA, 16 nt, Human
auaaaugguuaaaaga

SEQ ID NO: 1693983 - RNA, 21 nt, Human
uuaagucuguuuuaugacuuc

SEQ ID NO: 1693984 - RNA, 17 nt, Human
uuaagucuguuuuauga

SEQ ID NO: 1693985 - RNA, 18 nt, Human
uuaagucuguuuuaugac

SEQ ID NO: 1693986 - RNA, 20 nt, Human
uuaagucuguuuuaugacuu

SEQ ID NO: 1693987 - RNA, 13 nt, Human
agguuuuucuuaa

SEQ ID NO: 1693988 - RNA, 14 nt, Human
aguauugaagcauu

SEQ ID NO: 1693989 - RNA, 15 nt, Human
aguauugaagcauuu

SEQ ID NO: 1693990 - RNA, 18 nt, Human
aguauugaagcauuuuau

SEQ ID NO: 1693991 - RNA, 20 nt, Human
aguauugaagcauuuuauaa

SEQ ID NO: 1693992 - RNA, 21 nt, Human
aguauugaagcauuuuauaaa

SEQ ID NO: 1693993 - RNA, 16 nt, Human
uggugcccugcuuuca

SEQ ID NO: 1693994 - RNA, 19 nt, Human
uggugcccugcuuucagau

SEQ ID NO: 1693995 - RNA, 20 nt, Human
uggugcccugcuuucagaua

SEQ ID NO: 1693996 - RNA, 14 nt, Human
uggugcccugcuuu

SEQ ID NO: 1693997 - RNA, 14 nt, Human
uggugugaacuaaa

SEQ ID NO: 1693998 - RNA, 22 nt, Human
uggugugaacuaaacuuucaca

SEQ ID NO: 1693999 - RNA, 23 nt, Human
uggugugaacuaaacuuucacac

SEQ ID NO: 1694000 - RNA, 17 nt, Human
agguucuggugugaacu

SEQ ID NO: 1694001 - RNA, 15 nt, Human
uguaaauacaauuuu

SEQ ID NO: 1694002 - RNA, 22 nt, Human
ugcuauuucuauauuuucauuc

SEQ ID NO: 1694003 - RNA, 14 nt, Human
ugccaucaauaaaa

SEQ ID NO: 1694004 - RNA, 22 nt, Human
ugccaucaauaaaaaauuauga

SEQ ID NO: 1694005 - RNA, 13 nt, Human
aggaauucuguau

SEQ ID NO: 1694006 - RNA, 14 nt, Human
aggaauucuguaua

SEQ ID NO: 1694007 - RNA, 15 nt, Human
aggaauucuguauag

SEQ ID NO: 1694008 - RNA, 14 nt, Human
aggacuucuuuaau

SEQ ID NO: 1694009 - RNA, 16 nt, Human
aggacuucuuuaauuu

SEQ ID NO: 1694010 - RNA, 21 nt, Human
aggacuucuuuaauuuuggaa

SEQ ID NO: 1694011 - RNA, 22 nt, Human
aggacuucuuuaauuuuggaau

SEQ ID NO: 1694012 - RNA, 23 nt, Human
aggacuucuuuaauuuuggaauu

SEQ ID NO: 1694013 - RNA, 23 nt, Human
ugauuugacauagucuggcugua

SEQ ID NO: 1694014 - RNA, 20 nt, Human
ugauccagcagauuauucac

SEQ ID NO: 1694015 - RNA, 19 nt, Human
ugauccagcagauuauuca

SEQ ID NO: 1694016 - RNA, 13 nt, Human
agcauuuuauaaa

SEQ ID NO: 1694017 - RNA, 14 nt, Human
agcauuuuauaaau

SEQ ID NO: 1694018 - RNA, 15 nt, Human
agcauuuuauaaauc

SEQ ID NO: 1694019 - RNA, 20 nt, Human
agcauuuuauaaaucgcuuu

SEQ ID NO: 1694020 - RNA, 18 nt, Human
agcauauauuuuuauauu

SEQ ID NO: 1694021 - RNA, 20 nt, Human
agcauauauuuuuauauuua

SEQ ID NO: 1694022 - RNA, 22 nt, Human
agcauauauuuuuauauuuacu

SEQ ID NO: 1694023 - RNA, 15 nt, Human
agcauauauuuuuau

SEQ ID NO: 1694024 - RNA, 22 nt, Human
ugaauuuauuggcuuuucugau

SEQ ID NO: 1694025 - RNA, 23 nt, Human
ugaauuuauuggcuuuucugauc

SEQ ID NO: 1694026 - RNA, 17 nt, Human
ugaauuuauuggcuuuu

SEQ ID NO: 1694027 - RNA, 21 nt, Human
ugaauuuauuggcuuuucuga

SEQ ID NO: 1694028 - RNA, 17 nt, Human
ugaaauuugaauuuugu

SEQ ID NO: 1694029 - RNA, 14 nt, Human
ugaaauuugaauuu

SEQ ID NO: 1694030 - RNA, 15 nt, Human
ugaaauuugaauuuu

SEQ ID NO: 1694031 - RNA, 16 nt, Human
ugaaauuugaauuuug

SEQ ID NO: 1694032 - RNA, 21 nt, Human
ugaaauuguaauuauaucuga

SEQ ID NO: 1694033 - RNA, 23 nt, Human
agagauuuuuuuguuguuuguuu

SEQ ID NO: 1694034 - RNA, 22 nt, Human
agagauuuuuuuguuguuuguu

SEQ ID NO: 1694035 - RNA, 12 nt, Human
agacuggugacu

SEQ ID NO: 1694036 - RNA, 13 nt, Human
agacuggugacug

SEQ ID NO: 1694037 - RNA, 14 nt, Human
agacuggugacuga

SEQ ID NO: 1694038 - RNA, 16 nt, Human
agacuggugacugauu

SEQ ID NO: 1694039 - RNA, 17 nt, Human
agacuggugacugauuc

SEQ ID NO: 1694040 - RNA, 19 nt, Human
agacuggugacugauucuu

SEQ ID NO: 1694041 - RNA, 14 nt, Human
ucuguacuuuuugg

SEQ ID NO: 1694042 - RNA, 17 nt, Human
ucuguacuuuuuggcau

SEQ ID NO: 1694043 - RNA, 13 nt, Human
ucuguacuuuuug

SEQ ID NO: 1694044 - RNA, 22 nt, Human
ucugugaacuugaaauuugaau

SEQ ID NO: 1694045 - RNA, 19 nt, Human
ucugugaacuugaaauuug

SEQ ID NO: 1694046 - RNA, 23 nt, Human
acuuguuagaucuaguucacucu

SEQ ID NO: 1694047 - RNA, 14 nt, Human
acuuguuagaucua

SEQ ID NO: 1694048 - RNA, 15 nt, Human
acuuguuagaucuag

SEQ ID NO: 1694049 - RNA, 20 nt, Human
acuugaaauuugaauuuugu

SEQ ID NO: 1694050 - RNA, 19 nt, Human
acuugaaauuugaauuuug

SEQ ID NO: 1694051 - RNA, 15 nt, Human
ucugaagucagaucu

SEQ ID NO: 1694052 - RNA, 19 nt, Human
ucugaagucagaucugccu

SEQ ID NO: 1694053 - RNA, 13 nt, Human
acugcuuguuucc

SEQ ID NO: 1694054 - RNA, 16 nt, Human
acugcuuguuuccuag

SEQ ID NO: 1694055 - RNA, 18 nt, Human
acuguggugacuuuggau

SEQ ID NO: 1694056 - RNA, 20 nt, Human
acuguggugacuuuggauaa

SEQ ID NO: 1694057 - RNA, 21 nt, Human
acuguggugacuuuggauaau

SEQ ID NO: 1694058 - RNA, 12 nt, Human
acuguggugacu

SEQ ID NO: 1694059 - RNA, 14 nt, Human
acuguggugacuuu

SEQ ID NO: 1694060 - RNA, 15 nt, Human
acuguggugacuuug

SEQ ID NO: 1694061 - RNA, 13 nt, Human
acuguuauuuaua

SEQ ID NO: 1694062 - RNA, 14 nt, Human
acuguuauuuauaa

SEQ ID NO: 1694063 - RNA, 22 nt, Human
ucuaccagccucccuauuuuuu

SEQ ID NO: 1694064 - RNA, 18 nt, Human
uccauuuaauaauuauau

SEQ ID NO: 1694065 - RNA, 13 nt, Human
accuacauguauu

SEQ ID NO: 1694066 - RNA, 14 nt, Human
accuacauguauuu

SEQ ID NO: 1694067 - RNA, 15 nt, Human
accuacauguauuug

SEQ ID NO: 1694068 - RNA, 16 nt, Human
uauuucuauauuuuca

SEQ ID NO: 1694069 - RNA, 17 nt, Human
uauuucuauauuuucau

SEQ ID NO: 1694070 - RNA, 18 nt, Human
uauuucuauauuuucauu

SEQ ID NO: 1694071 - RNA, 18 nt, Human
acaguuuugguugcuuua

SEQ ID NO: 1694072 - RNA, 19 nt, Human
acaguuuugguugcuuuaa

SEQ ID NO: 1694073 - RNA, 24 nt, Human
acaguuuugguugcuuuaauauca

SEQ ID NO: 1694074 - RNA, 14 nt, Human
acauagucuggcug

SEQ ID NO: 1694075 - RNA, 15 nt, Human
acauagucuggcugu

SEQ ID NO: 1694076 - RNA, 20 nt, Human
acauagucuggcuguaccca

SEQ ID NO: 1694077 - RNA, 22 nt, Human
ucaaaguugccuaaauccauuu

SEQ ID NO: 1694078 - RNA, 18 nt, Human
ucaaaguugccuaaaucc

SEQ ID NO: 1694079 - RNA, 19 nt, Human
ucaaaguugccuaaaucca

SEQ ID NO: 1694080 - RNA, 21 nt, Human
ucaaaguugccuaaauccauu

SEQ ID NO: 1694081 - RNA, 16 nt, Human
uauuuuuauauuuacu

SEQ ID NO: 1694082 - RNA, 18 nt, Human
accccagacgaugucuuc

SEQ ID NO: 1694083 - RNA, 18 nt, Human
ucagaaggcaaaugacuu

SEQ ID NO: 1694084 - RNA, 19 nt, Human
ucagaaggcaaaugacuuu

SEQ ID NO: 1694085 - RNA, 22 nt, Human
ucagaaggcaaaugacuuugga

SEQ ID NO: 1694086 - RNA, 19 nt, Human
accaugggauaaaugccau

SEQ ID NO: 1694087 - RNA, 13 nt, Human
ucaauuuuaacaa

SEQ ID NO: 1694088 - RNA, 21 nt, Human
acaccccagacgaugucuuca

SEQ ID NO: 1694089 - RNA, 17 nt, Human
uagucuugucucagauu

SEQ ID NO: 1694090 - RNA, 22 nt, Human
uagucuugucucagauuuuauu

SEQ ID NO: 1694091 - RNA, 21 nt, Human
acacuccaauuaaggauuuua

SEQ ID NO: 1694092 - RNA, 18 nt, Human
acacuccaauuaaggauu

SEQ ID NO: 1694093 - RNA, 17 nt, Human
acacuccaauuaaggau

SEQ ID NO: 1694094 - RNA, 19 nt, Human
uacuuuuuggcauaacaua

SEQ ID NO: 1694095 - RNA, 20 nt, Human
uacuuuuuggcauaacauaa

SEQ ID NO: 1694096 - RNA, 14 nt, Human
uacuuuuuggcaua

SEQ ID NO: 1694097 - RNA, 16 nt, Human
uacuuugugcuggggu

SEQ ID NO: 1694098 - RNA, 22 nt, Human
uacuuugugcugggguuaucug

SEQ ID NO: 1694099 - RNA, 16 nt, Human
aauuuuguuucuguac

SEQ ID NO: 1694100 - RNA, 20 nt, Human
acaaaguauuaagcauauau

SEQ ID NO: 1694101 - RNA, 14 nt, Human
uagaucuaguucac

SEQ ID NO: 1694102 - RNA, 15 nt, Human
acaacagcuggugcc

SEQ ID NO: 1694103 - RNA, 15 nt, Human
uagcuagacugguga

SEQ ID NO: 1694104 - RNA, 18 nt, Human
uagcuagacuggugacug

SEQ ID NO: 1694105 - RNA, 15 nt, Human
uaaaucugugaacuu

SEQ ID NO: 1694106 - RNA, 16 nt, Human
uaaaucugugaacuug

SEQ ID NO: 1694107 - RNA, 17 nt, Human
uaaaucugugaacuuga

SEQ ID NO: 1694108 - RNA, 18 nt, Human
uaaaucugugaacuugaa

SEQ ID NO: 1694109 - RNA, 19 nt, Human
uaaaucugugaacuugaaa

SEQ ID NO: 1694110 - RNA, 21 nt, Human
uaaaucugugaacuugaaauu

SEQ ID NO: 1694111 - RNA, 22 nt, Human
uaaaucugugaacuugaaauuu

SEQ ID NO: 1694112 - RNA, 18 nt, Human
uaaauagcuagacuggug

SEQ ID NO: 1694113 - RNA, 17 nt, Human
uaaauaaauaaauagcu

SEQ ID NO: 1694114 - RNA, 14 nt, Human
uaaauaaauagcua

SEQ ID NO: 1694115 - RNA, 13 nt, Human
uaagaaugaaaua

SEQ ID NO: 1694116 - RNA, 15 nt, Human
uaagaaugaaauacu

SEQ ID NO: 1694117 - RNA, 21 nt, Human
uaagaaugaaauacuguuuga

SEQ ID NO: 1694118 - RNA, 17 nt, Human
aauauuuuaugauccag

SEQ ID NO: 1694119 - RNA, 18 nt, Human
aauauuuuaugauccagc

SEQ ID NO: 1694120 - RNA, 16 nt, Human
uaacauaaaucuguga

SEQ ID NO: 1694121 - RNA, 17 nt, Human
uaacauaaaucugugaa

SEQ ID NO: 1694122 - RNA, 18 nt, Human
uaacauaaaucugugaac

SEQ ID NO: 1694123 - RNA, 20 nt, Human
uaacauaaaucugugaacuu

SEQ ID NO: 1694124 - RNA, 15 nt, Human
uaacauaaaucugug

SEQ ID NO: 1694125 - RNA, 18 nt, Human
aauaucaucaguauugaa

SEQ ID NO: 1694126 - RNA, 13 nt, Human
aaucugugaacuu

SEQ ID NO: 1694127 - RNA, 15 nt, Human
aaucugugaacuuga

SEQ ID NO: 1694128 - RNA, 17 nt, Human
aaucugugaacuugaaa

SEQ ID NO: 1694129 - RNA, 18 nt, Human
aaucugugaacuugaaau

SEQ ID NO: 1694130 - RNA, 19 nt, Human
aaucugugaacuugaaauu

SEQ ID NO: 1694131 - RNA, 15 nt, Human
uaaguaucugacauc

SEQ ID NO: 1694132 - RNA, 16 nt, Human
uaaguaucugacaucu

SEQ ID NO: 1694133 - RNA, 21 nt, Human
uaaucaacugggcugaacacu

SEQ ID NO: 1694134 - RNA, 19 nt, Human
aaucuuuaaaaaaaaaauu

SEQ ID NO: 1694135 - RNA, 20 nt, Human
aaucuuuaaaaaaaaaauug

SEQ ID NO: 1694136 - RNA, 16 nt, Human
uacaguauaauuaaca

SEQ ID NO: 1694137 - RNA, 17 nt, Human
uacaguauaauuaacau

SEQ ID NO: 1694138 - RNA, 14 nt, Human
uacaguauaauuaa

SEQ ID NO: 1694139 - RNA, 14 nt, Human
uacaccauuaugug

SEQ ID NO: 1694140 - RNA, 20 nt, Human
aauggacuguggugacuuug

SEQ ID NO: 1694141 - RNA, 18 nt, Human
uacaguauaauuaacaug

SEQ ID NO: 1694142 - RNA, 19 nt, Human
uacaguauaauuaacaugu

SEQ ID NO: 1694143 - RNA, 23 nt, Human
uacaguauaauuaacauguuaaa

SEQ ID NO: 1694144 - RNA, 19 nt, Human
aagaaugguccgugcuaag

SEQ ID NO: 1694145 - RNA, 22 nt, Human
aagaaugguccgugcuaaggac

SEQ ID NO: 1694146 - RNA, 16 nt, Human
aagagguuuuucuuaa

SEQ ID NO: 1694147 - RNA, 19 nt, Human
guguuguacucaauuuuaa

SEQ ID NO: 1694148 - RNA, 20 nt, Human
guuucuguacuuuuuggcau

SEQ ID NO: 1694149 - RNA, 15 nt, Human
guugccuaaauccau

SEQ ID NO: 1694150 - RNA, 16 nt, Human
guugccuaaauccauu

SEQ ID NO: 1694151 - RNA, 14 nt, Human
guugccuaaaucca

SEQ ID NO: 1694152 - RNA, 17 nt, Human
guugccuaaauccauuu

SEQ ID NO: 1694153 - RNA, 17 nt, Human
guucuuguauuaagaau

SEQ ID NO: 1694154 - RNA, 18 nt, Human
guucuuguauuaagaaug

SEQ ID NO: 1694155 - RNA, 21 nt, Human
guucuuguauuaagaaugaaa

SEQ ID NO: 1694156 - RNA, 15 nt, Human
guucuggugugaacu

SEQ ID NO: 1694157 - RNA, 18 nt, Human
guucuggugugaacuaaa

SEQ ID NO: 1694158 - RNA, 12 nt, Human
guuagaucuagu

SEQ ID NO: 1694159 - RNA, 15 nt, Human
guuaagucuguuuua

SEQ ID NO: 1694160 - RNA, 22 nt, Human
guuaagucuguuuuaugacuuc

SEQ ID NO: 1694161 - RNA, 13 nt, Human
guuaagucuguuu

SEQ ID NO: 1694162 - RNA, 20 nt, Human
guuauuuauaaucacuuuuu

SEQ ID NO: 1694163 - RNA, 14 nt, Human
guuauuuauaauca

SEQ ID NO: 1694164 - RNA, 17 nt, Human
aacacuccaauuaagga

SEQ ID NO: 1694165 - RNA, 13 nt, Human
aacuaaacuuuca

SEQ ID NO: 1694166 - RNA, 15 nt, Human
aacuaaacuuucaca

SEQ ID NO: 1694167 - RNA, 17 nt, Human
aacuaaacuuucacacc

SEQ ID NO: 1694168 - RNA, 15 nt, Human
aaccaugggauaaau

SEQ ID NO: 1694169 - RNA, 17 nt, Human
aaccaugggauaaaugc

SEQ ID NO: 1694170 - RNA, 18 nt, Human
aaccaugggauaaaugcc

SEQ ID NO: 1694171 - RNA, 20 nt, Human
aaccaugggauaaaugccau

SEQ ID NO: 1694172 - RNA, 21 nt, Human
aaccaugggauaaaugccauc

SEQ ID NO: 1694173 - RNA, 15 nt, Human
aaauccauuuggaaa

SEQ ID NO: 1694174 - RNA, 16 nt, Human
aaauccauuuggaaau

SEQ ID NO: 1694175 - RNA, 14 nt, Human
aaauccauuuggaa

SEQ ID NO: 1694176 - RNA, 18 nt, Human
aaauccauuuggaaaucu

SEQ ID NO: 1694177 - RNA, 21 nt, Human
aaauccauuuggaaaucuuua

SEQ ID NO: 1694178 - RNA, 22 nt, Human
aaauccauuuggaaaucuuuaa

SEQ ID NO: 1694179 - RNA, 23 nt, Human
aaauccauuuggaaaucuuuaaa

SEQ ID NO: 1694180 - RNA, 13 nt, Human
aaaucccauuauu

SEQ ID NO: 1694181 - RNA, 15 nt, Human
aaaucccauuauuca

SEQ ID NO: 1694182 - RNA, 16 nt, Human
aaaucccauuauucaa

SEQ ID NO: 1694183 - RNA, 17 nt, Human
aaaucccauuauucaaa

SEQ ID NO: 1694184 - RNA, 19 nt, Human
aaaucccauuauucaaagu

SEQ ID NO: 1694185 - RNA, 20 nt, Human
aaaucccauuauucaaaguu

SEQ ID NO: 1694186 - RNA, 21 nt, Human
aaaucccauuauucaaaguug

SEQ ID NO: 1694187 - RNA, 22 nt, Human
aaaucccauuauucaaaguugc

SEQ ID NO: 1694188 - RNA, 13 nt, Human
aaaucgcuuuuga

SEQ ID NO: 1694189 - RNA, 14 nt, Human
aaaucgcuuuugau

SEQ ID NO: 1694190 - RNA, 15 nt, Human
aaaucgcuuuugaua

SEQ ID NO: 1694191 - RNA, 13 nt, Human
guaugugugaagu

SEQ ID NO: 1694192 - RNA, 17 nt, Human
guaugugugaagugagu

SEQ ID NO: 1694193 - RNA, 18 nt, Human
aaauucccuggccuuuca

SEQ ID NO: 1694194 - RNA, 15 nt, Human
aaauucccuggccuu

SEQ ID NO: 1694195 - RNA, 14 nt, Human
aaaaguuuaauauu

SEQ ID NO: 1694196 - RNA, 16 nt, Human
aaaaguuuaauauuaa

SEQ ID NO: 1694197 - RNA, 18 nt, Human
aaaaguuuaauauuaaag

SEQ ID NO: 1694198 - RNA, 17 nt, Human
aaaagagguuuuucuua

SEQ ID NO: 1694199 - RNA, 21 nt, Human
aaaagagguuuuucuuaaaua

SEQ ID NO: 1694200 - RNA, 22 nt, Human
aaaagagguuuuucuuaaauaa

SEQ ID NO: 1694201 - RNA, 14 nt, Human
aaaccaguauugua

SEQ ID NO: 1694202 - RNA, 16 nt, Human
aaaccaguauuguaca

SEQ ID NO: 1694203 - RNA, 17 nt, Human
aaaccaguauuguacaa

SEQ ID NO: 1694204 - RNA, 18 nt, Human
aaaccaguauuguacaaa

SEQ ID NO: 1694205 - RNA, 22 nt, Human
aaaccaguauuguacaaaguau

SEQ ID NO: 1694206 - RNA, 17 nt, Human
aaagccauguuuauuac

SEQ ID NO: 1694207 - RNA, 18 nt, Human
aaagccauguuuauuaca

SEQ ID NO: 1694208 - RNA, 23 nt, Human
aaagccauguuuauuacaguaua

SEQ ID NO: 1694209 - RNA, 14 nt, Human
aaagccauguuuau

SEQ ID NO: 1694210 - RNA, 16 nt, Human
aaagccauguuuauua

SEQ ID NO: 1694211 - RNA, 15 nt, Human
aaagaucauguaaaa

SEQ ID NO: 1694212 - RNA, 21 nt, Human
aaauggacuguggugacuuug

SEQ ID NO: 1694213 - RNA, 20 nt, Human
aaauggacuguggugacuuu

SEQ ID NO: 1694214 - RNA, 23 nt, Human
aaauggacuguggugacuuugga

SEQ ID NO: 1694215 - RNA, 23 nt, Human
aaggacuuguuagaucuaguuca

SEQ ID NO: 1694216 - RNA, 15 nt, Human
aaggacuuguuagau

SEQ ID NO: 1694217 - RNA, 21 nt, Human
aaggacuuguuagaucuaguu

SEQ ID NO: 1694218 - RNA, 23 nt, Human
aaggacuucuuuaauuuuggaau

SEQ ID NO: 1694219 - RNA, 17 nt, Human
aaguuuaauauuaaagc

SEQ ID NO: 1694220 - RNA, 18 nt, Human
aaguuuaauauuaaagcc

SEQ ID NO: 1694221 - RNA, 15 nt, Human
aaguuuaauauuaaa

SEQ ID NO: 1694222 - RNA, 23 nt, Human
aaguugaauuuauuggcuuuucu

SEQ ID NO: 1694223 - RNA, 24 nt, Human
aaguugaauuuauuggcuuuucug

SEQ ID NO: 1694224 - RNA, 21 nt, Human
aaguuguuugagaaauuaagu

SEQ ID NO: 1694225 - RNA, 22 nt, Human
aaguuguuugagaaauuaagua

SEQ ID NO: 1694226 - RNA, 14 nt, Human
aaguugaauuuauu

SEQ ID NO: 1694227 - RNA, 15 nt, Human
aaguugaauuuauug

SEQ ID NO: 1694228 - RNA, 17 nt, Human
aaguugaauuuauuggc

SEQ ID NO: 1694229 - RNA, 20 nt, Human
aauaaagaucauguaaaagu

SEQ ID NO: 1694230 - RNA, 14 nt, Human
aauaaagaucaugu

SEQ ID NO: 1694231 - RNA, 19 nt, Human
aauaaagaucauguaaaag

SEQ ID NO: 1694232 - RNA, 22 nt, Human
aauauuaaagccauguuuauua

SEQ ID NO: 1694233 - RNA, 16 nt, Human
acauguuaaaccaugg

SEQ ID NO: 1694234 - RNA, 21 nt, Human
acauguuaaaccaugggauaa

SEQ ID NO: 1694235 - RNA, 23 nt, Human
acauguuaaaccaugggauaaau

SEQ ID NO: 1694236 - RNA, 14 nt, Human
acauguuaaaccau

SEQ ID NO: 1694237 - RNA, 17 nt, Human
aauuguaauuauaucug

SEQ ID NO: 1694238 - RNA, 15 nt, Human
aauuguaauuauauc

SEQ ID NO: 1694239 - RNA, 16 nt, Human
aauuguaauuauaucu

SEQ ID NO: 1694240 - RNA, 14 nt, Human
aauuguaauuauau

SEQ ID NO: 1694241 - RNA, 13 nt, Human
aauucuguauaga

SEQ ID NO: 1694242 - RNA, 14 nt, Human
aauucuguauagau

SEQ ID NO: 1694243 - RNA, 20 nt, Human
aauucuguauagauuagaga

SEQ ID NO: 1694244 - RNA, 12 nt, Human
aauucuguauag

SEQ ID NO: 1694245 - RNA, 15 nt, Human
aauuggggauucuua

SEQ ID NO: 1694246 - RNA, 20 nt, Human
aauuauaucugaggaauucu

SEQ ID NO: 1694247 - RNA, 22 nt, Human
aauuauaucugaggaauucugu

SEQ ID NO: 1694248 - RNA, 23 nt, Human
aauuauaucugaggaauucugua

SEQ ID NO: 1694249 - RNA, 19 nt, Human
aauuauaugcuauuucuau

SEQ ID NO: 1694250 - RNA, 20 nt, Human
aauuauaugcuauuucuaua

SEQ ID NO: 1694251 - RNA, 21 nt, Human
aauuauaugcuauuucuauau

SEQ ID NO: 1694252 - RNA, 19 nt, Human
acuucuuuaauuuuggaau

SEQ ID NO: 1694253 - RNA, 20 nt, Human
acuucuuuaauuuuggaauu

SEQ ID NO: 1694254 - RNA, 18 nt, Human
acuucuuuaauuuuggaa

SEQ ID NO: 1694255 - RNA, 18 nt, Human
acuggugacugauucuuc

SEQ ID NO: 1694256 - RNA, 19 nt, Human
acuggugacugauucuuca

SEQ ID NO: 1694257 - RNA, 16 nt, Human
acuggugacugauucu

SEQ ID NO: 1694258 - RNA, 20 nt, Human
acuggugacugauucuucag

SEQ ID NO: 1694259 - RNA, 22 nt, Human
acugauuugacauagucuggcu

SEQ ID NO: 1694260 - RNA, 14 nt, Human
aggaagguucuggu

SEQ ID NO: 1694261 - RNA, 16 nt, Human
aggaagguucuggugu

SEQ ID NO: 1694262 - RNA, 21 nt, Human
aggaagguucuggugugaacu

SEQ ID NO: 1694263 - RNA, 13 nt, Human
agaucugccuaag

SEQ ID NO: 1694264 - RNA, 18 nt, Human
agaucugccuaaggacuu

SEQ ID NO: 1694265 - RNA, 16 nt, Human
agacgaugucuucaua

SEQ ID NO: 1694266 - RNA, 12 nt, Human
auacuguuugag

SEQ ID NO: 1694267 - RNA, 16 nt, Human
auacuguuugagguuu

SEQ ID NO: 1694268 - RNA, 20 nt, Human
auacuguuugagguuuuuaa

SEQ ID NO: 1694269 - RNA, 19 nt, Human
auaaagaucauguaaaagu

SEQ ID NO: 1694270 - RNA, 14 nt, Human
auacaauuuuguuu

SEQ ID NO: 1694271 - RNA, 16 nt, Human
auacaauuuuguuucu

SEQ ID NO: 1694272 - RNA, 17 nt, Human
auacaauuuuguuucug

SEQ ID NO: 1694273 - RNA, 18 nt, Human
auacaauuuuguuucugu

SEQ ID NO: 1694274 - RNA, 16 nt, Human
auaaaaaauuaugaca

SEQ ID NO: 1694275 - RNA, 19 nt, Human
agucuggcuguacccagga

SEQ ID NO: 1694276 - RNA, 21 nt, Human
agucuggcuguacccaggaau

SEQ ID NO: 1694277 - RNA, 18 nt, Human
augaaacuuguguaaaua

SEQ ID NO: 1694278 - RNA, 15 nt, Human
auggcuuuguauaga

SEQ ID NO: 1694279 - RNA, 16 nt, Human
auggcuuuguauagaa

SEQ ID NO: 1694280 - RNA, 18 nt, Human
auggcuuuguauagaacc

SEQ ID NO: 1694281 - RNA, 18 nt, Human
auccagcagauuauucac

SEQ ID NO: 1694282 - RNA, 18 nt, Human
caaaguugccuaaaucca

SEQ ID NO: 1694283 - RNA, 15 nt, Human
caaaguugccuaaau

SEQ ID NO: 1694284 - RNA, 17 nt, Human
caaaguugccuaaaucc

SEQ ID NO: 1694285 - RNA, 14 nt, Human
caaaguugccuaaa

SEQ ID NO: 1694286 - RNA, 17 nt, Human
auuuuaacaacagcugg

SEQ ID NO: 1694287 - RNA, 12 nt, Human
cacacacuuuug

SEQ ID NO: 1694288 - RNA, 14 nt, Human
caauuuuguuucug

SEQ ID NO: 1694289 - RNA, 16 nt, Human
caauuuuguuucugua

SEQ ID NO: 1694290 - RNA, 17 nt, Human
caauuuuguuucuguac

SEQ ID NO: 1694291 - RNA, 13 nt, Human
caauuuuguuucu

SEQ ID NO: 1694292 - RNA, 20 nt, Human
cacaguuuugguugcuuuaa

SEQ ID NO: 1694293 - RNA, 23 nt, Human
cacaguuuugguugcuuuaauau

SEQ ID NO: 1694294 - RNA, 19 nt, Human
cacaguuuugguugcuuua

SEQ ID NO: 1694295 - RNA, 14 nt, Human
uuuuucuguuauau

SEQ ID NO: 1694296 - RNA, 23 nt, Human
uuuuucuuaaauaauaaagauca

SEQ ID NO: 1694297 - RNA, 20 nt, Human
uuugagguuuuuaagccuua

SEQ ID NO: 1694298 - RNA, 22 nt, Human
uuugcauaggugaucucauuua

SEQ ID NO: 1694299 - RNA, 16 nt, Human
uuuggaaaucuuuaaa

SEQ ID NO: 1694300 - RNA, 22 nt, Human
uuugguuaagucuguuuuauga

SEQ ID NO: 1694301 - RNA, 18 nt, Human
uuugguuaagucuguuuu

SEQ ID NO: 1694302 - RNA, 19 nt, Human
uuugguuaagucuguuuua

SEQ ID NO: 1694303 - RNA, 20 nt, Human
uuugguuaagucuguuuuau

SEQ ID NO: 1694304 - RNA, 11 nt, Human
uuuguauagaa

SEQ ID NO: 1694305 - RNA, 12 nt, Human
uuuguguuagag

SEQ ID NO: 1694306 - RNA, 12 nt, Human
uuuguuguuugu

SEQ ID NO: 1694307 - RNA, 14 nt, Human
uuuguuguuuguuu

SEQ ID NO: 1694308 - RNA, 19 nt, Human
uuuguuguuuguuuagucu

SEQ ID NO: 1694309 - RNA, 15 nt, Human
uuuuaugauccagca

SEQ ID NO: 1694310 - RNA, 13 nt, Human
uuuuaugauccag

SEQ ID NO: 1694311 - RNA, 14 nt, Human
uuucucuuucguua

SEQ ID NO: 1694312 - RNA, 18 nt, Human
uuuccuagcacacacuuu

SEQ ID NO: 1694313 - RNA, 21 nt, Human
uuuccuagcacacacuuuugg

SEQ ID NO: 1694314 - RNA, 18 nt, Human
uuucagauaacuguuauu

SEQ ID NO: 1694315 - RNA, 13 nt, Human
uuuaugauccagc

SEQ ID NO: 1694316 - RNA, 17 nt, Human
uuuauuggcuuuucuga

SEQ ID NO: 1694317 - RNA, 21 nt, Human
uuuauuggcuuuucugaucca

SEQ ID NO: 1694318 - RNA, 17 nt, Human
uucuaugcugaguuugu

SEQ ID NO: 1694319 - RNA, 11 nt, Human
uucuauauuuu

SEQ ID NO: 1694320 - RNA, 14 nt, Human
uucuauauuuucau

SEQ ID NO: 1694321 - RNA, 15 nt, Human
uucuauauuuucauu

SEQ ID NO: 1694322 - RNA, 16 nt, Human
uucuauauuuucauuc

SEQ ID NO: 1694323 - RNA, 18 nt, Human
uucuauauuuucauucuc

SEQ ID NO: 1694324 - RNA, 21 nt, Human
uucuauauuuucauucuccua

SEQ ID NO: 1694325 - RNA, 17 nt, Human
uuccuagcacacacuuu

SEQ ID NO: 1694326 - RNA, 19 nt, Human
uuccuagcacacacuuuug

SEQ ID NO: 1694327 - RNA, 16 nt, Human
uuacuaaaauggacug

SEQ ID NO: 1694328 - RNA, 17 nt, Human
uuacuaaaauggacugu

SEQ ID NO: 1694329 - RNA, 18 nt, Human
uuacuaaaauggacugug

SEQ ID NO: 1694330 - RNA, 15 nt, Human
uuacuaaaauggacu

SEQ ID NO: 1694331 - RNA, 11 nt, Human
uucacugauuu

SEQ ID NO: 1694332 - RNA, 12 nt, Human
uuggaaaucuuu

SEQ ID NO: 1694333 - RNA, 15 nt, Human
uuggaaaucuuuaaa

SEQ ID NO: 1694334 - RNA, 21 nt, Human
uuggaccaaaaaccaguauug

SEQ ID NO: 1694335 - RNA, 19 nt, Human
uuggcuuuucugauccagu

SEQ ID NO: 1694336 - RNA, 22 nt, Human
uuggcuuuucugauccaguuuu

SEQ ID NO: 1694337 - RNA, 15 nt, Human
uuggcuuuucugauc

SEQ ID NO: 1694338 - RNA, 12 nt, Human
uucuuguauuaa

SEQ ID NO: 1694339 - RNA, 13 nt, Human
uucuuguauuaag

SEQ ID NO: 1694340 - RNA, 18 nt, Human
uucuuguauuaagaauga

SEQ ID NO: 1694341 - RNA, 22 nt, Human
uugaaacggaugauuucuaugc

SEQ ID NO: 1694342 - RNA, 20 nt, Human
uugaaacggaugauuucuau

SEQ ID NO: 1694343 - RNA, 21 nt, Human
uugaaacggaugauuucuaug

SEQ ID NO: 1694344 - RNA, 14 nt, Human
ugugcgcuaaacuu

SEQ ID NO: 1694345 - RNA, 19 nt, Human
ugugcgcuaaacuuuucug

SEQ ID NO: 1694346 - RNA, 22 nt, Human
ugugcgcuaaacuuuucugaua

SEQ ID NO: 1694347 - RNA, 23 nt, Human
ugugcgcuaaacuuuucugauag

SEQ ID NO: 1694348 - RNA, 13 nt, Human
uguacucaauuuu

SEQ ID NO: 1694349 - RNA, 14 nt, Human
uguauuuguuugca

SEQ ID NO: 1694350 - RNA, 16 nt, Human
uguauagaaccucuuu

SEQ ID NO: 1694351 - RNA, 17 nt, Human
ugugugaagugagugag

SEQ ID NO: 1694352 - RNA, 18 nt, Human
uguuaaaccaugggauaa

SEQ ID NO: 1694353 - RNA, 20 nt, Human
uguuaaaccaugggauaaau

SEQ ID NO: 1694354 - RNA, 21 nt, Human
uguuaaaccaugggauaaaug

SEQ ID NO: 1694355 - RNA, 23 nt, Human
uguuaaaccaugggauaaaugcc

SEQ ID NO: 1694356 - RNA, 16 nt, Human
uguuagaucuaguuca

SEQ ID NO: 1694357 - RNA, 20 nt, Human
uguugaaacggaugauuucu

SEQ ID NO: 1694358 - RNA, 21 nt, Human
uguugaaacggaugauuucua

SEQ ID NO: 1694359 - RNA, 22 nt, Human
uguugaaacggaugauuucuau

SEQ ID NO: 1694360 - RNA, 23 nt, Human
uguugaaacggaugauuucuaug

SEQ ID NO: 1694361 - RNA, 14 nt, Human
uguuguuuguuuag

SEQ ID NO: 1694362 - RNA, 18 nt, Human
uuaauaucaucaguauug

SEQ ID NO: 1694363 - RNA, 13 nt, Human
uuaaggauuuuau

SEQ ID NO: 1694364 - RNA, 15 nt, Human
uuaaggauuuuaugc

SEQ ID NO: 1694365 - RNA, 18 nt, Human
uuaaggauuuuaugcuuu

SEQ ID NO: 1694366 - RNA, 20 nt, Human
uuaaggauuuuaugcuuuaa

SEQ ID NO: 1694367 - RNA, 20 nt, Human
uuaauaauuauaugcuauuu

SEQ ID NO: 1694368 - RNA, 23 nt, Human
uuaauaauuauaugcuauuucua

SEQ ID NO: 1694369 - RNA, 18 nt, Human
uuaauaauuauaugcuau

SEQ ID NO: 1694370 - RNA, 12 nt, Human
uuaacauguuaa

SEQ ID NO: 1694371 - RNA, 18 nt, Human
uuaacauguuaaaccaug

SEQ ID NO: 1694372 - RNA, 19 nt, Human
uuaacauguuaaaccaugg

SEQ ID NO: 1694373 - RNA, 12 nt, Human
uguuuguuuagu

SEQ ID NO: 1694374 - RNA, 21 nt, Human
uguuuguuuagucuugucuca

SEQ ID NO: 1694375 - RNA, 14 nt, Human
uggcuuuguauaga

SEQ ID NO: 1694376 - RNA, 22 nt, Human
uggcuuuguauagaaccucuuu

SEQ ID NO: 1694377 - RNA, 15 nt, Human
uggcuguacccagga

SEQ ID NO: 1694378 - RNA, 20 nt, Human
uggccuuucauauuuuagcu

SEQ ID NO: 1694379 - RNA, 14 nt, Human
ugcuuguuuccuag

SEQ ID NO: 1694380 - RNA, 12 nt, Human
ugcuuuaaacau

SEQ ID NO: 1694381 - RNA, 16 nt, Human
ugcuuucagauacugg

SEQ ID NO: 1694382 - RNA, 17 nt, Human
ugcuuucagauacugga

SEQ ID NO: 1694383 - RNA, 20 nt, Human
ugcuuucagauacuggauug

SEQ ID NO: 1694384 - RNA, 21 nt, Human
ugcuuucagauacuggauugu

SEQ ID NO: 1694385 - RNA, 12 nt, Human
ugcuuucagaua

SEQ ID NO: 1694386 - RNA, 15 nt, Human
uggcauaacauaaau

SEQ ID NO: 1694387 - RNA, 17 nt, Human
uggcauaacauaaaucu

SEQ ID NO: 1694388 - RNA, 19 nt, Human
ugaagucucugaagugaaa

SEQ ID NO: 1694389 - RNA, 22 nt, Human
ugcacggugaauggcuuuguau

SEQ ID NO: 1694390 - RNA, 23 nt, Human
ugcacggugaauggcuuuguaua

SEQ ID NO: 1694391 - RNA, 23 nt, Human
ugccuaaggacuucuuuaauuuu

SEQ ID NO: 1694392 - RNA, 15 nt, Human
ugcugaguuugugcu

SEQ ID NO: 1694393 - RNA, 17 nt, Human
ugcugaguuugugcugg

SEQ ID NO: 1694394 - RNA, 19 nt, Human
ucuugucucagauuuuauu

SEQ ID NO: 1694395 - RNA, 18 nt, Human
ucuuuaaaaaaaaaauug

SEQ ID NO: 1694396 - RNA, 19 nt, Human
ucuuuaaaaaaaaaauugg

SEQ ID NO: 1694397 - RNA, 15 nt, Human
ucuugccuuuuucau

SEQ ID NO: 1694398 - RNA, 22 nt, Human
ucuuguauuaagaaugaaauac

SEQ ID NO: 1694399 - RNA, 21 nt, Human
ucuucucagaaggcaaaugac

SEQ ID NO: 1694400 - RNA, 23 nt, Human
ucuucucagaaggcaaaugacuu

SEQ ID NO: 1694401 - RNA, 17 nt, Human
ucuguuuuaugacuuca

SEQ ID NO: 1694402 - RNA, 13 nt, Human
ucuguuuuaugac

SEQ ID NO: 1694403 - RNA, 15 nt, Human
ucuguuuuaugacuu

SEQ ID NO: 1694404 - RNA, 16 nt, Human
ucuguuuuaugacuuc

SEQ ID NO: 1694405 - RNA, 15 nt, Human
ucuguuauauaaaug

SEQ ID NO: 1694406 - RNA, 18 nt, Human
ucuguuauauaaaugguu

SEQ ID NO: 1694407 - RNA, 18 nt, Human
ugaacacuccaauuaagg

SEQ ID NO: 1694408 - RNA, 19 nt, Human
ugaacacuccaauuaagga

SEQ ID NO: 1694409 - RNA, 22 nt, Human
ugaacacuccaauuaaggauuu

SEQ ID NO: 1694410 - RNA, 23 nt, Human
ugaacacuccaauuaaggauuuu

SEQ ID NO: 1694411 - RNA, 16 nt, Human
ucugacaucucugcaa

SEQ ID NO: 1694412 - RNA, 20 nt, Human
ucugaggaauucuguauaga

SEQ ID NO: 1694413 - RNA, 19 nt, Human
ucucugcaaucuucucaga

SEQ ID NO: 1694414 - RNA, 19 nt, Human
ucucagaaggcaaaugacu

SEQ ID NO: 1694415 - RNA, 20 nt, Human
ucucagaaggcaaaugacuu

SEQ ID NO: 1694416 - RNA, 21 nt, Human
ucucagaaggcaaaugacuuu

SEQ ID NO: 1694417 - RNA, 22 nt, Human
ucucagaaggcaaaugacuuug

SEQ ID NO: 1694418 - RNA, 17 nt, Human
ucucaaccaccuuucag

SEQ ID NO: 1694419 - RNA, 12 nt, Human
uauuuuaugauc

SEQ ID NO: 1694420 - RNA, 17 nt, Human
uaucugaagucagaucu

SEQ ID NO: 1694421 - RNA, 18 nt, Human
uaucugaagucagaucug

SEQ ID NO: 1694422 - RNA, 15 nt, Human
uaucugaggaauucu

SEQ ID NO: 1694423 - RNA, 18 nt, Human
uaucugacaucucugcaa

SEQ ID NO: 1694424 - RNA, 16 nt, Human
uaucugaggaauucug

SEQ ID NO: 1694425 - RNA, 18 nt, Human
ucacucuccauuuaauaa

SEQ ID NO: 1694426 - RNA, 15 nt, Human
ucagauaacuguuau

SEQ ID NO: 1694427 - RNA, 13 nt, Human
ucagauaacuguu

SEQ ID NO: 1694428 - RNA, 13 nt, Human
ucacuuuuuucca

SEQ ID NO: 1694429 - RNA, 15 nt, Human
ucacuuuuuuccaca

SEQ ID NO: 1694430 - RNA, 16 nt, Human
ucacuuuuuuccacau

SEQ ID NO: 1694431 - RNA, 20 nt, Human
uccagcagauuauucacuga

SEQ ID NO: 1694432 - RNA, 22 nt, Human
uccagcagauuauucacugauu

SEQ ID NO: 1694433 - RNA, 16 nt, Human
ucauuauuuuauuaug

SEQ ID NO: 1694434 - RNA, 18 nt, Human
ucauuauuuuauuaugaa

SEQ ID NO: 1694435 - RNA, 19 nt, Human
ucauuauuuuauuaugaaa

SEQ ID NO: 1694436 - RNA, 22 nt, Human
ucauuauuuuauuaugaaacuu

SEQ ID NO: 1694437 - RNA, 14 nt, Human
ucauuauuuuauua

SEQ ID NO: 1694438 - RNA, 15 nt, Human
ucauuauuuuauuau

SEQ ID NO: 1694439 - RNA, 13 nt, Human
ucauuauuuuauu

SEQ ID NO: 1694440 - RNA, 12 nt, Human
guuuguuuaguc

SEQ ID NO: 1694441 - RNA, 16 nt, Human
guuugagguuuuuaag

SEQ ID NO: 1694442 - RNA, 19 nt, Human
guuugagguuuuuaagccu

SEQ ID NO: 1694443 - RNA, 23 nt, Human
guuugugcugguguaugugugaa

SEQ ID NO: 1694444 - RNA, 14 nt, Human
guuuagucuugucu

SEQ ID NO: 1694445 - RNA, 18 nt, Human
guuuagucuugucucaga

SEQ ID NO: 1694446 - RNA, 12 nt, Human
uaaacuuucaca

SEQ ID NO: 1694447 - RNA, 13 nt, Human
uaaacuuucacac

SEQ ID NO: 1694448 - RNA, 13 nt, Human
uaaacuuuucuga

SEQ ID NO: 1694449 - RNA, 14 nt, Human
uaaacuuuucugau

SEQ ID NO: 1694450 - RNA, 15 nt, Human
uaaacuuuucugaua

SEQ ID NO: 1694451 - RNA, 13 nt, Human
uaaaguugaauuu

SEQ ID NO: 1694452 - RNA, 14 nt, Human
uaaaguugaauuua

SEQ ID NO: 1694453 - RNA, 15 nt, Human
uaaaguugaauuuau

SEQ ID NO: 1694454 - RNA, 17 nt, Human
uaaaguugaauuuauug

SEQ ID NO: 1694455 - RNA, 19 nt, Human
uaaaguugaauuuauuggc

SEQ ID NO: 1694456 - RNA, 21 nt, Human
uaaaguugaauuuauuggcuu

SEQ ID NO: 1694457 - RNA, 23 nt, Human
uaaaguugaauuuauuggcuuuu

SEQ ID NO: 1694458 - RNA, 15 nt, Human
uaaauccauuuggaa

SEQ ID NO: 1694459 - RNA, 16 nt, Human
uaaauccauuuggaaa

SEQ ID NO: 1694460 - RNA, 14 nt, Human
uaaauccauuugga

SEQ ID NO: 1694461 - RNA, 18 nt, Human
uaaauccauuuggaaauc

SEQ ID NO: 1694462 - RNA, 19 nt, Human
uaaauccauuuggaaaucu

SEQ ID NO: 1694463 - RNA, 22 nt, Human
uaaauccauuuggaaaucuuua

SEQ ID NO: 1694464 - RNA, 23 nt, Human
uaaauccauuuggaaaucuuuaa

SEQ ID NO: 1694465 - RNA, 16 nt, Human
uaaaucccauuauuca

SEQ ID NO: 1694466 - RNA, 17 nt, Human
uaaaucccauuauucaa

SEQ ID NO: 1694467 - RNA, 19 nt, Human
uaaaucccauuauucaaag

SEQ ID NO: 1694468 - RNA, 18 nt, Human
uaacauguuaaaccaugg

SEQ ID NO: 1694469 - RNA, 17 nt, Human
uaacauguuaaaccaug

SEQ ID NO: 1694470 - RNA, 21 nt, Human
uaagcauauauuuuuauauuu

SEQ ID NO: 1694471 - RNA, 22 nt, Human
uaagcauauauuuuuauauuua

SEQ ID NO: 1694472 - RNA, 19 nt, Human
uaagcauauauuuuuauau

SEQ ID NO: 1694473 - RNA, 23 nt, Human
uaagcauauauuuuuauauuuac

SEQ ID NO: 1694474 - RNA, 12 nt, Human
uaauauuaaagc

SEQ ID NO: 1694475 - RNA, 13 nt, Human
uaauauuaaagcc

SEQ ID NO: 1694476 - RNA, 14 nt, Human
uaauauuaaagcca

SEQ ID NO: 1694477 - RNA, 23 nt, Human
uaauccucucaaccaccuuucag

SEQ ID NO: 1694478 - RNA, 15 nt, Human
uaauaauuauaugcu

SEQ ID NO: 1694479 - RNA, 16 nt, Human
uaauaauuauaugcua

SEQ ID NO: 1694480 - RNA, 19 nt, Human
uaauaauuauaugcuauuu

SEQ ID NO: 1694481 - RNA, 20 nt, Human
uaauaauuauaugcuauuuc

SEQ ID NO: 1694482 - RNA, 22 nt, Human
uaauaauuauaugcuauuucua

SEQ ID NO: 1694483 - RNA, 23 nt, Human
uaauaauuauaugcuauuucuau

SEQ ID NO: 1694484 - RNA, 16 nt, Human
uaauaaagaucaugua

SEQ ID NO: 1694485 - RNA, 17 nt, Human
uaauaaagaucauguaa

SEQ ID NO: 1694486 - RNA, 20 nt, Human
uaauaaggaaaaguuuaaua

SEQ ID NO: 1694487 - RNA, 18 nt, Human
uaauaaggaaaaguuuaa

SEQ ID NO: 1694488 - RNA, 12 nt, Human
uaauuaacaugu

SEQ ID NO: 1694489 - RNA, 14 nt, Human
uaauuaacauguua

SEQ ID NO: 1694490 - RNA, 15 nt, Human
uaauuaacauguuaa

SEQ ID NO: 1694491 - RNA, 17 nt, Human
uaauuaacauguuaaac

SEQ ID NO: 1694492 - RNA, 18 nt, Human
uaauuaacauguuaaacc

SEQ ID NO: 1694493 - RNA, 19 nt, Human
uaauuaacauguuaaacca

SEQ ID NO: 1694494 - RNA, 20 nt, Human
uaauuaacauguuaaaccau

SEQ ID NO: 1694495 - RNA, 19 nt, Human
uacaauuuuguuucuguac

SEQ ID NO: 1694496 - RNA, 21 nt, Human
uacaauuuuguuucuguacuu

SEQ ID NO: 1694497 - RNA, 18 nt, Human
uacaauuuuguuucugua

SEQ ID NO: 1694498 - RNA, 12 nt, Human
uaauuuuggaau

SEQ ID NO: 1694499 - RNA, 13 nt, Human
uaauuuuggaauu

SEQ ID NO: 1694500 - RNA, 13 nt, Human
uagacuggugacu

SEQ ID NO: 1694501 - RNA, 14 nt, Human
uagacuggugacug

SEQ ID NO: 1694502 - RNA, 17 nt, Human
uagacuggugacugauu

SEQ ID NO: 1694503 - RNA, 18 nt, Human
uagacuggugacugauuc

SEQ ID NO: 1694504 - RNA, 15 nt, Human
uagagaguguugaaa

SEQ ID NO: 1694505 - RNA, 14 nt, Human
uagagaguguugaa

SEQ ID NO: 1694506 - RNA, 16 nt, Human
uauaugcuauuucuau

SEQ ID NO: 1694507 - RNA, 18 nt, Human
uauaugcuauuucuauau

SEQ ID NO: 1694508 - RNA, 18 nt, Human
uauauuuuuauauuuacu

SEQ ID NO: 1694509 - RNA, 22 nt, Human
uaucaucaguauugaagcauuu

SEQ ID NO: 1694510 - RNA, 19 nt, Human
uauauuuuuauauuuacua

SEQ ID NO: 1694511 - RNA, 18 nt, Human
uauaaaucgcuuuugaua

SEQ ID NO: 1694512 - RNA, 19 nt, Human
uauaaaucgcuuuugauaa

SEQ ID NO: 1694513 - RNA, 20 nt, Human
uauaaaucgcuuuugauaau

SEQ ID NO: 1694514 - RNA, 22 nt, Human
ggaagccaaaccucugugagca

SEQ ID NO: 1694515 - RNA, 19 nt, Human
ggaaaaguuuaauauuaaa

SEQ ID NO: 1694516 - RNA, 21 nt, Human
ggaacgcguugaaauuguaau

SEQ ID NO: 1694517 - RNA, 17 nt, Human
ggaacgcguugaaauug

SEQ ID NO: 1694518 - RNA, 16 nt, Human
ggaacgcguugaaauu

SEQ ID NO: 1694519 - RNA, 20 nt, Human
gcuuuaauaucaucaguauu

SEQ ID NO: 1694520 - RNA, 22 nt, Human
gcuuuaauaucaucaguauuga

SEQ ID NO: 1694521 - RNA, 23 nt, Human
gcuuuaauaucaucaguauugaa

SEQ ID NO: 1694522 - RNA, 24 nt, Human
gcuggugcccugcuuucagauacu

SEQ ID NO: 1694523 - RNA, 22 nt, Human
gcuggugcccugcuuucagaua

SEQ ID NO: 1694524 - RNA, 22 nt, Human
ggcugaugccaaguuguuugag

SEQ ID NO: 1694525 - RNA, 21 nt, Human
ggcugaugccaaguuguuuga

SEQ ID NO: 1694526 - RNA, 17 nt, Human
ggcuuuucugauccagu

SEQ ID NO: 1694527 - RNA, 12 nt, Human
ggcuuuucugau

SEQ ID NO: 1694528 - RNA, 13 nt, Human
ggcuuuucugauc

SEQ ID NO: 1694529 - RNA, 16 nt, Human
ggcuuuucugauccag

SEQ ID NO: 1694530 - RNA, 11 nt, Human
ggguuccugca

SEQ ID NO: 1694531 - RNA, 11 nt, Human
ggggauucuua

SEQ ID NO: 1694532 - RNA, 15 nt, Human
ggggauucuuaaagu

SEQ ID NO: 1694533 - RNA, 20 nt, Human
gguuaucugaagucagaucu

SEQ ID NO: 1694534 - RNA, 13 nt, Human
gguuaagucuguu

SEQ ID NO: 1694535 - RNA, 16 nt, Human
gguuaagucuguuuua

SEQ ID NO: 1694536 - RNA, 23 nt, Human
gguuaagucuguuuuaugacuuc

SEQ ID NO: 1694537 - RNA, 22 nt, Human
gguucuuguauuaagaaugaaa

SEQ ID NO: 1694538 - RNA, 14 nt, Human
gguucuuguauuaa

SEQ ID NO: 1694539 - RNA, 16 nt, Human
gguguaugugugaagu

SEQ ID NO: 1694540 - RNA, 14 nt, Human
ggugacuuuggaua

SEQ ID NO: 1694541 - RNA, 18 nt, Human
ggugacuuuggauaauaa

SEQ ID NO: 1694542 - RNA, 19 nt, Human
ggugacuuuggauaauaag

SEQ ID NO: 1694543 - RNA, 20 nt, Human
ggugacuuuggauaauaagg

SEQ ID NO: 1694544 - RNA, 21 nt, Human
ggugacuuuggauaauaagga

SEQ ID NO: 1694545 - RNA, 13 nt, Human
gcuagacugguga

SEQ ID NO: 1694546 - RNA, 15 nt, Human
gcuagacuggugacu

SEQ ID NO: 1694547 - RNA, 16 nt, Human
gcuagacuggugacug

SEQ ID NO: 1694548 - RNA, 19 nt, Human
gcuagacuggugacugauu

SEQ ID NO: 1694549 - RNA, 20 nt, Human
gcuagacuggugacugauuc

SEQ ID NO: 1694550 - RNA, 22 nt, Human
gcuagacuggugacugauucuu

SEQ ID NO: 1694551 - RNA, 12 nt, Human
gccuuuuucauu

SEQ ID NO: 1694552 - RNA, 16 nt, Human
gccuuuuucauuauuu

SEQ ID NO: 1694553 - RNA, 20 nt, Human
gccuuuuucauuauuuuauu

SEQ ID NO: 1694554 - RNA, 22 nt, Human
gccuuuuucauuauuuuauuau

SEQ ID NO: 1694555 - RNA, 14 nt, Human
gccuaaggacuucu

SEQ ID NO: 1694556 - RNA, 15 nt, Human
gccuaaggacuucuu

SEQ ID NO: 1694557 - RNA, 18 nt, Human
gccuaaggacuucuuuaa

SEQ ID NO: 1694558 - RNA, 12 nt, Human
gccuaaggacuu

SEQ ID NO: 1694559 - RNA, 13 nt, Human
gccuaaggacuuc

SEQ ID NO: 1694560 - RNA, 11 nt, Human
gccuaaaucca

SEQ ID NO: 1694561 - RNA, 13 nt, Human
gcauuuuauaaau

SEQ ID NO: 1694562 - RNA, 12 nt, Human
gcaucacaguuu

SEQ ID NO: 1694563 - RNA, 14 nt, Human
gcauauauuuuuau

SEQ ID NO: 1694564 - RNA, 15 nt, Human
gcauauauuuuuaua

SEQ ID NO: 1694565 - RNA, 11 nt, Human
gcauauauuuu

SEQ ID NO: 1694566 - RNA, 16 nt, Human
gcauauauuuuuauau

SEQ ID NO: 1694567 - RNA, 20 nt, Human
gcauauauuuuuauauuuac

SEQ ID NO: 1694568 - RNA, 21 nt, Human
gcauaggugaucucauuuaau

SEQ ID NO: 1694569 - RNA, 13 nt, Human
gcaaaugacuuug

SEQ ID NO: 1694570 - RNA, 12 nt, Human
gcaaaugacuuu

SEQ ID NO: 1694571 - RNA, 17 nt, Human
gcaaugaagucucugaa

SEQ ID NO: 1694572 - RNA, 19 nt, Human
gcaaugaagucucugaagu

SEQ ID NO: 1694573 - RNA, 17 nt, Human
gaucuaguucacucucc

SEQ ID NO: 1694574 - RNA, 21 nt, Human
gauaaucaacugggcugaaca

SEQ ID NO: 1694575 - RNA, 17 nt, Human
gauaaucaacugggcug

SEQ ID NO: 1694576 - RNA, 20 nt, Human
gauaauaaggaaaaguuuaa

SEQ ID NO: 1694577 - RNA, 21 nt, Human
gauaauaaggaaaaguuuaau

SEQ ID NO: 1694578 - RNA, 22 nt, Human
gauaauaaggaaaaguuuaaua

SEQ ID NO: 1694579 - RNA, 12 nt, Human
gaguguugaaac

SEQ ID NO: 1694580 - RNA, 15 nt, Human
gacuucauuaauaau

SEQ ID NO: 1694581 - RNA, 20 nt, Human
gaaugguccgugcuaaggac

SEQ ID NO: 1694582 - RNA, 22 nt, Human
gaaugguccgugcuaaggacuu

SEQ ID NO: 1694583 - RNA, 23 nt, Human
gaaugguccgugcuaaggacuug

SEQ ID NO: 1694584 - RNA, 21 nt, Human
gaauggcuuuguauagaaccu

SEQ ID NO: 1694585 - RNA, 14 nt, Human
gaauuuauuggcuu

SEQ ID NO: 1694586 - RNA, 16 nt, Human
gaauuuauuggcuuuu

SEQ ID NO: 1694587 - RNA, 20 nt, Human
gaauuuauuggcuuuucuga

SEQ ID NO: 1694588 - RNA, 21 nt, Human
gaauuuauuggcuuuucugau

SEQ ID NO: 1694589 - RNA, 22 nt, Human
gaauuuauuggcuuuucugauc

SEQ ID NO: 1694590 - RNA, 11 nt, Human
gaauucuguau

SEQ ID NO: 1694591 - RNA, 16 nt, Human
gaagucucugaaguga

SEQ ID NO: 1694592 - RNA, 21 nt, Human
gaagucucugaagugaaacug

SEQ ID NO: 1694593 - RNA, 15 nt, Human
gaacgcguugaaauu

SEQ ID NO: 1694594 - RNA, 12 nt, Human
gaacuaaacuuu

SEQ ID NO: 1694595 - RNA, 14 nt, Human
gaacuaaacuuuca

SEQ ID NO: 1694596 - RNA, 16 nt, Human
gaacuaaacuuucaca

SEQ ID NO: 1694597 - RNA, 18 nt, Human
gaacuaaacuuucacacc

SEQ ID NO: 1694598 - RNA, 17 nt, Human
gaacuaaacuuucacac

SEQ ID NO: 1694599 - RNA, 17 nt, Human
gaaauuguaauuauauc

SEQ ID NO: 1694600 - RNA, 13 nt, Human
gacugauucuuca

SEQ ID NO: 1694601 - RNA, 16 nt, Human
gacugauucuucagca

SEQ ID NO: 1694602 - RNA, 13 nt, Human
cuuguuagaucua

SEQ ID NO: 1694603 - RNA, 16 nt, Human
cuuguuagaucuaguu

SEQ ID NO: 1694604 - RNA, 16 nt, Human
cuuuggauaauaagga

SEQ ID NO: 1694605 - RNA, 14 nt, Human
cuuuggauaauaag

SEQ ID NO: 1694606 - RNA, 12 nt, Human
cuuuuucauuau

SEQ ID NO: 1694607 - RNA, 13 nt, Human
cuuuuucauuauu

SEQ ID NO: 1694608 - RNA, 14 nt, Human
cuuuuucauuauuu

SEQ ID NO: 1694609 - RNA, 21 nt, Human
cuuuuucauuauuuuauuaug

SEQ ID NO: 1694610 - RNA, 15 nt, Human
cuuuuuuaaauaaau

SEQ ID NO: 1694611 - RNA, 14 nt, Human
cuuuucugauccag

SEQ ID NO: 1694612 - RNA, 15 nt, Human
cuuuucugauccagu

SEQ ID NO: 1694613 - RNA, 11 nt, Human
cuuuucugauc

SEQ ID NO: 1694614 - RNA, 16 nt, Human
cuuuucugauccaguu

SEQ ID NO: 1694615 - RNA, 18 nt, Human
cuuuucugauccaguuuu

SEQ ID NO: 1694616 - RNA, 12 nt, Human
cuguuuuaugac

SEQ ID NO: 1694617 - RNA, 13 nt, Human
cuguuuuaugacu

SEQ ID NO: 1694618 - RNA, 14 nt, Human
cuguuuuaugacuu

SEQ ID NO: 1694619 - RNA, 15 nt, Human
cuguuuuaugacuuc

SEQ ID NO: 1694620 - RNA, 16 nt, Human
cuguuuuaugacuuca

SEQ ID NO: 1694621 - RNA, 14 nt, Human
cugaagucagaucu

SEQ ID NO: 1694622 - RNA, 15 nt, Human
cugaagucagaucug

SEQ ID NO: 1694623 - RNA, 16 nt, Human
cugaagucagaucugc

SEQ ID NO: 1694624 - RNA, 21 nt, Human
cugaagucagaucugccuaag

SEQ ID NO: 1694625 - RNA, 13 nt, Human
cugaagugaaacu

SEQ ID NO: 1694626 - RNA, 17 nt, Human
cugaagugaaacugcuu

SEQ ID NO: 1694627 - RNA, 19 nt, Human
cugaagugaaacugcuugu

SEQ ID NO: 1694628 - RNA, 13 nt, Human
cucuccauuuaau

SEQ ID NO: 1694629 - RNA, 17 nt, Human
cucugcaaucuucucag

SEQ ID NO: 1694630 - RNA, 18 nt, Human
cucugcaaucuucucaga

SEQ ID NO: 1694631 - RNA, 18 nt, Human
cuccuaucaccugucuug

SEQ ID NO: 1694632 - RNA, 19 nt, Human
cuggauuguacuuugugcu

SEQ ID NO: 1694633 - RNA, 20 nt, Human
cuggauuguacuuugugcug

SEQ ID NO: 1694634 - RNA, 18 nt, Human
cugcuuucagauacugga

SEQ ID NO: 1694635 - RNA, 21 nt, Human
cugcuuucagauacuggauug

SEQ ID NO: 1694636 - RNA, 19 nt, Human
cugccuaaggacuucuuua

SEQ ID NO: 1694637 - RNA, 22 nt, Human
cugccuaaggacuucuuuaauu

SEQ ID NO: 1694638 - RNA, 20 nt, Human
cugccuaaggacuucuuuaa

SEQ ID NO: 1694639 - RNA, 21 nt, Human
cugccuaaggacuucuuuaau

SEQ ID NO: 1694640 - RNA, 20 nt, Human
cugauccaguuuuguuugga

SEQ ID NO: 1694641 - RNA, 20 nt, Human
cugauagaggaagccugauu

SEQ ID NO: 1694642 - RNA, 15 nt, Human
cugauucuucagcaa

SEQ ID NO: 1694643 - RNA, 22 nt, Human
cugcaaucuucucagaaggcaa

SEQ ID NO: 1694644 - RNA, 18 nt, Human
cugcaaugaagucucuga

SEQ ID NO: 1694645 - RNA, 21 nt, Human
cugcaaugaagucucugaagu

SEQ ID NO: 1694646 - RNA, 13 nt, Human
ccgugcuaaggac

SEQ ID NO: 1694647 - RNA, 11 nt, Human
ccggaagccaa

SEQ ID NO: 1694648 - RNA, 22 nt, Human
ccggaagccaaaccucugugag

SEQ ID NO: 1694649 - RNA, 21 nt, Human
ccucacccacccuuuuuuaaa

SEQ ID NO: 1694650 - RNA, 12 nt, Human
ccugauuaaaga

SEQ ID NO: 1694651 - RNA, 13 nt, Human
ccugauuaaagaa

SEQ ID NO: 1694652 - RNA, 15 nt, Human
ccugcuuucagauac

SEQ ID NO: 1694653 - RNA, 16 nt, Human
ccugcuuucagauacu

SEQ ID NO: 1694654 - RNA, 21 nt, Human
ccugcuuucagauacuggauu

SEQ ID NO: 1694655 - RNA, 14 nt, Human
ccuggccuuucaua

SEQ ID NO: 1694656 - RNA, 15 nt, Human
ccuggccuuucauau

SEQ ID NO: 1694657 - RNA, 13 nt, Human
cguugaaauugua

SEQ ID NO: 1694658 - RNA, 23 nt, Human
cguucauggaacgcguugaaauu

SEQ ID NO: 1694659 - RNA, 21 nt, Human
cguucauggaacgcguugaaa

SEQ ID NO: 1694660 - RNA, 22 nt, Human
cguucauggaacgcguugaaau

SEQ ID NO: 1694661 - RNA, 13 nt, Human
cgcguugaaauug

SEQ ID NO: 1694662 - RNA, 22 nt, Human
cgcguugaaauuguaauuauau

SEQ ID NO: 1694663 - RNA, 17 nt, Human
cgcguugaaauuguaau

SEQ ID NO: 1694664 - RNA, 21 nt, Human
cgcguugaaauuguaauuaua

SEQ ID NO: 1694665 - RNA, 16 nt, Human
ccuuucucuuucguua

SEQ ID NO: 1694666 - RNA, 13 nt, Human
cggaugauuucua

SEQ ID NO: 1694667 - RNA, 14 nt, Human
cggaugauuucuau

SEQ ID NO: 1694668 - RNA, 19 nt, Human
ccaucaauaaaaaauuaug

SEQ ID NO: 1694669 - RNA, 20 nt, Human
ccaucaauaaaaaauuauga

SEQ ID NO: 1694670 - RNA, 20 nt, Human
ccaggaauggagccugcacg

SEQ ID NO: 1694671 - RNA, 15 nt, Human
cauuuaauaauuaua

SEQ ID NO: 1694672 - RNA, 16 nt, Human
cauuuaauaauuauau

SEQ ID NO: 1694673 - RNA, 17 nt, Human
cauuuaauaauuauaug

SEQ ID NO: 1694674 - RNA, 19 nt, Human
cauuuaauaauuauaugcu

SEQ ID NO: 1694675 - RNA, 12 nt, Human
cauuuaauaauu

SEQ ID NO: 1694676 - RNA, 14 nt, Human
cauuuaauaauuau

SEQ ID NO: 1694677 - RNA, 23 nt, Human
cauuuaauaauuauaugcuauuu

SEQ ID NO: 1694678 - RNA, 11 nt, Human
cauuuuauaaa

SEQ ID NO: 1694679 - RNA, 13 nt, Human
cauuuuauaaauc

SEQ ID NO: 1694680 - RNA, 17 nt, Human
cauuuuauaaaucgcuu

SEQ ID NO: 1694681 - RNA, 18 nt, Human
cauuuuauaaaucgcuuu

SEQ ID NO: 1694682 - RNA, 21 nt, Human
cauuuuauaaaucgcuuuuga

SEQ ID NO: 1694683 - RNA, 23 nt, Human
cauuuuauaaaucgcuuuugaua

SEQ ID NO: 1694684 - RNA, 18 nt, Human
cugugaacuugaaauuug

SEQ ID NO: 1694685 - RNA, 14 nt, Human
cuguacuuuuuggc

SEQ ID NO: 1694686 - RNA, 15 nt, Human
cuguacuuuuuggca

SEQ ID NO: 1694687 - RNA, 13 nt, Human
cuggguuccugca

SEQ ID NO: 1694688 - RNA, 20 nt, Human
cuucauaccuacauguauuu

SEQ ID NO: 1694689 - RNA, 20 nt, Human
cuugccuuuuucauuauuuu

SEQ ID NO: 1694690 - RNA, 22 nt, Human
cuugccuuuuucauuauuuuau

SEQ ID NO: 1694691 - RNA, 23 nt, Human
cuugccuuuuucauuauuuuauu

SEQ ID NO: 1694692 - RNA, 14 nt, Human
cuugccuuuuucau

SEQ ID NO: 1694693 - RNA, 15 nt, Human
cuugccuuuuucauu

SEQ ID NO: 1694694 - RNA, 16 nt, Human
cuuuugguuaagucug

SEQ ID NO: 1694695 - RNA, 20 nt, Human
cuuuugguuaagucuguuuu

SEQ ID NO: 1694696 - RNA, 11 nt, Human
cuuuguauaga

SEQ ID NO: 1694697 - RNA, 20 nt, Human
cuuuguauagaaccucuuug

SEQ ID NO: 1694698 - RNA, 15 nt, Human
gacuggugacugauu

SEQ ID NO: 1694699 - RNA, 18 nt, Human
gacuggugacugauucuu

SEQ ID NO: 1694700 - RNA, 12 nt, Human
gacuggugacug

SEQ ID NO: 1694701 - RNA, 16 nt, Human
gaauuuuguguuagag

SEQ ID NO: 1694702 - RNA, 22 nt, Human
gaauuuuguguuagagauuuuu

SEQ ID NO: 1694703 - RNA, 13 nt, Human
gaauuuuguguua

SEQ ID NO: 1694704 - RNA, 14 nt, Human
gaagugaaacugcu

SEQ ID NO: 1694705 - RNA, 21 nt, Human
gcauaacauaaaucugugaac

SEQ ID NO: 1694706 - RNA, 23 nt, Human
gcauaacauaaaucugugaacuu

SEQ ID NO: 1694707 - RNA, 14 nt, Human
gauuagaauucugu

SEQ ID NO: 1694708 - RNA, 15 nt, Human
gauuagaauucugua

SEQ ID NO: 1694709 - RNA, 23 nt, Human
gauuagaauucuguauagauuag

SEQ ID NO: 1694710 - RNA, 13 nt, Human
gauuauucacuga

SEQ ID NO: 1694711 - RNA, 15 nt, Human
gauuauucacugauu

SEQ ID NO: 1694712 - RNA, 16 nt, Human
gauuauucacugauuu

SEQ ID NO: 1694713 - RNA, 21 nt, Human
gauuauucacugauuugacau

SEQ ID NO: 1694714 - RNA, 14 nt, Human
gauuagagaguguu

SEQ ID NO: 1694715 - RNA, 18 nt, Human
gauuagagaguguugaaa

SEQ ID NO: 1694716 - RNA, 11 nt, Human
gauccaguuuu

SEQ ID NO: 1694717 - RNA, 17 nt, Human
gauccaguuuuguuugg

SEQ ID NO: 1694718 - RNA, 22 nt, Human
gauccaguuuuguuuggaccaa

SEQ ID NO: 1694719 - RNA, 18 nt, Human
gguucuggugugaacuaa

SEQ ID NO: 1694720 - RNA, 20 nt, Human
aaaguuuaauauuaaagcca

SEQ ID NO: 1694721 - RNA, 21 nt, Human
aaaguuuaauauuaaagccau

SEQ ID NO: 1694722 - RNA, 22 nt, Human
aaaguuuaauauuaaagccaug

SEQ ID NO: 1694723 - RNA, 16 nt, Human
aaaguuuaauauuaaa

SEQ ID NO: 1694724 - RNA, 19 nt, Human
aaaguuuaauauuaaagcc

SEQ ID NO: 1694725 - RNA, 12 nt, Human
aaaguugaauuu

SEQ ID NO: 1694726 - RNA, 13 nt, Human
aaaguugaauuua

SEQ ID NO: 1694727 - RNA, 16 nt, Human
aaaguugaauuuauug

SEQ ID NO: 1694728 - RNA, 22 nt, Human
aaaguugaauuuauuggcuuuu

SEQ ID NO: 1694729 - RNA, 14 nt, Human
aaaaauauuuuaug

SEQ ID NO: 1694730 - RNA, 12 nt, Human
ggauaaaugcca

SEQ ID NO: 1694731 - RNA, 22 nt, Human
ggauaauaaggaaaaguuuaau

SEQ ID NO: 1694732 - RNA, 12 nt, Human
gcuuuucugauc

SEQ ID NO: 1694733 - RNA, 15 nt, Human
gcuuuucugauccag

SEQ ID NO: 1694734 - RNA, 16 nt, Human
gcuuuucugauccagu

SEQ ID NO: 1694735 - RNA, 11 nt, Human
gcuuuucugau

SEQ ID NO: 1694736 - RNA, 23 nt, Human
gcguugaaauuguaauuauaucu

SEQ ID NO: 1694737 - RNA, 24 nt, Human
gcguugaaauuguaauuauaucug

SEQ ID NO: 1694738 - RNA, 18 nt, Human
gcguugaaauuguaauua

SEQ ID NO: 1694739 - RNA, 24 nt, Human
gccaucaauaaaaaauuaugacau

SEQ ID NO: 1694740 - RNA, 20 nt, Human
cucucaaccaccuuucagau

SEQ ID NO: 1694741 - RNA, 17 nt, Human
ccuuuuucauuauuuua

SEQ ID NO: 1694742 - RNA, 15 nt, Human
cuaaacuuuucugau

SEQ ID NO: 1694743 - RNA, 14 nt, Human
cuaaacuuucacac

SEQ ID NO: 1694744 - RNA, 13 nt, Human
cuaaacuuuucug

SEQ ID NO: 1694745 - RNA, 13 nt, Human
cuaaacuuucaca

SEQ ID NO: 1694746 - RNA, 20 nt, Human
cccuauuuuuuuucuguuau

SEQ ID NO: 1694747 - RNA, 21 nt, Human
cccuauuuuuuuucuguuaua

SEQ ID NO: 1694748 - RNA, 17 nt, Human
cccuggccuuucauauu

SEQ ID NO: 1694749 - RNA, 17 nt, Human
ccuagcacacacuuuug

SEQ ID NO: 1694750 - RNA, 21 nt, Human
ccagcagauuauucacugauu

SEQ ID NO: 1694751 - RNA, 22 nt, Human
ccagcagauuauucacugauuu

SEQ ID NO: 1694752 - RNA, 12 nt, Human
caguauugaagc

SEQ ID NO: 1694753 - RNA, 14 nt, Human
caguauugaagcau

SEQ ID NO: 1694754 - RNA, 15 nt, Human
caguauugaagcauu

SEQ ID NO: 1694755 - RNA, 22 nt, Human
caguauuguacaaaguauuaag

SEQ ID NO: 1694756 - RNA, 16 nt, Human
caguauugaagcauuu

SEQ ID NO: 1694757 - RNA, 17 nt, Human
caguauugaagcauuuu

SEQ ID NO: 1694758 - RNA, 20 nt, Human
caguauugaagcauuuuaua

SEQ ID NO: 1694759 - RNA, 21 nt, Human
caguauugaagcauuuuauaa

SEQ ID NO: 1694760 - RNA, 13 nt, Human
cagauacuggauu

SEQ ID NO: 1694761 - RNA, 13 nt, Human
ccaauuaaggauu

SEQ ID NO: 1694762 - RNA, 18 nt, Human
ccaauuaaggauuuuaug

SEQ ID NO: 1694763 - RNA, 22 nt, Human
ccaauuaaggauuuuaugcuuu

SEQ ID NO: 1694764 - RNA, 21 nt, Human
cauucuccuaucaccugucuu

SEQ ID NO: 1694765 - RNA, 16 nt, Human
ccaaaaaccaguauug

SEQ ID NO: 1694766 - RNA, 19 nt, Human
ccaaaaaccaguauuguac

SEQ ID NO: 1694767 - RNA, 20 nt, Human
ccaaaaaccaguauuguaca

SEQ ID NO: 1694768 - RNA, 17 nt, Human
cacuccaauuaaggauu

SEQ ID NO: 1694769 - RNA, 18 nt, Human
cacuccaauuaaggauuu

SEQ ID NO: 1694770 - RNA, 13 nt, Human
cacuccaauuaag

SEQ ID NO: 1694771 - RNA, 15 nt, Human
cacuccaauuaagga

SEQ ID NO: 1694772 - RNA, 14 nt, Human
auuuuaugauccag

SEQ ID NO: 1694773 - RNA, 15 nt, Human
auuuuaugauccagc

SEQ ID NO: 1694774 - RNA, 16 nt, Human
auuuuaugauccagca

SEQ ID NO: 1694775 - RNA, 12 nt, Human
auuuguuugcau

SEQ ID NO: 1694776 - RNA, 13 nt, Human
auuuggaaaucuu

SEQ ID NO: 1694777 - RNA, 11 nt, Human
auuuggaaauc

SEQ ID NO: 1694778 - RNA, 12 nt, Human
auuuggaaaucu

SEQ ID NO: 1694779 - RNA, 12 nt, Human
auuuuaugcuuu

SEQ ID NO: 1694780 - RNA, 17 nt, Human
auuuuaugcuuuaaaca

SEQ ID NO: 1694781 - RNA, 12 nt, Human
auuacaguauaa

SEQ ID NO: 1694782 - RNA, 14 nt, Human
auuacaguauaauu

SEQ ID NO: 1694783 - RNA, 15 nt, Human
auuacaguauaauua

SEQ ID NO: 1694784 - RNA, 16 nt, Human
auuacaguauaauuaa

SEQ ID NO: 1694785 - RNA, 18 nt, Human
auucaaaguugccuaaau

SEQ ID NO: 1694786 - RNA, 20 nt, Human
auucaaaguugccuaaaucc

SEQ ID NO: 1694787 - RNA, 21 nt, Human
auucaaaguugccuaaaucca

SEQ ID NO: 1694788 - RNA, 22 nt, Human
auucaaaguugccuaaauccau

SEQ ID NO: 1694789 - RNA, 17 nt, Human
auucaaaguugccuaaa

SEQ ID NO: 1694790 - RNA, 14 nt, Human
auuaugaaacuugu

SEQ ID NO: 1694791 - RNA, 15 nt, Human
auuaugaaacuugug

SEQ ID NO: 1694792 - RNA, 18 nt, Human
auuaugaaacuuguguaa

SEQ ID NO: 1694793 - RNA, 20 nt, Human
auuaugaaacuuguguaaau

SEQ ID NO: 1694794 - RNA, 21 nt, Human
auuaugaaacuuguguaaaua

SEQ ID NO: 1694795 - RNA, 14 nt, Human
auuguaauuauauc

SEQ ID NO: 1694796 - RNA, 13 nt, Human
auuguaauuauau

SEQ ID NO: 1694797 - RNA, 13 nt, Human
uuguacaaaguau

SEQ ID NO: 1694798 - RNA, 14 nt, Human
uuguacaaaguauu

SEQ ID NO: 1694799 - RNA, 13 nt, Human
uugguugcuuuaa

SEQ ID NO: 1694800 - RNA, 16 nt, Human
uugguugcuuuaauau

SEQ ID NO: 1694801 - RNA, 15 nt, Human
uuguacaaaguauua

SEQ ID NO: 1694802 - RNA, 17 nt, Human
uuguacaaaguauuaag

SEQ ID NO: 1694803 - RNA, 20 nt, Human
uuguacaaaguauuaagcau

SEQ ID NO: 1694804 - RNA, 21 nt, Human
uuguacaaaguauuaagcaua

SEQ ID NO: 1694805 - RNA, 22 nt, Human
uuguacaaaguauuaagcauau

SEQ ID NO: 1694806 - RNA, 16 nt, Human
augacuucauuaauaa

SEQ ID NO: 1694807 - RNA, 11 nt, Human
augacuuugga

SEQ ID NO: 1694808 - RNA, 12 nt, Human
augacuuuggac

SEQ ID NO: 1694809 - RNA, 15 nt, Human
uuggggauucuuaaa

SEQ ID NO: 1694810 - RNA, 13 nt, Human
uuggggauucuua

SEQ ID NO: 1694811 - RNA, 15 nt, Human
uuggauaauaaggaa

SEQ ID NO: 1694812 - RNA, 19 nt, Human
uuggauaauaaggaaaagu

SEQ ID NO: 1694813 - RNA, 21 nt, Human
uuggauaauaaggaaaaguuu

SEQ ID NO: 1694814 - RNA, 13 nt, Human
aucugugaacuug

SEQ ID NO: 1694815 - RNA, 17 nt, Human
aucugugaacuugaaau

SEQ ID NO: 1694816 - RNA, 18 nt, Human
aucugugaacuugaaauu

SEQ ID NO: 1694817 - RNA, 19 nt, Human
aucugugaacuugaaauuu

SEQ ID NO: 1694818 - RNA, 14 nt, Human
aucugccuaaggac

SEQ ID NO: 1694819 - RNA, 15 nt, Human
aucugccuaaggacu

SEQ ID NO: 1694820 - RNA, 16 nt, Human
aucugccuaaggacuu

SEQ ID NO: 1694821 - RNA, 17 nt, Human
aucugccuaaggacuuc

SEQ ID NO: 1694822 - RNA, 13 nt, Human
aucugccuaagga

SEQ ID NO: 1694823 - RNA, 18 nt, Human
aucugccuaaggacuucu

SEQ ID NO: 1694824 - RNA, 19 nt, Human
aucugccuaaggacuucuu

SEQ ID NO: 1694825 - RNA, 20 nt, Human
aucugccuaaggacuucuuu

SEQ ID NO: 1694826 - RNA, 15 nt, Human
aucugaggaauucug

SEQ ID NO: 1694827 - RNA, 16 nt, Human
aucugaggaauucugu

SEQ ID NO: 1694828 - RNA, 17 nt, Human
aucugaggaauucugua

SEQ ID NO: 1694829 - RNA, 18 nt, Human
aucugaggaauucuguau

SEQ ID NO: 1694830 - RNA, 20 nt, Human
aucugaggaauucuguauag

SEQ ID NO: 1694831 - RNA, 21 nt, Human
aucugaggaauucuguauaga

SEQ ID NO: 1694832 - RNA, 13 nt, Human
uugccuaaaucca

SEQ ID NO: 1694833 - RNA, 14 nt, Human
uugccuaaauccau

SEQ ID NO: 1694834 - RNA, 15 nt, Human
uugccuaaauccauu

SEQ ID NO: 1694835 - RNA, 22 nt, Human
uugccuaaauccauuuggaaau

SEQ ID NO: 1694836 - RNA, 14 nt, Human
uuuagucuugucuc

SEQ ID NO: 1694837 - RNA, 22 nt, Human
uuuauuacaguauaauuaacau

SEQ ID NO: 1694838 - RNA, 23 nt, Human
auggaacgcguugaaauuguaau

SEQ ID NO: 1694839 - RNA, 23 nt, Human
uuuauuacaguauaauuaacaug

SEQ ID NO: 1694840 - RNA, 13 nt, Human
uuucauauuuuag

SEQ ID NO: 1694841 - RNA, 21 nt, Human
uuucauauuuuagcuacuaua

SEQ ID NO: 1694842 - RNA, 14 nt, Human
augccaaguuguuu

SEQ ID NO: 1694843 - RNA, 16 nt, Human
augccaaguuguuuga

SEQ ID NO: 1694844 - RNA, 23 nt, Human
augccaaguuguuugagaaauua

SEQ ID NO: 1694845 - RNA, 14 nt, Human
uuuaauuuuggaau

SEQ ID NO: 1694846 - RNA, 15 nt, Human
uuuaauuuuggaauu

SEQ ID NO: 1694847 - RNA, 17 nt, Human
uuuaauuuuggaauuuu

SEQ ID NO: 1694848 - RNA, 12 nt, Human
augauuucuaug

SEQ ID NO: 1694849 - RNA, 13 nt, Human
augauuucuaugc

SEQ ID NO: 1694850 - RNA, 16 nt, Human
augauuucuaugcuga

SEQ ID NO: 1694851 - RNA, 19 nt, Human
uuguguaaauacaauuuug

SEQ ID NO: 1694852 - RNA, 17 nt, Human
auauuuucauucuccua

SEQ ID NO: 1694853 - RNA, 16 nt, Human
auauuuuuauauuuac

SEQ ID NO: 1694854 - RNA, 14 nt, Human
aucacuuuuuucca

SEQ ID NO: 1694855 - RNA, 18 nt, Human
uucucagaaggcaaauga

SEQ ID NO: 1694856 - RNA, 19 nt, Human
uucucagaaggcaaaugac

SEQ ID NO: 1694857 - RNA, 21 nt, Human
uucucagaaggcaaaugacuu

SEQ ID NO: 1694858 - RNA, 22 nt, Human
uucucagaaggcaaaugacuuu

SEQ ID NO: 1694859 - RNA, 15 nt, Human
aucaauaaaaaauua

SEQ ID NO: 1694860 - RNA, 17 nt, Human
aucaauaaaaaauuaug

SEQ ID NO: 1694861 - RNA, 18 nt, Human
aucaauaaaaaauuauga

SEQ ID NO: 1694862 - RNA, 13 nt, Human
uucuguacuuuuu

SEQ ID NO: 1694863 - RNA, 18 nt, Human
uucuguacuuuuuggcau

SEQ ID NO: 1694864 - RNA, 19 nt, Human
uucuguacuuuuuggcaua

SEQ ID NO: 1694865 - RNA, 20 nt, Human
uucuggugugaacuaaacuu

SEQ ID NO: 1694866 - RNA, 21 nt, Human
uucuggugugaacuaaacuuu

SEQ ID NO: 1694867 - RNA, 14 nt, Human
uucuggugugaacu

SEQ ID NO: 1694868 - RNA, 20 nt, Human
auccaguuuuguuuggacca

SEQ ID NO: 1694869 - RNA, 21 nt, Human
auccaguuuuguuuggaccaa

SEQ ID NO: 1694870 - RNA, 18 nt, Human
auccaguuuuguuuggac

SEQ ID NO: 1694871 - RNA, 17 nt, Human
auccaguuuuguuugga

SEQ ID NO: 1694872 - RNA, 17 nt, Human
auccauuuggaaaucuu

SEQ ID NO: 1694873 - RNA, 19 nt, Human
auccauuuggaaaucuuua

SEQ ID NO: 1694874 - RNA, 13 nt, Human
auccauuuggaaa

SEQ ID NO: 1694875 - RNA, 13 nt, Human
auagucuggcugu

SEQ ID NO: 1694876 - RNA, 14 nt, Human
auauaugugaugau

SEQ ID NO: 1694877 - RNA, 13 nt, Human
auuuuauuaugaa

SEQ ID NO: 1694878 - RNA, 14 nt, Human
auuuuauuaugaaa

SEQ ID NO: 1694879 - RNA, 11 nt, Human
auuuuauuaug

SEQ ID NO: 1694880 - RNA, 12 nt, Human
auuuuauuauga

SEQ ID NO: 1694881 - RNA, 18 nt, Human
auuuuauuaugaaacuug

SEQ ID NO: 1694882 - RNA, 21 nt, Human
auuuuauuaugaaacuugugu

SEQ ID NO: 1694883 - RNA, 14 nt, Human
auuuuauuauguaa

SEQ ID NO: 1694884 - RNA, 15 nt, Human
auuuuauuauguaaa

SEQ ID NO: 1694885 - RNA, 13 nt, Human
auuuuauuaugua

SEQ ID NO: 1694886 - RNA, 15 nt, Human
auuuacuaaaaugga

SEQ ID NO: 1694887 - RNA, 20 nt, Human
auuuggaaaucuuuaaaaaa

SEQ ID NO: 1694888 - RNA, 17 nt, Human
auuuggaaaucuuuaaa

SEQ ID NO: 1694889 - RNA, 23 nt, Human
auugugcgcuaaacuuuucugau

SEQ ID NO: 1694890 - RNA, 21 nt, Human
auuauuuuauuaugaaacuug

SEQ ID NO: 1694891 - RNA, 22 nt, Human
auuauuuuauuaugaaacuugu

SEQ ID NO: 1694892 - RNA, 15 nt, Human
auuagagaguguuga

SEQ ID NO: 1694893 - RNA, 16 nt, Human
auuagagaguguugaa

SEQ ID NO: 1694894 - RNA, 17 nt, Human
auuagagaguguugaaa

SEQ ID NO: 1694895 - RNA, 18 nt, Human
auuagagaguguugaaac

SEQ ID NO: 1694896 - RNA, 19 nt, Human
auuagagaguguugaaacg

SEQ ID NO: 1694897 - RNA, 15 nt, Human
auuauuuuauuauga

SEQ ID NO: 1694898 - RNA, 13 nt, Human
uuuuauuauguaa

SEQ ID NO: 1694899 - RNA, 14 nt, Human
uuuuauuauguaaa

SEQ ID NO: 1694900 - RNA, 15 nt, Human
uuuucauuauuuuau

SEQ ID NO: 1694901 - RNA, 21 nt, Human
uuuucauuauuuuauuaugaa

SEQ ID NO: 1694902 - RNA, 22 nt, Human
uuuucauucuccuaucaccugu

SEQ ID NO: 1694903 - RNA, 12 nt, Human
uuuuauuaugua

SEQ ID NO: 1694904 - RNA, 18 nt, Human
uuuuaugcuuuaaacauu

SEQ ID NO: 1694905 - RNA, 12 nt, Human
uuuuauaaaucg

SEQ ID NO: 1694906 - RNA, 20 nt, Human
uuuuauaaaucgcuuuugau

SEQ ID NO: 1694907 - RNA, 16 nt, Human
auuaagaaugaaauac

SEQ ID NO: 1694908 - RNA, 20 nt, Human
auuaagaaugaaauacuguu

SEQ ID NO: 1694909 - RNA, 21 nt, Human
auuaagaaugaaauacuguuu

SEQ ID NO: 1694910 - RNA, 22 nt, Human
auuaagaaugaaauacuguuug

SEQ ID NO: 1694911 - RNA, 12 nt, Human
auuaaagccaug

SEQ ID NO: 1694912 - RNA, 16 nt, Human
auuaaagccauguuua

SEQ ID NO: 1694913 - RNA, 17 nt, Human
auuaaagccauguuuau

SEQ ID NO: 1694914 - RNA, 21 nt, Human
auuaaagccauguuuauuaca

SEQ ID NO: 1694915 - RNA, 13 nt, Human
auuaacauguuaa

SEQ ID NO: 1694916 - RNA, 14 nt, Human
auuaacauguuaaa

SEQ ID NO: 1694917 - RNA, 15 nt, Human
auuaacauguuaaac

SEQ ID NO: 1694918 - RNA, 17 nt, Human
auuaacauguuaaacca

SEQ ID NO: 1694919 - RNA, 19 nt, Human
auuaacauguuaaaccaug

SEQ ID NO: 1694920 - RNA, 18 nt, Human
uuuguuucuguacuuuuu

SEQ ID NO: 1694921 - RNA, 12 nt, Human
uuuguuucugua

SEQ ID NO: 1694922 - RNA, 13 nt, Human
uuuguuucuguac

SEQ ID NO: 1694923 - RNA, 15 nt, Human
uuugucuacaccauu

SEQ ID NO: 1694924 - RNA, 23 nt, Human
auaauaaauucccuggccuuuca

SEQ ID NO: 1694925 - RNA, 21 nt, Human
auaaauucccuggccuuucau

SEQ ID NO: 1694926 - RNA, 22 nt, Human
auaaauucccuggccuuucaua

SEQ ID NO: 1694927 - RNA, 18 nt, Human
auaacuguuauuuauaau

SEQ ID NO: 1694928 - RNA, 20 nt, Human
auaacuguuauuuauaauca

SEQ ID NO: 1694929 - RNA, 22 nt, Human
auaacuguuauuuauaaucacu

SEQ ID NO: 1694930 - RNA, 22 nt, Human
auaaauagcuagacuggugacu

SEQ ID NO: 1694931 - RNA, 15 nt, Human
aguuuugguugcuuu

SEQ ID NO: 1694932 - RNA, 21 nt, Human
aguuuugguugcuuuaauauc

SEQ ID NO: 1694933 - RNA, 22 nt, Human
aguuuugguugcuuuaauauca

SEQ ID NO: 1694934 - RNA, 17 nt, Human
uuaaguaucugacaucu

SEQ ID NO: 1694935 - RNA, 14 nt, Human
uuaagucuguuuua

SEQ ID NO: 1694936 - RNA, 15 nt, Human
uuaagucuguuuuau

SEQ ID NO: 1694937 - RNA, 11 nt, Human
aguugccuaaa

SEQ ID NO: 1694938 - RNA, 15 nt, Human
aguugccuaaaucca

SEQ ID NO: 1694939 - RNA, 16 nt, Human
aguugccuaaauccau

SEQ ID NO: 1694940 - RNA, 17 nt, Human
aguugccuaaauccauu

SEQ ID NO: 1694941 - RNA, 19 nt, Human
aguugccuaaauccauuug

SEQ ID NO: 1694942 - RNA, 18 nt, Human
uguuauuuauaaucacuu

SEQ ID NO: 1694943 - RNA, 21 nt, Human
uguuauuuauaaucacuuuuu

SEQ ID NO: 1694944 - RNA, 21 nt, Human
aguguugaaacggaugauuuc

SEQ ID NO: 1694945 - RNA, 22 nt, Human
aguucacucuccauuuaauaau

SEQ ID NO: 1694946 - RNA, 24 nt, Human
aguucacucuccauuuaauaauua

SEQ ID NO: 1694947 - RNA, 13 nt, Human
uguuuagucuugu

SEQ ID NO: 1694948 - RNA, 17 nt, Human
uguuuagucuugucuca

SEQ ID NO: 1694949 - RNA, 18 nt, Human
uguuuagucuugucucag

SEQ ID NO: 1694950 - RNA, 19 nt, Human
uguuuagucuugucucaga

SEQ ID NO: 1694951 - RNA, 20 nt, Human
uguuuagucuugucucagau

SEQ ID NO: 1694952 - RNA, 16 nt, Human
uguggugacuuuggau

SEQ ID NO: 1694953 - RNA, 17 nt, Human
uguggugacuuuggaua

SEQ ID NO: 1694954 - RNA, 13 nt, Human
uguaaaucccauu

SEQ ID NO: 1694955 - RNA, 16 nt, Human
uguaaaucccauuauu

SEQ ID NO: 1694956 - RNA, 18 nt, Human
uguaaaucccauuauuca

SEQ ID NO: 1694957 - RNA, 19 nt, Human
uguaaaucccauuauucaa

SEQ ID NO: 1694958 - RNA, 20 nt, Human
uguaaaucccauuauucaaa

SEQ ID NO: 1694959 - RNA, 22 nt, Human
uguaaaucccauuauucaaagu

SEQ ID NO: 1694960 - RNA, 14 nt, Human
uguaauuauaucug

SEQ ID NO: 1694961 - RNA, 15 nt, Human
uguaauuauaucuga

SEQ ID NO: 1694962 - RNA, 13 nt, Human
uguaauuauaucu

SEQ ID NO: 1694963 - RNA, 14 nt, Human
agguuuuuaagccu

SEQ ID NO: 1694964 - RNA, 12 nt, Human
uguacuuuuugg

SEQ ID NO: 1694965 - RNA, 15 nt, Human
uguacuuuuuggcau

SEQ ID NO: 1694966 - RNA, 16 nt, Human
uguacuuuuuggcaua

SEQ ID NO: 1694967 - RNA, 17 nt, Human
uguacuuuuuggcauaa

SEQ ID NO: 1694968 - RNA, 17 nt, Human
ugggcugaacacuccaa

SEQ ID NO: 1694969 - RNA, 19 nt, Human
ugggcugaacacuccaauu

SEQ ID NO: 1694970 - RNA, 14 nt, Human
uggaaaucuuuaaa

SEQ ID NO: 1694971 - RNA, 15 nt, Human
uggaaaucuuuaaaa

SEQ ID NO: 1694972 - RNA, 17 nt, Human
uggacuguggugacuuu

SEQ ID NO: 1694973 - RNA, 19 nt, Human
uggacuguggugacuuugg

SEQ ID NO: 1694974 - RNA, 21 nt, Human
uggacuguggugacuuuggau

SEQ ID NO: 1694975 - RNA, 22 nt, Human
uggacuguggugacuuuggaua

SEQ ID NO: 1694976 - RNA, 15 nt, Human
uggacuguggugacu

SEQ ID NO: 1694977 - RNA, 16 nt, Human
uggacuguggugacuu

SEQ ID NO: 1694978 - RNA, 14 nt, Human
aggcaaaugacuuu

SEQ ID NO: 1694979 - RNA, 15 nt, Human
aggcaaaugacuuug

SEQ ID NO: 1694980 - RNA, 18 nt, Human
aggcaaaugacuuuggac

SEQ ID NO: 1694981 - RNA, 21 nt, Human
uggcauaacauaaaucuguga

SEQ ID NO: 1694982 - RNA, 22 nt, Human
uggcauaacauaaaucugugaa

SEQ ID NO: 1694983 - RNA, 12 nt, Human
ugcuaaggacuu

SEQ ID NO: 1694984 - RNA, 13 nt, Human
ugcuaaggacuug

SEQ ID NO: 1694985 - RNA, 18 nt, Human
ugcuaaggacuuguuaga

SEQ ID NO: 1694986 - RNA, 22 nt, Human
ugcuaaggacuuguuagaucua

SEQ ID NO: 1694987 - RNA, 23 nt, Human
aggaauggagccugcacggugaa

SEQ ID NO: 1694988 - RNA, 17 nt, Human
aggaagccugauuaaag

SEQ ID NO: 1694989 - RNA, 18 nt, Human
aggaagccugauuaaaga

SEQ ID NO: 1694990 - RNA, 21 nt, Human
aggaagccugauuaaagaaug

SEQ ID NO: 1694991 - RNA, 14 nt, Human
agcuagacugguga

SEQ ID NO: 1694992 - RNA, 16 nt, Human
agcuagacuggugacu

SEQ ID NO: 1694993 - RNA, 17 nt, Human
agcuagacuggugacug

SEQ ID NO: 1694994 - RNA, 21 nt, Human
agcuagacuggugacugauuc

SEQ ID NO: 1694995 - RNA, 13 nt, Human
agcuagacuggug

SEQ ID NO: 1694996 - RNA, 15 nt, Human
ugccaaguuguuuga

SEQ ID NO: 1694997 - RNA, 19 nt, Human
ugccaaguuguuugagaaa

SEQ ID NO: 1694998 - RNA, 20 nt, Human
ugccaaguuguuugagaaau

SEQ ID NO: 1694999 - RNA, 16 nt, Human
agccauguuuauuaca

SEQ ID NO: 1695000 - RNA, 13 nt, Human
agccauguuuauu

SEQ ID NO: 1695001 - RNA, 14 nt, Human
agccauguuuauua

SEQ ID NO: 1695002 - RNA, 22 nt, Human
ugauccaguuuuguuuggacca

SEQ ID NO: 1695003 - RNA, 22 nt, Human
ugauccagcagauuauucacug

SEQ ID NO: 1695004 - RNA, 21 nt, Human
ugauccagcagauuauucacu

SEQ ID NO: 1695005 - RNA, 15 nt, Human
ugagguuuuuaagcc

SEQ ID NO: 1695006 - RNA, 14 nt, Human
ugauaaucaacugg

SEQ ID NO: 1695007 - RNA, 18 nt, Human
ugauaaucaacugggcug

SEQ ID NO: 1695008 - RNA, 24 nt, Human
ugauaaucaacugggcugaacacu

SEQ ID NO: 1695009 - RNA, 17 nt, Human
agcaucacaguuuuggu

SEQ ID NO: 1695010 - RNA, 15 nt, Human
agcaucacaguuuug

SEQ ID NO: 1695011 - RNA, 18 nt, Human
agauuuuuuuguuguuug

SEQ ID NO: 1695012 - RNA, 19 nt, Human
agauuuuuuuguuguuugu

SEQ ID NO: 1695013 - RNA, 23 nt, Human
agauuuuuuuguuguuuguuuag

SEQ ID NO: 1695014 - RNA, 15 nt, Human
agauuuuuuuguugu

SEQ ID NO: 1695015 - RNA, 16 nt, Human
agauuuuuuuguuguu

SEQ ID NO: 1695016 - RNA, 14 nt, Human
agauuuuauuaugu

SEQ ID NO: 1695017 - RNA, 15 nt, Human
agauuuuauuaugua

SEQ ID NO: 1695018 - RNA, 16 nt, Human
agauuuuauuauguaa

SEQ ID NO: 1695019 - RNA, 17 nt, Human
agauuuuauuauguaaa

SEQ ID NO: 1695020 - RNA, 18 nt, Human
agauuuuauuauguaaau

SEQ ID NO: 1695021 - RNA, 19 nt, Human
agauuuuauuauguaaauc

SEQ ID NO: 1695022 - RNA, 17 nt, Human
ugaauuuuguguuagag

SEQ ID NO: 1695023 - RNA, 21 nt, Human
ugaauuuuguguuagagauuu

SEQ ID NO: 1695024 - RNA, 17 nt, Human
agauacuggauuguacu

SEQ ID NO: 1695025 - RNA, 14 nt, Human
agauacuggauugu

SEQ ID NO: 1695026 - RNA, 16 nt, Human
agauaacuguuauuua

SEQ ID NO: 1695027 - RNA, 19 nt, Human
agauaacuguuauuuauaa

SEQ ID NO: 1695028 - RNA, 20 nt, Human
agauaacuguuauuuauaau

SEQ ID NO: 1695029 - RNA, 12 nt, Human
ugaauggcuuug

SEQ ID NO: 1695030 - RNA, 15 nt, Human
ugaauggcuuuguau

SEQ ID NO: 1695031 - RNA, 11 nt, Human
ugaauggcuuu

SEQ ID NO: 1695032 - RNA, 17 nt, Human
ugaauggcuuuguauag

SEQ ID NO: 1695033 - RNA, 18 nt, Human
ugaauggcuuuguauaga

SEQ ID NO: 1695034 - RNA, 19 nt, Human
ugaauggcuuuguauagaa

SEQ ID NO: 1695035 - RNA, 22 nt, Human
ugaauggcuuuguauagaaccu

SEQ ID NO: 1695036 - RNA, 15 nt, Human
ugaagcauuuuauaa

SEQ ID NO: 1695037 - RNA, 16 nt, Human
ugaagcauuuuauaaa

SEQ ID NO: 1695038 - RNA, 17 nt, Human
ugaagcauuuuauaaau

SEQ ID NO: 1695039 - RNA, 18 nt, Human
ugaagcauuuuauaaauc

SEQ ID NO: 1695040 - RNA, 22 nt, Human
ugaagcauuuuauaaaucgcuu

SEQ ID NO: 1695041 - RNA, 14 nt, Human
ugaagcauuuuaua

SEQ ID NO: 1695042 - RNA, 17 nt, Human
ugaaacggaugauuucu

SEQ ID NO: 1695043 - RNA, 18 nt, Human
ugaaacggaugauuucua

SEQ ID NO: 1695044 - RNA, 19 nt, Human
ugaaacggaugauuucuau

SEQ ID NO: 1695045 - RNA, 20 nt, Human
ugaaacggaugauuucuaug

SEQ ID NO: 1695046 - RNA, 17 nt, Human
ugaaacuuguguaaaua

SEQ ID NO: 1695047 - RNA, 23 nt, Human
ugaaacuuguguaaauacaauuu

SEQ ID NO: 1695048 - RNA, 15 nt, Human
ugaaacggaugauuu

SEQ ID NO: 1695049 - RNA, 21 nt, Human
agaagccccacccugccucac

SEQ ID NO: 1695050 - RNA, 18 nt, Human
ucugaagugaaacugcuu

SEQ ID NO: 1695051 - RNA, 22 nt, Human
ucugaagugaaacugcuuguuu

SEQ ID NO: 1695052 - RNA, 16 nt, Human
ucugaagugaaacugc

SEQ ID NO: 1695053 - RNA, 13 nt, Human
agaaauuaaguau

SEQ ID NO: 1695054 - RNA, 17 nt, Human
agaaauuaaguaucuga

SEQ ID NO: 1695055 - RNA, 22 nt, Human
acuuugugcugggguuaucuga

SEQ ID NO: 1695056 - RNA, 21 nt, Human
acugggcugaacacuccaauu

SEQ ID NO: 1695057 - RNA, 16 nt, Human
acugggcugaacacuc

SEQ ID NO: 1695058 - RNA, 16 nt, Human
acuugaaauuugaauu

SEQ ID NO: 1695059 - RNA, 17 nt, Human
acuucauuaauaauaaa

SEQ ID NO: 1695060 - RNA, 12 nt, Human
ucuaguucacuc

SEQ ID NO: 1695061 - RNA, 16 nt, Human
ucuaguucacucucca

SEQ ID NO: 1695062 - RNA, 19 nt, Human
ucuaguucacucuccauuu

SEQ ID NO: 1695063 - RNA, 19 nt, Human
ucaguauugaagcauuuua

SEQ ID NO: 1695064 - RNA, 14 nt, Human
ucaguauugaagca

SEQ ID NO: 1695065 - RNA, 15 nt, Human
ucaguauugaagcau

SEQ ID NO: 1695066 - RNA, 16 nt, Human
ucaguauugaagcauu

SEQ ID NO: 1695067 - RNA, 17 nt, Human
ucaguauugaagcauuu

SEQ ID NO: 1695068 - RNA, 18 nt, Human
ucaguauugaagcauuuu

SEQ ID NO: 1695069 - RNA, 17 nt, Human
accaugggauaaaugcc

SEQ ID NO: 1695070 - RNA, 18 nt, Human
accaugggauaaaugcca

SEQ ID NO: 1695071 - RNA, 15 nt, Human
ucagaucugccuaag

SEQ ID NO: 1695072 - RNA, 18 nt, Human
ucagaucugccuaaggac

SEQ ID NO: 1695073 - RNA, 20 nt, Human
ucagaucugccuaaggacuu

SEQ ID NO: 1695074 - RNA, 13 nt, Human
ucagaucugccua

SEQ ID NO: 1695075 - RNA, 12 nt, Human
accaaaaaccag

SEQ ID NO: 1695076 - RNA, 13 nt, Human
accaaaaaccagu

SEQ ID NO: 1695077 - RNA, 14 nt, Human
acauugguguugua

SEQ ID NO: 1695078 - RNA, 16 nt, Human
acauugguguuguacu

SEQ ID NO: 1695079 - RNA, 22 nt, Human
acauugguguuguacucaauuu

SEQ ID NO: 1695080 - RNA, 23 nt, Human
acauugguguuguacucaauuuu

SEQ ID NO: 1695081 - RNA, 14 nt, Human
acauugguucuugu

SEQ ID NO: 1695082 - RNA, 16 nt, Human
acauugguucuuguau

SEQ ID NO: 1695083 - RNA, 18 nt, Human
acauugguucuuguauua

SEQ ID NO: 1695084 - RNA, 21 nt, Human
acauugguucuuguauuaaga

SEQ ID NO: 1695085 - RNA, 22 nt, Human
acauugguucuuguauuaagaa

SEQ ID NO: 1695086 - RNA, 23 nt, Human
acauugguucuuguauuaagaau

SEQ ID NO: 1695087 - RNA, 12 nt, Human
acauguauuugu

SEQ ID NO: 1695088 - RNA, 15 nt, Human
ucaaaguugccuaaa

SEQ ID NO: 1695089 - RNA, 15 nt, Human
uauuuguuugcauag

SEQ ID NO: 1695090 - RNA, 23 nt, Human
uccgugcuaaggacuuguuagau

SEQ ID NO: 1695091 - RNA, 16 nt, Human
uccgugcuaaggacuu

SEQ ID NO: 1695092 - RNA, 17 nt, Human
uccgugcuaaggacuug

SEQ ID NO: 1695093 - RNA, 18 nt, Human
uccgugcuaaggacuugu

SEQ ID NO: 1695094 - RNA, 17 nt, Human
uccauuuaauaauuaua

SEQ ID NO: 1695095 - RNA, 12 nt, Human
uccauuuggaaa

SEQ ID NO: 1695096 - RNA, 19 nt, Human
uccauuuggaaaucuuuaa

SEQ ID NO: 1695097 - RNA, 20 nt, Human
uccauuuggaaaucuuuaaa

SEQ ID NO: 1695098 - RNA, 12 nt, Human
uccauuuaauaa

SEQ ID NO: 1695099 - RNA, 15 nt, Human
acggaugauuucuau

SEQ ID NO: 1695100 - RNA, 13 nt, Human
acgcguugaaauu

SEQ ID NO: 1695101 - RNA, 14 nt, Human
acgcguugaaauug

SEQ ID NO: 1695102 - RNA, 18 nt, Human
acgcguugaaauuguaau

SEQ ID NO: 1695103 - RNA, 20 nt, Human
acgcguugaaauuguaauua

SEQ ID NO: 1695104 - RNA, 22 nt, Human
uccacauaaggaaacuggguuc

SEQ ID NO: 1695105 - RNA, 16 nt, Human
uccaauuaaggauuuu

SEQ ID NO: 1695106 - RNA, 17 nt, Human
uccaauuaaggauuuua

SEQ ID NO: 1695107 - RNA, 15 nt, Human
uccaauuaaggauuu

SEQ ID NO: 1695108 - RNA, 15 nt, Human
acaaaguauuaagca

SEQ ID NO: 1695109 - RNA, 16 nt, Human
acaaaguauuaagcau

SEQ ID NO: 1695110 - RNA, 13 nt, Human
acaaaguauuaag

SEQ ID NO: 1695111 - RNA, 18 nt, Human
acaaaguauuaagcauau

SEQ ID NO: 1695112 - RNA, 18 nt, Human
uagcacacacuuuugguu

SEQ ID NO: 1695113 - RNA, 14 nt, Human
uaugcuauuucuau

SEQ ID NO: 1695114 - RNA, 15 nt, Human
uaugcuauuucuaua

SEQ ID NO: 1695115 - RNA, 16 nt, Human
uaugcuauuucuauau

SEQ ID NO: 1695116 - RNA, 18 nt, Human
uaugcuauuucuauauuu

SEQ ID NO: 1695117 - RNA, 22 nt, Human
uaugcuauuucuauauuuucau

SEQ ID NO: 1695118 - RNA, 23 nt, Human
uaugcuauuucuauauuuucauu

SEQ ID NO: 1695119 - RNA, 14 nt, Human
uaugaaacuugugu

SEQ ID NO: 1695120 - RNA, 19 nt, Human
uaugaaacuuguguaaaua

SEQ ID NO: 1695121 - RNA, 21 nt, Human
uaugaaacuuguguaaauaca

SEQ ID NO: 1695122 - RNA, 18 nt, Human
uauagauuagaauucugu

SEQ ID NO: 1695123 - RNA, 19 nt, Human
uauagauuagaauucugua

SEQ ID NO: 1695124 - RNA, 13 nt, Human
acacuuuugguua

SEQ ID NO: 1695125 - RNA, 22 nt, Human
acacuuuugguuaagucuguuu

SEQ ID NO: 1695126 - RNA, 13 nt, Human
aauuaaguaucug

SEQ ID NO: 1695127 - RNA, 14 nt, Human
aauuaaguaucuga

SEQ ID NO: 1695128 - RNA, 14 nt, Human
uaauuauaugcuau

SEQ ID NO: 1695129 - RNA, 18 nt, Human
uaauuauaugcuauuucu

SEQ ID NO: 1695130 - RNA, 19 nt, Human
uaauuauaugcuauuucua

SEQ ID NO: 1695131 - RNA, 20 nt, Human
uaauuauaugcuauuucuau

SEQ ID NO: 1695132 - RNA, 19 nt, Human
uaauuauaucugaggaauu

SEQ ID NO: 1695133 - RNA, 21 nt, Human
uaauuauaucugaggaauucu

SEQ ID NO: 1695134 - RNA, 22 nt, Human
uaauuauaucugaggaauucug

SEQ ID NO: 1695135 - RNA, 23 nt, Human
uaauuauaucugaggaauucugu

SEQ ID NO: 1695136 - RNA, 14 nt, Human
uaaggacuucuuua

SEQ ID NO: 1695137 - RNA, 15 nt, Human
uaaggacuucuuuaa

SEQ ID NO: 1695138 - RNA, 16 nt, Human
uaaggacuucuuuaau

SEQ ID NO: 1695139 - RNA, 22 nt, Human
uaaggacuucuuuaauuuugga

SEQ ID NO: 1695140 - RNA, 17 nt, Human
uaaggaaaaguuuaaua

SEQ ID NO: 1695141 - RNA, 19 nt, Human
uaaggaaaaguuuaauauu

SEQ ID NO: 1695142 - RNA, 21 nt, Human
uaaggaaaaguuuaauauuaa

SEQ ID NO: 1695143 - RNA, 12 nt, Human
uaaggaaacugg

SEQ ID NO: 1695144 - RNA, 14 nt, Human
uaaggaaacugggu

SEQ ID NO: 1695145 - RNA, 19 nt, Human
uaaggaaacuggguuccug

SEQ ID NO: 1695146 - RNA, 13 nt, Human
uaagcauauauuu

SEQ ID NO: 1695147 - RNA, 16 nt, Human
uaagcauauauuuuua

SEQ ID NO: 1695148 - RNA, 13 nt, Human
uaaggacuuguua

SEQ ID NO: 1695149 - RNA, 15 nt, Human
uaaggacuuguuaga

SEQ ID NO: 1695150 - RNA, 16 nt, Human
uaaggacuuguuagau

SEQ ID NO: 1695151 - RNA, 19 nt, Human
uaaggacuuguuagaucua

SEQ ID NO: 1695152 - RNA, 21 nt, Human
aauccucucaaccaccuuuca

SEQ ID NO: 1695153 - RNA, 21 nt, Human
aaucccauuauucaaaguugc

SEQ ID NO: 1695154 - RNA, 14 nt, Human
aaucccauuauuca

SEQ ID NO: 1695155 - RNA, 16 nt, Human
aaucccauuauucaaa

SEQ ID NO: 1695156 - RNA, 12 nt, Human
uaacauguuaaa

SEQ ID NO: 1695157 - RNA, 15 nt, Human
uaacauguuaaacca

SEQ ID NO: 1695158 - RNA, 16 nt, Human
uaacauguuaaaccau

SEQ ID NO: 1695159 - RNA, 14 nt, Human
aauagcuagacugg

SEQ ID NO: 1695160 - RNA, 20 nt, Human
aauagcuagacuggugacug

SEQ ID NO: 1695161 - RNA, 21 nt, Human
aauagcuagacuggugacuga

SEQ ID NO: 1695162 - RNA, 17 nt, Human
aagccaaaccucuguga

SEQ ID NO: 1695163 - RNA, 21 nt, Human
guuuuucuuaaauaauaaaga

SEQ ID NO: 1695164 - RNA, 15 nt, Human
aaguauuaagcauau

SEQ ID NO: 1695165 - RNA, 18 nt, Human
aaguauuaagcauauauu

SEQ ID NO: 1695166 - RNA, 16 nt, Human
aaguauuaagcauaua

SEQ ID NO: 1695167 - RNA, 17 nt, Human
aaguauuaagcauauau

SEQ ID NO: 1695168 - RNA, 20 nt, Human
guuuuucuuaaauaauaaag

SEQ ID NO: 1695169 - RNA, 22 nt, Human
guugccuaaauccauuuggaaa

SEQ ID NO: 1695170 - RNA, 20 nt, Human
guuuaauauuaaagccaugu

SEQ ID NO: 1695171 - RNA, 10 nt, Human
guauaauuaa

SEQ ID NO: 1695172 - RNA, 13 nt, Human
aaaugguuaaaag

SEQ ID NO: 1695173 - RNA, 19 nt, Human
aaaugguuaaaagagguuu

SEQ ID NO: 1695174 - RNA, 11 nt, Human
aaaugguuaaa

SEQ ID NO: 1695175 - RNA, 14 nt, Human
aaauuguaauuaua

SEQ ID NO: 1695176 - RNA, 15 nt, Human
aaauuguaauuauau

SEQ ID NO: 1695177 - RNA, 16 nt, Human
aaccucuuugucuaca

SEQ ID NO: 1695178 - RNA, 14 nt, Human
aacugggcugaaca

SEQ ID NO: 1695179 - RNA, 16 nt, Human
aacugggcugaacacu

SEQ ID NO: 1695180 - RNA, 17 nt, Human
aacugcuuguuuccuag

SEQ ID NO: 1695181 - RNA, 14 nt, Human
gugaacuugaaauu

SEQ ID NO: 1695182 - RNA, 15 nt, Human
gugaacuugaaauuu

SEQ ID NO: 1695183 - RNA, 15 nt, Human
aacuggguuccugca

SEQ ID NO: 1695184 - RNA, 14 nt, Human
aacuggguuccugc

SEQ ID NO: 1695185 - RNA, 19 nt, Human
accugucuugccuuuuuca

SEQ ID NO: 1695186 - RNA, 21 nt, Human
accugucuugccuuuuucauu

SEQ ID NO: 1695187 - RNA, 22 nt, Human
accugucuugccuuuuucauua

SEQ ID NO: 1695188 - RNA, 15 nt, Human
acugauucuucagca

SEQ ID NO: 1695189 - RNA, 22 nt, Human
acugauucuucagcaaaaauau

SEQ ID NO: 1695190 - RNA, 12 nt, Human
acugauucuuca

SEQ ID NO: 1695191 - RNA, 13 nt, Human
acugauucuucag

SEQ ID NO: 1695192 - RNA, 17 nt, Human
aauuggggauucuuaaa

SEQ ID NO: 1695193 - RNA, 20 nt, Human
aauuggggauucuuaaaguu

SEQ ID NO: 1695194 - RNA, 21 nt, Human
aaugguccgugcuaaggacuu

SEQ ID NO: 1695195 - RNA, 16 nt, Human
aauuggggauucuuaa

SEQ ID NO: 1695196 - RNA, 17 nt, Human
aauuuauuggcuuuucu

SEQ ID NO: 1695197 - RNA, 19 nt, Human
aauuuauuggcuuuucuga

SEQ ID NO: 1695198 - RNA, 20 nt, Human
aauuuauuggcuuuucugau

SEQ ID NO: 1695199 - RNA, 21 nt, Human
aauuuauuggcuuuucugauc

SEQ ID NO: 1695200 - RNA, 23 nt, Human
aauuuauuggcuuuucugaucca

SEQ ID NO: 1695201 - RNA, 12 nt, Human
aauuuuggaauu

SEQ ID NO: 1695202 - RNA, 11 nt, Human
aauuuuggaau

SEQ ID NO: 1695203 - RNA, 20 nt, Human
acaauuuuguuucuguacuu

SEQ ID NO: 1695204 - RNA, 14 nt, Human
accaccuuucagau

SEQ ID NO: 1695205 - RNA, 14 nt, Human
aaggcaaaugacuu

SEQ ID NO: 1695206 - RNA, 15 nt, Human
aaggcaaaugacuuu

SEQ ID NO: 1695207 - RNA, 16 nt, Human
aaggcaaaugacuuug

SEQ ID NO: 1695208 - RNA, 20 nt, Human
aaugguccgugcuaaggacu

SEQ ID NO: 1695209 - RNA, 12 nt, Human
aauacuguuuga

SEQ ID NO: 1695210 - RNA, 13 nt, Human
aauauuaaagcca

SEQ ID NO: 1695211 - RNA, 14 nt, Human
aauauuaaagccau

SEQ ID NO: 1695212 - RNA, 15 nt, Human
aauauuaaagccaug

SEQ ID NO: 1695213 - RNA, 16 nt, Human
aauauuaaagccaugu

SEQ ID NO: 1695214 - RNA, 18 nt, Human
aauauuaaagccauguuu

SEQ ID NO: 1695215 - RNA, 19 nt, Human
aauauuaaagccauguuua

SEQ ID NO: 1695216 - RNA, 20 nt, Human
aauauuaaagccauguuuau

SEQ ID NO: 1695217 - RNA, 21 nt, Human
aauaauaaagaucauguaaaa

SEQ ID NO: 1695218 - RNA, 13 nt, Human
aauaauaaagauc

SEQ ID NO: 1695219 - RNA, 20 nt, Human
aaaucugugaacuugaaauu

SEQ ID NO: 1695220 - RNA, 19 nt, Human
aaaucugugaacuugaaau

SEQ ID NO: 1695221 - RNA, 21 nt, Human
aaaucugugaacuugaaauuu

SEQ ID NO: 1695222 - RNA, 23 nt, Human
aaauuggggauucuuaaaguuga

SEQ ID NO: 1695223 - RNA, 18 nt, Human
aaauuggggauucuuaaa

SEQ ID NO: 1695224 - RNA, 19 nt, Human
aaauuggggauucuuaaag

SEQ ID NO: 1695225 - RNA, 20 nt, Human
aaauuggggauucuuaaagu

SEQ ID NO: 1695226 - RNA, 22 nt, Human
aaauuggggauucuuaaaguug

SEQ ID NO: 1695227 - RNA, 11 nt, Human
aaccaguauug

SEQ ID NO: 1695228 - RNA, 13 nt, Human
aaccaguauugua

SEQ ID NO: 1695229 - RNA, 14 nt, Human
aaccaguauuguac

SEQ ID NO: 1695230 - RNA, 13 nt, Human
aacgcguugaaau

SEQ ID NO: 1695231 - RNA, 14 nt, Human
aacgcguugaaauu

SEQ ID NO: 1695232 - RNA, 15 nt, Human
aacgcguugaaauug

SEQ ID NO: 1695233 - RNA, 17 nt, Human
aacgcguugaaauugua

SEQ ID NO: 1695234 - RNA, 15 nt, Human
aacuguuauuuauaa

SEQ ID NO: 1695235 - RNA, 16 nt, Human
aacuguuauuuauaau

SEQ ID NO: 1695236 - RNA, 17 nt, Human
aacuguuauuuauaauc

SEQ ID NO: 1695237 - RNA, 20 nt, Human
aacuguuauuuauaaucacu

SEQ ID NO: 1695238 - RNA, 22 nt, Human
aacuguuauuuauaaucacuuu

SEQ ID NO: 1695239 - RNA, 20 nt, Human
aaaaguuuaauauuaaagcc

SEQ ID NO: 1695240 - RNA, 23 nt, Human
aaaaguuuaauauuaaagccaug

SEQ ID NO: 1695241 - RNA, 21 nt, Human
aaaaguuuaauauuaaagcca

SEQ ID NO: 1695242 - RNA, 22 nt, Human
aaaaguuuaauauuaaagccau

SEQ ID NO: 1695243 - RNA, 16 nt, Human
agaaugaaauacuguu

SEQ ID NO: 1695244 - RNA, 19 nt, Human
agaaugaaauacuguuuga

SEQ ID NO: 1695245 - RNA, 20 nt, Human
agaaugaaauacuguuugag

SEQ ID NO: 1695246 - RNA, 17 nt, Human
agacgaugucuucauac

SEQ ID NO: 1695247 - RNA, 19 nt, Human
agacgaugucuucauaccu

SEQ ID NO: 1695248 - RNA, 16 nt, Human
agccaaaccucuguga

SEQ ID NO: 1695249 - RNA, 14 nt, Human
agcacacacuuuug

SEQ ID NO: 1695250 - RNA, 20 nt, Human
agcacacacuuuugguuaag

SEQ ID NO: 1695251 - RNA, 19 nt, Human
agaucugccuaaggacuuc

SEQ ID NO: 1695252 - RNA, 12 nt, Human
agucuguuuuau

SEQ ID NO: 1695253 - RNA, 20 nt, Human
auauauuuuuauauuuacua

SEQ ID NO: 1695254 - RNA, 18 nt, Human
auauauuuuuauauuuac

SEQ ID NO: 1695255 - RNA, 19 nt, Human
auauauuuuuauauuuacu

SEQ ID NO: 1695256 - RNA, 13 nt, Human
auaucaucaguau

SEQ ID NO: 1695257 - RNA, 17 nt, Human
auaucaucaguauugaa

SEQ ID NO: 1695258 - RNA, 14 nt, Human
aucccauuauucaa

SEQ ID NO: 1695259 - RNA, 15 nt, Human
aucccauuauucaaa

SEQ ID NO: 1695260 - RNA, 20 nt, Human
aucccauuauucaaaguugc

SEQ ID NO: 1695261 - RNA, 15 nt, Human
aucacaguuuugguu

SEQ ID NO: 1695262 - RNA, 22 nt, Human
aucacaguuuugguugcuuuaa

SEQ ID NO: 1695263 - RNA, 21 nt, Human
aucacaguuuugguugcuuua

SEQ ID NO: 1695264 - RNA, 14 nt, Human
augaagucucugaa

SEQ ID NO: 1695265 - RNA, 18 nt, Human
aucucugcaaucuucuca

SEQ ID NO: 1695266 - RNA, 21 nt, Human
aucucugcaaucuucucagaa

SEQ ID NO: 1695267 - RNA, 13 nt, Human
augcuuuaaacau

SEQ ID NO: 1695268 - RNA, 19 nt, Human
auggcuuuguauagaaccu

SEQ ID NO: 1695269 - RNA, 20 nt, Human
augcugaguuugugcuggug

SEQ ID NO: 1695270 - RNA, 15 nt, Human
augguccgugcuaag

SEQ ID NO: 1695271 - RNA, 18 nt, Human
augguccgugcuaaggac

SEQ ID NO: 1695272 - RNA, 23 nt, Human
caacagcuggugcccugcuuuca

SEQ ID NO: 1695273 - RNA, 13 nt, Human
uuaauauuaaagc

SEQ ID NO: 1695274 - RNA, 14 nt, Human
uuaauauuaaagcc

SEQ ID NO: 1695275 - RNA, 16 nt, Human
uuaauauuaaagccau

SEQ ID NO: 1695276 - RNA, 17 nt, Human
uuaauauuaaagccaug

SEQ ID NO: 1695277 - RNA, 11 nt, Human
uuaauauuaaa

SEQ ID NO: 1695278 - RNA, 14 nt, Human
uuaauaauaaauuc

SEQ ID NO: 1695279 - RNA, 23 nt, Human
uuaauaauaaauucccuggccuu

SEQ ID NO: 1695280 - RNA, 12 nt, Human
uuacagaagccc

SEQ ID NO: 1695281 - RNA, 18 nt, Human
uuaauauuaaagccaugu

SEQ ID NO: 1695282 - RNA, 19 nt, Human
uuaauauuaaagccauguu

SEQ ID NO: 1695283 - RNA, 20 nt, Human
uuaauauuaaagccauguuu

SEQ ID NO: 1695284 - RNA, 12 nt, Human
uuaaagccaugu

SEQ ID NO: 1695285 - RNA, 14 nt, Human
uuaaagccauguuu

SEQ ID NO: 1695286 - RNA, 18 nt, Human
uuaaagccauguuuauua

SEQ ID NO: 1695287 - RNA, 20 nt, Human
uuaaagccauguuuauuaca

SEQ ID NO: 1695288 - RNA, 15 nt, Human
uuaaaaaaaaaauug

SEQ ID NO: 1695289 - RNA, 11 nt, Human
uguuucuguac

SEQ ID NO: 1695290 - RNA, 22 nt, Human
uguuucuguacuuuuuggcaua

SEQ ID NO: 1695291 - RNA, 23 nt, Human
uguuucuguacuuuuuggcauaa

SEQ ID NO: 1695292 - RNA, 23 nt, Human
uguuuccuagcacacacuuuugg

SEQ ID NO: 1695293 - RNA, 16 nt, Human
uguuaaaccaugggau

SEQ ID NO: 1695294 - RNA, 21 nt, Human
uguauugugcgcuaaacuuuu

SEQ ID NO: 1695295 - RNA, 14 nt, Human
ugcacggugaaugg

SEQ ID NO: 1695296 - RNA, 18 nt, Human
ugcacggugaauggcuuu

SEQ ID NO: 1695297 - RNA, 19 nt, Human
ugcacggugaauggcuuug

SEQ ID NO: 1695298 - RNA, 12 nt, Human
uggggauucuua

SEQ ID NO: 1695299 - RNA, 13 nt, Human
uggggauucuuaa

SEQ ID NO: 1695300 - RNA, 16 nt, Human
uggggauucuuaaagu

SEQ ID NO: 1695301 - RNA, 18 nt, Human
uggggauucuuaaaguug

SEQ ID NO: 1695302 - RNA, 20 nt, Human
uggggauucuuaaaguugaa

SEQ ID NO: 1695303 - RNA, 14 nt, Human
uggcuuuucugauc

SEQ ID NO: 1695304 - RNA, 17 nt, Human
uggcuuuucugauccag

SEQ ID NO: 1695305 - RNA, 18 nt, Human
uggcuuuucugauccagu

SEQ ID NO: 1695306 - RNA, 19 nt, Human
uggcuuuucugauccaguu

SEQ ID NO: 1695307 - RNA, 13 nt, Human
ugcuuuaauauca

SEQ ID NO: 1695308 - RNA, 15 nt, Human
ugcuuuaauaucauc

SEQ ID NO: 1695309 - RNA, 18 nt, Human
ugcuuuaauaucaucagu

SEQ ID NO: 1695310 - RNA, 20 nt, Human
ugcuuuaauaucaucaguau

SEQ ID NO: 1695311 - RNA, 19 nt, Human
uggaacgcguugaaauugu

SEQ ID NO: 1695312 - RNA, 18 nt, Human
uggaacgcguugaaauug

SEQ ID NO: 1695313 - RNA, 24 nt, Human
ucccuggccuuucauauuuuagcu

SEQ ID NO: 1695314 - RNA, 16 nt, Human
ucccuggccuuucaua

SEQ ID NO: 1695315 - RNA, 18 nt, Human
uccucucaaccaccuuuc

SEQ ID NO: 1695316 - RNA, 20 nt, Human
uccucucaaccaccuuucag

SEQ ID NO: 1695317 - RNA, 21 nt, Human
uccucucaaccaccuuucaga

SEQ ID NO: 1695318 - RNA, 15 nt, Human
ucgcuuuugauaauc

SEQ ID NO: 1695319 - RNA, 13 nt, Human
ucuauauuuucau

SEQ ID NO: 1695320 - RNA, 14 nt, Human
ucuauauuuucauu

SEQ ID NO: 1695321 - RNA, 15 nt, Human
ucuauauuuucauuc

SEQ ID NO: 1695322 - RNA, 16 nt, Human
ucuauauuuucauucu

SEQ ID NO: 1695323 - RNA, 19 nt, Human
ucuauauuuucauucuccu

SEQ ID NO: 1695324 - RNA, 16 nt, Human
ucucagauuuuauuau

SEQ ID NO: 1695325 - RNA, 17 nt, Human
ucucagauuuuauuaug

SEQ ID NO: 1695326 - RNA, 18 nt, Human
ucucagauuuuauuaugu

SEQ ID NO: 1695327 - RNA, 19 nt, Human
ucucagauuuuauuaugua

SEQ ID NO: 1695328 - RNA, 14 nt, Human
ucucagauuuuauu

SEQ ID NO: 1695329 - RNA, 15 nt, Human
ucucagauuuuauua

SEQ ID NO: 1695330 - RNA, 13 nt, Human
ucucagauuuuau

SEQ ID NO: 1695331 - RNA, 16 nt, Human
ucaucaguauugaagc

SEQ ID NO: 1695332 - RNA, 20 nt, Human
ucaucaguauugaagcauuu

SEQ ID NO: 1695333 - RNA, 21 nt, Human
ucaucaguauugaagcauuuu

SEQ ID NO: 1695334 - RNA, 23 nt, Human
ucaucaguauugaagcauuuuau

SEQ ID NO: 1695335 - RNA, 22 nt, Human
ucagauaacuguuauuuauaau

SEQ ID NO: 1695336 - RNA, 14 nt, Human
ucagauacuggauu

SEQ ID NO: 1695337 - RNA, 15 nt, Human
ucagauacuggauug

SEQ ID NO: 1695338 - RNA, 16 nt, Human
ucagauacuggauugu

SEQ ID NO: 1695339 - RNA, 19 nt, Human
ucagauacuggauuguacu

SEQ ID NO: 1695340 - RNA, 20 nt, Human
ucagauacuggauuguacuu

SEQ ID NO: 1695341 - RNA, 23 nt, Human
ucugccuaaggacuucuuuaauu

SEQ ID NO: 1695342 - RNA, 20 nt, Human
ucugccuaaggacuucuuua

SEQ ID NO: 1695343 - RNA, 21 nt, Human
ucugccuaaggacuucuuuaa

SEQ ID NO: 1695344 - RNA, 14 nt, Human
ucugcaaucuucuc

SEQ ID NO: 1695345 - RNA, 17 nt, Human
ucugcaaucuucucaga

SEQ ID NO: 1695346 - RNA, 17 nt, Human
ucuugucucagauuuua

SEQ ID NO: 1695347 - RNA, 14 nt, Human
ucuugucucagauu

SEQ ID NO: 1695348 - RNA, 15 nt, Human
ucuugucucagauuu

SEQ ID NO: 1695349 - RNA, 12 nt, Human
ucuugucucaga

SEQ ID NO: 1695350 - RNA, 14 nt, Human
ucuuguauuaagaa

SEQ ID NO: 1695351 - RNA, 15 nt, Human
ucuuguauuaagaau

SEQ ID NO: 1695352 - RNA, 12 nt, Human
ugacuuuggaua

SEQ ID NO: 1695353 - RNA, 13 nt, Human
ugacuuuggauaa

SEQ ID NO: 1695354 - RNA, 14 nt, Human
ugacuuuggauaau

SEQ ID NO: 1695355 - RNA, 15 nt, Human
ugacuuuggauaaua

SEQ ID NO: 1695356 - RNA, 16 nt, Human
ugacuuuggauaauaa

SEQ ID NO: 1695357 - RNA, 20 nt, Human
ugacuuuggauaauaaggaa

SEQ ID NO: 1695358 - RNA, 22 nt, Human
ugacuuuggauaauaaggaaaa

SEQ ID NO: 1695359 - RNA, 13 nt, Human
ugacaucucugca

SEQ ID NO: 1695360 - RNA, 14 nt, Human
ugacaucucugcaa

SEQ ID NO: 1695361 - RNA, 23 nt, Human
ugacaucucugcaaucuucucag

SEQ ID NO: 1695362 - RNA, 13 nt, Human
ugaacuugaaauu

SEQ ID NO: 1695363 - RNA, 14 nt, Human
ugaacuugaaauuu

SEQ ID NO: 1695364 - RNA, 18 nt, Human
ugaacuugaaauuugaau

SEQ ID NO: 1695365 - RNA, 12 nt, Human
uacaauuuuguu

SEQ ID NO: 1695366 - RNA, 15 nt, Human
uacaauuuuguuucu

SEQ ID NO: 1695367 - RNA, 16 nt, Human
uacaauuuuguuucug

SEQ ID NO: 1695368 - RNA, 17 nt, Human
uacaauuuuguuucugu

SEQ ID NO: 1695369 - RNA, 15 nt, Human
uacaaaguauuaagc

SEQ ID NO: 1695370 - RNA, 16 nt, Human
uacaaaguauuaagca

SEQ ID NO: 1695371 - RNA, 18 nt, Human
uacaaaguauuaagcaua

SEQ ID NO: 1695372 - RNA, 19 nt, Human
uacaaaguauuaagcauau

SEQ ID NO: 1695373 - RNA, 13 nt, Human
uacaaaguauuaa

SEQ ID NO: 1695374 - RNA, 14 nt, Human
uacaaaguauuaag

SEQ ID NO: 1695375 - RNA, 12 nt, Human
uacaaaguauua

SEQ ID NO: 1695376 - RNA, 17 nt, Human
uacuaaaauggacugug

SEQ ID NO: 1695377 - RNA, 15 nt, Human
uacuaaaauggacug

SEQ ID NO: 1695378 - RNA, 23 nt, Human
uacuaaaauggacuguggugacu

SEQ ID NO: 1695379 - RNA, 13 nt, Human
uaccuacauguau

SEQ ID NO: 1695380 - RNA, 23 nt, Human
uaccuacauguauuuguuugcau

SEQ ID NO: 1695381 - RNA, 21 nt, Human
uagacuggugacugauucuuc

SEQ ID NO: 1695382 - RNA, 23 nt, Human
uagacuggugacugauucuucag

SEQ ID NO: 1695383 - RNA, 20 nt, Human
uagacuggugacugauucuu

SEQ ID NO: 1695384 - RNA, 11 nt, Human
uagaauucugu

SEQ ID NO: 1695385 - RNA, 13 nt, Human
uagaauucuguau

SEQ ID NO: 1695386 - RNA, 14 nt, Human
uagaauucuguaua

SEQ ID NO: 1695387 - RNA, 15 nt, Human
uagaauucuguauag

SEQ ID NO: 1695388 - RNA, 16 nt, Human
uagaauucuguauaga

SEQ ID NO: 1695389 - RNA, 21 nt, Human
uagaauucuguauagauuaga

SEQ ID NO: 1695390 - RNA, 20 nt, Human
uagauuagagaguguugaaa

SEQ ID NO: 1695391 - RNA, 16 nt, Human
uagauuagaauucugu

SEQ ID NO: 1695392 - RNA, 17 nt, Human
uagauuagaauucugua

SEQ ID NO: 1695393 - RNA, 19 nt, Human
uagauuagaauucuguaua

SEQ ID NO: 1695394 - RNA, 20 nt, Human
uagauuagaauucuguauag

SEQ ID NO: 1695395 - RNA, 14 nt, Human
uagauuagaauucu

SEQ ID NO: 1695396 - RNA, 15 nt, Human
uagauuagaauucug

SEQ ID NO: 1695397 - RNA, 16 nt, Human
uauauuuucauucucc

SEQ ID NO: 1695398 - RNA, 14 nt, Human
uaucaucaguauug

SEQ ID NO: 1695399 - RNA, 15 nt, Human
uaucaucaguauuga

SEQ ID NO: 1695400 - RNA, 16 nt, Human
uaucaucaguauugaa

SEQ ID NO: 1695401 - RNA, 20 nt, Human
uauagaaccucuuugucuac

SEQ ID NO: 1695402 - RNA, 21 nt, Human
uauagaaccucuuugucuaca

SEQ ID NO: 1695403 - RNA, 23 nt, Human
uauaucugaggaauucuguauag

SEQ ID NO: 1695404 - RNA, 17 nt, Human
uaauauuaaagccaugu

SEQ ID NO: 1695405 - RNA, 20 nt, Human
uaauauuaaagccauguuua

SEQ ID NO: 1695406 - RNA, 21 nt, Human
uaauauuaaagccauguuuau

SEQ ID NO: 1695407 - RNA, 15 nt, Human
uaauauuaaagccau

SEQ ID NO: 1695408 - RNA, 16 nt, Human
uaauauuaaagccaug

SEQ ID NO: 1695409 - RNA, 23 nt, Human
uaauaucaucaguauugaagcau

SEQ ID NO: 1695410 - RNA, 21 nt, Human
uaauuaacauguuaaaccaug

SEQ ID NO: 1695411 - RNA, 20 nt, Human
uaaggauuuuaugcuuuaaa

SEQ ID NO: 1695412 - RNA, 22 nt, Human
uaaggauuuuaugcuuuaaaca

SEQ ID NO: 1695413 - RNA, 12 nt, Human
uaaggauuuuau

SEQ ID NO: 1695414 - RNA, 13 nt, Human
uaaggauuuuaug

SEQ ID NO: 1695415 - RNA, 17 nt, Human
uaaggauuuuaugcuuu

SEQ ID NO: 1695416 - RNA, 19 nt, Human
uaaggauuuuaugcuuuaa

SEQ ID NO: 1695417 - RNA, 13 nt, Human
uaagucuguuuua

SEQ ID NO: 1695418 - RNA, 16 nt, Human
uaagucuguuuuauga

SEQ ID NO: 1695419 - RNA, 19 nt, Human
uaagucuguuuuaugacuu

SEQ ID NO: 1695420 - RNA, 20 nt, Human
uaagucuguuuuaugacuuc

SEQ ID NO: 1695421 - RNA, 21 nt, Human
uaagucuguuuuaugacuuca

SEQ ID NO: 1695422 - RNA, 16 nt, Human
uaauaaggaaaaguuu

SEQ ID NO: 1695423 - RNA, 16 nt, Human
uaacuguuauuuauaa

SEQ ID NO: 1695424 - RNA, 17 nt, Human
uaacuguuauuuauaau

SEQ ID NO: 1695425 - RNA, 16 nt, Human
uaaaugccaucaauaa

SEQ ID NO: 1695426 - RNA, 23 nt, Human
uaaaugccaucaauaaaaaauua

SEQ ID NO: 1695427 - RNA, 14 nt, Human
uaaaugguuaaaag

SEQ ID NO: 1695428 - RNA, 19 nt, Human
uaaacauugguucuuguau

SEQ ID NO: 1695429 - RNA, 21 nt, Human
uaaacauugguucuuguauua

SEQ ID NO: 1695430 - RNA, 11 nt, Human
uaaagccaugu

SEQ ID NO: 1695431 - RNA, 13 nt, Human
uaaagccauguuu

SEQ ID NO: 1695432 - RNA, 15 nt, Human
uaaagccauguuuau

SEQ ID NO: 1695433 - RNA, 20 nt, Human
uaaagccauguuuauuacag

SEQ ID NO: 1695434 - RNA, 19 nt, Human
uaaaagagguuuuucuuaa

SEQ ID NO: 1695435 - RNA, 21 nt, Human
uaaaagagguuuuucuuaaau

SEQ ID NO: 1695436 - RNA, 18 nt, Human
uaaaagagguuuuucuua

SEQ ID NO: 1695437 - RNA, 16 nt, Human
guuuugguugcuuuaa

SEQ ID NO: 1695438 - RNA, 18 nt, Human
guuguuugagaaauuaag

SEQ ID NO: 1695439 - RNA, 21 nt, Human
guugaaacggaugauuucuau

SEQ ID NO: 1695440 - RNA, 22 nt, Human
guugaaacggaugauuucuaug

SEQ ID NO: 1695441 - RNA, 16 nt, Human
guugaaauuguaauua

SEQ ID NO: 1695442 - RNA, 20 nt, Human
guugaaauuguaauuauauc

SEQ ID NO: 1695443 - RNA, 15 nt, Human
guugaaauuguaauu

SEQ ID NO: 1695444 - RNA, 14 nt, Human
guugaauuuauugg

SEQ ID NO: 1695445 - RNA, 21 nt, Human
guugaauuuauuggcuuuucu

SEQ ID NO: 1695446 - RNA, 22 nt, Human
guugaauuuauuggcuuuucug

SEQ ID NO: 1695447 - RNA, 15 nt, Human
guuccugcaaugaag

SEQ ID NO: 1695448 - RNA, 22 nt, Human
guucauggaacgcguugaaauu

SEQ ID NO: 1695449 - RNA, 23 nt, Human
guucauggaacgcguugaaauug

SEQ ID NO: 1695450 - RNA, 19 nt, Human
guucacucuccauuuaaua

SEQ ID NO: 1695451 - RNA, 19 nt, Human
guuaucugaagucagaucu

SEQ ID NO: 1695452 - RNA, 10 nt, Human
guuauauaaa

SEQ ID NO: 1695453 - RNA, 12 nt, Human
guuauauaaaug

SEQ ID NO: 1695454 - RNA, 13 nt, Human
guuauauaaaugg

SEQ ID NO: 1695455 - RNA, 13 nt, Human
guuacagaagccc

SEQ ID NO: 1695456 - RNA, 21 nt, Human
guuaaaccaugggauaaaugc

SEQ ID NO: 1695457 - RNA, 18 nt, Human
guuaaaccaugggauaaa

SEQ ID NO: 1695458 - RNA, 20 nt, Human
guuaaaagagguuuuucuua

SEQ ID NO: 1695459 - RNA, 21 nt, Human
guuaaaagagguuuuucuuaa

SEQ ID NO: 1695460 - RNA, 14 nt, Human
guuaaaagagguuu

SEQ ID NO: 1695461 - RNA, 13 nt, Human
guggugacuuugg

SEQ ID NO: 1695462 - RNA, 15 nt, Human
guggugacuuuggau

SEQ ID NO: 1695463 - RNA, 16 nt, Human
guggugacuuuggaua

SEQ ID NO: 1695464 - RNA, 13 nt, Human
gugcuaaggacuu

SEQ ID NO: 1695465 - RNA, 14 nt, Human
gugcuaaggacuug

SEQ ID NO: 1695466 - RNA, 20 nt, Human
gugcuaaggacuuguuagau

SEQ ID NO: 1695467 - RNA, 12 nt, Human
gugcuaaggacu

SEQ ID NO: 1695468 - RNA, 21 nt, Human
gugcgcuaaacuuuucugaua

SEQ ID NO: 1695469 - RNA, 17 nt, Human
gugcgcuaaacuuuucu

SEQ ID NO: 1695470 - RNA, 15 nt, Human
gucuugucucagauu

SEQ ID NO: 1695471 - RNA, 20 nt, Human
gucuugucucagauuuuauu

SEQ ID NO: 1695472 - RNA, 22 nt, Human
gucuugucucagauuuuauuau

SEQ ID NO: 1695473 - RNA, 15 nt, Human
gucuugccuuuuuca

SEQ ID NO: 1695474 - RNA, 16 nt, Human
gucuugccuuuuucau

SEQ ID NO: 1695475 - RNA, 17 nt, Human
gucuugccuuuuucauu

SEQ ID NO: 1695476 - RNA, 18 nt, Human
gucuugccuuuuucauua

SEQ ID NO: 1695477 - RNA, 20 nt, Human
gucuugccuuuuucauuauu

SEQ ID NO: 1695478 - RNA, 13 nt, Human
gucuguuuuauga

SEQ ID NO: 1695479 - RNA, 15 nt, Human
gucuguuuuaugacu

SEQ ID NO: 1695480 - RNA, 17 nt, Human
gucucagauuuuauuau

SEQ ID NO: 1695481 - RNA, 21 nt, Human
gucucagauuuuauuauguaa

SEQ ID NO: 1695482 - RNA, 15 nt, Human
gucucagauuuuauu

SEQ ID NO: 1695483 - RNA, 16 nt, Human
gucucagauuuuauua

SEQ ID NO: 1695484 - RNA, 14 nt, Human
gucucagauuuuau

SEQ ID NO: 1695485 - RNA, 15 nt, Human
gucucugaagugaaa

SEQ ID NO: 1695486 - RNA, 21 nt, Human
gucucugaagugaaacugcuu

SEQ ID NO: 1695487 - RNA, 16 nt, Human
gucagaucugccuaag

SEQ ID NO: 1695488 - RNA, 18 nt, Human
gucagaucugccuaagga

SEQ ID NO: 1695489 - RNA, 19 nt, Human
gucagaucugccuaaggac

SEQ ID NO: 1695490 - RNA, 20 nt, Human
gucagaucugccuaaggacu

SEQ ID NO: 1695491 - RNA, 21 nt, Human
gucagaucugccuaaggacuu

SEQ ID NO: 1695492 - RNA, 16 nt, Human
guauuaagcauauauu

SEQ ID NO: 1695493 - RNA, 17 nt, Human
guauuaagcauauauuu

SEQ ID NO: 1695494 - RNA, 15 nt, Human
guauuaagcauauau

SEQ ID NO: 1695495 - RNA, 16 nt, Human
guauuaagaaugaaau

SEQ ID NO: 1695496 - RNA, 18 nt, Human
guauuaagcauauauuuu

SEQ ID NO: 1695497 - RNA, 21 nt, Human
guauuaagcauauauuuuuau

SEQ ID NO: 1695498 - RNA, 19 nt, Human
guauagaaccucuuugucu

SEQ ID NO: 1695499 - RNA, 14 nt, Human
guauagauuagaau

SEQ ID NO: 1695500 - RNA, 21 nt, Human
guaugugugaagugagugagu

SEQ ID NO: 1695501 - RNA, 15 nt, Human
guauaauuaacaugu

SEQ ID NO: 1695502 - RNA, 17 nt, Human
guauaauuaacauguua

SEQ ID NO: 1695503 - RNA, 19 nt, Human
guauaauuaacauguuaaa

SEQ ID NO: 1695504 - RNA, 22 nt, Human
guauaauuaacauguuaaacca

SEQ ID NO: 1695505 - RNA, 23 nt, Human
guauaauuaacauguuaaaccau

SEQ ID NO: 1695506 - RNA, 13 nt, Human
guauaauuaacau

SEQ ID NO: 1695507 - RNA, 14 nt, Human
guauaauuaacaug

SEQ ID NO: 1695508 - RNA, 22 nt, Human
uuuggaauuuuccuccuuucuc

SEQ ID NO: 1695509 - RNA, 16 nt, Human
uuuggauaauaaggaa

SEQ ID NO: 1695510 - RNA, 18 nt, Human
uuuuuaagccuuaaagga

SEQ ID NO: 1695511 - RNA, 21 nt, Human
uuuuggcauaacauaaaucug

SEQ ID NO: 1695512 - RNA, 16 nt, Human
uuuugguugcuuuaau

SEQ ID NO: 1695513 - RNA, 15 nt, Human
uuuugguugcuuuaa

SEQ ID NO: 1695514 - RNA, 22 nt, Human
gccuaaauccauuuggaaaucu

SEQ ID NO: 1695515 - RNA, 23 nt, Human
gccuaaauccauuuggaaaucuu

SEQ ID NO: 1695516 - RNA, 12 nt, Human
gccuaaauccau

SEQ ID NO: 1695517 - RNA, 13 nt, Human
gccuaaauccauu

SEQ ID NO: 1695518 - RNA, 19 nt, Human
gccuaaauccauuuggaaa

SEQ ID NO: 1695519 - RNA, 21 nt, Human
gccuaaauccauuuggaaauc

SEQ ID NO: 1695520 - RNA, 14 nt, Human
gcccugcuuucaga

SEQ ID NO: 1695521 - RNA, 16 nt, Human
gcccugcuuucagaua

SEQ ID NO: 1695522 - RNA, 13 nt, Human
gcuaaacuuuucu

SEQ ID NO: 1695523 - RNA, 15 nt, Human
gcuaaacuuuucuga

SEQ ID NO: 1695524 - RNA, 17 nt, Human
gcuaaacuuuucugaua

SEQ ID NO: 1695525 - RNA, 23 nt, Human
gccuuuuucauuauuuuauuaug

SEQ ID NO: 1695526 - RNA, 13 nt, Human
gauuuuauuaugu

SEQ ID NO: 1695527 - RNA, 15 nt, Human
gauuuuauuauguaa

SEQ ID NO: 1695528 - RNA, 18 nt, Human
gauuuuauuauguaaauc

SEQ ID NO: 1695529 - RNA, 19 nt, Human
gauuuuauuauguaaaucc

SEQ ID NO: 1695530 - RNA, 20 nt, Human
gauuuuauuauguaaauccc

SEQ ID NO: 1695531 - RNA, 23 nt, Human
gauuuuauuauguaaaucccauu

SEQ ID NO: 1695532 - RNA, 14 nt, Human
gauuuuaugcuuua

SEQ ID NO: 1695533 - RNA, 19 nt, Human
gauuuuaugcuuuaaacau

SEQ ID NO: 1695534 - RNA, 20 nt, Human
gaugccaaguuguuugagaa

SEQ ID NO: 1695535 - RNA, 18 nt, Human
gcacggugaauggcuuug

SEQ ID NO: 1695536 - RNA, 18 nt, Human
gcagauuauucacugauu

SEQ ID NO: 1695537 - RNA, 16 nt, Human
gacauagucuggcugu

SEQ ID NO: 1695538 - RNA, 13 nt, Human
gaccaaaaaccag

SEQ ID NO: 1695539 - RNA, 19 nt, Human
gaccaaaaaccaguauugu

SEQ ID NO: 1695540 - RNA, 20 nt, Human
gaccaaaaaccaguauugua

SEQ ID NO: 1695541 - RNA, 12 nt, Human
gacuuguuagau

SEQ ID NO: 1695542 - RNA, 18 nt, Human
gaggaagccugauuaaag

SEQ ID NO: 1695543 - RNA, 19 nt, Human
gaggaagccugauuaaaga

SEQ ID NO: 1695544 - RNA, 16 nt, Human
gaaauuugaauuuugu

SEQ ID NO: 1695545 - RNA, 24 nt, Human
gaaauuugaauuuuguguuagaga

SEQ ID NO: 1695546 - RNA, 13 nt, Human
gaaauuugaauuu

SEQ ID NO: 1695547 - RNA, 16 nt, Human
gaaacggaugauuucu

SEQ ID NO: 1695548 - RNA, 18 nt, Human
gaagccaaaccucuguga

SEQ ID NO: 1695549 - RNA, 15 nt, Human
gaagcauuuuauaaa

SEQ ID NO: 1695550 - RNA, 17 nt, Human
gaagcauuuuauaaauc

SEQ ID NO: 1695551 - RNA, 13 nt, Human
gaagcauuuuaua

SEQ ID NO: 1695552 - RNA, 22 nt, Human
gaagucagaucugccuaaggac

SEQ ID NO: 1695553 - RNA, 23 nt, Human
gaagucagaucugccuaaggacu

SEQ ID NO: 1695554 - RNA, 14 nt, Human
gaagucagaucugc

SEQ ID NO: 1695555 - RNA, 12 nt, Human
gaacuugaaauu

SEQ ID NO: 1695556 - RNA, 13 nt, Human
gaacuugaaauuu

SEQ ID NO: 1695557 - RNA, 15 nt, Human
gaacuugaaauuuga

SEQ ID NO: 1695558 - RNA, 22 nt, Human
gaacuugaaauuugaauuuugu

SEQ ID NO: 1695559 - RNA, 14 nt, Human
cuuguauuaagaau

SEQ ID NO: 1695560 - RNA, 15 nt, Human
cuuguauuaagaaug

SEQ ID NO: 1695561 - RNA, 19 nt, Human
cuugaaauuugaauuuugu

SEQ ID NO: 1695562 - RNA, 20 nt, Human
cuugaaauuugaauuuugug

SEQ ID NO: 1695563 - RNA, 23 nt, Human
cuuuugauaaucaacugggcuga

SEQ ID NO: 1695564 - RNA, 22 nt, Human
cuuuugauaaucaacugggcug

SEQ ID NO: 1695565 - RNA, 12 nt, Human
cugcuuucagau

SEQ ID NO: 1695566 - RNA, 15 nt, Human
cugcuuucagauacu

SEQ ID NO: 1695567 - RNA, 16 nt, Human
cugcuuucagauacug

SEQ ID NO: 1695568 - RNA, 14 nt, Human
cugcuuguuuccua

SEQ ID NO: 1695569 - RNA, 13 nt, Human
cugcuuguuuccu

SEQ ID NO: 1695570 - RNA, 14 nt, Human
cuggccuuucauau

SEQ ID NO: 1695571 - RNA, 15 nt, Human
cuguauagauuagag

SEQ ID NO: 1695572 - RNA, 20 nt, Human
cuguauagauuagaauucug

SEQ ID NO: 1695573 - RNA, 16 nt, Human
cuguauagauuagaga

SEQ ID NO: 1695574 - RNA, 18 nt, Human
cugaacacuccaauuaag

SEQ ID NO: 1695575 - RNA, 23 nt, Human
cugaacacuccaauuaaggauuu

SEQ ID NO: 1695576 - RNA, 22 nt, Human
cucugugagcaucacaguuuug

SEQ ID NO: 1695577 - RNA, 18 nt, Human
cucugugagcaucacagu

SEQ ID NO: 1695578 - RNA, 21 nt, Human
cucugugagcaucacaguuuu

SEQ ID NO: 1695579 - RNA, 14 nt, Human
cugacaucucugca

SEQ ID NO: 1695580 - RNA, 15 nt, Human
cugacaucucugcaa

SEQ ID NO: 1695581 - RNA, 16 nt, Human
cugacaucucugcaau

SEQ ID NO: 1695582 - RNA, 19 nt, Human
cucccuauuuuuuuucugu

SEQ ID NO: 1695583 - RNA, 20 nt, Human
cucccuauuuuuuuucuguu

SEQ ID NO: 1695584 - RNA, 21 nt, Human
cucccuauuuuuuuucuguua

SEQ ID NO: 1695585 - RNA, 17 nt, Human
cucccuauuuuuuuucu

SEQ ID NO: 1695586 - RNA, 18 nt, Human
cggugaauggcuuuguau

SEQ ID NO: 1695587 - RNA, 20 nt, Human
cggugaauggcuuuguauag

SEQ ID NO: 1695588 - RNA, 22 nt, Human
cggugaauggcuuuguauagaa

SEQ ID NO: 1695589 - RNA, 13 nt, Human
cggugaauggcuu

SEQ ID NO: 1695590 - RNA, 14 nt, Human
cggugaauggcuuu

SEQ ID NO: 1695591 - RNA, 15 nt, Human
cggugaauggcuuug

SEQ ID NO: 1695592 - RNA, 16 nt, Human
cggugaauggcuuugu

SEQ ID NO: 1695593 - RNA, 23 nt, Human
cguugaaauuguaauuauaucug

SEQ ID NO: 1695594 - RNA, 18 nt, Human
cguugaaauuguaauuau

SEQ ID NO: 1695595 - RNA, 16 nt, Human
cgugcuaaggacuugu

SEQ ID NO: 1695596 - RNA, 12 nt, Human
cgugcuaaggac

SEQ ID NO: 1695597 - RNA, 13 nt, Human
cgugcuaaggacu

SEQ ID NO: 1695598 - RNA, 14 nt, Human
cgugcuaaggacuu

SEQ ID NO: 1695599 - RNA, 15 nt, Human
cgugcuaaggacuug

SEQ ID NO: 1695600 - RNA, 17 nt, Human
cuaaauccauuuggaaa

SEQ ID NO: 1695601 - RNA, 19 nt, Human
cuaaauccauuuggaaauc

SEQ ID NO: 1695602 - RNA, 20 nt, Human
cuaaauccauuuggaaaucu

SEQ ID NO: 1695603 - RNA, 16 nt, Human
cuaaauccauuuggaa

SEQ ID NO: 1695604 - RNA, 12 nt, Human
cuaguucacucu

SEQ ID NO: 1695605 - RNA, 18 nt, Human
cuauauaugugaugaucu

SEQ ID NO: 1695606 - RNA, 23 nt, Human
cuauauaugugaugaucuaccag

SEQ ID NO: 1695607 - RNA, 16 nt, Human
cuaaggacuuguuaga

SEQ ID NO: 1695608 - RNA, 17 nt, Human
cuaaggacuuguuagau

SEQ ID NO: 1695609 - RNA, 11 nt, Human
cuaaggacuug

SEQ ID NO: 1695610 - RNA, 22 nt, Human
ccuacauguauuuguuugcaua

SEQ ID NO: 1695611 - RNA, 20 nt, Human
ccuaaauccauuuggaaauc

SEQ ID NO: 1695612 - RNA, 21 nt, Human
ccuaaauccauuuggaaaucu

SEQ ID NO: 1695613 - RNA, 19 nt, Human
ccuaaauccauuuggaaau

SEQ ID NO: 1695614 - RNA, 23 nt, Human
cccggaagccaaaccucugugag

SEQ ID NO: 1695615 - RNA, 12 nt, Human
cccauuauucaa

SEQ ID NO: 1695616 - RNA, 17 nt, Human
cccagacgaugucuuca

SEQ ID NO: 1695617 - RNA, 15 nt, Human
cccagacgaugucuu

SEQ ID NO: 1695618 - RNA, 12 nt, Human
cauuauuuuauu

SEQ ID NO: 1695619 - RNA, 14 nt, Human
cauuauuuuauuau

SEQ ID NO: 1695620 - RNA, 16 nt, Human
cauuauuuuauuauga

SEQ ID NO: 1695621 - RNA, 17 nt, Human
ccaaaccucugugagca

SEQ ID NO: 1695622 - RNA, 12 nt, Human
cauguuuauuac

SEQ ID NO: 1695623 - RNA, 13 nt, Human
cauguuuauuaca

SEQ ID NO: 1695624 - RNA, 18 nt, Human
cauguuuauuacaguaua

SEQ ID NO: 1695625 - RNA, 19 nt, Human
cauguuuauuacaguauaa

SEQ ID NO: 1695626 - RNA, 20 nt, Human
cauguuuauuacaguauaau

SEQ ID NO: 1695627 - RNA, 22 nt, Human
cauguuuauuacaguauaauua

SEQ ID NO: 1695628 - RNA, 11 nt, Human
cauuauuuuau

SEQ ID NO: 1695629 - RNA, 18 nt, Human
cauggaacgcguugaaau

SEQ ID NO: 1695630 - RNA, 19 nt, Human
cauggaacgcguugaaauu

SEQ ID NO: 1695631 - RNA, 20 nt, Human
cauggaacgcguugaaauug

SEQ ID NO: 1695632 - RNA, 23 nt, Human
cauggaacgcguugaaauuguaa

SEQ ID NO: 1695633 - RNA, 15 nt, Human
cauaccuacauguau

SEQ ID NO: 1695634 - RNA, 21 nt, Human
caguuuuguuuggaccaaaaa

SEQ ID NO: 1695635 - RNA, 18 nt, Human
caguuuugguugcuuuaa

SEQ ID NO: 1695636 - RNA, 19 nt, Human
caguuuugguugcuuuaau

SEQ ID NO: 1695637 - RNA, 17 nt, Human
caguuuugguugcuuua

SEQ ID NO: 1695638 - RNA, 16 nt, Human
cauaaaucugugaacu

SEQ ID NO: 1695639 - RNA, 18 nt, Human
cauaaaucugugaacuug

SEQ ID NO: 1695640 - RNA, 22 nt, Human
cauaaaucugugaacuugaaau

SEQ ID NO: 1695641 - RNA, 23 nt, Human
cauaaaucugugaacuugaaauu

SEQ ID NO: 1695642 - RNA, 14 nt, Human
cauaaaucugugaa

SEQ ID NO: 1695643 - RNA, 12 nt, Human
cauaacauaaau

SEQ ID NO: 1695644 - RNA, 19 nt, Human
cauaacauaaaucugugaa

SEQ ID NO: 1695645 - RNA, 21 nt, Human
cauaacauaaaucugugaacu

SEQ ID NO: 1695646 - RNA, 17 nt, Human
cauaaggaaacuggguu

SEQ ID NO: 1695647 - RNA, 13 nt, Human
caucacaguuuug

SEQ ID NO: 1695648 - RNA, 21 nt, Human
caucacaguuuugguugcuuu

SEQ ID NO: 1695649 - RNA, 22 nt, Human
caucacaguuuugguugcuuua

SEQ ID NO: 1695650 - RNA, 13 nt, Human
cauauuuuagcua

SEQ ID NO: 1695651 - RNA, 18 nt, Human
cugaggaauucuguauag

SEQ ID NO: 1695652 - RNA, 19 nt, Human
cugaggaauucuguauaga

SEQ ID NO: 1695653 - RNA, 15 nt, Human
cugaggaauucugua

SEQ ID NO: 1695654 - RNA, 16 nt, Human
cugaggaauucuguau

SEQ ID NO: 1695655 - RNA, 13 nt, Human
cuccuuucucuuu

SEQ ID NO: 1695656 - RNA, 16 nt, Human
cuaaacuuuucugaua

SEQ ID NO: 1695657 - RNA, 14 nt, Human
cuacuauauaugug

SEQ ID NO: 1695658 - RNA, 20 nt, Human
cucagaaggcaaaugacuuu

SEQ ID NO: 1695659 - RNA, 13 nt, Human
caaguuguuugag

SEQ ID NO: 1695660 - RNA, 17 nt, Human
caaguuguuugagaaau

SEQ ID NO: 1695661 - RNA, 21 nt, Human
caaguuguuugagaaauuaag

SEQ ID NO: 1695662 - RNA, 23 nt, Human
caaguuguuugagaaauuaagua

SEQ ID NO: 1695663 - RNA, 21 nt, Human
caccuuucagauaacuguuau

SEQ ID NO: 1695664 - RNA, 22 nt, Human
caccuuucagauaacuguuauu

SEQ ID NO: 1695665 - RNA, 18 nt, Human
auuuuuuuguuguuuguu

SEQ ID NO: 1695666 - RNA, 13 nt, Human
auuuuuuuguugu

SEQ ID NO: 1695667 - RNA, 15 nt, Human
auuuuuauauuuacu

SEQ ID NO: 1695668 - RNA, 16 nt, Human
auuuuuauauuuacua

SEQ ID NO: 1695669 - RNA, 18 nt, Human
auuuuagcuacuauauau

SEQ ID NO: 1695670 - RNA, 18 nt, Human
auuuuaugcuuuaaacau

SEQ ID NO: 1695671 - RNA, 19 nt, Human
auuuuaugcuuuaaacauu

SEQ ID NO: 1695672 - RNA, 12 nt, Human
auuauguaaauc

SEQ ID NO: 1695673 - RNA, 15 nt, Human
auuuauaaucacuuu

SEQ ID NO: 1695674 - RNA, 13 nt, Human
auuuauaaucacu

SEQ ID NO: 1695675 - RNA, 22 nt, Human
auuuauaaucacuuuuuuccac

SEQ ID NO: 1695676 - RNA, 19 nt, Human
auuucuauauuuucauucu

SEQ ID NO: 1695677 - RNA, 19 nt, Human
auuucuaugcugaguuugu

SEQ ID NO: 1695678 - RNA, 21 nt, Human
auuucuaugcugaguuugugc

SEQ ID NO: 1695679 - RNA, 22 nt, Human
auuucuaugcugaguuugugcu

SEQ ID NO: 1695680 - RNA, 17 nt, Human
auuucuauauuuucauu

SEQ ID NO: 1695681 - RNA, 18 nt, Human
auuucuauauuuucauuc

SEQ ID NO: 1695682 - RNA, 15 nt, Human
auuucuauauuuuca

SEQ ID NO: 1695683 - RNA, 16 nt, Human
auuucuauauuuucau

SEQ ID NO: 1695684 - RNA, 16 nt, Human
auuguaauuauaucug

SEQ ID NO: 1695685 - RNA, 17 nt, Human
auuguaauuauaucuga

SEQ ID NO: 1695686 - RNA, 15 nt, Human
auuguaauuauaucu

SEQ ID NO: 1695687 - RNA, 21 nt, Human
auuguaauuauaucugaggaa

SEQ ID NO: 1695688 - RNA, 16 nt, Human
auuguacaaaguauua

SEQ ID NO: 1695689 - RNA, 17 nt, Human
auuguacaaaguauuaa

SEQ ID NO: 1695690 - RNA, 19 nt, Human
auuguacaaaguauuaagc

SEQ ID NO: 1695691 - RNA, 16 nt, Human
caguauuguacaaagu

SEQ ID NO: 1695692 - RNA, 17 nt, Human
caguauuguacaaagua

SEQ ID NO: 1695693 - RNA, 18 nt, Human
caguauuguacaaaguau

SEQ ID NO: 1695694 - RNA, 19 nt, Human
caguauuguacaaaguauu

SEQ ID NO: 1695695 - RNA, 12 nt, Human
caguauuguaca

SEQ ID NO: 1695696 - RNA, 13 nt, Human
caguauuguacaa

SEQ ID NO: 1695697 - RNA, 21 nt, Human
caguauuguacaaaguauuaa

SEQ ID NO: 1695698 - RNA, 18 nt, Human
cauugguucuuguauuaa

SEQ ID NO: 1695699 - RNA, 22 nt, Human
cauugguucuuguauuaagaau

SEQ ID NO: 1695700 - RNA, 22 nt, Human
cuuaaaguugaauuuauuggcu

SEQ ID NO: 1695701 - RNA, 13 nt, Human
cuuaaauaauaaa

SEQ ID NO: 1695702 - RNA, 22 nt, Human
cuuaaauaauaaagaucaugua

SEQ ID NO: 1695703 - RNA, 14 nt, Human
cuuaaaguugaauu

SEQ ID NO: 1695704 - RNA, 15 nt, Human
cuuaaaguugaauuu

SEQ ID NO: 1695705 - RNA, 18 nt, Human
cuuaaaguugaauuuauu

SEQ ID NO: 1695706 - RNA, 14 nt, Human
cuguuauuuauaau

SEQ ID NO: 1695707 - RNA, 20 nt, Human
cuguuauuuauaaucacuuu

SEQ ID NO: 1695708 - RNA, 18 nt, Human
gaacacuccaauuaagga

SEQ ID NO: 1695709 - RNA, 20 nt, Human
gaacacuccaauuaaggauu

SEQ ID NO: 1695710 - RNA, 12 nt, Human
gaaaucuuuaaa

SEQ ID NO: 1695711 - RNA, 15 nt, Human
gaaaucuuuaaaaaa

SEQ ID NO: 1695712 - RNA, 21 nt, Human
gaaacugcuuguuuccuagca

SEQ ID NO: 1695713 - RNA, 17 nt, Human
gaaacuggguuccugca

SEQ ID NO: 1695714 - RNA, 14 nt, Human
cuugucucagauuu

SEQ ID NO: 1695715 - RNA, 17 nt, Human
cuugucucagauuuuau

SEQ ID NO: 1695716 - RNA, 13 nt, Human
cuugucucagauu

SEQ ID NO: 1695717 - RNA, 18 nt, Human
cuugucucagauuuuauu

SEQ ID NO: 1695718 - RNA, 14 nt, Human
cuuucagauacugg

SEQ ID NO: 1695719 - RNA, 15 nt, Human
cuuucagauacugga

SEQ ID NO: 1695720 - RNA, 17 nt, Human
cuuucagauacuggauu

SEQ ID NO: 1695721 - RNA, 22 nt, Human
cuuucagauacuggauuguacu

SEQ ID NO: 1695722 - RNA, 13 nt, Human
gcauaacauaaau

SEQ ID NO: 1695723 - RNA, 15 nt, Human
gcauaacauaaaucu

SEQ ID NO: 1695724 - RNA, 17 nt, Human
gcaaaaauauuuuauga

SEQ ID NO: 1695725 - RNA, 22 nt, Human
gcaaaaauauuuuaugauccag

SEQ ID NO: 1695726 - RNA, 23 nt, Human
gcaaaaauauuuuaugauccagc

SEQ ID NO: 1695727 - RNA, 16 nt, Human
gcaaaaauauuuuaug

SEQ ID NO: 1695728 - RNA, 21 nt, Human
gauucuuaaaguugaauuuau

SEQ ID NO: 1695729 - RNA, 16 nt, Human
gauucuuaaaguugaa

SEQ ID NO: 1695730 - RNA, 17 nt, Human
gauucuuaaaguugaau

SEQ ID NO: 1695731 - RNA, 15 nt, Human
gauucuuaaaguuga

SEQ ID NO: 1695732 - RNA, 14 nt, Human
gaugucuucauacc

SEQ ID NO: 1695733 - RNA, 18 nt, Human
gaugucuucauaccuaca

SEQ ID NO: 1695734 - RNA, 19 nt, Human
gacuuuggauaauaaggaa

SEQ ID NO: 1695735 - RNA, 13 nt, Human
aaaguauuaagca

SEQ ID NO: 1695736 - RNA, 18 nt, Human
aaaguauuaagcauauau

SEQ ID NO: 1695737 - RNA, 19 nt, Human
aaaguauuaagcauauauu

SEQ ID NO: 1695738 - RNA, 20 nt, Human
aaaguauuaagcauauauuu

SEQ ID NO: 1695739 - RNA, 13 nt, Human
aaaguugccuaaa

SEQ ID NO: 1695740 - RNA, 14 nt, Human
aaaguugccuaaau

SEQ ID NO: 1695741 - RNA, 12 nt, Human
aaaguuuaauau

SEQ ID NO: 1695742 - RNA, 14 nt, Human
aaaguuuaauauua

SEQ ID NO: 1695743 - RNA, 16 nt, Human
aaaguugccuaaaucc

SEQ ID NO: 1695744 - RNA, 17 nt, Human
aaaguugccuaaaucca

SEQ ID NO: 1695745 - RNA, 23 nt, Human
aaaguugccuaaauccauuugga

SEQ ID NO: 1695746 - RNA, 13 nt, Human
aaauacaauuuug

SEQ ID NO: 1695747 - RNA, 14 nt, Human
aaauacaauuuugu

SEQ ID NO: 1695748 - RNA, 17 nt, Human
aaauacaauuuuguuuc

SEQ ID NO: 1695749 - RNA, 18 nt, Human
aaauacaauuuuguuucu

SEQ ID NO: 1695750 - RNA, 20 nt, Human
aaauacaauuuuguuucugu

SEQ ID NO: 1695751 - RNA, 21 nt, Human
aaauacaauuuuguuucugua

SEQ ID NO: 1695752 - RNA, 22 nt, Human
aaauacaauuuuguuucuguac

SEQ ID NO: 1695753 - RNA, 15 nt, Human
aaaccucugugagca

SEQ ID NO: 1695754 - RNA, 13 nt, Human
aaacugcuuguuu

SEQ ID NO: 1695755 - RNA, 14 nt, Human
aaacugcuuguuuc

SEQ ID NO: 1695756 - RNA, 17 nt, Human
aaacugcuuguuuccua

SEQ ID NO: 1695757 - RNA, 19 nt, Human
aaacugcuuguuuccuagc

SEQ ID NO: 1695758 - RNA, 22 nt, Human
aaacugcuuguuuccuagcaca

SEQ ID NO: 1695759 - RNA, 11 nt, Human
aaacuuuucug

SEQ ID NO: 1695760 - RNA, 20 nt, Human
aaaggaagguucugguguga

SEQ ID NO: 1695761 - RNA, 15 nt, Human
ggcuguacccaggaa

SEQ ID NO: 1695762 - RNA, 17 nt, Human
aaaaccaguauuguaca

SEQ ID NO: 1695763 - RNA, 16 nt, Human
ggcauaacauaaaucu

SEQ ID NO: 1695764 - RNA, 17 nt, Human
ggcauaacauaaaucug

SEQ ID NO: 1695765 - RNA, 22 nt, Human
ggacuucuuuaauuuuggaauu

SEQ ID NO: 1695766 - RNA, 21 nt, Human
ggacuucuuuaauuuuggaau

SEQ ID NO: 1695767 - RNA, 18 nt, Human
ggacuucuuuaauuuugg

SEQ ID NO: 1695768 - RNA, 15 nt, Human
ggacuuguuagaucu

SEQ ID NO: 1695769 - RNA, 12 nt, Human
ggacuuguuaga

SEQ ID NO: 1695770 - RNA, 22 nt, Human
gcugggguuaucugaagucaga

SEQ ID NO: 1695771 - RNA, 23 nt, Human
gcugggguuaucugaagucagau

SEQ ID NO: 1695772 - RNA, 14 nt, Human
gcugggguuaucug

SEQ ID NO: 1695773 - RNA, 22 nt, Human
gcuauuucuauauuuucauucu

SEQ ID NO: 1695774 - RNA, 16 nt, Human
auuugacauagucugg

SEQ ID NO: 1695775 - RNA, 17 nt, Human
auuugacauagucuggc

SEQ ID NO: 1695776 - RNA, 21 nt, Human
auuugacauagucuggcugua

SEQ ID NO: 1695777 - RNA, 15 nt, Human
auuugaauuuugugu

SEQ ID NO: 1695778 - RNA, 13 nt, Human
auuggcuuuucug

SEQ ID NO: 1695779 - RNA, 15 nt, Human
auuggcuuuucugau

SEQ ID NO: 1695780 - RNA, 16 nt, Human
auuggcuuuucugauc

SEQ ID NO: 1695781 - RNA, 19 nt, Human
auuggcuuuucugauccag

SEQ ID NO: 1695782 - RNA, 20 nt, Human
auuggcuuuucugauccagu

SEQ ID NO: 1695783 - RNA, 15 nt, Human
auugguucuuguauu

SEQ ID NO: 1695784 - RNA, 16 nt, Human
auugguucuuguauua

SEQ ID NO: 1695785 - RNA, 12 nt, Human
auuuuggaauuu

SEQ ID NO: 1695786 - RNA, 11 nt, Human
auuuuguuucu

SEQ ID NO: 1695787 - RNA, 14 nt, Human
auuuuguuucugua

SEQ ID NO: 1695788 - RNA, 15 nt, Human
auuuuguuucuguac

SEQ ID NO: 1695789 - RNA, 21 nt, Human
auucuuaaaguugaauuuauu

SEQ ID NO: 1695790 - RNA, 15 nt, Human
auucuguauagauua

SEQ ID NO: 1695791 - RNA, 19 nt, Human
auucuuaaaguugaauuua

SEQ ID NO: 1695792 - RNA, 20 nt, Human
auucuuaaaguugaauuuau

SEQ ID NO: 1695793 - RNA, 22 nt, Human
auugaagcauuuuauaaaucgc

SEQ ID NO: 1695794 - RNA, 11 nt, Human
auucuguauag

SEQ ID NO: 1695795 - RNA, 12 nt, Human
auucuguauaga

SEQ ID NO: 1695796 - RNA, 13 nt, Human
auucuguauagau

SEQ ID NO: 1695797 - RNA, 17 nt, Human
auuauucaaaguugccu

SEQ ID NO: 1695798 - RNA, 14 nt, Human
auuauucaaaguug

SEQ ID NO: 1695799 - RNA, 15 nt, Human
auuauucaaaguugc

SEQ ID NO: 1695800 - RNA, 13 nt, Human
auuauucaaaguu

SEQ ID NO: 1695801 - RNA, 20 nt, Human
uuucuguacuuuuuggcaua

SEQ ID NO: 1695802 - RNA, 19 nt, Human
uuucuguacuuuuuggcau

SEQ ID NO: 1695803 - RNA, 19 nt, Human
uuucuguuauauaaauggu

SEQ ID NO: 1695804 - RNA, 15 nt, Human
augggauaaaugcca

SEQ ID NO: 1695805 - RNA, 16 nt, Human
augggauaaaugccau

SEQ ID NO: 1695806 - RNA, 20 nt, Human
augggauaaaugccaucaau

SEQ ID NO: 1695807 - RNA, 14 nt, Human
auguaaaucccauu

SEQ ID NO: 1695808 - RNA, 20 nt, Human
auguaaaucccauuauucaa

SEQ ID NO: 1695809 - RNA, 22 nt, Human
auguaaaucccauuauucaaag

SEQ ID NO: 1695810 - RNA, 23 nt, Human
auguaaaucccauuauucaaagu

SEQ ID NO: 1695811 - RNA, 21 nt, Human
uuuggcauaacauaaaucugu

SEQ ID NO: 1695812 - RNA, 20 nt, Human
uuuggcauaacauaaaucug

SEQ ID NO: 1695813 - RNA, 19 nt, Human
uuugugcugguguaugugu

SEQ ID NO: 1695814 - RNA, 21 nt, Human
uuuaaauaaauaaauagcuag

SEQ ID NO: 1695815 - RNA, 10 nt, Human
augauccagc

SEQ ID NO: 1695816 - RNA, 19 nt, Human
augauccagcagauuauuc

SEQ ID NO: 1695817 - RNA, 20 nt, Human
augauccagcagauuauuca

SEQ ID NO: 1695818 - RNA, 22 nt, Human
augauccagcagauuauucacu

SEQ ID NO: 1695819 - RNA, 14 nt, Human
augggauaaaugcc

SEQ ID NO: 1695820 - RNA, 16 nt, Human
auggacuguggugacu

SEQ ID NO: 1695821 - RNA, 17 nt, Human
auggacuguggugacuu

SEQ ID NO: 1695822 - RNA, 22 nt, Human
auggacuguggugacuuuggau

SEQ ID NO: 1695823 - RNA, 19 nt, Human
uuucauuauuuuauuauga

SEQ ID NO: 1695824 - RNA, 20 nt, Human
uuucauuauuuuauuaugaa

SEQ ID NO: 1695825 - RNA, 13 nt, Human
uuucauuauuuua

SEQ ID NO: 1695826 - RNA, 15 nt, Human
uuucauuauuuuauu

SEQ ID NO: 1695827 - RNA, 15 nt, Human
auggaacgcguugaa

SEQ ID NO: 1695828 - RNA, 16 nt, Human
auggaacgcguugaaa

SEQ ID NO: 1695829 - RNA, 17 nt, Human
auggaacgcguugaaau

SEQ ID NO: 1695830 - RNA, 18 nt, Human
auggaacgcguugaaauu

SEQ ID NO: 1695831 - RNA, 19 nt, Human
auggaacgcguugaaauug

SEQ ID NO: 1695832 - RNA, 14 nt, Human
uuuauuacaguaua

SEQ ID NO: 1695833 - RNA, 18 nt, Human
uuuauuacaguauaauua

SEQ ID NO: 1695834 - RNA, 21 nt, Human
augcuauuucuauauuuucau

SEQ ID NO: 1695835 - RNA, 22 nt, Human
augcuauuucuauauuuucauu

SEQ ID NO: 1695836 - RNA, 23 nt, Human
augcuauuucuauauuuucauuc

SEQ ID NO: 1695837 - RNA, 13 nt, Human
augcuauuucuau

SEQ ID NO: 1695838 - RNA, 14 nt, Human
augcuauuucuaua

SEQ ID NO: 1695839 - RNA, 15 nt, Human
augcuauuucuauau

SEQ ID NO: 1695840 - RNA, 20 nt, Human
augcuauuucuauauuuuca

SEQ ID NO: 1695841 - RNA, 11 nt, Human
augcuauuucu

SEQ ID NO: 1695842 - RNA, 16 nt, Human
uuuauauuuacuaaaa

SEQ ID NO: 1695843 - RNA, 13 nt, Human
uuuauauuuacua

SEQ ID NO: 1695844 - RNA, 20 nt, Human
auccauuuggaaaucuuuaa

SEQ ID NO: 1695845 - RNA, 21 nt, Human
auccauuuggaaaucuuuaaa

SEQ ID NO: 1695846 - RNA, 13 nt, Human
uugaaauuguaau

SEQ ID NO: 1695847 - RNA, 14 nt, Human
uugaaauuguaauu

SEQ ID NO: 1695848 - RNA, 15 nt, Human
uugaaauuguaauua

SEQ ID NO: 1695849 - RNA, 17 nt, Human
uugaaauuguaauuaua

SEQ ID NO: 1695850 - RNA, 23 nt, Human
aucaccugucuugccuuuuucau

SEQ ID NO: 1695851 - RNA, 22 nt, Human
aucaccugucuugccuuuuuca

SEQ ID NO: 1695852 - RNA, 15 nt, Human
aucugacaucucugc

SEQ ID NO: 1695853 - RNA, 16 nt, Human
aucugacaucucugca

SEQ ID NO: 1695854 - RNA, 20 nt, Human
aucugacaucucugcaaucu

SEQ ID NO: 1695855 - RNA, 20 nt, Human
auccucucaaccaccuuuca

SEQ ID NO: 1695856 - RNA, 23 nt, Human
uugaagcauuuuauaaaucgcuu

SEQ ID NO: 1695857 - RNA, 11 nt, Human
aucugccuaag

SEQ ID NO: 1695858 - RNA, 21 nt, Human
aucugccuaaggacuucuuua

SEQ ID NO: 1695859 - RNA, 22 nt, Human
aucugccuaaggacuucuuuaa

SEQ ID NO: 1695860 - RNA, 23 nt, Human
aucugccuaaggacuucuuuaau

SEQ ID NO: 1695861 - RNA, 14 nt, Human
uuagaauucuguau

SEQ ID NO: 1695862 - RNA, 15 nt, Human
uuagaauucuguaua

SEQ ID NO: 1695863 - RNA, 17 nt, Human
uuagaauucuguauaga

SEQ ID NO: 1695864 - RNA, 15 nt, Human
auaaaucugugaacu

SEQ ID NO: 1695865 - RNA, 16 nt, Human
auaaaucugugaacuu

SEQ ID NO: 1695866 - RNA, 19 nt, Human
auaaaucugugaacuugaa

SEQ ID NO: 1695867 - RNA, 17 nt, Human
auaaaugccaucaauaa

SEQ ID NO: 1695868 - RNA, 18 nt, Human
auaaaugccaucaauaaa

SEQ ID NO: 1695869 - RNA, 14 nt, Human
auaaaucgcuuuug

SEQ ID NO: 1695870 - RNA, 16 nt, Human
auaaaucgcuuuugau

SEQ ID NO: 1695871 - RNA, 19 nt, Human
auaaaucgcuuuugauaau

SEQ ID NO: 1695872 - RNA, 21 nt, Human
auaaaucgcuuuugauaauca

SEQ ID NO: 1695873 - RNA, 14 nt, Human
uuaauuuuggaauu

SEQ ID NO: 1695874 - RNA, 15 nt, Human
uuaauuuuggaauuu

SEQ ID NO: 1695875 - RNA, 13 nt, Human
uuaauuuuggaau

SEQ ID NO: 1695876 - RNA, 14 nt, Human
uuaagaaugaaaua

SEQ ID NO: 1695877 - RNA, 20 nt, Human
uuaagaaugaaauacuguuu

SEQ ID NO: 1695878 - RNA, 22 nt, Human
uuaagaaugaaauacuguuuga

SEQ ID NO: 1695879 - RNA, 18 nt, Human
aguuuuguuuggaccaaa

SEQ ID NO: 1695880 - RNA, 14 nt, Human
aguuuuguuuggac

SEQ ID NO: 1695881 - RNA, 16 nt, Human
aguuuuguuuggacca

SEQ ID NO: 1695882 - RNA, 12 nt, Human
aguuuuguuugg

SEQ ID NO: 1695883 - RNA, 17 nt, Human
uuaaaccaugggauaaa

SEQ ID NO: 1695884 - RNA, 22 nt, Human
uuaaacauugguucuuguauua

SEQ ID NO: 1695885 - RNA, 18 nt, Human
uuaaacauugguucuugu

SEQ ID NO: 1695886 - RNA, 20 nt, Human
uuaaacauugguucuuguau

SEQ ID NO: 1695887 - RNA, 13 nt, Human
uuaaaguugaauu

SEQ ID NO: 1695888 - RNA, 16 nt, Human
uuaaaguugaauuuau

SEQ ID NO: 1695889 - RNA, 17 nt, Human
uuaaaguugaauuuauu

SEQ ID NO: 1695890 - RNA, 22 nt, Human
uuaaaguugaauuuauuggcuu

SEQ ID NO: 1695891 - RNA, 21 nt, Human
uuaaaccaugggauaaaugcc

SEQ ID NO: 1695892 - RNA, 22 nt, Human
uuaaaccaugggauaaaugcca

SEQ ID NO: 1695893 - RNA, 23 nt, Human
uuaaaccaugggauaaaugccau

SEQ ID NO: 1695894 - RNA, 19 nt, Human
aguuugugcugguguaugu

SEQ ID NO: 1695895 - RNA, 16 nt, Human
uuaugugcgcugauaa

SEQ ID NO: 1695896 - RNA, 11 nt, Human
uuauguaaauc

SEQ ID NO: 1695897 - RNA, 12 nt, Human
uuauguaaaucc

SEQ ID NO: 1695898 - RNA, 13 nt, Human
uuauguaaauccc

SEQ ID NO: 1695899 - RNA, 19 nt, Human
uuauguaaaucccauuauu

SEQ ID NO: 1695900 - RNA, 21 nt, Human
uuauguaaaucccauuauuca

SEQ ID NO: 1695901 - RNA, 22 nt, Human
uuauguaaaucccauuauucaa

SEQ ID NO: 1695902 - RNA, 23 nt, Human
uuauguaaaucccauuauucaaa

SEQ ID NO: 1695903 - RNA, 22 nt, Human
uuaugauccagcagauuauuca

SEQ ID NO: 1695904 - RNA, 23 nt, Human
uuaugauccagcagauuauucac

SEQ ID NO: 1695905 - RNA, 16 nt, Human
uuaugaaacuugugua

SEQ ID NO: 1695906 - RNA, 18 nt, Human
uuaugaaacuuguguaaa

SEQ ID NO: 1695907 - RNA, 13 nt, Human
uuaugaaacuugu

SEQ ID NO: 1695908 - RNA, 19 nt, Human
uuaugaaacuuguguaaau

SEQ ID NO: 1695909 - RNA, 13 nt, Human
uuaugauccagca

SEQ ID NO: 1695910 - RNA, 18 nt, Human
uuaugauccagcagauua

SEQ ID NO: 1695911 - RNA, 19 nt, Human
uuaugacuucauuaauaau

SEQ ID NO: 1695912 - RNA, 22 nt, Human
uuaugacuucauuaauaauaaa

SEQ ID NO: 1695913 - RNA, 15 nt, Human
auacuggauuguacu

SEQ ID NO: 1695914 - RNA, 14 nt, Human
uuauucacugauuu

SEQ ID NO: 1695915 - RNA, 13 nt, Human
uuauucaaaguug

SEQ ID NO: 1695916 - RNA, 15 nt, Human
uuauucaaaguugcc

SEQ ID NO: 1695917 - RNA, 19 nt, Human
uuauucaaaguugccuaaa

SEQ ID NO: 1695918 - RNA, 16 nt, Human
uuauuauguaaauccc

SEQ ID NO: 1695919 - RNA, 22 nt, Human
uuauuauguaaaucccauuauu

SEQ ID NO: 1695920 - RNA, 13 nt, Human
uuauuauguaaau

SEQ ID NO: 1695921 - RNA, 14 nt, Human
uuauuauguaaauc

SEQ ID NO: 1695922 - RNA, 17 nt, Human
uuauuaugaaacuugug

SEQ ID NO: 1695923 - RNA, 20 nt, Human
uuauuaugaaacuuguguaa

SEQ ID NO: 1695924 - RNA, 21 nt, Human
uuauuaugaaacuuguguaaa

SEQ ID NO: 1695925 - RNA, 22 nt, Human
uuauuaugaaacuuguguaaau

SEQ ID NO: 1695926 - RNA, 23 nt, Human
uuauuaugaaacuuguguaaaua

SEQ ID NO: 1695927 - RNA, 11 nt, Human
uuauuaugaaa

SEQ ID NO: 1695928 - RNA, 14 nt, Human
auagaaccucuuug

SEQ ID NO: 1695929 - RNA, 20 nt, Human
auagaaccucuuugucuaca

SEQ ID NO: 1695930 - RNA, 22 nt, Human
auagauuagagaguguugaaac

SEQ ID NO: 1695931 - RNA, 13 nt, Human
auagauuagaauu

SEQ ID NO: 1695932 - RNA, 15 nt, Human
auagauuagaauucu

SEQ ID NO: 1695933 - RNA, 16 nt, Human
auagauuagaauucug

SEQ ID NO: 1695934 - RNA, 21 nt, Human
auagauuagagaguguugaaa

SEQ ID NO: 1695935 - RNA, 21 nt, Human
auagaggaagccugauuaaag

SEQ ID NO: 1695936 - RNA, 22 nt, Human
auagaggaagccugauuaaaga

SEQ ID NO: 1695937 - RNA, 19 nt, Human
ugugcugggguuaucugaa

SEQ ID NO: 1695938 - RNA, 20 nt, Human
ugugcugguguaugugugaa

SEQ ID NO: 1695939 - RNA, 21 nt, Human
agugaguuggguguauugugc

SEQ ID NO: 1695940 - RNA, 17 nt, Human
agucuugucucagauuu

SEQ ID NO: 1695941 - RNA, 19 nt, Human
agucuugucucagauuuua

SEQ ID NO: 1695942 - RNA, 16 nt, Human
agucuugucucagauu

SEQ ID NO: 1695943 - RNA, 20 nt, Human
agucuugucucagauuuuau

SEQ ID NO: 1695944 - RNA, 21 nt, Human
agucuugucucagauuuuauu

SEQ ID NO: 1695945 - RNA, 16 nt, Human
uguguuagagauuuuu

SEQ ID NO: 1695946 - RNA, 13 nt, Human
aguauaauuaaca

SEQ ID NO: 1695947 - RNA, 14 nt, Human
aguauaauuaacau

SEQ ID NO: 1695948 - RNA, 16 nt, Human
aguauaauuaacaugu

SEQ ID NO: 1695949 - RNA, 23 nt, Human
aguauaauuaacauguuaaacca

SEQ ID NO: 1695950 - RNA, 12 nt, Human
aguauuaagcau

SEQ ID NO: 1695951 - RNA, 14 nt, Human
aguauuaagcauau

SEQ ID NO: 1695952 - RNA, 23 nt, Human
uggagccugcacggugaauggcu

SEQ ID NO: 1695953 - RNA, 17 nt, Human
uggaauuuuccuccuuu

SEQ ID NO: 1695954 - RNA, 21 nt, Human
uggaauuuuccuccuuucucu

SEQ ID NO: 1695955 - RNA, 16 nt, Human
aggauuuuaugcuuua

SEQ ID NO: 1695956 - RNA, 17 nt, Human
aggauuuuaugcuuuaa

SEQ ID NO: 1695957 - RNA, 11 nt, Human
aggauuuuaug

SEQ ID NO: 1695958 - RNA, 14 nt, Human
aggauuuuaugcuu

SEQ ID NO: 1695959 - RNA, 15 nt, Human
aggauuuuaugcuuu

SEQ ID NO: 1695960 - RNA, 17 nt, Human
aggaauucuguauagau

SEQ ID NO: 1695961 - RNA, 22 nt, Human
aggaauucuguauagauuagaa

SEQ ID NO: 1695962 - RNA, 16 nt, Human
aggaauucuguauaga

SEQ ID NO: 1695963 - RNA, 23 nt, Human
aggaauucuguauagauuagaau

SEQ ID NO: 1695964 - RNA, 23 nt, Human
aggaaaaguuuaauauuaaagcc

SEQ ID NO: 1695965 - RNA, 24 nt, Human
aggaaaaguuuaauauuaaagcca

SEQ ID NO: 1695966 - RNA, 21 nt, Human
aggaaaaguuuaauauuaaag

SEQ ID NO: 1695967 - RNA, 19 nt, Human
aggaaacuggguuccugca

SEQ ID NO: 1695968 - RNA, 13 nt, Human
ugccuuuuucauu

SEQ ID NO: 1695969 - RNA, 14 nt, Human
ugccuuuuucauua

SEQ ID NO: 1695970 - RNA, 15 nt, Human
ugccuuuuucauuau

SEQ ID NO: 1695971 - RNA, 16 nt, Human
ugccuuuuucauuauu

SEQ ID NO: 1695972 - RNA, 17 nt, Human
ugccuuuuucauuauuu

SEQ ID NO: 1695973 - RNA, 21 nt, Human
ugccuuuuucauuauuuuauu

SEQ ID NO: 1695974 - RNA, 18 nt, Human
agccugcacggugaaugg

SEQ ID NO: 1695975 - RNA, 16 nt, Human
agccugcacggugaau

SEQ ID NO: 1695976 - RNA, 14 nt, Human
agccugauuaaaga

SEQ ID NO: 1695977 - RNA, 14 nt, Human
ucugccuaaggacu

SEQ ID NO: 1695978 - RNA, 15 nt, Human
ucugccuaaggacuu

SEQ ID NO: 1695979 - RNA, 16 nt, Human
ucugccuaaggacuuc

SEQ ID NO: 1695980 - RNA, 13 nt, Human
ucugccuaaggac

SEQ ID NO: 1695981 - RNA, 22 nt, Human
agaaccucuuugucuacaccau

SEQ ID NO: 1695982 - RNA, 16 nt, Human
acuuuugguuaagucu

SEQ ID NO: 1695983 - RNA, 20 nt, Human
acuuuugguuaagucuguuu

SEQ ID NO: 1695984 - RNA, 22 nt, Human
acuuuugguuaagucuguuuua

SEQ ID NO: 1695985 - RNA, 13 nt, Human
acuuuuuuccaca

SEQ ID NO: 1695986 - RNA, 21 nt, Human
acuuguguaaauacaauuuug

SEQ ID NO: 1695987 - RNA, 22 nt, Human
acuuguguaaauacaauuuugu

SEQ ID NO: 1695988 - RNA, 23 nt, Human
acuuguguaaauacaauuuuguu

SEQ ID NO: 1695989 - RNA, 12 nt, Human
ucuccauuuaau

SEQ ID NO: 1695990 - RNA, 16 nt, Human
ucuccauuuaauaauu

SEQ ID NO: 1695991 - RNA, 19 nt, Human
ucuccauuuaauaauuaua

SEQ ID NO: 1695992 - RNA, 14 nt, Human
ucuuuaauuuugga

SEQ ID NO: 1695993 - RNA, 15 nt, Human
ucuuuaauuuuggaa

SEQ ID NO: 1695994 - RNA, 16 nt, Human
ucuuuaauuuuggaau

SEQ ID NO: 1695995 - RNA, 17 nt, Human
ucuuuaauuuuggaauu

SEQ ID NO: 1695996 - RNA, 18 nt, Human
ucuuuaauuuuggaauuu

SEQ ID NO: 1695997 - RNA, 13 nt, Human
ucuuuaauuuugg

SEQ ID NO: 1695998 - RNA, 16 nt, Human
ucuguauagauuagag

SEQ ID NO: 1695999 - RNA, 17 nt, Human
ucuguauagauuagaau

SEQ ID NO: 1696000 - RNA, 12 nt, Human
ugaauuuauugg

SEQ ID NO: 1696001 - RNA, 15 nt, Human
ugaauuuauuggcuu

SEQ ID NO: 1696002 - RNA, 16 nt, Human
ugaauuuauuggcuuu

SEQ ID NO: 1696003 - RNA, 16 nt, Human
agauuauucacugauu

SEQ ID NO: 1696004 - RNA, 22 nt, Human
ugacuucauuaauaauaaauuc

SEQ ID NO: 1696005 - RNA, 15 nt, Human
agcaaaaauauuuua

SEQ ID NO: 1696006 - RNA, 17 nt, Human
agcaaaaauauuuuaug

SEQ ID NO: 1696007 - RNA, 18 nt, Human
agcaaaaauauuuuauga

SEQ ID NO: 1696008 - RNA, 19 nt, Human
agcaaaaauauuuuaugau

SEQ ID NO: 1696009 - RNA, 23 nt, Human
agcaaaaauauuuuaugauccag

SEQ ID NO: 1696010 - RNA, 21 nt, Human
agauuuuauuauguaaauccc

SEQ ID NO: 1696011 - RNA, 20 nt, Human
agauuuuauuauguaaaucc

SEQ ID NO: 1696012 - RNA, 22 nt, Human
agauuuuauuauguaaauccca

SEQ ID NO: 1696013 - RNA, 18 nt, Human
ugaggaauucuguauaga

SEQ ID NO: 1696014 - RNA, 19 nt, Human
ugaggaauucuguauagau

SEQ ID NO: 1696015 - RNA, 14 nt, Human
ugaggaauucugua

SEQ ID NO: 1696016 - RNA, 15 nt, Human
ugaggaauucuguau

SEQ ID NO: 1696017 - RNA, 16 nt, Human
ugaggaauucuguaua

SEQ ID NO: 1696018 - RNA, 19 nt, Human
agcagauuauucacugauu

SEQ ID NO: 1696019 - RNA, 20 nt, Human
agcagauuauucacugauuu

SEQ ID NO: 1696020 - RNA, 15 nt, Human
agcagauuauucacu

SEQ ID NO: 1696021 - RNA, 16 nt, Human
agcagauuauucacug

SEQ ID NO: 1696022 - RNA, 14 nt, Human
agcagauuauucac

SEQ ID NO: 1696023 - RNA, 16 nt, Human
ucagauuuuauuaugu

SEQ ID NO: 1696024 - RNA, 19 nt, Human
ucagauuuuauuauguaaa

SEQ ID NO: 1696025 - RNA, 20 nt, Human
ucagauuuuauuauguaaau

SEQ ID NO: 1696026 - RNA, 22 nt, Human
ucagauuuuauuauguaaaucc

SEQ ID NO: 1696027 - RNA, 14 nt, Human
ucagauuuuauuau

SEQ ID NO: 1696028 - RNA, 15 nt, Human
ucagauuuuauuaug

SEQ ID NO: 1696029 - RNA, 13 nt, Human
ucagauuuuauua

SEQ ID NO: 1696030 - RNA, 21 nt, Human
ucagaucugccuaaggacuuc

SEQ ID NO: 1696031 - RNA, 18 nt, Human
uccacauaaggaaacugg

SEQ ID NO: 1696032 - RNA, 21 nt, Human
uccugcaaugaagucucugaa

SEQ ID NO: 1696033 - RNA, 15 nt, Human
uccugcaaugaaguc

SEQ ID NO: 1696034 - RNA, 18 nt, Human
uccugcaaugaagucucu

SEQ ID NO: 1696035 - RNA, 20 nt, Human
uccugcaaugaagucucuga

SEQ ID NO: 1696036 - RNA, 16 nt, Human
acuggauuguacuuug

SEQ ID NO: 1696037 - RNA, 13 nt, Human
acuggauuguacu

SEQ ID NO: 1696038 - RNA, 22 nt, Human
acucuccauuuaauaauuauau

SEQ ID NO: 1696039 - RNA, 17 nt, Human
uccuagcacacacuuuu

SEQ ID NO: 1696040 - RNA, 18 nt, Human
uccuagcacacacuuuug

SEQ ID NO: 1696041 - RNA, 19 nt, Human
uccuagcacacacuuuugg

SEQ ID NO: 1696042 - RNA, 14 nt, Human
uccgugcuaaggac

SEQ ID NO: 1696043 - RNA, 15 nt, Human
uccgugcuaaggacu

SEQ ID NO: 1696044 - RNA, 17 nt, Human
acuccaauuaaggauuu

SEQ ID NO: 1696045 - RNA, 21 nt, Human
acuccaauuaaggauuuuaug

SEQ ID NO: 1696046 - RNA, 13 nt, Human
acuauauauguga

SEQ ID NO: 1696047 - RNA, 21 nt, Human
ucccuauuuuuuuucuguuau

SEQ ID NO: 1696048 - RNA, 22 nt, Human
ucccuauuuuuuuucuguuaua

SEQ ID NO: 1696049 - RNA, 20 nt, Human
uaugauccagcagauuauuc

SEQ ID NO: 1696050 - RNA, 21 nt, Human
uaugauccagcagauuauuca

SEQ ID NO: 1696051 - RNA, 22 nt, Human
uaugauccagcagauuauucac

SEQ ID NO: 1696052 - RNA, 15 nt, Human
uaugcugaguuugug

SEQ ID NO: 1696053 - RNA, 11 nt, Human
uaugauccagc

SEQ ID NO: 1696054 - RNA, 19 nt, Human
uaugauccagcagauuauu

SEQ ID NO: 1696055 - RNA, 10 nt, Human
uaugauccag

SEQ ID NO: 1696056 - RNA, 20 nt, Human
uaucaccugucuugccuuuu

SEQ ID NO: 1696057 - RNA, 19 nt, Human
uauagauuagagaguguug

SEQ ID NO: 1696058 - RNA, 22 nt, Human
uauagauuagagaguguugaaa

SEQ ID NO: 1696059 - RNA, 20 nt, Human
uauagauuagaauucuguau

SEQ ID NO: 1696060 - RNA, 15 nt, Human
acacuccaauuaagg

SEQ ID NO: 1696061 - RNA, 16 nt, Human
acacuccaauuaagga

SEQ ID NO: 1696062 - RNA, 15 nt, Human
uauuggcuuuucuga

SEQ ID NO: 1696063 - RNA, 16 nt, Human
uauuggcuuuucugau

SEQ ID NO: 1696064 - RNA, 17 nt, Human
uauuggcuuuucugauc

SEQ ID NO: 1696065 - RNA, 18 nt, Human
uauuggcuuuucugaucc

SEQ ID NO: 1696066 - RNA, 14 nt, Human
uauuggcuuuucug

SEQ ID NO: 1696067 - RNA, 21 nt, Human
uauuggcuuuucugauccagu

SEQ ID NO: 1696068 - RNA, 22 nt, Human
uauuggcuuuucugauccaguu

SEQ ID NO: 1696069 - RNA, 12 nt, Human
uauugaagcauu

SEQ ID NO: 1696070 - RNA, 13 nt, Human
uauugaagcauuu

SEQ ID NO: 1696071 - RNA, 15 nt, Human
uauugaagcauuuua

SEQ ID NO: 1696072 - RNA, 16 nt, Human
uauugaagcauuuuau

SEQ ID NO: 1696073 - RNA, 17 nt, Human
uauugaagcauuuuaua

SEQ ID NO: 1696074 - RNA, 19 nt, Human
uauugaagcauuuuauaaa

SEQ ID NO: 1696075 - RNA, 15 nt, Human
uauuguacaaaguau

SEQ ID NO: 1696076 - RNA, 16 nt, Human
uauuguacaaaguauu

SEQ ID NO: 1696077 - RNA, 21 nt, Human
uauuguacaaaguauuaagca

SEQ ID NO: 1696078 - RNA, 22 nt, Human
uauuguacaaaguauuaagcau

SEQ ID NO: 1696079 - RNA, 23 nt, Human
uauuguacaaaguauuaagcaua

SEQ ID NO: 1696080 - RNA, 18 nt, Human
uauuuacuaaaauggacu

SEQ ID NO: 1696081 - RNA, 21 nt, Human
acaguauaauuaacauguuaa

SEQ ID NO: 1696082 - RNA, 23 nt, Human
acaguauaauuaacauguuaaac

SEQ ID NO: 1696083 - RNA, 17 nt, Human
acagcuggugcccugcu

SEQ ID NO: 1696084 - RNA, 20 nt, Human
acagcuggugcccugcuuuc

SEQ ID NO: 1696085 - RNA, 17 nt, Human
uauuaaagccauguuua

SEQ ID NO: 1696086 - RNA, 18 nt, Human
uauuaaagccauguuuau

SEQ ID NO: 1696087 - RNA, 20 nt, Human
uauuaaagccauguuuauua

SEQ ID NO: 1696088 - RNA, 16 nt, Human
uauuacaguauaauua

SEQ ID NO: 1696089 - RNA, 18 nt, Human
uauuacaguauaauuaac

SEQ ID NO: 1696090 - RNA, 20 nt, Human
uauuacaguauaauuaacau

SEQ ID NO: 1696091 - RNA, 21 nt, Human
uauuacaguauaauuaacaug

SEQ ID NO: 1696092 - RNA, 13 nt, Human
uauuaaagccaug

SEQ ID NO: 1696093 - RNA, 14 nt, Human
uauuaaagccaugu

SEQ ID NO: 1696094 - RNA, 12 nt, Human
uauuaaagccau

SEQ ID NO: 1696095 - RNA, 18 nt, Human
uauucaaaguugccuaaa

SEQ ID NO: 1696096 - RNA, 21 nt, Human
uauucaaaguugccuaaaucc

SEQ ID NO: 1696097 - RNA, 22 nt, Human
uauucaaaguugccuaaaucca

SEQ ID NO: 1696098 - RNA, 23 nt, Human
uauucaaaguugccuaaauccau

SEQ ID NO: 1696099 - RNA, 13 nt, Human
uauucacugauuu

SEQ ID NO: 1696100 - RNA, 19 nt, Human
uauucacugauuugacaua

SEQ ID NO: 1696101 - RNA, 22 nt, Human
uauucacugauuugacauaguc

SEQ ID NO: 1696102 - RNA, 13 nt, Human
aauuugaauuuug

SEQ ID NO: 1696103 - RNA, 16 nt, Human
aauuugaauuuugugu

SEQ ID NO: 1696104 - RNA, 18 nt, Human
aauuugaauuuuguguua

SEQ ID NO: 1696105 - RNA, 12 nt, Human
uacucaauuuua

SEQ ID NO: 1696106 - RNA, 13 nt, Human
uacucaauuuuaa

SEQ ID NO: 1696107 - RNA, 14 nt, Human
uacucaauuuuaac

SEQ ID NO: 1696108 - RNA, 21 nt, Human
uagaggaagccugauuaaaga

SEQ ID NO: 1696109 - RNA, 14 nt, Human
uagaaccucuuugu

SEQ ID NO: 1696110 - RNA, 21 nt, Human
uaauuauaugcuauuucuaua

SEQ ID NO: 1696111 - RNA, 13 nt, Human
uaauuauaucuga

SEQ ID NO: 1696112 - RNA, 17 nt, Human
uaauuauaucugaggaa

SEQ ID NO: 1696113 - RNA, 13 nt, Human
aauuaacauguua

SEQ ID NO: 1696114 - RNA, 14 nt, Human
aauuaacauguuaa

SEQ ID NO: 1696115 - RNA, 18 nt, Human
aauuaacauguuaaacca

SEQ ID NO: 1696116 - RNA, 16 nt, Human
aauuaaggauuuuaug

SEQ ID NO: 1696117 - RNA, 20 nt, Human
aauuaaggauuuuaugcuuu

SEQ ID NO: 1696118 - RNA, 22 nt, Human
aauuaaggauuuuaugcuuuaa

SEQ ID NO: 1696119 - RNA, 16 nt, Human
aaggaagguucuggug

SEQ ID NO: 1696120 - RNA, 13 nt, Human
aaguauuaagcau

SEQ ID NO: 1696121 - RNA, 14 nt, Human
aaguauuaagcaua

SEQ ID NO: 1696122 - RNA, 15 nt, Human
guuucuguacuuuuu

SEQ ID NO: 1696123 - RNA, 14 nt, Human
guuugcauagguga

SEQ ID NO: 1696124 - RNA, 10 nt, Human
guuucuguac

SEQ ID NO: 1696125 - RNA, 23 nt, Human
aaggcugaugccaaguuguuuga

SEQ ID NO: 1696126 - RNA, 19 nt, Human
aaguuuaauauuaaagcca

SEQ ID NO: 1696127 - RNA, 20 nt, Human
aaguuuaauauuaaagccau

SEQ ID NO: 1696128 - RNA, 21 nt, Human
aaguuuaauauuaaagccaug

SEQ ID NO: 1696129 - RNA, 18 nt, Human
uaaaccaugggauaaaug

SEQ ID NO: 1696130 - RNA, 20 nt, Human
uaaaccaugggauaaaugcc

SEQ ID NO: 1696131 - RNA, 21 nt, Human
uaaaccaugggauaaaugcca

SEQ ID NO: 1696132 - RNA, 22 nt, Human
uaaaccaugggauaaaugccau

SEQ ID NO: 1696133 - RNA, 16 nt, Human
uaacaacagcuggugc

SEQ ID NO: 1696134 - RNA, 15 nt, Human
aauacaauuuuguuu

SEQ ID NO: 1696135 - RNA, 17 nt, Human
aauacaauuuuguuucu

SEQ ID NO: 1696136 - RNA, 18 nt, Human
aauacaauuuuguuucug

SEQ ID NO: 1696137 - RNA, 20 nt, Human
aauacaauuuuguuucugua

SEQ ID NO: 1696138 - RNA, 12 nt, Human
aauacaauuuug

SEQ ID NO: 1696139 - RNA, 13 nt, Human
aauacaauuuugu

SEQ ID NO: 1696140 - RNA, 22 nt, Human
aauacaauuuuguuucuguacu

SEQ ID NO: 1696141 - RNA, 23 nt, Human
aauacaauuuuguuucuguacuu

SEQ ID NO: 1696142 - RNA, 13 nt, Human
uaaauacaauuuu

SEQ ID NO: 1696143 - RNA, 15 nt, Human
uaaauacaauuuugu

SEQ ID NO: 1696144 - RNA, 22 nt, Human
uaaauacaauuuuguuucugua

SEQ ID NO: 1696145 - RNA, 23 nt, Human
uaaauacaauuuuguuucuguac

SEQ ID NO: 1696146 - RNA, 19 nt, Human
uaaauagcuagacugguga

SEQ ID NO: 1696147 - RNA, 23 nt, Human
uaaauagcuagacuggugacuga

SEQ ID NO: 1696148 - RNA, 18 nt, Human
uaaaucgcuuuugauaau

SEQ ID NO: 1696149 - RNA, 19 nt, Human
uaaaucgcuuuugauaauc

SEQ ID NO: 1696150 - RNA, 23 nt, Human
uaaaucccauuauucaaaguugc

SEQ ID NO: 1696151 - RNA, 14 nt, Human
aauaauuauaugcu

SEQ ID NO: 1696152 - RNA, 15 nt, Human
aauaauuauaugcua

SEQ ID NO: 1696153 - RNA, 20 nt, Human
aauaauuauaugcuauuucu

SEQ ID NO: 1696154 - RNA, 21 nt, Human
aauaauuauaugcuauuucua

SEQ ID NO: 1696155 - RNA, 22 nt, Human
aauaauuauaugcuauuucuau

SEQ ID NO: 1696156 - RNA, 23 nt, Human
aauaauuauaugcuauuucuaua

SEQ ID NO: 1696157 - RNA, 16 nt, Human
aauaaggaaaaguuua

SEQ ID NO: 1696158 - RNA, 19 nt, Human
aauaaggaaaaguuuaaua

SEQ ID NO: 1696159 - RNA, 22 nt, Human
aauaaggaaaaguuuaauauua

SEQ ID NO: 1696160 - RNA, 13 nt, Human
aauaaggaaaagu

SEQ ID NO: 1696161 - RNA, 15 nt, Human
aauaaggaaaaguuu

SEQ ID NO: 1696162 - RNA, 21 nt, Human
aauaaauagcuagacugguga

SEQ ID NO: 1696163 - RNA, 15 nt, Human
aauaaaaaauuauga

SEQ ID NO: 1696164 - RNA, 16 nt, Human
aauaaaaaauuaugac

SEQ ID NO: 1696165 - RNA, 14 nt, Human
aauaaaaaauuaug

SEQ ID NO: 1696166 - RNA, 19 nt, Human
gugcugguguaugugugaa

SEQ ID NO: 1696167 - RNA, 22 nt, Human
gugcugggguuaucugaaguca

SEQ ID NO: 1696168 - RNA, 14 nt, Human
aacuuguguaaaua

SEQ ID NO: 1696169 - RNA, 15 nt, Human
aacuuguguaaauac

SEQ ID NO: 1696170 - RNA, 20 nt, Human
aacuuguguaaauacaauuu

SEQ ID NO: 1696171 - RNA, 21 nt, Human
guguugaaacggaugauuucu

SEQ ID NO: 1696172 - RNA, 23 nt, Human
guguugaaacggaugauuucuau

SEQ ID NO: 1696173 - RNA, 23 nt, Human
aacauguuaaaccaugggauaaa

SEQ ID NO: 1696174 - RNA, 15 nt, Human
aacauaaaucuguga

SEQ ID NO: 1696175 - RNA, 12 nt, Human
aacauaaaucug

SEQ ID NO: 1696176 - RNA, 14 nt, Human
aacauaaaucugug

SEQ ID NO: 1696177 - RNA, 23 nt, Human
gucuucauaccuacauguauuug

SEQ ID NO: 1696178 - RNA, 17 nt, Human
auaacauaaaucuguga

SEQ ID NO: 1696179 - RNA, 18 nt, Human
auaacauaaaucugugaa

SEQ ID NO: 1696180 - RNA, 19 nt, Human
auaacauaaaucugugaac

SEQ ID NO: 1696181 - RNA, 14 nt, Human
auaacauaaaucug

SEQ ID NO: 1696182 - RNA, 15 nt, Human
auaacauaaaucugu

SEQ ID NO: 1696183 - RNA, 21 nt, Human
auaccuacauguauuuguuug

SEQ ID NO: 1696184 - RNA, 16 nt, Human
auaaggaaaaguuuaa

SEQ ID NO: 1696185 - RNA, 15 nt, Human
auaaggaaaaguuua

SEQ ID NO: 1696186 - RNA, 15 nt, Human
auaauuaacauguua

SEQ ID NO: 1696187 - RNA, 17 nt, Human
auaauuaacauguuaaa

SEQ ID NO: 1696188 - RNA, 22 nt, Human
auaucaucaguauugaagcauu

SEQ ID NO: 1696189 - RNA, 16 nt, Human
auaugcuauuucuaua

SEQ ID NO: 1696190 - RNA, 18 nt, Human
auaugcuauuucuauauu

SEQ ID NO: 1696191 - RNA, 19 nt, Human
auaugcuauuucuauauuu

SEQ ID NO: 1696192 - RNA, 21 nt, Human
auaugcuauuucuauauuuuc

SEQ ID NO: 1696193 - RNA, 15 nt, Human
auaugcuauuucuau

SEQ ID NO: 1696194 - RNA, 22 nt, Human
auaugcuauuucuauauuuuca

SEQ ID NO: 1696195 - RNA, 23 nt, Human
auaugcuauuucuauauuuucau

SEQ ID NO: 1696196 - RNA, 18 nt, Human
auauuuacuaaaauggac

SEQ ID NO: 1696197 - RNA, 20 nt, Human
auauuuacuaaaauggacug

SEQ ID NO: 1696198 - RNA, 13 nt, Human
augugugaaguga

SEQ ID NO: 1696199 - RNA, 21 nt, Human
augucuucauaccuacaugua

SEQ ID NO: 1696200 - RNA, 22 nt, Human
augucuucauaccuacauguau

SEQ ID NO: 1696201 - RNA, 19 nt, Human
augguccgugcuaaggacu

SEQ ID NO: 1696202 - RNA, 20 nt, Human
augguccgugcuaaggacuu

SEQ ID NO: 1696203 - RNA, 21 nt, Human
augguccgugcuaaggacuug

SEQ ID NO: 1696204 - RNA, 14 nt, Human
auguauuuguuugc

SEQ ID NO: 1696205 - RNA, 13 nt, Human
agaguguugaaac

SEQ ID NO: 1696206 - RNA, 23 nt, Human
aaugaagucucugaagugaaacu

SEQ ID NO: 1696207 - RNA, 14 nt, Human
aaugaagucucuga

SEQ ID NO: 1696208 - RNA, 16 nt, Human
aaugaagucucugaag

SEQ ID NO: 1696209 - RNA, 13 nt, Human
aaugaaauacugu

SEQ ID NO: 1696210 - RNA, 15 nt, Human
aaguugccuaaaucc

SEQ ID NO: 1696211 - RNA, 16 nt, Human
aaguugccuaaaucca

SEQ ID NO: 1696212 - RNA, 17 nt, Human
aaguugccuaaauccau

SEQ ID NO: 1696213 - RNA, 18 nt, Human
aaguugccuaaauccauu

SEQ ID NO: 1696214 - RNA, 19 nt, Human
aaguugccuaaauccauuu

SEQ ID NO: 1696215 - RNA, 12 nt, Human
aauauuaaagcc

SEQ ID NO: 1696216 - RNA, 13 nt, Human
aaugguuaaaaga

SEQ ID NO: 1696217 - RNA, 12 nt, Human
aagucuguuuua

SEQ ID NO: 1696218 - RNA, 13 nt, Human
aagucuguuuuau

SEQ ID NO: 1696219 - RNA, 14 nt, Human
aagucuguuuuaug

SEQ ID NO: 1696220 - RNA, 12 nt, Human
aaguugccuaaa

SEQ ID NO: 1696221 - RNA, 14 nt, Human
aaggacuucuuuaa

SEQ ID NO: 1696222 - RNA, 15 nt, Human
aaggacuucuuuaau

SEQ ID NO: 1696223 - RNA, 20 nt, Human
aaggacuucuuuaauuuugg

SEQ ID NO: 1696224 - RNA, 21 nt, Human
aaggacuucuuuaauuuugga

SEQ ID NO: 1696225 - RNA, 19 nt, Human
aacagcuggugcccugcuu

SEQ ID NO: 1696226 - RNA, 20 nt, Human
aacagcuggugcccugcuuu

SEQ ID NO: 1696227 - RNA, 21 nt, Human
aacagcuggugcccugcuuuc

SEQ ID NO: 1696228 - RNA, 14 nt, Human
aacggaugauuucu

SEQ ID NO: 1696229 - RNA, 15 nt, Human
aacggaugauuucua

SEQ ID NO: 1696230 - RNA, 16 nt, Human
aacggaugauuucuau

SEQ ID NO: 1696231 - RNA, 17 nt, Human
aacggaugauuucuaug

SEQ ID NO: 1696232 - RNA, 18 nt, Human
aaauagcuagacugguga

SEQ ID NO: 1696233 - RNA, 15 nt, Human
aaaucugugaacuug

SEQ ID NO: 1696234 - RNA, 16 nt, Human
aaaucugugaacuuga

SEQ ID NO: 1696235 - RNA, 18 nt, Human
aaaucugugaacuugaaa

SEQ ID NO: 1696236 - RNA, 10 nt, Human
aaauaaauaa

SEQ ID NO: 1696237 - RNA, 20 nt, Human
aaaccaugggauaaaugcca

SEQ ID NO: 1696238 - RNA, 15 nt, Human
aaaccaugggauaaa

SEQ ID NO: 1696239 - RNA, 13 nt, Human
aauuuuguuucug

SEQ ID NO: 1696240 - RNA, 14 nt, Human
aauuuuguuucugu

SEQ ID NO: 1696241 - RNA, 15 nt, Human
aauuuuguuucugua

SEQ ID NO: 1696242 - RNA, 23 nt, Human
acuguuugagguuuuuaagccuu

SEQ ID NO: 1696243 - RNA, 18 nt, Human
acuguuugagguuuuuaa

SEQ ID NO: 1696244 - RNA, 14 nt, Human
acuggugacugauu

SEQ ID NO: 1696245 - RNA, 18 nt, Human
aaaaaauuggggauucuu

SEQ ID NO: 1696246 - RNA, 20 nt, Human
aaaaaccaguauuguacaaa

SEQ ID NO: 1696247 - RNA, 15 nt, Human
cacccacccuuuuuu

SEQ ID NO: 1696248 - RNA, 19 nt, Human
caaaguugccuaaauccau

SEQ ID NO: 1696249 - RNA, 13 nt, Human
caauuaaggauuu

SEQ ID NO: 1696250 - RNA, 15 nt, Human
caauuaaggauuuua

SEQ ID NO: 1696251 - RNA, 20 nt, Human
caauuaaggauuuuaugcuu

SEQ ID NO: 1696252 - RNA, 21 nt, Human
caauuaaggauuuuaugcuuu

SEQ ID NO: 1696253 - RNA, 22 nt, Human
caauuaaggauuuuaugcuuua

SEQ ID NO: 1696254 - RNA, 20 nt, Human
cacauugguguuguacucaa

SEQ ID NO: 1696255 - RNA, 19 nt, Human
uucuuguauuaagaaugaa

SEQ ID NO: 1696256 - RNA, 14 nt, Human
uucuguauagauua

SEQ ID NO: 1696257 - RNA, 13 nt, Human
uucuguauagauu

SEQ ID NO: 1696258 - RNA, 11 nt, Human
uucuguauaga

SEQ ID NO: 1696259 - RNA, 16 nt, Human
uugaaacggaugauuu

SEQ ID NO: 1696260 - RNA, 19 nt, Human
uugaaacggaugauuucua

SEQ ID NO: 1696261 - RNA, 17 nt, Human
uucuuuaauuuuggaau

SEQ ID NO: 1696262 - RNA, 18 nt, Human
uucuuuaauuuuggaauu

SEQ ID NO: 1696263 - RNA, 12 nt, Human
uucuuuaauuuu

SEQ ID NO: 1696264 - RNA, 13 nt, Human
uugaagcauuuua

SEQ ID NO: 1696265 - RNA, 14 nt, Human
uugaagcauuuuau

SEQ ID NO: 1696266 - RNA, 15 nt, Human
uugaagcauuuuaua

SEQ ID NO: 1696267 - RNA, 17 nt, Human
uugaagcauuuuauaaa

SEQ ID NO: 1696268 - RNA, 22 nt, Human
uugaagcauuuuauaaaucgcu

SEQ ID NO: 1696269 - RNA, 12 nt, Human
uugccuuuuuca

SEQ ID NO: 1696270 - RNA, 13 nt, Human
uugccuuuuucau

SEQ ID NO: 1696271 - RNA, 14 nt, Human
uugccuuuuucauu

SEQ ID NO: 1696272 - RNA, 15 nt, Human
uugccuuuuucauua

SEQ ID NO: 1696273 - RNA, 16 nt, Human
uugccuuuuucauuau

SEQ ID NO: 1696274 - RNA, 17 nt, Human
uugccuuuuucauuauu

SEQ ID NO: 1696275 - RNA, 19 nt, Human
uuggcauaacauaaaucug

SEQ ID NO: 1696276 - RNA, 20 nt, Human
uuggcauaacauaaaucugu

SEQ ID NO: 1696277 - RNA, 22 nt, Human
uuggcauaacauaaaucuguga

SEQ ID NO: 1696278 - RNA, 23 nt, Human
uuggcauaacauaaaucugugaa

SEQ ID NO: 1696279 - RNA, 18 nt, Human
uuggcauaacauaaaucu

SEQ ID NO: 1696280 - RNA, 12 nt, Human
uuguuucuguac

SEQ ID NO: 1696281 - RNA, 14 nt, Human
uuguuucuguacuu

SEQ ID NO: 1696282 - RNA, 13 nt, Human
uuguuuguuuagu

SEQ ID NO: 1696283 - RNA, 14 nt, Human
uuguuuguuuaguc

SEQ ID NO: 1696284 - RNA, 14 nt, Human
uuuaauaauuauau

SEQ ID NO: 1696285 - RNA, 15 nt, Human
uuuaauauuaaagcc

SEQ ID NO: 1696286 - RNA, 17 nt, Human
uuuaauauuaaagccau

SEQ ID NO: 1696287 - RNA, 20 nt, Human
uuuaauauuaaagccauguu

SEQ ID NO: 1696288 - RNA, 21 nt, Human
uuuaauauuaaagccauguuu

SEQ ID NO: 1696289 - RNA, 14 nt, Human
uuuaauauuaaagc

SEQ ID NO: 1696290 - RNA, 15 nt, Human
uuuauaaaucgcuuu

SEQ ID NO: 1696291 - RNA, 18 nt, Human
uuuauaaaucgcuuuuga

SEQ ID NO: 1696292 - RNA, 22 nt, Human
uuuauaaaucgcuuuugauaau

SEQ ID NO: 1696293 - RNA, 19 nt, Human
uuuauaaaucgcuuuugau

SEQ ID NO: 1696294 - RNA, 20 nt, Human
uuuaugacuucauuaauaau

SEQ ID NO: 1696295 - RNA, 15 nt, Human
uuucugauccaguuu

SEQ ID NO: 1696296 - RNA, 16 nt, Human
uuucugauccaguuuu

SEQ ID NO: 1696297 - RNA, 20 nt, Human
uuucugauccaguuuuguuu

SEQ ID NO: 1696298 - RNA, 22 nt, Human
uuucugauccaguuuuguuugg

SEQ ID NO: 1696299 - RNA, 13 nt, Human
uuucugauccagu

SEQ ID NO: 1696300 - RNA, 12 nt, Human
uuuaugcuuuaa

SEQ ID NO: 1696301 - RNA, 15 nt, Human
uuuaugcuuuaaaca

SEQ ID NO: 1696302 - RNA, 16 nt, Human
uuuaugcuuuaaacau

SEQ ID NO: 1696303 - RNA, 18 nt, Human
uuugauaaucaacugggc

SEQ ID NO: 1696304 - RNA, 17 nt, Human
uuugguugcuuuaauau

SEQ ID NO: 1696305 - RNA, 12 nt, Human
uuucuuaaauaa

SEQ ID NO: 1696306 - RNA, 13 nt, Human
uuucuuaaauaau

SEQ ID NO: 1696307 - RNA, 20 nt, Human
uuugauaaucaacugggcug

SEQ ID NO: 1696308 - RNA, 21 nt, Human
uucacucuccauuuaauaauu

SEQ ID NO: 1696309 - RNA, 17 nt, Human
uucagauaacuguuauu

SEQ ID NO: 1696310 - RNA, 18 nt, Human
uucagauaacuguuauuu

SEQ ID NO: 1696311 - RNA, 23 nt, Human
uucagauaacuguuauuuauaau

SEQ ID NO: 1696312 - RNA, 11 nt, Human
uucaaaguugc

SEQ ID NO: 1696313 - RNA, 15 nt, Human
uucaaaguugccuaa

SEQ ID NO: 1696314 - RNA, 16 nt, Human
uucaaaguugccuaaa

SEQ ID NO: 1696315 - RNA, 17 nt, Human
uucaaaguugccuaaau

SEQ ID NO: 1696316 - RNA, 23 nt, Human
uucaaaguugccuaaauccauuu

SEQ ID NO: 1696317 - RNA, 13 nt, Human
uuauuuuauuaug

SEQ ID NO: 1696318 - RNA, 12 nt, Human
uuauuggcuuuu

SEQ ID NO: 1696319 - RNA, 16 nt, Human
uuauuggcuuuucuga

SEQ ID NO: 1696320 - RNA, 18 nt, Human
uuauuggcuuuucugauc

SEQ ID NO: 1696321 - RNA, 22 nt, Human
uuauuggcuuuucugauccagu

SEQ ID NO: 1696322 - RNA, 17 nt, Human
uuaucugaagucagauc

SEQ ID NO: 1696323 - RNA, 13 nt, Human
uuaugcuuuaaac

SEQ ID NO: 1696324 - RNA, 14 nt, Human
uuaugcuuuaaaca

SEQ ID NO: 1696325 - RNA, 14 nt, Human
uuauuacaguauaa

SEQ ID NO: 1696326 - RNA, 17 nt, Human
uucccuggccuuucaua

SEQ ID NO: 1696327 - RNA, 16 nt, Human
uucccuggccuuucau

SEQ ID NO: 1696328 - RNA, 12 nt, Human
uucccuggccuu

SEQ ID NO: 1696329 - RNA, 14 nt, Human
uuagagaguguuga

SEQ ID NO: 1696330 - RNA, 16 nt, Human
uuagagaguguugaaa

SEQ ID NO: 1696331 - RNA, 17 nt, Human
uuagagaguguugaaac

SEQ ID NO: 1696332 - RNA, 18 nt, Human
uuagagaguguugaaacg

SEQ ID NO: 1696333 - RNA, 12 nt, Human
uuagagauuuuu

SEQ ID NO: 1696334 - RNA, 13 nt, Human
uuagaucuaguuc

SEQ ID NO: 1696335 - RNA, 14 nt, Human
uuagaucuaguuca

SEQ ID NO: 1696336 - RNA, 16 nt, Human
uuagcuacuauauaug

SEQ ID NO: 1696337 - RNA, 13 nt, Human
uuaagcauauauu

SEQ ID NO: 1696338 - RNA, 15 nt, Human
uuaagcauauauuuu

SEQ ID NO: 1696339 - RNA, 18 nt, Human
uuaagcauauauuuuuau

SEQ ID NO: 1696340 - RNA, 19 nt, Human
uuaagcauauauuuuuaua

SEQ ID NO: 1696341 - RNA, 23 nt, Human
uuaagcauauauuuuuauauuua

SEQ ID NO: 1696342 - RNA, 21 nt, Human
uuaauauuaaagccauguuua

SEQ ID NO: 1696343 - RNA, 22 nt, Human
uuaauauuaaagccauguuuau

SEQ ID NO: 1696344 - RNA, 15 nt, Human
uuaauaucaucagua

SEQ ID NO: 1696345 - RNA, 17 nt, Human
uggaccaaaaaccagua

SEQ ID NO: 1696346 - RNA, 22 nt, Human
uggaccaaaaaccaguauugua

SEQ ID NO: 1696347 - RNA, 20 nt, Human
uggauaauaaggaaaaguuu

SEQ ID NO: 1696348 - RNA, 15 nt, Human
uggugacugauucuu

SEQ ID NO: 1696349 - RNA, 16 nt, Human
uggugacugauucuuc

SEQ ID NO: 1696350 - RNA, 19 nt, Human
uggugacugauucuucagc

SEQ ID NO: 1696351 - RNA, 17 nt, Human
ugguccgugcuaaggac

SEQ ID NO: 1696352 - RNA, 18 nt, Human
ugguccgugcuaaggacu

SEQ ID NO: 1696353 - RNA, 19 nt, Human
ugguccgugcuaaggacuu

SEQ ID NO: 1696354 - RNA, 20 nt, Human
ugguccgugcuaaggacuug

SEQ ID NO: 1696355 - RNA, 13 nt, Human
ugccuaaauccau

SEQ ID NO: 1696356 - RNA, 15 nt, Human
ugccuaaauccauuu

SEQ ID NO: 1696357 - RNA, 19 nt, Human
ugccuaaauccauuuggaa

SEQ ID NO: 1696358 - RNA, 20 nt, Human
ugccuaaauccauuuggaaa

SEQ ID NO: 1696359 - RNA, 22 nt, Human
ugccuaaauccauuuggaaauc

SEQ ID NO: 1696360 - RNA, 23 nt, Human
ugccuaaauccauuuggaaaucu

SEQ ID NO: 1696361 - RNA, 20 nt, Human
ugccucacccacccuuuuuu

SEQ ID NO: 1696362 - RNA, 23 nt, Human
ugccucacccacccuuuuuuaaa

SEQ ID NO: 1696363 - RNA, 20 nt, Human
ugcauaggugaucucauuua

SEQ ID NO: 1696364 - RNA, 19 nt, Human
ugcgcuaaacuuuucugau

SEQ ID NO: 1696365 - RNA, 20 nt, Human
ugcgcuaaacuuuucugaua

SEQ ID NO: 1696366 - RNA, 21 nt, Human
ugcgcuaaacuuuucugauag

SEQ ID NO: 1696367 - RNA, 22 nt, Human
ugcugguguaugugugaaguga

SEQ ID NO: 1696368 - RNA, 13 nt, Human
ugcugguguaugu

SEQ ID NO: 1696369 - RNA, 17 nt, Human
ugcugggguuaucugaa

SEQ ID NO: 1696370 - RNA, 20 nt, Human
ugcugggguuaucugaaguc

SEQ ID NO: 1696371 - RNA, 21 nt, Human
ugauucuucagcaaaaauauu

SEQ ID NO: 1696372 - RNA, 15 nt, Human
ugauagaggaagccu

SEQ ID NO: 1696373 - RNA, 22 nt, Human
ugaucucauuuaauccucucaa

SEQ ID NO: 1696374 - RNA, 15 nt, Human
ugaucucauuuaauc

SEQ ID NO: 1696375 - RNA, 15 nt, Human
ugagcaucacaguuu

SEQ ID NO: 1696376 - RNA, 14 nt, Human
ugagcaucacaguu

SEQ ID NO: 1696377 - RNA, 19 nt, Human
ucuugccuuuuucauuauu

SEQ ID NO: 1696378 - RNA, 16 nt, Human
ucuugccuuuuucauu

SEQ ID NO: 1696379 - RNA, 17 nt, Human
ucuugccuuuuucauua

SEQ ID NO: 1696380 - RNA, 14 nt, Human
ugaagugaaacugc

SEQ ID NO: 1696381 - RNA, 13 nt, Human
ugaagugaaacug

SEQ ID NO: 1696382 - RNA, 12 nt, Human
ugaagugaaacu

SEQ ID NO: 1696383 - RNA, 20 nt, Human
ugaagucagaucugccuaag

SEQ ID NO: 1696384 - RNA, 23 nt, Human
ugaagucagaucugccuaaggac

SEQ ID NO: 1696385 - RNA, 17 nt, Human
ugacauagucuggcugu

SEQ ID NO: 1696386 - RNA, 16 nt, Human
ugacauagucuggcug

SEQ ID NO: 1696387 - RNA, 20 nt, Human
uccuaucaccugucuugccu

SEQ ID NO: 1696388 - RNA, 13 nt, Human
ucccauuauucaa

SEQ ID NO: 1696389 - RNA, 14 nt, Human
ucccauuauucaaa

SEQ ID NO: 1696390 - RNA, 16 nt, Human
ucccauuauucaaagu

SEQ ID NO: 1696391 - RNA, 18 nt, Human
ucccauuauucaaaguug

SEQ ID NO: 1696392 - RNA, 19 nt, Human
ucccauuauucaaaguugc

SEQ ID NO: 1696393 - RNA, 14 nt, Human
uccagcagauuauu

SEQ ID NO: 1696394 - RNA, 15 nt, Human
uccagcagauuauuc

SEQ ID NO: 1696395 - RNA, 16 nt, Human
uccagcagauuauuca

SEQ ID NO: 1696396 - RNA, 17 nt, Human
uccagcagauuauucac

SEQ ID NO: 1696397 - RNA, 20 nt, Human
uccaguuuuguuuggaccaa

SEQ ID NO: 1696398 - RNA, 15 nt, Human
uccaguuuuguuugg

SEQ ID NO: 1696399 - RNA, 17 nt, Human
uccaguuuuguuuggac

SEQ ID NO: 1696400 - RNA, 23 nt, Human
ucaguauugaagcauuuuauaaa

SEQ ID NO: 1696401 - RNA, 22 nt, Human
ucaguauugaagcauuuuauaa

SEQ ID NO: 1696402 - RNA, 20 nt, Human
ucauggaacgcguugaaauu

SEQ ID NO: 1696403 - RNA, 21 nt, Human
ucauggaacgcguugaaauug

SEQ ID NO: 1696404 - RNA, 22 nt, Human
ucauggaacgcguugaaauugu

SEQ ID NO: 1696405 - RNA, 16 nt, Human
uauuaagcauauauuu

SEQ ID NO: 1696406 - RNA, 12 nt, Human
uauuaugaaacu

SEQ ID NO: 1696407 - RNA, 20 nt, Human
uauuaugaaacuuguguaaa

SEQ ID NO: 1696408 - RNA, 21 nt, Human
uauuaugaaacuuguguaaau

SEQ ID NO: 1696409 - RNA, 22 nt, Human
uauuaugaaacuuguguaaaua

SEQ ID NO: 1696410 - RNA, 12 nt, Human
uauuauguaaau

SEQ ID NO: 1696411 - RNA, 15 nt, Human
uauuauguaaauccc

SEQ ID NO: 1696412 - RNA, 22 nt, Human
uauuauguaaaucccauuauuc

SEQ ID NO: 1696413 - RNA, 19 nt, Human
uauugugcgcuaaacuuuu

SEQ ID NO: 1696414 - RNA, 22 nt, Human
uauugugcgcuaaacuuuucug

SEQ ID NO: 1696415 - RNA, 23 nt, Human
uauugugcgcuaaacuuuucuga

SEQ ID NO: 1696416 - RNA, 19 nt, Human
ucaauaaaaaauuaugaca

SEQ ID NO: 1696417 - RNA, 18 nt, Human
ucacauugguguuguacu

SEQ ID NO: 1696418 - RNA, 14 nt, Human
ucaauaaaaaauua

SEQ ID NO: 1696419 - RNA, 16 nt, Human
ucaauaaaaaauuaug

SEQ ID NO: 1696420 - RNA, 13 nt, Human
ucaauaaaaaauu

SEQ ID NO: 1696421 - RNA, 15 nt, Human
uauaauuaacauguu

SEQ ID NO: 1696422 - RNA, 16 nt, Human
uauaauuaacauguua

SEQ ID NO: 1696423 - RNA, 18 nt, Human
uauaauuaacauguuaaa

SEQ ID NO: 1696424 - RNA, 19 nt, Human
uauaauuaacauguuaaac

SEQ ID NO: 1696425 - RNA, 13 nt, Human
uauaauuaacaug

SEQ ID NO: 1696426 - RNA, 14 nt, Human
uauaauuaacaugu

SEQ ID NO: 1696427 - RNA, 12 nt, Human
uauaauuaacau

SEQ ID NO: 1696428 - RNA, 20 nt, Human
uauaaucacuuuuuuccaca

SEQ ID NO: 1696429 - RNA, 22 nt, Human
uauaauuaacauguuaaaccau

SEQ ID NO: 1696430 - RNA, 23 nt, Human
uauaaaucgcuuuugauaaucaa

SEQ ID NO: 1696431 - RNA, 18 nt, Human
uauaucugaggaauucug

SEQ ID NO: 1696432 - RNA, 19 nt, Human
uauaucugaggaauucugu

SEQ ID NO: 1696433 - RNA, 20 nt, Human
uauaucugaggaauucugua

SEQ ID NO: 1696434 - RNA, 21 nt, Human
uauaucugaggaauucuguau

SEQ ID NO: 1696435 - RNA, 22 nt, Human
uauaucugaggaauucuguaua

SEQ ID NO: 1696436 - RNA, 18 nt, Human
uauauaaaugguuaaaag

SEQ ID NO: 1696437 - RNA, 16 nt, Human
uauaugugaugaucua

SEQ ID NO: 1696438 - RNA, 21 nt, Human
uaggugaucucauuuaauccu

SEQ ID NO: 1696439 - RNA, 16 nt, Human
uaugacuucauuaaua

SEQ ID NO: 1696440 - RNA, 20 nt, Human
uaugacuucauuaauaauaa

SEQ ID NO: 1696441 - RNA, 15 nt, Human
uaugcuuuaaacauu

SEQ ID NO: 1696442 - RNA, 18 nt, Human
uaucugaggaauucugua

SEQ ID NO: 1696443 - RNA, 19 nt, Human
uaucugaggaauucuguau

SEQ ID NO: 1696444 - RNA, 21 nt, Human
uaucugaggaauucuguauag

SEQ ID NO: 1696445 - RNA, 22 nt, Human
uaucugaggaauucuguauaga

SEQ ID NO: 1696446 - RNA, 17 nt, Human
uaucugaggaauucugu

SEQ ID NO: 1696447 - RNA, 23 nt, Human
gugaaacugcuuguuuccuagca

SEQ ID NO: 1696448 - RNA, 20 nt, Human
gugaaacugcuuguuuccua

SEQ ID NO: 1696449 - RNA, 21 nt, Human
gugaaacugcuuguuuccuag

SEQ ID NO: 1696450 - RNA, 17 nt, Human
gugaauggcuuuguaua

SEQ ID NO: 1696451 - RNA, 18 nt, Human
gugaauggcuuuguauag

SEQ ID NO: 1696452 - RNA, 19 nt, Human
gugaauggcuuuguauaga

SEQ ID NO: 1696453 - RNA, 13 nt, Human
gugaauggcuuug

SEQ ID NO: 1696454 - RNA, 14 nt, Human
gugaauggcuuugu

SEQ ID NO: 1696455 - RNA, 13 nt, Human
gucucagauuuua

SEQ ID NO: 1696456 - RNA, 12 nt, Human
guauuuguuugc

SEQ ID NO: 1696457 - RNA, 23 nt, Human
guauuuguuugcauaggugaucu

SEQ ID NO: 1696458 - RNA, 16 nt, Human
gguccgugcuaaggac

SEQ ID NO: 1696459 - RNA, 17 nt, Human
gguccgugcuaaggacu

SEQ ID NO: 1696460 - RNA, 18 nt, Human
gguccgugcuaaggacuu

SEQ ID NO: 1696461 - RNA, 14 nt, Human
ggugaauggcuuug

SEQ ID NO: 1696462 - RNA, 17 nt, Human
ggugaauggcuuuguau

SEQ ID NO: 1696463 - RNA, 20 nt, Human
ggugaauggcuuuguauaga

SEQ ID NO: 1696464 - RNA, 19 nt, Human
ggugcccugcuuucagaua

SEQ ID NO: 1696465 - RNA, 16 nt, Human
guaaaucccauuauuc

SEQ ID NO: 1696466 - RNA, 17 nt, Human
guaaaucccauuauuca

SEQ ID NO: 1696467 - RNA, 18 nt, Human
guaaaucccauuauucaa

SEQ ID NO: 1696468 - RNA, 19 nt, Human
guaaaucccauuauucaaa

SEQ ID NO: 1696469 - RNA, 20 nt, Human
guaaaucccauuauucaaag

SEQ ID NO: 1696470 - RNA, 21 nt, Human
guaaaucccauuauucaaagu

SEQ ID NO: 1696471 - RNA, 21 nt, Human
guaaauacaauuuuguuucug

SEQ ID NO: 1696472 - RNA, 15 nt, Human
guaaaucccauuauu

SEQ ID NO: 1696473 - RNA, 22 nt, Human
guaaauacaauuuuguuucugu

SEQ ID NO: 1696474 - RNA, 23 nt, Human
guaaauacaauuuuguuucugua

SEQ ID NO: 1696475 - RNA, 13 nt, Human
guaauuauaucug

SEQ ID NO: 1696476 - RNA, 12 nt, Human
guacuuuuuggc

SEQ ID NO: 1696477 - RNA, 21 nt, Human
guacuuuuuggcauaacauaa

SEQ ID NO: 1696478 - RNA, 13 nt, Human
gccugauuaaaga

SEQ ID NO: 1696479 - RNA, 16 nt, Human
gccugauuaaagaaug

SEQ ID NO: 1696480 - RNA, 23 nt, Human
gccugcacggugaauggcuuugu

SEQ ID NO: 1696481 - RNA, 20 nt, Human
ggauucuuaaaguugaauuu

SEQ ID NO: 1696482 - RNA, 18 nt, Human
ggauucuuaaaguugaau

SEQ ID NO: 1696483 - RNA, 19 nt, Human
ggauucuuaaaguugaauu

SEQ ID NO: 1696484 - RNA, 16 nt, Human
ggauucuuaaaguuga

SEQ ID NO: 1696485 - RNA, 14 nt, Human
ggaaaaguuuaaua

SEQ ID NO: 1696486 - RNA, 18 nt, Human
ggaaaaguuuaauauuaa

SEQ ID NO: 1696487 - RNA, 14 nt, Human
gcuuucagauacug

SEQ ID NO: 1696488 - RNA, 18 nt, Human
gcuuucagauacuggauu

SEQ ID NO: 1696489 - RNA, 23 nt, Human
gcuuucagauacuggauuguacu

SEQ ID NO: 1696490 - RNA, 15 nt, Human
ggacuguggugacuu

SEQ ID NO: 1696491 - RNA, 17 nt, Human
ggacuguggugacuuug

SEQ ID NO: 1696492 - RNA, 21 nt, Human
ggacuguggugacuuuggaua

SEQ ID NO: 1696493 - RNA, 22 nt, Human
ggacuguggugacuuuggauaa

SEQ ID NO: 1696494 - RNA, 14 nt, Human
ggacuguggugacu

SEQ ID NO: 1696495 - RNA, 16 nt, Human
ggaccaaaaaccagua

SEQ ID NO: 1696496 - RNA, 23 nt, Human
ggaccaaaaaccaguauuguaca

SEQ ID NO: 1696497 - RNA, 12 nt, Human
ggaauucuguau

SEQ ID NO: 1696498 - RNA, 15 nt, Human
ggaauucuguauaga

SEQ ID NO: 1696499 - RNA, 17 nt, Human
ggaauucuguauagauu

SEQ ID NO: 1696500 - RNA, 17 nt, Human
gauaacuguuauuuaua

SEQ ID NO: 1696501 - RNA, 18 nt, Human
gauaacuguuauuuauaa

SEQ ID NO: 1696502 - RNA, 11 nt, Human
gauaaaugcca

SEQ ID NO: 1696503 - RNA, 15 nt, Human
gauaaaugccaucaa

SEQ ID NO: 1696504 - RNA, 20 nt, Human
gauaaaugccaucaauaaaa

SEQ ID NO: 1696505 - RNA, 16 nt, Human
gaguguugaaacggau

SEQ ID NO: 1696506 - RNA, 13 nt, Human
gauuuuaugcuuu

SEQ ID NO: 1696507 - RNA, 19 nt, Human
gaaugaaauacuguuugag

SEQ ID NO: 1696508 - RNA, 15 nt, Human
gaaugaaauacuguu

SEQ ID NO: 1696509 - RNA, 18 nt, Human
gaaugaaauacuguuuga

SEQ ID NO: 1696510 - RNA, 17 nt, Human
gaauggcuuuguauaga

SEQ ID NO: 1696511 - RNA, 14 nt, Human
gaauggcuuuguau

SEQ ID NO: 1696512 - RNA, 16 nt, Human
gaauggcuuuguauag

SEQ ID NO: 1696513 - RNA, 14 nt, Human
gaauucuguauaga

SEQ ID NO: 1696514 - RNA, 21 nt, Human
gaauucuguauagauuagaau

SEQ ID NO: 1696515 - RNA, 22 nt, Human
gaauucuguauagauuagaauu

SEQ ID NO: 1696516 - RNA, 13 nt, Human
gaauucuguauag

SEQ ID NO: 1696517 - RNA, 16 nt, Human
gacuucuuuaauuuug

SEQ ID NO: 1696518 - RNA, 17 nt, Human
gacuucuuuaauuuugg

SEQ ID NO: 1696519 - RNA, 18 nt, Human
gacuucuuuaauuuugga

SEQ ID NO: 1696520 - RNA, 19 nt, Human
gacuucuuuaauuuuggaa

SEQ ID NO: 1696521 - RNA, 20 nt, Human
gacuucuuuaauuuuggaau

SEQ ID NO: 1696522 - RNA, 21 nt, Human
gacuucuuuaauuuuggaauu

SEQ ID NO: 1696523 - RNA, 13 nt, Human
gagaguguugaaa

SEQ ID NO: 1696524 - RNA, 12 nt, Human
cugccuaaggac

SEQ ID NO: 1696525 - RNA, 13 nt, Human
cugccuaaggacu

SEQ ID NO: 1696526 - RNA, 14 nt, Human
cugccuaaggacuu

SEQ ID NO: 1696527 - RNA, 15 nt, Human
cugccuaaggacuuc

SEQ ID NO: 1696528 - RNA, 16 nt, Human
cuguauagauuagaau

SEQ ID NO: 1696529 - RNA, 19 nt, Human
cuucuuuaauuuuggaauu

SEQ ID NO: 1696530 - RNA, 15 nt, Human
cuucuuuaauuuugg

SEQ ID NO: 1696531 - RNA, 16 nt, Human
cuucuuuaauuuugga

SEQ ID NO: 1696532 - RNA, 17 nt, Human
cuucuuuaauuuuggaa

SEQ ID NO: 1696533 - RNA, 18 nt, Human
cuucuuuaauuuuggaau

SEQ ID NO: 1696534 - RNA, 15 nt, Human
cuuugugcugggguu

SEQ ID NO: 1696535 - RNA, 20 nt, Human
cuuugugcugggguuaucug

SEQ ID NO: 1696536 - RNA, 22 nt, Human
cuuugugcugggguuaucugaa

SEQ ID NO: 1696537 - RNA, 23 nt, Human
cuuugucuacaccauuaugugcg

SEQ ID NO: 1696538 - RNA, 20 nt, Human
cuuugucuacaccauuaugu

SEQ ID NO: 1696539 - RNA, 16 nt, Human
cuuucucuuucguuac

SEQ ID NO: 1696540 - RNA, 14 nt, Human
cuuguguaaauaca

SEQ ID NO: 1696541 - RNA, 16 nt, Human
cuuguguaaauacaau

SEQ ID NO: 1696542 - RNA, 21 nt, Human
cuuguguaaauacaauuuugu

SEQ ID NO: 1696543 - RNA, 12 nt, Human
cuuguguaaaua

SEQ ID NO: 1696544 - RNA, 22 nt, Human
cuuguuagaucuaguucacucu

SEQ ID NO: 1696545 - RNA, 21 nt, Human
cuuuaaacauugguucuugua

SEQ ID NO: 1696546 - RNA, 17 nt, Human
gaaacggaugauuucua

SEQ ID NO: 1696547 - RNA, 18 nt, Human
gaaacggaugauuucuau

SEQ ID NO: 1696548 - RNA, 16 nt, Human
cuuuuuggcauaacau

SEQ ID NO: 1696549 - RNA, 20 nt, Human
cuuuuuggcauaacauaaau

SEQ ID NO: 1696550 - RNA, 22 nt, Human
cuuuuuggcauaacauaaaucu

SEQ ID NO: 1696551 - RNA, 19 nt, Human
gaaaaguuuaauauuaaag

SEQ ID NO: 1696552 - RNA, 20 nt, Human
gaaaaguuuaauauuaaagc

SEQ ID NO: 1696553 - RNA, 21 nt, Human
gaaaaguuuaauauuaaagcc

SEQ ID NO: 1696554 - RNA, 22 nt, Human
gaaaaguuuaauauuaaagcca

SEQ ID NO: 1696555 - RNA, 15 nt, Human
gaaaaguuuaauauu

SEQ ID NO: 1696556 - RNA, 23 nt, Human
gaaaaguuuaauauuaaagccau

SEQ ID NO: 1696557 - RNA, 17 nt, Human
cgcuaaacuuuucugau

SEQ ID NO: 1696558 - RNA, 18 nt, Human
cgcuaaacuuuucugaua

SEQ ID NO: 1696559 - RNA, 19 nt, Human
cgcuaaacuuuucugauag

SEQ ID NO: 1696560 - RNA, 24 nt, Human
cgcguugaaauuguaauuauaucu

SEQ ID NO: 1696561 - RNA, 23 nt, Human
cucagauuuuauuauguaaaucc

SEQ ID NO: 1696562 - RNA, 22 nt, Human
cucagauuuuauuauguaaauc

SEQ ID NO: 1696563 - RNA, 13 nt, Human
cuccauuuaauaa

SEQ ID NO: 1696564 - RNA, 20 nt, Human
cuccauuuaauaauuauaug

SEQ ID NO: 1696565 - RNA, 22 nt, Human
cucccuauuuuuuuucuguuau

SEQ ID NO: 1696566 - RNA, 19 nt, Human
cuauuucuauauuuucauu

SEQ ID NO: 1696567 - RNA, 20 nt, Human
cuauuucuauauuuucauuc

SEQ ID NO: 1696568 - RNA, 18 nt, Human
cucaaccaccuuucagau

SEQ ID NO: 1696569 - RNA, 14 nt, Human
cuaugcugaguuug

SEQ ID NO: 1696570 - RNA, 15 nt, Human
cuaugcugaguuugu

SEQ ID NO: 1696571 - RNA, 13 nt, Human
cuaugcugaguuu

SEQ ID NO: 1696572 - RNA, 14 nt, Human
cuagacuggugacu

SEQ ID NO: 1696573 - RNA, 15 nt, Human
cuagacuggugacug

SEQ ID NO: 1696574 - RNA, 17 nt, Human
cuagacuggugacugau

SEQ ID NO: 1696575 - RNA, 18 nt, Human
cuagacuggugacugauu

SEQ ID NO: 1696576 - RNA, 19 nt, Human
cuagacuggugacugauuc

SEQ ID NO: 1696577 - RNA, 22 nt, Human
cuagacuggugacugauucuuc

SEQ ID NO: 1696578 - RNA, 23 nt, Human
cuagacuggugacugauucuuca

SEQ ID NO: 1696579 - RNA, 14 nt, Human
cuaaggacuucuuu

SEQ ID NO: 1696580 - RNA, 15 nt, Human
cuaaggacuucuuua

SEQ ID NO: 1696581 - RNA, 16 nt, Human
cuaaggacuucuuuaa

SEQ ID NO: 1696582 - RNA, 22 nt, Human
cuaaggacuucuuuaauuuugg

SEQ ID NO: 1696583 - RNA, 22 nt, Human
cuaaaauggacuguggugacuu

SEQ ID NO: 1696584 - RNA, 21 nt, Human
cuaaaauggacuguggugacu

SEQ ID NO: 1696585 - RNA, 18 nt, Human
cccauuauucaaaguugc

SEQ ID NO: 1696586 - RNA, 23 nt, Human
cccauuauucaaaguugccuaaa

SEQ ID NO: 1696587 - RNA, 16 nt, Human
ccccacccugccucac

SEQ ID NO: 1696588 - RNA, 11 nt, Human
ccauuauucaa

SEQ ID NO: 1696589 - RNA, 13 nt, Human
ccauuuggaaauc

SEQ ID NO: 1696590 - RNA, 14 nt, Human
caaaaauauuuuau

SEQ ID NO: 1696591 - RNA, 15 nt, Human
caaaaauauuuuaug

SEQ ID NO: 1696592 - RNA, 17 nt, Human
caaaaauauuuuaugau

SEQ ID NO: 1696593 - RNA, 21 nt, Human
caaaaauauuuuaugauccag

SEQ ID NO: 1696594 - RNA, 22 nt, Human
caaaaauauuuuaugauccagc

SEQ ID NO: 1696595 - RNA, 23 nt, Human
caaaaauauuuuaugauccagca

SEQ ID NO: 1696596 - RNA, 19 nt, Human
caaaaaccaguauuguaca

SEQ ID NO: 1696597 - RNA, 20 nt, Human
caaaaaccaguauuguacaa

SEQ ID NO: 1696598 - RNA, 18 nt, Human
caaaaaccaguauuguac

SEQ ID NO: 1696599 - RNA, 23 nt, Human
caauuaaggauuuuaugcuuuaa

SEQ ID NO: 1696600 - RNA, 23 nt, Human
uuuuguuuggaccaaaaaccagu

SEQ ID NO: 1696601 - RNA, 13 nt, Human
uuuuguuucugua

SEQ ID NO: 1696602 - RNA, 12 nt, Human
uuuuguuuggac

SEQ ID NO: 1696603 - RNA, 22 nt, Human
uuuuguuuggaccaaaaaccag

SEQ ID NO: 1696604 - RNA, 12 nt, Human
uuuuguuucugu

SEQ ID NO: 1696605 - RNA, 18 nt, Human
uuuuguuguuuguuuagu

SEQ ID NO: 1696606 - RNA, 14 nt, Human
auuaagcauauauu

SEQ ID NO: 1696607 - RNA, 15 nt, Human
auuaagcauauauuu

SEQ ID NO: 1696608 - RNA, 21 nt, Human
auuaagcauauauuuuuauau

SEQ ID NO: 1696609 - RNA, 11 nt, Human
auuaaagccau

SEQ ID NO: 1696610 - RNA, 21 nt, Human
auuagaauucuguauagauua

SEQ ID NO: 1696611 - RNA, 15 nt, Human
auuagaauucuguau

SEQ ID NO: 1696612 - RNA, 16 nt, Human
auuagaauucuguaua

SEQ ID NO: 1696613 - RNA, 17 nt, Human
auuagaauucuguauag

SEQ ID NO: 1696614 - RNA, 18 nt, Human
auuagaauucuguauaga

SEQ ID NO: 1696615 - RNA, 13 nt, Human
auuagaauucugu

SEQ ID NO: 1696616 - RNA, 14 nt, Human
auuagaauucugua

SEQ ID NO: 1696617 - RNA, 12 nt, Human
auuagaauucug

SEQ ID NO: 1696618 - RNA, 15 nt, Human
auuaauaauaaauuc

SEQ ID NO: 1696619 - RNA, 12 nt, Human
auguuaaaccau

SEQ ID NO: 1696620 - RNA, 13 nt, Human
auguuaaaccaug

SEQ ID NO: 1696621 - RNA, 20 nt, Human
auguuaaaccaugggauaaa

SEQ ID NO: 1696622 - RNA, 12 nt, Human
uuuuauuaugaa

SEQ ID NO: 1696623 - RNA, 21 nt, Human
uuuuauuaugaaacuugugua

SEQ ID NO: 1696624 - RNA, 22 nt, Human
uuuuauuaugaaacuuguguaa

SEQ ID NO: 1696625 - RNA, 15 nt, Human
uuuucugauccaguu

SEQ ID NO: 1696626 - RNA, 21 nt, Human
auucccuggccuuucauauuu

SEQ ID NO: 1696627 - RNA, 13 nt, Human
auucccuggccuu

SEQ ID NO: 1696628 - RNA, 19 nt, Human
auucccuggccuuucauau

SEQ ID NO: 1696629 - RNA, 21 nt, Human
auucuccuaucaccugucuug

SEQ ID NO: 1696630 - RNA, 14 nt, Human
auugguguuguacu

SEQ ID NO: 1696631 - RNA, 22 nt, Human
auugguguuguacucaauuuua

SEQ ID NO: 1696632 - RNA, 23 nt, Human
auugguguuguacucaauuuuaa

SEQ ID NO: 1696633 - RNA, 13 nt, Human
auucuuaaaguug

SEQ ID NO: 1696634 - RNA, 14 nt, Human
auucuuaaaguuga

SEQ ID NO: 1696635 - RNA, 15 nt, Human
auucuuaaaguugaa

SEQ ID NO: 1696636 - RNA, 16 nt, Human
auucuuaaaguugaau

SEQ ID NO: 1696637 - RNA, 21 nt, Human
auucuguauagauuagaauuc

SEQ ID NO: 1696638 - RNA, 15 nt, Human
auucuucagcaaaaa

SEQ ID NO: 1696639 - RNA, 23 nt, Human
auucuucagcaaaaauauuuuau

SEQ ID NO: 1696640 - RNA, 18 nt, Human
auucuuaaaguugaauuu

SEQ ID NO: 1696641 - RNA, 16 nt, Human
auuuuauuauguaaau

SEQ ID NO: 1696642 - RNA, 17 nt, Human
auuuuauuauguaaauc

SEQ ID NO: 1696643 - RNA, 18 nt, Human
auuuuauuauguaaaucc

SEQ ID NO: 1696644 - RNA, 19 nt, Human
auuuuauuauguaaauccc

SEQ ID NO: 1696645 - RNA, 20 nt, Human
auuuuauuauguaaauccca

SEQ ID NO: 1696646 - RNA, 21 nt, Human
auuuuauuauguaaaucccau

SEQ ID NO: 1696647 - RNA, 13 nt, Human
auuuuccuccuuu

SEQ ID NO: 1696648 - RNA, 17 nt, Human
auuuuccuccuuucucu

SEQ ID NO: 1696649 - RNA, 15 nt, Human
uuguaauuauaucug

SEQ ID NO: 1696650 - RNA, 16 nt, Human
uugguuaagucuguuu

SEQ ID NO: 1696651 - RNA, 18 nt, Human
uugguuaagucuguuuua

SEQ ID NO: 1696652 - RNA, 17 nt, Human
uuuaaaaaaaaaauugg

SEQ ID NO: 1696653 - RNA, 23 nt, Human
augaucuaccagccucccuauuu

SEQ ID NO: 1696654 - RNA, 15 nt, Human
uuucuauauuuucau

SEQ ID NO: 1696655 - RNA, 18 nt, Human
uuucuauauuuucauucu

SEQ ID NO: 1696656 - RNA, 13 nt, Human
uuucuauauuuuc

SEQ ID NO: 1696657 - RNA, 21 nt, Human
uuucuaugcugaguuugugcu

SEQ ID NO: 1696658 - RNA, 15 nt, Human
uuuacuaaaauggac

SEQ ID NO: 1696659 - RNA, 17 nt, Human
uuuacuaaaauggacug

SEQ ID NO: 1696660 - RNA, 23 nt, Human
uuuagcuacuauauaugugauga

SEQ ID NO: 1696661 - RNA, 21 nt, Human
uuuauuaugaaacuuguguaa

SEQ ID NO: 1696662 - RNA, 13 nt, Human
uuuauuaugaaac

SEQ ID NO: 1696663 - RNA, 17 nt, Human
uucagcaaaaauauuuu

SEQ ID NO: 1696664 - RNA, 19 nt, Human
uucagcaaaaauauuuuau

SEQ ID NO: 1696665 - RNA, 22 nt, Human
uucauuauuuuauuaugaaacu

SEQ ID NO: 1696666 - RNA, 21 nt, Human
uucauggaacgcguugaaauu

SEQ ID NO: 1696667 - RNA, 22 nt, Human
uucauggaacgcguugaaauug

SEQ ID NO: 1696668 - RNA, 15 nt, Human
uucauuaauaauaaa

SEQ ID NO: 1696669 - RNA, 18 nt, Human
uucauuaauaauaaauuc

SEQ ID NO: 1696670 - RNA, 21 nt, Human
uucauuaauaauaaauucccu

SEQ ID NO: 1696671 - RNA, 19 nt, Human
uucauggaacgcguugaaa

SEQ ID NO: 1696672 - RNA, 20 nt, Human
uucauggaacgcguugaaau

SEQ ID NO: 1696673 - RNA, 13 nt, Human
auauauuuuuaua

SEQ ID NO: 1696674 - RNA, 19 nt, Human
aucaacugggcugaacacu

SEQ ID NO: 1696675 - RNA, 12 nt, Human
auauuaaagcca

SEQ ID NO: 1696676 - RNA, 17 nt, Human
uugacauagucuggcug

SEQ ID NO: 1696677 - RNA, 14 nt, Human
uugacauagucugg

SEQ ID NO: 1696678 - RNA, 19 nt, Human
uugauaaucaacugggcug

SEQ ID NO: 1696679 - RNA, 13 nt, Human
uucuuaaaguuga

SEQ ID NO: 1696680 - RNA, 15 nt, Human
uucuuaaauaauaaa

SEQ ID NO: 1696681 - RNA, 19 nt, Human
uucuuaaauaauaaagauc

SEQ ID NO: 1696682 - RNA, 14 nt, Human
ugcuauuucuauau

SEQ ID NO: 1696683 - RNA, 20 nt, Human
ugcuauuucuauauuuucau

SEQ ID NO: 1696684 - RNA, 21 nt, Human
ugcuauuucuauauuuucauu

SEQ ID NO: 1696685 - RNA, 12 nt, Human
ugcuauuucuau

SEQ ID NO: 1696686 - RNA, 13 nt, Human
ugcuauuucuaua

SEQ ID NO: 1696687 - RNA, 14 nt, Human
aggacuuguuagau

SEQ ID NO: 1696688 - RNA, 16 nt, Human
aggacuuguuagaucu

SEQ ID NO: 1696689 - RNA, 17 nt, Human
aggacuuguuagaucua

SEQ ID NO: 1696690 - RNA, 20 nt, Human
aggauuuuaugcuuuaaaca

SEQ ID NO: 1696691 - RNA, 12 nt, Human
ugauuucuaugc

SEQ ID NO: 1696692 - RNA, 15 nt, Human
ugauuucuaugcuga

SEQ ID NO: 1696693 - RNA, 16 nt, Human
ugauuucuaugcugag

SEQ ID NO: 1696694 - RNA, 21 nt, Human
uguuguacucaauuuuaacaa

SEQ ID NO: 1696695 - RNA, 14 nt, Human
uuauaaaucgcuuu

SEQ ID NO: 1696696 - RNA, 17 nt, Human
uuauaaaucgcuuuuga

SEQ ID NO: 1696697 - RNA, 18 nt, Human
uuauaaaucgcuuuugau

SEQ ID NO: 1696698 - RNA, 21 nt, Human
auaauuauaugcuauuucuau

SEQ ID NO: 1696699 - RNA, 23 nt, Human
auaauuauaugcuauuucuauau

SEQ ID NO: 1696700 - RNA, 17 nt, Human
auaauuauaugcuauuu

SEQ ID NO: 1696701 - RNA, 19 nt, Human
auaauuauaugcuauuucu

SEQ ID NO: 1696702 - RNA, 19 nt, Human
auaaucacuuuuuuccaca

SEQ ID NO: 1696703 - RNA, 16 nt, Human
auaauaaggaaaaguu

SEQ ID NO: 1696704 - RNA, 17 nt, Human
auaauaaggaaaaguuu

SEQ ID NO: 1696705 - RNA, 18 nt, Human
auaauaaggaaaaguuua

SEQ ID NO: 1696706 - RNA, 19 nt, Human
auaauaaggaaaaguuuaa

SEQ ID NO: 1696707 - RNA, 22 nt, Human
auaauaaggaaaaguuuaauau

SEQ ID NO: 1696708 - RNA, 18 nt, Human
ugguuaagucuguuuuau

SEQ ID NO: 1696709 - RNA, 15 nt, Human
ugguuaagucuguuu

SEQ ID NO: 1696710 - RNA, 21 nt, Human
uguaaauacaauuuuguuucu

SEQ ID NO: 1696711 - RNA, 10 nt, Human
uguaaauccc

SEQ ID NO: 1696712 - RNA, 16 nt, Human
uguaaauacaauuuug

SEQ ID NO: 1696713 - RNA, 17 nt, Human
uguaaauacaauuuugu

SEQ ID NO: 1696714 - RNA, 18 nt, Human
uguaaauacaauuuuguu

SEQ ID NO: 1696715 - RNA, 19 nt, Human
uguaaauacaauuuuguuu

SEQ ID NO: 1696716 - RNA, 13 nt, Human
uguacaaaguauu

SEQ ID NO: 1696717 - RNA, 14 nt, Human
uguacaaaguauua

SEQ ID NO: 1696718 - RNA, 15 nt, Human
ugucuugccuuuuuc

SEQ ID NO: 1696719 - RNA, 16 nt, Human
ugucuugccuuuuuca

SEQ ID NO: 1696720 - RNA, 17 nt, Human
ugucuugccuuuuucau

SEQ ID NO: 1696721 - RNA, 21 nt, Human
ugucuugccuuuuucauuauu

SEQ ID NO: 1696722 - RNA, 14 nt, Human
ugugaacuaaacuu

SEQ ID NO: 1696723 - RNA, 19 nt, Human
ugugaacuaaacuuucaca

SEQ ID NO: 1696724 - RNA, 20 nt, Human
ugugaacuaaacuuucacac

SEQ ID NO: 1696725 - RNA, 22 nt, Human
ugucuucauaccuacauguauu

SEQ ID NO: 1696726 - RNA, 13 nt, Human
agucuguuuuaug

SEQ ID NO: 1696727 - RNA, 14 nt, Human
agucuguuuuauga

SEQ ID NO: 1696728 - RNA, 17 nt, Human
agucuguuuuaugacuu

SEQ ID NO: 1696729 - RNA, 18 nt, Human
agucuguuuuaugacuuc

SEQ ID NO: 1696730 - RNA, 18 nt, Human
agucucugaagugaaacu

SEQ ID NO: 1696731 - RNA, 19 nt, Human
agucucugaagugaaacug

SEQ ID NO: 1696732 - RNA, 18 nt, Human
ugugagcaucacaguuuu

SEQ ID NO: 1696733 - RNA, 12 nt, Human
uguaugugugaa

SEQ ID NO: 1696734 - RNA, 13 nt, Human
uguaugugugaag

SEQ ID NO: 1696735 - RNA, 12 nt, Human
uguauuaagaau

SEQ ID NO: 1696736 - RNA, 16 nt, Human
uguauuaagaaugaaa

SEQ ID NO: 1696737 - RNA, 15 nt, Human
aguauuguacaaagu

SEQ ID NO: 1696738 - RNA, 20 nt, Human
aguauuguacaaaguauuaa

SEQ ID NO: 1696739 - RNA, 22 nt, Human
aguauuguacaaaguauuaagc

SEQ ID NO: 1696740 - RNA, 23 nt, Human
aguauuguacaaaguauuaagca

SEQ ID NO: 1696741 - RNA, 11 nt, Human
aguauuguaca

SEQ ID NO: 1696742 - RNA, 23 nt, Human
agucagaucugccuaaggacuuc

SEQ ID NO: 1696743 - RNA, 21 nt, Human
agucagaucugccuaaggacu

SEQ ID NO: 1696744 - RNA, 22 nt, Human
agucagaucugccuaaggacuu

SEQ ID NO: 1696745 - RNA, 20 nt, Human
agucagaucugccuaaggac

SEQ ID NO: 1696746 - RNA, 17 nt, Human
agucagaucugccuaag

SEQ ID NO: 1696747 - RNA, 20 nt, Human
agacuggugacugauucuuc

SEQ ID NO: 1696748 - RNA, 21 nt, Human
agacuggugacugauucuuca

SEQ ID NO: 1696749 - RNA, 17 nt, Human
ucuuugucuacaccauu

SEQ ID NO: 1696750 - RNA, 18 nt, Human
ugaaacugcuuguuuccu

SEQ ID NO: 1696751 - RNA, 19 nt, Human
ugaaacugcuuguuuccua

SEQ ID NO: 1696752 - RNA, 16 nt, Human
agagaguguugaaacg

SEQ ID NO: 1696753 - RNA, 15 nt, Human
agagaguguugaaac

SEQ ID NO: 1696754 - RNA, 20 nt, Human
ugaaacugcuuguuuccuag

SEQ ID NO: 1696755 - RNA, 22 nt, Human
ugaaacugcuuguuuccuagca

SEQ ID NO: 1696756 - RNA, 12 nt, Human
agagguuuuucu

SEQ ID NO: 1696757 - RNA, 22 nt, Human
agagguuuuucuuaaauaauaa

SEQ ID NO: 1696758 - RNA, 17 nt, Human
ugaacuaaacuuucaca

SEQ ID NO: 1696759 - RNA, 19 nt, Human
ugaacuaaacuuucacacc

SEQ ID NO: 1696760 - RNA, 13 nt, Human
ugaaauuguaauu

SEQ ID NO: 1696761 - RNA, 14 nt, Human
ugaaauuguaauua

SEQ ID NO: 1696762 - RNA, 15 nt, Human
ugaaauuguaauuau

SEQ ID NO: 1696763 - RNA, 16 nt, Human
ugaaauuguaauuaua

SEQ ID NO: 1696764 - RNA, 19 nt, Human
ugaaauuguaauuauaucu

SEQ ID NO: 1696765 - RNA, 20 nt, Human
ugaaauuguaauuauaucug

SEQ ID NO: 1696766 - RNA, 14 nt, Human
ugaaauacuguuug

SEQ ID NO: 1696767 - RNA, 16 nt, Human
ugaaauacuguuugag

SEQ ID NO: 1696768 - RNA, 15 nt, Human
agauuagaauucugu

SEQ ID NO: 1696769 - RNA, 16 nt, Human
agauuagaauucugua

SEQ ID NO: 1696770 - RNA, 22 nt, Human
agauuagaauucuguauagauu

SEQ ID NO: 1696771 - RNA, 23 nt, Human
agauuagaauucuguauagauua

SEQ ID NO: 1696772 - RNA, 21 nt, Human
agauuagagaguguugaaacg

SEQ ID NO: 1696773 - RNA, 17 nt, Human
acuuuggauaauaagga

SEQ ID NO: 1696774 - RNA, 19 nt, Human
acuuuggauaauaaggaaa

SEQ ID NO: 1696775 - RNA, 12 nt, Human
acuuuggauaau

SEQ ID NO: 1696776 - RNA, 16 nt, Human
ucucauuuaauccucu

SEQ ID NO: 1696777 - RNA, 22 nt, Human
ucucagauuuuauuauguaaau

SEQ ID NO: 1696778 - RNA, 23 nt, Human
ucucagauuuuauuauguaaauc

SEQ ID NO: 1696779 - RNA, 13 nt, Human
acuuguguaaaua

SEQ ID NO: 1696780 - RNA, 15 nt, Human
acuguuauuuauaau

SEQ ID NO: 1696781 - RNA, 17 nt, Human
acuguuauuuauaauca

SEQ ID NO: 1696782 - RNA, 20 nt, Human
acuguuauuuauaaucacuu

SEQ ID NO: 1696783 - RNA, 21 nt, Human
acuguuauuuauaaucacuuu

SEQ ID NO: 1696784 - RNA, 14 nt, Human
ucugauccaguuuu

SEQ ID NO: 1696785 - RNA, 21 nt, Human
ucugauccaguuuuguuugga

SEQ ID NO: 1696786 - RNA, 11 nt, Human
ucugauccagu

SEQ ID NO: 1696787 - RNA, 20 nt, Human
ucugugagcaucacaguuuu

SEQ ID NO: 1696788 - RNA, 14 nt, Human
agaauucuguauag

SEQ ID NO: 1696789 - RNA, 12 nt, Human
agaauucuguau

SEQ ID NO: 1696790 - RNA, 14 nt, Human
ucugugaacuugaa

SEQ ID NO: 1696791 - RNA, 17 nt, Human
ucugugaacuugaaauu

SEQ ID NO: 1696792 - RNA, 18 nt, Human
ucugugaacuugaaauuu

SEQ ID NO: 1696793 - RNA, 21 nt, Human
agaaugguccgugcuaaggac

SEQ ID NO: 1696794 - RNA, 23 nt, Human
agaaugguccgugcuaaggacuu

SEQ ID NO: 1696795 - RNA, 14 nt, Human
agaaggcaaaugac

SEQ ID NO: 1696796 - RNA, 15 nt, Human
agaaggcaaaugacu

SEQ ID NO: 1696797 - RNA, 20 nt, Human
agaaggcaaaugacuuugga

SEQ ID NO: 1696798 - RNA, 22 nt, Human
uccugcaaugaagucucugaag

SEQ ID NO: 1696799 - RNA, 12 nt, Human
acucaauuuuaa

SEQ ID NO: 1696800 - RNA, 15 nt, Human
acucaauuuuaacaa

SEQ ID NO: 1696801 - RNA, 19 nt, Human
acggugaauggcuuuguau

SEQ ID NO: 1696802 - RNA, 20 nt, Human
acggugaauggcuuuguaua

SEQ ID NO: 1696803 - RNA, 16 nt, Human
acggugaauggcuuug

SEQ ID NO: 1696804 - RNA, 15 nt, Human
acuaaacuuucacac

SEQ ID NO: 1696805 - RNA, 16 nt, Human
acuaaacuuucacacc

SEQ ID NO: 1696806 - RNA, 13 nt, Human
acggaugauuucu

SEQ ID NO: 1696807 - RNA, 14 nt, Human
acggaugauuucua

SEQ ID NO: 1696808 - RNA, 19 nt, Human
accauaaccccggaagcca

SEQ ID NO: 1696809 - RNA, 23 nt, Human
ucagauuuuauuauguaaauccc

SEQ ID NO: 1696810 - RNA, 19 nt, Human
ucagcaaaaauauuuuaug

SEQ ID NO: 1696811 - RNA, 20 nt, Human
ucagcaaaaauauuuuauga

SEQ ID NO: 1696812 - RNA, 18 nt, Human
ucaacugggcugaacacu

SEQ ID NO: 1696813 - RNA, 17 nt, Human
ucaaccaccuuucagau

SEQ ID NO: 1696814 - RNA, 19 nt, Human
acauguauuuguuugcaua

SEQ ID NO: 1696815 - RNA, 17 nt, Human
acauguauuuguuugca

SEQ ID NO: 1696816 - RNA, 18 nt, Human
acauguauuuguuugcau

SEQ ID NO: 1696817 - RNA, 16 nt, Human
acauguauuuguuugc

SEQ ID NO: 1696818 - RNA, 12 nt, Human
ucaacugggcug

SEQ ID NO: 1696819 - RNA, 19 nt, Human
ucaccugucuugccuuuuu

SEQ ID NO: 1696820 - RNA, 20 nt, Human
ucaccugucuugccuuuuuc

SEQ ID NO: 1696821 - RNA, 23 nt, Human
accaguauuguacaaaguauuaa

SEQ ID NO: 1696822 - RNA, 14 nt, Human
accaguauuguaca

SEQ ID NO: 1696823 - RNA, 15 nt, Human
accaguauuguacaa

SEQ ID NO: 1696824 - RNA, 20 nt, Human
accaguauuguacaaaguau

SEQ ID NO: 1696825 - RNA, 22 nt, Human
accaguauuguacaaaguauua

SEQ ID NO: 1696826 - RNA, 20 nt, Human
ucacaguuuugguugcuuua

SEQ ID NO: 1696827 - RNA, 21 nt, Human
ucacaguuuugguugcuuuaa

SEQ ID NO: 1696828 - RNA, 23 nt, Human
ucacaguuuugguugcuuuaaua

SEQ ID NO: 1696829 - RNA, 21 nt, Human
uaacuguuauuuauaaucacu

SEQ ID NO: 1696830 - RNA, 12 nt, Human
uaacauaaaucu

SEQ ID NO: 1696831 - RNA, 14 nt, Human
uaacauaaaucugu

SEQ ID NO: 1696832 - RNA, 16 nt, Human
aauaucaucaguauug

SEQ ID NO: 1696833 - RNA, 20 nt, Human
aaucugugaacuugaaauuu

SEQ ID NO: 1696834 - RNA, 21 nt, Human
aaucugugaacuugaaauuug

SEQ ID NO: 1696835 - RNA, 22 nt, Human
aaucugugaacuugaaauuuga

SEQ ID NO: 1696836 - RNA, 16 nt, Human
uaaggaaaaguuuaau

SEQ ID NO: 1696837 - RNA, 16 nt, Human
uaaucacuuuuuucca

SEQ ID NO: 1696838 - RNA, 17 nt, Human
uaaucacuuuuuuccac

SEQ ID NO: 1696839 - RNA, 19 nt, Human
uaaucacuuuuuuccacau

SEQ ID NO: 1696840 - RNA, 18 nt, Human
uaaucacuuuuuuccaca

SEQ ID NO: 1696841 - RNA, 19 nt, Human
uacuauauaugugaugauc

SEQ ID NO: 1696842 - RNA, 19 nt, Human
aauucccuggccuuucaua

SEQ ID NO: 1696843 - RNA, 20 nt, Human
aauucccuggccuuucauau

SEQ ID NO: 1696844 - RNA, 14 nt, Human
uacuggauuguacu

SEQ ID NO: 1696845 - RNA, 16 nt, Human
aauggacuguggugac

SEQ ID NO: 1696846 - RNA, 16 nt, Human
aaugccaucaauaaaa

SEQ ID NO: 1696847 - RNA, 21 nt, Human
aaugccaucaauaaaaaauua

SEQ ID NO: 1696848 - RNA, 23 nt, Human
aaugccaucaauaaaaaauuaug

SEQ ID NO: 1696849 - RNA, 20 nt, Human
aauuaacauguuaaaccaug

SEQ ID NO: 1696850 - RNA, 19 nt, Human
aauuaacauguuaaaccau

SEQ ID NO: 1696851 - RNA, 13 nt, Human
uacauguauuugu

SEQ ID NO: 1696852 - RNA, 12 nt, Human
uauucaaaguug

SEQ ID NO: 1696853 - RNA, 13 nt, Human
uauucaaaguugc

SEQ ID NO: 1696854 - RNA, 16 nt, Human
uauucaaaguugccua

SEQ ID NO: 1696855 - RNA, 13 nt, Human
acaguauaauuaa

SEQ ID NO: 1696856 - RNA, 15 nt, Human
acaguauaauuaaca

SEQ ID NO: 1696857 - RNA, 20 nt, Human
acaguauaauuaacauguua

SEQ ID NO: 1696858 - RNA, 14 nt, Human
uaugugugaaguga

SEQ ID NO: 1696859 - RNA, 12 nt, Human
uaugugugaagu

SEQ ID NO: 1696860 - RNA, 20 nt, Human
uauauuuacuaaaauggacu

SEQ ID NO: 1696861 - RNA, 21 nt, Human
uauauuuacuaaaauggacug

SEQ ID NO: 1696862 - RNA, 19 nt, Human
uauauuuacuaaaauggac

SEQ ID NO: 1696863 - RNA, 23 nt, Human
acacacuuuugguuaagucuguu

SEQ ID NO: 1696864 - RNA, 17 nt, Human
acaccauuaugugcgcu

SEQ ID NO: 1696865 - RNA, 21 nt, Human
acaccauuaugugcgcugaua

SEQ ID NO: 1696866 - RNA, 21 nt, Human
uagcuagacuggugacugauu

SEQ ID NO: 1696867 - RNA, 22 nt, Human
uagcuagacuggugacugauuc

SEQ ID NO: 1696868 - RNA, 23 nt, Human
uagagauuuuuuuguuguuuguu

SEQ ID NO: 1696869 - RNA, 14 nt, Human
gugaucucauuuaa

SEQ ID NO: 1696870 - RNA, 13 nt, Human
aacuugaaauuug

SEQ ID NO: 1696871 - RNA, 18 nt, Human
aacuugaaauuugaauuu

SEQ ID NO: 1696872 - RNA, 19 nt, Human
aacuugaaauuugaauuuu

SEQ ID NO: 1696873 - RNA, 12 nt, Human
aacuugaaauuu

SEQ ID NO: 1696874 - RNA, 12 nt, Human
gugacuuuggau

SEQ ID NO: 1696875 - RNA, 15 nt, Human
gugacuuuggauaau

SEQ ID NO: 1696876 - RNA, 23 nt, Human
gucuugucucagauuuuauuaug

SEQ ID NO: 1696877 - RNA, 16 nt, Human
aacauguuaaaccaug

SEQ ID NO: 1696878 - RNA, 14 nt, Human
aacauguuaaacca

SEQ ID NO: 1696879 - RNA, 15 nt, Human
aacauguuaaaccau

SEQ ID NO: 1696880 - RNA, 16 nt, Human
aacauugguucuugua

SEQ ID NO: 1696881 - RNA, 18 nt, Human
aacauugguucuuguauu

SEQ ID NO: 1696882 - RNA, 19 nt, Human
aacauugguucuuguauua

SEQ ID NO: 1696883 - RNA, 22 nt, Human
aacauugguucuuguauuaaga

SEQ ID NO: 1696884 - RNA, 23 nt, Human
aacauugguucuuguauuaagaa

SEQ ID NO: 1696885 - RNA, 16 nt, Human
guccgugcuaaggacu

SEQ ID NO: 1696886 - RNA, 17 nt, Human
guccgugcuaaggacuu

SEQ ID NO: 1696887 - RNA, 15 nt, Human
guccgugcuaaggac

SEQ ID NO: 1696888 - RNA, 15 nt, Human
aaauuugaauuuugu

SEQ ID NO: 1696889 - RNA, 22 nt, Human
aaauuugaauuuuguguuagag

SEQ ID NO: 1696890 - RNA, 12 nt, Human
aaauuugaauuu

SEQ ID NO: 1696891 - RNA, 19 nt, Human
guauuguacaaaguauuaa

SEQ ID NO: 1696892 - RNA, 10 nt, Human
guauugaagc

SEQ ID NO: 1696893 - RNA, 13 nt, Human
guauugaagcauu

SEQ ID NO: 1696894 - RNA, 17 nt, Human
guauugaagcauuuuau

SEQ ID NO: 1696895 - RNA, 18 nt, Human
guauugaagcauuuuaua

SEQ ID NO: 1696896 - RNA, 22 nt, Human
guauugaagcauuuuauaaauc

SEQ ID NO: 1696897 - RNA, 21 nt, Human
guauuguacaaaguauuaagc

SEQ ID NO: 1696898 - RNA, 22 nt, Human
guauuguacaaaguauuaagca

SEQ ID NO: 1696899 - RNA, 23 nt, Human
guauuguacaaaguauuaagcau

SEQ ID NO: 1696900 - RNA, 23 nt, Human
aagucagaucugccuaaggacuu

SEQ ID NO: 1696901 - RNA, 14 nt, Human
uaaaaaaaaaauug

SEQ ID NO: 1696902 - RNA, 18 nt, Human
uaaaaaaaaaauugggga

SEQ ID NO: 1696903 - RNA, 12 nt, Human
guuguuuguuua

SEQ ID NO: 1696904 - RNA, 12 nt, Human
aaggaaaaguuu

SEQ ID NO: 1696905 - RNA, 20 nt, Human
aaggaaacuggguuccugca

SEQ ID NO: 1696906 - RNA, 13 nt, Human
guuuauuacagua

SEQ ID NO: 1696907 - RNA, 17 nt, Human
guuuauuacaguauaau

SEQ ID NO: 1696908 - RNA, 13 nt, Human
guuuaauauuaaa

SEQ ID NO: 1696909 - RNA, 14 nt, Human
guuuaauauuaaag

SEQ ID NO: 1696910 - RNA, 15 nt, Human
guuuaauauuaaagc

SEQ ID NO: 1696911 - RNA, 18 nt, Human
guuuaauauuaaagccau

SEQ ID NO: 1696912 - RNA, 19 nt, Human
guuuaauauuaaagccaug

SEQ ID NO: 1696913 - RNA, 18 nt, Human
guuuggaccaaaaaccag

SEQ ID NO: 1696914 - RNA, 13 nt, Human
guuuuaugacuuc

SEQ ID NO: 1696915 - RNA, 18 nt, Human
guuuuaugacuucauuaa

SEQ ID NO: 1696916 - RNA, 18 nt, Human
aagucagaucugccuaag

SEQ ID NO: 1696917 - RNA, 21 nt, Human
aagucagaucugccuaaggac

SEQ ID NO: 1696918 - RNA, 22 nt, Human
aagucagaucugccuaaggacu

SEQ ID NO: 1696919 - RNA, 20 nt, Human
aagccauguuuauuacagua

SEQ ID NO: 1696920 - RNA, 21 nt, Human
aagccauguuuauuacaguau

SEQ ID NO: 1696921 - RNA, 22 nt, Human
aagccauguuuauuacaguaua

SEQ ID NO: 1696922 - RNA, 23 nt, Human
aagccauguuuauuacaguauaa

SEQ ID NO: 1696923 - RNA, 18 nt, Human
guuagagauuuuuuuguu

SEQ ID NO: 1696924 - RNA, 23 nt, Human
aagcauauauuuuuauauuuacu

SEQ ID NO: 1696925 - RNA, 15 nt, Human
aagccauguuuauua

SEQ ID NO: 1696926 - RNA, 16 nt, Human
aagccauguuuauuac

SEQ ID NO: 1696927 - RNA, 17 nt, Human
aagccauguuuauuaca

SEQ ID NO: 1696928 - RNA, 21 nt, Human
aagcauuuuauaaaucgcuuu

SEQ ID NO: 1696929 - RNA, 17 nt, Human
aagcauuuuauaaaucg

SEQ ID NO: 1696930 - RNA, 19 nt, Human
aagcauuuuauaaaucgcu

SEQ ID NO: 1696931 - RNA, 12 nt, Human
aagcauuuuaua

SEQ ID NO: 1696932 - RNA, 14 nt, Human
aagcauuuuauaaa

SEQ ID NO: 1696933 - RNA, 15 nt, Human
aagcauuuuauaaau

SEQ ID NO: 1696934 - RNA, 18 nt, Human
guguaaauacaauuuugu

SEQ ID NO: 1696935 - RNA, 21 nt, Human
guguaaauacaauuuuguuuc

SEQ ID NO: 1696936 - RNA, 22 nt, Human
guguaaauacaauuuuguuucu

SEQ ID NO: 1696937 - RNA, 21 nt, Human
cuauuuuuuuucuguuauaua

SEQ ID NO: 1696938 - RNA, 20 nt, Human
cuauuuuuuuucuguuauau

SEQ ID NO: 1696939 - RNA, 15 nt, Human
ccuuuuucauuauuu

SEQ ID NO: 1696940 - RNA, 16 nt, Human
ccuuuuuuaaauaaau

SEQ ID NO: 1696941 - RNA, 12 nt, Human
ccuuucauauuu

SEQ ID NO: 1696942 - RNA, 19 nt, Human
ccugucuugccuuuuucau

SEQ ID NO: 1696943 - RNA, 20 nt, Human
ccugucuugccuuuuucauu

SEQ ID NO: 1696944 - RNA, 17 nt, Human
ccugucuugccuuuuuc

SEQ ID NO: 1696945 - RNA, 20 nt, Human
ccuauuuuuuuucuguuaua

SEQ ID NO: 1696946 - RNA, 18 nt, Human
cccaggaauggagccugc

SEQ ID NO: 1696947 - RNA, 19 nt, Human
cccaggaauggagccugca

SEQ ID NO: 1696948 - RNA, 20 nt, Human
cccaggaauggagccugcac

SEQ ID NO: 1696949 - RNA, 22 nt, Human
cccaggaauggagccugcacgg

SEQ ID NO: 1696950 - RNA, 15 nt, Human
ccagcagauuauuca

SEQ ID NO: 1696951 - RNA, 16 nt, Human
ccagcagauuauucac

SEQ ID NO: 1696952 - RNA, 20 nt, Human
ccaguauuguacaaaguauu

SEQ ID NO: 1696953 - RNA, 22 nt, Human
ccaguauuguacaaaguauuaa

SEQ ID NO: 1696954 - RNA, 16 nt, Human
ccaguuuuguuuggac

SEQ ID NO: 1696955 - RNA, 19 nt, Human
ccaguuuuguuuggaccaa

SEQ ID NO: 1696956 - RNA, 23 nt, Human
ccaccuuucagauaacuguuauu

SEQ ID NO: 1696957 - RNA, 18 nt, Human
cauguauuuguuugcaua

SEQ ID NO: 1696958 - RNA, 13 nt, Human
caauaaaaaauua

SEQ ID NO: 1696959 - RNA, 16 nt, Human
caauaaaaaauuauga

SEQ ID NO: 1696960 - RNA, 17 nt, Human
caauaaaaaauuaugac

SEQ ID NO: 1696961 - RNA, 16 nt, Human
caaaguauuaagcaua

SEQ ID NO: 1696962 - RNA, 17 nt, Human
caaaguauuaagcauau

SEQ ID NO: 1696963 - RNA, 19 nt, Human
caaaguauuaagcauauau

SEQ ID NO: 1696964 - RNA, 21 nt, Human
caaaguauuaagcauauauuu

SEQ ID NO: 1696965 - RNA, 14 nt, Human
caaaguauuaagca

SEQ ID NO: 1696966 - RNA, 15 nt, Human
caaaguauuaagcau

SEQ ID NO: 1696967 - RNA, 16 nt, Human
caaccaccuuucagau

SEQ ID NO: 1696968 - RNA, 15 nt, Human
auuuuauaaaucgcu

SEQ ID NO: 1696969 - RNA, 16 nt, Human
auuuuauaaaucgcuu

SEQ ID NO: 1696970 - RNA, 17 nt, Human
auuuuauaaaucgcuuu

SEQ ID NO: 1696971 - RNA, 20 nt, Human
auuuuauaaaucgcuuuuga

SEQ ID NO: 1696972 - RNA, 21 nt, Human
auuuuauaaaucgcuuuugau

SEQ ID NO: 1696973 - RNA, 23 nt, Human
auuuuauaaaucgcuuuugauaa

SEQ ID NO: 1696974 - RNA, 23 nt, Human
auuguacaaaguauuaagcauau

SEQ ID NO: 1696975 - RNA, 22 nt, Human
auuguacaaaguauuaagcaua

SEQ ID NO: 1696976 - RNA, 20 nt, Human
auuguacaaaguauuaagca

SEQ ID NO: 1696977 - RNA, 23 nt, Human
auuuauaaucacuuuuuuccaca

SEQ ID NO: 1696978 - RNA, 19 nt, Human
gguguuguacucaauuuua

SEQ ID NO: 1696979 - RNA, 20 nt, Human
gguguuguacucaauuuuaa

SEQ ID NO: 1696980 - RNA, 20 nt, Human
guacaaaguauuaagcauau

SEQ ID NO: 1696981 - RNA, 21 nt, Human
guacaaaguauuaagcauaua

SEQ ID NO: 1696982 - RNA, 15 nt, Human
aaaauauuuuaugau

SEQ ID NO: 1696983 - RNA, 18 nt, Human
aaaauauuuuaugaucca

SEQ ID NO: 1696984 - RNA, 15 nt, Human
ggaagccugauuaaa

SEQ ID NO: 1696985 - RNA, 13 nt, Human
ggaaaucuuuaaa

SEQ ID NO: 1696986 - RNA, 18 nt, Human
ggaaacuggguuccugca

SEQ ID NO: 1696987 - RNA, 13 nt, Human
gccauguuuauua

SEQ ID NO: 1696988 - RNA, 11 nt, Human
gccauguuuau

SEQ ID NO: 1696989 - RNA, 14 nt, Human
gccauguuuauuac

SEQ ID NO: 1696990 - RNA, 18 nt, Human
gccauguuuauuacagua

SEQ ID NO: 1696991 - RNA, 22 nt, Human
gccauguuuauuacaguauaau

SEQ ID NO: 1696992 - RNA, 11 nt, Human
gcuaaggacuu

SEQ ID NO: 1696993 - RNA, 12 nt, Human
gcuaaggacuug

SEQ ID NO: 1696994 - RNA, 12 nt, Human
gcguugaaauug

SEQ ID NO: 1696995 - RNA, 23 nt, Human
gcuaaggacuuguuagaucuagu

SEQ ID NO: 1696996 - RNA, 22 nt, Human
gcguucauggaacgcguugaaa

SEQ ID NO: 1696997 - RNA, 18 nt, Human
gcuauuucuauauuuuca

SEQ ID NO: 1696998 - RNA, 19 nt, Human
gcuauuucuauauuuucau

SEQ ID NO: 1696999 - RNA, 20 nt, Human
gcuauuucuauauuuucauu

SEQ ID NO: 1697000 - RNA, 11 nt, Human
gcuauuucuau

SEQ ID NO: 1697001 - RNA, 13 nt, Human
gcuauuucuauau

SEQ ID NO: 1697002 - RNA, 15 nt, Human
gcuauuucuauauuu

SEQ ID NO: 1697003 - RNA, 16 nt, Human
gcuauuucuauauuuu

SEQ ID NO: 1697004 - RNA, 19 nt, Human
gauccagcagauuauucac

SEQ ID NO: 1697005 - RNA, 18 nt, Human
gauccagcagauuauuca

SEQ ID NO: 1697006 - RNA, 16 nt, Human
gaucugccuaaggacu

SEQ ID NO: 1697007 - RNA, 17 nt, Human
gaucugccuaaggacuu

SEQ ID NO: 1697008 - RNA, 12 nt, Human
gaucugccuaag

SEQ ID NO: 1697009 - RNA, 15 nt, Human
gaucugccuaaggac

SEQ ID NO: 1697010 - RNA, 13 nt, Human
gaugauuucuaug

SEQ ID NO: 1697011 - RNA, 23 nt, Human
gaugauuucuaugcugaguuugu

SEQ ID NO: 1697012 - RNA, 12 nt, Human
gaugauuucuau

SEQ ID NO: 1697013 - RNA, 16 nt, Human
gauacuggauuguacu

SEQ ID NO: 1697014 - RNA, 20 nt, Human
gauacuggauuguacuuugu

SEQ ID NO: 1697015 - RNA, 19 nt, Human
cugugagcaucacaguuuu

SEQ ID NO: 1697016 - RNA, 13 nt, Human
cuguuauauaaau

SEQ ID NO: 1697017 - RNA, 14 nt, Human
cuguuauauaaaug

SEQ ID NO: 1697018 - RNA, 15 nt, Human
cuguuauauaaaugg

SEQ ID NO: 1697019 - RNA, 22 nt, Human
cuguuauauaaaugguuaaaag

SEQ ID NO: 1697020 - RNA, 15 nt, Human
cugugaacuugaaau

SEQ ID NO: 1697021 - RNA, 16 nt, Human
cugugaacuugaaauu

SEQ ID NO: 1697022 - RNA, 17 nt, Human
cugugaacuugaaauuu

SEQ ID NO: 1697023 - RNA, 16 nt, Human
cugugagcaucacagu

SEQ ID NO: 1697024 - RNA, 13 nt, Human
cuggugacugauu

SEQ ID NO: 1697025 - RNA, 14 nt, Human
cuggugacugauuc

SEQ ID NO: 1697026 - RNA, 15 nt, Human
cuggugacugauucu

SEQ ID NO: 1697027 - RNA, 17 nt, Human
cuggugacugauucuuc

SEQ ID NO: 1697028 - RNA, 18 nt, Human
cuggugacugauucuuca

SEQ ID NO: 1697029 - RNA, 15 nt, Human
cuggugcccugcuuu

SEQ ID NO: 1697030 - RNA, 16 nt, Human
cuggugcccugcuuuc

SEQ ID NO: 1697031 - RNA, 19 nt, Human
cuggugcccugcuuucaga

SEQ ID NO: 1697032 - RNA, 21 nt, Human
cuggugcccugcuuucagaua

SEQ ID NO: 1697033 - RNA, 23 nt, Human
cuggugcccugcuuucagauacu

SEQ ID NO: 1697034 - RNA, 14 nt, Human
gaaacuuguguaaa

SEQ ID NO: 1697035 - RNA, 16 nt, Human
gaaacuuguguaaaua

SEQ ID NO: 1697036 - RNA, 20 nt, Human
gaaacuuguguaaauacaau

SEQ ID NO: 1697037 - RNA, 13 nt, Human
cuuuugguuaagu

SEQ ID NO: 1697038 - RNA, 21 nt, Human
cuugucucagauuuuauuaug

SEQ ID NO: 1697039 - RNA, 14 nt, Human
agcuggugcccugc

SEQ ID NO: 1697040 - RNA, 23 nt, Human
aggcugaugccaaguuguuugag

SEQ ID NO: 1697041 - RNA, 23 nt, Human
agccucccuauuuuuuuucuguu

SEQ ID NO: 1697042 - RNA, 22 nt, Human
agccauguuuauuacaguauaa

SEQ ID NO: 1697043 - RNA, 17 nt, Human
agccauguuuauuacag

SEQ ID NO: 1697044 - RNA, 14 nt, Human
agaguguugaaacg

SEQ ID NO: 1697045 - RNA, 12 nt, Human
aucaccugucuu

SEQ ID NO: 1697046 - RNA, 21 nt, Human
aucaccugucuugccuuuuuc

SEQ ID NO: 1697047 - RNA, 24 nt, Human
aucuucucagaaggcaaaugacuu

SEQ ID NO: 1697048 - RNA, 18 nt, Human
auggagccugcacgguga

SEQ ID NO: 1697049 - RNA, 22 nt, Human
auggagccugcacggugaaugg

SEQ ID NO: 1697050 - RNA, 11 nt, Human
aguugaauuua

SEQ ID NO: 1697051 - RNA, 13 nt, Human
aguugaauuuauu

SEQ ID NO: 1697052 - RNA, 17 nt, Human
aguugaauuuauuggcu

SEQ ID NO: 1697053 - RNA, 19 nt, Human
aguugaauuuauuggcuuu

SEQ ID NO: 1697054 - RNA, 20 nt, Human
aguugaauuuauuggcuuuu

SEQ ID NO: 1697055 - RNA, 20 nt, Human
auaauuaacauguuaaacca

SEQ ID NO: 1697056 - RNA, 21 nt, Human
auaauuaacauguuaaaccau

SEQ ID NO: 1697057 - RNA, 22 nt, Human
auaauuaacauguuaaaccaug

SEQ ID NO: 1697058 - RNA, 17 nt, Human
auaccuacauguauuug

SEQ ID NO: 1697059 - RNA, 15 nt, Human
auaccuacauguauu

SEQ ID NO: 1697060 - RNA, 19 nt, Human
auacaauuuuguuucugua

SEQ ID NO: 1697061 - RNA, 20 nt, Human
auacaauuuuguuucuguac

SEQ ID NO: 1697062 - RNA, 14 nt, Human
auaugcuauuucua

SEQ ID NO: 1697063 - RNA, 14 nt, Human
acauaaaucuguga

SEQ ID NO: 1697064 - RNA, 15 nt, Human
acauaaaucugugaa

SEQ ID NO: 1697065 - RNA, 18 nt, Human
acauaaaucugugaacuu

SEQ ID NO: 1697066 - RNA, 14 nt, Human
acaauuuuguuucu

SEQ ID NO: 1697067 - RNA, 15 nt, Human
acaauuuuguuucug

SEQ ID NO: 1697068 - RNA, 17 nt, Human
acaauuuuguuucugua

SEQ ID NO: 1697069 - RNA, 18 nt, Human
acaauuuuguuucuguac

SEQ ID NO: 1697070 - RNA, 12 nt, Human
acuuuucugaua

SEQ ID NO: 1697071 - RNA, 14 nt, Human
acuggguuccugca

SEQ ID NO: 1697072 - RNA, 21 nt, Human
acuucuuuaauuuuggaauuu

SEQ ID NO: 1697073 - RNA, 23 nt, Human
accuuucagauaacuguuauuua

SEQ ID NO: 1697074 - RNA, 13 nt, Human
acgaugucuucau

SEQ ID NO: 1697075 - RNA, 17 nt, Human
aacagcuggugcccugc

SEQ ID NO: 1697076 - RNA, 20 nt, Human
aaccaguauuguacaaagua

SEQ ID NO: 1697077 - RNA, 15 nt, Human
aaccaguauuguaca

SEQ ID NO: 1697078 - RNA, 21 nt, Human
aaccaguauuguacaaaguau

SEQ ID NO: 1697079 - RNA, 22 nt, Human
aaccaguauuguacaaaguauu

SEQ ID NO: 1697080 - RNA, 16 nt, Human
aaauuggggauucuua

SEQ ID NO: 1697081 - RNA, 17 nt, Human
aaauuggggauucuuaa

SEQ ID NO: 1697082 - RNA, 13 nt, Human
aacuuuucugaua

SEQ ID NO: 1697083 - RNA, 14 nt, Human
aacuuuucugauag

SEQ ID NO: 1697084 - RNA, 12 nt, Human
aacuuuucugau

SEQ ID NO: 1697085 - RNA, 16 nt, Human
aaagagguuuuucuua

SEQ ID NO: 1697086 - RNA, 19 nt, Human
aaagagguuuuucuuaaau

SEQ ID NO: 1697087 - RNA, 17 nt, Human
aaaauuggggauucuua

SEQ ID NO: 1697088 - RNA, 18 nt, Human
aaaauuggggauucuuaa

SEQ ID NO: 1697089 - RNA, 19 nt, Human
aaaauuggggauucuuaaa

SEQ ID NO: 1697090 - RNA, 19 nt, Human
aaauggacuguggugacuu

SEQ ID NO: 1697091 - RNA, 14 nt, Human
aaauacuguuugag

SEQ ID NO: 1697092 - RNA, 18 nt, Human
aaauauuuuaugauccag

SEQ ID NO: 1697093 - RNA, 19 nt, Human
aaauauuuuaugauccagc

SEQ ID NO: 1697094 - RNA, 14 nt, Human
aaauauuuuaugau

SEQ ID NO: 1697095 - RNA, 12 nt, Human
aaggauuuuaug

SEQ ID NO: 1697096 - RNA, 13 nt, Human
aaggauuuuaugc

SEQ ID NO: 1697097 - RNA, 23 nt, Human
aaggauuuuaugcuuuaaacauu

SEQ ID NO: 1697098 - RNA, 16 nt, Human
aaggauuuuaugcuuu

SEQ ID NO: 1697099 - RNA, 20 nt, Human
aaggauuuuaugcuuuaaac

SEQ ID NO: 1697100 - RNA, 21 nt, Human
aaggauuuuaugcuuuaaaca

SEQ ID NO: 1697101 - RNA, 22 nt, Human
aaggauuuuaugcuuuaaacau

SEQ ID NO: 1697102 - RNA, 13 nt, Human
aagccauguuuau

SEQ ID NO: 1697103 - RNA, 12 nt, Human
aaguuguuugag

SEQ ID NO: 1697104 - RNA, 15 nt, Human
aaguuguuugagaaa

SEQ ID NO: 1697105 - RNA, 15 nt, Human
aagucuguuuuauga

SEQ ID NO: 1697106 - RNA, 16 nt, Human
aagucuguuuuaugac

SEQ ID NO: 1697107 - RNA, 18 nt, Human
aagucuguuuuaugacuu

SEQ ID NO: 1697108 - RNA, 19 nt, Human
aagucuguuuuaugacuuc

SEQ ID NO: 1697109 - RNA, 20 nt, Human
aagucuguuuuaugacuuca

SEQ ID NO: 1697110 - RNA, 23 nt, Human
aagucuguuuuaugacuucauua

SEQ ID NO: 1697111 - RNA, 19 nt, Human
aagucucugaagugaaacu

SEQ ID NO: 1697112 - RNA, 22 nt, Human
aagucucugaagugaaacugcu

SEQ ID NO: 1697113 - RNA, 18 nt, Human
aagguucuggugugaacu

SEQ ID NO: 1697114 - RNA, 15 nt, Human
aaguaucugacaucu

SEQ ID NO: 1697115 - RNA, 22 nt, Human
aaguaucugacaucucugcaau

SEQ ID NO: 1697116 - RNA, 19 nt, Human
aaucaacugggcugaacac

SEQ ID NO: 1697117 - RNA, 14 nt, Human
aaucaacugggcug

SEQ ID NO: 1697118 - RNA, 14 nt, Human
aauccauuuggaaa

SEQ ID NO: 1697119 - RNA, 15 nt, Human
aauccauuuggaaau

SEQ ID NO: 1697120 - RNA, 17 nt, Human
aauccauuuggaaaucu

SEQ ID NO: 1697121 - RNA, 18 nt, Human
aauccauuuggaaaucuu

SEQ ID NO: 1697122 - RNA, 22 nt, Human
aauccauuuggaaaucuuuaaa

SEQ ID NO: 1697123 - RNA, 22 nt, Human
aaugguccgugcuaaggacuug

SEQ ID NO: 1697124 - RNA, 15 nt, Human
aauggcuuuguauag

SEQ ID NO: 1697125 - RNA, 16 nt, Human
aauggcuuuguauaga

SEQ ID NO: 1697126 - RNA, 18 nt, Human
aauggcuuuguauagaac

SEQ ID NO: 1697127 - RNA, 13 nt, Human
aauggcuuuguau

SEQ ID NO: 1697128 - RNA, 16 nt, Human
aaaaaccaguauugua

SEQ ID NO: 1697129 - RNA, 18 nt, Human
aaaaaccaguauuguaca

SEQ ID NO: 1697130 - RNA, 17 nt, Human
aaaaauuggggauucuu

SEQ ID NO: 1697131 - RNA, 18 nt, Human
aaaaauuggggauucuua

SEQ ID NO: 1697132 - RNA, 19 nt, Human
aaaaauuggggauucuuaa

SEQ ID NO: 1697133 - RNA, 20 nt, Human
aaaaauuggggauucuuaaa

SEQ ID NO: 1697134 - RNA, 23 nt, Human
aaaaaauuggggauucuuaaagu

SEQ ID NO: 1697135 - RNA, 16 nt, Human
uuauuacaguauaauu

SEQ ID NO: 1697136 - RNA, 13 nt, Human
uuauaaucacuuu

SEQ ID NO: 1697137 - RNA, 20 nt, Human
uuauaucugaggaauucugu

SEQ ID NO: 1697138 - RNA, 21 nt, Human
uuauaucugaggaauucugua

SEQ ID NO: 1697139 - RNA, 14 nt, Human
uuauaucugaggaa

SEQ ID NO: 1697140 - RNA, 22 nt, Human
uuauaucugaggaauucuguau

SEQ ID NO: 1697141 - RNA, 23 nt, Human
uuauaucugaggaauucuguaua

SEQ ID NO: 1697142 - RNA, 18 nt, Human
uuauaugcuauuucuaua

SEQ ID NO: 1697143 - RNA, 16 nt, Human
uuauaugcuauuucua

SEQ ID NO: 1697144 - RNA, 16 nt, Human
uucagauacuggauug

SEQ ID NO: 1697145 - RNA, 20 nt, Human
uucagauacuggauuguacu

SEQ ID NO: 1697146 - RNA, 15 nt, Human
uuauuuuauuaugaa

SEQ ID NO: 1697147 - RNA, 16 nt, Human
uuauuuuauuaugaaa

SEQ ID NO: 1697148 - RNA, 14 nt, Human
uuauuuuauuauga

SEQ ID NO: 1697149 - RNA, 20 nt, Human
uuauuuuauuaugaaacuug

SEQ ID NO: 1697150 - RNA, 17 nt, Human
uugaauuuuguguuaga

SEQ ID NO: 1697151 - RNA, 21 nt, Human
uugaauuuuguguuagagauu

SEQ ID NO: 1697152 - RNA, 15 nt, Human
uugaauuuauuggcu

SEQ ID NO: 1697153 - RNA, 18 nt, Human
uugaauuuauuggcuuuu

SEQ ID NO: 1697154 - RNA, 22 nt, Human
uugaauuuauuggcuuuucuga

SEQ ID NO: 1697155 - RNA, 13 nt, Human
uucugauagagga

SEQ ID NO: 1697156 - RNA, 21 nt, Human
uucugauagaggaagccugau

SEQ ID NO: 1697157 - RNA, 13 nt, Human
uuccugcaaugaa

SEQ ID NO: 1697158 - RNA, 21 nt, Human
uuccugcaaugaagucucuga

SEQ ID NO: 1697159 - RNA, 13 nt, Human
uuucagauacugg

SEQ ID NO: 1697160 - RNA, 21 nt, Human
uuucagauacuggauuguacu

SEQ ID NO: 1697161 - RNA, 16 nt, Human
uuuauuauguaaaucc

SEQ ID NO: 1697162 - RNA, 17 nt, Human
uuuauuauguaaauccc

SEQ ID NO: 1697163 - RNA, 14 nt, Human
uuuauuauguaaau

SEQ ID NO: 1697164 - RNA, 21 nt, Human
uuuaauaauuauaugcuauuu

SEQ ID NO: 1697165 - RNA, 18 nt, Human
uuuaauaauuauaugcua

SEQ ID NO: 1697166 - RNA, 16 nt, Human
uuuaacaacagcuggu

SEQ ID NO: 1697167 - RNA, 21 nt, Human
uuguuuggaccaaaaaccagu

SEQ ID NO: 1697168 - RNA, 13 nt, Human
uuggguguauugu

SEQ ID NO: 1697169 - RNA, 15 nt, Human
uuggguguauugugc

SEQ ID NO: 1697170 - RNA, 16 nt, Human
uuggguguauugugcg

SEQ ID NO: 1697171 - RNA, 22 nt, Human
uugucucagauuuuauuaugua

SEQ ID NO: 1697172 - RNA, 16 nt, Human
uugucucagauuuuau

SEQ ID NO: 1697173 - RNA, 20 nt, Human
uugucucagauuuuauuaug

SEQ ID NO: 1697174 - RNA, 13 nt, Human
uugucucagauuu

SEQ ID NO: 1697175 - RNA, 20 nt, Human
uugucuacaccauuaugugc

SEQ ID NO: 1697176 - RNA, 19 nt, Human
uugucuacaccauuaugug

SEQ ID NO: 1697177 - RNA, 12 nt, Human
uuguauuaagaa

SEQ ID NO: 1697178 - RNA, 13 nt, Human
uuguauuaagaau

SEQ ID NO: 1697179 - RNA, 18 nt, Human
uuguauuaagaaugaaau

SEQ ID NO: 1697180 - RNA, 15 nt, Human
uuguacucaauuuua

SEQ ID NO: 1697181 - RNA, 14 nt, Human
uuguacucaauuuu

SEQ ID NO: 1697182 - RNA, 17 nt, Human
uuguuagaucuaguuca

SEQ ID NO: 1697183 - RNA, 17 nt, Human
uuguuguuuguuuaguc

SEQ ID NO: 1697184 - RNA, 15 nt, Human
uuguuugagaaauua

SEQ ID NO: 1697185 - RNA, 21 nt, Human
uuguuugagaaauuaaguauc

SEQ ID NO: 1697186 - RNA, 19 nt, Human
uugugcugggguuaucuga

SEQ ID NO: 1697187 - RNA, 22 nt, Human
uugugcgcuaaacuuuucugau

SEQ ID NO: 1697188 - RNA, 23 nt, Human
uugugcgcuaaacuuuucugaua

SEQ ID NO: 1697189 - RNA, 13 nt, Human
uuuuucauuauuu

SEQ ID NO: 1697190 - RNA, 22 nt, Human
uuuuucauuauuuuauuaugaa

SEQ ID NO: 1697191 - RNA, 21 nt, Human
uuuuuccacauaaggaaacug

SEQ ID NO: 1697192 - RNA, 24 nt, Human
uuuggaccaaaaaccaguauugua

SEQ ID NO: 1697193 - RNA, 15 nt, Human
uuuggaaaucuuuaa

SEQ ID NO: 1697194 - RNA, 18 nt, Human
uuuggaccaaaaaccagu

SEQ ID NO: 1697195 - RNA, 21 nt, Human
uuuggaccaaaaaccaguauu

SEQ ID NO: 1697196 - RNA, 22 nt, Human
uuuggaccaaaaaccaguauug

SEQ ID NO: 1697197 - RNA, 23 nt, Human
uuuccacauaaggaaacuggguu

SEQ ID NO: 1697198 - RNA, 20 nt, Human
uuuccacauaaggaaacugg

SEQ ID NO: 1697199 - RNA, 20 nt, Human
uuuuaugacuucauuaauaa

SEQ ID NO: 1697200 - RNA, 21 nt, Human
uuuuaugacuucauuaauaau

SEQ ID NO: 1697201 - RNA, 13 nt, Human
uuuuauauuuacu

SEQ ID NO: 1697202 - RNA, 14 nt, Human
ugccuaaggacuuc

SEQ ID NO: 1697203 - RNA, 15 nt, Human
ugccuaaggacuucu

SEQ ID NO: 1697204 - RNA, 16 nt, Human
ugccuaaggacuucuu

SEQ ID NO: 1697205 - RNA, 20 nt, Human
ugccuaaggacuucuuuaau

SEQ ID NO: 1697206 - RNA, 12 nt, Human
ugccuaaggacu

SEQ ID NO: 1697207 - RNA, 13 nt, Human
ugccuaaggacuu

SEQ ID NO: 1697208 - RNA, 21 nt, Human
ugccuaaggacuucuuuaauu

SEQ ID NO: 1697209 - RNA, 12 nt, Human
ugcccugcuuuc

SEQ ID NO: 1697210 - RNA, 16 nt, Human
ugcccugcuuucagau

SEQ ID NO: 1697211 - RNA, 17 nt, Human
ugcccugcuuucagaua

SEQ ID NO: 1697212 - RNA, 15 nt, Human
ugcaaugaagucucu

SEQ ID NO: 1697213 - RNA, 18 nt, Human
ugcaaugaagucucugaa

SEQ ID NO: 1697214 - RNA, 22 nt, Human
ugcaaugaagucucugaaguga

SEQ ID NO: 1697215 - RNA, 17 nt, Human
ugagcaucacaguuuug

SEQ ID NO: 1697216 - RNA, 16 nt, Human
ugagcaucacaguuuu

SEQ ID NO: 1697217 - RNA, 14 nt, Human
ugagaaauuaagua

SEQ ID NO: 1697218 - RNA, 13 nt, Human
ugagaaauuaagu

SEQ ID NO: 1697219 - RNA, 13 nt, Human
ugacugauucuuc

SEQ ID NO: 1697220 - RNA, 14 nt, Human
ugacugauucuuca

SEQ ID NO: 1697221 - RNA, 15 nt, Human
ugacugauucuucag

SEQ ID NO: 1697222 - RNA, 16 nt, Human
ugacugauucuucagc

SEQ ID NO: 1697223 - RNA, 17 nt, Human
ugacugauucuucagca

SEQ ID NO: 1697224 - RNA, 19 nt, Human
ugaugccaaguuguuugag

SEQ ID NO: 1697225 - RNA, 15 nt, Human
ugaugccaaguuguu

SEQ ID NO: 1697226 - RNA, 21 nt, Human
ugaugccaaguuguuugagaa

SEQ ID NO: 1697227 - RNA, 23 nt, Human
ugggguuaucugaagucagaucu

SEQ ID NO: 1697228 - RNA, 13 nt, Human
ugggauaaaugcc

SEQ ID NO: 1697229 - RNA, 14 nt, Human
ugggauaaaugcca

SEQ ID NO: 1697230 - RNA, 12 nt, Human
ugggauaaaugc

SEQ ID NO: 1697231 - RNA, 13 nt, Human
uggcuuuucugau

SEQ ID NO: 1697232 - RNA, 15 nt, Human
uggaccaaaaaccag

SEQ ID NO: 1697233 - RNA, 14 nt, Human
uggaacgcguugaa

SEQ ID NO: 1697234 - RNA, 15 nt, Human
uggaacgcguugaaa

SEQ ID NO: 1697235 - RNA, 16 nt, Human
uggaacgcguugaaau

SEQ ID NO: 1697236 - RNA, 17 nt, Human
uggaacgcguugaaauu

SEQ ID NO: 1697237 - RNA, 17 nt, Human
ugucuacaccauuaugu

SEQ ID NO: 1697238 - RNA, 18 nt, Human
ugucuacaccauuaugug

SEQ ID NO: 1697239 - RNA, 16 nt, Human
ugucucagauuuuauu

SEQ ID NO: 1697240 - RNA, 20 nt, Human
ugucucagauuuuauuaugu

SEQ ID NO: 1697241 - RNA, 22 nt, Human
ugucucagauuuuauuauguaa

SEQ ID NO: 1697242 - RNA, 15 nt, Human
uguauuuguuugcau

SEQ ID NO: 1697243 - RNA, 23 nt, Human
uguauagaaccucuuugucuaca

SEQ ID NO: 1697244 - RNA, 15 nt, Human
uguauagauuagaau

SEQ ID NO: 1697245 - RNA, 21 nt, Human
uguauagauuagaauucugua

SEQ ID NO: 1697246 - RNA, 23 nt, Human
uguauagauuagagaguguugaa

SEQ ID NO: 1697247 - RNA, 19 nt, Human
ugguucuuguauuaagaau

SEQ ID NO: 1697248 - RNA, 14 nt, Human
ugguucuuguauua

SEQ ID NO: 1697249 - RNA, 18 nt, Human
ugguucuuguauuaagaa

SEQ ID NO: 1697250 - RNA, 16 nt, Human
uggugacuuuggauaa

SEQ ID NO: 1697251 - RNA, 18 nt, Human
uggugacuuuggauaaua

SEQ ID NO: 1697252 - RNA, 19 nt, Human
uggugacuuuggauaauaa

SEQ ID NO: 1697253 - RNA, 23 nt, Human
uggugacuuuggauaauaaggaa

SEQ ID NO: 1697254 - RNA, 15 nt, Human
uggugacuuuggaua

SEQ ID NO: 1697255 - RNA, 14 nt, Human
ugguugcuuuaaua

SEQ ID NO: 1697256 - RNA, 18 nt, Human
ugguugcuuuaauaucau

SEQ ID NO: 1697257 - RNA, 17 nt, Human
uguacaaaguauuaagc

SEQ ID NO: 1697258 - RNA, 18 nt, Human
uguacaaaguauuaagca

SEQ ID NO: 1697259 - RNA, 19 nt, Human
uguacaaaguauuaagcau

SEQ ID NO: 1697260 - RNA, 20 nt, Human
uguacaaaguauuaagcaua

SEQ ID NO: 1697261 - RNA, 15 nt, Human
uguacaaaguauuaa

SEQ ID NO: 1697262 - RNA, 21 nt, Human
uguacaaaguauuaagcauau

SEQ ID NO: 1697263 - RNA, 15 nt, Human
ucccuggccuuucau

SEQ ID NO: 1697264 - RNA, 11 nt, Human
ucccuggccuu

SEQ ID NO: 1697265 - RNA, 20 nt, Human
ucuaugcugaguuugugcug

SEQ ID NO: 1697266 - RNA, 16 nt, Human
ucuaugcugaguuugu

SEQ ID NO: 1697267 - RNA, 16 nt, Human
ucucugaagugaaacu

SEQ ID NO: 1697268 - RNA, 12 nt, Human
ucugacaucucu

SEQ ID NO: 1697269 - RNA, 14 nt, Human
ucugacaucucugc

SEQ ID NO: 1697270 - RNA, 15 nt, Human
ucugacaucucugca

SEQ ID NO: 1697271 - RNA, 15 nt, Human
ucugaggaauucugu

SEQ ID NO: 1697272 - RNA, 16 nt, Human
ucugaggaauucugua

SEQ ID NO: 1697273 - RNA, 17 nt, Human
ucugaggaauucuguau

SEQ ID NO: 1697274 - RNA, 18 nt, Human
ucugaggaauucuguaua

SEQ ID NO: 1697275 - RNA, 19 nt, Human
ucugaggaauucuguauag

SEQ ID NO: 1697276 - RNA, 14 nt, Human
ucugaggaauucug

SEQ ID NO: 1697277 - RNA, 16 nt, Human
ucuuaaaguugaauuu

SEQ ID NO: 1697278 - RNA, 19 nt, Human
ucuuaaaguugaauuuauu

SEQ ID NO: 1697279 - RNA, 20 nt, Human
ucuuaaaguugaauuuauug

SEQ ID NO: 1697280 - RNA, 21 nt, Human
ucuuaaaguugaauuuauugg

SEQ ID NO: 1697281 - RNA, 22 nt, Human
ucuuaaaguugaauuuauuggc

SEQ ID NO: 1697282 - RNA, 15 nt, Human
ucuuaaauaauaaag

SEQ ID NO: 1697283 - RNA, 19 nt, Human
ucuuaaauaauaaagauca

SEQ ID NO: 1697284 - RNA, 13 nt, Human
ucuuaaaguugaa

SEQ ID NO: 1697285 - RNA, 14 nt, Human
ucuuaaaguugaau

SEQ ID NO: 1697286 - RNA, 12 nt, Human
ucuuaaaguuga

SEQ ID NO: 1697287 - RNA, 21 nt, Human
ucuucagcaaaaauauuuuau

SEQ ID NO: 1697288 - RNA, 22 nt, Human
ucuucagcaaaaauauuuuaug

SEQ ID NO: 1697289 - RNA, 23 nt, Human
ucuucagcaaaaauauuuuauga

SEQ ID NO: 1697290 - RNA, 18 nt, Human
ucuucauaccuacaugua

SEQ ID NO: 1697291 - RNA, 21 nt, Human
ucuucauaccuacauguauuu

SEQ ID NO: 1697292 - RNA, 14 nt, Human
uauuuuuuuucugu

SEQ ID NO: 1697293 - RNA, 18 nt, Human
uauuuuauuaugaaacuu

SEQ ID NO: 1697294 - RNA, 23 nt, Human
uauuuuauuaugaaacuugugua

SEQ ID NO: 1697295 - RNA, 13 nt, Human
uauuuuauuauga

SEQ ID NO: 1697296 - RNA, 17 nt, Human
uauuuauaaucacuuuu

SEQ ID NO: 1697297 - RNA, 15 nt, Human
uauuuucauucuccu

SEQ ID NO: 1697298 - RNA, 23 nt, Human
ucacaccccagacgaugucuuca

SEQ ID NO: 1697299 - RNA, 12 nt, Human
uauuacaguaua

SEQ ID NO: 1697300 - RNA, 13 nt, Human
uauuacaguauaa

SEQ ID NO: 1697301 - RNA, 14 nt, Human
uauuacaguauaau

SEQ ID NO: 1697302 - RNA, 15 nt, Human
uauguaaaucccauu

SEQ ID NO: 1697303 - RNA, 19 nt, Human
uauguaaaucccauuauuc

SEQ ID NO: 1697304 - RNA, 20 nt, Human
uauguaaaucccauuauuca

SEQ ID NO: 1697305 - RNA, 21 nt, Human
uauguaaaucccauuauucaa

SEQ ID NO: 1697306 - RNA, 23 nt, Human
uauguaaaucccauuauucaaag

SEQ ID NO: 1697307 - RNA, 12 nt, Human
uauguaaauccc

SEQ ID NO: 1697308 - RNA, 16 nt, Human
uauuaagaaugaaaua

SEQ ID NO: 1697309 - RNA, 13 nt, Human
uauuaagaaugaa

SEQ ID NO: 1697310 - RNA, 23 nt, Human
ucauuauuuuauuaugaaacuug

SEQ ID NO: 1697311 - RNA, 15 nt, Human
ucauaccuacaugua

SEQ ID NO: 1697312 - RNA, 16 nt, Human
ucauaccuacauguau

SEQ ID NO: 1697313 - RNA, 14 nt, Human
ucaucaguauugaa

SEQ ID NO: 1697314 - RNA, 14 nt, Human
ggaccaaaaaccag

SEQ ID NO: 1697315 - RNA, 13 nt, Human
ggauucuuaaagu

SEQ ID NO: 1697316 - RNA, 15 nt, Human
ggcuuuguauagaac

SEQ ID NO: 1697317 - RNA, 12 nt, Human
gcuuuguauaga

SEQ ID NO: 1697318 - RNA, 13 nt, Human
gcuuuguauagaa

SEQ ID NO: 1697319 - RNA, 14 nt, Human
gcuuuguauagaac

SEQ ID NO: 1697320 - RNA, 20 nt, Human
gcuuuguauagaaccucuuu

SEQ ID NO: 1697321 - RNA, 15 nt, Human
gcuuguuuccuagca

SEQ ID NO: 1697322 - RNA, 23 nt, Human
gcuuguuuccuagcacacacuuu

SEQ ID NO: 1697323 - RNA, 22 nt, Human
gcuuuaaacauugguucuugua

SEQ ID NO: 1697324 - RNA, 21 nt, Human
gcugguguaugugugaaguga

SEQ ID NO: 1697325 - RNA, 13 nt, Human
gcagauuauucac

SEQ ID NO: 1697326 - RNA, 16 nt, Human
gcagauuauucacuga

SEQ ID NO: 1697327 - RNA, 15 nt, Human
gauagaggaagccug

SEQ ID NO: 1697328 - RNA, 21 nt, Human
gauagaggaagccugauuaaa

SEQ ID NO: 1697329 - RNA, 22 nt, Human
gauagaggaagccugauuaaag

SEQ ID NO: 1697330 - RNA, 14 nt, Human
gauagaggaagccu

SEQ ID NO: 1697331 - RNA, 16 nt, Human
gaggaauucuguauag

SEQ ID NO: 1697332 - RNA, 17 nt, Human
gaggaauucuguauaga

SEQ ID NO: 1697333 - RNA, 14 nt, Human
gaggaauucuguau

SEQ ID NO: 1697334 - RNA, 23 nt, Human
gagccugcacggugaauggcuuu

SEQ ID NO: 1697335 - RNA, 17 nt, Human
gagccugcacggugaau

SEQ ID NO: 1697336 - RNA, 22 nt, Human
gagccugcacggugaauggcuu

SEQ ID NO: 1697337 - RNA, 14 nt, Human
cuauuucuauauuu

SEQ ID NO: 1697338 - RNA, 16 nt, Human
cuauuucuauauuuuc

SEQ ID NO: 1697339 - RNA, 18 nt, Human
cuauuucuauauuuucau

SEQ ID NO: 1697340 - RNA, 15 nt, Human
cucagauuuuauuau

SEQ ID NO: 1697341 - RNA, 17 nt, Human
cucagauuuuauuaugu

SEQ ID NO: 1697342 - RNA, 18 nt, Human
cucagauuuuauuaugua

SEQ ID NO: 1697343 - RNA, 13 nt, Human
cucagauuuuauu

SEQ ID NO: 1697344 - RNA, 19 nt, Human
cuauauuuucauucuccua

SEQ ID NO: 1697345 - RNA, 15 nt, Human
cuauauuuucauucu

SEQ ID NO: 1697346 - RNA, 18 nt, Human
cuaugcugaguuugugcu

SEQ ID NO: 1697347 - RNA, 22 nt, Human
cuccaauuaaggauuuuaugcu

SEQ ID NO: 1697348 - RNA, 17 nt, Human
cuccaauuaaggauuuu

SEQ ID NO: 1697349 - RNA, 20 nt, Human
cuccaauuaaggauuuuaug

SEQ ID NO: 1697350 - RNA, 19 nt, Human
cucugaagugaaacugcuu

SEQ ID NO: 1697351 - RNA, 23 nt, Human
cucugaagugaaacugcuuguuu

SEQ ID NO: 1697352 - RNA, 23 nt, Human
cucuuugucuacaccauuaugug

SEQ ID NO: 1697353 - RNA, 13 nt, Human
cugaguuugugcu

SEQ ID NO: 1697354 - RNA, 18 nt, Human
cugaguuugugcuggugu

SEQ ID NO: 1697355 - RNA, 22 nt, Human
cugauuugacauagucuggcug

SEQ ID NO: 1697356 - RNA, 23 nt, Human
cugauuugacauagucuggcugu

SEQ ID NO: 1697357 - RNA, 21 nt, Human
cugauuugacauagucuggcu

SEQ ID NO: 1697358 - RNA, 15 nt, Human
gaaauacuguuugag

SEQ ID NO: 1697359 - RNA, 19 nt, Human
gaaauacuguuugagguuu

SEQ ID NO: 1697360 - RNA, 16 nt, Human
gaacgcguugaaauug

SEQ ID NO: 1697361 - RNA, 15 nt, Human
gaaggcaaaugacuu

SEQ ID NO: 1697362 - RNA, 16 nt, Human
gaaggcaaaugacuuu

SEQ ID NO: 1697363 - RNA, 16 nt, Human
gaagguucugguguga

SEQ ID NO: 1697364 - RNA, 20 nt, Human
gaagguucuggugugaacua

SEQ ID NO: 1697365 - RNA, 14 nt, Human
gaaggcaaaugacu

SEQ ID NO: 1697366 - RNA, 11 nt, Human
cuuuucugaua

SEQ ID NO: 1697367 - RNA, 14 nt, Human
cuuuucugauagag

SEQ ID NO: 1697368 - RNA, 14 nt, Human
cuuucauauuuuag

SEQ ID NO: 1697369 - RNA, 17 nt, Human
cuuuaaaaaaaaaauug

SEQ ID NO: 1697370 - RNA, 16 nt, Human
cuucauuaauaauaaa

SEQ ID NO: 1697371 - RNA, 17 nt, Human
cuucauuaauaauaaau

SEQ ID NO: 1697372 - RNA, 20 nt, Human
cuucagcaaaaauauuuuau

SEQ ID NO: 1697373 - RNA, 23 nt, Human
cuucagcaaaaauauuuuaugau

SEQ ID NO: 1697374 - RNA, 17 nt, Human
cuucagcaaaaauauuu

SEQ ID NO: 1697375 - RNA, 16 nt, Human
cuucucagaaggcaaa

SEQ ID NO: 1697376 - RNA, 22 nt, Human
cuucucagaaggcaaaugacuu

SEQ ID NO: 1697377 - RNA, 15 nt, Human
cugguguauguguga

SEQ ID NO: 1697378 - RNA, 16 nt, Human
cuggugugaacuaaac

SEQ ID NO: 1697379 - RNA, 17 nt, Human
cuggugugaacuaaacu

SEQ ID NO: 1697380 - RNA, 14 nt, Human
cugggguuaucuga

SEQ ID NO: 1697381 - RNA, 18 nt, Human
cugggcugaacacuccaa

SEQ ID NO: 1697382 - RNA, 15 nt, Human
cuguggugacuuugg

SEQ ID NO: 1697383 - RNA, 17 nt, Human
cuguggugacuuuggau

SEQ ID NO: 1697384 - RNA, 18 nt, Human
cuguggugacuuuggaua

SEQ ID NO: 1697385 - RNA, 20 nt, Human
cuguggugacuuuggauaau

SEQ ID NO: 1697386 - RNA, 23 nt, Human
cuguggugacuuuggauaauaag

SEQ ID NO: 1697387 - RNA, 13 nt, Human
cuguggugacuuu

SEQ ID NO: 1697388 - RNA, 14 nt, Human
cuguggugacuuug

SEQ ID NO: 1697389 - RNA, 12 nt, Human
cuguggugacuu

SEQ ID NO: 1697390 - RNA, 21 nt, Human
cugucuugccuuuuucauuau

SEQ ID NO: 1697391 - RNA, 23 nt, Human
cugucuugccuuuuucauuauuu

SEQ ID NO: 1697392 - RNA, 17 nt, Human
cccugcuuucagauacu

SEQ ID NO: 1697393 - RNA, 14 nt, Human
cccugcuuucagau

SEQ ID NO: 1697394 - RNA, 17 nt, Human
ccuaaauccauuuggaa

SEQ ID NO: 1697395 - RNA, 18 nt, Human
ccuaaauccauuuggaaa

SEQ ID NO: 1697396 - RNA, 12 nt, Human
ccuaaauccauu

SEQ ID NO: 1697397 - RNA, 15 nt, Human
ccgugcuaaggacuu

SEQ ID NO: 1697398 - RNA, 16 nt, Human
ccgugcuaaggacuug

SEQ ID NO: 1697399 - RNA, 14 nt, Human
ccgugcuaaggacu

SEQ ID NO: 1697400 - RNA, 12 nt, Human
ccuuaaaggaag

SEQ ID NO: 1697401 - RNA, 20 nt, Human
ccugcacggugaauggcuuu

SEQ ID NO: 1697402 - RNA, 20 nt, Human
ccugcaaugaagucucugaa

SEQ ID NO: 1697403 - RNA, 21 nt, Human
ccugcacggugaauggcuuug

SEQ ID NO: 1697404 - RNA, 21 nt, Human
ccugcaaugaagucucugaag

SEQ ID NO: 1697405 - RNA, 19 nt, Human
ccugcaaugaagucucuga

SEQ ID NO: 1697406 - RNA, 14 nt, Human
ccauuauucaaagu

SEQ ID NO: 1697407 - RNA, 13 nt, Human
ccauguuuauuac

SEQ ID NO: 1697408 - RNA, 20 nt, Human
ccauguuuauuacaguauaa

SEQ ID NO: 1697409 - RNA, 17 nt, Human
ccauuauucaaaguugc

SEQ ID NO: 1697410 - RNA, 22 nt, Human
ccauuauucaaaguugccuaaa

SEQ ID NO: 1697411 - RNA, 17 nt, Human
ccaugggauaaaugcca

SEQ ID NO: 1697412 - RNA, 13 nt, Human
ccaugggauaaau

SEQ ID NO: 1697413 - RNA, 17 nt, Human
cauuauuuuauuaugaa

SEQ ID NO: 1697414 - RNA, 18 nt, Human
cauuauucaaaguugccu

SEQ ID NO: 1697415 - RNA, 21 nt, Human
cauuauucaaaguugccuaaa

SEQ ID NO: 1697416 - RNA, 22 nt, Human
cauuauucaaaguugccuaaau

SEQ ID NO: 1697417 - RNA, 14 nt, Human
cauuaauaauaaau

SEQ ID NO: 1697418 - RNA, 17 nt, Human
cauuuggaaaucuuuaa

SEQ ID NO: 1697419 - RNA, 18 nt, Human
cauuuggaaaucuuuaaa

SEQ ID NO: 1697420 - RNA, 11 nt, Human
cauuuggaaau

SEQ ID NO: 1697421 - RNA, 22 nt, Human
cauuuggaaaucuuuaaaaaaa

SEQ ID NO: 1697422 - RNA, 18 nt, Human
caugggauaaaugccauc

SEQ ID NO: 1697423 - RNA, 23 nt, Human
caugggauaaaugccaucaauaa

SEQ ID NO: 1697424 - RNA, 16 nt, Human
caugggauaaaugcca

SEQ ID NO: 1697425 - RNA, 17 nt, Human
caugggauaaaugccau

SEQ ID NO: 1697426 - RNA, 22 nt, Human
cauguuaaaccaugggauaaau

SEQ ID NO: 1697427 - RNA, 23 nt, Human
cauguuuauuacaguauaauuaa

SEQ ID NO: 1697428 - RNA, 13 nt, Human
cauguuaaaccau

SEQ ID NO: 1697429 - RNA, 16 nt, Human
caucaguauugaagca

SEQ ID NO: 1697430 - RNA, 20 nt, Human
caucaguauugaagcauuuu

SEQ ID NO: 1697431 - RNA, 22 nt, Human
caucaguauugaagcauuuuau

SEQ ID NO: 1697432 - RNA, 19 nt, Human
cauagucuggcuguaccca

SEQ ID NO: 1697433 - RNA, 18 nt, Human
cauauauuuuuauauuua

SEQ ID NO: 1697434 - RNA, 20 nt, Human
cauauauuuuuauauuuacu

SEQ ID NO: 1697435 - RNA, 21 nt, Human
cauauauuuuuauauuuacua

SEQ ID NO: 1697436 - RNA, 22 nt, Human
cauauauuuuuauauuuacuaa

SEQ ID NO: 1697437 - RNA, 15 nt, Human
caucucugcaaucuu

SEQ ID NO: 1697438 - RNA, 22 nt, Human
caucucugcaaucuucucagaa

SEQ ID NO: 1697439 - RNA, 14 nt, Human
caguauaauuaaca

SEQ ID NO: 1697440 - RNA, 15 nt, Human
caguauaauuaacau

SEQ ID NO: 1697441 - RNA, 17 nt, Human
caguauaauuaacaugu

SEQ ID NO: 1697442 - RNA, 21 nt, Human
caguauaauuaacauguuaaa

SEQ ID NO: 1697443 - RNA, 21 nt, Human
cagccucccuauuuuuuuucu

SEQ ID NO: 1697444 - RNA, 19 nt, Human
cagcuggugcccugcuuuc

SEQ ID NO: 1697445 - RNA, 20 nt, Human
cagcuggugcccugcuuuca

SEQ ID NO: 1697446 - RNA, 21 nt, Human
cagcuggugcccugcuuucag

SEQ ID NO: 1697447 - RNA, 23 nt, Human
cagcuggugcccugcuuucagau

SEQ ID NO: 1697448 - RNA, 18 nt, Human
cagcuggugcccugcuuu

SEQ ID NO: 1697449 - RNA, 17 nt, Human
caggaauggagccugca

SEQ ID NO: 1697450 - RNA, 23 nt, Human
caggaauggagccugcacgguga

SEQ ID NO: 1697451 - RNA, 14 nt, Human
cagcagauuauuca

SEQ ID NO: 1697452 - RNA, 15 nt, Human
cagcagauuauucac

SEQ ID NO: 1697453 - RNA, 19 nt, Human
cagcagauuauucacugau

SEQ ID NO: 1697454 - RNA, 13 nt, Human
cagauuuuauuau

SEQ ID NO: 1697455 - RNA, 15 nt, Human
cagauuuuauuaugu

SEQ ID NO: 1697456 - RNA, 16 nt, Human
cagauuuuauuaugua

SEQ ID NO: 1697457 - RNA, 18 nt, Human
cagauuuuauuauguaaa

SEQ ID NO: 1697458 - RNA, 20 nt, Human
cagauuuuauuauguaaauc

SEQ ID NO: 1697459 - RNA, 21 nt, Human
cagauuuuauuauguaaaucc

SEQ ID NO: 1697460 - RNA, 22 nt, Human
cagauuuuauuauguaaauccc

SEQ ID NO: 1697461 - RNA, 17 nt, Human
cagcaaaaauauuuuau

SEQ ID NO: 1697462 - RNA, 12 nt, Human
cagauuauucac

SEQ ID NO: 1697463 - RNA, 18 nt, Human
cagauuauucacugauuu

SEQ ID NO: 1697464 - RNA, 23 nt, Human
cagauuauucacugauuugacau

SEQ ID NO: 1697465 - RNA, 18 nt, Human
cagaaggcaaaugacuuu

SEQ ID NO: 1697466 - RNA, 19 nt, Human
cagaaggcaaaugacuuug

SEQ ID NO: 1697467 - RNA, 20 nt, Human
cagaaggcaaaugacuuugg

SEQ ID NO: 1697468 - RNA, 22 nt, Human
cacuuuugguuaagucuguuuu

SEQ ID NO: 1697469 - RNA, 14 nt, Human
cacuuuuuuccaca

SEQ ID NO: 1697470 - RNA, 12 nt, Human
cacuuuuuucca

SEQ ID NO: 1697471 - RNA, 19 nt, Human
cagaucugccuaaggacuu

SEQ ID NO: 1697472 - RNA, 20 nt, Human
cagaucugccuaaggacuuc

SEQ ID NO: 1697473 - RNA, 21 nt, Human
cagaucugccuaaggacuucu

SEQ ID NO: 1697474 - RNA, 23 nt, Human
cagaucugccuaaggacuucuuu

SEQ ID NO: 1697475 - RNA, 16 nt, Human
cagaucugccuaagga

SEQ ID NO: 1697476 - RNA, 17 nt, Human
cagaucugccuaaggac

SEQ ID NO: 1697477 - RNA, 14 nt, Human
cagaucugccuaag

SEQ ID NO: 1697478 - RNA, 20 nt, Human
cagauaacuguuauuuauaa

SEQ ID NO: 1697479 - RNA, 21 nt, Human
cagauaacuguuauuuauaau

SEQ ID NO: 1697480 - RNA, 14 nt, Human
cagauaacuguuau

SEQ ID NO: 1697481 - RNA, 16 nt, Human
cagauaacuguuauuu

SEQ ID NO: 1697482 - RNA, 19 nt, Human
cagauaacuguuauuuaua

SEQ ID NO: 1697483 - RNA, 15 nt, Human
cacucuccauuuaau

SEQ ID NO: 1697484 - RNA, 17 nt, Human
cacucuccauuuaauaa

SEQ ID NO: 1697485 - RNA, 20 nt, Human
cacggugaauggcuuuguau

SEQ ID NO: 1697486 - RNA, 23 nt, Human
cacggugaauggcuuuguauaga

SEQ ID NO: 1697487 - RNA, 20 nt, Human
caccugucuugccuuuuuca

SEQ ID NO: 1697488 - RNA, 17 nt, Human
caccugucuugccuuuu

SEQ ID NO: 1697489 - RNA, 21 nt, Human
cacugauuugacauagucugg

SEQ ID NO: 1697490 - RNA, 23 nt, Human
cacugauuugacauagucuggcu

SEQ ID NO: 1697491 - RNA, 23 nt, Human
aaaaaauuggggauucuuaaagu

SEQ ID NO: 1697492 - RNA, 20 nt, Human
aaaaauuggggauucuuaaa

SEQ ID NO: 1697493 - RNA, 19 nt, Human
aaaaauuggggauucuuaa

SEQ ID NO: 1697494 - RNA, 18 nt, Human
aaaaauuggggauucuua

SEQ ID NO: 1697495 - RNA, 17 nt, Human
aaaaauuggggauucuu

SEQ ID NO: 1697496 - RNA, 18 nt, Human
aaaaaccaguauuguaca

SEQ ID NO: 1697497 - RNA, 16 nt, Human
aaaaaccaguauugua

SEQ ID NO: 1697498 - RNA, 14 nt, Human
aaaacaaggaugaa

SEQ ID NO: 1697499 - RNA, 17 nt, Human
aaaacaaggaugaauua

SEQ ID NO: 1697500 - RNA, 13 nt, Human
aauggcuuuguau

SEQ ID NO: 1697501 - RNA, 18 nt, Human
aauggcuuuguauagaac

SEQ ID NO: 1697502 - RNA, 16 nt, Human
aauggcuuuguauaga

SEQ ID NO: 1697503 - RNA, 15 nt, Human
aauggcuuuguauag

SEQ ID NO: 1697504 - RNA, 22 nt, Human
aaugguccgugcuaaggacuug

SEQ ID NO: 1697505 - RNA, 20 nt, Human
aauuaguuuuauaugcuucu

SEQ ID NO: 1697506 - RNA, 17 nt, Human
aauuaguuuuauaugcu

SEQ ID NO: 1697507 - RNA, 14 nt, Human
aauuaguuuuauau

SEQ ID NO: 1697508 - RNA, 22 nt, Human
aauccauuuggaaaucuuuaaa

SEQ ID NO: 1697509 - RNA, 18 nt, Human
aauccauuuggaaaucuu

SEQ ID NO: 1697510 - RNA, 17 nt, Human
aauccauuuggaaaucu

SEQ ID NO: 1697511 - RNA, 15 nt, Human
aauccauuuggaaau

SEQ ID NO: 1697512 - RNA, 14 nt, Human
aauccauuuggaaa

SEQ ID NO: 1697513 - RNA, 14 nt, Human
aauccauacauuug

SEQ ID NO: 1697514 - RNA, 13 nt, Human
aauccauacauuu

SEQ ID NO: 1697515 - RNA, 20 nt, Human
aaugauaacuggaaacuuca

SEQ ID NO: 1697516 - RNA, 17 nt, Human
aaugauaacuggaaacu

SEQ ID NO: 1697517 - RNA, 14 nt, Human
aaucaacugggcug

SEQ ID NO: 1697518 - RNA, 19 nt, Human
aaucaacugggcugaacac

SEQ ID NO: 1697519 - RNA, 13 nt, Human
aaucacaauacau

SEQ ID NO: 1697520 - RNA, 16 nt, Human
aauauuauguuaaaac

SEQ ID NO: 1697521 - RNA, 22 nt, Human
aaguaucugacaucucugcaau

SEQ ID NO: 1697522 - RNA, 15 nt, Human
aaguaucugacaucu

SEQ ID NO: 1697523 - RNA, 18 nt, Human
aagguucuggugugaacu

SEQ ID NO: 1697524 - RNA, 22 nt, Human
aagucucugaagugaaacugcu

SEQ ID NO: 1697525 - RNA, 19 nt, Human
aagucucugaagugaaacu

SEQ ID NO: 1697526 - RNA, 23 nt, Human
aagucuguuuuaugacuucauua

SEQ ID NO: 1697527 - RNA, 20 nt, Human
aagucuguuuuaugacuuca

SEQ ID NO: 1697528 - RNA, 19 nt, Human
aagucuguuuuaugacuuc

SEQ ID NO: 1697529 - RNA, 18 nt, Human
aagucuguuuuaugacuu

SEQ ID NO: 1697530 - RNA, 16 nt, Human
aagucuguuuuaugac

SEQ ID NO: 1697531 - RNA, 15 nt, Human
aagucuguuuuauga

SEQ ID NO: 1697532 - RNA, 15 nt, Human
aaguuguuugagaaa

SEQ ID NO: 1697533 - RNA, 12 nt, Human
aaguuguuugag

SEQ ID NO: 1697534 - RNA, 21 nt, Human
aauaauccuaaacauaugaau

SEQ ID NO: 1697535 - RNA, 13 nt, Human
aagccauguuuau

SEQ ID NO: 1697536 - RNA, 13 nt, Human
aagccagauuuuc

SEQ ID NO: 1697537 - RNA, 16 nt, Human
aagauuuaccacuugu

SEQ ID NO: 1697538 - RNA, 22 nt, Human
aaggauuuuaugcuuuaaacau

SEQ ID NO: 1697539 - RNA, 21 nt, Human
aaggauuuuaugcuuuaaaca

SEQ ID NO: 1697540 - RNA, 20 nt, Human
aaggauuuuaugcuuuaaac

SEQ ID NO: 1697541 - RNA, 16 nt, Human
aaggauuuuaugcuuu

SEQ ID NO: 1697542 - RNA, 23 nt, Human
aaggauuuuaugcuuuaaacauu

SEQ ID NO: 1697543 - RNA, 13 nt, Human
aaggauuuuaugc

SEQ ID NO: 1697544 - RNA, 12 nt, Human
aaggauuuuaug

SEQ ID NO: 1697545 - RNA, 14 nt, Human
aaauauuuuaugau

SEQ ID NO: 1697546 - RNA, 19 nt, Human
aaauauuuuaugauccagc

SEQ ID NO: 1697547 - RNA, 18 nt, Human
aaauauuuuaugauccag

SEQ ID NO: 1697548 - RNA, 14 nt, Human
aaauacuguuugag

SEQ ID NO: 1697549 - RNA, 19 nt, Human
aaauggacuguggugacuu

SEQ ID NO: 1697550 - RNA, 18 nt, Human
aaauggcuuccuggcaau

SEQ ID NO: 1697551 - RNA, 12 nt, Human
aaauaacaauga

SEQ ID NO: 1697552 - RNA, 19 nt, Human
aaaauuggggauucuuaaa

SEQ ID NO: 1697553 - RNA, 18 nt, Human
aaaauuggggauucuuaa

SEQ ID NO: 1697554 - RNA, 17 nt, Human
aaaauuggggauucuua

SEQ ID NO: 1697555 - RNA, 19 nt, Human
aaagagguuuuucuuaaau

SEQ ID NO: 1697556 - RNA, 16 nt, Human
aaagagguuuuucuua

SEQ ID NO: 1697557 - RNA, 17 nt, Human
aaacugacucuuaagaa

SEQ ID NO: 1697558 - RNA, 16 nt, Human
aaacugacucuuaaga

SEQ ID NO: 1697559 - RNA, 12 nt, Human
aacuuuucugau

SEQ ID NO: 1697560 - RNA, 14 nt, Human
aacuuuucugauag

SEQ ID NO: 1697561 - RNA, 13 nt, Human
aacuuuucugaua

SEQ ID NO: 1697562 - RNA, 17 nt, Human
aaauuggggauucuuaa

SEQ ID NO: 1697563 - RNA, 16 nt, Human
aaauuggggauucuua

SEQ ID NO: 1697564 - RNA, 22 nt, Human
aaccaguauuguacaaaguauu

SEQ ID NO: 1697565 - RNA, 21 nt, Human
aaccaguauuguacaaaguau

SEQ ID NO: 1697566 - RNA, 15 nt, Human
aaccaguauuguaca

SEQ ID NO: 1697567 - RNA, 20 nt, Human
aaccaguauuguacaaagua

SEQ ID NO: 1697568 - RNA, 17 nt, Human
aacagcuggugcccugc

SEQ ID NO: 1697569 - RNA, 13 nt, Human
acgaugucuucau

SEQ ID NO: 1697570 - RNA, 16 nt, Human
acuaagagagaaugag

SEQ ID NO: 1697571 - RNA, 23 nt, Human
accuuucagauaacuguuauuua

SEQ ID NO: 1697572 - RNA, 14 nt, Human
acuagcuauggugu

SEQ ID NO: 1697573 - RNA, 13 nt, Human
acucccuuucaac

SEQ ID NO: 1697574 - RNA, 12 nt, Human
acucccuuucaa

SEQ ID NO: 1697575 - RNA, 21 nt, Human
acuucuuuaauuuuggaauuu

SEQ ID NO: 1697576 - RNA, 15 nt, Human
acuuggucugugaga

SEQ ID NO: 1697577 - RNA, 14 nt, Human
acuuggucugugag

SEQ ID NO: 1697578 - RNA, 19 nt, Human
acuuguaaaggaauuuaaa

SEQ ID NO: 1697579 - RNA, 20 nt, Human
acuuguaaaggaauuuaaaa

SEQ ID NO: 1697580 - RNA, 21 nt, Human
acuuggucugugagaugcuag

SEQ ID NO: 1697581 - RNA, 14 nt, Human
acuggguuccugca

SEQ ID NO: 1697582 - RNA, 12 nt, Human
acuuuucugaua

SEQ ID NO: 1697583 - RNA, 14 nt, Human
agaaaauaacaaua

SEQ ID NO: 1697584 - RNA, 18 nt, Human
acaauuuuguuucuguac

SEQ ID NO: 1697585 - RNA, 17 nt, Human
acaauuuuguuucugua

SEQ ID NO: 1697586 - RNA, 15 nt, Human
acaauuuuguuucug

SEQ ID NO: 1697587 - RNA, 14 nt, Human
acaauuuuguuucu

SEQ ID NO: 1697588 - RNA, 13 nt, Human
acaacuauauugu

SEQ ID NO: 1697589 - RNA, 20 nt, Human
acagcucugcauacucauua

SEQ ID NO: 1697590 - RNA, 18 nt, Human
acauaaaucugugaacuu

SEQ ID NO: 1697591 - RNA, 15 nt, Human
acauaaaucugugaa

SEQ ID NO: 1697592 - RNA, 14 nt, Human
acauaaaucuguga

SEQ ID NO: 1697593 - RNA, 13 nt, Human
acauguuacaaca

SEQ ID NO: 1697594 - RNA, 14 nt, Human
acauuuguauaaaa

SEQ ID NO: 1697595 - RNA, 18 nt, Human
acauuugcucauggaauu

SEQ ID NO: 1697596 - RNA, 15 nt, Human
acccacaagaaauga

SEQ ID NO: 1697597 - RNA, 14 nt, Human
auaugcuauuucua

SEQ ID NO: 1697598 - RNA, 23 nt, Human
auaugcuucuguuuuauaauuuu

SEQ ID NO: 1697599 - RNA, 18 nt, Human
auaucacuugucaauaaa

SEQ ID NO: 1697600 - RNA, 22 nt, Human
auauuuauuacuguaagaaaau

SEQ ID NO: 1697601 - RNA, 18 nt, Human
auauuuauuuuaauaaug

SEQ ID NO: 1697602 - RNA, 19 nt, Human
auauuuauuacuguaagaa

SEQ ID NO: 1697603 - RNA, 14 nt, Human
auauuuauuacugu

SEQ ID NO: 1697604 - RNA, 23 nt, Human
auauuucagauaaucacaauaca

SEQ ID NO: 1697605 - RNA, 20 nt, Human
auacaauuuuguuucuguac

SEQ ID NO: 1697606 - RNA, 19 nt, Human
auacaauuuuguuucugua

SEQ ID NO: 1697607 - RNA, 14 nt, Human
auaauuacuauguc

SEQ ID NO: 1697608 - RNA, 15 nt, Human
auaccuacauguauu

SEQ ID NO: 1697609 - RNA, 22 nt, Human
auaauuaacauguuaaaccaug

SEQ ID NO: 1697610 - RNA, 21 nt, Human
auaauuaacauguuaaaccau

SEQ ID NO: 1697611 - RNA, 20 nt, Human
auaauuaacauguuaaacca

SEQ ID NO: 1697612 - RNA, 20 nt, Human
aguugaauuuauuggcuuuu

SEQ ID NO: 1697613 - RNA, 18 nt, Human
aguuguaccgcaauguga

SEQ ID NO: 1697614 - RNA, 19 nt, Human
aguuguaccgcaaugugac

SEQ ID NO: 1697615 - RNA, 19 nt, Human
aguugaauuuauuggcuuu

SEQ ID NO: 1697616 - RNA, 17 nt, Human
aguugaauuuauuggcu

SEQ ID NO: 1697617 - RNA, 13 nt, Human
aguugaauuuauu

SEQ ID NO: 1697618 - RNA, 11 nt, Human
aguugaauuua

SEQ ID NO: 1697619 - RNA, 15 nt, Human
agugauuaccaggga

SEQ ID NO: 1697620 - RNA, 18 nt, Human
agugauuaccagggacug

SEQ ID NO: 1697621 - RNA, 13 nt, Human
agucaaauugugu

SEQ ID NO: 1697622 - RNA, 17 nt, Human
agucaaauugugugaaa

SEQ ID NO: 1697623 - RNA, 15 nt, Human
agucaaauuguguga

SEQ ID NO: 1697624 - RNA, 21 nt, Human
aguccaagcauuuagauguau

SEQ ID NO: 1697625 - RNA, 16 nt, Human
aguccaagcauuuaga

SEQ ID NO: 1697626 - RNA, 22 nt, Human
auggagccugcacggugaaugg

SEQ ID NO: 1697627 - RNA, 18 nt, Human
auggagccugcacgguga

SEQ ID NO: 1697628 - RNA, 16 nt, Human
augucaaucagccuag

SEQ ID NO: 1697629 - RNA, 24 nt, Human
aucuucucagaaggcaaaugacuu

SEQ ID NO: 1697630 - RNA, 22 nt, Human
aucuuauaauuuaaaauaugcu

SEQ ID NO: 1697631 - RNA, 21 nt, Human
aucaccugucuugccuuuuuc

SEQ ID NO: 1697632 - RNA, 12 nt, Human
aucaccugucuu

SEQ ID NO: 1697633 - RNA, 14 nt, Human
agaguguugaaacg

SEQ ID NO: 1697634 - RNA, 21 nt, Human
agauaggucagugcaaauacu

SEQ ID NO: 1697635 - RNA, 17 nt, Human
agacugcauuauauuua

SEQ ID NO: 1697636 - RNA, 17 nt, Human
agccauguuuauuacag

SEQ ID NO: 1697637 - RNA, 22 nt, Human
agccauguuuauuacaguauaa

SEQ ID NO: 1697638 - RNA, 19 nt, Human
agccagauuuuccugaaaa

SEQ ID NO: 1697639 - RNA, 15 nt, Human
agccagauuuuccug

SEQ ID NO: 1697640 - RNA, 21 nt, Human
agaugggagaaucacuugaac

SEQ ID NO: 1697641 - RNA, 14 nt, Human
agauguagaggaga

SEQ ID NO: 1697642 - RNA, 23 nt, Human
agccucccuauuuuuuuucuguu

SEQ ID NO: 1697643 - RNA, 23 nt, Human
aggcugaugccaaguuguuugag

SEQ ID NO: 1697644 - RNA, 14 nt, Human
agcuggugcccugc

SEQ ID NO: 1697645 - RNA, 14 nt, Human
agcuguaugauucc

SEQ ID NO: 1697646 - RNA, 14 nt, Human
aggauguugaaaaa

SEQ ID NO: 1697647 - RNA, 17 nt, Human
aggauguugaaaaaguu

SEQ ID NO: 1697648 - RNA, 21 nt, Human
cuugucucagauuuuauuaug

SEQ ID NO: 1697649 - RNA, 23 nt, Human
cuuggucucagugucaaugcagc

SEQ ID NO: 1697650 - RNA, 13 nt, Human
cuuuugguuaagu

SEQ ID NO: 1697651 - RNA, 20 nt, Human
gaaacuuguguaaauacaau

SEQ ID NO: 1697652 - RNA, 16 nt, Human
gaaacuuguguaaaua

SEQ ID NO: 1697653 - RNA, 14 nt, Human
gaaacuuguguaaa

SEQ ID NO: 1697654 - RNA, 23 nt, Human
gaaacuucagcgguuuauauaag

SEQ ID NO: 1697655 - RNA, 23 nt, Human
gaacaaauuuacagagacagaaa

SEQ ID NO: 1697656 - RNA, 18 nt, Human
gaacaaauuuacagagac

SEQ ID NO: 1697657 - RNA, 17 nt, Human
gaacaaauuuacagaga

SEQ ID NO: 1697658 - RNA, 18 nt, Human
gaaaugaaagcagggacu

SEQ ID NO: 1697659 - RNA, 23 nt, Human
cuggugcccugcuuucagauacu

SEQ ID NO: 1697660 - RNA, 21 nt, Human
cuggugcccugcuuucagaua

SEQ ID NO: 1697661 - RNA, 19 nt, Human
cuggugcccugcuuucaga

SEQ ID NO: 1697662 - RNA, 16 nt, Human
cuggugcccugcuuuc

SEQ ID NO: 1697663 - RNA, 15 nt, Human
cuggugcccugcuuu

SEQ ID NO: 1697664 - RNA, 18 nt, Human
cuggugacugauucuuca

SEQ ID NO: 1697665 - RNA, 12 nt, Human
cuggugccucac

SEQ ID NO: 1697666 - RNA, 17 nt, Human
cuggugacugauucuuc

SEQ ID NO: 1697667 - RNA, 15 nt, Human
cuggugacugauucu

SEQ ID NO: 1697668 - RNA, 14 nt, Human
cuggugacugauuc

SEQ ID NO: 1697669 - RNA, 13 nt, Human
cuggugacugauu

SEQ ID NO: 1697670 - RNA, 20 nt, Human
cuguaagaaaauaucacuug

SEQ ID NO: 1697671 - RNA, 16 nt, Human
cugugagcaucacagu

SEQ ID NO: 1697672 - RNA, 23 nt, Human
cugugagaugcuagaacucccuu

SEQ ID NO: 1697673 - RNA, 17 nt, Human
cugugaacuugaaauuu

SEQ ID NO: 1697674 - RNA, 16 nt, Human
cugugaacuugaaauu

SEQ ID NO: 1697675 - RNA, 15 nt, Human
cugugaacuugaaau

SEQ ID NO: 1697676 - RNA, 22 nt, Human
cuguuauauaaaugguuaaaag

SEQ ID NO: 1697677 - RNA, 15 nt, Human
cuguuauauaaaugg

SEQ ID NO: 1697678 - RNA, 14 nt, Human
cuguuauauaaaug

SEQ ID NO: 1697679 - RNA, 13 nt, Human
cuguuauauaaau

SEQ ID NO: 1697680 - RNA, 19 nt, Human
cugugagcaucacaguuuu

SEQ ID NO: 1697681 - RNA, 20 nt, Human
cuuaaaaaugguuuaaaugg

SEQ ID NO: 1697682 - RNA, 13 nt, Human
cuuaaaaaugguu

SEQ ID NO: 1697683 - RNA, 23 nt, Human
cuggaaaaguauguuagugcaaa

SEQ ID NO: 1697684 - RNA, 20 nt, Human
gauacuggauuguacuuugu

SEQ ID NO: 1697685 - RNA, 16 nt, Human
gauacuggauuguacu

SEQ ID NO: 1697686 - RNA, 12 nt, Human
gaugauuucuau

SEQ ID NO: 1697687 - RNA, 23 nt, Human
gaugauuucuaugcugaguuugu

SEQ ID NO: 1697688 - RNA, 13 nt, Human
gaugauuucuaug

SEQ ID NO: 1697689 - RNA, 15 nt, Human
gaucugccuaaggac

SEQ ID NO: 1697690 - RNA, 12 nt, Human
gaucugccuaag

SEQ ID NO: 1697691 - RNA, 16 nt, Human
gaucugccuaaggacu

SEQ ID NO: 1697692 - RNA, 18 nt, Human
gauccagcagauuauuca

SEQ ID NO: 1697693 - RNA, 19 nt, Human
gauccagcagauuauucac

SEQ ID NO: 1697694 - RNA, 22 nt, Human
gcagaacagugauuaccaggga

SEQ ID NO: 1697695 - RNA, 18 nt, Human
gcagaacagugauuacca

SEQ ID NO: 1697696 - RNA, 13 nt, Human
gcagaacagugau

SEQ ID NO: 1697697 - RNA, 12 nt, Human
gcagaacaguga

SEQ ID NO: 1697698 - RNA, 22 nt, Human
gcaguuguugcccacagcugua

SEQ ID NO: 1697699 - RNA, 20 nt, Human
gcaucuagcaugucgucaaa

SEQ ID NO: 1697700 - RNA, 15 nt, Human
gaggcuccacuuggu

SEQ ID NO: 1697701 - RNA, 18 nt, Human
gaggcuccacuuggucug

SEQ ID NO: 1697702 - RNA, 17 nt, Human
gaggcuccacuuggucu

SEQ ID NO: 1697703 - RNA, 18 nt, Human
gaggcugagaugggagaa

SEQ ID NO: 1697704 - RNA, 14 nt, Human
gaggagaaacugga

SEQ ID NO: 1697705 - RNA, 12 nt, Human
gaggagaaacug

SEQ ID NO: 1697706 - RNA, 21 nt, Human
gaggacgcucucuggccuucg

SEQ ID NO: 1697707 - RNA, 14 nt, Human
gagcagucaggaaa

SEQ ID NO: 1697708 - RNA, 22 nt, Human
gacuuuuuauggcacuaguauu

SEQ ID NO: 1697709 - RNA, 16 nt, Human
gagaugcuagaacucc

SEQ ID NO: 1697710 - RNA, 20 nt, Human
gagaugcuagaacucccuuu

SEQ ID NO: 1697711 - RNA, 21 nt, Human
gagauugugccccugcacucc

SEQ ID NO: 1697712 - RNA, 12 nt, Human
gacagcucugca

SEQ ID NO: 1697713 - RNA, 18 nt, Human
gacagucaccucauggaa

SEQ ID NO: 1697714 - RNA, 14 nt, Human
gacgcucucuggcc

SEQ ID NO: 1697715 - RNA, 14 nt, Human
gaaugaauggcuaa

SEQ ID NO: 1697716 - RNA, 20 nt, Human
gaaugaauggcuaagcaaaa

SEQ ID NO: 1697717 - RNA, 15 nt, Human
gaaugaauggcuaag

SEQ ID NO: 1697718 - RNA, 14 nt, Human
gaaugauuaugaau

SEQ ID NO: 1697719 - RNA, 22 nt, Human
gaaugauuaugaauuacauuug

SEQ ID NO: 1697720 - RNA, 15 nt, Human
gaauuaacacaugau

SEQ ID NO: 1697721 - RNA, 14 nt, Human
gaauuaacacauga

SEQ ID NO: 1697722 - RNA, 20 nt, Human
gaauuacauuuguauaaaau

SEQ ID NO: 1697723 - RNA, 18 nt, Human
gaauuacauuuguauaaa

SEQ ID NO: 1697724 - RNA, 15 nt, Human
gaauuacauuuguau

SEQ ID NO: 1697725 - RNA, 13 nt, Human
gaauuacauuugu

SEQ ID NO: 1697726 - RNA, 16 nt, Human
gcuauuucuauauuuu

SEQ ID NO: 1697727 - RNA, 15 nt, Human
gcuauuucuauauuu

SEQ ID NO: 1697728 - RNA, 13 nt, Human
gcuauuucuauau

SEQ ID NO: 1697729 - RNA, 11 nt, Human
gcuauuucuau

SEQ ID NO: 1697730 - RNA, 20 nt, Human
gcuauuucuauauuuucauu

SEQ ID NO: 1697731 - RNA, 19 nt, Human
gcuauuucuauauuuucau

SEQ ID NO: 1697732 - RNA, 18 nt, Human
gcuauuucuauauuuuca

SEQ ID NO: 1697733 - RNA, 22 nt, Human
gcguucauggaacgcguugaaa

SEQ ID NO: 1697734 - RNA, 23 nt, Human
gcuaaggacuuguuagaucuagu

SEQ ID NO: 1697735 - RNA, 12 nt, Human
gcguugaaauug

SEQ ID NO: 1697736 - RNA, 12 nt, Human
gcuaaggacuug

SEQ ID NO: 1697737 - RNA, 11 nt, Human
gcuaaggacuu

SEQ ID NO: 1697738 - RNA, 22 nt, Human
gccauguuuauuacaguauaau

SEQ ID NO: 1697739 - RNA, 18 nt, Human
gccauguuuauuacagua

SEQ ID NO: 1697740 - RNA, 14 nt, Human
gccauguuuauuac

SEQ ID NO: 1697741 - RNA, 11 nt, Human
gccauguuuau

SEQ ID NO: 1697742 - RNA, 13 nt, Human
gccauguuuauua

SEQ ID NO: 1697743 - RNA, 12 nt, Human
gcauuuagaugu

SEQ ID NO: 1697744 - RNA, 19 nt, Human
gcauuuaggccaugggaca

SEQ ID NO: 1697745 - RNA, 13 nt, Human
gcauuuagaugua

SEQ ID NO: 1697746 - RNA, 11 nt, Human
gccccaaaagg

SEQ ID NO: 1697747 - RNA, 22 nt, Human
gccucauguccacugguucuuc

SEQ ID NO: 1697748 - RNA, 15 nt, Human
gccuccauccugagg

SEQ ID NO: 1697749 - RNA, 14 nt, Human
gccuccauccugag

SEQ ID NO: 1697750 - RNA, 13 nt, Human
gccuccauccuga

SEQ ID NO: 1697751 - RNA, 18 nt, Human
ggaaacuggguuccugca

SEQ ID NO: 1697752 - RNA, 16 nt, Human
ggaaaaaauaacaaug

SEQ ID NO: 1697753 - RNA, 13 nt, Human
ggaaaucuuuaaa

SEQ ID NO: 1697754 - RNA, 19 nt, Human
ggaaaucaggguuaguauu

SEQ ID NO: 1697755 - RNA, 15 nt, Human
ggaagccugauuaaa

SEQ ID NO: 1697756 - RNA, 21 nt, Human
ggacagucaccucauggaauu

SEQ ID NO: 1697757 - RNA, 18 nt, Human
ggacagucaccucaugga

SEQ ID NO: 1697758 - RNA, 17 nt, Human
ggacagucaccucaugg

SEQ ID NO: 1697759 - RNA, 21 nt, Human
gcuguauuuuaaaagaaugau

SEQ ID NO: 1697760 - RNA, 18 nt, Human
gcuguauuuuaaaagaau

SEQ ID NO: 1697761 - RNA, 20 nt, Human
gcuguauuuuaaaagaauga

SEQ ID NO: 1697762 - RNA, 18 nt, Human
aaaauauuuuaugaucca

SEQ ID NO: 1697763 - RNA, 17 nt, Human
aaaaucucaauauuuca

SEQ ID NO: 1697764 - RNA, 15 nt, Human
aaaauauuuuaugau

SEQ ID NO: 1697765 - RNA, 20 nt, Human
aaaauaauuuuuauauuuga

SEQ ID NO: 1697766 - RNA, 17 nt, Human
aaaauaauuuuuauauu

SEQ ID NO: 1697767 - RNA, 16 nt, Human
aaaauaauuuuuauau

SEQ ID NO: 1697768 - RNA, 11 nt, Human
aaaauaauuuu

SEQ ID NO: 1697769 - RNA, 15 nt, Human
gggcgugguggugag

SEQ ID NO: 1697770 - RNA, 18 nt, Human
aaaaugguuuaaaugguc

SEQ ID NO: 1697771 - RNA, 16 nt, Human
aaaaugguuuaaaugg

SEQ ID NO: 1697772 - RNA, 14 nt, Human
ggucagugcaaaua

SEQ ID NO: 1697773 - RNA, 21 nt, Human
guacaaaguauuaagcauaua

SEQ ID NO: 1697774 - RNA, 20 nt, Human
guacaaaguauuaagcauau

SEQ ID NO: 1697775 - RNA, 18 nt, Human
aaauauaugcuaagucuu

SEQ ID NO: 1697776 - RNA, 22 nt, Human
aaauaucacuugucaauaaaau

SEQ ID NO: 1697777 - RNA, 20 nt, Human
gguguuguacucaauuuuaa

SEQ ID NO: 1697778 - RNA, 19 nt, Human
gguguuguacucaauuuua

SEQ ID NO: 1697779 - RNA, 17 nt, Human
aaaguauguuagugcaa

SEQ ID NO: 1697780 - RNA, 19 nt, Human
aaacuuuaugcuaagugaa

SEQ ID NO: 1697781 - RNA, 12 nt, Human
aaacuuuaugcu

SEQ ID NO: 1697782 - RNA, 16 nt, Human
aaagcagaacagugau

SEQ ID NO: 1697783 - RNA, 22 nt, Human
aaagggcuguuauaaucuuuca

SEQ ID NO: 1697784 - RNA, 20 nt, Human
aaagggcuguuauaaucuuu

SEQ ID NO: 1697785 - RNA, 13 nt, Human
aaaaauacaaaaa

SEQ ID NO: 1697786 - RNA, 16 nt, Human
ggccuucggccuccau

SEQ ID NO: 1697787 - RNA, 22 nt, Human
ggccuucggccuccauccugag

SEQ ID NO: 1697788 - RNA, 18 nt, Human
ggccuucggccuccaucc

SEQ ID NO: 1697789 - RNA, 20 nt, Human
ggcuaagcuucacuguaaaa

SEQ ID NO: 1697790 - RNA, 23 nt, Human
auuuauaaucacuuuuuuccaca

SEQ ID NO: 1697791 - RNA, 16 nt, Human
auuucagcagcugcag

SEQ ID NO: 1697792 - RNA, 20 nt, Human
auuucuaugaaauauuaugu

SEQ ID NO: 1697793 - RNA, 18 nt, Human
auuucuaugaaauauuau

SEQ ID NO: 1697794 - RNA, 15 nt, Human
auuucuaugaaauau

SEQ ID NO: 1697795 - RNA, 20 nt, Human
auuguacaaaguauuaagca

SEQ ID NO: 1697796 - RNA, 22 nt, Human
auuguacaaaguauuaagcaua

SEQ ID NO: 1697797 - RNA, 23 nt, Human
auuguacaaaguauuaagcauau

SEQ ID NO: 1697798 - RNA, 23 nt, Human
auuguaauaggcguaacuaauuu

SEQ ID NO: 1697799 - RNA, 13 nt, Human
auuguaaaauggu

SEQ ID NO: 1697800 - RNA, 18 nt, Human
auucacaagacccaaaag

SEQ ID NO: 1697801 - RNA, 17 nt, Human
auucuugccaaauauaa

SEQ ID NO: 1697802 - RNA, 23 nt, Human
auuuuauaaaucgcuuuugauaa

SEQ ID NO: 1697803 - RNA, 21 nt, Human
auuuuauaaaucgcuuuugau

SEQ ID NO: 1697804 - RNA, 20 nt, Human
auuuuauaaaucgcuuuuga

SEQ ID NO: 1697805 - RNA, 17 nt, Human
auuuuauaaaucgcuuu

SEQ ID NO: 1697806 - RNA, 16 nt, Human
auuuuauaaaucgcuu

SEQ ID NO: 1697807 - RNA, 15 nt, Human
auuuuauaaaucgcu

SEQ ID NO: 1697808 - RNA, 16 nt, Human
caaccaccuuucagau

SEQ ID NO: 1697809 - RNA, 19 nt, Human
caacccaaauguucaucaa

SEQ ID NO: 1697810 - RNA, 21 nt, Human
caacuaucucauuuccaagca

SEQ ID NO: 1697811 - RNA, 15 nt, Human
caaaguauuaagcau

SEQ ID NO: 1697812 - RNA, 14 nt, Human
caaaguauuaagca

SEQ ID NO: 1697813 - RNA, 21 nt, Human
caaaguauuaagcauauauuu

SEQ ID NO: 1697814 - RNA, 19 nt, Human
caaaguauuaagcauauau

SEQ ID NO: 1697815 - RNA, 17 nt, Human
caaaguauuaagcauau

SEQ ID NO: 1697816 - RNA, 16 nt, Human
caaaguauuaagcaua

SEQ ID NO: 1697817 - RNA, 17 nt, Human
caauaaaaaauuaugac

SEQ ID NO: 1697818 - RNA, 16 nt, Human
caauaaaaaauuauga

SEQ ID NO: 1697819 - RNA, 13 nt, Human
caauaaaaaauua

SEQ ID NO: 1697820 - RNA, 20 nt, Human
caaguauuagaauaccacag

SEQ ID NO: 1697821 - RNA, 14 nt, Human
caaguauuagaaua

SEQ ID NO: 1697822 - RNA, 23 nt, Human
caaugcuguauuuuaaaagaaug

SEQ ID NO: 1697823 - RNA, 14 nt, Human
caaugcuguauuuu

SEQ ID NO: 1697824 - RNA, 21 nt, Human
caauauuucagauaaucacaa

SEQ ID NO: 1697825 - RNA, 20 nt, Human
caauauuucagauaaucaca

SEQ ID NO: 1697826 - RNA, 12 nt, Human
caauauuucaga

SEQ ID NO: 1697827 - RNA, 12 nt, Human
caauuuaaaaaa

SEQ ID NO: 1697828 - RNA, 16 nt, Human
cacaagacugcacauc

SEQ ID NO: 1697829 - RNA, 20 nt, Human
cacuuggucugugagaugcu

SEQ ID NO: 1697830 - RNA, 17 nt, Human
cacuuggucugugagau

SEQ ID NO: 1697831 - RNA, 21 nt, Human
caccuacaugagguacugaga

SEQ ID NO: 1697832 - RNA, 11 nt, Human
cacugaagaag

SEQ ID NO: 1697833 - RNA, 18 nt, Human
cauguauuuguuugcaua

SEQ ID NO: 1697834 - RNA, 14 nt, Human
caugauguuuagaa

SEQ ID NO: 1697835 - RNA, 23 nt, Human
ccaccuuucagauaacuguuauu

SEQ ID NO: 1697836 - RNA, 17 nt, Human
ccaaauguucaucaaug

SEQ ID NO: 1697837 - RNA, 18 nt, Human
ccaaauguucaucaauga

SEQ ID NO: 1697838 - RNA, 20 nt, Human
cauuuguauaaaauaauuuu

SEQ ID NO: 1697839 - RNA, 19 nt, Human
cauuuguauaaaauaauuu

SEQ ID NO: 1697840 - RNA, 20 nt, Human
cagucugacuguuuccauca

SEQ ID NO: 1697841 - RNA, 19 nt, Human
cagucaccucauggaauug

SEQ ID NO: 1697842 - RNA, 15 nt, Human
cagucacauuccaag

SEQ ID NO: 1697843 - RNA, 16 nt, Human
cagucaccucauggaa

SEQ ID NO: 1697844 - RNA, 17 nt, Human
cagagguugcagugagc

SEQ ID NO: 1697845 - RNA, 12 nt, Human
cagauccuggaa

SEQ ID NO: 1697846 - RNA, 13 nt, Human
cagauccuggaaa

SEQ ID NO: 1697847 - RNA, 19 nt, Human
ccaguuuuguuuggaccaa

SEQ ID NO: 1697848 - RNA, 16 nt, Human
ccaguuuuguuuggac

SEQ ID NO: 1697849 - RNA, 14 nt, Human
ccauacauuugugu

SEQ ID NO: 1697850 - RNA, 13 nt, Human
ccauacauuugug

SEQ ID NO: 1697851 - RNA, 22 nt, Human
ccaguauuguacaaaguauuaa

SEQ ID NO: 1697852 - RNA, 20 nt, Human
ccaguauuguacaaaguauu

SEQ ID NO: 1697853 - RNA, 16 nt, Human
ccagcagauuauucac

SEQ ID NO: 1697854 - RNA, 15 nt, Human
ccagcagauuauuca

SEQ ID NO: 1697855 - RNA, 22 nt, Human
cccaggaauggagccugcacgg

SEQ ID NO: 1697856 - RNA, 20 nt, Human
cccaggaauggagccugcac

SEQ ID NO: 1697857 - RNA, 19 nt, Human
cccaggaauggagccugca

SEQ ID NO: 1697858 - RNA, 18 nt, Human
cccaggaauggagccugc

SEQ ID NO: 1697859 - RNA, 18 nt, Human
ccccugcacuccagccug

SEQ ID NO: 1697860 - RNA, 20 nt, Human
ccuauuuuuuuucuguuaua

SEQ ID NO: 1697861 - RNA, 23 nt, Human
ccucauggaauuggagcucgugg

SEQ ID NO: 1697862 - RNA, 17 nt, Human
ccugucuugccuuuuuc

SEQ ID NO: 1697863 - RNA, 20 nt, Human
ccugucuugccuuuuucauu

SEQ ID NO: 1697864 - RNA, 19 nt, Human
ccugucuugccuuuuucau

SEQ ID NO: 1697865 - RNA, 15 nt, Human
ccuguaaucacagcu

SEQ ID NO: 1697866 - RNA, 12 nt, Human
ccuuucauauuu

SEQ ID NO: 1697867 - RNA, 16 nt, Human
ccuuuuuuaaauaaau

SEQ ID NO: 1697868 - RNA, 20 nt, Human
cuauuuuuuuucuguuauau

SEQ ID NO: 1697869 - RNA, 21 nt, Human
cuauuuuuuuucuguuauaua

SEQ ID NO: 1697870 - RNA, 20 nt, Human
cuacaugagguacugagagu

SEQ ID NO: 1697871 - RNA, 13 nt, Human
cuagaacucccuu

SEQ ID NO: 1697872 - RNA, 12 nt, Human
cuagaacucccu

SEQ ID NO: 1697873 - RNA, 23 nt, Human
cuccacuuggucugugagaugcu

SEQ ID NO: 1697874 - RNA, 22 nt, Human
cuccacuuggucugugagaugc

SEQ ID NO: 1697875 - RNA, 21 nt, Human
cuccacuuggucugugagaug

SEQ ID NO: 1697876 - RNA, 17 nt, Human
cuccacuuggucuguga

SEQ ID NO: 1697877 - RNA, 16 nt, Human
cuccacuuggucugug

SEQ ID NO: 1697878 - RNA, 15 nt, Human
cuccacuuggucugu

SEQ ID NO: 1697879 - RNA, 13 nt, Human
cuccacuuggucu

SEQ ID NO: 1697880 - RNA, 14 nt, Human
cucguuaauuugua

SEQ ID NO: 1697881 - RNA, 22 nt, Human
cucuuagaugcaguucugaaga

SEQ ID NO: 1697882 - RNA, 22 nt, Human
guguaaauacaauuuuguuucu

SEQ ID NO: 1697883 - RNA, 21 nt, Human
guguaaauacaauuuuguuuc

SEQ ID NO: 1697884 - RNA, 18 nt, Human
guguaaauacaauuuugu

SEQ ID NO: 1697885 - RNA, 17 nt, Human
aagcaacccaaauguuc

SEQ ID NO: 1697886 - RNA, 13 nt, Human
aagcaaaauguga

SEQ ID NO: 1697887 - RNA, 15 nt, Human
aagcauuuuauaaau

SEQ ID NO: 1697888 - RNA, 14 nt, Human
aagcauuuuauaaa

SEQ ID NO: 1697889 - RNA, 12 nt, Human
aagcauuuuaua

SEQ ID NO: 1697890 - RNA, 19 nt, Human
aagcauuuuauaaaucgcu

SEQ ID NO: 1697891 - RNA, 17 nt, Human
aagcauuuuauaaaucg

SEQ ID NO: 1697892 - RNA, 21 nt, Human
aagcauuuuauaaaucgcuuu

SEQ ID NO: 1697893 - RNA, 17 nt, Human
aagccauguuuauuaca

SEQ ID NO: 1697894 - RNA, 16 nt, Human
aagccauguuuauuac

SEQ ID NO: 1697895 - RNA, 15 nt, Human
aagccauguuuauua

SEQ ID NO: 1697896 - RNA, 23 nt, Human
aagcauauauuuuuauauuuacu

SEQ ID NO: 1697897 - RNA, 16 nt, Human
aagcacuaaacaaaga

SEQ ID NO: 1697898 - RNA, 18 nt, Human
guuagagauuuuuuuguu

SEQ ID NO: 1697899 - RNA, 19 nt, Human
guuauuauauuuacaaaug

SEQ ID NO: 1697900 - RNA, 20 nt, Human
guuauuauauuuacaaaugg

SEQ ID NO: 1697901 - RNA, 23 nt, Human
aagccauguuuauuacaguauaa

SEQ ID NO: 1697902 - RNA, 22 nt, Human
aagccauguuuauuacaguaua

SEQ ID NO: 1697903 - RNA, 21 nt, Human
aagccauguuuauuacaguau

SEQ ID NO: 1697904 - RNA, 20 nt, Human
aagccauguuuauuacagua

SEQ ID NO: 1697905 - RNA, 21 nt, Human
aagccuuggggcugaugcagu

SEQ ID NO: 1697906 - RNA, 18 nt, Human
guucccuugaugaagaag

SEQ ID NO: 1697907 - RNA, 23 nt, Human
aagcuuguauuccuuuuucucuc

SEQ ID NO: 1697908 - RNA, 22 nt, Human
aagucagaucugccuaaggacu

SEQ ID NO: 1697909 - RNA, 21 nt, Human
aagucagaucugccuaaggac

SEQ ID NO: 1697910 - RNA, 18 nt, Human
aagucagaucugccuaag

SEQ ID NO: 1697911 - RNA, 19 nt, Human
aaguauguuagugcaaauu

SEQ ID NO: 1697912 - RNA, 18 nt, Human
aaguauguuagugcaaau

SEQ ID NO: 1697913 - RNA, 18 nt, Human
guuuuaugacuucauuaa

SEQ ID NO: 1697914 - RNA, 13 nt, Human
guuuuaugacuuc

SEQ ID NO: 1697915 - RNA, 18 nt, Human
guuuggaccaaaaaccag

SEQ ID NO: 1697916 - RNA, 14 nt, Human
guuuaugauuccac

SEQ ID NO: 1697917 - RNA, 18 nt, Human
guuuaauauuaaagccau

SEQ ID NO: 1697918 - RNA, 15 nt, Human
guuuaauauuaaagc

SEQ ID NO: 1697919 - RNA, 14 nt, Human
guuuaauauuaaag

SEQ ID NO: 1697920 - RNA, 13 nt, Human
guuuaauauuaaa

SEQ ID NO: 1697921 - RNA, 17 nt, Human
guuuauuacaguauaau

SEQ ID NO: 1697922 - RNA, 13 nt, Human
guuuauuacagua

SEQ ID NO: 1697923 - RNA, 20 nt, Human
aaggaaacuggguuccugca

SEQ ID NO: 1697924 - RNA, 12 nt, Human
aaggaaaaguuu

SEQ ID NO: 1697925 - RNA, 12 nt, Human
guuguuuguuua

SEQ ID NO: 1697926 - RNA, 17 nt, Human
aaggggaauugaggaca

SEQ ID NO: 1697927 - RNA, 17 nt, Human
aagggcuguuauaaucu

SEQ ID NO: 1697928 - RNA, 15 nt, Human
aagggcuguuauaau

SEQ ID NO: 1697929 - RNA, 18 nt, Human
uaaaaaaaaaauugggga

SEQ ID NO: 1697930 - RNA, 14 nt, Human
uaaaaaaaaaauug

SEQ ID NO: 1697931 - RNA, 21 nt, Human
uaaaaaaaaaccugagcccca

SEQ ID NO: 1697932 - RNA, 23 nt, Human
aagucagaucugccuaaggacuu

SEQ ID NO: 1697933 - RNA, 22 nt, Human
uaaaauaauuuuuauauuugaa

SEQ ID NO: 1697934 - RNA, 9 nt, Human
uaaaauggu

SEQ ID NO: 1697935 - RNA, 23 nt, Human
guauuguacaaaguauuaagcau

SEQ ID NO: 1697936 - RNA, 22 nt, Human
guauuguacaaaguauuaagca

SEQ ID NO: 1697937 - RNA, 21 nt, Human
guauuguacaaaguauuaagc

SEQ ID NO: 1697938 - RNA, 22 nt, Human
guauugaagcauuuuauaaauc

SEQ ID NO: 1697939 - RNA, 18 nt, Human
guauugaagcauuuuaua

SEQ ID NO: 1697940 - RNA, 17 nt, Human
guauugaagcauuuuau

SEQ ID NO: 1697941 - RNA, 13 nt, Human
guauugaagcauu

SEQ ID NO: 1697942 - RNA, 10 nt, Human
guauugaagc

SEQ ID NO: 1697943 - RNA, 19 nt, Human
guauuguacaaaguauuaa

SEQ ID NO: 1697944 - RNA, 17 nt, Human
aaauuccaagugauuga

SEQ ID NO: 1697945 - RNA, 17 nt, Human
aaauuguauuacaaauc

SEQ ID NO: 1697946 - RNA, 13 nt, Human
gucaggaaagaga

SEQ ID NO: 1697947 - RNA, 14 nt, Human
gucaggaaagagaa

SEQ ID NO: 1697948 - RNA, 15 nt, Human
gucacaggaaguaga

SEQ ID NO: 1697949 - RNA, 13 nt, Human
gucacaggaagua

SEQ ID NO: 1697950 - RNA, 21 nt, Human
gucaauuuuguuauguauauu

SEQ ID NO: 1697951 - RNA, 20 nt, Human
gucacaggaaguagaggagg

SEQ ID NO: 1697952 - RNA, 12 nt, Human
aaauuugaauuu

SEQ ID NO: 1697953 - RNA, 22 nt, Human
aaauuugaauuuuguguuagag

SEQ ID NO: 1697954 - RNA, 15 nt, Human
aaauuugaauuuugu

SEQ ID NO: 1697955 - RNA, 23 nt, Human
guccaugaagauguagaggagaa

SEQ ID NO: 1697956 - RNA, 22 nt, Human
guccaugaagauguagaggaga

SEQ ID NO: 1697957 - RNA, 15 nt, Human
guccgugcuaaggac

SEQ ID NO: 1697958 - RNA, 17 nt, Human
guccgugcuaaggacuu

SEQ ID NO: 1697959 - RNA, 16 nt, Human
guccgugcuaaggacu

SEQ ID NO: 1697960 - RNA, 12 nt, Human
aacauauauaac

SEQ ID NO: 1697961 - RNA, 23 nt, Human
aacauugguucuuguauuaagaa

SEQ ID NO: 1697962 - RNA, 22 nt, Human
aacauugguucuuguauuaaga

SEQ ID NO: 1697963 - RNA, 19 nt, Human
aacauugguucuuguauua

SEQ ID NO: 1697964 - RNA, 18 nt, Human
aacauugguucuuguauu

SEQ ID NO: 1697965 - RNA, 16 nt, Human
aacauugguucuugua

SEQ ID NO: 1697966 - RNA, 15 nt, Human
aacauguuaaaccau

SEQ ID NO: 1697967 - RNA, 14 nt, Human
aacauguuaaacca

SEQ ID NO: 1697968 - RNA, 16 nt, Human
aacauguuaaaccaug

SEQ ID NO: 1697969 - RNA, 23 nt, Human
gucuugucucagauuuuauuaug

SEQ ID NO: 1697970 - RNA, 15 nt, Human
gugacuuuggauaau

SEQ ID NO: 1697971 - RNA, 12 nt, Human
gugacuuuggau

SEQ ID NO: 1697972 - RNA, 12 nt, Human
aacuugaaauuu

SEQ ID NO: 1697973 - RNA, 19 nt, Human
aacuugaaauuugaauuuu

SEQ ID NO: 1697974 - RNA, 18 nt, Human
aacuugaaauuugaauuu

SEQ ID NO: 1697975 - RNA, 13 nt, Human
aacuugaaauuug

SEQ ID NO: 1697976 - RNA, 21 nt, Human
aacuucagcgguuuauauaag

SEQ ID NO: 1697977 - RNA, 13 nt, Human
aacuucagacaua

SEQ ID NO: 1697978 - RNA, 18 nt, Human
aacuucagcgguuuauau

SEQ ID NO: 1697979 - RNA, 14 nt, Human
gugaucucauuuaa

SEQ ID NO: 1697980 - RNA, 17 nt, Human
gugauuaccagggacug

SEQ ID NO: 1697981 - RNA, 16 nt, Human
gugauuaccagggacu

SEQ ID NO: 1697982 - RNA, 11 nt, Human
gugauuaccag

SEQ ID NO: 1697983 - RNA, 11 nt, Human
aagaaacauuu

SEQ ID NO: 1697984 - RNA, 16 nt, Human
aagaaagaaaaucagg

SEQ ID NO: 1697985 - RNA, 14 nt, Human
aagaaagaaaauca

SEQ ID NO: 1697986 - RNA, 23 nt, Human
uagagauuuuuuuguuguuuguu

SEQ ID NO: 1697987 - RNA, 22 nt, Human
uagaggagaaacuggaacucuc

SEQ ID NO: 1697988 - RNA, 18 nt, Human
acaaaaggauaaugaaua

SEQ ID NO: 1697989 - RNA, 15 nt, Human
uagaugcaguucuga

SEQ ID NO: 1697990 - RNA, 18 nt, Human
uagcaugucgucaaagcu

SEQ ID NO: 1697991 - RNA, 20 nt, Human
acaagacccaaaaggcagaa

SEQ ID NO: 1697992 - RNA, 18 nt, Human
acaaauuuacagagacag

SEQ ID NO: 1697993 - RNA, 19 nt, Human
acaaauuuacagagacaga

SEQ ID NO: 1697994 - RNA, 22 nt, Human
uagcuagacuggugacugauuc

SEQ ID NO: 1697995 - RNA, 21 nt, Human
uagcuagacuggugacugauu

SEQ ID NO: 1697996 - RNA, 23 nt, Human
acaauacaucccuuaccugggaa

SEQ ID NO: 1697997 - RNA, 14 nt, Human
acaagacugcacau

SEQ ID NO: 1697998 - RNA, 13 nt, Human
acaagacugcaca

SEQ ID NO: 1697999 - RNA, 18 nt, Human
uaggaaauauuuauuuua

SEQ ID NO: 1698000 - RNA, 19 nt, Human
uaggaaauauuuauuuuaa

SEQ ID NO: 1698001 - RNA, 21 nt, Human
acaccauuaugugcgcugaua

SEQ ID NO: 1698002 - RNA, 17 nt, Human
acaccauuaugugcgcu

SEQ ID NO: 1698003 - RNA, 18 nt, Human
acacaugauccugcaauu

SEQ ID NO: 1698004 - RNA, 15 nt, Human
acacaugaaguccaa

SEQ ID NO: 1698005 - RNA, 14 nt, Human
acacuaagagagaa

SEQ ID NO: 1698006 - RNA, 13 nt, Human
acacuaagagaga

SEQ ID NO: 1698007 - RNA, 23 nt, Human
acacacuuuugguuaagucuguu

SEQ ID NO: 1698008 - RNA, 23 nt, Human
uaguguuggagaagaacugaaau

SEQ ID NO: 1698009 - RNA, 22 nt, Human
uagugaaacucguuaauuugua

SEQ ID NO: 1698010 - RNA, 22 nt, Human
acaaugcuguauuuuaaaagaa

SEQ ID NO: 1698011 - RNA, 19 nt, Human
uauauuuacuaaaauggac

SEQ ID NO: 1698012 - RNA, 15 nt, Human
uauauuguuugcuaa

SEQ ID NO: 1698013 - RNA, 21 nt, Human
uauauuuacuaaaauggacug

SEQ ID NO: 1698014 - RNA, 20 nt, Human
uauauuuacuaaaauggacu

SEQ ID NO: 1698015 - RNA, 21 nt, Human
uaugauuaaguaaugauaacu

SEQ ID NO: 1698016 - RNA, 20 nt, Human
uaugauuaaguaaugauaac

SEQ ID NO: 1698017 - RNA, 16 nt, Human
uaugauuaaguaauga

SEQ ID NO: 1698018 - RNA, 19 nt, Human
uaugccccauucaacaucu

SEQ ID NO: 1698019 - RNA, 16 nt, Human
acagccucuuagaugc

SEQ ID NO: 1698020 - RNA, 12 nt, Human
uaugugugaagu

SEQ ID NO: 1698021 - RNA, 14 nt, Human
uaugugugaaguga

SEQ ID NO: 1698022 - RNA, 21 nt, Human
uauguuuucaggcuagaugua

SEQ ID NO: 1698023 - RNA, 17 nt, Human
acaggaaguagaggagg

SEQ ID NO: 1698024 - RNA, 20 nt, Human
acaguauaauuaacauguua

SEQ ID NO: 1698025 - RNA, 15 nt, Human
acaguauaauuaaca

SEQ ID NO: 1698026 - RNA, 16 nt, Human
acagucaccucaugga

SEQ ID NO: 1698027 - RNA, 13 nt, Human
acaguauaauuaa

SEQ ID NO: 1698028 - RNA, 18 nt, Human
acagucaccucauggaau

SEQ ID NO: 1698029 - RNA, 17 nt, Human
acagucaccucauggaa

SEQ ID NO: 1698030 - RNA, 21 nt, Human
acagggaggacgcucucuggc

SEQ ID NO: 1698031 - RNA, 20 nt, Human
acagggaggacgcucucugg

SEQ ID NO: 1698032 - RNA, 16 nt, Human
uauucaaaguugccua

SEQ ID NO: 1698033 - RNA, 13 nt, Human
uauucaaaguugc

SEQ ID NO: 1698034 - RNA, 12 nt, Human
uauucaaaguug

SEQ ID NO: 1698035 - RNA, 14 nt, Human
uauuacuguaagaa

SEQ ID NO: 1698036 - RNA, 13 nt, Human
uacauguauuugu

SEQ ID NO: 1698037 - RNA, 18 nt, Human
uaccaccagucugacugu

SEQ ID NO: 1698038 - RNA, 19 nt, Human
aauuaacauguuaaaccau

SEQ ID NO: 1698039 - RNA, 20 nt, Human
aauuaacauguuaaaccaug

SEQ ID NO: 1698040 - RNA, 20 nt, Human
uacaucccuuaccugggaaa

SEQ ID NO: 1698041 - RNA, 23 nt, Human
aaugccaucaauaaaaaauuaug

SEQ ID NO: 1698042 - RNA, 21 nt, Human
aaugccaucaauaaaaaauua

SEQ ID NO: 1698043 - RNA, 16 nt, Human
aaugccaucaauaaaa

SEQ ID NO: 1698044 - RNA, 16 nt, Human
aaugcuguauuuuaaa

SEQ ID NO: 1698045 - RNA, 16 nt, Human
aauggacuguggugac

SEQ ID NO: 1698046 - RNA, 18 nt, Human
uacacuaagagagaauga

SEQ ID NO: 1698047 - RNA, 14 nt, Human
uacacuaagagaga

SEQ ID NO: 1698048 - RNA, 14 nt, Human
uacuggauuguacu

SEQ ID NO: 1698049 - RNA, 14 nt, Human
uacuguaagaaaau

SEQ ID NO: 1698050 - RNA, 21 nt, Human
aauugacccacaagaaaugaa

SEQ ID NO: 1698051 - RNA, 22 nt, Human
aauugacccacaagaaaugaaa

SEQ ID NO: 1698052 - RNA, 20 nt, Human
aauucccuggccuuucauau

SEQ ID NO: 1698053 - RNA, 19 nt, Human
aauucccuggccuuucaua

SEQ ID NO: 1698054 - RNA, 19 nt, Human
uacuauauaugugaugauc

SEQ ID NO: 1698055 - RNA, 18 nt, Human
aauuccaagugauugaaa

SEQ ID NO: 1698056 - RNA, 22 nt, Human
aauuccacuuauaggaauugac

SEQ ID NO: 1698057 - RNA, 18 nt, Human
uaaucacuuuuuuccaca

SEQ ID NO: 1698058 - RNA, 19 nt, Human
uaaucacuuuuuuccacau

SEQ ID NO: 1698059 - RNA, 17 nt, Human
uaaucacuuuuuuccac

SEQ ID NO: 1698060 - RNA, 16 nt, Human
uaaucacuuuuuucca

SEQ ID NO: 1698061 - RNA, 22 nt, Human
aaugaauggcuaagcaaaaugu

SEQ ID NO: 1698062 - RNA, 16 nt, Human
uaaggaaaaguuuaau

SEQ ID NO: 1698063 - RNA, 19 nt, Human
uaaguaaugauaacuggaa

SEQ ID NO: 1698064 - RNA, 16 nt, Human
uaagcuuguauuccuu

SEQ ID NO: 1698065 - RNA, 15 nt, Human
aaucaugaauuaguu

SEQ ID NO: 1698066 - RNA, 12 nt, Human
aaucaugaauua

SEQ ID NO: 1698067 - RNA, 22 nt, Human
aaucugugaacuugaaauuuga

SEQ ID NO: 1698068 - RNA, 21 nt, Human
aaucugugaacuugaaauuug

SEQ ID NO: 1698069 - RNA, 20 nt, Human
aaucugugaacuugaaauuu

SEQ ID NO: 1698070 - RNA, 19 nt, Human
aaucuacacuccagugaga

SEQ ID NO: 1698071 - RNA, 19 nt, Human
aaucuuauaauuuaaaaua

SEQ ID NO: 1698072 - RNA, 16 nt, Human
aauaucaucaguauug

SEQ ID NO: 1698073 - RNA, 20 nt, Human
aauaucacuugucaauaaaa

SEQ ID NO: 1698074 - RNA, 22 nt, Human
aauaucacuugucaauaaaauc

SEQ ID NO: 1698075 - RNA, 14 nt, Human
uaacauaaaucugu

SEQ ID NO: 1698076 - RNA, 12 nt, Human
uaacauaaaucu

SEQ ID NO: 1698077 - RNA, 16 nt, Human
aauagucaaauugugu

SEQ ID NO: 1698078 - RNA, 21 nt, Human
uaacuguuauuuauaaucacu

SEQ ID NO: 1698079 - RNA, 20 nt, Human
uaacgauaaaagacagugaa

SEQ ID NO: 1698080 - RNA, 18 nt, Human
uaagaagugaaaaucuac

SEQ ID NO: 1698081 - RNA, 14 nt, Human
aauauuucagauaa

SEQ ID NO: 1698082 - RNA, 19 nt, Human
aauauuuauuuuaauaaug

SEQ ID NO: 1698083 - RNA, 18 nt, Human
aauauuuauuuuaauaau

SEQ ID NO: 1698084 - RNA, 24 nt, Human
aauaugccccauucaacaucuagu

SEQ ID NO: 1698085 - RNA, 21 nt, Human
aauaugccccauucaacaucu

SEQ ID NO: 1698086 - RNA, 21 nt, Human
aaucaggguuaguauugucca

SEQ ID NO: 1698087 - RNA, 16 nt, Human
aaucaggguuaguauu

SEQ ID NO: 1698088 - RNA, 22 nt, Human
aaucaggguuaguauuguccag

SEQ ID NO: 1698089 - RNA, 23 nt, Human
ucacaguuuugguugcuuuaaua

SEQ ID NO: 1698090 - RNA, 21 nt, Human
ucacaguuuugguugcuuuaa

SEQ ID NO: 1698091 - RNA, 20 nt, Human
ucacaguuuugguugcuuua

SEQ ID NO: 1698092 - RNA, 16 nt, Human
ucaauucuugccaaau

SEQ ID NO: 1698093 - RNA, 22 nt, Human
accaguauuguacaaaguauua

SEQ ID NO: 1698094 - RNA, 20 nt, Human
accaguauuguacaaaguau

SEQ ID NO: 1698095 - RNA, 15 nt, Human
accaguauuguacaa

SEQ ID NO: 1698096 - RNA, 14 nt, Human
accaguauuguaca

SEQ ID NO: 1698097 - RNA, 23 nt, Human
ucacuugaacccgggaggcagag

SEQ ID NO: 1698098 - RNA, 23 nt, Human
accaguauuguacaaaguauuaa

SEQ ID NO: 1698099 - RNA, 14 nt, Human
accagucugacugu

SEQ ID NO: 1698100 - RNA, 20 nt, Human
ucaccugucuugccuuuuuc

SEQ ID NO: 1698101 - RNA, 19 nt, Human
ucaccugucuugccuuuuu

SEQ ID NO: 1698102 - RNA, 14 nt, Human
ucaccucauggaau

SEQ ID NO: 1698103 - RNA, 13 nt, Human
ucaccucauggaa

SEQ ID NO: 1698104 - RNA, 12 nt, Human
ucaccucaugga

SEQ ID NO: 1698105 - RNA, 12 nt, Human
ucaacugggcug

SEQ ID NO: 1698106 - RNA, 22 nt, Human
ucaauaucuuuuuuuuaauaaa

SEQ ID NO: 1698107 - RNA, 23 nt, Human
ucaaugaaugaaugaauggcuaa

SEQ ID NO: 1698108 - RNA, 19 nt, Human
ucaauauuucagauaauca

SEQ ID NO: 1698109 - RNA, 15 nt, Human
ucaauauuucagaua

SEQ ID NO: 1698110 - RNA, 16 nt, Human
acauguauuuguuugc

SEQ ID NO: 1698111 - RNA, 18 nt, Human
acauguauuuguuugcau

SEQ ID NO: 1698112 - RNA, 17 nt, Human
acauguauuuguuugca

SEQ ID NO: 1698113 - RNA, 19 nt, Human
acauguauuuguuugcaua

SEQ ID NO: 1698114 - RNA, 18 nt, Human
ucaaauugugugaaaggu

SEQ ID NO: 1698115 - RNA, 15 nt, Human
ucaaauugugugaaa

SEQ ID NO: 1698116 - RNA, 17 nt, Human
ucaaccaccuuucagau

SEQ ID NO: 1698117 - RNA, 18 nt, Human
ucaacugggcugaacacu

SEQ ID NO: 1698118 - RNA, 20 nt, Human
acaugagguacugagaguga

SEQ ID NO: 1698119 - RNA, 23 nt, Human
acaugagguacugagagugaaca

SEQ ID NO: 1698120 - RNA, 14 nt, Human
acaugggacauuug

SEQ ID NO: 1698121 - RNA, 11 nt, Human
acaugggacau

SEQ ID NO: 1698122 - RNA, 21 nt, Human
acaugggacauuugcucaugg

SEQ ID NO: 1698123 - RNA, 20 nt, Human
acaugggacauuugcucaug

SEQ ID NO: 1698124 - RNA, 15 nt, Human
acaugggacauuugc

SEQ ID NO: 1698125 - RNA, 20 nt, Human
ucagcaaaaauauuuuauga

SEQ ID NO: 1698126 - RNA, 19 nt, Human
ucagcaaaaauauuuuaug

SEQ ID NO: 1698127 - RNA, 23 nt, Human
ucagauuuuauuauguaaauccc

SEQ ID NO: 1698128 - RNA, 22 nt, Human
ucagauuuuauuauguaaaucc

SEQ ID NO: 1698129 - RNA, 19 nt, Human
accauaaccccggaagcca

SEQ ID NO: 1698130 - RNA, 17 nt, Human
acccgggaggcagaggu

SEQ ID NO: 1698131 - RNA, 16 nt, Human
accuagggugauauua

SEQ ID NO: 1698132 - RNA, 17 nt, Human
ucaguuuuugugaaaag

SEQ ID NO: 1698133 - RNA, 15 nt, Human
ucaguuuuugugaaa

SEQ ID NO: 1698134 - RNA, 13 nt, Human
acggaugauuucu

SEQ ID NO: 1698135 - RNA, 18 nt, Human
uccagugagacagcucug

SEQ ID NO: 1698136 - RNA, 14 nt, Human
acgcucucuggccu

SEQ ID NO: 1698137 - RNA, 11 nt, Human
acgcucucugg

SEQ ID NO: 1698138 - RNA, 19 nt, Human
accuugaaaacuuuaugcu

SEQ ID NO: 1698139 - RNA, 22 nt, Human
uccacugguucuucuuggucuc

SEQ ID NO: 1698140 - RNA, 20 nt, Human
accuuuuggucuggagggaa

SEQ ID NO: 1698141 - RNA, 16 nt, Human
acuaaacuuucacacc

SEQ ID NO: 1698142 - RNA, 15 nt, Human
acuaaacuuucacac

SEQ ID NO: 1698143 - RNA, 15 nt, Human
acuaauuuuaaaaug

SEQ ID NO: 1698144 - RNA, 16 nt, Human
acggugaauggcuuug

SEQ ID NO: 1698145 - RNA, 19 nt, Human
uccauccugaggcuccacu

SEQ ID NO: 1698146 - RNA, 15 nt, Human
uccauccugaggcuc

SEQ ID NO: 1698147 - RNA, 12 nt, Human
uccauccugagg

SEQ ID NO: 1698148 - RNA, 20 nt, Human
acggugaauggcuuuguaua

SEQ ID NO: 1698149 - RNA, 19 nt, Human
acggugaauggcuuuguau

SEQ ID NO: 1698150 - RNA, 15 nt, Human
acucaauuuuaacaa

SEQ ID NO: 1698151 - RNA, 12 nt, Human
acucaauuuuaa

SEQ ID NO: 1698152 - RNA, 22 nt, Human
acuauauuguuugcuaagcauu

SEQ ID NO: 1698153 - RNA, 17 nt, Human
acuauauuguuugcuaa

SEQ ID NO: 1698154 - RNA, 15 nt, Human
acuaucucauuucca

SEQ ID NO: 1698155 - RNA, 17 nt, Human
acuaucucauuuccaag

SEQ ID NO: 1698156 - RNA, 16 nt, Human
acuaucucauuuccaa

SEQ ID NO: 1698157 - RNA, 22 nt, Human
uccugcaaugaagucucugaag

SEQ ID NO: 1698158 - RNA, 16 nt, Human
uccuggaaaucagggu

SEQ ID NO: 1698159 - RNA, 18 nt, Human
acugagagugaacaaauu

SEQ ID NO: 1698160 - RNA, 20 nt, Human
acugacucuuaagaagacug

SEQ ID NO: 1698161 - RNA, 18 nt, Human
acugacucuuaagaagac

SEQ ID NO: 1698162 - RNA, 17 nt, Human
acugacucuuaagaaga

SEQ ID NO: 1698163 - RNA, 16 nt, Human
acugacucuuaagaag

SEQ ID NO: 1698164 - RNA, 15 nt, Human
acugacucuuaagaa

SEQ ID NO: 1698165 - RNA, 14 nt, Human
acugacucuuaaga

SEQ ID NO: 1698166 - RNA, 13 nt, Human
acugacucuuaag

SEQ ID NO: 1698167 - RNA, 12 nt, Human
acugaagaagca

SEQ ID NO: 1698168 - RNA, 21 nt, Human
acucuuaagaagacugcauua

SEQ ID NO: 1698169 - RNA, 19 nt, Human
acuccagugagacagcucu

SEQ ID NO: 1698170 - RNA, 20 nt, Human
agaaggcaaaugacuuugga

SEQ ID NO: 1698171 - RNA, 15 nt, Human
agaaggcaaaugacu

SEQ ID NO: 1698172 - RNA, 14 nt, Human
agaaggcaaaugac

SEQ ID NO: 1698173 - RNA, 23 nt, Human
agaaugguccgugcuaaggacuu

SEQ ID NO: 1698174 - RNA, 21 nt, Human
agaaugguccgugcuaaggac

SEQ ID NO: 1698175 - RNA, 15 nt, Human
agaauuaacacauga

SEQ ID NO: 1698176 - RNA, 23 nt, Human
agaauuaacacaugauccugcaa

SEQ ID NO: 1698177 - RNA, 18 nt, Human
ucugugaacuugaaauuu

SEQ ID NO: 1698178 - RNA, 14 nt, Human
ucugugagaugcua

SEQ ID NO: 1698179 - RNA, 17 nt, Human
ucugugaacuugaaauu

SEQ ID NO: 1698180 - RNA, 14 nt, Human
ucugugaacuugaa

SEQ ID NO: 1698181 - RNA, 22 nt, Human
ucugugagaugcuagaacuccc

SEQ ID NO: 1698182 - RNA, 17 nt, Human
ucugugagaugcuagaa

SEQ ID NO: 1698183 - RNA, 23 nt, Human
ucugugagaugcuagaacucccu

SEQ ID NO: 1698184 - RNA, 12 nt, Human
agaauucuguau

SEQ ID NO: 1698185 - RNA, 14 nt, Human
agaauucuguauag

SEQ ID NO: 1698186 - RNA, 20 nt, Human
ucugugagcaucacaguuuu

SEQ ID NO: 1698187 - RNA, 15 nt, Human
agacacacaugaagu

SEQ ID NO: 1698188 - RNA, 12 nt, Human
agacacacauga

SEQ ID NO: 1698189 - RNA, 11 nt, Human
ucugauccagu

SEQ ID NO: 1698190 - RNA, 21 nt, Human
ucugauccaguuuuguuugga

SEQ ID NO: 1698191 - RNA, 14 nt, Human
ucugauccaguuuu

SEQ ID NO: 1698192 - RNA, 15 nt, Human
ucugcagauaaacag

SEQ ID NO: 1698193 - RNA, 18 nt, Human
ucugcagauaaacaguag

SEQ ID NO: 1698194 - RNA, 19 nt, Human
agaagcaacccaaauguuc

SEQ ID NO: 1698195 - RNA, 14 nt, Human
agaagaacugaaau

SEQ ID NO: 1698196 - RNA, 13 nt, Human
agaagaacugaaa

SEQ ID NO: 1698197 - RNA, 18 nt, Human
agaagaugguaccaccag

SEQ ID NO: 1698198 - RNA, 21 nt, Human
acuguuauuuauaaucacuuu

SEQ ID NO: 1698199 - RNA, 20 nt, Human
acuguuauuuauaaucacuu

SEQ ID NO: 1698200 - RNA, 17 nt, Human
acuguuauuuauaauca

SEQ ID NO: 1698201 - RNA, 15 nt, Human
acuguuauuuauaau

SEQ ID NO: 1698202 - RNA, 14 nt, Human
acuguuauuuauaa

SEQ ID NO: 1698203 - RNA, 16 nt, Human
ucuaggaaauauuuau

SEQ ID NO: 1698204 - RNA, 17 nt, Human
ucuaggaaauauuuauu

SEQ ID NO: 1698205 - RNA, 13 nt, Human
acuuguguaaaua

SEQ ID NO: 1698206 - RNA, 15 nt, Human
acuugucaauaaaau

SEQ ID NO: 1698207 - RNA, 23 nt, Human
ucucagauuuuauuauguaaauc

SEQ ID NO: 1698208 - RNA, 22 nt, Human
ucucagauuuuauuauguaaau

SEQ ID NO: 1698209 - RNA, 16 nt, Human
ucucauuuaauccucu

SEQ ID NO: 1698210 - RNA, 15 nt, Human
ucucauuuccaagca

SEQ ID NO: 1698211 - RNA, 12 nt, Human
acuuuggauaau

SEQ ID NO: 1698212 - RNA, 19 nt, Human
acuuuggauaauaaggaaa

SEQ ID NO: 1698213 - RNA, 17 nt, Human
acuuuggauaauaagga

SEQ ID NO: 1698214 - RNA, 21 nt, Human
agauuagagaguguugaaacg

SEQ ID NO: 1698215 - RNA, 23 nt, Human
agauuagaauucuguauagauua

SEQ ID NO: 1698216 - RNA, 22 nt, Human
agauuagaauucuguauagauu

SEQ ID NO: 1698217 - RNA, 16 nt, Human
agauuagaauucugua

SEQ ID NO: 1698218 - RNA, 15 nt, Human
agauuagaauucugu

SEQ ID NO: 1698219 - RNA, 22 nt, Human
agauguauguacuucaugcugu

SEQ ID NO: 1698220 - RNA, 15 nt, Human
ugacacuuaaaaaug

SEQ ID NO: 1698221 - RNA, 14 nt, Human
agauccuggaaauc

SEQ ID NO: 1698222 - RNA, 13 nt, Human
agauccuggaaau

SEQ ID NO: 1698223 - RNA, 22 nt, Human
agaugcuagaacucccuuucaa

SEQ ID NO: 1698224 - RNA, 21 nt, Human
agaugcuagaacucccuuuca

SEQ ID NO: 1698225 - RNA, 19 nt, Human
agaugcuagaacucccuuu

SEQ ID NO: 1698226 - RNA, 21 nt, Human
agaugcaguucugaagaagau

SEQ ID NO: 1698227 - RNA, 20 nt, Human
agaugcaguucugaagaaga

SEQ ID NO: 1698228 - RNA, 16 nt, Human
agauuuuccugaaaac

SEQ ID NO: 1698229 - RNA, 15 nt, Human
agauuuuccugaaaa

SEQ ID NO: 1698230 - RNA, 12 nt, Human
ugagacagcucu

SEQ ID NO: 1698231 - RNA, 20 nt, Human
ugagacucugucucagucca

SEQ ID NO: 1698232 - RNA, 20 nt, Human
ugagagacacacugaagaag

SEQ ID NO: 1698233 - RNA, 19 nt, Human
ugagagacacacugaagaa

SEQ ID NO: 1698234 - RNA, 17 nt, Human
ugagagacacacugaag

SEQ ID NO: 1698235 - RNA, 16 nt, Human
ugagagacacacugaa

SEQ ID NO: 1698236 - RNA, 22 nt, Human
ugagagacacacugaagaagca

SEQ ID NO: 1698237 - RNA, 21 nt, Human
ugagagacacacugaagaagc

SEQ ID NO: 1698238 - RNA, 16 nt, Human
ugaaauacuguuugag

SEQ ID NO: 1698239 - RNA, 14 nt, Human
ugaaauacuguuug

SEQ ID NO: 1698240 - RNA, 14 nt, Human
ugaaauaagccaga

SEQ ID NO: 1698241 - RNA, 20 nt, Human
ugaaauuguaauuauaucug

SEQ ID NO: 1698242 - RNA, 19 nt, Human
ugaaauuguaauuauaucu

SEQ ID NO: 1698243 - RNA, 16 nt, Human
ugaaauuguaauuaua

SEQ ID NO: 1698244 - RNA, 15 nt, Human
ugaaauuguaauuau

SEQ ID NO: 1698245 - RNA, 14 nt, Human
ugaaauuguaauua

SEQ ID NO: 1698246 - RNA, 13 nt, Human
ugaaauuguaauu

SEQ ID NO: 1698247 - RNA, 19 nt, Human
ugaacuaaacuuucacacc

SEQ ID NO: 1698248 - RNA, 17 nt, Human
ugaacuaaacuuucaca

SEQ ID NO: 1698249 - RNA, 23 nt, Human
ugaacuagaguuuagcuggaaaa

SEQ ID NO: 1698250 - RNA, 18 nt, Human
ugaacccgggaggcagag

SEQ ID NO: 1698251 - RNA, 22 nt, Human
ugaacccauauuuguacaccaa

SEQ ID NO: 1698252 - RNA, 13 nt, Human
ugaacaaauuuac

SEQ ID NO: 1698253 - RNA, 18 nt, Human
ugaacaaauuuacagaga

SEQ ID NO: 1698254 - RNA, 22 nt, Human
agagguuuuucuuaaauaauaa

SEQ ID NO: 1698255 - RNA, 12 nt, Human
agagguuuuucu

SEQ ID NO: 1698256 - RNA, 20 nt, Human
ugaagauuuaccacuugugu

SEQ ID NO: 1698257 - RNA, 17 nt, Human
ugaagauuuaccacuug

SEQ ID NO: 1698258 - RNA, 17 nt, Human
ugaaguacucauacaug

SEQ ID NO: 1698259 - RNA, 22 nt, Human
ugaaacugcuuguuuccuagca

SEQ ID NO: 1698260 - RNA, 20 nt, Human
ugaaacugcuuguuuccuag

SEQ ID NO: 1698261 - RNA, 17 nt, Human
ugaaagaggaaugaagu

SEQ ID NO: 1698262 - RNA, 18 nt, Human
ugaaagaggaaugaagua

SEQ ID NO: 1698263 - RNA, 15 nt, Human
agagaguguugaaac

SEQ ID NO: 1698264 - RNA, 16 nt, Human
agagaguguugaaacg

SEQ ID NO: 1698265 - RNA, 19 nt, Human
ugaaacugcuuguuuccua

SEQ ID NO: 1698266 - RNA, 18 nt, Human
ugaaacugcuuguuuccu

SEQ ID NO: 1698267 - RNA, 13 nt, Human
ugaaagaaaauaa

SEQ ID NO: 1698268 - RNA, 17 nt, Human
ucuuugucuacaccauu

SEQ ID NO: 1698269 - RNA, 15 nt, Human
agagacagaaagcag

SEQ ID NO: 1698270 - RNA, 14 nt, Human
agagacagaaagca

SEQ ID NO: 1698271 - RNA, 16 nt, Human
agagacacacugaaga

SEQ ID NO: 1698272 - RNA, 21 nt, Human
agacuggugacugauucuuca

SEQ ID NO: 1698273 - RNA, 20 nt, Human
agacuggugacugauucuuc

SEQ ID NO: 1698274 - RNA, 19 nt, Human
agacuggugacugauucuu

SEQ ID NO: 1698275 - RNA, 17 nt, Human
agucagaucugccuaag

SEQ ID NO: 1698276 - RNA, 20 nt, Human
agucagaucugccuaaggac

SEQ ID NO: 1698277 - RNA, 22 nt, Human
agucagaucugccuaaggacuu

SEQ ID NO: 1698278 - RNA, 21 nt, Human
agucagaucugccuaaggacu

SEQ ID NO: 1698279 - RNA, 23 nt, Human
agucagaucugccuaaggacuuc

SEQ ID NO: 1698280 - RNA, 11 nt, Human
aguauuguaca

SEQ ID NO: 1698281 - RNA, 23 nt, Human
aguauuguacaaaguauuaagca

SEQ ID NO: 1698282 - RNA, 22 nt, Human
aguauuguacaaaguauuaagc

SEQ ID NO: 1698283 - RNA, 20 nt, Human
aguauuguacaaaguauuaa

SEQ ID NO: 1698284 - RNA, 15 nt, Human
aguauuguacaaagu

SEQ ID NO: 1698285 - RNA, 21 nt, Human
aguauguuagugcaaauuguc

SEQ ID NO: 1698286 - RNA, 18 nt, Human
aguauguuagugcaaauu

SEQ ID NO: 1698287 - RNA, 21 nt, Human
aguauuagaauaccacaggaa

SEQ ID NO: 1698288 - RNA, 20 nt, Human
agucacauuccaagccucau

SEQ ID NO: 1698289 - RNA, 16 nt, Human
aguauuguccaggucu

SEQ ID NO: 1698290 - RNA, 15 nt, Human
aguauuguccagguc

SEQ ID NO: 1698291 - RNA, 16 nt, Human
uguauuaagaaugaaa

SEQ ID NO: 1698292 - RNA, 12 nt, Human
uguauuaagaau

SEQ ID NO: 1698293 - RNA, 13 nt, Human
uguaugugugaag

SEQ ID NO: 1698294 - RNA, 12 nt, Human
uguaugugugaa

SEQ ID NO: 1698295 - RNA, 18 nt, Human
ugugagcaucacaguuuu

SEQ ID NO: 1698296 - RNA, 19 nt, Human
agucucugaagugaaacug

SEQ ID NO: 1698297 - RNA, 18 nt, Human
agucucugaagugaaacu

SEQ ID NO: 1698298 - RNA, 14 nt, Human
ugugaagcaaaauu

SEQ ID NO: 1698299 - RNA, 18 nt, Human
agucuguuuuaugacuuc

SEQ ID NO: 1698300 - RNA, 17 nt, Human
agucuguuuuaugacuu

SEQ ID NO: 1698301 - RNA, 14 nt, Human
agucuguuuuauga

SEQ ID NO: 1698302 - RNA, 13 nt, Human
agucuguuuuaug

SEQ ID NO: 1698303 - RNA, 17 nt, Human
agugaaagaaaauaaca

SEQ ID NO: 1698304 - RNA, 14 nt, Human
agugagacagcucu

SEQ ID NO: 1698305 - RNA, 20 nt, Human
agugaaacucguuaauuugu

SEQ ID NO: 1698306 - RNA, 16 nt, Human
agugagccgagauugu

SEQ ID NO: 1698307 - RNA, 21 nt, Human
agugagcagucaggaaagaga

SEQ ID NO: 1698308 - RNA, 22 nt, Human
ugucuucauaccuacauguauu

SEQ ID NO: 1698309 - RNA, 20 nt, Human
ugugaacuaaacuuucacac

SEQ ID NO: 1698310 - RNA, 19 nt, Human
ugugaacuaaacuuucaca

SEQ ID NO: 1698311 - RNA, 14 nt, Human
ugugaacuaaacuu

SEQ ID NO: 1698312 - RNA, 21 nt, Human
ugucuugccuuuuucauuauu

SEQ ID NO: 1698313 - RNA, 17 nt, Human
ugucuugccuuuuucau

SEQ ID NO: 1698314 - RNA, 16 nt, Human
ugucuugccuuuuuca

SEQ ID NO: 1698315 - RNA, 15 nt, Human
ugucuugccuuuuuc

SEQ ID NO: 1698316 - RNA, 17 nt, Human
ugucucuacuaaaaaua

SEQ ID NO: 1698317 - RNA, 14 nt, Human
uguacaaaguauua

SEQ ID NO: 1698318 - RNA, 13 nt, Human
uguacaaaguauu

SEQ ID NO: 1698319 - RNA, 18 nt, Human
uguaagaaaauaucacuu

SEQ ID NO: 1698320 - RNA, 19 nt, Human
uguaaauacaauuuuguuu

SEQ ID NO: 1698321 - RNA, 18 nt, Human
uguaaauacaauuuuguu

SEQ ID NO: 1698322 - RNA, 17 nt, Human
uguaaauacaauuuugu

SEQ ID NO: 1698323 - RNA, 16 nt, Human
uguaaauacaauuuug

SEQ ID NO: 1698324 - RNA, 16 nt, Human
uguaaaggaauuuaaa

SEQ ID NO: 1698325 - RNA, 10 nt, Human
uguaaauccc

SEQ ID NO: 1698326 - RNA, 21 nt, Human
uguaaauacaauuuuguuucu

SEQ ID NO: 1698327 - RNA, 15 nt, Human
ugguuaagucuguuu

SEQ ID NO: 1698328 - RNA, 18 nt, Human
ugguuaagucuguuuuau

SEQ ID NO: 1698329 - RNA, 15 nt, Human
aggucagugcaaaua

SEQ ID NO: 1698330 - RNA, 20 nt, Human
aggguuuauguuuaggaugu

SEQ ID NO: 1698331 - RNA, 22 nt, Human
uggucugugagaugcuagaacu

SEQ ID NO: 1698332 - RNA, 22 nt, Human
ugguccaugggccauaugaaaa

SEQ ID NO: 1698333 - RNA, 22 nt, Human
auaauaaggaaaaguuuaauau

SEQ ID NO: 1698334 - RNA, 19 nt, Human
auaauaaggaaaaguuuaa

SEQ ID NO: 1698335 - RNA, 18 nt, Human
auaauaaggaaaaguuua

SEQ ID NO: 1698336 - RNA, 17 nt, Human
auaauaaggaaaaguuu

SEQ ID NO: 1698337 - RNA, 16 nt, Human
auaauaaggaaaaguu

SEQ ID NO: 1698338 - RNA, 19 nt, Human
auaaucacuuuuuuccaca

SEQ ID NO: 1698339 - RNA, 21 nt, Human
auaaucuuucacaggggacag

SEQ ID NO: 1698340 - RNA, 19 nt, Human
auaauuauaugcuauuucu

SEQ ID NO: 1698341 - RNA, 17 nt, Human
auaauuauaugcuauuu

SEQ ID NO: 1698342 - RNA, 14 nt, Human
auaaugaauacuuu

SEQ ID NO: 1698343 - RNA, 23 nt, Human
auaauuauaugcuauuucuauau

SEQ ID NO: 1698344 - RNA, 21 nt, Human
auaauuauaugcuauuucuau

SEQ ID NO: 1698345 - RNA, 22 nt, Human
uuagaugcaguucugaagaaga

SEQ ID NO: 1698346 - RNA, 23 nt, Human
uuagaugcaguucugaagaagau

SEQ ID NO: 1698347 - RNA, 12 nt, Human
auaacuggaaac

SEQ ID NO: 1698348 - RNA, 18 nt, Human
uuauaaaucgcuuuugau

SEQ ID NO: 1698349 - RNA, 17 nt, Human
uuauaaaucgcuuuuga

SEQ ID NO: 1698350 - RNA, 14 nt, Human
uuauaaaucgcuuu

SEQ ID NO: 1698351 - RNA, 18 nt, Human
uuauauaagcuuguauuc

SEQ ID NO: 1698352 - RNA, 22 nt, Human
auacaaaaaaaaaaaaaaauua

SEQ ID NO: 1698353 - RNA, 22 nt, Human
auaauuuuuauauuugaaauau

SEQ ID NO: 1698354 - RNA, 21 nt, Human
auaauuuuuauauuugaaaua

SEQ ID NO: 1698355 - RNA, 19 nt, Human
auaauuuuuauauuugaaa

SEQ ID NO: 1698356 - RNA, 16 nt, Human
auaauuuuuauauuug

SEQ ID NO: 1698357 - RNA, 14 nt, Human
auaauuuuuauauu

SEQ ID NO: 1698358 - RNA, 20 nt, Human
auaauuuugugaagcaaaau

SEQ ID NO: 1698359 - RNA, 15 nt, Human
auaauuuugugaagc

SEQ ID NO: 1698360 - RNA, 14 nt, Human
auaauuuugugaag

SEQ ID NO: 1698361 - RNA, 13 nt, Human
auaauuuugugaa

SEQ ID NO: 1698362 - RNA, 22 nt, Human
auaccacaggaaccacaagacu

SEQ ID NO: 1698363 - RNA, 21 nt, Human
auacaguucggugagcuacaa

SEQ ID NO: 1698364 - RNA, 20 nt, Human
auacaucccuuaccugggaa

SEQ ID NO: 1698365 - RNA, 21 nt, Human
uguuguacucaauuuuaacaa

SEQ ID NO: 1698366 - RNA, 20 nt, Human
aguuauuauauuuacaaaug

SEQ ID NO: 1698367 - RNA, 18 nt, Human
uuaaaaaagaaacauuug

SEQ ID NO: 1698368 - RNA, 15 nt, Human
uuaaaaaagaaacau

SEQ ID NO: 1698369 - RNA, 20 nt, Human
uuaaaaaugguuuaaauggu

SEQ ID NO: 1698370 - RNA, 16 nt, Human
aguucugaagaagaug

SEQ ID NO: 1698371 - RNA, 15 nt, Human
aguucugaagaagau

SEQ ID NO: 1698372 - RNA, 14 nt, Human
aguucugaagaaga

SEQ ID NO: 1698373 - RNA, 13 nt, Human
aguucugaagaag

SEQ ID NO: 1698374 - RNA, 21 nt, Human
aguugauaugccuuuucccaa

SEQ ID NO: 1698375 - RNA, 15 nt, Human
uguuugcuaagcauu

SEQ ID NO: 1698376 - RNA, 19 nt, Human
uguuugcuaagcauuccaa

SEQ ID NO: 1698377 - RNA, 20 nt, Human
uguuuuauaauuuugugaag

SEQ ID NO: 1698378 - RNA, 13 nt, Human
uguuuuauaauuu

SEQ ID NO: 1698379 - RNA, 16 nt, Human
ugauuucuaugcugag

SEQ ID NO: 1698380 - RNA, 15 nt, Human
ugauuucuaugcuga

SEQ ID NO: 1698381 - RNA, 12 nt, Human
ugauuucuaugc

SEQ ID NO: 1698382 - RNA, 18 nt, Human
ugauuaaguaaugauaac

SEQ ID NO: 1698383 - RNA, 23 nt, Human
ugauuaaguaaugauaacuggaa

SEQ ID NO: 1698384 - RNA, 12 nt, Human
ugaugaagaagu

SEQ ID NO: 1698385 - RNA, 11 nt, Human
ugaugaagaag

SEQ ID NO: 1698386 - RNA, 15 nt, Human
ugcagaagacaguau

SEQ ID NO: 1698387 - RNA, 14 nt, Human
ugcagaagacagua

SEQ ID NO: 1698388 - RNA, 16 nt, Human
ugccccauucaacauc

SEQ ID NO: 1698389 - RNA, 23 nt, Human
agcucugcccauccugccccuga

SEQ ID NO: 1698390 - RNA, 15 nt, Human
ugccucaccccuugc

SEQ ID NO: 1698391 - RNA, 18 nt, Human
ugccucagaaaacaagga

SEQ ID NO: 1698392 - RNA, 20 nt, Human
aggauuuuaugcuuuaaaca

SEQ ID NO: 1698393 - RNA, 18 nt, Human
uggaauuggagcucgugg

SEQ ID NO: 1698394 - RNA, 17 nt, Human
aggacuuguuagaucua

SEQ ID NO: 1698395 - RNA, 11 nt, Human
aggagaaacug

SEQ ID NO: 1698396 - RNA, 17 nt, Human
aggagaaacuggaacuc

SEQ ID NO: 1698397 - RNA, 16 nt, Human
aggacuuguuagaucu

SEQ ID NO: 1698398 - RNA, 14 nt, Human
aggacuuguuagau

SEQ ID NO: 1698399 - RNA, 13 nt, Human
uggaaaggcagcu

SEQ ID NO: 1698400 - RNA, 13 nt, Human
ugcuauuucuaua

SEQ ID NO: 1698401 - RNA, 12 nt, Human
ugcuauuucuau

SEQ ID NO: 1698402 - RNA, 21 nt, Human
ugcuauuucuauauuuucauu

SEQ ID NO: 1698403 - RNA, 20 nt, Human
ugcuauuucuauauuuucau

SEQ ID NO: 1698404 - RNA, 14 nt, Human
ugcuauuucuauau

SEQ ID NO: 1698405 - RNA, 11 nt, Human
aggaauuuaaa

SEQ ID NO: 1698406 - RNA, 23 nt, Human
aggaauugacccacaagaaauga

SEQ ID NO: 1698407 - RNA, 14 nt, Human
aggacacugauaug

SEQ ID NO: 1698408 - RNA, 14 nt, Human
ugcuggagcucugc

SEQ ID NO: 1698409 - RNA, 13 nt, Human
ugcuggagcucug

SEQ ID NO: 1698410 - RNA, 18 nt, Human
uggacgagaaaacaauaa

SEQ ID NO: 1698411 - RNA, 19 nt, Human
uucuuaaauaauaaagauc

SEQ ID NO: 1698412 - RNA, 15 nt, Human
uucuuaaauaauaaa

SEQ ID NO: 1698413 - RNA, 13 nt, Human
uucuuaaaguuga

SEQ ID NO: 1698414 - RNA, 17 nt, Human
uucuguuuuauaauuuu

SEQ ID NO: 1698415 - RNA, 16 nt, Human
uucuguuuuauaauuu

SEQ ID NO: 1698416 - RNA, 23 nt, Human
aucacuugaacccgggaggcaga

SEQ ID NO: 1698417 - RNA, 19 nt, Human
uugauaaucaacugggcug

SEQ ID NO: 1698418 - RNA, 14 nt, Human
uugacauagucugg

SEQ ID NO: 1698419 - RNA, 19 nt, Human
uugacacuuaaaaaugguu

SEQ ID NO: 1698420 - RNA, 17 nt, Human
uugacauagucuggcug

SEQ ID NO: 1698421 - RNA, 14 nt, Human
uugacccacaagaa

SEQ ID NO: 1698422 - RNA, 17 nt, Human
uugacacuuaaaaaugg

SEQ ID NO: 1698423 - RNA, 18 nt, Human
auccugaggcuccacuug

SEQ ID NO: 1698424 - RNA, 16 nt, Human
auccugaggcuccacu

SEQ ID NO: 1698425 - RNA, 13 nt, Human
auccugaggcucc

SEQ ID NO: 1698426 - RNA, 11 nt, Human
auccugaggcu

SEQ ID NO: 1698427 - RNA, 13 nt, Human
auccugccccuga

SEQ ID NO: 1698428 - RNA, 22 nt, Human
auccugaggcuccacuuggucu

SEQ ID NO: 1698429 - RNA, 16 nt, Human
auccugcaauuccacu

SEQ ID NO: 1698430 - RNA, 12 nt, Human
auauuaaagcca

SEQ ID NO: 1698431 - RNA, 13 nt, Human
auauuuacaaaug

SEQ ID NO: 1698432 - RNA, 14 nt, Human
auauuguuugcuaa

SEQ ID NO: 1698433 - RNA, 19 nt, Human
aucaacugggcugaacacu

SEQ ID NO: 1698434 - RNA, 16 nt, Human
aucaaggguacacugc

SEQ ID NO: 1698435 - RNA, 13 nt, Human
aucaauuuaaaaa

SEQ ID NO: 1698436 - RNA, 21 nt, Human
aucaaggguacacugccuucu

SEQ ID NO: 1698437 - RNA, 13 nt, Human
auauauuuuuaua

SEQ ID NO: 1698438 - RNA, 20 nt, Human
uucauggaacgcguugaaau

SEQ ID NO: 1698439 - RNA, 19 nt, Human
uucauggaacgcguugaaa

SEQ ID NO: 1698440 - RNA, 21 nt, Human
uucauuaauaauaaauucccu

SEQ ID NO: 1698441 - RNA, 18 nt, Human
uucauuaauaauaaauuc

SEQ ID NO: 1698442 - RNA, 15 nt, Human
uucauuaauaauaaa

SEQ ID NO: 1698443 - RNA, 22 nt, Human
uucauggaacgcguugaaauug

SEQ ID NO: 1698444 - RNA, 21 nt, Human
uucauggaacgcguugaaauu

SEQ ID NO: 1698445 - RNA, 23 nt, Human
auauguaccuaacgaaguauccu

SEQ ID NO: 1698446 - RNA, 22 nt, Human
uucauuauuuuauuaugaaacu

SEQ ID NO: 1698447 - RNA, 19 nt, Human
uucagcaaaaauauuuuau

SEQ ID NO: 1698448 - RNA, 17 nt, Human
uucagcgguuuauauaa

SEQ ID NO: 1698449 - RNA, 17 nt, Human
uucagcaaaaauauuuu

SEQ ID NO: 1698450 - RNA, 15 nt, Human
uucaucaaugaauga

SEQ ID NO: 1698451 - RNA, 13 nt, Human
auauaugcuaagu

SEQ ID NO: 1698452 - RNA, 13 nt, Human
uuuauuaugaaac

SEQ ID NO: 1698453 - RNA, 19 nt, Human
uuuauuacuguaagaaaau

SEQ ID NO: 1698454 - RNA, 21 nt, Human
uuuauuaugaaacuuguguaa

SEQ ID NO: 1698455 - RNA, 23 nt, Human
augcugucuacacuaagagagaa

SEQ ID NO: 1698456 - RNA, 14 nt, Human
augcuguauuuuaa

SEQ ID NO: 1698457 - RNA, 16 nt, Human
uuuauuuuaauaaugu

SEQ ID NO: 1698458 - RNA, 23 nt, Human
auggaauuggagcucgugggaca

SEQ ID NO: 1698459 - RNA, 23 nt, Human
uuuagcuacuauauaugugauga

SEQ ID NO: 1698460 - RNA, 19 nt, Human
uuuauaugcuucuguuuua

SEQ ID NO: 1698461 - RNA, 17 nt, Human
uuuauaugcuucuguuu

SEQ ID NO: 1698462 - RNA, 17 nt, Human
uuuacuaaaauggacug

SEQ ID NO: 1698463 - RNA, 15 nt, Human
uuuacuaaaauggac

SEQ ID NO: 1698464 - RNA, 13 nt, Human
augcuaagugaaa

SEQ ID NO: 1698465 - RNA, 21 nt, Human
uuucuaugcugaguuugugcu

SEQ ID NO: 1698466 - RNA, 20 nt, Human
uuucuaugaaauauuauguu

SEQ ID NO: 1698467 - RNA, 14 nt, Human
uuucuaugaaauau

SEQ ID NO: 1698468 - RNA, 13 nt, Human
uuucuaugaaaua

SEQ ID NO: 1698469 - RNA, 13 nt, Human
uuucuauauuuuc

SEQ ID NO: 1698470 - RNA, 18 nt, Human
uuucuauauuuucauucu

SEQ ID NO: 1698471 - RNA, 15 nt, Human
uuucuauauuuucau

SEQ ID NO: 1698472 - RNA, 14 nt, Human
uuugaaauauugac

SEQ ID NO: 1698473 - RNA, 21 nt, Human
augggacauuugcucauggaa

SEQ ID NO: 1698474 - RNA, 22 nt, Human
augggacauuugcucauggaau

SEQ ID NO: 1698475 - RNA, 23 nt, Human
augaucuaccagccucccuauuu

SEQ ID NO: 1698476 - RNA, 18 nt, Human
uugugaagcaaaauuuuu

SEQ ID NO: 1698477 - RNA, 17 nt, Human
uuuaaaaaaaaaauugg

SEQ ID NO: 1698478 - RNA, 20 nt, Human
uuuaaaaaagaaacauuugg

SEQ ID NO: 1698479 - RNA, 14 nt, Human
augauaacuggaaa

SEQ ID NO: 1698480 - RNA, 18 nt, Human
uugguuaagucuguuuua

SEQ ID NO: 1698481 - RNA, 16 nt, Human
uugguuaagucuguuu

SEQ ID NO: 1698482 - RNA, 22 nt, Human
augaauuacauuuguauaaaau

SEQ ID NO: 1698483 - RNA, 19 nt, Human
augaauuacauuuguauaa

SEQ ID NO: 1698484 - RNA, 18 nt, Human
augaauuacauuuguaua

SEQ ID NO: 1698485 - RNA, 15 nt, Human
uuguaauuauaucug

SEQ ID NO: 1698486 - RNA, 23 nt, Human
uuguaguguuggagaagaacuga

SEQ ID NO: 1698487 - RNA, 13 nt, Human
uuguauaaaauaa

SEQ ID NO: 1698488 - RNA, 19 nt, Human
uuguauaaaauaauuuuua

SEQ ID NO: 1698489 - RNA, 23 nt, Human
augaauuaguuuuauaugcuucu

SEQ ID NO: 1698490 - RNA, 21 nt, Human
augaauuaguuuuauaugcuu

SEQ ID NO: 1698491 - RNA, 20 nt, Human
augaaauauuauguuaaaac

SEQ ID NO: 1698492 - RNA, 21 nt, Human
augaaauauuauguuaaaacu

SEQ ID NO: 1698493 - RNA, 12 nt, Human
uugcucauggaa

SEQ ID NO: 1698494 - RNA, 11 nt, Human
uugcucaugga

SEQ ID NO: 1698495 - RNA, 17 nt, Human
auuuuccuccuuucucu

SEQ ID NO: 1698496 - RNA, 13 nt, Human
auuuuccuccuuu

SEQ ID NO: 1698497 - RNA, 22 nt, Human
auuuucaguuauuauauuuaca

SEQ ID NO: 1698498 - RNA, 21 nt, Human
auuuuauuauguaaaucccau

SEQ ID NO: 1698499 - RNA, 20 nt, Human
auuuuauuauguaaauccca

SEQ ID NO: 1698500 - RNA, 19 nt, Human
auuuuauuauguaaauccc

SEQ ID NO: 1698501 - RNA, 18 nt, Human
auuuuauuauguaaaucc

SEQ ID NO: 1698502 - RNA, 17 nt, Human
auuuuauuauguaaauc

SEQ ID NO: 1698503 - RNA, 16 nt, Human
auuuuauuauguaaau

SEQ ID NO: 1698504 - RNA, 17 nt, Human
auuuuaaaagaaugauu

SEQ ID NO: 1698505 - RNA, 19 nt, Human
auuuguauaaaauaauuuu

SEQ ID NO: 1698506 - RNA, 18 nt, Human
auuuguauaaaauaauuu

SEQ ID NO: 1698507 - RNA, 15 nt, Human
auuuguauaaaauaa

SEQ ID NO: 1698508 - RNA, 22 nt, Human
auuuuaaaagaaugauuaugaa

SEQ ID NO: 1698509 - RNA, 18 nt, Human
auuuuaaaagaaugauua

SEQ ID NO: 1698510 - RNA, 18 nt, Human
auucuuaaaguugaauuu

SEQ ID NO: 1698511 - RNA, 23 nt, Human
auucuucagcaaaaauauuuuau

SEQ ID NO: 1698512 - RNA, 15 nt, Human
auucuucagcaaaaa

SEQ ID NO: 1698513 - RNA, 21 nt, Human
auucuguauagauuagaauuc

SEQ ID NO: 1698514 - RNA, 16 nt, Human
auucuuaaaguugaau

SEQ ID NO: 1698515 - RNA, 15 nt, Human
auucuuaaaguugaa

SEQ ID NO: 1698516 - RNA, 14 nt, Human
auucuuaaaguuga

SEQ ID NO: 1698517 - RNA, 13 nt, Human
auucuuaaaguug

SEQ ID NO: 1698518 - RNA, 18 nt, Human
auugacccacaagaaaug

SEQ ID NO: 1698519 - RNA, 23 nt, Human
auugguguuguacucaauuuuaa

SEQ ID NO: 1698520 - RNA, 22 nt, Human
auugguguuguacucaauuuua

SEQ ID NO: 1698521 - RNA, 14 nt, Human
auugguguuguacu

SEQ ID NO: 1698522 - RNA, 13 nt, Human
auuuagauguaua

SEQ ID NO: 1698523 - RNA, 17 nt, Human
auuuauuuuaauaaugu

SEQ ID NO: 1698524 - RNA, 20 nt, Human
auuuauuuuaauaauguuuc

SEQ ID NO: 1698525 - RNA, 19 nt, Human
auuuauuuuaauaauguuu

SEQ ID NO: 1698526 - RNA, 14 nt, Human
auuugaaauauuga

SEQ ID NO: 1698527 - RNA, 21 nt, Human
auucuccuaucaccugucuug

SEQ ID NO: 1698528 - RNA, 19 nt, Human
auucccuggccuuucauau

SEQ ID NO: 1698529 - RNA, 13 nt, Human
auucccuggccuu

SEQ ID NO: 1698530 - RNA, 15 nt, Human
uuuucugauccaguu

SEQ ID NO: 1698531 - RNA, 16 nt, Human
uuuucucuaggaaaua

SEQ ID NO: 1698532 - RNA, 14 nt, Human
uuuucucuaggaaa

SEQ ID NO: 1698533 - RNA, 22 nt, Human
uuuuauuaugaaacuuguguaa

SEQ ID NO: 1698534 - RNA, 21 nt, Human
uuuuauuaugaaacuugugua

SEQ ID NO: 1698535 - RNA, 12 nt, Human
uuuuauuaugaa

SEQ ID NO: 1698536 - RNA, 21 nt, Human
auguuuucaggcuagauguau

SEQ ID NO: 1698537 - RNA, 17 nt, Human
auguuuucaggcuagau

SEQ ID NO: 1698538 - RNA, 15 nt, Human
auguuuucaggcuag

SEQ ID NO: 1698539 - RNA, 20 nt, Human
auguuaaaccaugggauaaa

SEQ ID NO: 1698540 - RNA, 13 nt, Human
auguuaaaccaug

SEQ ID NO: 1698541 - RNA, 12 nt, Human
auguuaaaccau

SEQ ID NO: 1698542 - RNA, 18 nt, Human
auguucaucaaugaauga

SEQ ID NO: 1698543 - RNA, 14 nt, Human
uuuuaauaauguuu

SEQ ID NO: 1698544 - RNA, 13 nt, Human
uuuuaauaauguu

SEQ ID NO: 1698545 - RNA, 12 nt, Human
uuuuaauaaugu

SEQ ID NO: 1698546 - RNA, 16 nt, Human
uuuuaauaauguuuca

SEQ ID NO: 1698547 - RNA, 19 nt, Human
augugcuaguaauuggaaa

SEQ ID NO: 1698548 - RNA, 15 nt, Human
auuaauaauaaauuc

SEQ ID NO: 1698549 - RNA, 20 nt, Human
auuacauuuguauaaaauaa

SEQ ID NO: 1698550 - RNA, 18 nt, Human
auuacauuuguauaaaau

SEQ ID NO: 1698551 - RNA, 17 nt, Human
auuacauuuguauaaaa

SEQ ID NO: 1698552 - RNA, 23 nt, Human
auuaaguaaugauaacuggaaac

SEQ ID NO: 1698553 - RNA, 21 nt, Human
auuaaguaaugauaacuggaa

SEQ ID NO: 1698554 - RNA, 19 nt, Human
uuuuugugaaaagcuccau

SEQ ID NO: 1698555 - RNA, 12 nt, Human
auuagaauucug

SEQ ID NO: 1698556 - RNA, 14 nt, Human
auuagaauucugua

SEQ ID NO: 1698557 - RNA, 13 nt, Human
auuagaauucugu

SEQ ID NO: 1698558 - RNA, 18 nt, Human
auuagaauucuguauaga

SEQ ID NO: 1698559 - RNA, 17 nt, Human
auuagaauucuguauag

SEQ ID NO: 1698560 - RNA, 16 nt, Human
auuagaauucuguaua

SEQ ID NO: 1698561 - RNA, 15 nt, Human
auuagaauucuguau

SEQ ID NO: 1698562 - RNA, 21 nt, Human
auuagaauucuguauagauua

SEQ ID NO: 1698563 - RNA, 11 nt, Human
auuaaagccau

SEQ ID NO: 1698564 - RNA, 21 nt, Human
auuaagcauauauuuuuauau

SEQ ID NO: 1698565 - RNA, 15 nt, Human
auuaagcauauauuu

SEQ ID NO: 1698566 - RNA, 14 nt, Human
auuaagcauauauu

SEQ ID NO: 1698567 - RNA, 18 nt, Human
uuuuguuguuuguuuagu

SEQ ID NO: 1698568 - RNA, 12 nt, Human
uuuuguuucugu

SEQ ID NO: 1698569 - RNA, 22 nt, Human
uuuuguuuggaccaaaaaccag

SEQ ID NO: 1698570 - RNA, 12 nt, Human
uuuuguuuggac

SEQ ID NO: 1698571 - RNA, 13 nt, Human
uuuuguuucugua

SEQ ID NO: 1698572 - RNA, 23 nt, Human
uuuuguuuggaccaaaaaccagu

SEQ ID NO: 1698573 - RNA, 19 nt, Human
uuuuuauauuugaaauauu

SEQ ID NO: 1698574 - RNA, 23 nt, Human
caauuaaggauuuuaugcuuuaa

SEQ ID NO: 1698575 - RNA, 23 nt, Human
caauacaucccuuaccugggaaa

SEQ ID NO: 1698576 - RNA, 19 nt, Human
caagacugcacaucaaaau

SEQ ID NO: 1698577 - RNA, 17 nt, Human
caaggcugauuaaacca

SEQ ID NO: 1698578 - RNA, 21 nt, Human
caagccagauuuuccugaaaa

SEQ ID NO: 1698579 - RNA, 18 nt, Human
caaaaaccaguauuguac

SEQ ID NO: 1698580 - RNA, 20 nt, Human
caaaaaccaguauuguacaa

SEQ ID NO: 1698581 - RNA, 19 nt, Human
caaaaaccaguauuguaca

SEQ ID NO: 1698582 - RNA, 13 nt, Human
auuuuccugaaaa

SEQ ID NO: 1698583 - RNA, 23 nt, Human
caaaaauauuuuaugauccagca

SEQ ID NO: 1698584 - RNA, 22 nt, Human
caaaaauauuuuaugauccagc

SEQ ID NO: 1698585 - RNA, 19 nt, Human
caaaaaucucaauauuuca

SEQ ID NO: 1698586 - RNA, 21 nt, Human
caaaaauauuuuaugauccag

SEQ ID NO: 1698587 - RNA, 17 nt, Human
caaaaauauuuuaugau

SEQ ID NO: 1698588 - RNA, 15 nt, Human
caaaaauauuuuaug

SEQ ID NO: 1698589 - RNA, 14 nt, Human
caaaaauauuuuau

SEQ ID NO: 1698590 - RNA, 23 nt, Human
caaaacuucagacauagaauuaa

SEQ ID NO: 1698591 - RNA, 22 nt, Human
caaaauuuuuucucuaggaaau

SEQ ID NO: 1698592 - RNA, 21 nt, Human
caaaauuuuuucucuaggaaa

SEQ ID NO: 1698593 - RNA, 16 nt, Human
caaaauuuuuucucua

SEQ ID NO: 1698594 - RNA, 15 nt, Human
caaauugugugaaag

SEQ ID NO: 1698595 - RNA, 23 nt, Human
cacugauuugacauagucuggcu

SEQ ID NO: 1698596 - RNA, 21 nt, Human
cacugauuugacauagucugg

SEQ ID NO: 1698597 - RNA, 20 nt, Human
cacugccuucucaacuccaa

SEQ ID NO: 1698598 - RNA, 23 nt, Human
cacuugaacccgggaggcagagg

SEQ ID NO: 1698599 - RNA, 21 nt, Human
cacuugaacccgggaggcaga

SEQ ID NO: 1698600 - RNA, 20 nt, Human
cacuugaacccgggaggcag

SEQ ID NO: 1698601 - RNA, 15 nt, Human
cacuuggucugugag

SEQ ID NO: 1698602 - RNA, 19 nt, Human
cacuguggguagacacaca

SEQ ID NO: 1698603 - RNA, 24 nt, Human
cacuguggguagacacacaugaag

SEQ ID NO: 1698604 - RNA, 22 nt, Human
cacuguggguagacacacauga

SEQ ID NO: 1698605 - RNA, 17 nt, Human
caccugucuugccuuuu

SEQ ID NO: 1698606 - RNA, 20 nt, Human
caccugucuugccuuuuuca

SEQ ID NO: 1698607 - RNA, 23 nt, Human
cacggugaauggcuuuguauaga

SEQ ID NO: 1698608 - RNA, 20 nt, Human
cacggugaauggcuuuguau

SEQ ID NO: 1698609 - RNA, 22 nt, Human
cacguucuuacuaguuucccuu

SEQ ID NO: 1698610 - RNA, 13 nt, Human
cacuaaacaaaga

SEQ ID NO: 1698611 - RNA, 17 nt, Human
cacucuccauuuaauaa

SEQ ID NO: 1698612 - RNA, 15 nt, Human
cacucuccauuuaau

SEQ ID NO: 1698613 - RNA, 19 nt, Human
cacuaguauuucuaugaaa

SEQ ID NO: 1698614 - RNA, 14 nt, Human
cacuaguauuucua

SEQ ID NO: 1698615 - RNA, 21 nt, Human
cacuaaauugacacuuaaaaa

SEQ ID NO: 1698616 - RNA, 17 nt, Human
cacuaagagagaaugag

SEQ ID NO: 1698617 - RNA, 14 nt, Human
caccucauggaauu

SEQ ID NO: 1698618 - RNA, 12 nt, Human
caccucauggaa

SEQ ID NO: 1698619 - RNA, 11 nt, Human
caccucaugga

SEQ ID NO: 1698620 - RNA, 19 nt, Human
cagauaacuguuauuuaua

SEQ ID NO: 1698621 - RNA, 16 nt, Human
cagauaacuguuauuu

SEQ ID NO: 1698622 - RNA, 14 nt, Human
cagauaacuguuau

SEQ ID NO: 1698623 - RNA, 21 nt, Human
cagauaacuguuauuuauaau

SEQ ID NO: 1698624 - RNA, 20 nt, Human
cagauaacuguuauuuauaa

SEQ ID NO: 1698625 - RNA, 14 nt, Human
cagauaaucacaau

SEQ ID NO: 1698626 - RNA, 14 nt, Human
cagauaaacaguag

SEQ ID NO: 1698627 - RNA, 23 nt, Human
cagauaaauaguuuaugauucca

SEQ ID NO: 1698628 - RNA, 14 nt, Human
cagaucugccuaag

SEQ ID NO: 1698629 - RNA, 17 nt, Human
cagaucugccuaaggac

SEQ ID NO: 1698630 - RNA, 16 nt, Human
cagaucugccuaagga

SEQ ID NO: 1698631 - RNA, 23 nt, Human
cagaucugccuaaggacuucuuu

SEQ ID NO: 1698632 - RNA, 21 nt, Human
cagaucugccuaaggacuucu

SEQ ID NO: 1698633 - RNA, 20 nt, Human
cagaucugccuaaggacuuc

SEQ ID NO: 1698634 - RNA, 19 nt, Human
cagaucugccuaaggacuu

SEQ ID NO: 1698635 - RNA, 14 nt, Human
cagauccuggaaau

SEQ ID NO: 1698636 - RNA, 12 nt, Human
cacuuuuuucca

SEQ ID NO: 1698637 - RNA, 14 nt, Human
cacuuuuuuccaca

SEQ ID NO: 1698638 - RNA, 22 nt, Human
cacuuuugguuaagucuguuuu

SEQ ID NO: 1698639 - RNA, 23 nt, Human
cagaacagugauuaccagggacu

SEQ ID NO: 1698640 - RNA, 19 nt, Human
cagaaagcagaacagugau

SEQ ID NO: 1698641 - RNA, 18 nt, Human
cagaaagcagaacaguga

SEQ ID NO: 1698642 - RNA, 20 nt, Human
cagaaggcaaaugacuuugg

SEQ ID NO: 1698643 - RNA, 19 nt, Human
cagaaggcaaaugacuuug

SEQ ID NO: 1698644 - RNA, 18 nt, Human
cagaaggcaaaugacuuu

SEQ ID NO: 1698645 - RNA, 20 nt, Human
cagaagcaacccaaauguuc

SEQ ID NO: 1698646 - RNA, 19 nt, Human
cagaagcaacccaaauguu

SEQ ID NO: 1698647 - RNA, 19 nt, Human
cagacauagaauuaacaca

SEQ ID NO: 1698648 - RNA, 17 nt, Human
cagacauagaauuaaca

SEQ ID NO: 1698649 - RNA, 23 nt, Human
cagauuauucacugauuugacau

SEQ ID NO: 1698650 - RNA, 18 nt, Human
cagauuauucacugauuu

SEQ ID NO: 1698651 - RNA, 12 nt, Human
cagauuauucac

SEQ ID NO: 1698652 - RNA, 17 nt, Human
cagcaaaaauauuuuau

SEQ ID NO: 1698653 - RNA, 15 nt, Human
cagauuuuccugaaa

SEQ ID NO: 1698654 - RNA, 14 nt, Human
cagauuuuccugaa

SEQ ID NO: 1698655 - RNA, 22 nt, Human
cagauuuuauuauguaaauccc

SEQ ID NO: 1698656 - RNA, 21 nt, Human
cagauuuuauuauguaaaucc

SEQ ID NO: 1698657 - RNA, 20 nt, Human
cagauuuuauuauguaaauc

SEQ ID NO: 1698658 - RNA, 18 nt, Human
cagauuuuauuauguaaa

SEQ ID NO: 1698659 - RNA, 16 nt, Human
cagauuuuauuaugua

SEQ ID NO: 1698660 - RNA, 15 nt, Human
cagauuuuauuaugu

SEQ ID NO: 1698661 - RNA, 13 nt, Human
cagauuuuauuau

SEQ ID NO: 1698662 - RNA, 19 nt, Human
cagcagauuauucacugau

SEQ ID NO: 1698663 - RNA, 15 nt, Human
cagcagauuauucac

SEQ ID NO: 1698664 - RNA, 14 nt, Human
cagcagauuauuca

SEQ ID NO: 1698665 - RNA, 23 nt, Human
caggaauggagccugcacgguga

SEQ ID NO: 1698666 - RNA, 17 nt, Human
caggaauggagccugca

SEQ ID NO: 1698667 - RNA, 15 nt, Human
caggaaguagaggag

SEQ ID NO: 1698668 - RNA, 16 nt, Human
caggaaguagaggagg

SEQ ID NO: 1698669 - RNA, 23 nt, Human
cagcuuuccucaaaacuucagac

SEQ ID NO: 1698670 - RNA, 18 nt, Human
caggaaccacaagacugc

SEQ ID NO: 1698671 - RNA, 19 nt, Human
cagcuguaugauucccagc

SEQ ID NO: 1698672 - RNA, 18 nt, Human
cagcuggugcccugcuuu

SEQ ID NO: 1698673 - RNA, 23 nt, Human
cagcuggugcccugcuuucagau

SEQ ID NO: 1698674 - RNA, 21 nt, Human
cagcuggugcccugcuuucag

SEQ ID NO: 1698675 - RNA, 20 nt, Human
cagcuggugcccugcuuuca

SEQ ID NO: 1698676 - RNA, 19 nt, Human
cagcuggugcccugcuuuc

SEQ ID NO: 1698677 - RNA, 18 nt, Human
cagcuguaugauucccag

SEQ ID NO: 1698678 - RNA, 20 nt, Human
cagcucugcauacucauuag

SEQ ID NO: 1698679 - RNA, 21 nt, Human
cagccucccuauuuuuuuucu

SEQ ID NO: 1698680 - RNA, 19 nt, Human
cagcuacuugggaggcuga

SEQ ID NO: 1698681 - RNA, 16 nt, Human
cagccuaguugaucag

SEQ ID NO: 1698682 - RNA, 21 nt, Human
caguauaauuaacauguuaaa

SEQ ID NO: 1698683 - RNA, 17 nt, Human
caguauaauuaacaugu

SEQ ID NO: 1698684 - RNA, 15 nt, Human
caguauaauuaacau

SEQ ID NO: 1698685 - RNA, 14 nt, Human
caguauaauuaaca

SEQ ID NO: 1698686 - RNA, 12 nt, Human
caguagugauag

SEQ ID NO: 1698687 - RNA, 12 nt, Human
caguauggcagc

SEQ ID NO: 1698688 - RNA, 13 nt, Human
caguccaugaaga

SEQ ID NO: 1698689 - RNA, 22 nt, Human
cagucaggaaagagaacuucca

SEQ ID NO: 1698690 - RNA, 18 nt, Human
cagucaggaaagagaacu

SEQ ID NO: 1698691 - RNA, 15 nt, Human
cagucaggaaagaga

SEQ ID NO: 1698692 - RNA, 15 nt, Human
cagugagacagcucu

SEQ ID NO: 1698693 - RNA, 16 nt, Human
cagugaaagaaaauaa

SEQ ID NO: 1698694 - RNA, 20 nt, Human
cagugaaagaaaauaacaau

SEQ ID NO: 1698695 - RNA, 18 nt, Human
cagugauuaccagggacu

SEQ ID NO: 1698696 - RNA, 17 nt, Human
cagugauuaccagggac

SEQ ID NO: 1698697 - RNA, 23 nt, Human
caggaugguucccuugaugaaga

SEQ ID NO: 1698698 - RNA, 21 nt, Human
caggaugguucccuugaugaa

SEQ ID NO: 1698699 - RNA, 16 nt, Human
caggggacaggauggu

SEQ ID NO: 1698700 - RNA, 11 nt, Human
caggggacagg

SEQ ID NO: 1698701 - RNA, 19 nt, Human
caggcuagauguauguacu

SEQ ID NO: 1698702 - RNA, 13 nt, Human
caggcuagaugua

SEQ ID NO: 1698703 - RNA, 22 nt, Human
caucucugcaaucuucucagaa

SEQ ID NO: 1698704 - RNA, 15 nt, Human
caucucugcaaucuu

SEQ ID NO: 1698705 - RNA, 19 nt, Human
caugaagauguagaggaga

SEQ ID NO: 1698706 - RNA, 18 nt, Human
caugaagauguagaggag

SEQ ID NO: 1698707 - RNA, 16 nt, Human
caugagguacugagag

SEQ ID NO: 1698708 - RNA, 19 nt, Human
caugagguacugagaguga

SEQ ID NO: 1698709 - RNA, 21 nt, Human
cauauauuuuuauauuuacua

SEQ ID NO: 1698710 - RNA, 20 nt, Human
cauauauuuuuauauuuacu

SEQ ID NO: 1698711 - RNA, 18 nt, Human
cauauauuuuuauauuua

SEQ ID NO: 1698712 - RNA, 20 nt, Human
cauauauaacaaugcuguau

SEQ ID NO: 1698713 - RNA, 15 nt, Human
cauauauaacaaugc

SEQ ID NO: 1698714 - RNA, 19 nt, Human
cauagucuggcuguaccca

SEQ ID NO: 1698715 - RNA, 13 nt, Human
cauauauaacaau

SEQ ID NO: 1698716 - RNA, 22 nt, Human
caucaguauugaagcauuuuau

SEQ ID NO: 1698717 - RNA, 20 nt, Human
caucaguauugaagcauuuu

SEQ ID NO: 1698718 - RNA, 16 nt, Human
caucaguauugaagca

SEQ ID NO: 1698719 - RNA, 18 nt, Human
caucccuuaccugggaaa

SEQ ID NO: 1698720 - RNA, 13 nt, Human
cauguuaaaccau

SEQ ID NO: 1698721 - RNA, 23 nt, Human
cauguuuauuacaguauaauuaa

SEQ ID NO: 1698722 - RNA, 22 nt, Human
cauguuaaaccaugggauaaau

SEQ ID NO: 1698723 - RNA, 20 nt, Human
caugugcuaguaauuggaaa

SEQ ID NO: 1698724 - RNA, 17 nt, Human
caugggauaaaugccau

SEQ ID NO: 1698725 - RNA, 16 nt, Human
caugggauaaaugcca

SEQ ID NO: 1698726 - RNA, 23 nt, Human
caugggauaaaugccaucaauaa

SEQ ID NO: 1698727 - RNA, 18 nt, Human
caugggauaaaugccauc

SEQ ID NO: 1698728 - RNA, 23 nt, Human
caugggacagggaggacgcucuc

SEQ ID NO: 1698729 - RNA, 20 nt, Human
cauggaauuggagcucgugg

SEQ ID NO: 1698730 - RNA, 22 nt, Human
cauuuggaaaucuuuaaaaaaa

SEQ ID NO: 1698731 - RNA, 11 nt, Human
cauuuggaaau

SEQ ID NO: 1698732 - RNA, 18 nt, Human
cauuuggaaaucuuuaaa

SEQ ID NO: 1698733 - RNA, 17 nt, Human
cauuuggaaaucuuuaa

SEQ ID NO: 1698734 - RNA, 14 nt, Human
cauuaauaauaaau

SEQ ID NO: 1698735 - RNA, 22 nt, Human
cauuauucaaaguugccuaaau

SEQ ID NO: 1698736 - RNA, 21 nt, Human
cauuauucaaaguugccuaaa

SEQ ID NO: 1698737 - RNA, 18 nt, Human
cauuauucaaaguugccu

SEQ ID NO: 1698738 - RNA, 17 nt, Human
cauuauuuuauuaugaa

SEQ ID NO: 1698739 - RNA, 22 nt, Human
cauuccaacuaucucauuucca

SEQ ID NO: 1698740 - RNA, 13 nt, Human
cauucuggaauaa

SEQ ID NO: 1698741 - RNA, 13 nt, Human
ccaugggauaaau

SEQ ID NO: 1698742 - RNA, 19 nt, Human
ccaugggacagggaggacg

SEQ ID NO: 1698743 - RNA, 16 nt, Human
ccaugggacagggagg

SEQ ID NO: 1698744 - RNA, 17 nt, Human
ccaugggauaaaugcca

SEQ ID NO: 1698745 - RNA, 22 nt, Human
ccauuauucaaaguugccuaaa

SEQ ID NO: 1698746 - RNA, 17 nt, Human
ccauuauucaaaguugc

SEQ ID NO: 1698747 - RNA, 20 nt, Human
ccauguuuauuacaguauaa

SEQ ID NO: 1698748 - RNA, 13 nt, Human
ccauguuuauuac

SEQ ID NO: 1698749 - RNA, 14 nt, Human
ccauuauucaaagu

SEQ ID NO: 1698750 - RNA, 19 nt, Human
ccugcaaugaagucucuga

SEQ ID NO: 1698751 - RNA, 21 nt, Human
ccugcaaugaagucucugaag

SEQ ID NO: 1698752 - RNA, 21 nt, Human
ccugcacggugaauggcuuug

SEQ ID NO: 1698753 - RNA, 20 nt, Human
ccugcaaugaagucucugaa

SEQ ID NO: 1698754 - RNA, 20 nt, Human
ccugcacggugaauggcuuu

SEQ ID NO: 1698755 - RNA, 11 nt, Human
ccugagcccca

SEQ ID NO: 1698756 - RNA, 23 nt, Human
ccuggaaaucaggguuaguauug

SEQ ID NO: 1698757 - RNA, 12 nt, Human
ccuuaaaggaag

SEQ ID NO: 1698758 - RNA, 16 nt, Human
ccuucggccuccaucc

SEQ ID NO: 1698759 - RNA, 20 nt, Human
ccuugaaaacuuuaugcuaa

SEQ ID NO: 1698760 - RNA, 19 nt, Human
ccuuggggcugaugcaguu

SEQ ID NO: 1698761 - RNA, 14 nt, Human
ccuugaugaagaag

SEQ ID NO: 1698762 - RNA, 20 nt, Human
ccuucggccuccauccugag

SEQ ID NO: 1698763 - RNA, 19 nt, Human
ccuucggccuccauccuga

SEQ ID NO: 1698764 - RNA, 14 nt, Human
ccuucggccuccau

SEQ ID NO: 1698765 - RNA, 12 nt, Human
ccuucagccuga

SEQ ID NO: 1698766 - RNA, 14 nt, Human
ccgugcuaaggacu

SEQ ID NO: 1698767 - RNA, 16 nt, Human
ccgugcuaaggacuug

SEQ ID NO: 1698768 - RNA, 15 nt, Human
ccgugcuaaggacuu

SEQ ID NO: 1698769 - RNA, 16 nt, Human
ccgggcguggugguga

SEQ ID NO: 1698770 - RNA, 12 nt, Human
ccuaaauccauu

SEQ ID NO: 1698771 - RNA, 18 nt, Human
ccuaaauccauuuggaaa

SEQ ID NO: 1698772 - RNA, 17 nt, Human
ccuaaauccauuuggaa

SEQ ID NO: 1698773 - RNA, 14 nt, Human
cccugcuuucagau

SEQ ID NO: 1698774 - RNA, 17 nt, Human
cccugcuuucagauacu

SEQ ID NO: 1698775 - RNA, 15 nt, Human
cccgugggguuccuc

SEQ ID NO: 1698776 - RNA, 13 nt, Human
cccacaagaaaug

SEQ ID NO: 1698777 - RNA, 20 nt, Human
cccacaagaaaugaaagcag

SEQ ID NO: 1698778 - RNA, 23 nt, Human
cugucuugccuuuuucauuauuu

SEQ ID NO: 1698779 - RNA, 21 nt, Human
cugucuugccuuuuucauuau

SEQ ID NO: 1698780 - RNA, 12 nt, Human
cuguggugacuu

SEQ ID NO: 1698781 - RNA, 14 nt, Human
cuguggugacuuug

SEQ ID NO: 1698782 - RNA, 13 nt, Human
cuguggugacuuu

SEQ ID NO: 1698783 - RNA, 23 nt, Human
cuguggugacuuuggauaauaag

SEQ ID NO: 1698784 - RNA, 20 nt, Human
cuguggugacuuuggauaau

SEQ ID NO: 1698785 - RNA, 18 nt, Human
cuguggugacuuuggaua

SEQ ID NO: 1698786 - RNA, 17 nt, Human
cuguggugacuuuggau

SEQ ID NO: 1698787 - RNA, 15 nt, Human
cuguggugacuuugg

SEQ ID NO: 1698788 - RNA, 18 nt, Human
cugggcugaacacuccaa

SEQ ID NO: 1698789 - RNA, 14 nt, Human
cugggguuaucuga

SEQ ID NO: 1698790 - RNA, 17 nt, Human
cuggugugaacuaaacu

SEQ ID NO: 1698791 - RNA, 16 nt, Human
cuggugugaacuaaac

SEQ ID NO: 1698792 - RNA, 15 nt, Human
cugguguauguguga

SEQ ID NO: 1698793 - RNA, 22 nt, Human
cuucucagaaggcaaaugacuu

SEQ ID NO: 1698794 - RNA, 16 nt, Human
cuucucagaaggcaaa

SEQ ID NO: 1698795 - RNA, 20 nt, Human
cuucggccuccauccugagg

SEQ ID NO: 1698796 - RNA, 17 nt, Human
cuucagcaaaaauauuu

SEQ ID NO: 1698797 - RNA, 17 nt, Human
cuucaaauccuugaaga

SEQ ID NO: 1698798 - RNA, 23 nt, Human
cuucagcaaaaauauuuuaugau

SEQ ID NO: 1698799 - RNA, 20 nt, Human
cuucagcaaaaauauuuuau

SEQ ID NO: 1698800 - RNA, 15 nt, Human
cuucagccugaaaga

SEQ ID NO: 1698801 - RNA, 16 nt, Human
cuucagcgguuuauau

SEQ ID NO: 1698802 - RNA, 17 nt, Human
cuucauuaauaauaaau

SEQ ID NO: 1698803 - RNA, 16 nt, Human
cuucauuaauaauaaa

SEQ ID NO: 1698804 - RNA, 15 nt, Human
cuguuuuauaauuuu

SEQ ID NO: 1698805 - RNA, 14 nt, Human
cuguuuuauaauuu

SEQ ID NO: 1698806 - RNA, 12 nt, Human
cuuaaaaauggu

SEQ ID NO: 1698807 - RNA, 23 nt, Human
cuuaagaagacugcauuauauuu

SEQ ID NO: 1698808 - RNA, 17 nt, Human
cuuuaaaaaaaaaauug

SEQ ID NO: 1698809 - RNA, 14 nt, Human
cuuucauauuuuag

SEQ ID NO: 1698810 - RNA, 13 nt, Human
cuuuccacagaag

SEQ ID NO: 1698811 - RNA, 21 nt, Human
cuuuauuuucuauaauuuaaa

SEQ ID NO: 1698812 - RNA, 19 nt, Human
cuuguaaaggaauuuaaaa

SEQ ID NO: 1698813 - RNA, 14 nt, Human
cuuuucugauagag

SEQ ID NO: 1698814 - RNA, 11 nt, Human
cuuuucugaua

SEQ ID NO: 1698815 - RNA, 22 nt, Human
gaaaacaauaacgauaaaagac

SEQ ID NO: 1698816 - RNA, 12 nt, Human
gaaaauaucacu

SEQ ID NO: 1698817 - RNA, 19 nt, Human
gaaaaucuuauaauuuaaa

SEQ ID NO: 1698818 - RNA, 19 nt, Human
gaaaauaacgauaaaagac

SEQ ID NO: 1698819 - RNA, 20 nt, Human
gaaaaucuuauaauuuaaaa

SEQ ID NO: 1698820 - RNA, 14 nt, Human
gaaggcaaaugacu

SEQ ID NO: 1698821 - RNA, 20 nt, Human
gaagguucuggugugaacua

SEQ ID NO: 1698822 - RNA, 16 nt, Human
gaagguucugguguga

SEQ ID NO: 1698823 - RNA, 16 nt, Human
gaaggcaaaugacuuu

SEQ ID NO: 1698824 - RNA, 15 nt, Human
gaaggcaaaugacuu

SEQ ID NO: 1698825 - RNA, 21 nt, Human
gaagccuuggggcugaugcag

SEQ ID NO: 1698826 - RNA, 17 nt, Human
gaagacugcauuauauu

SEQ ID NO: 1698827 - RNA, 20 nt, Human
gaauaauccuaaacauauga

SEQ ID NO: 1698828 - RNA, 14 nt, Human
gaauacuuuauaaa

SEQ ID NO: 1698829 - RNA, 16 nt, Human
gaacgcguugaaauug

SEQ ID NO: 1698830 - RNA, 15 nt, Human
gaacgcguugaaauu

SEQ ID NO: 1698831 - RNA, 22 nt, Human
gaacuagaguuuagcuggaaaa

SEQ ID NO: 1698832 - RNA, 21 nt, Human
gaacuagaguuuagcuggaaa

SEQ ID NO: 1698833 - RNA, 22 nt, Human
gaacuuccagauccuggaaauc

SEQ ID NO: 1698834 - RNA, 14 nt, Human
gaacucccuuucaa

SEQ ID NO: 1698835 - RNA, 15 nt, Human
gaacucccuuucaac

SEQ ID NO: 1698836 - RNA, 21 nt, Human
gaacuuguaaaggaauuuaaa

SEQ ID NO: 1698837 - RNA, 21 nt, Human
gaagaagcaccaaucaugaau

SEQ ID NO: 1698838 - RNA, 19 nt, Human
gaaauacuguuugagguuu

SEQ ID NO: 1698839 - RNA, 15 nt, Human
gaaauacuguuugag

SEQ ID NO: 1698840 - RNA, 16 nt, Human
gaaauauuauguuaaa

SEQ ID NO: 1698841 - RNA, 13 nt, Human
gaaauauuauguu

SEQ ID NO: 1698842 - RNA, 21 nt, Human
cugauuugacauagucuggcu

SEQ ID NO: 1698843 - RNA, 23 nt, Human
cugauuugacauagucuggcugu

SEQ ID NO: 1698844 - RNA, 22 nt, Human
cugauuugacauagucuggcug

SEQ ID NO: 1698845 - RNA, 18 nt, Human
cugaguuugugcuggugu

SEQ ID NO: 1698846 - RNA, 13 nt, Human
cugaguuugugcu

SEQ ID NO: 1698847 - RNA, 21 nt, Human
cugaggcuccacuuggucugu

SEQ ID NO: 1698848 - RNA, 15 nt, Human
cugaggcuccacuug

SEQ ID NO: 1698849 - RNA, 23 nt, Human
cucuuugucuacaccauuaugug

SEQ ID NO: 1698850 - RNA, 14 nt, Human
cugaagaagauggu

SEQ ID NO: 1698851 - RNA, 23 nt, Human
cucugaagugaaacugcuuguuu

SEQ ID NO: 1698852 - RNA, 19 nt, Human
cucugaagugaaacugcuu

SEQ ID NO: 1698853 - RNA, 22 nt, Human
cucuggccuucggccuccaucc

SEQ ID NO: 1698854 - RNA, 21 nt, Human
cucuggccuucggccuccauc

SEQ ID NO: 1698855 - RNA, 19 nt, Human
cucuuaagaagacugcauu

SEQ ID NO: 1698856 - RNA, 20 nt, Human
cuccaauuaaggauuuuaug

SEQ ID NO: 1698857 - RNA, 17 nt, Human
cuccaauuaaggauuuu

SEQ ID NO: 1698858 - RNA, 22 nt, Human
cuccaauuaaggauuuuaugcu

SEQ ID NO: 1698859 - RNA, 21 nt, Human
cucauuuccaagcaaguauua

SEQ ID NO: 1698860 - RNA, 21 nt, Human
cuccaaacugacucuuaagaa

SEQ ID NO: 1698861 - RNA, 12 nt, Human
cuccauccugag

SEQ ID NO: 1698862 - RNA, 12 nt, Human
cucccuuucaac

SEQ ID NO: 1698863 - RNA, 13 nt, Human
cuccauccugagg

SEQ ID NO: 1698864 - RNA, 14 nt, Human
cuccauccugaggc

SEQ ID NO: 1698865 - RNA, 18 nt, Human
cuaugcugaguuugugcu

SEQ ID NO: 1698866 - RNA, 15 nt, Human
cuauauuuucauucu

SEQ ID NO: 1698867 - RNA, 19 nt, Human
cuauauuuucauucuccua

SEQ ID NO: 1698868 - RNA, 18 nt, Human
cuauauuguuugcuaagc

SEQ ID NO: 1698869 - RNA, 21 nt, Human
cuagugagcagucaggaaaga

SEQ ID NO: 1698870 - RNA, 20 nt, Human
cuagugaaacucguuaauuu

SEQ ID NO: 1698871 - RNA, 16 nt, Human
cuaguaauuggaaagg

SEQ ID NO: 1698872 - RNA, 13 nt, Human
cucagauuuuauu

SEQ ID NO: 1698873 - RNA, 18 nt, Human
cucagauuuuauuaugua

SEQ ID NO: 1698874 - RNA, 17 nt, Human
cucagauuuuauuaugu

SEQ ID NO: 1698875 - RNA, 15 nt, Human
cucagauuuuauuau

SEQ ID NO: 1698876 - RNA, 18 nt, Human
cuauuucuauauuuucau

SEQ ID NO: 1698877 - RNA, 16 nt, Human
cuauuucuauauuuuc

SEQ ID NO: 1698878 - RNA, 14 nt, Human
cuauuucuauauuu

SEQ ID NO: 1698879 - RNA, 22 nt, Human
gagccugcacggugaauggcuu

SEQ ID NO: 1698880 - RNA, 17 nt, Human
gagccugcacggugaau

SEQ ID NO: 1698881 - RNA, 23 nt, Human
gagccugcacggugaauggcuuu

SEQ ID NO: 1698882 - RNA, 12 nt, Human
gagcuacaaaug

SEQ ID NO: 1698883 - RNA, 13 nt, Human
gagcuacaaaugc

SEQ ID NO: 1698884 - RNA, 14 nt, Human
gagcuacaaaugca

SEQ ID NO: 1698885 - RNA, 14 nt, Human
gaggaauucuguau

SEQ ID NO: 1698886 - RNA, 17 nt, Human
gaggaauucuguauaga

SEQ ID NO: 1698887 - RNA, 16 nt, Human
gaggaauucuguauag

SEQ ID NO: 1698888 - RNA, 14 nt, Human
gauagaggaagccu

SEQ ID NO: 1698889 - RNA, 22 nt, Human
gauagaggaagccugauuaaag

SEQ ID NO: 1698890 - RNA, 21 nt, Human
gauagaggaagccugauuaaa

SEQ ID NO: 1698891 - RNA, 15 nt, Human
gauagaggaagccug

SEQ ID NO: 1698892 - RNA, 19 nt, Human
gagugaacaaauuuacaga

SEQ ID NO: 1698893 - RNA, 23 nt, Human
gagugaacaaauuuacagagaca

SEQ ID NO: 1698894 - RNA, 22 nt, Human
gagugaacaaauuuacagagac

SEQ ID NO: 1698895 - RNA, 21 nt, Human
gaguugaaaaucuuauaauuu

SEQ ID NO: 1698896 - RNA, 18 nt, Human
gaugcaguucugaagaag

SEQ ID NO: 1698897 - RNA, 13 nt, Human
gauugugccccug

SEQ ID NO: 1698898 - RNA, 19 nt, Human
gauguugaaaaaguucugc

SEQ ID NO: 1698899 - RNA, 16 nt, Human
gcagauuauucacuga

SEQ ID NO: 1698900 - RNA, 13 nt, Human
gcagauuauucac

SEQ ID NO: 1698901 - RNA, 18 nt, Human
gcagagguugcagugagc

SEQ ID NO: 1698902 - RNA, 23 nt, Human
gcagagguugcagugagccgaga

SEQ ID NO: 1698903 - RNA, 18 nt, Human
gcacagccucuuagaugc

SEQ ID NO: 1698904 - RNA, 15 nt, Human
gcacagccucuuaga

SEQ ID NO: 1698905 - RNA, 19 nt, Human
gccagauuuuccugaaaac

SEQ ID NO: 1698906 - RNA, 23 nt, Human
gccaugggacagggaggacgcuc

SEQ ID NO: 1698907 - RNA, 22 nt, Human
gccaugggacagggaggacgcu

SEQ ID NO: 1698908 - RNA, 21 nt, Human
gcugguguaugugugaaguga

SEQ ID NO: 1698909 - RNA, 22 nt, Human
gcuuuaaacauugguucuugua

SEQ ID NO: 1698910 - RNA, 23 nt, Human
gcuuguuuccuagcacacacuuu

SEQ ID NO: 1698911 - RNA, 15 nt, Human
gcuuguuuccuagca

SEQ ID NO: 1698912 - RNA, 20 nt, Human
gcuuuguauagaaccucuuu

SEQ ID NO: 1698913 - RNA, 14 nt, Human
gcuuuguauagaac

SEQ ID NO: 1698914 - RNA, 13 nt, Human
gcuuuguauagaa

SEQ ID NO: 1698915 - RNA, 12 nt, Human
gcuuuguauaga

SEQ ID NO: 1698916 - RNA, 19 nt, Human
gcuucuguuuuauaauuuu

SEQ ID NO: 1698917 - RNA, 23 nt, Human
gcuggaaaaguauguuagugcaa

SEQ ID NO: 1698918 - RNA, 21 nt, Human
gcuggaaaaguauguuagugc

SEQ ID NO: 1698919 - RNA, 21 nt, Human
gcugauuaaaccaaggcuaga

SEQ ID NO: 1698920 - RNA, 20 nt, Human
gccugagcgacagugagacu

SEQ ID NO: 1698921 - RNA, 17 nt, Human
gccugagcgacagugag

SEQ ID NO: 1698922 - RNA, 13 nt, Human
gcuagauguaugu

SEQ ID NO: 1698923 - RNA, 16 nt, Human
gcuagauguauguacu

SEQ ID NO: 1698924 - RNA, 14 nt, Human
gcuagauguaugua

SEQ ID NO: 1698925 - RNA, 15 nt, Human
ggcuuuguauagaac

SEQ ID NO: 1698926 - RNA, 14 nt, Human
gggaauugaggaca

SEQ ID NO: 1698927 - RNA, 21 nt, Human
gggacugaggggaggggagca

SEQ ID NO: 1698928 - RNA, 11 nt, Human
gggaggcagag

SEQ ID NO: 1698929 - RNA, 20 nt, Human
gggaggacgcucucuggccu

SEQ ID NO: 1698930 - RNA, 17 nt, Human
gggaggacgcucucugg

SEQ ID NO: 1698931 - RNA, 20 nt, Human
ggcuaguaucaaaagaaaga

SEQ ID NO: 1698932 - RNA, 16 nt, Human
ggcuccacuuggucug

SEQ ID NO: 1698933 - RNA, 13 nt, Human
ggauucuuaaagu

SEQ ID NO: 1698934 - RNA, 21 nt, Human
ggcagagguugcagugagccg

SEQ ID NO: 1698935 - RNA, 20 nt, Human
ggacauuugcucauggaauu

SEQ ID NO: 1698936 - RNA, 17 nt, Human
ggacauuugcucaugga

SEQ ID NO: 1698937 - RNA, 19 nt, Human
ggacgcucucuggccuucg

SEQ ID NO: 1698938 - RNA, 16 nt, Human
ggacgcucucuggccu

SEQ ID NO: 1698939 - RNA, 14 nt, Human
ggagaagaacugaa

SEQ ID NO: 1698940 - RNA, 11 nt, Human
ggagaagaacu

SEQ ID NO: 1698941 - RNA, 19 nt, Human
ggaggggagcaugggaagu

SEQ ID NO: 1698942 - RNA, 16 nt, Human
ggaggacgcucucugg

SEQ ID NO: 1698943 - RNA, 14 nt, Human
ucaucaguauugaa

SEQ ID NO: 1698944 - RNA, 16 nt, Human
ucauaccuacauguau

SEQ ID NO: 1698945 - RNA, 15 nt, Human
ucauaccuacaugua

SEQ ID NO: 1698946 - RNA, 23 nt, Human
ucauuauuuuauuaugaaacuug

SEQ ID NO: 1698947 - RNA, 16 nt, Human
ucauuuccaagcaagu

SEQ ID NO: 1698948 - RNA, 13 nt, Human
ucauuuccaagca

SEQ ID NO: 1698949 - RNA, 19 nt, Human
uccacagaagcuccaggua

SEQ ID NO: 1698950 - RNA, 16 nt, Human
uccacuuggucuguga

SEQ ID NO: 1698951 - RNA, 15 nt, Human
uccacuuggucugug

SEQ ID NO: 1698952 - RNA, 17 nt, Human
uccacuuggucugugag

SEQ ID NO: 1698953 - RNA, 17 nt, Human
ucaggcuagauguaugu

SEQ ID NO: 1698954 - RNA, 13 nt, Human
ucaggcuagaugu

SEQ ID NO: 1698955 - RNA, 13 nt, Human
uauuaagaaugaa

SEQ ID NO: 1698956 - RNA, 16 nt, Human
uauuaagaaugaaaua

SEQ ID NO: 1698957 - RNA, 12 nt, Human
uauguaaauccc

SEQ ID NO: 1698958 - RNA, 23 nt, Human
uauguaaaucccauuauucaaag

SEQ ID NO: 1698959 - RNA, 21 nt, Human
uauguaaaucccauuauucaa

SEQ ID NO: 1698960 - RNA, 20 nt, Human
uauguaaaucccauuauuca

SEQ ID NO: 1698961 - RNA, 19 nt, Human
uauguaaaucccauuauuc

SEQ ID NO: 1698962 - RNA, 15 nt, Human
uauguaaaucccauu

SEQ ID NO: 1698963 - RNA, 17 nt, Human
uauguacuucaugcugu

SEQ ID NO: 1698964 - RNA, 13 nt, Human
uauguacuucaug

SEQ ID NO: 1698965 - RNA, 14 nt, Human
uauuacaguauaau

SEQ ID NO: 1698966 - RNA, 13 nt, Human
uauuacaguauaa

SEQ ID NO: 1698967 - RNA, 12 nt, Human
uauuacaguaua

SEQ ID NO: 1698968 - RNA, 23 nt, Human
ucacaccccagacgaugucuuca

SEQ ID NO: 1698969 - RNA, 18 nt, Human
ucacaagacccaaaaggc

SEQ ID NO: 1698970 - RNA, 17 nt, Human
ucacaagacccaaaagg

SEQ ID NO: 1698971 - RNA, 13 nt, Human
ucacaagacccaa

SEQ ID NO: 1698972 - RNA, 16 nt, Human
ucacagucacauucca

SEQ ID NO: 1698973 - RNA, 14 nt, Human
ucaccaaggcugau

SEQ ID NO: 1698974 - RNA, 21 nt, Human
ucaauaaaauccauacauuug

SEQ ID NO: 1698975 - RNA, 15 nt, Human
uauuuucauucuccu

SEQ ID NO: 1698976 - RNA, 17 nt, Human
uauuuauaaucacuuuu

SEQ ID NO: 1698977 - RNA, 13 nt, Human
uauuuuauuauga

SEQ ID NO: 1698978 - RNA, 23 nt, Human
uauuuuauuaugaaacuugugua

SEQ ID NO: 1698979 - RNA, 18 nt, Human
uauuuuauuaugaaacuu

SEQ ID NO: 1698980 - RNA, 14 nt, Human
uauuuuuuuucugu

SEQ ID NO: 1698981 - RNA, 14 nt, Human
ucaaauugugugaa

SEQ ID NO: 1698982 - RNA, 15 nt, Human
ucaaauccuugaaga

SEQ ID NO: 1698983 - RNA, 21 nt, Human
ucuucauaccuacauguauuu

SEQ ID NO: 1698984 - RNA, 18 nt, Human
ucuucauaccuacaugua

SEQ ID NO: 1698985 - RNA, 23 nt, Human
ucuucagcaaaaauauuuuauga

SEQ ID NO: 1698986 - RNA, 22 nt, Human
ucuucagcaaaaauauuuuaug

SEQ ID NO: 1698987 - RNA, 21 nt, Human
ucuucagcaaaaauauuuuau

SEQ ID NO: 1698988 - RNA, 12 nt, Human
ucuuaaaguuga

SEQ ID NO: 1698989 - RNA, 14 nt, Human
ucuuaaaguugaau

SEQ ID NO: 1698990 - RNA, 13 nt, Human
ucuuaaaguugaa

SEQ ID NO: 1698991 - RNA, 19 nt, Human
ucuuaaauaauaaagauca

SEQ ID NO: 1698992 - RNA, 15 nt, Human
ucuuaaauaauaaag

SEQ ID NO: 1698993 - RNA, 22 nt, Human
ucuuaaaguugaauuuauuggc

SEQ ID NO: 1698994 - RNA, 21 nt, Human
ucuuaaaguugaauuuauugg

SEQ ID NO: 1698995 - RNA, 20 nt, Human
ucuuaaaguugaauuuauug

SEQ ID NO: 1698996 - RNA, 19 nt, Human
ucuuaaaguugaauuuauu

SEQ ID NO: 1698997 - RNA, 16 nt, Human
ucuuaaaguugaauuu

SEQ ID NO: 1698998 - RNA, 18 nt, Human
ucuuaagaagacugcauu

SEQ ID NO: 1698999 - RNA, 12 nt, Human
ucuuaagaagac

SEQ ID NO: 1699000 - RNA, 23 nt, Human
ucuggccuucggccuccauccug

SEQ ID NO: 1699001 - RNA, 18 nt, Human
ucuggccuucggccucca

SEQ ID NO: 1699002 - RNA, 17 nt, Human
ucuggccuucggccucc

SEQ ID NO: 1699003 - RNA, 14 nt, Human
ucugaggaauucug

SEQ ID NO: 1699004 - RNA, 19 nt, Human
ucugaggaauucuguauag

SEQ ID NO: 1699005 - RNA, 18 nt, Human
ucugaggaauucuguaua

SEQ ID NO: 1699006 - RNA, 17 nt, Human
ucugaggaauucuguau

SEQ ID NO: 1699007 - RNA, 16 nt, Human
ucugaggaauucugua

SEQ ID NO: 1699008 - RNA, 15 nt, Human
ucugaggaauucugu

SEQ ID NO: 1699009 - RNA, 15 nt, Human
ucugacaucucugca

SEQ ID NO: 1699010 - RNA, 14 nt, Human
ucugacaucucugc

SEQ ID NO: 1699011 - RNA, 12 nt, Human
ucugacaucucu

SEQ ID NO: 1699012 - RNA, 16 nt, Human
ucucugaagugaaacu

SEQ ID NO: 1699013 - RNA, 16 nt, Human
ucuaugcugaguuugu

SEQ ID NO: 1699014 - RNA, 20 nt, Human
ucuaugcugaguuugugcug

SEQ ID NO: 1699015 - RNA, 15 nt, Human
ucucaacuccaaacu

SEQ ID NO: 1699016 - RNA, 17 nt, Human
ucuaugaaauauuaugu

SEQ ID NO: 1699017 - RNA, 14 nt, Human
ucuaugaaauauua

SEQ ID NO: 1699018 - RNA, 13 nt, Human
ucuaugaaauauu

SEQ ID NO: 1699019 - RNA, 19 nt, Human
ucuagugagcagucaggaa

SEQ ID NO: 1699020 - RNA, 22 nt, Human
ucuagugagcagucaggaaaga

SEQ ID NO: 1699021 - RNA, 22 nt, Human
ucgugggacagucaccucaugg

SEQ ID NO: 1699022 - RNA, 21 nt, Human
ucguggaacaguuaccucugc

SEQ ID NO: 1699023 - RNA, 18 nt, Human
ucggccuccauccugagg

SEQ ID NO: 1699024 - RNA, 13 nt, Human
ucguuaauuugua

SEQ ID NO: 1699025 - RNA, 20 nt, Human
uccugccuaagugcagcccc

SEQ ID NO: 1699026 - RNA, 11 nt, Human
ucccuggccuu

SEQ ID NO: 1699027 - RNA, 15 nt, Human
ucccuggccuuucau

SEQ ID NO: 1699028 - RNA, 16 nt, Human
ucccuugaugaagaag

SEQ ID NO: 1699029 - RNA, 15 nt, Human
ucccuugaugaagaa

SEQ ID NO: 1699030 - RNA, 21 nt, Human
uguacaaaguauuaagcauau

SEQ ID NO: 1699031 - RNA, 15 nt, Human
uguacaaaguauuaa

SEQ ID NO: 1699032 - RNA, 20 nt, Human
uguacaaaguauuaagcaua

SEQ ID NO: 1699033 - RNA, 19 nt, Human
uguacaaaguauuaagcau

SEQ ID NO: 1699034 - RNA, 18 nt, Human
uguacaaaguauuaagca

SEQ ID NO: 1699035 - RNA, 17 nt, Human
uguacaaaguauuaagc

SEQ ID NO: 1699036 - RNA, 18 nt, Human
ugguugcuuuaauaucau

SEQ ID NO: 1699037 - RNA, 14 nt, Human
ugguugcuuuaaua

SEQ ID NO: 1699038 - RNA, 12 nt, Human
uguaaaauggug

SEQ ID NO: 1699039 - RNA, 11 nt, Human
uguaaaauggu

SEQ ID NO: 1699040 - RNA, 15 nt, Human
uggugacuuuggaua

SEQ ID NO: 1699041 - RNA, 14 nt, Human
uggguagacacaca

SEQ ID NO: 1699042 - RNA, 23 nt, Human
uggugacuuuggauaauaaggaa

SEQ ID NO: 1699043 - RNA, 19 nt, Human
uggugacuuuggauaauaa

SEQ ID NO: 1699044 - RNA, 18 nt, Human
uggugacuuuggauaaua

SEQ ID NO: 1699045 - RNA, 16 nt, Human
uggugacuuuggauaa

SEQ ID NO: 1699046 - RNA, 18 nt, Human
ugguucuuguauuaagaa

SEQ ID NO: 1699047 - RNA, 14 nt, Human
ugguucuuguauua

SEQ ID NO: 1699048 - RNA, 19 nt, Human
ugguucuuguauuaagaau

SEQ ID NO: 1699049 - RNA, 20 nt, Human
ugguucccuugaugaagaag

SEQ ID NO: 1699050 - RNA, 17 nt, Human
ugguucccuugaugaag

SEQ ID NO: 1699051 - RNA, 16 nt, Human
ugguucccuugaugaa

SEQ ID NO: 1699052 - RNA, 23 nt, Human
uguauagauuagagaguguugaa

SEQ ID NO: 1699053 - RNA, 21 nt, Human
uguauagauuagaauucugua

SEQ ID NO: 1699054 - RNA, 15 nt, Human
uguauagauuagaau

SEQ ID NO: 1699055 - RNA, 23 nt, Human
uguauagaaccucuuugucuaca

SEQ ID NO: 1699056 - RNA, 13 nt, Human
uguauaaaauaau

SEQ ID NO: 1699057 - RNA, 14 nt, Human
uguauaaaauaauu

SEQ ID NO: 1699058 - RNA, 19 nt, Human
uguaguguuggagaagaac

SEQ ID NO: 1699059 - RNA, 21 nt, Human
uguaguguuggagaagaacug

SEQ ID NO: 1699060 - RNA, 20 nt, Human
uguaguguuggagaagaacu

SEQ ID NO: 1699061 - RNA, 15 nt, Human
uguauuuguuugcau

SEQ ID NO: 1699062 - RNA, 19 nt, Human
uguauuuuaaaagaaugau

SEQ ID NO: 1699063 - RNA, 18 nt, Human
uguauuuuaaaagaauga

SEQ ID NO: 1699064 - RNA, 22 nt, Human
ugucucagauuuuauuauguaa

SEQ ID NO: 1699065 - RNA, 20 nt, Human
ugucucagauuuuauuaugu

SEQ ID NO: 1699066 - RNA, 16 nt, Human
ugucucagauuuuauu

SEQ ID NO: 1699067 - RNA, 18 nt, Human
ugucuacaccauuaugug

SEQ ID NO: 1699068 - RNA, 22 nt, Human
ugucuacacuaagagagaauga

SEQ ID NO: 1699069 - RNA, 17 nt, Human
ugucuacaccauuaugu

SEQ ID NO: 1699070 - RNA, 17 nt, Human
ugucuacacuaagagag

SEQ ID NO: 1699071 - RNA, 17 nt, Human
uggaacgcguugaaauu

SEQ ID NO: 1699072 - RNA, 16 nt, Human
uggaacgcguugaaau

SEQ ID NO: 1699073 - RNA, 15 nt, Human
uggaacgcguugaaa

SEQ ID NO: 1699074 - RNA, 14 nt, Human
uggaacgcguugaa

SEQ ID NO: 1699075 - RNA, 22 nt, Human
uggaaaaguauguuagugcaaa

SEQ ID NO: 1699076 - RNA, 22 nt, Human
ugcuucuguuuuauaauuuugu

SEQ ID NO: 1699077 - RNA, 17 nt, Human
ugcuucuguuuuauaau

SEQ ID NO: 1699078 - RNA, 15 nt, Human
uggaccaaaaaccag

SEQ ID NO: 1699079 - RNA, 13 nt, Human
uggcuuuucugau

SEQ ID NO: 1699080 - RNA, 22 nt, Human
uggccuucggccuccauccuga

SEQ ID NO: 1699081 - RNA, 23 nt, Human
uggccuucggccuccauccugag

SEQ ID NO: 1699082 - RNA, 12 nt, Human
ugggauaaaugc

SEQ ID NO: 1699083 - RNA, 14 nt, Human
ugggauaaaugcca

SEQ ID NO: 1699084 - RNA, 13 nt, Human
ugggauaaaugcc

SEQ ID NO: 1699085 - RNA, 14 nt, Human
ugggacagggagga

SEQ ID NO: 1699086 - RNA, 23 nt, Human
ugggguuaucugaagucagaucu

SEQ ID NO: 1699087 - RNA, 21 nt, Human
ugaugccaaguuguuugagaa

SEQ ID NO: 1699088 - RNA, 15 nt, Human
ugaugccaaguuguu

SEQ ID NO: 1699089 - RNA, 19 nt, Human
ugaugccaaguuguuugag

SEQ ID NO: 1699090 - RNA, 24 nt, Human
ugauaguuguaccgcaaugugacu

SEQ ID NO: 1699091 - RNA, 17 nt, Human
ugacugauucuucagca

SEQ ID NO: 1699092 - RNA, 16 nt, Human
ugacugauucuucagc

SEQ ID NO: 1699093 - RNA, 15 nt, Human
ugacugauucuucag

SEQ ID NO: 1699094 - RNA, 14 nt, Human
ugacugauucuuca

SEQ ID NO: 1699095 - RNA, 13 nt, Human
ugacugauucuuc

SEQ ID NO: 1699096 - RNA, 12 nt, Human
ugacucuuaaga

SEQ ID NO: 1699097 - RNA, 13 nt, Human
ugagaaauuaagu

SEQ ID NO: 1699098 - RNA, 14 nt, Human
ugagaaauuaagua

SEQ ID NO: 1699099 - RNA, 16 nt, Human
ugagacagcucugcau

SEQ ID NO: 1699100 - RNA, 14 nt, Human
ugagacagcucugc

SEQ ID NO: 1699101 - RNA, 16 nt, Human
ugagcaucacaguuuu

SEQ ID NO: 1699102 - RNA, 17 nt, Human
ugagcaucacaguuuug

SEQ ID NO: 1699103 - RNA, 13 nt, Human
ugagccccaaaag

SEQ ID NO: 1699104 - RNA, 20 nt, Human
ugagaugcuagaacucccuu

SEQ ID NO: 1699105 - RNA, 16 nt, Human
ugagaugcuagaacuc

SEQ ID NO: 1699106 - RNA, 14 nt, Human
ugagaugcuagaac

SEQ ID NO: 1699107 - RNA, 20 nt, Human
ugagcagucaggaaagagaa

SEQ ID NO: 1699108 - RNA, 15 nt, Human
ugagcagucaggaaa

SEQ ID NO: 1699109 - RNA, 17 nt, Human
ugagcagucaggaaaga

SEQ ID NO: 1699110 - RNA, 22 nt, Human
ugcaaugaagucucugaaguga

SEQ ID NO: 1699111 - RNA, 18 nt, Human
ugcaaugaagucucugaa

SEQ ID NO: 1699112 - RNA, 15 nt, Human
ugcaaugaagucucu

SEQ ID NO: 1699113 - RNA, 17 nt, Human
ugcccugcuuucagaua

SEQ ID NO: 1699114 - RNA, 16 nt, Human
ugcccugcuuucagau

SEQ ID NO: 1699115 - RNA, 12 nt, Human
ugcccugcuuuc

SEQ ID NO: 1699116 - RNA, 21 nt, Human
ugccuaaggacuucuuuaauu

SEQ ID NO: 1699117 - RNA, 13 nt, Human
ugccuaaggacuu

SEQ ID NO: 1699118 - RNA, 12 nt, Human
ugccuaaggacu

SEQ ID NO: 1699119 - RNA, 20 nt, Human
ugccuaaggacuucuuuaau

SEQ ID NO: 1699120 - RNA, 16 nt, Human
ugccuaaggacuucuu

SEQ ID NO: 1699121 - RNA, 15 nt, Human
ugccuaaggacuucu

SEQ ID NO: 1699122 - RNA, 14 nt, Human
ugccuaaggacuuc

SEQ ID NO: 1699123 - RNA, 14 nt, Human
ugcauuauauuuau

SEQ ID NO: 1699124 - RNA, 19 nt, Human
ugcagauaaacaguaguga

SEQ ID NO: 1699125 - RNA, 13 nt, Human
uuuuauauuuacu

SEQ ID NO: 1699126 - RNA, 18 nt, Human
uuuuauauuugaaauauu

SEQ ID NO: 1699127 - RNA, 13 nt, Human
uuuuauauuugaa

SEQ ID NO: 1699128 - RNA, 21 nt, Human
uuuuaugacuucauuaauaau

SEQ ID NO: 1699129 - RNA, 20 nt, Human
uuuuaugacuucauuaauaa

SEQ ID NO: 1699130 - RNA, 21 nt, Human
uuuuauaauuuugugaagcaa

SEQ ID NO: 1699131 - RNA, 23 nt, Human
uuuuauaauuuugugaagcaaaa

SEQ ID NO: 1699132 - RNA, 21 nt, Human
uuuuaaaguaacccuacaaaa

SEQ ID NO: 1699133 - RNA, 20 nt, Human
uuuccacauaaggaaacugg

SEQ ID NO: 1699134 - RNA, 23 nt, Human
uuuccacauaaggaaacuggguu

SEQ ID NO: 1699135 - RNA, 15 nt, Human
uuuccacagaagcuc

SEQ ID NO: 1699136 - RNA, 22 nt, Human
uuuggaccaaaaaccaguauug

SEQ ID NO: 1699137 - RNA, 21 nt, Human
uuuggaccaaaaaccaguauu

SEQ ID NO: 1699138 - RNA, 18 nt, Human
uuuggaccaaaaaccagu

SEQ ID NO: 1699139 - RNA, 15 nt, Human
uuuggaaaucuuuaa

SEQ ID NO: 1699140 - RNA, 24 nt, Human
uuuggaccaaaaaccaguauugua

SEQ ID NO: 1699141 - RNA, 17 nt, Human
uuuguauaaaauaauuu

SEQ ID NO: 1699142 - RNA, 19 nt, Human
uuuguauaaaauaauuuuu

SEQ ID NO: 1699143 - RNA, 18 nt, Human
uuuguauaaaauaauuuu

SEQ ID NO: 1699144 - RNA, 21 nt, Human
uuuuuccacauaaggaaacug

SEQ ID NO: 1699145 - RNA, 22 nt, Human
uuuuucauuauuuuauuaugaa

SEQ ID NO: 1699146 - RNA, 13 nt, Human
uuuuucauuauuu

SEQ ID NO: 1699147 - RNA, 23 nt, Human
uugugcgcuaaacuuuucugaua

SEQ ID NO: 1699148 - RNA, 22 nt, Human
uugugcgcuaaacuuuucugau

SEQ ID NO: 1699149 - RNA, 19 nt, Human
uugugcugggguuaucuga

SEQ ID NO: 1699150 - RNA, 12 nt, Human
uugugccccugc

SEQ ID NO: 1699151 - RNA, 21 nt, Human
uuguuugagaaauuaaguauc

SEQ ID NO: 1699152 - RNA, 15 nt, Human
uuguuugagaaauua

SEQ ID NO: 1699153 - RNA, 17 nt, Human
uuguuguuuguuuaguc

SEQ ID NO: 1699154 - RNA, 17 nt, Human
uuguuagaucuaguuca

SEQ ID NO: 1699155 - RNA, 18 nt, Human
uuguguuuugcaagccag

SEQ ID NO: 1699156 - RNA, 14 nt, Human
uuguacucaauuuu

SEQ ID NO: 1699157 - RNA, 15 nt, Human
uuguacucaauuuua

SEQ ID NO: 1699158 - RNA, 18 nt, Human
uuguauuaagaaugaaau

SEQ ID NO: 1699159 - RNA, 13 nt, Human
uuguauuaagaau

SEQ ID NO: 1699160 - RNA, 12 nt, Human
uuguauuaagaa

SEQ ID NO: 1699161 - RNA, 14 nt, Human
uuguauuacaaauc

SEQ ID NO: 1699162 - RNA, 19 nt, Human
uugucuacaccauuaugug

SEQ ID NO: 1699163 - RNA, 20 nt, Human
uugucuacaccauuaugugc

SEQ ID NO: 1699164 - RNA, 15 nt, Human
uugucuagugaaacu

SEQ ID NO: 1699165 - RNA, 13 nt, Human
uugucucagauuu

SEQ ID NO: 1699166 - RNA, 20 nt, Human
uugucucagauuuuauuaug

SEQ ID NO: 1699167 - RNA, 16 nt, Human
uugucucagauuuuau

SEQ ID NO: 1699168 - RNA, 22 nt, Human
uugucucagauuuuauuaugua

SEQ ID NO: 1699169 - RNA, 16 nt, Human
uuggguguauugugcg

SEQ ID NO: 1699170 - RNA, 15 nt, Human
uuggguguauugugc

SEQ ID NO: 1699171 - RNA, 13 nt, Human
uuggguguauugu

SEQ ID NO: 1699172 - RNA, 16 nt, Human
uuggucugugagaugc

SEQ ID NO: 1699173 - RNA, 21 nt, Human
uuguuuggaccaaaaaccagu

SEQ ID NO: 1699174 - RNA, 16 nt, Human
uuuaacaacagcuggu

SEQ ID NO: 1699175 - RNA, 19 nt, Human
uuuaacucuauaauguguu

SEQ ID NO: 1699176 - RNA, 13 nt, Human
uuuaauaauguuu

SEQ ID NO: 1699177 - RNA, 18 nt, Human
uuuaauaauuauaugcua

SEQ ID NO: 1699178 - RNA, 21 nt, Human
uuuaauaauuauaugcuauuu

SEQ ID NO: 1699179 - RNA, 13 nt, Human
uuuaccacuugug

SEQ ID NO: 1699180 - RNA, 14 nt, Human
uuuauuauguaaau

SEQ ID NO: 1699181 - RNA, 17 nt, Human
uuuauuauguaaauccc

SEQ ID NO: 1699182 - RNA, 16 nt, Human
uuuauuauguaaaucc

SEQ ID NO: 1699183 - RNA, 22 nt, Human
uuuauaauuuugugaagcaaaa

SEQ ID NO: 1699184 - RNA, 21 nt, Human
uuucagauacuggauuguacu

SEQ ID NO: 1699185 - RNA, 13 nt, Human
uuucagauacugg

SEQ ID NO: 1699186 - RNA, 21 nt, Human
uuccugcaaugaagucucuga

SEQ ID NO: 1699187 - RNA, 13 nt, Human
uuccugcaaugaa

SEQ ID NO: 1699188 - RNA, 18 nt, Human
uucggugagcuacaaaug

SEQ ID NO: 1699189 - RNA, 21 nt, Human
uucugauagaggaagccugau

SEQ ID NO: 1699190 - RNA, 13 nt, Human
uucugauagagga

SEQ ID NO: 1699191 - RNA, 21 nt, Human
uucuaugaaauauuauguuaa

SEQ ID NO: 1699192 - RNA, 14 nt, Human
uucuaugaaauauu

SEQ ID NO: 1699193 - RNA, 22 nt, Human
uugaauuuauuggcuuuucuga

SEQ ID NO: 1699194 - RNA, 18 nt, Human
uugaauuuauuggcuuuu

SEQ ID NO: 1699195 - RNA, 15 nt, Human
uugaauuuauuggcu

SEQ ID NO: 1699196 - RNA, 21 nt, Human
uugaauuuuguguuagagauu

SEQ ID NO: 1699197 - RNA, 17 nt, Human
uugaauuuuguguuaga

SEQ ID NO: 1699198 - RNA, 17 nt, Human
uugacccacaagaaaug

SEQ ID NO: 1699199 - RNA, 23 nt, Human
uugaugaagaaguugauaugccu

SEQ ID NO: 1699200 - RNA, 14 nt, Human
uugaugaagaaguu

SEQ ID NO: 1699201 - RNA, 13 nt, Human
uugaugaagaagu

SEQ ID NO: 1699202 - RNA, 20 nt, Human
uuauuuuauuaugaaacuug

SEQ ID NO: 1699203 - RNA, 14 nt, Human
uuauuuuauuauga

SEQ ID NO: 1699204 - RNA, 20 nt, Human
uuauuuuaauaauguuucaa

SEQ ID NO: 1699205 - RNA, 16 nt, Human
uuauuuuauuaugaaa

SEQ ID NO: 1699206 - RNA, 15 nt, Human
uuauuuuauuaugaa

SEQ ID NO: 1699207 - RNA, 19 nt, Human
uuauuuuaauaauguuuca

SEQ ID NO: 1699208 - RNA, 20 nt, Human
uucagauacuggauuguacu

SEQ ID NO: 1699209 - RNA, 16 nt, Human
uucagauacuggauug

SEQ ID NO: 1699210 - RNA, 22 nt, Human
uucacaagacccaaaaggcaga

SEQ ID NO: 1699211 - RNA, 18 nt, Human
uuccagauccuggaaauc

SEQ ID NO: 1699212 - RNA, 23 nt, Human
uucaguuauuauauuuacaaaug

SEQ ID NO: 1699213 - RNA, 16 nt, Human
uuauaugcuauuucua

SEQ ID NO: 1699214 - RNA, 18 nt, Human
uuauaugcuauuucuaua

SEQ ID NO: 1699215 - RNA, 23 nt, Human
uuauaucugaggaauucuguaua

SEQ ID NO: 1699216 - RNA, 22 nt, Human
uuauaucugaggaauucuguau

SEQ ID NO: 1699217 - RNA, 14 nt, Human
uuauaucugaggaa

SEQ ID NO: 1699218 - RNA, 21 nt, Human
uuauaucugaggaauucugua

SEQ ID NO: 1699219 - RNA, 20 nt, Human
uuauaucugaggaauucugu

SEQ ID NO: 1699220 - RNA, 18 nt, Human
uuauaauuuugugaagca

SEQ ID NO: 1699221 - RNA, 17 nt, Human
uuauaauuuugugaagc

SEQ ID NO: 1699222 - RNA, 16 nt, Human
uuauaauuuugugaag

SEQ ID NO: 1699223 - RNA, 13 nt, Human
uuauaaucacuuu

SEQ ID NO: 1699224 - RNA, 11 nt, Human
uuauaaucuuu

SEQ ID NO: 1699225 - RNA, 15 nt, Human
uuauaauuuugugaa

SEQ ID NO: 1699226 - RNA, 14 nt, Human
uuauaauuuuguga

SEQ ID NO: 1699227 - RNA, 12 nt, Human
uuauaauuuaaa

SEQ ID NO: 1699228 - RNA, 16 nt, Human
uuauuacaguauaauu

SEQ ID NO: 1699229 - RNA, 15 nt, Human
uuauauuugaaauau

SEQ ID NO: 1699230 - RNA, 13 nt, Human
uuauauuugaaau

SEQ ID NO: 1699231 - RNA, 12 nt, Human
uuauauuugaaa

SEQ ID NO: 1699232 - RNA, 20 nt, Human
uuauauuuauuacuguaaga

SEQ ID NO: 1699233 - RNA, 16 nt, Human
uuauauuuacaaaugg

SEQ ID NO: 1699234 - RNA, 20 nt, Human
cacauugguguuguacucaa

SEQ ID NO: 1699235 - RNA, 15 nt, Human
cacaggaaguagagg

SEQ ID NO: 1699236 - RNA, 20 nt, Human
cacaggaaccacaagacugc

SEQ ID NO: 1699237 - RNA, 19 nt, Human
cacaggaaccacaagacug

SEQ ID NO: 1699238 - RNA, 22 nt, Human
caauuaaggauuuuaugcuuua

SEQ ID NO: 1699239 - RNA, 21 nt, Human
caauuaaggauuuuaugcuuu

SEQ ID NO: 1699240 - RNA, 20 nt, Human
caauuaaggauuuuaugcuu

SEQ ID NO: 1699241 - RNA, 15 nt, Human
caauuaaggauuuua

SEQ ID NO: 1699242 - RNA, 13 nt, Human
caauuaaggauuu

SEQ ID NO: 1699243 - RNA, 22 nt, Human
caaugaaugaaugaauggcuaa

SEQ ID NO: 1699244 - RNA, 13 nt, Human
cacaacuauauug

SEQ ID NO: 1699245 - RNA, 19 nt, Human
caaaguugccuaaauccau

SEQ ID NO: 1699246 - RNA, 21 nt, Human
caaauguucaucaaugaauga

SEQ ID NO: 1699247 - RNA, 15 nt, Human
caaauuuacagagac

SEQ ID NO: 1699248 - RNA, 16 nt, Human
caaauuuacagagaca

SEQ ID NO: 1699249 - RNA, 14 nt, Human
caaauuuacagaga

SEQ ID NO: 1699250 - RNA, 17 nt, Human
caagcacuaaacaaaga

SEQ ID NO: 1699251 - RNA, 15 nt, Human
cacccacccuuuuuu

SEQ ID NO: 1699252 - RNA, 20 nt, Human
aaaaaccaguauuguacaaa

SEQ ID NO: 1699253 - RNA, 18 nt, Human
aaaaaauuggggauucuu

SEQ ID NO: 1699254 - RNA, 14 nt, Human
acuggugacugauu

SEQ ID NO: 1699255 - RNA, 22 nt, Human
acuguaagaaaauaucacuugu

SEQ ID NO: 1699256 - RNA, 13 nt, Human
acuguaagaaaau

SEQ ID NO: 1699257 - RNA, 19 nt, Human
acuguaagaaaauaucacu

SEQ ID NO: 1699258 - RNA, 18 nt, Human
acucugucucaguccaug

SEQ ID NO: 1699259 - RNA, 20 nt, Human
acucugucucaguccaugaa

SEQ ID NO: 1699260 - RNA, 18 nt, Human
acuguuugagguuuuuaa

SEQ ID NO: 1699261 - RNA, 23 nt, Human
acuguuugagguuuuuaagccuu

SEQ ID NO: 1699262 - RNA, 12 nt, Human
acuucagacaua

SEQ ID NO: 1699263 - RNA, 18 nt, Human
acuuguaaaggaauuuaa

SEQ ID NO: 1699264 - RNA, 22 nt, Human
acuuuauuuucuauaauuuaaa

SEQ ID NO: 1699265 - RNA, 16 nt, Human
agaaaaucaggcuggc

SEQ ID NO: 1699266 - RNA, 20 nt, Human
acuaguauuucuaugaaaua

SEQ ID NO: 1699267 - RNA, 17 nt, Human
acucuauguucuaagaa

SEQ ID NO: 1699268 - RNA, 15 nt, Human
acuaagagagaauga

SEQ ID NO: 1699269 - RNA, 13 nt, Human
acuaagagagaau

SEQ ID NO: 1699270 - RNA, 15 nt, Human
aauuuuguuucugua

SEQ ID NO: 1699271 - RNA, 14 nt, Human
aauuuuguuucugu

SEQ ID NO: 1699272 - RNA, 13 nt, Human
acaagaaaugaaa

SEQ ID NO: 1699273 - RNA, 13 nt, Human
aauuuuguuucug

SEQ ID NO: 1699274 - RNA, 13 nt, Human
aauuuugugaagc

SEQ ID NO: 1699275 - RNA, 17 nt, Human
acccacaagaaaugaaa

SEQ ID NO: 1699276 - RNA, 21 nt, Human
acccacaagaaaugaaagcag

SEQ ID NO: 1699277 - RNA, 15 nt, Human
aaaccaugggauaaa

SEQ ID NO: 1699278 - RNA, 20 nt, Human
aaaccaugggauaaaugcca

SEQ ID NO: 1699279 - RNA, 21 nt, Human
aaaaucuacacuccagugaga

SEQ ID NO: 1699280 - RNA, 18 nt, Human
aaaaguucugcagauaaa

SEQ ID NO: 1699281 - RNA, 16 nt, Human
aaaaagaaacauuugg

SEQ ID NO: 1699282 - RNA, 16 nt, Human
aaaaucucaauauuuc

SEQ ID NO: 1699283 - RNA, 10 nt, Human
aaauaaauaa

SEQ ID NO: 1699284 - RNA, 14 nt, Human
aaaggcagaagcaa

SEQ ID NO: 1699285 - RNA, 18 nt, Human
aaaucugugaacuugaaa

SEQ ID NO: 1699286 - RNA, 16 nt, Human
aaaucugugaacuuga

SEQ ID NO: 1699287 - RNA, 15 nt, Human
aaaucugugaacuug

SEQ ID NO: 1699288 - RNA, 20 nt, Human
aaauauuuauuuuaauaaug

SEQ ID NO: 1699289 - RNA, 13 nt, Human
aaauauuuauuuu

SEQ ID NO: 1699290 - RNA, 15 nt, Human
aaauauuuauuuuaa

SEQ ID NO: 1699291 - RNA, 18 nt, Human
aaauagcuagacugguga

SEQ ID NO: 1699292 - RNA, 17 nt, Human
aacggaugauuucuaug

SEQ ID NO: 1699293 - RNA, 16 nt, Human
aacggaugauuucuau

SEQ ID NO: 1699294 - RNA, 15 nt, Human
aacggaugauuucua

SEQ ID NO: 1699295 - RNA, 14 nt, Human
aacggaugauuucu

SEQ ID NO: 1699296 - RNA, 20 nt, Human
aacugacucuuaagaagacu

SEQ ID NO: 1699297 - RNA, 19 nt, Human
aacugacucuuaagaagac

SEQ ID NO: 1699298 - RNA, 18 nt, Human
aacugacucuuaagaaga

SEQ ID NO: 1699299 - RNA, 15 nt, Human
aacugacucuuaaga

SEQ ID NO: 1699300 - RNA, 20 nt, Human
aacuuuaugcuaagugaaau

SEQ ID NO: 1699301 - RNA, 21 nt, Human
aacuuuaugcuaagugaaaua

SEQ ID NO: 1699302 - RNA, 21 nt, Human
aacagcuggugcccugcuuuc

SEQ ID NO: 1699303 - RNA, 20 nt, Human
aacagcuggugcccugcuuu

SEQ ID NO: 1699304 - RNA, 19 nt, Human
aacagcuggugcccugcuu

SEQ ID NO: 1699305 - RNA, 17 nt, Human
aaccuagggugauauua

SEQ ID NO: 1699306 - RNA, 22 nt, Human
aaccacuggaaaguuuaugguu

SEQ ID NO: 1699307 - RNA, 19 nt, Human
aaauugacacuuaaaaaug

SEQ ID NO: 1699308 - RNA, 22 nt, Human
aaauugacacuuaaaaaugguu

SEQ ID NO: 1699309 - RNA, 17 nt, Human
aaaucuuauaauuuaaa

SEQ ID NO: 1699310 - RNA, 18 nt, Human
aacaaauuuacagagaca

SEQ ID NO: 1699311 - RNA, 21 nt, Human
aaggacuucuuuaauuuugga

SEQ ID NO: 1699312 - RNA, 20 nt, Human
aaggacuucuuuaauuuugg

SEQ ID NO: 1699313 - RNA, 15 nt, Human
aaggacuucuuuaau

SEQ ID NO: 1699314 - RNA, 14 nt, Human
aaggacuucuuuaa

SEQ ID NO: 1699315 - RNA, 20 nt, Human
aaggcagcucuaaaugucaa

SEQ ID NO: 1699316 - RNA, 12 nt, Human
aaguugccuaaa

SEQ ID NO: 1699317 - RNA, 14 nt, Human
aagucuguuuuaug

SEQ ID NO: 1699318 - RNA, 13 nt, Human
aagucuguuuuau

SEQ ID NO: 1699319 - RNA, 12 nt, Human
aagucuguuuua

SEQ ID NO: 1699320 - RNA, 18 nt, Human
aaguccaagcauuuagau

SEQ ID NO: 1699321 - RNA, 13 nt, Human
aaugguuaaaaga

SEQ ID NO: 1699322 - RNA, 23 nt, Human
aauguuucaaacauauauaacaa

SEQ ID NO: 1699323 - RNA, 12 nt, Human
aauauuaaagcc

SEQ ID NO: 1699324 - RNA, 19 nt, Human
aaguugccuaaauccauuu

SEQ ID NO: 1699325 - RNA, 18 nt, Human
aaguugccuaaauccauu

SEQ ID NO: 1699326 - RNA, 17 nt, Human
aaguugccuaaauccau

SEQ ID NO: 1699327 - RNA, 16 nt, Human
aaguugccuaaaucca

SEQ ID NO: 1699328 - RNA, 15 nt, Human
aaguugccuaaaucc

SEQ ID NO: 1699329 - RNA, 13 nt, Human
aaugaaauacugu

SEQ ID NO: 1699330 - RNA, 16 nt, Human
aaugaagucucugaag

SEQ ID NO: 1699331 - RNA, 14 nt, Human
aaugaagucucuga

SEQ ID NO: 1699332 - RNA, 23 nt, Human
aaugaagucucugaagugaaacu

SEQ ID NO: 1699333 - RNA, 15 nt, Human
aaugauuaugaauua

SEQ ID NO: 1699334 - RNA, 23 nt, Human
aaugauuaugaauuacauuugua

SEQ ID NO: 1699335 - RNA, 21 nt, Human
aaugauuaugaauuacauuug

SEQ ID NO: 1699336 - RNA, 15 nt, Human
aauccaaugaaauga

SEQ ID NO: 1699337 - RNA, 13 nt, Human
agaguguugaaac

SEQ ID NO: 1699338 - RNA, 21 nt, Human
agacugcauuauauuuauuac

SEQ ID NO: 1699339 - RNA, 17 nt, Human
agagaacuuccagaucc

SEQ ID NO: 1699340 - RNA, 21 nt, Human
agccgggcgugguggugagug

SEQ ID NO: 1699341 - RNA, 17 nt, Human
aggcuagauguauguac

SEQ ID NO: 1699342 - RNA, 16 nt, Human
aggcuagauguaugua

SEQ ID NO: 1699343 - RNA, 15 nt, Human
aggcuagauguaugu

SEQ ID NO: 1699344 - RNA, 21 nt, Human
aggcuagaaccaccugccuau

SEQ ID NO: 1699345 - RNA, 20 nt, Human
agguaaaagcaucacaugaa

SEQ ID NO: 1699346 - RNA, 23 nt, Human
aggaugguucccuugaugaagaa

SEQ ID NO: 1699347 - RNA, 14 nt, Human
auguauuuguuugc

SEQ ID NO: 1699348 - RNA, 21 nt, Human
augguccgugcuaaggacuug

SEQ ID NO: 1699349 - RNA, 20 nt, Human
augguccgugcuaaggacuu

SEQ ID NO: 1699350 - RNA, 19 nt, Human
augguccgugcuaaggacu

SEQ ID NO: 1699351 - RNA, 22 nt, Human
augucuucauaccuacauguau

SEQ ID NO: 1699352 - RNA, 21 nt, Human
augucuucauaccuacaugua

SEQ ID NO: 1699353 - RNA, 13 nt, Human
augugugaaguga

SEQ ID NO: 1699354 - RNA, 17 nt, Human
auguucuaagaagugaa

SEQ ID NO: 1699355 - RNA, 15 nt, Human
auauuuauuuuaaua

SEQ ID NO: 1699356 - RNA, 14 nt, Human
auauuuauuuuaau

SEQ ID NO: 1699357 - RNA, 17 nt, Human
auauuuauuuuaauaau

SEQ ID NO: 1699358 - RNA, 20 nt, Human
auauuuacuaaaauggacug

SEQ ID NO: 1699359 - RNA, 18 nt, Human
auauuuacuaaaauggac

SEQ ID NO: 1699360 - RNA, 13 nt, Human
auauuuauuuuaa

SEQ ID NO: 1699361 - RNA, 23 nt, Human
auaugcuauuucuauauuuucau

SEQ ID NO: 1699362 - RNA, 22 nt, Human
auaugcuauuucuauauuuuca

SEQ ID NO: 1699363 - RNA, 22 nt, Human
auaugcuucuguuuuauaauuu

SEQ ID NO: 1699364 - RNA, 20 nt, Human
auaugcuucuguuuuauaau

SEQ ID NO: 1699365 - RNA, 15 nt, Human
auaugcuauuucuau

SEQ ID NO: 1699366 - RNA, 21 nt, Human
auaugcuauuucuauauuuuc

SEQ ID NO: 1699367 - RNA, 19 nt, Human
auaugcuauuucuauauuu

SEQ ID NO: 1699368 - RNA, 18 nt, Human
auaugcuauuucuauauu

SEQ ID NO: 1699369 - RNA, 16 nt, Human
auaugcuauuucuaua

SEQ ID NO: 1699370 - RNA, 22 nt, Human
auaucaucaguauugaagcauu

SEQ ID NO: 1699371 - RNA, 15 nt, Human
auaucaauuuaaaaa

SEQ ID NO: 1699372 - RNA, 17 nt, Human
auaucaucaguauugaa

SEQ ID NO: 1699373 - RNA, 14 nt, Human
auagucaaauugug

SEQ ID NO: 1699374 - RNA, 15 nt, Human
auagguuuaauaauu

SEQ ID NO: 1699375 - RNA, 17 nt, Human
auaauuaacauguuaaa

SEQ ID NO: 1699376 - RNA, 15 nt, Human
auaauuaacauguua

SEQ ID NO: 1699377 - RNA, 23 nt, Human
auaauguuucaaacauauauaac

SEQ ID NO: 1699378 - RNA, 15 nt, Human
auaaggaaaaguuua

SEQ ID NO: 1699379 - RNA, 16 nt, Human
auaaggaaaaguuuaa

SEQ ID NO: 1699380 - RNA, 21 nt, Human
auaccuacauguauuuguuug

SEQ ID NO: 1699381 - RNA, 17 nt, Human
auaccuacauguauuug

SEQ ID NO: 1699382 - RNA, 15 nt, Human
auaacauaaaucugu

SEQ ID NO: 1699383 - RNA, 14 nt, Human
auaacauaaaucug

SEQ ID NO: 1699384 - RNA, 18 nt, Human
auaaaggauuaaugucaa

SEQ ID NO: 1699385 - RNA, 19 nt, Human
auaacauaaaucugugaac

SEQ ID NO: 1699386 - RNA, 18 nt, Human
auaacauaaaucugugaa

SEQ ID NO: 1699387 - RNA, 17 nt, Human
auaacauaaaucuguga

SEQ ID NO: 1699388 - RNA, 19 nt, Human
agucaaauugugugaaagg

SEQ ID NO: 1699389 - RNA, 23 nt, Human
agucaaauugugugaaagguacu

SEQ ID NO: 1699390 - RNA, 12 nt, Human
aguccuguaaug

SEQ ID NO: 1699391 - RNA, 22 nt, Human
aguugaaaaucuuauaauuuaa

SEQ ID NO: 1699392 - RNA, 23 nt, Human
aguugaaaaucuuauaauuuaaa

SEQ ID NO: 1699393 - RNA, 23 nt, Human
gucuucauaccuacauguauuug

SEQ ID NO: 1699394 - RNA, 23 nt, Human
aacuaucucauuuccaagcaagu

SEQ ID NO: 1699395 - RNA, 20 nt, Human
aacuaucucauuuccaagca

SEQ ID NO: 1699396 - RNA, 13 nt, Human
aacuauauuguuu

SEQ ID NO: 1699397 - RNA, 20 nt, Human
aacugaaaucauacuucuua

SEQ ID NO: 1699398 - RNA, 13 nt, Human
aacugaaaucaua

SEQ ID NO: 1699399 - RNA, 14 nt, Human
aacauaaaucugug

SEQ ID NO: 1699400 - RNA, 12 nt, Human
aacauaaaucug

SEQ ID NO: 1699401 - RNA, 15 nt, Human
aacauaaaucuguga

SEQ ID NO: 1699402 - RNA, 23 nt, Human
aacauguuaaaccaugggauaaa

SEQ ID NO: 1699403 - RNA, 16 nt, Human
aacauauauaacaaug

SEQ ID NO: 1699404 - RNA, 23 nt, Human
gucucaguccaugaagauguaga

SEQ ID NO: 1699405 - RNA, 23 nt, Human
guguugaaacggaugauuucuau

SEQ ID NO: 1699406 - RNA, 21 nt, Human
guguugaaacggaugauuucu

SEQ ID NO: 1699407 - RNA, 16 nt, Human
aagcaaguauuagaau

SEQ ID NO: 1699408 - RNA, 19 nt, Human
aagcaaaauuuuuucucua

SEQ ID NO: 1699409 - RNA, 22 nt, Human
aagauguagaggagaaacugga

SEQ ID NO: 1699410 - RNA, 19 nt, Human
aagauguagaggagaaacu

SEQ ID NO: 1699411 - RNA, 20 nt, Human
aacuuguguaaauacaauuu

SEQ ID NO: 1699412 - RNA, 15 nt, Human
aacuuguguaaauac

SEQ ID NO: 1699413 - RNA, 14 nt, Human
aacuuguguaaaua

SEQ ID NO: 1699414 - RNA, 22 nt, Human
aagaagcaccaaucaugaauua

SEQ ID NO: 1699415 - RNA, 13 nt, Human
aagaaaauaucac

SEQ ID NO: 1699416 - RNA, 22 nt, Human
gugcugggguuaucugaaguca

SEQ ID NO: 1699417 - RNA, 19 nt, Human
gugcugguguaugugugaa

SEQ ID NO: 1699418 - RNA, 13 nt, Human
aagacccaaaagg

SEQ ID NO: 1699419 - RNA, 14 nt, Human
aauaaaaaauuaug

SEQ ID NO: 1699420 - RNA, 16 nt, Human
aauaaaaaauuaugac

SEQ ID NO: 1699421 - RNA, 15 nt, Human
aauaaaaaauuauga

SEQ ID NO: 1699422 - RNA, 12 nt, Human
aauaaaaauaau

SEQ ID NO: 1699423 - RNA, 22 nt, Human
aauaaaauccauacauuugugu

SEQ ID NO: 1699424 - RNA, 21 nt, Human
aauaaauagcuagacugguga

SEQ ID NO: 1699425 - RNA, 15 nt, Human
aauaacaauaaaaga

SEQ ID NO: 1699426 - RNA, 15 nt, Human
aauaaggaaaaguuu

SEQ ID NO: 1699427 - RNA, 13 nt, Human
aauaaggaaaagu

SEQ ID NO: 1699428 - RNA, 22 nt, Human
aauaaggaaaaguuuaauauua

SEQ ID NO: 1699429 - RNA, 19 nt, Human
aauaaggaaaaguuuaaua

SEQ ID NO: 1699430 - RNA, 16 nt, Human
aauaaggaaaaguuua

SEQ ID NO: 1699431 - RNA, 23 nt, Human
aauaauuauaugcuauuucuaua

SEQ ID NO: 1699432 - RNA, 22 nt, Human
aauaauuauaugcuauuucuau

SEQ ID NO: 1699433 - RNA, 21 nt, Human
aauaauuauaugcuauuucua

SEQ ID NO: 1699434 - RNA, 20 nt, Human
aauaauuauaugcuauuucu

SEQ ID NO: 1699435 - RNA, 15 nt, Human
aauaauuauaugcua

SEQ ID NO: 1699436 - RNA, 14 nt, Human
aauaauuauaugcu

SEQ ID NO: 1699437 - RNA, 23 nt, Human
uaaaucccauuauucaaaguugc

SEQ ID NO: 1699438 - RNA, 19 nt, Human
uaaaucgcuuuugauaauc

SEQ ID NO: 1699439 - RNA, 18 nt, Human
uaaaucgcuuuugauaau

SEQ ID NO: 1699440 - RNA, 23 nt, Human
uaaauagcuagacuggugacuga

SEQ ID NO: 1699441 - RNA, 19 nt, Human
uaaauagcuagacugguga

SEQ ID NO: 1699442 - RNA, 23 nt, Human
uaaauacaauuuuguuucuguac

SEQ ID NO: 1699443 - RNA, 22 nt, Human
uaaauacaauuuuguuucugua

SEQ ID NO: 1699444 - RNA, 15 nt, Human
uaaauacaauuuugu

SEQ ID NO: 1699445 - RNA, 13 nt, Human
uaaauacaauuuu

SEQ ID NO: 1699446 - RNA, 23 nt, Human
aauacaauuuuguuucuguacuu

SEQ ID NO: 1699447 - RNA, 22 nt, Human
aauacaauuuuguuucuguacu

SEQ ID NO: 1699448 - RNA, 13 nt, Human
aauacaauuuugu

SEQ ID NO: 1699449 - RNA, 12 nt, Human
aauacaauuuug

SEQ ID NO: 1699450 - RNA, 20 nt, Human
aauacaauuuuguuucugua

SEQ ID NO: 1699451 - RNA, 18 nt, Human
aauacaauuuuguuucug

SEQ ID NO: 1699452 - RNA, 17 nt, Human
aauacaauuuuguuucu

SEQ ID NO: 1699453 - RNA, 15 nt, Human
aauacaauuuuguuu

SEQ ID NO: 1699454 - RNA, 16 nt, Human
uaacaacagcuggugc

SEQ ID NO: 1699455 - RNA, 17 nt, Human
uaacaaugcuguauuuu

SEQ ID NO: 1699456 - RNA, 15 nt, Human
uaacaaugcuguauu

SEQ ID NO: 1699457 - RNA, 15 nt, Human
uaaauguugacaugg

SEQ ID NO: 1699458 - RNA, 17 nt, Human
uaaaugauuucauucaa

SEQ ID NO: 1699459 - RNA, 22 nt, Human
uaaaccaugggauaaaugccau

SEQ ID NO: 1699460 - RNA, 21 nt, Human
uaaaccaugggauaaaugcca

SEQ ID NO: 1699461 - RNA, 20 nt, Human
uaaaccaugggauaaaugcc

SEQ ID NO: 1699462 - RNA, 18 nt, Human
uaaaccaugggauaaaug

SEQ ID NO: 1699463 - RNA, 21 nt, Human
aaguuuaauauuaaagccaug

SEQ ID NO: 1699464 - RNA, 20 nt, Human
aaguuuaauauuaaagccau

SEQ ID NO: 1699465 - RNA, 19 nt, Human
aaguuuaauauuaaagcca

SEQ ID NO: 1699466 - RNA, 17 nt, Human
aaguucugcagauaaac

SEQ ID NO: 1699467 - RNA, 19 nt, Human
uaaaccaaggcuagaacca

SEQ ID NO: 1699468 - RNA, 23 nt, Human
aaggcugaugccaaguuguuuga

SEQ ID NO: 1699469 - RNA, 10 nt, Human
guuucuguac

SEQ ID NO: 1699470 - RNA, 14 nt, Human
guuugcauagguga

SEQ ID NO: 1699471 - RNA, 15 nt, Human
guuucuguacuuuuu

SEQ ID NO: 1699472 - RNA, 22 nt, Human
guuuuauaauuuugugaagcaa

SEQ ID NO: 1699473 - RNA, 15 nt, Human
guuuuauaauuuugu

SEQ ID NO: 1699474 - RNA, 13 nt, Human
aaguauuaagcau

SEQ ID NO: 1699475 - RNA, 21 nt, Human
aaguauguuagugcaaauugu

SEQ ID NO: 1699476 - RNA, 23 nt, Human
aaguauguuagugcaaauuguca

SEQ ID NO: 1699477 - RNA, 23 nt, Human
guuuuuuuuuaaaaaagaaacau

SEQ ID NO: 1699478 - RNA, 22 nt, Human
aagucuuauauauuguagauaa

SEQ ID NO: 1699479 - RNA, 16 nt, Human
aaggaagguucuggug

SEQ ID NO: 1699480 - RNA, 13 nt, Human
aaggauaaugaau

SEQ ID NO: 1699481 - RNA, 16 nt, Human
aaggaaaaaauaacaa

SEQ ID NO: 1699482 - RNA, 19 nt, Human
aaggaaaaaauaacaauga

SEQ ID NO: 1699483 - RNA, 22 nt, Human
aauuaaggauuuuaugcuuuaa

SEQ ID NO: 1699484 - RNA, 20 nt, Human
aauuaaggauuuuaugcuuu

SEQ ID NO: 1699485 - RNA, 16 nt, Human
aauuaaggauuuuaug

SEQ ID NO: 1699486 - RNA, 18 nt, Human
aauuaacauguuaaacca

SEQ ID NO: 1699487 - RNA, 14 nt, Human
aauuaacauguuaa

SEQ ID NO: 1699488 - RNA, 13 nt, Human
aauuaacauguua

SEQ ID NO: 1699489 - RNA, 18 nt, Human
aauguugacaugggacau

SEQ ID NO: 1699490 - RNA, 16 nt, Human
aaugguuuaaaugguc

SEQ ID NO: 1699491 - RNA, 17 nt, Human
uaauuauaucugaggaa

SEQ ID NO: 1699492 - RNA, 13 nt, Human
uaauuauaucuga

SEQ ID NO: 1699493 - RNA, 21 nt, Human
uaauuauaugcuauuucuaua

SEQ ID NO: 1699494 - RNA, 15 nt, Human
aaugaaugaaugaau

SEQ ID NO: 1699495 - RNA, 13 nt, Human
uaaucuuucacag

SEQ ID NO: 1699496 - RNA, 19 nt, Human
uaacaaugcuguauuuuaa

SEQ ID NO: 1699497 - RNA, 14 nt, Human
uagaaccucuuugu

SEQ ID NO: 1699498 - RNA, 15 nt, Human
uagaacucccuuuca

SEQ ID NO: 1699499 - RNA, 16 nt, Human
uacuucaugcugucua

SEQ ID NO: 1699500 - RNA, 21 nt, Human
uacuucaaauccuugaagauu

SEQ ID NO: 1699501 - RNA, 19 nt, Human
aauuuuuucucuaggaaau

SEQ ID NO: 1699502 - RNA, 19 nt, Human
aauuuuuauauuugaaaua

SEQ ID NO: 1699503 - RNA, 21 nt, Human
uagaggaagccugauuaaaga

SEQ ID NO: 1699504 - RNA, 19 nt, Human
uagaggagaaacuggaacu

SEQ ID NO: 1699505 - RNA, 16 nt, Human
uagaugcaguucugaa

SEQ ID NO: 1699506 - RNA, 19 nt, Human
uagaugcaguucugaagaa

SEQ ID NO: 1699507 - RNA, 17 nt, Human
uagaugcaguucugaag

SEQ ID NO: 1699508 - RNA, 21 nt, Human
uagcaugucgucaaagcugaa

SEQ ID NO: 1699509 - RNA, 18 nt, Human
acaagcacuaaacaaaga

SEQ ID NO: 1699510 - RNA, 14 nt, Human
uacucaauuuuaac

SEQ ID NO: 1699511 - RNA, 13 nt, Human
uacucaauuuuaa

SEQ ID NO: 1699512 - RNA, 12 nt, Human
uacucaauuuua

SEQ ID NO: 1699513 - RNA, 21 nt, Human
aauucuugccaaauauaaaua

SEQ ID NO: 1699514 - RNA, 19 nt, Human
aauugacccacaagaaaug

SEQ ID NO: 1699515 - RNA, 16 nt, Human
aauugacccacaagaa

SEQ ID NO: 1699516 - RNA, 18 nt, Human
aauuugaauuuuguguua

SEQ ID NO: 1699517 - RNA, 16 nt, Human
aauuugaauuuugugu

SEQ ID NO: 1699518 - RNA, 13 nt, Human
aauuugaauuuug

SEQ ID NO: 1699519 - RNA, 19 nt, Human
uacuucaaauccuugaaga

SEQ ID NO: 1699520 - RNA, 14 nt, Human
uacuucaaauccuu

SEQ ID NO: 1699521 - RNA, 13 nt, Human
uacuguaagaaaa

SEQ ID NO: 1699522 - RNA, 23 nt, Human
aauugugugaaagguacuucaaa

SEQ ID NO: 1699523 - RNA, 22 nt, Human
uauucacugauuugacauaguc

SEQ ID NO: 1699524 - RNA, 19 nt, Human
uauucacugauuugacaua

SEQ ID NO: 1699525 - RNA, 13 nt, Human
uauucacugauuu

SEQ ID NO: 1699526 - RNA, 23 nt, Human
uauucaaaguugccuaaauccau

SEQ ID NO: 1699527 - RNA, 22 nt, Human
uauucaaaguugccuaaaucca

SEQ ID NO: 1699528 - RNA, 21 nt, Human
uauucaaaguugccuaaaucc

SEQ ID NO: 1699529 - RNA, 18 nt, Human
uauucaaaguugccuaaa

SEQ ID NO: 1699530 - RNA, 23 nt, Human
uauucauagcagcuuauucacaa

SEQ ID NO: 1699531 - RNA, 15 nt, Human
uauuagaauaccaca

SEQ ID NO: 1699532 - RNA, 12 nt, Human
uauuaaagccau

SEQ ID NO: 1699533 - RNA, 14 nt, Human
uauuaaagccaugu

SEQ ID NO: 1699534 - RNA, 13 nt, Human
uauuaaagccaug

SEQ ID NO: 1699535 - RNA, 21 nt, Human
uauuacaguauaauuaacaug

SEQ ID NO: 1699536 - RNA, 20 nt, Human
uauuacaguauaauuaacau

SEQ ID NO: 1699537 - RNA, 18 nt, Human
uauuacaguauaauuaac

SEQ ID NO: 1699538 - RNA, 16 nt, Human
uauuacaguauaauua

SEQ ID NO: 1699539 - RNA, 20 nt, Human
uauuaaagccauguuuauua

SEQ ID NO: 1699540 - RNA, 18 nt, Human
uauuaaagccauguuuau

SEQ ID NO: 1699541 - RNA, 17 nt, Human
uauuaaagccauguuua

SEQ ID NO: 1699542 - RNA, 20 nt, Human
acagcuggugcccugcuuuc

SEQ ID NO: 1699543 - RNA, 17 nt, Human
acagcuggugcccugcu

SEQ ID NO: 1699544 - RNA, 23 nt, Human
acaguauaauuaacauguuaaac

SEQ ID NO: 1699545 - RNA, 21 nt, Human
acaguauggcagcuuuccuca

SEQ ID NO: 1699546 - RNA, 21 nt, Human
acaguauaauuaacauguuaa

SEQ ID NO: 1699547 - RNA, 20 nt, Human
acagugaaagaaaauaacaa

SEQ ID NO: 1699548 - RNA, 18 nt, Human
acagugagacucugucuc

SEQ ID NO: 1699549 - RNA, 14 nt, Human
acagugagacucug

SEQ ID NO: 1699550 - RNA, 21 nt, Human
acaguuaccucugccucagaa

SEQ ID NO: 1699551 - RNA, 18 nt, Human
uauuuacuaaaauggacu

SEQ ID NO: 1699552 - RNA, 18 nt, Human
uauuuauuuuaauaaugu

SEQ ID NO: 1699553 - RNA, 16 nt, Human
uauuuauuuuaauaau

SEQ ID NO: 1699554 - RNA, 14 nt, Human
uauuuauuuuaaua

SEQ ID NO: 1699555 - RNA, 23 nt, Human
uauuguacaaaguauuaagcaua

SEQ ID NO: 1699556 - RNA, 22 nt, Human
uauuguacaaaguauuaagcau

SEQ ID NO: 1699557 - RNA, 21 nt, Human
uauuguacaaaguauuaagca

SEQ ID NO: 1699558 - RNA, 16 nt, Human
uauuguacaaaguauu

SEQ ID NO: 1699559 - RNA, 15 nt, Human
uauuguacaaaguau

SEQ ID NO: 1699560 - RNA, 17 nt, Human
uauugucuagugaaacu

SEQ ID NO: 1699561 - RNA, 19 nt, Human
uauugaagcauuuuauaaa

SEQ ID NO: 1699562 - RNA, 17 nt, Human
uauugaagcauuuuaua

SEQ ID NO: 1699563 - RNA, 16 nt, Human
uauugaagcauuuuau

SEQ ID NO: 1699564 - RNA, 15 nt, Human
uauugaagcauuuua

SEQ ID NO: 1699565 - RNA, 13 nt, Human
uauugaagcauuu

SEQ ID NO: 1699566 - RNA, 12 nt, Human
uauugaagcauu

SEQ ID NO: 1699567 - RNA, 22 nt, Human
uauuggcuuuucugauccaguu

SEQ ID NO: 1699568 - RNA, 21 nt, Human
uauuggcuuuucugauccagu

SEQ ID NO: 1699569 - RNA, 14 nt, Human
uauuggcuuuucug

SEQ ID NO: 1699570 - RNA, 18 nt, Human
uauuggcuuuucugaucc

SEQ ID NO: 1699571 - RNA, 17 nt, Human
uauuggcuuuucugauc

SEQ ID NO: 1699572 - RNA, 16 nt, Human
uauuggcuuuucugau

SEQ ID NO: 1699573 - RNA, 15 nt, Human
uauuggcuuuucuga

SEQ ID NO: 1699574 - RNA, 23 nt, Human
acaguucggugagcuacaaaugc

SEQ ID NO: 1699575 - RNA, 19 nt, Human
acaguucggugagcuacaa

SEQ ID NO: 1699576 - RNA, 22 nt, Human
acaguucggugagcuacaaaug

SEQ ID NO: 1699577 - RNA, 16 nt, Human
acacuccaauuaagga

SEQ ID NO: 1699578 - RNA, 15 nt, Human
acacuccaauuaagg

SEQ ID NO: 1699579 - RNA, 19 nt, Human
uauaggaauugacccacaa

SEQ ID NO: 1699580 - RNA, 14 nt, Human
uauaggaauugacc

SEQ ID NO: 1699581 - RNA, 13 nt, Human
uauaggaauugac

SEQ ID NO: 1699582 - RNA, 20 nt, Human
uauagauuagaauucuguau

SEQ ID NO: 1699583 - RNA, 22 nt, Human
uauagauuagagaguguugaaa

SEQ ID NO: 1699584 - RNA, 19 nt, Human
uauagauuagagaguguug

SEQ ID NO: 1699585 - RNA, 19 nt, Human
uauaauuuugugaagcaaa

SEQ ID NO: 1699586 - RNA, 14 nt, Human
uauaauuuugugaa

SEQ ID NO: 1699587 - RNA, 18 nt, Human
uauaacaaugcuguauuu

SEQ ID NO: 1699588 - RNA, 23 nt, Human
uauaaaauaauuuuuauauuuga

SEQ ID NO: 1699589 - RNA, 22 nt, Human
uauaaaauaauuuuuauauuug

SEQ ID NO: 1699590 - RNA, 21 nt, Human
uauaaaauaauuuuuauauuu

SEQ ID NO: 1699591 - RNA, 22 nt, Human
uagugagcagucaggaaagaga

SEQ ID NO: 1699592 - RNA, 16 nt, Human
uaguuuuauaugcuuc

SEQ ID NO: 1699593 - RNA, 20 nt, Human
uaucaccugucuugccuuuu

SEQ ID NO: 1699594 - RNA, 15 nt, Human
uauauuuacaaaugg

SEQ ID NO: 1699595 - RNA, 14 nt, Human
uauauuuacaaaug

SEQ ID NO: 1699596 - RNA, 10 nt, Human
uaugauccag

SEQ ID NO: 1699597 - RNA, 19 nt, Human
uaugauccagcagauuauu

SEQ ID NO: 1699598 - RNA, 11 nt, Human
uaugauccagc

SEQ ID NO: 1699599 - RNA, 15 nt, Human
uaugcugaguuugug

SEQ ID NO: 1699600 - RNA, 22 nt, Human
uaugauccagcagauuauucac

SEQ ID NO: 1699601 - RNA, 21 nt, Human
uaugauccagcagauuauuca

SEQ ID NO: 1699602 - RNA, 20 nt, Human
uaugauccagcagauuauuc

SEQ ID NO: 1699603 - RNA, 22 nt, Human
ucccuauuuuuuuucuguuaua

SEQ ID NO: 1699604 - RNA, 21 nt, Human
ucccuauuuuuuuucuguuau

SEQ ID NO: 1699605 - RNA, 13 nt, Human
acuauauauguga

SEQ ID NO: 1699606 - RNA, 13 nt, Human
acuaaaaauacaa

SEQ ID NO: 1699607 - RNA, 21 nt, Human
acuccaauuaaggauuuuaug

SEQ ID NO: 1699608 - RNA, 17 nt, Human
acuccaauuaaggauuu

SEQ ID NO: 1699609 - RNA, 15 nt, Human
uccgugcuaaggacu

SEQ ID NO: 1699610 - RNA, 14 nt, Human
uccgugcuaaggac

SEQ ID NO: 1699611 - RNA, 19 nt, Human
uccuagcacacacuuuugg

SEQ ID NO: 1699612 - RNA, 18 nt, Human
uccuagcacacacuuuug

SEQ ID NO: 1699613 - RNA, 17 nt, Human
uccuagcacacacuuuu

SEQ ID NO: 1699614 - RNA, 22 nt, Human
acucuccauuuaauaauuauau

SEQ ID NO: 1699615 - RNA, 13 nt, Human
acuggauuguacu

SEQ ID NO: 1699616 - RNA, 16 nt, Human
acuggauuguacuuug

SEQ ID NO: 1699617 - RNA, 22 nt, Human
acugccuucucaacuccaaacu

SEQ ID NO: 1699618 - RNA, 13 nt, Human
uccuucagccuga

SEQ ID NO: 1699619 - RNA, 20 nt, Human
uccugcaaugaagucucuga

SEQ ID NO: 1699620 - RNA, 18 nt, Human
uccugcaaugaagucucu

SEQ ID NO: 1699621 - RNA, 15 nt, Human
uccugcaaugaaguc

SEQ ID NO: 1699622 - RNA, 21 nt, Human
uccugcaaugaagucucugaa

SEQ ID NO: 1699623 - RNA, 22 nt, Human
acugaggggaggggagcauggg

SEQ ID NO: 1699624 - RNA, 17 nt, Human
acugaggggaggggagc

SEQ ID NO: 1699625 - RNA, 18 nt, Human
uccacauaaggaaacugg

SEQ ID NO: 1699626 - RNA, 21 nt, Human
uccaacuaucucauuuccaag

SEQ ID NO: 1699627 - RNA, 20 nt, Human
uccagccugagcgacaguga

SEQ ID NO: 1699628 - RNA, 21 nt, Human
uccagccugagcgacagugag

SEQ ID NO: 1699629 - RNA, 22 nt, Human
ucaugaauuaguuuuauaugcu

SEQ ID NO: 1699630 - RNA, 21 nt, Human
ucagaucugccuaaggacuuc

SEQ ID NO: 1699631 - RNA, 13 nt, Human
ucagauuuuauua

SEQ ID NO: 1699632 - RNA, 15 nt, Human
ucagauuuuauuaug

SEQ ID NO: 1699633 - RNA, 14 nt, Human
ucagauuuuauuau

SEQ ID NO: 1699634 - RNA, 20 nt, Human
ucagauuuuauuauguaaau

SEQ ID NO: 1699635 - RNA, 19 nt, Human
ucagauuuuauuauguaaa

SEQ ID NO: 1699636 - RNA, 16 nt, Human
ucagauuuuauuaugu

SEQ ID NO: 1699637 - RNA, 19 nt, Human
accacugcagaagacagua

SEQ ID NO: 1699638 - RNA, 14 nt, Human
accacugcagaaga

SEQ ID NO: 1699639 - RNA, 13 nt, Human
accacugcagaag

SEQ ID NO: 1699640 - RNA, 23 nt, Human
accacuuguguuuugcaagccag

SEQ ID NO: 1699641 - RNA, 19 nt, Human
accacuuguguuuugcaag

SEQ ID NO: 1699642 - RNA, 15 nt, Human
acccaaaaggcagaa

SEQ ID NO: 1699643 - RNA, 13 nt, Human
acccaaaaggcag

SEQ ID NO: 1699644 - RNA, 18 nt, Human
acccaaaaggcagaagca

SEQ ID NO: 1699645 - RNA, 21 nt, Human
acccaaauguucaucaaugaa

SEQ ID NO: 1699646 - RNA, 14 nt, Human
agcagauuauucac

SEQ ID NO: 1699647 - RNA, 16 nt, Human
agcagauuauucacug

SEQ ID NO: 1699648 - RNA, 15 nt, Human
agcagauuauucacu

SEQ ID NO: 1699649 - RNA, 20 nt, Human
agcagauuauucacugauuu

SEQ ID NO: 1699650 - RNA, 19 nt, Human
agcagauuauucacugauu

SEQ ID NO: 1699651 - RNA, 22 nt, Human
ugagguacugagagugaacaaa

SEQ ID NO: 1699652 - RNA, 17 nt, Human
ugagguacugagaguga

SEQ ID NO: 1699653 - RNA, 16 nt, Human
ugaggaauucuguaua

SEQ ID NO: 1699654 - RNA, 15 nt, Human
ugaggaauucuguau

SEQ ID NO: 1699655 - RNA, 14 nt, Human
ugaggaauucugua

SEQ ID NO: 1699656 - RNA, 19 nt, Human
ugaggaauucuguauagau

SEQ ID NO: 1699657 - RNA, 18 nt, Human
ugaggaauucuguauaga

SEQ ID NO: 1699658 - RNA, 15 nt, Human
ugaggacacugauau

SEQ ID NO: 1699659 - RNA, 13 nt, Human
ugagcuacaaaug

SEQ ID NO: 1699660 - RNA, 14 nt, Human
ugagcuacaaaugc

SEQ ID NO: 1699661 - RNA, 16 nt, Human
ugagcuacaaaugcau

SEQ ID NO: 1699662 - RNA, 20 nt, Human
ugagcgacagugagacucug

SEQ ID NO: 1699663 - RNA, 16 nt, Human
ugagcgacagugagac

SEQ ID NO: 1699664 - RNA, 14 nt, Human
ugagcgacagugag

SEQ ID NO: 1699665 - RNA, 13 nt, Human
ugagcgacaguga

SEQ ID NO: 1699666 - RNA, 14 nt, Human
agcagaacagugau

SEQ ID NO: 1699667 - RNA, 16 nt, Human
agcaccaaucaugaau

SEQ ID NO: 1699668 - RNA, 22 nt, Human
agcacagccucuuagaugcagu

SEQ ID NO: 1699669 - RNA, 22 nt, Human
agauuuuauuauguaaauccca

SEQ ID NO: 1699670 - RNA, 20 nt, Human
agauuuuauuauguaaaucc

SEQ ID NO: 1699671 - RNA, 21 nt, Human
agauuuuauuauguaaauccc

SEQ ID NO: 1699672 - RNA, 14 nt, Human
agauuuuccugaaa

SEQ ID NO: 1699673 - RNA, 23 nt, Human
agcaaaaauauuuuaugauccag

SEQ ID NO: 1699674 - RNA, 19 nt, Human
agcaaaaauauuuuaugau

SEQ ID NO: 1699675 - RNA, 18 nt, Human
agcaaaaauauuuuauga

SEQ ID NO: 1699676 - RNA, 17 nt, Human
agcaaaaauauuuuaug

SEQ ID NO: 1699677 - RNA, 15 nt, Human
agcaaaaauauuuua

SEQ ID NO: 1699678 - RNA, 21 nt, Human
agauugugccccugcacucca

SEQ ID NO: 1699679 - RNA, 16 nt, Human
agauugugccccugca

SEQ ID NO: 1699680 - RNA, 16 nt, Human
agauuuaccacuugug

SEQ ID NO: 1699681 - RNA, 22 nt, Human
ugacuucauuaauaauaaauuc

SEQ ID NO: 1699682 - RNA, 16 nt, Human
agauuauucacugauu

SEQ ID NO: 1699683 - RNA, 15 nt, Human
ugacuguuuccauca

SEQ ID NO: 1699684 - RNA, 16 nt, Human
ugaauuuauuggcuuu

SEQ ID NO: 1699685 - RNA, 15 nt, Human
ugaauuuauuggcuu

SEQ ID NO: 1699686 - RNA, 12 nt, Human
ugaauuuauugg

SEQ ID NO: 1699687 - RNA, 23 nt, Human
agaugcuagaacucccuuucaac

SEQ ID NO: 1699688 - RNA, 22 nt, Human
agagugaacaaauuuacagaga

SEQ ID NO: 1699689 - RNA, 14 nt, Human
agagugaacaaauu

SEQ ID NO: 1699690 - RNA, 20 nt, Human
ugaagaagcaccaaucauga

SEQ ID NO: 1699691 - RNA, 14 nt, Human
ugaagaagauggua

SEQ ID NO: 1699692 - RNA, 22 nt, Human
ugaagaagcaccaaucaugaau

SEQ ID NO: 1699693 - RNA, 18 nt, Human
ugaagauguagaggagaa

SEQ ID NO: 1699694 - RNA, 17 nt, Human
ugaagauguagaggaga

SEQ ID NO: 1699695 - RNA, 17 nt, Human
ucuguauagauuagaau

SEQ ID NO: 1699696 - RNA, 16 nt, Human
ucuguauagauuagag

SEQ ID NO: 1699697 - RNA, 18 nt, Human
ucuguuuuauaauuuugu

SEQ ID NO: 1699698 - RNA, 20 nt, Human
ucuguuuuauaauuuuguga

SEQ ID NO: 1699699 - RNA, 22 nt, Human
ucuuagaugcaguucugaagaa

SEQ ID NO: 1699700 - RNA, 13 nt, Human
ucuuuaauuuugg

SEQ ID NO: 1699701 - RNA, 18 nt, Human
ucuuuaauuuuggaauuu

SEQ ID NO: 1699702 - RNA, 17 nt, Human
ucuuuaauuuuggaauu

SEQ ID NO: 1699703 - RNA, 16 nt, Human
ucuuuaauuuuggaau

SEQ ID NO: 1699704 - RNA, 15 nt, Human
ucuuuaauuuuggaa

SEQ ID NO: 1699705 - RNA, 14 nt, Human
ucuuuaauuuugga

SEQ ID NO: 1699706 - RNA, 15 nt, Human
agagaaugagagaca

SEQ ID NO: 1699707 - RNA, 17 nt, Human
agagacacacugaagaa

SEQ ID NO: 1699708 - RNA, 20 nt, Human
agagacacacugaagaagca

SEQ ID NO: 1699709 - RNA, 18 nt, Human
agagacacacugaagaag

SEQ ID NO: 1699710 - RNA, 19 nt, Human
ucuccauuuaauaauuaua

SEQ ID NO: 1699711 - RNA, 16 nt, Human
ucuccauuuaauaauu

SEQ ID NO: 1699712 - RNA, 12 nt, Human
ucuccauuuaau

SEQ ID NO: 1699713 - RNA, 23 nt, Human
acuuguguaaauacaauuuuguu

SEQ ID NO: 1699714 - RNA, 22 nt, Human
acuuguguaaauacaauuuugu

SEQ ID NO: 1699715 - RNA, 21 nt, Human
acuuguguaaauacaauuuug

SEQ ID NO: 1699716 - RNA, 13 nt, Human
acuuuuuuccaca

SEQ ID NO: 1699717 - RNA, 22 nt, Human
acuuuugguuaagucuguuuua

SEQ ID NO: 1699718 - RNA, 20 nt, Human
acuuuugguuaagucuguuu

SEQ ID NO: 1699719 - RNA, 16 nt, Human
acuuuugguuaagucu

SEQ ID NO: 1699720 - RNA, 22 nt, Human
acuuuuuauggcacuaguauuu

SEQ ID NO: 1699721 - RNA, 17 nt, Human
ucucuggccuucggccu

SEQ ID NO: 1699722 - RNA, 16 nt, Human
ucucuggccuucggcc

SEQ ID NO: 1699723 - RNA, 13 nt, Human
ucucuggccuucg

SEQ ID NO: 1699724 - RNA, 19 nt, Human
agaaaacaaggaugaauua

SEQ ID NO: 1699725 - RNA, 15 nt, Human
agaaacuggaacucu

SEQ ID NO: 1699726 - RNA, 13 nt, Human
agaaacuggaacu

SEQ ID NO: 1699727 - RNA, 22 nt, Human
agaaccucuuugucuacaccau

SEQ ID NO: 1699728 - RNA, 15 nt, Human
agaacucccuuucaa

SEQ ID NO: 1699729 - RNA, 14 nt, Human
agaacucccuuuca

SEQ ID NO: 1699730 - RNA, 21 nt, Human
ucugacuguuuccaucaaggg

SEQ ID NO: 1699731 - RNA, 13 nt, Human
ucugccuaaggac

SEQ ID NO: 1699732 - RNA, 16 nt, Human
ucugccuaaggacuuc

SEQ ID NO: 1699733 - RNA, 15 nt, Human
ucugccuaaggacuu

SEQ ID NO: 1699734 - RNA, 14 nt, Human
ucugccuaaggacu

SEQ ID NO: 1699735 - RNA, 21 nt, Human
agaagaacugaaaucauacuu

SEQ ID NO: 1699736 - RNA, 14 nt, Human
agaagcuccaggua

SEQ ID NO: 1699737 - RNA, 14 nt, Human
agccugauuaaaga

SEQ ID NO: 1699738 - RNA, 16 nt, Human
agccugcacggugaau

SEQ ID NO: 1699739 - RNA, 18 nt, Human
agccugcacggugaaugg

SEQ ID NO: 1699740 - RNA, 19 nt, Human
ugcagugagccgagauugu

SEQ ID NO: 1699741 - RNA, 14 nt, Human
ugcagugagccgag

SEQ ID NO: 1699742 - RNA, 18 nt, Human
agccugagcgacagugag

SEQ ID NO: 1699743 - RNA, 19 nt, Human
agccugagcgacagugaga

SEQ ID NO: 1699744 - RNA, 19 nt, Human
agcccuucuuuccacagaa

SEQ ID NO: 1699745 - RNA, 18 nt, Human
agcccuucuuuccacaga

SEQ ID NO: 1699746 - RNA, 19 nt, Human
agcuauggugucauaggcu

SEQ ID NO: 1699747 - RNA, 21 nt, Human
ugccuuuuucauuauuuuauu

SEQ ID NO: 1699748 - RNA, 17 nt, Human
ugccuuuuucauuauuu

SEQ ID NO: 1699749 - RNA, 16 nt, Human
ugccuuuuucauuauu

SEQ ID NO: 1699750 - RNA, 15 nt, Human
ugccuuuuucauuau

SEQ ID NO: 1699751 - RNA, 14 nt, Human
ugccuuuuucauua

SEQ ID NO: 1699752 - RNA, 13 nt, Human
ugccuuuuucauu

SEQ ID NO: 1699753 - RNA, 13 nt, Human
agcuggaaaagua

SEQ ID NO: 1699754 - RNA, 19 nt, Human
aggaaacuggguuccugca

SEQ ID NO: 1699755 - RNA, 19 nt, Human
aggaaagagaacuuccaga

SEQ ID NO: 1699756 - RNA, 13 nt, Human
aggaaagagaacu

SEQ ID NO: 1699757 - RNA, 14 nt, Human
ugcuaguaauugga

SEQ ID NO: 1699758 - RNA, 16 nt, Human
ugcuaguaauuggaaa

SEQ ID NO: 1699759 - RNA, 21 nt, Human
aggaaaaguuuaauauuaaag

SEQ ID NO: 1699760 - RNA, 24 nt, Human
aggaaaaguuuaauauuaaagcca

SEQ ID NO: 1699761 - RNA, 23 nt, Human
aggaaaaguuuaauauuaaagcc

SEQ ID NO: 1699762 - RNA, 21 nt, Human
agcuuauugucuagugaaacu

SEQ ID NO: 1699763 - RNA, 23 nt, Human
aggaauucuguauagauuagaau

SEQ ID NO: 1699764 - RNA, 19 nt, Human
aggaauugacccacaagaa

SEQ ID NO: 1699765 - RNA, 16 nt, Human
aggaauucuguauaga

SEQ ID NO: 1699766 - RNA, 22 nt, Human
aggaauucuguauagauuagaa

SEQ ID NO: 1699767 - RNA, 17 nt, Human
aggaauucuguauagau

SEQ ID NO: 1699768 - RNA, 18 nt, Human
aggaaauauuuauuuuaa

SEQ ID NO: 1699769 - RNA, 14 nt, Human
aggaaauauuuauu

SEQ ID NO: 1699770 - RNA, 15 nt, Human
aggauuuuaugcuuu

SEQ ID NO: 1699771 - RNA, 14 nt, Human
aggauuuuaugcuu

SEQ ID NO: 1699772 - RNA, 11 nt, Human
aggauuuuaug

SEQ ID NO: 1699773 - RNA, 17 nt, Human
aggauuuuaugcuuuaa

SEQ ID NO: 1699774 - RNA, 16 nt, Human
aggauuuuaugcuuua

SEQ ID NO: 1699775 - RNA, 21 nt, Human
uggaauuuuccuccuuucucu

SEQ ID NO: 1699776 - RNA, 17 nt, Human
uggaauuuuccuccuuu

SEQ ID NO: 1699777 - RNA, 23 nt, Human
uggagccugcacggugaauggcu

SEQ ID NO: 1699778 - RNA, 16 nt, Human
uggagaagaacugaaa

SEQ ID NO: 1699779 - RNA, 20 nt, Human
aggcagcucuaaaugucaau

SEQ ID NO: 1699780 - RNA, 22 nt, Human
aggcuccacuuggucugugaga

SEQ ID NO: 1699781 - RNA, 21 nt, Human
aggcuccacuuggucugugag

SEQ ID NO: 1699782 - RNA, 17 nt, Human
aggcuccacuuggucug

SEQ ID NO: 1699783 - RNA, 11 nt, Human
aggcuccacuu

SEQ ID NO: 1699784 - RNA, 13 nt, Human
agggaaauuucag

SEQ ID NO: 1699785 - RNA, 19 nt, Human
ugggaggcugagaugggag

SEQ ID NO: 1699786 - RNA, 22 nt, Human
agggcuguuauaaucuuucaca

SEQ ID NO: 1699787 - RNA, 18 nt, Human
uggcuaagcaaaauguga

SEQ ID NO: 1699788 - RNA, 18 nt, Human
ugggaaacaaaaggauaa

SEQ ID NO: 1699789 - RNA, 14 nt, Human
aguauuaagcauau

SEQ ID NO: 1699790 - RNA, 12 nt, Human
aguauuaagcau

SEQ ID NO: 1699791 - RNA, 23 nt, Human
aguauaauuaacauguuaaacca

SEQ ID NO: 1699792 - RNA, 16 nt, Human
aguauaauuaacaugu

SEQ ID NO: 1699793 - RNA, 14 nt, Human
aguauaauuaacau

SEQ ID NO: 1699794 - RNA, 13 nt, Human
aguauaauuaaca

SEQ ID NO: 1699795 - RNA, 14 nt, Human
agucaggaaagaga

SEQ ID NO: 1699796 - RNA, 16 nt, Human
uguaguguuggagaag

SEQ ID NO: 1699797 - RNA, 18 nt, Human
uguaguguuggagaagaa

SEQ ID NO: 1699798 - RNA, 17 nt, Human
uguaguguuggagaaga

SEQ ID NO: 1699799 - RNA, 13 nt, Human
aguaauuggaaag

SEQ ID NO: 1699800 - RNA, 12 nt, Human
aguaauuggaaa

SEQ ID NO: 1699801 - RNA, 13 nt, Human
aguaaugauaacu

SEQ ID NO: 1699802 - RNA, 14 nt, Human
agguugcagugagc

SEQ ID NO: 1699803 - RNA, 16 nt, Human
uguguuagagauuuuu

SEQ ID NO: 1699804 - RNA, 22 nt, Human
uguugcccacagcuguaugauu

SEQ ID NO: 1699805 - RNA, 15 nt, Human
uguucuaagaaguga

SEQ ID NO: 1699806 - RNA, 21 nt, Human
agucuugucucagauuuuauu

SEQ ID NO: 1699807 - RNA, 20 nt, Human
agucuugucucagauuuuau

SEQ ID NO: 1699808 - RNA, 16 nt, Human
agucuuucacauuuaa

SEQ ID NO: 1699809 - RNA, 21 nt, Human
agugaacaaauuuacagagac

SEQ ID NO: 1699810 - RNA, 18 nt, Human
agucuuucacauuuaaau

SEQ ID NO: 1699811 - RNA, 23 nt, Human
agugaacaaauuuacagagacag

SEQ ID NO: 1699812 - RNA, 22 nt, Human
agugaacaaauuuacagagaca

SEQ ID NO: 1699813 - RNA, 16 nt, Human
agucuugucucagauu

SEQ ID NO: 1699814 - RNA, 19 nt, Human
agucuugucucagauuuua

SEQ ID NO: 1699815 - RNA, 17 nt, Human
agucuugucucagauuu

SEQ ID NO: 1699816 - RNA, 21 nt, Human
agugaguuggguguauugugc

SEQ ID NO: 1699817 - RNA, 14 nt, Human
agugcaaauuguca

SEQ ID NO: 1699818 - RNA, 20 nt, Human
ugugcugguguaugugugaa

SEQ ID NO: 1699819 - RNA, 19 nt, Human
ugugcugggguuaucugaa

SEQ ID NO: 1699820 - RNA, 22 nt, Human
auagaggaagccugauuaaaga

SEQ ID NO: 1699821 - RNA, 21 nt, Human
auagaggaagccugauuaaag

SEQ ID NO: 1699822 - RNA, 18 nt, Human
auagauaggucagugcaa

SEQ ID NO: 1699823 - RNA, 21 nt, Human
auagauuagagaguguugaaa

SEQ ID NO: 1699824 - RNA, 16 nt, Human
auagauuagaauucug

SEQ ID NO: 1699825 - RNA, 15 nt, Human
auagauuagaauucu

SEQ ID NO: 1699826 - RNA, 13 nt, Human
auagauuagaauu

SEQ ID NO: 1699827 - RNA, 22 nt, Human
auagauuagagaguguugaaac

SEQ ID NO: 1699828 - RNA, 20 nt, Human
auagaaccucuuugucuaca

SEQ ID NO: 1699829 - RNA, 14 nt, Human
auagaaccucuuug

SEQ ID NO: 1699830 - RNA, 13 nt, Human
auagaaguaaaaa

SEQ ID NO: 1699831 - RNA, 17 nt, Human
auagaauuaacacauga

SEQ ID NO: 1699832 - RNA, 11 nt, Human
uuauuaugaaa

SEQ ID NO: 1699833 - RNA, 15 nt, Human
uuauuauauuuacaa

SEQ ID NO: 1699834 - RNA, 23 nt, Human
uuauuaugaaacuuguguaaaua

SEQ ID NO: 1699835 - RNA, 22 nt, Human
uuauuaugaaacuuguguaaau

SEQ ID NO: 1699836 - RNA, 21 nt, Human
uuauuaugaaacuuguguaaa

SEQ ID NO: 1699837 - RNA, 20 nt, Human
uuauuaugaaacuuguguaa

SEQ ID NO: 1699838 - RNA, 17 nt, Human
uuauuaugaaacuugug

SEQ ID NO: 1699839 - RNA, 19 nt, Human
uuauguuaaaacugggaca

SEQ ID NO: 1699840 - RNA, 14 nt, Human
uuauuauauuuaca

SEQ ID NO: 1699841 - RNA, 14 nt, Human
uuauuauguaaauc

SEQ ID NO: 1699842 - RNA, 13 nt, Human
uuauuauguaaau

SEQ ID NO: 1699843 - RNA, 22 nt, Human
uuauuauguaaaucccauuauu

SEQ ID NO: 1699844 - RNA, 16 nt, Human
uuauuauguaaauccc

SEQ ID NO: 1699845 - RNA, 19 nt, Human
uuauucaaaguugccuaaa

SEQ ID NO: 1699846 - RNA, 15 nt, Human
uuauucaaaguugcc

SEQ ID NO: 1699847 - RNA, 13 nt, Human
uuauucaaaguug

SEQ ID NO: 1699848 - RNA, 14 nt, Human
uuauucacugauuu

SEQ ID NO: 1699849 - RNA, 15 nt, Human
auacuggauuguacu

SEQ ID NO: 1699850 - RNA, 16 nt, Human
auacucauuaggaugg

SEQ ID NO: 1699851 - RNA, 22 nt, Human
uuaugacuucauuaauaauaaa

SEQ ID NO: 1699852 - RNA, 19 nt, Human
uuaugacuucauuaauaau

SEQ ID NO: 1699853 - RNA, 18 nt, Human
uuaugauccagcagauua

SEQ ID NO: 1699854 - RNA, 13 nt, Human
uuaugauccagca

SEQ ID NO: 1699855 - RNA, 21 nt, Human
uuaugaauuacauuuguauaa

SEQ ID NO: 1699856 - RNA, 17 nt, Human
uuaugaauuacauuugu

SEQ ID NO: 1699857 - RNA, 16 nt, Human
uuaugaauuacauuug

SEQ ID NO: 1699858 - RNA, 14 nt, Human
uuaugaauuacauu

SEQ ID NO: 1699859 - RNA, 19 nt, Human
uuaugaaacuuguguaaau

SEQ ID NO: 1699860 - RNA, 13 nt, Human
uuaugaaacuugu

SEQ ID NO: 1699861 - RNA, 18 nt, Human
uuaugaaacuuguguaaa

SEQ ID NO: 1699862 - RNA, 16 nt, Human
uuaugaaacuugugua

SEQ ID NO: 1699863 - RNA, 23 nt, Human
uuaugauccagcagauuauucac

SEQ ID NO: 1699864 - RNA, 22 nt, Human
uuaugauccagcagauuauuca

SEQ ID NO: 1699865 - RNA, 19 nt, Human
uuaugauuaaguaaugaua

SEQ ID NO: 1699866 - RNA, 22 nt, Human
uuaugauuaaguaaugauaacu

SEQ ID NO: 1699867 - RNA, 23 nt, Human
uuauguaaaucccauuauucaaa

SEQ ID NO: 1699868 - RNA, 22 nt, Human
uuauguaaaucccauuauucaa

SEQ ID NO: 1699869 - RNA, 21 nt, Human
uuauguaaaucccauuauuca

SEQ ID NO: 1699870 - RNA, 19 nt, Human
uuauguaaaucccauuauu

SEQ ID NO: 1699871 - RNA, 13 nt, Human
uuauguaaauccc

SEQ ID NO: 1699872 - RNA, 12 nt, Human
uuauguaaaucc

SEQ ID NO: 1699873 - RNA, 11 nt, Human
uuauguaaauc

SEQ ID NO: 1699874 - RNA, 16 nt, Human
uuaugugcgcugauaa

SEQ ID NO: 1699875 - RNA, 19 nt, Human
uuauauuugaaauauugac

SEQ ID NO: 1699876 - RNA, 19 nt, Human
aguuugugcugguguaugu

SEQ ID NO: 1699877 - RNA, 23 nt, Human
uuaaaccaugggauaaaugccau

SEQ ID NO: 1699878 - RNA, 22 nt, Human
uuaaaccaugggauaaaugcca

SEQ ID NO: 1699879 - RNA, 21 nt, Human
uuaaaccaugggauaaaugcc

SEQ ID NO: 1699880 - RNA, 22 nt, Human
uuaaaguugaauuuauuggcuu

SEQ ID NO: 1699881 - RNA, 17 nt, Human
uuaaaguugaauuuauu

SEQ ID NO: 1699882 - RNA, 16 nt, Human
uuaaaguugaauuuau

SEQ ID NO: 1699883 - RNA, 13 nt, Human
uuaaaguugaauu

SEQ ID NO: 1699884 - RNA, 20 nt, Human
uuaaacauugguucuuguau

SEQ ID NO: 1699885 - RNA, 18 nt, Human
uuaaacauugguucuugu

SEQ ID NO: 1699886 - RNA, 22 nt, Human
uuaaacauugguucuuguauua

SEQ ID NO: 1699887 - RNA, 17 nt, Human
uuaaaccaugggauaaa

SEQ ID NO: 1699888 - RNA, 17 nt, Human
aguuuaaauuguaauag

SEQ ID NO: 1699889 - RNA, 20 nt, Human
aguuuaaauuguaauaggcg

SEQ ID NO: 1699890 - RNA, 15 nt, Human
aguuuagcuggaaaa

SEQ ID NO: 1699891 - RNA, 16 nt, Human
aguuuagcuggaaaag

SEQ ID NO: 1699892 - RNA, 19 nt, Human
uuaaaaaagaaacauuugg

SEQ ID NO: 1699893 - RNA, 12 nt, Human
aguuuuguuugg

SEQ ID NO: 1699894 - RNA, 16 nt, Human
aguuuuguuuggacca

SEQ ID NO: 1699895 - RNA, 14 nt, Human
aguuuuguuuggac

SEQ ID NO: 1699896 - RNA, 16 nt, Human
aguuuuauaugcuucu

SEQ ID NO: 1699897 - RNA, 18 nt, Human
aguuuuguuuggaccaaa

SEQ ID NO: 1699898 - RNA, 22 nt, Human
uuaagaaugaaauacuguuuga

SEQ ID NO: 1699899 - RNA, 20 nt, Human
uuaagaaugaaauacuguuu

SEQ ID NO: 1699900 - RNA, 14 nt, Human
uuaagaaugaaaua

SEQ ID NO: 1699901 - RNA, 13 nt, Human
uuaauuuuggaau

SEQ ID NO: 1699902 - RNA, 15 nt, Human
uuaauuuuggaauuu

SEQ ID NO: 1699903 - RNA, 14 nt, Human
uuaauuuuggaauu

SEQ ID NO: 1699904 - RNA, 21 nt, Human
auaaaucgcuuuugauaauca

SEQ ID NO: 1699905 - RNA, 19 nt, Human
auaaaucgcuuuugauaau

SEQ ID NO: 1699906 - RNA, 16 nt, Human
auaaaucgcuuuugau

SEQ ID NO: 1699907 - RNA, 14 nt, Human
auaaaucgcuuuug

SEQ ID NO: 1699908 - RNA, 18 nt, Human
auaaaugccaucaauaaa

SEQ ID NO: 1699909 - RNA, 17 nt, Human
auaaaugccaucaauaa

SEQ ID NO: 1699910 - RNA, 19 nt, Human
auaaaucugugaacuugaa

SEQ ID NO: 1699911 - RNA, 16 nt, Human
auaaaucugugaacuu

SEQ ID NO: 1699912 - RNA, 15 nt, Human
auaaaucugugaacu

SEQ ID NO: 1699913 - RNA, 17 nt, Human
uuagaauucuguauaga

SEQ ID NO: 1699914 - RNA, 15 nt, Human
uuagaauucuguaua

SEQ ID NO: 1699915 - RNA, 14 nt, Human
uuagaauucuguau

SEQ ID NO: 1699916 - RNA, 14 nt, Human
auaaucuuucacag

SEQ ID NO: 1699917 - RNA, 14 nt, Human
auaagccagacauc

SEQ ID NO: 1699918 - RNA, 16 nt, Human
uuaggguuaugauuaa

SEQ ID NO: 1699919 - RNA, 14 nt, Human
uuaggguuaugauu

SEQ ID NO: 1699920 - RNA, 23 nt, Human
aucugccuaaggacuucuuuaau

SEQ ID NO: 1699921 - RNA, 22 nt, Human
aucugccuaaggacuucuuuaa

SEQ ID NO: 1699922 - RNA, 21 nt, Human
aucugccuaaggacuucuuua

SEQ ID NO: 1699923 - RNA, 11 nt, Human
aucugccuaag

SEQ ID NO: 1699924 - RNA, 14 nt, Human
aucuuauaauuuaa

SEQ ID NO: 1699925 - RNA, 18 nt, Human
augaacuuguaaaggaau

SEQ ID NO: 1699926 - RNA, 17 nt, Human
augaauuacauuuguau

SEQ ID NO: 1699927 - RNA, 16 nt, Human
augaauuacauuugua

SEQ ID NO: 1699928 - RNA, 23 nt, Human
augaauggcuaagcaaaauguga

SEQ ID NO: 1699929 - RNA, 15 nt, Human
augaauuacauuugu

SEQ ID NO: 1699930 - RNA, 23 nt, Human
uugaagcauuuuauaaaucgcuu

SEQ ID NO: 1699931 - RNA, 20 nt, Human
auccucucaaccaccuuuca

SEQ ID NO: 1699932 - RNA, 17 nt, Human
uugaagggaaauuucag

SEQ ID NO: 1699933 - RNA, 19 nt, Human
aucuacacuccagugagac

SEQ ID NO: 1699934 - RNA, 18 nt, Human
aucuacacuccagugaga

SEQ ID NO: 1699935 - RNA, 20 nt, Human
aucugacaucucugcaaucu

SEQ ID NO: 1699936 - RNA, 16 nt, Human
aucugacaucucugca

SEQ ID NO: 1699937 - RNA, 15 nt, Human
aucugacaucucugc

SEQ ID NO: 1699938 - RNA, 22 nt, Human
uugcaagccagauuuuccugaa

SEQ ID NO: 1699939 - RNA, 14 nt, Human
aucucauuuccaag

SEQ ID NO: 1699940 - RNA, 22 nt, Human
aucaccugucuugccuuuuuca

SEQ ID NO: 1699941 - RNA, 23 nt, Human
aucaccugucuugccuuuuucau

SEQ ID NO: 1699942 - RNA, 18 nt, Human
auauuuuuuguuaaauga

SEQ ID NO: 1699943 - RNA, 20 nt, Human
auauuuuuuguuaaaugauu

SEQ ID NO: 1699944 - RNA, 14 nt, Human
aucaacagauaaau

SEQ ID NO: 1699945 - RNA, 19 nt, Human
uuccguagguuauuuucag

SEQ ID NO: 1699946 - RNA, 23 nt, Human
uucuaagaagugaaaaucuacac

SEQ ID NO: 1699947 - RNA, 14 nt, Human
uucggccuccaucc

SEQ ID NO: 1699948 - RNA, 15 nt, Human
uucggccuccauccu

SEQ ID NO: 1699949 - RNA, 22 nt, Human
aucacuugucaauaaaauccau

SEQ ID NO: 1699950 - RNA, 17 nt, Human
aucaggguuaguauugu

SEQ ID NO: 1699951 - RNA, 17 nt, Human
uugaaauuguaauuaua

SEQ ID NO: 1699952 - RNA, 15 nt, Human
uugaaauuguaauua

SEQ ID NO: 1699953 - RNA, 17 nt, Human
uugaaauuguauuacaa

SEQ ID NO: 1699954 - RNA, 19 nt, Human
uugaacccgggaggcagag

SEQ ID NO: 1699955 - RNA, 14 nt, Human
uugaaauuguaauu

SEQ ID NO: 1699956 - RNA, 13 nt, Human
uugaaauuguaau

SEQ ID NO: 1699957 - RNA, 21 nt, Human
auccauuuggaaaucuuuaaa

SEQ ID NO: 1699958 - RNA, 20 nt, Human
auccauuuggaaaucuuuaa

SEQ ID NO: 1699959 - RNA, 12 nt, Human
uucucuaggaaa

SEQ ID NO: 1699960 - RNA, 13 nt, Human
uuuauauuuacua

SEQ ID NO: 1699961 - RNA, 16 nt, Human
uuuauauuuacuaaaa

SEQ ID NO: 1699962 - RNA, 11 nt, Human
augcuauuucu

SEQ ID NO: 1699963 - RNA, 20 nt, Human
augcuauuucuauauuuuca

SEQ ID NO: 1699964 - RNA, 15 nt, Human
augcuauuucuauau

SEQ ID NO: 1699965 - RNA, 14 nt, Human
augcuauuucuaua

SEQ ID NO: 1699966 - RNA, 13 nt, Human
augcuauuucuau

SEQ ID NO: 1699967 - RNA, 23 nt, Human
augcuauuucuauauuuucauuc

SEQ ID NO: 1699968 - RNA, 22 nt, Human
augcuauuucuauauuuucauu

SEQ ID NO: 1699969 - RNA, 21 nt, Human
augcuauuucuauauuuucau

SEQ ID NO: 1699970 - RNA, 18 nt, Human
uuuauuacaguauaauua

SEQ ID NO: 1699971 - RNA, 14 nt, Human
uuuauuacaguaua

SEQ ID NO: 1699972 - RNA, 22 nt, Human
augcuagaacucccuuucaaca

SEQ ID NO: 1699973 - RNA, 21 nt, Human
augcuagaacucccuuucaac

SEQ ID NO: 1699974 - RNA, 20 nt, Human
augcuagaacucccuuucaa

SEQ ID NO: 1699975 - RNA, 19 nt, Human
auggaacgcguugaaauug

SEQ ID NO: 1699976 - RNA, 18 nt, Human
auggaacgcguugaaauu

SEQ ID NO: 1699977 - RNA, 17 nt, Human
uuucaaacauauauaac

SEQ ID NO: 1699978 - RNA, 16 nt, Human
uuucaaacauauauaa

SEQ ID NO: 1699979 - RNA, 17 nt, Human
auggaacgcguugaaau

SEQ ID NO: 1699980 - RNA, 16 nt, Human
auggaacgcguugaaa

SEQ ID NO: 1699981 - RNA, 15 nt, Human
auggaacgcguugaa

SEQ ID NO: 1699982 - RNA, 15 nt, Human
uuucauuauuuuauu

SEQ ID NO: 1699983 - RNA, 13 nt, Human
uuucauuauuuua

SEQ ID NO: 1699984 - RNA, 20 nt, Human
uuucauuauuuuauuaugaa

SEQ ID NO: 1699985 - RNA, 19 nt, Human
uuucauuauuuuauuauga

SEQ ID NO: 1699986 - RNA, 22 nt, Human
auggacuguggugacuuuggau

SEQ ID NO: 1699987 - RNA, 17 nt, Human
auggacuguggugacuu

SEQ ID NO: 1699988 - RNA, 16 nt, Human
auggacuguggugacu

SEQ ID NO: 1699989 - RNA, 14 nt, Human
augggauaaaugcc

SEQ ID NO: 1699990 - RNA, 19 nt, Human
auggcuaagcaaaauguga

SEQ ID NO: 1699991 - RNA, 16 nt, Human
auggcacuaguauuuc

SEQ ID NO: 1699992 - RNA, 14 nt, Human
auggcacuaguauu

SEQ ID NO: 1699993 - RNA, 22 nt, Human
augauccagcagauuauucacu

SEQ ID NO: 1699994 - RNA, 18 nt, Human
augauuaaguaaugauaa

SEQ ID NO: 1699995 - RNA, 14 nt, Human
augauuaaguaaug

SEQ ID NO: 1699996 - RNA, 20 nt, Human
augauccagcagauuauuca

SEQ ID NO: 1699997 - RNA, 19 nt, Human
augauccagcagauuauuc

SEQ ID NO: 1699998 - RNA, 10 nt, Human
augauccagc

SEQ ID NO: 1699999 - RNA, 15 nt, Human
augauaacuggaaac

SEQ ID NO: 1700000 - RNA, 21 nt, Human
uuuaaauaaauaaauagcuag

SEQ ID NO: 1700001 - RNA, 18 nt, Human
uuuaaauauaugcuaagu

SEQ ID NO: 1700002 - RNA, 13 nt, Human
augcaguucugaa

SEQ ID NO: 1700003 - RNA, 19 nt, Human
uuugugcugguguaugugu

SEQ ID NO: 1700004 - RNA, 17 nt, Human
uuugugaagcaaaauuu

SEQ ID NO: 1700005 - RNA, 21 nt, Human
uuuguaguguuggagaagaac

SEQ ID NO: 1700006 - RNA, 19 nt, Human
uuuguaguguuggagaaga

SEQ ID NO: 1700007 - RNA, 20 nt, Human
uuuggcauaacauaaaucug

SEQ ID NO: 1700008 - RNA, 21 nt, Human
uuuggcauaacauaaaucugu

SEQ ID NO: 1700009 - RNA, 17 nt, Human
auguccacugguucuuc

SEQ ID NO: 1700010 - RNA, 13 nt, Human
auguagaggagaa

SEQ ID NO: 1700011 - RNA, 12 nt, Human
auguagaggaga

SEQ ID NO: 1700012 - RNA, 19 nt, Human
auguagaggagaaacugga

SEQ ID NO: 1700013 - RNA, 17 nt, Human
auguagaggagaaacug

SEQ ID NO: 1700014 - RNA, 16 nt, Human
auguacuucaugcugu

SEQ ID NO: 1700015 - RNA, 14 nt, Human
uuugcaagccagau

SEQ ID NO: 1700016 - RNA, 23 nt, Human
auguaaaucccauuauucaaagu

SEQ ID NO: 1700017 - RNA, 22 nt, Human
auguaaaucccauuauucaaag

SEQ ID NO: 1700018 - RNA, 20 nt, Human
auguaaaucccauuauucaa

SEQ ID NO: 1700019 - RNA, 14 nt, Human
auguaaaucccauu

SEQ ID NO: 1700020 - RNA, 21 nt, Human
augguucccuugaugaagaag

SEQ ID NO: 1700021 - RNA, 20 nt, Human
augggauaaaugccaucaau

SEQ ID NO: 1700022 - RNA, 16 nt, Human
augggauaaaugccau

SEQ ID NO: 1700023 - RNA, 15 nt, Human
augggauaaaugcca

SEQ ID NO: 1700024 - RNA, 19 nt, Human
uuucuguuauauaaauggu

SEQ ID NO: 1700025 - RNA, 19 nt, Human
uuucuguacuuuuuggcau

SEQ ID NO: 1700026 - RNA, 20 nt, Human
uuucuguacuuuuuggcaua

SEQ ID NO: 1700027 - RNA, 15 nt, Human
uuugaaauauugacu

SEQ ID NO: 1700028 - RNA, 13 nt, Human
auuauucaaaguu

SEQ ID NO: 1700029 - RNA, 15 nt, Human
auuauucaaaguugc

SEQ ID NO: 1700030 - RNA, 14 nt, Human
auuauucaaaguug

SEQ ID NO: 1700031 - RNA, 17 nt, Human
auuauucaaaguugccu

SEQ ID NO: 1700032 - RNA, 21 nt, Human
auuauguuaaaacugggacag

SEQ ID NO: 1700033 - RNA, 18 nt, Human
auuauauuuauuacugua

SEQ ID NO: 1700034 - RNA, 15 nt, Human
auuauauuuauuacu

SEQ ID NO: 1700035 - RNA, 15 nt, Human
auuauauuuacaaau

SEQ ID NO: 1700036 - RNA, 13 nt, Human
auucuguauagau

SEQ ID NO: 1700037 - RNA, 12 nt, Human
auucuguauaga

SEQ ID NO: 1700038 - RNA, 11 nt, Human
auucuguauag

SEQ ID NO: 1700039 - RNA, 22 nt, Human
auugaagcauuuuauaaaucgc

SEQ ID NO: 1700040 - RNA, 17 nt, Human
auugacacuuaaaaaug

SEQ ID NO: 1700041 - RNA, 15 nt, Human
auugacacuuaaaaa

SEQ ID NO: 1700042 - RNA, 19 nt, Human
auugacacuuaaaaauggu

SEQ ID NO: 1700043 - RNA, 20 nt, Human
auucuuaaaguugaauuuau

SEQ ID NO: 1700044 - RNA, 19 nt, Human
auucuuaaaguugaauuua

SEQ ID NO: 1700045 - RNA, 15 nt, Human
auucuguauagauua

SEQ ID NO: 1700046 - RNA, 21 nt, Human
auucuuaaaguugaauuuauu

SEQ ID NO: 1700047 - RNA, 15 nt, Human
auuuuguuucuguac

SEQ ID NO: 1700048 - RNA, 14 nt, Human
auuuuguuucugua

SEQ ID NO: 1700049 - RNA, 22 nt, Human
auuuuugugauuuugugauuga

SEQ ID NO: 1700050 - RNA, 18 nt, Human
auuuuuuguuaaaugauu

SEQ ID NO: 1700051 - RNA, 23 nt, Human
auuuuuucucuaggaaauauuua

SEQ ID NO: 1700052 - RNA, 20 nt, Human
auuuuuucucuaggaaauau

SEQ ID NO: 1700053 - RNA, 11 nt, Human
auuuuguuucu

SEQ ID NO: 1700054 - RNA, 12 nt, Human
auuuuggaauuu

SEQ ID NO: 1700055 - RNA, 14 nt, Human
auuuuccugaaaac

SEQ ID NO: 1700056 - RNA, 14 nt, Human
auuuucuauaauuu

SEQ ID NO: 1700057 - RNA, 15 nt, Human
auuuucuauaauuua

SEQ ID NO: 1700058 - RNA, 12 nt, Human
auuuuaauaaug

SEQ ID NO: 1700059 - RNA, 16 nt, Human
auugguucuuguauua

SEQ ID NO: 1700060 - RNA, 15 nt, Human
auugguucuuguauu

SEQ ID NO: 1700061 - RNA, 20 nt, Human
auuggcuuuucugauccagu

SEQ ID NO: 1700062 - RNA, 19 nt, Human
auuggcuuuucugauccag

SEQ ID NO: 1700063 - RNA, 16 nt, Human
auuggcuuuucugauc

SEQ ID NO: 1700064 - RNA, 15 nt, Human
auuggcuuuucugau

SEQ ID NO: 1700065 - RNA, 13 nt, Human
auuggcuuuucug

SEQ ID NO: 1700066 - RNA, 18 nt, Human
auugacuuuuuauggcac

SEQ ID NO: 1700067 - RNA, 13 nt, Human
auugacuuuuuau

SEQ ID NO: 1700068 - RNA, 19 nt, Human
auuggagcucgugggacag

SEQ ID NO: 1700069 - RNA, 19 nt, Human
auuggacaguaaaauccac

SEQ ID NO: 1700070 - RNA, 13 nt, Human
auugucuagugaa

SEQ ID NO: 1700071 - RNA, 15 nt, Human
auuugaauuuugugu

SEQ ID NO: 1700072 - RNA, 21 nt, Human
auuugacauagucuggcugua

SEQ ID NO: 1700073 - RNA, 17 nt, Human
auuugacauagucuggc

SEQ ID NO: 1700074 - RNA, 16 nt, Human
auuugacauagucugg

SEQ ID NO: 1700075 - RNA, 20 nt, Human
auuucuugagguaaaagcau

SEQ ID NO: 1700076 - RNA, 14 nt, Human
auuuauuuuaauaa

SEQ ID NO: 1700077 - RNA, 16 nt, Human
auuuuaaaagaaugau

SEQ ID NO: 1700078 - RNA, 23 nt, Human
auuuuaaaagaaugauuaugaau

SEQ ID NO: 1700079 - RNA, 14 nt, Human
auuuguauaaaaua

SEQ ID NO: 1700080 - RNA, 22 nt, Human
auuuguaguguuggagaagaac

SEQ ID NO: 1700081 - RNA, 19 nt, Human
auuuguaguguuggagaag

SEQ ID NO: 1700082 - RNA, 22 nt, Human
gcuauuucuauauuuucauucu

SEQ ID NO: 1700083 - RNA, 15 nt, Human
gcuagaacucccuuu

SEQ ID NO: 1700084 - RNA, 14 nt, Human
gcuagaacucccuu

SEQ ID NO: 1700085 - RNA, 13 nt, Human
gcuagaacucccu

SEQ ID NO: 1700086 - RNA, 12 nt, Human
gcuagaacuccc

SEQ ID NO: 1700087 - RNA, 18 nt, Human
gcuagaacucccuuucaa

SEQ ID NO: 1700088 - RNA, 16 nt, Human
gcuagaacucccuuuc

SEQ ID NO: 1700089 - RNA, 15 nt, Human
gcuccacuuggucug

SEQ ID NO: 1700090 - RNA, 19 nt, Human
gcuccacuuggucugugag

SEQ ID NO: 1700091 - RNA, 18 nt, Human
gcuccacuuggucuguga

SEQ ID NO: 1700092 - RNA, 12 nt, Human
gccuccauccug

SEQ ID NO: 1700093 - RNA, 15 nt, Human
gccucuuagaugcag

SEQ ID NO: 1700094 - RNA, 20 nt, Human
gccuucggccuccauccuga

SEQ ID NO: 1700095 - RNA, 23 nt, Human
gccuucggccuccauccugaggc

SEQ ID NO: 1700096 - RNA, 21 nt, Human
gccuucggccuccauccugag

SEQ ID NO: 1700097 - RNA, 14 nt, Human
gcugggguuaucug

SEQ ID NO: 1700098 - RNA, 23 nt, Human
gcugggguuaucugaagucagau

SEQ ID NO: 1700099 - RNA, 22 nt, Human
gcugggguuaucugaagucaga

SEQ ID NO: 1700100 - RNA, 12 nt, Human
ggacuuguuaga

SEQ ID NO: 1700101 - RNA, 15 nt, Human
ggacuuguuagaucu

SEQ ID NO: 1700102 - RNA, 18 nt, Human
ggacuucuuuaauuuugg

SEQ ID NO: 1700103 - RNA, 21 nt, Human
ggacuucuuuaauuuuggaau

SEQ ID NO: 1700104 - RNA, 22 nt, Human
ggacuucuuuaauuuuggaauu

SEQ ID NO: 1700105 - RNA, 13 nt, Human
ggagaaacuggaa

SEQ ID NO: 1700106 - RNA, 17 nt, Human
ggcauaacauaaaucug

SEQ ID NO: 1700107 - RNA, 16 nt, Human
ggcauaacauaaaucu

SEQ ID NO: 1700108 - RNA, 16 nt, Human
ggccuccauccugagg

SEQ ID NO: 1700109 - RNA, 15 nt, Human
ggccuccauccugag

SEQ ID NO: 1700110 - RNA, 14 nt, Human
ggccuccauccuga

SEQ ID NO: 1700111 - RNA, 17 nt, Human
aaaaccaguauuguaca

SEQ ID NO: 1700112 - RNA, 17 nt, Human
aaaaaugguuuaaaugg

SEQ ID NO: 1700113 - RNA, 15 nt, Human
aaaacuucagacaua

SEQ ID NO: 1700114 - RNA, 15 nt, Human
ggcuguacccaggaa

SEQ ID NO: 1700115 - RNA, 14 nt, Human
aaaaauaacaauga

SEQ ID NO: 1700116 - RNA, 22 nt, Human
gggacagucaccucauggaauu

SEQ ID NO: 1700117 - RNA, 21 nt, Human
gggacagucaccucauggaau

SEQ ID NO: 1700118 - RNA, 20 nt, Human
gggacagucaccucauggaa

SEQ ID NO: 1700119 - RNA, 14 nt, Human
ggcuccacuugguc

SEQ ID NO: 1700120 - RNA, 20 nt, Human
aaaggaagguucugguguga

SEQ ID NO: 1700121 - RNA, 14 nt, Human
aaagguacuucaaa

SEQ ID NO: 1700122 - RNA, 11 nt, Human
aaacuuuucug

SEQ ID NO: 1700123 - RNA, 13 nt, Human
aaagacagugaaa

SEQ ID NO: 1700124 - RNA, 23 nt, Human
aaacuucagcgguuuauauaagc

SEQ ID NO: 1700125 - RNA, 19 nt, Human
aaacuucagacauagaauu

SEQ ID NO: 1700126 - RNA, 15 nt, Human
aaagaggaaugaagu

SEQ ID NO: 1700127 - RNA, 22 nt, Human
aaacugcuuguuuccuagcaca

SEQ ID NO: 1700128 - RNA, 19 nt, Human
aaacugcuuguuuccuagc

SEQ ID NO: 1700129 - RNA, 17 nt, Human
aaacugcuuguuuccua

SEQ ID NO: 1700130 - RNA, 14 nt, Human
aaacugcuuguuuc

SEQ ID NO: 1700131 - RNA, 13 nt, Human
aaacugcuuguuu

SEQ ID NO: 1700132 - RNA, 15 nt, Human
aaacucguuaauuug

SEQ ID NO: 1700133 - RNA, 15 nt, Human
aaaccucugugagca

SEQ ID NO: 1700134 - RNA, 14 nt, Human
aaacaguagugaua

SEQ ID NO: 1700135 - RNA, 19 nt, Human
ggggaauugaggacacuga

SEQ ID NO: 1700136 - RNA, 22 nt, Human
aaauacaauuuuguuucuguac

SEQ ID NO: 1700137 - RNA, 21 nt, Human
aaauacaauuuuguuucugua

SEQ ID NO: 1700138 - RNA, 20 nt, Human
aaauacaauuuuguuucugu

SEQ ID NO: 1700139 - RNA, 18 nt, Human
aaauacaauuuuguuucu

SEQ ID NO: 1700140 - RNA, 17 nt, Human
aaauacaauuuuguuuc

SEQ ID NO: 1700141 - RNA, 14 nt, Human
aaauacaauuuugu

SEQ ID NO: 1700142 - RNA, 13 nt, Human
aaauacaauuuug

SEQ ID NO: 1700143 - RNA, 23 nt, Human
aaauaauuuuuauauuugaaaua

SEQ ID NO: 1700144 - RNA, 22 nt, Human
aaauaauuuuuauauuugaaau

SEQ ID NO: 1700145 - RNA, 21 nt, Human
aaauaauuuuuauauuugaaa

SEQ ID NO: 1700146 - RNA, 23 nt, Human
guacacugccuucucaacuccaa

SEQ ID NO: 1700147 - RNA, 20 nt, Human
guaauaggcguaacuaauuu

SEQ ID NO: 1700148 - RNA, 23 nt, Human
aaaguugccuaaauccauuugga

SEQ ID NO: 1700149 - RNA, 17 nt, Human
aaaguugccuaaaucca

SEQ ID NO: 1700150 - RNA, 16 nt, Human
aaaguugccuaaaucc

SEQ ID NO: 1700151 - RNA, 14 nt, Human
aaaguuuaauauua

SEQ ID NO: 1700152 - RNA, 12 nt, Human
aaaguuuaauau

SEQ ID NO: 1700153 - RNA, 14 nt, Human
aaaguugccuaaau

SEQ ID NO: 1700154 - RNA, 13 nt, Human
aaaguugccuaaa

SEQ ID NO: 1700155 - RNA, 23 nt, Human
aaaguucugcagauaaacaguag

SEQ ID NO: 1700156 - RNA, 20 nt, Human
aaaguauuaagcauauauuu

SEQ ID NO: 1700157 - RNA, 19 nt, Human
aaaguauuaagcauauauu

SEQ ID NO: 1700158 - RNA, 18 nt, Human
aaaguauuaagcauauau

SEQ ID NO: 1700159 - RNA, 13 nt, Human
aaaguauuaagca

SEQ ID NO: 1700160 - RNA, 20 nt, Human
aaagguauuuuaaucaccaa

SEQ ID NO: 1700161 - RNA, 18 nt, Human
aaaguauguuagugcaaa

SEQ ID NO: 1700162 - RNA, 15 nt, Human
guacuucaugcuguc

SEQ ID NO: 1700163 - RNA, 22 nt, Human
guacuucaaauccuugaagauu

SEQ ID NO: 1700164 - RNA, 21 nt, Human
guacuucaaauccuugaagau

SEQ ID NO: 1700165 - RNA, 18 nt, Human
aaauccauacauuugugu

SEQ ID NO: 1700166 - RNA, 15 nt, Human
aaauccauacauuug

SEQ ID NO: 1700167 - RNA, 17 nt, Human
aaauauuauguuaaaac

SEQ ID NO: 1700168 - RNA, 19 nt, Human
gacuuuggauaauaaggaa

SEQ ID NO: 1700169 - RNA, 17 nt, Human
gacuguggugacuuugg

SEQ ID NO: 1700170 - RNA, 14 nt, Human
gacagaaagcagaa

SEQ ID NO: 1700171 - RNA, 20 nt, Human
gacagaaagcagaacaguga

SEQ ID NO: 1700172 - RNA, 21 nt, Human
gacagcccuucuuuccacaga

SEQ ID NO: 1700173 - RNA, 20 nt, Human
gacaguauggcagcuuuccu

SEQ ID NO: 1700174 - RNA, 15 nt, Human
gagcgacagugagac

SEQ ID NO: 1700175 - RNA, 13 nt, Human
gagcgacagugag

SEQ ID NO: 1700176 - RNA, 18 nt, Human
gaugucuucauaccuaca

SEQ ID NO: 1700177 - RNA, 14 nt, Human
gaugucuucauacc

SEQ ID NO: 1700178 - RNA, 15 nt, Human
gauucuuaaaguuga

SEQ ID NO: 1700179 - RNA, 17 nt, Human
gauucuuaaaguugaau

SEQ ID NO: 1700180 - RNA, 16 nt, Human
gauucuuaaaguugaa

SEQ ID NO: 1700181 - RNA, 21 nt, Human
gauucuuaaaguugaauuuau

SEQ ID NO: 1700182 - RNA, 16 nt, Human
gcaaaaauauuuuaug

SEQ ID NO: 1700183 - RNA, 23 nt, Human
gcaaaaauauuuuaugauccagc

SEQ ID NO: 1700184 - RNA, 22 nt, Human
gcaaaaauauuuuaugauccag

SEQ ID NO: 1700185 - RNA, 17 nt, Human
gcaaaaauauuuuauga

SEQ ID NO: 1700186 - RNA, 18 nt, Human
gcaauagucaaauugugu

SEQ ID NO: 1700187 - RNA, 13 nt, Human
gcauaacauaaau

SEQ ID NO: 1700188 - RNA, 15 nt, Human
gcagcuuauucacaa

SEQ ID NO: 1700189 - RNA, 22 nt, Human
cuuucagauacuggauuguacu

SEQ ID NO: 1700190 - RNA, 17 nt, Human
cuuucagauacuggauu

SEQ ID NO: 1700191 - RNA, 15 nt, Human
cuuucagauacugga

SEQ ID NO: 1700192 - RNA, 14 nt, Human
cuuucagauacugg

SEQ ID NO: 1700193 - RNA, 18 nt, Human
cuugucucagauuuuauu

SEQ ID NO: 1700194 - RNA, 13 nt, Human
cuugucucagauu

SEQ ID NO: 1700195 - RNA, 17 nt, Human
cuugucucagauuuuau

SEQ ID NO: 1700196 - RNA, 14 nt, Human
cuugucucagauuu

SEQ ID NO: 1700197 - RNA, 16 nt, Human
cuuggucugugagaug

SEQ ID NO: 1700198 - RNA, 19 nt, Human
cuuggucugugagaugcua

SEQ ID NO: 1700199 - RNA, 13 nt, Human
cuucucacauuua

SEQ ID NO: 1700200 - RNA, 20 nt, Human
cuucucacauuuauauuuuu

SEQ ID NO: 1700201 - RNA, 17 nt, Human
gaaacuggguuccugca

SEQ ID NO: 1700202 - RNA, 18 nt, Human
gaaagaaaaucaggcugg

SEQ ID NO: 1700203 - RNA, 21 nt, Human
gaaacugcuuguuuccuagca

SEQ ID NO: 1700204 - RNA, 15 nt, Human
gaaaucuuuaaaaaa

SEQ ID NO: 1700205 - RNA, 12 nt, Human
gaaaucuuuaaa

SEQ ID NO: 1700206 - RNA, 17 nt, Human
gaaaugaaagcagggac

SEQ ID NO: 1700207 - RNA, 18 nt, Human
gaacacuccaauuaagga

SEQ ID NO: 1700208 - RNA, 21 nt, Human
gaaaacuuuaugcuaagugaa

SEQ ID NO: 1700209 - RNA, 19 nt, Human
gaacccgggaggcagaggu

SEQ ID NO: 1700210 - RNA, 17 nt, Human
gaacccgggaggcagag

SEQ ID NO: 1700211 - RNA, 13 nt, Human
gaacugaaaucau

SEQ ID NO: 1700212 - RNA, 20 nt, Human
cuguuauuuauaaucacuuu

SEQ ID NO: 1700213 - RNA, 14 nt, Human
cuguuauuuauaau

SEQ ID NO: 1700214 - RNA, 18 nt, Human
cuuaaaguugaauuuauu

SEQ ID NO: 1700215 - RNA, 15 nt, Human
cuuaaaguugaauuu

SEQ ID NO: 1700216 - RNA, 14 nt, Human
cuuaaaguugaauu

SEQ ID NO: 1700217 - RNA, 22 nt, Human
cuuaaauaauaaagaucaugua

SEQ ID NO: 1700218 - RNA, 13 nt, Human
cuuaaauaauaaa

SEQ ID NO: 1700219 - RNA, 22 nt, Human
cuuaaaguugaauuuauuggcu

SEQ ID NO: 1700220 - RNA, 21 nt, Human
cuuaaaaaugguuuaaauggu

SEQ ID NO: 1700221 - RNA, 19 nt, Human
cuguuauaaucuuucacag

SEQ ID NO: 1700222 - RNA, 13 nt, Human
cuguuauaaucuu

SEQ ID NO: 1700223 - RNA, 22 nt, Human
cauugguucuuguauuaagaau

SEQ ID NO: 1700224 - RNA, 18 nt, Human
cauugguucuuguauuaa

SEQ ID NO: 1700225 - RNA, 18 nt, Human
ccacagaagcuccaggua

SEQ ID NO: 1700226 - RNA, 18 nt, Human
ccaccagucugacuguuu

SEQ ID NO: 1700227 - RNA, 16 nt, Human
ccacagaagcuccagg

SEQ ID NO: 1700228 - RNA, 21 nt, Human
caguauuguacaaaguauuaa

SEQ ID NO: 1700229 - RNA, 15 nt, Human
cagucaccucaugga

SEQ ID NO: 1700230 - RNA, 13 nt, Human
caguauuguacaa

SEQ ID NO: 1700231 - RNA, 12 nt, Human
caguauuguaca

SEQ ID NO: 1700232 - RNA, 19 nt, Human
caguauuguacaaaguauu

SEQ ID NO: 1700233 - RNA, 18 nt, Human
caguauuguacaaaguau

SEQ ID NO: 1700234 - RNA, 17 nt, Human
caguauuguacaaagua

SEQ ID NO: 1700235 - RNA, 16 nt, Human
caguauuguacaaagu

SEQ ID NO: 1700236 - RNA, 18 nt, Human
cagggaggacgcucucug

SEQ ID NO: 1700237 - RNA, 17 nt, Human
cagggaggacgcucucu

SEQ ID NO: 1700238 - RNA, 19 nt, Human
cagggaggacgcucucugg

SEQ ID NO: 1700239 - RNA, 22 nt, Human
cagcacagccucuuagaugcag

SEQ ID NO: 1700240 - RNA, 22 nt, Human
cagccugagcgacagugagacu

SEQ ID NO: 1700241 - RNA, 19 nt, Human
cagccugagcgacagugag

SEQ ID NO: 1700242 - RNA, 18 nt, Human
cagccugagcgacaguga

SEQ ID NO: 1700243 - RNA, 20 nt, Human
cagcccuucuuuccacagaa

SEQ ID NO: 1700244 - RNA, 19 nt, Human
cagcccuucuuuccacaga

SEQ ID NO: 1700245 - RNA, 15 nt, Human
cagcccuucuuucca

SEQ ID NO: 1700246 - RNA, 19 nt, Human
auuguacaaaguauuaagc

SEQ ID NO: 1700247 - RNA, 17 nt, Human
auuguacaaaguauuaa

SEQ ID NO: 1700248 - RNA, 16 nt, Human
auuguacaaaguauua

SEQ ID NO: 1700249 - RNA, 21 nt, Human
auuguaauuauaucugaggaa

SEQ ID NO: 1700250 - RNA, 15 nt, Human
auuguaauuauaucu

SEQ ID NO: 1700251 - RNA, 17 nt, Human
auuguaauuauaucuga

SEQ ID NO: 1700252 - RNA, 16 nt, Human
auuguaauuauaucug

SEQ ID NO: 1700253 - RNA, 16 nt, Human
auuucuauauuuucau

SEQ ID NO: 1700254 - RNA, 15 nt, Human
auuucuauauuuuca

SEQ ID NO: 1700255 - RNA, 18 nt, Human
auuucuauauuuucauuc

SEQ ID NO: 1700256 - RNA, 17 nt, Human
auuucuauauuuucauu

SEQ ID NO: 1700257 - RNA, 14 nt, Human
auuucuaugaaaua

SEQ ID NO: 1700258 - RNA, 22 nt, Human
auuucuaugcugaguuugugcu

SEQ ID NO: 1700259 - RNA, 21 nt, Human
auuucuaugcugaguuugugc

SEQ ID NO: 1700260 - RNA, 19 nt, Human
auuucuaugcugaguuugu

SEQ ID NO: 1700261 - RNA, 19 nt, Human
auuucuauauuuucauucu

SEQ ID NO: 1700262 - RNA, 22 nt, Human
auuuauaaucacuuuuuuccac

SEQ ID NO: 1700263 - RNA, 13 nt, Human
auuuauaaucacu

SEQ ID NO: 1700264 - RNA, 15 nt, Human
auuuauaaucacuuu

SEQ ID NO: 1700265 - RNA, 12 nt, Human
auuauguaaauc

SEQ ID NO: 1700266 - RNA, 22 nt, Human
auuaugaauuacauuuguauaa

SEQ ID NO: 1700267 - RNA, 20 nt, Human
auuaugaauuacauuuguau

SEQ ID NO: 1700268 - RNA, 19 nt, Human
auuaugaauuacauuugua

SEQ ID NO: 1700269 - RNA, 19 nt, Human
auuuuaugcuuuaaacauu

SEQ ID NO: 1700270 - RNA, 18 nt, Human
auuuuaugcuuuaaacau

SEQ ID NO: 1700271 - RNA, 18 nt, Human
auuuuagcuacuauauau

SEQ ID NO: 1700272 - RNA, 21 nt, Human
auuuuauaucaauuuaaaaaa

SEQ ID NO: 1700273 - RNA, 16 nt, Human
auuuuuauauuuacua

SEQ ID NO: 1700274 - RNA, 15 nt, Human
auuuuuauauuuacu

SEQ ID NO: 1700275 - RNA, 16 nt, Human
auuuuuauauuugaaa

SEQ ID NO: 1700276 - RNA, 15 nt, Human
auuuuuauauuugaa

SEQ ID NO: 1700277 - RNA, 13 nt, Human
auuuuuuuguugu

SEQ ID NO: 1700278 - RNA, 17 nt, Human
caaacauauauaacaau

SEQ ID NO: 1700279 - RNA, 21 nt, Human
caaaaggauaaugaauacuuu

SEQ ID NO: 1700280 - RNA, 19 nt, Human
caagacccaaaaggcagaa

SEQ ID NO: 1700281 - RNA, 22 nt, Human
caccuuucagauaacuguuauu

SEQ ID NO: 1700282 - RNA, 21 nt, Human
caccuuucagauaacuguuau

SEQ ID NO: 1700283 - RNA, 12 nt, Human
cacuccagccug

SEQ ID NO: 1700284 - RNA, 13 nt, Human
cacuccagccuga

SEQ ID NO: 1700285 - RNA, 23 nt, Human
cacuccagccugagcgacaguga

SEQ ID NO: 1700286 - RNA, 15 nt, Human
cacuuaaaaaugguu

SEQ ID NO: 1700287 - RNA, 17 nt, Human
cacuuguguuuugcaag

SEQ ID NO: 1700288 - RNA, 18 nt, Human
cagaacagugauuaccag

SEQ ID NO: 1700289 - RNA, 17 nt, Human
cagaacagugauuacca

SEQ ID NO: 1700290 - RNA, 12 nt, Human
cagaacagugau

SEQ ID NO: 1700291 - RNA, 11 nt, Human
cagaacaguga

SEQ ID NO: 1700292 - RNA, 23 nt, Human
caaguuguuugagaaauuaagua

SEQ ID NO: 1700293 - RNA, 21 nt, Human
caaguuguuugagaaauuaag

SEQ ID NO: 1700294 - RNA, 17 nt, Human
caaguuguuugagaaau

SEQ ID NO: 1700295 - RNA, 13 nt, Human
caaguuguuugag

SEQ ID NO: 1700296 - RNA, 23 nt, Human
caauaaaauccauacauuugugu

SEQ ID NO: 1700297 - RNA, 20 nt, Human
caauaaaauccauacauuug

SEQ ID NO: 1700298 - RNA, 20 nt, Human
cucagaaggcaaaugacuuu

SEQ ID NO: 1700299 - RNA, 23 nt, Human
cucagaaaacaaggaugaauuaa

SEQ ID NO: 1700300 - RNA, 19 nt, Human
cucagaaaacaaggaugaa

SEQ ID NO: 1700301 - RNA, 23 nt, Human
cuaugucauuugcuggagcucug

SEQ ID NO: 1700302 - RNA, 14 nt, Human
cuacuauauaugug

SEQ ID NO: 1700303 - RNA, 16 nt, Human
cuaaacuuuucugaua

SEQ ID NO: 1700304 - RNA, 15 nt, Human
cuaaacuuuucugau

SEQ ID NO: 1700305 - RNA, 15 nt, Human
cgguuuauauaagcu

SEQ ID NO: 1700306 - RNA, 13 nt, Human
cuccuuucucuuu

SEQ ID NO: 1700307 - RNA, 17 nt, Human
cucucuggccuucggcc

SEQ ID NO: 1700308 - RNA, 22 nt, Human
cucucuggccuucggccuccau

SEQ ID NO: 1700309 - RNA, 19 nt, Human
cucucuggccuucggccuc

SEQ ID NO: 1700310 - RNA, 19 nt, Human
cuccccaugauguuuagaa

SEQ ID NO: 1700311 - RNA, 16 nt, Human
cugaggaauucuguau

SEQ ID NO: 1700312 - RNA, 15 nt, Human
cugaggaauucugua

SEQ ID NO: 1700313 - RNA, 19 nt, Human
cugaggaauucuguauaga

SEQ ID NO: 1700314 - RNA, 18 nt, Human
cugaggaauucuguauag

SEQ ID NO: 1700315 - RNA, 17 nt, Human
cugaaagaggaaugaag

SEQ ID NO: 1700316 - RNA, 13 nt, Human
cugaaagaggaau

SEQ ID NO: 1700317 - RNA, 17 nt, Human
ccugucucuacuaaaaa

SEQ ID NO: 1700318 - RNA, 16 nt, Human
ccucccuucucuucac

SEQ ID NO: 1700319 - RNA, 13 nt, Human
ccccugcacucca

SEQ ID NO: 1700320 - RNA, 13 nt, Human
cccaacuccagaa

SEQ ID NO: 1700321 - RNA, 13 nt, Human
ccauuuggaaauc

SEQ ID NO: 1700322 - RNA, 11 nt, Human
ccauuauucaa

SEQ ID NO: 1700323 - RNA, 18 nt, Human
ccauccugaggcuccacu

SEQ ID NO: 1700324 - RNA, 20 nt, Human
ccauccugaggcuccacuug

SEQ ID NO: 1700325 - RNA, 20 nt, Human
ccagguagaggguguguaag

SEQ ID NO: 1700326 - RNA, 15 nt, Human
ccacugguucuucuu

SEQ ID NO: 1700327 - RNA, 14 nt, Human
ccagacaucaacag

SEQ ID NO: 1700328 - RNA, 19 nt, Human
ccagccugagcgacaguga

SEQ ID NO: 1700329 - RNA, 16 nt, Human
ccccacccugccucac

SEQ ID NO: 1700330 - RNA, 23 nt, Human
cccauuauucaaaguugccuaaa

SEQ ID NO: 1700331 - RNA, 18 nt, Human
cccauuauucaaaguugc

SEQ ID NO: 1700332 - RNA, 15 nt, Human
ccuaacgaaguaucc

SEQ ID NO: 1700333 - RNA, 15 nt, Human
cccuugaugaagaag

SEQ ID NO: 1700334 - RNA, 21 nt, Human
cuaaaauggacuguggugacu

SEQ ID NO: 1700335 - RNA, 22 nt, Human
cuaaaauggacuguggugacuu

SEQ ID NO: 1700336 - RNA, 20 nt, Human
cgggaggcagagguugcagu

SEQ ID NO: 1700337 - RNA, 15 nt, Human
cuaagagagaaugag

SEQ ID NO: 1700338 - RNA, 14 nt, Human
cuaagagagaauga

SEQ ID NO: 1700339 - RNA, 19 nt, Human
cuaaauugacacuuaaaaa

SEQ ID NO: 1700340 - RNA, 22 nt, Human
cuaaggacuucuuuaauuuugg

SEQ ID NO: 1700341 - RNA, 16 nt, Human
cuaaggacuucuuuaa

SEQ ID NO: 1700342 - RNA, 15 nt, Human
cuaaggacuucuuua

SEQ ID NO: 1700343 - RNA, 14 nt, Human
cuaaggacuucuuu

SEQ ID NO: 1700344 - RNA, 21 nt, Human
cuaagcuucacuguaaaauaa

SEQ ID NO: 1700345 - RNA, 14 nt, Human
cuacacuaagagag

SEQ ID NO: 1700346 - RNA, 23 nt, Human
cuacacgagauacagaauuuuau

SEQ ID NO: 1700347 - RNA, 22 nt, Human
cuaggaaauauuuauuuuaaua

SEQ ID NO: 1700348 - RNA, 23 nt, Human
cuagacuggugacugauucuuca

SEQ ID NO: 1700349 - RNA, 22 nt, Human
cuagacuggugacugauucuuc

SEQ ID NO: 1700350 - RNA, 19 nt, Human
cuagacuggugacugauuc

SEQ ID NO: 1700351 - RNA, 18 nt, Human
cuagacuggugacugauu

SEQ ID NO: 1700352 - RNA, 17 nt, Human
cuagacuggugacugau

SEQ ID NO: 1700353 - RNA, 15 nt, Human
cuagacuggugacug

SEQ ID NO: 1700354 - RNA, 14 nt, Human
cuagacuggugacu

SEQ ID NO: 1700355 - RNA, 19 nt, Human
cuagaguuuagcuggaaaa

SEQ ID NO: 1700356 - RNA, 18 nt, Human
cuagaguuuagcuggaaa

SEQ ID NO: 1700357 - RNA, 20 nt, Human
cuaggaaauauuuauuuuaa

SEQ ID NO: 1700358 - RNA, 19 nt, Human
cuaggaaauauuuauuuua

SEQ ID NO: 1700359 - RNA, 15 nt, Human
cuaggaaauauuuau

SEQ ID NO: 1700360 - RNA, 14 nt, Human
cuaggaaauauuua

SEQ ID NO: 1700361 - RNA, 13 nt, Human
cuaugcugaguuu

SEQ ID NO: 1700362 - RNA, 15 nt, Human
cuaugcugaguuugu

SEQ ID NO: 1700363 - RNA, 14 nt, Human
cuaugcugaguuug

SEQ ID NO: 1700364 - RNA, 12 nt, Human
cuauaauuuaaa

SEQ ID NO: 1700365 - RNA, 13 nt, Human
cuauaauuuaaau

SEQ ID NO: 1700366 - RNA, 19 nt, Human
cuaugaaauauuauguuaa

SEQ ID NO: 1700367 - RNA, 18 nt, Human
cucaaccaccuuucagau

SEQ ID NO: 1700368 - RNA, 20 nt, Human
cuauuucuauauuuucauuc

SEQ ID NO: 1700369 - RNA, 19 nt, Human
cuauuucuauauuuucauu

SEQ ID NO: 1700370 - RNA, 22 nt, Human
cucccuauuuuuuuucuguuau

SEQ ID NO: 1700371 - RNA, 20 nt, Human
cuccauuuaauaauuauaug

SEQ ID NO: 1700372 - RNA, 13 nt, Human
cuccauuuaauaa

SEQ ID NO: 1700373 - RNA, 17 nt, Human
cucauuuccaagcaagu

SEQ ID NO: 1700374 - RNA, 14 nt, Human
cucauuuccaagca

SEQ ID NO: 1700375 - RNA, 13 nt, Human
cucauuuccaagc

SEQ ID NO: 1700376 - RNA, 12 nt, Human
cucauuuccaag

SEQ ID NO: 1700377 - RNA, 22 nt, Human
cucagauuuuauuauguaaauc

SEQ ID NO: 1700378 - RNA, 23 nt, Human
cucagauuuuauuauguaaaucc

SEQ ID NO: 1700379 - RNA, 24 nt, Human
cgcguugaaauuguaauuauaucu

SEQ ID NO: 1700380 - RNA, 19 nt, Human
cgcuaaacuuuucugauag

SEQ ID NO: 1700381 - RNA, 18 nt, Human
cgcuaaacuuuucugaua

SEQ ID NO: 1700382 - RNA, 17 nt, Human
cgcuaaacuuuucugau

SEQ ID NO: 1700383 - RNA, 18 nt, Human
ccuucggccuccauccug

SEQ ID NO: 1700384 - RNA, 17 nt, Human
ccuucggccuccauccu

SEQ ID NO: 1700385 - RNA, 14 nt, Human
ccugaggcuccacu

SEQ ID NO: 1700386 - RNA, 13 nt, Human
ccugaggcuccac

SEQ ID NO: 1700387 - RNA, 17 nt, Human
ccugaggcuccacuugg

SEQ ID NO: 1700388 - RNA, 13 nt, Human
ccugaaagaggaa

SEQ ID NO: 1700389 - RNA, 17 nt, Human
ccugccccugagcccau

SEQ ID NO: 1700390 - RNA, 23 nt, Human
gaaaaguuuaauauuaaagccau

SEQ ID NO: 1700391 - RNA, 22 nt, Human
gaaaaucuacacuccagugaga

SEQ ID NO: 1700392 - RNA, 18 nt, Human
gaaaaucuuauaauuuaa

SEQ ID NO: 1700393 - RNA, 15 nt, Human
gaaaaguuuaauauu

SEQ ID NO: 1700394 - RNA, 22 nt, Human
gaaaaguuuaauauuaaagcca

SEQ ID NO: 1700395 - RNA, 21 nt, Human
gaaaaguuuaauauuaaagcc

SEQ ID NO: 1700396 - RNA, 20 nt, Human
gaaaaguuuaauauuaaagc

SEQ ID NO: 1700397 - RNA, 19 nt, Human
gaaaaguuuaauauuaaag

SEQ ID NO: 1700398 - RNA, 22 nt, Human
cuuuuuggcauaacauaaaucu

SEQ ID NO: 1700399 - RNA, 20 nt, Human
cuuuuuggcauaacauaaau

SEQ ID NO: 1700400 - RNA, 16 nt, Human
cuuuuuggcauaacau

SEQ ID NO: 1700401 - RNA, 18 nt, Human
gaaacggaugauuucuau

SEQ ID NO: 1700402 - RNA, 17 nt, Human
gaaacggaugauuucua

SEQ ID NO: 1700403 - RNA, 23 nt, Human
gaaacucguuaauuuguaguguu

SEQ ID NO: 1700404 - RNA, 14 nt, Human
gaaacccugucucu

SEQ ID NO: 1700405 - RNA, 16 nt, Human
gaaacacaacuauauu

SEQ ID NO: 1700406 - RNA, 11 nt, Human
gaaacauuugg

SEQ ID NO: 1700407 - RNA, 17 nt, Human
gaaagagaacuuccaga

SEQ ID NO: 1700408 - RNA, 21 nt, Human
gaaagaggaaugaaguacuca

SEQ ID NO: 1700409 - RNA, 17 nt, Human
gaaagcagaacagugau

SEQ ID NO: 1700410 - RNA, 22 nt, Human
gaaagcagaacagugauuacca

SEQ ID NO: 1700411 - RNA, 14 nt, Human
gaaagcagggacuu

SEQ ID NO: 1700412 - RNA, 21 nt, Human
gaaagcuugcccuggugccuc

SEQ ID NO: 1700413 - RNA, 21 nt, Human
cuuuaaacauugguucuugua

SEQ ID NO: 1700414 - RNA, 22 nt, Human
cuuguuagaucuaguucacucu

SEQ ID NO: 1700415 - RNA, 12 nt, Human
cuuguguaaaua

SEQ ID NO: 1700416 - RNA, 21 nt, Human
cuuguguaaauacaauuuugu

SEQ ID NO: 1700417 - RNA, 16 nt, Human
cuuguguaaauacaau

SEQ ID NO: 1700418 - RNA, 14 nt, Human
cuuguguaaauaca

SEQ ID NO: 1700419 - RNA, 23 nt, Human
cuugucaauaaaauccauacauu

SEQ ID NO: 1700420 - RNA, 17 nt, Human
cuuguacuuuauuuucu

SEQ ID NO: 1700421 - RNA, 19 nt, Human
cuugaguuuaaauuguaau

SEQ ID NO: 1700422 - RNA, 16 nt, Human
cuuucucuuucguuac

SEQ ID NO: 1700423 - RNA, 20 nt, Human
cuuugucuacaccauuaugu

SEQ ID NO: 1700424 - RNA, 23 nt, Human
cuuugucuacaccauuaugugcg

SEQ ID NO: 1700425 - RNA, 22 nt, Human
cuuugugcugggguuaucugaa

SEQ ID NO: 1700426 - RNA, 20 nt, Human
cuuugugcugggguuaucug

SEQ ID NO: 1700427 - RNA, 15 nt, Human
cuuugugcugggguu

SEQ ID NO: 1700428 - RNA, 18 nt, Human
cuucuuuaauuuuggaau

SEQ ID NO: 1700429 - RNA, 17 nt, Human
cuucuuuaauuuuggaa

SEQ ID NO: 1700430 - RNA, 16 nt, Human
cuucuuuaauuuugga

SEQ ID NO: 1700431 - RNA, 15 nt, Human
cuucuuuaauuuugg

SEQ ID NO: 1700432 - RNA, 19 nt, Human
cuucuuuaauuuuggaauu

SEQ ID NO: 1700433 - RNA, 22 nt, Human
cuuagaugcaguucugaagaag

SEQ ID NO: 1700434 - RNA, 20 nt, Human
cuuagaugcaguucugaaga

SEQ ID NO: 1700435 - RNA, 16 nt, Human
cuguauagauuagaau

SEQ ID NO: 1700436 - RNA, 19 nt, Human
cuguauuuuaaaagaauga

SEQ ID NO: 1700437 - RNA, 20 nt, Human
cuguauuuuaaaagaaugau

SEQ ID NO: 1700438 - RNA, 22 nt, Human
cuguauuuuaaaagaaugauua

SEQ ID NO: 1700439 - RNA, 20 nt, Human
cugucuacacuaagagagaa

SEQ ID NO: 1700440 - RNA, 23 nt, Human
cuguaaucacagcuacuugggag

SEQ ID NO: 1700441 - RNA, 22 nt, Human
cugggggggauuguaaaauggu

SEQ ID NO: 1700442 - RNA, 15 nt, Human
cugccuaaggacuuc

SEQ ID NO: 1700443 - RNA, 14 nt, Human
cugccuaaggacuu

SEQ ID NO: 1700444 - RNA, 13 nt, Human
cugccuaaggacu

SEQ ID NO: 1700445 - RNA, 12 nt, Human
cugccuaaggac

SEQ ID NO: 1700446 - RNA, 13 nt, Human
cuggagcucugcc

SEQ ID NO: 1700447 - RNA, 12 nt, Human
cuggagcucugc

SEQ ID NO: 1700448 - RNA, 16 nt, Human
cuggagcucugcccau

SEQ ID NO: 1700449 - RNA, 23 nt, Human
cuggccuucggccuccauccuga

SEQ ID NO: 1700450 - RNA, 22 nt, Human
cuggccuucggccuccauccug

SEQ ID NO: 1700451 - RNA, 13 nt, Human
gagaguguugaaa

SEQ ID NO: 1700452 - RNA, 20 nt, Human
gagacagcucugcauacuca

SEQ ID NO: 1700453 - RNA, 21 nt, Human
gagaaugagagacacacugaa

SEQ ID NO: 1700454 - RNA, 20 nt, Human
gagaaugagagacacacuga

SEQ ID NO: 1700455 - RNA, 21 nt, Human
gacuucuuuaauuuuggaauu

SEQ ID NO: 1700456 - RNA, 20 nt, Human
gacuucuuuaauuuuggaau

SEQ ID NO: 1700457 - RNA, 19 nt, Human
gacuucuuuaauuuuggaa

SEQ ID NO: 1700458 - RNA, 18 nt, Human
gacuucuuuaauuuugga

SEQ ID NO: 1700459 - RNA, 17 nt, Human
gacuucuuuaauuuugg

SEQ ID NO: 1700460 - RNA, 16 nt, Human
gacuucuuuaauuuug

SEQ ID NO: 1700461 - RNA, 22 nt, Human
gagaaccuagggugauauuaac

SEQ ID NO: 1700462 - RNA, 21 nt, Human
gagaaccuagggugauauuaa

SEQ ID NO: 1700463 - RNA, 23 nt, Human
gagaacuuccagauccuggaaau

SEQ ID NO: 1700464 - RNA, 22 nt, Human
gagaacuuccagauccuggaaa

SEQ ID NO: 1700465 - RNA, 17 nt, Human
gagaaugagagacacac

SEQ ID NO: 1700466 - RNA, 16 nt, Human
gacugcauuauauuua

SEQ ID NO: 1700467 - RNA, 14 nt, Human
gacugcauuauauu

SEQ ID NO: 1700468 - RNA, 13 nt, Human
gaauucuguauag

SEQ ID NO: 1700469 - RNA, 22 nt, Human
gaauucuguauagauuagaauu

SEQ ID NO: 1700470 - RNA, 21 nt, Human
gaauucuguauagauuagaau

SEQ ID NO: 1700471 - RNA, 14 nt, Human
gaauucuguauaga

SEQ ID NO: 1700472 - RNA, 21 nt, Human
gaauugacccacaagaaauga

SEQ ID NO: 1700473 - RNA, 16 nt, Human
gaauugacccacaaga

SEQ ID NO: 1700474 - RNA, 16 nt, Human
gaauuggagcucgugg

SEQ ID NO: 1700475 - RNA, 16 nt, Human
gaauggcuuuguauag

SEQ ID NO: 1700476 - RNA, 14 nt, Human
gaauggcuuuguau

SEQ ID NO: 1700477 - RNA, 17 nt, Human
gaauggcuuuguauaga

SEQ ID NO: 1700478 - RNA, 18 nt, Human
gaaugaaauacuguuuga

SEQ ID NO: 1700479 - RNA, 15 nt, Human
gaaugaaauacuguu

SEQ ID NO: 1700480 - RNA, 19 nt, Human
gaaugaaauacuguuugag

SEQ ID NO: 1700481 - RNA, 16 nt, Human
gacaaggaaaaaauaa

SEQ ID NO: 1700482 - RNA, 17 nt, Human
gacagggaggacgcucu

SEQ ID NO: 1700483 - RNA, 18 nt, Human
gacagggaggacgcucuc

SEQ ID NO: 1700484 - RNA, 20 nt, Human
gacauagaauuaacacauga

SEQ ID NO: 1700485 - RNA, 22 nt, Human
gacccacaagaaaugaaagcag

SEQ ID NO: 1700486 - RNA, 15 nt, Human
gacccacaagaaaug

SEQ ID NO: 1700487 - RNA, 16 nt, Human
gacccaaaaggcagaa

SEQ ID NO: 1700488 - RNA, 21 nt, Human
gaccacugcagaagacaguau

SEQ ID NO: 1700489 - RNA, 16 nt, Human
gacaugggacauuugc

SEQ ID NO: 1700490 - RNA, 13 nt, Human
gauuuuaugcuuu

SEQ ID NO: 1700491 - RNA, 16 nt, Human
gcaaauugucacagga

SEQ ID NO: 1700492 - RNA, 22 nt, Human
gaugguucccuugaugaagaag

SEQ ID NO: 1700493 - RNA, 22 nt, Human
gaugcuagaacucccuuucaac

SEQ ID NO: 1700494 - RNA, 20 nt, Human
gaugcuagaacucccuuuca

SEQ ID NO: 1700495 - RNA, 18 nt, Human
gaugcuagaacucccuuu

SEQ ID NO: 1700496 - RNA, 19 nt, Human
gcacuguggguagacacac

SEQ ID NO: 1700497 - RNA, 16 nt, Human
gaguguugaaacggau

SEQ ID NO: 1700498 - RNA, 12 nt, Human
gaguguugaaac

SEQ ID NO: 1700499 - RNA, 20 nt, Human
gauaaaugccaucaauaaaa

SEQ ID NO: 1700500 - RNA, 22 nt, Human
gauaaauggcuuccuggcaaua

SEQ ID NO: 1700501 - RNA, 15 nt, Human
gauaaaugccaucaa

SEQ ID NO: 1700502 - RNA, 11 nt, Human
gauaaaugcca

SEQ ID NO: 1700503 - RNA, 18 nt, Human
gauaacuguuauuuauaa

SEQ ID NO: 1700504 - RNA, 17 nt, Human
gauaacuguuauuuaua

SEQ ID NO: 1700505 - RNA, 19 nt, Human
gaggcagagguugcaguga

SEQ ID NO: 1700506 - RNA, 17 nt, Human
ggaauucuguauagauu

SEQ ID NO: 1700507 - RNA, 15 nt, Human
ggaauucuguauaga

SEQ ID NO: 1700508 - RNA, 12 nt, Human
ggaauucuguau

SEQ ID NO: 1700509 - RNA, 22 nt, Human
ggaauuggagcucgugggacag

SEQ ID NO: 1700510 - RNA, 16 nt, Human
ggaauuggagcucgug

SEQ ID NO: 1700511 - RNA, 20 nt, Human
ggaagugacgguuuaauggg

SEQ ID NO: 1700512 - RNA, 23 nt, Human
ggaccaaaaaccaguauuguaca

SEQ ID NO: 1700513 - RNA, 16 nt, Human
ggaccaaaaaccagua

SEQ ID NO: 1700514 - RNA, 16 nt, Human
ggacauuugcucaugg

SEQ ID NO: 1700515 - RNA, 14 nt, Human
ggaccaaaaaccag

SEQ ID NO: 1700516 - RNA, 14 nt, Human
ggacuguggugacu

SEQ ID NO: 1700517 - RNA, 14 nt, Human
ggacgcucucuggc

SEQ ID NO: 1700518 - RNA, 13 nt, Human
ggacgcucucugg

SEQ ID NO: 1700519 - RNA, 15 nt, Human
ggacgcucucuggcc

SEQ ID NO: 1700520 - RNA, 22 nt, Human
ggacuguggugacuuuggauaa

SEQ ID NO: 1700521 - RNA, 21 nt, Human
ggacuguggugacuuuggaua

SEQ ID NO: 1700522 - RNA, 17 nt, Human
ggacuguggugacuuug

SEQ ID NO: 1700523 - RNA, 15 nt, Human
ggacuguggugacuu

SEQ ID NO: 1700524 - RNA, 19 nt, Human
ggagaaucacuugaacccg

SEQ ID NO: 1700525 - RNA, 15 nt, Human
ggagaaucacuugaa

SEQ ID NO: 1700526 - RNA, 23 nt, Human
gcuuucagauacuggauuguacu

SEQ ID NO: 1700527 - RNA, 18 nt, Human
gcuuucagauacuggauu

SEQ ID NO: 1700528 - RNA, 14 nt, Human
gcuuucagauacug

SEQ ID NO: 1700529 - RNA, 14 nt, Human
ggaaaaguuuaaua

SEQ ID NO: 1700530 - RNA, 20 nt, Human
gcugucuacacuaagagaga

SEQ ID NO: 1700531 - RNA, 16 nt, Human
ggauucuuaaaguuga

SEQ ID NO: 1700532 - RNA, 19 nt, Human
ggauucuuaaaguugaauu

SEQ ID NO: 1700533 - RNA, 18 nt, Human
ggauucuuaaaguugaau

SEQ ID NO: 1700534 - RNA, 20 nt, Human
ggauucuuaaaguugaauuu

SEQ ID NO: 1700535 - RNA, 15 nt, Human
ggauuguaaaauggu

SEQ ID NO: 1700536 - RNA, 23 nt, Human
gccugcacggugaauggcuuugu

SEQ ID NO: 1700537 - RNA, 16 nt, Human
gccugauuaaagaaug

SEQ ID NO: 1700538 - RNA, 13 nt, Human
gccugauuaaaga

SEQ ID NO: 1700539 - RNA, 17 nt, Human
gccuaagugcagccccg

SEQ ID NO: 1700540 - RNA, 22 nt, Human
gccuauauuuuuuguuaaauga

SEQ ID NO: 1700541 - RNA, 20 nt, Human
gcucucuggccuucggccuc

SEQ ID NO: 1700542 - RNA, 19 nt, Human
gcucucuggccuucggccu

SEQ ID NO: 1700543 - RNA, 15 nt, Human
gcucucuggccuucg

SEQ ID NO: 1700544 - RNA, 14 nt, Human
gcucucuggccuuc

SEQ ID NO: 1700545 - RNA, 13 nt, Human
gcucucuggccuu

SEQ ID NO: 1700546 - RNA, 12 nt, Human
gcucucuggccu

SEQ ID NO: 1700547 - RNA, 11 nt, Human
gcucucuggcc

SEQ ID NO: 1700548 - RNA, 17 nt, Human
gcuaagcaaaaugugau

SEQ ID NO: 1700549 - RNA, 14 nt, Human
gcuaagcauuccaa

SEQ ID NO: 1700550 - RNA, 20 nt, Human
gcuccauuuuuagugaaaua

SEQ ID NO: 1700551 - RNA, 21 nt, Human
guacuuuuuggcauaacauaa

SEQ ID NO: 1700552 - RNA, 12 nt, Human
guacuuuuuggc

SEQ ID NO: 1700553 - RNA, 15 nt, Human
guagaggagaaacug

SEQ ID NO: 1700554 - RNA, 23 nt, Human
guacuuuauuuucuauaauuuaa

SEQ ID NO: 1700555 - RNA, 15 nt, Human
guaccgcaaugugac

SEQ ID NO: 1700556 - RNA, 13 nt, Human
guaauuauaucug

SEQ ID NO: 1700557 - RNA, 15 nt, Human
guaauuggaaaggca

SEQ ID NO: 1700558 - RNA, 19 nt, Human
guaaugauaacuggaaacu

SEQ ID NO: 1700559 - RNA, 23 nt, Human
guaaauacaauuuuguuucugua

SEQ ID NO: 1700560 - RNA, 22 nt, Human
guaaauacaauuuuguuucugu

SEQ ID NO: 1700561 - RNA, 15 nt, Human
guaaaucccauuauu

SEQ ID NO: 1700562 - RNA, 21 nt, Human
guaaauacaauuuuguuucug

SEQ ID NO: 1700563 - RNA, 21 nt, Human
guaaaucccauuauucaaagu

SEQ ID NO: 1700564 - RNA, 20 nt, Human
guaaaucccauuauucaaag

SEQ ID NO: 1700565 - RNA, 19 nt, Human
guaaaucccauuauucaaa

SEQ ID NO: 1700566 - RNA, 18 nt, Human
guaaaucccauuauucaa

SEQ ID NO: 1700567 - RNA, 17 nt, Human
guaaaucccauuauuca

SEQ ID NO: 1700568 - RNA, 16 nt, Human
guaaaucccauuauuc

SEQ ID NO: 1700569 - RNA, 19 nt, Human
ggugcccugcuuucagaua

SEQ ID NO: 1700570 - RNA, 20 nt, Human
ggugaauggcuuuguauaga

SEQ ID NO: 1700571 - RNA, 17 nt, Human
ggugaauggcuuuguau

SEQ ID NO: 1700572 - RNA, 14 nt, Human
ggugaauggcuuug

SEQ ID NO: 1700573 - RNA, 18 nt, Human
gguccgugcuaaggacuu

SEQ ID NO: 1700574 - RNA, 17 nt, Human
gguccgugcuaaggacu

SEQ ID NO: 1700575 - RNA, 16 nt, Human
gguccgugcuaaggac

SEQ ID NO: 1700576 - RNA, 22 nt, Human
gguagacacacaugaaguccaa

SEQ ID NO: 1700577 - RNA, 15 nt, Human
gguagacacacauga

SEQ ID NO: 1700578 - RNA, 22 nt, Human
gguacuucaaauccuugaagau

SEQ ID NO: 1700579 - RNA, 23 nt, Human
guauuuguuugcauaggugaucu

SEQ ID NO: 1700580 - RNA, 12 nt, Human
guauuuguuugc

SEQ ID NO: 1700581 - RNA, 18 nt, Human
guauuuuaaaagaaugau

SEQ ID NO: 1700582 - RNA, 17 nt, Human
guauuuuaaaagaauga

SEQ ID NO: 1700583 - RNA, 16 nt, Human
guauuuuaaaagaaug

SEQ ID NO: 1700584 - RNA, 21 nt, Human
gucaauaaaauccauacauuu

SEQ ID NO: 1700585 - RNA, 15 nt, Human
gucaauaaaauccau

SEQ ID NO: 1700586 - RNA, 14 nt, Human
gucaccucauggaa

SEQ ID NO: 1700587 - RNA, 22 nt, Human
guauuucuaugaaauauuaugu

SEQ ID NO: 1700588 - RNA, 17 nt, Human
guauuucuaugaaauau

SEQ ID NO: 1700589 - RNA, 13 nt, Human
gucucagauuuua

SEQ ID NO: 1700590 - RNA, 23 nt, Human
gucuacacuaagagagaaugaga

SEQ ID NO: 1700591 - RNA, 17 nt, Human
gucuacacuaagagaga

SEQ ID NO: 1700592 - RNA, 14 nt, Human
gugaauggcuuugu

SEQ ID NO: 1700593 - RNA, 13 nt, Human
gugaauggcuuug

SEQ ID NO: 1700594 - RNA, 19 nt, Human
gugaauggcuuuguauaga

SEQ ID NO: 1700595 - RNA, 18 nt, Human
gugaauggcuuuguauag

SEQ ID NO: 1700596 - RNA, 17 nt, Human
gugaauggcuuuguaua

SEQ ID NO: 1700597 - RNA, 21 nt, Human
gugaaacugcuuguuuccuag

SEQ ID NO: 1700598 - RNA, 20 nt, Human
gugaaacugcuuguuuccua

SEQ ID NO: 1700599 - RNA, 20 nt, Human
gugaaacucguuaauuugua

SEQ ID NO: 1700600 - RNA, 23 nt, Human
gugaaacugcuuguuuccuagca

SEQ ID NO: 1700601 - RNA, 19 nt, Human
gugaaagaaaauaacaaua

SEQ ID NO: 1700602 - RNA, 16 nt, Human
gugagcagucaggaaa

SEQ ID NO: 1700603 - RNA, 16 nt, Human
gugacaagcucacaga

SEQ ID NO: 1700604 - RNA, 18 nt, Human
gugcaaauugucacagga

SEQ ID NO: 1700605 - RNA, 17 nt, Human
uaucugaggaauucugu

SEQ ID NO: 1700606 - RNA, 16 nt, Human
uaucugaggaauucug

SEQ ID NO: 1700607 - RNA, 22 nt, Human
uaucugaggaauucuguauaga

SEQ ID NO: 1700608 - RNA, 21 nt, Human
uaucugaggaauucuguauag

SEQ ID NO: 1700609 - RNA, 19 nt, Human
uaucugaggaauucuguau

SEQ ID NO: 1700610 - RNA, 18 nt, Human
uaucugaggaauucugua

SEQ ID NO: 1700611 - RNA, 14 nt, Human
uauccuucagccug

SEQ ID NO: 1700612 - RNA, 15 nt, Human
uauccuucagccuga

SEQ ID NO: 1700613 - RNA, 23 nt, Human
uaugaauuacauuuguauaaaau

SEQ ID NO: 1700614 - RNA, 17 nt, Human
uaugaauuacauuugua

SEQ ID NO: 1700615 - RNA, 15 nt, Human
uaugcuuuaaacauu

SEQ ID NO: 1700616 - RNA, 16 nt, Human
uaugcuucuguuuuau

SEQ ID NO: 1700617 - RNA, 15 nt, Human
uaugcuucuguuuua

SEQ ID NO: 1700618 - RNA, 20 nt, Human
uaugacuucauuaauaauaa

SEQ ID NO: 1700619 - RNA, 16 nt, Human
uaugacuucauuaaua

SEQ ID NO: 1700620 - RNA, 16 nt, Human
uaugauucccagccag

SEQ ID NO: 1700621 - RNA, 21 nt, Human
uaggugaucucauuuaauccu

SEQ ID NO: 1700622 - RNA, 13 nt, Human
uaguaucaaaaga

SEQ ID NO: 1700623 - RNA, 16 nt, Human
uaguauuucuaugaaa

SEQ ID NO: 1700624 - RNA, 19 nt, Human
uaguauuucuaugaaauau

SEQ ID NO: 1700625 - RNA, 18 nt, Human
uaguauuucuaugaaaua

SEQ ID NO: 1700626 - RNA, 15 nt, Human
uagugcaaauuguca

SEQ ID NO: 1700627 - RNA, 14 nt, Human
uagugcaaauuguc

SEQ ID NO: 1700628 - RNA, 14 nt, Human
uagucaaauugugu

SEQ ID NO: 1700629 - RNA, 13 nt, Human
uagucaaauugug

SEQ ID NO: 1700630 - RNA, 18 nt, Human
uaggccaugggacaggga

SEQ ID NO: 1700631 - RNA, 12 nt, Human
uaggaauugacc

SEQ ID NO: 1700632 - RNA, 16 nt, Human
uaggucagugcaaaua

SEQ ID NO: 1700633 - RNA, 16 nt, Human
uauaugugaugaucua

SEQ ID NO: 1700634 - RNA, 13 nt, Human
uauaugcuucugu

SEQ ID NO: 1700635 - RNA, 18 nt, Human
uauauaaaugguuaaaag

SEQ ID NO: 1700636 - RNA, 13 nt, Human
uauauaacaaugc

SEQ ID NO: 1700637 - RNA, 22 nt, Human
uauaucugaggaauucuguaua

SEQ ID NO: 1700638 - RNA, 21 nt, Human
uauaucugaggaauucuguau

SEQ ID NO: 1700639 - RNA, 20 nt, Human
uauaucugaggaauucugua

SEQ ID NO: 1700640 - RNA, 19 nt, Human
uauaucugaggaauucugu

SEQ ID NO: 1700641 - RNA, 18 nt, Human
uauaucugaggaauucug

SEQ ID NO: 1700642 - RNA, 23 nt, Human
uauaaaucgcuuuugauaaucaa

SEQ ID NO: 1700643 - RNA, 22 nt, Human
uauaauuaacauguuaaaccau

SEQ ID NO: 1700644 - RNA, 20 nt, Human
uauaaucacuuuuuuccaca

SEQ ID NO: 1700645 - RNA, 12 nt, Human
uauaauuaacau

SEQ ID NO: 1700646 - RNA, 14 nt, Human
uauaauuaacaugu

SEQ ID NO: 1700647 - RNA, 13 nt, Human
uauaauuaacaug

SEQ ID NO: 1700648 - RNA, 19 nt, Human
uauaauuaacauguuaaac

SEQ ID NO: 1700649 - RNA, 18 nt, Human
uauaauuaacauguuaaa

SEQ ID NO: 1700650 - RNA, 16 nt, Human
uauaauuaacauguua

SEQ ID NO: 1700651 - RNA, 15 nt, Human
uauaauuaacauguu

SEQ ID NO: 1700652 - RNA, 13 nt, Human
ucaauaaaaaauu

SEQ ID NO: 1700653 - RNA, 16 nt, Human
ucaauaaaaaauuaug

SEQ ID NO: 1700654 - RNA, 14 nt, Human
ucaauaaaaaauua

SEQ ID NO: 1700655 - RNA, 22 nt, Human
ucaacuccaaacugacucuuaa

SEQ ID NO: 1700656 - RNA, 16 nt, Human
ucaaauccuugaagau

SEQ ID NO: 1700657 - RNA, 17 nt, Human
ucaaacauauauaacaa

SEQ ID NO: 1700658 - RNA, 18 nt, Human
ucacauugguguuguacu

SEQ ID NO: 1700659 - RNA, 12 nt, Human
ucacauuuaaau

SEQ ID NO: 1700660 - RNA, 19 nt, Human
ucaauaaaaaauuaugaca

SEQ ID NO: 1700661 - RNA, 14 nt, Human
ucaauaaaauccau

SEQ ID NO: 1700662 - RNA, 22 nt, Human
ucacaagacccaaaaggcagaa

SEQ ID NO: 1700663 - RNA, 23 nt, Human
uauugugcgcuaaacuuuucuga

SEQ ID NO: 1700664 - RNA, 22 nt, Human
uauugugcgcuaaacuuuucug

SEQ ID NO: 1700665 - RNA, 19 nt, Human
uauugugcgcuaaacuuuu

SEQ ID NO: 1700666 - RNA, 14 nt, Human
uauuuauuacugua

SEQ ID NO: 1700667 - RNA, 13 nt, Human
uauuucuaugaaa

SEQ ID NO: 1700668 - RNA, 15 nt, Human
uauuucuaugaaaua

SEQ ID NO: 1700669 - RNA, 14 nt, Human
uauuucuaugaaau

SEQ ID NO: 1700670 - RNA, 22 nt, Human
uauuauguaaaucccauuauuc

SEQ ID NO: 1700671 - RNA, 16 nt, Human
uauuauguuaaaacug

SEQ ID NO: 1700672 - RNA, 15 nt, Human
uauuauguaaauccc

SEQ ID NO: 1700673 - RNA, 12 nt, Human
uauuauguaaau

SEQ ID NO: 1700674 - RNA, 22 nt, Human
uauuaugaaacuuguguaaaua

SEQ ID NO: 1700675 - RNA, 21 nt, Human
uauuaugaaacuuguguaaau

SEQ ID NO: 1700676 - RNA, 20 nt, Human
uauuaugaaacuuguguaaa

SEQ ID NO: 1700677 - RNA, 12 nt, Human
uauuaugaaacu

SEQ ID NO: 1700678 - RNA, 16 nt, Human
uauuaagcauauauuu

SEQ ID NO: 1700679 - RNA, 17 nt, Human
uauuauauuuacaaaug

SEQ ID NO: 1700680 - RNA, 17 nt, Human
uauguucuaagaaguga

SEQ ID NO: 1700681 - RNA, 19 nt, Human
uauguuagugcaaauuguc

SEQ ID NO: 1700682 - RNA, 12 nt, Human
uauguuaaaacu

SEQ ID NO: 1700683 - RNA, 22 nt, Human
ucauggaacgcguugaaauugu

SEQ ID NO: 1700684 - RNA, 21 nt, Human
ucauggaacgcguugaaauug

SEQ ID NO: 1700685 - RNA, 20 nt, Human
ucauggaacgcguugaaauu

SEQ ID NO: 1700686 - RNA, 11 nt, Human
ucauagcagcu

SEQ ID NO: 1700687 - RNA, 12 nt, Human
ucauagcagcuu

SEQ ID NO: 1700688 - RNA, 17 nt, Human
ucaucaaugaaugaaug

SEQ ID NO: 1700689 - RNA, 16 nt, Human
ucauuaggauggcuag

SEQ ID NO: 1700690 - RNA, 22 nt, Human
ucaguauugaagcauuuuauaa

SEQ ID NO: 1700691 - RNA, 23 nt, Human
ucaguauugaagcauuuuauaaa

SEQ ID NO: 1700692 - RNA, 17 nt, Human
uccaguuuuguuuggac

SEQ ID NO: 1700693 - RNA, 15 nt, Human
uccaguuuuguuugg

SEQ ID NO: 1700694 - RNA, 20 nt, Human
uccaguuuuguuuggaccaa

SEQ ID NO: 1700695 - RNA, 19 nt, Human
uccagguagagggugugua

SEQ ID NO: 1700696 - RNA, 15 nt, Human
uccauacauuugugu

SEQ ID NO: 1700697 - RNA, 20 nt, Human
uccaugggccauaugaaaag

SEQ ID NO: 1700698 - RNA, 16 nt, Human
uccagcagauuauuca

SEQ ID NO: 1700699 - RNA, 15 nt, Human
uccagcagauuauuc

SEQ ID NO: 1700700 - RNA, 14 nt, Human
uccagcagauuauu

SEQ ID NO: 1700701 - RNA, 23 nt, Human
uccacuuggucugugagaugcua

SEQ ID NO: 1700702 - RNA, 21 nt, Human
uccacuuggucugugagaugc

SEQ ID NO: 1700703 - RNA, 19 nt, Human
ucccauuauucaaaguugc

SEQ ID NO: 1700704 - RNA, 18 nt, Human
ucccauuauucaaaguug

SEQ ID NO: 1700705 - RNA, 16 nt, Human
ucccauuauucaaagu

SEQ ID NO: 1700706 - RNA, 14 nt, Human
ucccauuauucaaa

SEQ ID NO: 1700707 - RNA, 13 nt, Human
ucccauuauucaa

SEQ ID NO: 1700708 - RNA, 20 nt, Human
uccuaucaccugucuugccu

SEQ ID NO: 1700709 - RNA, 18 nt, Human
uccugccccugagcccau

SEQ ID NO: 1700710 - RNA, 17 nt, Human
uccugccccugagccca

SEQ ID NO: 1700711 - RNA, 20 nt, Human
uccugaggcuccacuugguc

SEQ ID NO: 1700712 - RNA, 19 nt, Human
uccugaggcuccacuuggu

SEQ ID NO: 1700713 - RNA, 21 nt, Human
uccugaggcuccacuuggucu

SEQ ID NO: 1700714 - RNA, 17 nt, Human
uccuggcaauagucaaa

SEQ ID NO: 1700715 - RNA, 17 nt, Human
ucuacacuaagagagaa

SEQ ID NO: 1700716 - RNA, 18 nt, Human
ucuaugaaauauuauguu

SEQ ID NO: 1700717 - RNA, 23 nt, Human
ucucaguccaugaagauguagag

SEQ ID NO: 1700718 - RNA, 16 nt, Human
ugacauagucuggcug

SEQ ID NO: 1700719 - RNA, 17 nt, Human
ugacauagucuggcugu

SEQ ID NO: 1700720 - RNA, 17 nt, Human
ugacaugggacauuugc

SEQ ID NO: 1700721 - RNA, 16 nt, Human
ugacaugggacauuug

SEQ ID NO: 1700722 - RNA, 18 nt, Human
ugacaugggacauuugcu

SEQ ID NO: 1700723 - RNA, 20 nt, Human
ugaccacugcagaagacagu

SEQ ID NO: 1700724 - RNA, 20 nt, Human
ugacaagcucacagaccuuu

SEQ ID NO: 1700725 - RNA, 15 nt, Human
ugacaagcucacaga

SEQ ID NO: 1700726 - RNA, 12 nt, Human
ugacaagcucac

SEQ ID NO: 1700727 - RNA, 23 nt, Human
ugaagucagaucugccuaaggac

SEQ ID NO: 1700728 - RNA, 11 nt, Human
ugaaguccaag

SEQ ID NO: 1700729 - RNA, 20 nt, Human
ugaagucagaucugccuaag

SEQ ID NO: 1700730 - RNA, 12 nt, Human
ugaagugaaacu

SEQ ID NO: 1700731 - RNA, 13 nt, Human
ugaagugaaacug

SEQ ID NO: 1700732 - RNA, 14 nt, Human
ugaagugaaacugc

SEQ ID NO: 1700733 - RNA, 13 nt, Human
ugaaguccaagca

SEQ ID NO: 1700734 - RNA, 18 nt, Human
ugaauuacauuuguauaa

SEQ ID NO: 1700735 - RNA, 16 nt, Human
ugaauuacauuuguau

SEQ ID NO: 1700736 - RNA, 15 nt, Human
ugaauuacauuugua

SEQ ID NO: 1700737 - RNA, 17 nt, Human
ucuugccuuuuucauua

SEQ ID NO: 1700738 - RNA, 16 nt, Human
ucuugccuuuuucauu

SEQ ID NO: 1700739 - RNA, 19 nt, Human
ucuugccuuuuucauuauu

SEQ ID NO: 1700740 - RNA, 12 nt, Human
ucuuugccaagu

SEQ ID NO: 1700741 - RNA, 19 nt, Human
ucuuuccacagaagcucca

SEQ ID NO: 1700742 - RNA, 15 nt, Human
ugaaagguacuucaa

SEQ ID NO: 1700743 - RNA, 16 nt, Human
ugaaagguacuucaaa

SEQ ID NO: 1700744 - RNA, 20 nt, Human
ugaaaagcuccauuuuuagu

SEQ ID NO: 1700745 - RNA, 16 nt, Human
ugaaauauugacuuuu

SEQ ID NO: 1700746 - RNA, 14 nt, Human
ugagcaucacaguu

SEQ ID NO: 1700747 - RNA, 15 nt, Human
ugagcaucacaguuu

SEQ ID NO: 1700748 - RNA, 16 nt, Human
ugagagugaacaaauu

SEQ ID NO: 1700749 - RNA, 16 nt, Human
ugauaacuggaaacuu

SEQ ID NO: 1700750 - RNA, 20 nt, Human
ugaggcuccacuuggucugu

SEQ ID NO: 1700751 - RNA, 18 nt, Human
ugaggcuccacuuggucu

SEQ ID NO: 1700752 - RNA, 15 nt, Human
ugaucucauuuaauc

SEQ ID NO: 1700753 - RNA, 22 nt, Human
ugaucucauuuaauccucucaa

SEQ ID NO: 1700754 - RNA, 15 nt, Human
ugauagaggaagccu

SEQ ID NO: 1700755 - RNA, 24 nt, Human
ugaucagcuuauugucuagugaaa

SEQ ID NO: 1700756 - RNA, 17 nt, Human
ugaucagcuuauugucu

SEQ ID NO: 1700757 - RNA, 15 nt, Human
ugauggugguauguu

SEQ ID NO: 1700758 - RNA, 23 nt, Human
ugaugcuacaggauuugaaauug

SEQ ID NO: 1700759 - RNA, 20 nt, Human
ugaugcuacaggauuugaaa

SEQ ID NO: 1700760 - RNA, 21 nt, Human
ugauucuucagcaaaaauauu

SEQ ID NO: 1700761 - RNA, 22 nt, Human
ugauuaugaauuacauuuguau

SEQ ID NO: 1700762 - RNA, 21 nt, Human
ugauuaugaauuacauuugua

SEQ ID NO: 1700763 - RNA, 22 nt, Human
ugauguuuagaaacacaacuau

SEQ ID NO: 1700764 - RNA, 16 nt, Human
ugauuaccagggacug

SEQ ID NO: 1700765 - RNA, 19 nt, Human
ugauuaugaauuacauuug

SEQ ID NO: 1700766 - RNA, 17 nt, Human
ugauuaugaauuacauu

SEQ ID NO: 1700767 - RNA, 13 nt, Human
ugauuauauguca

SEQ ID NO: 1700768 - RNA, 20 nt, Human
ugcugggguuaucugaaguc

SEQ ID NO: 1700769 - RNA, 17 nt, Human
ugcugggguuaucugaa

SEQ ID NO: 1700770 - RNA, 13 nt, Human
ugcugguguaugu

SEQ ID NO: 1700771 - RNA, 22 nt, Human
ugcugguguaugugugaaguga

SEQ ID NO: 1700772 - RNA, 20 nt, Human
ugcugggggggauuguaaaa

SEQ ID NO: 1700773 - RNA, 21 nt, Human
ugcgcuaaacuuuucugauag

SEQ ID NO: 1700774 - RNA, 20 nt, Human
ugcgcuaaacuuuucugaua

SEQ ID NO: 1700775 - RNA, 19 nt, Human
ugcgcuaaacuuuucugau

SEQ ID NO: 1700776 - RNA, 17 nt, Human
ugcuagaacucccuuuc

SEQ ID NO: 1700777 - RNA, 15 nt, Human
ugcuagaacucccuu

SEQ ID NO: 1700778 - RNA, 14 nt, Human
ugcuagaacucccu

SEQ ID NO: 1700779 - RNA, 13 nt, Human
ugcuagaacuccc

SEQ ID NO: 1700780 - RNA, 18 nt, Human
ugcuagaacucccuuuca

SEQ ID NO: 1700781 - RNA, 20 nt, Human
ugcauaggugaucucauuua

SEQ ID NO: 1700782 - RNA, 14 nt, Human
ugcaguucugaaga

SEQ ID NO: 1700783 - RNA, 12 nt, Human
ugcaguucugaa

SEQ ID NO: 1700784 - RNA, 17 nt, Human
ugcaugguuuagaaagc

SEQ ID NO: 1700785 - RNA, 16 nt, Human
ugccacuaaauugaca

SEQ ID NO: 1700786 - RNA, 23 nt, Human
ugccucacccacccuuuuuuaaa

SEQ ID NO: 1700787 - RNA, 20 nt, Human
ugccucacccacccuuuuuu

SEQ ID NO: 1700788 - RNA, 23 nt, Human
ugccuaaauccauuuggaaaucu

SEQ ID NO: 1700789 - RNA, 22 nt, Human
ugccuaaauccauuuggaaauc

SEQ ID NO: 1700790 - RNA, 20 nt, Human
ugccuaaauccauuuggaaa

SEQ ID NO: 1700791 - RNA, 19 nt, Human
ugccuaaauccauuuggaa

SEQ ID NO: 1700792 - RNA, 15 nt, Human
ugccuaaauccauuu

SEQ ID NO: 1700793 - RNA, 13 nt, Human
ugccuaaauccau

SEQ ID NO: 1700794 - RNA, 20 nt, Human
ugguccgugcuaaggacuug

SEQ ID NO: 1700795 - RNA, 19 nt, Human
ugguccgugcuaaggacuu

SEQ ID NO: 1700796 - RNA, 18 nt, Human
ugguccgugcuaaggacu

SEQ ID NO: 1700797 - RNA, 17 nt, Human
ugguccgugcuaaggac

SEQ ID NO: 1700798 - RNA, 21 nt, Human
ugguauguuuucaggcuagau

SEQ ID NO: 1700799 - RNA, 13 nt, Human
ugguauguuuuca

SEQ ID NO: 1700800 - RNA, 22 nt, Human
uggucacaggaaguagaggagg

SEQ ID NO: 1700801 - RNA, 19 nt, Human
uggugacugauucuucagc

SEQ ID NO: 1700802 - RNA, 16 nt, Human
uggugacugauucuuc

SEQ ID NO: 1700803 - RNA, 15 nt, Human
uggugacugauucuu

SEQ ID NO: 1700804 - RNA, 20 nt, Human
uggauaauaaggaaaaguuu

SEQ ID NO: 1700805 - RNA, 15 nt, Human
uggcacuaguauuuc

SEQ ID NO: 1700806 - RNA, 20 nt, Human
uggcaauagucaaauugugu

SEQ ID NO: 1700807 - RNA, 22 nt, Human
uggaccaaaaaccaguauugua

SEQ ID NO: 1700808 - RNA, 17 nt, Human
uggaccaaaaaccagua

SEQ ID NO: 1700809 - RNA, 15 nt, Human
uuaauaucaucagua

SEQ ID NO: 1700810 - RNA, 22 nt, Human
uuaauauuaaagccauguuuau

SEQ ID NO: 1700811 - RNA, 21 nt, Human
uuaauauuaaagccauguuua

SEQ ID NO: 1700812 - RNA, 23 nt, Human
uuaagcauauauuuuuauauuua

SEQ ID NO: 1700813 - RNA, 19 nt, Human
uuaagcauauauuuuuaua

SEQ ID NO: 1700814 - RNA, 18 nt, Human
uuaagcauauauuuuuau

SEQ ID NO: 1700815 - RNA, 15 nt, Human
uuaagcauauauuuu

SEQ ID NO: 1700816 - RNA, 13 nt, Human
uuaagcauauauu

SEQ ID NO: 1700817 - RNA, 13 nt, Human
uuaaaagaaugau

SEQ ID NO: 1700818 - RNA, 19 nt, Human
uguuucaaacauauauaac

SEQ ID NO: 1700819 - RNA, 22 nt, Human
uguuucaaacauauauaacaau

SEQ ID NO: 1700820 - RNA, 21 nt, Human
uguuucaaacauauauaacaa

SEQ ID NO: 1700821 - RNA, 16 nt, Human
uuagcuacuauauaug

SEQ ID NO: 1700822 - RNA, 21 nt, Human
uuagaugcaguucugaagaag

SEQ ID NO: 1700823 - RNA, 20 nt, Human
uuagaugcaguucugaagaa

SEQ ID NO: 1700824 - RNA, 14 nt, Human
uuagaucuaguuca

SEQ ID NO: 1700825 - RNA, 13 nt, Human
uuagaucuaguuc

SEQ ID NO: 1700826 - RNA, 12 nt, Human
uuagagauuuuu

SEQ ID NO: 1700827 - RNA, 18 nt, Human
uuagagaguguugaaacg

SEQ ID NO: 1700828 - RNA, 13 nt, Human
uuagcuggaaaag

SEQ ID NO: 1700829 - RNA, 12 nt, Human
uuagcuggaaaa

SEQ ID NO: 1700830 - RNA, 18 nt, Human
uuaggauguugaaaaagu

SEQ ID NO: 1700831 - RNA, 17 nt, Human
uuagagaguguugaaac

SEQ ID NO: 1700832 - RNA, 16 nt, Human
uuagagaguguugaaa

SEQ ID NO: 1700833 - RNA, 14 nt, Human
uuagagaguguuga

SEQ ID NO: 1700834 - RNA, 19 nt, Human
uuagaaacacaacuauauu

SEQ ID NO: 1700835 - RNA, 17 nt, Human
uuacuaguuucccuugc

SEQ ID NO: 1700836 - RNA, 12 nt, Human
uucccuggccuu

SEQ ID NO: 1700837 - RNA, 16 nt, Human
uucccuggccuuucau

SEQ ID NO: 1700838 - RNA, 17 nt, Human
uucccuggccuuucaua

SEQ ID NO: 1700839 - RNA, 17 nt, Human
uucccuugaugaagaag

SEQ ID NO: 1700840 - RNA, 18 nt, Human
uucccuugaugaagaagu

SEQ ID NO: 1700841 - RNA, 19 nt, Human
uuccagauccuggaaauca

SEQ ID NO: 1700842 - RNA, 14 nt, Human
uuauuacaguauaa

SEQ ID NO: 1700843 - RNA, 16 nt, Human
uuauuacuguaagaaa

SEQ ID NO: 1700844 - RNA, 18 nt, Human
uuauuacuguaagaaaau

SEQ ID NO: 1700845 - RNA, 17 nt, Human
uuauuacuguaagaaaa

SEQ ID NO: 1700846 - RNA, 14 nt, Human
uuaugcuuuaaaca

SEQ ID NO: 1700847 - RNA, 13 nt, Human
uuaugcuuuaaac

SEQ ID NO: 1700848 - RNA, 21 nt, Human
uuauggcacuaguauuucuau

SEQ ID NO: 1700849 - RNA, 17 nt, Human
uuaucugaagucagauc

SEQ ID NO: 1700850 - RNA, 22 nt, Human
uuauuggcuuuucugauccagu

SEQ ID NO: 1700851 - RNA, 18 nt, Human
uuauuggcuuuucugauc

SEQ ID NO: 1700852 - RNA, 16 nt, Human
uuauuggcuuuucuga

SEQ ID NO: 1700853 - RNA, 12 nt, Human
uuauuggcuuuu

SEQ ID NO: 1700854 - RNA, 15 nt, Human
uuauugucuagugaa

SEQ ID NO: 1700855 - RNA, 16 nt, Human
uuauuuuaauaauguu

SEQ ID NO: 1700856 - RNA, 15 nt, Human
uuauuuuaauaaugu

SEQ ID NO: 1700857 - RNA, 13 nt, Human
uuauuuuauuaug

SEQ ID NO: 1700858 - RNA, 17 nt, Human
uuauuuuaauaauguuu

SEQ ID NO: 1700859 - RNA, 23 nt, Human
uucaaaguugccuaaauccauuu

SEQ ID NO: 1700860 - RNA, 17 nt, Human
uucaaaguugccuaaau

SEQ ID NO: 1700861 - RNA, 16 nt, Human
uucaaaguugccuaaa

SEQ ID NO: 1700862 - RNA, 15 nt, Human
uucaaaguugccuaa

SEQ ID NO: 1700863 - RNA, 11 nt, Human
uucaaaguugc

SEQ ID NO: 1700864 - RNA, 17 nt, Human
uucaaauccuugaagau

SEQ ID NO: 1700865 - RNA, 23 nt, Human
uucagauaacuguuauuuauaau

SEQ ID NO: 1700866 - RNA, 18 nt, Human
uucagauaacuguuauuu

SEQ ID NO: 1700867 - RNA, 17 nt, Human
uucagauaacuguuauu

SEQ ID NO: 1700868 - RNA, 20 nt, Human
uucagauaaucacaauacau

SEQ ID NO: 1700869 - RNA, 21 nt, Human
uucacucuccauuuaauaauu

SEQ ID NO: 1700870 - RNA, 20 nt, Human
uucagacauagaauuaacac

SEQ ID NO: 1700871 - RNA, 16 nt, Human
uucagacauagaauua

SEQ ID NO: 1700872 - RNA, 20 nt, Human
uuugauaaucaacugggcug

SEQ ID NO: 1700873 - RNA, 13 nt, Human
uuucuuaaauaau

SEQ ID NO: 1700874 - RNA, 12 nt, Human
uuucuuaaauaa

SEQ ID NO: 1700875 - RNA, 21 nt, Human
uuugaaauuguauuacaaauc

SEQ ID NO: 1700876 - RNA, 17 nt, Human
uuugguugcuuuaauau

SEQ ID NO: 1700877 - RNA, 18 nt, Human
uuugguaaggggaauuga

SEQ ID NO: 1700878 - RNA, 18 nt, Human
uuugauaaucaacugggc

SEQ ID NO: 1700879 - RNA, 16 nt, Human
uuuaugcuuuaaacau

SEQ ID NO: 1700880 - RNA, 15 nt, Human
uuuaugcuuuaaaca

SEQ ID NO: 1700881 - RNA, 17 nt, Human
uuuauggcacuaguauu

SEQ ID NO: 1700882 - RNA, 12 nt, Human
uuuaugcuuuaa

SEQ ID NO: 1700883 - RNA, 13 nt, Human
uuucugauccagu

SEQ ID NO: 1700884 - RNA, 22 nt, Human
uuucugauccaguuuuguuugg

SEQ ID NO: 1700885 - RNA, 20 nt, Human
uuucugauccaguuuuguuu

SEQ ID NO: 1700886 - RNA, 16 nt, Human
uuucugauccaguuuu

SEQ ID NO: 1700887 - RNA, 15 nt, Human
uuucugauccaguuu

SEQ ID NO: 1700888 - RNA, 12 nt, Human
uuucucuaggaa

SEQ ID NO: 1700889 - RNA, 20 nt, Human
uuuaugacuucauuaauaau

SEQ ID NO: 1700890 - RNA, 19 nt, Human
uuuauaaaucgcuuuugau

SEQ ID NO: 1700891 - RNA, 22 nt, Human
uuuauaaaucgcuuuugauaau

SEQ ID NO: 1700892 - RNA, 18 nt, Human
uuuauaaaucgcuuuuga

SEQ ID NO: 1700893 - RNA, 15 nt, Human
uuuauaaaucgcuuu

SEQ ID NO: 1700894 - RNA, 14 nt, Human
uuuaauauuaaagc

SEQ ID NO: 1700895 - RNA, 21 nt, Human
uuuaauauuaaagccauguuu

SEQ ID NO: 1700896 - RNA, 20 nt, Human
uuuaauauuaaagccauguu

SEQ ID NO: 1700897 - RNA, 17 nt, Human
uuuaauauuaaagccau

SEQ ID NO: 1700898 - RNA, 15 nt, Human
uuuaauauuaaagcc

SEQ ID NO: 1700899 - RNA, 13 nt, Human
uuuacagagacag

SEQ ID NO: 1700900 - RNA, 14 nt, Human
uuuaauaauuauau

SEQ ID NO: 1700901 - RNA, 19 nt, Human
uuuaauaauguuucaaaca

SEQ ID NO: 1700902 - RNA, 15 nt, Human
uuuaauaauguuuca

SEQ ID NO: 1700903 - RNA, 14 nt, Human
uuuaauaauguuuc

SEQ ID NO: 1700904 - RNA, 13 nt, Human
uuuaauaaaccau

SEQ ID NO: 1700905 - RNA, 14 nt, Human
uuguuuguuuaguc

SEQ ID NO: 1700906 - RNA, 13 nt, Human
uuguuuguuuagu

SEQ ID NO: 1700907 - RNA, 14 nt, Human
uuguuucuguacuu

SEQ ID NO: 1700908 - RNA, 12 nt, Human
uuguuucuguac

SEQ ID NO: 1700909 - RNA, 17 nt, Human
uuuaaaagaaugauuau

SEQ ID NO: 1700910 - RNA, 14 nt, Human
uuuaaaagaaugau

SEQ ID NO: 1700911 - RNA, 12 nt, Human
uuuaaaaugucu

SEQ ID NO: 1700912 - RNA, 18 nt, Human
uuggcauaacauaaaucu

SEQ ID NO: 1700913 - RNA, 23 nt, Human
uuggcauaacauaaaucugugaa

SEQ ID NO: 1700914 - RNA, 22 nt, Human
uuggcauaacauaaaucuguga

SEQ ID NO: 1700915 - RNA, 20 nt, Human
uuggcauaacauaaaucugu

SEQ ID NO: 1700916 - RNA, 19 nt, Human
uuggcauaacauaaaucug

SEQ ID NO: 1700917 - RNA, 13 nt, Human
uuguaaaauggug

SEQ ID NO: 1700918 - RNA, 12 nt, Human
uuguaaaauggu

SEQ ID NO: 1700919 - RNA, 15 nt, Human
uuggucugugagaug

SEQ ID NO: 1700920 - RNA, 20 nt, Human
uugguaaggggaauugagga

SEQ ID NO: 1700921 - RNA, 16 nt, Human
uuguaccgcaauguga

SEQ ID NO: 1700922 - RNA, 20 nt, Human
uuguaaaauggugugaccac

SEQ ID NO: 1700923 - RNA, 17 nt, Human
uugccuuuuucauuauu

SEQ ID NO: 1700924 - RNA, 16 nt, Human
uugccuuuuucauuau

SEQ ID NO: 1700925 - RNA, 15 nt, Human
uugccuuuuucauua

SEQ ID NO: 1700926 - RNA, 14 nt, Human
uugccuuuuucauu

SEQ ID NO: 1700927 - RNA, 13 nt, Human
uugccuuuuucau

SEQ ID NO: 1700928 - RNA, 12 nt, Human
uugccuuuuuca

SEQ ID NO: 1700929 - RNA, 18 nt, Human
uugcuaagcauuccaacu

SEQ ID NO: 1700930 - RNA, 16 nt, Human
uugcuaagcauuccaa

SEQ ID NO: 1700931 - RNA, 22 nt, Human
uugaagcauuuuauaaaucgcu

SEQ ID NO: 1700932 - RNA, 17 nt, Human
uugaagcauuuuauaaa

SEQ ID NO: 1700933 - RNA, 15 nt, Human
uugaagcauuuuaua

SEQ ID NO: 1700934 - RNA, 14 nt, Human
uugaagcauuuuau

SEQ ID NO: 1700935 - RNA, 13 nt, Human
uugaagcauuuua

SEQ ID NO: 1700936 - RNA, 12 nt, Human
uucuuuaauuuu

SEQ ID NO: 1700937 - RNA, 18 nt, Human
uucuuuaauuuuggaauu

SEQ ID NO: 1700938 - RNA, 17 nt, Human
uucuuuaauuuuggaau

SEQ ID NO: 1700939 - RNA, 18 nt, Human
uucuuuccacagaagcuc

SEQ ID NO: 1700940 - RNA, 21 nt, Human
uugaaaaucuuauaauuuaaa

SEQ ID NO: 1700941 - RNA, 19 nt, Human
uugaaacggaugauuucua

SEQ ID NO: 1700942 - RNA, 16 nt, Human
uugaaacggaugauuu

SEQ ID NO: 1700943 - RNA, 11 nt, Human
uucuguauaga

SEQ ID NO: 1700944 - RNA, 13 nt, Human
uucuguauagauu

SEQ ID NO: 1700945 - RNA, 14 nt, Human
uucuguauagauua

SEQ ID NO: 1700946 - RNA, 19 nt, Human
uucuuguauuaagaaugaa

SEQ ID NO: 1700947 - RNA, 19 nt, Human
uucuuaggguuaugauuaa

SEQ ID NO: 1700948 - RNA, 20 nt, Human
uugauaugccuuuucccaac

SEQ ID NO: 1700949 - RNA, 23 nt, Human
caacagcuggugcccugcuuuca

SEQ ID NO: 1700950 - RNA, 14 nt, Human
caaauguucaucaa

SEQ ID NO: 1700951 - RNA, 18 nt, Human
caaauguucaucaaugaa

SEQ ID NO: 1700952 - RNA, 20 nt, Human
caaauguucaucaaugaaug

SEQ ID NO: 1700953 - RNA, 19 nt, Human
caagaaaugaaagcaggga

SEQ ID NO: 1700954 - RNA, 17 nt, Human
caagaaaugaaagcagg

SEQ ID NO: 1700955 - RNA, 16 nt, Human
caaacugacucuuaag

SEQ ID NO: 1700956 - RNA, 21 nt, Human
caaacugacucuuaagaagac

SEQ ID NO: 1700957 - RNA, 17 nt, Human
caaacugacucuuaaga

SEQ ID NO: 1700958 - RNA, 19 nt, Human
caauagucaaauuguguga

SEQ ID NO: 1700959 - RNA, 17 nt, Human
caauagucaaauugugu

SEQ ID NO: 1700960 - RNA, 18 nt, Human
caaggaaaaaauaacaau

SEQ ID NO: 1700961 - RNA, 20 nt, Human
caaggaaaaaauaacaauga

SEQ ID NO: 1700962 - RNA, 14 nt, Human
cacacugaagaagc

SEQ ID NO: 1700963 - RNA, 13 nt, Human
cacacugaagaag

SEQ ID NO: 1700964 - RNA, 21 nt, Human
caauaucuuuuuuuuaauaaa

SEQ ID NO: 1700965 - RNA, 22 nt, Human
caaugugacuuaaugccacuaa

SEQ ID NO: 1700966 - RNA, 18 nt, Human
cacaagaaaugaaagcag

SEQ ID NO: 1700967 - RNA, 21 nt, Human
cacaagaaaugaaagcaggga

SEQ ID NO: 1700968 - RNA, 20 nt, Human
cacaagaaaugaaagcaggg

SEQ ID NO: 1700969 - RNA, 18 nt, Human
augguccgugcuaaggac

SEQ ID NO: 1700970 - RNA, 15 nt, Human
augguccgugcuaag

SEQ ID NO: 1700971 - RNA, 21 nt, Human
augucaaucagccuaguugau

SEQ ID NO: 1700972 - RNA, 20 nt, Human
augcugaguuugugcuggug

SEQ ID NO: 1700973 - RNA, 19 nt, Human
auggcuuuguauagaaccu

SEQ ID NO: 1700974 - RNA, 13 nt, Human
augcuuuaaacau

SEQ ID NO: 1700975 - RNA, 18 nt, Human
auggcuuuguauagaacc

SEQ ID NO: 1700976 - RNA, 21 nt, Human
aucucugcaaucuucucagaa

SEQ ID NO: 1700977 - RNA, 18 nt, Human
aucucugcaaucuucuca

SEQ ID NO: 1700978 - RNA, 14 nt, Human
augaagucucugaa

SEQ ID NO: 1700979 - RNA, 23 nt, Human
augaaguccaagcauuuagaugu

SEQ ID NO: 1700980 - RNA, 20 nt, Human
augaaguccaagcauuuaga

SEQ ID NO: 1700981 - RNA, 21 nt, Human
augaaguacucauacauguua

SEQ ID NO: 1700982 - RNA, 21 nt, Human
aucacaguuuugguugcuuua

SEQ ID NO: 1700983 - RNA, 22 nt, Human
aucacaguuuugguugcuuuaa

SEQ ID NO: 1700984 - RNA, 15 nt, Human
aucacaguuuugguu

SEQ ID NO: 1700985 - RNA, 17 nt, Human
aucaugaauuaguuuua

SEQ ID NO: 1700986 - RNA, 13 nt, Human
aucagcuuauugu

SEQ ID NO: 1700987 - RNA, 20 nt, Human
aucccauuauucaaaguugc

SEQ ID NO: 1700988 - RNA, 15 nt, Human
aucccauuauucaaa

SEQ ID NO: 1700989 - RNA, 14 nt, Human
aucccauuauucaa

SEQ ID NO: 1700990 - RNA, 19 nt, Human
auccucaguuuuugugaaa

SEQ ID NO: 1700991 - RNA, 13 nt, Human
auaucaucaguau

SEQ ID NO: 1700992 - RNA, 13 nt, Human
auauuauguuaaa

SEQ ID NO: 1700993 - RNA, 16 nt, Human
auauuauguuaaaacu

SEQ ID NO: 1700994 - RNA, 14 nt, Human
auauuauguuaaaa

SEQ ID NO: 1700995 - RNA, 19 nt, Human
auauauuuuuauauuuacu

SEQ ID NO: 1700996 - RNA, 18 nt, Human
auauauuuuuauauuuac

SEQ ID NO: 1700997 - RNA, 20 nt, Human
auauauuuuuauauuuacua

SEQ ID NO: 1700998 - RNA, 15 nt, Human
auagcagcuuauuca

SEQ ID NO: 1700999 - RNA, 18 nt, Human
auagcagcuuauucacaa

SEQ ID NO: 1701000 - RNA, 18 nt, Human
auaauguuucaaacauau

SEQ ID NO: 1701001 - RNA, 22 nt, Human
auaagccagacaucaacagaua

SEQ ID NO: 1701002 - RNA, 21 nt, Human
auaagccagacaucaacagau

SEQ ID NO: 1701003 - RNA, 13 nt, Human
auaauguuucaaa

SEQ ID NO: 1701004 - RNA, 21 nt, Human
auaacaaugcuguauuuuaaa

SEQ ID NO: 1701005 - RNA, 20 nt, Human
auaacaaugcuguauuuuaa

SEQ ID NO: 1701006 - RNA, 19 nt, Human
auaacaaugcuguauuuua

SEQ ID NO: 1701007 - RNA, 17 nt, Human
auaacaaugcuguauuu

SEQ ID NO: 1701008 - RNA, 15 nt, Human
auaacaaugcuguau

SEQ ID NO: 1701009 - RNA, 14 nt, Human
auaacaaugaaagu

SEQ ID NO: 1701010 - RNA, 12 nt, Human
agucuguuuuau

SEQ ID NO: 1701011 - RNA, 13 nt, Human
aguacucauacau

SEQ ID NO: 1701012 - RNA, 19 nt, Human
agugucaaugcagccccca

SEQ ID NO: 1701013 - RNA, 19 nt, Human
agaucugccuaaggacuuc

SEQ ID NO: 1701014 - RNA, 19 nt, Human
agauguagaggagaaacug

SEQ ID NO: 1701015 - RNA, 16 nt, Human
agauguagaggagaaa

SEQ ID NO: 1701016 - RNA, 24 nt, Human
agcaaaauuuuuucucuaggaaau

SEQ ID NO: 1701017 - RNA, 20 nt, Human
agcacacacuuuugguuaag

SEQ ID NO: 1701018 - RNA, 14 nt, Human
agcacacacuuuug

SEQ ID NO: 1701019 - RNA, 16 nt, Human
agccaaaccucuguga

SEQ ID NO: 1701020 - RNA, 19 nt, Human
agacgaugucuucauaccu

SEQ ID NO: 1701021 - RNA, 17 nt, Human
agacgaugucuucauac

SEQ ID NO: 1701022 - RNA, 19 nt, Human
agacccaaaaggcagaagc

SEQ ID NO: 1701023 - RNA, 20 nt, Human
agaaugaaauacuguuugag

SEQ ID NO: 1701024 - RNA, 19 nt, Human
agaaugaaauacuguuuga

SEQ ID NO: 1701025 - RNA, 16 nt, Human
agaaugaaauacuguu

SEQ ID NO: 1701026 - RNA, 21 nt, Human
agaagugaaaaucuacacucc

SEQ ID NO: 1701027 - RNA, 17 nt, Human
agaaugauuaugaauua

SEQ ID NO: 1701028 - RNA, 22 nt, Human
agaaugagagacacacugaaga

SEQ ID NO: 1701029 - RNA, 17 nt, Human
agaaugagagacacacu

SEQ ID NO: 1701030 - RNA, 18 nt, Human
agaagacugcauuauauu

SEQ ID NO: 1701031 - RNA, 18 nt, Human
agacucugucucagucca

SEQ ID NO: 1701032 - RNA, 13 nt, Human
agaggaaugaagu

SEQ ID NO: 1701033 - RNA, 12 nt, Human
agcuacaaaugc

SEQ ID NO: 1701034 - RNA, 18 nt, Human
agcuucacuguaaaauaa

SEQ ID NO: 1701035 - RNA, 15 nt, Human
agggacugaggggag

SEQ ID NO: 1701036 - RNA, 21 nt, Human
aggccaugggcacugugggua

SEQ ID NO: 1701037 - RNA, 22 nt, Human
aaaaguuuaauauuaaagccau

SEQ ID NO: 1701038 - RNA, 21 nt, Human
aaaaguuuaauauuaaagcca

SEQ ID NO: 1701039 - RNA, 23 nt, Human
aaaaguuuaauauuaaagccaug

SEQ ID NO: 1701040 - RNA, 20 nt, Human
aaaaguuuaauauuaaagcc

SEQ ID NO: 1701041 - RNA, 19 nt, Human
aaaauccauacauuugugu

SEQ ID NO: 1701042 - RNA, 19 nt, Human
aaaggcagaagcaacccaa

SEQ ID NO: 1701043 - RNA, 19 nt, Human
aaacccuugccaugugcua

SEQ ID NO: 1701044 - RNA, 21 nt, Human
aaacccugucucuacuaaaaa

SEQ ID NO: 1701045 - RNA, 13 nt, Human
aaagaaacauuug

SEQ ID NO: 1701046 - RNA, 22 nt, Human
aacuguuauuuauaaucacuuu

SEQ ID NO: 1701047 - RNA, 20 nt, Human
aacuguuauuuauaaucacu

SEQ ID NO: 1701048 - RNA, 17 nt, Human
aacuguuauuuauaauc

SEQ ID NO: 1701049 - RNA, 16 nt, Human
aacuguuauuuauaau

SEQ ID NO: 1701050 - RNA, 15 nt, Human
aacuguuauuuauaa

SEQ ID NO: 1701051 - RNA, 17 nt, Human
aacgcguugaaauugua

SEQ ID NO: 1701052 - RNA, 15 nt, Human
aacgcguugaaauug

SEQ ID NO: 1701053 - RNA, 14 nt, Human
aacgcguugaaauu

SEQ ID NO: 1701054 - RNA, 13 nt, Human
aacgcguugaaau

SEQ ID NO: 1701055 - RNA, 14 nt, Human
aaccaguauuguac

SEQ ID NO: 1701056 - RNA, 13 nt, Human
aaccaguauugua

SEQ ID NO: 1701057 - RNA, 11 nt, Human
aaccaguauug

SEQ ID NO: 1701058 - RNA, 22 nt, Human
aaauuggggauucuuaaaguug

SEQ ID NO: 1701059 - RNA, 20 nt, Human
aaauuggggauucuuaaagu

SEQ ID NO: 1701060 - RNA, 19 nt, Human
aaauuggggauucuuaaag

SEQ ID NO: 1701061 - RNA, 18 nt, Human
aaauuggggauucuuaaa

SEQ ID NO: 1701062 - RNA, 23 nt, Human
aaauuggggauucuuaaaguuga

SEQ ID NO: 1701063 - RNA, 20 nt, Human
aaauguucaucaaugaauga

SEQ ID NO: 1701064 - RNA, 21 nt, Human
aaaucugugaacuugaaauuu

SEQ ID NO: 1701065 - RNA, 19 nt, Human
aaaucugugaacuugaaau

SEQ ID NO: 1701066 - RNA, 20 nt, Human
aaaucugugaacuugaaauu

SEQ ID NO: 1701067 - RNA, 13 nt, Human
aauaauaaagauc

SEQ ID NO: 1701068 - RNA, 21 nt, Human
aauaauaaagaucauguaaaa

SEQ ID NO: 1701069 - RNA, 10 nt, Human
aauaaaccau

SEQ ID NO: 1701070 - RNA, 22 nt, Human
aaguugauaugccuuuucccaa

SEQ ID NO: 1701071 - RNA, 12 nt, Human
aauaauguuuca

SEQ ID NO: 1701072 - RNA, 19 nt, Human
aauaauguuucaaacauau

SEQ ID NO: 1701073 - RNA, 14 nt, Human
aauaauguuucaaa

SEQ ID NO: 1701074 - RNA, 20 nt, Human
aauauuaaagccauguuuau

SEQ ID NO: 1701075 - RNA, 19 nt, Human
aauauuaaagccauguuua

SEQ ID NO: 1701076 - RNA, 18 nt, Human
aauauuaaagccauguuu

SEQ ID NO: 1701077 - RNA, 16 nt, Human
aauauuaaagccaugu

SEQ ID NO: 1701078 - RNA, 15 nt, Human
aauauuaaagccaug

SEQ ID NO: 1701079 - RNA, 14 nt, Human
aauauuaaagccau

SEQ ID NO: 1701080 - RNA, 13 nt, Human
aauauuaaagcca

SEQ ID NO: 1701081 - RNA, 12 nt, Human
aauacuguuuga

SEQ ID NO: 1701082 - RNA, 20 nt, Human
aaugguccgugcuaaggacu

SEQ ID NO: 1701083 - RNA, 16 nt, Human
aaugauaacuggaaac

SEQ ID NO: 1701084 - RNA, 15 nt, Human
aaugauaacuggaaa

SEQ ID NO: 1701085 - RNA, 14 nt, Human
aaugauaacuggaa

SEQ ID NO: 1701086 - RNA, 17 nt, Human
aauccauacauuugugu

SEQ ID NO: 1701087 - RNA, 16 nt, Human
aauccauacauuugug

SEQ ID NO: 1701088 - RNA, 16 nt, Human
aaggcaaaugacuuug

SEQ ID NO: 1701089 - RNA, 15 nt, Human
aaggcaaaugacuuu

SEQ ID NO: 1701090 - RNA, 14 nt, Human
aaggcaaaugacuu

SEQ ID NO: 1701091 - RNA, 19 nt, Human
aagccagauuuuccugaaa

SEQ ID NO: 1701092 - RNA, 12 nt, Human
aaguagaggagg

SEQ ID NO: 1701093 - RNA, 15 nt, Human
aagcagggacuugaa

SEQ ID NO: 1701094 - RNA, 23 nt, Human
aagacagugaaagaaaauaacaa

SEQ ID NO: 1701095 - RNA, 15 nt, Human
aagagaacuuccaga

SEQ ID NO: 1701096 - RNA, 14 nt, Human
accaccuuucagau

SEQ ID NO: 1701097 - RNA, 20 nt, Human
accaaggcugauuaaaccaa

SEQ ID NO: 1701098 - RNA, 19 nt, Human
accaaggcugauuaaacca

SEQ ID NO: 1701099 - RNA, 20 nt, Human
acaucccuuaccugggaaag

SEQ ID NO: 1701100 - RNA, 21 nt, Human
acagugauuaccagggacuga

SEQ ID NO: 1701101 - RNA, 20 nt, Human
acaauuuuguuucuguacuu

SEQ ID NO: 1701102 - RNA, 16 nt, Human
acagaagcuccaggua

SEQ ID NO: 1701103 - RNA, 11 nt, Human
aauuuuggaau

SEQ ID NO: 1701104 - RNA, 12 nt, Human
aauuuuggaauu

SEQ ID NO: 1701105 - RNA, 18 nt, Human
aauuuugugaagcaaaau

SEQ ID NO: 1701106 - RNA, 17 nt, Human
aauuuugugaagcaaaa

SEQ ID NO: 1701107 - RNA, 16 nt, Human
acaagaaaugaaagca

SEQ ID NO: 1701108 - RNA, 15 nt, Human
acaagaaaugaaagc

SEQ ID NO: 1701109 - RNA, 22 nt, Human
acaagaaaugaaagcagggacu

SEQ ID NO: 1701110 - RNA, 21 nt, Human
acaaggaugaauuaaguuuuu

SEQ ID NO: 1701111 - RNA, 23 nt, Human
aauuuauuggcuuuucugaucca

SEQ ID NO: 1701112 - RNA, 21 nt, Human
aauuuauuggcuuuucugauc

SEQ ID NO: 1701113 - RNA, 20 nt, Human
aauuuauuggcuuuucugau

SEQ ID NO: 1701114 - RNA, 19 nt, Human
aauuuauuggcuuuucuga

SEQ ID NO: 1701115 - RNA, 17 nt, Human
aauuuauuggcuuuucu

SEQ ID NO: 1701116 - RNA, 16 nt, Human
aauuggggauucuuaa

SEQ ID NO: 1701117 - RNA, 21 nt, Human
aaugguccgugcuaaggacuu

SEQ ID NO: 1701118 - RNA, 20 nt, Human
aauuggggauucuuaaaguu

SEQ ID NO: 1701119 - RNA, 17 nt, Human
aauuggggauucuuaaa

SEQ ID NO: 1701120 - RNA, 13 nt, Human
acugauucuucag

SEQ ID NO: 1701121 - RNA, 12 nt, Human
acugauucuuca

SEQ ID NO: 1701122 - RNA, 22 nt, Human
acugauucuucagcaaaaauau

SEQ ID NO: 1701123 - RNA, 15 nt, Human
acugauucuucagca

SEQ ID NO: 1701124 - RNA, 17 nt, Human
acucugucucaguccau

SEQ ID NO: 1701125 - RNA, 15 nt, Human
acucugucucagucc

SEQ ID NO: 1701126 - RNA, 20 nt, Human
acucuuaagaagacugcauu

SEQ ID NO: 1701127 - RNA, 15 nt, Human
acucuuaagaagacu

SEQ ID NO: 1701128 - RNA, 14 nt, Human
acucuuaagaagac

SEQ ID NO: 1701129 - RNA, 22 nt, Human
acuugggaggcugagaugggag

SEQ ID NO: 1701130 - RNA, 17 nt, Human
acuuuaugcuaagugaa

SEQ ID NO: 1701131 - RNA, 12 nt, Human
acuuuaugcuaa

SEQ ID NO: 1701132 - RNA, 14 nt, Human
acuuaaaaaugguu

SEQ ID NO: 1701133 - RNA, 13 nt, Human
acuuaaaaauggu

SEQ ID NO: 1701134 - RNA, 21 nt, Human
acuuaaaaaugguuuaaaugg

SEQ ID NO: 1701135 - RNA, 19 nt, Human
acuucaaauccuugaagau

SEQ ID NO: 1701136 - RNA, 19 nt, Human
acuucagcgguuuauauaa

SEQ ID NO: 1701137 - RNA, 18 nt, Human
acuucagcgguuuauaua

SEQ ID NO: 1701138 - RNA, 17 nt, Human
acuucagcgguuuauau

SEQ ID NO: 1701139 - RNA, 20 nt, Human
acuucaaauccuugaagauu

SEQ ID NO: 1701140 - RNA, 22 nt, Human
accugucuugccuuuuucauua

SEQ ID NO: 1701141 - RNA, 21 nt, Human
accugucuugccuuuuucauu

SEQ ID NO: 1701142 - RNA, 19 nt, Human
accugucuugccuuuuuca

SEQ ID NO: 1701143 - RNA, 20 nt, Human
accucugccucagaaaacaa

SEQ ID NO: 1701144 - RNA, 18 nt, Human
accucugccucagaaaac

SEQ ID NO: 1701145 - RNA, 17 nt, Human
accucugccucagaaaa

SEQ ID NO: 1701146 - RNA, 19 nt, Human
acggacgaaccuugaaaac

SEQ ID NO: 1701147 - RNA, 18 nt, Human
acuaguauuucuaugaaa

SEQ ID NO: 1701148 - RNA, 19 nt, Human
acuaguauuucuaugaaau

SEQ ID NO: 1701149 - RNA, 14 nt, Human
aacuggguuccugc

SEQ ID NO: 1701150 - RNA, 15 nt, Human
aacuggguuccugca

SEQ ID NO: 1701151 - RNA, 18 nt, Human
aacuuccagauccuggaa

SEQ ID NO: 1701152 - RNA, 15 nt, Human
gugaacuugaaauuu

SEQ ID NO: 1701153 - RNA, 14 nt, Human
gugaacuugaaauu

SEQ ID NO: 1701154 - RNA, 21 nt, Human
gugagaugcuagaacucccuu

SEQ ID NO: 1701155 - RNA, 12 nt, Human
aacugaaaucau

SEQ ID NO: 1701156 - RNA, 17 nt, Human
aacugcuuguuuccuag

SEQ ID NO: 1701157 - RNA, 16 nt, Human
aacugggcugaacacu

SEQ ID NO: 1701158 - RNA, 14 nt, Human
aacugggcugaaca

SEQ ID NO: 1701159 - RNA, 17 nt, Human
aacugggacaggggaga

SEQ ID NO: 1701160 - RNA, 16 nt, Human
aaccucuuugucuaca

SEQ ID NO: 1701161 - RNA, 18 nt, Human
aaccugagccccaaaagg

SEQ ID NO: 1701162 - RNA, 16 nt, Human
aacccgggaggcagag

SEQ ID NO: 1701163 - RNA, 23 nt, Human
aacccaaauguucaucaaugaau

SEQ ID NO: 1701164 - RNA, 18 nt, Human
aaccuugaaaacuuuaug

SEQ ID NO: 1701165 - RNA, 21 nt, Human
aacuagaguuuagcuggaaaa

SEQ ID NO: 1701166 - RNA, 16 nt, Human
gucuuucacauuuaaa

SEQ ID NO: 1701167 - RNA, 20 nt, Human
aaccugagccccaaaaggua

SEQ ID NO: 1701168 - RNA, 15 nt, Human
aaauuguaauuauau

SEQ ID NO: 1701169 - RNA, 14 nt, Human
aaauuguaauuaua

SEQ ID NO: 1701170 - RNA, 18 nt, Human
guauguacuucaugcugu

SEQ ID NO: 1701171 - RNA, 11 nt, Human
aaaugguuaaa

SEQ ID NO: 1701172 - RNA, 19 nt, Human
aaaugguuaaaagagguuu

SEQ ID NO: 1701173 - RNA, 13 nt, Human
aaaugguuaaaag

SEQ ID NO: 1701174 - RNA, 17 nt, Human
guaguguuggagaagaa

SEQ ID NO: 1701175 - RNA, 20 nt, Human
guaguguuggagaagaacug

SEQ ID NO: 1701176 - RNA, 10 nt, Human
guauaauuaa

SEQ ID NO: 1701177 - RNA, 21 nt, Human
guauaaaauaauuuuuauauu

SEQ ID NO: 1701178 - RNA, 15 nt, Human
guauaaaauaauuuu

SEQ ID NO: 1701179 - RNA, 16 nt, Human
guauauuuuauaucaa

SEQ ID NO: 1701180 - RNA, 20 nt, Human
aaauuuuuucucuaggaaau

SEQ ID NO: 1701181 - RNA, 15 nt, Human
aacaaugcuguauuu

SEQ ID NO: 1701182 - RNA, 14 nt, Human
aacaaugcuguauu

SEQ ID NO: 1701183 - RNA, 12 nt, Human
aacaauaaaaga

SEQ ID NO: 1701184 - RNA, 16 nt, Human
aacacaacuauauugu

SEQ ID NO: 1701185 - RNA, 15 nt, Human
aacacaacuauauug

SEQ ID NO: 1701186 - RNA, 22 nt, Human
aacaaugcuguauuuuaaaaga

SEQ ID NO: 1701187 - RNA, 17 nt, Human
aacaaugcuguauuuua

SEQ ID NO: 1701188 - RNA, 16 nt, Human
aacagauaaauaguuu

SEQ ID NO: 1701189 - RNA, 22 nt, Human
aacagugauuaccagggacuga

SEQ ID NO: 1701190 - RNA, 15 nt, Human
aacagugauuaccag

SEQ ID NO: 1701191 - RNA, 17 nt, Human
aacacaacuauauuguu

SEQ ID NO: 1701192 - RNA, 20 nt, Human
guuuaauauuaaagccaugu

SEQ ID NO: 1701193 - RNA, 19 nt, Human
guuuaauauuaaagccaug

SEQ ID NO: 1701194 - RNA, 14 nt, Human
aagguacuucaaau

SEQ ID NO: 1701195 - RNA, 22 nt, Human
guugccuaaauccauuuggaaa

SEQ ID NO: 1701196 - RNA, 17 nt, Human
guugccuaaauccauuu

SEQ ID NO: 1701197 - RNA, 20 nt, Human
guuuuucuuaaauaauaaag

SEQ ID NO: 1701198 - RNA, 16 nt, Human
aagucuuucacauuua

SEQ ID NO: 1701199 - RNA, 17 nt, Human
aaguauuaagcauauau

SEQ ID NO: 1701200 - RNA, 16 nt, Human
aaguauuaagcauaua

SEQ ID NO: 1701201 - RNA, 13 nt, Human
aaguauuagaaua

SEQ ID NO: 1701202 - RNA, 18 nt, Human
aaguauuaagcauauauu

SEQ ID NO: 1701203 - RNA, 15 nt, Human
aaguauuaagcauau

SEQ ID NO: 1701204 - RNA, 14 nt, Human
aaguauuaagcaua

SEQ ID NO: 1701205 - RNA, 19 nt, Human
aaguaaugauaacuggaaa

SEQ ID NO: 1701206 - RNA, 14 nt, Human
aaguaaugauaacu

SEQ ID NO: 1701207 - RNA, 21 nt, Human
guuuuucuuaaauaauaaaga

SEQ ID NO: 1701208 - RNA, 12 nt, Human
uaaaagaaugau

SEQ ID NO: 1701209 - RNA, 20 nt, Human
uaaaauaauuuuuauauuug

SEQ ID NO: 1701210 - RNA, 20 nt, Human
uaaaagacagugaaagaaaa

SEQ ID NO: 1701211 - RNA, 17 nt, Human
aagccaaaccucuguga

SEQ ID NO: 1701212 - RNA, 16 nt, Human
aagcauuuagauguau

SEQ ID NO: 1701213 - RNA, 20 nt, Human
aagcucacagaccuuugaac

SEQ ID NO: 1701214 - RNA, 14 nt, Human
aagcuccagguaga

SEQ ID NO: 1701215 - RNA, 13 nt, Human
aagcuccagguag

SEQ ID NO: 1701216 - RNA, 17 nt, Human
aagacugcauuauauuu

SEQ ID NO: 1701217 - RNA, 16 nt, Human
aagacugcacaucaaa

SEQ ID NO: 1701218 - RNA, 23 nt, Human
aagaggaaugaaguacucauaca

SEQ ID NO: 1701219 - RNA, 13 nt, Human
aagauguagagga

SEQ ID NO: 1701220 - RNA, 21 nt, Human
gugugaccacugcagaagaca

SEQ ID NO: 1701221 - RNA, 21 nt, Human
aauagcuagacuggugacuga

SEQ ID NO: 1701222 - RNA, 19 nt, Human
aauagucaaauugugugaa

SEQ ID NO: 1701223 - RNA, 20 nt, Human
aauagcuagacuggugacug

SEQ ID NO: 1701224 - RNA, 14 nt, Human
aauagcuagacugg

SEQ ID NO: 1701225 - RNA, 15 nt, Human
uaacauguuaaacca

SEQ ID NO: 1701226 - RNA, 12 nt, Human
uaacauguuaaa

SEQ ID NO: 1701227 - RNA, 13 nt, Human
uaagaagugaaaa

SEQ ID NO: 1701228 - RNA, 23 nt, Human
aauacaucccuuaccugggaaag

SEQ ID NO: 1701229 - RNA, 23 nt, Human
aauaccacaggaaccacaagacu

SEQ ID NO: 1701230 - RNA, 13 nt, Human
uaacaaugcugua

SEQ ID NO: 1701231 - RNA, 16 nt, Human
aaucccauuauucaaa

SEQ ID NO: 1701232 - RNA, 14 nt, Human
aaucccauuauuca

SEQ ID NO: 1701233 - RNA, 21 nt, Human
aaucccauuauucaaaguugc

SEQ ID NO: 1701234 - RNA, 21 nt, Human
aauccucucaaccaccuuuca

SEQ ID NO: 1701235 - RNA, 19 nt, Human
uaaggacuuguuagaucua

SEQ ID NO: 1701236 - RNA, 16 nt, Human
uaaggacuuguuagau

SEQ ID NO: 1701237 - RNA, 15 nt, Human
uaaggacuuguuaga

SEQ ID NO: 1701238 - RNA, 13 nt, Human
uaaggacuuguua

SEQ ID NO: 1701239 - RNA, 20 nt, Human
uaaguaaugauaacuggaaa

SEQ ID NO: 1701240 - RNA, 13 nt, Human
uaagcauauauuu

SEQ ID NO: 1701241 - RNA, 14 nt, Human
uaagcaaaauguga

SEQ ID NO: 1701242 - RNA, 21 nt, Human
uaagcaaaaugugauauguac

SEQ ID NO: 1701243 - RNA, 15 nt, Human
uaagcaaaaugugau

SEQ ID NO: 1701244 - RNA, 19 nt, Human
uaaggaaacuggguuccug

SEQ ID NO: 1701245 - RNA, 14 nt, Human
uaaggaaacugggu

SEQ ID NO: 1701246 - RNA, 12 nt, Human
uaaggaaacugg

SEQ ID NO: 1701247 - RNA, 21 nt, Human
uaaggaaaaguuuaauauuaa

SEQ ID NO: 1701248 - RNA, 19 nt, Human
uaaggaaaaguuuaauauu

SEQ ID NO: 1701249 - RNA, 17 nt, Human
uaaggaaaaguuuaaua

SEQ ID NO: 1701250 - RNA, 22 nt, Human
uaaggacuucuuuaauuuugga

SEQ ID NO: 1701251 - RNA, 16 nt, Human
uaaggacuucuuuaau

SEQ ID NO: 1701252 - RNA, 15 nt, Human
uaaggacuucuuuaa

SEQ ID NO: 1701253 - RNA, 14 nt, Human
uaaggacuucuuua

SEQ ID NO: 1701254 - RNA, 16 nt, Human
aaucagccuaguugau

SEQ ID NO: 1701255 - RNA, 15 nt, Human
aauauuuauuuuaau

SEQ ID NO: 1701256 - RNA, 23 nt, Human
uaauuauaucugaggaauucugu

SEQ ID NO: 1701257 - RNA, 22 nt, Human
uaauuauaucugaggaauucug

SEQ ID NO: 1701258 - RNA, 21 nt, Human
uaauuauaucugaggaauucu

SEQ ID NO: 1701259 - RNA, 19 nt, Human
uaauuauaucugaggaauu

SEQ ID NO: 1701260 - RNA, 20 nt, Human
uaauuauaugcuauuucuau

SEQ ID NO: 1701261 - RNA, 19 nt, Human
uaauuauaugcuauuucua

SEQ ID NO: 1701262 - RNA, 18 nt, Human
uaauuauaugcuauuucu

SEQ ID NO: 1701263 - RNA, 14 nt, Human
uaauuauaugcuau

SEQ ID NO: 1701264 - RNA, 16 nt, Human
aaugauuucauucaau

SEQ ID NO: 1701265 - RNA, 18 nt, Human
uaauuuuuauauuugaaa

SEQ ID NO: 1701266 - RNA, 21 nt, Human
uaauuuuuauauuugaaauau

SEQ ID NO: 1701267 - RNA, 19 nt, Human
uaauuuuuauauuugaaau

SEQ ID NO: 1701268 - RNA, 22 nt, Human
uaauuccguagguuauuuucag

SEQ ID NO: 1701269 - RNA, 22 nt, Human
aaugagagacacacugaagaag

SEQ ID NO: 1701270 - RNA, 21 nt, Human
uacaaaaaaaaaaaaaaauua

SEQ ID NO: 1701271 - RNA, 21 nt, Human
aaugcuguauuuuaaaagaau

SEQ ID NO: 1701272 - RNA, 20 nt, Human
aaugcuguauuuuaaaagaa

SEQ ID NO: 1701273 - RNA, 22 nt, Human
aaugcuguauuuuaaaagaaug

SEQ ID NO: 1701274 - RNA, 17 nt, Human
uacagagacagaaagca

SEQ ID NO: 1701275 - RNA, 14 nt, Human
uacaccauuaugug

SEQ ID NO: 1701276 - RNA, 14 nt, Human
aauuaaguaucuga

SEQ ID NO: 1701277 - RNA, 13 nt, Human
aauuaaguaucug

SEQ ID NO: 1701278 - RNA, 19 nt, Human
uaccagggacugaggggag

SEQ ID NO: 1701279 - RNA, 20 nt, Human
aauguucaucaaugaaugaa

SEQ ID NO: 1701280 - RNA, 16 nt, Human
aauguucaucaaugaa

SEQ ID NO: 1701281 - RNA, 13 nt, Human
aauguucaucaau

SEQ ID NO: 1701282 - RNA, 14 nt, Human
aauuacauuuguau

SEQ ID NO: 1701283 - RNA, 13 nt, Human
aauuacauuugua

SEQ ID NO: 1701284 - RNA, 22 nt, Human
acacuuuugguuaagucuguuu

SEQ ID NO: 1701285 - RNA, 13 nt, Human
acacuuuugguua

SEQ ID NO: 1701286 - RNA, 14 nt, Human
acagaccuuugaac

SEQ ID NO: 1701287 - RNA, 19 nt, Human
uauagauuagaauucugua

SEQ ID NO: 1701288 - RNA, 18 nt, Human
uauagauuagaauucugu

SEQ ID NO: 1701289 - RNA, 12 nt, Human
uauaggaauuga

SEQ ID NO: 1701290 - RNA, 21 nt, Human
uaugaaacuuguguaaauaca

SEQ ID NO: 1701291 - RNA, 19 nt, Human
uaugaaacuuguguaaaua

SEQ ID NO: 1701292 - RNA, 14 nt, Human
uaugaaacuugugu

SEQ ID NO: 1701293 - RNA, 19 nt, Human
acagcccuucuuuccacag

SEQ ID NO: 1701294 - RNA, 23 nt, Human
uaugcuauuucuauauuuucauu

SEQ ID NO: 1701295 - RNA, 22 nt, Human
uaugcuauuucuauauuuucau

SEQ ID NO: 1701296 - RNA, 18 nt, Human
uaugcuauuucuauauuu

SEQ ID NO: 1701297 - RNA, 16 nt, Human
uaugcuauuucuauau

SEQ ID NO: 1701298 - RNA, 15 nt, Human
uaugcuauuucuaua

SEQ ID NO: 1701299 - RNA, 14 nt, Human
uaugcuauuucuau

SEQ ID NO: 1701300 - RNA, 15 nt, Human
uaugccccauucaac

SEQ ID NO: 1701301 - RNA, 22 nt, Human
acaggaaccacaagacugcaca

SEQ ID NO: 1701302 - RNA, 23 nt, Human
acagcuguaugauucccagccag

SEQ ID NO: 1701303 - RNA, 20 nt, Human
acagcuguaugauucccagc

SEQ ID NO: 1701304 - RNA, 19 nt, Human
acagcuguaugauucccag

SEQ ID NO: 1701305 - RNA, 14 nt, Human
acagcuguaugauu

SEQ ID NO: 1701306 - RNA, 18 nt, Human
uagcacacacuuuugguu

SEQ ID NO: 1701307 - RNA, 14 nt, Human
uagaggguguguaa

SEQ ID NO: 1701308 - RNA, 18 nt, Human
acaaaguauuaagcauau

SEQ ID NO: 1701309 - RNA, 13 nt, Human
acaaaguauuaag

SEQ ID NO: 1701310 - RNA, 16 nt, Human
acaaaguauuaagcau

SEQ ID NO: 1701311 - RNA, 15 nt, Human
acaaaguauuaagca

SEQ ID NO: 1701312 - RNA, 13 nt, Human
uagacacacauga

SEQ ID NO: 1701313 - RNA, 16 nt, Human
uagaacucccuuucaa

SEQ ID NO: 1701314 - RNA, 18 nt, Human
uagaacucccuuucaaca

SEQ ID NO: 1701315 - RNA, 17 nt, Human
uagaacucccuuucaac

SEQ ID NO: 1701316 - RNA, 15 nt, Human
uagaaacacaacuau

SEQ ID NO: 1701317 - RNA, 13 nt, Human
uaggauguugaaa

SEQ ID NO: 1701318 - RNA, 13 nt, Human
acacaacuauauu

SEQ ID NO: 1701319 - RNA, 15 nt, Human
uccaauuaaggauuu

SEQ ID NO: 1701320 - RNA, 17 nt, Human
uccaauuaaggauuuua

SEQ ID NO: 1701321 - RNA, 16 nt, Human
uccaauuaaggauuuu

SEQ ID NO: 1701322 - RNA, 22 nt, Human
uccacauaaggaaacuggguuc

SEQ ID NO: 1701323 - RNA, 17 nt, Human
accugagccccaaaagg

SEQ ID NO: 1701324 - RNA, 12 nt, Human
accugagcccca

SEQ ID NO: 1701325 - RNA, 16 nt, Human
ucauaauaaguugcau

SEQ ID NO: 1701326 - RNA, 20 nt, Human
acgcguugaaauuguaauua

SEQ ID NO: 1701327 - RNA, 18 nt, Human
acgcguugaaauuguaau

SEQ ID NO: 1701328 - RNA, 14 nt, Human
acgcguugaaauug

SEQ ID NO: 1701329 - RNA, 13 nt, Human
acgcguugaaauu

SEQ ID NO: 1701330 - RNA, 16 nt, Human
acgcucucuggccuuc

SEQ ID NO: 1701331 - RNA, 15 nt, Human
acgcucucuggccuu

SEQ ID NO: 1701332 - RNA, 15 nt, Human
acggaugauuucuau

SEQ ID NO: 1701333 - RNA, 14 nt, Human
acggaugauuucua

SEQ ID NO: 1701334 - RNA, 17 nt, Human
acgcucucuggccuucg

SEQ ID NO: 1701335 - RNA, 12 nt, Human
uccauuuaauaa

SEQ ID NO: 1701336 - RNA, 22 nt, Human
uccaugaagauguagaggagaa

SEQ ID NO: 1701337 - RNA, 11 nt, Human
uccauccugag

SEQ ID NO: 1701338 - RNA, 14 nt, Human
uccagugagacagc

SEQ ID NO: 1701339 - RNA, 20 nt, Human
uccauuuggaaaucuuuaaa

SEQ ID NO: 1701340 - RNA, 19 nt, Human
uccauuuggaaaucuuuaa

SEQ ID NO: 1701341 - RNA, 12 nt, Human
uccauuuggaaa

SEQ ID NO: 1701342 - RNA, 17 nt, Human
uccauuuaauaauuaua

SEQ ID NO: 1701343 - RNA, 18 nt, Human
uccgugcuaaggacuugu

SEQ ID NO: 1701344 - RNA, 17 nt, Human
uccgugcuaaggacuug

SEQ ID NO: 1701345 - RNA, 16 nt, Human
uccgugcuaaggacuu

SEQ ID NO: 1701346 - RNA, 18 nt, Human
acuccagaaagugacaag

SEQ ID NO: 1701347 - RNA, 14 nt, Human
acuccagaaaguga

SEQ ID NO: 1701348 - RNA, 23 nt, Human
uccgugcuaaggacuuguuagau

SEQ ID NO: 1701349 - RNA, 22 nt, Human
uccugaaaacccuugccaugug

SEQ ID NO: 1701350 - RNA, 21 nt, Human
uccugaaaacccuugccaugu

SEQ ID NO: 1701351 - RNA, 17 nt, Human
uccucuccccaugaugu

SEQ ID NO: 1701352 - RNA, 21 nt, Human
acuccaaacugacucuuaaga

SEQ ID NO: 1701353 - RNA, 20 nt, Human
acuagaguuuagcuggaaaa

SEQ ID NO: 1701354 - RNA, 15 nt, Human
uauuuguuugcauag

SEQ ID NO: 1701355 - RNA, 14 nt, Human
uauuuuaaaagaau

SEQ ID NO: 1701356 - RNA, 18 nt, Human
uauuuuaaaagaaugauu

SEQ ID NO: 1701357 - RNA, 22 nt, Human
uauuuuaauaauguuucaaaca

SEQ ID NO: 1701358 - RNA, 19 nt, Human
uauuuuaauaauguuucaa

SEQ ID NO: 1701359 - RNA, 15 nt, Human
ucaaaguugccuaaa

SEQ ID NO: 1701360 - RNA, 12 nt, Human
acauguauuugu

SEQ ID NO: 1701361 - RNA, 16 nt, Human
acaugagguacugaga

SEQ ID NO: 1701362 - RNA, 23 nt, Human
acauugguucuuguauuaagaau

SEQ ID NO: 1701363 - RNA, 22 nt, Human
acauugguucuuguauuaagaa

SEQ ID NO: 1701364 - RNA, 21 nt, Human
acauugguucuuguauuaaga

SEQ ID NO: 1701365 - RNA, 18 nt, Human
acauugguucuuguauua

SEQ ID NO: 1701366 - RNA, 16 nt, Human
acauugguucuuguau

SEQ ID NO: 1701367 - RNA, 14 nt, Human
acauugguucuugu

SEQ ID NO: 1701368 - RNA, 23 nt, Human
acauugguguuguacucaauuuu

SEQ ID NO: 1701369 - RNA, 22 nt, Human
acauugguguuguacucaauuu

SEQ ID NO: 1701370 - RNA, 16 nt, Human
acauugguguuguacu

SEQ ID NO: 1701371 - RNA, 14 nt, Human
acauugguguugua

SEQ ID NO: 1701372 - RNA, 23 nt, Human
ucaauauuucagauaaucacaau

SEQ ID NO: 1701373 - RNA, 13 nt, Human
accaaaaaccagu

SEQ ID NO: 1701374 - RNA, 12 nt, Human
accaaaaaccag

SEQ ID NO: 1701375 - RNA, 23 nt, Human
accaaaaaucucaauauuucaga

SEQ ID NO: 1701376 - RNA, 16 nt, Human
accacaagacugcaca

SEQ ID NO: 1701377 - RNA, 14 nt, Human
ucacaggaaguaga

SEQ ID NO: 1701378 - RNA, 13 nt, Human
ucaauuuaaaaaa

SEQ ID NO: 1701379 - RNA, 12 nt, Human
ucaauuuaaaaa

SEQ ID NO: 1701380 - RNA, 16 nt, Human
ucacagaccuuugaac

SEQ ID NO: 1701381 - RNA, 13 nt, Human
ucagaucugccua

SEQ ID NO: 1701382 - RNA, 20 nt, Human
ucagaucugccuaaggacuu

SEQ ID NO: 1701383 - RNA, 18 nt, Human
ucagaucugccuaaggac

SEQ ID NO: 1701384 - RNA, 15 nt, Human
ucagaucugccuaag

SEQ ID NO: 1701385 - RNA, 18 nt, Human
accaugggauaaaugcca

SEQ ID NO: 1701386 - RNA, 17 nt, Human
accaugggauaaaugcc

SEQ ID NO: 1701387 - RNA, 20 nt, Human
acccaaauguucaucaauga

SEQ ID NO: 1701388 - RNA, 16 nt, Human
acccaaauguucauca

SEQ ID NO: 1701389 - RNA, 18 nt, Human
ucaguauugaagcauuuu

SEQ ID NO: 1701390 - RNA, 17 nt, Human
ucaguauugaagcauuu

SEQ ID NO: 1701391 - RNA, 16 nt, Human
ucaguauugaagcauu

SEQ ID NO: 1701392 - RNA, 15 nt, Human
ucaguauugaagcau

SEQ ID NO: 1701393 - RNA, 14 nt, Human
ucaguauugaagca

SEQ ID NO: 1701394 - RNA, 19 nt, Human
ucaguauugaagcauuuua

SEQ ID NO: 1701395 - RNA, 15 nt, Human
acccgggaggcagag

SEQ ID NO: 1701396 - RNA, 19 nt, Human
ucuaguucacucuccauuu

SEQ ID NO: 1701397 - RNA, 16 nt, Human
ucuaguucacucucca

SEQ ID NO: 1701398 - RNA, 12 nt, Human
ucuaguucacuc

SEQ ID NO: 1701399 - RNA, 13 nt, Human
ucuauaauuuaaa

SEQ ID NO: 1701400 - RNA, 17 nt, Human
acuucauuaauaauaaa

SEQ ID NO: 1701401 - RNA, 20 nt, Human
acuuccagauccuggaaauc

SEQ ID NO: 1701402 - RNA, 16 nt, Human
acuugaaauuugaauu

SEQ ID NO: 1701403 - RNA, 23 nt, Human
acuugaacccgggaggcagaggu

SEQ ID NO: 1701404 - RNA, 16 nt, Human
acugggcugaacacuc

SEQ ID NO: 1701405 - RNA, 21 nt, Human
acugggcugaacacuccaauu

SEQ ID NO: 1701406 - RNA, 22 nt, Human
acugaagaagcaccaaucauga

SEQ ID NO: 1701407 - RNA, 17 nt, Human
ucuaccaaaaaucucaa

SEQ ID NO: 1701408 - RNA, 13 nt, Human
acuguggguagac

SEQ ID NO: 1701409 - RNA, 22 nt, Human
acuuugugcugggguuaucuga

SEQ ID NO: 1701410 - RNA, 15 nt, Human
agaaacauuugguaa

SEQ ID NO: 1701411 - RNA, 16 nt, Human
agaaacacaacuauau

SEQ ID NO: 1701412 - RNA, 16 nt, Human
agaaaacaaggaugaa

SEQ ID NO: 1701413 - RNA, 18 nt, Human
agaaagcagaacagugau

SEQ ID NO: 1701414 - RNA, 17 nt, Human
agaaagcagaacaguga

SEQ ID NO: 1701415 - RNA, 20 nt, Human
agaaagcagaacagugauua

SEQ ID NO: 1701416 - RNA, 17 nt, Human
agaaauuaaguaucuga

SEQ ID NO: 1701417 - RNA, 13 nt, Human
agaaauuaaguau

SEQ ID NO: 1701418 - RNA, 16 nt, Human
ucugaagugaaacugc

SEQ ID NO: 1701419 - RNA, 22 nt, Human
ucugaagugaaacugcuuguuu

SEQ ID NO: 1701420 - RNA, 18 nt, Human
ucugaagugaaacugcuu

SEQ ID NO: 1701421 - RNA, 16 nt, Human
agaacucccuuucaac

SEQ ID NO: 1701422 - RNA, 17 nt, Human
agaacucccuuucaaca

SEQ ID NO: 1701423 - RNA, 21 nt, Human
agaagccccacccugccucac

SEQ ID NO: 1701424 - RNA, 20 nt, Human
ucugcccauccugccccuga

SEQ ID NO: 1701425 - RNA, 19 nt, Human
agaagcaccaaucaugaau

SEQ ID NO: 1701426 - RNA, 13 nt, Human
agaaguugauaug

SEQ ID NO: 1701427 - RNA, 10 nt, Human
ucuggccuuc

SEQ ID NO: 1701428 - RNA, 15 nt, Human
ugaaacggaugauuu

SEQ ID NO: 1701429 - RNA, 20 nt, Human
ugaaaaucuuauaauuuaaa

SEQ ID NO: 1701430 - RNA, 23 nt, Human
ugaaacuuguguaaauacaauuu

SEQ ID NO: 1701431 - RNA, 17 nt, Human
ugaaacuuguguaaaua

SEQ ID NO: 1701432 - RNA, 19 nt, Human
ugaaacucguuaauuugua

SEQ ID NO: 1701433 - RNA, 20 nt, Human
ugaaacggaugauuucuaug

SEQ ID NO: 1701434 - RNA, 19 nt, Human
ugaaacggaugauuucuau

SEQ ID NO: 1701435 - RNA, 18 nt, Human
ugaaacggaugauuucua

SEQ ID NO: 1701436 - RNA, 17 nt, Human
ugaaacggaugauuucu

SEQ ID NO: 1701437 - RNA, 22 nt, Human
ugaaaaaguucugcagauaaac

SEQ ID NO: 1701438 - RNA, 18 nt, Human
agacaucaacagauaaau

SEQ ID NO: 1701439 - RNA, 17 nt, Human
agacaucaacagauaaa

SEQ ID NO: 1701440 - RNA, 21 nt, Human
agacauagaauuaacacauga

SEQ ID NO: 1701441 - RNA, 14 nt, Human
agaaucacuugaac

SEQ ID NO: 1701442 - RNA, 14 nt, Human
ugaagcauuuuaua

SEQ ID NO: 1701443 - RNA, 22 nt, Human
ugaagcauuuuauaaaucgcuu

SEQ ID NO: 1701444 - RNA, 18 nt, Human
ugaagcauuuuauaaauc

SEQ ID NO: 1701445 - RNA, 17 nt, Human
ugaagcauuuuauaaau

SEQ ID NO: 1701446 - RNA, 16 nt, Human
ugaagcauuuuauaaa

SEQ ID NO: 1701447 - RNA, 15 nt, Human
ugaagcauuuuauaa

SEQ ID NO: 1701448 - RNA, 22 nt, Human
ugaauggcuuuguauagaaccu

SEQ ID NO: 1701449 - RNA, 19 nt, Human
ugaauggcuuuguauagaa

SEQ ID NO: 1701450 - RNA, 18 nt, Human
ugaauggcuuuguauaga

SEQ ID NO: 1701451 - RNA, 17 nt, Human
ugaauggcuuuguauag

SEQ ID NO: 1701452 - RNA, 11 nt, Human
ugaauggcuuu

SEQ ID NO: 1701453 - RNA, 15 nt, Human
ugaauggcuuuguau

SEQ ID NO: 1701454 - RNA, 12 nt, Human
ugaauggcuuug

SEQ ID NO: 1701455 - RNA, 15 nt, Human
ugaauacuuuauaaa

SEQ ID NO: 1701456 - RNA, 20 nt, Human
agauaacuguuauuuauaau

SEQ ID NO: 1701457 - RNA, 19 nt, Human
agauaacuguuauuuauaa

SEQ ID NO: 1701458 - RNA, 16 nt, Human
agauaacuguuauuua

SEQ ID NO: 1701459 - RNA, 14 nt, Human
agauacuggauugu

SEQ ID NO: 1701460 - RNA, 17 nt, Human
agauacuggauuguacu

SEQ ID NO: 1701461 - RNA, 21 nt, Human
ugaauuuuguguuagagauuu

SEQ ID NO: 1701462 - RNA, 17 nt, Human
ugaauuuuguguuagag

SEQ ID NO: 1701463 - RNA, 19 nt, Human
agauuuuauuauguaaauc

SEQ ID NO: 1701464 - RNA, 18 nt, Human
agauuuuauuauguaaau

SEQ ID NO: 1701465 - RNA, 17 nt, Human
agauuuuauuauguaaa

SEQ ID NO: 1701466 - RNA, 16 nt, Human
agauuuuauuauguaa

SEQ ID NO: 1701467 - RNA, 15 nt, Human
agauuuuauuaugua

SEQ ID NO: 1701468 - RNA, 14 nt, Human
agauuuuauuaugu

SEQ ID NO: 1701469 - RNA, 16 nt, Human
agauuuuuuuguuguu

SEQ ID NO: 1701470 - RNA, 15 nt, Human
agauuuuuuuguugu

SEQ ID NO: 1701471 - RNA, 23 nt, Human
agauuuuuuuguuguuuguuuag

SEQ ID NO: 1701472 - RNA, 19 nt, Human
agauuuuuuuguuguuugu

SEQ ID NO: 1701473 - RNA, 18 nt, Human
agauuuuuuuguuguuug

SEQ ID NO: 1701474 - RNA, 16 nt, Human
ugacacuuaaaaaugg

SEQ ID NO: 1701475 - RNA, 17 nt, Human
ugacacuuaaaaauggu

SEQ ID NO: 1701476 - RNA, 16 nt, Human
agaugcaguucugaag

SEQ ID NO: 1701477 - RNA, 15 nt, Human
agcaucacaguuuug

SEQ ID NO: 1701478 - RNA, 17 nt, Human
agcaucacaguuuuggu

SEQ ID NO: 1701479 - RNA, 20 nt, Human
agcaucacaugaacuuguaa

SEQ ID NO: 1701480 - RNA, 12 nt, Human
ugauaugggucu

SEQ ID NO: 1701481 - RNA, 17 nt, Human
agcaugucgucaaagcu

SEQ ID NO: 1701482 - RNA, 20 nt, Human
agcaugucgucaaagcugaa

SEQ ID NO: 1701483 - RNA, 24 nt, Human
ugauaaucaacugggcugaacacu

SEQ ID NO: 1701484 - RNA, 18 nt, Human
ugauaaucaacugggcug

SEQ ID NO: 1701485 - RNA, 14 nt, Human
ugauaaucaacugg

SEQ ID NO: 1701486 - RNA, 15 nt, Human
ugagguuuuuaagcc

SEQ ID NO: 1701487 - RNA, 22 nt, Human
ugaguaacugauuuguaacaag

SEQ ID NO: 1701488 - RNA, 23 nt, Human
agcauaaauguugacaugggaca

SEQ ID NO: 1701489 - RNA, 21 nt, Human
ugauccagcagauuauucacu

SEQ ID NO: 1701490 - RNA, 22 nt, Human
ugauccagcagauuauucacug

SEQ ID NO: 1701491 - RNA, 22 nt, Human
ugauccaguuuuguuuggacca

SEQ ID NO: 1701492 - RNA, 17 nt, Human
ugaugaagaaguugaua

SEQ ID NO: 1701493 - RNA, 14 nt, Human
ugauuaccagggac

SEQ ID NO: 1701494 - RNA, 12 nt, Human
ugauuaaaccaa

SEQ ID NO: 1701495 - RNA, 14 nt, Human
agccauguuuauua

SEQ ID NO: 1701496 - RNA, 13 nt, Human
agccauguuuauu

SEQ ID NO: 1701497 - RNA, 16 nt, Human
agccauguuuauuaca

SEQ ID NO: 1701498 - RNA, 20 nt, Human
ugccaaguuguuugagaaau

SEQ ID NO: 1701499 - RNA, 19 nt, Human
ugccaaguuguuugagaaa

SEQ ID NO: 1701500 - RNA, 15 nt, Human
ugccaaguuguuuga

SEQ ID NO: 1701501 - RNA, 20 nt, Human
agccuuggggcugaugcagu

SEQ ID NO: 1701502 - RNA, 13 nt, Human
agcuagacuggug

SEQ ID NO: 1701503 - RNA, 21 nt, Human
agcuagacuggugacugauuc

SEQ ID NO: 1701504 - RNA, 17 nt, Human
agcuagacuggugacug

SEQ ID NO: 1701505 - RNA, 16 nt, Human
agcuagacuggugacu

SEQ ID NO: 1701506 - RNA, 14 nt, Human
agcuagacugguga

SEQ ID NO: 1701507 - RNA, 18 nt, Human
agcuacuugggaggcuga

SEQ ID NO: 1701508 - RNA, 17 nt, Human
agcuacuugggaggcug

SEQ ID NO: 1701509 - RNA, 19 nt, Human
agcuacuaauuuuaaaaug

SEQ ID NO: 1701510 - RNA, 22 nt, Human
agccugaaagaggaaugaagua

SEQ ID NO: 1701511 - RNA, 15 nt, Human
agccucauguccacu

SEQ ID NO: 1701512 - RNA, 20 nt, Human
agccucauguccacugguuc

SEQ ID NO: 1701513 - RNA, 17 nt, Human
agcccuucuuuccacag

SEQ ID NO: 1701514 - RNA, 18 nt, Human
agcccauggcacucuaug

SEQ ID NO: 1701515 - RNA, 21 nt, Human
aggaagccugauuaaagaaug

SEQ ID NO: 1701516 - RNA, 18 nt, Human
aggaagccugauuaaaga

SEQ ID NO: 1701517 - RNA, 17 nt, Human
aggaagccugauuaaag

SEQ ID NO: 1701518 - RNA, 12 nt, Human
aggaaauauuua

SEQ ID NO: 1701519 - RNA, 13 nt, Human
aggaaauauuuau

SEQ ID NO: 1701520 - RNA, 14 nt, Human
ugcucauggaauug

SEQ ID NO: 1701521 - RNA, 23 nt, Human
aggaauggagccugcacggugaa

SEQ ID NO: 1701522 - RNA, 13 nt, Human
ugcuguauuuuaa

SEQ ID NO: 1701523 - RNA, 22 nt, Human
ugcuguauuuuaaaagaaugau

SEQ ID NO: 1701524 - RNA, 21 nt, Human
ugcuguauuuuaaaagaauga

SEQ ID NO: 1701525 - RNA, 23 nt, Human
ugcuguauuuuaaaagaaugauu

SEQ ID NO: 1701526 - RNA, 17 nt, Human
aggacacugauaugggu

SEQ ID NO: 1701527 - RNA, 22 nt, Human
ugcuaaggacuuguuagaucua

SEQ ID NO: 1701528 - RNA, 18 nt, Human
ugcuaaggacuuguuaga

SEQ ID NO: 1701529 - RNA, 13 nt, Human
ugcuaaggacuug

SEQ ID NO: 1701530 - RNA, 12 nt, Human
ugcuaaggacuu

SEQ ID NO: 1701531 - RNA, 22 nt, Human
uggcauaacauaaaucugugaa

SEQ ID NO: 1701532 - RNA, 21 nt, Human
uggcauaacauaaaucuguga

SEQ ID NO: 1701533 - RNA, 17 nt, Human
uggcauaacauaaaucu

SEQ ID NO: 1701534 - RNA, 14 nt, Human
uggccuucggccuc

SEQ ID NO: 1701535 - RNA, 18 nt, Human
aggcaaaugacuuuggac

SEQ ID NO: 1701536 - RNA, 15 nt, Human
aggcaaaugacuuug

SEQ ID NO: 1701537 - RNA, 14 nt, Human
aggcaaaugacuuu

SEQ ID NO: 1701538 - RNA, 16 nt, Human
uggacuguggugacuu

SEQ ID NO: 1701539 - RNA, 15 nt, Human
uggacuguggugacu

SEQ ID NO: 1701540 - RNA, 22 nt, Human
uggacuguggugacuuuggaua

SEQ ID NO: 1701541 - RNA, 21 nt, Human
uggacuguggugacuuuggau

SEQ ID NO: 1701542 - RNA, 19 nt, Human
uggacuguggugacuuugg

SEQ ID NO: 1701543 - RNA, 17 nt, Human
uggacuguggugacuuu

SEQ ID NO: 1701544 - RNA, 13 nt, Human
uggagaagaacug

SEQ ID NO: 1701545 - RNA, 14 nt, Human
uggagaagaacuga

SEQ ID NO: 1701546 - RNA, 14 nt, Human
uggagcucguggaa

SEQ ID NO: 1701547 - RNA, 15 nt, Human
uggaaaucuuuaaaa

SEQ ID NO: 1701548 - RNA, 14 nt, Human
uggaaaucuuuaaa

SEQ ID NO: 1701549 - RNA, 23 nt, Human
aggacagcccuucuuuccacaga

SEQ ID NO: 1701550 - RNA, 19 nt, Human
ugggcugaacacuccaauu

SEQ ID NO: 1701551 - RNA, 17 nt, Human
ugggcugaacacuccaa

SEQ ID NO: 1701552 - RNA, 14 nt, Human
ugggaguacaaaag

SEQ ID NO: 1701553 - RNA, 23 nt, Human
agguacuucaaauccuugaagau

SEQ ID NO: 1701554 - RNA, 17 nt, Human
aggguuaugauuaagua

SEQ ID NO: 1701555 - RNA, 20 nt, Human
ugguaaggggaauugaggac

SEQ ID NO: 1701556 - RNA, 17 nt, Human
uguacuuuuuggcauaa

SEQ ID NO: 1701557 - RNA, 18 nt, Human
uguagaggagaaacugga

SEQ ID NO: 1701558 - RNA, 16 nt, Human
uguacuuuuuggcaua

SEQ ID NO: 1701559 - RNA, 15 nt, Human
uguacuuuuuggcau

SEQ ID NO: 1701560 - RNA, 12 nt, Human
uguacuuuuugg

SEQ ID NO: 1701561 - RNA, 14 nt, Human
agguuuuuaagccu

SEQ ID NO: 1701562 - RNA, 19 nt, Human
aguagauaggccaugggca

SEQ ID NO: 1701563 - RNA, 13 nt, Human
uguaauuauaucu

SEQ ID NO: 1701564 - RNA, 15 nt, Human
uguaauuauaucuga

SEQ ID NO: 1701565 - RNA, 14 nt, Human
uguaauuauaucug

SEQ ID NO: 1701566 - RNA, 17 nt, Human
uguaagaaaauaucacu

SEQ ID NO: 1701567 - RNA, 22 nt, Human
uguaaaucccauuauucaaagu

SEQ ID NO: 1701568 - RNA, 20 nt, Human
uguaaaucccauuauucaaa

SEQ ID NO: 1701569 - RNA, 19 nt, Human
uguaaaucccauuauucaa

SEQ ID NO: 1701570 - RNA, 18 nt, Human
uguaaaucccauuauuca

SEQ ID NO: 1701571 - RNA, 16 nt, Human
uguaaaucccauuauu

SEQ ID NO: 1701572 - RNA, 13 nt, Human
uguaaaucccauu

SEQ ID NO: 1701573 - RNA, 15 nt, Human
aguauuucuaugaaa

SEQ ID NO: 1701574 - RNA, 13 nt, Human
aguauuucuauga

SEQ ID NO: 1701575 - RNA, 22 nt, Human
aguauuucuaugaaauauuaug

SEQ ID NO: 1701576 - RNA, 23 nt, Human
ugucauuugcuggagcucugccc

SEQ ID NO: 1701577 - RNA, 21 nt, Human
ugucaauaaaauccauacauu

SEQ ID NO: 1701578 - RNA, 20 nt, Human
ugucaaucagccuaguugau

SEQ ID NO: 1701579 - RNA, 15 nt, Human
agucaggaaagagaa

SEQ ID NO: 1701580 - RNA, 16 nt, Human
agucaggaaagagaac

SEQ ID NO: 1701581 - RNA, 17 nt, Human
uguggugacuuuggaua

SEQ ID NO: 1701582 - RNA, 16 nt, Human
uguggugacuuuggau

SEQ ID NO: 1701583 - RNA, 21 nt, Human
agugccuguaaucacagcuac

SEQ ID NO: 1701584 - RNA, 21 nt, Human
agugcaaauugucacaggaca

SEQ ID NO: 1701585 - RNA, 18 nt, Human
agugcaaauugucacagg

SEQ ID NO: 1701586 - RNA, 22 nt, Human
agugcaaauugucacaggacag

SEQ ID NO: 1701587 - RNA, 19 nt, Human
uguuuagucuugucucaga

SEQ ID NO: 1701588 - RNA, 18 nt, Human
uguuuagucuugucucag

SEQ ID NO: 1701589 - RNA, 17 nt, Human
uguuuagucuugucuca

SEQ ID NO: 1701590 - RNA, 13 nt, Human
uguuuagucuugu

SEQ ID NO: 1701591 - RNA, 24 nt, Human
aguucacucuccauuuaauaauua

SEQ ID NO: 1701592 - RNA, 22 nt, Human
aguucacucuccauuuaauaau

SEQ ID NO: 1701593 - RNA, 20 nt, Human
aguucggugagcuacaaaug

SEQ ID NO: 1701594 - RNA, 19 nt, Human
aguucggugagcuacaaau

SEQ ID NO: 1701595 - RNA, 21 nt, Human
aguguugaaacggaugauuuc

SEQ ID NO: 1701596 - RNA, 16 nt, Human
aguguuggagaagaac

SEQ ID NO: 1701597 - RNA, 14 nt, Human
aguguuggagaaga

SEQ ID NO: 1701598 - RNA, 18 nt, Human
aguguuggagaagaacug

SEQ ID NO: 1701599 - RNA, 17 nt, Human
aguguuggagaagaacu

SEQ ID NO: 1701600 - RNA, 23 nt, Human
aguguuggagaagaacugaaauc

SEQ ID NO: 1701601 - RNA, 21 nt, Human
uguuauuuauaaucacuuuuu

SEQ ID NO: 1701602 - RNA, 18 nt, Human
uguuauuuauaaucacuu

SEQ ID NO: 1701603 - RNA, 17 nt, Human
aguugccuaaauccauu

SEQ ID NO: 1701604 - RNA, 16 nt, Human
aguugccuaaauccau

SEQ ID NO: 1701605 - RNA, 15 nt, Human
aguugccuaaaucca

SEQ ID NO: 1701606 - RNA, 11 nt, Human
aguugccuaaa

SEQ ID NO: 1701607 - RNA, 13 nt, Human
uguuucaaacaua

SEQ ID NO: 1701608 - RNA, 14 nt, Human
aguuuaaauuguaa

SEQ ID NO: 1701609 - RNA, 15 nt, Human
uuaagucuguuuuau

SEQ ID NO: 1701610 - RNA, 14 nt, Human
uuaagucuguuuua

SEQ ID NO: 1701611 - RNA, 17 nt, Human
uuaaguaucugacaucu

SEQ ID NO: 1701612 - RNA, 20 nt, Human
uuaagaagacugcauuauau

SEQ ID NO: 1701613 - RNA, 22 nt, Human
aguuuugguugcuuuaauauca

SEQ ID NO: 1701614 - RNA, 21 nt, Human
aguuuugguugcuuuaauauc

SEQ ID NO: 1701615 - RNA, 15 nt, Human
aguuuugguugcuuu

SEQ ID NO: 1701616 - RNA, 15 nt, Human
auaaaauaauuuuua

SEQ ID NO: 1701617 - RNA, 12 nt, Human
auaaaauaauuu

SEQ ID NO: 1701618 - RNA, 22 nt, Human
auaaauagcuagacuggugacu

SEQ ID NO: 1701619 - RNA, 21 nt, Human
auaaauagcuagacuggugac

SEQ ID NO: 1701620 - RNA, 14 nt, Human
auaaauaaaaauaa

SEQ ID NO: 1701621 - RNA, 15 nt, Human
auaaauaguuuauga

SEQ ID NO: 1701622 - RNA, 13 nt, Human
auaaauaaaaaua

SEQ ID NO: 1701623 - RNA, 22 nt, Human
auaacuguuauuuauaaucacu

SEQ ID NO: 1701624 - RNA, 20 nt, Human
auaacuguuauuuauaauca

SEQ ID NO: 1701625 - RNA, 18 nt, Human
auaacuguuauuuauaau

SEQ ID NO: 1701626 - RNA, 22 nt, Human
auaacgauaaaagacagugaaa

SEQ ID NO: 1701627 - RNA, 22 nt, Human
auaaauucccuggccuuucaua

SEQ ID NO: 1701628 - RNA, 21 nt, Human
auaaauucccuggccuuucau

SEQ ID NO: 1701629 - RNA, 23 nt, Human
auaauaaauucccuggccuuuca

SEQ ID NO: 1701630 - RNA, 18 nt, Human
auaauccuaaacauauga

SEQ ID NO: 1701631 - RNA, 15 nt, Human
uuugucuacaccauu

SEQ ID NO: 1701632 - RNA, 13 nt, Human
uuuguuucuguac

SEQ ID NO: 1701633 - RNA, 12 nt, Human
uuuguuucugua

SEQ ID NO: 1701634 - RNA, 18 nt, Human
uuuguuucuguacuuuuu

SEQ ID NO: 1701635 - RNA, 13 nt, Human
uuuuaaaaaagaa

SEQ ID NO: 1701636 - RNA, 15 nt, Human
uuuuaaaagaaugau

SEQ ID NO: 1701637 - RNA, 14 nt, Human
uuuuaaaagaauga

SEQ ID NO: 1701638 - RNA, 13 nt, Human
uuugcucauggaa

SEQ ID NO: 1701639 - RNA, 12 nt, Human
uuugcucaugga

SEQ ID NO: 1701640 - RNA, 11 nt, Human
uuugcucaugg

SEQ ID NO: 1701641 - RNA, 16 nt, Human
auguccacugguucuu

SEQ ID NO: 1701642 - RNA, 19 nt, Human
auuaacauguuaaaccaug

SEQ ID NO: 1701643 - RNA, 17 nt, Human
auuaacauguuaaacca

SEQ ID NO: 1701644 - RNA, 15 nt, Human
auuaacauguuaaac

SEQ ID NO: 1701645 - RNA, 14 nt, Human
auuaacauguuaaa

SEQ ID NO: 1701646 - RNA, 13 nt, Human
auuaacauguuaa

SEQ ID NO: 1701647 - RNA, 21 nt, Human
auuaaagccauguuuauuaca

SEQ ID NO: 1701648 - RNA, 17 nt, Human
auuaaagccauguuuau

SEQ ID NO: 1701649 - RNA, 16 nt, Human
auuaaagccauguuua

SEQ ID NO: 1701650 - RNA, 12 nt, Human
auuaaagccaug

SEQ ID NO: 1701651 - RNA, 22 nt, Human
auuaagaaugaaauacuguuug

SEQ ID NO: 1701652 - RNA, 21 nt, Human
auuaagaaugaaauacuguuu

SEQ ID NO: 1701653 - RNA, 20 nt, Human
auuaagaaugaaauacuguu

SEQ ID NO: 1701654 - RNA, 16 nt, Human
auuaagaaugaaauac

SEQ ID NO: 1701655 - RNA, 21 nt, Human
auguuucaaacauauauaaca

SEQ ID NO: 1701656 - RNA, 18 nt, Human
auguuucaaacauauaua

SEQ ID NO: 1701657 - RNA, 20 nt, Human
uuuuauaaaucgcuuuugau

SEQ ID NO: 1701658 - RNA, 12 nt, Human
uuuuauaaaucg

SEQ ID NO: 1701659 - RNA, 18 nt, Human
uuuuaugcuuuaaacauu

SEQ ID NO: 1701660 - RNA, 14 nt, Human
uuuuauaauuuugu

SEQ ID NO: 1701661 - RNA, 12 nt, Human
uuuuauuaugua

SEQ ID NO: 1701662 - RNA, 19 nt, Human
uuuuauggcacuaguauuu

SEQ ID NO: 1701663 - RNA, 22 nt, Human
uuuucauucuccuaucaccugu

SEQ ID NO: 1701664 - RNA, 21 nt, Human
uuuucauuauuuuauuaugaa

SEQ ID NO: 1701665 - RNA, 15 nt, Human
uuuucauuauuuuau

SEQ ID NO: 1701666 - RNA, 14 nt, Human
uuuuauuauguaaa

SEQ ID NO: 1701667 - RNA, 13 nt, Human
uuuuauuauguaa

SEQ ID NO: 1701668 - RNA, 19 nt, Human
auguucaucaaugaaugaa

SEQ ID NO: 1701669 - RNA, 15 nt, Human
auguugacaugggac

SEQ ID NO: 1701670 - RNA, 15 nt, Human
auuauuuuauuauga

SEQ ID NO: 1701671 - RNA, 17 nt, Human
auuauauuuacaaaugg

SEQ ID NO: 1701672 - RNA, 19 nt, Human
auuagagaguguugaaacg

SEQ ID NO: 1701673 - RNA, 18 nt, Human
auuagagaguguugaaac

SEQ ID NO: 1701674 - RNA, 17 nt, Human
auuagagaguguugaaa

SEQ ID NO: 1701675 - RNA, 16 nt, Human
auuagagaguguugaa

SEQ ID NO: 1701676 - RNA, 15 nt, Human
auuagagaguguuga

SEQ ID NO: 1701677 - RNA, 16 nt, Human
auuauauuuacaaaug

SEQ ID NO: 1701678 - RNA, 15 nt, Human
auuaaguaaugauaa

SEQ ID NO: 1701679 - RNA, 13 nt, Human
auuaaguaaugau

SEQ ID NO: 1701680 - RNA, 23 nt, Human
uuuuuuaaaaaagaaacauuugg

SEQ ID NO: 1701681 - RNA, 12 nt, Human
auuaccagggac

SEQ ID NO: 1701682 - RNA, 16 nt, Human
auuacauuuguauaaa

SEQ ID NO: 1701683 - RNA, 15 nt, Human
auuacauuuguauaa

SEQ ID NO: 1701684 - RNA, 13 nt, Human
auuacauuuguau

SEQ ID NO: 1701685 - RNA, 22 nt, Human
auuauuuuauuaugaaacuugu

SEQ ID NO: 1701686 - RNA, 21 nt, Human
auuauuuuauuaugaaacuug

SEQ ID NO: 1701687 - RNA, 20 nt, Human
auuccacuuauaggaauuga

SEQ ID NO: 1701688 - RNA, 21 nt, Human
auucccuggccuuucauauuu

SEQ ID NO: 1701689 - RNA, 23 nt, Human
auugugcgcuaaacuuuucugau

SEQ ID NO: 1701690 - RNA, 13 nt, Human
auugugccccugc

SEQ ID NO: 1701691 - RNA, 14 nt, Human
auuguauuacaaau

SEQ ID NO: 1701692 - RNA, 15 nt, Human
auuguauuacaaauc

SEQ ID NO: 1701693 - RNA, 16 nt, Human
auuuacaaaugggaaa

SEQ ID NO: 1701694 - RNA, 20 nt, Human
auugacacuuaaaaaugguu

SEQ ID NO: 1701695 - RNA, 21 nt, Human
auugacccacaagaaaugaaa

SEQ ID NO: 1701696 - RNA, 17 nt, Human
auuuggaaaucuuuaaa

SEQ ID NO: 1701697 - RNA, 20 nt, Human
auuuggaaaucuuuaaaaaa

SEQ ID NO: 1701698 - RNA, 23 nt, Human
auuugguaaggggaauugaggac

SEQ ID NO: 1701699 - RNA, 18 nt, Human
auuuguaguguuggagaa

SEQ ID NO: 1701700 - RNA, 15 nt, Human
auuuacuaaaaugga

SEQ ID NO: 1701701 - RNA, 22 nt, Human
auuuauuacuguaagaaaauau

SEQ ID NO: 1701702 - RNA, 13 nt, Human
auuuuauuaugua

SEQ ID NO: 1701703 - RNA, 15 nt, Human
auuuuauuauguaaa

SEQ ID NO: 1701704 - RNA, 14 nt, Human
auuuuauuauguaa

SEQ ID NO: 1701705 - RNA, 21 nt, Human
auuuuauuaugaaacuugugu

SEQ ID NO: 1701706 - RNA, 18 nt, Human
auuuuauuaugaaacuug

SEQ ID NO: 1701707 - RNA, 12 nt, Human
auuuuauuauga

SEQ ID NO: 1701708 - RNA, 11 nt, Human
auuuuauuaug

SEQ ID NO: 1701709 - RNA, 14 nt, Human
auuuuauuaugaaa

SEQ ID NO: 1701710 - RNA, 13 nt, Human
auuuuauuaugaa

SEQ ID NO: 1701711 - RNA, 16 nt, Human
auuuuaauaauguuuc

SEQ ID NO: 1701712 - RNA, 15 nt, Human
auuuuaauaauguuu

SEQ ID NO: 1701713 - RNA, 14 nt, Human
auuuuaauaauguu

SEQ ID NO: 1701714 - RNA, 21 nt, Human
auuuguauaaaauaauuuuua

SEQ ID NO: 1701715 - RNA, 14 nt, Human
auauaugugaugau

SEQ ID NO: 1701716 - RNA, 18 nt, Human
uucccaacuccagaaagu

SEQ ID NO: 1701717 - RNA, 13 nt, Human
auagucuggcugu

SEQ ID NO: 1701718 - RNA, 20 nt, Human
auaguuguaccgcaauguga

SEQ ID NO: 1701719 - RNA, 14 nt, Human
auauauaacaaugc

SEQ ID NO: 1701720 - RNA, 14 nt, Human
uucaaacauauaua

SEQ ID NO: 1701721 - RNA, 23 nt, Human
uucacaagacccaaaaggcagaa

SEQ ID NO: 1701722 - RNA, 17 nt, Human
auaggcguaacuaauuu

SEQ ID NO: 1701723 - RNA, 13 nt, Human
auccauuuggaaa

SEQ ID NO: 1701724 - RNA, 19 nt, Human
auccauuuggaaaucuuua

SEQ ID NO: 1701725 - RNA, 17 nt, Human
auccauuuggaaaucuu

SEQ ID NO: 1701726 - RNA, 14 nt, Human
auccauacauuugu

SEQ ID NO: 1701727 - RNA, 17 nt, Human
auccaguuuuguuugga

SEQ ID NO: 1701728 - RNA, 18 nt, Human
auccaguuuuguuuggac

SEQ ID NO: 1701729 - RNA, 21 nt, Human
auccaguuuuguuuggaccaa

SEQ ID NO: 1701730 - RNA, 20 nt, Human
auccaguuuuguuuggacca

SEQ ID NO: 1701731 - RNA, 14 nt, Human
uucuggugugaacu

SEQ ID NO: 1701732 - RNA, 21 nt, Human
uucuggugugaacuaaacuuu

SEQ ID NO: 1701733 - RNA, 20 nt, Human
uucuggugugaacuaaacuu

SEQ ID NO: 1701734 - RNA, 19 nt, Human
uucuguacuuuuuggcaua

SEQ ID NO: 1701735 - RNA, 18 nt, Human
uucuguacuuuuuggcau

SEQ ID NO: 1701736 - RNA, 13 nt, Human
uucuguacuuuuu

SEQ ID NO: 1701737 - RNA, 18 nt, Human
uugaacccgggaggcaga

SEQ ID NO: 1701738 - RNA, 19 nt, Human
uugaaauauugacuuuuua

SEQ ID NO: 1701739 - RNA, 18 nt, Human
aucaauaaaaaauuauga

SEQ ID NO: 1701740 - RNA, 17 nt, Human
aucaauaaaaaauuaug

SEQ ID NO: 1701741 - RNA, 15 nt, Human
aucaauaaaaaauua

SEQ ID NO: 1701742 - RNA, 13 nt, Human
uucuaagaaguga

SEQ ID NO: 1701743 - RNA, 22 nt, Human
uucucagaaggcaaaugacuuu

SEQ ID NO: 1701744 - RNA, 21 nt, Human
uucucagaaggcaaaugacuu

SEQ ID NO: 1701745 - RNA, 19 nt, Human
uucucagaaggcaaaugac

SEQ ID NO: 1701746 - RNA, 18 nt, Human
uucucagaaggcaaauga

SEQ ID NO: 1701747 - RNA, 13 nt, Human
uucuauaauuuaa

SEQ ID NO: 1701748 - RNA, 14 nt, Human
uucuauaauuuaaa

SEQ ID NO: 1701749 - RNA, 14 nt, Human
aucacuuuuuucca

SEQ ID NO: 1701750 - RNA, 16 nt, Human
auauuuuuauauuuac

SEQ ID NO: 1701751 - RNA, 17 nt, Human
auauuuucauucuccua

SEQ ID NO: 1701752 - RNA, 19 nt, Human
uuguguaaauacaauuuug

SEQ ID NO: 1701753 - RNA, 23 nt, Human
uugugugaaagguacuucaaauc

SEQ ID NO: 1701754 - RNA, 23 nt, Human
augagagacacacugaagaagca

SEQ ID NO: 1701755 - RNA, 21 nt, Human
augagagacacacugaagaag

SEQ ID NO: 1701756 - RNA, 20 nt, Human
augagagacacacugaagaa

SEQ ID NO: 1701757 - RNA, 16 nt, Human
augauuucuaugcuga

SEQ ID NO: 1701758 - RNA, 13 nt, Human
augauuucuaugc

SEQ ID NO: 1701759 - RNA, 12 nt, Human
augauuucuaug

SEQ ID NO: 1701760 - RNA, 22 nt, Human
augauuaugaauuacauuugua

SEQ ID NO: 1701761 - RNA, 12 nt, Human
augauucccagc

SEQ ID NO: 1701762 - RNA, 17 nt, Human
uuuaauuuuggaauuuu

SEQ ID NO: 1701763 - RNA, 15 nt, Human
uuuaauuuuggaauu

SEQ ID NO: 1701764 - RNA, 14 nt, Human
uuuaauuuuggaau

SEQ ID NO: 1701765 - RNA, 17 nt, Human
augcaguucugaagaag

SEQ ID NO: 1701766 - RNA, 15 nt, Human
augcaguucugaaga

SEQ ID NO: 1701767 - RNA, 23 nt, Human
augccaaguuguuugagaaauua

SEQ ID NO: 1701768 - RNA, 17 nt, Human
augccacuaaauugaca

SEQ ID NO: 1701769 - RNA, 15 nt, Human
augccacuaaauuga

SEQ ID NO: 1701770 - RNA, 16 nt, Human
augccaaguuguuuga

SEQ ID NO: 1701771 - RNA, 14 nt, Human
augccaaguuguuu

SEQ ID NO: 1701772 - RNA, 19 nt, Human
augcaguucugaagaagau

SEQ ID NO: 1701773 - RNA, 18 nt, Human
augcaguucugaagaaga

SEQ ID NO: 1701774 - RNA, 21 nt, Human
uuucauauuuuagcuacuaua

SEQ ID NO: 1701775 - RNA, 13 nt, Human
uuucauauuuuag

SEQ ID NO: 1701776 - RNA, 20 nt, Human
auggcuaguaucaaaagaaa

SEQ ID NO: 1701777 - RNA, 23 nt, Human
uuuauuacaguauaauuaacaug

SEQ ID NO: 1701778 - RNA, 15 nt, Human
augcuagaacucccu

SEQ ID NO: 1701779 - RNA, 19 nt, Human
augcuagaacucccuuuca

SEQ ID NO: 1701780 - RNA, 16 nt, Human
augcuagaacucccuu

SEQ ID NO: 1701781 - RNA, 16 nt, Human
uuuauuacuguaagaa

SEQ ID NO: 1701782 - RNA, 23 nt, Human
auggaacgcguugaaauuguaau

SEQ ID NO: 1701783 - RNA, 22 nt, Human
augcugucuacacuaagagaga

SEQ ID NO: 1701784 - RNA, 22 nt, Human
uuuauuacaguauaauuaacau

SEQ ID NO: 1701785 - RNA, 13 nt, Human
uuuauauaagcuu

SEQ ID NO: 1701786 - RNA, 14 nt, Human
uuuagucuugucuc

SEQ ID NO: 1701787 - RNA, 22 nt, Human
uuuagcuggaaaaguauguuag

SEQ ID NO: 1701788 - RNA, 20 nt, Human
uuuagcuggaaaaguauguu

SEQ ID NO: 1701789 - RNA, 22 nt, Human
uugccuaaauccauuuggaaau

SEQ ID NO: 1701790 - RNA, 15 nt, Human
uugccuaaauccauu

SEQ ID NO: 1701791 - RNA, 14 nt, Human
uugccuaaauccau

SEQ ID NO: 1701792 - RNA, 13 nt, Human
uugccuaaaucca

SEQ ID NO: 1701793 - RNA, 21 nt, Human
aucugaggaauucuguauaga

SEQ ID NO: 1701794 - RNA, 20 nt, Human
aucugaggaauucuguauag

SEQ ID NO: 1701795 - RNA, 18 nt, Human
aucugaggaauucuguau

SEQ ID NO: 1701796 - RNA, 17 nt, Human
aucugaggaauucugua

SEQ ID NO: 1701797 - RNA, 16 nt, Human
aucugaggaauucugu

SEQ ID NO: 1701798 - RNA, 15 nt, Human
aucugaggaauucug

SEQ ID NO: 1701799 - RNA, 20 nt, Human
aucugccuaaggacuucuuu

SEQ ID NO: 1701800 - RNA, 19 nt, Human
aucugccuaaggacuucuu

SEQ ID NO: 1701801 - RNA, 18 nt, Human
aucugccuaaggacuucu

SEQ ID NO: 1701802 - RNA, 13 nt, Human
aucugccuaagga

SEQ ID NO: 1701803 - RNA, 17 nt, Human
aucugccuaaggacuuc

SEQ ID NO: 1701804 - RNA, 16 nt, Human
aucugccuaaggacuu

SEQ ID NO: 1701805 - RNA, 15 nt, Human
aucugccuaaggacu

SEQ ID NO: 1701806 - RNA, 14 nt, Human
aucugccuaaggac

SEQ ID NO: 1701807 - RNA, 19 nt, Human
aucugugaacuugaaauuu

SEQ ID NO: 1701808 - RNA, 18 nt, Human
aucugugaacuugaaauu

SEQ ID NO: 1701809 - RNA, 17 nt, Human
aucugugaacuugaaau

SEQ ID NO: 1701810 - RNA, 13 nt, Human
aucugugaacuug

SEQ ID NO: 1701811 - RNA, 21 nt, Human
aucucauuuccaagcaaguau

SEQ ID NO: 1701812 - RNA, 23 nt, Human
aucucauuuccaagcaaguauua

SEQ ID NO: 1701813 - RNA, 13 nt, Human
aucucaauauuuc

SEQ ID NO: 1701814 - RNA, 19 nt, Human
uugauggugguauguuuuc

SEQ ID NO: 1701815 - RNA, 18 nt, Human
uugauggugguauguuuu

SEQ ID NO: 1701816 - RNA, 21 nt, Human
uuggauaauaaggaaaaguuu

SEQ ID NO: 1701817 - RNA, 19 nt, Human
uuggauaauaaggaaaagu

SEQ ID NO: 1701818 - RNA, 15 nt, Human
uuggauaauaaggaa

SEQ ID NO: 1701819 - RNA, 15 nt, Human
augaaagcagggacu

SEQ ID NO: 1701820 - RNA, 13 nt, Human
uuggggauucuua

SEQ ID NO: 1701821 - RNA, 15 nt, Human
augaauuaaguuuuu

SEQ ID NO: 1701822 - RNA, 15 nt, Human
uuggggauucuuaaa

SEQ ID NO: 1701823 - RNA, 18 nt, Human
augaaauauuauguuaaa

SEQ ID NO: 1701824 - RNA, 17 nt, Human
augaaauauuauguuaa

SEQ ID NO: 1701825 - RNA, 13 nt, Human
augaaauauuaug

SEQ ID NO: 1701826 - RNA, 13 nt, Human
augaaugaauggc

SEQ ID NO: 1701827 - RNA, 18 nt, Human
augaagauguagaggaga

SEQ ID NO: 1701828 - RNA, 12 nt, Human
augacuuuggac

SEQ ID NO: 1701829 - RNA, 11 nt, Human
augacuuugga

SEQ ID NO: 1701830 - RNA, 16 nt, Human
augacuucauuaauaa

SEQ ID NO: 1701831 - RNA, 19 nt, Human
augagagacacacugaaga

SEQ ID NO: 1701832 - RNA, 17 nt, Human
augagagacacacugaa

SEQ ID NO: 1701833 - RNA, 14 nt, Human
augagagacacacu

SEQ ID NO: 1701834 - RNA, 13 nt, Human
augagagacacac

SEQ ID NO: 1701835 - RNA, 22 nt, Human
uuguacaaaguauuaagcauau

SEQ ID NO: 1701836 - RNA, 21 nt, Human
uuguacaaaguauuaagcaua

SEQ ID NO: 1701837 - RNA, 20 nt, Human
uuguacaaaguauuaagcau

SEQ ID NO: 1701838 - RNA, 17 nt, Human
uuguacaaaguauuaag

SEQ ID NO: 1701839 - RNA, 15 nt, Human
uuguacaaaguauua

SEQ ID NO: 1701840 - RNA, 15 nt, Human
uuguauaaaauaauu

SEQ ID NO: 1701841 - RNA, 16 nt, Human
uuguauaaaauaauuu

SEQ ID NO: 1701842 - RNA, 16 nt, Human
uugguugcuuuaauau

SEQ ID NO: 1701843 - RNA, 13 nt, Human
uugguugcuuuaa

SEQ ID NO: 1701844 - RNA, 14 nt, Human
uuguacaaaguauu

SEQ ID NO: 1701845 - RNA, 13 nt, Human
uuguacaaaguau

SEQ ID NO: 1701846 - RNA, 17 nt, Human
uuguauaaaauaauuuu

SEQ ID NO: 1701847 - RNA, 13 nt, Human
auuguaauuauau

SEQ ID NO: 1701848 - RNA, 14 nt, Human
auuguaaaauggug

SEQ ID NO: 1701849 - RNA, 14 nt, Human
auuguaauuauauc

SEQ ID NO: 1701850 - RNA, 21 nt, Human
auuaugaaacuuguguaaaua

SEQ ID NO: 1701851 - RNA, 20 nt, Human
auuaugaaacuuguguaaau

SEQ ID NO: 1701852 - RNA, 18 nt, Human
auuaugaaacuuguguaa

SEQ ID NO: 1701853 - RNA, 17 nt, Human
auuaugaauuacauuug

SEQ ID NO: 1701854 - RNA, 14 nt, Human
auuaugaauuacau

SEQ ID NO: 1701855 - RNA, 15 nt, Human
auuaugaaacuugug

SEQ ID NO: 1701856 - RNA, 14 nt, Human
auuaugaaacuugu

SEQ ID NO: 1701857 - RNA, 17 nt, Human
auucaaaguugccuaaa

SEQ ID NO: 1701858 - RNA, 22 nt, Human
auucaaaguugccuaaauccau

SEQ ID NO: 1701859 - RNA, 21 nt, Human
auucaaaguugccuaaaucca

SEQ ID NO: 1701860 - RNA, 20 nt, Human
auucaaaguugccuaaaucc

SEQ ID NO: 1701861 - RNA, 18 nt, Human
auucaaaguugccuaaau

SEQ ID NO: 1701862 - RNA, 18 nt, Human
auuaugaauuacauuugu

SEQ ID NO: 1701863 - RNA, 19 nt, Human
auucacaagacccaaaagg

SEQ ID NO: 1701864 - RNA, 22 nt, Human
auucauagcagcuuauucacaa

SEQ ID NO: 1701865 - RNA, 19 nt, Human
auucauagcagcuuauuca

SEQ ID NO: 1701866 - RNA, 16 nt, Human
auuacaguauaauuaa

SEQ ID NO: 1701867 - RNA, 15 nt, Human
auuacaguauaauua

SEQ ID NO: 1701868 - RNA, 14 nt, Human
auuacaguauaauu

SEQ ID NO: 1701869 - RNA, 12 nt, Human
auuacaguauaa

SEQ ID NO: 1701870 - RNA, 17 nt, Human
auuuuaugcuuuaaaca

SEQ ID NO: 1701871 - RNA, 12 nt, Human
auuuuaugcuuu

SEQ ID NO: 1701872 - RNA, 12 nt, Human
auuuggaaaucu

SEQ ID NO: 1701873 - RNA, 11 nt, Human
auuuggaaauc

SEQ ID NO: 1701874 - RNA, 13 nt, Human
auuuggaaaucuu

SEQ ID NO: 1701875 - RNA, 17 nt, Human
auuugcucauggaauug

SEQ ID NO: 1701876 - RNA, 14 nt, Human
auuugcucauggaa

SEQ ID NO: 1701877 - RNA, 12 nt, Human
auuuguuugcau

SEQ ID NO: 1701878 - RNA, 19 nt, Human
auuuuauagcuacuaauuu

SEQ ID NO: 1701879 - RNA, 16 nt, Human
auuuuaugauccagca

SEQ ID NO: 1701880 - RNA, 15 nt, Human
auuuuaugauccagc

SEQ ID NO: 1701881 - RNA, 14 nt, Human
auuuuaugauccag

SEQ ID NO: 1701882 - RNA, 17 nt, Human
auuuuauagcuacuaau

SEQ ID NO: 1701883 - RNA, 15 nt, Human
caaauccuugaagau

SEQ ID NO: 1701884 - RNA, 20 nt, Human
caaaaaaaaaaaaaaauuag

SEQ ID NO: 1701885 - RNA, 15 nt, Human
caaaaggcagaagca

SEQ ID NO: 1701886 - RNA, 15 nt, Human
cacuccaauuaagga

SEQ ID NO: 1701887 - RNA, 13 nt, Human
cacuccaauuaag

SEQ ID NO: 1701888 - RNA, 18 nt, Human
cacuccaauuaaggauuu

SEQ ID NO: 1701889 - RNA, 17 nt, Human
cacuccaauuaaggauu

SEQ ID NO: 1701890 - RNA, 16 nt, Human
cacuccagugagacag

SEQ ID NO: 1701891 - RNA, 22 nt, Human
cacugguucuucuuggucucag

SEQ ID NO: 1701892 - RNA, 19 nt, Human
cacuuguguuuugcaagcc

SEQ ID NO: 1701893 - RNA, 16 nt, Human
cacuugucaauaaaau

SEQ ID NO: 1701894 - RNA, 22 nt, Human
cacuuguguuuugcaagccaga

SEQ ID NO: 1701895 - RNA, 21 nt, Human
cacugcagaagacaguauggc

SEQ ID NO: 1701896 - RNA, 18 nt, Human
cacaagacugcacaucaa

SEQ ID NO: 1701897 - RNA, 15 nt, Human
caauucuugccaaau

SEQ ID NO: 1701898 - RNA, 17 nt, Human
caaugcuguauuuuaaa

SEQ ID NO: 1701899 - RNA, 16 nt, Human
caaugcuguauuuuaa

SEQ ID NO: 1701900 - RNA, 15 nt, Human
caaugcuguauuuua

SEQ ID NO: 1701901 - RNA, 21 nt, Human
cacagccucuuagaugcaguu

SEQ ID NO: 1701902 - RNA, 17 nt, Human
cacagccucuuagaugc

SEQ ID NO: 1701903 - RNA, 22 nt, Human
cacacaugaaguccaagcauuu

SEQ ID NO: 1701904 - RNA, 17 nt, Human
cacacaugaaguccaag

SEQ ID NO: 1701905 - RNA, 20 nt, Human
ccaaaaaccaguauuguaca

SEQ ID NO: 1701906 - RNA, 19 nt, Human
ccaaaaaccaguauuguac

SEQ ID NO: 1701907 - RNA, 16 nt, Human
ccaaaaaccaguauug

SEQ ID NO: 1701908 - RNA, 12 nt, Human
cauuuccaagca

SEQ ID NO: 1701909 - RNA, 21 nt, Human
cauucuccuaucaccugucuu

SEQ ID NO: 1701910 - RNA, 15 nt, Human
cauuaggauggcuag

SEQ ID NO: 1701911 - RNA, 22 nt, Human
ccaauuaaggauuuuaugcuuu

SEQ ID NO: 1701912 - RNA, 18 nt, Human
ccaauuaaggauuuuaug

SEQ ID NO: 1701913 - RNA, 13 nt, Human
ccaauuaaggauu

SEQ ID NO: 1701914 - RNA, 16 nt, Human
caugaauuaguuuuau

SEQ ID NO: 1701915 - RNA, 13 nt, Human
cagauacuggauu

SEQ ID NO: 1701916 - RNA, 16 nt, Human
cagagguugcagugag

SEQ ID NO: 1701917 - RNA, 23 nt, Human
cagccugagcgacagugagacuc

SEQ ID NO: 1701918 - RNA, 19 nt, Human
cagccccgugggguuccuc

SEQ ID NO: 1701919 - RNA, 21 nt, Human
caguauugaagcauuuuauaa

SEQ ID NO: 1701920 - RNA, 20 nt, Human
caguauugaagcauuuuaua

SEQ ID NO: 1701921 - RNA, 17 nt, Human
caguauugaagcauuuu

SEQ ID NO: 1701922 - RNA, 16 nt, Human
caguauugaagcauuu

SEQ ID NO: 1701923 - RNA, 22 nt, Human
caguauuguacaaaguauuaag

SEQ ID NO: 1701924 - RNA, 15 nt, Human
caguauugaagcauu

SEQ ID NO: 1701925 - RNA, 14 nt, Human
caguauugaagcau

SEQ ID NO: 1701926 - RNA, 12 nt, Human
caguauugaagc

SEQ ID NO: 1701927 - RNA, 22 nt, Human
cagggaggacgcucucuggccu

SEQ ID NO: 1701928 - RNA, 17 nt, Human
cagcuuauucacaagac

SEQ ID NO: 1701929 - RNA, 16 nt, Human
cagcuuauucacaaga

SEQ ID NO: 1701930 - RNA, 24 nt, Human
caggacagcccuucuuuccacaga

SEQ ID NO: 1701931 - RNA, 23 nt, Human
caggacagcccuucuuuccacag

SEQ ID NO: 1701932 - RNA, 22 nt, Human
ccagcagauuauucacugauuu

SEQ ID NO: 1701933 - RNA, 21 nt, Human
ccagcagauuauucacugauu

SEQ ID NO: 1701934 - RNA, 15 nt, Human
ccagauccuggaaau

SEQ ID NO: 1701935 - RNA, 23 nt, Human
cccgggaggcagagguugcagug

SEQ ID NO: 1701936 - RNA, 23 nt, Human
cccauuguggucacaggaaguag

SEQ ID NO: 1701937 - RNA, 22 nt, Human
cccauuguggucacaggaagua

SEQ ID NO: 1701938 - RNA, 20 nt, Human
cccauauuuguacaccaaua

SEQ ID NO: 1701939 - RNA, 17 nt, Human
ccuagcacacacuuuug

SEQ ID NO: 1701940 - RNA, 16 nt, Human
ccguagguuauuuuca

SEQ ID NO: 1701941 - RNA, 20 nt, Human
ccucauguccacugguucuu

SEQ ID NO: 1701942 - RNA, 15 nt, Human
ccucauguccacugg

SEQ ID NO: 1701943 - RNA, 17 nt, Human
cccuggccuuucauauu

SEQ ID NO: 1701944 - RNA, 21 nt, Human
cccuauuuuuuuucuguuaua

SEQ ID NO: 1701945 - RNA, 20 nt, Human
cccuauuuuuuuucuguuau

SEQ ID NO: 1701946 - RNA, 17 nt, Human
cccuucuuuccacagaa

SEQ ID NO: 1701947 - RNA, 13 nt, Human
cuaaacuuucaca

SEQ ID NO: 1701948 - RNA, 13 nt, Human
cuaaacuuuucug

SEQ ID NO: 1701949 - RNA, 14 nt, Human
cuaaacuuucacac

SEQ ID NO: 1701950 - RNA, 15 nt, Human
cuacaugagguacug

SEQ ID NO: 1701951 - RNA, 18 nt, Human
cuacaugagguacugaga

SEQ ID NO: 1701952 - RNA, 23 nt, Human
cuaagugaaauaagccagacauc

SEQ ID NO: 1701953 - RNA, 20 nt, Human
cuaagugaaauaagccagac

SEQ ID NO: 1701954 - RNA, 19 nt, Human
cuagaacucccuuucaaca

SEQ ID NO: 1701955 - RNA, 18 nt, Human
cuagaacucccuuucaac

SEQ ID NO: 1701956 - RNA, 17 nt, Human
cuagaacucccuuucaa

SEQ ID NO: 1701957 - RNA, 16 nt, Human
cuagaacucccuuuca

SEQ ID NO: 1701958 - RNA, 23 nt, Human
cuaguugaucagcuuauugucua

SEQ ID NO: 1701959 - RNA, 17 nt, Human
ccuuuuucauuauuuua

SEQ ID NO: 1701960 - RNA, 15 nt, Human
ccuuuuucauuauuu

SEQ ID NO: 1701961 - RNA, 16 nt, Human
cgacagugagacucug

SEQ ID NO: 1701962 - RNA, 15 nt, Human
cgacagugagacucu

SEQ ID NO: 1701963 - RNA, 20 nt, Human
cucucaaccaccuuucagau

SEQ ID NO: 1701964 - RNA, 11 nt, Human
cucucuggccu

SEQ ID NO: 1701965 - RNA, 12 nt, Human
cucucuggccuu

SEQ ID NO: 1701966 - RNA, 15 nt, Human
cucuuagaugcaguu

SEQ ID NO: 1701967 - RNA, 21 nt, Human
cucuuagaugcaguucugaag

SEQ ID NO: 1701968 - RNA, 20 nt, Human
cucuuagaugcaguucugaa

SEQ ID NO: 1701969 - RNA, 21 nt, Human
cuccagugagacagcucugca

SEQ ID NO: 1701970 - RNA, 24 nt, Human
gccaucaauaaaaaauuaugacau

SEQ ID NO: 1701971 - RNA, 22 nt, Human
gccaugugcuaguaauuggaaa

SEQ ID NO: 1701972 - RNA, 16 nt, Human
gccauaugaaaaggcu

SEQ ID NO: 1701973 - RNA, 18 nt, Human
gcguugaaauuguaauua

SEQ ID NO: 1701974 - RNA, 24 nt, Human
gcguugaaauuguaauuauaucug

SEQ ID NO: 1701975 - RNA, 23 nt, Human
gcguugaaauuguaauuauaucu

SEQ ID NO: 1701976 - RNA, 17 nt, Human
gcuacuugggaggcuga

SEQ ID NO: 1701977 - RNA, 20 nt, Human
gccuccauccugaggcucca

SEQ ID NO: 1701978 - RNA, 16 nt, Human
gccuccauccugaggc

SEQ ID NO: 1701979 - RNA, 11 nt, Human
gcuuuucugau

SEQ ID NO: 1701980 - RNA, 16 nt, Human
gcuuuucugauccagu

SEQ ID NO: 1701981 - RNA, 15 nt, Human
gcuuuucugauccag

SEQ ID NO: 1701982 - RNA, 12 nt, Human
gcuuuucugauc

SEQ ID NO: 1701983 - RNA, 19 nt, Human
gcuuccuggcaauagucaa

SEQ ID NO: 1701984 - RNA, 13 nt, Human
gcuguauuuuaaa

SEQ ID NO: 1701985 - RNA, 12 nt, Human
gcuguauuuuaa

SEQ ID NO: 1701986 - RNA, 15 nt, Human
gcucugcccauccug

SEQ ID NO: 1701987 - RNA, 21 nt, Human
gcucugcccauccugccccug

SEQ ID NO: 1701988 - RNA, 20 nt, Human
gcuccacuuggucugugaga

SEQ ID NO: 1701989 - RNA, 22 nt, Human
ggauaauaaggaaaaguuuaau

SEQ ID NO: 1701990 - RNA, 12 nt, Human
ggauaaaugcca

SEQ ID NO: 1701991 - RNA, 22 nt, Human
ggauguugaaaaaguucugcag

SEQ ID NO: 1701992 - RNA, 13 nt, Human
ggccuccauccug

SEQ ID NO: 1701993 - RNA, 23 nt, Human
ggccuucggccuccauccugagg

SEQ ID NO: 1701994 - RNA, 14 nt, Human
aaaaauauuuuaug

SEQ ID NO: 1701995 - RNA, 21 nt, Human
gggacauuugcucauggaauu

SEQ ID NO: 1701996 - RNA, 20 nt, Human
gggacauuugcucauggaau

SEQ ID NO: 1701997 - RNA, 19 nt, Human
gggacauuugcucauggaa

SEQ ID NO: 1701998 - RNA, 17 nt, Human
gggauuguaaaauggug

SEQ ID NO: 1701999 - RNA, 16 nt, Human
gggauuguaaaauggu

SEQ ID NO: 1702000 - RNA, 15 nt, Human
aaaaugugauaugua

SEQ ID NO: 1702001 - RNA, 22 nt, Human
aaaauuuuuucucuaggaaaua

SEQ ID NO: 1702002 - RNA, 20 nt, Human
aaacaagcacuaaacaaaga

SEQ ID NO: 1702003 - RNA, 19 nt, Human
aaaaguauguuagugcaaa

SEQ ID NO: 1702004 - RNA, 22 nt, Human
aaaguugaauuuauuggcuuuu

SEQ ID NO: 1702005 - RNA, 16 nt, Human
aaaguugaauuuauug

SEQ ID NO: 1702006 - RNA, 13 nt, Human
aaaguugaauuua

SEQ ID NO: 1702007 - RNA, 12 nt, Human
aaaguugaauuu

SEQ ID NO: 1702008 - RNA, 19 nt, Human
aaaguuuaauauuaaagcc

SEQ ID NO: 1702009 - RNA, 16 nt, Human
aaaguuuaauauuaaa

SEQ ID NO: 1702010 - RNA, 22 nt, Human
aaaguuuaauauuaaagccaug

SEQ ID NO: 1702011 - RNA, 21 nt, Human
aaaguuuaauauuaaagccau

SEQ ID NO: 1702012 - RNA, 20 nt, Human
aaaguuuaauauuaaagcca

SEQ ID NO: 1702013 - RNA, 20 nt, Human
aaauaauuuuuauauuugaa

SEQ ID NO: 1702014 - RNA, 18 nt, Human
aaauaauuuuuauauuug

SEQ ID NO: 1702015 - RNA, 15 nt, Human
aaauaauuuuuauau

SEQ ID NO: 1702016 - RNA, 18 nt, Human
gguucuggugugaacuaa

SEQ ID NO: 1702017 - RNA, 16 nt, Human
gguuuagaaagcuugc

SEQ ID NO: 1702018 - RNA, 16 nt, Human
ggugugaccacugcag

SEQ ID NO: 1702019 - RNA, 17 nt, Human
aaagcagggacuugaac

SEQ ID NO: 1702020 - RNA, 22 nt, Human
gauccaguuuuguuuggaccaa

SEQ ID NO: 1702021 - RNA, 17 nt, Human
gauccaguuuuguuugg

SEQ ID NO: 1702022 - RNA, 11 nt, Human
gauccaguuuu

SEQ ID NO: 1702023 - RNA, 18 nt, Human
gauuagagaguguugaaa

SEQ ID NO: 1702024 - RNA, 14 nt, Human
gauuagagaguguu

SEQ ID NO: 1702025 - RNA, 21 nt, Human
gauuauucacugauuugacau

SEQ ID NO: 1702026 - RNA, 16 nt, Human
gauuauucacugauuu

SEQ ID NO: 1702027 - RNA, 15 nt, Human
gauuauucacugauu

SEQ ID NO: 1702028 - RNA, 13 nt, Human
gauuauucacuga

SEQ ID NO: 1702029 - RNA, 23 nt, Human
gauuagaauucuguauagauuag

SEQ ID NO: 1702030 - RNA, 15 nt, Human
gauuagaauucugua

SEQ ID NO: 1702031 - RNA, 14 nt, Human
gauuagaauucugu

SEQ ID NO: 1702032 - RNA, 14 nt, Human
gauuaccagggacu

SEQ ID NO: 1702033 - RNA, 16 nt, Human
gaguuuagcuggaaaa

SEQ ID NO: 1702034 - RNA, 20 nt, Human
gauauguaccuaacgaagua

SEQ ID NO: 1702035 - RNA, 23 nt, Human
gcauaacauaaaucugugaacuu

SEQ ID NO: 1702036 - RNA, 21 nt, Human
gcauaacauaaaucugugaac

SEQ ID NO: 1702037 - RNA, 15 nt, Human
gcauaacauaaaucu

SEQ ID NO: 1702038 - RNA, 19 nt, Human
gcagggacuugaacccaua

SEQ ID NO: 1702039 - RNA, 14 nt, Human
gaagugaaacugcu

SEQ ID NO: 1702040 - RNA, 20 nt, Human
gaaugagagacacacugaag

SEQ ID NO: 1702041 - RNA, 23 nt, Human
gaaugagagacacacugaagaag

SEQ ID NO: 1702042 - RNA, 22 nt, Human
gaaugagagacacacugaagaa

SEQ ID NO: 1702043 - RNA, 13 nt, Human
gaauuuuguguua

SEQ ID NO: 1702044 - RNA, 22 nt, Human
gaauuuuguguuagagauuuuu

SEQ ID NO: 1702045 - RNA, 16 nt, Human
gaauuuuguguuagag

SEQ ID NO: 1702046 - RNA, 11 nt, Human
gaauuaguuuu

SEQ ID NO: 1702047 - RNA, 14 nt, Human
gacacacugaagaa

SEQ ID NO: 1702048 - RNA, 12 nt, Human
gacacacaugaa

SEQ ID NO: 1702049 - RNA, 13 nt, Human
gacacacugaaga

SEQ ID NO: 1702050 - RNA, 17 nt, Human
gacagucaccucaugga

SEQ ID NO: 1702051 - RNA, 14 nt, Human
gacagugaaagaaa

SEQ ID NO: 1702052 - RNA, 16 nt, Human
gacacuuaaaaauggu

SEQ ID NO: 1702053 - RNA, 12 nt, Human
gacuggugacug

SEQ ID NO: 1702054 - RNA, 18 nt, Human
gacuggugacugauucuu

SEQ ID NO: 1702055 - RNA, 15 nt, Human
gacuggugacugauu

SEQ ID NO: 1702056 - RNA, 14 nt, Human
gagaaucacuugaa

SEQ ID NO: 1702057 - RNA, 15 nt, Human
gagaaucacuugaac

SEQ ID NO: 1702058 - RNA, 16 nt, Human
gacucuuaagaagacu

SEQ ID NO: 1702059 - RNA, 18 nt, Human
gacucuuaagaagacugc

SEQ ID NO: 1702060 - RNA, 17 nt, Human
gacucuuaagaagacug

SEQ ID NO: 1702061 - RNA, 20 nt, Human
cuuuguauagaaccucuuug

SEQ ID NO: 1702062 - RNA, 11 nt, Human
cuuuguauaga

SEQ ID NO: 1702063 - RNA, 20 nt, Human
cuuuugguuaagucuguuuu

SEQ ID NO: 1702064 - RNA, 16 nt, Human
cuuuugguuaagucug

SEQ ID NO: 1702065 - RNA, 17 nt, Human
gaaauauuuauuuuaau

SEQ ID NO: 1702066 - RNA, 22 nt, Human
gaaauauuuauuuuaauaaugu

SEQ ID NO: 1702067 - RNA, 18 nt, Human
gaaauauuuauuuuaaua

SEQ ID NO: 1702068 - RNA, 15 nt, Human
cuugccuuuuucauu

SEQ ID NO: 1702069 - RNA, 14 nt, Human
cuugccuuuuucau

SEQ ID NO: 1702070 - RNA, 23 nt, Human
cuugccuuuuucauuauuuuauu

SEQ ID NO: 1702071 - RNA, 22 nt, Human
cuugccuuuuucauuauuuuau

SEQ ID NO: 1702072 - RNA, 20 nt, Human
cuugccuuuuucauuauuuu

SEQ ID NO: 1702073 - RNA, 13 nt, Human
cuugaugaagaag

SEQ ID NO: 1702074 - RNA, 12 nt, Human
cuugaugaagaa

SEQ ID NO: 1702075 - RNA, 20 nt, Human
cuucauaccuacauguauuu

SEQ ID NO: 1702076 - RNA, 15 nt, Human
cuucacuguaaaaua

SEQ ID NO: 1702077 - RNA, 13 nt, Human
cuggguuccugca

SEQ ID NO: 1702078 - RNA, 10 nt, Human
cugggacagg

SEQ ID NO: 1702079 - RNA, 15 nt, Human
cuguacuuuuuggca

SEQ ID NO: 1702080 - RNA, 14 nt, Human
cuguacuuuuuggc

SEQ ID NO: 1702081 - RNA, 18 nt, Human
cugugaacuugaaauuug

SEQ ID NO: 1702082 - RNA, 21 nt, Human
cugugagaugcuagaacuccc

SEQ ID NO: 1702083 - RNA, 16 nt, Human
cugugagaugcuagaa

SEQ ID NO: 1702084 - RNA, 21 nt, Human
cuggaaaucaggguuaguauu

SEQ ID NO: 1702085 - RNA, 13 nt, Human
cauauuuuagcua

SEQ ID NO: 1702086 - RNA, 18 nt, Human
caucaaugaaugaaugaa

SEQ ID NO: 1702087 - RNA, 22 nt, Human
caucaagucuuucacauuuaaa

SEQ ID NO: 1702088 - RNA, 22 nt, Human
cauauauuuuuauauuuacuaa

SEQ ID NO: 1702089 - RNA, 22 nt, Human
caucacaguuuugguugcuuua

SEQ ID NO: 1702090 - RNA, 21 nt, Human
caucacaguuuugguugcuuu

SEQ ID NO: 1702091 - RNA, 13 nt, Human
caucacaguuuug

SEQ ID NO: 1702092 - RNA, 22 nt, Human
caucuagugagcagucaggaaa

SEQ ID NO: 1702093 - RNA, 14 nt, Human
caucuagugagcag

SEQ ID NO: 1702094 - RNA, 17 nt, Human
cauaaggaaacuggguu

SEQ ID NO: 1702095 - RNA, 21 nt, Human
cauaacauaaaucugugaacu

SEQ ID NO: 1702096 - RNA, 19 nt, Human
cauaacauaaaucugugaa

SEQ ID NO: 1702097 - RNA, 12 nt, Human
cauaacauaaau

SEQ ID NO: 1702098 - RNA, 14 nt, Human
cauaaaucugugaa

SEQ ID NO: 1702099 - RNA, 23 nt, Human
cauaaaucugugaacuugaaauu

SEQ ID NO: 1702100 - RNA, 22 nt, Human
cauaaaucugugaacuugaaau

SEQ ID NO: 1702101 - RNA, 18 nt, Human
cauaaaucugugaacuug

SEQ ID NO: 1702102 - RNA, 16 nt, Human
cauaaaucugugaacu

SEQ ID NO: 1702103 - RNA, 17 nt, Human
caguuuugguugcuuua

SEQ ID NO: 1702104 - RNA, 19 nt, Human
caguuuugguugcuuuaau

SEQ ID NO: 1702105 - RNA, 18 nt, Human
caguuuugguugcuuuaa

SEQ ID NO: 1702106 - RNA, 21 nt, Human
caguuuuguuuggaccaaaaa

SEQ ID NO: 1702107 - RNA, 15 nt, Human
cauaccuacauguau

SEQ ID NO: 1702108 - RNA, 14 nt, Human
cagugucaaugcag

SEQ ID NO: 1702109 - RNA, 22 nt, Human
caguucggugagcuacaaaugc

SEQ ID NO: 1702110 - RNA, 12 nt, Human
caguucugaaga

SEQ ID NO: 1702111 - RNA, 14 nt, Human
caguucugaagaag

SEQ ID NO: 1702112 - RNA, 13 nt, Human
caguucugaagaa

SEQ ID NO: 1702113 - RNA, 22 nt, Human
caguucugaagaagaugguacc

SEQ ID NO: 1702114 - RNA, 16 nt, Human
caguucugaagaagau

SEQ ID NO: 1702115 - RNA, 15 nt, Human
caguucugaagaaga

SEQ ID NO: 1702116 - RNA, 21 nt, Human
caguuaccucugccucagaaa

SEQ ID NO: 1702117 - RNA, 23 nt, Human
cauggaacgcguugaaauuguaa

SEQ ID NO: 1702118 - RNA, 20 nt, Human
cauggaacgcguugaaauug

SEQ ID NO: 1702119 - RNA, 19 nt, Human
cauggaacgcguugaaauu

SEQ ID NO: 1702120 - RNA, 18 nt, Human
cauggaacgcguugaaau

SEQ ID NO: 1702121 - RNA, 23 nt, Human
caugcugucuacacuaagagaga

SEQ ID NO: 1702122 - RNA, 17 nt, Human
caugggacagggaggac

SEQ ID NO: 1702123 - RNA, 11 nt, Human
cauuauuuuau

SEQ ID NO: 1702124 - RNA, 22 nt, Human
cauguuuauuacaguauaauua

SEQ ID NO: 1702125 - RNA, 20 nt, Human
cauguuuauuacaguauaau

SEQ ID NO: 1702126 - RNA, 19 nt, Human
cauguuuauuacaguauaa

SEQ ID NO: 1702127 - RNA, 18 nt, Human
cauguuuauuacaguaua

SEQ ID NO: 1702128 - RNA, 13 nt, Human
cauguuuauuaca

SEQ ID NO: 1702129 - RNA, 12 nt, Human
cauguuuauuac

SEQ ID NO: 1702130 - RNA, 17 nt, Human
ccaaaccucugugagca

SEQ ID NO: 1702131 - RNA, 16 nt, Human
cauuugcucauggaau

SEQ ID NO: 1702132 - RNA, 14 nt, Human
cauuugcucaugga

SEQ ID NO: 1702133 - RNA, 15 nt, Human
cauuugcucauggaa

SEQ ID NO: 1702134 - RNA, 16 nt, Human
cauuauuuuauuauga

SEQ ID NO: 1702135 - RNA, 14 nt, Human
cauuauuuuauuau

SEQ ID NO: 1702136 - RNA, 12 nt, Human
cauuauuuuauu

SEQ ID NO: 1702137 - RNA, 20 nt, Human
ccaauauucauagcagcuua

SEQ ID NO: 1702138 - RNA, 19 nt, Human
ccaaggcugauuaaaccaa

SEQ ID NO: 1702139 - RNA, 22 nt, Human
ccacaagaaaugaaagcaggga

SEQ ID NO: 1702140 - RNA, 16 nt, Human
ccacaagaaaugaaag

SEQ ID NO: 1702141 - RNA, 18 nt, Human
ccaaggcuagaaccaccu

SEQ ID NO: 1702142 - RNA, 15 nt, Human
cccagacgaugucuu

SEQ ID NO: 1702143 - RNA, 17 nt, Human
cccagacgaugucuuca

SEQ ID NO: 1702144 - RNA, 23 nt, Human
ccauggcacucuauguucuaaga

SEQ ID NO: 1702145 - RNA, 12 nt, Human
cccauuauucaa

SEQ ID NO: 1702146 - RNA, 15 nt, Human
ccauccugaggcucc

SEQ ID NO: 1702147 - RNA, 16 nt, Human
ccauccugaggcucca

SEQ ID NO: 1702148 - RNA, 23 nt, Human
cccggaagccaaaccucugugag

SEQ ID NO: 1702149 - RNA, 19 nt, Human
ccuaaauccauuuggaaau

SEQ ID NO: 1702150 - RNA, 13 nt, Human
ccuaaacauauga

SEQ ID NO: 1702151 - RNA, 21 nt, Human
ccuaaauccauuuggaaaucu

SEQ ID NO: 1702152 - RNA, 20 nt, Human
ccuaaauccauuuggaaauc

SEQ ID NO: 1702153 - RNA, 22 nt, Human
ccuacauguauuuguuugcaua

SEQ ID NO: 1702154 - RNA, 13 nt, Human
ccuccauccugag

SEQ ID NO: 1702155 - RNA, 12 nt, Human
ccuccauccuga

SEQ ID NO: 1702156 - RNA, 14 nt, Human
ccuccauccugagg

SEQ ID NO: 1702157 - RNA, 11 nt, Human
cuaaggacuug

SEQ ID NO: 1702158 - RNA, 17 nt, Human
cuaaggacuuguuagau

SEQ ID NO: 1702159 - RNA, 16 nt, Human
cuaaggacuuguuaga

SEQ ID NO: 1702160 - RNA, 14 nt, Human
cuaagcaaaaugug

SEQ ID NO: 1702161 - RNA, 18 nt, Human
cuaagcaaaaugugauau

SEQ ID NO: 1702162 - RNA, 15 nt, Human
cuaagcaaaauguga

SEQ ID NO: 1702163 - RNA, 17 nt, Human
cuacacuccagugagac

SEQ ID NO: 1702164 - RNA, 16 nt, Human
cuacacuccagugaga

SEQ ID NO: 1702165 - RNA, 19 nt, Human
cuacuugggaggcugagau

SEQ ID NO: 1702166 - RNA, 18 nt, Human
cuacuugggaggcugaga

SEQ ID NO: 1702167 - RNA, 15 nt, Human
cuacuugggaggcug

SEQ ID NO: 1702168 - RNA, 23 nt, Human
cuauauaugugaugaucuaccag

SEQ ID NO: 1702169 - RNA, 18 nt, Human
cuauauaugugaugaucu

SEQ ID NO: 1702170 - RNA, 12 nt, Human
cuaguucacucu

SEQ ID NO: 1702171 - RNA, 20 nt, Human
cuauauuuuuuguuaaauga

SEQ ID NO: 1702172 - RNA, 19 nt, Human
cuauauuguuugcuaagca

SEQ ID NO: 1702173 - RNA, 18 nt, Human
cuaugaaauauuauguua

SEQ ID NO: 1702174 - RNA, 13 nt, Human
cuaugaaauauua

SEQ ID NO: 1702175 - RNA, 22 nt, Human
cuauauuuuuuguuaaaugauu

SEQ ID NO: 1702176 - RNA, 23 nt, Human
cuaguaucaaaagaaagaaaauc

SEQ ID NO: 1702177 - RNA, 17 nt, Human
cuaguaucaaaagaaag

SEQ ID NO: 1702178 - RNA, 15 nt, Human
cuaguaucaaaagaa

SEQ ID NO: 1702179 - RNA, 20 nt, Human
cuaguauuucuaugaaauau

SEQ ID NO: 1702180 - RNA, 19 nt, Human
cuaguauuucuaugaaaua

SEQ ID NO: 1702181 - RNA, 22 nt, Human
cuaguauuucuaugaaauauua

SEQ ID NO: 1702182 - RNA, 17 nt, Human
cucaccccuugccauaa

SEQ ID NO: 1702183 - RNA, 13 nt, Human
cucacauuuauau

SEQ ID NO: 1702184 - RNA, 16 nt, Human
cuaaauccauuuggaa

SEQ ID NO: 1702185 - RNA, 20 nt, Human
cuaaauccauuuggaaaucu

SEQ ID NO: 1702186 - RNA, 19 nt, Human
cuaaauccauuuggaaauc

SEQ ID NO: 1702187 - RNA, 17 nt, Human
cuaaauccauuuggaaa

SEQ ID NO: 1702188 - RNA, 23 nt, Human
cuaaauugacacuuaaaaauggu

SEQ ID NO: 1702189 - RNA, 15 nt, Human
cgugcuaaggacuug

SEQ ID NO: 1702190 - RNA, 14 nt, Human
cgugcuaaggacuu

SEQ ID NO: 1702191 - RNA, 13 nt, Human
cgugcuaaggacu

SEQ ID NO: 1702192 - RNA, 12 nt, Human
cgugcuaaggac

SEQ ID NO: 1702193 - RNA, 16 nt, Human
cgugcuaaggacuugu

SEQ ID NO: 1702194 - RNA, 18 nt, Human
cguugaaauuguaauuau

SEQ ID NO: 1702195 - RNA, 23 nt, Human
cguugaaauuguaauuauaucug

SEQ ID NO: 1702196 - RNA, 16 nt, Human
cggugaauggcuuugu

SEQ ID NO: 1702197 - RNA, 15 nt, Human
cggugaauggcuuug

SEQ ID NO: 1702198 - RNA, 14 nt, Human
cggugaauggcuuu

SEQ ID NO: 1702199 - RNA, 13 nt, Human
cggugaauggcuu

SEQ ID NO: 1702200 - RNA, 22 nt, Human
cggugaauggcuuuguauagaa

SEQ ID NO: 1702201 - RNA, 20 nt, Human
cggugaauggcuuuguauag

SEQ ID NO: 1702202 - RNA, 18 nt, Human
cggugaauggcuuuguau

SEQ ID NO: 1702203 - RNA, 17 nt, Human
cggugagcuacaaaugc

SEQ ID NO: 1702204 - RNA, 14 nt, Human
cggccuccauccug

SEQ ID NO: 1702205 - RNA, 12 nt, Human
cggccuccaucc

SEQ ID NO: 1702206 - RNA, 18 nt, Human
cgcucucuggccuucggc

SEQ ID NO: 1702207 - RNA, 15 nt, Human
cgcucucuggccuuc

SEQ ID NO: 1702208 - RNA, 14 nt, Human
cgcucucuggccuu

SEQ ID NO: 1702209 - RNA, 17 nt, Human
cucccuauuuuuuuucu

SEQ ID NO: 1702210 - RNA, 20 nt, Human
cuccauccugaggcuccacu

SEQ ID NO: 1702211 - RNA, 18 nt, Human
cuccauccugaggcucca

SEQ ID NO: 1702212 - RNA, 16 nt, Human
cuccauccugaggcuc

SEQ ID NO: 1702213 - RNA, 11 nt, Human
cuccauccuga

SEQ ID NO: 1702214 - RNA, 21 nt, Human
cucccuauuuuuuuucuguua

SEQ ID NO: 1702215 - RNA, 20 nt, Human
cucccuauuuuuuuucuguu

SEQ ID NO: 1702216 - RNA, 19 nt, Human
cucccuauuuuuuuucugu

SEQ ID NO: 1702217 - RNA, 17 nt, Human
cucuaggaaauauuuau

SEQ ID NO: 1702218 - RNA, 15 nt, Human
cucuaggaaauauuu

SEQ ID NO: 1702219 - RNA, 16 nt, Human
cugacaucucugcaau

SEQ ID NO: 1702220 - RNA, 15 nt, Human
cugacaucucugcaa

SEQ ID NO: 1702221 - RNA, 14 nt, Human
cugacaucucugca

SEQ ID NO: 1702222 - RNA, 17 nt, Human
cugacucuuaagaagac

SEQ ID NO: 1702223 - RNA, 20 nt, Human
cugagcgacagugagacucu

SEQ ID NO: 1702224 - RNA, 16 nt, Human
cugagcgacagugaga

SEQ ID NO: 1702225 - RNA, 21 nt, Human
cucugugagcaucacaguuuu

SEQ ID NO: 1702226 - RNA, 18 nt, Human
cucugugagcaucacagu

SEQ ID NO: 1702227 - RNA, 22 nt, Human
cucugugagcaucacaguuuug

SEQ ID NO: 1702228 - RNA, 19 nt, Human
cucuggccuucggccucca

SEQ ID NO: 1702229 - RNA, 12 nt, Human
cucuggccuucg

SEQ ID NO: 1702230 - RNA, 23 nt, Human
cugaacacuccaauuaaggauuu

SEQ ID NO: 1702231 - RNA, 18 nt, Human
cugaacacuccaauuaag

SEQ ID NO: 1702232 - RNA, 23 nt, Human
cugaagaagcaccaaucaugaau

SEQ ID NO: 1702233 - RNA, 16 nt, Human
cuguauagauuagaga

SEQ ID NO: 1702234 - RNA, 20 nt, Human
cuguauagauuagaauucug

SEQ ID NO: 1702235 - RNA, 15 nt, Human
cuguauagauuagag

SEQ ID NO: 1702236 - RNA, 15 nt, Human
cuguaugauucccag

SEQ ID NO: 1702237 - RNA, 16 nt, Human
cuguauuuuaaaagaa

SEQ ID NO: 1702238 - RNA, 13 nt, Human
cuguauuuuaaaa

SEQ ID NO: 1702239 - RNA, 18 nt, Human
cugucucuacuaaaaaua

SEQ ID NO: 1702240 - RNA, 14 nt, Human
cuggccuuucauau

SEQ ID NO: 1702241 - RNA, 15 nt, Human
cuggccuucggccuc

SEQ ID NO: 1702242 - RNA, 21 nt, Human
cuggccuucggccuccauccu

SEQ ID NO: 1702243 - RNA, 18 nt, Human
cuggccuucggccuccau

SEQ ID NO: 1702244 - RNA, 17 nt, Human
cuggccuucggccucca

SEQ ID NO: 1702245 - RNA, 16 nt, Human
cuggccuucggccucc

SEQ ID NO: 1702246 - RNA, 13 nt, Human
cugcuuguuuccu

SEQ ID NO: 1702247 - RNA, 14 nt, Human
cugcuuguuuccua

SEQ ID NO: 1702248 - RNA, 16 nt, Human
cugcuuucagauacug

SEQ ID NO: 1702249 - RNA, 15 nt, Human
cugcuuucagauacu

SEQ ID NO: 1702250 - RNA, 12 nt, Human
cugcuuucagau

SEQ ID NO: 1702251 - RNA, 22 nt, Human
cuuuugauaaucaacugggcug

SEQ ID NO: 1702252 - RNA, 23 nt, Human
cuuuugauaaucaacugggcuga

SEQ ID NO: 1702253 - RNA, 20 nt, Human
cuugaaauuugaauuuugug

SEQ ID NO: 1702254 - RNA, 19 nt, Human
cuugaaauuugaauuuugu

SEQ ID NO: 1702255 - RNA, 14 nt, Human
cuugaacccgggag

SEQ ID NO: 1702256 - RNA, 20 nt, Human
cuugaacccgggaggcagag

SEQ ID NO: 1702257 - RNA, 19 nt, Human
cuugaacccgggaggcaga

SEQ ID NO: 1702258 - RNA, 19 nt, Human
cuucuuuccacagaagcuc

SEQ ID NO: 1702259 - RNA, 13 nt, Human
cuucuuuccacag

SEQ ID NO: 1702260 - RNA, 21 nt, Human
cuugcaugguuuagaaagcuu

SEQ ID NO: 1702261 - RNA, 15 nt, Human
cuuguauuaagaaug

SEQ ID NO: 1702262 - RNA, 14 nt, Human
cuuguauuaagaau

SEQ ID NO: 1702263 - RNA, 18 nt, Human
cuuguaaaggaauuuaaa

SEQ ID NO: 1702264 - RNA, 17 nt, Human
cuugccaaauauaaaua

SEQ ID NO: 1702265 - RNA, 22 nt, Human
gaacuugaaauuugaauuuugu

SEQ ID NO: 1702266 - RNA, 15 nt, Human
gaacuugaaauuuga

SEQ ID NO: 1702267 - RNA, 13 nt, Human
gaacuugaaauuu

SEQ ID NO: 1702268 - RNA, 12 nt, Human
gaacuugaaauu

SEQ ID NO: 1702269 - RNA, 16 nt, Human
gaacucccuuucaaca

SEQ ID NO: 1702270 - RNA, 15 nt, Human
gaaccacaagacugc

SEQ ID NO: 1702271 - RNA, 14 nt, Human
gaaccacaagacug

SEQ ID NO: 1702272 - RNA, 22 nt, Human
gaacuuguaaaggaauuuaaaa

SEQ ID NO: 1702273 - RNA, 17 nt, Human
gaagauguagaggagaa

SEQ ID NO: 1702274 - RNA, 14 nt, Human
gaagucagaucugc

SEQ ID NO: 1702275 - RNA, 23 nt, Human
gaagucagaucugccuaaggacu

SEQ ID NO: 1702276 - RNA, 22 nt, Human
gaagucagaucugccuaaggac

SEQ ID NO: 1702277 - RNA, 23 nt, Human
gaaguccaagcauuuagauguau

SEQ ID NO: 1702278 - RNA, 13 nt, Human
gaagcauuuuaua

SEQ ID NO: 1702279 - RNA, 17 nt, Human
gaagcauuuuauaaauc

SEQ ID NO: 1702280 - RNA, 15 nt, Human
gaagcauuuuauaaa

SEQ ID NO: 1702281 - RNA, 18 nt, Human
gaagccaaaccucuguga

SEQ ID NO: 1702282 - RNA, 16 nt, Human
gaaacggaugauuucu

SEQ ID NO: 1702283 - RNA, 14 nt, Human
gaaagcagaacagu

SEQ ID NO: 1702284 - RNA, 13 nt, Human
gaaagcagaacag

SEQ ID NO: 1702285 - RNA, 13 nt, Human
gaaauuugaauuu

SEQ ID NO: 1702286 - RNA, 24 nt, Human
gaaauuugaauuuuguguuagaga

SEQ ID NO: 1702287 - RNA, 16 nt, Human
gaaauuugaauuuugu

SEQ ID NO: 1702288 - RNA, 20 nt, Human
gaacacuccaauuaaggauu

SEQ ID NO: 1702289 - RNA, 24 nt, Human
gaacaguuaccucugccucagaaa

SEQ ID NO: 1702290 - RNA, 13 nt, Human
gaaauauuuauuu

SEQ ID NO: 1702291 - RNA, 16 nt, Human
gaaauauuuauuuuaa

SEQ ID NO: 1702292 - RNA, 15 nt, Human
gaaauauuuauuuua

SEQ ID NO: 1702293 - RNA, 19 nt, Human
gaggaagccugauuaaaga

SEQ ID NO: 1702294 - RNA, 18 nt, Human
gaggaagccugauuaaag

SEQ ID NO: 1702295 - RNA, 16 nt, Human
gagcucgugggacagu

SEQ ID NO: 1702296 - RNA, 12 nt, Human
gacuuguuagau

SEQ ID NO: 1702297 - RNA, 18 nt, Human
gagacacacugaagaagc

SEQ ID NO: 1702298 - RNA, 16 nt, Human
gagaagaacugaaauc

SEQ ID NO: 1702299 - RNA, 14 nt, Human
gagaagaacugaaa

SEQ ID NO: 1702300 - RNA, 13 nt, Human
gagaagaacugaa

SEQ ID NO: 1702301 - RNA, 13 nt, Human
gagacagcucugc

SEQ ID NO: 1702302 - RNA, 18 nt, Human
gagacagcucugcauacu

SEQ ID NO: 1702303 - RNA, 15 nt, Human
gagacagcucugcau

SEQ ID NO: 1702304 - RNA, 15 nt, Human
gagagugaacaaauu

SEQ ID NO: 1702305 - RNA, 19 nt, Human
gagagugaacaaauuuaca

SEQ ID NO: 1702306 - RNA, 17 nt, Human
gagauacagaauuuuau

SEQ ID NO: 1702307 - RNA, 19 nt, Human
gagagacacacugaagaag

SEQ ID NO: 1702308 - RNA, 20 nt, Human
gaccaaaaaccaguauugua

SEQ ID NO: 1702309 - RNA, 19 nt, Human
gaccaaaaaccaguauugu

SEQ ID NO: 1702310 - RNA, 13 nt, Human
gaccaaaaaccag

SEQ ID NO: 1702311 - RNA, 22 nt, Human
gacaugggacauuugcucaugg

SEQ ID NO: 1702312 - RNA, 17 nt, Human
gacaugggacauuugcu

SEQ ID NO: 1702313 - RNA, 16 nt, Human
gacauagucuggcugu

SEQ ID NO: 1702314 - RNA, 14 nt, Human
gacaucaacagaua

SEQ ID NO: 1702315 - RNA, 15 nt, Human
gacaagcucacagac

SEQ ID NO: 1702316 - RNA, 23 nt, Human
gaccugauuucugagcauuuaau

SEQ ID NO: 1702317 - RNA, 18 nt, Human
gcagauuauucacugauu

SEQ ID NO: 1702318 - RNA, 18 nt, Human
gcagauaaacaguaguga

SEQ ID NO: 1702319 - RNA, 20 nt, Human
gcagccccgugggguuccuc

SEQ ID NO: 1702320 - RNA, 18 nt, Human
gcacggugaauggcuuug

SEQ ID NO: 1702321 - RNA, 17 nt, Human
gcauagguuuaauaauu

SEQ ID NO: 1702322 - RNA, 21 nt, Human
gcauaggugaucucauuuaau

SEQ ID NO: 1702323 - RNA, 15 nt, Human
gcaguucugaagaag

SEQ ID NO: 1702324 - RNA, 17 nt, Human
gcaguucugaagaagau

SEQ ID NO: 1702325 - RNA, 13 nt, Human
gcauagaaguaaa

SEQ ID NO: 1702326 - RNA, 13 nt, Human
gcauuauauuuau

SEQ ID NO: 1702327 - RNA, 20 nt, Human
gaugccaaguuguuugagaa

SEQ ID NO: 1702328 - RNA, 21 nt, Human
gauggcuaguaucaaaagaaa

SEQ ID NO: 1702329 - RNA, 13 nt, Human
gauccuggaaauc

SEQ ID NO: 1702330 - RNA, 22 nt, Human
gauaaauaguuuaugauuccac

SEQ ID NO: 1702331 - RNA, 23 nt, Human
gauagauaggucagugcaaauac

SEQ ID NO: 1702332 - RNA, 19 nt, Human
gauuuuaugcuuuaaacau

SEQ ID NO: 1702333 - RNA, 14 nt, Human
gauuuuaugcuuua

SEQ ID NO: 1702334 - RNA, 23 nt, Human
gauuuuauuauguaaaucccauu

SEQ ID NO: 1702335 - RNA, 20 nt, Human
gauuuuauuauguaaauccc

SEQ ID NO: 1702336 - RNA, 19 nt, Human
gauuuuauuauguaaaucc

SEQ ID NO: 1702337 - RNA, 18 nt, Human
gauuuuauuauguaaauc

SEQ ID NO: 1702338 - RNA, 15 nt, Human
gauuuuauuauguaa

SEQ ID NO: 1702339 - RNA, 13 nt, Human
gauuuuauuaugu

SEQ ID NO: 1702340 - RNA, 15 nt, Human
gauuuuccugaaaac

SEQ ID NO: 1702341 - RNA, 10 nt, Human
gcaagccaga

SEQ ID NO: 1702342 - RNA, 23 nt, Human
gccuuuuucauuauuuuauuaug

SEQ ID NO: 1702343 - RNA, 17 nt, Human
gcuaaacuuuucugaua

SEQ ID NO: 1702344 - RNA, 15 nt, Human
gcuaaacuuuucuga

SEQ ID NO: 1702345 - RNA, 13 nt, Human
gcuaaacuuuucu

SEQ ID NO: 1702346 - RNA, 19 nt, Human
gcuagaacucccuuucaac

SEQ ID NO: 1702347 - RNA, 12 nt, Human
gcgacagugaga

SEQ ID NO: 1702348 - RNA, 22 nt, Human
gcgacagugagacucugucuca

SEQ ID NO: 1702349 - RNA, 16 nt, Human
gcccugcuuucagaua

SEQ ID NO: 1702350 - RNA, 14 nt, Human
gcccugcuuucaga

SEQ ID NO: 1702351 - RNA, 20 nt, Human
gccgggcgugguggugagug

SEQ ID NO: 1702352 - RNA, 21 nt, Human
gccuaaauccauuuggaaauc

SEQ ID NO: 1702353 - RNA, 19 nt, Human
gccuaaauccauuuggaaa

SEQ ID NO: 1702354 - RNA, 13 nt, Human
gccuaaauccauu

SEQ ID NO: 1702355 - RNA, 12 nt, Human
gccuaaauccau

SEQ ID NO: 1702356 - RNA, 23 nt, Human
gccuaaauccauuuggaaaucuu

SEQ ID NO: 1702357 - RNA, 22 nt, Human
gccuaaauccauuuggaaaucu

SEQ ID NO: 1702358 - RNA, 19 nt, Human
gccaugggcacugugggua

SEQ ID NO: 1702359 - RNA, 15 nt, Human
uuuugguugcuuuaa

SEQ ID NO: 1702360 - RNA, 16 nt, Human
uuuugguugcuuuaau

SEQ ID NO: 1702361 - RNA, 18 nt, Human
uuuuuaaaaaagaaacau

SEQ ID NO: 1702362 - RNA, 21 nt, Human
uuuuggcauaacauaaaucug

SEQ ID NO: 1702363 - RNA, 18 nt, Human
uuuuggucuggagggaag

SEQ ID NO: 1702364 - RNA, 14 nt, Human
uuuuccugaaaacc

SEQ ID NO: 1702365 - RNA, 18 nt, Human
uuuuuaagccuuaaagga

SEQ ID NO: 1702366 - RNA, 19 nt, Human
uuuuucucuaggaaauauu

SEQ ID NO: 1702367 - RNA, 16 nt, Human
uuuggauaauaaggaa

SEQ ID NO: 1702368 - RNA, 16 nt, Human
uuuguauaaaauaauu

SEQ ID NO: 1702369 - RNA, 14 nt, Human
uuuguauaaaauaa

SEQ ID NO: 1702370 - RNA, 13 nt, Human
uuuguauaaaaua

SEQ ID NO: 1702371 - RNA, 22 nt, Human
uuuggaauuuuccuccuuucuc

SEQ ID NO: 1702372 - RNA, 20 nt, Human
uuuuaauaauguuucaaaca

SEQ ID NO: 1702373 - RNA, 21 nt, Human
uuuuaaaagaaugauuaugaa

SEQ ID NO: 1702374 - RNA, 18 nt, Human
uuugaaucaucaagucuu

SEQ ID NO: 1702375 - RNA, 14 nt, Human
guauaauuaacaug

SEQ ID NO: 1702376 - RNA, 13 nt, Human
guauaauuaacau

SEQ ID NO: 1702377 - RNA, 15 nt, Human
guaguguuggagaag

SEQ ID NO: 1702378 - RNA, 14 nt, Human
guaguguuggagaa

SEQ ID NO: 1702379 - RNA, 23 nt, Human
guauaauuaacauguuaaaccau

SEQ ID NO: 1702380 - RNA, 22 nt, Human
guauaauuaacauguuaaacca

SEQ ID NO: 1702381 - RNA, 19 nt, Human
guauaauuaacauguuaaa

SEQ ID NO: 1702382 - RNA, 17 nt, Human
guauaauuaacauguua

SEQ ID NO: 1702383 - RNA, 15 nt, Human
guauaauuaacaugu

SEQ ID NO: 1702384 - RNA, 21 nt, Human
guaugugugaagugagugagu

SEQ ID NO: 1702385 - RNA, 17 nt, Human
guauguuagugcaaauu

SEQ ID NO: 1702386 - RNA, 14 nt, Human
guauagauuagaau

SEQ ID NO: 1702387 - RNA, 19 nt, Human
guauagaaccucuuugucu

SEQ ID NO: 1702388 - RNA, 21 nt, Human
guauuaagcauauauuuuuau

SEQ ID NO: 1702389 - RNA, 18 nt, Human
guauuaagcauauauuuu

SEQ ID NO: 1702390 - RNA, 16 nt, Human
guauuaagaaugaaau

SEQ ID NO: 1702391 - RNA, 15 nt, Human
guauuaagcauauau

SEQ ID NO: 1702392 - RNA, 17 nt, Human
guauuaagcauauauuu

SEQ ID NO: 1702393 - RNA, 16 nt, Human
guauuaagcauauauu

SEQ ID NO: 1702394 - RNA, 13 nt, Human
guauuuuaaucac

SEQ ID NO: 1702395 - RNA, 20 nt, Human
guauuuuaaaagaaugauua

SEQ ID NO: 1702396 - RNA, 15 nt, Human
gucaaugcagccccc

SEQ ID NO: 1702397 - RNA, 22 nt, Human
gucaauaaaauccauacauuug

SEQ ID NO: 1702398 - RNA, 23 nt, Human
gucaauaaaauccauacauuugu

SEQ ID NO: 1702399 - RNA, 21 nt, Human
gucagaucugccuaaggacuu

SEQ ID NO: 1702400 - RNA, 20 nt, Human
gucagaucugccuaaggacu

SEQ ID NO: 1702401 - RNA, 19 nt, Human
gucagaucugccuaaggac

SEQ ID NO: 1702402 - RNA, 18 nt, Human
gucagaucugccuaagga

SEQ ID NO: 1702403 - RNA, 16 nt, Human
gucagaucugccuaag

SEQ ID NO: 1702404 - RNA, 21 nt, Human
gucucugaagugaaacugcuu

SEQ ID NO: 1702405 - RNA, 15 nt, Human
gucucugaagugaaa

SEQ ID NO: 1702406 - RNA, 13 nt, Human
gucugacuguuuc

SEQ ID NO: 1702407 - RNA, 14 nt, Human
gucucagauuuuau

SEQ ID NO: 1702408 - RNA, 16 nt, Human
gucucagauuuuauua

SEQ ID NO: 1702409 - RNA, 15 nt, Human
gucucagauuuuauu

SEQ ID NO: 1702410 - RNA, 21 nt, Human
gucucagauuuuauuauguaa

SEQ ID NO: 1702411 - RNA, 17 nt, Human
gucucagauuuuauuau

SEQ ID NO: 1702412 - RNA, 18 nt, Human
gucgucaaagcugaaaug

SEQ ID NO: 1702413 - RNA, 15 nt, Human
gucuguuuuaugacu

SEQ ID NO: 1702414 - RNA, 13 nt, Human
gucuguuuuauga

SEQ ID NO: 1702415 - RNA, 21 nt, Human
gucugugagaugcuagaacuc

SEQ ID NO: 1702416 - RNA, 17 nt, Human
gucugugagaugcuaga

SEQ ID NO: 1702417 - RNA, 16 nt, Human
gucugugagaugcuag

SEQ ID NO: 1702418 - RNA, 15 nt, Human
gucugugagaugcua

SEQ ID NO: 1702419 - RNA, 23 nt, Human
gucugugagaugcuagaacuccc

SEQ ID NO: 1702420 - RNA, 22 nt, Human
gucugugagaugcuagaacucc

SEQ ID NO: 1702421 - RNA, 20 nt, Human
gucuugccuuuuucauuauu

SEQ ID NO: 1702422 - RNA, 18 nt, Human
gucuugccuuuuucauua

SEQ ID NO: 1702423 - RNA, 17 nt, Human
gucuugccuuuuucauu

SEQ ID NO: 1702424 - RNA, 16 nt, Human
gucuugccuuuuucau

SEQ ID NO: 1702425 - RNA, 15 nt, Human
gucuugccuuuuuca

SEQ ID NO: 1702426 - RNA, 22 nt, Human
gucuugucucagauuuuauuau

SEQ ID NO: 1702427 - RNA, 20 nt, Human
gucuugucucagauuuuauu

SEQ ID NO: 1702428 - RNA, 15 nt, Human
gucuugucucagauu

SEQ ID NO: 1702429 - RNA, 17 nt, Human
gugcgcuaaacuuuucu

SEQ ID NO: 1702430 - RNA, 21 nt, Human
gugcgcuaaacuuuucugaua

SEQ ID NO: 1702431 - RNA, 12 nt, Human
gugcuaaggacu

SEQ ID NO: 1702432 - RNA, 20 nt, Human
gugcuaaggacuuguuagau

SEQ ID NO: 1702433 - RNA, 14 nt, Human
gugcuaaggacuug

SEQ ID NO: 1702434 - RNA, 13 nt, Human
gugcuaaggacuu

SEQ ID NO: 1702435 - RNA, 21 nt, Human
gugaacaaauuuacagagaca

SEQ ID NO: 1702436 - RNA, 14 nt, Human
gugagcuacaaaug

SEQ ID NO: 1702437 - RNA, 16 nt, Human
guggugacuuuggaua

SEQ ID NO: 1702438 - RNA, 21 nt, Human
guguaaguagauaggccaugg

SEQ ID NO: 1702439 - RNA, 15 nt, Human
guggugacuuuggau

SEQ ID NO: 1702440 - RNA, 13 nt, Human
guggugacuuugg

SEQ ID NO: 1702441 - RNA, 14 nt, Human
guuaaaagagguuu

SEQ ID NO: 1702442 - RNA, 21 nt, Human
guuaaaagagguuuuucuuaa

SEQ ID NO: 1702443 - RNA, 20 nt, Human
guuaaaagagguuuuucuua

SEQ ID NO: 1702444 - RNA, 18 nt, Human
guuaaaccaugggauaaa

SEQ ID NO: 1702445 - RNA, 21 nt, Human
guuaaaccaugggauaaaugc

SEQ ID NO: 1702446 - RNA, 13 nt, Human
guuacagaagccc

SEQ ID NO: 1702447 - RNA, 13 nt, Human
guuauauaaaugg

SEQ ID NO: 1702448 - RNA, 12 nt, Human
guuauauaaaug

SEQ ID NO: 1702449 - RNA, 10 nt, Human
guuauauaaa

SEQ ID NO: 1702450 - RNA, 19 nt, Human
guuaucugaagucagaucu

SEQ ID NO: 1702451 - RNA, 17 nt, Human
guuauuauauuuacaaa

SEQ ID NO: 1702452 - RNA, 23 nt, Human
guuaccucugccucagaaaacaa

SEQ ID NO: 1702453 - RNA, 19 nt, Human
guucacucuccauuuaaua

SEQ ID NO: 1702454 - RNA, 23 nt, Human
guucauggaacgcguugaaauug

SEQ ID NO: 1702455 - RNA, 22 nt, Human
guucauggaacgcguugaaauu

SEQ ID NO: 1702456 - RNA, 16 nt, Human
guucaucaaugaauga

SEQ ID NO: 1702457 - RNA, 15 nt, Human
guuccugcaaugaag

SEQ ID NO: 1702458 - RNA, 22 nt, Human
guugaauuuauuggcuuuucug

SEQ ID NO: 1702459 - RNA, 21 nt, Human
guugaauuuauuggcuuuucu

SEQ ID NO: 1702460 - RNA, 20 nt, Human
guugauggugguauguuuuc

SEQ ID NO: 1702461 - RNA, 21 nt, Human
guugauggugguauguuuuca

SEQ ID NO: 1702462 - RNA, 14 nt, Human
guugaauuuauugg

SEQ ID NO: 1702463 - RNA, 15 nt, Human
guugaaauuguaauu

SEQ ID NO: 1702464 - RNA, 20 nt, Human
guugaaauuguaauuauauc

SEQ ID NO: 1702465 - RNA, 16 nt, Human
guugaaauuguaauua

SEQ ID NO: 1702466 - RNA, 22 nt, Human
guugaaacggaugauuucuaug

SEQ ID NO: 1702467 - RNA, 21 nt, Human
guugaaacggaugauuucuau

SEQ ID NO: 1702468 - RNA, 15 nt, Human
guucugaagaagaug

SEQ ID NO: 1702469 - RNA, 14 nt, Human
guucugaagaagau

SEQ ID NO: 1702470 - RNA, 13 nt, Human
guucugaagaaga

SEQ ID NO: 1702471 - RNA, 12 nt, Human
guucugaagaag

SEQ ID NO: 1702472 - RNA, 18 nt, Human
guuguuugagaaauuaag

SEQ ID NO: 1702473 - RNA, 20 nt, Human
guuuauauaagcuuguauuc

SEQ ID NO: 1702474 - RNA, 20 nt, Human
guuuaggauguugaaaaagu

SEQ ID NO: 1702475 - RNA, 21 nt, Human
guuuagcuggaaaaguauguu

SEQ ID NO: 1702476 - RNA, 20 nt, Human
guuuagcuggaaaaguaugu

SEQ ID NO: 1702477 - RNA, 16 nt, Human
guuuugguugcuuuaa

SEQ ID NO: 1702478 - RNA, 18 nt, Human
uaaaagagguuuuucuua

SEQ ID NO: 1702479 - RNA, 21 nt, Human
uaaaagagguuuuucuuaaau

SEQ ID NO: 1702480 - RNA, 19 nt, Human
uaaaagagguuuuucuuaa

SEQ ID NO: 1702481 - RNA, 17 nt, Human
uaaaauccauacauuug

SEQ ID NO: 1702482 - RNA, 15 nt, Human
uaaaauccauacauu

SEQ ID NO: 1702483 - RNA, 18 nt, Human
uaaaaaugguuuaaaugg

SEQ ID NO: 1702484 - RNA, 19 nt, Human
uaaaaaugguuuaaauggu

SEQ ID NO: 1702485 - RNA, 22 nt, Human
uaaaacaagcacuaaacaaaga

SEQ ID NO: 1702486 - RNA, 20 nt, Human
uaaagccauguuuauuacag

SEQ ID NO: 1702487 - RNA, 15 nt, Human
uaaagccauguuuau

SEQ ID NO: 1702488 - RNA, 13 nt, Human
uaaagccauguuu

SEQ ID NO: 1702489 - RNA, 11 nt, Human
uaaagccaugu

SEQ ID NO: 1702490 - RNA, 14 nt, Human
uaaaguguuugaaa

SEQ ID NO: 1702491 - RNA, 21 nt, Human
uaaacauugguucuuguauua

SEQ ID NO: 1702492 - RNA, 19 nt, Human
uaaacauugguucuuguau

SEQ ID NO: 1702493 - RNA, 14 nt, Human
uaaaugguuaaaag

SEQ ID NO: 1702494 - RNA, 20 nt, Human
uaaauggcuuccuggcaaua

SEQ ID NO: 1702495 - RNA, 23 nt, Human
uaaaugccaucaauaaaaaauua

SEQ ID NO: 1702496 - RNA, 16 nt, Human
uaaaugccaucaauaa

SEQ ID NO: 1702497 - RNA, 23 nt, Human
uaaauugacacuuaaaaaugguu

SEQ ID NO: 1702498 - RNA, 20 nt, Human
uaaauugacacuuaaaaaug

SEQ ID NO: 1702499 - RNA, 17 nt, Human
uaacuguuauuuauaau

SEQ ID NO: 1702500 - RNA, 16 nt, Human
uaacuguuauuuauaa

SEQ ID NO: 1702501 - RNA, 15 nt, Human
uaacuggaaacuuca

SEQ ID NO: 1702502 - RNA, 21 nt, Human
uaagaaaauaucacuugucaa

SEQ ID NO: 1702503 - RNA, 13 nt, Human
uaagagagaauga

SEQ ID NO: 1702504 - RNA, 23 nt, Human
uaagagagaaugagagacacacu

SEQ ID NO: 1702505 - RNA, 14 nt, Human
uaagagagaaugag

SEQ ID NO: 1702506 - RNA, 17 nt, Human
uaaccaggggccaugaa

SEQ ID NO: 1702507 - RNA, 16 nt, Human
uaauaaggaaaaguuu

SEQ ID NO: 1702508 - RNA, 21 nt, Human
uaagucuguuuuaugacuuca

SEQ ID NO: 1702509 - RNA, 20 nt, Human
uaagucuguuuuaugacuuc

SEQ ID NO: 1702510 - RNA, 19 nt, Human
uaagucuguuuuaugacuu

SEQ ID NO: 1702511 - RNA, 16 nt, Human
uaagucuguuuuauga

SEQ ID NO: 1702512 - RNA, 13 nt, Human
uaagucuguuuua

SEQ ID NO: 1702513 - RNA, 13 nt, Human
uaagugaaauaag

SEQ ID NO: 1702514 - RNA, 19 nt, Human
uaaggauuuuaugcuuuaa

SEQ ID NO: 1702515 - RNA, 17 nt, Human
uaaggauuuuaugcuuu

SEQ ID NO: 1702516 - RNA, 13 nt, Human
uaaggauuuuaug

SEQ ID NO: 1702517 - RNA, 12 nt, Human
uaaggauuuuau

SEQ ID NO: 1702518 - RNA, 22 nt, Human
uaaggauuuuaugcuuuaaaca

SEQ ID NO: 1702519 - RNA, 20 nt, Human
uaaggauuuuaugcuuuaaa

SEQ ID NO: 1702520 - RNA, 21 nt, Human
uaauuaacauguuaaaccaug

SEQ ID NO: 1702521 - RNA, 22 nt, Human
uaauguuucaaacauauauaac

SEQ ID NO: 1702522 - RNA, 23 nt, Human
uaaugauaacuggaaacuucagc

SEQ ID NO: 1702523 - RNA, 22 nt, Human
uaaugauaacuggaaacuucag

SEQ ID NO: 1702524 - RNA, 17 nt, Human
uaaugauaacuggaaac

SEQ ID NO: 1702525 - RNA, 23 nt, Human
uaauaucaucaguauugaagcau

SEQ ID NO: 1702526 - RNA, 14 nt, Human
uaauaauguuucaa

SEQ ID NO: 1702527 - RNA, 16 nt, Human
uaauauuaaagccaug

SEQ ID NO: 1702528 - RNA, 15 nt, Human
uaauauuaaagccau

SEQ ID NO: 1702529 - RNA, 21 nt, Human
uaauauuaaagccauguuuau

SEQ ID NO: 1702530 - RNA, 20 nt, Human
uaauauuaaagccauguuua

SEQ ID NO: 1702531 - RNA, 17 nt, Human
uaauauuaaagccaugu

SEQ ID NO: 1702532 - RNA, 23 nt, Human
uauaucugaggaauucuguauag

SEQ ID NO: 1702533 - RNA, 19 nt, Human
uauauaacaaugcuguauu

SEQ ID NO: 1702534 - RNA, 17 nt, Human
uauauaacaaugcugua

SEQ ID NO: 1702535 - RNA, 21 nt, Human
uauagaaccucuuugucuaca

SEQ ID NO: 1702536 - RNA, 20 nt, Human
uauagaaccucuuugucuac

SEQ ID NO: 1702537 - RNA, 16 nt, Human
uaucaucaguauugaa

SEQ ID NO: 1702538 - RNA, 15 nt, Human
uaucaucaguauuga

SEQ ID NO: 1702539 - RNA, 14 nt, Human
uaucaucaguauug

SEQ ID NO: 1702540 - RNA, 14 nt, Human
uaucaaaagaaaga

SEQ ID NO: 1702541 - RNA, 16 nt, Human
uauauuuucauucucc

SEQ ID NO: 1702542 - RNA, 21 nt, Human
uauauuuuuuguuaaaugauu

SEQ ID NO: 1702543 - RNA, 16 nt, Human
uauaugcuucuguuuu

SEQ ID NO: 1702544 - RNA, 14 nt, Human
uauaugcuucuguu

SEQ ID NO: 1702545 - RNA, 20 nt, Human
uauauuugaaauauugacuu

SEQ ID NO: 1702546 - RNA, 17 nt, Human
uaguauuguccaggucu

SEQ ID NO: 1702547 - RNA, 15 nt, Human
uagauuagaauucug

SEQ ID NO: 1702548 - RNA, 14 nt, Human
uagauuagaauucu

SEQ ID NO: 1702549 - RNA, 20 nt, Human
uagauuagaauucuguauag

SEQ ID NO: 1702550 - RNA, 19 nt, Human
uagauuagaauucuguaua

SEQ ID NO: 1702551 - RNA, 17 nt, Human
uagauuagaauucugua

SEQ ID NO: 1702552 - RNA, 16 nt, Human
uagauuagaauucugu

SEQ ID NO: 1702553 - RNA, 14 nt, Human
uagauaggccaugg

SEQ ID NO: 1702554 - RNA, 20 nt, Human
uagauuagagaguguugaaa

SEQ ID NO: 1702555 - RNA, 21 nt, Human
uagaauucuguauagauuaga

SEQ ID NO: 1702556 - RNA, 16 nt, Human
uagaauucuguauaga

SEQ ID NO: 1702557 - RNA, 15 nt, Human
uagaauucuguauag

SEQ ID NO: 1702558 - RNA, 14 nt, Human
uagaauucuguaua

SEQ ID NO: 1702559 - RNA, 13 nt, Human
uagaauucuguau

SEQ ID NO: 1702560 - RNA, 11 nt, Human
uagaauucugu

SEQ ID NO: 1702561 - RNA, 20 nt, Human
uagacuggugacugauucuu

SEQ ID NO: 1702562 - RNA, 23 nt, Human
uagacuggugacugauucuucag

SEQ ID NO: 1702563 - RNA, 21 nt, Human
uagacuggugacugauucuuc

SEQ ID NO: 1702564 - RNA, 18 nt, Human
uagaauuaacacaugauc

SEQ ID NO: 1702565 - RNA, 16 nt, Human
uagaauuaacacauga

SEQ ID NO: 1702566 - RNA, 15 nt, Human
uagaauuaacacaug

SEQ ID NO: 1702567 - RNA, 23 nt, Human
uagaauaccacaggaaccacaag

SEQ ID NO: 1702568 - RNA, 23 nt, Human
uaccuacauguauuuguuugcau

SEQ ID NO: 1702569 - RNA, 13 nt, Human
uaccuacauguau

SEQ ID NO: 1702570 - RNA, 22 nt, Human
uaccaaaaaucucaauauuuca

SEQ ID NO: 1702571 - RNA, 22 nt, Human
uaccuaacgaaguauccuucag

SEQ ID NO: 1702572 - RNA, 23 nt, Human
uacuaaaauggacuguggugacu

SEQ ID NO: 1702573 - RNA, 15 nt, Human
uacuaaaauggacug

SEQ ID NO: 1702574 - RNA, 17 nt, Human
uacuaaaauggacugug

SEQ ID NO: 1702575 - RNA, 12 nt, Human
uacaaaguauua

SEQ ID NO: 1702576 - RNA, 14 nt, Human
uacaaaguauuaag

SEQ ID NO: 1702577 - RNA, 13 nt, Human
uacaaaguauuaa

SEQ ID NO: 1702578 - RNA, 19 nt, Human
uacaaaguauuaagcauau

SEQ ID NO: 1702579 - RNA, 18 nt, Human
uacaaaguauuaagcaua

SEQ ID NO: 1702580 - RNA, 16 nt, Human
uacaaaguauuaagca

SEQ ID NO: 1702581 - RNA, 15 nt, Human
uacaaaguauuaagc

SEQ ID NO: 1702582 - RNA, 13 nt, Human
uaauuuugugaag

SEQ ID NO: 1702583 - RNA, 17 nt, Human
uaauuuuuauauuugaa

SEQ ID NO: 1702584 - RNA, 16 nt, Human
uaauuuuuauauuuga

SEQ ID NO: 1702585 - RNA, 12 nt, Human
uaauuuuuauau

SEQ ID NO: 1702586 - RNA, 18 nt, Human
uaauuuugugaagcaaaa

SEQ ID NO: 1702587 - RNA, 17 nt, Human
uacaauuuuguuucugu

SEQ ID NO: 1702588 - RNA, 16 nt, Human
uacaauuuuguuucug

SEQ ID NO: 1702589 - RNA, 15 nt, Human
uacaauuuuguuucu

SEQ ID NO: 1702590 - RNA, 12 nt, Human
uacaauuuuguu

SEQ ID NO: 1702591 - RNA, 23 nt, Human
uacaguucggugagcuacaaaug

SEQ ID NO: 1702592 - RNA, 18 nt, Human
ugaacuugaaauuugaau

SEQ ID NO: 1702593 - RNA, 14 nt, Human
ugaacuugaaauuu

SEQ ID NO: 1702594 - RNA, 13 nt, Human
ugaacuugaaauu

SEQ ID NO: 1702595 - RNA, 20 nt, Human
ugaaugaauggcuaagcaaa

SEQ ID NO: 1702596 - RNA, 15 nt, Human
ugaaugaauggcuaa

SEQ ID NO: 1702597 - RNA, 23 nt, Human
ugacaucucugcaaucuucucag

SEQ ID NO: 1702598 - RNA, 14 nt, Human
ugacaucucugcaa

SEQ ID NO: 1702599 - RNA, 13 nt, Human
ugacaucucugca

SEQ ID NO: 1702600 - RNA, 18 nt, Human
ugaccacugcagaagaca

SEQ ID NO: 1702601 - RNA, 17 nt, Human
ugaccacugcagaagac

SEQ ID NO: 1702602 - RNA, 16 nt, Human
ugaccacugcagaaga

SEQ ID NO: 1702603 - RNA, 14 nt, Human
ugaauuacauuugu

SEQ ID NO: 1702604 - RNA, 13 nt, Human
ugaauuacauuug

SEQ ID NO: 1702605 - RNA, 14 nt, Human
ugaauuaaguuuuu

SEQ ID NO: 1702606 - RNA, 22 nt, Human
ugacuuuggauaauaaggaaaa

SEQ ID NO: 1702607 - RNA, 20 nt, Human
ugacuuuggauaauaaggaa

SEQ ID NO: 1702608 - RNA, 16 nt, Human
ugacuuuggauaauaa

SEQ ID NO: 1702609 - RNA, 15 nt, Human
ugacuuuggauaaua

SEQ ID NO: 1702610 - RNA, 14 nt, Human
ugacuuuggauaau

SEQ ID NO: 1702611 - RNA, 13 nt, Human
ugacuuuggauaa

SEQ ID NO: 1702612 - RNA, 12 nt, Human
ugacuuuggaua

SEQ ID NO: 1702613 - RNA, 13 nt, Human
ugacucuuaagaa

SEQ ID NO: 1702614 - RNA, 16 nt, Human
ugacucuuaagaagac

SEQ ID NO: 1702615 - RNA, 15 nt, Human
ugacucuuaagaaga

SEQ ID NO: 1702616 - RNA, 14 nt, Human
ugacucuuaagaag

SEQ ID NO: 1702617 - RNA, 15 nt, Human
ucuuguauuaagaau

SEQ ID NO: 1702618 - RNA, 14 nt, Human
ucuuguauuaagaa

SEQ ID NO: 1702619 - RNA, 19 nt, Human
ucuugccaaauauaaauaa

SEQ ID NO: 1702620 - RNA, 16 nt, Human
ucuucuuggucucagu

SEQ ID NO: 1702621 - RNA, 13 nt, Human
ucuuauaauuuaa

SEQ ID NO: 1702622 - RNA, 14 nt, Human
ucuuauaauuuaaa

SEQ ID NO: 1702623 - RNA, 22 nt, Human
ucuuaggguuaugauuaaguaa

SEQ ID NO: 1702624 - RNA, 12 nt, Human
ucuugucucaga

SEQ ID NO: 1702625 - RNA, 15 nt, Human
ucuugucucagauuu

SEQ ID NO: 1702626 - RNA, 14 nt, Human
ucuugucucagauu

SEQ ID NO: 1702627 - RNA, 17 nt, Human
ucuugucucagauuuua

SEQ ID NO: 1702628 - RNA, 17 nt, Human
ucuuuccacagaagcuc

SEQ ID NO: 1702629 - RNA, 17 nt, Human
ucugcaaucuucucaga

SEQ ID NO: 1702630 - RNA, 14 nt, Human
ucugcaaucuucuc

SEQ ID NO: 1702631 - RNA, 21 nt, Human
ucugccuaaggacuucuuuaa

SEQ ID NO: 1702632 - RNA, 20 nt, Human
ucugccuaaggacuucuuua

SEQ ID NO: 1702633 - RNA, 23 nt, Human
ucugccuaaggacuucuuuaauu

SEQ ID NO: 1702634 - RNA, 14 nt, Human
ucugucucagucca

SEQ ID NO: 1702635 - RNA, 20 nt, Human
ucagauacuggauuguacuu

SEQ ID NO: 1702636 - RNA, 19 nt, Human
ucagauacuggauuguacu

SEQ ID NO: 1702637 - RNA, 16 nt, Human
ucagauacuggauugu

SEQ ID NO: 1702638 - RNA, 15 nt, Human
ucagauacuggauug

SEQ ID NO: 1702639 - RNA, 14 nt, Human
ucagauacuggauu

SEQ ID NO: 1702640 - RNA, 22 nt, Human
ucagauaacuguuauuuauaau

SEQ ID NO: 1702641 - RNA, 23 nt, Human
ucaucaguauugaagcauuuuau

SEQ ID NO: 1702642 - RNA, 21 nt, Human
ucaucaguauugaagcauuuu

SEQ ID NO: 1702643 - RNA, 20 nt, Human
ucaucaguauugaagcauuu

SEQ ID NO: 1702644 - RNA, 16 nt, Human
ucaucaguauugaagc

SEQ ID NO: 1702645 - RNA, 19 nt, Human
ucauggaauuggagcucgu

SEQ ID NO: 1702646 - RNA, 21 nt, Human
ucauggaauuggagcucgugg

SEQ ID NO: 1702647 - RNA, 18 nt, Human
ucaguccaugaagaugua

SEQ ID NO: 1702648 - RNA, 12 nt, Human
uccauacauuug

SEQ ID NO: 1702649 - RNA, 13 nt, Human
ucucagauuuuau

SEQ ID NO: 1702650 - RNA, 15 nt, Human
ucucagauuuuauua

SEQ ID NO: 1702651 - RNA, 14 nt, Human
ucucagauuuuauu

SEQ ID NO: 1702652 - RNA, 19 nt, Human
ucucagauuuuauuaugua

SEQ ID NO: 1702653 - RNA, 18 nt, Human
ucucagauuuuauuaugu

SEQ ID NO: 1702654 - RNA, 17 nt, Human
ucucagauuuuauuaug

SEQ ID NO: 1702655 - RNA, 16 nt, Human
ucucagauuuuauuau

SEQ ID NO: 1702656 - RNA, 19 nt, Human
ucuauauuuucauucuccu

SEQ ID NO: 1702657 - RNA, 16 nt, Human
ucuauauuuucauucu

SEQ ID NO: 1702658 - RNA, 15 nt, Human
ucuauauuuucauuc

SEQ ID NO: 1702659 - RNA, 14 nt, Human
ucuauauuuucauu

SEQ ID NO: 1702660 - RNA, 13 nt, Human
ucuauauuuucau

SEQ ID NO: 1702661 - RNA, 19 nt, Human
ucuacuaaaaauacaaaaa

SEQ ID NO: 1702662 - RNA, 15 nt, Human
ucuacuaaaaauaca

SEQ ID NO: 1702663 - RNA, 12 nt, Human
ucuacuaaaaau

SEQ ID NO: 1702664 - RNA, 15 nt, Human
ucgcuuuugauaauc

SEQ ID NO: 1702665 - RNA, 17 nt, Human
ucggccuccauccugag

SEQ ID NO: 1702666 - RNA, 16 nt, Human
ucggccuccauccuga

SEQ ID NO: 1702667 - RNA, 15 nt, Human
ucggccuccauccug

SEQ ID NO: 1702668 - RNA, 21 nt, Human
uccucucaaccaccuuucaga

SEQ ID NO: 1702669 - RNA, 20 nt, Human
uccucucaaccaccuuucag

SEQ ID NO: 1702670 - RNA, 18 nt, Human
uccucucaaccaccuuuc

SEQ ID NO: 1702671 - RNA, 17 nt, Human
uccugaggcuccacuug

SEQ ID NO: 1702672 - RNA, 16 nt, Human
uccugaggcuccacuu

SEQ ID NO: 1702673 - RNA, 15 nt, Human
uccugaggcuccacu

SEQ ID NO: 1702674 - RNA, 20 nt, Human
uccucaaaacuucagacaua

SEQ ID NO: 1702675 - RNA, 16 nt, Human
ucccuggccuuucaua

SEQ ID NO: 1702676 - RNA, 24 nt, Human
ucccuggccuuucauauuuuagcu

SEQ ID NO: 1702677 - RNA, 18 nt, Human
uggaacgcguugaaauug

SEQ ID NO: 1702678 - RNA, 19 nt, Human
uggaacgcguugaaauugu

SEQ ID NO: 1702679 - RNA, 22 nt, Human
uggaauaauccuaaacauauga

SEQ ID NO: 1702680 - RNA, 20 nt, Human
ugcuuuaauaucaucaguau

SEQ ID NO: 1702681 - RNA, 18 nt, Human
ugcuuuaauaucaucagu

SEQ ID NO: 1702682 - RNA, 15 nt, Human
ugcuuuaauaucauc

SEQ ID NO: 1702683 - RNA, 13 nt, Human
ugcuuuaauauca

SEQ ID NO: 1702684 - RNA, 23 nt, Human
uggaaacuucagcgguuuauaua

SEQ ID NO: 1702685 - RNA, 11 nt, Human
uggagggaagc

SEQ ID NO: 1702686 - RNA, 19 nt, Human
uggcuuuucugauccaguu

SEQ ID NO: 1702687 - RNA, 18 nt, Human
uggcuuuucugauccagu

SEQ ID NO: 1702688 - RNA, 17 nt, Human
uggcuuuucugauccag

SEQ ID NO: 1702689 - RNA, 14 nt, Human
uggcuuuucugauc

SEQ ID NO: 1702690 - RNA, 21 nt, Human
uggcuugaguuuaaauuguaa

SEQ ID NO: 1702691 - RNA, 16 nt, Human
uggcuuccuggcaaua

SEQ ID NO: 1702692 - RNA, 20 nt, Human
uggggauucuuaaaguugaa

SEQ ID NO: 1702693 - RNA, 18 nt, Human
uggggauucuuaaaguug

SEQ ID NO: 1702694 - RNA, 16 nt, Human
uggggauucuuaaagu

SEQ ID NO: 1702695 - RNA, 13 nt, Human
uggggauucuuaa

SEQ ID NO: 1702696 - RNA, 12 nt, Human
uggggauucuua

SEQ ID NO: 1702697 - RNA, 19 nt, Human
ugcacggugaauggcuuug

SEQ ID NO: 1702698 - RNA, 18 nt, Human
ugcacggugaauggcuuu

SEQ ID NO: 1702699 - RNA, 14 nt, Human
ugcacggugaaugg

SEQ ID NO: 1702700 - RNA, 22 nt, Human
ugcaguucugaagaagauggua

SEQ ID NO: 1702701 - RNA, 19 nt, Human
ugcaguucugaagaagaug

SEQ ID NO: 1702702 - RNA, 18 nt, Human
ugcaguucugaagaagau

SEQ ID NO: 1702703 - RNA, 17 nt, Human
ugcaguucugaagaaga

SEQ ID NO: 1702704 - RNA, 16 nt, Human
ugcaguucugaagaag

SEQ ID NO: 1702705 - RNA, 15 nt, Human
ugcaguucugaagaa

SEQ ID NO: 1702706 - RNA, 19 nt, Human
ugccaaauauaaauaaaaa

SEQ ID NO: 1702707 - RNA, 22 nt, Human
ugccaaauauaaauaaaaauaa

SEQ ID NO: 1702708 - RNA, 17 nt, Human
ugccaaauauaaauaaa

SEQ ID NO: 1702709 - RNA, 18 nt, Human
ugccaaauauaaauaaaa

SEQ ID NO: 1702710 - RNA, 20 nt, Human
ugccacuaaauugacacuua

SEQ ID NO: 1702711 - RNA, 15 nt, Human
ugccuucucaacucc

SEQ ID NO: 1702712 - RNA, 18 nt, Human
ugccuguaaucacagcua

SEQ ID NO: 1702713 - RNA, 19 nt, Human
ugcuaagcauuccaacuau

SEQ ID NO: 1702714 - RNA, 15 nt, Human
ugcuaagcauuccaa

SEQ ID NO: 1702715 - RNA, 21 nt, Human
uguauugugcgcuaaacuuuu

SEQ ID NO: 1702716 - RNA, 15 nt, Human
uguaugauucccagc

SEQ ID NO: 1702717 - RNA, 22 nt, Human
uguaguguuggagaagaacuga

SEQ ID NO: 1702718 - RNA, 16 nt, Human
uguaccgcaaugugac

SEQ ID NO: 1702719 - RNA, 17 nt, Human
uggucacaggaaguaga

SEQ ID NO: 1702720 - RNA, 14 nt, Human
uguaaucacagcua

SEQ ID NO: 1702721 - RNA, 19 nt, Human
ugugcuaguaauuggaaag

SEQ ID NO: 1702722 - RNA, 14 nt, Human
uguuagugcaaauu

SEQ ID NO: 1702723 - RNA, 19 nt, Human
uguguuuugcaagccagau

SEQ ID NO: 1702724 - RNA, 13 nt, Human
uguguuuugcaag

SEQ ID NO: 1702725 - RNA, 22 nt, Human
ugugugaaagguacuucaaauc

SEQ ID NO: 1702726 - RNA, 21 nt, Human
ugugugaaagguacuucaaau

SEQ ID NO: 1702727 - RNA, 20 nt, Human
uguuggagaagaacugaaau

SEQ ID NO: 1702728 - RNA, 19 nt, Human
uguuggagaagaacugaaa

SEQ ID NO: 1702729 - RNA, 17 nt, Human
uguuggagaagaacuga

SEQ ID NO: 1702730 - RNA, 16 nt, Human
uguuggagaagaacug

SEQ ID NO: 1702731 - RNA, 14 nt, Human
uguuggagaagaac

SEQ ID NO: 1702732 - RNA, 20 nt, Human
uguugacaugggacauuugc

SEQ ID NO: 1702733 - RNA, 23 nt, Human
uguuuccuagcacacacuuuugg

SEQ ID NO: 1702734 - RNA, 23 nt, Human
uguuucuguacuuuuuggcauaa

SEQ ID NO: 1702735 - RNA, 22 nt, Human
uguuucuguacuuuuuggcaua

SEQ ID NO: 1702736 - RNA, 11 nt, Human
uguuucuguac

SEQ ID NO: 1702737 - RNA, 15 nt, Human
uuaaaaaaaaaauug

SEQ ID NO: 1702738 - RNA, 22 nt, Human
uuaaaaaaaaaccugagcccca

SEQ ID NO: 1702739 - RNA, 20 nt, Human
uuaaagccauguuuauuaca

SEQ ID NO: 1702740 - RNA, 18 nt, Human
uuaaagccauguuuauua

SEQ ID NO: 1702741 - RNA, 14 nt, Human
uuaaagccauguuu

SEQ ID NO: 1702742 - RNA, 12 nt, Human
uuaaagccaugu

SEQ ID NO: 1702743 - RNA, 20 nt, Human
uuaauauuaaagccauguuu

SEQ ID NO: 1702744 - RNA, 19 nt, Human
uuaauauuaaagccauguu

SEQ ID NO: 1702745 - RNA, 18 nt, Human
uuaauauuaaagccaugu

SEQ ID NO: 1702746 - RNA, 12 nt, Human
uuacagaagccc

SEQ ID NO: 1702747 - RNA, 20 nt, Human
uuacauuuguauaaaauaau

SEQ ID NO: 1702748 - RNA, 23 nt, Human
uuaauaauaaauucccuggccuu

SEQ ID NO: 1702749 - RNA, 14 nt, Human
uuaauaauaaauuc

SEQ ID NO: 1702750 - RNA, 11 nt, Human
uuaauauuaaa

SEQ ID NO: 1702751 - RNA, 17 nt, Human
uuaauauuaaagccaug

SEQ ID NO: 1702752 - RNA, 16 nt, Human
uuaauauuaaagccau

SEQ ID NO: 1702753 - RNA, 14 nt, Human
uuaauauuaaagcc

SEQ ID NO: 1702754 - RNA, 13 nt, Human
uuaauauuaaagc

SEQ ID NO: 1702755 - RNA, 19 nt, Human
cacaguuuugguugcuuua

SEQ ID NO: 1702756 - RNA, 16 nt, Human
cacaugaaguccaagc

SEQ ID NO: 1702757 - RNA, 20 nt, Human
cacaugaaguccaagcauuu

SEQ ID NO: 1702758 - RNA, 17 nt, Human
cacaugaaguccaagca

SEQ ID NO: 1702759 - RNA, 23 nt, Human
cacaguuuugguugcuuuaauau

SEQ ID NO: 1702760 - RNA, 20 nt, Human
cacaguuuugguugcuuuaa

SEQ ID NO: 1702761 - RNA, 13 nt, Human
caauuuuguuucu

SEQ ID NO: 1702762 - RNA, 17 nt, Human
caauuuuguuucuguac

SEQ ID NO: 1702763 - RNA, 16 nt, Human
caauuuuguuucugua

SEQ ID NO: 1702764 - RNA, 14 nt, Human
caauuuuguuucug

SEQ ID NO: 1702765 - RNA, 23 nt, Human
cacaagacccaaaaggcagaagc

SEQ ID NO: 1702766 - RNA, 23 nt, Human
cacaagaaaugaaagcagggacu

SEQ ID NO: 1702767 - RNA, 15 nt, Human
cacaagaaaugaaag

SEQ ID NO: 1702768 - RNA, 13 nt, Human
cacaagaaaugaa

SEQ ID NO: 1702769 - RNA, 12 nt, Human
cacacacuuuug

SEQ ID NO: 1702770 - RNA, 17 nt, Human
auuuuaacaacagcugg

SEQ ID NO: 1702771 - RNA, 19 nt, Human
auuuuaauaauguuucaaa

SEQ ID NO: 1702772 - RNA, 18 nt, Human
auuuuaauaauguuucaa

SEQ ID NO: 1702773 - RNA, 14 nt, Human
caaaguugccuaaa

SEQ ID NO: 1702774 - RNA, 17 nt, Human
caaaguugccuaaaucc

SEQ ID NO: 1702775 - RNA, 15 nt, Human
caaaguugccuaaau

SEQ ID NO: 1702776 - RNA, 18 nt, Human
caaaguugccuaaaucca

SEQ ID NO: 1702777 - RNA, 23 nt, Human
caaauuuacagagacagaaagca

SEQ ID NO: 1702778 - RNA, 17 nt, Human
caaauuuacagagacag

SEQ ID NO: 1702779 - RNA, 19 nt, Human
caagcauuuagauguauag

SEQ ID NO: 1702780 - RNA, 16 nt, Human
caagcauuuagaugua

SEQ ID NO: 1702781 - RNA, 13 nt, Human
caagaaaugaaag

SEQ ID NO: 1702782 - RNA, 15 nt, Human
caagaaaugaaagca

SEQ ID NO: 1702783 - RNA, 18 nt, Human
auccagcagauuauucac

SEQ ID NO: 1702784 - RNA, 21 nt, Human
aucaugaauuaguuuuauaug

SEQ ID NO: 1702785 - RNA, 12 nt, Human
auccuugaagau

SEQ ID NO: 1702786 - RNA, 14 nt, Human
aucaaaagaaagaa

SEQ ID NO: 1702787 - RNA, 16 nt, Human
auggcuuuguauagaa

SEQ ID NO: 1702788 - RNA, 15 nt, Human
auggcuuuguauaga

SEQ ID NO: 1702789 - RNA, 23 nt, Human
auggcuuccuggcaauagucaaa

SEQ ID NO: 1702790 - RNA, 15 nt, Human
augggacagggagga

SEQ ID NO: 1702791 - RNA, 20 nt, Human
augggacauuugcucaugga

SEQ ID NO: 1702792 - RNA, 18 nt, Human
augaaacuuguguaaaua

SEQ ID NO: 1702793 - RNA, 13 nt, Human
augaaguacucau

SEQ ID NO: 1702794 - RNA, 21 nt, Human
agucuggcuguacccaggaau

SEQ ID NO: 1702795 - RNA, 19 nt, Human
agucuggcuguacccagga

SEQ ID NO: 1702796 - RNA, 13 nt, Human
agugauuaccagg

SEQ ID NO: 1702797 - RNA, 16 nt, Human
auaaaaaauuaugaca

SEQ ID NO: 1702798 - RNA, 16 nt, Human
auaaaagacagugaaa

SEQ ID NO: 1702799 - RNA, 15 nt, Human
auaaaagacagugaa

SEQ ID NO: 1702800 - RNA, 18 nt, Human
auacaauuuuguuucugu

SEQ ID NO: 1702801 - RNA, 17 nt, Human
auacaauuuuguuucug

SEQ ID NO: 1702802 - RNA, 16 nt, Human
auacaauuuuguuucu

SEQ ID NO: 1702803 - RNA, 14 nt, Human
auacaauuuuguuu

SEQ ID NO: 1702804 - RNA, 19 nt, Human
auaaagaucauguaaaagu

SEQ ID NO: 1702805 - RNA, 20 nt, Human
auacuguuugagguuuuuaa

SEQ ID NO: 1702806 - RNA, 16 nt, Human
auacuguuugagguuu

SEQ ID NO: 1702807 - RNA, 12 nt, Human
auacuguuugag

SEQ ID NO: 1702808 - RNA, 16 nt, Human
agacgaugucuucaua

SEQ ID NO: 1702809 - RNA, 17 nt, Human
agacccaaaaggcagaa

SEQ ID NO: 1702810 - RNA, 19 nt, Human
agacaaggaaaaaauaaca

SEQ ID NO: 1702811 - RNA, 22 nt, Human
agaacagugauuaccagggacu

SEQ ID NO: 1702812 - RNA, 21 nt, Human
agaagacugcauuauauuuau

SEQ ID NO: 1702813 - RNA, 18 nt, Human
agaucugccuaaggacuu

SEQ ID NO: 1702814 - RNA, 13 nt, Human
agaucugccuaag

SEQ ID NO: 1702815 - RNA, 23 nt, Human
agcaaaauuuuuucucuaggaaa

SEQ ID NO: 1702816 - RNA, 20 nt, Human
agauagauaggucagugcaa

SEQ ID NO: 1702817 - RNA, 21 nt, Human
aggaagguucuggugugaacu

SEQ ID NO: 1702818 - RNA, 16 nt, Human
aggaagguucuggugu

SEQ ID NO: 1702819 - RNA, 14 nt, Human
aggaagguucuggu

SEQ ID NO: 1702820 - RNA, 18 nt, Human
aggaaaaaauaacaauga

SEQ ID NO: 1702821 - RNA, 18 nt, Human
agcuguaugauucccagc

SEQ ID NO: 1702822 - RNA, 17 nt, Human
agcuguaugauucccag

SEQ ID NO: 1702823 - RNA, 13 nt, Human
agcuacaaaugca

SEQ ID NO: 1702824 - RNA, 17 nt, Human
agcgacagugagacucu

SEQ ID NO: 1702825 - RNA, 15 nt, Human
agcgacagugagacu

SEQ ID NO: 1702826 - RNA, 13 nt, Human
agcgacagugaga

SEQ ID NO: 1702827 - RNA, 20 nt, Human
aggcagagguugcagugagc

SEQ ID NO: 1702828 - RNA, 23 nt, Human
aggccaugggcacuguggguaga

SEQ ID NO: 1702829 - RNA, 13 nt, Human
aggaaguagagga

SEQ ID NO: 1702830 - RNA, 22 nt, Human
acugauuugacauagucuggcu

SEQ ID NO: 1702831 - RNA, 19 nt, Human
acugauaugggucuugaua

SEQ ID NO: 1702832 - RNA, 14 nt, Human
acucccuuucaaca

SEQ ID NO: 1702833 - RNA, 19 nt, Human
acucguuaauuuguagugu

SEQ ID NO: 1702834 - RNA, 14 nt, Human
acucguuaauuugu

SEQ ID NO: 1702835 - RNA, 20 nt, Human
acuggugacugauucuucag

SEQ ID NO: 1702836 - RNA, 17 nt, Human
acuguaaaauaauaacu

SEQ ID NO: 1702837 - RNA, 16 nt, Human
acuggugacugauucu

SEQ ID NO: 1702838 - RNA, 19 nt, Human
acuggugacugauucuuca

SEQ ID NO: 1702839 - RNA, 18 nt, Human
acuggugacugauucuuc

SEQ ID NO: 1702840 - RNA, 12 nt, Human
acuggaacucuc

SEQ ID NO: 1702841 - RNA, 18 nt, Human
acuucuuuaauuuuggaa

SEQ ID NO: 1702842 - RNA, 20 nt, Human
acuucuuuaauuuuggaauu

SEQ ID NO: 1702843 - RNA, 19 nt, Human
acuucuuuaauuuuggaau

SEQ ID NO: 1702844 - RNA, 21 nt, Human
acuucagacauagaauuaaca

SEQ ID NO: 1702845 - RNA, 13 nt, Human
acuuggucuguga

SEQ ID NO: 1702846 - RNA, 22 nt, Human
acuuaaaaaugguuuaaauggu

SEQ ID NO: 1702847 - RNA, 18 nt, Human
acuucaaauccuugaaga

SEQ ID NO: 1702848 - RNA, 17 nt, Human
acuucaaauccuugaag

SEQ ID NO: 1702849 - RNA, 21 nt, Human
acccugucucuacuaaaaaua

SEQ ID NO: 1702850 - RNA, 21 nt, Human
aauuauaugcuauuucuauau

SEQ ID NO: 1702851 - RNA, 20 nt, Human
aauuauaugcuauuucuaua

SEQ ID NO: 1702852 - RNA, 19 nt, Human
aauuauaugcuauuucuau

SEQ ID NO: 1702853 - RNA, 23 nt, Human
aauuauaucugaggaauucugua

SEQ ID NO: 1702854 - RNA, 22 nt, Human
aauuauaucugaggaauucugu

SEQ ID NO: 1702855 - RNA, 20 nt, Human
aauuauaucugaggaauucu

SEQ ID NO: 1702856 - RNA, 15 nt, Human
aauuggggauucuua

SEQ ID NO: 1702857 - RNA, 12 nt, Human
aauucuguauag

SEQ ID NO: 1702858 - RNA, 20 nt, Human
aauucuguauagauuagaga

SEQ ID NO: 1702859 - RNA, 14 nt, Human
aauucuguauagau

SEQ ID NO: 1702860 - RNA, 13 nt, Human
aauucuguauaga

SEQ ID NO: 1702861 - RNA, 14 nt, Human
aauuguaauuauau

SEQ ID NO: 1702862 - RNA, 16 nt, Human
aauuguaauuauaucu

SEQ ID NO: 1702863 - RNA, 15 nt, Human
aauuguaauuauauc

SEQ ID NO: 1702864 - RNA, 11 nt, Human
aauuguaauag

SEQ ID NO: 1702865 - RNA, 17 nt, Human
aauuguaauuauaucug

SEQ ID NO: 1702866 - RNA, 15 nt, Human
acaccaauauucaua

SEQ ID NO: 1702867 - RNA, 14 nt, Human
acauguuaaaccau

SEQ ID NO: 1702868 - RNA, 23 nt, Human
acauguuaaaccaugggauaaau

SEQ ID NO: 1702869 - RNA, 21 nt, Human
acauguuaaaccaugggauaa

SEQ ID NO: 1702870 - RNA, 16 nt, Human
acauguuaaaccaugg

SEQ ID NO: 1702871 - RNA, 21 nt, Human
acauuuguauaaaauaauuuu

SEQ ID NO: 1702872 - RNA, 19 nt, Human
acauuuguauaaaauaauu

SEQ ID NO: 1702873 - RNA, 16 nt, Human
acauuuguauaaaaua

SEQ ID NO: 1702874 - RNA, 16 nt, Human
acauuugcucauggaa

SEQ ID NO: 1702875 - RNA, 15 nt, Human
acauuugcucaugga

SEQ ID NO: 1702876 - RNA, 22 nt, Human
acaggaugguucccuugaugaa

SEQ ID NO: 1702877 - RNA, 24 nt, Human
acaggaugguucccuugaugaaga

SEQ ID NO: 1702878 - RNA, 20 nt, Human
acagugauuaccagggacug

SEQ ID NO: 1702879 - RNA, 19 nt, Human
acagugauuaccagggacu

SEQ ID NO: 1702880 - RNA, 22 nt, Human
aauauuaaagccauguuuauua

SEQ ID NO: 1702881 - RNA, 16 nt, Human
aaucucaauauuucag

SEQ ID NO: 1702882 - RNA, 20 nt, Human
aaugaauacuuuauaaagga

SEQ ID NO: 1702883 - RNA, 19 nt, Human
aauaaagaucauguaaaag

SEQ ID NO: 1702884 - RNA, 14 nt, Human
aauaaagaucaugu

SEQ ID NO: 1702885 - RNA, 20 nt, Human
aauaaagaucauguaaaagu

SEQ ID NO: 1702886 - RNA, 17 nt, Human
aaguugaauuuauuggc

SEQ ID NO: 1702887 - RNA, 15 nt, Human
aaguugaauuuauug

SEQ ID NO: 1702888 - RNA, 14 nt, Human
aaguugaauuuauu

SEQ ID NO: 1702889 - RNA, 22 nt, Human
aaguuguuugagaaauuaagua

SEQ ID NO: 1702890 - RNA, 21 nt, Human
aaguuguuugagaaauuaagu

SEQ ID NO: 1702891 - RNA, 24 nt, Human
aaguugaauuuauuggcuuuucug

SEQ ID NO: 1702892 - RNA, 23 nt, Human
aaguugaauuuauuggcuuuucu

SEQ ID NO: 1702893 - RNA, 15 nt, Human
aaguuuaauauuaaa

SEQ ID NO: 1702894 - RNA, 18 nt, Human
aaguuuaauauuaaagcc

SEQ ID NO: 1702895 - RNA, 17 nt, Human
aaguuuaauauuaaagc

SEQ ID NO: 1702896 - RNA, 23 nt, Human
aaggacuucuuuaauuuuggaau

SEQ ID NO: 1702897 - RNA, 21 nt, Human
aaggacuuguuagaucuaguu

SEQ ID NO: 1702898 - RNA, 15 nt, Human
aaggacuuguuagau

SEQ ID NO: 1702899 - RNA, 23 nt, Human
aaggacuuguuagaucuaguuca

SEQ ID NO: 1702900 - RNA, 15 nt, Human
aagaagacugcauua

SEQ ID NO: 1702901 - RNA, 20 nt, Human
aagaagacugcauuauauuu

SEQ ID NO: 1702902 - RNA, 21 nt, Human
aagacaaggaaaaaauaacaa

SEQ ID NO: 1702903 - RNA, 15 nt, Human
aagaacugaaaucau

SEQ ID NO: 1702904 - RNA, 13 nt, Human
aagaacugaaauc

SEQ ID NO: 1702905 - RNA, 12 nt, Human
aagaacugaaau

SEQ ID NO: 1702906 - RNA, 11 nt, Human
aagaacugaaa

SEQ ID NO: 1702907 - RNA, 23 nt, Human
aaauggacuguggugacuuugga

SEQ ID NO: 1702908 - RNA, 20 nt, Human
aaauggacuguggugacuuu

SEQ ID NO: 1702909 - RNA, 21 nt, Human
aaauggacuguggugacuuug

SEQ ID NO: 1702910 - RNA, 18 nt, Human
aaaucucaauauuucaga

SEQ ID NO: 1702911 - RNA, 21 nt, Human
aaauauuuauuuuaauaaugu

SEQ ID NO: 1702912 - RNA, 23 nt, Human
aaauguugacaugggacauuugc

SEQ ID NO: 1702913 - RNA, 13 nt, Human
aaauguucaucaa

SEQ ID NO: 1702914 - RNA, 17 nt, Human
aaauguucaucaaugaa

SEQ ID NO: 1702915 - RNA, 22 nt, Human
aaauguugacaugggacauuug

SEQ ID NO: 1702916 - RNA, 15 nt, Human
aaagaucauguaaaa

SEQ ID NO: 1702917 - RNA, 16 nt, Human
aaagccauguuuauua

SEQ ID NO: 1702918 - RNA, 14 nt, Human
aaagccauguuuau

SEQ ID NO: 1702919 - RNA, 23 nt, Human
aaagccauguuuauuacaguaua

SEQ ID NO: 1702920 - RNA, 18 nt, Human
aaagccauguuuauuaca

SEQ ID NO: 1702921 - RNA, 17 nt, Human
aaagccauguuuauuac

SEQ ID NO: 1702922 - RNA, 22 nt, Human
aaaccaguauuguacaaaguau

SEQ ID NO: 1702923 - RNA, 18 nt, Human
aaaccaguauuguacaaa

SEQ ID NO: 1702924 - RNA, 17 nt, Human
aaaccaguauuguacaa

SEQ ID NO: 1702925 - RNA, 16 nt, Human
aaaccaguauuguaca

SEQ ID NO: 1702926 - RNA, 14 nt, Human
aaaccaguauugua

SEQ ID NO: 1702927 - RNA, 22 nt, Human
aaaagagguuuuucuuaaauaa

SEQ ID NO: 1702928 - RNA, 21 nt, Human
aaaagagguuuuucuuaaaua

SEQ ID NO: 1702929 - RNA, 17 nt, Human
aaaagagguuuuucuua

SEQ ID NO: 1702930 - RNA, 11 nt, Human
aaaagaaugau

SEQ ID NO: 1702931 - RNA, 20 nt, Human
aaaagacaaggaaaaaauaa

SEQ ID NO: 1702932 - RNA, 17 nt, Human
aaaagaaagaaaaucag

SEQ ID NO: 1702933 - RNA, 18 nt, Human
aaaaguuuaauauuaaag

SEQ ID NO: 1702934 - RNA, 16 nt, Human
aaaaguuuaauauuaa

SEQ ID NO: 1702935 - RNA, 14 nt, Human
aaaaguuuaauauu

SEQ ID NO: 1702936 - RNA, 15 nt, Human
aaauucccuggccuu

SEQ ID NO: 1702937 - RNA, 18 nt, Human
aaauucccuggccuuuca

SEQ ID NO: 1702938 - RNA, 17 nt, Human
aaauuucagcagcugca

SEQ ID NO: 1702939 - RNA, 18 nt, Human
aaauuucagcagcugcag

SEQ ID NO: 1702940 - RNA, 16 nt, Human
gucaaauugugugaaa

SEQ ID NO: 1702941 - RNA, 17 nt, Human
guaugugugaagugagu

SEQ ID NO: 1702942 - RNA, 13 nt, Human
guaugugugaagu

SEQ ID NO: 1702943 - RNA, 14 nt, Human
guaugauucccagc

SEQ ID NO: 1702944 - RNA, 15 nt, Human
aaaucgcuuuugaua

SEQ ID NO: 1702945 - RNA, 14 nt, Human
aaaucgcuuuugau

SEQ ID NO: 1702946 - RNA, 13 nt, Human
aaaucgcuuuuga

SEQ ID NO: 1702947 - RNA, 19 nt, Human
aaaucuacacuccagugag

SEQ ID NO: 1702948 - RNA, 22 nt, Human
aaaucccauuauucaaaguugc

SEQ ID NO: 1702949 - RNA, 21 nt, Human
aaaucccauuauucaaaguug

SEQ ID NO: 1702950 - RNA, 20 nt, Human
aaaucccauuauucaaaguu

SEQ ID NO: 1702951 - RNA, 19 nt, Human
aaaucccauuauucaaagu

SEQ ID NO: 1702952 - RNA, 17 nt, Human
aaaucccauuauucaaa

SEQ ID NO: 1702953 - RNA, 16 nt, Human
aaaucccauuauucaa

SEQ ID NO: 1702954 - RNA, 15 nt, Human
aaaucccauuauuca

SEQ ID NO: 1702955 - RNA, 13 nt, Human
aaaucccauuauu

SEQ ID NO: 1702956 - RNA, 23 nt, Human
aaauccauuuggaaaucuuuaaa

SEQ ID NO: 1702957 - RNA, 22 nt, Human
aaauccauuuggaaaucuuuaa

SEQ ID NO: 1702958 - RNA, 21 nt, Human
aaauccauuuggaaaucuuua

SEQ ID NO: 1702959 - RNA, 18 nt, Human
aaauccauuuggaaaucu

SEQ ID NO: 1702960 - RNA, 14 nt, Human
aaauccuugaagau

SEQ ID NO: 1702961 - RNA, 14 nt, Human
aaauccauuuggaa

SEQ ID NO: 1702962 - RNA, 16 nt, Human
aaauccauuuggaaau

SEQ ID NO: 1702963 - RNA, 15 nt, Human
aaauccauuuggaaa

SEQ ID NO: 1702964 - RNA, 14 nt, Human
aaaugcauuucuaa

SEQ ID NO: 1702965 - RNA, 19 nt, Human
aaauggcuuccuggcaaua

SEQ ID NO: 1702966 - RNA, 22 nt, Human
aaaugaaagcagggacuugaac

SEQ ID NO: 1702967 - RNA, 21 nt, Human
aaaugaaagcagggacuugaa

SEQ ID NO: 1702968 - RNA, 21 nt, Human
aaccaugggauaaaugccauc

SEQ ID NO: 1702969 - RNA, 13 nt, Human
aacccaaauguuc

SEQ ID NO: 1702970 - RNA, 18 nt, Human
aacccaaauguucaucaa

SEQ ID NO: 1702971 - RNA, 20 nt, Human
aacccauauuuguacaccaa

SEQ ID NO: 1702972 - RNA, 20 nt, Human
aaccuagggugauauuaacc

SEQ ID NO: 1702973 - RNA, 20 nt, Human
aaccaugggauaaaugccau

SEQ ID NO: 1702974 - RNA, 18 nt, Human
aaccaugggauaaaugcc

SEQ ID NO: 1702975 - RNA, 17 nt, Human
aaccaugggauaaaugc

SEQ ID NO: 1702976 - RNA, 15 nt, Human
aaccaugggauaaau

SEQ ID NO: 1702977 - RNA, 17 nt, Human
aacuaaacuuucacacc

SEQ ID NO: 1702978 - RNA, 15 nt, Human
aacuaaacuuucaca

SEQ ID NO: 1702979 - RNA, 13 nt, Human
aacuaaacuuuca

SEQ ID NO: 1702980 - RNA, 14 nt, Human
aacucccuuucaac

SEQ ID NO: 1702981 - RNA, 13 nt, Human
aacucccuuucaa

SEQ ID NO: 1702982 - RNA, 18 nt, Human
aacucguuaauuuguagu

SEQ ID NO: 1702983 - RNA, 21 nt, Human
aacuccagaaagugacaagcu

SEQ ID NO: 1702984 - RNA, 14 nt, Human
aacuccagaaagug

SEQ ID NO: 1702985 - RNA, 19 nt, Human
gucuuauauauuguagaua

SEQ ID NO: 1702986 - RNA, 17 nt, Human
aacacuccaauuaagga

SEQ ID NO: 1702987 - RNA, 21 nt, Human
guccaagcauuuagauguaua

SEQ ID NO: 1702988 - RNA, 21 nt, Human
aacaagccuccuuuuaaagua

SEQ ID NO: 1702989 - RNA, 15 nt, Human
aacaaggaugaauua

SEQ ID NO: 1702990 - RNA, 18 nt, Human
aacauuugguaaggggaa

SEQ ID NO: 1702991 - RNA, 22 nt, Human
aacaguagugauaguuguaccg

SEQ ID NO: 1702992 - RNA, 14 nt, Human
guuauuuauaauca

SEQ ID NO: 1702993 - RNA, 20 nt, Human
guuauuuauaaucacuuuuu

SEQ ID NO: 1702994 - RNA, 13 nt, Human
guuaagucuguuu

SEQ ID NO: 1702995 - RNA, 22 nt, Human
guuaagucuguuuuaugacuuc

SEQ ID NO: 1702996 - RNA, 15 nt, Human
guuaagucuguuuua

SEQ ID NO: 1702997 - RNA, 12 nt, Human
guuagaucuagu

SEQ ID NO: 1702998 - RNA, 18 nt, Human
guucuggugugaacuaaa

SEQ ID NO: 1702999 - RNA, 15 nt, Human
guucuggugugaacu

SEQ ID NO: 1703000 - RNA, 21 nt, Human
guucuuguauuaagaaugaaa

SEQ ID NO: 1703001 - RNA, 18 nt, Human
guucuuguauuaagaaug

SEQ ID NO: 1703002 - RNA, 17 nt, Human
guucuuguauuaagaau

SEQ ID NO: 1703003 - RNA, 13 nt, Human
guugacaugggac

SEQ ID NO: 1703004 - RNA, 18 nt, Human
guugacaugggacauuug

SEQ ID NO: 1703005 - RNA, 14 nt, Human
guugacaugggaca

SEQ ID NO: 1703006 - RNA, 18 nt, Human
guuguaccgcaaugugac

SEQ ID NO: 1703007 - RNA, 14 nt, Human
guugccuaaaucca

SEQ ID NO: 1703008 - RNA, 16 nt, Human
guugccuaaauccauu

SEQ ID NO: 1703009 - RNA, 15 nt, Human
guugccuaaauccau

SEQ ID NO: 1703010 - RNA, 20 nt, Human
guuucuguacuuuuuggcau

SEQ ID NO: 1703011 - RNA, 13 nt, Human
aagguacuucaaa

SEQ ID NO: 1703012 - RNA, 21 nt, Human
guuucaaacauauauaacaau

SEQ ID NO: 1703013 - RNA, 19 nt, Human
guguuguacucaauuuuaa

SEQ ID NO: 1703014 - RNA, 16 nt, Human
aagagguuuuucuuaa

SEQ ID NO: 1703015 - RNA, 14 nt, Human
guggguagacacac

SEQ ID NO: 1703016 - RNA, 21 nt, Human
gugggacagucaccucaugga

SEQ ID NO: 1703017 - RNA, 22 nt, Human
aagaaugguccgugcuaaggac

SEQ ID NO: 1703018 - RNA, 19 nt, Human
aagaaugguccgugcuaag

SEQ ID NO: 1703019 - RNA, 18 nt, Human
aagaaugauuaugaauua

SEQ ID NO: 1703020 - RNA, 16 nt, Human
aagaaugauuaugaau

SEQ ID NO: 1703021 - RNA, 13 nt, Human
aagaaagaaaauc

SEQ ID NO: 1703022 - RNA, 22 nt, Human
aagaagugaaaaucuacacucc

SEQ ID NO: 1703023 - RNA, 16 nt, Human
aagaagugaaaaucua

SEQ ID NO: 1703024 - RNA, 18 nt, Human
gugcuaguaauuggaaag

SEQ ID NO: 1703025 - RNA, 23 nt, Human
uacaguauaauuaacauguuaaa

SEQ ID NO: 1703026 - RNA, 19 nt, Human
uacaguauaauuaacaugu

SEQ ID NO: 1703027 - RNA, 18 nt, Human
uacaguauaauuaacaug

SEQ ID NO: 1703028 - RNA, 11 nt, Human
aaugugauaug

SEQ ID NO: 1703029 - RNA, 20 nt, Human
aauggacuguggugacuuug

SEQ ID NO: 1703030 - RNA, 19 nt, Human
aauggacuuuuguacauag

SEQ ID NO: 1703031 - RNA, 19 nt, Human
uacacuaagagagaaugag

SEQ ID NO: 1703032 - RNA, 14 nt, Human
uacacuccagugag

SEQ ID NO: 1703033 - RNA, 14 nt, Human
uacaguauaauuaa

SEQ ID NO: 1703034 - RNA, 17 nt, Human
uacaguauaauuaacau

SEQ ID NO: 1703035 - RNA, 16 nt, Human
uacaguauaauuaaca

SEQ ID NO: 1703036 - RNA, 20 nt, Human
aaucuuuaaaaaaaaaauug

SEQ ID NO: 1703037 - RNA, 19 nt, Human
aaucuuuaaaaaaaaaauu

SEQ ID NO: 1703038 - RNA, 16 nt, Human
uaaugauaacuggaaa

SEQ ID NO: 1703039 - RNA, 21 nt, Human
aaugagagacacacugaagaa

SEQ ID NO: 1703040 - RNA, 21 nt, Human
uaaucaacugggcugaacacu

SEQ ID NO: 1703041 - RNA, 16 nt, Human
uaaguaucugacaucu

SEQ ID NO: 1703042 - RNA, 15 nt, Human
uaaguaucugacauc

SEQ ID NO: 1703043 - RNA, 18 nt, Human
uaaguuuuuuuuuaaaaa

SEQ ID NO: 1703044 - RNA, 23 nt, Human
aaucaugaauuaguuuuauaugc

SEQ ID NO: 1703045 - RNA, 17 nt, Human
aaucaugaauuaguuuu

SEQ ID NO: 1703046 - RNA, 19 nt, Human
aaucaugaauuaguuuuau

SEQ ID NO: 1703047 - RNA, 15 nt, Human
aaucaucaagucuuu

SEQ ID NO: 1703048 - RNA, 19 nt, Human
aaucugugaacuugaaauu

SEQ ID NO: 1703049 - RNA, 18 nt, Human
aaucugugaacuugaaau

SEQ ID NO: 1703050 - RNA, 17 nt, Human
aaucugugaacuugaaa

SEQ ID NO: 1703051 - RNA, 15 nt, Human
aaucugugaacuuga

SEQ ID NO: 1703052 - RNA, 13 nt, Human
aaucugugaacuu

SEQ ID NO: 1703053 - RNA, 14 nt, Human
aaucuuauaauuua

SEQ ID NO: 1703054 - RNA, 16 nt, Human
aaucuuauaauuuaaa

SEQ ID NO: 1703055 - RNA, 13 nt, Human
aauccuugaagau

SEQ ID NO: 1703056 - RNA, 20 nt, Human
aauccucaguuuuugugaaa

SEQ ID NO: 1703057 - RNA, 18 nt, Human
aauaucaucaguauugaa

SEQ ID NO: 1703058 - RNA, 15 nt, Human
aauaucacuugucaa

SEQ ID NO: 1703059 - RNA, 12 nt, Human
aauaucacuugu

SEQ ID NO: 1703060 - RNA, 15 nt, Human
uaacauaaaucugug

SEQ ID NO: 1703061 - RNA, 20 nt, Human
uaacauaaaucugugaacuu

SEQ ID NO: 1703062 - RNA, 18 nt, Human
uaacauaaaucugugaac

SEQ ID NO: 1703063 - RNA, 17 nt, Human
uaacauaaaucugugaa

SEQ ID NO: 1703064 - RNA, 16 nt, Human
uaacauaaaucuguga

SEQ ID NO: 1703065 - RNA, 18 nt, Human
aauaggcguaacuaauuu

SEQ ID NO: 1703066 - RNA, 18 nt, Human
aauauuuuaugauccagc

SEQ ID NO: 1703067 - RNA, 17 nt, Human
aauauuuuaugauccag

SEQ ID NO: 1703068 - RNA, 15 nt, Human
aauauuucagauaau

SEQ ID NO: 1703069 - RNA, 21 nt, Human
uaagaaugaaauacuguuuga

SEQ ID NO: 1703070 - RNA, 15 nt, Human
uaagaaugaaauacu

SEQ ID NO: 1703071 - RNA, 13 nt, Human
uaagaaugaaaua

SEQ ID NO: 1703072 - RNA, 19 nt, Human
aauaucuuuuuuuuaauaa

SEQ ID NO: 1703073 - RNA, 14 nt, Human
uaaauaaauagcua

SEQ ID NO: 1703074 - RNA, 17 nt, Human
uaaauaaauaaauagcu

SEQ ID NO: 1703075 - RNA, 20 nt, Human
aauaauuuuuauauuugaaa

SEQ ID NO: 1703076 - RNA, 19 nt, Human
aauaauuuuuauauuugaa

SEQ ID NO: 1703077 - RNA, 17 nt, Human
aauaauuuuuauauuug

SEQ ID NO: 1703078 - RNA, 16 nt, Human
aauaauuuuuauauuu

SEQ ID NO: 1703079 - RNA, 18 nt, Human
uaaauagcuagacuggug

SEQ ID NO: 1703080 - RNA, 22 nt, Human
uaaaucugugaacuugaaauuu

SEQ ID NO: 1703081 - RNA, 21 nt, Human
uaaaucugugaacuugaaauu

SEQ ID NO: 1703082 - RNA, 19 nt, Human
uaaaucugugaacuugaaa

SEQ ID NO: 1703083 - RNA, 18 nt, Human
uaaaucugugaacuugaa

SEQ ID NO: 1703084 - RNA, 17 nt, Human
uaaaucugugaacuuga

SEQ ID NO: 1703085 - RNA, 16 nt, Human
uaaaucugugaacuug

SEQ ID NO: 1703086 - RNA, 15 nt, Human
uaaaucugugaacuu

SEQ ID NO: 1703087 - RNA, 15 nt, Human
aauaacgauaaaaga

SEQ ID NO: 1703088 - RNA, 21 nt, Human
aauaacaaugaaaguugauaa

SEQ ID NO: 1703089 - RNA, 18 nt, Human
uagcuagacuggugacug

SEQ ID NO: 1703090 - RNA, 15 nt, Human
uagcuagacugguga

SEQ ID NO: 1703091 - RNA, 16 nt, Human
uagcuacuaauuuuaa

SEQ ID NO: 1703092 - RNA, 15 nt, Human
acaacagcuggugcc

SEQ ID NO: 1703093 - RNA, 17 nt, Human
acaaauuuacagagaca

SEQ ID NO: 1703094 - RNA, 22 nt, Human
acaagcucacagaccuuugaac

SEQ ID NO: 1703095 - RNA, 14 nt, Human
uagaucuaguucac

SEQ ID NO: 1703096 - RNA, 20 nt, Human
uagaugcaguucugaagaag

SEQ ID NO: 1703097 - RNA, 21 nt, Human
uagaugcaguucugaagaaga

SEQ ID NO: 1703098 - RNA, 17 nt, Human
uagauaggccaugggca

SEQ ID NO: 1703099 - RNA, 22 nt, Human
uagauaggucagugcaaauacu

SEQ ID NO: 1703100 - RNA, 20 nt, Human
acaaaguauuaagcauauau

SEQ ID NO: 1703101 - RNA, 16 nt, Human
aauuuuguuucuguac

SEQ ID NO: 1703102 - RNA, 22 nt, Human
aauuuuuucucuaggaaauauu

SEQ ID NO: 1703103 - RNA, 22 nt, Human
uacuuugugcugggguuaucug

SEQ ID NO: 1703104 - RNA, 16 nt, Human
uacuuugugcuggggu

SEQ ID NO: 1703105 - RNA, 14 nt, Human
uacuuuuuggcaua

SEQ ID NO: 1703106 - RNA, 20 nt, Human
uacuuuuuggcauaacauaa

SEQ ID NO: 1703107 - RNA, 19 nt, Human
uacuuuuuggcauaacaua

SEQ ID NO: 1703108 - RNA, 18 nt, Human
aauuuacagagacagaaa

SEQ ID NO: 1703109 - RNA, 17 nt, Human
aauuuacagagacagaa

SEQ ID NO: 1703110 - RNA, 15 nt, Human
aauuggagcucgugg

SEQ ID NO: 1703111 - RNA, 19 nt, Human
uacuucuuaggguuaugau

SEQ ID NO: 1703112 - RNA, 13 nt, Human
aauugacccacaa

SEQ ID NO: 1703113 - RNA, 14 nt, Human
uacuaaaaauacaa

SEQ ID NO: 1703114 - RNA, 18 nt, Human
uacuaaaaauacaaaaaa

SEQ ID NO: 1703115 - RNA, 18 nt, Human
aauugaggacacugauau

SEQ ID NO: 1703116 - RNA, 19 nt, Human
uacugagagugaacaaauu

SEQ ID NO: 1703117 - RNA, 17 nt, Human
uacugagagugaacaaa

SEQ ID NO: 1703118 - RNA, 17 nt, Human
acacuccaauuaaggau

SEQ ID NO: 1703119 - RNA, 18 nt, Human
acacuccaauuaaggauu

SEQ ID NO: 1703120 - RNA, 21 nt, Human
acacuccaauuaaggauuuua

SEQ ID NO: 1703121 - RNA, 14 nt, Human
acacuccagugaga

SEQ ID NO: 1703122 - RNA, 14 nt, Human
acacugaagaagca

SEQ ID NO: 1703123 - RNA, 12 nt, Human
acacugaagaag

SEQ ID NO: 1703124 - RNA, 12 nt, Human
uauauuuacaaa

SEQ ID NO: 1703125 - RNA, 19 nt, Human
acagaaagcagaacaguga

SEQ ID NO: 1703126 - RNA, 15 nt, Human
acacuuaaaaauggu

SEQ ID NO: 1703127 - RNA, 13 nt, Human
acacuuaaaaaug

SEQ ID NO: 1703128 - RNA, 21 nt, Human
acagcccuucuuuccacagaa

SEQ ID NO: 1703129 - RNA, 20 nt, Human
acagcccuucuuuccacaga

SEQ ID NO: 1703130 - RNA, 19 nt, Human
uauauuuauuacuguaaga

SEQ ID NO: 1703131 - RNA, 15 nt, Human
uauauuuauuacugu

SEQ ID NO: 1703132 - RNA, 22 nt, Human
uagucuugucucagauuuuauu

SEQ ID NO: 1703133 - RNA, 17 nt, Human
uagucuugucucagauu

SEQ ID NO: 1703134 - RNA, 17 nt, Human
uaguguuggagaagaac

SEQ ID NO: 1703135 - RNA, 16 nt, Human
uaguguuggagaagaa

SEQ ID NO: 1703136 - RNA, 12 nt, Human
uaguguuggaga

SEQ ID NO: 1703137 - RNA, 14 nt, Human
acacacugaagaag

SEQ ID NO: 1703138 - RNA, 17 nt, Human
acacaacuauauuguuu

SEQ ID NO: 1703139 - RNA, 14 nt, Human
acacaacuauauug

SEQ ID NO: 1703140 - RNA, 18 nt, Human
acaaugcuguauuuuaaa

SEQ ID NO: 1703141 - RNA, 17 nt, Human
acaaugcuguauuuuaa

SEQ ID NO: 1703142 - RNA, 14 nt, Human
acaaugcuguauuu

SEQ ID NO: 1703143 - RNA, 13 nt, Human
acacacugaagaa

SEQ ID NO: 1703144 - RNA, 21 nt, Human
acaccccagacgaugucuuca

SEQ ID NO: 1703145 - RNA, 17 nt, Human
acacuaagagagaauga

SEQ ID NO: 1703146 - RNA, 19 nt, Human
acacuaagagagaaugaga

SEQ ID NO: 1703147 - RNA, 18 nt, Human
acacuaagagagaaugag

SEQ ID NO: 1703148 - RNA, 13 nt, Human
ucaauuuuaacaa

SEQ ID NO: 1703149 - RNA, 15 nt, Human
ucaauucuugccaaa

SEQ ID NO: 1703150 - RNA, 15 nt, Human
accaaucaugaauua

SEQ ID NO: 1703151 - RNA, 13 nt, Human
accaaucaugaau

SEQ ID NO: 1703152 - RNA, 14 nt, Human
accagggacugagg

SEQ ID NO: 1703153 - RNA, 18 nt, Human
accacuuguguuuugcaa

SEQ ID NO: 1703154 - RNA, 19 nt, Human
accaugggauaaaugccau

SEQ ID NO: 1703155 - RNA, 23 nt, Human
accauuucuugagguaaaagcau

SEQ ID NO: 1703156 - RNA, 22 nt, Human
ucagaaggcaaaugacuuugga

SEQ ID NO: 1703157 - RNA, 19 nt, Human
ucagaaggcaaaugacuuu

SEQ ID NO: 1703158 - RNA, 18 nt, Human
ucagaaggcaaaugacuu

SEQ ID NO: 1703159 - RNA, 18 nt, Human
accccagacgaugucuuc

SEQ ID NO: 1703160 - RNA, 19 nt, Human
ucaggaaagagaacuucca

SEQ ID NO: 1703161 - RNA, 13 nt, Human
ucaggaaagagaa

SEQ ID NO: 1703162 - RNA, 16 nt, Human
uauuuuuauauuuacu

SEQ ID NO: 1703163 - RNA, 18 nt, Human
ucaaaagaaagaaaauca

SEQ ID NO: 1703164 - RNA, 21 nt, Human
ucaaaauaugccccauucaac

SEQ ID NO: 1703165 - RNA, 21 nt, Human
ucaaaguugccuaaauccauu

SEQ ID NO: 1703166 - RNA, 19 nt, Human
ucaaaguugccuaaaucca

SEQ ID NO: 1703167 - RNA, 18 nt, Human
ucaaaguugccuaaaucc

SEQ ID NO: 1703168 - RNA, 22 nt, Human
ucaaaguugccuaaauccauuu

SEQ ID NO: 1703169 - RNA, 14 nt, Human
ucaaagcugaaaug

SEQ ID NO: 1703170 - RNA, 19 nt, Human
acaugauccugcaauucca

SEQ ID NO: 1703171 - RNA, 16 nt, Human
acaugaaguccaagca

SEQ ID NO: 1703172 - RNA, 20 nt, Human
acauagucuggcuguaccca

SEQ ID NO: 1703173 - RNA, 15 nt, Human
acauagucuggcugu

SEQ ID NO: 1703174 - RNA, 14 nt, Human
acauagucuggcug

SEQ ID NO: 1703175 - RNA, 19 nt, Human
acauauauaacaaugcugu

SEQ ID NO: 1703176 - RNA, 18 nt, Human
acauagaauuaacacaug

SEQ ID NO: 1703177 - RNA, 14 nt, Human
acauagaauuaaca

SEQ ID NO: 1703178 - RNA, 13 nt, Human
acaucaacagaua

SEQ ID NO: 1703179 - RNA, 24 nt, Human
acaguuuugguugcuuuaauauca

SEQ ID NO: 1703180 - RNA, 19 nt, Human
acaguuuugguugcuuuaa

SEQ ID NO: 1703181 - RNA, 18 nt, Human
acaguuuugguugcuuua

SEQ ID NO: 1703182 - RNA, 18 nt, Human
uauuucuauauuuucauu

SEQ ID NO: 1703183 - RNA, 17 nt, Human
uauuucuauauuuucau

SEQ ID NO: 1703184 - RNA, 16 nt, Human
uauuucuauauuuuca

SEQ ID NO: 1703185 - RNA, 21 nt, Human
uaugaaauauuauguuaaaac

SEQ ID NO: 1703186 - RNA, 15 nt, Human
accuacauguauuug

SEQ ID NO: 1703187 - RNA, 14 nt, Human
accuacauguauuu

SEQ ID NO: 1703188 - RNA, 13 nt, Human
accuacauguauu

SEQ ID NO: 1703189 - RNA, 21 nt, Human
accuagggugauauuaaccag

SEQ ID NO: 1703190 - RNA, 16 nt, Human
ucaugaauuaguuuua

SEQ ID NO: 1703191 - RNA, 21 nt, Human
ucaugaauuaguuuuauaugc

SEQ ID NO: 1703192 - RNA, 14 nt, Human
acgagaaaacaaua

SEQ ID NO: 1703193 - RNA, 18 nt, Human
uccauuuaauaauuauau

SEQ ID NO: 1703194 - RNA, 21 nt, Human
uccaugaagauguagaggaga

SEQ ID NO: 1703195 - RNA, 13 nt, Human
uccaugaagaugu

SEQ ID NO: 1703196 - RNA, 21 nt, Human
uccauccugaggcuccacuug

SEQ ID NO: 1703197 - RNA, 20 nt, Human
uccauccugaggcuccacuu

SEQ ID NO: 1703198 - RNA, 22 nt, Human
ucuaccagccucccuauuuuuu

SEQ ID NO: 1703199 - RNA, 13 nt, Human
acuguuauuuaua

SEQ ID NO: 1703200 - RNA, 20 nt, Human
ucuaaagccauuguaguccu

SEQ ID NO: 1703201 - RNA, 15 nt, Human
acuguggugacuuug

SEQ ID NO: 1703202 - RNA, 14 nt, Human
acuguggugacuuu

SEQ ID NO: 1703203 - RNA, 12 nt, Human
acuguggugacu

SEQ ID NO: 1703204 - RNA, 18 nt, Human
acuguggguagacacaca

SEQ ID NO: 1703205 - RNA, 21 nt, Human
acuguggugacuuuggauaau

SEQ ID NO: 1703206 - RNA, 20 nt, Human
acuguggugacuuuggauaa

SEQ ID NO: 1703207 - RNA, 18 nt, Human
acuguggugacuuuggau

SEQ ID NO: 1703208 - RNA, 18 nt, Human
acugggacaggggagaac

SEQ ID NO: 1703209 - RNA, 16 nt, Human
acugcuuguuuccuag

SEQ ID NO: 1703210 - RNA, 13 nt, Human
acugcuuguuucc

SEQ ID NO: 1703211 - RNA, 20 nt, Human
acugccuucucaacuccaaa

SEQ ID NO: 1703212 - RNA, 19 nt, Human
acugccuucucaacuccaa

SEQ ID NO: 1703213 - RNA, 13 nt, Human
acugccuucucaa

SEQ ID NO: 1703214 - RNA, 14 nt, Human
acugcauuauauuu

SEQ ID NO: 1703215 - RNA, 15 nt, Human
acugcauuauauuua

SEQ ID NO: 1703216 - RNA, 19 nt, Human
ucugaagucagaucugccu

SEQ ID NO: 1703217 - RNA, 15 nt, Human
ucugaagucagaucu

SEQ ID NO: 1703218 - RNA, 12 nt, Human
ucugaagaagau

SEQ ID NO: 1703219 - RNA, 14 nt, Human
agaaaugaaagcag

SEQ ID NO: 1703220 - RNA, 14 nt, Human
agaaagaaaaucag

SEQ ID NO: 1703221 - RNA, 23 nt, Human
ucucuggccuucggccuccaucc

SEQ ID NO: 1703222 - RNA, 22 nt, Human
ucucuggccuucggccuccauc

SEQ ID NO: 1703223 - RNA, 21 nt, Human
ucucuggccuucggccuccau

SEQ ID NO: 1703224 - RNA, 12 nt, Human
ucucuggccuuc

SEQ ID NO: 1703225 - RNA, 19 nt, Human
acuugaaauuugaauuuug

SEQ ID NO: 1703226 - RNA, 20 nt, Human
acuugaaauuugaauuuugu

SEQ ID NO: 1703227 - RNA, 20 nt, Human
acuugaacccgggaggcaga

SEQ ID NO: 1703228 - RNA, 19 nt, Human
acuugaacccgggaggcag

SEQ ID NO: 1703229 - RNA, 21 nt, Human
acuugaacccauauuuguaca

SEQ ID NO: 1703230 - RNA, 21 nt, Human
acuugaacccgggaggcagag

SEQ ID NO: 1703231 - RNA, 16 nt, Human
acuugucaauaaaauc

SEQ ID NO: 1703232 - RNA, 15 nt, Human
acuuguuagaucuag

SEQ ID NO: 1703233 - RNA, 14 nt, Human
acuuguuagaucua

SEQ ID NO: 1703234 - RNA, 16 nt, Human
acuuguguuuugcaag

SEQ ID NO: 1703235 - RNA, 23 nt, Human
acuuguuagaucuaguucacucu

SEQ ID NO: 1703236 - RNA, 19 nt, Human
ucugugaacuugaaauuug

SEQ ID NO: 1703237 - RNA, 22 nt, Human
ucugugaacuugaaauuugaau

SEQ ID NO: 1703238 - RNA, 13 nt, Human
ucuguacuuuuug

SEQ ID NO: 1703239 - RNA, 17 nt, Human
ucuguacuuuuuggcau

SEQ ID NO: 1703240 - RNA, 14 nt, Human
ucuguacuuuuugg

SEQ ID NO: 1703241 - RNA, 17 nt, Human
agacacacugaagaagc

SEQ ID NO: 1703242 - RNA, 16 nt, Human
agacacacugaagaag

SEQ ID NO: 1703243 - RNA, 23 nt, Human
ucuuagaugcaguucugaagaag

SEQ ID NO: 1703244 - RNA, 17 nt, Human
agacuggugacugauuc

SEQ ID NO: 1703245 - RNA, 16 nt, Human
agacuggugacugauu

SEQ ID NO: 1703246 - RNA, 14 nt, Human
agacuggugacuga

SEQ ID NO: 1703247 - RNA, 13 nt, Human
agacuggugacug

SEQ ID NO: 1703248 - RNA, 12 nt, Human
agacuggugacu

SEQ ID NO: 1703249 - RNA, 24 nt, Human
agagacagaaagcagaacagugau

SEQ ID NO: 1703250 - RNA, 14 nt, Human
agacauagaauuaa

SEQ ID NO: 1703251 - RNA, 22 nt, Human
agagauuuuuuuguuguuuguu

SEQ ID NO: 1703252 - RNA, 23 nt, Human
agagauuuuuuuguuguuuguuu

SEQ ID NO: 1703253 - RNA, 21 nt, Human
ugaaauuguaauuauaucuga

SEQ ID NO: 1703254 - RNA, 16 nt, Human
ugaaauuugaauuuug

SEQ ID NO: 1703255 - RNA, 15 nt, Human
ugaaauuugaauuuu

SEQ ID NO: 1703256 - RNA, 14 nt, Human
ugaaauuugaauuu

SEQ ID NO: 1703257 - RNA, 17 nt, Human
ugaaauuugaauuuugu

SEQ ID NO: 1703258 - RNA, 18 nt, Human
ugaaauauuauguuaaaa

SEQ ID NO: 1703259 - RNA, 15 nt, Human
ugaaauuguauuaca

SEQ ID NO: 1703260 - RNA, 23 nt, Human
ugaaauaagccagacaucaacag

SEQ ID NO: 1703261 - RNA, 20 nt, Human
ugaaauaagccagacaucaa

SEQ ID NO: 1703262 - RNA, 18 nt, Human
ugaaauaagccagacauc

SEQ ID NO: 1703263 - RNA, 17 nt, Human
ugaaauaagccagacau

SEQ ID NO: 1703264 - RNA, 20 nt, Human
ugaacaaauuuacagagaca

SEQ ID NO: 1703265 - RNA, 19 nt, Human
ugaacaaauuuacagagac

SEQ ID NO: 1703266 - RNA, 15 nt, Human
agagguugcagugag

SEQ ID NO: 1703267 - RNA, 21 nt, Human
ugaauuuauuggcuuuucuga

SEQ ID NO: 1703268 - RNA, 17 nt, Human
ugaauuuauuggcuuuu

SEQ ID NO: 1703269 - RNA, 23 nt, Human
ugaauuuauuggcuuuucugauc

SEQ ID NO: 1703270 - RNA, 22 nt, Human
ugaauuuauuggcuuuucugau

SEQ ID NO: 1703271 - RNA, 17 nt, Human
agaguuuagcuggaaaa

SEQ ID NO: 1703272 - RNA, 16 nt, Human
agaguuuagcuggaaa

SEQ ID NO: 1703273 - RNA, 17 nt, Human
ugacccacaagaaauga

SEQ ID NO: 1703274 - RNA, 15 nt, Human
agaugcuagaacucc

SEQ ID NO: 1703275 - RNA, 14 nt, Human
agaugcuagaacuc

SEQ ID NO: 1703276 - RNA, 19 nt, Human
agaugcaguucugaagaag

SEQ ID NO: 1703277 - RNA, 18 nt, Human
agaugcaguucugaagaa

SEQ ID NO: 1703278 - RNA, 17 nt, Human
agaugcaguucugaaga

SEQ ID NO: 1703279 - RNA, 15 nt, Human
agcauauauuuuuau

SEQ ID NO: 1703280 - RNA, 22 nt, Human
agcauauauuuuuauauuuacu

SEQ ID NO: 1703281 - RNA, 20 nt, Human
agcauauauuuuuauauuua

SEQ ID NO: 1703282 - RNA, 18 nt, Human
agcauauauuuuuauauu

SEQ ID NO: 1703283 - RNA, 19 nt, Human
agcagucaggaaagagaac

SEQ ID NO: 1703284 - RNA, 18 nt, Human
agcagucaggaaagagaa

SEQ ID NO: 1703285 - RNA, 17 nt, Human
agcagucaggaaagaga

SEQ ID NO: 1703286 - RNA, 20 nt, Human
agcauuuuauaaaucgcuuu

SEQ ID NO: 1703287 - RNA, 15 nt, Human
agcauuuuauaaauc

SEQ ID NO: 1703288 - RNA, 14 nt, Human
agcauuuuauaaau

SEQ ID NO: 1703289 - RNA, 13 nt, Human
agcauuuuauaaa

SEQ ID NO: 1703290 - RNA, 22 nt, Human
agcauuuagauguauagguuga

SEQ ID NO: 1703291 - RNA, 19 nt, Human
ugauccagcagauuauuca

SEQ ID NO: 1703292 - RNA, 20 nt, Human
ugauccagcagauuauucac

SEQ ID NO: 1703293 - RNA, 16 nt, Human
ugauuaaguaaugaua

SEQ ID NO: 1703294 - RNA, 15 nt, Human
ugauuaaguaaugau

SEQ ID NO: 1703295 - RNA, 23 nt, Human
ugauuugacauagucuggcugua

SEQ ID NO: 1703296 - RNA, 13 nt, Human
ugauuucauucaa

SEQ ID NO: 1703297 - RNA, 21 nt, Human
ugcaagccagauuuuccugaa

SEQ ID NO: 1703298 - RNA, 15 nt, Human
ugcaagccagauuuu

SEQ ID NO: 1703299 - RNA, 18 nt, Human
agccccgugggguuccuc

SEQ ID NO: 1703300 - RNA, 15 nt, Human
ugcacuccagccuga

SEQ ID NO: 1703301 - RNA, 17 nt, Human
ugcacuccagccugagc

SEQ ID NO: 1703302 - RNA, 22 nt, Human
ugcagaagacaguauggcagcu

SEQ ID NO: 1703303 - RNA, 13 nt, Human
ugccauaauuacu

SEQ ID NO: 1703304 - RNA, 19 nt, Human
ugcauacucauuaggaugg

SEQ ID NO: 1703305 - RNA, 13 nt, Human
ugcauacucauua

SEQ ID NO: 1703306 - RNA, 23 nt, Human
aggacuucuuuaauuuuggaauu

SEQ ID NO: 1703307 - RNA, 22 nt, Human
aggacuucuuuaauuuuggaau

SEQ ID NO: 1703308 - RNA, 21 nt, Human
aggacuucuuuaauuuuggaa

SEQ ID NO: 1703309 - RNA, 16 nt, Human
aggacuucuuuaauuu

SEQ ID NO: 1703310 - RNA, 19 nt, Human
aggagaaacuggaacucuc

SEQ ID NO: 1703311 - RNA, 18 nt, Human
aggagaaacuggaacucu

SEQ ID NO: 1703312 - RNA, 14 nt, Human
aggacuucuuuaau

SEQ ID NO: 1703313 - RNA, 15 nt, Human
aggaauucuguauag

SEQ ID NO: 1703314 - RNA, 14 nt, Human
aggaauucuguaua

SEQ ID NO: 1703315 - RNA, 13 nt, Human
aggaauucuguau

SEQ ID NO: 1703316 - RNA, 20 nt, Human
aggacgcucucuggccuucg

SEQ ID NO: 1703317 - RNA, 19 nt, Human
aggacgcucucuggccuuc

SEQ ID NO: 1703318 - RNA, 17 nt, Human
aggacgcucucuggccu

SEQ ID NO: 1703319 - RNA, 16 nt, Human
aggacgcucucuggcc

SEQ ID NO: 1703320 - RNA, 14 nt, Human
aggacgcucucugg

SEQ ID NO: 1703321 - RNA, 13 nt, Human
aggacgcucucug

SEQ ID NO: 1703322 - RNA, 14 nt, Human
uggaguugaaaauc

SEQ ID NO: 1703323 - RNA, 20 nt, Human
aggcauuuaggccaugggac

SEQ ID NO: 1703324 - RNA, 21 nt, Human
uggagcucgugggacagucac

SEQ ID NO: 1703325 - RNA, 21 nt, Human
uggagcucguggaacaguuac

SEQ ID NO: 1703326 - RNA, 17 nt, Human
uggagcucguggaacag

SEQ ID NO: 1703327 - RNA, 22 nt, Human
ugccaucaauaaaaaauuauga

SEQ ID NO: 1703328 - RNA, 14 nt, Human
ugccaucaauaaaa

SEQ ID NO: 1703329 - RNA, 22 nt, Human
ugcuauuucuauauuuucauuc

SEQ ID NO: 1703330 - RNA, 20 nt, Human
agcuugcccuggugccucac

SEQ ID NO: 1703331 - RNA, 19 nt, Human
ugccuuuucccaacuccag

SEQ ID NO: 1703332 - RNA, 17 nt, Human
ugccuuuucccaacucc

SEQ ID NO: 1703333 - RNA, 15 nt, Human
uguaaauacaauuuu

SEQ ID NO: 1703334 - RNA, 17 nt, Human
agguucuggugugaacu

SEQ ID NO: 1703335 - RNA, 23 nt, Human
uggugugaacuaaacuuucacac

SEQ ID NO: 1703336 - RNA, 22 nt, Human
uggugugaacuaaacuuucaca

SEQ ID NO: 1703337 - RNA, 14 nt, Human
uggugugaacuaaa

SEQ ID NO: 1703338 - RNA, 23 nt, Human
uggugugaccacugcagaagaca

SEQ ID NO: 1703339 - RNA, 14 nt, Human
uggugcccugcuuu

SEQ ID NO: 1703340 - RNA, 20 nt, Human
uggugcccugcuuucagaua

SEQ ID NO: 1703341 - RNA, 19 nt, Human
uggugcccugcuuucagau

SEQ ID NO: 1703342 - RNA, 16 nt, Human
uggugcccugcuuuca

SEQ ID NO: 1703343 - RNA, 21 nt, Human
aguauugaagcauuuuauaaa

SEQ ID NO: 1703344 - RNA, 20 nt, Human
aguauugaagcauuuuauaa

SEQ ID NO: 1703345 - RNA, 18 nt, Human
aguauugaagcauuuuau

SEQ ID NO: 1703346 - RNA, 15 nt, Human
aguauugaagcauuu

SEQ ID NO: 1703347 - RNA, 14 nt, Human
aguauugaagcauu

SEQ ID NO: 1703348 - RNA, 18 nt, Human
aguauuucuaugaaauau

SEQ ID NO: 1703349 - RNA, 16 nt, Human
aguauuucuaugaaau

SEQ ID NO: 1703350 - RNA, 17 nt, Human
aguauuucuaugaaaua

SEQ ID NO: 1703351 - RNA, 17 nt, Human
agucaccucauggaauu

SEQ ID NO: 1703352 - RNA, 15 nt, Human
agucaccucauggaa

SEQ ID NO: 1703353 - RNA, 14 nt, Human
agucaccucaugga

SEQ ID NO: 1703354 - RNA, 18 nt, Human
aguauuagaauaccacag

SEQ ID NO: 1703355 - RNA, 22 nt, Human
uguauuacaaauccaaugaaau

SEQ ID NO: 1703356 - RNA, 13 nt, Human
uguauuacaaauc

SEQ ID NO: 1703357 - RNA, 15 nt, Human
uguaguguuggagaa

SEQ ID NO: 1703358 - RNA, 14 nt, Human
uguaguguuggaga

SEQ ID NO: 1703359 - RNA, 13 nt, Human
agguuuuucuuaa

SEQ ID NO: 1703360 - RNA, 13 nt, Human
aguaaaauccaca

SEQ ID NO: 1703361 - RNA, 17 nt, Human
aguaaugauaacuggaa

SEQ ID NO: 1703362 - RNA, 20 nt, Human
aguaaugauaacuggaaacu

SEQ ID NO: 1703363 - RNA, 18 nt, Human
aguaaugauaacuggaaa

SEQ ID NO: 1703364 - RNA, 16 nt, Human
uguagaggagaaacug

SEQ ID NO: 1703365 - RNA, 18 nt, Human
aggggagcaugggaagug

SEQ ID NO: 1703366 - RNA, 16 nt, Human
aggggaauugaggaca

SEQ ID NO: 1703367 - RNA, 22 nt, Human
agggaggacgcucucuggccuu

SEQ ID NO: 1703368 - RNA, 21 nt, Human
agggaggacgcucucuggccu

SEQ ID NO: 1703369 - RNA, 23 nt, Human
agggaggacgcucucuggccuuc

SEQ ID NO: 1703370 - RNA, 20 nt, Human
uuaagucuguuuuaugacuu

SEQ ID NO: 1703371 - RNA, 18 nt, Human
uuaagucuguuuuaugac

SEQ ID NO: 1703372 - RNA, 17 nt, Human
uuaagucuguuuuauga

SEQ ID NO: 1703373 - RNA, 21 nt, Human
uuaagucuguuuuaugacuuc

SEQ ID NO: 1703374 - RNA, 18 nt, Human
uuaaguaaugauaacugg

SEQ ID NO: 1703375 - RNA, 22 nt, Human
uuaagaagacugcauuauauuu

SEQ ID NO: 1703376 - RNA, 19 nt, Human
auaaaauccauacauuugu

SEQ ID NO: 1703377 - RNA, 18 nt, Human
auaaaauccauacauuug

SEQ ID NO: 1703378 - RNA, 22 nt, Human
auaaaauaauuuuuauauuuga

SEQ ID NO: 1703379 - RNA, 21 nt, Human
auaaaauaauuuuuauauuug

SEQ ID NO: 1703380 - RNA, 16 nt, Human
auaaaauaauuuuuau

SEQ ID NO: 1703381 - RNA, 16 nt, Human
auaaaugguuaaaaga

SEQ ID NO: 1703382 - RNA, 22 nt, Human
auaaaugguuaaaagagguuuu

SEQ ID NO: 1703383 - RNA, 13 nt, Human
uuacaguauaauu

SEQ ID NO: 1703384 - RNA, 17 nt, Human
uuacaguauaauuaaca

SEQ ID NO: 1703385 - RNA, 16 nt, Human
uuacaguauaauuaac

SEQ ID NO: 1703386 - RNA, 20 nt, Human
uuacaguauaauuaacaugu

SEQ ID NO: 1703387 - RNA, 19 nt, Human
uuacaguauaauuaacaug

SEQ ID NO: 1703388 - RNA, 18 nt, Human
uuacaguauaauuaacau

SEQ ID NO: 1703389 - RNA, 18 nt, Human
auaaauagcuagacuggu

SEQ ID NO: 1703390 - RNA, 16 nt, Human
auaaauagcuagacug

SEQ ID NO: 1703391 - RNA, 22 nt, Human
auaaaucugugaacuugaaauu

SEQ ID NO: 1703392 - RNA, 21 nt, Human
auaaaucugugaacuugaaau

SEQ ID NO: 1703393 - RNA, 20 nt, Human
auaaaucugugaacuugaaa

SEQ ID NO: 1703394 - RNA, 12 nt, Human
uuaccugggaaa

SEQ ID NO: 1703395 - RNA, 15 nt, Human
uuacuguaagaaaau

SEQ ID NO: 1703396 - RNA, 14 nt, Human
uguuugagaaauua

SEQ ID NO: 1703397 - RNA, 22 nt, Human
uguuugagguuuuuaagccuua

SEQ ID NO: 1703398 - RNA, 14 nt, Human
uguuuauuacagua

SEQ ID NO: 1703399 - RNA, 18 nt, Human
uguuuauuacaguauaau

SEQ ID NO: 1703400 - RNA, 22 nt, Human
uguuuagucuugucucagauuu

SEQ ID NO: 1703401 - RNA, 20 nt, Human
uguuuagucuugucucagau

SEQ ID NO: 1703402 - RNA, 23 nt, Human
uguuuagucuugucucagauuuu

SEQ ID NO: 1703403 - RNA, 18 nt, Human
uguuuuaugacuucauua

SEQ ID NO: 1703404 - RNA, 19 nt, Human
uguuuggaccaaaaaccag

SEQ ID NO: 1703405 - RNA, 16 nt, Human
aguucugcagauaaac

SEQ ID NO: 1703406 - RNA, 21 nt, Human
aguucugcagauaaacaguag

SEQ ID NO: 1703407 - RNA, 14 nt, Human
uguuuugcaagcca

SEQ ID NO: 1703408 - RNA, 23 nt, Human
aguugccuaaauccauuuggaaa

SEQ ID NO: 1703409 - RNA, 22 nt, Human
aguugccuaaauccauuuggaa

SEQ ID NO: 1703410 - RNA, 22 nt, Human
aguugcauagguuuaauaauuu

SEQ ID NO: 1703411 - RNA, 19 nt, Human
aguugccuaaauccauuug

SEQ ID NO: 1703412 - RNA, 16 nt, Human
aguuggguguauugug

SEQ ID NO: 1703413 - RNA, 20 nt, Human
aguuggguguauugugcgcu

SEQ ID NO: 1703414 - RNA, 17 nt, Human
aguuggguguauugugc

SEQ ID NO: 1703415 - RNA, 20 nt, Human
aguuuaauauuaaagccaug

SEQ ID NO: 1703416 - RNA, 19 nt, Human
aguuuaauauuaaagccau

SEQ ID NO: 1703417 - RNA, 18 nt, Human
aguuuaauauuaaagcca

SEQ ID NO: 1703418 - RNA, 16 nt, Human
aguuuaauauuaaagc

SEQ ID NO: 1703419 - RNA, 15 nt, Human
aguuuaauauuaaag

SEQ ID NO: 1703420 - RNA, 20 nt, Human
uuaaaggaagguucuggugu

SEQ ID NO: 1703421 - RNA, 22 nt, Human
uuaaaggaagguucugguguga

SEQ ID NO: 1703422 - RNA, 16 nt, Human
uuaaauaauaaagauc

SEQ ID NO: 1703423 - RNA, 14 nt, Human
uuaacaacagcugg

SEQ ID NO: 1703424 - RNA, 20 nt, Human
agugaguuggguguauugug

SEQ ID NO: 1703425 - RNA, 19 nt, Human
agugaguuggguguauugu

SEQ ID NO: 1703426 - RNA, 20 nt, Human
uguggucacaggaaguagag

SEQ ID NO: 1703427 - RNA, 13 nt, Human
uguguaaguagau

SEQ ID NO: 1703428 - RNA, 20 nt, Human
ugugugaaagguacuucaaa

SEQ ID NO: 1703429 - RNA, 13 nt, Human
uguuauauaaaug

SEQ ID NO: 1703430 - RNA, 14 nt, Human
uguuauauaaaugg

SEQ ID NO: 1703431 - RNA, 15 nt, Human
uguuauaaucuuuca

SEQ ID NO: 1703432 - RNA, 12 nt, Human
ugugaacuugaa

SEQ ID NO: 1703433 - RNA, 16 nt, Human
ugugaacuugaaauuu

SEQ ID NO: 1703434 - RNA, 15 nt, Human
ugugaacuugaaauu

SEQ ID NO: 1703435 - RNA, 14 nt, Human
ugugaacuugaaau

SEQ ID NO: 1703436 - RNA, 24 nt, Human
agugaaacugcuuguuuccuagca

SEQ ID NO: 1703437 - RNA, 21 nt, Human
agugaaacugcuuguuuccua

SEQ ID NO: 1703438 - RNA, 13 nt, Human
agugaaacugcuu

SEQ ID NO: 1703439 - RNA, 22 nt, Human
ugugagaugcuagaacucccuu

SEQ ID NO: 1703440 - RNA, 19 nt, Human
ugugagaugcuagaacucc

SEQ ID NO: 1703441 - RNA, 15 nt, Human
ugugagaugcuagaa

SEQ ID NO: 1703442 - RNA, 18 nt, Human
ugugcugggguuaucuga

SEQ ID NO: 1703443 - RNA, 20 nt, Human
agugaacaaauuuacagaga

SEQ ID NO: 1703444 - RNA, 16 nt, Human
agugaacaaauuuaca

SEQ ID NO: 1703445 - RNA, 15 nt, Human
agugaaagaaaauaa

SEQ ID NO: 1703446 - RNA, 23 nt, Human
auauuaaagccauguuuauuaca

SEQ ID NO: 1703447 - RNA, 18 nt, Human
auauuaaagccauguuua

SEQ ID NO: 1703448 - RNA, 15 nt, Human
auauuaaagccaugu

SEQ ID NO: 1703449 - RNA, 14 nt, Human
auauuaaagccaug

SEQ ID NO: 1703450 - RNA, 13 nt, Human
auauuugaaauau

SEQ ID NO: 1703451 - RNA, 23 nt, Human
auauuugaaauauugacuuuuua

SEQ ID NO: 1703452 - RNA, 19 nt, Human
auauuugaaauauugacuu

SEQ ID NO: 1703453 - RNA, 14 nt, Human
auauuugaaauauu

SEQ ID NO: 1703454 - RNA, 13 nt, Human
auauuuucauucu

SEQ ID NO: 1703455 - RNA, 13 nt, Human
auauuuuaugauc

SEQ ID NO: 1703456 - RNA, 12 nt, Human
auauuuuaugau

SEQ ID NO: 1703457 - RNA, 22 nt, Human
auauuuuaugauccagcagauu

SEQ ID NO: 1703458 - RNA, 17 nt, Human
auauuuuaugauccagc

SEQ ID NO: 1703459 - RNA, 22 nt, Human
aucaguauugaagcauuuuaua

SEQ ID NO: 1703460 - RNA, 15 nt, Human
aucaguauugaagca

SEQ ID NO: 1703461 - RNA, 17 nt, Human
aucaucaguauugaagc

SEQ ID NO: 1703462 - RNA, 19 nt, Human
aucaucaguauugaagcau

SEQ ID NO: 1703463 - RNA, 15 nt, Human
aucaucaguauugaa

SEQ ID NO: 1703464 - RNA, 18 nt, Human
uucucaacuccaaacuga

SEQ ID NO: 1703465 - RNA, 14 nt, Human
uucucaacuccaaa

SEQ ID NO: 1703466 - RNA, 12 nt, Human
uucuggugugaa

SEQ ID NO: 1703467 - RNA, 13 nt, Human
uucugaagaagau

SEQ ID NO: 1703468 - RNA, 12 nt, Human
uucugaagaaga

SEQ ID NO: 1703469 - RNA, 14 nt, Human
uucugaagaagaug

SEQ ID NO: 1703470 - RNA, 17 nt, Human
uuauuuauaaucacuuu

SEQ ID NO: 1703471 - RNA, 16 nt, Human
auagcuagacugguga

SEQ ID NO: 1703472 - RNA, 15 nt, Human
auagcuagacuggug

SEQ ID NO: 1703473 - RNA, 14 nt, Human
auagcuagacuggu

SEQ ID NO: 1703474 - RNA, 18 nt, Human
auagcuacuaauuuuaaa

SEQ ID NO: 1703475 - RNA, 23 nt, Human
auagcuagacuggugacugauuc

SEQ ID NO: 1703476 - RNA, 19 nt, Human
auagcuagacuggugacug

SEQ ID NO: 1703477 - RNA, 18 nt, Human
auagcuagacuggugacu

SEQ ID NO: 1703478 - RNA, 14 nt, Human
auagcuacuaauuu

SEQ ID NO: 1703479 - RNA, 17 nt, Human
auagcuacuaauuuuaa

SEQ ID NO: 1703480 - RNA, 15 nt, Human
uucaaacauauauaa

SEQ ID NO: 1703481 - RNA, 21 nt, Human
auaggaauugacccacaagaa

SEQ ID NO: 1703482 - RNA, 22 nt, Human
auaggaauugacccacaagaaa

SEQ ID NO: 1703483 - RNA, 17 nt, Human
auauaaaugguuaaaag

SEQ ID NO: 1703484 - RNA, 18 nt, Human
auagucaaauugugugaa

SEQ ID NO: 1703485 - RNA, 17 nt, Human
auagucaaauuguguga

SEQ ID NO: 1703486 - RNA, 19 nt, Human
auauaagcuuguauuccuu

SEQ ID NO: 1703487 - RNA, 17 nt, Human
auauaacaaugcuguau

SEQ ID NO: 1703488 - RNA, 15 nt, Human
auauaacaaugcugu

SEQ ID NO: 1703489 - RNA, 12 nt, Human
auauaacaaugc

SEQ ID NO: 1703490 - RNA, 19 nt, Human
auauauaacaaugcuguau

SEQ ID NO: 1703491 - RNA, 18 nt, Human
auauauaacaaugcugua

SEQ ID NO: 1703492 - RNA, 17 nt, Human
auauauaacaaugcugu

SEQ ID NO: 1703493 - RNA, 21 nt, Human
uucagcaaaaauauuuuauga

SEQ ID NO: 1703494 - RNA, 18 nt, Human
auaucugaggaauucugu

SEQ ID NO: 1703495 - RNA, 17 nt, Human
auaucugaggaauucug

SEQ ID NO: 1703496 - RNA, 16 nt, Human
auaucugaggaauucu

SEQ ID NO: 1703497 - RNA, 15 nt, Human
auaucugaggaauuc

SEQ ID NO: 1703498 - RNA, 23 nt, Human
auaucugaggaauucuguauaga

SEQ ID NO: 1703499 - RNA, 22 nt, Human
auaucugaggaauucuguauag

SEQ ID NO: 1703500 - RNA, 21 nt, Human
auaucugaggaauucuguaua

SEQ ID NO: 1703501 - RNA, 20 nt, Human
auaucugaggaauucuguau

SEQ ID NO: 1703502 - RNA, 19 nt, Human
auaucugaggaauucugua

SEQ ID NO: 1703503 - RNA, 19 nt, Human
uucauaccuacauguauuu

SEQ ID NO: 1703504 - RNA, 16 nt, Human
uucauaccuacaugua

SEQ ID NO: 1703505 - RNA, 22 nt, Human
augaaauacuguuugagguuuu

SEQ ID NO: 1703506 - RNA, 15 nt, Human
uuggagaagaacuga

SEQ ID NO: 1703507 - RNA, 22 nt, Human
uuggagaagaacugaaaucaua

SEQ ID NO: 1703508 - RNA, 17 nt, Human
uuggagaagaacugaaa

SEQ ID NO: 1703509 - RNA, 16 nt, Human
aucuuauaauuuaaaa

SEQ ID NO: 1703510 - RNA, 15 nt, Human
aucuuauaauuuaaa

SEQ ID NO: 1703511 - RNA, 23 nt, Human
aucugaagucagaucugccuaag

SEQ ID NO: 1703512 - RNA, 18 nt, Human
aucugaagucagaucugc

SEQ ID NO: 1703513 - RNA, 17 nt, Human
aucugaagucagaucug

SEQ ID NO: 1703514 - RNA, 16 nt, Human
aucugaagucagaucu

SEQ ID NO: 1703515 - RNA, 12 nt, Human
uugacuuuuuau

SEQ ID NO: 1703516 - RNA, 13 nt, Human
uugacaugggaca

SEQ ID NO: 1703517 - RNA, 23 nt, Human
uuuagucuugucucagauuuuau

SEQ ID NO: 1703518 - RNA, 17 nt, Human
uuuagucuugucucaga

SEQ ID NO: 1703519 - RNA, 21 nt, Human
uuuauaugcuucuguuuuaua

SEQ ID NO: 1703520 - RNA, 15 nt, Human
uuuagucuugucuca

SEQ ID NO: 1703521 - RNA, 14 nt, Human
augccaucaauaaa

SEQ ID NO: 1703522 - RNA, 18 nt, Human
augcuacaggauuugaaa

SEQ ID NO: 1703523 - RNA, 22 nt, Human
augccuuuucccaacuccagaa

SEQ ID NO: 1703524 - RNA, 20 nt, Human
augccuuuucccaacuccag

SEQ ID NO: 1703525 - RNA, 14 nt, Human
augccuuuucccaa

SEQ ID NO: 1703526 - RNA, 19 nt, Human
uuucaaacauauauaacaa

SEQ ID NO: 1703527 - RNA, 21 nt, Human
augcuucuguuuuauaauuuu

SEQ ID NO: 1703528 - RNA, 22 nt, Human
augcuguauuuuaaaagaauga

SEQ ID NO: 1703529 - RNA, 19 nt, Human
augcuguauuuuaaaagaa

SEQ ID NO: 1703530 - RNA, 23 nt, Human
augcuguauuuuaaaagaaugau

SEQ ID NO: 1703531 - RNA, 15 nt, Human
augagguacugagag

SEQ ID NO: 1703532 - RNA, 18 nt, Human
augagguacugagaguga

SEQ ID NO: 1703533 - RNA, 17 nt, Human
augagguacugagagug

SEQ ID NO: 1703534 - RNA, 20 nt, Human
uugucaauaaaauccauaca

SEQ ID NO: 1703535 - RNA, 13 nt, Human
augauuucauuca

SEQ ID NO: 1703536 - RNA, 18 nt, Human
uuuaaaaaaauuccaagu

SEQ ID NO: 1703537 - RNA, 21 nt, Human
uuuaaauauaugcuaagucuu

SEQ ID NO: 1703538 - RNA, 13 nt, Human
auuugaauuuugu

SEQ ID NO: 1703539 - RNA, 23 nt, Human
auuuauuggcuuuucugauccag

SEQ ID NO: 1703540 - RNA, 20 nt, Human
auuuauuggcuuuucugauc

SEQ ID NO: 1703541 - RNA, 21 nt, Human
auuuauuuuaauaauguuuca

SEQ ID NO: 1703542 - RNA, 18 nt, Human
auuuauuggcuuuucuga

SEQ ID NO: 1703543 - RNA, 14 nt, Human
auuuauuggcuuuu

SEQ ID NO: 1703544 - RNA, 20 nt, Human
auuuauuacuguaagaaaau

SEQ ID NO: 1703545 - RNA, 19 nt, Human
auuuauuacuguaagaaaa

SEQ ID NO: 1703546 - RNA, 15 nt, Human
auuguacuuugugcu

SEQ ID NO: 1703547 - RNA, 16 nt, Human
auuguaguccuguaau

SEQ ID NO: 1703548 - RNA, 17 nt, Human
auuuaaaaaaaaaccug

SEQ ID NO: 1703549 - RNA, 20 nt, Human
auuuacuaaaauggacugug

SEQ ID NO: 1703550 - RNA, 19 nt, Human
auuuacuaaaauggacugu

SEQ ID NO: 1703551 - RNA, 16 nt, Human
auuuacuaaaauggac

SEQ ID NO: 1703552 - RNA, 22 nt, Human
auuuaccacuuguguuuugcaa

SEQ ID NO: 1703553 - RNA, 15 nt, Human
auuuaccacuugugu

SEQ ID NO: 1703554 - RNA, 22 nt, Human
auuggggauucuuaaaguugaa

SEQ ID NO: 1703555 - RNA, 21 nt, Human
auuggggauucuuaaaguuga

SEQ ID NO: 1703556 - RNA, 20 nt, Human
auuggggauucuuaaaguug

SEQ ID NO: 1703557 - RNA, 16 nt, Human
auuggggauucuuaaa

SEQ ID NO: 1703558 - RNA, 15 nt, Human
auuggggauucuuaa

SEQ ID NO: 1703559 - RNA, 14 nt, Human
auuggggauucuua

SEQ ID NO: 1703560 - RNA, 17 nt, Human
auuggagcucgugggac

SEQ ID NO: 1703561 - RNA, 16 nt, Human
auuggagcucguggaa

SEQ ID NO: 1703562 - RNA, 24 nt, Human
uuuuuggcauaacauaaaucugug

SEQ ID NO: 1703563 - RNA, 23 nt, Human
uuuuuggcauaacauaaaucugu

SEQ ID NO: 1703564 - RNA, 17 nt, Human
auuaaguaucugacauc

SEQ ID NO: 1703565 - RNA, 20 nt, Human
auuaaggauuuuaugcuuua

SEQ ID NO: 1703566 - RNA, 17 nt, Human
auuaaggauuuuaugcu

SEQ ID NO: 1703567 - RNA, 15 nt, Human
auuaaggauuuuaug

SEQ ID NO: 1703568 - RNA, 15 nt, Human
uuuuugaagcuguau

SEQ ID NO: 1703569 - RNA, 17 nt, Human
uuuuuauauuugaaaua

SEQ ID NO: 1703570 - RNA, 15 nt, Human
uuuuggaauuuuccu

SEQ ID NO: 1703571 - RNA, 14 nt, Human
uuuugugaagcaaa

SEQ ID NO: 1703572 - RNA, 20 nt, Human
uuuuuauauuuacuaaaaug

SEQ ID NO: 1703573 - RNA, 16 nt, Human
auuacuguaagaaaau

SEQ ID NO: 1703574 - RNA, 15 nt, Human
auuacuguaagaaaa

SEQ ID NO: 1703575 - RNA, 17 nt, Human
auucacugauuugacau

SEQ ID NO: 1703576 - RNA, 12 nt, Human
auucacugauuu

SEQ ID NO: 1703577 - RNA, 17 nt, Human
auuccaagugauugaaa

SEQ ID NO: 1703578 - RNA, 19 nt, Human
auuauaugcuauuucuaua

SEQ ID NO: 1703579 - RNA, 17 nt, Human
auuauaugcuauuucua

SEQ ID NO: 1703580 - RNA, 18 nt, Human
auuauaugcuauuucuau

SEQ ID NO: 1703581 - RNA, 20 nt, Human
auuauauggcuugaguuuaa

SEQ ID NO: 1703582 - RNA, 19 nt, Human
auuauucacugauuugaca

SEQ ID NO: 1703583 - RNA, 24 nt, Human
auuauucaaaguugccuaaaucca

SEQ ID NO: 1703584 - RNA, 18 nt, Human
auuauucaaaguugccua

SEQ ID NO: 1703585 - RNA, 22 nt, Human
auuauucaaaguugccuaaauc

SEQ ID NO: 1703586 - RNA, 19 nt, Human
auuauucaaaguugccuaa

SEQ ID NO: 1703587 - RNA, 19 nt, Human
auuauaucugaggaauucu

SEQ ID NO: 1703588 - RNA, 18 nt, Human
auuauaucugaggaauuc

SEQ ID NO: 1703589 - RNA, 16 nt, Human
auuauaugcuauuucu

SEQ ID NO: 1703590 - RNA, 22 nt, Human
auuauaucugaggaauucugua

SEQ ID NO: 1703591 - RNA, 21 nt, Human
auuauaucugaggaauucugu

SEQ ID NO: 1703592 - RNA, 20 nt, Human
auuauaucugaggaauucug

SEQ ID NO: 1703593 - RNA, 14 nt, Human
uuugaauuuugugu

SEQ ID NO: 1703594 - RNA, 12 nt, Human
uuugaauuuugu

SEQ ID NO: 1703595 - RNA, 16 nt, Human
uuugagaaauuaagua

SEQ ID NO: 1703596 - RNA, 20 nt, Human
uuugcuggagcucugcccau

SEQ ID NO: 1703597 - RNA, 19 nt, Human
uuugcuaagcauuccaacu

SEQ ID NO: 1703598 - RNA, 19 nt, Human
auguauauuuuauaucaau

SEQ ID NO: 1703599 - RNA, 23 nt, Human
augucgucaaagcugaaauggac

SEQ ID NO: 1703600 - RNA, 17 nt, Human
uuuguaguguuggagaa

SEQ ID NO: 1703601 - RNA, 12 nt, Human
auguuuauuaca

SEQ ID NO: 1703602 - RNA, 12 nt, Human
uuuucuguuaua

SEQ ID NO: 1703603 - RNA, 23 nt, Human
uuuucuuaaauaauaaagaucau

SEQ ID NO: 1703604 - RNA, 14 nt, Human
uuuucuuaaauaau

SEQ ID NO: 1703605 - RNA, 19 nt, Human
uuuucugauccaguuuugu

SEQ ID NO: 1703606 - RNA, 23 nt, Human
auguuuauuacaguauaauuaac

SEQ ID NO: 1703607 - RNA, 22 nt, Human
auguuuauuacaguauaauuaa

SEQ ID NO: 1703608 - RNA, 19 nt, Human
auguuuauuacaguauaau

SEQ ID NO: 1703609 - RNA, 18 nt, Human
auguuuauuacaguauaa

SEQ ID NO: 1703610 - RNA, 16 nt, Human
auguuuauuacaguau

SEQ ID NO: 1703611 - RNA, 15 nt, Human
auguuuauuacagua

SEQ ID NO: 1703612 - RNA, 20 nt, Human
uuuucaggcuagauguaugu

SEQ ID NO: 1703613 - RNA, 16 nt, Human
uuuucuauaauuuaaa

SEQ ID NO: 1703614 - RNA, 22 nt, Human
uuuuauggcacuaguauuucua

SEQ ID NO: 1703615 - RNA, 21 nt, Human
augugcuaguaauuggaaagg

SEQ ID NO: 1703616 - RNA, 20 nt, Human
augugcuaguaauuggaaag

SEQ ID NO: 1703617 - RNA, 22 nt, Human
cacuccaauuaaggauuuuaug

SEQ ID NO: 1703618 - RNA, 21 nt, Human
cacuccaauuaaggauuuuau

SEQ ID NO: 1703619 - RNA, 21 nt, Human
cacuccagugagacagcucug

SEQ ID NO: 1703620 - RNA, 23 nt, Human
cacugaagaagcaccaaucauga

SEQ ID NO: 1703621 - RNA, 12 nt, Human
caacuccagaaa

SEQ ID NO: 1703622 - RNA, 19 nt, Human
caacuaucucauuuccaag

SEQ ID NO: 1703623 - RNA, 19 nt, Human
caacuauauuguuugcuaa

SEQ ID NO: 1703624 - RNA, 14 nt, Human
caagcaaguauuag

SEQ ID NO: 1703625 - RNA, 17 nt, Human
caaucagccuaguugau

SEQ ID NO: 1703626 - RNA, 13 nt, Human
auuuaauaauuau

SEQ ID NO: 1703627 - RNA, 18 nt, Human
auuuaauaauuauaugcu

SEQ ID NO: 1703628 - RNA, 15 nt, Human
auuuaauaauuauau

SEQ ID NO: 1703629 - RNA, 17 nt, Human
auuuuuuuucuguuaua

SEQ ID NO: 1703630 - RNA, 15 nt, Human
auuuuuuuucuguua

SEQ ID NO: 1703631 - RNA, 19 nt, Human
auuuuuuuucuguuauaua

SEQ ID NO: 1703632 - RNA, 18 nt, Human
auuuuuuuucuguuauau

SEQ ID NO: 1703633 - RNA, 20 nt, Human
auuuuuuuucuguuauauaa

SEQ ID NO: 1703634 - RNA, 21 nt, Human
caaaagguauuuuaaucacca

SEQ ID NO: 1703635 - RNA, 19 nt, Human
auuuuuauauuugaaauau

SEQ ID NO: 1703636 - RNA, 18 nt, Human
auuuuuuuguuguuuguu

SEQ ID NO: 1703637 - RNA, 17 nt, Human
auuuucuauaauuuaaa

SEQ ID NO: 1703638 - RNA, 18 nt, Human
auuuucuauaauuuaaau

SEQ ID NO: 1703639 - RNA, 19 nt, Human
auuuucuauaauuuaaaua

SEQ ID NO: 1703640 - RNA, 14 nt, Human
auuauguaaauccc

SEQ ID NO: 1703641 - RNA, 13 nt, Human
auuauguaaaucc

SEQ ID NO: 1703642 - RNA, 23 nt, Human
auuauguaaaucccauuauucaa

SEQ ID NO: 1703643 - RNA, 22 nt, Human
auuauguaaaucccauuauuca

SEQ ID NO: 1703644 - RNA, 17 nt, Human
auuauguaaaucccauu

SEQ ID NO: 1703645 - RNA, 15 nt, Human
auuauguaaauccca

SEQ ID NO: 1703646 - RNA, 22 nt, Human
auugaggacacugauauggguc

SEQ ID NO: 1703647 - RNA, 16 nt, Human
cauaggugaucucauu

SEQ ID NO: 1703648 - RNA, 16 nt, Human
cauagguuuaauaauu

SEQ ID NO: 1703649 - RNA, 19 nt, Human
cauagcagcuuauucacaa

SEQ ID NO: 1703650 - RNA, 20 nt, Human
cauagcagcuuauucacaag

SEQ ID NO: 1703651 - RNA, 19 nt, Human
cauccugaggcuccacuug

SEQ ID NO: 1703652 - RNA, 18 nt, Human
cauccugaggcuccacuu

SEQ ID NO: 1703653 - RNA, 22 nt, Human
cagugauuaccagggacugagg

SEQ ID NO: 1703654 - RNA, 17 nt, Human
caguuauuauauuuaca

SEQ ID NO: 1703655 - RNA, 21 nt, Human
caguuauuauauuuacaaaug

SEQ ID NO: 1703656 - RNA, 22 nt, Human
caguuauuauauuuacaaaugg

SEQ ID NO: 1703657 - RNA, 17 nt, Human
cauugguguuguacuca

SEQ ID NO: 1703658 - RNA, 15 nt, Human
cauugguucuuguau

SEQ ID NO: 1703659 - RNA, 14 nt, Human
cauugguucuugua

SEQ ID NO: 1703660 - RNA, 16 nt, Human
cauuuguauaaaauaa

SEQ ID NO: 1703661 - RNA, 14 nt, Human
cauuuguauaaaau

SEQ ID NO: 1703662 - RNA, 17 nt, Human
cauuuguauaaaauaau

SEQ ID NO: 1703663 - RNA, 14 nt, Human
ccaaaaggcagaag

SEQ ID NO: 1703664 - RNA, 21 nt, Human
ccaacuccagaaagugacaag

SEQ ID NO: 1703665 - RNA, 14 nt, Human
cauuauucaaaguu

SEQ ID NO: 1703666 - RNA, 16 nt, Human
cauuauucaaaguugc

SEQ ID NO: 1703667 - RNA, 15 nt, Human
cauuauucaaaguug

SEQ ID NO: 1703668 - RNA, 19 nt, Human
cauuauauuuauuacugua

SEQ ID NO: 1703669 - RNA, 14 nt, Human
cagauacuggauug

SEQ ID NO: 1703670 - RNA, 18 nt, Human
cagauacuggauuguacu

SEQ ID NO: 1703671 - RNA, 20 nt, Human
caggaaagagaacuuccaga

SEQ ID NO: 1703672 - RNA, 16 nt, Human
caggaaagagaacuuc

SEQ ID NO: 1703673 - RNA, 20 nt, Human
cagcuuauugucuagugaaa

SEQ ID NO: 1703674 - RNA, 14 nt, Human
cagcuuauugucua

SEQ ID NO: 1703675 - RNA, 20 nt, Human
cagcuguaugauucccagcc

SEQ ID NO: 1703676 - RNA, 20 nt, Human
ccagacgaugucuucauacc

SEQ ID NO: 1703677 - RNA, 13 nt, Human
ccagacgaugucu

SEQ ID NO: 1703678 - RNA, 19 nt, Human
ccacuuggucugugagaug

SEQ ID NO: 1703679 - RNA, 17 nt, Human
ccacuuggucugugaga

SEQ ID NO: 1703680 - RNA, 16 nt, Human
ccacuuggucugugag

SEQ ID NO: 1703681 - RNA, 15 nt, Human
ccacuuggucuguga

SEQ ID NO: 1703682 - RNA, 22 nt, Human
ccacuuggucugugagaugcua

SEQ ID NO: 1703683 - RNA, 20 nt, Human
ccacuuggucugugagaugc

SEQ ID NO: 1703684 - RNA, 12 nt, Human
ccacuuggucug

SEQ ID NO: 1703685 - RNA, 14 nt, Human
ccaguauuguacaa

SEQ ID NO: 1703686 - RNA, 15 nt, Human
ccaggggccaugaau

SEQ ID NO: 1703687 - RNA, 19 nt, Human
ccaugggauaaaugccauc

SEQ ID NO: 1703688 - RNA, 18 nt, Human
ccaugggcacugugggua

SEQ ID NO: 1703689 - RNA, 22 nt, Human
ccauuguggucacaggaaguag

SEQ ID NO: 1703690 - RNA, 15 nt, Human
ccccauuguggucac

SEQ ID NO: 1703691 - RNA, 12 nt, Human
ccuaaggacuuc

SEQ ID NO: 1703692 - RNA, 11 nt, Human
ccuaaggacuu

SEQ ID NO: 1703693 - RNA, 23 nt, Human
ccuaaggacuucuuuaauuuugg

SEQ ID NO: 1703694 - RNA, 18 nt, Human
ccuaaggacuucuuuaau

SEQ ID NO: 1703695 - RNA, 17 nt, Human
ccuaaggacuucuuuaa

SEQ ID NO: 1703696 - RNA, 16 nt, Human
ccuaaggacuucuuua

SEQ ID NO: 1703697 - RNA, 20 nt, Human
ccuaacgaaguauccuucag

SEQ ID NO: 1703698 - RNA, 19 nt, Human
cgcugauaagcguucaugg

SEQ ID NO: 1703699 - RNA, 12 nt, Human
ccuuuucccaac

SEQ ID NO: 1703700 - RNA, 20 nt, Human
cuaacgaaguauccuucagc

SEQ ID NO: 1703701 - RNA, 17 nt, Human
ccuucucuucacaguca

SEQ ID NO: 1703702 - RNA, 19 nt, Human
cucagaaggcaaaugacuu

SEQ ID NO: 1703703 - RNA, 16 nt, Human
cucaguccaugaagau

SEQ ID NO: 1703704 - RNA, 18 nt, Human
cuauguucuaagaaguga

SEQ ID NO: 1703705 - RNA, 18 nt, Human
cuaucucauuuccaagca

SEQ ID NO: 1703706 - RNA, 13 nt, Human
cucucuggccuuc

SEQ ID NO: 1703707 - RNA, 16 nt, Human
cucucuggccuucggc

SEQ ID NO: 1703708 - RNA, 14 nt, Human
cucucuggccuucg

SEQ ID NO: 1703709 - RNA, 19 nt, Human
cucuauguucuaagaagug

SEQ ID NO: 1703710 - RNA, 15 nt, Human
cucuccccaugaugu

SEQ ID NO: 1703711 - RNA, 16 nt, Human
cucuccccaugauguu

SEQ ID NO: 1703712 - RNA, 23 nt, Human
gcugaacacuccaauuaaggauu

SEQ ID NO: 1703713 - RNA, 21 nt, Human
gcugaacacuccaauuaagga

SEQ ID NO: 1703714 - RNA, 20 nt, Human
gcugaacacuccaauuaagg

SEQ ID NO: 1703715 - RNA, 16 nt, Human
gcuaguaucaaaagaa

SEQ ID NO: 1703716 - RNA, 21 nt, Human
gcuaguaauuggaaaggcagc

SEQ ID NO: 1703717 - RNA, 17 nt, Human
gcuggagcucugcccau

SEQ ID NO: 1703718 - RNA, 14 nt, Human
gcuggagcucugcc

SEQ ID NO: 1703719 - RNA, 22 nt, Human
gccagacaucaacagauaaaua

SEQ ID NO: 1703720 - RNA, 13 nt, Human
ggcaaaugacuuu

SEQ ID NO: 1703721 - RNA, 23 nt, Human
ggaugguucccuugaugaagaag

SEQ ID NO: 1703722 - RNA, 22 nt, Human
ggaugguucccuugaugaagaa

SEQ ID NO: 1703723 - RNA, 19 nt, Human
ggaggcugagaugggagaa

SEQ ID NO: 1703724 - RNA, 15 nt, Human
ggaggcugagauggg

SEQ ID NO: 1703725 - RNA, 23 nt, Human
aaaauuggggauucuuaaaguug

SEQ ID NO: 1703726 - RNA, 21 nt, Human
aaaauuggggauucuuaaagu

SEQ ID NO: 1703727 - RNA, 22 nt, Human
aaaauggacuguggugacuuug

SEQ ID NO: 1703728 - RNA, 17 nt, Human
aaacaaggaugaauuaa

SEQ ID NO: 1703729 - RNA, 19 nt, Human
aaaauuuuuucucuaggaa

SEQ ID NO: 1703730 - RNA, 21 nt, Human
aaacauauauaacaaugcugu

SEQ ID NO: 1703731 - RNA, 19 nt, Human
aaacauauauaacaaugcu

SEQ ID NO: 1703732 - RNA, 16 nt, Human
aaacauauauaacaau

SEQ ID NO: 1703733 - RNA, 13 nt, Human
aaacauauauaac

SEQ ID NO: 1703734 - RNA, 14 nt, Human
aaacacaacuauau

SEQ ID NO: 1703735 - RNA, 18 nt, Human
aaacggaugauuucuaug

SEQ ID NO: 1703736 - RNA, 16 nt, Human
aaacggaugauuucua

SEQ ID NO: 1703737 - RNA, 15 nt, Human
aaacuggguuccugc

SEQ ID NO: 1703738 - RNA, 16 nt, Human
aaacuggguuccugca

SEQ ID NO: 1703739 - RNA, 17 nt, Human
aaacauugguucuugua

SEQ ID NO: 1703740 - RNA, 21 nt, Human
aaacauugguucuuguauuaa

SEQ ID NO: 1703741 - RNA, 20 nt, Human
aaacauugguucuuguauua

SEQ ID NO: 1703742 - RNA, 18 nt, Human
aaacauugguucuuguau

SEQ ID NO: 1703743 - RNA, 17 nt, Human
aaacuuuucugauagag

SEQ ID NO: 1703744 - RNA, 16 nt, Human
aaacuuuucugauaga

SEQ ID NO: 1703745 - RNA, 16 nt, Human
aaagaaugauuaugaa

SEQ ID NO: 1703746 - RNA, 12 nt, Human
aaacuuuucuga

SEQ ID NO: 1703747 - RNA, 14 nt, Human
aaacuuuucugaua

SEQ ID NO: 1703748 - RNA, 13 nt, Human
aaacuuuucugau

SEQ ID NO: 1703749 - RNA, 15 nt, Human
aaacuuguguaaaua

SEQ ID NO: 1703750 - RNA, 17 nt, Human
aaacuuguguaaauaca

SEQ ID NO: 1703751 - RNA, 18 nt, Human
aaagagaacuuccagauc

SEQ ID NO: 1703752 - RNA, 23 nt, Human
aaaggaagguucuggugugaacu

SEQ ID NO: 1703753 - RNA, 13 nt, Human
aaaggaauuuaaa

SEQ ID NO: 1703754 - RNA, 24 nt, Human
ggucugugagaugcuagaacuccc

SEQ ID NO: 1703755 - RNA, 14 nt, Human
ggucugugagaugc

SEQ ID NO: 1703756 - RNA, 20 nt, Human
gggauucuuaaaguugaauu

SEQ ID NO: 1703757 - RNA, 15 nt, Human
gggauucuuaaaguu

SEQ ID NO: 1703758 - RNA, 23 nt, Human
aaaauaauuuuuauauuugaaau

SEQ ID NO: 1703759 - RNA, 21 nt, Human
aaaauaauuuuuauauuugaa

SEQ ID NO: 1703760 - RNA, 21 nt, Human
aaaacuuuaugcuaagugaaa

SEQ ID NO: 1703761 - RNA, 22 nt, Human
aaaagcuccauuuuuagugaaa

SEQ ID NO: 1703762 - RNA, 20 nt, Human
gggaggcagagguugcagug

SEQ ID NO: 1703763 - RNA, 21 nt, Human
ggcugaacacuccaauuaagg

SEQ ID NO: 1703764 - RNA, 14 nt, Human
gacuguggugacuu

SEQ ID NO: 1703765 - RNA, 13 nt, Human
gacuguggugacu

SEQ ID NO: 1703766 - RNA, 21 nt, Human
gacucuuaagaagacugcauu

SEQ ID NO: 1703767 - RNA, 15 nt, Human
gacucuuaagaagac

SEQ ID NO: 1703768 - RNA, 14 nt, Human
gacucuuaagaaga

SEQ ID NO: 1703769 - RNA, 17 nt, Human
gacgcucucuggccuuc

SEQ ID NO: 1703770 - RNA, 16 nt, Human
gacgcucucuggccuu

SEQ ID NO: 1703771 - RNA, 15 nt, Human
gacgcucucuggccu

SEQ ID NO: 1703772 - RNA, 16 nt, Human
gacacacugaagaagc

SEQ ID NO: 1703773 - RNA, 15 nt, Human
gacacacugaagaag

SEQ ID NO: 1703774 - RNA, 21 nt, Human
gacagaaagcagaacagugau

SEQ ID NO: 1703775 - RNA, 21 nt, Human
gacagugagacucugucucag

SEQ ID NO: 1703776 - RNA, 17 nt, Human
gacauuugcucauggaa

SEQ ID NO: 1703777 - RNA, 16 nt, Human
gacauuugcucaugga

SEQ ID NO: 1703778 - RNA, 14 nt, Human
gaagcaaaauuuuu

SEQ ID NO: 1703779 - RNA, 23 nt, Human
gaagcaacccaaauguucaucaa

SEQ ID NO: 1703780 - RNA, 14 nt, Human
gaacugaaaucaua

SEQ ID NO: 1703781 - RNA, 21 nt, Human
gagugaguuggguguauugug

SEQ ID NO: 1703782 - RNA, 16 nt, Human
gaguuuaaauuguaau

SEQ ID NO: 1703783 - RNA, 15 nt, Human
gaggacgcucucugg

SEQ ID NO: 1703784 - RNA, 20 nt, Human
gaggacgcucucuggccuuc

SEQ ID NO: 1703785 - RNA, 23 nt, Human
gaggcuccacuuggucugugaga

SEQ ID NO: 1703786 - RNA, 12 nt, Human
gaggcuccacuu

SEQ ID NO: 1703787 - RNA, 19 nt, Human
gaggcuccacuuggucugu

SEQ ID NO: 1703788 - RNA, 21 nt, Human
gauuuuuuuguuguuuguuua

SEQ ID NO: 1703789 - RNA, 18 nt, Human
gauuuuuuuguuguuugu

SEQ ID NO: 1703790 - RNA, 20 nt, Human
gcaaguauuagaauaccaca

SEQ ID NO: 1703791 - RNA, 22 nt, Human
gcaauagucaaauugugugaaa

SEQ ID NO: 1703792 - RNA, 23 nt, Human
gauucuucagcaaaaauauuuua

SEQ ID NO: 1703793 - RNA, 15 nt, Human
gauuuaccacuugug

SEQ ID NO: 1703794 - RNA, 16 nt, Human
gauuuaccacuugugu

SEQ ID NO: 1703795 - RNA, 22 nt, Human
gauuauucacugauuugacaua

SEQ ID NO: 1703796 - RNA, 23 nt, Human
gaucugccuaaggacuucuuuaa

SEQ ID NO: 1703797 - RNA, 21 nt, Human
gaucugccuaaggacuucuuu

SEQ ID NO: 1703798 - RNA, 20 nt, Human
gaucugccuaaggacuucuu

SEQ ID NO: 1703799 - RNA, 18 nt, Human
gaucugccuaaggacuuc

SEQ ID NO: 1703800 - RNA, 17 nt, Human
gaucugccuaaggacuu

SEQ ID NO: 1703801 - RNA, 18 nt, Human
gauguagaggagaaacug

SEQ ID NO: 1703802 - RNA, 17 nt, Human
gauguagaggagaaacu

SEQ ID NO: 1703803 - RNA, 20 nt, Human
cuuucagauaacuguuauuu

SEQ ID NO: 1703804 - RNA, 13 nt, Human
cuuucagauacug

SEQ ID NO: 1703805 - RNA, 21 nt, Human
cuuuaauaucaucaguauuga

SEQ ID NO: 1703806 - RNA, 19 nt, Human
cuuuaauaucaucaguauu

SEQ ID NO: 1703807 - RNA, 18 nt, Human
cuuuaauaucaucaguau

SEQ ID NO: 1703808 - RNA, 16 nt, Human
cuuuaauuuuggaauu

SEQ ID NO: 1703809 - RNA, 13 nt, Human
cuuuaauuuugga

SEQ ID NO: 1703810 - RNA, 15 nt, Human
cuuuaauuuuggaau

SEQ ID NO: 1703811 - RNA, 14 nt, Human
cuuuaauuuuggaa

SEQ ID NO: 1703812 - RNA, 20 nt, Human
cuucuguuuuauaauuuugu

SEQ ID NO: 1703813 - RNA, 15 nt, Human
cuucuguuuuauaau

SEQ ID NO: 1703814 - RNA, 13 nt, Human
cuuaaaguugaau

SEQ ID NO: 1703815 - RNA, 11 nt, Human
cuuaaaguuga

SEQ ID NO: 1703816 - RNA, 23 nt, Human
cuucaugcugucuacacuaagag

SEQ ID NO: 1703817 - RNA, 11 nt, Human
cuucagacaua

SEQ ID NO: 1703818 - RNA, 19 nt, Human
cugaugccaaguuguuuga

SEQ ID NO: 1703819 - RNA, 20 nt, Human
cugcacggugaauggcuuug

SEQ ID NO: 1703820 - RNA, 17 nt, Human
cugcacggugaauggcu

SEQ ID NO: 1703821 - RNA, 15 nt, Human
cugcacggugaaugg

SEQ ID NO: 1703822 - RNA, 14 nt, Human
cugcacggugaaug

SEQ ID NO: 1703823 - RNA, 16 nt, Human
cugcacuccagccuga

SEQ ID NO: 1703824 - RNA, 20 nt, Human
cugcacuccagccugagcga

SEQ ID NO: 1703825 - RNA, 17 nt, Human
cugcacuccagccugag

SEQ ID NO: 1703826 - RNA, 21 nt, Human
cuggugccucaccccuugcca

SEQ ID NO: 1703827 - RNA, 23 nt, Human
cauuuuauaaaucgcuuuugaua

SEQ ID NO: 1703828 - RNA, 21 nt, Human
cauuuuauaaaucgcuuuuga

SEQ ID NO: 1703829 - RNA, 18 nt, Human
cauuuuauaaaucgcuuu

SEQ ID NO: 1703830 - RNA, 17 nt, Human
cauuuuauaaaucgcuu

SEQ ID NO: 1703831 - RNA, 13 nt, Human
cauuuuauaaauc

SEQ ID NO: 1703832 - RNA, 11 nt, Human
cauuuuauaaa

SEQ ID NO: 1703833 - RNA, 18 nt, Human
cauuugcucauggaauug

SEQ ID NO: 1703834 - RNA, 13 nt, Human
cauuugcucaugg

SEQ ID NO: 1703835 - RNA, 23 nt, Human
cauuuaauaauuauaugcuauuu

SEQ ID NO: 1703836 - RNA, 17 nt, Human
cauuuaggccaugggac

SEQ ID NO: 1703837 - RNA, 14 nt, Human
cauuuaauaauuau

SEQ ID NO: 1703838 - RNA, 12 nt, Human
cauuuaauaauu

SEQ ID NO: 1703839 - RNA, 19 nt, Human
cauuuaauaauuauaugcu

SEQ ID NO: 1703840 - RNA, 17 nt, Human
cauuuaauaauuauaug

SEQ ID NO: 1703841 - RNA, 16 nt, Human
cauuuaauaauuauau

SEQ ID NO: 1703842 - RNA, 15 nt, Human
cauuuaauaauuaua

SEQ ID NO: 1703843 - RNA, 22 nt, Human
ccaaacugacucuuaagaagac

SEQ ID NO: 1703844 - RNA, 17 nt, Human
ccaagcauuuagaugua

SEQ ID NO: 1703845 - RNA, 14 nt, Human
ccaagcaaguauua

SEQ ID NO: 1703846 - RNA, 20 nt, Human
ccacaggaaccacaagacug

SEQ ID NO: 1703847 - RNA, 16 nt, Human
ccaauauucauagcag

SEQ ID NO: 1703848 - RNA, 18 nt, Human
ccacugcagaagacagua

SEQ ID NO: 1703849 - RNA, 13 nt, Human
ccacugcagaaga

SEQ ID NO: 1703850 - RNA, 20 nt, Human
ccaggaauggagccugcacg

SEQ ID NO: 1703851 - RNA, 20 nt, Human
ccaucaauaaaaaauuauga

SEQ ID NO: 1703852 - RNA, 19 nt, Human
ccaucaauaaaaaauuaug

SEQ ID NO: 1703853 - RNA, 18 nt, Human
ccaucaaggguacacugc

SEQ ID NO: 1703854 - RNA, 14 nt, Human
ccaugaagauguag

SEQ ID NO: 1703855 - RNA, 16 nt, Human
ccaugauguuuagaaa

SEQ ID NO: 1703856 - RNA, 13 nt, Human
cccaaaaggcaga

SEQ ID NO: 1703857 - RNA, 18 nt, Human
cccaaaaggcagaagcaa

SEQ ID NO: 1703858 - RNA, 14 nt, Human
cggaugauuucuau

SEQ ID NO: 1703859 - RNA, 13 nt, Human
cggaugauuucua

SEQ ID NO: 1703860 - RNA, 17 nt, Human
cggccuccauccugagg

SEQ ID NO: 1703861 - RNA, 16 nt, Human
cggccuccauccugag

SEQ ID NO: 1703862 - RNA, 16 nt, Human
ccuuucucuuucguua

SEQ ID NO: 1703863 - RNA, 11 nt, Human
cgcaaugugac

SEQ ID NO: 1703864 - RNA, 21 nt, Human
cgcguugaaauuguaauuaua

SEQ ID NO: 1703865 - RNA, 17 nt, Human
cgcguugaaauuguaau

SEQ ID NO: 1703866 - RNA, 22 nt, Human
cgcguugaaauuguaauuauau

SEQ ID NO: 1703867 - RNA, 13 nt, Human
cgcguugaaauug

SEQ ID NO: 1703868 - RNA, 22 nt, Human
cguucauggaacgcguugaaau

SEQ ID NO: 1703869 - RNA, 21 nt, Human
cguucauggaacgcguugaaa

SEQ ID NO: 1703870 - RNA, 23 nt, Human
cguucauggaacgcguugaaauu

SEQ ID NO: 1703871 - RNA, 13 nt, Human
cguugaaauugua

SEQ ID NO: 1703872 - RNA, 15 nt, Human
ccuggccuuucauau

SEQ ID NO: 1703873 - RNA, 14 nt, Human
ccuggccuuucaua

SEQ ID NO: 1703874 - RNA, 21 nt, Human
ccugcuuucagauacuggauu

SEQ ID NO: 1703875 - RNA, 16 nt, Human
ccugcuuucagauacu

SEQ ID NO: 1703876 - RNA, 15 nt, Human
ccugcuuucagauac

SEQ ID NO: 1703877 - RNA, 13 nt, Human
ccugauuaaagaa

SEQ ID NO: 1703878 - RNA, 12 nt, Human
ccugauuaaaga

SEQ ID NO: 1703879 - RNA, 20 nt, Human
ccugaggcuccacuuggucu

SEQ ID NO: 1703880 - RNA, 18 nt, Human
ccugaggcuccacuuggu

SEQ ID NO: 1703881 - RNA, 23 nt, Human
ccugaaagaggaaugaaguacuc

SEQ ID NO: 1703882 - RNA, 18 nt, Human
ccugaaagaggaaugaag

SEQ ID NO: 1703883 - RNA, 23 nt, Human
ccucuuagaugcaguucugaaga

SEQ ID NO: 1703884 - RNA, 20 nt, Human
ccucagaaaacaaggaugaa

SEQ ID NO: 1703885 - RNA, 21 nt, Human
ccucacccacccuuuuuuaaa

SEQ ID NO: 1703886 - RNA, 22 nt, Human
ccggaagccaaaccucugugag

SEQ ID NO: 1703887 - RNA, 11 nt, Human
ccggaagccaa

SEQ ID NO: 1703888 - RNA, 22 nt, Human
ccgggaggcagagguugcagug

SEQ ID NO: 1703889 - RNA, 13 nt, Human
ccgugcuaaggac

SEQ ID NO: 1703890 - RNA, 16 nt, Human
cccuugaugaagaagu

SEQ ID NO: 1703891 - RNA, 21 nt, Human
cugcaaugaagucucugaagu

SEQ ID NO: 1703892 - RNA, 18 nt, Human
cugcaaugaagucucuga

SEQ ID NO: 1703893 - RNA, 22 nt, Human
cugcaaucuucucagaaggcaa

SEQ ID NO: 1703894 - RNA, 15 nt, Human
cugauucuucagcaa

SEQ ID NO: 1703895 - RNA, 13 nt, Human
cugcagaagacag

SEQ ID NO: 1703896 - RNA, 23 nt, Human
cugcagaagacaguauggcagcu

SEQ ID NO: 1703897 - RNA, 20 nt, Human
cugauagaggaagccugauu

SEQ ID NO: 1703898 - RNA, 20 nt, Human
cugauccaguuuuguuugga

SEQ ID NO: 1703899 - RNA, 21 nt, Human
cugccuaaggacuucuuuaau

SEQ ID NO: 1703900 - RNA, 20 nt, Human
cugccuaaggacuucuuuaa

SEQ ID NO: 1703901 - RNA, 15 nt, Human
cugccuaagugcagc

SEQ ID NO: 1703902 - RNA, 22 nt, Human
cugccuaaggacuucuuuaauu

SEQ ID NO: 1703903 - RNA, 19 nt, Human
cugccuaaggacuucuuua

SEQ ID NO: 1703904 - RNA, 21 nt, Human
cugcuuucagauacuggauug

SEQ ID NO: 1703905 - RNA, 18 nt, Human
cugcuuucagauacugga

SEQ ID NO: 1703906 - RNA, 23 nt, Human
cuggaauaauccuaaacauauga

SEQ ID NO: 1703907 - RNA, 20 nt, Human
cuggauuguacuuugugcug

SEQ ID NO: 1703908 - RNA, 19 nt, Human
cuggauuguacuuugugcu

SEQ ID NO: 1703909 - RNA, 16 nt, Human
cuggccaacgggguga

SEQ ID NO: 1703910 - RNA, 18 nt, Human
cuccuaucaccugucuug

SEQ ID NO: 1703911 - RNA, 16 nt, Human
cucccuucucuucaca

SEQ ID NO: 1703912 - RNA, 13 nt, Human
cucccuuucaaca

SEQ ID NO: 1703913 - RNA, 18 nt, Human
cucauuaggauggcuagu

SEQ ID NO: 1703914 - RNA, 17 nt, Human
cucauuaggauggcuag

SEQ ID NO: 1703915 - RNA, 21 nt, Human
cuccauccugaggcuccacuu

SEQ ID NO: 1703916 - RNA, 23 nt, Human
cuccauccugaggcuccacuugg

SEQ ID NO: 1703917 - RNA, 18 nt, Human
cucugcaaucuucucaga

SEQ ID NO: 1703918 - RNA, 17 nt, Human
cucugcaaucuucucag

SEQ ID NO: 1703919 - RNA, 23 nt, Human
cucugcauacucauuaggauggc

SEQ ID NO: 1703920 - RNA, 13 nt, Human
cucuccauuuaau

SEQ ID NO: 1703921 - RNA, 19 nt, Human
cugaagugaaacugcuugu

SEQ ID NO: 1703922 - RNA, 17 nt, Human
cugaagugaaacugcuu

SEQ ID NO: 1703923 - RNA, 13 nt, Human
cugaagugaaacu

SEQ ID NO: 1703924 - RNA, 21 nt, Human
cugaagucagaucugccuaag

SEQ ID NO: 1703925 - RNA, 16 nt, Human
cugaagucagaucugc

SEQ ID NO: 1703926 - RNA, 15 nt, Human
cugaagucagaucug

SEQ ID NO: 1703927 - RNA, 14 nt, Human
cugaagucagaucu

SEQ ID NO: 1703928 - RNA, 13 nt, Human
cucuuaagaagac

SEQ ID NO: 1703929 - RNA, 16 nt, Human
cuguuuuaugacuuca

SEQ ID NO: 1703930 - RNA, 15 nt, Human
cuguuuuaugacuuc

SEQ ID NO: 1703931 - RNA, 14 nt, Human
cuguuuuaugacuu

SEQ ID NO: 1703932 - RNA, 13 nt, Human
cuguuuuaugacu

SEQ ID NO: 1703933 - RNA, 12 nt, Human
cuguuuuaugac

SEQ ID NO: 1703934 - RNA, 19 nt, Human
cuguuuuauaauuuuguga

SEQ ID NO: 1703935 - RNA, 18 nt, Human
cuuaaugccacuaaauug

SEQ ID NO: 1703936 - RNA, 21 nt, Human
cuuaagaagacugcauuauau

SEQ ID NO: 1703937 - RNA, 21 nt, Human
cuuaggguuaugauuaaguaa

SEQ ID NO: 1703938 - RNA, 13 nt, Human
cuuauaauuuaaa

SEQ ID NO: 1703939 - RNA, 14 nt, Human
cuuauaauuuaaaa

SEQ ID NO: 1703940 - RNA, 19 nt, Human
cuuauaggaauugacccac

SEQ ID NO: 1703941 - RNA, 19 nt, Human
cuuacuaguuucccuugca

SEQ ID NO: 1703942 - RNA, 19 nt, Human
cuuagaugcaguucugaag

SEQ ID NO: 1703943 - RNA, 19 nt, Human
cuuccagauccuggaaauc

SEQ ID NO: 1703944 - RNA, 18 nt, Human
cuucagcgguuuauauaa

SEQ ID NO: 1703945 - RNA, 17 nt, Human
cuucggccuccauccug

SEQ ID NO: 1703946 - RNA, 19 nt, Human
cuucggccuccauccugag

SEQ ID NO: 1703947 - RNA, 18 nt, Human
cuucggccuccauccuga

SEQ ID NO: 1703948 - RNA, 18 nt, Human
cuuuucugauccaguuuu

SEQ ID NO: 1703949 - RNA, 16 nt, Human
cuuuucugauccaguu

SEQ ID NO: 1703950 - RNA, 11 nt, Human
cuuuucugauc

SEQ ID NO: 1703951 - RNA, 15 nt, Human
cuuuucugauccagu

SEQ ID NO: 1703952 - RNA, 14 nt, Human
cuuuucugauccag

SEQ ID NO: 1703953 - RNA, 15 nt, Human
cuuuuuuaaauaaau

SEQ ID NO: 1703954 - RNA, 21 nt, Human
cuuuuucauuauuuuauuaug

SEQ ID NO: 1703955 - RNA, 14 nt, Human
cuuuuucauuauuu

SEQ ID NO: 1703956 - RNA, 13 nt, Human
cuuuuucauuauu

SEQ ID NO: 1703957 - RNA, 12 nt, Human
cuuuuucauuau

SEQ ID NO: 1703958 - RNA, 20 nt, Human
gaaaaguauguuagugcaaa

SEQ ID NO: 1703959 - RNA, 14 nt, Human
gaaaaguauguuag

SEQ ID NO: 1703960 - RNA, 19 nt, Human
gaaaauaacaauaaaagac

SEQ ID NO: 1703961 - RNA, 14 nt, Human
gaaaacaaggauga

SEQ ID NO: 1703962 - RNA, 14 nt, Human
cuuuggauaauaag

SEQ ID NO: 1703963 - RNA, 16 nt, Human
cuuuggauaauaagga

SEQ ID NO: 1703964 - RNA, 19 nt, Human
cuuuccucaaaacuucaga

SEQ ID NO: 1703965 - RNA, 16 nt, Human
cuuguuagaucuaguu

SEQ ID NO: 1703966 - RNA, 13 nt, Human
cuuguuagaucua

SEQ ID NO: 1703967 - RNA, 18 nt, Human
cuuggggcugaugcaguu

SEQ ID NO: 1703968 - RNA, 16 nt, Human
cuuggggcugaugcag

SEQ ID NO: 1703969 - RNA, 18 nt, Human
cuugcccuggugccucac

SEQ ID NO: 1703970 - RNA, 20 nt, Human
cuugcuugauuguauggugg

SEQ ID NO: 1703971 - RNA, 16 nt, Human
gacugauucuucagca

SEQ ID NO: 1703972 - RNA, 13 nt, Human
gacugauucuuca

SEQ ID NO: 1703973 - RNA, 24 nt, Human
gacugcauuauauuuauuacugua

SEQ ID NO: 1703974 - RNA, 16 nt, Human
gacugaggggagggga

SEQ ID NO: 1703975 - RNA, 23 nt, Human
gacaggaugguucccuugaugaa

SEQ ID NO: 1703976 - RNA, 18 nt, Human
gaccacugcagaagacag

SEQ ID NO: 1703977 - RNA, 16 nt, Human
gaccacugcagaagac

SEQ ID NO: 1703978 - RNA, 19 nt, Human
gacccaaaaggcagaagca

SEQ ID NO: 1703979 - RNA, 18 nt, Human
gacccaaaaggcagaagc

SEQ ID NO: 1703980 - RNA, 20 nt, Human
gacccaaaaggcagaagcaa

SEQ ID NO: 1703981 - RNA, 17 nt, Human
gaaauuguaauuauauc

SEQ ID NO: 1703982 - RNA, 18 nt, Human
gaaauuguauuacaaauc

SEQ ID NO: 1703983 - RNA, 16 nt, Human
gaaauuguauuacaaa

SEQ ID NO: 1703984 - RNA, 20 nt, Human
gaacagugauuaccagggac

SEQ ID NO: 1703985 - RNA, 16 nt, Human
gaacagugauuaccag

SEQ ID NO: 1703986 - RNA, 17 nt, Human
gaacuaaacuuucacac

SEQ ID NO: 1703987 - RNA, 18 nt, Human
gaacuaaacuuucacacc

SEQ ID NO: 1703988 - RNA, 16 nt, Human
gaacuaaacuuucaca

SEQ ID NO: 1703989 - RNA, 14 nt, Human
gaacuaaacuuuca

SEQ ID NO: 1703990 - RNA, 12 nt, Human
gaacuaaacuuu

SEQ ID NO: 1703991 - RNA, 18 nt, Human
gaagauguagaggagaaa

SEQ ID NO: 1703992 - RNA, 19 nt, Human
gaagacugcauuauauuua

SEQ ID NO: 1703993 - RNA, 12 nt, Human
gaagaacugaaa

SEQ ID NO: 1703994 - RNA, 21 nt, Human
gaagucucugaagugaaacug

SEQ ID NO: 1703995 - RNA, 16 nt, Human
gaagucucugaaguga

SEQ ID NO: 1703996 - RNA, 22 nt, Human
gaaguccaagcauuuagaugua

SEQ ID NO: 1703997 - RNA, 12 nt, Human
gaaguccaagca

SEQ ID NO: 1703998 - RNA, 14 nt, Human
gaaguauccuucag

SEQ ID NO: 1703999 - RNA, 16 nt, Human
gaaguauccuucagcc

SEQ ID NO: 1704000 - RNA, 11 nt, Human
gaauucuguau

SEQ ID NO: 1704001 - RNA, 22 nt, Human
gaauuuauuggcuuuucugauc

SEQ ID NO: 1704002 - RNA, 21 nt, Human
gaauuuauuggcuuuucugau

SEQ ID NO: 1704003 - RNA, 20 nt, Human
gaauuuauuggcuuuucuga

SEQ ID NO: 1704004 - RNA, 16 nt, Human
gaauuuauuggcuuuu

SEQ ID NO: 1704005 - RNA, 14 nt, Human
gaauuuauuggcuu

SEQ ID NO: 1704006 - RNA, 21 nt, Human
gaauggcuuuguauagaaccu

SEQ ID NO: 1704007 - RNA, 23 nt, Human
gaaugguccgugcuaaggacuug

SEQ ID NO: 1704008 - RNA, 22 nt, Human
gaaugguccgugcuaaggacuu

SEQ ID NO: 1704009 - RNA, 20 nt, Human
gaaugguccgugcuaaggac

SEQ ID NO: 1704010 - RNA, 15 nt, Human
gacuucauuaauaau

SEQ ID NO: 1704011 - RNA, 22 nt, Human
gauaauaaggaaaaguuuaaua

SEQ ID NO: 1704012 - RNA, 21 nt, Human
gauaauaaggaaaaguuuaau

SEQ ID NO: 1704013 - RNA, 20 nt, Human
gauaauaaggaaaaguuuaa

SEQ ID NO: 1704014 - RNA, 13 nt, Human
gauaaacaguagu

SEQ ID NO: 1704015 - RNA, 17 nt, Human
gauaaucaacugggcug

SEQ ID NO: 1704016 - RNA, 21 nt, Human
gauaaucaacugggcugaaca

SEQ ID NO: 1704017 - RNA, 17 nt, Human
gauaggucagugcaaau

SEQ ID NO: 1704018 - RNA, 23 nt, Human
gaucagcuuauugucuagugaaa

SEQ ID NO: 1704019 - RNA, 17 nt, Human
gaucuaguucacucucc

SEQ ID NO: 1704020 - RNA, 14 nt, Human
gauccuggaaauca

SEQ ID NO: 1704021 - RNA, 19 nt, Human
gcaaugaagucucugaagu

SEQ ID NO: 1704022 - RNA, 17 nt, Human
gcaaugaagucucugaa

SEQ ID NO: 1704023 - RNA, 12 nt, Human
gcaaaugacuuu

SEQ ID NO: 1704024 - RNA, 13 nt, Human
gcaaaugacuuug

SEQ ID NO: 1704025 - RNA, 16 nt, Human
gaugcuagaacucccu

SEQ ID NO: 1704026 - RNA, 14 nt, Human
gauuaaguaaugau

SEQ ID NO: 1704027 - RNA, 22 nt, Human
gauuaaguaaugauaacuggaa

SEQ ID NO: 1704028 - RNA, 14 nt, Human
gcaguucugaagaa

SEQ ID NO: 1704029 - RNA, 13 nt, Human
gcaguucugaaga

SEQ ID NO: 1704030 - RNA, 20 nt, Human
gcauauauuuuuauauuuac

SEQ ID NO: 1704031 - RNA, 16 nt, Human
gcauauauuuuuauau

SEQ ID NO: 1704032 - RNA, 11 nt, Human
gcauauauuuu

SEQ ID NO: 1704033 - RNA, 15 nt, Human
gcauauauuuuuaua

SEQ ID NO: 1704034 - RNA, 14 nt, Human
gcauauauuuuuau

SEQ ID NO: 1704035 - RNA, 12 nt, Human
gcaucacaguuu

SEQ ID NO: 1704036 - RNA, 13 nt, Human
gcauuuuauaaau

SEQ ID NO: 1704037 - RNA, 20 nt, Human
gcacagccucuuagaugcag

SEQ ID NO: 1704038 - RNA, 14 nt, Human
gcagaagacaguau

SEQ ID NO: 1704039 - RNA, 11 nt, Human
gccuaaaucca

SEQ ID NO: 1704040 - RNA, 13 nt, Human
gccuaaggacuuc

SEQ ID NO: 1704041 - RNA, 12 nt, Human
gccuaaggacuu

SEQ ID NO: 1704042 - RNA, 18 nt, Human
gccuaaggacuucuuuaa

SEQ ID NO: 1704043 - RNA, 15 nt, Human
gccuaaggacuucuu

SEQ ID NO: 1704044 - RNA, 14 nt, Human
gccuaaggacuucu

SEQ ID NO: 1704045 - RNA, 19 nt, Human
gcccuucuuuccacagaag

SEQ ID NO: 1704046 - RNA, 22 nt, Human
gccuuuuucauuauuuuauuau

SEQ ID NO: 1704047 - RNA, 20 nt, Human
gccuuuuucauuauuuuauu

SEQ ID NO: 1704048 - RNA, 16 nt, Human
gccuuuuucauuauuu

SEQ ID NO: 1704049 - RNA, 12 nt, Human
gccuuuuucauu

SEQ ID NO: 1704050 - RNA, 18 nt, Human
gccuucggccuccauccu

SEQ ID NO: 1704051 - RNA, 19 nt, Human
gccuucggccuccauccug

SEQ ID NO: 1704052 - RNA, 18 nt, Human
gccuuggggcugaugcag

SEQ ID NO: 1704053 - RNA, 18 nt, Human
gccuguaaucacagcuac

SEQ ID NO: 1704054 - RNA, 22 nt, Human
gcuagacuggugacugauucuu

SEQ ID NO: 1704055 - RNA, 20 nt, Human
gcuagacuggugacugauuc

SEQ ID NO: 1704056 - RNA, 19 nt, Human
gcuagacuggugacugauu

SEQ ID NO: 1704057 - RNA, 16 nt, Human
gcuagacuggugacug

SEQ ID NO: 1704058 - RNA, 15 nt, Human
gcuagacuggugacu

SEQ ID NO: 1704059 - RNA, 13 nt, Human
gcuagacugguga

SEQ ID NO: 1704060 - RNA, 22 nt, Human
gccacguucuuacuaguuuccc

SEQ ID NO: 1704061 - RNA, 19 nt, Human
gccaugggacagggaggac

SEQ ID NO: 1704062 - RNA, 14 nt, Human
gccaugggacaggg

SEQ ID NO: 1704063 - RNA, 16 nt, Human
gcccacagcuguauga

SEQ ID NO: 1704064 - RNA, 19 nt, Human
gccccugcacuccagccug

SEQ ID NO: 1704065 - RNA, 17 nt, Human
gccccgugggguuccuc

SEQ ID NO: 1704066 - RNA, 21 nt, Human
ggugacuuuggauaauaagga

SEQ ID NO: 1704067 - RNA, 20 nt, Human
ggugacuuuggauaauaagg

SEQ ID NO: 1704068 - RNA, 19 nt, Human
ggugacuuuggauaauaag

SEQ ID NO: 1704069 - RNA, 18 nt, Human
ggugacuuuggauaauaa

SEQ ID NO: 1704070 - RNA, 14 nt, Human
ggugacuuuggaua

SEQ ID NO: 1704071 - RNA, 16 nt, Human
gguguaugugugaagu

SEQ ID NO: 1704072 - RNA, 14 nt, Human
gguucuuguauuaa

SEQ ID NO: 1704073 - RNA, 22 nt, Human
gguucuuguauuaagaaugaaa

SEQ ID NO: 1704074 - RNA, 23 nt, Human
gguuaagucuguuuuaugacuuc

SEQ ID NO: 1704075 - RNA, 16 nt, Human
gguuaagucuguuuua

SEQ ID NO: 1704076 - RNA, 13 nt, Human
gguuaagucuguu

SEQ ID NO: 1704077 - RNA, 20 nt, Human
gguuaucugaagucagaucu

SEQ ID NO: 1704078 - RNA, 15 nt, Human
ggggauucuuaaagu

SEQ ID NO: 1704079 - RNA, 11 nt, Human
ggggauucuua

SEQ ID NO: 1704080 - RNA, 11 nt, Human
ggguuccugca

SEQ ID NO: 1704081 - RNA, 16 nt, Human
ggcuuuucugauccag

SEQ ID NO: 1704082 - RNA, 13 nt, Human
ggcuuuucugauc

SEQ ID NO: 1704083 - RNA, 12 nt, Human
ggcuuuucugau

SEQ ID NO: 1704084 - RNA, 22 nt, Human
ggcuugaguuuaaauuguaaua

SEQ ID NO: 1704085 - RNA, 17 nt, Human
ggcuuuucugauccagu

SEQ ID NO: 1704086 - RNA, 21 nt, Human
ggcugaugccaaguuguuuga

SEQ ID NO: 1704087 - RNA, 22 nt, Human
ggcugaugccaaguuguuugag

SEQ ID NO: 1704088 - RNA, 22 nt, Human
gcuggugcccugcuuucagaua

SEQ ID NO: 1704089 - RNA, 24 nt, Human
gcuggugcccugcuuucagauacu

SEQ ID NO: 1704090 - RNA, 22 nt, Human
gcuguauuuuaaaagaaugauu

SEQ ID NO: 1704091 - RNA, 18 nt, Human
gcuagauguauguacuuc

SEQ ID NO: 1704092 - RNA, 23 nt, Human
gcuuuaauaucaucaguauugaa

SEQ ID NO: 1704093 - RNA, 22 nt, Human
gcuuuaauaucaucaguauuga

SEQ ID NO: 1704094 - RNA, 20 nt, Human
gcuuuaauaucaucaguauu

SEQ ID NO: 1704095 - RNA, 20 nt, Human
ggaaaaaauaacaaugaaag

SEQ ID NO: 1704096 - RNA, 19 nt, Human
gcuugcccuggugccucac

SEQ ID NO: 1704097 - RNA, 17 nt, Human
gcuugcccuggugccuc

SEQ ID NO: 1704098 - RNA, 16 nt, Human
ggaacgcguugaaauu

SEQ ID NO: 1704099 - RNA, 17 nt, Human
ggaacgcguugaaauug

SEQ ID NO: 1704100 - RNA, 21 nt, Human
ggaacgcguugaaauuguaau

SEQ ID NO: 1704101 - RNA, 19 nt, Human
ggaaaaguuuaauauuaaa

SEQ ID NO: 1704102 - RNA, 18 nt, Human
ggaaaaguuuaauauuaa

SEQ ID NO: 1704103 - RNA, 18 nt, Human
ggaaauauuuauuuuaau

SEQ ID NO: 1704104 - RNA, 17 nt, Human
ggaaauauuuauuuuaa

SEQ ID NO: 1704105 - RNA, 15 nt, Human
ggaaauauuuauuuu

SEQ ID NO: 1704106 - RNA, 13 nt, Human
ggaaauauuuauu

SEQ ID NO: 1704107 - RNA, 12 nt, Human
ggaaauauuuau

SEQ ID NO: 1704108 - RNA, 22 nt, Human
ggaagccaaaccucugugagca

SEQ ID NO: 1704109 - RNA, 19 nt, Human
ggaggacgcucucuggccu

SEQ ID NO: 1704110 - RNA, 21 nt, Human
ggaggacgcucucuggccuuc

SEQ ID NO: 1704111 - RNA, 20 nt, Human
ggaggacgcucucuggccuu

SEQ ID NO: 1704112 - RNA, 22 nt, Human
ggccaugggacagggaggacgc

SEQ ID NO: 1704113 - RNA, 20 nt, Human
uauaaaucgcuuuugauaau

SEQ ID NO: 1704114 - RNA, 19 nt, Human
uauaaaucgcuuuugauaa

SEQ ID NO: 1704115 - RNA, 18 nt, Human
uauaaaucgcuuuugaua

SEQ ID NO: 1704116 - RNA, 15 nt, Human
uaguuuuauaugcuu

SEQ ID NO: 1704117 - RNA, 21 nt, Human
uaguuguaccgcaaugugacu

SEQ ID NO: 1704118 - RNA, 18 nt, Human
uagucaaauugugugaaa

SEQ ID NO: 1704119 - RNA, 19 nt, Human
uauauuuuuauauuuacua

SEQ ID NO: 1704120 - RNA, 19 nt, Human
uauauuuuuuguuaaauga

SEQ ID NO: 1704121 - RNA, 22 nt, Human
uaucaucaguauugaagcauuu

SEQ ID NO: 1704122 - RNA, 18 nt, Human
uauauuuuuauauuuacu

SEQ ID NO: 1704123 - RNA, 14 nt, Human
uauauuugaaauau

SEQ ID NO: 1704124 - RNA, 13 nt, Human
uauauuugaaaua

SEQ ID NO: 1704125 - RNA, 23 nt, Human
uauauuuauuacuguaagaaaau

SEQ ID NO: 1704126 - RNA, 20 nt, Human
uauauuuauuacuguaagaa

SEQ ID NO: 1704127 - RNA, 18 nt, Human
uauaugcuauuucuauau

SEQ ID NO: 1704128 - RNA, 16 nt, Human
uauaugcuauuucuau

SEQ ID NO: 1704129 - RNA, 14 nt, Human
uagagaguguugaa

SEQ ID NO: 1704130 - RNA, 15 nt, Human
uagagaguguugaaa

SEQ ID NO: 1704131 - RNA, 18 nt, Human
uagaguuuagcuggaaaa

SEQ ID NO: 1704132 - RNA, 17 nt, Human
uagaguuuagcuggaaa

SEQ ID NO: 1704133 - RNA, 18 nt, Human
uagacuggugacugauuc

SEQ ID NO: 1704134 - RNA, 17 nt, Human
uagacuggugacugauu

SEQ ID NO: 1704135 - RNA, 14 nt, Human
uagacuggugacug

SEQ ID NO: 1704136 - RNA, 13 nt, Human
uagacuggugacu

SEQ ID NO: 1704137 - RNA, 20 nt, Human
uagauguauguacuucaugc

SEQ ID NO: 1704138 - RNA, 16 nt, Human
uagauguauguacuuc

SEQ ID NO: 1704139 - RNA, 16 nt, Human
uaggccaugggacagg

SEQ ID NO: 1704140 - RNA, 13 nt, Human
uaggccaugggac

SEQ ID NO: 1704141 - RNA, 20 nt, Human
uaggaauugacccacaagaa

SEQ ID NO: 1704142 - RNA, 23 nt, Human
uaggaauugacccacaagaaaug

SEQ ID NO: 1704143 - RNA, 13 nt, Human
uaauuuuggaauu

SEQ ID NO: 1704144 - RNA, 12 nt, Human
uaauuuuggaau

SEQ ID NO: 1704145 - RNA, 18 nt, Human
uacaauuuuguuucugua

SEQ ID NO: 1704146 - RNA, 21 nt, Human
uacaauuuuguuucuguacuu

SEQ ID NO: 1704147 - RNA, 19 nt, Human
uacaauuuuguuucuguac

SEQ ID NO: 1704148 - RNA, 13 nt, Human
uacagaauuuuau

SEQ ID NO: 1704149 - RNA, 14 nt, Human
uacaggauuugaaa

SEQ ID NO: 1704150 - RNA, 16 nt, Human
uacauuuguauaaaau

SEQ ID NO: 1704151 - RNA, 11 nt, Human
uacauuugugu

SEQ ID NO: 1704152 - RNA, 17 nt, Human
uacauuuguauaaaaua

SEQ ID NO: 1704153 - RNA, 22 nt, Human
uacaugagguacugagagugaa

SEQ ID NO: 1704154 - RNA, 21 nt, Human
uacaugagguacugagaguga

SEQ ID NO: 1704155 - RNA, 23 nt, Human
uaccacaggaaccacaagacugc

SEQ ID NO: 1704156 - RNA, 20 nt, Human
uaauuaacauguuaaaccau

SEQ ID NO: 1704157 - RNA, 19 nt, Human
uaauuaacauguuaaacca

SEQ ID NO: 1704158 - RNA, 18 nt, Human
uaauuaacauguuaaacc

SEQ ID NO: 1704159 - RNA, 17 nt, Human
uaauuaacauguuaaac

SEQ ID NO: 1704160 - RNA, 15 nt, Human
uaauuaacauguuaa

SEQ ID NO: 1704161 - RNA, 14 nt, Human
uaauuaacauguua

SEQ ID NO: 1704162 - RNA, 12 nt, Human
uaauuaacaugu

SEQ ID NO: 1704163 - RNA, 15 nt, Human
uaauguuucaaacau

SEQ ID NO: 1704164 - RNA, 14 nt, Human
uaauguuucaaaca

SEQ ID NO: 1704165 - RNA, 23 nt, Human
uaauuuguaguguuggagaagaa

SEQ ID NO: 1704166 - RNA, 20 nt, Human
uaauuuguaguguuggagaa

SEQ ID NO: 1704167 - RNA, 22 nt, Human
uaauuggaaaggcagcucuaaa

SEQ ID NO: 1704168 - RNA, 18 nt, Human
uaauaaggaaaaguuuaa

SEQ ID NO: 1704169 - RNA, 20 nt, Human
uaauaaggaaaaguuuaaua

SEQ ID NO: 1704170 - RNA, 17 nt, Human
uaauaaagaucauguaa

SEQ ID NO: 1704171 - RNA, 16 nt, Human
uaauaaagaucaugua

SEQ ID NO: 1704172 - RNA, 23 nt, Human
uaauaauuauaugcuauuucuau

SEQ ID NO: 1704173 - RNA, 22 nt, Human
uaauaauuauaugcuauuucua

SEQ ID NO: 1704174 - RNA, 20 nt, Human
uaauaauuauaugcuauuuc

SEQ ID NO: 1704175 - RNA, 19 nt, Human
uaauaauuauaugcuauuu

SEQ ID NO: 1704176 - RNA, 16 nt, Human
uaauaauuauaugcua

SEQ ID NO: 1704177 - RNA, 15 nt, Human
uaauaauuauaugcu

SEQ ID NO: 1704178 - RNA, 15 nt, Human
uaauaauguuucaaa

SEQ ID NO: 1704179 - RNA, 23 nt, Human
uaauccucucaaccaccuuucag

SEQ ID NO: 1704180 - RNA, 14 nt, Human
uaauauuaaagcca

SEQ ID NO: 1704181 - RNA, 13 nt, Human
uaauauuaaagcc

SEQ ID NO: 1704182 - RNA, 12 nt, Human
uaauauuaaagc

SEQ ID NO: 1704183 - RNA, 19 nt, Human
uaaugccacuaaauugaca

SEQ ID NO: 1704184 - RNA, 23 nt, Human
uaagcauauauuuuuauauuuac

SEQ ID NO: 1704185 - RNA, 19 nt, Human
uaagcauauauuuuuauau

SEQ ID NO: 1704186 - RNA, 16 nt, Human
uaagcauauauuuuua

SEQ ID NO: 1704187 - RNA, 22 nt, Human
uaagcauauauuuuuauauuua

SEQ ID NO: 1704188 - RNA, 21 nt, Human
uaagcauauauuuuuauauuu

SEQ ID NO: 1704189 - RNA, 13 nt, Human
uaagccagacauc

SEQ ID NO: 1704190 - RNA, 20 nt, Human
uaagcauuccaacuaucuca

SEQ ID NO: 1704191 - RNA, 18 nt, Human
uaagcauuccaacuaucu

SEQ ID NO: 1704192 - RNA, 16 nt, Human
uaagcauuccaacuau

SEQ ID NO: 1704193 - RNA, 21 nt, Human
uaagccagacaucaacagaua

SEQ ID NO: 1704194 - RNA, 20 nt, Human
uaagccagacaucaacagau

SEQ ID NO: 1704195 - RNA, 17 nt, Human
uaacauguuaaaccaug

SEQ ID NO: 1704196 - RNA, 16 nt, Human
uaacauguuaaaccau

SEQ ID NO: 1704197 - RNA, 18 nt, Human
uaacauguuaaaccaugg

SEQ ID NO: 1704198 - RNA, 19 nt, Human
uaaaucccauuauucaaag

SEQ ID NO: 1704199 - RNA, 17 nt, Human
uaaaucccauuauucaa

SEQ ID NO: 1704200 - RNA, 16 nt, Human
uaaaucccauuauuca

SEQ ID NO: 1704201 - RNA, 23 nt, Human
uaaauccauuuggaaaucuuuaa

SEQ ID NO: 1704202 - RNA, 22 nt, Human
uaaauccauuuggaaaucuuua

SEQ ID NO: 1704203 - RNA, 19 nt, Human
uaaauccauuuggaaaucu

SEQ ID NO: 1704204 - RNA, 18 nt, Human
uaaauccauuuggaaauc

SEQ ID NO: 1704205 - RNA, 14 nt, Human
uaaauccauuugga

SEQ ID NO: 1704206 - RNA, 16 nt, Human
uaaauccauuuggaaa

SEQ ID NO: 1704207 - RNA, 15 nt, Human
uaaauccauuuggaa

SEQ ID NO: 1704208 - RNA, 18 nt, Human
uaaauauaugcuaagucu

SEQ ID NO: 1704209 - RNA, 23 nt, Human
uaaaguugaauuuauuggcuuuu

SEQ ID NO: 1704210 - RNA, 21 nt, Human
uaaaguugaauuuauuggcuu

SEQ ID NO: 1704211 - RNA, 19 nt, Human
uaaaguugaauuuauuggc

SEQ ID NO: 1704212 - RNA, 17 nt, Human
uaaaguugaauuuauug

SEQ ID NO: 1704213 - RNA, 15 nt, Human
uaaaguugaauuuau

SEQ ID NO: 1704214 - RNA, 14 nt, Human
uaaaguugaauuua

SEQ ID NO: 1704215 - RNA, 13 nt, Human
uaaaguugaauuu

SEQ ID NO: 1704216 - RNA, 17 nt, Human
uaaauaaaaauaauccu

SEQ ID NO: 1704217 - RNA, 15 nt, Human
uaaacuuuucugaua

SEQ ID NO: 1704218 - RNA, 14 nt, Human
uaaacuuuucugau

SEQ ID NO: 1704219 - RNA, 13 nt, Human
uaaacuuuucuga

SEQ ID NO: 1704220 - RNA, 14 nt, Human
uaaaggaauuuaaa

SEQ ID NO: 1704221 - RNA, 13 nt, Human
uaaacuuucacac

SEQ ID NO: 1704222 - RNA, 12 nt, Human
uaaacuuucaca

SEQ ID NO: 1704223 - RNA, 15 nt, Human
uaaaaaugguuuaaa

SEQ ID NO: 1704224 - RNA, 18 nt, Human
uaaaauccauacauuugu

SEQ ID NO: 1704225 - RNA, 19 nt, Human
uaaaauccauacauuugug

SEQ ID NO: 1704226 - RNA, 18 nt, Human
guuuagucuugucucaga

SEQ ID NO: 1704227 - RNA, 14 nt, Human
guuuagucuugucu

SEQ ID NO: 1704228 - RNA, 17 nt, Human
guuuagaaagcuugccc

SEQ ID NO: 1704229 - RNA, 13 nt, Human
guuuagaaagcuu

SEQ ID NO: 1704230 - RNA, 23 nt, Human
guuugugcugguguaugugugaa

SEQ ID NO: 1704231 - RNA, 19 nt, Human
guuugagguuuuuaagccu

SEQ ID NO: 1704232 - RNA, 16 nt, Human
guuugagguuuuuaag

SEQ ID NO: 1704233 - RNA, 12 nt, Human
guuuguuuaguc

SEQ ID NO: 1704234 - RNA, 18 nt, Human
guuuucaggcuagaugua

SEQ ID NO: 1704235 - RNA, 16 nt, Human
uaaaaaagaaacauuu

SEQ ID NO: 1704236 - RNA, 13 nt, Human
ucauuauuuuauu

SEQ ID NO: 1704237 - RNA, 15 nt, Human
ucauuauuuuauuau

SEQ ID NO: 1704238 - RNA, 14 nt, Human
ucauuauuuuauua

SEQ ID NO: 1704239 - RNA, 22 nt, Human
ucauuauuuuauuaugaaacuu

SEQ ID NO: 1704240 - RNA, 19 nt, Human
ucauuauuuuauuaugaaa

SEQ ID NO: 1704241 - RNA, 18 nt, Human
ucauuauuuuauuaugaa

SEQ ID NO: 1704242 - RNA, 16 nt, Human
ucauuauuuuauuaug

SEQ ID NO: 1704243 - RNA, 22 nt, Human
uccagcagauuauucacugauu

SEQ ID NO: 1704244 - RNA, 17 nt, Human
uccagcagauuauucac

SEQ ID NO: 1704245 - RNA, 20 nt, Human
uccagcagauuauucacuga

SEQ ID NO: 1704246 - RNA, 14 nt, Human
uccagauccuggaa

SEQ ID NO: 1704247 - RNA, 17 nt, Human
uccagauccuggaaauc

SEQ ID NO: 1704248 - RNA, 16 nt, Human
uccagauccuggaaau

SEQ ID NO: 1704249 - RNA, 13 nt, Human
uccacuuggucug

SEQ ID NO: 1704250 - RNA, 12 nt, Human
uccacuuggucu

SEQ ID NO: 1704251 - RNA, 14 nt, Human
uccacuuggucugu

SEQ ID NO: 1704252 - RNA, 20 nt, Human
uccaagcauuuagauguaua

SEQ ID NO: 1704253 - RNA, 14 nt, Human
uccaccuacaugag

SEQ ID NO: 1704254 - RNA, 17 nt, Human
uccaagcauuuagaugu

SEQ ID NO: 1704255 - RNA, 23 nt, Human
uccaaacugacucuuaagaagac

SEQ ID NO: 1704256 - RNA, 16 nt, Human
ucacuuuuuuccacau

SEQ ID NO: 1704257 - RNA, 15 nt, Human
ucacuuuuuuccaca

SEQ ID NO: 1704258 - RNA, 13 nt, Human
ucacuuuuuucca

SEQ ID NO: 1704259 - RNA, 17 nt, Human
ucacuugucaauaaaau

SEQ ID NO: 1704260 - RNA, 13 nt, Human
ucagauaacuguu

SEQ ID NO: 1704261 - RNA, 15 nt, Human
ucagauaacuguuau

SEQ ID NO: 1704262 - RNA, 19 nt, Human
ucagacauagaauuaacac

SEQ ID NO: 1704263 - RNA, 22 nt, Human
ucagacauagaauuaacacaug

SEQ ID NO: 1704264 - RNA, 18 nt, Human
ucacucuccauuuaauaa

SEQ ID NO: 1704265 - RNA, 18 nt, Human
uaucugacaucucugcaa

SEQ ID NO: 1704266 - RNA, 15 nt, Human
uaucugaggaauucu

SEQ ID NO: 1704267 - RNA, 18 nt, Human
uaucugaagucagaucug

SEQ ID NO: 1704268 - RNA, 17 nt, Human
uaucugaagucagaucu

SEQ ID NO: 1704269 - RNA, 21 nt, Human
uauuucuaugaaauauuaugu

SEQ ID NO: 1704270 - RNA, 22 nt, Human
uauuucuaugaaauauuauguu

SEQ ID NO: 1704271 - RNA, 13 nt, Human
uauuuauuacugu

SEQ ID NO: 1704272 - RNA, 12 nt, Human
uauuuuaugauc

SEQ ID NO: 1704273 - RNA, 13 nt, Human
ucaaugcagcccc

SEQ ID NO: 1704274 - RNA, 19 nt, Human
ucacaggaaguagaggagg

SEQ ID NO: 1704275 - RNA, 23 nt, Human
ucacaggacagcccuucuuucca

SEQ ID NO: 1704276 - RNA, 19 nt, Human
ucaacuccaaacugacucu

SEQ ID NO: 1704277 - RNA, 17 nt, Human
ucucaaccaccuuucag

SEQ ID NO: 1704278 - RNA, 22 nt, Human
ucucagaaggcaaaugacuuug

SEQ ID NO: 1704279 - RNA, 21 nt, Human
ucucagaaggcaaaugacuuu

SEQ ID NO: 1704280 - RNA, 20 nt, Human
ucucagaaggcaaaugacuu

SEQ ID NO: 1704281 - RNA, 19 nt, Human
ucucagaaggcaaaugacu

SEQ ID NO: 1704282 - RNA, 21 nt, Human
ucuacacuaagagagaaugag

SEQ ID NO: 1704283 - RNA, 17 nt, Human
ucuacacuccagugaga

SEQ ID NO: 1704284 - RNA, 19 nt, Human
ucucugcaaucuucucaga

SEQ ID NO: 1704285 - RNA, 18 nt, Human
ucucuucacagucacauu

SEQ ID NO: 1704286 - RNA, 20 nt, Human
ucugaggaauucuguauaga

SEQ ID NO: 1704287 - RNA, 16 nt, Human
ucugacaucucugcaa

SEQ ID NO: 1704288 - RNA, 19 nt, Human
ucucuaggaaauauuuauu

SEQ ID NO: 1704289 - RNA, 13 nt, Human
ucucuaggaaaua

SEQ ID NO: 1704290 - RNA, 21 nt, Human
ucucagugucaaugcagcccc

SEQ ID NO: 1704291 - RNA, 23 nt, Human
ugaacacuccaauuaaggauuuu

SEQ ID NO: 1704292 - RNA, 22 nt, Human
ugaacacuccaauuaaggauuu

SEQ ID NO: 1704293 - RNA, 19 nt, Human
ugaacacuccaauuaagga

SEQ ID NO: 1704294 - RNA, 18 nt, Human
ugaacacuccaauuaagg

SEQ ID NO: 1704295 - RNA, 19 nt, Human
ugaaauggacuuuuguaca

SEQ ID NO: 1704296 - RNA, 22 nt, Human
ugaacuuguaaaggaauuuaaa

SEQ ID NO: 1704297 - RNA, 22 nt, Human
ugaaguccaagcauuuagaugu

SEQ ID NO: 1704298 - RNA, 21 nt, Human
ugaaguccaagcauuuagaug

SEQ ID NO: 1704299 - RNA, 18 nt, Human
ugaaacccugucucuacu

SEQ ID NO: 1704300 - RNA, 23 nt, Human
ugaaagcagggacuugaacccau

SEQ ID NO: 1704301 - RNA, 19 nt, Human
ugaaagcagggacuugaac

SEQ ID NO: 1704302 - RNA, 18 nt, Human
ugaaagcagggacuugaa

SEQ ID NO: 1704303 - RNA, 19 nt, Human
ugaaaacuuuaugcuaagu

SEQ ID NO: 1704304 - RNA, 17 nt, Human
ucuuucacauuuaaaua

SEQ ID NO: 1704305 - RNA, 18 nt, Human
ucuguuauauaaaugguu

SEQ ID NO: 1704306 - RNA, 15 nt, Human
ucuguuauauaaaug

SEQ ID NO: 1704307 - RNA, 16 nt, Human
ucuguuuuaugacuuc

SEQ ID NO: 1704308 - RNA, 15 nt, Human
ucuguuuuaugacuu

SEQ ID NO: 1704309 - RNA, 13 nt, Human
ucuguuuuaugac

SEQ ID NO: 1704310 - RNA, 22 nt, Human
ucuguuuuauaauuuugugaag

SEQ ID NO: 1704311 - RNA, 17 nt, Human
ucuguuuuaugacuuca

SEQ ID NO: 1704312 - RNA, 23 nt, Human
ucuucucagaaggcaaaugacuu

SEQ ID NO: 1704313 - RNA, 21 nt, Human
ucuucucagaaggcaaaugac

SEQ ID NO: 1704314 - RNA, 22 nt, Human
ucuuguauuaagaaugaaauac

SEQ ID NO: 1704315 - RNA, 15 nt, Human
ucuugccuuuuucau

SEQ ID NO: 1704316 - RNA, 19 nt, Human
ucuuuaaaaaaaaaauugg

SEQ ID NO: 1704317 - RNA, 18 nt, Human
ucuuuaaaaaaaaaauug

SEQ ID NO: 1704318 - RNA, 19 nt, Human
ucuugucucagauuuuauu

SEQ ID NO: 1704319 - RNA, 17 nt, Human
ugcugaguuugugcugg

SEQ ID NO: 1704320 - RNA, 15 nt, Human
ugcugaguuugugcu

SEQ ID NO: 1704321 - RNA, 11 nt, Human
ugcucauggaa

SEQ ID NO: 1704322 - RNA, 21 nt, Human
ugcuagaacucccuuucaaca

SEQ ID NO: 1704323 - RNA, 20 nt, Human
ugcuagaacucccuuucaac

SEQ ID NO: 1704324 - RNA, 19 nt, Human
ugcuagaacucccuuucaa

SEQ ID NO: 1704325 - RNA, 23 nt, Human
ugccuaaggacuucuuuaauuuu

SEQ ID NO: 1704326 - RNA, 17 nt, Human
ugccuucucaacuccaa

SEQ ID NO: 1704327 - RNA, 22 nt, Human
ugccuucucaacuccaaacuga

SEQ ID NO: 1704328 - RNA, 23 nt, Human
ugcacggugaauggcuuuguaua

SEQ ID NO: 1704329 - RNA, 22 nt, Human
ugcacggugaauggcuuuguau

SEQ ID NO: 1704330 - RNA, 17 nt, Human
ugcagauaaacaguagu

SEQ ID NO: 1704331 - RNA, 16 nt, Human
ugcagauaaacaguag

SEQ ID NO: 1704332 - RNA, 19 nt, Human
ugaagucucugaagugaaa

SEQ ID NO: 1704333 - RNA, 15 nt, Human
ugcacaucaaaauau

SEQ ID NO: 1704334 - RNA, 21 nt, Human
ugcauuauauuuauuacugua

SEQ ID NO: 1704335 - RNA, 20 nt, Human
ugcauuauauuuauuacugu

SEQ ID NO: 1704336 - RNA, 15 nt, Human
ugcauuauauuuauu

SEQ ID NO: 1704337 - RNA, 15 nt, Human
uggcauaacauaaau

SEQ ID NO: 1704338 - RNA, 12 nt, Human
ugcuuucagaua

SEQ ID NO: 1704339 - RNA, 21 nt, Human
ugcuuucagauacuggauugu

SEQ ID NO: 1704340 - RNA, 20 nt, Human
ugcuuucagauacuggauug

SEQ ID NO: 1704341 - RNA, 17 nt, Human
ugcuuucagauacugga

SEQ ID NO: 1704342 - RNA, 16 nt, Human
ugcuuucagauacugg

SEQ ID NO: 1704343 - RNA, 12 nt, Human
ugcuuuaaacau

SEQ ID NO: 1704344 - RNA, 14 nt, Human
ugcuuguuuccuag

SEQ ID NO: 1704345 - RNA, 14 nt, Human
ugcuucuguuuuau

SEQ ID NO: 1704346 - RNA, 14 nt, Human
uggaacucucgagc

SEQ ID NO: 1704347 - RNA, 20 nt, Human
uggccuuucauauuuuagcu

SEQ ID NO: 1704348 - RNA, 20 nt, Human
uggccuucggccuccauccu

SEQ ID NO: 1704349 - RNA, 18 nt, Human
uggccuucggccuccauc

SEQ ID NO: 1704350 - RNA, 17 nt, Human
uggccuucggccuccau

SEQ ID NO: 1704351 - RNA, 15 nt, Human
uggcuguacccagga

SEQ ID NO: 1704352 - RNA, 22 nt, Human
uggcuuuguauagaaccucuuu

SEQ ID NO: 1704353 - RNA, 14 nt, Human
uggcuuuguauaga

SEQ ID NO: 1704354 - RNA, 21 nt, Human
ugggacagucaccucauggaa

SEQ ID NO: 1704355 - RNA, 20 nt, Human
ugggacagucaccucaugga

SEQ ID NO: 1704356 - RNA, 18 nt, Human
ugggacagucaccucaug

SEQ ID NO: 1704357 - RNA, 20 nt, Human
ugggacauuugcucauggaa

SEQ ID NO: 1704358 - RNA, 19 nt, Human
ugggacauuugcucaugga

SEQ ID NO: 1704359 - RNA, 16 nt, Human
uggguagacacacaug

SEQ ID NO: 1704360 - RNA, 17 nt, Human
uggguagacacacauga

SEQ ID NO: 1704361 - RNA, 21 nt, Human
uguuuguuuagucuugucuca

SEQ ID NO: 1704362 - RNA, 12 nt, Human
uguuuguuuagu

SEQ ID NO: 1704363 - RNA, 19 nt, Human
uuaacauguuaaaccaugg

SEQ ID NO: 1704364 - RNA, 18 nt, Human
uuaacauguuaaaccaug

SEQ ID NO: 1704365 - RNA, 12 nt, Human
uuaacauguuaa

SEQ ID NO: 1704366 - RNA, 19 nt, Human
uuaaaagaaugauuaugaa

SEQ ID NO: 1704367 - RNA, 18 nt, Human
uuaauaauuauaugcuau

SEQ ID NO: 1704368 - RNA, 18 nt, Human
uuaauaauguuucaaaca

SEQ ID NO: 1704369 - RNA, 23 nt, Human
uuaauaauuauaugcuauuucua

SEQ ID NO: 1704370 - RNA, 20 nt, Human
uuaauaauuauaugcuauuu

SEQ ID NO: 1704371 - RNA, 20 nt, Human
uuaaggauuuuaugcuuuaa

SEQ ID NO: 1704372 - RNA, 18 nt, Human
uuaaggauuuuaugcuuu

SEQ ID NO: 1704373 - RNA, 16 nt, Human
uuaauaauguuucaaa

SEQ ID NO: 1704374 - RNA, 15 nt, Human
uuaaggauuuuaugc

SEQ ID NO: 1704375 - RNA, 13 nt, Human
uuaaggauuuuau

SEQ ID NO: 1704376 - RNA, 18 nt, Human
uuaauaucaucaguauug

SEQ ID NO: 1704377 - RNA, 22 nt, Human
uuaaugucaauucuugccaaau

SEQ ID NO: 1704378 - RNA, 21 nt, Human
uuaccacuuguguuuugcaag

SEQ ID NO: 1704379 - RNA, 15 nt, Human
uuacauuuguauaaa

SEQ ID NO: 1704380 - RNA, 14 nt, Human
uuacauuuguauaa

SEQ ID NO: 1704381 - RNA, 20 nt, Human
uuacagagacagaaagcaga

SEQ ID NO: 1704382 - RNA, 14 nt, Human
uguuguuuguuuag

SEQ ID NO: 1704383 - RNA, 21 nt, Human
uguuggagaagaacugaaauc

SEQ ID NO: 1704384 - RNA, 23 nt, Human
uguugaaacggaugauuucuaug

SEQ ID NO: 1704385 - RNA, 22 nt, Human
uguugaaacggaugauuucuau

SEQ ID NO: 1704386 - RNA, 21 nt, Human
uguugaaacggaugauuucua

SEQ ID NO: 1704387 - RNA, 20 nt, Human
uguugaaacggaugauuucu

SEQ ID NO: 1704388 - RNA, 16 nt, Human
uguuagaucuaguuca

SEQ ID NO: 1704389 - RNA, 12 nt, Human
uguuauaaucuu

SEQ ID NO: 1704390 - RNA, 23 nt, Human
uguuaaaccaugggauaaaugcc

SEQ ID NO: 1704391 - RNA, 21 nt, Human
uguuaaaccaugggauaaaug

SEQ ID NO: 1704392 - RNA, 20 nt, Human
uguuaaaccaugggauaaau

SEQ ID NO: 1704393 - RNA, 18 nt, Human
uguuaaaccaugggauaa

SEQ ID NO: 1704394 - RNA, 16 nt, Human
uguuaaaccaugggau

SEQ ID NO: 1704395 - RNA, 17 nt, Human
ugugugaagugagugag

SEQ ID NO: 1704396 - RNA, 16 nt, Human
uguauagaaccucuuu

SEQ ID NO: 1704397 - RNA, 16 nt, Human
uguaugauucccagcc

SEQ ID NO: 1704398 - RNA, 14 nt, Human
uguauuuguuugca

SEQ ID NO: 1704399 - RNA, 13 nt, Human
uguacucaauuuu

SEQ ID NO: 1704400 - RNA, 17 nt, Human
uguagauaauacaguuc

SEQ ID NO: 1704401 - RNA, 15 nt, Human
uguaccgcaauguga

SEQ ID NO: 1704402 - RNA, 15 nt, Human
uguaaucacagcuac

SEQ ID NO: 1704403 - RNA, 23 nt, Human
ugugcgcuaaacuuuucugauag

SEQ ID NO: 1704404 - RNA, 22 nt, Human
ugugcgcuaaacuuuucugaua

SEQ ID NO: 1704405 - RNA, 19 nt, Human
ugugcgcuaaacuuuucug

SEQ ID NO: 1704406 - RNA, 14 nt, Human
ugugcgcuaaacuu

SEQ ID NO: 1704407 - RNA, 22 nt, Human
ugucucaguccaugaagaugua

SEQ ID NO: 1704408 - RNA, 21 nt, Human
ugucucaguccaugaagaugu

SEQ ID NO: 1704409 - RNA, 22 nt, Human
ugugaccacugcagaagacagu

SEQ ID NO: 1704410 - RNA, 21 nt, Human
uugaaacggaugauuucuaug

SEQ ID NO: 1704411 - RNA, 20 nt, Human
uugaaacggaugauuucuau

SEQ ID NO: 1704412 - RNA, 22 nt, Human
uugaaacggaugauuucuaugc

SEQ ID NO: 1704413 - RNA, 18 nt, Human
uucuuguauuaagaauga

SEQ ID NO: 1704414 - RNA, 13 nt, Human
uucuuguauuaag

SEQ ID NO: 1704415 - RNA, 12 nt, Human
uucuuguauuaa

SEQ ID NO: 1704416 - RNA, 14 nt, Human
uucugagcauuuaa

SEQ ID NO: 1704417 - RNA, 12 nt, Human
uugaugaagaag

SEQ ID NO: 1704418 - RNA, 15 nt, Human
uugaggacacugaua

SEQ ID NO: 1704419 - RNA, 14 nt, Human
uugaggacacugau

SEQ ID NO: 1704420 - RNA, 15 nt, Human
uuggcuuuucugauc

SEQ ID NO: 1704421 - RNA, 22 nt, Human
uuggcuuuucugauccaguuuu

SEQ ID NO: 1704422 - RNA, 19 nt, Human
uuggcuuuucugauccagu

SEQ ID NO: 1704423 - RNA, 12 nt, Human
uugggaggcuga

SEQ ID NO: 1704424 - RNA, 16 nt, Human
uuguaaaggaauuuaa

SEQ ID NO: 1704425 - RNA, 21 nt, Human
uuggaccaaaaaccaguauug

SEQ ID NO: 1704426 - RNA, 15 nt, Human
uuggaaaucuuuaaa

SEQ ID NO: 1704427 - RNA, 12 nt, Human
uuggaaaucuuu

SEQ ID NO: 1704428 - RNA, 11 nt, Human
uucacugauuu

SEQ ID NO: 1704429 - RNA, 15 nt, Human
uuacuaaaauggacu

SEQ ID NO: 1704430 - RNA, 18 nt, Human
uuacuaaaauggacugug

SEQ ID NO: 1704431 - RNA, 17 nt, Human
uuacuaaaauggacugu

SEQ ID NO: 1704432 - RNA, 16 nt, Human
uuacuaaaauggacug

SEQ ID NO: 1704433 - RNA, 19 nt, Human
uuccacuuauaggaauuga

SEQ ID NO: 1704434 - RNA, 19 nt, Human
uuccuagcacacacuuuug

SEQ ID NO: 1704435 - RNA, 17 nt, Human
uuccuagcacacacuuu

SEQ ID NO: 1704436 - RNA, 19 nt, Human
uucggccuccauccugagg

SEQ ID NO: 1704437 - RNA, 18 nt, Human
uucggccuccauccugag

SEQ ID NO: 1704438 - RNA, 22 nt, Human
uucggccuccauccugaggcuc

SEQ ID NO: 1704439 - RNA, 21 nt, Human
uucuauauuuucauucuccua

SEQ ID NO: 1704440 - RNA, 18 nt, Human
uucuauauuuucauucuc

SEQ ID NO: 1704441 - RNA, 16 nt, Human
uucuauauuuucauuc

SEQ ID NO: 1704442 - RNA, 15 nt, Human
uucuauauuuucauu

SEQ ID NO: 1704443 - RNA, 14 nt, Human
uucuauauuuucau

SEQ ID NO: 1704444 - RNA, 11 nt, Human
uucuauauuuu

SEQ ID NO: 1704445 - RNA, 17 nt, Human
uucuaugcugaguuugu

SEQ ID NO: 1704446 - RNA, 23 nt, Human
uucucuccucuccccaugauguu

SEQ ID NO: 1704447 - RNA, 21 nt, Human
uuuauuggcuuuucugaucca

SEQ ID NO: 1704448 - RNA, 17 nt, Human
uuuauuggcuuuucuga

SEQ ID NO: 1704449 - RNA, 13 nt, Human
uuuaugauccagc

SEQ ID NO: 1704450 - RNA, 12 nt, Human
uuuagaaacaca

SEQ ID NO: 1704451 - RNA, 20 nt, Human
uuuagaaacacaacuauauu

SEQ ID NO: 1704452 - RNA, 18 nt, Human
uuucagauaacuguuauu

SEQ ID NO: 1704453 - RNA, 21 nt, Human
uuucagauaaucacaauacau

SEQ ID NO: 1704454 - RNA, 15 nt, Human
uuucagcagcugcag

SEQ ID NO: 1704455 - RNA, 15 nt, Human
uuucagauaaucaca

SEQ ID NO: 1704456 - RNA, 21 nt, Human
uuuccuagcacacacuuuugg

SEQ ID NO: 1704457 - RNA, 18 nt, Human
uuuccuagcacacacuuu

SEQ ID NO: 1704458 - RNA, 22 nt, Human
uuuccucaaaacuucagacaua

SEQ ID NO: 1704459 - RNA, 14 nt, Human
uuucucuuucguua

SEQ ID NO: 1704460 - RNA, 13 nt, Human
uuuuaugauccag

SEQ ID NO: 1704461 - RNA, 15 nt, Human
uuuuaugauccagca

SEQ ID NO: 1704462 - RNA, 13 nt, Human
uuuuccugaaaac

SEQ ID NO: 1704463 - RNA, 19 nt, Human
uuuguuguuuguuuagucu

SEQ ID NO: 1704464 - RNA, 10 nt, Human
uuuuauauuu

SEQ ID NO: 1704465 - RNA, 20 nt, Human
uuuuauaucaauuuaaaaaa

SEQ ID NO: 1704466 - RNA, 20 nt, Human
uuuuauaugcuucuguuuua

SEQ ID NO: 1704467 - RNA, 15 nt, Human
uuuuauaugcuucug

SEQ ID NO: 1704468 - RNA, 14 nt, Human
uuuguuguuuguuu

SEQ ID NO: 1704469 - RNA, 12 nt, Human
uuuguuguuugu

SEQ ID NO: 1704470 - RNA, 12 nt, Human
uuuguguuagag

SEQ ID NO: 1704471 - RNA, 11 nt, Human
uuuguauagaa

SEQ ID NO: 1704472 - RNA, 21 nt, Human
uuuguauaaaauaauuuuuau

SEQ ID NO: 1704473 - RNA, 20 nt, Human
uuugguuaagucuguuuuau

SEQ ID NO: 1704474 - RNA, 19 nt, Human
uuugguuaagucuguuuua

SEQ ID NO: 1704475 - RNA, 18 nt, Human
uuugguuaagucuguuuu

SEQ ID NO: 1704476 - RNA, 22 nt, Human
uuugguuaagucuguuuuauga

SEQ ID NO: 1704477 - RNA, 16 nt, Human
uuuggaaaucuuuaaa

SEQ ID NO: 1704478 - RNA, 22 nt, Human
uuugcauaggugaucucauuua

SEQ ID NO: 1704479 - RNA, 20 nt, Human
uuugagguuuuuaagccuua

SEQ ID NO: 1704480 - RNA, 23 nt, Human
uuuuucuuaaauaauaaagauca

SEQ ID NO: 1704481 - RNA, 14 nt, Human
uuuuucuguuauau

SEQ ID NO: 1704482 - RNA, 14 nt, Human
cugcacggugaaug

SEQ ID NO: 1704483 - RNA, 15 nt, Human
cugcacggugaaugg

SEQ ID NO: 1704484 - RNA, 17 nt, Human
cugcacggugaauggcu

SEQ ID NO: 1704485 - RNA, 20 nt, Human
cugcacggugaauggcuuug

SEQ ID NO: 1704486 - RNA, 19 nt, Human
cugaugccaaguuguuuga

SEQ ID NO: 1704487 - RNA, 11 nt, Human
cuuaaaguuga

SEQ ID NO: 1704488 - RNA, 13 nt, Human
cuuaaaguugaau

SEQ ID NO: 1704489 - RNA, 14 nt, Human
cuuuaauuuuggaa

SEQ ID NO: 1704490 - RNA, 15 nt, Human
cuuuaauuuuggaau

SEQ ID NO: 1704491 - RNA, 13 nt, Human
cuuuaauuuugga

SEQ ID NO: 1704492 - RNA, 16 nt, Human
cuuuaauuuuggaauu

SEQ ID NO: 1704493 - RNA, 18 nt, Human
cuuuaauaucaucaguau

SEQ ID NO: 1704494 - RNA, 19 nt, Human
cuuuaauaucaucaguauu

SEQ ID NO: 1704495 - RNA, 21 nt, Human
cuuuaauaucaucaguauuga

SEQ ID NO: 1704496 - RNA, 13 nt, Human
cuuucagauacug

SEQ ID NO: 1704497 - RNA, 20 nt, Human
cuuucagauaacuguuauuu

SEQ ID NO: 1704498 - RNA, 17 nt, Human
gaucugccuaaggacuu

SEQ ID NO: 1704499 - RNA, 18 nt, Human
gaucugccuaaggacuuc

SEQ ID NO: 1704500 - RNA, 20 nt, Human
gaucugccuaaggacuucuu

SEQ ID NO: 1704501 - RNA, 21 nt, Human
gaucugccuaaggacuucuuu

SEQ ID NO: 1704502 - RNA, 23 nt, Human
gaucugccuaaggacuucuuuaa

SEQ ID NO: 1704503 - RNA, 22 nt, Human
gauuauucacugauuugacaua

SEQ ID NO: 1704504 - RNA, 21 nt, Human
gauuauucacugauuugacau

SEQ ID NO: 1704505 - RNA, 23 nt, Human
gauucuucagcaaaaauauuuua

SEQ ID NO: 1704506 - RNA, 18 nt, Human
gauuuuuuuguuguuugu

SEQ ID NO: 1704507 - RNA, 21 nt, Human
gauuuuuuuguuguuuguuua

SEQ ID NO: 1704508 - RNA, 21 nt, Human
gagugaguuggguguauugug

SEQ ID NO: 1704509 - RNA, 13 nt, Human
gacuguggugacu

SEQ ID NO: 1704510 - RNA, 14 nt, Human
gacuguggugacuu

SEQ ID NO: 1704511 - RNA, 21 nt, Human
ggcugaacacuccaauuaagg

SEQ ID NO: 1704512 - RNA, 15 nt, Human
gggauucuuaaaguu

SEQ ID NO: 1704513 - RNA, 20 nt, Human
gggauucuuaaaguugaauu

SEQ ID NO: 1704514 - RNA, 23 nt, Human
aaaggaagguucuggugugaacu

SEQ ID NO: 1704515 - RNA, 20 nt, Human
aaaggaagguucugguguga

SEQ ID NO: 1704516 - RNA, 17 nt, Human
aaacuuguguaaauaca

SEQ ID NO: 1704517 - RNA, 15 nt, Human
aaacuuguguaaaua

SEQ ID NO: 1704518 - RNA, 13 nt, Human
aaacuuuucugau

SEQ ID NO: 1704519 - RNA, 14 nt, Human
aaacuuuucugaua

SEQ ID NO: 1704520 - RNA, 12 nt, Human
aaacuuuucuga

SEQ ID NO: 1704521 - RNA, 16 nt, Human
aaacuuuucugauaga

SEQ ID NO: 1704522 - RNA, 17 nt, Human
aaacuuuucugauagag

SEQ ID NO: 1704523 - RNA, 18 nt, Human
aaacauugguucuuguau

SEQ ID NO: 1704524 - RNA, 20 nt, Human
aaacauugguucuuguauua

SEQ ID NO: 1704525 - RNA, 21 nt, Human
aaacauugguucuuguauuaa

SEQ ID NO: 1704526 - RNA, 17 nt, Human
aaacauugguucuugua

SEQ ID NO: 1704527 - RNA, 16 nt, Human
aaacuggguuccugca

SEQ ID NO: 1704528 - RNA, 15 nt, Human
aaacuggguuccugc

SEQ ID NO: 1704529 - RNA, 16 nt, Human
aaacggaugauuucua

SEQ ID NO: 1704530 - RNA, 18 nt, Human
aaacggaugauuucuaug

SEQ ID NO: 1704531 - RNA, 22 nt, Human
aaaauggacuguggugacuuug

SEQ ID NO: 1704532 - RNA, 21 nt, Human
aaaauuggggauucuuaaagu

SEQ ID NO: 1704533 - RNA, 23 nt, Human
aaaauuggggauucuuaaaguug

SEQ ID NO: 1704534 - RNA, 13 nt, Human
ggcaaaugacuuu

SEQ ID NO: 1704535 - RNA, 20 nt, Human
gcugaacacuccaauuaagg

SEQ ID NO: 1704536 - RNA, 21 nt, Human
gcugaacacuccaauuaagga

SEQ ID NO: 1704537 - RNA, 23 nt, Human
gcugaacacuccaauuaaggauu

SEQ ID NO: 1704538 - RNA, 19 nt, Human
cucagaaggcaaaugacuu

SEQ ID NO: 1704539 - RNA, 19 nt, Human
cgcugauaagcguucaugg

SEQ ID NO: 1704540 - RNA, 16 nt, Human
ccuaaggacuucuuua

SEQ ID NO: 1704541 - RNA, 17 nt, Human
ccuaaggacuucuuuaa

SEQ ID NO: 1704542 - RNA, 18 nt, Human
ccuaaggacuucuuuaau

SEQ ID NO: 1704543 - RNA, 23 nt, Human
ccuaaggacuucuuuaauuuugg

SEQ ID NO: 1704544 - RNA, 11 nt, Human
ccuaaggacuu

SEQ ID NO: 1704545 - RNA, 12 nt, Human
ccuaaggacuuc

SEQ ID NO: 1704546 - RNA, 19 nt, Human
ccaugggauaaaugccauc

SEQ ID NO: 1704547 - RNA, 14 nt, Human
ccaguauuguacaa

SEQ ID NO: 1704548 - RNA, 13 nt, Human
ccagacgaugucu

SEQ ID NO: 1704549 - RNA, 20 nt, Human
ccagacgaugucuucauacc

SEQ ID NO: 1704550 - RNA, 18 nt, Human
cagauacuggauuguacu

SEQ ID NO: 1704551 - RNA, 14 nt, Human
cagauacuggauug

SEQ ID NO: 1704552 - RNA, 15 nt, Human
cauuauucaaaguug

SEQ ID NO: 1704553 - RNA, 14 nt, Human
cauuauucaaaguu

SEQ ID NO: 1704554 - RNA, 14 nt, Human
cauugguucuugua

SEQ ID NO: 1704555 - RNA, 17 nt, Human
cauugguguuguacuca

SEQ ID NO: 1704556 - RNA, 16 nt, Human
cauaggugaucucauu

SEQ ID NO: 1704557 - RNA, 15 nt, Human
auuauguaaauccca

SEQ ID NO: 1704558 - RNA, 17 nt, Human
auuauguaaaucccauu

SEQ ID NO: 1704559 - RNA, 22 nt, Human
auuauguaaaucccauuauuca

SEQ ID NO: 1704560 - RNA, 23 nt, Human
auuauguaaaucccauuauucaa

SEQ ID NO: 1704561 - RNA, 13 nt, Human
auuauguaaaucc

SEQ ID NO: 1704562 - RNA, 14 nt, Human
auuauguaaauccc

SEQ ID NO: 1704563 - RNA, 18 nt, Human
auuuuuuuguuguuuguu

SEQ ID NO: 1704564 - RNA, 20 nt, Human
auuuuuuuucuguuauauaa

SEQ ID NO: 1704565 - RNA, 18 nt, Human
auuuuuuuucuguuauau

SEQ ID NO: 1704566 - RNA, 19 nt, Human
auuuuuuuucuguuauaua

SEQ ID NO: 1704567 - RNA, 15 nt, Human
auuuuuuuucuguua

SEQ ID NO: 1704568 - RNA, 17 nt, Human
auuuuuuuucuguuaua

SEQ ID NO: 1704569 - RNA, 15 nt, Human
auuuaauaauuauau

SEQ ID NO: 1704570 - RNA, 18 nt, Human
auuuaauaauuauaugcu

SEQ ID NO: 1704571 - RNA, 13 nt, Human
auuuaauaauuau

SEQ ID NO: 1704572 - RNA, 21 nt, Human
cacuccaauuaaggauuuuau

SEQ ID NO: 1704573 - RNA, 22 nt, Human
cacuccaauuaaggauuuuaug

SEQ ID NO: 1704574 - RNA, 15 nt, Human
auguuuauuacagua

SEQ ID NO: 1704575 - RNA, 16 nt, Human
auguuuauuacaguau

SEQ ID NO: 1704576 - RNA, 18 nt, Human
auguuuauuacaguauaa

SEQ ID NO: 1704577 - RNA, 19 nt, Human
auguuuauuacaguauaau

SEQ ID NO: 1704578 - RNA, 22 nt, Human
auguuuauuacaguauaauuaa

SEQ ID NO: 1704579 - RNA, 23 nt, Human
auguuuauuacaguauaauuaac

SEQ ID NO: 1704580 - RNA, 19 nt, Human
uuuucugauccaguuuugu

SEQ ID NO: 1704581 - RNA, 14 nt, Human
uuuucuuaaauaau

SEQ ID NO: 1704582 - RNA, 23 nt, Human
uuuucuuaaauaauaaagaucau

SEQ ID NO: 1704583 - RNA, 12 nt, Human
uuuucuguuaua

SEQ ID NO: 1704584 - RNA, 12 nt, Human
auguuuauuaca

SEQ ID NO: 1704585 - RNA, 16 nt, Human
uuugagaaauuaagua

SEQ ID NO: 1704586 - RNA, 12 nt, Human
uuugaauuuugu

SEQ ID NO: 1704587 - RNA, 14 nt, Human
uuugaauuuugugu

SEQ ID NO: 1704588 - RNA, 20 nt, Human
auuauaucugaggaauucug

SEQ ID NO: 1704589 - RNA, 21 nt, Human
auuauaucugaggaauucugu

SEQ ID NO: 1704590 - RNA, 22 nt, Human
auuauaucugaggaauucugua

SEQ ID NO: 1704591 - RNA, 16 nt, Human
auuauaugcuauuucu

SEQ ID NO: 1704592 - RNA, 18 nt, Human
auuauaucugaggaauuc

SEQ ID NO: 1704593 - RNA, 19 nt, Human
auuauaucugaggaauucu

SEQ ID NO: 1704594 - RNA, 19 nt, Human
auuauucaaaguugccuaa

SEQ ID NO: 1704595 - RNA, 22 nt, Human
auuauucaaaguugccuaaauc

SEQ ID NO: 1704596 - RNA, 18 nt, Human
auuauucaaaguugccua

SEQ ID NO: 1704597 - RNA, 24 nt, Human
auuauucaaaguugccuaaaucca

SEQ ID NO: 1704598 - RNA, 19 nt, Human
auuauucacugauuugaca

SEQ ID NO: 1704599 - RNA, 18 nt, Human
auuauaugcuauuucuau

SEQ ID NO: 1704600 - RNA, 17 nt, Human
auuauaugcuauuucua

SEQ ID NO: 1704601 - RNA, 19 nt, Human
auuauaugcuauuucuaua

SEQ ID NO: 1704602 - RNA, 12 nt, Human
auucacugauuu

SEQ ID NO: 1704603 - RNA, 17 nt, Human
auucacugauuugacau

SEQ ID NO: 1704604 - RNA, 20 nt, Human
uuuuuauauuuacuaaaaug

SEQ ID NO: 1704605 - RNA, 15 nt, Human
uuuuggaauuuuccu

SEQ ID NO: 1704606 - RNA, 15 nt, Human
auuaaggauuuuaug

SEQ ID NO: 1704607 - RNA, 17 nt, Human
auuaaggauuuuaugcu

SEQ ID NO: 1704608 - RNA, 20 nt, Human
auuaaggauuuuaugcuuua

SEQ ID NO: 1704609 - RNA, 17 nt, Human
auuaaguaucugacauc

SEQ ID NO: 1704610 - RNA, 23 nt, Human
uuuuuggcauaacauaaaucugu

SEQ ID NO: 1704611 - RNA, 24 nt, Human
uuuuuggcauaacauaaaucugug

SEQ ID NO: 1704612 - RNA, 14 nt, Human
auuggggauucuua

SEQ ID NO: 1704613 - RNA, 15 nt, Human
auuggggauucuuaa

SEQ ID NO: 1704614 - RNA, 16 nt, Human
auuggggauucuuaaa

SEQ ID NO: 1704615 - RNA, 20 nt, Human
auuggggauucuuaaaguug

SEQ ID NO: 1704616 - RNA, 21 nt, Human
auuggggauucuuaaaguuga

SEQ ID NO: 1704617 - RNA, 22 nt, Human
auuggggauucuuaaaguugaa

SEQ ID NO: 1704618 - RNA, 16 nt, Human
auuuacuaaaauggac

SEQ ID NO: 1704619 - RNA, 19 nt, Human
auuuacuaaaauggacugu

SEQ ID NO: 1704620 - RNA, 20 nt, Human
auuuacuaaaauggacugug

SEQ ID NO: 1704621 - RNA, 15 nt, Human
auuguacuuugugcu

SEQ ID NO: 1704622 - RNA, 14 nt, Human
auuuauuggcuuuu

SEQ ID NO: 1704623 - RNA, 18 nt, Human
auuuauuggcuuuucuga

SEQ ID NO: 1704624 - RNA, 20 nt, Human
auuuauuggcuuuucugauc

SEQ ID NO: 1704625 - RNA, 23 nt, Human
auuuauuggcuuuucugauccag

SEQ ID NO: 1704626 - RNA, 13 nt, Human
auuugaauuuugu

SEQ ID NO: 1704627 - RNA, 14 nt, Human
augccaucaauaaa

SEQ ID NO: 1704628 - RNA, 15 nt, Human
uuuagucuugucuca

SEQ ID NO: 1704629 - RNA, 17 nt, Human
uuuagucuugucucaga

SEQ ID NO: 1704630 - RNA, 23 nt, Human
uuuagucuugucucagauuuuau

SEQ ID NO: 1704631 - RNA, 16 nt, Human
aucugaagucagaucu

SEQ ID NO: 1704632 - RNA, 17 nt, Human
aucugaagucagaucug

SEQ ID NO: 1704633 - RNA, 18 nt, Human
aucugaagucagaucugc

SEQ ID NO: 1704634 - RNA, 23 nt, Human
aucugaagucagaucugccuaag

SEQ ID NO: 1704635 - RNA, 22 nt, Human
augaaauacuguuugagguuuu

SEQ ID NO: 1704636 - RNA, 16 nt, Human
uucauaccuacaugua

SEQ ID NO: 1704637 - RNA, 19 nt, Human
uucauaccuacauguauuu

SEQ ID NO: 1704638 - RNA, 19 nt, Human
auaucugaggaauucugua

SEQ ID NO: 1704639 - RNA, 20 nt, Human
auaucugaggaauucuguau

SEQ ID NO: 1704640 - RNA, 21 nt, Human
auaucugaggaauucuguaua

SEQ ID NO: 1704641 - RNA, 22 nt, Human
auaucugaggaauucuguauag

SEQ ID NO: 1704642 - RNA, 23 nt, Human
auaucugaggaauucuguauaga

SEQ ID NO: 1704643 - RNA, 15 nt, Human
auaucugaggaauuc

SEQ ID NO: 1704644 - RNA, 16 nt, Human
auaucugaggaauucu

SEQ ID NO: 1704645 - RNA, 17 nt, Human
auaucugaggaauucug

SEQ ID NO: 1704646 - RNA, 18 nt, Human
auaucugaggaauucugu

SEQ ID NO: 1704647 - RNA, 21 nt, Human
uucagcaaaaauauuuuauga

SEQ ID NO: 1704648 - RNA, 17 nt, Human
auauaaaugguuaaaag

SEQ ID NO: 1704649 - RNA, 18 nt, Human
auagcuagacuggugacu

SEQ ID NO: 1704650 - RNA, 19 nt, Human
auagcuagacuggugacug

SEQ ID NO: 1704651 - RNA, 23 nt, Human
auagcuagacuggugacugauuc

SEQ ID NO: 1704652 - RNA, 14 nt, Human
auagcuagacuggu

SEQ ID NO: 1704653 - RNA, 15 nt, Human
auagcuagacuggug

SEQ ID NO: 1704654 - RNA, 16 nt, Human
auagcuagacugguga

SEQ ID NO: 1704655 - RNA, 17 nt, Human
uuauuuauaaucacuuu

SEQ ID NO: 1704656 - RNA, 12 nt, Human
uucuggugugaa

SEQ ID NO: 1704657 - RNA, 15 nt, Human
aucaucaguauugaa

SEQ ID NO: 1704658 - RNA, 19 nt, Human
aucaucaguauugaagcau

SEQ ID NO: 1704659 - RNA, 17 nt, Human
aucaucaguauugaagc

SEQ ID NO: 1704660 - RNA, 15 nt, Human
aucaguauugaagca

SEQ ID NO: 1704661 - RNA, 22 nt, Human
aucaguauugaagcauuuuaua

SEQ ID NO: 1704662 - RNA, 17 nt, Human
auauuuuaugauccagc

SEQ ID NO: 1704663 - RNA, 22 nt, Human
auauuuuaugauccagcagauu

SEQ ID NO: 1704664 - RNA, 12 nt, Human
auauuuuaugau

SEQ ID NO: 1704665 - RNA, 13 nt, Human
auauuuuaugauc

SEQ ID NO: 1704666 - RNA, 13 nt, Human
auauuuucauucu

SEQ ID NO: 1704667 - RNA, 14 nt, Human
auauuaaagccaug

SEQ ID NO: 1704668 - RNA, 15 nt, Human
auauuaaagccaugu

SEQ ID NO: 1704669 - RNA, 18 nt, Human
auauuaaagccauguuua

SEQ ID NO: 1704670 - RNA, 23 nt, Human
auauuaaagccauguuuauuaca

SEQ ID NO: 1704671 - RNA, 18 nt, Human
ugugcugggguuaucuga

SEQ ID NO: 1704672 - RNA, 13 nt, Human
agugaaacugcuu

SEQ ID NO: 1704673 - RNA, 21 nt, Human
agugaaacugcuuguuuccua

SEQ ID NO: 1704674 - RNA, 24 nt, Human
agugaaacugcuuguuuccuagca

SEQ ID NO: 1704675 - RNA, 14 nt, Human
ugugaacuugaaau

SEQ ID NO: 1704676 - RNA, 15 nt, Human
ugugaacuugaaauu

SEQ ID NO: 1704677 - RNA, 16 nt, Human
ugugaacuugaaauuu

SEQ ID NO: 1704678 - RNA, 12 nt, Human
ugugaacuugaa

SEQ ID NO: 1704679 - RNA, 14 nt, Human
uguuauauaaaugg

SEQ ID NO: 1704680 - RNA, 13 nt, Human
uguuauauaaaug

SEQ ID NO: 1704681 - RNA, 19 nt, Human
agugaguuggguguauugu

SEQ ID NO: 1704682 - RNA, 20 nt, Human
agugaguuggguguauugug

SEQ ID NO: 1704683 - RNA, 14 nt, Human
uuaacaacagcugg

SEQ ID NO: 1704684 - RNA, 16 nt, Human
uuaaauaauaaagauc

SEQ ID NO: 1704685 - RNA, 22 nt, Human
uuaaaggaagguucugguguga

SEQ ID NO: 1704686 - RNA, 20 nt, Human
uuaaaggaagguucuggugu

SEQ ID NO: 1704687 - RNA, 15 nt, Human
aguuuaauauuaaag

SEQ ID NO: 1704688 - RNA, 16 nt, Human
aguuuaauauuaaagc

SEQ ID NO: 1704689 - RNA, 18 nt, Human
aguuuaauauuaaagcca

SEQ ID NO: 1704690 - RNA, 19 nt, Human
aguuuaauauuaaagccau

SEQ ID NO: 1704691 - RNA, 20 nt, Human
aguuuaauauuaaagccaug

SEQ ID NO: 1704692 - RNA, 17 nt, Human
aguuggguguauugugc

SEQ ID NO: 1704693 - RNA, 20 nt, Human
aguuggguguauugugcgcu

SEQ ID NO: 1704694 - RNA, 16 nt, Human
aguuggguguauugug

SEQ ID NO: 1704695 - RNA, 19 nt, Human
aguugccuaaauccauuug

SEQ ID NO: 1704696 - RNA, 22 nt, Human
aguugccuaaauccauuuggaa

SEQ ID NO: 1704697 - RNA, 23 nt, Human
aguugccuaaauccauuuggaaa

SEQ ID NO: 1704698 - RNA, 19 nt, Human
uguuuggaccaaaaaccag

SEQ ID NO: 1704699 - RNA, 18 nt, Human
uguuuuaugacuucauua

SEQ ID NO: 1704700 - RNA, 23 nt, Human
uguuuagucuugucucagauuuu

SEQ ID NO: 1704701 - RNA, 20 nt, Human
uguuuagucuugucucagau

SEQ ID NO: 1704702 - RNA, 22 nt, Human
uguuuagucuugucucagauuu

SEQ ID NO: 1704703 - RNA, 14 nt, Human
uguuuauuacagua

SEQ ID NO: 1704704 - RNA, 22 nt, Human
uguuugagguuuuuaagccuua

SEQ ID NO: 1704705 - RNA, 14 nt, Human
uguuugagaaauua

SEQ ID NO: 1704706 - RNA, 20 nt, Human
auaaaucugugaacuugaaa

SEQ ID NO: 1704707 - RNA, 21 nt, Human
auaaaucugugaacuugaaau

SEQ ID NO: 1704708 - RNA, 22 nt, Human
auaaaucugugaacuugaaauu

SEQ ID NO: 1704709 - RNA, 16 nt, Human
auaaauagcuagacug

SEQ ID NO: 1704710 - RNA, 18 nt, Human
auaaauagcuagacuggu

SEQ ID NO: 1704711 - RNA, 18 nt, Human
uuacaguauaauuaacau

SEQ ID NO: 1704712 - RNA, 19 nt, Human
uuacaguauaauuaacaug

SEQ ID NO: 1704713 - RNA, 20 nt, Human
uuacaguauaauuaacaugu

SEQ ID NO: 1704714 - RNA, 16 nt, Human
uuacaguauaauuaac

SEQ ID NO: 1704715 - RNA, 17 nt, Human
uuacaguauaauuaaca

SEQ ID NO: 1704716 - RNA, 13 nt, Human
uuacaguauaauu

SEQ ID NO: 1704717 - RNA, 22 nt, Human
auaaaugguuaaaagagguuuu

SEQ ID NO: 1704718 - RNA, 16 nt, Human
auaaaugguuaaaaga

SEQ ID NO: 1704719 - RNA, 21 nt, Human
uuaagucuguuuuaugacuuc

SEQ ID NO: 1704720 - RNA, 17 nt, Human
uuaagucuguuuuauga

SEQ ID NO: 1704721 - RNA, 18 nt, Human
uuaagucuguuuuaugac

SEQ ID NO: 1704722 - RNA, 20 nt, Human
uuaagucuguuuuaugacuu

SEQ ID NO: 1704723 - RNA, 13 nt, Human
agguuuuucuuaa

SEQ ID NO: 1704724 - RNA, 14 nt, Human
aguauugaagcauu

SEQ ID NO: 1704725 - RNA, 15 nt, Human
aguauugaagcauuu

SEQ ID NO: 1704726 - RNA, 18 nt, Human
aguauugaagcauuuuau

SEQ ID NO: 1704727 - RNA, 20 nt, Human
aguauugaagcauuuuauaa

SEQ ID NO: 1704728 - RNA, 21 nt, Human
aguauugaagcauuuuauaaa

SEQ ID NO: 1704729 - RNA, 16 nt, Human
uggugcccugcuuuca

SEQ ID NO: 1704730 - RNA, 19 nt, Human
uggugcccugcuuucagau

SEQ ID NO: 1704731 - RNA, 20 nt, Human
uggugcccugcuuucagaua

SEQ ID NO: 1704732 - RNA, 14 nt, Human
uggugcccugcuuu

SEQ ID NO: 1704733 - RNA, 14 nt, Human
uggugugaacuaaa

SEQ ID NO: 1704734 - RNA, 22 nt, Human
uggugugaacuaaacuuucaca

SEQ ID NO: 1704735 - RNA, 23 nt, Human
uggugugaacuaaacuuucacac

SEQ ID NO: 1704736 - RNA, 17 nt, Human
agguucuggugugaacu

SEQ ID NO: 1704737 - RNA, 15 nt, Human
uguaaauacaauuuu

SEQ ID NO: 1704738 - RNA, 22 nt, Human
ugcuauuucuauauuuucauuc

SEQ ID NO: 1704739 - RNA, 21 nt, Human
ugcuauuucuauauuuucauu

SEQ ID NO: 1704740 - RNA, 14 nt, Human
ugccaucaauaaaa

SEQ ID NO: 1704741 - RNA, 22 nt, Human
ugccaucaauaaaaaauuauga

SEQ ID NO: 1704742 - RNA, 13 nt, Human
aggaauucuguau

SEQ ID NO: 1704743 - RNA, 14 nt, Human
aggaauucuguaua

SEQ ID NO: 1704744 - RNA, 15 nt, Human
aggaauucuguauag

SEQ ID NO: 1704745 - RNA, 14 nt, Human
aggacuucuuuaau

SEQ ID NO: 1704746 - RNA, 16 nt, Human
aggacuucuuuaauuu

SEQ ID NO: 1704747 - RNA, 21 nt, Human
aggacuucuuuaauuuuggaa

SEQ ID NO: 1704748 - RNA, 22 nt, Human
aggacuucuuuaauuuuggaau

SEQ ID NO: 1704749 - RNA, 23 nt, Human
aggacuucuuuaauuuuggaauu

SEQ ID NO: 1704750 - RNA, 23 nt, Human
ugauuugacauagucuggcugua

SEQ ID NO: 1704751 - RNA, 20 nt, Human
ugauccagcagauuauucac

SEQ ID NO: 1704752 - RNA, 19 nt, Human
ugauccagcagauuauuca

SEQ ID NO: 1704753 - RNA, 13 nt, Human
agcauuuuauaaa

SEQ ID NO: 1704754 - RNA, 14 nt, Human
agcauuuuauaaau

SEQ ID NO: 1704755 - RNA, 15 nt, Human
agcauuuuauaaauc

SEQ ID NO: 1704756 - RNA, 20 nt, Human
agcauuuuauaaaucgcuuu

SEQ ID NO: 1704757 - RNA, 18 nt, Human
agcauauauuuuuauauu

SEQ ID NO: 1704758 - RNA, 20 nt, Human
agcauauauuuuuauauuua

SEQ ID NO: 1704759 - RNA, 22 nt, Human
agcauauauuuuuauauuuacu

SEQ ID NO: 1704760 - RNA, 15 nt, Human
agcauauauuuuuau

SEQ ID NO: 1704761 - RNA, 22 nt, Human
ugaauuuauuggcuuuucugau

SEQ ID NO: 1704762 - RNA, 23 nt, Human
ugaauuuauuggcuuuucugauc

SEQ ID NO: 1704763 - RNA, 17 nt, Human
ugaauuuauuggcuuuu

SEQ ID NO: 1704764 - RNA, 21 nt, Human
ugaauuuauuggcuuuucuga

SEQ ID NO: 1704765 - RNA, 17 nt, Human
ugaaauuugaauuuugu

SEQ ID NO: 1704766 - RNA, 14 nt, Human
ugaaauuugaauuu

SEQ ID NO: 1704767 - RNA, 15 nt, Human
ugaaauuugaauuuu

SEQ ID NO: 1704768 - RNA, 16 nt, Human
ugaaauuugaauuuug

SEQ ID NO: 1704769 - RNA, 21 nt, Human
ugaaauuguaauuauaucuga

SEQ ID NO: 1704770 - RNA, 20 nt, Human
ugaaauuguaauuauaucug

SEQ ID NO: 1704771 - RNA, 23 nt, Human
agagauuuuuuuguuguuuguuu

SEQ ID NO: 1704772 - RNA, 22 nt, Human
agagauuuuuuuguuguuuguu

SEQ ID NO: 1704773 - RNA, 12 nt, Human
agacuggugacu

SEQ ID NO: 1704774 - RNA, 13 nt, Human
agacuggugacug

SEQ ID NO: 1704775 - RNA, 14 nt, Human
agacuggugacuga

SEQ ID NO: 1704776 - RNA, 16 nt, Human
agacuggugacugauu

SEQ ID NO: 1704777 - RNA, 17 nt, Human
agacuggugacugauuc

SEQ ID NO: 1704778 - RNA, 14 nt, Human
ucuguacuuuuugg

SEQ ID NO: 1704779 - RNA, 17 nt, Human
ucuguacuuuuuggcau

SEQ ID NO: 1704780 - RNA, 13 nt, Human
ucuguacuuuuug

SEQ ID NO: 1704781 - RNA, 22 nt, Human
ucugugaacuugaaauuugaau

SEQ ID NO: 1704782 - RNA, 19 nt, Human
ucugugaacuugaaauuug

SEQ ID NO: 1704783 - RNA, 23 nt, Human
acuuguuagaucuaguucacucu

SEQ ID NO: 1704784 - RNA, 14 nt, Human
acuuguuagaucua

SEQ ID NO: 1704785 - RNA, 15 nt, Human
acuuguuagaucuag

SEQ ID NO: 1704786 - RNA, 20 nt, Human
acuugaaauuugaauuuugu

SEQ ID NO: 1704787 - RNA, 19 nt, Human
acuugaaauuugaauuuug

SEQ ID NO: 1704788 - RNA, 15 nt, Human
ucugaagucagaucu

SEQ ID NO: 1704789 - RNA, 19 nt, Human
ucugaagucagaucugccu

SEQ ID NO: 1704790 - RNA, 13 nt, Human
acugcuuguuucc

SEQ ID NO: 1704791 - RNA, 16 nt, Human
acugcuuguuuccuag

SEQ ID NO: 1704792 - RNA, 18 nt, Human
acuguggugacuuuggau

SEQ ID NO: 1704793 - RNA, 20 nt, Human
acuguggugacuuuggauaa

SEQ ID NO: 1704794 - RNA, 21 nt, Human
acuguggugacuuuggauaau

SEQ ID NO: 1704795 - RNA, 12 nt, Human
acuguggugacu

SEQ ID NO: 1704796 - RNA, 14 nt, Human
acuguggugacuuu

SEQ ID NO: 1704797 - RNA, 15 nt, Human
acuguggugacuuug

SEQ ID NO: 1704798 - RNA, 13 nt, Human
acuguuauuuaua

SEQ ID NO: 1704799 - RNA, 22 nt, Human
ucuaccagccucccuauuuuuu

SEQ ID NO: 1704800 - RNA, 18 nt, Human
uccauuuaauaauuauau

SEQ ID NO: 1704801 - RNA, 13 nt, Human
accuacauguauu

SEQ ID NO: 1704802 - RNA, 14 nt, Human
accuacauguauuu

SEQ ID NO: 1704803 - RNA, 15 nt, Human
accuacauguauuug

SEQ ID NO: 1704804 - RNA, 16 nt, Human
uauuucuauauuuuca

SEQ ID NO: 1704805 - RNA, 17 nt, Human
uauuucuauauuuucau

SEQ ID NO: 1704806 - RNA, 18 nt, Human
uauuucuauauuuucauu

SEQ ID NO: 1704807 - RNA, 18 nt, Human
acaguuuugguugcuuua

SEQ ID NO: 1704808 - RNA, 19 nt, Human
acaguuuugguugcuuuaa

SEQ ID NO: 1704809 - RNA, 24 nt, Human
acaguuuugguugcuuuaauauca

SEQ ID NO: 1704810 - RNA, 14 nt, Human
acauagucuggcug

SEQ ID NO: 1704811 - RNA, 15 nt, Human
acauagucuggcugu

SEQ ID NO: 1704812 - RNA, 20 nt, Human
acauagucuggcuguaccca

SEQ ID NO: 1704813 - RNA, 22 nt, Human
ucaaaguugccuaaauccauuu

SEQ ID NO: 1704814 - RNA, 18 nt, Human
ucaaaguugccuaaaucc

SEQ ID NO: 1704815 - RNA, 19 nt, Human
ucaaaguugccuaaaucca

SEQ ID NO: 1704816 - RNA, 21 nt, Human
ucaaaguugccuaaauccauu

SEQ ID NO: 1704817 - RNA, 16 nt, Human
uauuuuuauauuuacu

SEQ ID NO: 1704818 - RNA, 18 nt, Human
accccagacgaugucuuc

SEQ ID NO: 1704819 - RNA, 18 nt, Human
ucagaaggcaaaugacuu

SEQ ID NO: 1704820 - RNA, 19 nt, Human
ucagaaggcaaaugacuuu

SEQ ID NO: 1704821 - RNA, 22 nt, Human
ucagaaggcaaaugacuuugga

SEQ ID NO: 1704822 - RNA, 19 nt, Human
accaugggauaaaugccau

SEQ ID NO: 1704823 - RNA, 13 nt, Human
ucaauuuuaacaa

SEQ ID NO: 1704824 - RNA, 21 nt, Human
acaccccagacgaugucuuca

SEQ ID NO: 1704825 - RNA, 17 nt, Human
uagucuugucucagauu

SEQ ID NO: 1704826 - RNA, 22 nt, Human
uagucuugucucagauuuuauu

SEQ ID NO: 1704827 - RNA, 21 nt, Human
acacuccaauuaaggauuuua

SEQ ID NO: 1704828 - RNA, 18 nt, Human
acacuccaauuaaggauu

SEQ ID NO: 1704829 - RNA, 17 nt, Human
acacuccaauuaaggau

SEQ ID NO: 1704830 - RNA, 19 nt, Human
uacuuuuuggcauaacaua

SEQ ID NO: 1704831 - RNA, 20 nt, Human
uacuuuuuggcauaacauaa

SEQ ID NO: 1704832 - RNA, 14 nt, Human
uacuuuuuggcaua

SEQ ID NO: 1704833 - RNA, 16 nt, Human
uacuuugugcuggggu

SEQ ID NO: 1704834 - RNA, 22 nt, Human
uacuuugugcugggguuaucug

SEQ ID NO: 1704835 - RNA, 16 nt, Human
aauuuuguuucuguac

SEQ ID NO: 1704836 - RNA, 20 nt, Human
acaaaguauuaagcauauau

SEQ ID NO: 1704837 - RNA, 14 nt, Human
uagaucuaguucac

SEQ ID NO: 1704838 - RNA, 15 nt, Human
acaacagcuggugcc

SEQ ID NO: 1704839 - RNA, 15 nt, Human
uagcuagacugguga

SEQ ID NO: 1704840 - RNA, 18 nt, Human
uagcuagacuggugacug

SEQ ID NO: 1704841 - RNA, 15 nt, Human
uaaaucugugaacuu

SEQ ID NO: 1704842 - RNA, 16 nt, Human
uaaaucugugaacuug

SEQ ID NO: 1704843 - RNA, 17 nt, Human
uaaaucugugaacuuga

SEQ ID NO: 1704844 - RNA, 18 nt, Human
uaaaucugugaacuugaa

SEQ ID NO: 1704845 - RNA, 19 nt, Human
uaaaucugugaacuugaaa

SEQ ID NO: 1704846 - RNA, 21 nt, Human
uaaaucugugaacuugaaauu

SEQ ID NO: 1704847 - RNA, 22 nt, Human
uaaaucugugaacuugaaauuu

SEQ ID NO: 1704848 - RNA, 18 nt, Human
uaaauagcuagacuggug

SEQ ID NO: 1704849 - RNA, 17 nt, Human
uaaauaaauaaauagcu

SEQ ID NO: 1704850 - RNA, 14 nt, Human
uaaauaaauagcua

SEQ ID NO: 1704851 - RNA, 13 nt, Human
uaagaaugaaaua

SEQ ID NO: 1704852 - RNA, 15 nt, Human
uaagaaugaaauacu

SEQ ID NO: 1704853 - RNA, 21 nt, Human
uaagaaugaaauacuguuuga

SEQ ID NO: 1704854 - RNA, 17 nt, Human
aauauuuuaugauccag

SEQ ID NO: 1704855 - RNA, 18 nt, Human
aauauuuuaugauccagc

SEQ ID NO: 1704856 - RNA, 16 nt, Human
uaacauaaaucuguga

SEQ ID NO: 1704857 - RNA, 17 nt, Human
uaacauaaaucugugaa

SEQ ID NO: 1704858 - RNA, 18 nt, Human
uaacauaaaucugugaac

SEQ ID NO: 1704859 - RNA, 20 nt, Human
uaacauaaaucugugaacuu

SEQ ID NO: 1704860 - RNA, 15 nt, Human
uaacauaaaucugug

SEQ ID NO: 1704861 - RNA, 14 nt, Human
uaacauaaaucugu

SEQ ID NO: 1704862 - RNA, 18 nt, Human
aauaucaucaguauugaa

SEQ ID NO: 1704863 - RNA, 13 nt, Human
aaucugugaacuu

SEQ ID NO: 1704864 - RNA, 15 nt, Human
aaucugugaacuuga

SEQ ID NO: 1704865 - RNA, 17 nt, Human
aaucugugaacuugaaa

SEQ ID NO: 1704866 - RNA, 18 nt, Human
aaucugugaacuugaaau

SEQ ID NO: 1704867 - RNA, 19 nt, Human
aaucugugaacuugaaauu

SEQ ID NO: 1704868 - RNA, 15 nt, Human
uaaguaucugacauc

SEQ ID NO: 1704869 - RNA, 16 nt, Human
uaaguaucugacaucu

SEQ ID NO: 1704870 - RNA, 21 nt, Human
uaaucaacugggcugaacacu

SEQ ID NO: 1704871 - RNA, 19 nt, Human
aaucuuuaaaaaaaaaauu

SEQ ID NO: 1704872 - RNA, 20 nt, Human
aaucuuuaaaaaaaaaauug

SEQ ID NO: 1704873 - RNA, 16 nt, Human
uacaguauaauuaaca

SEQ ID NO: 1704874 - RNA, 17 nt, Human
uacaguauaauuaacau

SEQ ID NO: 1704875 - RNA, 14 nt, Human
uacaguauaauuaa

SEQ ID NO: 1704876 - RNA, 20 nt, Human
aauggacuguggugacuuug

SEQ ID NO: 1704877 - RNA, 18 nt, Human
uacaguauaauuaacaug

SEQ ID NO: 1704878 - RNA, 19 nt, Human
uacaguauaauuaacaugu

SEQ ID NO: 1704879 - RNA, 23 nt, Human
uacaguauaauuaacauguuaaa

SEQ ID NO: 1704880 - RNA, 19 nt, Human
aagaaugguccgugcuaag

SEQ ID NO: 1704881 - RNA, 22 nt, Human
aagaaugguccgugcuaaggac

SEQ ID NO: 1704882 - RNA, 16 nt, Human
aagagguuuuucuuaa

SEQ ID NO: 1704883 - RNA, 19 nt, Human
guguuguacucaauuuuaa

SEQ ID NO: 1704884 - RNA, 20 nt, Human
guuucuguacuuuuuggcau

SEQ ID NO: 1704885 - RNA, 15 nt, Human
guugccuaaauccau

SEQ ID NO: 1704886 - RNA, 16 nt, Human
guugccuaaauccauu

SEQ ID NO: 1704887 - RNA, 14 nt, Human
guugccuaaaucca

SEQ ID NO: 1704888 - RNA, 17 nt, Human
guucuuguauuaagaau

SEQ ID NO: 1704889 - RNA, 18 nt, Human
guucuuguauuaagaaug

SEQ ID NO: 1704890 - RNA, 21 nt, Human
guucuuguauuaagaaugaaa

SEQ ID NO: 1704891 - RNA, 15 nt, Human
guucuggugugaacu

SEQ ID NO: 1704892 - RNA, 18 nt, Human
guucuggugugaacuaaa

SEQ ID NO: 1704893 - RNA, 12 nt, Human
guuagaucuagu

SEQ ID NO: 1704894 - RNA, 15 nt, Human
guuaagucuguuuua

SEQ ID NO: 1704895 - RNA, 22 nt, Human
guuaagucuguuuuaugacuuc

SEQ ID NO: 1704896 - RNA, 13 nt, Human
guuaagucuguuu

SEQ ID NO: 1704897 - RNA, 20 nt, Human
guuauuuauaaucacuuuuu

SEQ ID NO: 1704898 - RNA, 14 nt, Human
guuauuuauaauca

SEQ ID NO: 1704899 - RNA, 17 nt, Human
aacacuccaauuaagga

SEQ ID NO: 1704900 - RNA, 13 nt, Human
aacuaaacuuuca

SEQ ID NO: 1704901 - RNA, 15 nt, Human
aacuaaacuuucaca

SEQ ID NO: 1704902 - RNA, 17 nt, Human
aacuaaacuuucacacc

SEQ ID NO: 1704903 - RNA, 15 nt, Human
aaccaugggauaaau

SEQ ID NO: 1704904 - RNA, 17 nt, Human
aaccaugggauaaaugc

SEQ ID NO: 1704905 - RNA, 18 nt, Human
aaccaugggauaaaugcc

SEQ ID NO: 1704906 - RNA, 20 nt, Human
aaccaugggauaaaugccau

SEQ ID NO: 1704907 - RNA, 21 nt, Human
aaccaugggauaaaugccauc

SEQ ID NO: 1704908 - RNA, 15 nt, Human
aaauccauuuggaaa

SEQ ID NO: 1704909 - RNA, 16 nt, Human
aaauccauuuggaaau

SEQ ID NO: 1704910 - RNA, 14 nt, Human
aaauccauuuggaa

SEQ ID NO: 1704911 - RNA, 18 nt, Human
aaauccauuuggaaaucu

SEQ ID NO: 1704912 - RNA, 21 nt, Human
aaauccauuuggaaaucuuua

SEQ ID NO: 1704913 - RNA, 22 nt, Human
aaauccauuuggaaaucuuuaa

SEQ ID NO: 1704914 - RNA, 23 nt, Human
aaauccauuuggaaaucuuuaaa

SEQ ID NO: 1704915 - RNA, 13 nt, Human
aaaucccauuauu

SEQ ID NO: 1704916 - RNA, 15 nt, Human
aaaucccauuauuca

SEQ ID NO: 1704917 - RNA, 16 nt, Human
aaaucccauuauucaa

SEQ ID NO: 1704918 - RNA, 17 nt, Human
aaaucccauuauucaaa

SEQ ID NO: 1704919 - RNA, 19 nt, Human
aaaucccauuauucaaagu

SEQ ID NO: 1704920 - RNA, 20 nt, Human
aaaucccauuauucaaaguu

SEQ ID NO: 1704921 - RNA, 21 nt, Human
aaaucccauuauucaaaguug

SEQ ID NO: 1704922 - RNA, 22 nt, Human
aaaucccauuauucaaaguugc

SEQ ID NO: 1704923 - RNA, 13 nt, Human
aaaucgcuuuuga

SEQ ID NO: 1704924 - RNA, 14 nt, Human
aaaucgcuuuugau

SEQ ID NO: 1704925 - RNA, 15 nt, Human
aaaucgcuuuugaua

SEQ ID NO: 1704926 - RNA, 13 nt, Human
guaugugugaagu

SEQ ID NO: 1704927 - RNA, 17 nt, Human
guaugugugaagugagu

SEQ ID NO: 1704928 - RNA, 18 nt, Human
aaauucccuggccuuuca

SEQ ID NO: 1704929 - RNA, 15 nt, Human
aaauucccuggccuu

SEQ ID NO: 1704930 - RNA, 14 nt, Human
aaaaguuuaauauu

SEQ ID NO: 1704931 - RNA, 16 nt, Human
aaaaguuuaauauuaa

SEQ ID NO: 1704932 - RNA, 18 nt, Human
aaaaguuuaauauuaaag

SEQ ID NO: 1704933 - RNA, 17 nt, Human
aaaagagguuuuucuua

SEQ ID NO: 1704934 - RNA, 21 nt, Human
aaaagagguuuuucuuaaaua

SEQ ID NO: 1704935 - RNA, 22 nt, Human
aaaagagguuuuucuuaaauaa

SEQ ID NO: 1704936 - RNA, 14 nt, Human
aaaccaguauugua

SEQ ID NO: 1704937 - RNA, 16 nt, Human
aaaccaguauuguaca

SEQ ID NO: 1704938 - RNA, 17 nt, Human
aaaccaguauuguacaa

SEQ ID NO: 1704939 - RNA, 18 nt, Human
aaaccaguauuguacaaa

SEQ ID NO: 1704940 - RNA, 22 nt, Human
aaaccaguauuguacaaaguau

SEQ ID NO: 1704941 - RNA, 17 nt, Human
aaagccauguuuauuac

SEQ ID NO: 1704942 - RNA, 18 nt, Human
aaagccauguuuauuaca

SEQ ID NO: 1704943 - RNA, 23 nt, Human
aaagccauguuuauuacaguaua

SEQ ID NO: 1704944 - RNA, 14 nt, Human
aaagccauguuuau

SEQ ID NO: 1704945 - RNA, 16 nt, Human
aaagccauguuuauua

SEQ ID NO: 1704946 - RNA, 15 nt, Human
aaagaucauguaaaa

SEQ ID NO: 1704947 - RNA, 21 nt, Human
aaauggacuguggugacuuug

SEQ ID NO: 1704948 - RNA, 20 nt, Human
aaauggacuguggugacuuu

SEQ ID NO: 1704949 - RNA, 23 nt, Human
aaauggacuguggugacuuugga

SEQ ID NO: 1704950 - RNA, 23 nt, Human
aaggacuuguuagaucuaguuca

SEQ ID NO: 1704951 - RNA, 15 nt, Human
aaggacuuguuagau

SEQ ID NO: 1704952 - RNA, 21 nt, Human
aaggacuuguuagaucuaguu

SEQ ID NO: 1704953 - RNA, 23 nt, Human
aaggacuucuuuaauuuuggaau

SEQ ID NO: 1704954 - RNA, 17 nt, Human
aaguuuaauauuaaagc

SEQ ID NO: 1704955 - RNA, 18 nt, Human
aaguuuaauauuaaagcc

SEQ ID NO: 1704956 - RNA, 15 nt, Human
aaguuuaauauuaaa

SEQ ID NO: 1704957 - RNA, 23 nt, Human
aaguugaauuuauuggcuuuucu

SEQ ID NO: 1704958 - RNA, 24 nt, Human
aaguugaauuuauuggcuuuucug

SEQ ID NO: 1704959 - RNA, 21 nt, Human
aaguuguuugagaaauuaagu

SEQ ID NO: 1704960 - RNA, 15 nt, Human
aaguuguuugagaaa

SEQ ID NO: 1704961 - RNA, 22 nt, Human
aaguuguuugagaaauuaagua

SEQ ID NO: 1704962 - RNA, 14 nt, Human
aaguugaauuuauu

SEQ ID NO: 1704963 - RNA, 15 nt, Human
aaguugaauuuauug

SEQ ID NO: 1704964 - RNA, 17 nt, Human
aaguugaauuuauuggc

SEQ ID NO: 1704965 - RNA, 20 nt, Human
aauaaagaucauguaaaagu

SEQ ID NO: 1704966 - RNA, 14 nt, Human
aauaaagaucaugu

SEQ ID NO: 1704967 - RNA, 19 nt, Human
aauaaagaucauguaaaag

SEQ ID NO: 1704968 - RNA, 22 nt, Human
aauauuaaagccauguuuauua

SEQ ID NO: 1704969 - RNA, 16 nt, Human
acauguuaaaccaugg

SEQ ID NO: 1704970 - RNA, 21 nt, Human
acauguuaaaccaugggauaa

SEQ ID NO: 1704971 - RNA, 23 nt, Human
acauguuaaaccaugggauaaau

SEQ ID NO: 1704972 - RNA, 14 nt, Human
acauguuaaaccau

SEQ ID NO: 1704973 - RNA, 17 nt, Human
aauuguaauuauaucug

SEQ ID NO: 1704974 - RNA, 15 nt, Human
aauuguaauuauauc

SEQ ID NO: 1704975 - RNA, 16 nt, Human
aauuguaauuauaucu

SEQ ID NO: 1704976 - RNA, 14 nt, Human
aauuguaauuauau

SEQ ID NO: 1704977 - RNA, 13 nt, Human
aauucuguauaga

SEQ ID NO: 1704978 - RNA, 14 nt, Human
aauucuguauagau

SEQ ID NO: 1704979 - RNA, 20 nt, Human
aauucuguauagauuagaga

SEQ ID NO: 1704980 - RNA, 12 nt, Human
aauucuguauag

SEQ ID NO: 1704981 - RNA, 15 nt, Human
aauuggggauucuua

SEQ ID NO: 1704982 - RNA, 20 nt, Human
aauuauaucugaggaauucu

SEQ ID NO: 1704983 - RNA, 22 nt, Human
aauuauaucugaggaauucugu

SEQ ID NO: 1704984 - RNA, 23 nt, Human
aauuauaucugaggaauucugua

SEQ ID NO: 1704985 - RNA, 19 nt, Human
aauuauaugcuauuucuau

SEQ ID NO: 1704986 - RNA, 20 nt, Human
aauuauaugcuauuucuaua

SEQ ID NO: 1704987 - RNA, 21 nt, Human
aauuauaugcuauuucuauau

SEQ ID NO: 1704988 - RNA, 19 nt, Human
acuucuuuaauuuuggaau

SEQ ID NO: 1704989 - RNA, 20 nt, Human
acuucuuuaauuuuggaauu

SEQ ID NO: 1704990 - RNA, 18 nt, Human
acuucuuuaauuuuggaa

SEQ ID NO: 1704991 - RNA, 18 nt, Human
acuggugacugauucuuc

SEQ ID NO: 1704992 - RNA, 19 nt, Human
acuggugacugauucuuca

SEQ ID NO: 1704993 - RNA, 16 nt, Human
acuggugacugauucu

SEQ ID NO: 1704994 - RNA, 20 nt, Human
acuggugacugauucuucag

SEQ ID NO: 1704995 - RNA, 22 nt, Human
acugauuugacauagucuggcu

SEQ ID NO: 1704996 - RNA, 14 nt, Human
aggaagguucuggu

SEQ ID NO: 1704997 - RNA, 16 nt, Human
aggaagguucuggugu

SEQ ID NO: 1704998 - RNA, 21 nt, Human
aggaagguucuggugugaacu

SEQ ID NO: 1704999 - RNA, 13 nt, Human
agaucugccuaag

SEQ ID NO: 1705000 - RNA, 18 nt, Human
agaucugccuaaggacuu

SEQ ID NO: 1705001 - RNA, 12 nt, Human
auacuguuugag

SEQ ID NO: 1705002 - RNA, 16 nt, Human
auacuguuugagguuu

SEQ ID NO: 1705003 - RNA, 20 nt, Human
auacuguuugagguuuuuaa

SEQ ID NO: 1705004 - RNA, 19 nt, Human
auaaagaucauguaaaagu

SEQ ID NO: 1705005 - RNA, 14 nt, Human
auacaauuuuguuu

SEQ ID NO: 1705006 - RNA, 16 nt, Human
auacaauuuuguuucu

SEQ ID NO: 1705007 - RNA, 17 nt, Human
auacaauuuuguuucug

SEQ ID NO: 1705008 - RNA, 18 nt, Human
auacaauuuuguuucugu

SEQ ID NO: 1705009 - RNA, 16 nt, Human
auaaaaaauuaugaca

SEQ ID NO: 1705010 - RNA, 19 nt, Human
agucuggcuguacccagga

SEQ ID NO: 1705011 - RNA, 21 nt, Human
agucuggcuguacccaggaau

SEQ ID NO: 1705012 - RNA, 18 nt, Human
augaaacuuguguaaaua

SEQ ID NO: 1705013 - RNA, 15 nt, Human
auggcuuuguauaga

SEQ ID NO: 1705014 - RNA, 16 nt, Human
auggcuuuguauagaa

SEQ ID NO: 1705015 - RNA, 18 nt, Human
auccagcagauuauucac

SEQ ID NO: 1705016 - RNA, 18 nt, Human
caaaguugccuaaaucca

SEQ ID NO: 1705017 - RNA, 15 nt, Human
caaaguugccuaaau

SEQ ID NO: 1705018 - RNA, 17 nt, Human
caaaguugccuaaaucc

SEQ ID NO: 1705019 - RNA, 14 nt, Human
caaaguugccuaaa

SEQ ID NO: 1705020 - RNA, 17 nt, Human
auuuuaacaacagcugg

SEQ ID NO: 1705021 - RNA, 12 nt, Human
cacacacuuuug

SEQ ID NO: 1705022 - RNA, 14 nt, Human
caauuuuguuucug

SEQ ID NO: 1705023 - RNA, 16 nt, Human
caauuuuguuucugua

SEQ ID NO: 1705024 - RNA, 17 nt, Human
caauuuuguuucuguac

SEQ ID NO: 1705025 - RNA, 13 nt, Human
caauuuuguuucu

SEQ ID NO: 1705026 - RNA, 20 nt, Human
cacaguuuugguugcuuuaa

SEQ ID NO: 1705027 - RNA, 23 nt, Human
cacaguuuugguugcuuuaauau

SEQ ID NO: 1705028 - RNA, 19 nt, Human
cacaguuuugguugcuuua

SEQ ID NO: 1705029 - RNA, 14 nt, Human
uuuuucuguuauau

SEQ ID NO: 1705030 - RNA, 23 nt, Human
uuuuucuuaaauaauaaagauca

SEQ ID NO: 1705031 - RNA, 20 nt, Human
uuugagguuuuuaagccuua

SEQ ID NO: 1705032 - RNA, 22 nt, Human
uuugcauaggugaucucauuua

SEQ ID NO: 1705033 - RNA, 16 nt, Human
uuuggaaaucuuuaaa

SEQ ID NO: 1705034 - RNA, 22 nt, Human
uuugguuaagucuguuuuauga

SEQ ID NO: 1705035 - RNA, 18 nt, Human
uuugguuaagucuguuuu

SEQ ID NO: 1705036 - RNA, 19 nt, Human
uuugguuaagucuguuuua

SEQ ID NO: 1705037 - RNA, 20 nt, Human
uuugguuaagucuguuuuau

SEQ ID NO: 1705038 - RNA, 11 nt, Human
uuuguauagaa

SEQ ID NO: 1705039 - RNA, 12 nt, Human
uuuguguuagag

SEQ ID NO: 1705040 - RNA, 12 nt, Human
uuuguuguuugu

SEQ ID NO: 1705041 - RNA, 14 nt, Human
uuuguuguuuguuu

SEQ ID NO: 1705042 - RNA, 19 nt, Human
uuuguuguuuguuuagucu

SEQ ID NO: 1705043 - RNA, 15 nt, Human
uuuuaugauccagca

SEQ ID NO: 1705044 - RNA, 13 nt, Human
uuuuaugauccag

SEQ ID NO: 1705045 - RNA, 14 nt, Human
uuucucuuucguua

SEQ ID NO: 1705046 - RNA, 18 nt, Human
uuuccuagcacacacuuu

SEQ ID NO: 1705047 - RNA, 21 nt, Human
uuuccuagcacacacuuuugg

SEQ ID NO: 1705048 - RNA, 18 nt, Human
uuucagauaacuguuauu

SEQ ID NO: 1705049 - RNA, 13 nt, Human
uuuaugauccagc

SEQ ID NO: 1705050 - RNA, 17 nt, Human
uuuauuggcuuuucuga

SEQ ID NO: 1705051 - RNA, 21 nt, Human
uuuauuggcuuuucugaucca

SEQ ID NO: 1705052 - RNA, 17 nt, Human
uucuaugcugaguuugu

SEQ ID NO: 1705053 - RNA, 11 nt, Human
uucuauauuuu

SEQ ID NO: 1705054 - RNA, 14 nt, Human
uucuauauuuucau

SEQ ID NO: 1705055 - RNA, 15 nt, Human
uucuauauuuucauu

SEQ ID NO: 1705056 - RNA, 16 nt, Human
uucuauauuuucauuc

SEQ ID NO: 1705057 - RNA, 18 nt, Human
uucuauauuuucauucuc

SEQ ID NO: 1705058 - RNA, 21 nt, Human
uucuauauuuucauucuccua

SEQ ID NO: 1705059 - RNA, 17 nt, Human
uuccuagcacacacuuu

SEQ ID NO: 1705060 - RNA, 19 nt, Human
uuccuagcacacacuuuug

SEQ ID NO: 1705061 - RNA, 16 nt, Human
uuacuaaaauggacug

SEQ ID NO: 1705062 - RNA, 17 nt, Human
uuacuaaaauggacugu

SEQ ID NO: 1705063 - RNA, 18 nt, Human
uuacuaaaauggacugug

SEQ ID NO: 1705064 - RNA, 15 nt, Human
uuacuaaaauggacu

SEQ ID NO: 1705065 - RNA, 11 nt, Human
uucacugauuu

SEQ ID NO: 1705066 - RNA, 12 nt, Human
uuggaaaucuuu

SEQ ID NO: 1705067 - RNA, 15 nt, Human
uuggaaaucuuuaaa

SEQ ID NO: 1705068 - RNA, 21 nt, Human
uuggaccaaaaaccaguauug

SEQ ID NO: 1705069 - RNA, 19 nt, Human
uuggcuuuucugauccagu

SEQ ID NO: 1705070 - RNA, 22 nt, Human
uuggcuuuucugauccaguuuu

SEQ ID NO: 1705071 - RNA, 15 nt, Human
uuggcuuuucugauc

SEQ ID NO: 1705072 - RNA, 12 nt, Human
uucuuguauuaa

SEQ ID NO: 1705073 - RNA, 13 nt, Human
uucuuguauuaag

SEQ ID NO: 1705074 - RNA, 18 nt, Human
uucuuguauuaagaauga

SEQ ID NO: 1705075 - RNA, 22 nt, Human
uugaaacggaugauuucuaugc

SEQ ID NO: 1705076 - RNA, 20 nt, Human
uugaaacggaugauuucuau

SEQ ID NO: 1705077 - RNA, 21 nt, Human
uugaaacggaugauuucuaug

SEQ ID NO: 1705078 - RNA, 14 nt, Human
ugugcgcuaaacuu

SEQ ID NO: 1705079 - RNA, 19 nt, Human
ugugcgcuaaacuuuucug

SEQ ID NO: 1705080 - RNA, 22 nt, Human
ugugcgcuaaacuuuucugaua

SEQ ID NO: 1705081 - RNA, 23 nt, Human
ugugcgcuaaacuuuucugauag

SEQ ID NO: 1705082 - RNA, 13 nt, Human
uguacucaauuuu

SEQ ID NO: 1705083 - RNA, 16 nt, Human
uguauagaaccucuuu

SEQ ID NO: 1705084 - RNA, 17 nt, Human
ugugugaagugagugag

SEQ ID NO: 1705085 - RNA, 16 nt, Human
uguuaaaccaugggau

SEQ ID NO: 1705086 - RNA, 18 nt, Human
uguuaaaccaugggauaa

SEQ ID NO: 1705087 - RNA, 20 nt, Human
uguuaaaccaugggauaaau

SEQ ID NO: 1705088 - RNA, 21 nt, Human
uguuaaaccaugggauaaaug

SEQ ID NO: 1705089 - RNA, 23 nt, Human
uguuaaaccaugggauaaaugcc

SEQ ID NO: 1705090 - RNA, 16 nt, Human
uguuagaucuaguuca

SEQ ID NO: 1705091 - RNA, 20 nt, Human
uguugaaacggaugauuucu

SEQ ID NO: 1705092 - RNA, 21 nt, Human
uguugaaacggaugauuucua

SEQ ID NO: 1705093 - RNA, 22 nt, Human
uguugaaacggaugauuucuau

SEQ ID NO: 1705094 - RNA, 23 nt, Human
uguugaaacggaugauuucuaug

SEQ ID NO: 1705095 - RNA, 14 nt, Human
uguuguuuguuuag

SEQ ID NO: 1705096 - RNA, 18 nt, Human
uuaauaucaucaguauug

SEQ ID NO: 1705097 - RNA, 15 nt, Human
uuaauaucaucagua

SEQ ID NO: 1705098 - RNA, 13 nt, Human
uuaaggauuuuau

SEQ ID NO: 1705099 - RNA, 15 nt, Human
uuaaggauuuuaugc

SEQ ID NO: 1705100 - RNA, 18 nt, Human
uuaaggauuuuaugcuuu

SEQ ID NO: 1705101 - RNA, 20 nt, Human
uuaaggauuuuaugcuuuaa

SEQ ID NO: 1705102 - RNA, 20 nt, Human
uuaauaauuauaugcuauuu

SEQ ID NO: 1705103 - RNA, 23 nt, Human
uuaauaauuauaugcuauuucua

SEQ ID NO: 1705104 - RNA, 18 nt, Human
uuaauaauuauaugcuau

SEQ ID NO: 1705105 - RNA, 12 nt, Human
uuaacauguuaa

SEQ ID NO: 1705106 - RNA, 18 nt, Human
uuaacauguuaaaccaug

SEQ ID NO: 1705107 - RNA, 19 nt, Human
uuaacauguuaaaccaugg

SEQ ID NO: 1705108 - RNA, 12 nt, Human
uguuuguuuagu

SEQ ID NO: 1705109 - RNA, 21 nt, Human
uguuuguuuagucuugucuca

SEQ ID NO: 1705110 - RNA, 14 nt, Human
uggcuuuguauaga

SEQ ID NO: 1705111 - RNA, 22 nt, Human
uggcuuuguauagaaccucuuu

SEQ ID NO: 1705112 - RNA, 15 nt, Human
uggcuguacccagga

SEQ ID NO: 1705113 - RNA, 20 nt, Human
uggccuuucauauuuuagcu

SEQ ID NO: 1705114 - RNA, 14 nt, Human
ugcuuguuuccuag

SEQ ID NO: 1705115 - RNA, 12 nt, Human
ugcuuuaaacau

SEQ ID NO: 1705116 - RNA, 16 nt, Human
ugcuuucagauacugg

SEQ ID NO: 1705117 - RNA, 17 nt, Human
ugcuuucagauacugga

SEQ ID NO: 1705118 - RNA, 20 nt, Human
ugcuuucagauacuggauug

SEQ ID NO: 1705119 - RNA, 21 nt, Human
ugcuuucagauacuggauugu

SEQ ID NO: 1705120 - RNA, 12 nt, Human
ugcuuucagaua

SEQ ID NO: 1705121 - RNA, 15 nt, Human
uggcauaacauaaau

SEQ ID NO: 1705122 - RNA, 19 nt, Human
ugaagucucugaagugaaa

SEQ ID NO: 1705123 - RNA, 22 nt, Human
ugcacggugaauggcuuuguau

SEQ ID NO: 1705124 - RNA, 23 nt, Human
ugcacggugaauggcuuuguaua

SEQ ID NO: 1705125 - RNA, 23 nt, Human
ugccuaaggacuucuuuaauuuu

SEQ ID NO: 1705126 - RNA, 15 nt, Human
ugcugaguuugugcu

SEQ ID NO: 1705127 - RNA, 17 nt, Human
ugcugaguuugugcugg

SEQ ID NO: 1705128 - RNA, 19 nt, Human
ucuugucucagauuuuauu

SEQ ID NO: 1705129 - RNA, 18 nt, Human
ucuuuaaaaaaaaaauug

SEQ ID NO: 1705130 - RNA, 19 nt, Human
ucuuuaaaaaaaaaauugg

SEQ ID NO: 1705131 - RNA, 15 nt, Human
ucuugccuuuuucau

SEQ ID NO: 1705132 - RNA, 22 nt, Human
ucuuguauuaagaaugaaauac

SEQ ID NO: 1705133 - RNA, 21 nt, Human
ucuucucagaaggcaaaugac

SEQ ID NO: 1705134 - RNA, 23 nt, Human
ucuucucagaaggcaaaugacuu

SEQ ID NO: 1705135 - RNA, 17 nt, Human
ucuguuuuaugacuuca

SEQ ID NO: 1705136 - RNA, 13 nt, Human
ucuguuuuaugac

SEQ ID NO: 1705137 - RNA, 15 nt, Human
ucuguuuuaugacuu

SEQ ID NO: 1705138 - RNA, 16 nt, Human
ucuguuuuaugacuuc

SEQ ID NO: 1705139 - RNA, 15 nt, Human
ucuguuauauaaaug

SEQ ID NO: 1705140 - RNA, 18 nt, Human
ucuguuauauaaaugguu

SEQ ID NO: 1705141 - RNA, 18 nt, Human
ugaacacuccaauuaagg

SEQ ID NO: 1705142 - RNA, 19 nt, Human
ugaacacuccaauuaagga

SEQ ID NO: 1705143 - RNA, 22 nt, Human
ugaacacuccaauuaaggauuu

SEQ ID NO: 1705144 - RNA, 23 nt, Human
ugaacacuccaauuaaggauuuu

SEQ ID NO: 1705145 - RNA, 16 nt, Human
ucugacaucucugcaa

SEQ ID NO: 1705146 - RNA, 20 nt, Human
ucugaggaauucuguauaga

SEQ ID NO: 1705147 - RNA, 19 nt, Human
ucucugcaaucuucucaga

SEQ ID NO: 1705148 - RNA, 19 nt, Human
ucucagaaggcaaaugacu

SEQ ID NO: 1705149 - RNA, 20 nt, Human
ucucagaaggcaaaugacuu

SEQ ID NO: 1705150 - RNA, 21 nt, Human
ucucagaaggcaaaugacuuu

SEQ ID NO: 1705151 - RNA, 22 nt, Human
ucucagaaggcaaaugacuuug

SEQ ID NO: 1705152 - RNA, 17 nt, Human
ucucaaccaccuuucag

SEQ ID NO: 1705153 - RNA, 12 nt, Human
uauuuuaugauc

SEQ ID NO: 1705154 - RNA, 17 nt, Human
uaucugaagucagaucu

SEQ ID NO: 1705155 - RNA, 18 nt, Human
uaucugaagucagaucug

SEQ ID NO: 1705156 - RNA, 15 nt, Human
uaucugaggaauucu

SEQ ID NO: 1705157 - RNA, 18 nt, Human
uaucugacaucucugcaa

SEQ ID NO: 1705158 - RNA, 18 nt, Human
ucacucuccauuuaauaa

SEQ ID NO: 1705159 - RNA, 15 nt, Human
ucagauaacuguuau

SEQ ID NO: 1705160 - RNA, 13 nt, Human
ucagauaacuguu

SEQ ID NO: 1705161 - RNA, 13 nt, Human
ucacuuuuuucca

SEQ ID NO: 1705162 - RNA, 15 nt, Human
ucacuuuuuuccaca

SEQ ID NO: 1705163 - RNA, 16 nt, Human
ucacuuuuuuccacau

SEQ ID NO: 1705164 - RNA, 20 nt, Human
uccagcagauuauucacuga

SEQ ID NO: 1705165 - RNA, 17 nt, Human
uccagcagauuauucac

SEQ ID NO: 1705166 - RNA, 22 nt, Human
uccagcagauuauucacugauu

SEQ ID NO: 1705167 - RNA, 16 nt, Human
ucauuauuuuauuaug

SEQ ID NO: 1705168 - RNA, 18 nt, Human
ucauuauuuuauuaugaa

SEQ ID NO: 1705169 - RNA, 19 nt, Human
ucauuauuuuauuaugaaa

SEQ ID NO: 1705170 - RNA, 14 nt, Human
ucauuauuuuauua

SEQ ID NO: 1705171 - RNA, 15 nt, Human
ucauuauuuuauuau

SEQ ID NO: 1705172 - RNA, 13 nt, Human
ucauuauuuuauu

SEQ ID NO: 1705173 - RNA, 12 nt, Human
guuuguuuaguc

SEQ ID NO: 1705174 - RNA, 16 nt, Human
guuugagguuuuuaag

SEQ ID NO: 1705175 - RNA, 19 nt, Human
guuugagguuuuuaagccu

SEQ ID NO: 1705176 - RNA, 23 nt, Human
guuugugcugguguaugugugaa

SEQ ID NO: 1705177 - RNA, 14 nt, Human
guuuagucuugucu

SEQ ID NO: 1705178 - RNA, 18 nt, Human
guuuagucuugucucaga

SEQ ID NO: 1705179 - RNA, 12 nt, Human
uaaacuuucaca

SEQ ID NO: 1705180 - RNA, 13 nt, Human
uaaacuuucacac

SEQ ID NO: 1705181 - RNA, 13 nt, Human
uaaacuuuucuga

SEQ ID NO: 1705182 - RNA, 14 nt, Human
uaaacuuuucugau

SEQ ID NO: 1705183 - RNA, 15 nt, Human
uaaacuuuucugaua

SEQ ID NO: 1705184 - RNA, 13 nt, Human
uaaaguugaauuu

SEQ ID NO: 1705185 - RNA, 14 nt, Human
uaaaguugaauuua

SEQ ID NO: 1705186 - RNA, 15 nt, Human
uaaaguugaauuuau

SEQ ID NO: 1705187 - RNA, 17 nt, Human
uaaaguugaauuuauug

SEQ ID NO: 1705188 - RNA, 19 nt, Human
uaaaguugaauuuauuggc

SEQ ID NO: 1705189 - RNA, 21 nt, Human
uaaaguugaauuuauuggcuu

SEQ ID NO: 1705190 - RNA, 23 nt, Human
uaaaguugaauuuauuggcuuuu

SEQ ID NO: 1705191 - RNA, 15 nt, Human
uaaauccauuuggaa

SEQ ID NO: 1705192 - RNA, 16 nt, Human
uaaauccauuuggaaa

SEQ ID NO: 1705193 - RNA, 14 nt, Human
uaaauccauuugga

SEQ ID NO: 1705194 - RNA, 18 nt, Human
uaaauccauuuggaaauc

SEQ ID NO: 1705195 - RNA, 19 nt, Human
uaaauccauuuggaaaucu

SEQ ID NO: 1705196 - RNA, 22 nt, Human
uaaauccauuuggaaaucuuua

SEQ ID NO: 1705197 - RNA, 23 nt, Human
uaaauccauuuggaaaucuuuaa

SEQ ID NO: 1705198 - RNA, 16 nt, Human
uaaaucccauuauuca

SEQ ID NO: 1705199 - RNA, 17 nt, Human
uaaaucccauuauucaa

SEQ ID NO: 1705200 - RNA, 19 nt, Human
uaaaucccauuauucaaag

SEQ ID NO: 1705201 - RNA, 18 nt, Human
uaacauguuaaaccaugg

SEQ ID NO: 1705202 - RNA, 16 nt, Human
uaacauguuaaaccau

SEQ ID NO: 1705203 - RNA, 17 nt, Human
uaacauguuaaaccaug

SEQ ID NO: 1705204 - RNA, 21 nt, Human
uaagcauauauuuuuauauuu

SEQ ID NO: 1705205 - RNA, 22 nt, Human
uaagcauauauuuuuauauuua

SEQ ID NO: 1705206 - RNA, 16 nt, Human
uaagcauauauuuuua

SEQ ID NO: 1705207 - RNA, 19 nt, Human
uaagcauauauuuuuauau

SEQ ID NO: 1705208 - RNA, 23 nt, Human
uaagcauauauuuuuauauuuac

SEQ ID NO: 1705209 - RNA, 12 nt, Human
uaauauuaaagc

SEQ ID NO: 1705210 - RNA, 13 nt, Human
uaauauuaaagcc

SEQ ID NO: 1705211 - RNA, 14 nt, Human
uaauauuaaagcca

SEQ ID NO: 1705212 - RNA, 23 nt, Human
uaauccucucaaccaccuuucag

SEQ ID NO: 1705213 - RNA, 15 nt, Human
uaauaauuauaugcu

SEQ ID NO: 1705214 - RNA, 16 nt, Human
uaauaauuauaugcua

SEQ ID NO: 1705215 - RNA, 19 nt, Human
uaauaauuauaugcuauuu

SEQ ID NO: 1705216 - RNA, 20 nt, Human
uaauaauuauaugcuauuuc

SEQ ID NO: 1705217 - RNA, 22 nt, Human
uaauaauuauaugcuauuucua

SEQ ID NO: 1705218 - RNA, 23 nt, Human
uaauaauuauaugcuauuucuau

SEQ ID NO: 1705219 - RNA, 16 nt, Human
uaauaaagaucaugua

SEQ ID NO: 1705220 - RNA, 17 nt, Human
uaauaaagaucauguaa

SEQ ID NO: 1705221 - RNA, 20 nt, Human
uaauaaggaaaaguuuaaua

SEQ ID NO: 1705222 - RNA, 18 nt, Human
uaauaaggaaaaguuuaa

SEQ ID NO: 1705223 - RNA, 12 nt, Human
uaauuaacaugu

SEQ ID NO: 1705224 - RNA, 14 nt, Human
uaauuaacauguua

SEQ ID NO: 1705225 - RNA, 15 nt, Human
uaauuaacauguuaa

SEQ ID NO: 1705226 - RNA, 17 nt, Human
uaauuaacauguuaaac

SEQ ID NO: 1705227 - RNA, 18 nt, Human
uaauuaacauguuaaacc

SEQ ID NO: 1705228 - RNA, 19 nt, Human
uaauuaacauguuaaacca

SEQ ID NO: 1705229 - RNA, 20 nt, Human
uaauuaacauguuaaaccau

SEQ ID NO: 1705230 - RNA, 19 nt, Human
uacaauuuuguuucuguac

SEQ ID NO: 1705231 - RNA, 21 nt, Human
uacaauuuuguuucuguacuu

SEQ ID NO: 1705232 - RNA, 18 nt, Human
uacaauuuuguuucugua

SEQ ID NO: 1705233 - RNA, 12 nt, Human
uaauuuuggaau

SEQ ID NO: 1705234 - RNA, 13 nt, Human
uaauuuuggaauu

SEQ ID NO: 1705235 - RNA, 13 nt, Human
uagacuggugacu

SEQ ID NO: 1705236 - RNA, 14 nt, Human
uagacuggugacug

SEQ ID NO: 1705237 - RNA, 17 nt, Human
uagacuggugacugauu

SEQ ID NO: 1705238 - RNA, 18 nt, Human
uagacuggugacugauuc

SEQ ID NO: 1705239 - RNA, 15 nt, Human
uagagaguguugaaa

SEQ ID NO: 1705240 - RNA, 14 nt, Human
uagagaguguugaa

SEQ ID NO: 1705241 - RNA, 16 nt, Human
uauaugcuauuucuau

SEQ ID NO: 1705242 - RNA, 18 nt, Human
uauaugcuauuucuauau

SEQ ID NO: 1705243 - RNA, 18 nt, Human
uauauuuuuauauuuacu

SEQ ID NO: 1705244 - RNA, 22 nt, Human
uaucaucaguauugaagcauuu

SEQ ID NO: 1705245 - RNA, 19 nt, Human
uauauuuuuauauuuacua

SEQ ID NO: 1705246 - RNA, 18 nt, Human
uauaaaucgcuuuugaua

SEQ ID NO: 1705247 - RNA, 19 nt, Human
uauaaaucgcuuuugauaa

SEQ ID NO: 1705248 - RNA, 20 nt, Human
uauaaaucgcuuuugauaau

SEQ ID NO: 1705249 - RNA, 22 nt, Human
ggaagccaaaccucugugagca

SEQ ID NO: 1705250 - RNA, 18 nt, Human
ggaaaaguuuaauauuaa

SEQ ID NO: 1705251 - RNA, 19 nt, Human
ggaaaaguuuaauauuaaa

SEQ ID NO: 1705252 - RNA, 21 nt, Human
ggaacgcguugaaauuguaau

SEQ ID NO: 1705253 - RNA, 17 nt, Human
ggaacgcguugaaauug

SEQ ID NO: 1705254 - RNA, 16 nt, Human
ggaacgcguugaaauu

SEQ ID NO: 1705255 - RNA, 20 nt, Human
gcuuuaauaucaucaguauu

SEQ ID NO: 1705256 - RNA, 22 nt, Human
gcuuuaauaucaucaguauuga

SEQ ID NO: 1705257 - RNA, 23 nt, Human
gcuuuaauaucaucaguauugaa

SEQ ID NO: 1705258 - RNA, 24 nt, Human
gcuggugcccugcuuucagauacu

SEQ ID NO: 1705259 - RNA, 22 nt, Human
gcuggugcccugcuuucagaua

SEQ ID NO: 1705260 - RNA, 22 nt, Human
ggcugaugccaaguuguuugag

SEQ ID NO: 1705261 - RNA, 21 nt, Human
ggcugaugccaaguuguuuga

SEQ ID NO: 1705262 - RNA, 17 nt, Human
ggcuuuucugauccagu

SEQ ID NO: 1705263 - RNA, 12 nt, Human
ggcuuuucugau

SEQ ID NO: 1705264 - RNA, 13 nt, Human
ggcuuuucugauc

SEQ ID NO: 1705265 - RNA, 16 nt, Human
ggcuuuucugauccag

SEQ ID NO: 1705266 - RNA, 11 nt, Human
ggguuccugca

SEQ ID NO: 1705267 - RNA, 11 nt, Human
ggggauucuua

SEQ ID NO: 1705268 - RNA, 15 nt, Human
ggggauucuuaaagu

SEQ ID NO: 1705269 - RNA, 20 nt, Human
gguuaucugaagucagaucu

SEQ ID NO: 1705270 - RNA, 13 nt, Human
gguuaagucuguu

SEQ ID NO: 1705271 - RNA, 16 nt, Human
gguuaagucuguuuua

SEQ ID NO: 1705272 - RNA, 23 nt, Human
gguuaagucuguuuuaugacuuc

SEQ ID NO: 1705273 - RNA, 22 nt, Human
gguucuuguauuaagaaugaaa

SEQ ID NO: 1705274 - RNA, 14 nt, Human
gguucuuguauuaa

SEQ ID NO: 1705275 - RNA, 16 nt, Human
gguguaugugugaagu

SEQ ID NO: 1705276 - RNA, 14 nt, Human
ggugacuuuggaua

SEQ ID NO: 1705277 - RNA, 18 nt, Human
ggugacuuuggauaauaa

SEQ ID NO: 1705278 - RNA, 19 nt, Human
ggugacuuuggauaauaag

SEQ ID NO: 1705279 - RNA, 20 nt, Human
ggugacuuuggauaauaagg

SEQ ID NO: 1705280 - RNA, 21 nt, Human
ggugacuuuggauaauaagga

SEQ ID NO: 1705281 - RNA, 13 nt, Human
gcuagacugguga

SEQ ID NO: 1705282 - RNA, 15 nt, Human
gcuagacuggugacu

SEQ ID NO: 1705283 - RNA, 16 nt, Human
gcuagacuggugacug

SEQ ID NO: 1705284 - RNA, 19 nt, Human
gcuagacuggugacugauu

SEQ ID NO: 1705285 - RNA, 20 nt, Human
gcuagacuggugacugauuc

SEQ ID NO: 1705286 - RNA, 22 nt, Human
gcuagacuggugacugauucuu

SEQ ID NO: 1705287 - RNA, 12 nt, Human
gccuuuuucauu

SEQ ID NO: 1705288 - RNA, 16 nt, Human
gccuuuuucauuauuu

SEQ ID NO: 1705289 - RNA, 20 nt, Human
gccuuuuucauuauuuuauu

SEQ ID NO: 1705290 - RNA, 22 nt, Human
gccuuuuucauuauuuuauuau

SEQ ID NO: 1705291 - RNA, 14 nt, Human
gccuaaggacuucu

SEQ ID NO: 1705292 - RNA, 15 nt, Human
gccuaaggacuucuu

SEQ ID NO: 1705293 - RNA, 18 nt, Human
gccuaaggacuucuuuaa

SEQ ID NO: 1705294 - RNA, 12 nt, Human
gccuaaggacuu

SEQ ID NO: 1705295 - RNA, 13 nt, Human
gccuaaggacuuc

SEQ ID NO: 1705296 - RNA, 11 nt, Human
gccuaaaucca

SEQ ID NO: 1705297 - RNA, 13 nt, Human
gcauuuuauaaau

SEQ ID NO: 1705298 - RNA, 12 nt, Human
gcaucacaguuu

SEQ ID NO: 1705299 - RNA, 14 nt, Human
gcauauauuuuuau

SEQ ID NO: 1705300 - RNA, 15 nt, Human
gcauauauuuuuaua

SEQ ID NO: 1705301 - RNA, 11 nt, Human
gcauauauuuu

SEQ ID NO: 1705302 - RNA, 16 nt, Human
gcauauauuuuuauau

SEQ ID NO: 1705303 - RNA, 13 nt, Human
gcaaaugacuuug

SEQ ID NO: 1705304 - RNA, 12 nt, Human
gcaaaugacuuu

SEQ ID NO: 1705305 - RNA, 17 nt, Human
gcaaugaagucucugaa

SEQ ID NO: 1705306 - RNA, 19 nt, Human
gcaaugaagucucugaagu

SEQ ID NO: 1705307 - RNA, 17 nt, Human
gaucuaguucacucucc

SEQ ID NO: 1705308 - RNA, 21 nt, Human
gauaaucaacugggcugaaca

SEQ ID NO: 1705309 - RNA, 17 nt, Human
gauaaucaacugggcug

SEQ ID NO: 1705310 - RNA, 20 nt, Human
gauaauaaggaaaaguuuaa

SEQ ID NO: 1705311 - RNA, 21 nt, Human
gauaauaaggaaaaguuuaau

SEQ ID NO: 1705312 - RNA, 22 nt, Human
gauaauaaggaaaaguuuaaua

SEQ ID NO: 1705313 - RNA, 15 nt, Human
gacuucauuaauaau

SEQ ID NO: 1705314 - RNA, 20 nt, Human
gaaugguccgugcuaaggac

SEQ ID NO: 1705315 - RNA, 22 nt, Human
gaaugguccgugcuaaggacuu

SEQ ID NO: 1705316 - RNA, 23 nt, Human
gaaugguccgugcuaaggacuug

SEQ ID NO: 1705317 - RNA, 21 nt, Human
gaauggcuuuguauagaaccu

SEQ ID NO: 1705318 - RNA, 14 nt, Human
gaauuuauuggcuu

SEQ ID NO: 1705319 - RNA, 16 nt, Human
gaauuuauuggcuuuu

SEQ ID NO: 1705320 - RNA, 20 nt, Human
gaauuuauuggcuuuucuga

SEQ ID NO: 1705321 - RNA, 21 nt, Human
gaauuuauuggcuuuucugau

SEQ ID NO: 1705322 - RNA, 22 nt, Human
gaauuuauuggcuuuucugauc

SEQ ID NO: 1705323 - RNA, 11 nt, Human
gaauucuguau

SEQ ID NO: 1705324 - RNA, 16 nt, Human
gaagucucugaaguga

SEQ ID NO: 1705325 - RNA, 21 nt, Human
gaagucucugaagugaaacug

SEQ ID NO: 1705326 - RNA, 12 nt, Human
gaacuaaacuuu

SEQ ID NO: 1705327 - RNA, 14 nt, Human
gaacuaaacuuuca

SEQ ID NO: 1705328 - RNA, 16 nt, Human
gaacuaaacuuucaca

SEQ ID NO: 1705329 - RNA, 18 nt, Human
gaacuaaacuuucacacc

SEQ ID NO: 1705330 - RNA, 17 nt, Human
gaacuaaacuuucacac

SEQ ID NO: 1705331 - RNA, 17 nt, Human
gaaauuguaauuauauc

SEQ ID NO: 1705332 - RNA, 13 nt, Human
gacugauucuuca

SEQ ID NO: 1705333 - RNA, 16 nt, Human
gacugauucuucagca

SEQ ID NO: 1705334 - RNA, 13 nt, Human
cuuguuagaucua

SEQ ID NO: 1705335 - RNA, 16 nt, Human
cuuguuagaucuaguu

SEQ ID NO: 1705336 - RNA, 17 nt, Human
cuuuaaaaaaaaaauug

SEQ ID NO: 1705337 - RNA, 16 nt, Human
cuuuggauaauaagga

SEQ ID NO: 1705338 - RNA, 14 nt, Human
cuuuggauaauaag

SEQ ID NO: 1705339 - RNA, 12 nt, Human
cuuuuucauuau

SEQ ID NO: 1705340 - RNA, 13 nt, Human
cuuuuucauuauu

SEQ ID NO: 1705341 - RNA, 14 nt, Human
cuuuuucauuauuu

SEQ ID NO: 1705342 - RNA, 15 nt, Human
cuuuuuuaaauaaau

SEQ ID NO: 1705343 - RNA, 14 nt, Human
cuuuucugauccag

SEQ ID NO: 1705344 - RNA, 15 nt, Human
cuuuucugauccagu

SEQ ID NO: 1705345 - RNA, 11 nt, Human
cuuuucugauc

SEQ ID NO: 1705346 - RNA, 16 nt, Human
cuuuucugauccaguu

SEQ ID NO: 1705347 - RNA, 18 nt, Human
cuuuucugauccaguuuu

SEQ ID NO: 1705348 - RNA, 12 nt, Human
cuguuuuaugac

SEQ ID NO: 1705349 - RNA, 13 nt, Human
cuguuuuaugacu

SEQ ID NO: 1705350 - RNA, 14 nt, Human
cuguuuuaugacuu

SEQ ID NO: 1705351 - RNA, 15 nt, Human
cuguuuuaugacuuc

SEQ ID NO: 1705352 - RNA, 16 nt, Human
cuguuuuaugacuuca

SEQ ID NO: 1705353 - RNA, 14 nt, Human
cugaagucagaucu

SEQ ID NO: 1705354 - RNA, 15 nt, Human
cugaagucagaucug

SEQ ID NO: 1705355 - RNA, 16 nt, Human
cugaagucagaucugc

SEQ ID NO: 1705356 - RNA, 21 nt, Human
cugaagucagaucugccuaag

SEQ ID NO: 1705357 - RNA, 13 nt, Human
cugaagugaaacu

SEQ ID NO: 1705358 - RNA, 17 nt, Human
cugaagugaaacugcuu

SEQ ID NO: 1705359 - RNA, 19 nt, Human
cugaagugaaacugcuugu

SEQ ID NO: 1705360 - RNA, 13 nt, Human
cucuccauuuaau

SEQ ID NO: 1705361 - RNA, 17 nt, Human
cucugcaaucuucucag

SEQ ID NO: 1705362 - RNA, 18 nt, Human
cucugcaaucuucucaga

SEQ ID NO: 1705363 - RNA, 18 nt, Human
cuccuaucaccugucuug

SEQ ID NO: 1705364 - RNA, 19 nt, Human
cuggauuguacuuugugcu

SEQ ID NO: 1705365 - RNA, 20 nt, Human
cuggauuguacuuugugcug

SEQ ID NO: 1705366 - RNA, 18 nt, Human
cugcuuucagauacugga

SEQ ID NO: 1705367 - RNA, 21 nt, Human
cugcuuucagauacuggauug

SEQ ID NO: 1705368 - RNA, 16 nt, Human
cugcuuucagauacug

SEQ ID NO: 1705369 - RNA, 19 nt, Human
cugccuaaggacuucuuua

SEQ ID NO: 1705370 - RNA, 22 nt, Human
cugccuaaggacuucuuuaauu

SEQ ID NO: 1705371 - RNA, 20 nt, Human
cugccuaaggacuucuuuaa

SEQ ID NO: 1705372 - RNA, 21 nt, Human
cugccuaaggacuucuuuaau

SEQ ID NO: 1705373 - RNA, 20 nt, Human
cugauccaguuuuguuugga

SEQ ID NO: 1705374 - RNA, 20 nt, Human
cugauagaggaagccugauu

SEQ ID NO: 1705375 - RNA, 15 nt, Human
cugauucuucagcaa

SEQ ID NO: 1705376 - RNA, 22 nt, Human
cugcaaucuucucagaaggcaa

SEQ ID NO: 1705377 - RNA, 18 nt, Human
cugcaaugaagucucuga

SEQ ID NO: 1705378 - RNA, 21 nt, Human
cugcaaugaagucucugaagu

SEQ ID NO: 1705379 - RNA, 13 nt, Human
ccgugcuaaggac

SEQ ID NO: 1705380 - RNA, 11 nt, Human
ccggaagccaa

SEQ ID NO: 1705381 - RNA, 22 nt, Human
ccggaagccaaaccucugugag

SEQ ID NO: 1705382 - RNA, 21 nt, Human
ccucacccacccuuuuuuaaa

SEQ ID NO: 1705383 - RNA, 12 nt, Human
ccugauuaaaga

SEQ ID NO: 1705384 - RNA, 13 nt, Human
ccugauuaaagaa

SEQ ID NO: 1705385 - RNA, 15 nt, Human
ccugcuuucagauac

SEQ ID NO: 1705386 - RNA, 16 nt, Human
ccugcuuucagauacu

SEQ ID NO: 1705387 - RNA, 21 nt, Human
ccugcuuucagauacuggauu

SEQ ID NO: 1705388 - RNA, 14 nt, Human
ccuggccuuucaua

SEQ ID NO: 1705389 - RNA, 15 nt, Human
ccuggccuuucauau

SEQ ID NO: 1705390 - RNA, 13 nt, Human
cguugaaauugua

SEQ ID NO: 1705391 - RNA, 23 nt, Human
cguucauggaacgcguugaaauu

SEQ ID NO: 1705392 - RNA, 21 nt, Human
cguucauggaacgcguugaaa

SEQ ID NO: 1705393 - RNA, 22 nt, Human
cguucauggaacgcguugaaau

SEQ ID NO: 1705394 - RNA, 13 nt, Human
cgcguugaaauug

SEQ ID NO: 1705395 - RNA, 17 nt, Human
cgcguugaaauuguaau

SEQ ID NO: 1705396 - RNA, 21 nt, Human
cgcguugaaauuguaauuaua

SEQ ID NO: 1705397 - RNA, 16 nt, Human
ccuuucucuuucguua

SEQ ID NO: 1705398 - RNA, 13 nt, Human
cggaugauuucua

SEQ ID NO: 1705399 - RNA, 14 nt, Human
cggaugauuucuau

SEQ ID NO: 1705400 - RNA, 19 nt, Human
ccaucaauaaaaaauuaug

SEQ ID NO: 1705401 - RNA, 20 nt, Human
ccaucaauaaaaaauuauga

SEQ ID NO: 1705402 - RNA, 20 nt, Human
ccaggaauggagccugcacg

SEQ ID NO: 1705403 - RNA, 15 nt, Human
cauuuaauaauuaua

SEQ ID NO: 1705404 - RNA, 16 nt, Human
cauuuaauaauuauau

SEQ ID NO: 1705405 - RNA, 17 nt, Human
cauuuaauaauuauaug

SEQ ID NO: 1705406 - RNA, 19 nt, Human
cauuuaauaauuauaugcu

SEQ ID NO: 1705407 - RNA, 12 nt, Human
cauuuaauaauu

SEQ ID NO: 1705408 - RNA, 14 nt, Human
cauuuaauaauuau

SEQ ID NO: 1705409 - RNA, 23 nt, Human
cauuuaauaauuauaugcuauuu

SEQ ID NO: 1705410 - RNA, 11 nt, Human
cauuuuauaaa

SEQ ID NO: 1705411 - RNA, 13 nt, Human
cauuuuauaaauc

SEQ ID NO: 1705412 - RNA, 17 nt, Human
cauuuuauaaaucgcuu

SEQ ID NO: 1705413 - RNA, 18 nt, Human
cauuuuauaaaucgcuuu

SEQ ID NO: 1705414 - RNA, 21 nt, Human
cauuuuauaaaucgcuuuuga

SEQ ID NO: 1705415 - RNA, 23 nt, Human
cauuuuauaaaucgcuuuugaua

SEQ ID NO: 1705416 - RNA, 18 nt, Human
cugugaacuugaaauuug

SEQ ID NO: 1705417 - RNA, 14 nt, Human
cuguacuuuuuggc

SEQ ID NO: 1705418 - RNA, 15 nt, Human
cuguacuuuuuggca

SEQ ID NO: 1705419 - RNA, 13 nt, Human
cuggguuccugca

SEQ ID NO: 1705420 - RNA, 20 nt, Human
cuucauaccuacauguauuu

SEQ ID NO: 1705421 - RNA, 20 nt, Human
cuugccuuuuucauuauuuu

SEQ ID NO: 1705422 - RNA, 22 nt, Human
cuugccuuuuucauuauuuuau

SEQ ID NO: 1705423 - RNA, 23 nt, Human
cuugccuuuuucauuauuuuauu

SEQ ID NO: 1705424 - RNA, 14 nt, Human
cuugccuuuuucau

SEQ ID NO: 1705425 - RNA, 15 nt, Human
cuugccuuuuucauu

SEQ ID NO: 1705426 - RNA, 16 nt, Human
cuuuugguuaagucug

SEQ ID NO: 1705427 - RNA, 20 nt, Human
cuuuugguuaagucuguuuu

SEQ ID NO: 1705428 - RNA, 13 nt, Human
cuuuugguuaagu

SEQ ID NO: 1705429 - RNA, 11 nt, Human
cuuuguauaga

SEQ ID NO: 1705430 - RNA, 20 nt, Human
cuuuguauagaaccucuuug

SEQ ID NO: 1705431 - RNA, 15 nt, Human
gacuggugacugauu

SEQ ID NO: 1705432 - RNA, 18 nt, Human
gacuggugacugauucuu

SEQ ID NO: 1705433 - RNA, 12 nt, Human
gacuggugacug

SEQ ID NO: 1705434 - RNA, 16 nt, Human
gaauuuuguguuagag

SEQ ID NO: 1705435 - RNA, 22 nt, Human
gaauuuuguguuagagauuuuu

SEQ ID NO: 1705436 - RNA, 13 nt, Human
gaauuuuguguua

SEQ ID NO: 1705437 - RNA, 14 nt, Human
gaagugaaacugcu

SEQ ID NO: 1705438 - RNA, 15 nt, Human
gcauaacauaaaucu

SEQ ID NO: 1705439 - RNA, 21 nt, Human
gcauaacauaaaucugugaac

SEQ ID NO: 1705440 - RNA, 23 nt, Human
gcauaacauaaaucugugaacuu

SEQ ID NO: 1705441 - RNA, 14 nt, Human
gauuagaauucugu

SEQ ID NO: 1705442 - RNA, 15 nt, Human
gauuagaauucugua

SEQ ID NO: 1705443 - RNA, 23 nt, Human
gauuagaauucuguauagauuag

SEQ ID NO: 1705444 - RNA, 13 nt, Human
gauuauucacuga

SEQ ID NO: 1705445 - RNA, 15 nt, Human
gauuauucacugauu

SEQ ID NO: 1705446 - RNA, 16 nt, Human
gauuauucacugauuu

SEQ ID NO: 1705447 - RNA, 14 nt, Human
gauuagagaguguu

SEQ ID NO: 1705448 - RNA, 18 nt, Human
gauuagagaguguugaaa

SEQ ID NO: 1705449 - RNA, 11 nt, Human
gauccaguuuu

SEQ ID NO: 1705450 - RNA, 17 nt, Human
gauccaguuuuguuugg

SEQ ID NO: 1705451 - RNA, 22 nt, Human
gauccaguuuuguuuggaccaa

SEQ ID NO: 1705452 - RNA, 18 nt, Human
gguucuggugugaacuaa

SEQ ID NO: 1705453 - RNA, 20 nt, Human
aaaguuuaauauuaaagcca

SEQ ID NO: 1705454 - RNA, 21 nt, Human
aaaguuuaauauuaaagccau

SEQ ID NO: 1705455 - RNA, 22 nt, Human
aaaguuuaauauuaaagccaug

SEQ ID NO: 1705456 - RNA, 16 nt, Human
aaaguuuaauauuaaa

SEQ ID NO: 1705457 - RNA, 19 nt, Human
aaaguuuaauauuaaagcc

SEQ ID NO: 1705458 - RNA, 12 nt, Human
aaaguugaauuu

SEQ ID NO: 1705459 - RNA, 13 nt, Human
aaaguugaauuua

SEQ ID NO: 1705460 - RNA, 16 nt, Human
aaaguugaauuuauug

SEQ ID NO: 1705461 - RNA, 22 nt, Human
aaaguugaauuuauuggcuuuu

SEQ ID NO: 1705462 - RNA, 14 nt, Human
aaaaauauuuuaug

SEQ ID NO: 1705463 - RNA, 12 nt, Human
ggauaaaugcca

SEQ ID NO: 1705464 - RNA, 22 nt, Human
ggauaauaaggaaaaguuuaau

SEQ ID NO: 1705465 - RNA, 12 nt, Human
gcuuuucugauc

SEQ ID NO: 1705466 - RNA, 15 nt, Human
gcuuuucugauccag

SEQ ID NO: 1705467 - RNA, 16 nt, Human
gcuuuucugauccagu

SEQ ID NO: 1705468 - RNA, 11 nt, Human
gcuuuucugau

SEQ ID NO: 1705469 - RNA, 13 nt, Human
ggaaaucuuuaaa

SEQ ID NO: 1705470 - RNA, 23 nt, Human
gcguugaaauuguaauuauaucu

SEQ ID NO: 1705471 - RNA, 24 nt, Human
gcguugaaauuguaauuauaucug

SEQ ID NO: 1705472 - RNA, 18 nt, Human
gcguugaaauuguaauua

SEQ ID NO: 1705473 - RNA, 24 nt, Human
gccaucaauaaaaaauuaugacau

SEQ ID NO: 1705474 - RNA, 20 nt, Human
cucucaaccaccuuucagau

SEQ ID NO: 1705475 - RNA, 15 nt, Human
ccuuuuucauuauuu

SEQ ID NO: 1705476 - RNA, 17 nt, Human
ccuuuuucauuauuuua

SEQ ID NO: 1705477 - RNA, 14 nt, Human
cuaaacuuucacac

SEQ ID NO: 1705478 - RNA, 13 nt, Human
cuaaacuuuucug

SEQ ID NO: 1705479 - RNA, 13 nt, Human
cuaaacuuucaca

SEQ ID NO: 1705480 - RNA, 20 nt, Human
cccuauuuuuuuucuguuau

SEQ ID NO: 1705481 - RNA, 21 nt, Human
cccuauuuuuuuucuguuaua

SEQ ID NO: 1705482 - RNA, 17 nt, Human
cccuggccuuucauauu

SEQ ID NO: 1705483 - RNA, 17 nt, Human
ccuagcacacacuuuug

SEQ ID NO: 1705484 - RNA, 21 nt, Human
ccagcagauuauucacugauu

SEQ ID NO: 1705485 - RNA, 22 nt, Human
ccagcagauuauucacugauuu

SEQ ID NO: 1705486 - RNA, 16 nt, Human
ccagcagauuauucac

SEQ ID NO: 1705487 - RNA, 12 nt, Human
caguauugaagc

SEQ ID NO: 1705488 - RNA, 14 nt, Human
caguauugaagcau

SEQ ID NO: 1705489 - RNA, 15 nt, Human
caguauugaagcauu

SEQ ID NO: 1705490 - RNA, 22 nt, Human
caguauuguacaaaguauuaag

SEQ ID NO: 1705491 - RNA, 16 nt, Human
caguauugaagcauuu

SEQ ID NO: 1705492 - RNA, 17 nt, Human
caguauugaagcauuuu

SEQ ID NO: 1705493 - RNA, 20 nt, Human
caguauugaagcauuuuaua

SEQ ID NO: 1705494 - RNA, 13 nt, Human
cagauacuggauu

SEQ ID NO: 1705495 - RNA, 13 nt, Human
ccaauuaaggauu

SEQ ID NO: 1705496 - RNA, 18 nt, Human
ccaauuaaggauuuuaug

SEQ ID NO: 1705497 - RNA, 22 nt, Human
ccaauuaaggauuuuaugcuuu

SEQ ID NO: 1705498 - RNA, 21 nt, Human
cauucuccuaucaccugucuu

SEQ ID NO: 1705499 - RNA, 16 nt, Human
ccaaaaaccaguauug

SEQ ID NO: 1705500 - RNA, 19 nt, Human
ccaaaaaccaguauuguac

SEQ ID NO: 1705501 - RNA, 20 nt, Human
ccaaaaaccaguauuguaca

SEQ ID NO: 1705502 - RNA, 17 nt, Human
cacuccaauuaaggauu

SEQ ID NO: 1705503 - RNA, 18 nt, Human
cacuccaauuaaggauuu

SEQ ID NO: 1705504 - RNA, 13 nt, Human
cacuccaauuaag

SEQ ID NO: 1705505 - RNA, 15 nt, Human
cacuccaauuaagga

SEQ ID NO: 1705506 - RNA, 14 nt, Human
auuuuaugauccag

SEQ ID NO: 1705507 - RNA, 15 nt, Human
auuuuaugauccagc

SEQ ID NO: 1705508 - RNA, 16 nt, Human
auuuuaugauccagca

SEQ ID NO: 1705509 - RNA, 12 nt, Human
auuuguuugcau

SEQ ID NO: 1705510 - RNA, 13 nt, Human
auuuggaaaucuu

SEQ ID NO: 1705511 - RNA, 11 nt, Human
auuuggaaauc

SEQ ID NO: 1705512 - RNA, 12 nt, Human
auuuggaaaucu

SEQ ID NO: 1705513 - RNA, 12 nt, Human
auuuuaugcuuu

SEQ ID NO: 1705514 - RNA, 17 nt, Human
auuuuaugcuuuaaaca

SEQ ID NO: 1705515 - RNA, 12 nt, Human
auuacaguauaa

SEQ ID NO: 1705516 - RNA, 14 nt, Human
auuacaguauaauu

SEQ ID NO: 1705517 - RNA, 15 nt, Human
auuacaguauaauua

SEQ ID NO: 1705518 - RNA, 16 nt, Human
auuacaguauaauuaa

SEQ ID NO: 1705519 - RNA, 18 nt, Human
auucaaaguugccuaaau

SEQ ID NO: 1705520 - RNA, 20 nt, Human
auucaaaguugccuaaaucc

SEQ ID NO: 1705521 - RNA, 21 nt, Human
auucaaaguugccuaaaucca

SEQ ID NO: 1705522 - RNA, 22 nt, Human
auucaaaguugccuaaauccau

SEQ ID NO: 1705523 - RNA, 17 nt, Human
auucaaaguugccuaaa

SEQ ID NO: 1705524 - RNA, 14 nt, Human
auuaugaaacuugu

SEQ ID NO: 1705525 - RNA, 15 nt, Human
auuaugaaacuugug

SEQ ID NO: 1705526 - RNA, 18 nt, Human
auuaugaaacuuguguaa

SEQ ID NO: 1705527 - RNA, 20 nt, Human
auuaugaaacuuguguaaau

SEQ ID NO: 1705528 - RNA, 21 nt, Human
auuaugaaacuuguguaaaua

SEQ ID NO: 1705529 - RNA, 14 nt, Human
auuguaauuauauc

SEQ ID NO: 1705530 - RNA, 13 nt, Human
auuguaauuauau

SEQ ID NO: 1705531 - RNA, 13 nt, Human
uuguacaaaguau

SEQ ID NO: 1705532 - RNA, 14 nt, Human
uuguacaaaguauu

SEQ ID NO: 1705533 - RNA, 13 nt, Human
uugguugcuuuaa

SEQ ID NO: 1705534 - RNA, 16 nt, Human
uugguugcuuuaauau

SEQ ID NO: 1705535 - RNA, 15 nt, Human
uuguacaaaguauua

SEQ ID NO: 1705536 - RNA, 17 nt, Human
uuguacaaaguauuaag

SEQ ID NO: 1705537 - RNA, 20 nt, Human
uuguacaaaguauuaagcau

SEQ ID NO: 1705538 - RNA, 21 nt, Human
uuguacaaaguauuaagcaua

SEQ ID NO: 1705539 - RNA, 22 nt, Human
uuguacaaaguauuaagcauau

SEQ ID NO: 1705540 - RNA, 16 nt, Human
augacuucauuaauaa

SEQ ID NO: 1705541 - RNA, 11 nt, Human
augacuuugga

SEQ ID NO: 1705542 - RNA, 12 nt, Human
augacuuuggac

SEQ ID NO: 1705543 - RNA, 15 nt, Human
uuggggauucuuaaa

SEQ ID NO: 1705544 - RNA, 13 nt, Human
uuggggauucuua

SEQ ID NO: 1705545 - RNA, 15 nt, Human
uuggauaauaaggaa

SEQ ID NO: 1705546 - RNA, 19 nt, Human
uuggauaauaaggaaaagu

SEQ ID NO: 1705547 - RNA, 21 nt, Human
uuggauaauaaggaaaaguuu

SEQ ID NO: 1705548 - RNA, 13 nt, Human
aucugugaacuug

SEQ ID NO: 1705549 - RNA, 17 nt, Human
aucugugaacuugaaau

SEQ ID NO: 1705550 - RNA, 18 nt, Human
aucugugaacuugaaauu

SEQ ID NO: 1705551 - RNA, 19 nt, Human
aucugugaacuugaaauuu

SEQ ID NO: 1705552 - RNA, 14 nt, Human
aucugccuaaggac

SEQ ID NO: 1705553 - RNA, 15 nt, Human
aucugccuaaggacu

SEQ ID NO: 1705554 - RNA, 16 nt, Human
aucugccuaaggacuu

SEQ ID NO: 1705555 - RNA, 17 nt, Human
aucugccuaaggacuuc

SEQ ID NO: 1705556 - RNA, 13 nt, Human
aucugccuaagga

SEQ ID NO: 1705557 - RNA, 18 nt, Human
aucugccuaaggacuucu

SEQ ID NO: 1705558 - RNA, 19 nt, Human
aucugccuaaggacuucuu

SEQ ID NO: 1705559 - RNA, 20 nt, Human
aucugccuaaggacuucuuu

SEQ ID NO: 1705560 - RNA, 15 nt, Human
aucugaggaauucug

SEQ ID NO: 1705561 - RNA, 16 nt, Human
aucugaggaauucugu

SEQ ID NO: 1705562 - RNA, 17 nt, Human
aucugaggaauucugua

SEQ ID NO: 1705563 - RNA, 18 nt, Human
aucugaggaauucuguau

SEQ ID NO: 1705564 - RNA, 20 nt, Human
aucugaggaauucuguauag

SEQ ID NO: 1705565 - RNA, 21 nt, Human
aucugaggaauucuguauaga

SEQ ID NO: 1705566 - RNA, 13 nt, Human
uugccuaaaucca

SEQ ID NO: 1705567 - RNA, 14 nt, Human
uugccuaaauccau

SEQ ID NO: 1705568 - RNA, 15 nt, Human
uugccuaaauccauu

SEQ ID NO: 1705569 - RNA, 22 nt, Human
uugccuaaauccauuuggaaau

SEQ ID NO: 1705570 - RNA, 14 nt, Human
uuuagucuugucuc

SEQ ID NO: 1705571 - RNA, 22 nt, Human
uuuauuacaguauaauuaacau

SEQ ID NO: 1705572 - RNA, 23 nt, Human
auggaacgcguugaaauuguaau

SEQ ID NO: 1705573 - RNA, 23 nt, Human
uuuauuacaguauaauuaacaug

SEQ ID NO: 1705574 - RNA, 13 nt, Human
uuucauauuuuag

SEQ ID NO: 1705575 - RNA, 21 nt, Human
uuucauauuuuagcuacuaua

SEQ ID NO: 1705576 - RNA, 14 nt, Human
augccaaguuguuu

SEQ ID NO: 1705577 - RNA, 16 nt, Human
augccaaguuguuuga

SEQ ID NO: 1705578 - RNA, 23 nt, Human
augccaaguuguuugagaaauua

SEQ ID NO: 1705579 - RNA, 14 nt, Human
uuuaauuuuggaau

SEQ ID NO: 1705580 - RNA, 15 nt, Human
uuuaauuuuggaauu

SEQ ID NO: 1705581 - RNA, 17 nt, Human
uuuaauuuuggaauuuu

SEQ ID NO: 1705582 - RNA, 12 nt, Human
augauuucuaug

SEQ ID NO: 1705583 - RNA, 13 nt, Human
augauuucuaugc

SEQ ID NO: 1705584 - RNA, 16 nt, Human
augauuucuaugcuga

SEQ ID NO: 1705585 - RNA, 19 nt, Human
uuguguaaauacaauuuug

SEQ ID NO: 1705586 - RNA, 17 nt, Human
auauuuucauucuccua

SEQ ID NO: 1705587 - RNA, 16 nt, Human
auauuuuuauauuuac

SEQ ID NO: 1705588 - RNA, 14 nt, Human
aucacuuuuuucca

SEQ ID NO: 1705589 - RNA, 18 nt, Human
uucucagaaggcaaauga

SEQ ID NO: 1705590 - RNA, 19 nt, Human
uucucagaaggcaaaugac

SEQ ID NO: 1705591 - RNA, 21 nt, Human
uucucagaaggcaaaugacuu

SEQ ID NO: 1705592 - RNA, 22 nt, Human
uucucagaaggcaaaugacuuu

SEQ ID NO: 1705593 - RNA, 15 nt, Human
aucaauaaaaaauua

SEQ ID NO: 1705594 - RNA, 17 nt, Human
aucaauaaaaaauuaug

SEQ ID NO: 1705595 - RNA, 18 nt, Human
aucaauaaaaaauuauga

SEQ ID NO: 1705596 - RNA, 13 nt, Human
uucuguacuuuuu

SEQ ID NO: 1705597 - RNA, 18 nt, Human
uucuguacuuuuuggcau

SEQ ID NO: 1705598 - RNA, 19 nt, Human
uucuguacuuuuuggcaua

SEQ ID NO: 1705599 - RNA, 20 nt, Human
uucuggugugaacuaaacuu

SEQ ID NO: 1705600 - RNA, 21 nt, Human
uucuggugugaacuaaacuuu

SEQ ID NO: 1705601 - RNA, 14 nt, Human
uucuggugugaacu

SEQ ID NO: 1705602 - RNA, 20 nt, Human
auccaguuuuguuuggacca

SEQ ID NO: 1705603 - RNA, 21 nt, Human
auccaguuuuguuuggaccaa

SEQ ID NO: 1705604 - RNA, 18 nt, Human
auccaguuuuguuuggac

SEQ ID NO: 1705605 - RNA, 17 nt, Human
auccaguuuuguuugga

SEQ ID NO: 1705606 - RNA, 17 nt, Human
auccauuuggaaaucuu

SEQ ID NO: 1705607 - RNA, 19 nt, Human
auccauuuggaaaucuuua

SEQ ID NO: 1705608 - RNA, 13 nt, Human
auccauuuggaaa

SEQ ID NO: 1705609 - RNA, 13 nt, Human
auagucuggcugu

SEQ ID NO: 1705610 - RNA, 14 nt, Human
auauaugugaugau

SEQ ID NO: 1705611 - RNA, 13 nt, Human
auuuuauuaugaa

SEQ ID NO: 1705612 - RNA, 14 nt, Human
auuuuauuaugaaa

SEQ ID NO: 1705613 - RNA, 11 nt, Human
auuuuauuaug

SEQ ID NO: 1705614 - RNA, 12 nt, Human
auuuuauuauga

SEQ ID NO: 1705615 - RNA, 18 nt, Human
auuuuauuaugaaacuug

SEQ ID NO: 1705616 - RNA, 21 nt, Human
auuuuauuaugaaacuugugu

SEQ ID NO: 1705617 - RNA, 14 nt, Human
auuuuauuauguaa

SEQ ID NO: 1705618 - RNA, 13 nt, Human
auuuuauuaugua

SEQ ID NO: 1705619 - RNA, 15 nt, Human
auuuacuaaaaugga

SEQ ID NO: 1705620 - RNA, 20 nt, Human
auuuggaaaucuuuaaaaaa

SEQ ID NO: 1705621 - RNA, 17 nt, Human
auuuggaaaucuuuaaa

SEQ ID NO: 1705622 - RNA, 23 nt, Human
auugugcgcuaaacuuuucugau

SEQ ID NO: 1705623 - RNA, 21 nt, Human
auucccuggccuuucauauuu

SEQ ID NO: 1705624 - RNA, 21 nt, Human
auuauuuuauuaugaaacuug

SEQ ID NO: 1705625 - RNA, 22 nt, Human
auuauuuuauuaugaaacuugu

SEQ ID NO: 1705626 - RNA, 15 nt, Human
auuagagaguguuga

SEQ ID NO: 1705627 - RNA, 16 nt, Human
auuagagaguguugaa

SEQ ID NO: 1705628 - RNA, 17 nt, Human
auuagagaguguugaaa

SEQ ID NO: 1705629 - RNA, 18 nt, Human
auuagagaguguugaaac

SEQ ID NO: 1705630 - RNA, 19 nt, Human
auuagagaguguugaaacg

SEQ ID NO: 1705631 - RNA, 15 nt, Human
auuauuuuauuauga

SEQ ID NO: 1705632 - RNA, 13 nt, Human
uuuuauuauguaa

SEQ ID NO: 1705633 - RNA, 14 nt, Human
uuuuauuauguaaa

SEQ ID NO: 1705634 - RNA, 15 nt, Human
uuuucauuauuuuau

SEQ ID NO: 1705635 - RNA, 21 nt, Human
uuuucauuauuuuauuaugaa

SEQ ID NO: 1705636 - RNA, 22 nt, Human
uuuucauucuccuaucaccugu

SEQ ID NO: 1705637 - RNA, 12 nt, Human
uuuuauuaugua

SEQ ID NO: 1705638 - RNA, 18 nt, Human
uuuuaugcuuuaaacauu

SEQ ID NO: 1705639 - RNA, 12 nt, Human
uuuuauaaaucg

SEQ ID NO: 1705640 - RNA, 20 nt, Human
uuuuauaaaucgcuuuugau

SEQ ID NO: 1705641 - RNA, 16 nt, Human
auuaagaaugaaauac

SEQ ID NO: 1705642 - RNA, 20 nt, Human
auuaagaaugaaauacuguu

SEQ ID NO: 1705643 - RNA, 21 nt, Human
auuaagaaugaaauacuguuu

SEQ ID NO: 1705644 - RNA, 22 nt, Human
auuaagaaugaaauacuguuug

SEQ ID NO: 1705645 - RNA, 12 nt, Human
auuaaagccaug

SEQ ID NO: 1705646 - RNA, 16 nt, Human
auuaaagccauguuua

SEQ ID NO: 1705647 - RNA, 17 nt, Human
auuaaagccauguuuau

SEQ ID NO: 1705648 - RNA, 21 nt, Human
auuaaagccauguuuauuaca

SEQ ID NO: 1705649 - RNA, 13 nt, Human
auuaacauguuaa

SEQ ID NO: 1705650 - RNA, 14 nt, Human
auuaacauguuaaa

SEQ ID NO: 1705651 - RNA, 15 nt, Human
auuaacauguuaaac

SEQ ID NO: 1705652 - RNA, 17 nt, Human
auuaacauguuaaacca

SEQ ID NO: 1705653 - RNA, 19 nt, Human
auuaacauguuaaaccaug

SEQ ID NO: 1705654 - RNA, 18 nt, Human
uuuguuucuguacuuuuu

SEQ ID NO: 1705655 - RNA, 12 nt, Human
uuuguuucugua

SEQ ID NO: 1705656 - RNA, 13 nt, Human
uuuguuucuguac

SEQ ID NO: 1705657 - RNA, 15 nt, Human
uuugucuacaccauu

SEQ ID NO: 1705658 - RNA, 21 nt, Human
auaaauucccuggccuuucau

SEQ ID NO: 1705659 - RNA, 22 nt, Human
auaaauucccuggccuuucaua

SEQ ID NO: 1705660 - RNA, 18 nt, Human
auaacuguuauuuauaau

SEQ ID NO: 1705661 - RNA, 20 nt, Human
auaacuguuauuuauaauca

SEQ ID NO: 1705662 - RNA, 22 nt, Human
auaacuguuauuuauaaucacu

SEQ ID NO: 1705663 - RNA, 21 nt, Human
auaaauagcuagacuggugac

SEQ ID NO: 1705664 - RNA, 22 nt, Human
auaaauagcuagacuggugacu

SEQ ID NO: 1705665 - RNA, 15 nt, Human
aguuuugguugcuuu

SEQ ID NO: 1705666 - RNA, 21 nt, Human
aguuuugguugcuuuaauauc

SEQ ID NO: 1705667 - RNA, 22 nt, Human
aguuuugguugcuuuaauauca

SEQ ID NO: 1705668 - RNA, 17 nt, Human
uuaaguaucugacaucu

SEQ ID NO: 1705669 - RNA, 14 nt, Human
uuaagucuguuuua

SEQ ID NO: 1705670 - RNA, 15 nt, Human
uuaagucuguuuuau

SEQ ID NO: 1705671 - RNA, 11 nt, Human
aguugccuaaa

SEQ ID NO: 1705672 - RNA, 15 nt, Human
aguugccuaaaucca

SEQ ID NO: 1705673 - RNA, 16 nt, Human
aguugccuaaauccau

SEQ ID NO: 1705674 - RNA, 17 nt, Human
aguugccuaaauccauu

SEQ ID NO: 1705675 - RNA, 18 nt, Human
uguuauuuauaaucacuu

SEQ ID NO: 1705676 - RNA, 21 nt, Human
uguuauuuauaaucacuuuuu

SEQ ID NO: 1705677 - RNA, 21 nt, Human
aguguugaaacggaugauuuc

SEQ ID NO: 1705678 - RNA, 22 nt, Human
aguucacucuccauuuaauaau

SEQ ID NO: 1705679 - RNA, 24 nt, Human
aguucacucuccauuuaauaauua

SEQ ID NO: 1705680 - RNA, 13 nt, Human
uguuuagucuugu

SEQ ID NO: 1705681 - RNA, 17 nt, Human
uguuuagucuugucuca

SEQ ID NO: 1705682 - RNA, 18 nt, Human
uguuuagucuugucucag

SEQ ID NO: 1705683 - RNA, 19 nt, Human
uguuuagucuugucucaga

SEQ ID NO: 1705684 - RNA, 18 nt, Human
uguuuauuacaguauaau

SEQ ID NO: 1705685 - RNA, 16 nt, Human
uguggugacuuuggau

SEQ ID NO: 1705686 - RNA, 17 nt, Human
uguggugacuuuggaua

SEQ ID NO: 1705687 - RNA, 13 nt, Human
uguaaaucccauu

SEQ ID NO: 1705688 - RNA, 16 nt, Human
uguaaaucccauuauu

SEQ ID NO: 1705689 - RNA, 18 nt, Human
uguaaaucccauuauuca

SEQ ID NO: 1705690 - RNA, 19 nt, Human
uguaaaucccauuauucaa

SEQ ID NO: 1705691 - RNA, 20 nt, Human
uguaaaucccauuauucaaa

SEQ ID NO: 1705692 - RNA, 22 nt, Human
uguaaaucccauuauucaaagu

SEQ ID NO: 1705693 - RNA, 14 nt, Human
uguaauuauaucug

SEQ ID NO: 1705694 - RNA, 15 nt, Human
uguaauuauaucuga

SEQ ID NO: 1705695 - RNA, 13 nt, Human
uguaauuauaucu

SEQ ID NO: 1705696 - RNA, 14 nt, Human
agguuuuuaagccu

SEQ ID NO: 1705697 - RNA, 12 nt, Human
uguacuuuuugg

SEQ ID NO: 1705698 - RNA, 15 nt, Human
uguacuuuuuggcau

SEQ ID NO: 1705699 - RNA, 16 nt, Human
uguacuuuuuggcaua

SEQ ID NO: 1705700 - RNA, 17 nt, Human
uguacuuuuuggcauaa

SEQ ID NO: 1705701 - RNA, 17 nt, Human
ugggcugaacacuccaa

SEQ ID NO: 1705702 - RNA, 19 nt, Human
ugggcugaacacuccaauu

SEQ ID NO: 1705703 - RNA, 14 nt, Human
uggaaaucuuuaaa

SEQ ID NO: 1705704 - RNA, 15 nt, Human
uggaaaucuuuaaaa

SEQ ID NO: 1705705 - RNA, 17 nt, Human
uggacuguggugacuuu

SEQ ID NO: 1705706 - RNA, 19 nt, Human
uggacuguggugacuuugg

SEQ ID NO: 1705707 - RNA, 21 nt, Human
uggacuguggugacuuuggau

SEQ ID NO: 1705708 - RNA, 22 nt, Human
uggacuguggugacuuuggaua

SEQ ID NO: 1705709 - RNA, 15 nt, Human
uggacuguggugacu

SEQ ID NO: 1705710 - RNA, 16 nt, Human
uggacuguggugacuu

SEQ ID NO: 1705711 - RNA, 14 nt, Human
aggcaaaugacuuu

SEQ ID NO: 1705712 - RNA, 15 nt, Human
aggcaaaugacuuug

SEQ ID NO: 1705713 - RNA, 18 nt, Human
aggcaaaugacuuuggac

SEQ ID NO: 1705714 - RNA, 17 nt, Human
uggcauaacauaaaucu

SEQ ID NO: 1705715 - RNA, 21 nt, Human
uggcauaacauaaaucuguga

SEQ ID NO: 1705716 - RNA, 22 nt, Human
uggcauaacauaaaucugugaa

SEQ ID NO: 1705717 - RNA, 12 nt, Human
ugcuaaggacuu

SEQ ID NO: 1705718 - RNA, 13 nt, Human
ugcuaaggacuug

SEQ ID NO: 1705719 - RNA, 18 nt, Human
ugcuaaggacuuguuaga

SEQ ID NO: 1705720 - RNA, 22 nt, Human
ugcuaaggacuuguuagaucua

SEQ ID NO: 1705721 - RNA, 23 nt, Human
aggaauggagccugcacggugaa

SEQ ID NO: 1705722 - RNA, 17 nt, Human
aggaagccugauuaaag

SEQ ID NO: 1705723 - RNA, 18 nt, Human
aggaagccugauuaaaga

SEQ ID NO: 1705724 - RNA, 21 nt, Human
aggaagccugauuaaagaaug

SEQ ID NO: 1705725 - RNA, 14 nt, Human
agcuagacugguga

SEQ ID NO: 1705726 - RNA, 16 nt, Human
agcuagacuggugacu

SEQ ID NO: 1705727 - RNA, 17 nt, Human
agcuagacuggugacug

SEQ ID NO: 1705728 - RNA, 21 nt, Human
agcuagacuggugacugauuc

SEQ ID NO: 1705729 - RNA, 13 nt, Human
agcuagacuggug

SEQ ID NO: 1705730 - RNA, 15 nt, Human
ugccaaguuguuuga

SEQ ID NO: 1705731 - RNA, 19 nt, Human
ugccaaguuguuugagaaa

SEQ ID NO: 1705732 - RNA, 20 nt, Human
ugccaaguuguuugagaaau

SEQ ID NO: 1705733 - RNA, 16 nt, Human
agccauguuuauuaca

SEQ ID NO: 1705734 - RNA, 13 nt, Human
agccauguuuauu

SEQ ID NO: 1705735 - RNA, 14 nt, Human
agccauguuuauua

SEQ ID NO: 1705736 - RNA, 22 nt, Human
ugauccaguuuuguuuggacca

SEQ ID NO: 1705737 - RNA, 22 nt, Human
ugauccagcagauuauucacug

SEQ ID NO: 1705738 - RNA, 21 nt, Human
ugauccagcagauuauucacu

SEQ ID NO: 1705739 - RNA, 15 nt, Human
ugagguuuuuaagcc

SEQ ID NO: 1705740 - RNA, 14 nt, Human
ugauaaucaacugg

SEQ ID NO: 1705741 - RNA, 18 nt, Human
ugauaaucaacugggcug

SEQ ID NO: 1705742 - RNA, 24 nt, Human
ugauaaucaacugggcugaacacu

SEQ ID NO: 1705743 - RNA, 17 nt, Human
agcaucacaguuuuggu

SEQ ID NO: 1705744 - RNA, 15 nt, Human
agcaucacaguuuug

SEQ ID NO: 1705745 - RNA, 18 nt, Human
agauuuuuuuguuguuug

SEQ ID NO: 1705746 - RNA, 19 nt, Human
agauuuuuuuguuguuugu

SEQ ID NO: 1705747 - RNA, 23 nt, Human
agauuuuuuuguuguuuguuuag

SEQ ID NO: 1705748 - RNA, 15 nt, Human
agauuuuuuuguugu

SEQ ID NO: 1705749 - RNA, 16 nt, Human
agauuuuuuuguuguu

SEQ ID NO: 1705750 - RNA, 14 nt, Human
agauuuuauuaugu

SEQ ID NO: 1705751 - RNA, 15 nt, Human
agauuuuauuaugua

SEQ ID NO: 1705752 - RNA, 16 nt, Human
agauuuuauuauguaa

SEQ ID NO: 1705753 - RNA, 17 nt, Human
agauuuuauuauguaaa

SEQ ID NO: 1705754 - RNA, 18 nt, Human
agauuuuauuauguaaau

SEQ ID NO: 1705755 - RNA, 19 nt, Human
agauuuuauuauguaaauc

SEQ ID NO: 1705756 - RNA, 17 nt, Human
ugaauuuuguguuagag

SEQ ID NO: 1705757 - RNA, 21 nt, Human
ugaauuuuguguuagagauuu

SEQ ID NO: 1705758 - RNA, 17 nt, Human
agauacuggauuguacu

SEQ ID NO: 1705759 - RNA, 14 nt, Human
agauacuggauugu

SEQ ID NO: 1705760 - RNA, 16 nt, Human
agauaacuguuauuua

SEQ ID NO: 1705761 - RNA, 19 nt, Human
agauaacuguuauuuauaa

SEQ ID NO: 1705762 - RNA, 20 nt, Human
agauaacuguuauuuauaau

SEQ ID NO: 1705763 - RNA, 12 nt, Human
ugaauggcuuug

SEQ ID NO: 1705764 - RNA, 15 nt, Human
ugaauggcuuuguau

SEQ ID NO: 1705765 - RNA, 11 nt, Human
ugaauggcuuu

SEQ ID NO: 1705766 - RNA, 17 nt, Human
ugaauggcuuuguauag

SEQ ID NO: 1705767 - RNA, 18 nt, Human
ugaauggcuuuguauaga

SEQ ID NO: 1705768 - RNA, 19 nt, Human
ugaauggcuuuguauagaa

SEQ ID NO: 1705769 - RNA, 22 nt, Human
ugaauggcuuuguauagaaccu

SEQ ID NO: 1705770 - RNA, 15 nt, Human
ugaagcauuuuauaa

SEQ ID NO: 1705771 - RNA, 16 nt, Human
ugaagcauuuuauaaa

SEQ ID NO: 1705772 - RNA, 17 nt, Human
ugaagcauuuuauaaau

SEQ ID NO: 1705773 - RNA, 18 nt, Human
ugaagcauuuuauaaauc

SEQ ID NO: 1705774 - RNA, 22 nt, Human
ugaagcauuuuauaaaucgcuu

SEQ ID NO: 1705775 - RNA, 14 nt, Human
ugaagcauuuuaua

SEQ ID NO: 1705776 - RNA, 17 nt, Human
ugaaacggaugauuucu

SEQ ID NO: 1705777 - RNA, 18 nt, Human
ugaaacggaugauuucua

SEQ ID NO: 1705778 - RNA, 19 nt, Human
ugaaacggaugauuucuau

SEQ ID NO: 1705779 - RNA, 20 nt, Human
ugaaacggaugauuucuaug

SEQ ID NO: 1705780 - RNA, 17 nt, Human
ugaaacuuguguaaaua

SEQ ID NO: 1705781 - RNA, 23 nt, Human
ugaaacuuguguaaauacaauuu

SEQ ID NO: 1705782 - RNA, 15 nt, Human
ugaaacggaugauuu

SEQ ID NO: 1705783 - RNA, 21 nt, Human
agaagccccacccugccucac

SEQ ID NO: 1705784 - RNA, 18 nt, Human
ucugaagugaaacugcuu

SEQ ID NO: 1705785 - RNA, 22 nt, Human
ucugaagugaaacugcuuguuu

SEQ ID NO: 1705786 - RNA, 16 nt, Human
ucugaagugaaacugc

SEQ ID NO: 1705787 - RNA, 13 nt, Human
agaaauuaaguau

SEQ ID NO: 1705788 - RNA, 17 nt, Human
agaaauuaaguaucuga

SEQ ID NO: 1705789 - RNA, 22 nt, Human
acuuugugcugggguuaucuga

SEQ ID NO: 1705790 - RNA, 21 nt, Human
acugggcugaacacuccaauu

SEQ ID NO: 1705791 - RNA, 16 nt, Human
acugggcugaacacuc

SEQ ID NO: 1705792 - RNA, 16 nt, Human
acuugaaauuugaauu

SEQ ID NO: 1705793 - RNA, 17 nt, Human
acuucauuaauaauaaa

SEQ ID NO: 1705794 - RNA, 12 nt, Human
ucuaguucacuc

SEQ ID NO: 1705795 - RNA, 16 nt, Human
ucuaguucacucucca

SEQ ID NO: 1705796 - RNA, 19 nt, Human
ucuaguucacucuccauuu

SEQ ID NO: 1705797 - RNA, 19 nt, Human
ucaguauugaagcauuuua

SEQ ID NO: 1705798 - RNA, 14 nt, Human
ucaguauugaagca

SEQ ID NO: 1705799 - RNA, 15 nt, Human
ucaguauugaagcau

SEQ ID NO: 1705800 - RNA, 16 nt, Human
ucaguauugaagcauu

SEQ ID NO: 1705801 - RNA, 17 nt, Human
ucaguauugaagcauuu

SEQ ID NO: 1705802 - RNA, 18 nt, Human
ucaguauugaagcauuuu

SEQ ID NO: 1705803 - RNA, 17 nt, Human
accaugggauaaaugcc

SEQ ID NO: 1705804 - RNA, 18 nt, Human
accaugggauaaaugcca

SEQ ID NO: 1705805 - RNA, 15 nt, Human
ucagaucugccuaag

SEQ ID NO: 1705806 - RNA, 18 nt, Human
ucagaucugccuaaggac

SEQ ID NO: 1705807 - RNA, 20 nt, Human
ucagaucugccuaaggacuu

SEQ ID NO: 1705808 - RNA, 13 nt, Human
ucagaucugccua

SEQ ID NO: 1705809 - RNA, 12 nt, Human
accaaaaaccag

SEQ ID NO: 1705810 - RNA, 13 nt, Human
accaaaaaccagu

SEQ ID NO: 1705811 - RNA, 14 nt, Human
acauugguguugua

SEQ ID NO: 1705812 - RNA, 16 nt, Human
acauugguguuguacu

SEQ ID NO: 1705813 - RNA, 22 nt, Human
acauugguguuguacucaauuu

SEQ ID NO: 1705814 - RNA, 23 nt, Human
acauugguguuguacucaauuuu

SEQ ID NO: 1705815 - RNA, 14 nt, Human
acauugguucuugu

SEQ ID NO: 1705816 - RNA, 16 nt, Human
acauugguucuuguau

SEQ ID NO: 1705817 - RNA, 18 nt, Human
acauugguucuuguauua

SEQ ID NO: 1705818 - RNA, 21 nt, Human
acauugguucuuguauuaaga

SEQ ID NO: 1705819 - RNA, 22 nt, Human
acauugguucuuguauuaagaa

SEQ ID NO: 1705820 - RNA, 23 nt, Human
acauugguucuuguauuaagaau

SEQ ID NO: 1705821 - RNA, 12 nt, Human
acauguauuugu

SEQ ID NO: 1705822 - RNA, 15 nt, Human
ucaaaguugccuaaa

SEQ ID NO: 1705823 - RNA, 15 nt, Human
uauuuguuugcauag

SEQ ID NO: 1705824 - RNA, 23 nt, Human
uccgugcuaaggacuuguuagau

SEQ ID NO: 1705825 - RNA, 16 nt, Human
uccgugcuaaggacuu

SEQ ID NO: 1705826 - RNA, 17 nt, Human
uccgugcuaaggacuug

SEQ ID NO: 1705827 - RNA, 18 nt, Human
uccgugcuaaggacuugu

SEQ ID NO: 1705828 - RNA, 17 nt, Human
uccauuuaauaauuaua

SEQ ID NO: 1705829 - RNA, 12 nt, Human
uccauuuggaaa

SEQ ID NO: 1705830 - RNA, 19 nt, Human
uccauuuggaaaucuuuaa

SEQ ID NO: 1705831 - RNA, 20 nt, Human
uccauuuggaaaucuuuaaa

SEQ ID NO: 1705832 - RNA, 12 nt, Human
uccauuuaauaa

SEQ ID NO: 1705833 - RNA, 14 nt, Human
acggaugauuucua

SEQ ID NO: 1705834 - RNA, 15 nt, Human
acggaugauuucuau

SEQ ID NO: 1705835 - RNA, 13 nt, Human
acgcguugaaauu

SEQ ID NO: 1705836 - RNA, 14 nt, Human
acgcguugaaauug

SEQ ID NO: 1705837 - RNA, 18 nt, Human
acgcguugaaauuguaau

SEQ ID NO: 1705838 - RNA, 20 nt, Human
acgcguugaaauuguaauua

SEQ ID NO: 1705839 - RNA, 22 nt, Human
uccacauaaggaaacuggguuc

SEQ ID NO: 1705840 - RNA, 16 nt, Human
uccaauuaaggauuuu

SEQ ID NO: 1705841 - RNA, 17 nt, Human
uccaauuaaggauuuua

SEQ ID NO: 1705842 - RNA, 15 nt, Human
uccaauuaaggauuu

SEQ ID NO: 1705843 - RNA, 15 nt, Human
acaaaguauuaagca

SEQ ID NO: 1705844 - RNA, 16 nt, Human
acaaaguauuaagcau

SEQ ID NO: 1705845 - RNA, 13 nt, Human
acaaaguauuaag

SEQ ID NO: 1705846 - RNA, 18 nt, Human
acaaaguauuaagcauau

SEQ ID NO: 1705847 - RNA, 18 nt, Human
uagcacacacuuuugguu

SEQ ID NO: 1705848 - RNA, 14 nt, Human
uaugcuauuucuau

SEQ ID NO: 1705849 - RNA, 15 nt, Human
uaugcuauuucuaua

SEQ ID NO: 1705850 - RNA, 16 nt, Human
uaugcuauuucuauau

SEQ ID NO: 1705851 - RNA, 18 nt, Human
uaugcuauuucuauauuu

SEQ ID NO: 1705852 - RNA, 22 nt, Human
uaugcuauuucuauauuuucau

SEQ ID NO: 1705853 - RNA, 23 nt, Human
uaugcuauuucuauauuuucauu

SEQ ID NO: 1705854 - RNA, 14 nt, Human
uaugaaacuugugu

SEQ ID NO: 1705855 - RNA, 19 nt, Human
uaugaaacuuguguaaaua

SEQ ID NO: 1705856 - RNA, 21 nt, Human
uaugaaacuuguguaaauaca

SEQ ID NO: 1705857 - RNA, 18 nt, Human
uauagauuagaauucugu

SEQ ID NO: 1705858 - RNA, 13 nt, Human
acacuuuugguua

SEQ ID NO: 1705859 - RNA, 22 nt, Human
acacuuuugguuaagucuguuu

SEQ ID NO: 1705860 - RNA, 13 nt, Human
aauuaaguaucug

SEQ ID NO: 1705861 - RNA, 14 nt, Human
aauuaaguaucuga

SEQ ID NO: 1705862 - RNA, 14 nt, Human
uacaccauuaugug

SEQ ID NO: 1705863 - RNA, 14 nt, Human
uaauuauaugcuau

SEQ ID NO: 1705864 - RNA, 18 nt, Human
uaauuauaugcuauuucu

SEQ ID NO: 1705865 - RNA, 19 nt, Human
uaauuauaugcuauuucua

SEQ ID NO: 1705866 - RNA, 19 nt, Human
uaauuauaucugaggaauu

SEQ ID NO: 1705867 - RNA, 21 nt, Human
uaauuauaucugaggaauucu

SEQ ID NO: 1705868 - RNA, 22 nt, Human
uaauuauaucugaggaauucug

SEQ ID NO: 1705869 - RNA, 23 nt, Human
uaauuauaucugaggaauucugu

SEQ ID NO: 1705870 - RNA, 14 nt, Human
uaaggacuucuuua

SEQ ID NO: 1705871 - RNA, 15 nt, Human
uaaggacuucuuuaa

SEQ ID NO: 1705872 - RNA, 16 nt, Human
uaaggacuucuuuaau

SEQ ID NO: 1705873 - RNA, 22 nt, Human
uaaggacuucuuuaauuuugga

SEQ ID NO: 1705874 - RNA, 17 nt, Human
uaaggaaaaguuuaaua

SEQ ID NO: 1705875 - RNA, 19 nt, Human
uaaggaaaaguuuaauauu

SEQ ID NO: 1705876 - RNA, 21 nt, Human
uaaggaaaaguuuaauauuaa

SEQ ID NO: 1705877 - RNA, 12 nt, Human
uaaggaaacugg

SEQ ID NO: 1705878 - RNA, 14 nt, Human
uaaggaaacugggu

SEQ ID NO: 1705879 - RNA, 19 nt, Human
uaaggaaacuggguuccug

SEQ ID NO: 1705880 - RNA, 13 nt, Human
uaagcauauauuu

SEQ ID NO: 1705881 - RNA, 13 nt, Human
uaaggacuuguua

SEQ ID NO: 1705882 - RNA, 15 nt, Human
uaaggacuuguuaga

SEQ ID NO: 1705883 - RNA, 16 nt, Human
uaaggacuuguuagau

SEQ ID NO: 1705884 - RNA, 19 nt, Human
uaaggacuuguuagaucua

SEQ ID NO: 1705885 - RNA, 21 nt, Human
aauccucucaaccaccuuuca

SEQ ID NO: 1705886 - RNA, 21 nt, Human
aaucccauuauucaaaguugc

SEQ ID NO: 1705887 - RNA, 14 nt, Human
aaucccauuauuca

SEQ ID NO: 1705888 - RNA, 16 nt, Human
aaucccauuauucaaa

SEQ ID NO: 1705889 - RNA, 12 nt, Human
uaacauguuaaa

SEQ ID NO: 1705890 - RNA, 15 nt, Human
uaacauguuaaacca

SEQ ID NO: 1705891 - RNA, 14 nt, Human
aauagcuagacugg

SEQ ID NO: 1705892 - RNA, 20 nt, Human
aauagcuagacuggugacug

SEQ ID NO: 1705893 - RNA, 21 nt, Human
aauagcuagacuggugacuga

SEQ ID NO: 1705894 - RNA, 17 nt, Human
aagccaaaccucuguga

SEQ ID NO: 1705895 - RNA, 21 nt, Human
guuuuucuuaaauaauaaaga

SEQ ID NO: 1705896 - RNA, 14 nt, Human
aaguauuaagcaua

SEQ ID NO: 1705897 - RNA, 15 nt, Human
aaguauuaagcauau

SEQ ID NO: 1705898 - RNA, 18 nt, Human
aaguauuaagcauauauu

SEQ ID NO: 1705899 - RNA, 16 nt, Human
aaguauuaagcauaua

SEQ ID NO: 1705900 - RNA, 17 nt, Human
aaguauuaagcauauau

SEQ ID NO: 1705901 - RNA, 20 nt, Human
guuuuucuuaaauaauaaag

SEQ ID NO: 1705902 - RNA, 17 nt, Human
guugccuaaauccauuu

SEQ ID NO: 1705903 - RNA, 22 nt, Human
guugccuaaauccauuuggaaa

SEQ ID NO: 1705904 - RNA, 19 nt, Human
guuuaauauuaaagccaug

SEQ ID NO: 1705905 - RNA, 20 nt, Human
guuuaauauuaaagccaugu

SEQ ID NO: 1705906 - RNA, 13 nt, Human
aaaugguuaaaag

SEQ ID NO: 1705907 - RNA, 19 nt, Human
aaaugguuaaaagagguuu

SEQ ID NO: 1705908 - RNA, 11 nt, Human
aaaugguuaaa

SEQ ID NO: 1705909 - RNA, 14 nt, Human
aaauuguaauuaua

SEQ ID NO: 1705910 - RNA, 15 nt, Human
aaauuguaauuauau

SEQ ID NO: 1705911 - RNA, 16 nt, Human
aaccucuuugucuaca

SEQ ID NO: 1705912 - RNA, 14 nt, Human
aacugggcugaaca

SEQ ID NO: 1705913 - RNA, 16 nt, Human
aacugggcugaacacu

SEQ ID NO: 1705914 - RNA, 17 nt, Human
aacugcuuguuuccuag

SEQ ID NO: 1705915 - RNA, 14 nt, Human
gugaacuugaaauu

SEQ ID NO: 1705916 - RNA, 15 nt, Human
gugaacuugaaauuu

SEQ ID NO: 1705917 - RNA, 15 nt, Human
aacuggguuccugca

SEQ ID NO: 1705918 - RNA, 14 nt, Human
aacuggguuccugc

SEQ ID NO: 1705919 - RNA, 19 nt, Human
accugucuugccuuuuuca

SEQ ID NO: 1705920 - RNA, 21 nt, Human
accugucuugccuuuuucauu

SEQ ID NO: 1705921 - RNA, 22 nt, Human
accugucuugccuuuuucauua

SEQ ID NO: 1705922 - RNA, 15 nt, Human
acugauucuucagca

SEQ ID NO: 1705923 - RNA, 22 nt, Human
acugauucuucagcaaaaauau

SEQ ID NO: 1705924 - RNA, 12 nt, Human
acugauucuuca

SEQ ID NO: 1705925 - RNA, 13 nt, Human
acugauucuucag

SEQ ID NO: 1705926 - RNA, 17 nt, Human
aauuggggauucuuaaa

SEQ ID NO: 1705927 - RNA, 20 nt, Human
aauuggggauucuuaaaguu

SEQ ID NO: 1705928 - RNA, 21 nt, Human
aaugguccgugcuaaggacuu

SEQ ID NO: 1705929 - RNA, 16 nt, Human
aauuggggauucuuaa

SEQ ID NO: 1705930 - RNA, 17 nt, Human
aauuuauuggcuuuucu

SEQ ID NO: 1705931 - RNA, 19 nt, Human
aauuuauuggcuuuucuga

SEQ ID NO: 1705932 - RNA, 20 nt, Human
aauuuauuggcuuuucugau

SEQ ID NO: 1705933 - RNA, 21 nt, Human
aauuuauuggcuuuucugauc

SEQ ID NO: 1705934 - RNA, 23 nt, Human
aauuuauuggcuuuucugaucca

SEQ ID NO: 1705935 - RNA, 12 nt, Human
aauuuuggaauu

SEQ ID NO: 1705936 - RNA, 11 nt, Human
aauuuuggaau

SEQ ID NO: 1705937 - RNA, 20 nt, Human
acaauuuuguuucuguacuu

SEQ ID NO: 1705938 - RNA, 18 nt, Human
acaauuuuguuucuguac

SEQ ID NO: 1705939 - RNA, 14 nt, Human
accaccuuucagau

SEQ ID NO: 1705940 - RNA, 14 nt, Human
aaggcaaaugacuu

SEQ ID NO: 1705941 - RNA, 15 nt, Human
aaggcaaaugacuuu

SEQ ID NO: 1705942 - RNA, 16 nt, Human
aaggcaaaugacuuug

SEQ ID NO: 1705943 - RNA, 20 nt, Human
aaugguccgugcuaaggacu

SEQ ID NO: 1705944 - RNA, 12 nt, Human
aauacuguuuga

SEQ ID NO: 1705945 - RNA, 13 nt, Human
aauauuaaagcca

SEQ ID NO: 1705946 - RNA, 12 nt, Human
aauauuaaagcc

SEQ ID NO: 1705947 - RNA, 14 nt, Human
aauauuaaagccau

SEQ ID NO: 1705948 - RNA, 15 nt, Human
aauauuaaagccaug

SEQ ID NO: 1705949 - RNA, 16 nt, Human
aauauuaaagccaugu

SEQ ID NO: 1705950 - RNA, 18 nt, Human
aauauuaaagccauguuu

SEQ ID NO: 1705951 - RNA, 19 nt, Human
aauauuaaagccauguuua

SEQ ID NO: 1705952 - RNA, 20 nt, Human
aauauuaaagccauguuuau

SEQ ID NO: 1705953 - RNA, 21 nt, Human
aauaauaaagaucauguaaaa

SEQ ID NO: 1705954 - RNA, 13 nt, Human
aauaauaaagauc

SEQ ID NO: 1705955 - RNA, 20 nt, Human
aaaucugugaacuugaaauu

SEQ ID NO: 1705956 - RNA, 19 nt, Human
aaaucugugaacuugaaau

SEQ ID NO: 1705957 - RNA, 21 nt, Human
aaaucugugaacuugaaauuu

SEQ ID NO: 1705958 - RNA, 23 nt, Human
aaauuggggauucuuaaaguuga

SEQ ID NO: 1705959 - RNA, 18 nt, Human
aaauuggggauucuuaaa

SEQ ID NO: 1705960 - RNA, 19 nt, Human
aaauuggggauucuuaaag

SEQ ID NO: 1705961 - RNA, 20 nt, Human
aaauuggggauucuuaaagu

SEQ ID NO: 1705962 - RNA, 22 nt, Human
aaauuggggauucuuaaaguug

SEQ ID NO: 1705963 - RNA, 11 nt, Human
aaccaguauug

SEQ ID NO: 1705964 - RNA, 13 nt, Human
aaccaguauugua

SEQ ID NO: 1705965 - RNA, 14 nt, Human
aaccaguauuguac

SEQ ID NO: 1705966 - RNA, 13 nt, Human
aacgcguugaaau

SEQ ID NO: 1705967 - RNA, 14 nt, Human
aacgcguugaaauu

SEQ ID NO: 1705968 - RNA, 15 nt, Human
aacgcguugaaauug

SEQ ID NO: 1705969 - RNA, 17 nt, Human
aacgcguugaaauugua

SEQ ID NO: 1705970 - RNA, 15 nt, Human
aacuguuauuuauaa

SEQ ID NO: 1705971 - RNA, 16 nt, Human
aacuguuauuuauaau

SEQ ID NO: 1705972 - RNA, 17 nt, Human
aacuguuauuuauaauc

SEQ ID NO: 1705973 - RNA, 20 nt, Human
aacuguuauuuauaaucacu

SEQ ID NO: 1705974 - RNA, 22 nt, Human
aacuguuauuuauaaucacuuu

SEQ ID NO: 1705975 - RNA, 20 nt, Human
aaaaguuuaauauuaaagcc

SEQ ID NO: 1705976 - RNA, 23 nt, Human
aaaaguuuaauauuaaagccaug

SEQ ID NO: 1705977 - RNA, 21 nt, Human
aaaaguuuaauauuaaagcca

SEQ ID NO: 1705978 - RNA, 22 nt, Human
aaaaguuuaauauuaaagccau

SEQ ID NO: 1705979 - RNA, 16 nt, Human
agaaugaaauacuguu

SEQ ID NO: 1705980 - RNA, 19 nt, Human
agaaugaaauacuguuuga

SEQ ID NO: 1705981 - RNA, 20 nt, Human
agaaugaaauacuguuugag

SEQ ID NO: 1705982 - RNA, 17 nt, Human
agacgaugucuucauac

SEQ ID NO: 1705983 - RNA, 19 nt, Human
agacgaugucuucauaccu

SEQ ID NO: 1705984 - RNA, 16 nt, Human
agacgaugucuucaua

SEQ ID NO: 1705985 - RNA, 16 nt, Human
agccaaaccucuguga

SEQ ID NO: 1705986 - RNA, 14 nt, Human
agcacacacuuuug

SEQ ID NO: 1705987 - RNA, 20 nt, Human
agcacacacuuuugguuaag

SEQ ID NO: 1705988 - RNA, 19 nt, Human
agaucugccuaaggacuuc

SEQ ID NO: 1705989 - RNA, 12 nt, Human
agucuguuuuau

SEQ ID NO: 1705990 - RNA, 20 nt, Human
auauauuuuuauauuuacua

SEQ ID NO: 1705991 - RNA, 18 nt, Human
auauauuuuuauauuuac

SEQ ID NO: 1705992 - RNA, 19 nt, Human
auauauuuuuauauuuacu

SEQ ID NO: 1705993 - RNA, 13 nt, Human
auaucaucaguau

SEQ ID NO: 1705994 - RNA, 14 nt, Human
aucccauuauucaa

SEQ ID NO: 1705995 - RNA, 15 nt, Human
aucccauuauucaaa

SEQ ID NO: 1705996 - RNA, 20 nt, Human
aucccauuauucaaaguugc

SEQ ID NO: 1705997 - RNA, 15 nt, Human
aucacaguuuugguu

SEQ ID NO: 1705998 - RNA, 22 nt, Human
aucacaguuuugguugcuuuaa

SEQ ID NO: 1705999 - RNA, 21 nt, Human
aucacaguuuugguugcuuua

SEQ ID NO: 1706000 - RNA, 14 nt, Human
augaagucucugaa

SEQ ID NO: 1706001 - RNA, 18 nt, Human
aucucugcaaucuucuca

SEQ ID NO: 1706002 - RNA, 21 nt, Human
aucucugcaaucuucucagaa

SEQ ID NO: 1706003 - RNA, 18 nt, Human
auggcuuuguauagaacc

SEQ ID NO: 1706004 - RNA, 13 nt, Human
augcuuuaaacau

SEQ ID NO: 1706005 - RNA, 19 nt, Human
auggcuuuguauagaaccu

SEQ ID NO: 1706006 - RNA, 20 nt, Human
augcugaguuugugcuggug

SEQ ID NO: 1706007 - RNA, 15 nt, Human
augguccgugcuaag

SEQ ID NO: 1706008 - RNA, 18 nt, Human
augguccgugcuaaggac

SEQ ID NO: 1706009 - RNA, 23 nt, Human
caacagcuggugcccugcuuuca

SEQ ID NO: 1706010 - RNA, 13 nt, Human
uuaauauuaaagc

SEQ ID NO: 1706011 - RNA, 14 nt, Human
uuaauauuaaagcc

SEQ ID NO: 1706012 - RNA, 16 nt, Human
uuaauauuaaagccau

SEQ ID NO: 1706013 - RNA, 17 nt, Human
uuaauauuaaagccaug

SEQ ID NO: 1706014 - RNA, 11 nt, Human
uuaauauuaaa

SEQ ID NO: 1706015 - RNA, 14 nt, Human
uuaauaauaaauuc

SEQ ID NO: 1706016 - RNA, 23 nt, Human
uuaauaauaaauucccuggccuu

SEQ ID NO: 1706017 - RNA, 12 nt, Human
uuacagaagccc

SEQ ID NO: 1706018 - RNA, 18 nt, Human
uuaauauuaaagccaugu

SEQ ID NO: 1706019 - RNA, 19 nt, Human
uuaauauuaaagccauguu

SEQ ID NO: 1706020 - RNA, 20 nt, Human
uuaauauuaaagccauguuu

SEQ ID NO: 1706021 - RNA, 12 nt, Human
uuaaagccaugu

SEQ ID NO: 1706022 - RNA, 14 nt, Human
uuaaagccauguuu

SEQ ID NO: 1706023 - RNA, 18 nt, Human
uuaaagccauguuuauua

SEQ ID NO: 1706024 - RNA, 20 nt, Human
uuaaagccauguuuauuaca

SEQ ID NO: 1706025 - RNA, 15 nt, Human
uuaaaaaaaaaauug

SEQ ID NO: 1706026 - RNA, 11 nt, Human
uguuucuguac

SEQ ID NO: 1706027 - RNA, 22 nt, Human
uguuucuguacuuuuuggcaua

SEQ ID NO: 1706028 - RNA, 23 nt, Human
uguuucuguacuuuuuggcauaa

SEQ ID NO: 1706029 - RNA, 23 nt, Human
uguuuccuagcacacacuuuugg

SEQ ID NO: 1706030 - RNA, 21 nt, Human
uguauugugcgcuaaacuuuu

SEQ ID NO: 1706031 - RNA, 14 nt, Human
ugcacggugaaugg

SEQ ID NO: 1706032 - RNA, 18 nt, Human
ugcacggugaauggcuuu

SEQ ID NO: 1706033 - RNA, 19 nt, Human
ugcacggugaauggcuuug

SEQ ID NO: 1706034 - RNA, 12 nt, Human
uggggauucuua

SEQ ID NO: 1706035 - RNA, 13 nt, Human
uggggauucuuaa

SEQ ID NO: 1706036 - RNA, 16 nt, Human
uggggauucuuaaagu

SEQ ID NO: 1706037 - RNA, 18 nt, Human
uggggauucuuaaaguug

SEQ ID NO: 1706038 - RNA, 20 nt, Human
uggggauucuuaaaguugaa

SEQ ID NO: 1706039 - RNA, 14 nt, Human
uggcuuuucugauc

SEQ ID NO: 1706040 - RNA, 17 nt, Human
uggcuuuucugauccag

SEQ ID NO: 1706041 - RNA, 13 nt, Human
uggcuuuucugau

SEQ ID NO: 1706042 - RNA, 18 nt, Human
uggcuuuucugauccagu

SEQ ID NO: 1706043 - RNA, 19 nt, Human
uggcuuuucugauccaguu

SEQ ID NO: 1706044 - RNA, 13 nt, Human
ugcuuuaauauca

SEQ ID NO: 1706045 - RNA, 15 nt, Human
ugcuuuaauaucauc

SEQ ID NO: 1706046 - RNA, 18 nt, Human
ugcuuuaauaucaucagu

SEQ ID NO: 1706047 - RNA, 20 nt, Human
ugcuuuaauaucaucaguau

SEQ ID NO: 1706048 - RNA, 19 nt, Human
uggaacgcguugaaauugu

SEQ ID NO: 1706049 - RNA, 18 nt, Human
uggaacgcguugaaauug

SEQ ID NO: 1706050 - RNA, 24 nt, Human
ucccuggccuuucauauuuuagcu

SEQ ID NO: 1706051 - RNA, 16 nt, Human
ucccuggccuuucaua

SEQ ID NO: 1706052 - RNA, 18 nt, Human
uccucucaaccaccuuuc

SEQ ID NO: 1706053 - RNA, 20 nt, Human
uccucucaaccaccuuucag

SEQ ID NO: 1706054 - RNA, 21 nt, Human
uccucucaaccaccuuucaga

SEQ ID NO: 1706055 - RNA, 15 nt, Human
ucgcuuuugauaauc

SEQ ID NO: 1706056 - RNA, 13 nt, Human
ucuauauuuucau

SEQ ID NO: 1706057 - RNA, 14 nt, Human
ucuauauuuucauu

SEQ ID NO: 1706058 - RNA, 15 nt, Human
ucuauauuuucauuc

SEQ ID NO: 1706059 - RNA, 16 nt, Human
ucuauauuuucauucu

SEQ ID NO: 1706060 - RNA, 19 nt, Human
ucuauauuuucauucuccu

SEQ ID NO: 1706061 - RNA, 16 nt, Human
ucucagauuuuauuau

SEQ ID NO: 1706062 - RNA, 17 nt, Human
ucucagauuuuauuaug

SEQ ID NO: 1706063 - RNA, 18 nt, Human
ucucagauuuuauuaugu

SEQ ID NO: 1706064 - RNA, 19 nt, Human
ucucagauuuuauuaugua

SEQ ID NO: 1706065 - RNA, 14 nt, Human
ucucagauuuuauu

SEQ ID NO: 1706066 - RNA, 15 nt, Human
ucucagauuuuauua

SEQ ID NO: 1706067 - RNA, 13 nt, Human
ucucagauuuuau

SEQ ID NO: 1706068 - RNA, 16 nt, Human
ucaucaguauugaagc

SEQ ID NO: 1706069 - RNA, 20 nt, Human
ucaucaguauugaagcauuu

SEQ ID NO: 1706070 - RNA, 21 nt, Human
ucaucaguauugaagcauuuu

SEQ ID NO: 1706071 - RNA, 23 nt, Human
ucaucaguauugaagcauuuuau

SEQ ID NO: 1706072 - RNA, 22 nt, Human
ucagauaacuguuauuuauaau

SEQ ID NO: 1706073 - RNA, 14 nt, Human
ucagauacuggauu

SEQ ID NO: 1706074 - RNA, 15 nt, Human
ucagauacuggauug

SEQ ID NO: 1706075 - RNA, 16 nt, Human
ucagauacuggauugu

SEQ ID NO: 1706076 - RNA, 19 nt, Human
ucagauacuggauuguacu

SEQ ID NO: 1706077 - RNA, 20 nt, Human
ucagauacuggauuguacuu

SEQ ID NO: 1706078 - RNA, 23 nt, Human
ucugccuaaggacuucuuuaauu

SEQ ID NO: 1706079 - RNA, 20 nt, Human
ucugccuaaggacuucuuua

SEQ ID NO: 1706080 - RNA, 21 nt, Human
ucugccuaaggacuucuuuaa

SEQ ID NO: 1706081 - RNA, 14 nt, Human
ucugcaaucuucuc

SEQ ID NO: 1706082 - RNA, 17 nt, Human
ucugcaaucuucucaga

SEQ ID NO: 1706083 - RNA, 17 nt, Human
ucuugucucagauuuua

SEQ ID NO: 1706084 - RNA, 14 nt, Human
ucuugucucagauu

SEQ ID NO: 1706085 - RNA, 15 nt, Human
ucuugucucagauuu

SEQ ID NO: 1706086 - RNA, 12 nt, Human
ucuugucucaga

SEQ ID NO: 1706087 - RNA, 14 nt, Human
ucuuguauuaagaa

SEQ ID NO: 1706088 - RNA, 15 nt, Human
ucuuguauuaagaau

SEQ ID NO: 1706089 - RNA, 12 nt, Human
ugacuuuggaua

SEQ ID NO: 1706090 - RNA, 13 nt, Human
ugacuuuggauaa

SEQ ID NO: 1706091 - RNA, 14 nt, Human
ugacuuuggauaau

SEQ ID NO: 1706092 - RNA, 15 nt, Human
ugacuuuggauaaua

SEQ ID NO: 1706093 - RNA, 16 nt, Human
ugacuuuggauaauaa

SEQ ID NO: 1706094 - RNA, 20 nt, Human
ugacuuuggauaauaaggaa

SEQ ID NO: 1706095 - RNA, 22 nt, Human
ugacuuuggauaauaaggaaaa

SEQ ID NO: 1706096 - RNA, 13 nt, Human
ugacaucucugca

SEQ ID NO: 1706097 - RNA, 14 nt, Human
ugacaucucugcaa

SEQ ID NO: 1706098 - RNA, 23 nt, Human
ugacaucucugcaaucuucucag

SEQ ID NO: 1706099 - RNA, 13 nt, Human
ugaacuugaaauu

SEQ ID NO: 1706100 - RNA, 14 nt, Human
ugaacuugaaauuu

SEQ ID NO: 1706101 - RNA, 18 nt, Human
ugaacuugaaauuugaau

SEQ ID NO: 1706102 - RNA, 12 nt, Human
uacaauuuuguu

SEQ ID NO: 1706103 - RNA, 15 nt, Human
uacaauuuuguuucu

SEQ ID NO: 1706104 - RNA, 16 nt, Human
uacaauuuuguuucug

SEQ ID NO: 1706105 - RNA, 17 nt, Human
uacaauuuuguuucugu

SEQ ID NO: 1706106 - RNA, 15 nt, Human
uacaaaguauuaagc

SEQ ID NO: 1706107 - RNA, 16 nt, Human
uacaaaguauuaagca

SEQ ID NO: 1706108 - RNA, 18 nt, Human
uacaaaguauuaagcaua

SEQ ID NO: 1706109 - RNA, 19 nt, Human
uacaaaguauuaagcauau

SEQ ID NO: 1706110 - RNA, 13 nt, Human
uacaaaguauuaa

SEQ ID NO: 1706111 - RNA, 14 nt, Human
uacaaaguauuaag

SEQ ID NO: 1706112 - RNA, 12 nt, Human
uacaaaguauua

SEQ ID NO: 1706113 - RNA, 17 nt, Human
uacuaaaauggacugug

SEQ ID NO: 1706114 - RNA, 15 nt, Human
uacuaaaauggacug

SEQ ID NO: 1706115 - RNA, 23 nt, Human
uacuaaaauggacuguggugacu

SEQ ID NO: 1706116 - RNA, 13 nt, Human
uaccuacauguau

SEQ ID NO: 1706117 - RNA, 23 nt, Human
uaccuacauguauuuguuugcau

SEQ ID NO: 1706118 - RNA, 21 nt, Human
uagacuggugacugauucuuc

SEQ ID NO: 1706119 - RNA, 23 nt, Human
uagacuggugacugauucuucag

SEQ ID NO: 1706120 - RNA, 20 nt, Human
uagacuggugacugauucuu

SEQ ID NO: 1706121 - RNA, 11 nt, Human
uagaauucugu

SEQ ID NO: 1706122 - RNA, 13 nt, Human
uagaauucuguau

SEQ ID NO: 1706123 - RNA, 14 nt, Human
uagaauucuguaua

SEQ ID NO: 1706124 - RNA, 15 nt, Human
uagaauucuguauag

SEQ ID NO: 1706125 - RNA, 16 nt, Human
uagaauucuguauaga

SEQ ID NO: 1706126 - RNA, 21 nt, Human
uagaauucuguauagauuaga

SEQ ID NO: 1706127 - RNA, 20 nt, Human
uagauuagagaguguugaaa

SEQ ID NO: 1706128 - RNA, 16 nt, Human
uagauuagaauucugu

SEQ ID NO: 1706129 - RNA, 17 nt, Human
uagauuagaauucugua

SEQ ID NO: 1706130 - RNA, 19 nt, Human
uagauuagaauucuguaua

SEQ ID NO: 1706131 - RNA, 20 nt, Human
uagauuagaauucuguauag

SEQ ID NO: 1706132 - RNA, 14 nt, Human
uagauuagaauucu

SEQ ID NO: 1706133 - RNA, 15 nt, Human
uagauuagaauucug

SEQ ID NO: 1706134 - RNA, 16 nt, Human
uauauuuucauucucc

SEQ ID NO: 1706135 - RNA, 14 nt, Human
uaucaucaguauug

SEQ ID NO: 1706136 - RNA, 15 nt, Human
uaucaucaguauuga

SEQ ID NO: 1706137 - RNA, 16 nt, Human
uaucaucaguauugaa

SEQ ID NO: 1706138 - RNA, 20 nt, Human
uauagaaccucuuugucuac

SEQ ID NO: 1706139 - RNA, 21 nt, Human
uauagaaccucuuugucuaca

SEQ ID NO: 1706140 - RNA, 23 nt, Human
uauaucugaggaauucuguauag

SEQ ID NO: 1706141 - RNA, 17 nt, Human
uaauauuaaagccaugu

SEQ ID NO: 1706142 - RNA, 20 nt, Human
uaauauuaaagccauguuua

SEQ ID NO: 1706143 - RNA, 21 nt, Human
uaauauuaaagccauguuuau

SEQ ID NO: 1706144 - RNA, 15 nt, Human
uaauauuaaagccau

SEQ ID NO: 1706145 - RNA, 16 nt, Human
uaauauuaaagccaug

SEQ ID NO: 1706146 - RNA, 23 nt, Human
uaauaucaucaguauugaagcau

SEQ ID NO: 1706147 - RNA, 21 nt, Human
uaauuaacauguuaaaccaug

SEQ ID NO: 1706148 - RNA, 20 nt, Human
uaaggauuuuaugcuuuaaa

SEQ ID NO: 1706149 - RNA, 22 nt, Human
uaaggauuuuaugcuuuaaaca

SEQ ID NO: 1706150 - RNA, 12 nt, Human
uaaggauuuuau

SEQ ID NO: 1706151 - RNA, 13 nt, Human
uaaggauuuuaug

SEQ ID NO: 1706152 - RNA, 17 nt, Human
uaaggauuuuaugcuuu

SEQ ID NO: 1706153 - RNA, 19 nt, Human
uaaggauuuuaugcuuuaa

SEQ ID NO: 1706154 - RNA, 13 nt, Human
uaagucuguuuua

SEQ ID NO: 1706155 - RNA, 16 nt, Human
uaagucuguuuuauga

SEQ ID NO: 1706156 - RNA, 19 nt, Human
uaagucuguuuuaugacuu

SEQ ID NO: 1706157 - RNA, 20 nt, Human
uaagucuguuuuaugacuuc

SEQ ID NO: 1706158 - RNA, 21 nt, Human
uaagucuguuuuaugacuuca

SEQ ID NO: 1706159 - RNA, 16 nt, Human
uaauaaggaaaaguuu

SEQ ID NO: 1706160 - RNA, 16 nt, Human
uaacuguuauuuauaa

SEQ ID NO: 1706161 - RNA, 17 nt, Human
uaacuguuauuuauaau

SEQ ID NO: 1706162 - RNA, 16 nt, Human
uaaaugccaucaauaa

SEQ ID NO: 1706163 - RNA, 23 nt, Human
uaaaugccaucaauaaaaaauua

SEQ ID NO: 1706164 - RNA, 14 nt, Human
uaaaugguuaaaag

SEQ ID NO: 1706165 - RNA, 19 nt, Human
uaaacauugguucuuguau

SEQ ID NO: 1706166 - RNA, 21 nt, Human
uaaacauugguucuuguauua

SEQ ID NO: 1706167 - RNA, 11 nt, Human
uaaagccaugu

SEQ ID NO: 1706168 - RNA, 13 nt, Human
uaaagccauguuu

SEQ ID NO: 1706169 - RNA, 15 nt, Human
uaaagccauguuuau

SEQ ID NO: 1706170 - RNA, 20 nt, Human
uaaagccauguuuauuacag

SEQ ID NO: 1706171 - RNA, 19 nt, Human
uaaaagagguuuuucuuaa

SEQ ID NO: 1706172 - RNA, 21 nt, Human
uaaaagagguuuuucuuaaau

SEQ ID NO: 1706173 - RNA, 18 nt, Human
uaaaagagguuuuucuua

SEQ ID NO: 1706174 - RNA, 16 nt, Human
guuuugguugcuuuaa

SEQ ID NO: 1706175 - RNA, 18 nt, Human
guuguuugagaaauuaag

SEQ ID NO: 1706176 - RNA, 21 nt, Human
guugaaacggaugauuucuau

SEQ ID NO: 1706177 - RNA, 22 nt, Human
guugaaacggaugauuucuaug

SEQ ID NO: 1706178 - RNA, 16 nt, Human
guugaaauuguaauua

SEQ ID NO: 1706179 - RNA, 20 nt, Human
guugaaauuguaauuauauc

SEQ ID NO: 1706180 - RNA, 15 nt, Human
guugaaauuguaauu

SEQ ID NO: 1706181 - RNA, 14 nt, Human
guugaauuuauugg

SEQ ID NO: 1706182 - RNA, 21 nt, Human
guugaauuuauuggcuuuucu

SEQ ID NO: 1706183 - RNA, 22 nt, Human
guugaauuuauuggcuuuucug

SEQ ID NO: 1706184 - RNA, 15 nt, Human
guuccugcaaugaag

SEQ ID NO: 1706185 - RNA, 22 nt, Human
guucauggaacgcguugaaauu

SEQ ID NO: 1706186 - RNA, 23 nt, Human
guucauggaacgcguugaaauug

SEQ ID NO: 1706187 - RNA, 19 nt, Human
guucacucuccauuuaaua

SEQ ID NO: 1706188 - RNA, 19 nt, Human
guuaucugaagucagaucu

SEQ ID NO: 1706189 - RNA, 10 nt, Human
guuauauaaa

SEQ ID NO: 1706190 - RNA, 12 nt, Human
guuauauaaaug

SEQ ID NO: 1706191 - RNA, 13 nt, Human
guuauauaaaugg

SEQ ID NO: 1706192 - RNA, 13 nt, Human
guuacagaagccc

SEQ ID NO: 1706193 - RNA, 21 nt, Human
guuaaaccaugggauaaaugc

SEQ ID NO: 1706194 - RNA, 18 nt, Human
guuaaaccaugggauaaa

SEQ ID NO: 1706195 - RNA, 20 nt, Human
guuaaaagagguuuuucuua

SEQ ID NO: 1706196 - RNA, 21 nt, Human
guuaaaagagguuuuucuuaa

SEQ ID NO: 1706197 - RNA, 14 nt, Human
guuaaaagagguuu

SEQ ID NO: 1706198 - RNA, 13 nt, Human
guggugacuuugg

SEQ ID NO: 1706199 - RNA, 15 nt, Human
guggugacuuuggau

SEQ ID NO: 1706200 - RNA, 16 nt, Human
guggugacuuuggaua

SEQ ID NO: 1706201 - RNA, 13 nt, Human
gugcuaaggacuu

SEQ ID NO: 1706202 - RNA, 14 nt, Human
gugcuaaggacuug

SEQ ID NO: 1706203 - RNA, 20 nt, Human
gugcuaaggacuuguuagau

SEQ ID NO: 1706204 - RNA, 12 nt, Human
gugcuaaggacu

SEQ ID NO: 1706205 - RNA, 21 nt, Human
gugcgcuaaacuuuucugaua

SEQ ID NO: 1706206 - RNA, 17 nt, Human
gugcgcuaaacuuuucu

SEQ ID NO: 1706207 - RNA, 15 nt, Human
gucuugucucagauu

SEQ ID NO: 1706208 - RNA, 20 nt, Human
gucuugucucagauuuuauu

SEQ ID NO: 1706209 - RNA, 22 nt, Human
gucuugucucagauuuuauuau

SEQ ID NO: 1706210 - RNA, 15 nt, Human
gucuugccuuuuuca

SEQ ID NO: 1706211 - RNA, 16 nt, Human
gucuugccuuuuucau

SEQ ID NO: 1706212 - RNA, 17 nt, Human
gucuugccuuuuucauu

SEQ ID NO: 1706213 - RNA, 18 nt, Human
gucuugccuuuuucauua

SEQ ID NO: 1706214 - RNA, 20 nt, Human
gucuugccuuuuucauuauu

SEQ ID NO: 1706215 - RNA, 13 nt, Human
gucuguuuuauga

SEQ ID NO: 1706216 - RNA, 15 nt, Human
gucuguuuuaugacu

SEQ ID NO: 1706217 - RNA, 17 nt, Human
gucucagauuuuauuau

SEQ ID NO: 1706218 - RNA, 21 nt, Human
gucucagauuuuauuauguaa

SEQ ID NO: 1706219 - RNA, 15 nt, Human
gucucagauuuuauu

SEQ ID NO: 1706220 - RNA, 16 nt, Human
gucucagauuuuauua

SEQ ID NO: 1706221 - RNA, 14 nt, Human
gucucagauuuuau

SEQ ID NO: 1706222 - RNA, 15 nt, Human
gucucugaagugaaa

SEQ ID NO: 1706223 - RNA, 21 nt, Human
gucucugaagugaaacugcuu

SEQ ID NO: 1706224 - RNA, 16 nt, Human
gucagaucugccuaag

SEQ ID NO: 1706225 - RNA, 18 nt, Human
gucagaucugccuaagga

SEQ ID NO: 1706226 - RNA, 19 nt, Human
gucagaucugccuaaggac

SEQ ID NO: 1706227 - RNA, 20 nt, Human
gucagaucugccuaaggacu

SEQ ID NO: 1706228 - RNA, 21 nt, Human
gucagaucugccuaaggacuu

SEQ ID NO: 1706229 - RNA, 16 nt, Human
guauuaagcauauauu

SEQ ID NO: 1706230 - RNA, 17 nt, Human
guauuaagcauauauuu

SEQ ID NO: 1706231 - RNA, 15 nt, Human
guauuaagcauauau

SEQ ID NO: 1706232 - RNA, 16 nt, Human
guauuaagaaugaaau

SEQ ID NO: 1706233 - RNA, 18 nt, Human
guauuaagcauauauuuu

SEQ ID NO: 1706234 - RNA, 21 nt, Human
guauuaagcauauauuuuuau

SEQ ID NO: 1706235 - RNA, 19 nt, Human
guauagaaccucuuugucu

SEQ ID NO: 1706236 - RNA, 14 nt, Human
guauagauuagaau

SEQ ID NO: 1706237 - RNA, 21 nt, Human
guaugugugaagugagugagu

SEQ ID NO: 1706238 - RNA, 15 nt, Human
guauaauuaacaugu

SEQ ID NO: 1706239 - RNA, 17 nt, Human
guauaauuaacauguua

SEQ ID NO: 1706240 - RNA, 19 nt, Human
guauaauuaacauguuaaa

SEQ ID NO: 1706241 - RNA, 22 nt, Human
guauaauuaacauguuaaacca

SEQ ID NO: 1706242 - RNA, 23 nt, Human
guauaauuaacauguuaaaccau

SEQ ID NO: 1706243 - RNA, 13 nt, Human
guauaauuaacau

SEQ ID NO: 1706244 - RNA, 14 nt, Human
guauaauuaacaug

SEQ ID NO: 1706245 - RNA, 10 nt, Human
guauaauuaa

SEQ ID NO: 1706246 - RNA, 22 nt, Human
uuuggaauuuuccuccuuucuc

SEQ ID NO: 1706247 - RNA, 16 nt, Human
uuuggauaauaaggaa

SEQ ID NO: 1706248 - RNA, 18 nt, Human
uuuuuaagccuuaaagga

SEQ ID NO: 1706249 - RNA, 21 nt, Human
uuuuggcauaacauaaaucug

SEQ ID NO: 1706250 - RNA, 16 nt, Human
uuuugguugcuuuaau

SEQ ID NO: 1706251 - RNA, 15 nt, Human
uuuugguugcuuuaa

SEQ ID NO: 1706252 - RNA, 22 nt, Human
gccuaaauccauuuggaaaucu

SEQ ID NO: 1706253 - RNA, 23 nt, Human
gccuaaauccauuuggaaaucuu

SEQ ID NO: 1706254 - RNA, 12 nt, Human
gccuaaauccau

SEQ ID NO: 1706255 - RNA, 13 nt, Human
gccuaaauccauu

SEQ ID NO: 1706256 - RNA, 19 nt, Human
gccuaaauccauuuggaaa

SEQ ID NO: 1706257 - RNA, 21 nt, Human
gccuaaauccauuuggaaauc

SEQ ID NO: 1706258 - RNA, 14 nt, Human
gcccugcuuucaga

SEQ ID NO: 1706259 - RNA, 16 nt, Human
gcccugcuuucagaua

SEQ ID NO: 1706260 - RNA, 13 nt, Human
gcuaaacuuuucu

SEQ ID NO: 1706261 - RNA, 15 nt, Human
gcuaaacuuuucuga

SEQ ID NO: 1706262 - RNA, 17 nt, Human
gcuaaacuuuucugaua

SEQ ID NO: 1706263 - RNA, 23 nt, Human
gccuuuuucauuauuuuauuaug

SEQ ID NO: 1706264 - RNA, 13 nt, Human
gauuuuauuaugu

SEQ ID NO: 1706265 - RNA, 15 nt, Human
gauuuuauuauguaa

SEQ ID NO: 1706266 - RNA, 18 nt, Human
gauuuuauuauguaaauc

SEQ ID NO: 1706267 - RNA, 19 nt, Human
gauuuuauuauguaaaucc

SEQ ID NO: 1706268 - RNA, 20 nt, Human
gauuuuauuauguaaauccc

SEQ ID NO: 1706269 - RNA, 23 nt, Human
gauuuuauuauguaaaucccauu

SEQ ID NO: 1706270 - RNA, 14 nt, Human
gauuuuaugcuuua

SEQ ID NO: 1706271 - RNA, 19 nt, Human
gauuuuaugcuuuaaacau

SEQ ID NO: 1706272 - RNA, 20 nt, Human
gaugccaaguuguuugagaa

SEQ ID NO: 1706273 - RNA, 21 nt, Human
gcauaggugaucucauuuaau

SEQ ID NO: 1706274 - RNA, 20 nt, Human
gcauauauuuuuauauuuac

SEQ ID NO: 1706275 - RNA, 18 nt, Human
gcacggugaauggcuuug

SEQ ID NO: 1706276 - RNA, 18 nt, Human
gcagauuauucacugauu

SEQ ID NO: 1706277 - RNA, 16 nt, Human
gacauagucuggcugu

SEQ ID NO: 1706278 - RNA, 13 nt, Human
gaccaaaaaccag

SEQ ID NO: 1706279 - RNA, 19 nt, Human
gaccaaaaaccaguauugu

SEQ ID NO: 1706280 - RNA, 20 nt, Human
gaccaaaaaccaguauugua

SEQ ID NO: 1706281 - RNA, 12 nt, Human
gacuuguuagau

SEQ ID NO: 1706282 - RNA, 18 nt, Human
gaggaagccugauuaaag

SEQ ID NO: 1706283 - RNA, 19 nt, Human
gaggaagccugauuaaaga

SEQ ID NO: 1706284 - RNA, 20 nt, Human
gaacacuccaauuaaggauu

SEQ ID NO: 1706285 - RNA, 16 nt, Human
gaaauuugaauuuugu

SEQ ID NO: 1706286 - RNA, 24 nt, Human
gaaauuugaauuuuguguuagaga

SEQ ID NO: 1706287 - RNA, 13 nt, Human
gaaauuugaauuu

SEQ ID NO: 1706288 - RNA, 16 nt, Human
gaaacggaugauuucu

SEQ ID NO: 1706289 - RNA, 18 nt, Human
gaagccaaaccucuguga

SEQ ID NO: 1706290 - RNA, 15 nt, Human
gaagcauuuuauaaa

SEQ ID NO: 1706291 - RNA, 17 nt, Human
gaagcauuuuauaaauc

SEQ ID NO: 1706292 - RNA, 13 nt, Human
gaagcauuuuaua

SEQ ID NO: 1706293 - RNA, 22 nt, Human
gaagucagaucugccuaaggac

SEQ ID NO: 1706294 - RNA, 23 nt, Human
gaagucagaucugccuaaggacu

SEQ ID NO: 1706295 - RNA, 14 nt, Human
gaagucagaucugc

SEQ ID NO: 1706296 - RNA, 12 nt, Human
gaacuugaaauu

SEQ ID NO: 1706297 - RNA, 13 nt, Human
gaacuugaaauuu

SEQ ID NO: 1706298 - RNA, 15 nt, Human
gaacuugaaauuuga

SEQ ID NO: 1706299 - RNA, 22 nt, Human
gaacuugaaauuugaauuuugu

SEQ ID NO: 1706300 - RNA, 14 nt, Human
cuuguauuaagaau

SEQ ID NO: 1706301 - RNA, 15 nt, Human
cuuguauuaagaaug

SEQ ID NO: 1706302 - RNA, 19 nt, Human
cuugaaauuugaauuuugu

SEQ ID NO: 1706303 - RNA, 20 nt, Human
cuugaaauuugaauuuugug

SEQ ID NO: 1706304 - RNA, 23 nt, Human
cuuuugauaaucaacugggcuga

SEQ ID NO: 1706305 - RNA, 22 nt, Human
cuuuugauaaucaacugggcug

SEQ ID NO: 1706306 - RNA, 21 nt, Human
cuuuuucauuauuuuauuaug

SEQ ID NO: 1706307 - RNA, 12 nt, Human
cugcuuucagau

SEQ ID NO: 1706308 - RNA, 15 nt, Human
cugcuuucagauacu

SEQ ID NO: 1706309 - RNA, 14 nt, Human
cugcuuguuuccua

SEQ ID NO: 1706310 - RNA, 13 nt, Human
cugcuuguuuccu

SEQ ID NO: 1706311 - RNA, 14 nt, Human
cuggccuuucauau

SEQ ID NO: 1706312 - RNA, 15 nt, Human
cuguauagauuagag

SEQ ID NO: 1706313 - RNA, 20 nt, Human
cuguauagauuagaauucug

SEQ ID NO: 1706314 - RNA, 16 nt, Human
cuguauagauuagaga

SEQ ID NO: 1706315 - RNA, 18 nt, Human
cugaacacuccaauuaag

SEQ ID NO: 1706316 - RNA, 23 nt, Human
cugaacacuccaauuaaggauuu

SEQ ID NO: 1706317 - RNA, 22 nt, Human
cucugugagcaucacaguuuug

SEQ ID NO: 1706318 - RNA, 18 nt, Human
cucugugagcaucacagu

SEQ ID NO: 1706319 - RNA, 21 nt, Human
cucugugagcaucacaguuuu

SEQ ID NO: 1706320 - RNA, 14 nt, Human
cugacaucucugca

SEQ ID NO: 1706321 - RNA, 15 nt, Human
cugacaucucugcaa

SEQ ID NO: 1706322 - RNA, 16 nt, Human
cugacaucucugcaau

SEQ ID NO: 1706323 - RNA, 19 nt, Human
cucccuauuuuuuuucugu

SEQ ID NO: 1706324 - RNA, 20 nt, Human
cucccuauuuuuuuucuguu

SEQ ID NO: 1706325 - RNA, 17 nt, Human
cucccuauuuuuuuucu

SEQ ID NO: 1706326 - RNA, 18 nt, Human
cggugaauggcuuuguau

SEQ ID NO: 1706327 - RNA, 20 nt, Human
cggugaauggcuuuguauag

SEQ ID NO: 1706328 - RNA, 22 nt, Human
cggugaauggcuuuguauagaa

SEQ ID NO: 1706329 - RNA, 13 nt, Human
cggugaauggcuu

SEQ ID NO: 1706330 - RNA, 14 nt, Human
cggugaauggcuuu

SEQ ID NO: 1706331 - RNA, 15 nt, Human
cggugaauggcuuug

SEQ ID NO: 1706332 - RNA, 16 nt, Human
cggugaauggcuuugu

SEQ ID NO: 1706333 - RNA, 23 nt, Human
cguugaaauuguaauuauaucug

SEQ ID NO: 1706334 - RNA, 18 nt, Human
cguugaaauuguaauuau

SEQ ID NO: 1706335 - RNA, 16 nt, Human
cgugcuaaggacuugu

SEQ ID NO: 1706336 - RNA, 12 nt, Human
cgugcuaaggac

SEQ ID NO: 1706337 - RNA, 13 nt, Human
cgugcuaaggacu

SEQ ID NO: 1706338 - RNA, 14 nt, Human
cgugcuaaggacuu

SEQ ID NO: 1706339 - RNA, 15 nt, Human
cgugcuaaggacuug

SEQ ID NO: 1706340 - RNA, 17 nt, Human
cuaaauccauuuggaaa

SEQ ID NO: 1706341 - RNA, 19 nt, Human
cuaaauccauuuggaaauc

SEQ ID NO: 1706342 - RNA, 20 nt, Human
cuaaauccauuuggaaaucu

SEQ ID NO: 1706343 - RNA, 16 nt, Human
cuaaauccauuuggaa

SEQ ID NO: 1706344 - RNA, 12 nt, Human
cuaguucacucu

SEQ ID NO: 1706345 - RNA, 18 nt, Human
cuauauaugugaugaucu

SEQ ID NO: 1706346 - RNA, 23 nt, Human
cuauauaugugaugaucuaccag

SEQ ID NO: 1706347 - RNA, 16 nt, Human
cuaaggacuuguuaga

SEQ ID NO: 1706348 - RNA, 17 nt, Human
cuaaggacuuguuagau

SEQ ID NO: 1706349 - RNA, 11 nt, Human
cuaaggacuug

SEQ ID NO: 1706350 - RNA, 22 nt, Human
ccuacauguauuuguuugcaua

SEQ ID NO: 1706351 - RNA, 20 nt, Human
ccuaaauccauuuggaaauc

SEQ ID NO: 1706352 - RNA, 21 nt, Human
ccuaaauccauuuggaaaucu

SEQ ID NO: 1706353 - RNA, 19 nt, Human
ccuaaauccauuuggaaau

SEQ ID NO: 1706354 - RNA, 23 nt, Human
cccggaagccaaaccucugugag

SEQ ID NO: 1706355 - RNA, 12 nt, Human
cccauuauucaa

SEQ ID NO: 1706356 - RNA, 17 nt, Human
cccagacgaugucuuca

SEQ ID NO: 1706357 - RNA, 15 nt, Human
cccagacgaugucuu

SEQ ID NO: 1706358 - RNA, 12 nt, Human
cauuauuuuauu

SEQ ID NO: 1706359 - RNA, 14 nt, Human
cauuauuuuauuau

SEQ ID NO: 1706360 - RNA, 16 nt, Human
cauuauuuuauuauga

SEQ ID NO: 1706361 - RNA, 17 nt, Human
ccaaaccucugugagca

SEQ ID NO: 1706362 - RNA, 12 nt, Human
cauguuuauuac

SEQ ID NO: 1706363 - RNA, 13 nt, Human
cauguuuauuaca

SEQ ID NO: 1706364 - RNA, 18 nt, Human
cauguuuauuacaguaua

SEQ ID NO: 1706365 - RNA, 19 nt, Human
cauguuuauuacaguauaa

SEQ ID NO: 1706366 - RNA, 20 nt, Human
cauguuuauuacaguauaau

SEQ ID NO: 1706367 - RNA, 22 nt, Human
cauguuuauuacaguauaauua

SEQ ID NO: 1706368 - RNA, 11 nt, Human
cauuauuuuau

SEQ ID NO: 1706369 - RNA, 18 nt, Human
cauggaacgcguugaaau

SEQ ID NO: 1706370 - RNA, 19 nt, Human
cauggaacgcguugaaauu

SEQ ID NO: 1706371 - RNA, 20 nt, Human
cauggaacgcguugaaauug

SEQ ID NO: 1706372 - RNA, 23 nt, Human
cauggaacgcguugaaauuguaa

SEQ ID NO: 1706373 - RNA, 15 nt, Human
cauaccuacauguau

SEQ ID NO: 1706374 - RNA, 21 nt, Human
caguuuuguuuggaccaaaaa

SEQ ID NO: 1706375 - RNA, 18 nt, Human
caguuuugguugcuuuaa

SEQ ID NO: 1706376 - RNA, 19 nt, Human
caguuuugguugcuuuaau

SEQ ID NO: 1706377 - RNA, 17 nt, Human
caguuuugguugcuuua

SEQ ID NO: 1706378 - RNA, 16 nt, Human
cauaaaucugugaacu

SEQ ID NO: 1706379 - RNA, 18 nt, Human
cauaaaucugugaacuug

SEQ ID NO: 1706380 - RNA, 22 nt, Human
cauaaaucugugaacuugaaau

SEQ ID NO: 1706381 - RNA, 23 nt, Human
cauaaaucugugaacuugaaauu

SEQ ID NO: 1706382 - RNA, 14 nt, Human
cauaaaucugugaa

SEQ ID NO: 1706383 - RNA, 12 nt, Human
cauaacauaaau

SEQ ID NO: 1706384 - RNA, 19 nt, Human
cauaacauaaaucugugaa

SEQ ID NO: 1706385 - RNA, 21 nt, Human
cauaacauaaaucugugaacu

SEQ ID NO: 1706386 - RNA, 17 nt, Human
cauaaggaaacuggguu

SEQ ID NO: 1706387 - RNA, 13 nt, Human
caucacaguuuug

SEQ ID NO: 1706388 - RNA, 21 nt, Human
caucacaguuuugguugcuuu

SEQ ID NO: 1706389 - RNA, 22 nt, Human
caucacaguuuugguugcuuua

SEQ ID NO: 1706390 - RNA, 22 nt, Human
cauauauuuuuauauuuacuaa

SEQ ID NO: 1706391 - RNA, 13 nt, Human
cauauuuuagcua

SEQ ID NO: 1706392 - RNA, 18 nt, Human
cugaggaauucuguauag

SEQ ID NO: 1706393 - RNA, 19 nt, Human
cugaggaauucuguauaga

SEQ ID NO: 1706394 - RNA, 15 nt, Human
cugaggaauucugua

SEQ ID NO: 1706395 - RNA, 16 nt, Human
cugaggaauucuguau

SEQ ID NO: 1706396 - RNA, 13 nt, Human
cuccuuucucuuu

SEQ ID NO: 1706397 - RNA, 15 nt, Human
cuaaacuuuucugau

SEQ ID NO: 1706398 - RNA, 16 nt, Human
cuaaacuuuucugaua

SEQ ID NO: 1706399 - RNA, 14 nt, Human
cuacuauauaugug

SEQ ID NO: 1706400 - RNA, 20 nt, Human
cucagaaggcaaaugacuuu

SEQ ID NO: 1706401 - RNA, 13 nt, Human
caaguuguuugag

SEQ ID NO: 1706402 - RNA, 17 nt, Human
caaguuguuugagaaau

SEQ ID NO: 1706403 - RNA, 21 nt, Human
caaguuguuugagaaauuaag

SEQ ID NO: 1706404 - RNA, 23 nt, Human
caaguuguuugagaaauuaagua

SEQ ID NO: 1706405 - RNA, 21 nt, Human
caccuuucagauaacuguuau

SEQ ID NO: 1706406 - RNA, 22 nt, Human
caccuuucagauaacuguuauu

SEQ ID NO: 1706407 - RNA, 13 nt, Human
auuuuuuuguugu

SEQ ID NO: 1706408 - RNA, 15 nt, Human
auuuuuauauuuacu

SEQ ID NO: 1706409 - RNA, 16 nt, Human
auuuuuauauuuacua

SEQ ID NO: 1706410 - RNA, 18 nt, Human
auuuuagcuacuauauau

SEQ ID NO: 1706411 - RNA, 18 nt, Human
auuuuaugcuuuaaacau

SEQ ID NO: 1706412 - RNA, 19 nt, Human
auuuuaugcuuuaaacauu

SEQ ID NO: 1706413 - RNA, 12 nt, Human
auuauguaaauc

SEQ ID NO: 1706414 - RNA, 15 nt, Human
auuuauaaucacuuu

SEQ ID NO: 1706415 - RNA, 13 nt, Human
auuuauaaucacu

SEQ ID NO: 1706416 - RNA, 22 nt, Human
auuuauaaucacuuuuuuccac

SEQ ID NO: 1706417 - RNA, 19 nt, Human
auuucuauauuuucauucu

SEQ ID NO: 1706418 - RNA, 19 nt, Human
auuucuaugcugaguuugu

SEQ ID NO: 1706419 - RNA, 21 nt, Human
auuucuaugcugaguuugugc

SEQ ID NO: 1706420 - RNA, 22 nt, Human
auuucuaugcugaguuugugcu

SEQ ID NO: 1706421 - RNA, 17 nt, Human
auuucuauauuuucauu

SEQ ID NO: 1706422 - RNA, 18 nt, Human
auuucuauauuuucauuc

SEQ ID NO: 1706423 - RNA, 15 nt, Human
auuucuauauuuuca

SEQ ID NO: 1706424 - RNA, 16 nt, Human
auuucuauauuuucau

SEQ ID NO: 1706425 - RNA, 16 nt, Human
auuguaauuauaucug

SEQ ID NO: 1706426 - RNA, 17 nt, Human
auuguaauuauaucuga

SEQ ID NO: 1706427 - RNA, 15 nt, Human
auuguaauuauaucu

SEQ ID NO: 1706428 - RNA, 21 nt, Human
auuguaauuauaucugaggaa

SEQ ID NO: 1706429 - RNA, 16 nt, Human
auuguacaaaguauua

SEQ ID NO: 1706430 - RNA, 17 nt, Human
auuguacaaaguauuaa

SEQ ID NO: 1706431 - RNA, 19 nt, Human
auuguacaaaguauuaagc

SEQ ID NO: 1706432 - RNA, 16 nt, Human
caguauuguacaaagu

SEQ ID NO: 1706433 - RNA, 17 nt, Human
caguauuguacaaagua

SEQ ID NO: 1706434 - RNA, 18 nt, Human
caguauuguacaaaguau

SEQ ID NO: 1706435 - RNA, 19 nt, Human
caguauuguacaaaguauu

SEQ ID NO: 1706436 - RNA, 12 nt, Human
caguauuguaca

SEQ ID NO: 1706437 - RNA, 13 nt, Human
caguauuguacaa

SEQ ID NO: 1706438 - RNA, 21 nt, Human
caguauugaagcauuuuauaa

SEQ ID NO: 1706439 - RNA, 21 nt, Human
caguauuguacaaaguauuaa

SEQ ID NO: 1706440 - RNA, 18 nt, Human
cauugguucuuguauuaa

SEQ ID NO: 1706441 - RNA, 15 nt, Human
cauugguucuuguau

SEQ ID NO: 1706442 - RNA, 22 nt, Human
cauugguucuuguauuaagaau

SEQ ID NO: 1706443 - RNA, 22 nt, Human
cauuuggaaaucuuuaaaaaaa

SEQ ID NO: 1706444 - RNA, 22 nt, Human
cuuaaaguugaauuuauuggcu

SEQ ID NO: 1706445 - RNA, 13 nt, Human
cuuaaauaauaaa

SEQ ID NO: 1706446 - RNA, 22 nt, Human
cuuaaauaauaaagaucaugua

SEQ ID NO: 1706447 - RNA, 14 nt, Human
cuuaaaguugaauu

SEQ ID NO: 1706448 - RNA, 15 nt, Human
cuuaaaguugaauuu

SEQ ID NO: 1706449 - RNA, 18 nt, Human
cuuaaaguugaauuuauu

SEQ ID NO: 1706450 - RNA, 14 nt, Human
cuguuauuuauaau

SEQ ID NO: 1706451 - RNA, 20 nt, Human
cuguuauuuauaaucacuuu

SEQ ID NO: 1706452 - RNA, 18 nt, Human
gaacacuccaauuaagga

SEQ ID NO: 1706453 - RNA, 12 nt, Human
gaaaucuuuaaa

SEQ ID NO: 1706454 - RNA, 15 nt, Human
gaaaucuuuaaaaaa

SEQ ID NO: 1706455 - RNA, 21 nt, Human
gaaacugcuuguuuccuagca

SEQ ID NO: 1706456 - RNA, 17 nt, Human
gaaacuggguuccugca

SEQ ID NO: 1706457 - RNA, 14 nt, Human
cuugucucagauuu

SEQ ID NO: 1706458 - RNA, 17 nt, Human
cuugucucagauuuuau

SEQ ID NO: 1706459 - RNA, 13 nt, Human
cuugucucagauu

SEQ ID NO: 1706460 - RNA, 18 nt, Human
cuugucucagauuuuauu

SEQ ID NO: 1706461 - RNA, 14 nt, Human
cuuucagauacugg

SEQ ID NO: 1706462 - RNA, 15 nt, Human
cuuucagauacugga

SEQ ID NO: 1706463 - RNA, 17 nt, Human
cuuucagauacuggauu

SEQ ID NO: 1706464 - RNA, 22 nt, Human
cuuucagauacuggauuguacu

SEQ ID NO: 1706465 - RNA, 13 nt, Human
gcauaacauaaau

SEQ ID NO: 1706466 - RNA, 17 nt, Human
gcaaaaauauuuuauga

SEQ ID NO: 1706467 - RNA, 22 nt, Human
gcaaaaauauuuuaugauccag

SEQ ID NO: 1706468 - RNA, 23 nt, Human
gcaaaaauauuuuaugauccagc

SEQ ID NO: 1706469 - RNA, 16 nt, Human
gcaaaaauauuuuaug

SEQ ID NO: 1706470 - RNA, 21 nt, Human
gauucuuaaaguugaauuuau

SEQ ID NO: 1706471 - RNA, 16 nt, Human
gauucuuaaaguugaa

SEQ ID NO: 1706472 - RNA, 17 nt, Human
gauucuuaaaguugaau

SEQ ID NO: 1706473 - RNA, 15 nt, Human
gauucuuaaaguuga

SEQ ID NO: 1706474 - RNA, 14 nt, Human
gaugucuucauacc

SEQ ID NO: 1706475 - RNA, 18 nt, Human
gaugucuucauaccuaca

SEQ ID NO: 1706476 - RNA, 17 nt, Human
gacuguggugacuuugg

SEQ ID NO: 1706477 - RNA, 19 nt, Human
gacuuuggauaauaaggaa

SEQ ID NO: 1706478 - RNA, 13 nt, Human
aaaguauuaagca

SEQ ID NO: 1706479 - RNA, 18 nt, Human
aaaguauuaagcauauau

SEQ ID NO: 1706480 - RNA, 19 nt, Human
aaaguauuaagcauauauu

SEQ ID NO: 1706481 - RNA, 20 nt, Human
aaaguauuaagcauauauuu

SEQ ID NO: 1706482 - RNA, 13 nt, Human
aaaguugccuaaa

SEQ ID NO: 1706483 - RNA, 14 nt, Human
aaaguugccuaaau

SEQ ID NO: 1706484 - RNA, 12 nt, Human
aaaguuuaauau

SEQ ID NO: 1706485 - RNA, 14 nt, Human
aaaguuuaauauua

SEQ ID NO: 1706486 - RNA, 16 nt, Human
aaaguugccuaaaucc

SEQ ID NO: 1706487 - RNA, 17 nt, Human
aaaguugccuaaaucca

SEQ ID NO: 1706488 - RNA, 23 nt, Human
aaaguugccuaaauccauuugga

SEQ ID NO: 1706489 - RNA, 13 nt, Human
aaauacaauuuug

SEQ ID NO: 1706490 - RNA, 14 nt, Human
aaauacaauuuugu

SEQ ID NO: 1706491 - RNA, 17 nt, Human
aaauacaauuuuguuuc

SEQ ID NO: 1706492 - RNA, 18 nt, Human
aaauacaauuuuguuucu

SEQ ID NO: 1706493 - RNA, 20 nt, Human
aaauacaauuuuguuucugu

SEQ ID NO: 1706494 - RNA, 21 nt, Human
aaauacaauuuuguuucugua

SEQ ID NO: 1706495 - RNA, 22 nt, Human
aaauacaauuuuguuucuguac

SEQ ID NO: 1706496 - RNA, 15 nt, Human
aaaccucugugagca

SEQ ID NO: 1706497 - RNA, 13 nt, Human
aaacugcuuguuu

SEQ ID NO: 1706498 - RNA, 14 nt, Human
aaacugcuuguuuc

SEQ ID NO: 1706499 - RNA, 17 nt, Human
aaacugcuuguuuccua

SEQ ID NO: 1706500 - RNA, 19 nt, Human
aaacugcuuguuuccuagc

SEQ ID NO: 1706501 - RNA, 22 nt, Human
aaacugcuuguuuccuagcaca

SEQ ID NO: 1706502 - RNA, 11 nt, Human
aaacuuuucug

SEQ ID NO: 1706503 - RNA, 15 nt, Human
ggcuguacccaggaa

SEQ ID NO: 1706504 - RNA, 17 nt, Human
aaaaccaguauuguaca

SEQ ID NO: 1706505 - RNA, 16 nt, Human
ggcauaacauaaaucu

SEQ ID NO: 1706506 - RNA, 17 nt, Human
ggcauaacauaaaucug

SEQ ID NO: 1706507 - RNA, 22 nt, Human
ggacuucuuuaauuuuggaauu

SEQ ID NO: 1706508 - RNA, 21 nt, Human
ggacuucuuuaauuuuggaau

SEQ ID NO: 1706509 - RNA, 18 nt, Human
ggacuucuuuaauuuugg

SEQ ID NO: 1706510 - RNA, 15 nt, Human
ggacuuguuagaucu

SEQ ID NO: 1706511 - RNA, 12 nt, Human
ggacuuguuaga

SEQ ID NO: 1706512 - RNA, 22 nt, Human
gcugggguuaucugaagucaga

SEQ ID NO: 1706513 - RNA, 23 nt, Human
gcugggguuaucugaagucagau

SEQ ID NO: 1706514 - RNA, 14 nt, Human
gcugggguuaucug

SEQ ID NO: 1706515 - RNA, 22 nt, Human
gcuauuucuauauuuucauucu

SEQ ID NO: 1706516 - RNA, 16 nt, Human
auuugacauagucugg

SEQ ID NO: 1706517 - RNA, 17 nt, Human
auuugacauagucuggc

SEQ ID NO: 1706518 - RNA, 21 nt, Human
auuugacauagucuggcugua

SEQ ID NO: 1706519 - RNA, 15 nt, Human
auuugaauuuugugu

SEQ ID NO: 1706520 - RNA, 13 nt, Human
auuggcuuuucug

SEQ ID NO: 1706521 - RNA, 15 nt, Human
auuggcuuuucugau

SEQ ID NO: 1706522 - RNA, 16 nt, Human
auuggcuuuucugauc

SEQ ID NO: 1706523 - RNA, 19 nt, Human
auuggcuuuucugauccag

SEQ ID NO: 1706524 - RNA, 20 nt, Human
auuggcuuuucugauccagu

SEQ ID NO: 1706525 - RNA, 15 nt, Human
auugguucuuguauu

SEQ ID NO: 1706526 - RNA, 16 nt, Human
auugguucuuguauua

SEQ ID NO: 1706527 - RNA, 12 nt, Human
auuuuggaauuu

SEQ ID NO: 1706528 - RNA, 11 nt, Human
auuuuguuucu

SEQ ID NO: 1706529 - RNA, 14 nt, Human
auuuuguuucugua

SEQ ID NO: 1706530 - RNA, 15 nt, Human
auuuuguuucuguac

SEQ ID NO: 1706531 - RNA, 21 nt, Human
auucuuaaaguugaauuuauu

SEQ ID NO: 1706532 - RNA, 19 nt, Human
auucuuaaaguugaauuua

SEQ ID NO: 1706533 - RNA, 20 nt, Human
auucuuaaaguugaauuuau

SEQ ID NO: 1706534 - RNA, 22 nt, Human
auugaagcauuuuauaaaucgc

SEQ ID NO: 1706535 - RNA, 11 nt, Human
auucuguauag

SEQ ID NO: 1706536 - RNA, 12 nt, Human
auucuguauaga

SEQ ID NO: 1706537 - RNA, 13 nt, Human
auucuguauagau

SEQ ID NO: 1706538 - RNA, 17 nt, Human
auuauucaaaguugccu

SEQ ID NO: 1706539 - RNA, 14 nt, Human
auuauucaaaguug

SEQ ID NO: 1706540 - RNA, 15 nt, Human
auuauucaaaguugc

SEQ ID NO: 1706541 - RNA, 13 nt, Human
auuauucaaaguu

SEQ ID NO: 1706542 - RNA, 20 nt, Human
uuucuguacuuuuuggcaua

SEQ ID NO: 1706543 - RNA, 19 nt, Human
uuucuguacuuuuuggcau

SEQ ID NO: 1706544 - RNA, 19 nt, Human
uuucuguuauauaaauggu

SEQ ID NO: 1706545 - RNA, 15 nt, Human
augggauaaaugcca

SEQ ID NO: 1706546 - RNA, 16 nt, Human
augggauaaaugccau

SEQ ID NO: 1706547 - RNA, 20 nt, Human
augggauaaaugccaucaau

SEQ ID NO: 1706548 - RNA, 14 nt, Human
auguaaaucccauu

SEQ ID NO: 1706549 - RNA, 20 nt, Human
auguaaaucccauuauucaa

SEQ ID NO: 1706550 - RNA, 22 nt, Human
auguaaaucccauuauucaaag

SEQ ID NO: 1706551 - RNA, 23 nt, Human
auguaaaucccauuauucaaagu

SEQ ID NO: 1706552 - RNA, 21 nt, Human
uuuggcauaacauaaaucugu

SEQ ID NO: 1706553 - RNA, 20 nt, Human
uuuggcauaacauaaaucug

SEQ ID NO: 1706554 - RNA, 19 nt, Human
uuugugcugguguaugugu

SEQ ID NO: 1706555 - RNA, 21 nt, Human
uuuaaauaaauaaauagcuag

SEQ ID NO: 1706556 - RNA, 10 nt, Human
augauccagc

SEQ ID NO: 1706557 - RNA, 19 nt, Human
augauccagcagauuauuc

SEQ ID NO: 1706558 - RNA, 20 nt, Human
augauccagcagauuauuca

SEQ ID NO: 1706559 - RNA, 22 nt, Human
augauccagcagauuauucacu

SEQ ID NO: 1706560 - RNA, 14 nt, Human
augggauaaaugcc

SEQ ID NO: 1706561 - RNA, 16 nt, Human
auggacuguggugacu

SEQ ID NO: 1706562 - RNA, 17 nt, Human
auggacuguggugacuu

SEQ ID NO: 1706563 - RNA, 22 nt, Human
auggacuguggugacuuuggau

SEQ ID NO: 1706564 - RNA, 19 nt, Human
uuucauuauuuuauuauga

SEQ ID NO: 1706565 - RNA, 20 nt, Human
uuucauuauuuuauuaugaa

SEQ ID NO: 1706566 - RNA, 13 nt, Human
uuucauuauuuua

SEQ ID NO: 1706567 - RNA, 15 nt, Human
uuucauuauuuuauu

SEQ ID NO: 1706568 - RNA, 15 nt, Human
auggaacgcguugaa

SEQ ID NO: 1706569 - RNA, 16 nt, Human
auggaacgcguugaaa

SEQ ID NO: 1706570 - RNA, 17 nt, Human
auggaacgcguugaaau

SEQ ID NO: 1706571 - RNA, 18 nt, Human
auggaacgcguugaaauu

SEQ ID NO: 1706572 - RNA, 19 nt, Human
auggaacgcguugaaauug

SEQ ID NO: 1706573 - RNA, 14 nt, Human
uuuauuacaguaua

SEQ ID NO: 1706574 - RNA, 18 nt, Human
uuuauuacaguauaauua

SEQ ID NO: 1706575 - RNA, 21 nt, Human
augcuauuucuauauuuucau

SEQ ID NO: 1706576 - RNA, 22 nt, Human
augcuauuucuauauuuucauu

SEQ ID NO: 1706577 - RNA, 23 nt, Human
augcuauuucuauauuuucauuc

SEQ ID NO: 1706578 - RNA, 13 nt, Human
augcuauuucuau

SEQ ID NO: 1706579 - RNA, 14 nt, Human
augcuauuucuaua

SEQ ID NO: 1706580 - RNA, 15 nt, Human
augcuauuucuauau

SEQ ID NO: 1706581 - RNA, 20 nt, Human
augcuauuucuauauuuuca

SEQ ID NO: 1706582 - RNA, 11 nt, Human
augcuauuucu

SEQ ID NO: 1706583 - RNA, 16 nt, Human
uuuauauuuacuaaaa

SEQ ID NO: 1706584 - RNA, 13 nt, Human
uuuauauuuacua

SEQ ID NO: 1706585 - RNA, 20 nt, Human
auccauuuggaaaucuuuaa

SEQ ID NO: 1706586 - RNA, 21 nt, Human
auccauuuggaaaucuuuaaa

SEQ ID NO: 1706587 - RNA, 13 nt, Human
uugaaauuguaau

SEQ ID NO: 1706588 - RNA, 14 nt, Human
uugaaauuguaauu

SEQ ID NO: 1706589 - RNA, 15 nt, Human
uugaaauuguaauua

SEQ ID NO: 1706590 - RNA, 17 nt, Human
uugaaauuguaauuaua

SEQ ID NO: 1706591 - RNA, 23 nt, Human
aucaccugucuugccuuuuucau

SEQ ID NO: 1706592 - RNA, 22 nt, Human
aucaccugucuugccuuuuuca

SEQ ID NO: 1706593 - RNA, 15 nt, Human
aucugacaucucugc

SEQ ID NO: 1706594 - RNA, 16 nt, Human
aucugacaucucugca

SEQ ID NO: 1706595 - RNA, 20 nt, Human
aucugacaucucugcaaucu

SEQ ID NO: 1706596 - RNA, 20 nt, Human
auccucucaaccaccuuuca

SEQ ID NO: 1706597 - RNA, 23 nt, Human
uugaagcauuuuauaaaucgcuu

SEQ ID NO: 1706598 - RNA, 11 nt, Human
aucugccuaag

SEQ ID NO: 1706599 - RNA, 21 nt, Human
aucugccuaaggacuucuuua

SEQ ID NO: 1706600 - RNA, 22 nt, Human
aucugccuaaggacuucuuuaa

SEQ ID NO: 1706601 - RNA, 23 nt, Human
aucugccuaaggacuucuuuaau

SEQ ID NO: 1706602 - RNA, 14 nt, Human
uuagaauucuguau

SEQ ID NO: 1706603 - RNA, 15 nt, Human
uuagaauucuguaua

SEQ ID NO: 1706604 - RNA, 17 nt, Human
uuagaauucuguauaga

SEQ ID NO: 1706605 - RNA, 15 nt, Human
auaaaucugugaacu

SEQ ID NO: 1706606 - RNA, 16 nt, Human
auaaaucugugaacuu

SEQ ID NO: 1706607 - RNA, 19 nt, Human
auaaaucugugaacuugaa

SEQ ID NO: 1706608 - RNA, 17 nt, Human
auaaaugccaucaauaa

SEQ ID NO: 1706609 - RNA, 18 nt, Human
auaaaugccaucaauaaa

SEQ ID NO: 1706610 - RNA, 14 nt, Human
auaaaucgcuuuug

SEQ ID NO: 1706611 - RNA, 16 nt, Human
auaaaucgcuuuugau

SEQ ID NO: 1706612 - RNA, 19 nt, Human
auaaaucgcuuuugauaau

SEQ ID NO: 1706613 - RNA, 21 nt, Human
auaaaucgcuuuugauaauca

SEQ ID NO: 1706614 - RNA, 14 nt, Human
uuaauuuuggaauu

SEQ ID NO: 1706615 - RNA, 15 nt, Human
uuaauuuuggaauuu

SEQ ID NO: 1706616 - RNA, 13 nt, Human
uuaauuuuggaau

SEQ ID NO: 1706617 - RNA, 14 nt, Human
uuaagaaugaaaua

SEQ ID NO: 1706618 - RNA, 20 nt, Human
uuaagaaugaaauacuguuu

SEQ ID NO: 1706619 - RNA, 22 nt, Human
uuaagaaugaaauacuguuuga

SEQ ID NO: 1706620 - RNA, 18 nt, Human
aguuuuguuuggaccaaa

SEQ ID NO: 1706621 - RNA, 14 nt, Human
aguuuuguuuggac

SEQ ID NO: 1706622 - RNA, 16 nt, Human
aguuuuguuuggacca

SEQ ID NO: 1706623 - RNA, 12 nt, Human
aguuuuguuugg

SEQ ID NO: 1706624 - RNA, 17 nt, Human
uuaaaccaugggauaaa

SEQ ID NO: 1706625 - RNA, 22 nt, Human
uuaaacauugguucuuguauua

SEQ ID NO: 1706626 - RNA, 18 nt, Human
uuaaacauugguucuugu

SEQ ID NO: 1706627 - RNA, 20 nt, Human
uuaaacauugguucuuguau

SEQ ID NO: 1706628 - RNA, 13 nt, Human
uuaaaguugaauu

SEQ ID NO: 1706629 - RNA, 16 nt, Human
uuaaaguugaauuuau

SEQ ID NO: 1706630 - RNA, 17 nt, Human
uuaaaguugaauuuauu

SEQ ID NO: 1706631 - RNA, 22 nt, Human
uuaaaguugaauuuauuggcuu

SEQ ID NO: 1706632 - RNA, 21 nt, Human
uuaaaccaugggauaaaugcc

SEQ ID NO: 1706633 - RNA, 22 nt, Human
uuaaaccaugggauaaaugcca

SEQ ID NO: 1706634 - RNA, 23 nt, Human
uuaaaccaugggauaaaugccau

SEQ ID NO: 1706635 - RNA, 19 nt, Human
aguuugugcugguguaugu

SEQ ID NO: 1706636 - RNA, 16 nt, Human
uuaugugcgcugauaa

SEQ ID NO: 1706637 - RNA, 11 nt, Human
uuauguaaauc

SEQ ID NO: 1706638 - RNA, 12 nt, Human
uuauguaaaucc

SEQ ID NO: 1706639 - RNA, 13 nt, Human
uuauguaaauccc

SEQ ID NO: 1706640 - RNA, 19 nt, Human
uuauguaaaucccauuauu

SEQ ID NO: 1706641 - RNA, 21 nt, Human
uuauguaaaucccauuauuca

SEQ ID NO: 1706642 - RNA, 22 nt, Human
uuauguaaaucccauuauucaa

SEQ ID NO: 1706643 - RNA, 23 nt, Human
uuauguaaaucccauuauucaaa

SEQ ID NO: 1706644 - RNA, 22 nt, Human
uuaugauccagcagauuauuca

SEQ ID NO: 1706645 - RNA, 23 nt, Human
uuaugauccagcagauuauucac

SEQ ID NO: 1706646 - RNA, 16 nt, Human
uuaugaaacuugugua

SEQ ID NO: 1706647 - RNA, 18 nt, Human
uuaugaaacuuguguaaa

SEQ ID NO: 1706648 - RNA, 13 nt, Human
uuaugaaacuugu

SEQ ID NO: 1706649 - RNA, 19 nt, Human
uuaugaaacuuguguaaau

SEQ ID NO: 1706650 - RNA, 13 nt, Human
uuaugauccagca

SEQ ID NO: 1706651 - RNA, 18 nt, Human
uuaugauccagcagauua

SEQ ID NO: 1706652 - RNA, 19 nt, Human
uuaugacuucauuaauaau

SEQ ID NO: 1706653 - RNA, 22 nt, Human
uuaugacuucauuaauaauaaa

SEQ ID NO: 1706654 - RNA, 15 nt, Human
auacuggauuguacu

SEQ ID NO: 1706655 - RNA, 14 nt, Human
uuauucacugauuu

SEQ ID NO: 1706656 - RNA, 13 nt, Human
uuauucaaaguug

SEQ ID NO: 1706657 - RNA, 15 nt, Human
uuauucaaaguugcc

SEQ ID NO: 1706658 - RNA, 19 nt, Human
uuauucaaaguugccuaaa

SEQ ID NO: 1706659 - RNA, 16 nt, Human
uuauuauguaaauccc

SEQ ID NO: 1706660 - RNA, 22 nt, Human
uuauuauguaaaucccauuauu

SEQ ID NO: 1706661 - RNA, 13 nt, Human
uuauuauguaaau

SEQ ID NO: 1706662 - RNA, 14 nt, Human
uuauuauguaaauc

SEQ ID NO: 1706663 - RNA, 17 nt, Human
uuauuaugaaacuugug

SEQ ID NO: 1706664 - RNA, 20 nt, Human
uuauuaugaaacuuguguaa

SEQ ID NO: 1706665 - RNA, 21 nt, Human
uuauuaugaaacuuguguaaa

SEQ ID NO: 1706666 - RNA, 22 nt, Human
uuauuaugaaacuuguguaaau

SEQ ID NO: 1706667 - RNA, 23 nt, Human
uuauuaugaaacuuguguaaaua

SEQ ID NO: 1706668 - RNA, 11 nt, Human
uuauuaugaaa

SEQ ID NO: 1706669 - RNA, 14 nt, Human
auagaaccucuuug

SEQ ID NO: 1706670 - RNA, 20 nt, Human
auagaaccucuuugucuaca

SEQ ID NO: 1706671 - RNA, 22 nt, Human
auagauuagagaguguugaaac

SEQ ID NO: 1706672 - RNA, 13 nt, Human
auagauuagaauu

SEQ ID NO: 1706673 - RNA, 15 nt, Human
auagauuagaauucu

SEQ ID NO: 1706674 - RNA, 16 nt, Human
auagauuagaauucug

SEQ ID NO: 1706675 - RNA, 21 nt, Human
auagauuagagaguguugaaa

SEQ ID NO: 1706676 - RNA, 21 nt, Human
auagaggaagccugauuaaag

SEQ ID NO: 1706677 - RNA, 22 nt, Human
auagaggaagccugauuaaaga

SEQ ID NO: 1706678 - RNA, 19 nt, Human
ugugcugggguuaucugaa

SEQ ID NO: 1706679 - RNA, 20 nt, Human
ugugcugguguaugugugaa

SEQ ID NO: 1706680 - RNA, 21 nt, Human
agugaguuggguguauugugc

SEQ ID NO: 1706681 - RNA, 17 nt, Human
agucuugucucagauuu

SEQ ID NO: 1706682 - RNA, 19 nt, Human
agucuugucucagauuuua

SEQ ID NO: 1706683 - RNA, 16 nt, Human
agucuugucucagauu

SEQ ID NO: 1706684 - RNA, 20 nt, Human
agucuugucucagauuuuau

SEQ ID NO: 1706685 - RNA, 21 nt, Human
agucuugucucagauuuuauu

SEQ ID NO: 1706686 - RNA, 16 nt, Human
uguguuagagauuuuu

SEQ ID NO: 1706687 - RNA, 13 nt, Human
aguauaauuaaca

SEQ ID NO: 1706688 - RNA, 14 nt, Human
aguauaauuaacau

SEQ ID NO: 1706689 - RNA, 16 nt, Human
aguauaauuaacaugu

SEQ ID NO: 1706690 - RNA, 23 nt, Human
aguauaauuaacauguuaaacca

SEQ ID NO: 1706691 - RNA, 12 nt, Human
aguauuaagcau

SEQ ID NO: 1706692 - RNA, 14 nt, Human
aguauuaagcauau

SEQ ID NO: 1706693 - RNA, 23 nt, Human
uggagccugcacggugaauggcu

SEQ ID NO: 1706694 - RNA, 17 nt, Human
uggaauuuuccuccuuu

SEQ ID NO: 1706695 - RNA, 21 nt, Human
uggaauuuuccuccuuucucu

SEQ ID NO: 1706696 - RNA, 16 nt, Human
aggauuuuaugcuuua

SEQ ID NO: 1706697 - RNA, 17 nt, Human
aggauuuuaugcuuuaa

SEQ ID NO: 1706698 - RNA, 11 nt, Human
aggauuuuaug

SEQ ID NO: 1706699 - RNA, 14 nt, Human
aggauuuuaugcuu

SEQ ID NO: 1706700 - RNA, 15 nt, Human
aggauuuuaugcuuu

SEQ ID NO: 1706701 - RNA, 17 nt, Human
aggaauucuguauagau

SEQ ID NO: 1706702 - RNA, 22 nt, Human
aggaauucuguauagauuagaa

SEQ ID NO: 1706703 - RNA, 16 nt, Human
aggaauucuguauaga

SEQ ID NO: 1706704 - RNA, 23 nt, Human
aggaauucuguauagauuagaau

SEQ ID NO: 1706705 - RNA, 23 nt, Human
aggaaaaguuuaauauuaaagcc

SEQ ID NO: 1706706 - RNA, 24 nt, Human
aggaaaaguuuaauauuaaagcca

SEQ ID NO: 1706707 - RNA, 21 nt, Human
aggaaaaguuuaauauuaaag

SEQ ID NO: 1706708 - RNA, 19 nt, Human
aggaaacuggguuccugca

SEQ ID NO: 1706709 - RNA, 13 nt, Human
ugccuuuuucauu

SEQ ID NO: 1706710 - RNA, 14 nt, Human
ugccuuuuucauua

SEQ ID NO: 1706711 - RNA, 15 nt, Human
ugccuuuuucauuau

SEQ ID NO: 1706712 - RNA, 16 nt, Human
ugccuuuuucauuauu

SEQ ID NO: 1706713 - RNA, 17 nt, Human
ugccuuuuucauuauuu

SEQ ID NO: 1706714 - RNA, 21 nt, Human
ugccuuuuucauuauuuuauu

SEQ ID NO: 1706715 - RNA, 18 nt, Human
agccugcacggugaaugg

SEQ ID NO: 1706716 - RNA, 16 nt, Human
agccugcacggugaau

SEQ ID NO: 1706717 - RNA, 14 nt, Human
agccugauuaaaga

SEQ ID NO: 1706718 - RNA, 14 nt, Human
ucugccuaaggacu

SEQ ID NO: 1706719 - RNA, 15 nt, Human
ucugccuaaggacuu

SEQ ID NO: 1706720 - RNA, 16 nt, Human
ucugccuaaggacuuc

SEQ ID NO: 1706721 - RNA, 13 nt, Human
ucugccuaaggac

SEQ ID NO: 1706722 - RNA, 22 nt, Human
agaaccucuuugucuacaccau

SEQ ID NO: 1706723 - RNA, 16 nt, Human
acuuuugguuaagucu

SEQ ID NO: 1706724 - RNA, 20 nt, Human
acuuuugguuaagucuguuu

SEQ ID NO: 1706725 - RNA, 22 nt, Human
acuuuugguuaagucuguuuua

SEQ ID NO: 1706726 - RNA, 13 nt, Human
acuuuuuuccaca

SEQ ID NO: 1706727 - RNA, 21 nt, Human
acuuguguaaauacaauuuug

SEQ ID NO: 1706728 - RNA, 22 nt, Human
acuuguguaaauacaauuuugu

SEQ ID NO: 1706729 - RNA, 23 nt, Human
acuuguguaaauacaauuuuguu

SEQ ID NO: 1706730 - RNA, 12 nt, Human
ucuccauuuaau

SEQ ID NO: 1706731 - RNA, 16 nt, Human
ucuccauuuaauaauu

SEQ ID NO: 1706732 - RNA, 19 nt, Human
ucuccauuuaauaauuaua

SEQ ID NO: 1706733 - RNA, 14 nt, Human
ucuuuaauuuugga

SEQ ID NO: 1706734 - RNA, 15 nt, Human
ucuuuaauuuuggaa

SEQ ID NO: 1706735 - RNA, 16 nt, Human
ucuuuaauuuuggaau

SEQ ID NO: 1706736 - RNA, 17 nt, Human
ucuuuaauuuuggaauu

SEQ ID NO: 1706737 - RNA, 18 nt, Human
ucuuuaauuuuggaauuu

SEQ ID NO: 1706738 - RNA, 13 nt, Human
ucuuuaauuuugg

SEQ ID NO: 1706739 - RNA, 16 nt, Human
ucuguauagauuagag

SEQ ID NO: 1706740 - RNA, 17 nt, Human
ucuguauagauuagaau

SEQ ID NO: 1706741 - RNA, 12 nt, Human
ugaauuuauugg

SEQ ID NO: 1706742 - RNA, 15 nt, Human
ugaauuuauuggcuu

SEQ ID NO: 1706743 - RNA, 16 nt, Human
ugaauuuauuggcuuu

SEQ ID NO: 1706744 - RNA, 16 nt, Human
agauuauucacugauu

SEQ ID NO: 1706745 - RNA, 22 nt, Human
ugacuucauuaauaauaaauuc

SEQ ID NO: 1706746 - RNA, 15 nt, Human
agcaaaaauauuuua

SEQ ID NO: 1706747 - RNA, 17 nt, Human
agcaaaaauauuuuaug

SEQ ID NO: 1706748 - RNA, 18 nt, Human
agcaaaaauauuuuauga

SEQ ID NO: 1706749 - RNA, 19 nt, Human
agcaaaaauauuuuaugau

SEQ ID NO: 1706750 - RNA, 23 nt, Human
agcaaaaauauuuuaugauccag

SEQ ID NO: 1706751 - RNA, 21 nt, Human
agauuuuauuauguaaauccc

SEQ ID NO: 1706752 - RNA, 20 nt, Human
agauuuuauuauguaaaucc

SEQ ID NO: 1706753 - RNA, 22 nt, Human
agauuuuauuauguaaauccca

SEQ ID NO: 1706754 - RNA, 18 nt, Human
ugaggaauucuguauaga

SEQ ID NO: 1706755 - RNA, 19 nt, Human
ugaggaauucuguauagau

SEQ ID NO: 1706756 - RNA, 14 nt, Human
ugaggaauucugua

SEQ ID NO: 1706757 - RNA, 15 nt, Human
ugaggaauucuguau

SEQ ID NO: 1706758 - RNA, 16 nt, Human
ugaggaauucuguaua

SEQ ID NO: 1706759 - RNA, 19 nt, Human
agcagauuauucacugauu

SEQ ID NO: 1706760 - RNA, 20 nt, Human
agcagauuauucacugauuu

SEQ ID NO: 1706761 - RNA, 15 nt, Human
agcagauuauucacu

SEQ ID NO: 1706762 - RNA, 16 nt, Human
agcagauuauucacug

SEQ ID NO: 1706763 - RNA, 14 nt, Human
agcagauuauucac

SEQ ID NO: 1706764 - RNA, 16 nt, Human
ucagauuuuauuaugu

SEQ ID NO: 1706765 - RNA, 19 nt, Human
ucagauuuuauuauguaaa

SEQ ID NO: 1706766 - RNA, 20 nt, Human
ucagauuuuauuauguaaau

SEQ ID NO: 1706767 - RNA, 14 nt, Human
ucagauuuuauuau

SEQ ID NO: 1706768 - RNA, 15 nt, Human
ucagauuuuauuaug

SEQ ID NO: 1706769 - RNA, 13 nt, Human
ucagauuuuauua

SEQ ID NO: 1706770 - RNA, 21 nt, Human
ucagaucugccuaaggacuuc

SEQ ID NO: 1706771 - RNA, 18 nt, Human
uccacauaaggaaacugg

SEQ ID NO: 1706772 - RNA, 21 nt, Human
uccugcaaugaagucucugaa

SEQ ID NO: 1706773 - RNA, 15 nt, Human
uccugcaaugaaguc

SEQ ID NO: 1706774 - RNA, 18 nt, Human
uccugcaaugaagucucu

SEQ ID NO: 1706775 - RNA, 20 nt, Human
uccugcaaugaagucucuga

SEQ ID NO: 1706776 - RNA, 16 nt, Human
acuggauuguacuuug

SEQ ID NO: 1706777 - RNA, 13 nt, Human
acuggauuguacu

SEQ ID NO: 1706778 - RNA, 22 nt, Human
acucuccauuuaauaauuauau

SEQ ID NO: 1706779 - RNA, 17 nt, Human
uccuagcacacacuuuu

SEQ ID NO: 1706780 - RNA, 18 nt, Human
uccuagcacacacuuuug

SEQ ID NO: 1706781 - RNA, 19 nt, Human
uccuagcacacacuuuugg

SEQ ID NO: 1706782 - RNA, 14 nt, Human
uccgugcuaaggac

SEQ ID NO: 1706783 - RNA, 15 nt, Human
uccgugcuaaggacu

SEQ ID NO: 1706784 - RNA, 17 nt, Human
acuccaauuaaggauuu

SEQ ID NO: 1706785 - RNA, 21 nt, Human
acuccaauuaaggauuuuaug

SEQ ID NO: 1706786 - RNA, 13 nt, Human
acuauauauguga

SEQ ID NO: 1706787 - RNA, 21 nt, Human
ucccuauuuuuuuucuguuau

SEQ ID NO: 1706788 - RNA, 22 nt, Human
ucccuauuuuuuuucuguuaua

SEQ ID NO: 1706789 - RNA, 20 nt, Human
uaugauccagcagauuauuc

SEQ ID NO: 1706790 - RNA, 21 nt, Human
uaugauccagcagauuauuca

SEQ ID NO: 1706791 - RNA, 22 nt, Human
uaugauccagcagauuauucac

SEQ ID NO: 1706792 - RNA, 15 nt, Human
uaugcugaguuugug

SEQ ID NO: 1706793 - RNA, 11 nt, Human
uaugauccagc

SEQ ID NO: 1706794 - RNA, 19 nt, Human
uaugauccagcagauuauu

SEQ ID NO: 1706795 - RNA, 10 nt, Human
uaugauccag

SEQ ID NO: 1706796 - RNA, 20 nt, Human
uaucaccugucuugccuuuu

SEQ ID NO: 1706797 - RNA, 19 nt, Human
uauagauuagagaguguug

SEQ ID NO: 1706798 - RNA, 22 nt, Human
uauagauuagagaguguugaaa

SEQ ID NO: 1706799 - RNA, 20 nt, Human
uauagauuagaauucuguau

SEQ ID NO: 1706800 - RNA, 19 nt, Human
uauagauuagaauucugua

SEQ ID NO: 1706801 - RNA, 15 nt, Human
acacuccaauuaagg

SEQ ID NO: 1706802 - RNA, 16 nt, Human
acacuccaauuaagga

SEQ ID NO: 1706803 - RNA, 15 nt, Human
uauuggcuuuucuga

SEQ ID NO: 1706804 - RNA, 16 nt, Human
uauuggcuuuucugau

SEQ ID NO: 1706805 - RNA, 17 nt, Human
uauuggcuuuucugauc

SEQ ID NO: 1706806 - RNA, 18 nt, Human
uauuggcuuuucugaucc

SEQ ID NO: 1706807 - RNA, 14 nt, Human
uauuggcuuuucug

SEQ ID NO: 1706808 - RNA, 21 nt, Human
uauuggcuuuucugauccagu

SEQ ID NO: 1706809 - RNA, 22 nt, Human
uauuggcuuuucugauccaguu

SEQ ID NO: 1706810 - RNA, 12 nt, Human
uauugaagcauu

SEQ ID NO: 1706811 - RNA, 13 nt, Human
uauugaagcauuu

SEQ ID NO: 1706812 - RNA, 15 nt, Human
uauugaagcauuuua

SEQ ID NO: 1706813 - RNA, 16 nt, Human
uauugaagcauuuuau

SEQ ID NO: 1706814 - RNA, 17 nt, Human
uauugaagcauuuuaua

SEQ ID NO: 1706815 - RNA, 19 nt, Human
uauugaagcauuuuauaaa

SEQ ID NO: 1706816 - RNA, 15 nt, Human
uauuguacaaaguau

SEQ ID NO: 1706817 - RNA, 16 nt, Human
uauuguacaaaguauu

SEQ ID NO: 1706818 - RNA, 21 nt, Human
uauuguacaaaguauuaagca

SEQ ID NO: 1706819 - RNA, 22 nt, Human
uauuguacaaaguauuaagcau

SEQ ID NO: 1706820 - RNA, 23 nt, Human
uauuguacaaaguauuaagcaua

SEQ ID NO: 1706821 - RNA, 18 nt, Human
uauuuacuaaaauggacu

SEQ ID NO: 1706822 - RNA, 21 nt, Human
acaguauaauuaacauguuaa

SEQ ID NO: 1706823 - RNA, 23 nt, Human
acaguauaauuaacauguuaaac

SEQ ID NO: 1706824 - RNA, 17 nt, Human
acagcuggugcccugcu

SEQ ID NO: 1706825 - RNA, 20 nt, Human
acagcuggugcccugcuuuc

SEQ ID NO: 1706826 - RNA, 17 nt, Human
uauuaaagccauguuua

SEQ ID NO: 1706827 - RNA, 18 nt, Human
uauuaaagccauguuuau

SEQ ID NO: 1706828 - RNA, 20 nt, Human
uauuaaagccauguuuauua

SEQ ID NO: 1706829 - RNA, 16 nt, Human
uauuacaguauaauua

SEQ ID NO: 1706830 - RNA, 18 nt, Human
uauuacaguauaauuaac

SEQ ID NO: 1706831 - RNA, 20 nt, Human
uauuacaguauaauuaacau

SEQ ID NO: 1706832 - RNA, 21 nt, Human
uauuacaguauaauuaacaug

SEQ ID NO: 1706833 - RNA, 14 nt, Human
uauuacaguauaau

SEQ ID NO: 1706834 - RNA, 13 nt, Human
uauuaaagccaug

SEQ ID NO: 1706835 - RNA, 14 nt, Human
uauuaaagccaugu

SEQ ID NO: 1706836 - RNA, 12 nt, Human
uauuaaagccau

SEQ ID NO: 1706837 - RNA, 18 nt, Human
uauucaaaguugccuaaa

SEQ ID NO: 1706838 - RNA, 21 nt, Human
uauucaaaguugccuaaaucc

SEQ ID NO: 1706839 - RNA, 22 nt, Human
uauucaaaguugccuaaaucca

SEQ ID NO: 1706840 - RNA, 23 nt, Human
uauucaaaguugccuaaauccau

SEQ ID NO: 1706841 - RNA, 13 nt, Human
uauucacugauuu

SEQ ID NO: 1706842 - RNA, 19 nt, Human
uauucacugauuugacaua

SEQ ID NO: 1706843 - RNA, 22 nt, Human
uauucacugauuugacauaguc

SEQ ID NO: 1706844 - RNA, 13 nt, Human
aauuugaauuuug

SEQ ID NO: 1706845 - RNA, 16 nt, Human
aauuugaauuuugugu

SEQ ID NO: 1706846 - RNA, 18 nt, Human
aauuugaauuuuguguua

SEQ ID NO: 1706847 - RNA, 12 nt, Human
uacucaauuuua

SEQ ID NO: 1706848 - RNA, 13 nt, Human
uacucaauuuuaa

SEQ ID NO: 1706849 - RNA, 14 nt, Human
uacucaauuuuaac

SEQ ID NO: 1706850 - RNA, 21 nt, Human
uagaggaagccugauuaaaga

SEQ ID NO: 1706851 - RNA, 14 nt, Human
uagaaccucuuugu

SEQ ID NO: 1706852 - RNA, 21 nt, Human
uaauuauaugcuauuucuaua

SEQ ID NO: 1706853 - RNA, 20 nt, Human
uaauuauaugcuauuucuau

SEQ ID NO: 1706854 - RNA, 13 nt, Human
uaauuauaucuga

SEQ ID NO: 1706855 - RNA, 17 nt, Human
uaauuauaucugaggaa

SEQ ID NO: 1706856 - RNA, 13 nt, Human
aauuaacauguua

SEQ ID NO: 1706857 - RNA, 14 nt, Human
aauuaacauguuaa

SEQ ID NO: 1706858 - RNA, 18 nt, Human
aauuaacauguuaaacca

SEQ ID NO: 1706859 - RNA, 16 nt, Human
aauuaaggauuuuaug

SEQ ID NO: 1706860 - RNA, 20 nt, Human
aauuaaggauuuuaugcuuu

SEQ ID NO: 1706861 - RNA, 22 nt, Human
aauuaaggauuuuaugcuuuaa

SEQ ID NO: 1706862 - RNA, 16 nt, Human
aaggaagguucuggug

SEQ ID NO: 1706863 - RNA, 13 nt, Human
aaguauuaagcau

SEQ ID NO: 1706864 - RNA, 15 nt, Human
guuucuguacuuuuu

SEQ ID NO: 1706865 - RNA, 14 nt, Human
guuugcauagguga

SEQ ID NO: 1706866 - RNA, 10 nt, Human
guuucuguac

SEQ ID NO: 1706867 - RNA, 23 nt, Human
aaggcugaugccaaguuguuuga

SEQ ID NO: 1706868 - RNA, 19 nt, Human
aaguuuaauauuaaagcca

SEQ ID NO: 1706869 - RNA, 20 nt, Human
aaguuuaauauuaaagccau

SEQ ID NO: 1706870 - RNA, 21 nt, Human
aaguuuaauauuaaagccaug

SEQ ID NO: 1706871 - RNA, 18 nt, Human
uaaaccaugggauaaaug

SEQ ID NO: 1706872 - RNA, 20 nt, Human
uaaaccaugggauaaaugcc

SEQ ID NO: 1706873 - RNA, 21 nt, Human
uaaaccaugggauaaaugcca

SEQ ID NO: 1706874 - RNA, 22 nt, Human
uaaaccaugggauaaaugccau

SEQ ID NO: 1706875 - RNA, 16 nt, Human
uaacaacagcuggugc

SEQ ID NO: 1706876 - RNA, 15 nt, Human
aauacaauuuuguuu

SEQ ID NO: 1706877 - RNA, 17 nt, Human
aauacaauuuuguuucu

SEQ ID NO: 1706878 - RNA, 18 nt, Human
aauacaauuuuguuucug

SEQ ID NO: 1706879 - RNA, 20 nt, Human
aauacaauuuuguuucugua

SEQ ID NO: 1706880 - RNA, 12 nt, Human
aauacaauuuug

SEQ ID NO: 1706881 - RNA, 13 nt, Human
aauacaauuuugu

SEQ ID NO: 1706882 - RNA, 22 nt, Human
aauacaauuuuguuucuguacu

SEQ ID NO: 1706883 - RNA, 23 nt, Human
aauacaauuuuguuucuguacuu

SEQ ID NO: 1706884 - RNA, 13 nt, Human
uaaauacaauuuu

SEQ ID NO: 1706885 - RNA, 15 nt, Human
uaaauacaauuuugu

SEQ ID NO: 1706886 - RNA, 22 nt, Human
uaaauacaauuuuguuucugua

SEQ ID NO: 1706887 - RNA, 23 nt, Human
uaaauacaauuuuguuucuguac

SEQ ID NO: 1706888 - RNA, 19 nt, Human
uaaauagcuagacugguga

SEQ ID NO: 1706889 - RNA, 23 nt, Human
uaaauagcuagacuggugacuga

SEQ ID NO: 1706890 - RNA, 18 nt, Human
uaaaucgcuuuugauaau

SEQ ID NO: 1706891 - RNA, 19 nt, Human
uaaaucgcuuuugauaauc

SEQ ID NO: 1706892 - RNA, 23 nt, Human
uaaaucccauuauucaaaguugc

SEQ ID NO: 1706893 - RNA, 14 nt, Human
aauaauuauaugcu

SEQ ID NO: 1706894 - RNA, 15 nt, Human
aauaauuauaugcua

SEQ ID NO: 1706895 - RNA, 20 nt, Human
aauaauuauaugcuauuucu

SEQ ID NO: 1706896 - RNA, 21 nt, Human
aauaauuauaugcuauuucua

SEQ ID NO: 1706897 - RNA, 22 nt, Human
aauaauuauaugcuauuucuau

SEQ ID NO: 1706898 - RNA, 23 nt, Human
aauaauuauaugcuauuucuaua

SEQ ID NO: 1706899 - RNA, 16 nt, Human
aauaaggaaaaguuua

SEQ ID NO: 1706900 - RNA, 19 nt, Human
aauaaggaaaaguuuaaua

SEQ ID NO: 1706901 - RNA, 22 nt, Human
aauaaggaaaaguuuaauauua

SEQ ID NO: 1706902 - RNA, 13 nt, Human
aauaaggaaaagu

SEQ ID NO: 1706903 - RNA, 15 nt, Human
aauaaggaaaaguuu

SEQ ID NO: 1706904 - RNA, 21 nt, Human
aauaaauagcuagacugguga

SEQ ID NO: 1706905 - RNA, 15 nt, Human
aauaaaaaauuauga

SEQ ID NO: 1706906 - RNA, 16 nt, Human
aauaaaaaauuaugac

SEQ ID NO: 1706907 - RNA, 14 nt, Human
aauaaaaaauuaug

SEQ ID NO: 1706908 - RNA, 19 nt, Human
gugcugguguaugugugaa

SEQ ID NO: 1706909 - RNA, 22 nt, Human
gugcugggguuaucugaaguca

SEQ ID NO: 1706910 - RNA, 14 nt, Human
aacuuguguaaaua

SEQ ID NO: 1706911 - RNA, 15 nt, Human
aacuuguguaaauac

SEQ ID NO: 1706912 - RNA, 20 nt, Human
aacuuguguaaauacaauuu

SEQ ID NO: 1706913 - RNA, 21 nt, Human
guguugaaacggaugauuucu

SEQ ID NO: 1706914 - RNA, 23 nt, Human
guguugaaacggaugauuucuau

SEQ ID NO: 1706915 - RNA, 23 nt, Human
aacauguuaaaccaugggauaaa

SEQ ID NO: 1706916 - RNA, 15 nt, Human
aacauaaaucuguga

SEQ ID NO: 1706917 - RNA, 12 nt, Human
aacauaaaucug

SEQ ID NO: 1706918 - RNA, 14 nt, Human
aacauaaaucugug

SEQ ID NO: 1706919 - RNA, 23 nt, Human
gucuucauaccuacauguauuug

SEQ ID NO: 1706920 - RNA, 17 nt, Human
auaacauaaaucuguga

SEQ ID NO: 1706921 - RNA, 18 nt, Human
auaacauaaaucugugaa

SEQ ID NO: 1706922 - RNA, 19 nt, Human
auaacauaaaucugugaac

SEQ ID NO: 1706923 - RNA, 14 nt, Human
auaacauaaaucug

SEQ ID NO: 1706924 - RNA, 15 nt, Human
auaacauaaaucugu

SEQ ID NO: 1706925 - RNA, 17 nt, Human
auaccuacauguauuug

SEQ ID NO: 1706926 - RNA, 21 nt, Human
auaccuacauguauuuguuug

SEQ ID NO: 1706927 - RNA, 16 nt, Human
auaaggaaaaguuuaa

SEQ ID NO: 1706928 - RNA, 15 nt, Human
auaaggaaaaguuua

SEQ ID NO: 1706929 - RNA, 15 nt, Human
auaauuaacauguua

SEQ ID NO: 1706930 - RNA, 17 nt, Human
auaauuaacauguuaaa

SEQ ID NO: 1706931 - RNA, 17 nt, Human
auaucaucaguauugaa

SEQ ID NO: 1706932 - RNA, 22 nt, Human
auaucaucaguauugaagcauu

SEQ ID NO: 1706933 - RNA, 16 nt, Human
auaugcuauuucuaua

SEQ ID NO: 1706934 - RNA, 18 nt, Human
auaugcuauuucuauauu

SEQ ID NO: 1706935 - RNA, 19 nt, Human
auaugcuauuucuauauuu

SEQ ID NO: 1706936 - RNA, 21 nt, Human
auaugcuauuucuauauuuuc

SEQ ID NO: 1706937 - RNA, 15 nt, Human
auaugcuauuucuau

SEQ ID NO: 1706938 - RNA, 22 nt, Human
auaugcuauuucuauauuuuca

SEQ ID NO: 1706939 - RNA, 23 nt, Human
auaugcuauuucuauauuuucau

SEQ ID NO: 1706940 - RNA, 18 nt, Human
auauuuacuaaaauggac

SEQ ID NO: 1706941 - RNA, 20 nt, Human
auauuuacuaaaauggacug

SEQ ID NO: 1706942 - RNA, 13 nt, Human
augugugaaguga

SEQ ID NO: 1706943 - RNA, 21 nt, Human
augucuucauaccuacaugua

SEQ ID NO: 1706944 - RNA, 22 nt, Human
augucuucauaccuacauguau

SEQ ID NO: 1706945 - RNA, 19 nt, Human
augguccgugcuaaggacu

SEQ ID NO: 1706946 - RNA, 20 nt, Human
augguccgugcuaaggacuu

SEQ ID NO: 1706947 - RNA, 21 nt, Human
augguccgugcuaaggacuug

SEQ ID NO: 1706948 - RNA, 14 nt, Human
auguauuuguuugc

SEQ ID NO: 1706949 - RNA, 13 nt, Human
agaguguugaaac

SEQ ID NO: 1706950 - RNA, 23 nt, Human
aaugaagucucugaagugaaacu

SEQ ID NO: 1706951 - RNA, 14 nt, Human
aaugaagucucuga

SEQ ID NO: 1706952 - RNA, 16 nt, Human
aaugaagucucugaag

SEQ ID NO: 1706953 - RNA, 13 nt, Human
aaugaaauacugu

SEQ ID NO: 1706954 - RNA, 15 nt, Human
aaguugccuaaaucc

SEQ ID NO: 1706955 - RNA, 16 nt, Human
aaguugccuaaaucca

SEQ ID NO: 1706956 - RNA, 17 nt, Human
aaguugccuaaauccau

SEQ ID NO: 1706957 - RNA, 18 nt, Human
aaguugccuaaauccauu

SEQ ID NO: 1706958 - RNA, 19 nt, Human
aaguugccuaaauccauuu

SEQ ID NO: 1706959 - RNA, 13 nt, Human
aaugguuaaaaga

SEQ ID NO: 1706960 - RNA, 12 nt, Human
aagucuguuuua

SEQ ID NO: 1706961 - RNA, 13 nt, Human
aagucuguuuuau

SEQ ID NO: 1706962 - RNA, 14 nt, Human
aagucuguuuuaug

SEQ ID NO: 1706963 - RNA, 12 nt, Human
aaguugccuaaa

SEQ ID NO: 1706964 - RNA, 14 nt, Human
aaggacuucuuuaa

SEQ ID NO: 1706965 - RNA, 15 nt, Human
aaggacuucuuuaau

SEQ ID NO: 1706966 - RNA, 20 nt, Human
aaggacuucuuuaauuuugg

SEQ ID NO: 1706967 - RNA, 21 nt, Human
aaggacuucuuuaauuuugga

SEQ ID NO: 1706968 - RNA, 19 nt, Human
aacagcuggugcccugcuu

SEQ ID NO: 1706969 - RNA, 20 nt, Human
aacagcuggugcccugcuuu

SEQ ID NO: 1706970 - RNA, 21 nt, Human
aacagcuggugcccugcuuuc

SEQ ID NO: 1706971 - RNA, 14 nt, Human
aacggaugauuucu

SEQ ID NO: 1706972 - RNA, 15 nt, Human
aacggaugauuucua

SEQ ID NO: 1706973 - RNA, 16 nt, Human
aacggaugauuucuau

SEQ ID NO: 1706974 - RNA, 17 nt, Human
aacggaugauuucuaug

SEQ ID NO: 1706975 - RNA, 18 nt, Human
aaauagcuagacugguga

SEQ ID NO: 1706976 - RNA, 15 nt, Human
aaaucugugaacuug

SEQ ID NO: 1706977 - RNA, 16 nt, Human
aaaucugugaacuuga

SEQ ID NO: 1706978 - RNA, 18 nt, Human
aaaucugugaacuugaaa

SEQ ID NO: 1706979 - RNA, 10 nt, Human
aaauaaauaa

SEQ ID NO: 1706980 - RNA, 20 nt, Human
aaaccaugggauaaaugcca

SEQ ID NO: 1706981 - RNA, 15 nt, Human
aaaccaugggauaaa

SEQ ID NO: 1706982 - RNA, 13 nt, Human
aauuuuguuucug

SEQ ID NO: 1706983 - RNA, 14 nt, Human
aauuuuguuucugu

SEQ ID NO: 1706984 - RNA, 15 nt, Human
aauuuuguuucugua

SEQ ID NO: 1706985 - RNA, 23 nt, Human
acuguuugagguuuuuaagccuu

SEQ ID NO: 1706986 - RNA, 18 nt, Human
acuguuugagguuuuuaa

SEQ ID NO: 1706987 - RNA, 14 nt, Human
acuggugacugauu

SEQ ID NO: 1706988 - RNA, 18 nt, Human
aaaaaauuggggauucuu

SEQ ID NO: 1706989 - RNA, 20 nt, Human
aaaaaccaguauuguacaaa

SEQ ID NO: 1706990 - RNA, 15 nt, Human
cacccacccuuuuuu

SEQ ID NO: 1706991 - RNA, 19 nt, Human
caaaguugccuaaauccau

SEQ ID NO: 1706992 - RNA, 13 nt, Human
caauuaaggauuu

SEQ ID NO: 1706993 - RNA, 15 nt, Human
caauuaaggauuuua

SEQ ID NO: 1706994 - RNA, 20 nt, Human
caauuaaggauuuuaugcuu

SEQ ID NO: 1706995 - RNA, 21 nt, Human
caauuaaggauuuuaugcuuu

SEQ ID NO: 1706996 - RNA, 22 nt, Human
caauuaaggauuuuaugcuuua

SEQ ID NO: 1706997 - RNA, 20 nt, Human
cacauugguguuguacucaa

SEQ ID NO: 1706998 - RNA, 19 nt, Human
uucuuguauuaagaaugaa

SEQ ID NO: 1706999 - RNA, 14 nt, Human
uucuguauagauua

SEQ ID NO: 1707000 - RNA, 13 nt, Human
uucuguauagauu

SEQ ID NO: 1707001 - RNA, 11 nt, Human
uucuguauaga

SEQ ID NO: 1707002 - RNA, 16 nt, Human
uugaaacggaugauuu

SEQ ID NO: 1707003 - RNA, 19 nt, Human
uugaaacggaugauuucua

SEQ ID NO: 1707004 - RNA, 17 nt, Human
uucuuuaauuuuggaau

SEQ ID NO: 1707005 - RNA, 18 nt, Human
uucuuuaauuuuggaauu

SEQ ID NO: 1707006 - RNA, 12 nt, Human
uucuuuaauuuu

SEQ ID NO: 1707007 - RNA, 13 nt, Human
uugaagcauuuua

SEQ ID NO: 1707008 - RNA, 14 nt, Human
uugaagcauuuuau

SEQ ID NO: 1707009 - RNA, 15 nt, Human
uugaagcauuuuaua

SEQ ID NO: 1707010 - RNA, 17 nt, Human
uugaagcauuuuauaaa

SEQ ID NO: 1707011 - RNA, 22 nt, Human
uugaagcauuuuauaaaucgcu

SEQ ID NO: 1707012 - RNA, 12 nt, Human
uugccuuuuuca

SEQ ID NO: 1707013 - RNA, 13 nt, Human
uugccuuuuucau

SEQ ID NO: 1707014 - RNA, 14 nt, Human
uugccuuuuucauu

SEQ ID NO: 1707015 - RNA, 15 nt, Human
uugccuuuuucauua

SEQ ID NO: 1707016 - RNA, 16 nt, Human
uugccuuuuucauuau

SEQ ID NO: 1707017 - RNA, 17 nt, Human
uugccuuuuucauuauu

SEQ ID NO: 1707018 - RNA, 19 nt, Human
uuggcauaacauaaaucug

SEQ ID NO: 1707019 - RNA, 20 nt, Human
uuggcauaacauaaaucugu

SEQ ID NO: 1707020 - RNA, 22 nt, Human
uuggcauaacauaaaucuguga

SEQ ID NO: 1707021 - RNA, 23 nt, Human
uuggcauaacauaaaucugugaa

SEQ ID NO: 1707022 - RNA, 18 nt, Human
uuggcauaacauaaaucu

SEQ ID NO: 1707023 - RNA, 12 nt, Human
uuguuucuguac

SEQ ID NO: 1707024 - RNA, 14 nt, Human
uuguuucuguacuu

SEQ ID NO: 1707025 - RNA, 13 nt, Human
uuguuuguuuagu

SEQ ID NO: 1707026 - RNA, 14 nt, Human
uuguuuguuuaguc

SEQ ID NO: 1707027 - RNA, 14 nt, Human
uuuaauaauuauau

SEQ ID NO: 1707028 - RNA, 15 nt, Human
uuuaauauuaaagcc

SEQ ID NO: 1707029 - RNA, 17 nt, Human
uuuaauauuaaagccau

SEQ ID NO: 1707030 - RNA, 20 nt, Human
uuuaauauuaaagccauguu

SEQ ID NO: 1707031 - RNA, 21 nt, Human
uuuaauauuaaagccauguuu

SEQ ID NO: 1707032 - RNA, 14 nt, Human
uuuaauauuaaagc

SEQ ID NO: 1707033 - RNA, 15 nt, Human
uuuauaaaucgcuuu

SEQ ID NO: 1707034 - RNA, 18 nt, Human
uuuauaaaucgcuuuuga

SEQ ID NO: 1707035 - RNA, 22 nt, Human
uuuauaaaucgcuuuugauaau

SEQ ID NO: 1707036 - RNA, 19 nt, Human
uuuauaaaucgcuuuugau

SEQ ID NO: 1707037 - RNA, 20 nt, Human
uuuaugacuucauuaauaau

SEQ ID NO: 1707038 - RNA, 15 nt, Human
uuucugauccaguuu

SEQ ID NO: 1707039 - RNA, 16 nt, Human
uuucugauccaguuuu

SEQ ID NO: 1707040 - RNA, 20 nt, Human
uuucugauccaguuuuguuu

SEQ ID NO: 1707041 - RNA, 22 nt, Human
uuucugauccaguuuuguuugg

SEQ ID NO: 1707042 - RNA, 13 nt, Human
uuucugauccagu

SEQ ID NO: 1707043 - RNA, 12 nt, Human
uuuaugcuuuaa

SEQ ID NO: 1707044 - RNA, 15 nt, Human
uuuaugcuuuaaaca

SEQ ID NO: 1707045 - RNA, 16 nt, Human
uuuaugcuuuaaacau

SEQ ID NO: 1707046 - RNA, 18 nt, Human
uuugauaaucaacugggc

SEQ ID NO: 1707047 - RNA, 17 nt, Human
uuugguugcuuuaauau

SEQ ID NO: 1707048 - RNA, 12 nt, Human
uuucuuaaauaa

SEQ ID NO: 1707049 - RNA, 13 nt, Human
uuucuuaaauaau

SEQ ID NO: 1707050 - RNA, 20 nt, Human
uuugauaaucaacugggcug

SEQ ID NO: 1707051 - RNA, 21 nt, Human
uucacucuccauuuaauaauu

SEQ ID NO: 1707052 - RNA, 17 nt, Human
uucagauaacuguuauu

SEQ ID NO: 1707053 - RNA, 18 nt, Human
uucagauaacuguuauuu

SEQ ID NO: 1707054 - RNA, 23 nt, Human
uucagauaacuguuauuuauaau

SEQ ID NO: 1707055 - RNA, 11 nt, Human
uucaaaguugc

SEQ ID NO: 1707056 - RNA, 15 nt, Human
uucaaaguugccuaa

SEQ ID NO: 1707057 - RNA, 16 nt, Human
uucaaaguugccuaaa

SEQ ID NO: 1707058 - RNA, 17 nt, Human
uucaaaguugccuaaau

SEQ ID NO: 1707059 - RNA, 23 nt, Human
uucaaaguugccuaaauccauuu

SEQ ID NO: 1707060 - RNA, 13 nt, Human
uuauuuuauuaug

SEQ ID NO: 1707061 - RNA, 12 nt, Human
uuauuggcuuuu

SEQ ID NO: 1707062 - RNA, 16 nt, Human
uuauuggcuuuucuga

SEQ ID NO: 1707063 - RNA, 18 nt, Human
uuauuggcuuuucugauc

SEQ ID NO: 1707064 - RNA, 22 nt, Human
uuauuggcuuuucugauccagu

SEQ ID NO: 1707065 - RNA, 17 nt, Human
uuaucugaagucagauc

SEQ ID NO: 1707066 - RNA, 13 nt, Human
uuaugcuuuaaac

SEQ ID NO: 1707067 - RNA, 14 nt, Human
uuaugcuuuaaaca

SEQ ID NO: 1707068 - RNA, 14 nt, Human
uuauuacaguauaa

SEQ ID NO: 1707069 - RNA, 17 nt, Human
uucccuggccuuucaua

SEQ ID NO: 1707070 - RNA, 16 nt, Human
uucccuggccuuucau

SEQ ID NO: 1707071 - RNA, 12 nt, Human
uucccuggccuu

SEQ ID NO: 1707072 - RNA, 14 nt, Human
uuagagaguguuga

SEQ ID NO: 1707073 - RNA, 16 nt, Human
uuagagaguguugaaa

SEQ ID NO: 1707074 - RNA, 17 nt, Human
uuagagaguguugaaac

SEQ ID NO: 1707075 - RNA, 18 nt, Human
uuagagaguguugaaacg

SEQ ID NO: 1707076 - RNA, 12 nt, Human
uuagagauuuuu

SEQ ID NO: 1707077 - RNA, 13 nt, Human
uuagaucuaguuc

SEQ ID NO: 1707078 - RNA, 14 nt, Human
uuagaucuaguuca

SEQ ID NO: 1707079 - RNA, 16 nt, Human
uuagcuacuauauaug

SEQ ID NO: 1707080 - RNA, 13 nt, Human
uuaagcauauauu

SEQ ID NO: 1707081 - RNA, 15 nt, Human
uuaagcauauauuuu

SEQ ID NO: 1707082 - RNA, 18 nt, Human
uuaagcauauauuuuuau

SEQ ID NO: 1707083 - RNA, 19 nt, Human
uuaagcauauauuuuuaua

SEQ ID NO: 1707084 - RNA, 23 nt, Human
uuaagcauauauuuuuauauuua

SEQ ID NO: 1707085 - RNA, 21 nt, Human
uuaauauuaaagccauguuua

SEQ ID NO: 1707086 - RNA, 22 nt, Human
uuaauauuaaagccauguuuau

SEQ ID NO: 1707087 - RNA, 17 nt, Human
uggaccaaaaaccagua

SEQ ID NO: 1707088 - RNA, 22 nt, Human
uggaccaaaaaccaguauugua

SEQ ID NO: 1707089 - RNA, 20 nt, Human
uggauaauaaggaaaaguuu

SEQ ID NO: 1707090 - RNA, 15 nt, Human
uggugacugauucuu

SEQ ID NO: 1707091 - RNA, 16 nt, Human
uggugacugauucuuc

SEQ ID NO: 1707092 - RNA, 19 nt, Human
uggugacugauucuucagc

SEQ ID NO: 1707093 - RNA, 17 nt, Human
ugguccgugcuaaggac

SEQ ID NO: 1707094 - RNA, 18 nt, Human
ugguccgugcuaaggacu

SEQ ID NO: 1707095 - RNA, 19 nt, Human
ugguccgugcuaaggacuu

SEQ ID NO: 1707096 - RNA, 20 nt, Human
ugguccgugcuaaggacuug

SEQ ID NO: 1707097 - RNA, 13 nt, Human
ugccuaaauccau

SEQ ID NO: 1707098 - RNA, 15 nt, Human
ugccuaaauccauuu

SEQ ID NO: 1707099 - RNA, 19 nt, Human
ugccuaaauccauuuggaa

SEQ ID NO: 1707100 - RNA, 20 nt, Human
ugccuaaauccauuuggaaa

SEQ ID NO: 1707101 - RNA, 22 nt, Human
ugccuaaauccauuuggaaauc

SEQ ID NO: 1707102 - RNA, 23 nt, Human
ugccuaaauccauuuggaaaucu

SEQ ID NO: 1707103 - RNA, 20 nt, Human
ugccucacccacccuuuuuu

SEQ ID NO: 1707104 - RNA, 23 nt, Human
ugccucacccacccuuuuuuaaa

SEQ ID NO: 1707105 - RNA, 20 nt, Human
ugcauaggugaucucauuua

SEQ ID NO: 1707106 - RNA, 19 nt, Human
ugcgcuaaacuuuucugau

SEQ ID NO: 1707107 - RNA, 20 nt, Human
ugcgcuaaacuuuucugaua

SEQ ID NO: 1707108 - RNA, 21 nt, Human
ugcgcuaaacuuuucugauag

SEQ ID NO: 1707109 - RNA, 22 nt, Human
ugcugguguaugugugaaguga

SEQ ID NO: 1707110 - RNA, 13 nt, Human
ugcugguguaugu

SEQ ID NO: 1707111 - RNA, 17 nt, Human
ugcugggguuaucugaa

SEQ ID NO: 1707112 - RNA, 20 nt, Human
ugcugggguuaucugaaguc

SEQ ID NO: 1707113 - RNA, 21 nt, Human
ugauucuucagcaaaaauauu

SEQ ID NO: 1707114 - RNA, 15 nt, Human
ugauagaggaagccu

SEQ ID NO: 1707115 - RNA, 22 nt, Human
ugaucucauuuaauccucucaa

SEQ ID NO: 1707116 - RNA, 15 nt, Human
ugaucucauuuaauc

SEQ ID NO: 1707117 - RNA, 15 nt, Human
ugagcaucacaguuu

SEQ ID NO: 1707118 - RNA, 14 nt, Human
ugagcaucacaguu

SEQ ID NO: 1707119 - RNA, 19 nt, Human
ucuugccuuuuucauuauu

SEQ ID NO: 1707120 - RNA, 16 nt, Human
ucuugccuuuuucauu

SEQ ID NO: 1707121 - RNA, 17 nt, Human
ucuugccuuuuucauua

SEQ ID NO: 1707122 - RNA, 14 nt, Human
ugaagugaaacugc

SEQ ID NO: 1707123 - RNA, 13 nt, Human
ugaagugaaacug

SEQ ID NO: 1707124 - RNA, 12 nt, Human
ugaagugaaacu

SEQ ID NO: 1707125 - RNA, 20 nt, Human
ugaagucagaucugccuaag

SEQ ID NO: 1707126 - RNA, 23 nt, Human
ugaagucagaucugccuaaggac

SEQ ID NO: 1707127 - RNA, 17 nt, Human
ugacauagucuggcugu

SEQ ID NO: 1707128 - RNA, 16 nt, Human
ugacauagucuggcug

SEQ ID NO: 1707129 - RNA, 20 nt, Human
uccuaucaccugucuugccu

SEQ ID NO: 1707130 - RNA, 13 nt, Human
ucccauuauucaa

SEQ ID NO: 1707131 - RNA, 14 nt, Human
ucccauuauucaaa

SEQ ID NO: 1707132 - RNA, 16 nt, Human
ucccauuauucaaagu

SEQ ID NO: 1707133 - RNA, 18 nt, Human
ucccauuauucaaaguug

SEQ ID NO: 1707134 - RNA, 19 nt, Human
ucccauuauucaaaguugc

SEQ ID NO: 1707135 - RNA, 14 nt, Human
uccagcagauuauu

SEQ ID NO: 1707136 - RNA, 15 nt, Human
uccagcagauuauuc

SEQ ID NO: 1707137 - RNA, 16 nt, Human
uccagcagauuauuca

SEQ ID NO: 1707138 - RNA, 20 nt, Human
uccaguuuuguuuggaccaa

SEQ ID NO: 1707139 - RNA, 15 nt, Human
uccaguuuuguuugg

SEQ ID NO: 1707140 - RNA, 17 nt, Human
uccaguuuuguuuggac

SEQ ID NO: 1707141 - RNA, 23 nt, Human
ucaguauugaagcauuuuauaaa

SEQ ID NO: 1707142 - RNA, 22 nt, Human
ucaguauugaagcauuuuauaa

SEQ ID NO: 1707143 - RNA, 20 nt, Human
ucauggaacgcguugaaauu

SEQ ID NO: 1707144 - RNA, 21 nt, Human
ucauggaacgcguugaaauug

SEQ ID NO: 1707145 - RNA, 22 nt, Human
ucauggaacgcguugaaauugu

SEQ ID NO: 1707146 - RNA, 16 nt, Human
uauuaagcauauauuu

SEQ ID NO: 1707147 - RNA, 12 nt, Human
uauuaugaaacu

SEQ ID NO: 1707148 - RNA, 20 nt, Human
uauuaugaaacuuguguaaa

SEQ ID NO: 1707149 - RNA, 21 nt, Human
uauuaugaaacuuguguaaau

SEQ ID NO: 1707150 - RNA, 22 nt, Human
uauuaugaaacuuguguaaaua

SEQ ID NO: 1707151 - RNA, 12 nt, Human
uauuauguaaau

SEQ ID NO: 1707152 - RNA, 15 nt, Human
uauuauguaaauccc

SEQ ID NO: 1707153 - RNA, 22 nt, Human
uauuauguaaaucccauuauuc

SEQ ID NO: 1707154 - RNA, 19 nt, Human
uauugugcgcuaaacuuuu

SEQ ID NO: 1707155 - RNA, 22 nt, Human
uauugugcgcuaaacuuuucug

SEQ ID NO: 1707156 - RNA, 23 nt, Human
uauugugcgcuaaacuuuucuga

SEQ ID NO: 1707157 - RNA, 19 nt, Human
ucaauaaaaaauuaugaca

SEQ ID NO: 1707158 - RNA, 18 nt, Human
ucacauugguguuguacu

SEQ ID NO: 1707159 - RNA, 14 nt, Human
ucaauaaaaaauua

SEQ ID NO: 1707160 - RNA, 16 nt, Human
ucaauaaaaaauuaug

SEQ ID NO: 1707161 - RNA, 13 nt, Human
ucaauaaaaaauu

SEQ ID NO: 1707162 - RNA, 15 nt, Human
uauaauuaacauguu

SEQ ID NO: 1707163 - RNA, 16 nt, Human
uauaauuaacauguua

SEQ ID NO: 1707164 - RNA, 18 nt, Human
uauaauuaacauguuaaa

SEQ ID NO: 1707165 - RNA, 19 nt, Human
uauaauuaacauguuaaac

SEQ ID NO: 1707166 - RNA, 13 nt, Human
uauaauuaacaug

SEQ ID NO: 1707167 - RNA, 14 nt, Human
uauaauuaacaugu

SEQ ID NO: 1707168 - RNA, 12 nt, Human
uauaauuaacau

SEQ ID NO: 1707169 - RNA, 20 nt, Human
uauaaucacuuuuuuccaca

SEQ ID NO: 1707170 - RNA, 22 nt, Human
uauaauuaacauguuaaaccau

SEQ ID NO: 1707171 - RNA, 23 nt, Human
uauaaaucgcuuuugauaaucaa

SEQ ID NO: 1707172 - RNA, 18 nt, Human
uauaucugaggaauucug

SEQ ID NO: 1707173 - RNA, 19 nt, Human
uauaucugaggaauucugu

SEQ ID NO: 1707174 - RNA, 20 nt, Human
uauaucugaggaauucugua

SEQ ID NO: 1707175 - RNA, 21 nt, Human
uauaucugaggaauucuguau

SEQ ID NO: 1707176 - RNA, 22 nt, Human
uauaucugaggaauucuguaua

SEQ ID NO: 1707177 - RNA, 18 nt, Human
uauauaaaugguuaaaag

SEQ ID NO: 1707178 - RNA, 16 nt, Human
uauaugugaugaucua

SEQ ID NO: 1707179 - RNA, 21 nt, Human
uaggugaucucauuuaauccu

SEQ ID NO: 1707180 - RNA, 16 nt, Human
uaugacuucauuaaua

SEQ ID NO: 1707181 - RNA, 20 nt, Human
uaugacuucauuaauaauaa

SEQ ID NO: 1707182 - RNA, 15 nt, Human
uaugcuuuaaacauu

SEQ ID NO: 1707183 - RNA, 18 nt, Human
uaucugaggaauucugua

SEQ ID NO: 1707184 - RNA, 19 nt, Human
uaucugaggaauucuguau

SEQ ID NO: 1707185 - RNA, 21 nt, Human
uaucugaggaauucuguauag

SEQ ID NO: 1707186 - RNA, 22 nt, Human
uaucugaggaauucuguauaga

SEQ ID NO: 1707187 - RNA, 16 nt, Human
uaucugaggaauucug

SEQ ID NO: 1707188 - RNA, 17 nt, Human
uaucugaggaauucugu

SEQ ID NO: 1707189 - RNA, 23 nt, Human
gugaaacugcuuguuuccuagca

SEQ ID NO: 1707190 - RNA, 20 nt, Human
gugaaacugcuuguuuccua

SEQ ID NO: 1707191 - RNA, 21 nt, Human
gugaaacugcuuguuuccuag

SEQ ID NO: 1707192 - RNA, 17 nt, Human
gugaauggcuuuguaua

SEQ ID NO: 1707193 - RNA, 18 nt, Human
gugaauggcuuuguauag

SEQ ID NO: 1707194 - RNA, 19 nt, Human
gugaauggcuuuguauaga

SEQ ID NO: 1707195 - RNA, 13 nt, Human
gugaauggcuuug

SEQ ID NO: 1707196 - RNA, 14 nt, Human
gugaauggcuuugu

SEQ ID NO: 1707197 - RNA, 13 nt, Human
gucucagauuuua

SEQ ID NO: 1707198 - RNA, 12 nt, Human
guauuuguuugc

SEQ ID NO: 1707199 - RNA, 23 nt, Human
guauuuguuugcauaggugaucu

SEQ ID NO: 1707200 - RNA, 16 nt, Human
gguccgugcuaaggac

SEQ ID NO: 1707201 - RNA, 17 nt, Human
gguccgugcuaaggacu

SEQ ID NO: 1707202 - RNA, 18 nt, Human
gguccgugcuaaggacuu

SEQ ID NO: 1707203 - RNA, 14 nt, Human
ggugaauggcuuug

SEQ ID NO: 1707204 - RNA, 17 nt, Human
ggugaauggcuuuguau

SEQ ID NO: 1707205 - RNA, 20 nt, Human
ggugaauggcuuuguauaga

SEQ ID NO: 1707206 - RNA, 19 nt, Human
ggugcccugcuuucagaua

SEQ ID NO: 1707207 - RNA, 16 nt, Human
guaaaucccauuauuc

SEQ ID NO: 1707208 - RNA, 17 nt, Human
guaaaucccauuauuca

SEQ ID NO: 1707209 - RNA, 18 nt, Human
guaaaucccauuauucaa

SEQ ID NO: 1707210 - RNA, 19 nt, Human
guaaaucccauuauucaaa

SEQ ID NO: 1707211 - RNA, 20 nt, Human
guaaaucccauuauucaaag

SEQ ID NO: 1707212 - RNA, 21 nt, Human
guaaaucccauuauucaaagu

SEQ ID NO: 1707213 - RNA, 21 nt, Human
guaaauacaauuuuguuucug

SEQ ID NO: 1707214 - RNA, 15 nt, Human
guaaaucccauuauu

SEQ ID NO: 1707215 - RNA, 22 nt, Human
guaaauacaauuuuguuucugu

SEQ ID NO: 1707216 - RNA, 23 nt, Human
guaaauacaauuuuguuucugua

SEQ ID NO: 1707217 - RNA, 13 nt, Human
guaauuauaucug

SEQ ID NO: 1707218 - RNA, 12 nt, Human
guacuuuuuggc

SEQ ID NO: 1707219 - RNA, 21 nt, Human
guacuuuuuggcauaacauaa

SEQ ID NO: 1707220 - RNA, 13 nt, Human
gccugauuaaaga

SEQ ID NO: 1707221 - RNA, 16 nt, Human
gccugauuaaagaaug

SEQ ID NO: 1707222 - RNA, 23 nt, Human
gccugcacggugaauggcuuugu

SEQ ID NO: 1707223 - RNA, 20 nt, Human
ggauucuuaaaguugaauuu

SEQ ID NO: 1707224 - RNA, 18 nt, Human
ggauucuuaaaguugaau

SEQ ID NO: 1707225 - RNA, 19 nt, Human
ggauucuuaaaguugaauu

SEQ ID NO: 1707226 - RNA, 16 nt, Human
ggauucuuaaaguuga

SEQ ID NO: 1707227 - RNA, 14 nt, Human
ggaaaaguuuaaua

SEQ ID NO: 1707228 - RNA, 14 nt, Human
gcuuucagauacug

SEQ ID NO: 1707229 - RNA, 18 nt, Human
gcuuucagauacuggauu

SEQ ID NO: 1707230 - RNA, 23 nt, Human
gcuuucagauacuggauuguacu

SEQ ID NO: 1707231 - RNA, 20 nt, Human
gcuuuguauagaaccucuuu

SEQ ID NO: 1707232 - RNA, 15 nt, Human
ggacuguggugacuu

SEQ ID NO: 1707233 - RNA, 17 nt, Human
ggacuguggugacuuug

SEQ ID NO: 1707234 - RNA, 21 nt, Human
ggacuguggugacuuuggaua

SEQ ID NO: 1707235 - RNA, 22 nt, Human
ggacuguggugacuuuggauaa

SEQ ID NO: 1707236 - RNA, 14 nt, Human
ggacuguggugacu

SEQ ID NO: 1707237 - RNA, 14 nt, Human
ggaccaaaaaccag

SEQ ID NO: 1707238 - RNA, 16 nt, Human
ggaccaaaaaccagua

SEQ ID NO: 1707239 - RNA, 23 nt, Human
ggaccaaaaaccaguauuguaca

SEQ ID NO: 1707240 - RNA, 12 nt, Human
ggaauucuguau

SEQ ID NO: 1707241 - RNA, 15 nt, Human
ggaauucuguauaga

SEQ ID NO: 1707242 - RNA, 17 nt, Human
ggaauucuguauagauu

SEQ ID NO: 1707243 - RNA, 17 nt, Human
gauaacuguuauuuaua

SEQ ID NO: 1707244 - RNA, 18 nt, Human
gauaacuguuauuuauaa

SEQ ID NO: 1707245 - RNA, 11 nt, Human
gauaaaugcca

SEQ ID NO: 1707246 - RNA, 15 nt, Human
gauaaaugccaucaa

SEQ ID NO: 1707247 - RNA, 20 nt, Human
gauaaaugccaucaauaaaa

SEQ ID NO: 1707248 - RNA, 12 nt, Human
gaguguugaaac

SEQ ID NO: 1707249 - RNA, 16 nt, Human
gaguguugaaacggau

SEQ ID NO: 1707250 - RNA, 13 nt, Human
gauuuuaugcuuu

SEQ ID NO: 1707251 - RNA, 19 nt, Human
gaaugaaauacuguuugag

SEQ ID NO: 1707252 - RNA, 15 nt, Human
gaaugaaauacuguu

SEQ ID NO: 1707253 - RNA, 18 nt, Human
gaaugaaauacuguuuga

SEQ ID NO: 1707254 - RNA, 17 nt, Human
gaauggcuuuguauaga

SEQ ID NO: 1707255 - RNA, 14 nt, Human
gaauggcuuuguau

SEQ ID NO: 1707256 - RNA, 16 nt, Human
gaauggcuuuguauag

SEQ ID NO: 1707257 - RNA, 14 nt, Human
gaauucuguauaga

SEQ ID NO: 1707258 - RNA, 21 nt, Human
gaauucuguauagauuagaau

SEQ ID NO: 1707259 - RNA, 22 nt, Human
gaauucuguauagauuagaauu

SEQ ID NO: 1707260 - RNA, 13 nt, Human
gaauucuguauag

SEQ ID NO: 1707261 - RNA, 16 nt, Human
gacuucuuuaauuuug

SEQ ID NO: 1707262 - RNA, 17 nt, Human
gacuucuuuaauuuugg

SEQ ID NO: 1707263 - RNA, 18 nt, Human
gacuucuuuaauuuugga

SEQ ID NO: 1707264 - RNA, 19 nt, Human
gacuucuuuaauuuuggaa

SEQ ID NO: 1707265 - RNA, 20 nt, Human
gacuucuuuaauuuuggaau

SEQ ID NO: 1707266 - RNA, 21 nt, Human
gacuucuuuaauuuuggaauu

SEQ ID NO: 1707267 - RNA, 13 nt, Human
gagaguguugaaa

SEQ ID NO: 1707268 - RNA, 12 nt, Human
cugccuaaggac

SEQ ID NO: 1707269 - RNA, 13 nt, Human
cugccuaaggacu

SEQ ID NO: 1707270 - RNA, 14 nt, Human
cugccuaaggacuu

SEQ ID NO: 1707271 - RNA, 15 nt, Human
cugccuaaggacuuc

SEQ ID NO: 1707272 - RNA, 16 nt, Human
cuguauagauuagaau

SEQ ID NO: 1707273 - RNA, 19 nt, Human
cuucuuuaauuuuggaauu

SEQ ID NO: 1707274 - RNA, 15 nt, Human
cuucuuuaauuuugg

SEQ ID NO: 1707275 - RNA, 16 nt, Human
cuucuuuaauuuugga

SEQ ID NO: 1707276 - RNA, 17 nt, Human
cuucuuuaauuuuggaa

SEQ ID NO: 1707277 - RNA, 18 nt, Human
cuucuuuaauuuuggaau

SEQ ID NO: 1707278 - RNA, 15 nt, Human
cuuugugcugggguu

SEQ ID NO: 1707279 - RNA, 20 nt, Human
cuuugugcugggguuaucug

SEQ ID NO: 1707280 - RNA, 22 nt, Human
cuuugugcugggguuaucugaa

SEQ ID NO: 1707281 - RNA, 23 nt, Human
cuuugucuacaccauuaugugcg

SEQ ID NO: 1707282 - RNA, 20 nt, Human
cuuugucuacaccauuaugu

SEQ ID NO: 1707283 - RNA, 16 nt, Human
cuuucucuuucguuac

SEQ ID NO: 1707284 - RNA, 14 nt, Human
cuuguguaaauaca

SEQ ID NO: 1707285 - RNA, 16 nt, Human
cuuguguaaauacaau

SEQ ID NO: 1707286 - RNA, 21 nt, Human
cuuguguaaauacaauuuugu

SEQ ID NO: 1707287 - RNA, 12 nt, Human
cuuguguaaaua

SEQ ID NO: 1707288 - RNA, 22 nt, Human
cuuguuagaucuaguucacucu

SEQ ID NO: 1707289 - RNA, 21 nt, Human
cuuuaaacauugguucuugua

SEQ ID NO: 1707290 - RNA, 17 nt, Human
gaaacggaugauuucua

SEQ ID NO: 1707291 - RNA, 18 nt, Human
gaaacggaugauuucuau

SEQ ID NO: 1707292 - RNA, 16 nt, Human
cuuuuuggcauaacau

SEQ ID NO: 1707293 - RNA, 20 nt, Human
cuuuuuggcauaacauaaau

SEQ ID NO: 1707294 - RNA, 22 nt, Human
cuuuuuggcauaacauaaaucu

SEQ ID NO: 1707295 - RNA, 19 nt, Human
gaaaaguuuaauauuaaag

SEQ ID NO: 1707296 - RNA, 20 nt, Human
gaaaaguuuaauauuaaagc

SEQ ID NO: 1707297 - RNA, 21 nt, Human
gaaaaguuuaauauuaaagcc

SEQ ID NO: 1707298 - RNA, 22 nt, Human
gaaaaguuuaauauuaaagcca

SEQ ID NO: 1707299 - RNA, 15 nt, Human
gaaaaguuuaauauu

SEQ ID NO: 1707300 - RNA, 23 nt, Human
gaaaaguuuaauauuaaagccau

SEQ ID NO: 1707301 - RNA, 17 nt, Human
cgcuaaacuuuucugau

SEQ ID NO: 1707302 - RNA, 18 nt, Human
cgcuaaacuuuucugaua

SEQ ID NO: 1707303 - RNA, 19 nt, Human
cgcuaaacuuuucugauag

SEQ ID NO: 1707304 - RNA, 24 nt, Human
cgcguugaaauuguaauuauaucu

SEQ ID NO: 1707305 - RNA, 22 nt, Human
cgcguugaaauuguaauuauau

SEQ ID NO: 1707306 - RNA, 23 nt, Human
cucagauuuuauuauguaaaucc

SEQ ID NO: 1707307 - RNA, 22 nt, Human
cucagauuuuauuauguaaauc

SEQ ID NO: 1707308 - RNA, 13 nt, Human
cuccauuuaauaa

SEQ ID NO: 1707309 - RNA, 20 nt, Human
cuccauuuaauaauuauaug

SEQ ID NO: 1707310 - RNA, 22 nt, Human
cucccuauuuuuuuucuguuau

SEQ ID NO: 1707311 - RNA, 21 nt, Human
cucccuauuuuuuuucuguua

SEQ ID NO: 1707312 - RNA, 19 nt, Human
cuauuucuauauuuucauu

SEQ ID NO: 1707313 - RNA, 20 nt, Human
cuauuucuauauuuucauuc

SEQ ID NO: 1707314 - RNA, 18 nt, Human
cucaaccaccuuucagau

SEQ ID NO: 1707315 - RNA, 14 nt, Human
cuaugcugaguuug

SEQ ID NO: 1707316 - RNA, 15 nt, Human
cuaugcugaguuugu

SEQ ID NO: 1707317 - RNA, 13 nt, Human
cuaugcugaguuu

SEQ ID NO: 1707318 - RNA, 14 nt, Human
cuagacuggugacu

SEQ ID NO: 1707319 - RNA, 15 nt, Human
cuagacuggugacug

SEQ ID NO: 1707320 - RNA, 17 nt, Human
cuagacuggugacugau

SEQ ID NO: 1707321 - RNA, 18 nt, Human
cuagacuggugacugauu

SEQ ID NO: 1707322 - RNA, 19 nt, Human
cuagacuggugacugauuc

SEQ ID NO: 1707323 - RNA, 22 nt, Human
cuagacuggugacugauucuuc

SEQ ID NO: 1707324 - RNA, 23 nt, Human
cuagacuggugacugauucuuca

SEQ ID NO: 1707325 - RNA, 14 nt, Human
cuaaggacuucuuu

SEQ ID NO: 1707326 - RNA, 15 nt, Human
cuaaggacuucuuua

SEQ ID NO: 1707327 - RNA, 16 nt, Human
cuaaggacuucuuuaa

SEQ ID NO: 1707328 - RNA, 22 nt, Human
cuaaggacuucuuuaauuuugg

SEQ ID NO: 1707329 - RNA, 22 nt, Human
cuaaaauggacuguggugacuu

SEQ ID NO: 1707330 - RNA, 21 nt, Human
cuaaaauggacuguggugacu

SEQ ID NO: 1707331 - RNA, 18 nt, Human
cccauuauucaaaguugc

SEQ ID NO: 1707332 - RNA, 23 nt, Human
cccauuauucaaaguugccuaaa

SEQ ID NO: 1707333 - RNA, 16 nt, Human
ccccacccugccucac

SEQ ID NO: 1707334 - RNA, 11 nt, Human
ccauuauucaa

SEQ ID NO: 1707335 - RNA, 13 nt, Human
ccauuuggaaauc

SEQ ID NO: 1707336 - RNA, 14 nt, Human
caaaaauauuuuau

SEQ ID NO: 1707337 - RNA, 15 nt, Human
caaaaauauuuuaug

SEQ ID NO: 1707338 - RNA, 17 nt, Human
caaaaauauuuuaugau

SEQ ID NO: 1707339 - RNA, 21 nt, Human
caaaaauauuuuaugauccag

SEQ ID NO: 1707340 - RNA, 22 nt, Human
caaaaauauuuuaugauccagc

SEQ ID NO: 1707341 - RNA, 23 nt, Human
caaaaauauuuuaugauccagca

SEQ ID NO: 1707342 - RNA, 19 nt, Human
caaaaaccaguauuguaca

SEQ ID NO: 1707343 - RNA, 20 nt, Human
caaaaaccaguauuguacaa

SEQ ID NO: 1707344 - RNA, 18 nt, Human
caaaaaccaguauuguac

SEQ ID NO: 1707345 - RNA, 23 nt, Human
caauuaaggauuuuaugcuuuaa

SEQ ID NO: 1707346 - RNA, 23 nt, Human
uuuuguuuggaccaaaaaccagu

SEQ ID NO: 1707347 - RNA, 13 nt, Human
uuuuguuucugua

SEQ ID NO: 1707348 - RNA, 12 nt, Human
uuuuguuuggac

SEQ ID NO: 1707349 - RNA, 22 nt, Human
uuuuguuuggaccaaaaaccag

SEQ ID NO: 1707350 - RNA, 12 nt, Human
uuuuguuucugu

SEQ ID NO: 1707351 - RNA, 18 nt, Human
uuuuguuguuuguuuagu

SEQ ID NO: 1707352 - RNA, 14 nt, Human
auuaagcauauauu

SEQ ID NO: 1707353 - RNA, 15 nt, Human
auuaagcauauauuu

SEQ ID NO: 1707354 - RNA, 21 nt, Human
auuaagcauauauuuuuauau

SEQ ID NO: 1707355 - RNA, 11 nt, Human
auuaaagccau

SEQ ID NO: 1707356 - RNA, 21 nt, Human
auuagaauucuguauagauua

SEQ ID NO: 1707357 - RNA, 15 nt, Human
auuagaauucuguau

SEQ ID NO: 1707358 - RNA, 16 nt, Human
auuagaauucuguaua

SEQ ID NO: 1707359 - RNA, 17 nt, Human
auuagaauucuguauag

SEQ ID NO: 1707360 - RNA, 18 nt, Human
auuagaauucuguauaga

SEQ ID NO: 1707361 - RNA, 13 nt, Human
auuagaauucugu

SEQ ID NO: 1707362 - RNA, 14 nt, Human
auuagaauucugua

SEQ ID NO: 1707363 - RNA, 12 nt, Human
auuagaauucug

SEQ ID NO: 1707364 - RNA, 15 nt, Human
auuaauaauaaauuc

SEQ ID NO: 1707365 - RNA, 12 nt, Human
auguuaaaccau

SEQ ID NO: 1707366 - RNA, 13 nt, Human
auguuaaaccaug

SEQ ID NO: 1707367 - RNA, 20 nt, Human
auguuaaaccaugggauaaa

SEQ ID NO: 1707368 - RNA, 12 nt, Human
uuuuauuaugaa

SEQ ID NO: 1707369 - RNA, 21 nt, Human
uuuuauuaugaaacuugugua

SEQ ID NO: 1707370 - RNA, 22 nt, Human
uuuuauuaugaaacuuguguaa

SEQ ID NO: 1707371 - RNA, 15 nt, Human
uuuucugauccaguu

SEQ ID NO: 1707372 - RNA, 13 nt, Human
auucccuggccuu

SEQ ID NO: 1707373 - RNA, 19 nt, Human
auucccuggccuuucauau

SEQ ID NO: 1707374 - RNA, 21 nt, Human
auucuccuaucaccugucuug

SEQ ID NO: 1707375 - RNA, 14 nt, Human
auugguguuguacu

SEQ ID NO: 1707376 - RNA, 22 nt, Human
auugguguuguacucaauuuua

SEQ ID NO: 1707377 - RNA, 23 nt, Human
auugguguuguacucaauuuuaa

SEQ ID NO: 1707378 - RNA, 13 nt, Human
auucuuaaaguug

SEQ ID NO: 1707379 - RNA, 14 nt, Human
auucuuaaaguuga

SEQ ID NO: 1707380 - RNA, 15 nt, Human
auucuuaaaguugaa

SEQ ID NO: 1707381 - RNA, 16 nt, Human
auucuuaaaguugaau

SEQ ID NO: 1707382 - RNA, 21 nt, Human
auucuguauagauuagaauuc

SEQ ID NO: 1707383 - RNA, 15 nt, Human
auucuguauagauua

SEQ ID NO: 1707384 - RNA, 15 nt, Human
auucuucagcaaaaa

SEQ ID NO: 1707385 - RNA, 23 nt, Human
auucuucagcaaaaauauuuuau

SEQ ID NO: 1707386 - RNA, 18 nt, Human
auucuuaaaguugaauuu

SEQ ID NO: 1707387 - RNA, 16 nt, Human
auuuuauuauguaaau

SEQ ID NO: 1707388 - RNA, 17 nt, Human
auuuuauuauguaaauc

SEQ ID NO: 1707389 - RNA, 18 nt, Human
auuuuauuauguaaaucc

SEQ ID NO: 1707390 - RNA, 19 nt, Human
auuuuauuauguaaauccc

SEQ ID NO: 1707391 - RNA, 15 nt, Human
auuuuauuauguaaa

SEQ ID NO: 1707392 - RNA, 20 nt, Human
auuuuauuauguaaauccca

SEQ ID NO: 1707393 - RNA, 21 nt, Human
auuuuauuauguaaaucccau

SEQ ID NO: 1707394 - RNA, 13 nt, Human
auuuuccuccuuu

SEQ ID NO: 1707395 - RNA, 17 nt, Human
auuuuccuccuuucucu

SEQ ID NO: 1707396 - RNA, 15 nt, Human
uuguaauuauaucug

SEQ ID NO: 1707397 - RNA, 16 nt, Human
uugguuaagucuguuu

SEQ ID NO: 1707398 - RNA, 18 nt, Human
uugguuaagucuguuuua

SEQ ID NO: 1707399 - RNA, 17 nt, Human
uuuaaaaaaaaaauugg

SEQ ID NO: 1707400 - RNA, 23 nt, Human
augaucuaccagccucccuauuu

SEQ ID NO: 1707401 - RNA, 15 nt, Human
uuucuauauuuucau

SEQ ID NO: 1707402 - RNA, 18 nt, Human
uuucuauauuuucauucu

SEQ ID NO: 1707403 - RNA, 13 nt, Human
uuucuauauuuuc

SEQ ID NO: 1707404 - RNA, 21 nt, Human
uuucuaugcugaguuugugcu

SEQ ID NO: 1707405 - RNA, 15 nt, Human
uuuacuaaaauggac

SEQ ID NO: 1707406 - RNA, 17 nt, Human
uuuacuaaaauggacug

SEQ ID NO: 1707407 - RNA, 23 nt, Human
uuuagcuacuauauaugugauga

SEQ ID NO: 1707408 - RNA, 21 nt, Human
uuuauuaugaaacuuguguaa

SEQ ID NO: 1707409 - RNA, 13 nt, Human
uuuauuaugaaac

SEQ ID NO: 1707410 - RNA, 17 nt, Human
uucagcaaaaauauuuu

SEQ ID NO: 1707411 - RNA, 19 nt, Human
uucagcaaaaauauuuuau

SEQ ID NO: 1707412 - RNA, 22 nt, Human
uucauuauuuuauuaugaaacu

SEQ ID NO: 1707413 - RNA, 21 nt, Human
uucauggaacgcguugaaauu

SEQ ID NO: 1707414 - RNA, 22 nt, Human
uucauggaacgcguugaaauug

SEQ ID NO: 1707415 - RNA, 15 nt, Human
uucauuaauaauaaa

SEQ ID NO: 1707416 - RNA, 18 nt, Human
uucauuaauaauaaauuc

SEQ ID NO: 1707417 - RNA, 21 nt, Human
uucauuaauaauaaauucccu

SEQ ID NO: 1707418 - RNA, 19 nt, Human
uucauggaacgcguugaaa

SEQ ID NO: 1707419 - RNA, 20 nt, Human
uucauggaacgcguugaaau

SEQ ID NO: 1707420 - RNA, 13 nt, Human
auauauuuuuaua

SEQ ID NO: 1707421 - RNA, 19 nt, Human
aucaacugggcugaacacu

SEQ ID NO: 1707422 - RNA, 12 nt, Human
auauuaaagcca

SEQ ID NO: 1707423 - RNA, 17 nt, Human
uugacauagucuggcug

SEQ ID NO: 1707424 - RNA, 14 nt, Human
uugacauagucugg

SEQ ID NO: 1707425 - RNA, 19 nt, Human
uugauaaucaacugggcug

SEQ ID NO: 1707426 - RNA, 13 nt, Human
uucuuaaaguuga

SEQ ID NO: 1707427 - RNA, 15 nt, Human
uucuuaaauaauaaa

SEQ ID NO: 1707428 - RNA, 19 nt, Human
uucuuaaauaauaaagauc

SEQ ID NO: 1707429 - RNA, 14 nt, Human
ugcuauuucuauau

SEQ ID NO: 1707430 - RNA, 20 nt, Human
ugcuauuucuauauuuucau

SEQ ID NO: 1707431 - RNA, 12 nt, Human
ugcuauuucuau

SEQ ID NO: 1707432 - RNA, 13 nt, Human
ugcuauuucuaua

SEQ ID NO: 1707433 - RNA, 14 nt, Human
aggacuuguuagau

SEQ ID NO: 1707434 - RNA, 16 nt, Human
aggacuuguuagaucu

SEQ ID NO: 1707435 - RNA, 17 nt, Human
aggacuuguuagaucua

SEQ ID NO: 1707436 - RNA, 20 nt, Human
aggauuuuaugcuuuaaaca

SEQ ID NO: 1707437 - RNA, 12 nt, Human
ugauuucuaugc

SEQ ID NO: 1707438 - RNA, 15 nt, Human
ugauuucuaugcuga

SEQ ID NO: 1707439 - RNA, 16 nt, Human
ugauuucuaugcugag

SEQ ID NO: 1707440 - RNA, 21 nt, Human
uguuguacucaauuuuaacaa

SEQ ID NO: 1707441 - RNA, 14 nt, Human
uuauaaaucgcuuu

SEQ ID NO: 1707442 - RNA, 17 nt, Human
uuauaaaucgcuuuuga

SEQ ID NO: 1707443 - RNA, 18 nt, Human
uuauaaaucgcuuuugau

SEQ ID NO: 1707444 - RNA, 21 nt, Human
auaauuauaugcuauuucuau

SEQ ID NO: 1707445 - RNA, 23 nt, Human
auaauuauaugcuauuucuauau

SEQ ID NO: 1707446 - RNA, 17 nt, Human
auaauuauaugcuauuu

SEQ ID NO: 1707447 - RNA, 19 nt, Human
auaauuauaugcuauuucu

SEQ ID NO: 1707448 - RNA, 19 nt, Human
auaaucacuuuuuuccaca

SEQ ID NO: 1707449 - RNA, 16 nt, Human
auaauaaggaaaaguu

SEQ ID NO: 1707450 - RNA, 23 nt, Human
auaauaaauucccuggccuuuca

SEQ ID NO: 1707451 - RNA, 17 nt, Human
auaauaaggaaaaguuu

SEQ ID NO: 1707452 - RNA, 18 nt, Human
auaauaaggaaaaguuua

SEQ ID NO: 1707453 - RNA, 19 nt, Human
auaauaaggaaaaguuuaa

SEQ ID NO: 1707454 - RNA, 22 nt, Human
auaauaaggaaaaguuuaauau

SEQ ID NO: 1707455 - RNA, 18 nt, Human
ugguuaagucuguuuuau

SEQ ID NO: 1707456 - RNA, 15 nt, Human
ugguuaagucuguuu

SEQ ID NO: 1707457 - RNA, 21 nt, Human
uguaaauacaauuuuguuucu

SEQ ID NO: 1707458 - RNA, 10 nt, Human
uguaaauccc

SEQ ID NO: 1707459 - RNA, 16 nt, Human
uguaaauacaauuuug

SEQ ID NO: 1707460 - RNA, 17 nt, Human
uguaaauacaauuuugu

SEQ ID NO: 1707461 - RNA, 18 nt, Human
uguaaauacaauuuuguu

SEQ ID NO: 1707462 - RNA, 19 nt, Human
uguaaauacaauuuuguuu

SEQ ID NO: 1707463 - RNA, 13 nt, Human
uguacaaaguauu

SEQ ID NO: 1707464 - RNA, 14 nt, Human
uguacaaaguauua

SEQ ID NO: 1707465 - RNA, 15 nt, Human
ugucuugccuuuuuc

SEQ ID NO: 1707466 - RNA, 16 nt, Human
ugucuugccuuuuuca

SEQ ID NO: 1707467 - RNA, 17 nt, Human
ugucuugccuuuuucau

SEQ ID NO: 1707468 - RNA, 21 nt, Human
ugucuugccuuuuucauuauu

SEQ ID NO: 1707469 - RNA, 14 nt, Human
ugugaacuaaacuu

SEQ ID NO: 1707470 - RNA, 19 nt, Human
ugugaacuaaacuuucaca

SEQ ID NO: 1707471 - RNA, 20 nt, Human
ugugaacuaaacuuucacac

SEQ ID NO: 1707472 - RNA, 22 nt, Human
ugucuucauaccuacauguauu

SEQ ID NO: 1707473 - RNA, 13 nt, Human
agucuguuuuaug

SEQ ID NO: 1707474 - RNA, 14 nt, Human
agucuguuuuauga

SEQ ID NO: 1707475 - RNA, 17 nt, Human
agucuguuuuaugacuu

SEQ ID NO: 1707476 - RNA, 18 nt, Human
agucuguuuuaugacuuc

SEQ ID NO: 1707477 - RNA, 18 nt, Human
agucucugaagugaaacu

SEQ ID NO: 1707478 - RNA, 19 nt, Human
agucucugaagugaaacug

SEQ ID NO: 1707479 - RNA, 18 nt, Human
ugugagcaucacaguuuu

SEQ ID NO: 1707480 - RNA, 12 nt, Human
uguaugugugaa

SEQ ID NO: 1707481 - RNA, 13 nt, Human
uguaugugugaag

SEQ ID NO: 1707482 - RNA, 12 nt, Human
uguauuaagaau

SEQ ID NO: 1707483 - RNA, 16 nt, Human
uguauuaagaaugaaa

SEQ ID NO: 1707484 - RNA, 15 nt, Human
aguauuguacaaagu

SEQ ID NO: 1707485 - RNA, 20 nt, Human
aguauuguacaaaguauuaa

SEQ ID NO: 1707486 - RNA, 22 nt, Human
aguauuguacaaaguauuaagc

SEQ ID NO: 1707487 - RNA, 23 nt, Human
aguauuguacaaaguauuaagca

SEQ ID NO: 1707488 - RNA, 11 nt, Human
aguauuguaca

SEQ ID NO: 1707489 - RNA, 23 nt, Human
agucagaucugccuaaggacuuc

SEQ ID NO: 1707490 - RNA, 21 nt, Human
agucagaucugccuaaggacu

SEQ ID NO: 1707491 - RNA, 22 nt, Human
agucagaucugccuaaggacuu

SEQ ID NO: 1707492 - RNA, 20 nt, Human
agucagaucugccuaaggac

SEQ ID NO: 1707493 - RNA, 17 nt, Human
agucagaucugccuaag

SEQ ID NO: 1707494 - RNA, 19 nt, Human
agacuggugacugauucuu

SEQ ID NO: 1707495 - RNA, 20 nt, Human
agacuggugacugauucuuc

SEQ ID NO: 1707496 - RNA, 21 nt, Human
agacuggugacugauucuuca

SEQ ID NO: 1707497 - RNA, 17 nt, Human
ucuuugucuacaccauu

SEQ ID NO: 1707498 - RNA, 18 nt, Human
ugaaacugcuuguuuccu

SEQ ID NO: 1707499 - RNA, 19 nt, Human
ugaaacugcuuguuuccua

SEQ ID NO: 1707500 - RNA, 16 nt, Human
agagaguguugaaacg

SEQ ID NO: 1707501 - RNA, 15 nt, Human
agagaguguugaaac

SEQ ID NO: 1707502 - RNA, 20 nt, Human
ugaaacugcuuguuuccuag

SEQ ID NO: 1707503 - RNA, 22 nt, Human
ugaaacugcuuguuuccuagca

SEQ ID NO: 1707504 - RNA, 12 nt, Human
agagguuuuucu

SEQ ID NO: 1707505 - RNA, 22 nt, Human
agagguuuuucuuaaauaauaa

SEQ ID NO: 1707506 - RNA, 17 nt, Human
ugaacuaaacuuucaca

SEQ ID NO: 1707507 - RNA, 19 nt, Human
ugaacuaaacuuucacacc

SEQ ID NO: 1707508 - RNA, 13 nt, Human
ugaaauuguaauu

SEQ ID NO: 1707509 - RNA, 14 nt, Human
ugaaauuguaauua

SEQ ID NO: 1707510 - RNA, 15 nt, Human
ugaaauuguaauuau

SEQ ID NO: 1707511 - RNA, 16 nt, Human
ugaaauuguaauuaua

SEQ ID NO: 1707512 - RNA, 19 nt, Human
ugaaauuguaauuauaucu

SEQ ID NO: 1707513 - RNA, 14 nt, Human
ugaaauacuguuug

SEQ ID NO: 1707514 - RNA, 16 nt, Human
ugaaauacuguuugag

SEQ ID NO: 1707515 - RNA, 15 nt, Human
agauuagaauucugu

SEQ ID NO: 1707516 - RNA, 16 nt, Human
agauuagaauucugua

SEQ ID NO: 1707517 - RNA, 22 nt, Human
agauuagaauucuguauagauu

SEQ ID NO: 1707518 - RNA, 23 nt, Human
agauuagaauucuguauagauua

SEQ ID NO: 1707519 - RNA, 21 nt, Human
agauuagagaguguugaaacg

SEQ ID NO: 1707520 - RNA, 17 nt, Human
acuuuggauaauaagga

SEQ ID NO: 1707521 - RNA, 19 nt, Human
acuuuggauaauaaggaaa

SEQ ID NO: 1707522 - RNA, 12 nt, Human
acuuuggauaau

SEQ ID NO: 1707523 - RNA, 16 nt, Human
ucucauuuaauccucu

SEQ ID NO: 1707524 - RNA, 22 nt, Human
ucucagauuuuauuauguaaau

SEQ ID NO: 1707525 - RNA, 23 nt, Human
ucucagauuuuauuauguaaauc

SEQ ID NO: 1707526 - RNA, 13 nt, Human
acuuguguaaaua

SEQ ID NO: 1707527 - RNA, 14 nt, Human
acuguuauuuauaa

SEQ ID NO: 1707528 - RNA, 15 nt, Human
acuguuauuuauaau

SEQ ID NO: 1707529 - RNA, 17 nt, Human
acuguuauuuauaauca

SEQ ID NO: 1707530 - RNA, 20 nt, Human
acuguuauuuauaaucacuu

SEQ ID NO: 1707531 - RNA, 21 nt, Human
acuguuauuuauaaucacuuu

SEQ ID NO: 1707532 - RNA, 14 nt, Human
ucugauccaguuuu

SEQ ID NO: 1707533 - RNA, 21 nt, Human
ucugauccaguuuuguuugga

SEQ ID NO: 1707534 - RNA, 11 nt, Human
ucugauccagu

SEQ ID NO: 1707535 - RNA, 20 nt, Human
ucugugagcaucacaguuuu

SEQ ID NO: 1707536 - RNA, 14 nt, Human
agaauucuguauag

SEQ ID NO: 1707537 - RNA, 12 nt, Human
agaauucuguau

SEQ ID NO: 1707538 - RNA, 14 nt, Human
ucugugaacuugaa

SEQ ID NO: 1707539 - RNA, 17 nt, Human
ucugugaacuugaaauu

SEQ ID NO: 1707540 - RNA, 18 nt, Human
ucugugaacuugaaauuu

SEQ ID NO: 1707541 - RNA, 21 nt, Human
agaaugguccgugcuaaggac

SEQ ID NO: 1707542 - RNA, 23 nt, Human
agaaugguccgugcuaaggacuu

SEQ ID NO: 1707543 - RNA, 14 nt, Human
agaaggcaaaugac

SEQ ID NO: 1707544 - RNA, 15 nt, Human
agaaggcaaaugacu

SEQ ID NO: 1707545 - RNA, 20 nt, Human
agaaggcaaaugacuuugga

SEQ ID NO: 1707546 - RNA, 22 nt, Human
uccugcaaugaagucucugaag

SEQ ID NO: 1707547 - RNA, 12 nt, Human
acucaauuuuaa

SEQ ID NO: 1707548 - RNA, 15 nt, Human
acucaauuuuaacaa

SEQ ID NO: 1707549 - RNA, 19 nt, Human
acggugaauggcuuuguau

SEQ ID NO: 1707550 - RNA, 20 nt, Human
acggugaauggcuuuguaua

SEQ ID NO: 1707551 - RNA, 16 nt, Human
acggugaauggcuuug

SEQ ID NO: 1707552 - RNA, 15 nt, Human
acuaaacuuucacac

SEQ ID NO: 1707553 - RNA, 16 nt, Human
acuaaacuuucacacc

SEQ ID NO: 1707554 - RNA, 13 nt, Human
acggaugauuucu

SEQ ID NO: 1707555 - RNA, 19 nt, Human
accauaaccccggaagcca

SEQ ID NO: 1707556 - RNA, 22 nt, Human
ucagauuuuauuauguaaaucc

SEQ ID NO: 1707557 - RNA, 23 nt, Human
ucagauuuuauuauguaaauccc

SEQ ID NO: 1707558 - RNA, 19 nt, Human
ucagcaaaaauauuuuaug

SEQ ID NO: 1707559 - RNA, 20 nt, Human
ucagcaaaaauauuuuauga

SEQ ID NO: 1707560 - RNA, 18 nt, Human
ucaacugggcugaacacu

SEQ ID NO: 1707561 - RNA, 17 nt, Human
ucaaccaccuuucagau

SEQ ID NO: 1707562 - RNA, 19 nt, Human
acauguauuuguuugcaua

SEQ ID NO: 1707563 - RNA, 17 nt, Human
acauguauuuguuugca

SEQ ID NO: 1707564 - RNA, 18 nt, Human
acauguauuuguuugcau

SEQ ID NO: 1707565 - RNA, 16 nt, Human
acauguauuuguuugc

SEQ ID NO: 1707566 - RNA, 12 nt, Human
ucaacugggcug

SEQ ID NO: 1707567 - RNA, 19 nt, Human
ucaccugucuugccuuuuu

SEQ ID NO: 1707568 - RNA, 20 nt, Human
ucaccugucuugccuuuuuc

SEQ ID NO: 1707569 - RNA, 23 nt, Human
accaguauuguacaaaguauuaa

SEQ ID NO: 1707570 - RNA, 14 nt, Human
accaguauuguaca

SEQ ID NO: 1707571 - RNA, 15 nt, Human
accaguauuguacaa

SEQ ID NO: 1707572 - RNA, 20 nt, Human
accaguauuguacaaaguau

SEQ ID NO: 1707573 - RNA, 22 nt, Human
accaguauuguacaaaguauua

SEQ ID NO: 1707574 - RNA, 20 nt, Human
ucacaguuuugguugcuuua

SEQ ID NO: 1707575 - RNA, 21 nt, Human
ucacaguuuugguugcuuuaa

SEQ ID NO: 1707576 - RNA, 23 nt, Human
ucacaguuuugguugcuuuaaua

SEQ ID NO: 1707577 - RNA, 21 nt, Human
uaacuguuauuuauaaucacu

SEQ ID NO: 1707578 - RNA, 12 nt, Human
uaacauaaaucu

SEQ ID NO: 1707579 - RNA, 16 nt, Human
aauaucaucaguauug

SEQ ID NO: 1707580 - RNA, 20 nt, Human
aaucugugaacuugaaauuu

SEQ ID NO: 1707581 - RNA, 21 nt, Human
aaucugugaacuugaaauuug

SEQ ID NO: 1707582 - RNA, 22 nt, Human
aaucugugaacuugaaauuuga

SEQ ID NO: 1707583 - RNA, 16 nt, Human
uaaggaaaaguuuaau

SEQ ID NO: 1707584 - RNA, 16 nt, Human
uaaucacuuuuuucca

SEQ ID NO: 1707585 - RNA, 17 nt, Human
uaaucacuuuuuuccac

SEQ ID NO: 1707586 - RNA, 19 nt, Human
uaaucacuuuuuuccacau

SEQ ID NO: 1707587 - RNA, 18 nt, Human
uaaucacuuuuuuccaca

SEQ ID NO: 1707588 - RNA, 19 nt, Human
uacuauauaugugaugauc

SEQ ID NO: 1707589 - RNA, 19 nt, Human
aauucccuggccuuucaua

SEQ ID NO: 1707590 - RNA, 20 nt, Human
aauucccuggccuuucauau

SEQ ID NO: 1707591 - RNA, 14 nt, Human
uacuggauuguacu

SEQ ID NO: 1707592 - RNA, 16 nt, Human
aauggacuguggugac

SEQ ID NO: 1707593 - RNA, 16 nt, Human
aaugccaucaauaaaa

SEQ ID NO: 1707594 - RNA, 21 nt, Human
aaugccaucaauaaaaaauua

SEQ ID NO: 1707595 - RNA, 23 nt, Human
aaugccaucaauaaaaaauuaug

SEQ ID NO: 1707596 - RNA, 20 nt, Human
aauuaacauguuaaaccaug

SEQ ID NO: 1707597 - RNA, 19 nt, Human
aauuaacauguuaaaccau

SEQ ID NO: 1707598 - RNA, 13 nt, Human
uacauguauuugu

SEQ ID NO: 1707599 - RNA, 12 nt, Human
uauucaaaguug

SEQ ID NO: 1707600 - RNA, 13 nt, Human
uauucaaaguugc

SEQ ID NO: 1707601 - RNA, 16 nt, Human
uauucaaaguugccua

SEQ ID NO: 1707602 - RNA, 13 nt, Human
acaguauaauuaa

SEQ ID NO: 1707603 - RNA, 15 nt, Human
acaguauaauuaaca

SEQ ID NO: 1707604 - RNA, 20 nt, Human
acaguauaauuaacauguua

SEQ ID NO: 1707605 - RNA, 14 nt, Human
uaugugugaaguga

SEQ ID NO: 1707606 - RNA, 12 nt, Human
uaugugugaagu

SEQ ID NO: 1707607 - RNA, 20 nt, Human
uauauuuacuaaaauggacu

SEQ ID NO: 1707608 - RNA, 21 nt, Human
uauauuuacuaaaauggacug

SEQ ID NO: 1707609 - RNA, 19 nt, Human
uauauuuacuaaaauggac

SEQ ID NO: 1707610 - RNA, 23 nt, Human
acacacuuuugguuaagucuguu

SEQ ID NO: 1707611 - RNA, 17 nt, Human
acaccauuaugugcgcu

SEQ ID NO: 1707612 - RNA, 21 nt, Human
acaccauuaugugcgcugaua

SEQ ID NO: 1707613 - RNA, 21 nt, Human
uagcuagacuggugacugauu

SEQ ID NO: 1707614 - RNA, 22 nt, Human
uagcuagacuggugacugauuc

SEQ ID NO: 1707615 - RNA, 23 nt, Human
uagagauuuuuuuguuguuuguu

SEQ ID NO: 1707616 - RNA, 14 nt, Human
gugaucucauuuaa

SEQ ID NO: 1707617 - RNA, 13 nt, Human
aacuugaaauuug

SEQ ID NO: 1707618 - RNA, 18 nt, Human
aacuugaaauuugaauuu

SEQ ID NO: 1707619 - RNA, 19 nt, Human
aacuugaaauuugaauuuu

SEQ ID NO: 1707620 - RNA, 12 nt, Human
aacuugaaauuu

SEQ ID NO: 1707621 - RNA, 12 nt, Human
gugacuuuggau

SEQ ID NO: 1707622 - RNA, 15 nt, Human
gugacuuuggauaau

SEQ ID NO: 1707623 - RNA, 23 nt, Human
gucuugucucagauuuuauuaug

SEQ ID NO: 1707624 - RNA, 16 nt, Human
aacauguuaaaccaug

SEQ ID NO: 1707625 - RNA, 14 nt, Human
aacauguuaaacca

SEQ ID NO: 1707626 - RNA, 15 nt, Human
aacauguuaaaccau

SEQ ID NO: 1707627 - RNA, 16 nt, Human
aacauugguucuugua

SEQ ID NO: 1707628 - RNA, 18 nt, Human
aacauugguucuuguauu

SEQ ID NO: 1707629 - RNA, 19 nt, Human
aacauugguucuuguauua

SEQ ID NO: 1707630 - RNA, 22 nt, Human
aacauugguucuuguauuaaga

SEQ ID NO: 1707631 - RNA, 23 nt, Human
aacauugguucuuguauuaagaa

SEQ ID NO: 1707632 - RNA, 16 nt, Human
guccgugcuaaggacu

SEQ ID NO: 1707633 - RNA, 17 nt, Human
guccgugcuaaggacuu

SEQ ID NO: 1707634 - RNA, 15 nt, Human
guccgugcuaaggac

SEQ ID NO: 1707635 - RNA, 15 nt, Human
aaauuugaauuuugu

SEQ ID NO: 1707636 - RNA, 22 nt, Human
aaauuugaauuuuguguuagag

SEQ ID NO: 1707637 - RNA, 12 nt, Human
aaauuugaauuu

SEQ ID NO: 1707638 - RNA, 19 nt, Human
guauuguacaaaguauuaa

SEQ ID NO: 1707639 - RNA, 10 nt, Human
guauugaagc

SEQ ID NO: 1707640 - RNA, 13 nt, Human
guauugaagcauu

SEQ ID NO: 1707641 - RNA, 17 nt, Human
guauugaagcauuuuau

SEQ ID NO: 1707642 - RNA, 18 nt, Human
guauugaagcauuuuaua

SEQ ID NO: 1707643 - RNA, 22 nt, Human
guauugaagcauuuuauaaauc

SEQ ID NO: 1707644 - RNA, 21 nt, Human
guauuguacaaaguauuaagc

SEQ ID NO: 1707645 - RNA, 22 nt, Human
guauuguacaaaguauuaagca

SEQ ID NO: 1707646 - RNA, 23 nt, Human
guauuguacaaaguauuaagcau

SEQ ID NO: 1707647 - RNA, 23 nt, Human
aagucagaucugccuaaggacuu

SEQ ID NO: 1707648 - RNA, 14 nt, Human
uaaaaaaaaaauug

SEQ ID NO: 1707649 - RNA, 18 nt, Human
uaaaaaaaaaauugggga

SEQ ID NO: 1707650 - RNA, 12 nt, Human
guuguuuguuua

SEQ ID NO: 1707651 - RNA, 12 nt, Human
aaggaaaaguuu

SEQ ID NO: 1707652 - RNA, 20 nt, Human
aaggaaacuggguuccugca

SEQ ID NO: 1707653 - RNA, 13 nt, Human
guuuauuacagua

SEQ ID NO: 1707654 - RNA, 17 nt, Human
guuuauuacaguauaau

SEQ ID NO: 1707655 - RNA, 13 nt, Human
guuuaauauuaaa

SEQ ID NO: 1707656 - RNA, 14 nt, Human
guuuaauauuaaag

SEQ ID NO: 1707657 - RNA, 15 nt, Human
guuuaauauuaaagc

SEQ ID NO: 1707658 - RNA, 18 nt, Human
guuuaauauuaaagccau

SEQ ID NO: 1707659 - RNA, 18 nt, Human
guuuggaccaaaaaccag

SEQ ID NO: 1707660 - RNA, 13 nt, Human
guuuuaugacuuc

SEQ ID NO: 1707661 - RNA, 18 nt, Human
guuuuaugacuucauuaa

SEQ ID NO: 1707662 - RNA, 18 nt, Human
aagucagaucugccuaag

SEQ ID NO: 1707663 - RNA, 21 nt, Human
aagucagaucugccuaaggac

SEQ ID NO: 1707664 - RNA, 22 nt, Human
aagucagaucugccuaaggacu

SEQ ID NO: 1707665 - RNA, 20 nt, Human
aagccauguuuauuacagua

SEQ ID NO: 1707666 - RNA, 21 nt, Human
aagccauguuuauuacaguau

SEQ ID NO: 1707667 - RNA, 22 nt, Human
aagccauguuuauuacaguaua

SEQ ID NO: 1707668 - RNA, 23 nt, Human
aagccauguuuauuacaguauaa

SEQ ID NO: 1707669 - RNA, 18 nt, Human
guuagagauuuuuuuguu

SEQ ID NO: 1707670 - RNA, 23 nt, Human
aagcauauauuuuuauauuuacu

SEQ ID NO: 1707671 - RNA, 15 nt, Human
aagccauguuuauua

SEQ ID NO: 1707672 - RNA, 16 nt, Human
aagccauguuuauuac

SEQ ID NO: 1707673 - RNA, 17 nt, Human
aagccauguuuauuaca

SEQ ID NO: 1707674 - RNA, 21 nt, Human
aagcauuuuauaaaucgcuuu

SEQ ID NO: 1707675 - RNA, 17 nt, Human
aagcauuuuauaaaucg

SEQ ID NO: 1707676 - RNA, 19 nt, Human
aagcauuuuauaaaucgcu

SEQ ID NO: 1707677 - RNA, 12 nt, Human
aagcauuuuaua

SEQ ID NO: 1707678 - RNA, 14 nt, Human
aagcauuuuauaaa

SEQ ID NO: 1707679 - RNA, 15 nt, Human
aagcauuuuauaaau

SEQ ID NO: 1707680 - RNA, 18 nt, Human
guguaaauacaauuuugu

SEQ ID NO: 1707681 - RNA, 21 nt, Human
guguaaauacaauuuuguuuc

SEQ ID NO: 1707682 - RNA, 22 nt, Human
guguaaauacaauuuuguuucu

SEQ ID NO: 1707683 - RNA, 21 nt, Human
cuauuuuuuuucuguuauaua

SEQ ID NO: 1707684 - RNA, 20 nt, Human
cuauuuuuuuucuguuauau

SEQ ID NO: 1707685 - RNA, 16 nt, Human
ccuuuuuuaaauaaau

SEQ ID NO: 1707686 - RNA, 12 nt, Human
ccuuucauauuu

SEQ ID NO: 1707687 - RNA, 19 nt, Human
ccugucuugccuuuuucau

SEQ ID NO: 1707688 - RNA, 20 nt, Human
ccugucuugccuuuuucauu

SEQ ID NO: 1707689 - RNA, 17 nt, Human
ccugucuugccuuuuuc

SEQ ID NO: 1707690 - RNA, 20 nt, Human
ccuauuuuuuuucuguuaua

SEQ ID NO: 1707691 - RNA, 18 nt, Human
cccaggaauggagccugc

SEQ ID NO: 1707692 - RNA, 19 nt, Human
cccaggaauggagccugca

SEQ ID NO: 1707693 - RNA, 20 nt, Human
cccaggaauggagccugcac

SEQ ID NO: 1707694 - RNA, 22 nt, Human
cccaggaauggagccugcacgg

SEQ ID NO: 1707695 - RNA, 15 nt, Human
ccagcagauuauuca

SEQ ID NO: 1707696 - RNA, 20 nt, Human
ccaguauuguacaaaguauu

SEQ ID NO: 1707697 - RNA, 22 nt, Human
ccaguauuguacaaaguauuaa

SEQ ID NO: 1707698 - RNA, 16 nt, Human
ccaguuuuguuuggac

SEQ ID NO: 1707699 - RNA, 19 nt, Human
ccaguuuuguuuggaccaa

SEQ ID NO: 1707700 - RNA, 23 nt, Human
ccaccuuucagauaacuguuauu

SEQ ID NO: 1707701 - RNA, 18 nt, Human
cauguauuuguuugcaua

SEQ ID NO: 1707702 - RNA, 13 nt, Human
caauaaaaaauua

SEQ ID NO: 1707703 - RNA, 16 nt, Human
caauaaaaaauuauga

SEQ ID NO: 1707704 - RNA, 17 nt, Human
caauaaaaaauuaugac

SEQ ID NO: 1707705 - RNA, 16 nt, Human
caaaguauuaagcaua

SEQ ID NO: 1707706 - RNA, 17 nt, Human
caaaguauuaagcauau

SEQ ID NO: 1707707 - RNA, 19 nt, Human
caaaguauuaagcauauau

SEQ ID NO: 1707708 - RNA, 21 nt, Human
caaaguauuaagcauauauuu

SEQ ID NO: 1707709 - RNA, 14 nt, Human
caaaguauuaagca

SEQ ID NO: 1707710 - RNA, 15 nt, Human
caaaguauuaagcau

SEQ ID NO: 1707711 - RNA, 16 nt, Human
caaccaccuuucagau

SEQ ID NO: 1707712 - RNA, 15 nt, Human
auuuuauaaaucgcu

SEQ ID NO: 1707713 - RNA, 16 nt, Human
auuuuauaaaucgcuu

SEQ ID NO: 1707714 - RNA, 17 nt, Human
auuuuauaaaucgcuuu

SEQ ID NO: 1707715 - RNA, 20 nt, Human
auuuuauaaaucgcuuuuga

SEQ ID NO: 1707716 - RNA, 21 nt, Human
auuuuauaaaucgcuuuugau

SEQ ID NO: 1707717 - RNA, 23 nt, Human
auuuuauaaaucgcuuuugauaa

SEQ ID NO: 1707718 - RNA, 23 nt, Human
auuguacaaaguauuaagcauau

SEQ ID NO: 1707719 - RNA, 22 nt, Human
auuguacaaaguauuaagcaua

SEQ ID NO: 1707720 - RNA, 20 nt, Human
auuguacaaaguauuaagca

SEQ ID NO: 1707721 - RNA, 23 nt, Human
auuuauaaucacuuuuuuccaca

SEQ ID NO: 1707722 - RNA, 19 nt, Human
gguguuguacucaauuuua

SEQ ID NO: 1707723 - RNA, 20 nt, Human
gguguuguacucaauuuuaa

SEQ ID NO: 1707724 - RNA, 20 nt, Human
guacaaaguauuaagcauau

SEQ ID NO: 1707725 - RNA, 21 nt, Human
guacaaaguauuaagcauaua

SEQ ID NO: 1707726 - RNA, 15 nt, Human
aaaauauuuuaugau

SEQ ID NO: 1707727 - RNA, 18 nt, Human
aaaauauuuuaugaucca

SEQ ID NO: 1707728 - RNA, 15 nt, Human
ggaagccugauuaaa

SEQ ID NO: 1707729 - RNA, 18 nt, Human
ggaaacuggguuccugca

SEQ ID NO: 1707730 - RNA, 13 nt, Human
gccauguuuauua

SEQ ID NO: 1707731 - RNA, 11 nt, Human
gccauguuuau

SEQ ID NO: 1707732 - RNA, 14 nt, Human
gccauguuuauuac

SEQ ID NO: 1707733 - RNA, 18 nt, Human
gccauguuuauuacagua

SEQ ID NO: 1707734 - RNA, 22 nt, Human
gccauguuuauuacaguauaau

SEQ ID NO: 1707735 - RNA, 11 nt, Human
gcuaaggacuu

SEQ ID NO: 1707736 - RNA, 12 nt, Human
gcuaaggacuug

SEQ ID NO: 1707737 - RNA, 12 nt, Human
gcguugaaauug

SEQ ID NO: 1707738 - RNA, 23 nt, Human
gcuaaggacuuguuagaucuagu

SEQ ID NO: 1707739 - RNA, 22 nt, Human
gcguucauggaacgcguugaaa

SEQ ID NO: 1707740 - RNA, 18 nt, Human
gcuauuucuauauuuuca

SEQ ID NO: 1707741 - RNA, 19 nt, Human
gcuauuucuauauuuucau

SEQ ID NO: 1707742 - RNA, 20 nt, Human
gcuauuucuauauuuucauu

SEQ ID NO: 1707743 - RNA, 11 nt, Human
gcuauuucuau

SEQ ID NO: 1707744 - RNA, 13 nt, Human
gcuauuucuauau

SEQ ID NO: 1707745 - RNA, 15 nt, Human
gcuauuucuauauuu

SEQ ID NO: 1707746 - RNA, 16 nt, Human
gcuauuucuauauuuu

SEQ ID NO: 1707747 - RNA, 19 nt, Human
gauccagcagauuauucac

SEQ ID NO: 1707748 - RNA, 18 nt, Human
gauccagcagauuauuca

SEQ ID NO: 1707749 - RNA, 16 nt, Human
gaucugccuaaggacu

SEQ ID NO: 1707750 - RNA, 12 nt, Human
gaucugccuaag

SEQ ID NO: 1707751 - RNA, 15 nt, Human
gaucugccuaaggac

SEQ ID NO: 1707752 - RNA, 13 nt, Human
gaugauuucuaug

SEQ ID NO: 1707753 - RNA, 23 nt, Human
gaugauuucuaugcugaguuugu

SEQ ID NO: 1707754 - RNA, 12 nt, Human
gaugauuucuau

SEQ ID NO: 1707755 - RNA, 16 nt, Human
gauacuggauuguacu

SEQ ID NO: 1707756 - RNA, 20 nt, Human
gauacuggauuguacuuugu

SEQ ID NO: 1707757 - RNA, 19 nt, Human
cugugagcaucacaguuuu

SEQ ID NO: 1707758 - RNA, 13 nt, Human
cuguuauauaaau

SEQ ID NO: 1707759 - RNA, 14 nt, Human
cuguuauauaaaug

SEQ ID NO: 1707760 - RNA, 15 nt, Human
cuguuauauaaaugg

SEQ ID NO: 1707761 - RNA, 22 nt, Human
cuguuauauaaaugguuaaaag

SEQ ID NO: 1707762 - RNA, 15 nt, Human
cugugaacuugaaau

SEQ ID NO: 1707763 - RNA, 16 nt, Human
cugugaacuugaaauu

SEQ ID NO: 1707764 - RNA, 17 nt, Human
cugugaacuugaaauuu

SEQ ID NO: 1707765 - RNA, 16 nt, Human
cugugagcaucacagu

SEQ ID NO: 1707766 - RNA, 13 nt, Human
cuggugacugauu

SEQ ID NO: 1707767 - RNA, 14 nt, Human
cuggugacugauuc

SEQ ID NO: 1707768 - RNA, 15 nt, Human
cuggugacugauucu

SEQ ID NO: 1707769 - RNA, 17 nt, Human
cuggugacugauucuuc

SEQ ID NO: 1707770 - RNA, 18 nt, Human
cuggugacugauucuuca

SEQ ID NO: 1707771 - RNA, 15 nt, Human
cuggugcccugcuuu

SEQ ID NO: 1707772 - RNA, 16 nt, Human
cuggugcccugcuuuc

SEQ ID NO: 1707773 - RNA, 19 nt, Human
cuggugcccugcuuucaga

SEQ ID NO: 1707774 - RNA, 21 nt, Human
cuggugcccugcuuucagaua

SEQ ID NO: 1707775 - RNA, 23 nt, Human
cuggugcccugcuuucagauacu

SEQ ID NO: 1707776 - RNA, 14 nt, Human
gaaacuuguguaaa

SEQ ID NO: 1707777 - RNA, 16 nt, Human
gaaacuuguguaaaua

SEQ ID NO: 1707778 - RNA, 20 nt, Human
gaaacuuguguaaauacaau

SEQ ID NO: 1707779 - RNA, 21 nt, Human
cuugucucagauuuuauuaug

SEQ ID NO: 1707780 - RNA, 14 nt, Human
agcuggugcccugc

SEQ ID NO: 1707781 - RNA, 23 nt, Human
aggcugaugccaaguuguuugag

SEQ ID NO: 1707782 - RNA, 23 nt, Human
agccucccuauuuuuuuucuguu

SEQ ID NO: 1707783 - RNA, 22 nt, Human
agccauguuuauuacaguauaa

SEQ ID NO: 1707784 - RNA, 17 nt, Human
agccauguuuauuacag

SEQ ID NO: 1707785 - RNA, 14 nt, Human
agaguguugaaacg

SEQ ID NO: 1707786 - RNA, 12 nt, Human
aucaccugucuu

SEQ ID NO: 1707787 - RNA, 21 nt, Human
aucaccugucuugccuuuuuc

SEQ ID NO: 1707788 - RNA, 24 nt, Human
aucuucucagaaggcaaaugacuu

SEQ ID NO: 1707789 - RNA, 18 nt, Human
auggagccugcacgguga

SEQ ID NO: 1707790 - RNA, 22 nt, Human
auggagccugcacggugaaugg

SEQ ID NO: 1707791 - RNA, 11 nt, Human
aguugaauuua

SEQ ID NO: 1707792 - RNA, 13 nt, Human
aguugaauuuauu

SEQ ID NO: 1707793 - RNA, 17 nt, Human
aguugaauuuauuggcu

SEQ ID NO: 1707794 - RNA, 19 nt, Human
aguugaauuuauuggcuuu

SEQ ID NO: 1707795 - RNA, 20 nt, Human
aguugaauuuauuggcuuuu

SEQ ID NO: 1707796 - RNA, 20 nt, Human
auaauuaacauguuaaacca

SEQ ID NO: 1707797 - RNA, 21 nt, Human
auaauuaacauguuaaaccau

SEQ ID NO: 1707798 - RNA, 22 nt, Human
auaauuaacauguuaaaccaug

SEQ ID NO: 1707799 - RNA, 15 nt, Human
auaccuacauguauu

SEQ ID NO: 1707800 - RNA, 19 nt, Human
auacaauuuuguuucugua

SEQ ID NO: 1707801 - RNA, 20 nt, Human
auacaauuuuguuucuguac

SEQ ID NO: 1707802 - RNA, 14 nt, Human
auaugcuauuucua

SEQ ID NO: 1707803 - RNA, 14 nt, Human
acauaaaucuguga

SEQ ID NO: 1707804 - RNA, 15 nt, Human
acauaaaucugugaa

SEQ ID NO: 1707805 - RNA, 18 nt, Human
acauaaaucugugaacuu

SEQ ID NO: 1707806 - RNA, 14 nt, Human
acaauuuuguuucu

SEQ ID NO: 1707807 - RNA, 15 nt, Human
acaauuuuguuucug

SEQ ID NO: 1707808 - RNA, 17 nt, Human
acaauuuuguuucugua

SEQ ID NO: 1707809 - RNA, 12 nt, Human
acuuuucugaua

SEQ ID NO: 1707810 - RNA, 14 nt, Human
acuggguuccugca

SEQ ID NO: 1707811 - RNA, 21 nt, Human
acuucuuuaauuuuggaauuu

SEQ ID NO: 1707812 - RNA, 23 nt, Human
accuuucagauaacuguuauuua

SEQ ID NO: 1707813 - RNA, 13 nt, Human
acgaugucuucau

SEQ ID NO: 1707814 - RNA, 17 nt, Human
aacagcuggugcccugc

SEQ ID NO: 1707815 - RNA, 20 nt, Human
aaccaguauuguacaaagua

SEQ ID NO: 1707816 - RNA, 15 nt, Human
aaccaguauuguaca

SEQ ID NO: 1707817 - RNA, 21 nt, Human
aaccaguauuguacaaaguau

SEQ ID NO: 1707818 - RNA, 22 nt, Human
aaccaguauuguacaaaguauu

SEQ ID NO: 1707819 - RNA, 16 nt, Human
aaauuggggauucuua

SEQ ID NO: 1707820 - RNA, 17 nt, Human
aaauuggggauucuuaa

SEQ ID NO: 1707821 - RNA, 13 nt, Human
aacuuuucugaua

SEQ ID NO: 1707822 - RNA, 14 nt, Human
aacuuuucugauag

SEQ ID NO: 1707823 - RNA, 12 nt, Human
aacuuuucugau

SEQ ID NO: 1707824 - RNA, 16 nt, Human
aaagagguuuuucuua

SEQ ID NO: 1707825 - RNA, 19 nt, Human
aaagagguuuuucuuaaau

SEQ ID NO: 1707826 - RNA, 17 nt, Human
aaaauuggggauucuua

SEQ ID NO: 1707827 - RNA, 18 nt, Human
aaaauuggggauucuuaa

SEQ ID NO: 1707828 - RNA, 19 nt, Human
aaaauuggggauucuuaaa

SEQ ID NO: 1707829 - RNA, 19 nt, Human
aaauggacuguggugacuu

SEQ ID NO: 1707830 - RNA, 14 nt, Human
aaauacuguuugag

SEQ ID NO: 1707831 - RNA, 18 nt, Human
aaauauuuuaugauccag

SEQ ID NO: 1707832 - RNA, 19 nt, Human
aaauauuuuaugauccagc

SEQ ID NO: 1707833 - RNA, 14 nt, Human
aaauauuuuaugau

SEQ ID NO: 1707834 - RNA, 12 nt, Human
aaggauuuuaug

SEQ ID NO: 1707835 - RNA, 13 nt, Human
aaggauuuuaugc

SEQ ID NO: 1707836 - RNA, 23 nt, Human
aaggauuuuaugcuuuaaacauu

SEQ ID NO: 1707837 - RNA, 16 nt, Human
aaggauuuuaugcuuu

SEQ ID NO: 1707838 - RNA, 20 nt, Human
aaggauuuuaugcuuuaaac

SEQ ID NO: 1707839 - RNA, 21 nt, Human
aaggauuuuaugcuuuaaaca

SEQ ID NO: 1707840 - RNA, 22 nt, Human
aaggauuuuaugcuuuaaacau

SEQ ID NO: 1707841 - RNA, 13 nt, Human
aagccauguuuau

SEQ ID NO: 1707842 - RNA, 12 nt, Human
aaguuguuugag

SEQ ID NO: 1707843 - RNA, 15 nt, Human
aagucuguuuuauga

SEQ ID NO: 1707844 - RNA, 16 nt, Human
aagucuguuuuaugac

SEQ ID NO: 1707845 - RNA, 18 nt, Human
aagucuguuuuaugacuu

SEQ ID NO: 1707846 - RNA, 19 nt, Human
aagucuguuuuaugacuuc

SEQ ID NO: 1707847 - RNA, 20 nt, Human
aagucuguuuuaugacuuca

SEQ ID NO: 1707848 - RNA, 23 nt, Human
aagucuguuuuaugacuucauua

SEQ ID NO: 1707849 - RNA, 19 nt, Human
aagucucugaagugaaacu

SEQ ID NO: 1707850 - RNA, 22 nt, Human
aagucucugaagugaaacugcu

SEQ ID NO: 1707851 - RNA, 18 nt, Human
aagguucuggugugaacu

SEQ ID NO: 1707852 - RNA, 15 nt, Human
aaguaucugacaucu

SEQ ID NO: 1707853 - RNA, 22 nt, Human
aaguaucugacaucucugcaau

SEQ ID NO: 1707854 - RNA, 19 nt, Human
aaucaacugggcugaacac

SEQ ID NO: 1707855 - RNA, 14 nt, Human
aaucaacugggcug

SEQ ID NO: 1707856 - RNA, 14 nt, Human
aauccauuuggaaa

SEQ ID NO: 1707857 - RNA, 15 nt, Human
aauccauuuggaaau

SEQ ID NO: 1707858 - RNA, 17 nt, Human
aauccauuuggaaaucu

SEQ ID NO: 1707859 - RNA, 18 nt, Human
aauccauuuggaaaucuu

SEQ ID NO: 1707860 - RNA, 22 nt, Human
aauccauuuggaaaucuuuaaa

SEQ ID NO: 1707861 - RNA, 22 nt, Human
aaugguccgugcuaaggacuug

SEQ ID NO: 1707862 - RNA, 15 nt, Human
aauggcuuuguauag

SEQ ID NO: 1707863 - RNA, 16 nt, Human
aauggcuuuguauaga

SEQ ID NO: 1707864 - RNA, 18 nt, Human
aauggcuuuguauagaac

SEQ ID NO: 1707865 - RNA, 13 nt, Human
aauggcuuuguau

SEQ ID NO: 1707866 - RNA, 16 nt, Human
aaaaaccaguauugua

SEQ ID NO: 1707867 - RNA, 18 nt, Human
aaaaaccaguauuguaca

SEQ ID NO: 1707868 - RNA, 17 nt, Human
aaaaauuggggauucuu

SEQ ID NO: 1707869 - RNA, 18 nt, Human
aaaaauuggggauucuua

SEQ ID NO: 1707870 - RNA, 19 nt, Human
aaaaauuggggauucuuaa

SEQ ID NO: 1707871 - RNA, 20 nt, Human
aaaaauuggggauucuuaaa

SEQ ID NO: 1707872 - RNA, 23 nt, Human
aaaaaauuggggauucuuaaagu

SEQ ID NO: 1707873 - RNA, 16 nt, Human
uuauuacaguauaauu

SEQ ID NO: 1707874 - RNA, 13 nt, Human
uuauaaucacuuu

SEQ ID NO: 1707875 - RNA, 20 nt, Human
uuauaucugaggaauucugu

SEQ ID NO: 1707876 - RNA, 21 nt, Human
uuauaucugaggaauucugua

SEQ ID NO: 1707877 - RNA, 14 nt, Human
uuauaucugaggaa

SEQ ID NO: 1707878 - RNA, 22 nt, Human
uuauaucugaggaauucuguau

SEQ ID NO: 1707879 - RNA, 23 nt, Human
uuauaucugaggaauucuguaua

SEQ ID NO: 1707880 - RNA, 18 nt, Human
uuauaugcuauuucuaua

SEQ ID NO: 1707881 - RNA, 16 nt, Human
uuauaugcuauuucua

SEQ ID NO: 1707882 - RNA, 16 nt, Human
uucagauacuggauug

SEQ ID NO: 1707883 - RNA, 20 nt, Human
uucagauacuggauuguacu

SEQ ID NO: 1707884 - RNA, 15 nt, Human
uuauuuuauuaugaa

SEQ ID NO: 1707885 - RNA, 16 nt, Human
uuauuuuauuaugaaa

SEQ ID NO: 1707886 - RNA, 14 nt, Human
uuauuuuauuauga

SEQ ID NO: 1707887 - RNA, 20 nt, Human
uuauuuuauuaugaaacuug

SEQ ID NO: 1707888 - RNA, 17 nt, Human
uugaauuuuguguuaga

SEQ ID NO: 1707889 - RNA, 21 nt, Human
uugaauuuuguguuagagauu

SEQ ID NO: 1707890 - RNA, 15 nt, Human
uugaauuuauuggcu

SEQ ID NO: 1707891 - RNA, 18 nt, Human
uugaauuuauuggcuuuu

SEQ ID NO: 1707892 - RNA, 22 nt, Human
uugaauuuauuggcuuuucuga

SEQ ID NO: 1707893 - RNA, 13 nt, Human
uucugauagagga

SEQ ID NO: 1707894 - RNA, 21 nt, Human
uucugauagaggaagccugau

SEQ ID NO: 1707895 - RNA, 13 nt, Human
uuccugcaaugaa

SEQ ID NO: 1707896 - RNA, 21 nt, Human
uuccugcaaugaagucucuga

SEQ ID NO: 1707897 - RNA, 13 nt, Human
uuucagauacugg

SEQ ID NO: 1707898 - RNA, 21 nt, Human
uuucagauacuggauuguacu

SEQ ID NO: 1707899 - RNA, 16 nt, Human
uuuauuauguaaaucc

SEQ ID NO: 1707900 - RNA, 17 nt, Human
uuuauuauguaaauccc

SEQ ID NO: 1707901 - RNA, 14 nt, Human
uuuauuauguaaau

SEQ ID NO: 1707902 - RNA, 21 nt, Human
uuuaauaauuauaugcuauuu

SEQ ID NO: 1707903 - RNA, 18 nt, Human
uuuaauaauuauaugcua

SEQ ID NO: 1707904 - RNA, 16 nt, Human
uuuaacaacagcuggu

SEQ ID NO: 1707905 - RNA, 21 nt, Human
uuguuuggaccaaaaaccagu

SEQ ID NO: 1707906 - RNA, 13 nt, Human
uuggguguauugu

SEQ ID NO: 1707907 - RNA, 15 nt, Human
uuggguguauugugc

SEQ ID NO: 1707908 - RNA, 16 nt, Human
uuggguguauugugcg

SEQ ID NO: 1707909 - RNA, 22 nt, Human
uugucucagauuuuauuaugua

SEQ ID NO: 1707910 - RNA, 16 nt, Human
uugucucagauuuuau

SEQ ID NO: 1707911 - RNA, 20 nt, Human
uugucucagauuuuauuaug

SEQ ID NO: 1707912 - RNA, 13 nt, Human
uugucucagauuu

SEQ ID NO: 1707913 - RNA, 20 nt, Human
uugucuacaccauuaugugc

SEQ ID NO: 1707914 - RNA, 19 nt, Human
uugucuacaccauuaugug

SEQ ID NO: 1707915 - RNA, 12 nt, Human
uuguauuaagaa

SEQ ID NO: 1707916 - RNA, 13 nt, Human
uuguauuaagaau

SEQ ID NO: 1707917 - RNA, 18 nt, Human
uuguauuaagaaugaaau

SEQ ID NO: 1707918 - RNA, 15 nt, Human
uuguacucaauuuua

SEQ ID NO: 1707919 - RNA, 14 nt, Human
uuguacucaauuuu

SEQ ID NO: 1707920 - RNA, 17 nt, Human
uuguuagaucuaguuca

SEQ ID NO: 1707921 - RNA, 17 nt, Human
uuguuguuuguuuaguc

SEQ ID NO: 1707922 - RNA, 15 nt, Human
uuguuugagaaauua

SEQ ID NO: 1707923 - RNA, 21 nt, Human
uuguuugagaaauuaaguauc

SEQ ID NO: 1707924 - RNA, 19 nt, Human
uugugcugggguuaucuga

SEQ ID NO: 1707925 - RNA, 22 nt, Human
uugugcgcuaaacuuuucugau

SEQ ID NO: 1707926 - RNA, 23 nt, Human
uugugcgcuaaacuuuucugaua

SEQ ID NO: 1707927 - RNA, 13 nt, Human
uuuuucauuauuu

SEQ ID NO: 1707928 - RNA, 22 nt, Human
uuuuucauuauuuuauuaugaa

SEQ ID NO: 1707929 - RNA, 21 nt, Human
uuuuuccacauaaggaaacug

SEQ ID NO: 1707930 - RNA, 24 nt, Human
uuuggaccaaaaaccaguauugua

SEQ ID NO: 1707931 - RNA, 15 nt, Human
uuuggaaaucuuuaa

SEQ ID NO: 1707932 - RNA, 18 nt, Human
uuuggaccaaaaaccagu

SEQ ID NO: 1707933 - RNA, 21 nt, Human
uuuggaccaaaaaccaguauu

SEQ ID NO: 1707934 - RNA, 22 nt, Human
uuuggaccaaaaaccaguauug

SEQ ID NO: 1707935 - RNA, 23 nt, Human
uuuccacauaaggaaacuggguu

SEQ ID NO: 1707936 - RNA, 20 nt, Human
uuuccacauaaggaaacugg

SEQ ID NO: 1707937 - RNA, 20 nt, Human
uuuuaugacuucauuaauaa

SEQ ID NO: 1707938 - RNA, 21 nt, Human
uuuuaugacuucauuaauaau

SEQ ID NO: 1707939 - RNA, 13 nt, Human
uuuuauauuuacu

SEQ ID NO: 1707940 - RNA, 14 nt, Human
ugccuaaggacuuc

SEQ ID NO: 1707941 - RNA, 15 nt, Human
ugccuaaggacuucu

SEQ ID NO: 1707942 - RNA, 16 nt, Human
ugccuaaggacuucuu

SEQ ID NO: 1707943 - RNA, 20 nt, Human
ugccuaaggacuucuuuaau

SEQ ID NO: 1707944 - RNA, 12 nt, Human
ugccuaaggacu

SEQ ID NO: 1707945 - RNA, 13 nt, Human
ugccuaaggacuu

SEQ ID NO: 1707946 - RNA, 21 nt, Human
ugccuaaggacuucuuuaauu

SEQ ID NO: 1707947 - RNA, 12 nt, Human
ugcccugcuuuc

SEQ ID NO: 1707948 - RNA, 16 nt, Human
ugcccugcuuucagau

SEQ ID NO: 1707949 - RNA, 17 nt, Human
ugcccugcuuucagaua

SEQ ID NO: 1707950 - RNA, 15 nt, Human
ugcaaugaagucucu

SEQ ID NO: 1707951 - RNA, 18 nt, Human
ugcaaugaagucucugaa

SEQ ID NO: 1707952 - RNA, 22 nt, Human
ugcaaugaagucucugaaguga

SEQ ID NO: 1707953 - RNA, 17 nt, Human
ugagcaucacaguuuug

SEQ ID NO: 1707954 - RNA, 16 nt, Human
ugagcaucacaguuuu

SEQ ID NO: 1707955 - RNA, 14 nt, Human
ugagaaauuaagua

SEQ ID NO: 1707956 - RNA, 13 nt, Human
ugagaaauuaagu

SEQ ID NO: 1707957 - RNA, 13 nt, Human
ugacugauucuuc

SEQ ID NO: 1707958 - RNA, 14 nt, Human
ugacugauucuuca

SEQ ID NO: 1707959 - RNA, 15 nt, Human
ugacugauucuucag

SEQ ID NO: 1707960 - RNA, 16 nt, Human
ugacugauucuucagc

SEQ ID NO: 1707961 - RNA, 17 nt, Human
ugacugauucuucagca

SEQ ID NO: 1707962 - RNA, 19 nt, Human
ugaugccaaguuguuugag

SEQ ID NO: 1707963 - RNA, 15 nt, Human
ugaugccaaguuguu

SEQ ID NO: 1707964 - RNA, 21 nt, Human
ugaugccaaguuguuugagaa

SEQ ID NO: 1707965 - RNA, 23 nt, Human
ugggguuaucugaagucagaucu

SEQ ID NO: 1707966 - RNA, 13 nt, Human
ugggauaaaugcc

SEQ ID NO: 1707967 - RNA, 14 nt, Human
ugggauaaaugcca

SEQ ID NO: 1707968 - RNA, 12 nt, Human
ugggauaaaugc

SEQ ID NO: 1707969 - RNA, 15 nt, Human
uggaccaaaaaccag

SEQ ID NO: 1707970 - RNA, 14 nt, Human
uggaacgcguugaa

SEQ ID NO: 1707971 - RNA, 15 nt, Human
uggaacgcguugaaa

SEQ ID NO: 1707972 - RNA, 16 nt, Human
uggaacgcguugaaau

SEQ ID NO: 1707973 - RNA, 17 nt, Human
uggaacgcguugaaauu

SEQ ID NO: 1707974 - RNA, 17 nt, Human
ugucuacaccauuaugu

SEQ ID NO: 1707975 - RNA, 18 nt, Human
ugucuacaccauuaugug

SEQ ID NO: 1707976 - RNA, 16 nt, Human
ugucucagauuuuauu

SEQ ID NO: 1707977 - RNA, 20 nt, Human
ugucucagauuuuauuaugu

SEQ ID NO: 1707978 - RNA, 22 nt, Human
ugucucagauuuuauuauguaa

SEQ ID NO: 1707979 - RNA, 15 nt, Human
uguauuuguuugcau

SEQ ID NO: 1707980 - RNA, 14 nt, Human
uguauuuguuugca

SEQ ID NO: 1707981 - RNA, 23 nt, Human
uguauagaaccucuuugucuaca

SEQ ID NO: 1707982 - RNA, 15 nt, Human
uguauagauuagaau

SEQ ID NO: 1707983 - RNA, 21 nt, Human
uguauagauuagaauucugua

SEQ ID NO: 1707984 - RNA, 23 nt, Human
uguauagauuagagaguguugaa

SEQ ID NO: 1707985 - RNA, 19 nt, Human
ugguucuuguauuaagaau

SEQ ID NO: 1707986 - RNA, 14 nt, Human
ugguucuuguauua

SEQ ID NO: 1707987 - RNA, 18 nt, Human
ugguucuuguauuaagaa

SEQ ID NO: 1707988 - RNA, 16 nt, Human
uggugacuuuggauaa

SEQ ID NO: 1707989 - RNA, 18 nt, Human
uggugacuuuggauaaua

SEQ ID NO: 1707990 - RNA, 19 nt, Human
uggugacuuuggauaauaa

SEQ ID NO: 1707991 - RNA, 23 nt, Human
uggugacuuuggauaauaaggaa

SEQ ID NO: 1707992 - RNA, 15 nt, Human
uggugacuuuggaua

SEQ ID NO: 1707993 - RNA, 14 nt, Human
ugguugcuuuaaua

SEQ ID NO: 1707994 - RNA, 18 nt, Human
ugguugcuuuaauaucau

SEQ ID NO: 1707995 - RNA, 17 nt, Human
uguacaaaguauuaagc

SEQ ID NO: 1707996 - RNA, 18 nt, Human
uguacaaaguauuaagca

SEQ ID NO: 1707997 - RNA, 19 nt, Human
uguacaaaguauuaagcau

SEQ ID NO: 1707998 - RNA, 20 nt, Human
uguacaaaguauuaagcaua

SEQ ID NO: 1707999 - RNA, 15 nt, Human
uguacaaaguauuaa

SEQ ID NO: 1708000 - RNA, 21 nt, Human
uguacaaaguauuaagcauau

SEQ ID NO: 1708001 - RNA, 15 nt, Human
ucccuggccuuucau

SEQ ID NO: 1708002 - RNA, 11 nt, Human
ucccuggccuu

SEQ ID NO: 1708003 - RNA, 20 nt, Human
ucuaugcugaguuugugcug

SEQ ID NO: 1708004 - RNA, 16 nt, Human
ucuaugcugaguuugu

SEQ ID NO: 1708005 - RNA, 16 nt, Human
ucucugaagugaaacu

SEQ ID NO: 1708006 - RNA, 12 nt, Human
ucugacaucucu

SEQ ID NO: 1708007 - RNA, 14 nt, Human
ucugacaucucugc

SEQ ID NO: 1708008 - RNA, 15 nt, Human
ucugacaucucugca

SEQ ID NO: 1708009 - RNA, 15 nt, Human
ucugaggaauucugu

SEQ ID NO: 1708010 - RNA, 16 nt, Human
ucugaggaauucugua

SEQ ID NO: 1708011 - RNA, 17 nt, Human
ucugaggaauucuguau

SEQ ID NO: 1708012 - RNA, 18 nt, Human
ucugaggaauucuguaua

SEQ ID NO: 1708013 - RNA, 19 nt, Human
ucugaggaauucuguauag

SEQ ID NO: 1708014 - RNA, 14 nt, Human
ucugaggaauucug

SEQ ID NO: 1708015 - RNA, 16 nt, Human
ucuuaaaguugaauuu

SEQ ID NO: 1708016 - RNA, 19 nt, Human
ucuuaaaguugaauuuauu

SEQ ID NO: 1708017 - RNA, 20 nt, Human
ucuuaaaguugaauuuauug

SEQ ID NO: 1708018 - RNA, 21 nt, Human
ucuuaaaguugaauuuauugg

SEQ ID NO: 1708019 - RNA, 22 nt, Human
ucuuaaaguugaauuuauuggc

SEQ ID NO: 1708020 - RNA, 15 nt, Human
ucuuaaauaauaaag

SEQ ID NO: 1708021 - RNA, 19 nt, Human
ucuuaaauaauaaagauca

SEQ ID NO: 1708022 - RNA, 13 nt, Human
ucuuaaaguugaa

SEQ ID NO: 1708023 - RNA, 14 nt, Human
ucuuaaaguugaau

SEQ ID NO: 1708024 - RNA, 12 nt, Human
ucuuaaaguuga

SEQ ID NO: 1708025 - RNA, 21 nt, Human
ucuucagcaaaaauauuuuau

SEQ ID NO: 1708026 - RNA, 22 nt, Human
ucuucagcaaaaauauuuuaug

SEQ ID NO: 1708027 - RNA, 23 nt, Human
ucuucagcaaaaauauuuuauga

SEQ ID NO: 1708028 - RNA, 18 nt, Human
ucuucauaccuacaugua

SEQ ID NO: 1708029 - RNA, 21 nt, Human
ucuucauaccuacauguauuu

SEQ ID NO: 1708030 - RNA, 14 nt, Human
uauuuuuuuucugu

SEQ ID NO: 1708031 - RNA, 18 nt, Human
uauuuuauuaugaaacuu

SEQ ID NO: 1708032 - RNA, 23 nt, Human
uauuuuauuaugaaacuugugua

SEQ ID NO: 1708033 - RNA, 13 nt, Human
uauuuuauuauga

SEQ ID NO: 1708034 - RNA, 17 nt, Human
uauuuauaaucacuuuu

SEQ ID NO: 1708035 - RNA, 15 nt, Human
uauuuucauucuccu

SEQ ID NO: 1708036 - RNA, 23 nt, Human
ucacaccccagacgaugucuuca

SEQ ID NO: 1708037 - RNA, 12 nt, Human
uauuacaguaua

SEQ ID NO: 1708038 - RNA, 13 nt, Human
uauuacaguauaa

SEQ ID NO: 1708039 - RNA, 15 nt, Human
uauguaaaucccauu

SEQ ID NO: 1708040 - RNA, 19 nt, Human
uauguaaaucccauuauuc

SEQ ID NO: 1708041 - RNA, 20 nt, Human
uauguaaaucccauuauuca

SEQ ID NO: 1708042 - RNA, 21 nt, Human
uauguaaaucccauuauucaa

SEQ ID NO: 1708043 - RNA, 23 nt, Human
uauguaaaucccauuauucaaag

SEQ ID NO: 1708044 - RNA, 12 nt, Human
uauguaaauccc

SEQ ID NO: 1708045 - RNA, 16 nt, Human
uauuaagaaugaaaua

SEQ ID NO: 1708046 - RNA, 13 nt, Human
uauuaagaaugaa

SEQ ID NO: 1708047 - RNA, 23 nt, Human
ucauuauuuuauuaugaaacuug

SEQ ID NO: 1708048 - RNA, 22 nt, Human
ucauuauuuuauuaugaaacuu

SEQ ID NO: 1708049 - RNA, 15 nt, Human
ucauaccuacaugua

SEQ ID NO: 1708050 - RNA, 16 nt, Human
ucauaccuacauguau

SEQ ID NO: 1708051 - RNA, 14 nt, Human
ucaucaguauugaa

SEQ ID NO: 1708052 - RNA, 13 nt, Human
ggauucuuaaagu

SEQ ID NO: 1708053 - RNA, 15 nt, Human
ggcuuuguauagaac

SEQ ID NO: 1708054 - RNA, 12 nt, Human
gcuuuguauaga

SEQ ID NO: 1708055 - RNA, 13 nt, Human
gcuuuguauagaa

SEQ ID NO: 1708056 - RNA, 14 nt, Human
gcuuuguauagaac

SEQ ID NO: 1708057 - RNA, 15 nt, Human
gcuuguuuccuagca

SEQ ID NO: 1708058 - RNA, 23 nt, Human
gcuuguuuccuagcacacacuuu

SEQ ID NO: 1708059 - RNA, 22 nt, Human
gcuuuaaacauugguucuugua

SEQ ID NO: 1708060 - RNA, 21 nt, Human
gcugguguaugugugaaguga

SEQ ID NO: 1708061 - RNA, 13 nt, Human
gcagauuauucac

SEQ ID NO: 1708062 - RNA, 16 nt, Human
gcagauuauucacuga

SEQ ID NO: 1708063 - RNA, 15 nt, Human
gauagaggaagccug

SEQ ID NO: 1708064 - RNA, 21 nt, Human
gauagaggaagccugauuaaa

SEQ ID NO: 1708065 - RNA, 22 nt, Human
gauagaggaagccugauuaaag

SEQ ID NO: 1708066 - RNA, 14 nt, Human
gauagaggaagccu

SEQ ID NO: 1708067 - RNA, 16 nt, Human
gaggaauucuguauag

SEQ ID NO: 1708068 - RNA, 17 nt, Human
gaggaauucuguauaga

SEQ ID NO: 1708069 - RNA, 14 nt, Human
gaggaauucuguau

SEQ ID NO: 1708070 - RNA, 23 nt, Human
gagccugcacggugaauggcuuu

SEQ ID NO: 1708071 - RNA, 17 nt, Human
gagccugcacggugaau

SEQ ID NO: 1708072 - RNA, 22 nt, Human
gagccugcacggugaauggcuu

SEQ ID NO: 1708073 - RNA, 14 nt, Human
cuauuucuauauuu

SEQ ID NO: 1708074 - RNA, 16 nt, Human
cuauuucuauauuuuc

SEQ ID NO: 1708075 - RNA, 18 nt, Human
cuauuucuauauuuucau

SEQ ID NO: 1708076 - RNA, 15 nt, Human
cucagauuuuauuau

SEQ ID NO: 1708077 - RNA, 17 nt, Human
cucagauuuuauuaugu

SEQ ID NO: 1708078 - RNA, 18 nt, Human
cucagauuuuauuaugua

SEQ ID NO: 1708079 - RNA, 13 nt, Human
cucagauuuuauu

SEQ ID NO: 1708080 - RNA, 19 nt, Human
cuauauuuucauucuccua

SEQ ID NO: 1708081 - RNA, 15 nt, Human
cuauauuuucauucu

SEQ ID NO: 1708082 - RNA, 18 nt, Human
cuaugcugaguuugugcu

SEQ ID NO: 1708083 - RNA, 22 nt, Human
cuccaauuaaggauuuuaugcu

SEQ ID NO: 1708084 - RNA, 17 nt, Human
cuccaauuaaggauuuu

SEQ ID NO: 1708085 - RNA, 20 nt, Human
cuccaauuaaggauuuuaug

SEQ ID NO: 1708086 - RNA, 19 nt, Human
cucugaagugaaacugcuu

SEQ ID NO: 1708087 - RNA, 23 nt, Human
cucugaagugaaacugcuuguuu

SEQ ID NO: 1708088 - RNA, 23 nt, Human
cucuuugucuacaccauuaugug

SEQ ID NO: 1708089 - RNA, 13 nt, Human
cugaguuugugcu

SEQ ID NO: 1708090 - RNA, 18 nt, Human
cugaguuugugcuggugu

SEQ ID NO: 1708091 - RNA, 22 nt, Human
cugauuugacauagucuggcug

SEQ ID NO: 1708092 - RNA, 23 nt, Human
cugauuugacauagucuggcugu

SEQ ID NO: 1708093 - RNA, 21 nt, Human
cugauuugacauagucuggcu

SEQ ID NO: 1708094 - RNA, 15 nt, Human
gaaauacuguuugag

SEQ ID NO: 1708095 - RNA, 19 nt, Human
gaaauacuguuugagguuu

SEQ ID NO: 1708096 - RNA, 15 nt, Human
gaacgcguugaaauu

SEQ ID NO: 1708097 - RNA, 16 nt, Human
gaacgcguugaaauug

SEQ ID NO: 1708098 - RNA, 15 nt, Human
gaaggcaaaugacuu

SEQ ID NO: 1708099 - RNA, 16 nt, Human
gaaggcaaaugacuuu

SEQ ID NO: 1708100 - RNA, 16 nt, Human
gaagguucugguguga

SEQ ID NO: 1708101 - RNA, 20 nt, Human
gaagguucuggugugaacua

SEQ ID NO: 1708102 - RNA, 14 nt, Human
gaaggcaaaugacu

SEQ ID NO: 1708103 - RNA, 11 nt, Human
cuuuucugaua

SEQ ID NO: 1708104 - RNA, 14 nt, Human
cuuuucugauagag

SEQ ID NO: 1708105 - RNA, 14 nt, Human
cuuucauauuuuag

SEQ ID NO: 1708106 - RNA, 16 nt, Human
cuucauuaauaauaaa

SEQ ID NO: 1708107 - RNA, 17 nt, Human
cuucauuaauaauaaau

SEQ ID NO: 1708108 - RNA, 20 nt, Human
cuucagcaaaaauauuuuau

SEQ ID NO: 1708109 - RNA, 23 nt, Human
cuucagcaaaaauauuuuaugau

SEQ ID NO: 1708110 - RNA, 17 nt, Human
cuucagcaaaaauauuu

SEQ ID NO: 1708111 - RNA, 16 nt, Human
cuucucagaaggcaaa

SEQ ID NO: 1708112 - RNA, 22 nt, Human
cuucucagaaggcaaaugacuu

SEQ ID NO: 1708113 - RNA, 15 nt, Human
cugguguauguguga

SEQ ID NO: 1708114 - RNA, 16 nt, Human
cuggugugaacuaaac

SEQ ID NO: 1708115 - RNA, 17 nt, Human
cuggugugaacuaaacu

SEQ ID NO: 1708116 - RNA, 14 nt, Human
cugggguuaucuga

SEQ ID NO: 1708117 - RNA, 18 nt, Human
cugggcugaacacuccaa

SEQ ID NO: 1708118 - RNA, 15 nt, Human
cuguggugacuuugg

SEQ ID NO: 1708119 - RNA, 17 nt, Human
cuguggugacuuuggau

SEQ ID NO: 1708120 - RNA, 18 nt, Human
cuguggugacuuuggaua

SEQ ID NO: 1708121 - RNA, 20 nt, Human
cuguggugacuuuggauaau

SEQ ID NO: 1708122 - RNA, 23 nt, Human
cuguggugacuuuggauaauaag

SEQ ID NO: 1708123 - RNA, 13 nt, Human
cuguggugacuuu

SEQ ID NO: 1708124 - RNA, 14 nt, Human
cuguggugacuuug

SEQ ID NO: 1708125 - RNA, 12 nt, Human
cuguggugacuu

SEQ ID NO: 1708126 - RNA, 21 nt, Human
cugucuugccuuuuucauuau

SEQ ID NO: 1708127 - RNA, 23 nt, Human
cugucuugccuuuuucauuauuu

SEQ ID NO: 1708128 - RNA, 17 nt, Human
cccugcuuucagauacu

SEQ ID NO: 1708129 - RNA, 14 nt, Human
cccugcuuucagau

SEQ ID NO: 1708130 - RNA, 17 nt, Human
ccuaaauccauuuggaa

SEQ ID NO: 1708131 - RNA, 18 nt, Human
ccuaaauccauuuggaaa

SEQ ID NO: 1708132 - RNA, 12 nt, Human
ccuaaauccauu

SEQ ID NO: 1708133 - RNA, 15 nt, Human
ccgugcuaaggacuu

SEQ ID NO: 1708134 - RNA, 16 nt, Human
ccgugcuaaggacuug

SEQ ID NO: 1708135 - RNA, 14 nt, Human
ccgugcuaaggacu

SEQ ID NO: 1708136 - RNA, 12 nt, Human
ccuuaaaggaag

SEQ ID NO: 1708137 - RNA, 20 nt, Human
ccugcacggugaauggcuuu

SEQ ID NO: 1708138 - RNA, 20 nt, Human
ccugcaaugaagucucugaa

SEQ ID NO: 1708139 - RNA, 21 nt, Human
ccugcacggugaauggcuuug

SEQ ID NO: 1708140 - RNA, 21 nt, Human
ccugcaaugaagucucugaag

SEQ ID NO: 1708141 - RNA, 19 nt, Human
ccugcaaugaagucucuga

SEQ ID NO: 1708142 - RNA, 14 nt, Human
ccauuauucaaagu

SEQ ID NO: 1708143 - RNA, 13 nt, Human
ccauguuuauuac

SEQ ID NO: 1708144 - RNA, 20 nt, Human
ccauguuuauuacaguauaa

SEQ ID NO: 1708145 - RNA, 17 nt, Human
ccauuauucaaaguugc

SEQ ID NO: 1708146 - RNA, 22 nt, Human
ccauuauucaaaguugccuaaa

SEQ ID NO: 1708147 - RNA, 17 nt, Human
ccaugggauaaaugcca

SEQ ID NO: 1708148 - RNA, 13 nt, Human
ccaugggauaaau

SEQ ID NO: 1708149 - RNA, 17 nt, Human
cauuauuuuauuaugaa

SEQ ID NO: 1708150 - RNA, 18 nt, Human
cauuauucaaaguugccu

SEQ ID NO: 1708151 - RNA, 21 nt, Human
cauuauucaaaguugccuaaa

SEQ ID NO: 1708152 - RNA, 22 nt, Human
cauuauucaaaguugccuaaau

SEQ ID NO: 1708153 - RNA, 16 nt, Human
cauuauucaaaguugc

SEQ ID NO: 1708154 - RNA, 14 nt, Human
cauuaauaauaaau

SEQ ID NO: 1708155 - RNA, 17 nt, Human
cauuuggaaaucuuuaa

SEQ ID NO: 1708156 - RNA, 18 nt, Human
cauuuggaaaucuuuaaa

SEQ ID NO: 1708157 - RNA, 11 nt, Human
cauuuggaaau

SEQ ID NO: 1708158 - RNA, 18 nt, Human
caugggauaaaugccauc

SEQ ID NO: 1708159 - RNA, 23 nt, Human
caugggauaaaugccaucaauaa

SEQ ID NO: 1708160 - RNA, 16 nt, Human
caugggauaaaugcca

SEQ ID NO: 1708161 - RNA, 17 nt, Human
caugggauaaaugccau

SEQ ID NO: 1708162 - RNA, 22 nt, Human
cauguuaaaccaugggauaaau

SEQ ID NO: 1708163 - RNA, 23 nt, Human
cauguuuauuacaguauaauuaa

SEQ ID NO: 1708164 - RNA, 13 nt, Human
cauguuaaaccau

SEQ ID NO: 1708165 - RNA, 16 nt, Human
caucaguauugaagca

SEQ ID NO: 1708166 - RNA, 20 nt, Human
caucaguauugaagcauuuu

SEQ ID NO: 1708167 - RNA, 22 nt, Human
caucaguauugaagcauuuuau

SEQ ID NO: 1708168 - RNA, 19 nt, Human
cauagucuggcuguaccca

SEQ ID NO: 1708169 - RNA, 18 nt, Human
cauauauuuuuauauuua

SEQ ID NO: 1708170 - RNA, 20 nt, Human
cauauauuuuuauauuuacu

SEQ ID NO: 1708171 - RNA, 21 nt, Human
cauauauuuuuauauuuacua

SEQ ID NO: 1708172 - RNA, 15 nt, Human
caucucugcaaucuu

SEQ ID NO: 1708173 - RNA, 22 nt, Human
caucucugcaaucuucucagaa

SEQ ID NO: 1708174 - RNA, 14 nt, Human
caguauaauuaaca

SEQ ID NO: 1708175 - RNA, 15 nt, Human
caguauaauuaacau

SEQ ID NO: 1708176 - RNA, 17 nt, Human
caguauaauuaacaugu

SEQ ID NO: 1708177 - RNA, 21 nt, Human
caguauaauuaacauguuaaa

SEQ ID NO: 1708178 - RNA, 21 nt, Human
cagccucccuauuuuuuuucu

SEQ ID NO: 1708179 - RNA, 19 nt, Human
cagcuggugcccugcuuuc

SEQ ID NO: 1708180 - RNA, 20 nt, Human
cagcuggugcccugcuuuca

SEQ ID NO: 1708181 - RNA, 21 nt, Human
cagcuggugcccugcuuucag

SEQ ID NO: 1708182 - RNA, 23 nt, Human
cagcuggugcccugcuuucagau

SEQ ID NO: 1708183 - RNA, 18 nt, Human
cagcuggugcccugcuuu

SEQ ID NO: 1708184 - RNA, 17 nt, Human
caggaauggagccugca

SEQ ID NO: 1708185 - RNA, 23 nt, Human
caggaauggagccugcacgguga

SEQ ID NO: 1708186 - RNA, 14 nt, Human
cagcagauuauuca

SEQ ID NO: 1708187 - RNA, 15 nt, Human
cagcagauuauucac

SEQ ID NO: 1708188 - RNA, 19 nt, Human
cagcagauuauucacugau

SEQ ID NO: 1708189 - RNA, 13 nt, Human
cagauuuuauuau

SEQ ID NO: 1708190 - RNA, 15 nt, Human
cagauuuuauuaugu

SEQ ID NO: 1708191 - RNA, 16 nt, Human
cagauuuuauuaugua

SEQ ID NO: 1708192 - RNA, 18 nt, Human
cagauuuuauuauguaaa

SEQ ID NO: 1708193 - RNA, 20 nt, Human
cagauuuuauuauguaaauc

SEQ ID NO: 1708194 - RNA, 21 nt, Human
cagauuuuauuauguaaaucc

SEQ ID NO: 1708195 - RNA, 22 nt, Human
cagauuuuauuauguaaauccc

SEQ ID NO: 1708196 - RNA, 17 nt, Human
cagcaaaaauauuuuau

SEQ ID NO: 1708197 - RNA, 12 nt, Human
cagauuauucac

SEQ ID NO: 1708198 - RNA, 18 nt, Human
cagauuauucacugauuu

SEQ ID NO: 1708199 - RNA, 23 nt, Human
cagauuauucacugauuugacau

SEQ ID NO: 1708200 - RNA, 18 nt, Human
cagaaggcaaaugacuuu

SEQ ID NO: 1708201 - RNA, 19 nt, Human
cagaaggcaaaugacuuug

SEQ ID NO: 1708202 - RNA, 20 nt, Human
cagaaggcaaaugacuuugg

SEQ ID NO: 1708203 - RNA, 22 nt, Human
cacuuuugguuaagucuguuuu

SEQ ID NO: 1708204 - RNA, 14 nt, Human
cacuuuuuuccaca

SEQ ID NO: 1708205 - RNA, 12 nt, Human
cacuuuuuucca

SEQ ID NO: 1708206 - RNA, 19 nt, Human
cagaucugccuaaggacuu

SEQ ID NO: 1708207 - RNA, 20 nt, Human
cagaucugccuaaggacuuc

SEQ ID NO: 1708208 - RNA, 21 nt, Human
cagaucugccuaaggacuucu

SEQ ID NO: 1708209 - RNA, 23 nt, Human
cagaucugccuaaggacuucuuu

SEQ ID NO: 1708210 - RNA, 16 nt, Human
cagaucugccuaagga

SEQ ID NO: 1708211 - RNA, 17 nt, Human
cagaucugccuaaggac

SEQ ID NO: 1708212 - RNA, 14 nt, Human
cagaucugccuaag

SEQ ID NO: 1708213 - RNA, 20 nt, Human
cagauaacuguuauuuauaa

SEQ ID NO: 1708214 - RNA, 21 nt, Human
cagauaacuguuauuuauaau

SEQ ID NO: 1708215 - RNA, 14 nt, Human
cagauaacuguuau

SEQ ID NO: 1708216 - RNA, 16 nt, Human
cagauaacuguuauuu

SEQ ID NO: 1708217 - RNA, 19 nt, Human
cagauaacuguuauuuaua

SEQ ID NO: 1708218 - RNA, 15 nt, Human
cacucuccauuuaau

SEQ ID NO: 1708219 - RNA, 17 nt, Human
cacucuccauuuaauaa

SEQ ID NO: 1708220 - RNA, 20 nt, Human
cacggugaauggcuuuguau

SEQ ID NO: 1708221 - RNA, 23 nt, Human
cacggugaauggcuuuguauaga

SEQ ID NO: 1708222 - RNA, 20 nt, Human
caccugucuugccuuuuuca

SEQ ID NO: 1708223 - RNA, 17 nt, Human
caccugucuugccuuuu

SEQ ID NO: 1708224 - RNA, 21 nt, Human
cacugauuugacauagucugg

SEQ ID NO: 1708225 - RNA, 23 nt, Human
cacugauuugacauagucuggcu

SEQ ID NO: 1708226 - RNA, 16 nt, Human
aaugucucacugagca

SEQ ID NO: 1708227 - RNA, 19 nt, Human
aaugucucacugagcacug

SEQ ID NO: 1708228 - RNA, 22 nt, Human
aaugucucacugagcacuguuu

SEQ ID NO: 1708229 - RNA, 19 nt, Human
aaugaagacaaaacauaca

SEQ ID NO: 1708230 - RNA, 21 nt, Human
aaugaucugauugaccguguu

SEQ ID NO: 1708231 - RNA, 21 nt, Human
aauaauccuaaacauaugaau

SEQ ID NO: 1708232 - RNA, 20 nt, Human
aagcugcucaacuugcaaaa

SEQ ID NO: 1708233 - RNA, 12 nt, Human
aagcugcucaac

SEQ ID NO: 1708234 - RNA, 23 nt, Human
aagcugcucaacuugcaaaauca

SEQ ID NO: 1708235 - RNA, 14 nt, Human
aaauagaauguaaa

SEQ ID NO: 1708236 - RNA, 17 nt, Human
aaauagaauguaaaugu

SEQ ID NO: 1708237 - RNA, 21 nt, Human
aaauagaauguaaaugucuca

SEQ ID NO: 1708238 - RNA, 19 nt, Human
aaauagaauguaaaugucu

SEQ ID NO: 1708239 - RNA, 14 nt, Human
aaauacuugucugu

SEQ ID NO: 1708240 - RNA, 16 nt, Human
aaauacuugucuguuu

SEQ ID NO: 1708241 - RNA, 19 nt, Human
aaauacuugucuguuuuaa

SEQ ID NO: 1708242 - RNA, 14 nt, Human
aaaucuuccaauuu

SEQ ID NO: 1708243 - RNA, 12 nt, Human
aaaucuuccaau

SEQ ID NO: 1708244 - RNA, 12 nt, Human
aaauaacaauga

SEQ ID NO: 1708245 - RNA, 14 nt, Human
aaacagauguccau

SEQ ID NO: 1708246 - RNA, 22 nt, Human
aaacagauguccaucagaugac

SEQ ID NO: 1708247 - RNA, 13 nt, Human
aagaaaucuauuu

SEQ ID NO: 1708248 - RNA, 21 nt, Human
aacuuagcauuuucugcaucu

SEQ ID NO: 1708249 - RNA, 23 nt, Human
aacuuagcauuuucugcaucucc

SEQ ID NO: 1708250 - RNA, 19 nt, Human
aacugacaagcuccauuua

SEQ ID NO: 1708251 - RNA, 20 nt, Human
aacugacaagcuccauuuaa

SEQ ID NO: 1708252 - RNA, 12 nt, Human
aaauuggagaaa

SEQ ID NO: 1708253 - RNA, 16 nt, Human
aacaaagccacuuuca

SEQ ID NO: 1708254 - RNA, 20 nt, Human
aacaugcagaacaaaugaag

SEQ ID NO: 1708255 - RNA, 12 nt, Human
aacaugcagaac

SEQ ID NO: 1708256 - RNA, 19 nt, Human
aacaugcagaacaaaugaa

SEQ ID NO: 1708257 - RNA, 22 nt, Human
acgugauuagugaaaggaagau

SEQ ID NO: 1708258 - RNA, 17 nt, Human
acuaauacagcugagcu

SEQ ID NO: 1708259 - RNA, 14 nt, Human
acuagcuauggugu

SEQ ID NO: 1708260 - RNA, 20 nt, Human
acuuguaaaggaauuuaaaa

SEQ ID NO: 1708261 - RNA, 19 nt, Human
acuuguaaaggaauuuaaa

SEQ ID NO: 1708262 - RNA, 24 nt, Human
acuguuuucuaguguaucaaaaug

SEQ ID NO: 1708263 - RNA, 19 nt, Human
acuguuuucuaguguauca

SEQ ID NO: 1708264 - RNA, 20 nt, Human
acuguuuucuaguguaucaa

SEQ ID NO: 1708265 - RNA, 21 nt, Human
acuguuuucuaguguaucaaa

SEQ ID NO: 1708266 - RNA, 23 nt, Human
acuguuuucuaguguaucaaaau

SEQ ID NO: 1708267 - RNA, 13 nt, Human
acuguuuucuagu

SEQ ID NO: 1708268 - RNA, 17 nt, Human
acuguuuucuaguguau

SEQ ID NO: 1708269 - RNA, 18 nt, Human
acuguuuucuaguguauc

SEQ ID NO: 1708270 - RNA, 17 nt, Human
acuguuguuaucuguuu

SEQ ID NO: 1708271 - RNA, 20 nt, Human
acugaaguaaaacaaacaau

SEQ ID NO: 1708272 - RNA, 14 nt, Human
agaaaauaacaaua

SEQ ID NO: 1708273 - RNA, 13 nt, Human
aauuuuaucugcc

SEQ ID NO: 1708274 - RNA, 21 nt, Human
acaggguaacuaacuaaaaca

SEQ ID NO: 1708275 - RNA, 22 nt, Human
acaggguaacuaacuaaaacaa

SEQ ID NO: 1708276 - RNA, 14 nt, Human
acagcaucucagcu

SEQ ID NO: 1708277 - RNA, 15 nt, Human
acagcaucucagcuc

SEQ ID NO: 1708278 - RNA, 22 nt, Human
accccaaaauuagccaguaauc

SEQ ID NO: 1708279 - RNA, 23 nt, Human
accccaaaauuagccaguaaucc

SEQ ID NO: 1708280 - RNA, 12 nt, Human
auaguauaaacc

SEQ ID NO: 1708281 - RNA, 19 nt, Human
auauacucaagagugguau

SEQ ID NO: 1708282 - RNA, 19 nt, Human
auaccugaaugcucuguag

SEQ ID NO: 1708283 - RNA, 13 nt, Human
augaugugcuuaa

SEQ ID NO: 1708284 - RNA, 11 nt, Human
augaugugcuu

SEQ ID NO: 1708285 - RNA, 14 nt, Human
augucaagggcagc

SEQ ID NO: 1708286 - RNA, 21 nt, Human
augucaagggcagcuuugcuc

SEQ ID NO: 1708287 - RNA, 23 nt, Human
augucaagggcagcuuugcucau

SEQ ID NO: 1708288 - RNA, 15 nt, Human
augucaagauucagc

SEQ ID NO: 1708289 - RNA, 16 nt, Human
augucaagauucagcu

SEQ ID NO: 1708290 - RNA, 17 nt, Human
augucaagauucagcua

SEQ ID NO: 1708291 - RNA, 18 nt, Human
augucaagauucagcuag

SEQ ID NO: 1708292 - RNA, 18 nt, Human
auguacauagugcuaaca

SEQ ID NO: 1708293 - RNA, 15 nt, Human
auguacauagugcua

SEQ ID NO: 1708294 - RNA, 17 nt, Human
auguacauagugcuaac

SEQ ID NO: 1708295 - RNA, 16 nt, Human
auguggugaaaagcag

SEQ ID NO: 1708296 - RNA, 20 nt, Human
auguggugaaaagcagguug

SEQ ID NO: 1708297 - RNA, 13 nt, Human
auguuugcauaua

SEQ ID NO: 1708298 - RNA, 15 nt, Human
auguuugcauauaag

SEQ ID NO: 1708299 - RNA, 14 nt, Human
auguuugcauauaa

SEQ ID NO: 1708300 - RNA, 22 nt, Human
aucuuauaauuuaaaauaugcu

SEQ ID NO: 1708301 - RNA, 17 nt, Human
augacuccauagaccuu

SEQ ID NO: 1708302 - RNA, 15 nt, Human
auccuuugugaaaaa

SEQ ID NO: 1708303 - RNA, 21 nt, Human
agauaggucagugcaaauacu

SEQ ID NO: 1708304 - RNA, 16 nt, Human
agaugggacaauuaga

SEQ ID NO: 1708305 - RNA, 21 nt, Human
agcugacaaaauacuugucug

SEQ ID NO: 1708306 - RNA, 16 nt, Human
agcugacaaaauacuu

SEQ ID NO: 1708307 - RNA, 14 nt, Human
cuuccauauggauc

SEQ ID NO: 1708308 - RNA, 15 nt, Human
cuuaaagaauucaaa

SEQ ID NO: 1708309 - RNA, 17 nt, Human
cuuaaagaauucaaauu

SEQ ID NO: 1708310 - RNA, 18 nt, Human
cuuaaagaauucaaauuu

SEQ ID NO: 1708311 - RNA, 16 nt, Human
cuuaaauacagcuuuu

SEQ ID NO: 1708312 - RNA, 21 nt, Human
cuguaggaagguacuguauga

SEQ ID NO: 1708313 - RNA, 22 nt, Human
cuguagccuaaacuccaaacau

SEQ ID NO: 1708314 - RNA, 17 nt, Human
cuguaggaagguacugu

SEQ ID NO: 1708315 - RNA, 18 nt, Human
cuguaggaagguacugua

SEQ ID NO: 1708316 - RNA, 19 nt, Human
cuguaggaagguacuguau

SEQ ID NO: 1708317 - RNA, 20 nt, Human
cuguaggaagguacuguaug

SEQ ID NO: 1708318 - RNA, 14 nt, Human
cuguuguuaugaug

SEQ ID NO: 1708319 - RNA, 15 nt, Human
cuguuguuaugaugu

SEQ ID NO: 1708320 - RNA, 17 nt, Human
cuguuguuaugaugugc

SEQ ID NO: 1708321 - RNA, 19 nt, Human
cuguuguuaugaugugcuu

SEQ ID NO: 1708322 - RNA, 23 nt, Human
cuguuguuaugaugugcuuaaca

SEQ ID NO: 1708323 - RNA, 21 nt, Human
cuguuguuaugaugugcuuaa

SEQ ID NO: 1708324 - RNA, 22 nt, Human
cuuaaacaguugcacagcaucu

SEQ ID NO: 1708325 - RNA, 18 nt, Human
cuuaaacaguugcacagc

SEQ ID NO: 1708326 - RNA, 19 nt, Human
cuuaaacaguugcacagca

SEQ ID NO: 1708327 - RNA, 20 nt, Human
cuuaaacaguugcacagcau

SEQ ID NO: 1708328 - RNA, 13 nt, Human
cuguuguuaucug

SEQ ID NO: 1708329 - RNA, 22 nt, Human
cuguuguuaucuguuugagaaa

SEQ ID NO: 1708330 - RNA, 16 nt, Human
cugcucaacuugcaaa

SEQ ID NO: 1708331 - RNA, 14 nt, Human
gaucaaauguuuaa

SEQ ID NO: 1708332 - RNA, 16 nt, Human
gaucaaauguuuaauc

SEQ ID NO: 1708333 - RNA, 20 nt, Human
gaucaaauguuuaaucauau

SEQ ID NO: 1708334 - RNA, 18 nt, Human
gaucaaauguuuaaucau

SEQ ID NO: 1708335 - RNA, 16 nt, Human
gaucugauugaccgug

SEQ ID NO: 1708336 - RNA, 23 nt, Human
gaucugauugaccguguuggucu

SEQ ID NO: 1708337 - RNA, 19 nt, Human
gauccacuggcuggacaaa

SEQ ID NO: 1708338 - RNA, 13 nt, Human
gauccacuggcug

SEQ ID NO: 1708339 - RNA, 13 nt, Human
gcaaaaucaguuu

SEQ ID NO: 1708340 - RNA, 15 nt, Human
gcaaaaucaguuuuc

SEQ ID NO: 1708341 - RNA, 20 nt, Human
gcaucuagcaugucgucaaa

SEQ ID NO: 1708342 - RNA, 13 nt, Human
gaaugaucugauu

SEQ ID NO: 1708343 - RNA, 16 nt, Human
gaaugaucugauugac

SEQ ID NO: 1708344 - RNA, 20 nt, Human
gagaaaaagaaaaaauauau

SEQ ID NO: 1708345 - RNA, 15 nt, Human
gcucaacuugcaaaa

SEQ ID NO: 1708346 - RNA, 16 nt, Human
ggaaaaaauaacaaug

SEQ ID NO: 1708347 - RNA, 18 nt, Human
gcuuuuggauuggacaaa

SEQ ID NO: 1708348 - RNA, 13 nt, Human
gcuguuguuauga

SEQ ID NO: 1708349 - RNA, 14 nt, Human
gcuguuguuaugau

SEQ ID NO: 1708350 - RNA, 15 nt, Human
gcuguuguuaugaug

SEQ ID NO: 1708351 - RNA, 19 nt, Human
gcuguuguuaugaugugcu

SEQ ID NO: 1708352 - RNA, 17 nt, Human
gcuguuguuaugaugug

SEQ ID NO: 1708353 - RNA, 20 nt, Human
aaaauacuugucuguuuuaa

SEQ ID NO: 1708354 - RNA, 14 nt, Human
ggucagugcaaaua

SEQ ID NO: 1708355 - RNA, 17 nt, Human
aaacuucguuuaaugaa

SEQ ID NO: 1708356 - RNA, 14 nt, Human
aaacuucguuuaau

SEQ ID NO: 1708357 - RNA, 21 nt, Human
gguauaucuagguuuaugaca

SEQ ID NO: 1708358 - RNA, 19 nt, Human
gguauaucuagguuuauga

SEQ ID NO: 1708359 - RNA, 13 nt, Human
aaacgcaucuagu

SEQ ID NO: 1708360 - RNA, 23 nt, Human
ggguuuuuauuuccuaugaugua

SEQ ID NO: 1708361 - RNA, 21 nt, Human
guacaaaaaaaucuuccaauu

SEQ ID NO: 1708362 - RNA, 12 nt, Human
guaauccuguag

SEQ ID NO: 1708363 - RNA, 22 nt, Human
guaauaccucuaauaguauaaa

SEQ ID NO: 1708364 - RNA, 21 nt, Human
guaauaccucuaauaguauaa

SEQ ID NO: 1708365 - RNA, 17 nt, Human
guaacuaacuaaaacaa

SEQ ID NO: 1708366 - RNA, 16 nt, Human
guaacuaacuaaaaca

SEQ ID NO: 1708367 - RNA, 18 nt, Human
aaauauaugcuaagucuu

SEQ ID NO: 1708368 - RNA, 14 nt, Human
aaauauauacucaa

SEQ ID NO: 1708369 - RNA, 21 nt, Human
aaagcagguugauaaaucauu

SEQ ID NO: 1708370 - RNA, 20 nt, Human
ggcuaagcuucacuguaaaa

SEQ ID NO: 1708371 - RNA, 22 nt, Human
ggccaagagaugcagugccagg

SEQ ID NO: 1708372 - RNA, 21 nt, Human
ggaucucuucuuaauguacau

SEQ ID NO: 1708373 - RNA, 22 nt, Human
ggaucucuucuuaauguacaua

SEQ ID NO: 1708374 - RNA, 16 nt, Human
auuucagcagcugcag

SEQ ID NO: 1708375 - RNA, 23 nt, Human
auuuauaccucaauuuucacugu

SEQ ID NO: 1708376 - RNA, 14 nt, Human
auugaugauccauu

SEQ ID NO: 1708377 - RNA, 23 nt, Human
auuguaauaggcguaacuaauuu

SEQ ID NO: 1708378 - RNA, 17 nt, Human
auucuugccaaauauaa

SEQ ID NO: 1708379 - RNA, 21 nt, Human
auucaauuugauguggugaaa

SEQ ID NO: 1708380 - RNA, 16 nt, Human
auucaauuugaugugg

SEQ ID NO: 1708381 - RNA, 12 nt, Human
auucaagauucc

SEQ ID NO: 1708382 - RNA, 13 nt, Human
auucaagauuccc

SEQ ID NO: 1708383 - RNA, 21 nt, Human
auuuuaucugccucucuugua

SEQ ID NO: 1708384 - RNA, 22 nt, Human
auuuuaucugccucucuuguaa

SEQ ID NO: 1708385 - RNA, 23 nt, Human
caauaaaauuauagcucuaaugu

SEQ ID NO: 1708386 - RNA, 13 nt, Human
caagauucagcua

SEQ ID NO: 1708387 - RNA, 14 nt, Human
cacuacucagcaug

SEQ ID NO: 1708388 - RNA, 13 nt, Human
cacuacucagcau

SEQ ID NO: 1708389 - RNA, 21 nt, Human
cacuguuucacuacucagcau

SEQ ID NO: 1708390 - RNA, 22 nt, Human
cacuguuucacuacucagcaug

SEQ ID NO: 1708391 - RNA, 21 nt, Human
cacuuucaaucuucaauccuu

SEQ ID NO: 1708392 - RNA, 12 nt, Human
cagaacaaauga

SEQ ID NO: 1708393 - RNA, 14 nt, Human
cagaacaaaugaag

SEQ ID NO: 1708394 - RNA, 16 nt, Human
cagaacaaaugaagac

SEQ ID NO: 1708395 - RNA, 14 nt, Human
cauguuaguaauac

SEQ ID NO: 1708396 - RNA, 16 nt, Human
cauguuaguaauaccu

SEQ ID NO: 1708397 - RNA, 17 nt, Human
cauguuaguaauaccuc

SEQ ID NO: 1708398 - RNA, 18 nt, Human
cauguuaguaauaccucu

SEQ ID NO: 1708399 - RNA, 19 nt, Human
cauguuaguaauaccucua

SEQ ID NO: 1708400 - RNA, 20 nt, Human
cauguuaguaauaccucuaa

SEQ ID NO: 1708401 - RNA, 24 nt, Human
cauguuaguaauaccucuaauagu

SEQ ID NO: 1708402 - RNA, 21 nt, Human
cauucuagagugcauauauuu

SEQ ID NO: 1708403 - RNA, 13 nt, Human
caugauuucaugu

SEQ ID NO: 1708404 - RNA, 14 nt, Human
caugauuucaugua

SEQ ID NO: 1708405 - RNA, 16 nt, Human
caugauuucauguacu

SEQ ID NO: 1708406 - RNA, 17 nt, Human
caugauuucauguacug

SEQ ID NO: 1708407 - RNA, 19 nt, Human
caugauuucauguacugca

SEQ ID NO: 1708408 - RNA, 20 nt, Human
caugauuucauguacugcau

SEQ ID NO: 1708409 - RNA, 13 nt, Human
cauauuaagaaug

SEQ ID NO: 1708410 - RNA, 19 nt, Human
cauauuaagaaugaucuga

SEQ ID NO: 1708411 - RNA, 15 nt, Human
cauauuaagaaugau

SEQ ID NO: 1708412 - RNA, 18 nt, Human
cauauggauccacuggcu

SEQ ID NO: 1708413 - RNA, 17 nt, Human
cauauggauccacuggc

SEQ ID NO: 1708414 - RNA, 22 nt, Human
cauuuguggguuuuuauuuccu

SEQ ID NO: 1708415 - RNA, 23 nt, Human
cauuuguggguuuuuauuuccua

SEQ ID NO: 1708416 - RNA, 17 nt, Human
cauuuguggguuuuuau

SEQ ID NO: 1708417 - RNA, 15 nt, Human
cucaauuuucacugu

SEQ ID NO: 1708418 - RNA, 17 nt, Human
cucaauuuucacugugu

SEQ ID NO: 1708419 - RNA, 15 nt, Human
cucaauaaaauuaua

SEQ ID NO: 1708420 - RNA, 20 nt, Human
cucaauaaaauuauagcucu

SEQ ID NO: 1708421 - RNA, 11 nt, Human
cuacucagcau

SEQ ID NO: 1708422 - RNA, 13 nt, Human
cucuuauuucauc

SEQ ID NO: 1708423 - RNA, 14 nt, Human
cucuuauuucauca

SEQ ID NO: 1708424 - RNA, 16 nt, Human
cugacaaaauacuugu

SEQ ID NO: 1708425 - RNA, 13 nt, Human
cugacaagcucca

SEQ ID NO: 1708426 - RNA, 18 nt, Human
cugacaagcuccauuuaa

SEQ ID NO: 1708427 - RNA, 17 nt, Human
cuccacuuggcauuagc

SEQ ID NO: 1708428 - RNA, 16 nt, Human
aagcacuaaacaaaga

SEQ ID NO: 1708429 - RNA, 19 nt, Human
guuauuauauuuacaaaug

SEQ ID NO: 1708430 - RNA, 20 nt, Human
guuauuauauuuacaaaugg

SEQ ID NO: 1708431 - RNA, 19 nt, Human
guucuucgacuguuguuau

SEQ ID NO: 1708432 - RNA, 15 nt, Human
guuuaugacaguaau

SEQ ID NO: 1708433 - RNA, 17 nt, Human
guuuaugacaguaauug

SEQ ID NO: 1708434 - RNA, 19 nt, Human
guuuauucauaugcauauu

SEQ ID NO: 1708435 - RNA, 18 nt, Human
guuuauucauaugcauau

SEQ ID NO: 1708436 - RNA, 13 nt, Human
guuuauucauaug

SEQ ID NO: 1708437 - RNA, 14 nt, Human
guuuauucauaugc

SEQ ID NO: 1708438 - RNA, 16 nt, Human
guuuauucauaugcau

SEQ ID NO: 1708439 - RNA, 17 nt, Human
guuuauucauaugcaua

SEQ ID NO: 1708440 - RNA, 23 nt, Human
aagguauaucuagguuuaugaca

SEQ ID NO: 1708441 - RNA, 22 nt, Human
aagguauaucuagguuuaugac

SEQ ID NO: 1708442 - RNA, 16 nt, Human
aagucaggaaucauca

SEQ ID NO: 1708443 - RNA, 18 nt, Human
guauugacaaaauguuau

SEQ ID NO: 1708444 - RNA, 19 nt, Human
guauugacaaaauguuauu

SEQ ID NO: 1708445 - RNA, 11 nt, Human
guauugacaaa

SEQ ID NO: 1708446 - RNA, 13 nt, Human
guauugacaaaau

SEQ ID NO: 1708447 - RNA, 15 nt, Human
guauugacaaaaugu

SEQ ID NO: 1708448 - RNA, 16 nt, Human
guauugacaaaauguu

SEQ ID NO: 1708449 - RNA, 17 nt, Human
guauugacaaaauguua

SEQ ID NO: 1708450 - RNA, 16 nt, Human
aaaugucucacugagc

SEQ ID NO: 1708451 - RNA, 17 nt, Human
aaaugucucacugagca

SEQ ID NO: 1708452 - RNA, 17 nt, Human
aaauuguauuacaaauc

SEQ ID NO: 1708453 - RNA, 17 nt, Human
aaauuccaagugauuga

SEQ ID NO: 1708454 - RNA, 20 nt, Human
aaauuagccaguaauccugu

SEQ ID NO: 1708455 - RNA, 21 nt, Human
aaauuagccaguaauccugua

SEQ ID NO: 1708456 - RNA, 22 nt, Human
aaauuagccaguaauccuguag

SEQ ID NO: 1708457 - RNA, 18 nt, Human
aacguuuagcugacaaaa

SEQ ID NO: 1708458 - RNA, 20 nt, Human
aacuaaaacaaagccacuuu

SEQ ID NO: 1708459 - RNA, 13 nt, Human
aacuaaaacaaag

SEQ ID NO: 1708460 - RNA, 17 nt, Human
aacuaaaacaaagccac

SEQ ID NO: 1708461 - RNA, 13 nt, Human
gugauuagugaaa

SEQ ID NO: 1708462 - RNA, 18 nt, Human
acaaaaggauaaugaaua

SEQ ID NO: 1708463 - RNA, 18 nt, Human
uagcaugucgucaaagcu

SEQ ID NO: 1708464 - RNA, 17 nt, Human
uagcauuuucugcaucu

SEQ ID NO: 1708465 - RNA, 19 nt, Human
uagcauuuucugcaucucc

SEQ ID NO: 1708466 - RNA, 10 nt, Human
acaauaccug

SEQ ID NO: 1708467 - RNA, 15 nt, Human
uaguuccccuguuua

SEQ ID NO: 1708468 - RNA, 16 nt, Human
uaguuccccuguuuau

SEQ ID NO: 1708469 - RNA, 21 nt, Human
uagugaaaggaagauaaacgu

SEQ ID NO: 1708470 - RNA, 17 nt, Human
uauauuguucacuucuu

SEQ ID NO: 1708471 - RNA, 21 nt, Human
acaguaauuguguuuacauuu

SEQ ID NO: 1708472 - RNA, 15 nt, Human
acaguaauuguguuu

SEQ ID NO: 1708473 - RNA, 17 nt, Human
acaguaauuguguuuac

SEQ ID NO: 1708474 - RNA, 18 nt, Human
acaguaauuguguuuaca

SEQ ID NO: 1708475 - RNA, 21 nt, Human
acagggaacgugauuagugaa

SEQ ID NO: 1708476 - RNA, 22 nt, Human
acagggaacgugauuagugaaa

SEQ ID NO: 1708477 - RNA, 16 nt, Human
uacauucuucaagauc

SEQ ID NO: 1708478 - RNA, 17 nt, Human
uacauucuucaagaucc

SEQ ID NO: 1708479 - RNA, 21 nt, Human
uacauucuucaagaucccauu

SEQ ID NO: 1708480 - RNA, 20 nt, Human
uacauucuucaagaucccau

SEQ ID NO: 1708481 - RNA, 19 nt, Human
aaugcuuaaagaauucaaa

SEQ ID NO: 1708482 - RNA, 21 nt, Human
aaugcuuaaagaauucaaauu

SEQ ID NO: 1708483 - RNA, 22 nt, Human
aaugcuuaaagaauucaaauuu

SEQ ID NO: 1708484 - RNA, 12 nt, Human
aauguaaauguc

SEQ ID NO: 1708485 - RNA, 13 nt, Human
aauguaaaugucu

SEQ ID NO: 1708486 - RNA, 14 nt, Human
aauguaaaugucuc

SEQ ID NO: 1708487 - RNA, 15 nt, Human
aauguaaaugucuca

SEQ ID NO: 1708488 - RNA, 16 nt, Human
aauguaaaugucucac

SEQ ID NO: 1708489 - RNA, 18 nt, Human
aauguaaaugucucacug

SEQ ID NO: 1708490 - RNA, 24 nt, Human
aauguaaaugucucacugagcacu

SEQ ID NO: 1708491 - RNA, 18 nt, Human
aauuccaagugauugaaa

SEQ ID NO: 1708492 - RNA, 22 nt, Human
aauucaaauuuuaucugccucu

SEQ ID NO: 1708493 - RNA, 14 nt, Human
uaccaccugacauu

SEQ ID NO: 1708494 - RNA, 12 nt, Human
aauuagccagua

SEQ ID NO: 1708495 - RNA, 14 nt, Human
aauuagccaguaau

SEQ ID NO: 1708496 - RNA, 20 nt, Human
aauuagccaguaauccugua

SEQ ID NO: 1708497 - RNA, 17 nt, Human
aauuagccaguaauccu

SEQ ID NO: 1708498 - RNA, 18 nt, Human
aauuagccaguaauccug

SEQ ID NO: 1708499 - RNA, 19 nt, Human
aauuagccaguaauccugu

SEQ ID NO: 1708500 - RNA, 22 nt, Human
aauuagcuuauguuaacugaca

SEQ ID NO: 1708501 - RNA, 16 nt, Human
aauuagcuuauguuaa

SEQ ID NO: 1708502 - RNA, 12 nt, Human
uaaugaauaccu

SEQ ID NO: 1708503 - RNA, 13 nt, Human
uaaugaauaccuu

SEQ ID NO: 1708504 - RNA, 18 nt, Human
uaaugaauaccuuagugc

SEQ ID NO: 1708505 - RNA, 20 nt, Human
uaaugaauaccuuagugcag

SEQ ID NO: 1708506 - RNA, 14 nt, Human
aaugaaugcuuaaa

SEQ ID NO: 1708507 - RNA, 23 nt, Human
uaaugaaugcuuaaagaauucaa

SEQ ID NO: 1708508 - RNA, 13 nt, Human
uaaugaaugcuua

SEQ ID NO: 1708509 - RNA, 18 nt, Human
uaaugaaugcuuaaagaa

SEQ ID NO: 1708510 - RNA, 20 nt, Human
uaaugaaugcuuaaagaauu

SEQ ID NO: 1708511 - RNA, 13 nt, Human
uaauguacauagu

SEQ ID NO: 1708512 - RNA, 19 nt, Human
uaauguacauagugcuaac

SEQ ID NO: 1708513 - RNA, 22 nt, Human
aaucauauaaauagaauguaaa

SEQ ID NO: 1708514 - RNA, 20 nt, Human
aaucauauaaauagaaugua

SEQ ID NO: 1708515 - RNA, 21 nt, Human
aaucauauaaauagaauguaa

SEQ ID NO: 1708516 - RNA, 12 nt, Human
aaucauauaaau

SEQ ID NO: 1708517 - RNA, 17 nt, Human
aaucauauaaauagaau

SEQ ID NO: 1708518 - RNA, 18 nt, Human
aaucauauaaauagaaug

SEQ ID NO: 1708519 - RNA, 19 nt, Human
aaucuuauaauuuaaaaua

SEQ ID NO: 1708520 - RNA, 13 nt, Human
aauccuuugugaa

SEQ ID NO: 1708521 - RNA, 18 nt, Human
aauccuguaggaagguac

SEQ ID NO: 1708522 - RNA, 20 nt, Human
aauccuguaggaagguacug

SEQ ID NO: 1708523 - RNA, 22 nt, Human
aauccuguaggaagguacugua

SEQ ID NO: 1708524 - RNA, 23 nt, Human
aauccuguaggaagguacuguau

SEQ ID NO: 1708525 - RNA, 15 nt, Human
uaacaugaagaccuu

SEQ ID NO: 1708526 - RNA, 20 nt, Human
uaacgauaaaagacagugaa

SEQ ID NO: 1708527 - RNA, 16 nt, Human
ucaauucuugccaaau

SEQ ID NO: 1708528 - RNA, 19 nt, Human
ucaauuuauaccucaauuu

SEQ ID NO: 1708529 - RNA, 16 nt, Human
ucaauuugauguggug

SEQ ID NO: 1708530 - RNA, 15 nt, Human
ucacuguuucacuac

SEQ ID NO: 1708531 - RNA, 14 nt, Human
ucacuguuucacua

SEQ ID NO: 1708532 - RNA, 21 nt, Human
ucacuguuucacuacucagca

SEQ ID NO: 1708533 - RNA, 16 nt, Human
ucacugugcuguuguu

SEQ ID NO: 1708534 - RNA, 19 nt, Human
ucacugugcuguuguuaug

SEQ ID NO: 1708535 - RNA, 20 nt, Human
ucacugugcuguuguuauga

SEQ ID NO: 1708536 - RNA, 15 nt, Human
ucacuguguccaggu

SEQ ID NO: 1708537 - RNA, 23 nt, Human
ucacugugcuguuguuaugaugu

SEQ ID NO: 1708538 - RNA, 13 nt, Human
ucaacuugcaaaa

SEQ ID NO: 1708539 - RNA, 14 nt, Human
ucaacuugcaaaau

SEQ ID NO: 1708540 - RNA, 16 nt, Human
ucaacuugcaaaauca

SEQ ID NO: 1708541 - RNA, 20 nt, Human
ucaacuugcaaaaucaguuu

SEQ ID NO: 1708542 - RNA, 19 nt, Human
ucaacuugcaaaaucaguu

SEQ ID NO: 1708543 - RNA, 15 nt, Human
ucaagucuaccaacc

SEQ ID NO: 1708544 - RNA, 22 nt, Human
ucaagucuaccaaccuguucaa

SEQ ID NO: 1708545 - RNA, 18 nt, Human
ucaagucuaccaauuaua

SEQ ID NO: 1708546 - RNA, 17 nt, Human
ucaaucuucaauccuug

SEQ ID NO: 1708547 - RNA, 21 nt, Human
acauucuucaagaucccauuu

SEQ ID NO: 1708548 - RNA, 21 nt, Human
acauuccuugcugaaacgcau

SEQ ID NO: 1708549 - RNA, 14 nt, Human
acauuccuugcuga

SEQ ID NO: 1708550 - RNA, 14 nt, Human
ucaaauuuuaucug

SEQ ID NO: 1708551 - RNA, 22 nt, Human
ucaaauuuuaucugccucucuu

SEQ ID NO: 1708552 - RNA, 15 nt, Human
ucaguuuuugugaaa

SEQ ID NO: 1708553 - RNA, 17 nt, Human
ucaguuuuugugaaaag

SEQ ID NO: 1708554 - RNA, 20 nt, Human
ucaguuuuccucucaauaaa

SEQ ID NO: 1708555 - RNA, 22 nt, Human
ucauauaaauagaauguaaaug

SEQ ID NO: 1708556 - RNA, 14 nt, Human
ucauauaaauagaa

SEQ ID NO: 1708557 - RNA, 16 nt, Human
ucauauaaauagaaug

SEQ ID NO: 1708558 - RNA, 18 nt, Human
ucauauaaauagaaugua

SEQ ID NO: 1708559 - RNA, 21 nt, Human
ucauauaaauagaauguaaau

SEQ ID NO: 1708560 - RNA, 13 nt, Human
ucauauaaauaga

SEQ ID NO: 1708561 - RNA, 13 nt, Human
ucauaugcauauu

SEQ ID NO: 1708562 - RNA, 13 nt, Human
ucauauuucccau

SEQ ID NO: 1708563 - RNA, 19 nt, Human
ucauauuucccaugauuuc

SEQ ID NO: 1708564 - RNA, 21 nt, Human
ucauauuucccaugauuucau

SEQ ID NO: 1708565 - RNA, 22 nt, Human
ucauauuucccaugauuucaug

SEQ ID NO: 1708566 - RNA, 15 nt, Human
acuaauuuuaaaaug

SEQ ID NO: 1708567 - RNA, 19 nt, Human
acugcaccaguugcugcuu

SEQ ID NO: 1708568 - RNA, 23 nt, Human
acugagcacuguuuucuagugua

SEQ ID NO: 1708569 - RNA, 17 nt, Human
acugagcacuguuuucu

SEQ ID NO: 1708570 - RNA, 13 nt, Human
acugagcacuguu

SEQ ID NO: 1708571 - RNA, 15 nt, Human
acugagcacuguuuu

SEQ ID NO: 1708572 - RNA, 16 nt, Human
acugagcacuguuuuc

SEQ ID NO: 1708573 - RNA, 19 nt, Human
acuccauagaccuuuucau

SEQ ID NO: 1708574 - RNA, 13 nt, Human
agaauguaaaugu

SEQ ID NO: 1708575 - RNA, 14 nt, Human
agaauguaaauguc

SEQ ID NO: 1708576 - RNA, 17 nt, Human
agaauguaaaugucuca

SEQ ID NO: 1708577 - RNA, 19 nt, Human
agaauguaaaugucucacu

SEQ ID NO: 1708578 - RNA, 20 nt, Human
agaauccagcaccggcccca

SEQ ID NO: 1708579 - RNA, 22 nt, Human
agaauguaaaugucucacugag

SEQ ID NO: 1708580 - RNA, 17 nt, Human
agaauucaaauuuuauc

SEQ ID NO: 1708581 - RNA, 12 nt, Human
agaauucaaauu

SEQ ID NO: 1708582 - RNA, 17 nt, Human
acuuacagcaaauccuu

SEQ ID NO: 1708583 - RNA, 13 nt, Human
acuugcaaaauca

SEQ ID NO: 1708584 - RNA, 16 nt, Human
acuugcaaaaucaguu

SEQ ID NO: 1708585 - RNA, 17 nt, Human
acuugcaaaaucaguuu

SEQ ID NO: 1708586 - RNA, 18 nt, Human
acuugcaaaaucaguuuu

SEQ ID NO: 1708587 - RNA, 13 nt, Human
agauucagcuagu

SEQ ID NO: 1708588 - RNA, 21 nt, Human
ugaaugcuuaaagaauucaaa

SEQ ID NO: 1708589 - RNA, 22 nt, Human
ugaaugcuuaaagaauucaaau

SEQ ID NO: 1708590 - RNA, 17 nt, Human
ugaaugcuuaaagaauu

SEQ ID NO: 1708591 - RNA, 15 nt, Human
ugacauuccuugcug

SEQ ID NO: 1708592 - RNA, 14 nt, Human
ugagaagcugcuca

SEQ ID NO: 1708593 - RNA, 16 nt, Human
ugagaagcugcucaac

SEQ ID NO: 1708594 - RNA, 17 nt, Human
ugagaagcugcucaacu

SEQ ID NO: 1708595 - RNA, 13 nt, Human
ugagaagcugcuc

SEQ ID NO: 1708596 - RNA, 21 nt, Human
ugagaagcugcucaacuugca

SEQ ID NO: 1708597 - RNA, 13 nt, Human
ugaaguaaaacaa

SEQ ID NO: 1708598 - RNA, 22 nt, Human
ugaaguaaaacaaacaauaccu

SEQ ID NO: 1708599 - RNA, 23 nt, Human
ugaaguaaaacaaacaauaccug

SEQ ID NO: 1708600 - RNA, 13 nt, Human
ugaaagaaaauaa

SEQ ID NO: 1708601 - RNA, 16 nt, Human
agucagauucuugcau

SEQ ID NO: 1708602 - RNA, 17 nt, Human
agucagauucuugcauc

SEQ ID NO: 1708603 - RNA, 12 nt, Human
aguauugcaaag

SEQ ID NO: 1708604 - RNA, 21 nt, Human
aguauugacaaaauguuauuu

SEQ ID NO: 1708605 - RNA, 22 nt, Human
aguauugacaaaauguuauuuc

SEQ ID NO: 1708606 - RNA, 16 nt, Human
aguauugcaaagucag

SEQ ID NO: 1708607 - RNA, 19 nt, Human
uguagagaaaacaugcaga

SEQ ID NO: 1708608 - RNA, 17 nt, Human
agugagcaguguuagcu

SEQ ID NO: 1708609 - RNA, 17 nt, Human
agugaaagaaaauaaca

SEQ ID NO: 1708610 - RNA, 17 nt, Human
uguagagaaaacaugca

SEQ ID NO: 1708611 - RNA, 16 nt, Human
uguaaaggaauuuaaa

SEQ ID NO: 1708612 - RNA, 22 nt, Human
ugguccaugggccauaugaaaa

SEQ ID NO: 1708613 - RNA, 22 nt, Human
uggugaaaagcagguugauaaa

SEQ ID NO: 1708614 - RNA, 23 nt, Human
uggugaaaagcagguugauaaau

SEQ ID NO: 1708615 - RNA, 19 nt, Human
agguauaucuagguuuaug

SEQ ID NO: 1708616 - RNA, 22 nt, Human
agguauaucuagguuuaugaca

SEQ ID NO: 1708617 - RNA, 15 nt, Human
aggucagugcaaaua

SEQ ID NO: 1708618 - RNA, 22 nt, Human
uggguuuuuauuuccuaugaug

SEQ ID NO: 1708619 - RNA, 14 nt, Human
auaaugaauacuuu

SEQ ID NO: 1708620 - RNA, 22 nt, Human
auaaaccccaccccaaaauuag

SEQ ID NO: 1708621 - RNA, 23 nt, Human
auaaaccccaccccaaaauuagc

SEQ ID NO: 1708622 - RNA, 18 nt, Human
auaaacguggauguuacu

SEQ ID NO: 1708623 - RNA, 17 nt, Human
auaaacguggauguuac

SEQ ID NO: 1708624 - RNA, 21 nt, Human
uuagccaguaauccuguagga

SEQ ID NO: 1708625 - RNA, 14 nt, Human
uuauaccucaauuu

SEQ ID NO: 1708626 - RNA, 22 nt, Human
uuauaccucaauuuucacugug

SEQ ID NO: 1708627 - RNA, 21 nt, Human
uuauaccucaauuuucacugu

SEQ ID NO: 1708628 - RNA, 20 nt, Human
uuauagcucuaauguuugca

SEQ ID NO: 1708629 - RNA, 15 nt, Human
uuauagcucuaaugu

SEQ ID NO: 1708630 - RNA, 16 nt, Human
uuauagcucuaauguu

SEQ ID NO: 1708631 - RNA, 17 nt, Human
uuauagcucuaauguuu

SEQ ID NO: 1708632 - RNA, 18 nt, Human
uuauagcucuaauguuug

SEQ ID NO: 1708633 - RNA, 12 nt, Human
uuauagcucuaa

SEQ ID NO: 1708634 - RNA, 20 nt, Human
auacauucuucaagauccca

SEQ ID NO: 1708635 - RNA, 16 nt, Human
auacauuuuguaccaa

SEQ ID NO: 1708636 - RNA, 21 nt, Human
auacaguucggugagcuacaa

SEQ ID NO: 1708637 - RNA, 16 nt, Human
auacagcuuuuggauu

SEQ ID NO: 1708638 - RNA, 23 nt, Human
auacucaagagugguaucuugca

SEQ ID NO: 1708639 - RNA, 14 nt, Human
uguuguagagaaaa

SEQ ID NO: 1708640 - RNA, 17 nt, Human
uguuguagagaaaacau

SEQ ID NO: 1708641 - RNA, 23 nt, Human
uguuguagagaaaacaugcagaa

SEQ ID NO: 1708642 - RNA, 14 nt, Human
aguuccugugcaca

SEQ ID NO: 1708643 - RNA, 16 nt, Human
aguuccugugcacagc

SEQ ID NO: 1708644 - RNA, 17 nt, Human
aguuccugugcacagcc

SEQ ID NO: 1708645 - RNA, 20 nt, Human
aguuauuauauuuacaaaug

SEQ ID NO: 1708646 - RNA, 14 nt, Human
aguguaaugaauac

SEQ ID NO: 1708647 - RNA, 16 nt, Human
aguguaaugaauaccu

SEQ ID NO: 1708648 - RNA, 22 nt, Human
aguguaaugaauaccuuagugc

SEQ ID NO: 1708649 - RNA, 12 nt, Human
uguuaugaugug

SEQ ID NO: 1708650 - RNA, 14 nt, Human
uguuaugaugugcu

SEQ ID NO: 1708651 - RNA, 16 nt, Human
uguuaugaugugcuua

SEQ ID NO: 1708652 - RNA, 17 nt, Human
uguuaugaugugcuuaa

SEQ ID NO: 1708653 - RNA, 19 nt, Human
uguuaugaugugcuuaaca

SEQ ID NO: 1708654 - RNA, 22 nt, Human
uguuaugaugugcuuaacaggg

SEQ ID NO: 1708655 - RNA, 13 nt, Human
uguuuucuagugu

SEQ ID NO: 1708656 - RNA, 14 nt, Human
uguuuucuagugua

SEQ ID NO: 1708657 - RNA, 15 nt, Human
uguuuucuaguguau

SEQ ID NO: 1708658 - RNA, 16 nt, Human
uguuuucuaguguauc

SEQ ID NO: 1708659 - RNA, 18 nt, Human
uguuuucuaguguaucaa

SEQ ID NO: 1708660 - RNA, 19 nt, Human
uguuuucuaguguaucaaa

SEQ ID NO: 1708661 - RNA, 20 nt, Human
uguuuucuaguguaucaaaa

SEQ ID NO: 1708662 - RNA, 21 nt, Human
uguuuucuaguguaucaaaau

SEQ ID NO: 1708663 - RNA, 13 nt, Human
uguuugcauauaa

SEQ ID NO: 1708664 - RNA, 14 nt, Human
uguuugcauauaag

SEQ ID NO: 1708665 - RNA, 16 nt, Human
aguugcacagcaucuc

SEQ ID NO: 1708666 - RNA, 17 nt, Human
aguugcacagcaucuca

SEQ ID NO: 1708667 - RNA, 12 nt, Human
aguugcacagca

SEQ ID NO: 1708668 - RNA, 13 nt, Human
aguugcacagcau

SEQ ID NO: 1708669 - RNA, 14 nt, Human
aguugcacagcauc

SEQ ID NO: 1708670 - RNA, 15 nt, Human
aguugcacagcaucu

SEQ ID NO: 1708671 - RNA, 11 nt, Human
aguugcacagc

SEQ ID NO: 1708672 - RNA, 22 nt, Human
aguugcauagguuuaauaauuu

SEQ ID NO: 1708673 - RNA, 20 nt, Human
aguugcacagcaucucagcu

SEQ ID NO: 1708674 - RNA, 13 nt, Human
ugauuucauguac

SEQ ID NO: 1708675 - RNA, 15 nt, Human
ugauuucauguacug

SEQ ID NO: 1708676 - RNA, 16 nt, Human
ugauuucauguacugc

SEQ ID NO: 1708677 - RNA, 17 nt, Human
ugauuucauguacugca

SEQ ID NO: 1708678 - RNA, 18 nt, Human
ugauuucauguacugcau

SEQ ID NO: 1708679 - RNA, 18 nt, Human
ugcaauacaaguuucauc

SEQ ID NO: 1708680 - RNA, 23 nt, Human
ugcaauacaaguuucauccagaa

SEQ ID NO: 1708681 - RNA, 16 nt, Human
ugcaauacaaguuuca

SEQ ID NO: 1708682 - RNA, 17 nt, Human
ugcaauacaaguuucau

SEQ ID NO: 1708683 - RNA, 21 nt, Human
agcucuaauguuugcauauaa

SEQ ID NO: 1708684 - RNA, 14 nt, Human
agcucuaauguuug

SEQ ID NO: 1708685 - RNA, 17 nt, Human
agcucuaauguuugcau

SEQ ID NO: 1708686 - RNA, 18 nt, Human
agcucuaauguuugcaua

SEQ ID NO: 1708687 - RNA, 20 nt, Human
agcucuaauguuugcauaua

SEQ ID NO: 1708688 - RNA, 22 nt, Human
agcucuaauguuugcauauaag

SEQ ID NO: 1708689 - RNA, 14 nt, Human
agcuccauuuaaac

SEQ ID NO: 1708690 - RNA, 15 nt, Human
agcuccauuuaaaca

SEQ ID NO: 1708691 - RNA, 18 nt, Human
agcuccauuuaaacagau

SEQ ID NO: 1708692 - RNA, 21 nt, Human
agcuccauuuaaacagauguc

SEQ ID NO: 1708693 - RNA, 19 nt, Human
ugccaggaacccuuaaaca

SEQ ID NO: 1708694 - RNA, 23 nt, Human
ugcauuauuugagaagcugcuca

SEQ ID NO: 1708695 - RNA, 14 nt, Human
agcgcacucuucau

SEQ ID NO: 1708696 - RNA, 15 nt, Human
ugcauuauuugagaa

SEQ ID NO: 1708697 - RNA, 16 nt, Human
ugcauuauuugagaag

SEQ ID NO: 1708698 - RNA, 11 nt, Human
aggaauuuaaa

SEQ ID NO: 1708699 - RNA, 21 nt, Human
ugcuguacugaaguaaaacaa

SEQ ID NO: 1708700 - RNA, 16 nt, Human
ugcuuauauuguucac

SEQ ID NO: 1708701 - RNA, 18 nt, Human
uggacgagaaaacaauaa

SEQ ID NO: 1708702 - RNA, 22 nt, Human
aggcugcuguacugaaguaaaa

SEQ ID NO: 1708703 - RNA, 23 nt, Human
uggcuagauuaaccuucucuguc

SEQ ID NO: 1708704 - RNA, 19 nt, Human
uucuucgacuguuguuauc

SEQ ID NO: 1708705 - RNA, 20 nt, Human
auccaauuagcuuauguuaa

SEQ ID NO: 1708706 - RNA, 22 nt, Human
auccaauuagcuuauguuaacu

SEQ ID NO: 1708707 - RNA, 21 nt, Human
aucaguuacacaugaucauaa

SEQ ID NO: 1708708 - RNA, 24 nt, Human
aucauauaaauagaauguaaaugu

SEQ ID NO: 1708709 - RNA, 14 nt, Human
aucauauaaauaga

SEQ ID NO: 1708710 - RNA, 18 nt, Human
aucauauaaauagaaugu

SEQ ID NO: 1708711 - RNA, 19 nt, Human
aucauauaaauagaaugua

SEQ ID NO: 1708712 - RNA, 21 nt, Human
aucauauaaauagaauguaaa

SEQ ID NO: 1708713 - RNA, 22 nt, Human
aucauauaaauagaauguaaau

SEQ ID NO: 1708714 - RNA, 23 nt, Human
aucauauaaauagaauguaaaug

SEQ ID NO: 1708715 - RNA, 15 nt, Human
uugauaaaucauuuu

SEQ ID NO: 1708716 - RNA, 21 nt, Human
uugauaaaucauuuuauguca

SEQ ID NO: 1708717 - RNA, 18 nt, Human
uugauaaaucauuuuaug

SEQ ID NO: 1708718 - RNA, 17 nt, Human
uugagaaagucagauuc

SEQ ID NO: 1708719 - RNA, 16 nt, Human
uugagaagcugcucaa

SEQ ID NO: 1708720 - RNA, 13 nt, Human
uugagaagcugcu

SEQ ID NO: 1708721 - RNA, 15 nt, Human
uugagaagcugcuca

SEQ ID NO: 1708722 - RNA, 22 nt, Human
auccucuuccauauggauccac

SEQ ID NO: 1708723 - RNA, 21 nt, Human
auccuguaggaagguacugua

SEQ ID NO: 1708724 - RNA, 19 nt, Human
auccuguaggaagguacug

SEQ ID NO: 1708725 - RNA, 20 nt, Human
auccuguaggaagguacugu

SEQ ID NO: 1708726 - RNA, 22 nt, Human
auccuguaggaagguacuguau

SEQ ID NO: 1708727 - RNA, 13 nt, Human
auauuuacaaaug

SEQ ID NO: 1708728 - RNA, 19 nt, Human
uucccuacauuaaacauga

SEQ ID NO: 1708729 - RNA, 14 nt, Human
uucccuacauuaaa

SEQ ID NO: 1708730 - RNA, 20 nt, Human
auaugcaaacaggguaacua

SEQ ID NO: 1708731 - RNA, 17 nt, Human
uuccaauuuaguuguug

SEQ ID NO: 1708732 - RNA, 16 nt, Human
uucacuucacugugcu

SEQ ID NO: 1708733 - RNA, 11 nt, Human
uuaucauguua

SEQ ID NO: 1708734 - RNA, 17 nt, Human
uuaucauguuaguaaua

SEQ ID NO: 1708735 - RNA, 18 nt, Human
uuaucauguuaguaauac

SEQ ID NO: 1708736 - RNA, 22 nt, Human
uuaucauguuaguaauaccucu

SEQ ID NO: 1708737 - RNA, 23 nt, Human
uuaucauguuaguaauaccucua

SEQ ID NO: 1708738 - RNA, 15 nt, Human
uucacuucacugugc

SEQ ID NO: 1708739 - RNA, 13 nt, Human
auauaugcuaagu

SEQ ID NO: 1708740 - RNA, 12 nt, Human
uucauaugcaua

SEQ ID NO: 1708741 - RNA, 20 nt, Human
augcuuauauuguucacuuc

SEQ ID NO: 1708742 - RNA, 15 nt, Human
uuuagcugacaaaau

SEQ ID NO: 1708743 - RNA, 19 nt, Human
uuucuaguguaucaaaaug

SEQ ID NO: 1708744 - RNA, 20 nt, Human
uuucuaguguaucaaaaugc

SEQ ID NO: 1708745 - RNA, 21 nt, Human
uuucuaguguaucaaaaugcu

SEQ ID NO: 1708746 - RNA, 16 nt, Human
uuucuaguguaucaaa

SEQ ID NO: 1708747 - RNA, 13 nt, Human
uuucugcaucucc

SEQ ID NO: 1708748 - RNA, 16 nt, Human
uuucugcaucuccacu

SEQ ID NO: 1708749 - RNA, 15 nt, Human
uuucugcaucuccac

SEQ ID NO: 1708750 - RNA, 13 nt, Human
augaucugauuga

SEQ ID NO: 1708751 - RNA, 13 nt, Human
augaucaaauguu

SEQ ID NO: 1708752 - RNA, 14 nt, Human
augaucaaauguuu

SEQ ID NO: 1708753 - RNA, 15 nt, Human
augaucaaauguuua

SEQ ID NO: 1708754 - RNA, 16 nt, Human
augaucaaauguuuaa

SEQ ID NO: 1708755 - RNA, 17 nt, Human
augaucaaauguuuaau

SEQ ID NO: 1708756 - RNA, 19 nt, Human
augaucaaauguuuaauca

SEQ ID NO: 1708757 - RNA, 20 nt, Human
augaucaaauguuuaaucau

SEQ ID NO: 1708758 - RNA, 12 nt, Human
augaucaaaugu

SEQ ID NO: 1708759 - RNA, 21 nt, Human
augacaagaaaggcugcugua

SEQ ID NO: 1708760 - RNA, 21 nt, Human
augacaguaauuguguuuaca

SEQ ID NO: 1708761 - RNA, 22 nt, Human
augacaguaauuguguuuacau

SEQ ID NO: 1708762 - RNA, 12 nt, Human
augacaguaauu

SEQ ID NO: 1708763 - RNA, 20 nt, Human
augacaguaauuguguuuac

SEQ ID NO: 1708764 - RNA, 15 nt, Human
uugcugaaugcaaga

SEQ ID NO: 1708765 - RNA, 22 nt, Human
auuuucaguuauuauauuuaca

SEQ ID NO: 1708766 - RNA, 13 nt, Human
auuuucacugugu

SEQ ID NO: 1708767 - RNA, 14 nt, Human
auuuucacuguguc

SEQ ID NO: 1708768 - RNA, 18 nt, Human
auucuucaagaucccauu

SEQ ID NO: 1708769 - RNA, 21 nt, Human
auucuucaagaucccauuuga

SEQ ID NO: 1708770 - RNA, 15 nt, Human
auugugcauucuaga

SEQ ID NO: 1708771 - RNA, 18 nt, Human
auuucccaugauuucaug

SEQ ID NO: 1708772 - RNA, 12 nt, Human
auucccucccca

SEQ ID NO: 1708773 - RNA, 11 nt, Human
uuuuauuuccu

SEQ ID NO: 1708774 - RNA, 18 nt, Human
uuuuauuuccuaugaugu

SEQ ID NO: 1708775 - RNA, 16 nt, Human
uuuuauuuccuaugau

SEQ ID NO: 1708776 - RNA, 23 nt, Human
auuaaacaugacuccauagaccu

SEQ ID NO: 1708777 - RNA, 19 nt, Human
uuuuugugaaaagcuccau

SEQ ID NO: 1708778 - RNA, 15 nt, Human
auuacuuaguauugc

SEQ ID NO: 1708779 - RNA, 18 nt, Human
auuacuuaguauugcaaa

SEQ ID NO: 1708780 - RNA, 22 nt, Human
auuacuuaguauugcaaaguca

SEQ ID NO: 1708781 - RNA, 20 nt, Human
uuuuuacccauuuguucaua

SEQ ID NO: 1708782 - RNA, 13 nt, Human
caauuugaugugg

SEQ ID NO: 1708783 - RNA, 16 nt, Human
caauacaaguuucauc

SEQ ID NO: 1708784 - RNA, 21 nt, Human
caauacaaguuucauccagaa

SEQ ID NO: 1708785 - RNA, 12 nt, Human
caaguguaauga

SEQ ID NO: 1708786 - RNA, 15 nt, Human
caaguguaaugaaua

SEQ ID NO: 1708787 - RNA, 19 nt, Human
caaguguaaugaauaccuu

SEQ ID NO: 1708788 - RNA, 18 nt, Human
caaguguaaugaauaccu

SEQ ID NO: 1708789 - RNA, 21 nt, Human
caaaacuucguuuaaugaaug

SEQ ID NO: 1708790 - RNA, 18 nt, Human
caaaauguuauuucccua

SEQ ID NO: 1708791 - RNA, 16 nt, Human
caaaauguuauuuccc

SEQ ID NO: 1708792 - RNA, 17 nt, Human
caaaauguuauuucccu

SEQ ID NO: 1708793 - RNA, 23 nt, Human
caaaauuagccaguaauccugua

SEQ ID NO: 1708794 - RNA, 13 nt, Human
caaaauuagccag

SEQ ID NO: 1708795 - RNA, 20 nt, Human
caaaauuagccaguaauccu

SEQ ID NO: 1708796 - RNA, 21 nt, Human
caaaauuagccaguaauccug

SEQ ID NO: 1708797 - RNA, 22 nt, Human
caaaauuagccaguaauccugu

SEQ ID NO: 1708798 - RNA, 22 nt, Human
caaaaugcucuuauuucaucau

SEQ ID NO: 1708799 - RNA, 13 nt, Human
cacugagcacugu

SEQ ID NO: 1708800 - RNA, 15 nt, Human
cacugagcacuguuu

SEQ ID NO: 1708801 - RNA, 16 nt, Human
cacugagcacuguuuu

SEQ ID NO: 1708802 - RNA, 17 nt, Human
cacugagcacuguuuuc

SEQ ID NO: 1708803 - RNA, 18 nt, Human
cacugagcacuguuuucu

SEQ ID NO: 1708804 - RNA, 22 nt, Human
cacugagcacuguuuucuagug

SEQ ID NO: 1708805 - RNA, 19 nt, Human
cacugagcacuguuuucua

SEQ ID NO: 1708806 - RNA, 14 nt, Human
cacugugcuguugu

SEQ ID NO: 1708807 - RNA, 15 nt, Human
cacugugcuguuguu

SEQ ID NO: 1708808 - RNA, 17 nt, Human
cacugugcuguuguuau

SEQ ID NO: 1708809 - RNA, 19 nt, Human
cacugugcuguuguuauga

SEQ ID NO: 1708810 - RNA, 20 nt, Human
cacugugcuguuguuaugau

SEQ ID NO: 1708811 - RNA, 23 nt, Human
cacugugcuguuguuaugaugug

SEQ ID NO: 1708812 - RNA, 21 nt, Human
cacugugcuguuguuaugaug

SEQ ID NO: 1708813 - RNA, 12 nt, Human
cacuucacugug

SEQ ID NO: 1708814 - RNA, 13 nt, Human
cacuucacugugc

SEQ ID NO: 1708815 - RNA, 15 nt, Human
cacuucacugugcug

SEQ ID NO: 1708816 - RNA, 13 nt, Human
cacuaaacaaaga

SEQ ID NO: 1708817 - RNA, 19 nt, Human
cacucgaggucgggcagca

SEQ ID NO: 1708818 - RNA, 22 nt, Human
caccggccccauuuacccaacu

SEQ ID NO: 1708819 - RNA, 23 nt, Human
cagaugacaagaaaggcugcugu

SEQ ID NO: 1708820 - RNA, 19 nt, Human
cagaacuaccaccugacau

SEQ ID NO: 1708821 - RNA, 14 nt, Human
cagacauugugcua

SEQ ID NO: 1708822 - RNA, 15 nt, Human
cagauucuugcaucc

SEQ ID NO: 1708823 - RNA, 16 nt, Human
cagauguccaucagau

SEQ ID NO: 1708824 - RNA, 19 nt, Human
cagauguccaucagaugac

SEQ ID NO: 1708825 - RNA, 21 nt, Human
cagauguccaucagaugacaa

SEQ ID NO: 1708826 - RNA, 15 nt, Human
cagaugucuauauug

SEQ ID NO: 1708827 - RNA, 18 nt, Human
cagcaaauccuuugugaa

SEQ ID NO: 1708828 - RNA, 16 nt, Human
cagcaaauccuuugug

SEQ ID NO: 1708829 - RNA, 13 nt, Human
cagcaucucagcu

SEQ ID NO: 1708830 - RNA, 14 nt, Human
cagcaucucagcuc

SEQ ID NO: 1708831 - RNA, 15 nt, Human
caggaacguuuagcu

SEQ ID NO: 1708832 - RNA, 23 nt, Human
cagcuuuuggauuggacaaaaug

SEQ ID NO: 1708833 - RNA, 16 nt, Human
cagcuuugcucauauu

SEQ ID NO: 1708834 - RNA, 21 nt, Human
cagcuuugcucauauuuccca

SEQ ID NO: 1708835 - RNA, 20 nt, Human
cagcuuugcucauauuuccc

SEQ ID NO: 1708836 - RNA, 20 nt, Human
caguaucggcacuguacaaa

SEQ ID NO: 1708837 - RNA, 19 nt, Human
caguaucggcacuguacaa

SEQ ID NO: 1708838 - RNA, 14 nt, Human
caguaucggcacug

SEQ ID NO: 1708839 - RNA, 15 nt, Human
caguaucggcacugu

SEQ ID NO: 1708840 - RNA, 16 nt, Human
caguaucggcacugua

SEQ ID NO: 1708841 - RNA, 20 nt, Human
cagugaaagaaaauaacaau

SEQ ID NO: 1708842 - RNA, 16 nt, Human
cagugaaagaaaauaa

SEQ ID NO: 1708843 - RNA, 12 nt, Human
caggguaacuaa

SEQ ID NO: 1708844 - RNA, 19 nt, Human
caggguaacuaacuaaaac

SEQ ID NO: 1708845 - RNA, 22 nt, Human
caggguaacuaacuaaaacaaa

SEQ ID NO: 1708846 - RNA, 21 nt, Human
caggguaacuaacuaaaacaa

SEQ ID NO: 1708847 - RNA, 17 nt, Human
caguaauuguguuuaca

SEQ ID NO: 1708848 - RNA, 18 nt, Human
caguaauuguguuuacau

SEQ ID NO: 1708849 - RNA, 20 nt, Human
caguaauuguguuuacauuu

SEQ ID NO: 1708850 - RNA, 23 nt, Human
caguaauccuguaggaagguacu

SEQ ID NO: 1708851 - RNA, 12 nt, Human
caguaauccugu

SEQ ID NO: 1708852 - RNA, 13 nt, Human
caguaauccugua

SEQ ID NO: 1708853 - RNA, 16 nt, Human
caguaauccuguagga

SEQ ID NO: 1708854 - RNA, 17 nt, Human
caguaauccuguaggaa

SEQ ID NO: 1708855 - RNA, 21 nt, Human
caguaauccuguaggaaggua

SEQ ID NO: 1708856 - RNA, 18 nt, Human
cagggaacgugauuagug

SEQ ID NO: 1708857 - RNA, 19 nt, Human
cagggaacgugauuaguga

SEQ ID NO: 1708858 - RNA, 17 nt, Human
caugaagaccuuuuucu

SEQ ID NO: 1708859 - RNA, 19 nt, Human
caugaagaccuuuuucugc

SEQ ID NO: 1708860 - RNA, 20 nt, Human
caugaagaccuuuuucugca

SEQ ID NO: 1708861 - RNA, 15 nt, Human
caugaagaccuuuuu

SEQ ID NO: 1708862 - RNA, 22 nt, Human
caugaagaccuuuuucugcacu

SEQ ID NO: 1708863 - RNA, 23 nt, Human
cauauaagggaaguaguuaucau

SEQ ID NO: 1708864 - RNA, 17 nt, Human
cauauaaauagaaugua

SEQ ID NO: 1708865 - RNA, 20 nt, Human
cauauaaauagaauguaaau

SEQ ID NO: 1708866 - RNA, 21 nt, Human
cauauaaauagaauguaaaug

SEQ ID NO: 1708867 - RNA, 22 nt, Human
cauauaaauagaauguaaaugu

SEQ ID NO: 1708868 - RNA, 19 nt, Human
cauauaagggaaguaguua

SEQ ID NO: 1708869 - RNA, 19 nt, Human
caucauucacuucacugug

SEQ ID NO: 1708870 - RNA, 16 nt, Human
caucauucacuucacu

SEQ ID NO: 1708871 - RNA, 17 nt, Human
caucauucacuucacug

SEQ ID NO: 1708872 - RNA, 18 nt, Human
caucauucacuucacugu

SEQ ID NO: 1708873 - RNA, 20 nt, Human
caucauucacuucacugugc

SEQ ID NO: 1708874 - RNA, 15 nt, Human
cauguacugcauuau

SEQ ID NO: 1708875 - RNA, 16 nt, Human
cauguacugcauuauu

SEQ ID NO: 1708876 - RNA, 17 nt, Human
cauguacugcauuauuu

SEQ ID NO: 1708877 - RNA, 22 nt, Human
cauguacugcauuauuugagaa

SEQ ID NO: 1708878 - RNA, 23 nt, Human
cauguacugcauuauuugagaag

SEQ ID NO: 1708879 - RNA, 23 nt, Human
cauggaaacaagaugaaauucca

SEQ ID NO: 1708880 - RNA, 20 nt, Human
caugcagaacaaaugaagac

SEQ ID NO: 1708881 - RNA, 19 nt, Human
caugcagaacaaaugaaga

SEQ ID NO: 1708882 - RNA, 23 nt, Human
ccaaaauuagccaguaauccugu

SEQ ID NO: 1708883 - RNA, 14 nt, Human
cauuuucugcaucu

SEQ ID NO: 1708884 - RNA, 16 nt, Human
cauuuucugcaucucc

SEQ ID NO: 1708885 - RNA, 17 nt, Human
cauuuucugcaucucca

SEQ ID NO: 1708886 - RNA, 15 nt, Human
cauuaaacaugacuc

SEQ ID NO: 1708887 - RNA, 14 nt, Human
cauucaagauuccc

SEQ ID NO: 1708888 - RNA, 14 nt, Human
cauucacuucacug

SEQ ID NO: 1708889 - RNA, 17 nt, Human
cauucacuucacugugc

SEQ ID NO: 1708890 - RNA, 18 nt, Human
cauucacuucacugugcu

SEQ ID NO: 1708891 - RNA, 19 nt, Human
cauucacuucacugugcug

SEQ ID NO: 1708892 - RNA, 20 nt, Human
cauucacuucacugugcugu

SEQ ID NO: 1708893 - RNA, 13 nt, Human
cauucuggaauaa

SEQ ID NO: 1708894 - RNA, 12 nt, Human
cauucuucaaga

SEQ ID NO: 1708895 - RNA, 13 nt, Human
cauucuucaagau

SEQ ID NO: 1708896 - RNA, 17 nt, Human
cauucuucaagauccca

SEQ ID NO: 1708897 - RNA, 18 nt, Human
cauuccucccauucaaga

SEQ ID NO: 1708898 - RNA, 19 nt, Human
cauuccucccauucaagau

SEQ ID NO: 1708899 - RNA, 13 nt, Human
ccauuuguucaua

SEQ ID NO: 1708900 - RNA, 16 nt, Human
ccacuggcuggacaaa

SEQ ID NO: 1708901 - RNA, 20 nt, Human
ccaccugacauuccuugcug

SEQ ID NO: 1708902 - RNA, 23 nt, Human
ccacuggcuggacaaacugcacc

SEQ ID NO: 1708903 - RNA, 17 nt, Human
ccugacauuccuugcug

SEQ ID NO: 1708904 - RNA, 18 nt, Human
ccugacauuccuugcuga

SEQ ID NO: 1708905 - RNA, 20 nt, Human
ccugccuuuuaguuccugug

SEQ ID NO: 1708906 - RNA, 22 nt, Human
ccugccuuuuaguuccugugca

SEQ ID NO: 1708907 - RNA, 19 nt, Human
ccuuaaacaguugcacagc

SEQ ID NO: 1708908 - RNA, 20 nt, Human
ccuuaaacaguugcacagca

SEQ ID NO: 1708909 - RNA, 21 nt, Human
ccuguuuauucauaugcauau

SEQ ID NO: 1708910 - RNA, 14 nt, Human
ccuuguccccauga

SEQ ID NO: 1708911 - RNA, 14 nt, Human
ccuugaagguauau

SEQ ID NO: 1708912 - RNA, 16 nt, Human
ccuuuuaguuccugug

SEQ ID NO: 1708913 - RNA, 22 nt, Human
ccuuuuaguuccugugcacagc

SEQ ID NO: 1708914 - RNA, 19 nt, Human
cgacuguuguuaucuguuu

SEQ ID NO: 1708915 - RNA, 11 nt, Human
cgacuguuguu

SEQ ID NO: 1708916 - RNA, 22 nt, Human
ccuaugauguauacugccacua

SEQ ID NO: 1708917 - RNA, 21 nt, Human
cuucaauuuauaccucaauuu

SEQ ID NO: 1708918 - RNA, 13 nt, Human
cuuaguauugcaa

SEQ ID NO: 1708919 - RNA, 18 nt, Human
cuucaagaucccauuuga

SEQ ID NO: 1708920 - RNA, 14 nt, Human
cuuccaaaaauuac

SEQ ID NO: 1708921 - RNA, 19 nt, Human
cuuaacagggaacgugauu

SEQ ID NO: 1708922 - RNA, 20 nt, Human
cuguuuucuaguguaucaaa

SEQ ID NO: 1708923 - RNA, 22 nt, Human
cuguuuucuaguguaucaaaau

SEQ ID NO: 1708924 - RNA, 15 nt, Human
cuguuuucuagugua

SEQ ID NO: 1708925 - RNA, 17 nt, Human
cuguuuucuaguguauc

SEQ ID NO: 1708926 - RNA, 18 nt, Human
cuguuuucuaguguauca

SEQ ID NO: 1708927 - RNA, 21 nt, Human
cuguuuauucauaugcauauu

SEQ ID NO: 1708928 - RNA, 12 nt, Human
cuguuugagaaa

SEQ ID NO: 1708929 - RNA, 13 nt, Human
cuguuugagaaag

SEQ ID NO: 1708930 - RNA, 21 nt, Human
cuuuauuuucuauaauuuaaa

SEQ ID NO: 1708931 - RNA, 19 nt, Human
cuuguaaaggaauuuaaaa

SEQ ID NO: 1708932 - RNA, 20 nt, Human
gaaaaucuuauaauuuaaaa

SEQ ID NO: 1708933 - RNA, 19 nt, Human
gaaaauaacgauaaaagac

SEQ ID NO: 1708934 - RNA, 19 nt, Human
gaaaaucuuauaauuuaaa

SEQ ID NO: 1708935 - RNA, 22 nt, Human
gaaaacaauaacgauaaaagac

SEQ ID NO: 1708936 - RNA, 14 nt, Human
gaaaacaugcagaa

SEQ ID NO: 1708937 - RNA, 13 nt, Human
gaagguacuguau

SEQ ID NO: 1708938 - RNA, 14 nt, Human
gaauacuuuauaaa

SEQ ID NO: 1708939 - RNA, 20 nt, Human
gaauaauccuaaacauauga

SEQ ID NO: 1708940 - RNA, 22 nt, Human
gaacgugauuagugaaaggaag

SEQ ID NO: 1708941 - RNA, 20 nt, Human
gaacguuuagcugacaaaau

SEQ ID NO: 1708942 - RNA, 21 nt, Human
gaacuuguaaaggaauuuaaa

SEQ ID NO: 1708943 - RNA, 18 nt, Human
cugcaauacaaguuucau

SEQ ID NO: 1708944 - RNA, 17 nt, Human
cugccuuuuaguuccug

SEQ ID NO: 1708945 - RNA, 19 nt, Human
cugccuuuuaguuccugug

SEQ ID NO: 1708946 - RNA, 20 nt, Human
cugccuuuuaguuccugugc

SEQ ID NO: 1708947 - RNA, 23 nt, Human
cugccuuuuaguuccugugcaca

SEQ ID NO: 1708948 - RNA, 21 nt, Human
cugccuuuuaguuccugugca

SEQ ID NO: 1708949 - RNA, 14 nt, Human
cugaaugcucugua

SEQ ID NO: 1708950 - RNA, 14 nt, Human
cugagcacuguuuu

SEQ ID NO: 1708951 - RNA, 15 nt, Human
cugagcacuguuuuc

SEQ ID NO: 1708952 - RNA, 23 nt, Human
cugagcacuguuuucuaguguau

SEQ ID NO: 1708953 - RNA, 21 nt, Human
cugagcacuguuuucuagugu

SEQ ID NO: 1708954 - RNA, 13 nt, Human
cugagcacuguuu

SEQ ID NO: 1708955 - RNA, 12 nt, Human
cugagcacuguu

SEQ ID NO: 1708956 - RNA, 19 nt, Human
cuccaaaacuucguuuaau

SEQ ID NO: 1708957 - RNA, 20 nt, Human
cuauauugcugaaugcaaga

SEQ ID NO: 1708958 - RNA, 12 nt, Human
cuagguuuauga

SEQ ID NO: 1708959 - RNA, 16 nt, Human
cuagguuuaugacagu

SEQ ID NO: 1708960 - RNA, 15 nt, Human
cucacugagcacugu

SEQ ID NO: 1708961 - RNA, 16 nt, Human
cucacugagcacuguu

SEQ ID NO: 1708962 - RNA, 18 nt, Human
cucacugagcacuguuuu

SEQ ID NO: 1708963 - RNA, 17 nt, Human
cucacugagcacuguuu

SEQ ID NO: 1708964 - RNA, 13 nt, Human
gagcuacaaaugc

SEQ ID NO: 1708965 - RNA, 12 nt, Human
gagcuacaaaug

SEQ ID NO: 1708966 - RNA, 14 nt, Human
gagcuacaaaugca

SEQ ID NO: 1708967 - RNA, 22 nt, Human
gagcacuguuuucuaguguauc

SEQ ID NO: 1708968 - RNA, 14 nt, Human
gagcacuguuuucu

SEQ ID NO: 1708969 - RNA, 21 nt, Human
gaguugaaaaucuuauaauuu

SEQ ID NO: 1708970 - RNA, 13 nt, Human
gaugugcuuaaca

SEQ ID NO: 1708971 - RNA, 14 nt, Human
gaugugcuuaacag

SEQ ID NO: 1708972 - RNA, 24 nt, Human
gauugaccguguuggucuguacug

SEQ ID NO: 1708973 - RNA, 14 nt, Human
gauuggacaaaaug

SEQ ID NO: 1708974 - RNA, 15 nt, Human
gauuggacaaaauga

SEQ ID NO: 1708975 - RNA, 22 nt, Human
gaugggacaauuagauaaaugu

SEQ ID NO: 1708976 - RNA, 23 nt, Human
gcacuguuuucuaguguaucaaa

SEQ ID NO: 1708977 - RNA, 13 nt, Human
gcacagcaucuca

SEQ ID NO: 1708978 - RNA, 18 nt, Human
gcacagcaucucagcuca

SEQ ID NO: 1708979 - RNA, 19 nt, Human
gcacuguuuucuaguguau

SEQ ID NO: 1708980 - RNA, 20 nt, Human
gcacuguuuucuaguguauc

SEQ ID NO: 1708981 - RNA, 21 nt, Human
gcacuguuuucuaguguauca

SEQ ID NO: 1708982 - RNA, 22 nt, Human
gcacuguuuucuaguguaucaa

SEQ ID NO: 1708983 - RNA, 20 nt, Human
gcaucuaguuccccuguuua

SEQ ID NO: 1708984 - RNA, 22 nt, Human
gcaucuaguuccccuguuuauu

SEQ ID NO: 1708985 - RNA, 22 nt, Human
gcaucucagcucaucuucacug

SEQ ID NO: 1708986 - RNA, 14 nt, Human
gcaucucagcucau

SEQ ID NO: 1708987 - RNA, 17 nt, Human
gccacacgagaaccuga

SEQ ID NO: 1708988 - RNA, 15 nt, Human
gcuuauauuguucac

SEQ ID NO: 1708989 - RNA, 19 nt, Human
gcuggacaaacugcaccag

SEQ ID NO: 1708990 - RNA, 14 nt, Human
gcuggacaaacugc

SEQ ID NO: 1708991 - RNA, 15 nt, Human
gcucauauuucccau

SEQ ID NO: 1708992 - RNA, 15 nt, Human
ucaucaggaacguuu

SEQ ID NO: 1708993 - RNA, 13 nt, Human
ucaucuucacugc

SEQ ID NO: 1708994 - RNA, 18 nt, Human
uccaauuuaguuguugua

SEQ ID NO: 1708995 - RNA, 12 nt, Human
uauuaagaauga

SEQ ID NO: 1708996 - RNA, 23 nt, Human
uaugucaagggcagcuuugcuca

SEQ ID NO: 1708997 - RNA, 16 nt, Human
uaugucaagggcagcu

SEQ ID NO: 1708998 - RNA, 23 nt, Human
uauggauccacuggcuggacaaa

SEQ ID NO: 1708999 - RNA, 22 nt, Human
uauggugccuaguauugacaaa

SEQ ID NO: 1709000 - RNA, 23 nt, Human
uauucuaacuuuuauuuuuauca

SEQ ID NO: 1709001 - RNA, 17 nt, Human
uauugcugaaugcaaga

SEQ ID NO: 1709002 - RNA, 14 nt, Human
ucaauaaaauuaua

SEQ ID NO: 1709003 - RNA, 15 nt, Human
ucaauaaaauuauag

SEQ ID NO: 1709004 - RNA, 17 nt, Human
ucaauaaaauuauagcu

SEQ ID NO: 1709005 - RNA, 19 nt, Human
ucaauaaaauuauagcucu

SEQ ID NO: 1709006 - RNA, 21 nt, Human
ucaaauguuuaaucauauaaa

SEQ ID NO: 1709007 - RNA, 13 nt, Human
ucugcaucuccac

SEQ ID NO: 1709008 - RNA, 11 nt, Human
ucugcaucucc

SEQ ID NO: 1709009 - RNA, 15 nt, Human
ucucuguccgagugu

SEQ ID NO: 1709010 - RNA, 22 nt, Human
ucucaauaaaauuauagcucua

SEQ ID NO: 1709011 - RNA, 23 nt, Human
ucucaauaaaauuauagcucuaa

SEQ ID NO: 1709012 - RNA, 21 nt, Human
ucucaauaaaauuauagcucu

SEQ ID NO: 1709013 - RNA, 13 nt, Human
ucuaauguuugca

SEQ ID NO: 1709014 - RNA, 14 nt, Human
ucuaauguuugcau

SEQ ID NO: 1709015 - RNA, 15 nt, Human
ucuaauguuugcaua

SEQ ID NO: 1709016 - RNA, 16 nt, Human
ucuaauguuugcauau

SEQ ID NO: 1709017 - RNA, 17 nt, Human
ucuaauguuugcauaua

SEQ ID NO: 1709018 - RNA, 19 nt, Human
ucuaauguuugcauauaag

SEQ ID NO: 1709019 - RNA, 18 nt, Human
ucuaauguuugcauauaa

SEQ ID NO: 1709020 - RNA, 12 nt, Human
ucuaauaguaua

SEQ ID NO: 1709021 - RNA, 17 nt, Human
ucuaauaguauaaaccc

SEQ ID NO: 1709022 - RNA, 14 nt, Human
ucuaauaguauaaa

SEQ ID NO: 1709023 - RNA, 13 nt, Human
uccuugaagguau

SEQ ID NO: 1709024 - RNA, 17 nt, Human
uccuugaagguauaucu

SEQ ID NO: 1709025 - RNA, 13 nt, Human
ucccuacauuaaa

SEQ ID NO: 1709026 - RNA, 16 nt, Human
ucccuacauuaaacau

SEQ ID NO: 1709027 - RNA, 16 nt, Human
uguaggaagguacugu

SEQ ID NO: 1709028 - RNA, 18 nt, Human
uguaggaagguacuguau

SEQ ID NO: 1709029 - RNA, 19 nt, Human
uguaggaagguacuguaug

SEQ ID NO: 1709030 - RNA, 20 nt, Human
uguaggaagguacuguauga

SEQ ID NO: 1709031 - RNA, 22 nt, Human
uguaggaagguacuguaugauc

SEQ ID NO: 1709032 - RNA, 20 nt, Human
ugucucacugagcacuguuu

SEQ ID NO: 1709033 - RNA, 14 nt, Human
ugucucacugagca

SEQ ID NO: 1709034 - RNA, 16 nt, Human
ugucuguuuuaaaaac

SEQ ID NO: 1709035 - RNA, 17 nt, Human
ugcuuucgguuccaguu

SEQ ID NO: 1709036 - RNA, 22 nt, Human
ugcuuaacagggaacgugauua

SEQ ID NO: 1709037 - RNA, 18 nt, Human
ugcuuaaagaauucaaau

SEQ ID NO: 1709038 - RNA, 19 nt, Human
ugcuuaaagaauucaaauu

SEQ ID NO: 1709039 - RNA, 20 nt, Human
ugcuuaaagaauucaaauuu

SEQ ID NO: 1709040 - RNA, 14 nt, Human
ugauaaaucauuuu

SEQ ID NO: 1709041 - RNA, 15 nt, Human
ugauaaaucauuuua

SEQ ID NO: 1709042 - RNA, 20 nt, Human
ugauaaaucauuuuauguca

SEQ ID NO: 1709043 - RNA, 21 nt, Human
ugaccguguuggucuguacug

SEQ ID NO: 1709044 - RNA, 19 nt, Human
ugaccguguuggucuguac

SEQ ID NO: 1709045 - RNA, 20 nt, Human
ugaccguguuggucuguacu

SEQ ID NO: 1709046 - RNA, 22 nt, Human
ugcaagaaguggggcagcagca

SEQ ID NO: 1709047 - RNA, 14 nt, Human
ugcaaaaucaguuu

SEQ ID NO: 1709048 - RNA, 15 nt, Human
ugcaaaaucaguuuu

SEQ ID NO: 1709049 - RNA, 20 nt, Human
ugcaaaaucaguuuuccucu

SEQ ID NO: 1709050 - RNA, 17 nt, Human
ugaugugcuuaacaggg

SEQ ID NO: 1709051 - RNA, 13 nt, Human
ugaugugcuuaac

SEQ ID NO: 1709052 - RNA, 22 nt, Human
ugauuuuuuuuuuuuuccuguc

SEQ ID NO: 1709053 - RNA, 14 nt, Human
ugcaucccuggcug

SEQ ID NO: 1709054 - RNA, 21 nt, Human
uuuuaaaguaacccuacaaaa

SEQ ID NO: 1709055 - RNA, 15 nt, Human
uuuuuuccugucaua

SEQ ID NO: 1709056 - RNA, 13 nt, Human
uuuuuuuuccugu

SEQ ID NO: 1709057 - RNA, 12 nt, Human
uuguguuuacau

SEQ ID NO: 1709058 - RNA, 13 nt, Human
uuguguuuacauu

SEQ ID NO: 1709059 - RNA, 18 nt, Human
uuguguuuacauuuuaug

SEQ ID NO: 1709060 - RNA, 22 nt, Human
uuguguuuacauuuuauggugc

SEQ ID NO: 1709061 - RNA, 13 nt, Human
uuguuaucuguuu

SEQ ID NO: 1709062 - RNA, 13 nt, Human
uuguuaugaugug

SEQ ID NO: 1709063 - RNA, 15 nt, Human
uuguuaugaugugcu

SEQ ID NO: 1709064 - RNA, 17 nt, Human
uuguuaugaugugcuua

SEQ ID NO: 1709065 - RNA, 18 nt, Human
uuguuaugaugugcuuaa

SEQ ID NO: 1709066 - RNA, 19 nt, Human
uuuaacucuauaauguguu

SEQ ID NO: 1709067 - RNA, 23 nt, Human
uuuacauuuuauggugccuagua

SEQ ID NO: 1709068 - RNA, 13 nt, Human
uuuacauuuuaug

SEQ ID NO: 1709069 - RNA, 17 nt, Human
uuuacauuuuauggugc

SEQ ID NO: 1709070 - RNA, 22 nt, Human
uuuacauuuuauggugccuagu

SEQ ID NO: 1709071 - RNA, 20 nt, Human
uuuauggcagacauugugcu

SEQ ID NO: 1709072 - RNA, 21 nt, Human
uuuauggcagacauugugcua

SEQ ID NO: 1709073 - RNA, 15 nt, Human
uuccaugucaagauu

SEQ ID NO: 1709074 - RNA, 21 nt, Human
uuccaugucaagauucagcua

SEQ ID NO: 1709075 - RNA, 17 nt, Human
uuccaugucaagauuca

SEQ ID NO: 1709076 - RNA, 18 nt, Human
uucggugagcuacaaaug

SEQ ID NO: 1709077 - RNA, 14 nt, Human
uugacaaaauguua

SEQ ID NO: 1709078 - RNA, 19 nt, Human
uugacaaaauguuauuucc

SEQ ID NO: 1709079 - RNA, 20 nt, Human
uugacaaaauguuauuuccc

SEQ ID NO: 1709080 - RNA, 21 nt, Human
uugacaaaauguuauuucccu

SEQ ID NO: 1709081 - RNA, 12 nt, Human
uuauuugagaag

SEQ ID NO: 1709082 - RNA, 18 nt, Human
uuauuugagaagcugcuc

SEQ ID NO: 1709083 - RNA, 20 nt, Human
uuauuugagaagcugcucaa

SEQ ID NO: 1709084 - RNA, 23 nt, Human
uucaguuauuauauuuacaaaug

SEQ ID NO: 1709085 - RNA, 18 nt, Human
uuccauauggauccacug

SEQ ID NO: 1709086 - RNA, 19 nt, Human
uuccauauggauccacugg

SEQ ID NO: 1709087 - RNA, 21 nt, Human
uuccauauggauccacuggcu

SEQ ID NO: 1709088 - RNA, 22 nt, Human
uuccauauggauccacuggcug

SEQ ID NO: 1709089 - RNA, 22 nt, Human
uuccaaaaauuacuuaguauug

SEQ ID NO: 1709090 - RNA, 18 nt, Human
uuauaagggcaaauugga

SEQ ID NO: 1709091 - RNA, 12 nt, Human
uuauaauuuaaa

SEQ ID NO: 1709092 - RNA, 15 nt, Human
uuagugacuaaacca

SEQ ID NO: 1709093 - RNA, 17 nt, Human
uuagugacuaaaccauu

SEQ ID NO: 1709094 - RNA, 23 nt, Human
uuagugacuaaaccauugugcau

SEQ ID NO: 1709095 - RNA, 22 nt, Human
uuauaagggcaaauuggagaaa

SEQ ID NO: 1709096 - RNA, 16 nt, Human
uuauauuuacaaaugg

SEQ ID NO: 1709097 - RNA, 15 nt, Human
uuauauuguucacuu

SEQ ID NO: 1709098 - RNA, 17 nt, Human
uuauauuguucacuucu

SEQ ID NO: 1709099 - RNA, 16 nt, Human
uuaucuguuugagaaa

SEQ ID NO: 1709100 - RNA, 20 nt, Human
uuaucuguuugagaaaguca

SEQ ID NO: 1709101 - RNA, 14 nt, Human
uuaugauuagcuuu

SEQ ID NO: 1709102 - RNA, 15 nt, Human
cacagcaucucagcu

SEQ ID NO: 1709103 - RNA, 16 nt, Human
cacagcaucucagcuc

SEQ ID NO: 1709104 - RNA, 19 nt, Human
cacagcaucucagcucauc

SEQ ID NO: 1709105 - RNA, 12 nt, Human
cacagcaucuca

SEQ ID NO: 1709106 - RNA, 13 nt, Human
cacagcaucucag

SEQ ID NO: 1709107 - RNA, 14 nt, Human
cacagcaucucagc

SEQ ID NO: 1709108 - RNA, 14 nt, Human
caauuuucacugug

SEQ ID NO: 1709109 - RNA, 20 nt, Human
caauuuucacuguguccagg

SEQ ID NO: 1709110 - RNA, 15 nt, Human
caauuuucacugugu

SEQ ID NO: 1709111 - RNA, 17 nt, Human
cacacgagaaccugaag

SEQ ID NO: 1709112 - RNA, 15 nt, Human
caaauguuuaaucau

SEQ ID NO: 1709113 - RNA, 13 nt, Human
caaauguuuaauc

SEQ ID NO: 1709114 - RNA, 18 nt, Human
caaaaaaaucuuccaauu

SEQ ID NO: 1709115 - RNA, 17 nt, Human
caagcacuaaacaaaga

SEQ ID NO: 1709116 - RNA, 14 nt, Human
caagucuaccaauu

SEQ ID NO: 1709117 - RNA, 22 nt, Human
acuucacugugcuguuguuaug

SEQ ID NO: 1709118 - RNA, 20 nt, Human
acuucacugugcuguuguua

SEQ ID NO: 1709119 - RNA, 21 nt, Human
acuucacugugcuguuguuau

SEQ ID NO: 1709120 - RNA, 24 nt, Human
acuucacugugcuguuguuaugau

SEQ ID NO: 1709121 - RNA, 13 nt, Human
acuucacugugcu

SEQ ID NO: 1709122 - RNA, 14 nt, Human
acuucacugugcug

SEQ ID NO: 1709123 - RNA, 17 nt, Human
acuucacugugcuguug

SEQ ID NO: 1709124 - RNA, 19 nt, Human
acuucacugugcuguuguu

SEQ ID NO: 1709125 - RNA, 18 nt, Human
acuuguaaaggaauuuaa

SEQ ID NO: 1709126 - RNA, 22 nt, Human
acuuuauuuucuauaauuuaaa

SEQ ID NO: 1709127 - RNA, 14 nt, Human
agaaagugagcagu

SEQ ID NO: 1709128 - RNA, 16 nt, Human
agaaagugagcagugu

SEQ ID NO: 1709129 - RNA, 15 nt, Human
agaaaggcugcugua

SEQ ID NO: 1709130 - RNA, 22 nt, Human
acgcaucuaguuccccuguuua

SEQ ID NO: 1709131 - RNA, 11 nt, Human
acucagcaugg

SEQ ID NO: 1709132 - RNA, 11 nt, Human
acaaaauguua

SEQ ID NO: 1709133 - RNA, 12 nt, Human
acaaaauguuau

SEQ ID NO: 1709134 - RNA, 17 nt, Human
acaaaauguuauuuccc

SEQ ID NO: 1709135 - RNA, 21 nt, Human
acaagaaaggcugcuguacug

SEQ ID NO: 1709136 - RNA, 22 nt, Human
acaagaaaggcugcuguacuga

SEQ ID NO: 1709137 - RNA, 14 nt, Human
acccauuuguucau

SEQ ID NO: 1709138 - RNA, 15 nt, Human
acccauuuguucaua

SEQ ID NO: 1709139 - RNA, 23 nt, Human
aaauagcuuggguagcgcacucu

SEQ ID NO: 1709140 - RNA, 22 nt, Human
aaccacuggaaaguuuaugguu

SEQ ID NO: 1709141 - RNA, 17 nt, Human
aaaucuuauaauuuaaa

SEQ ID NO: 1709142 - RNA, 11 nt, Human
aaauguuuaau

SEQ ID NO: 1709143 - RNA, 13 nt, Human
aaauguuuaauca

SEQ ID NO: 1709144 - RNA, 14 nt, Human
aaauguuuaaucau

SEQ ID NO: 1709145 - RNA, 15 nt, Human
aaauguuuaaucaua

SEQ ID NO: 1709146 - RNA, 17 nt, Human
aaauguuuaaucauaua

SEQ ID NO: 1709147 - RNA, 19 nt, Human
aaauguuuaaucauauaaa

SEQ ID NO: 1709148 - RNA, 18 nt, Human
aaauguuuaaucauauaa

SEQ ID NO: 1709149 - RNA, 21 nt, Human
aagauaaacguggauguuacu

SEQ ID NO: 1709150 - RNA, 14 nt, Human
aaguguaaugaaua

SEQ ID NO: 1709151 - RNA, 20 nt, Human
aagucuaccaaccuguucaa

SEQ ID NO: 1709152 - RNA, 22 nt, Human
aagggaaguaguuaucauguua

SEQ ID NO: 1709153 - RNA, 20 nt, Human
aagggaaguaguuaucaugu

SEQ ID NO: 1709154 - RNA, 23 nt, Human
aauguuuaaucauauaaauagaa

SEQ ID NO: 1709155 - RNA, 13 nt, Human
aauguuuaaucau

SEQ ID NO: 1709156 - RNA, 14 nt, Human
aauguuuaaucaua

SEQ ID NO: 1709157 - RNA, 16 nt, Human
aauguuuaaucauaua

SEQ ID NO: 1709158 - RNA, 17 nt, Human
aauguuuaaucauauaa

SEQ ID NO: 1709159 - RNA, 18 nt, Human
aauguuuaaucauauaaa

SEQ ID NO: 1709160 - RNA, 20 nt, Human
aauguuuaaucauauaaaua

SEQ ID NO: 1709161 - RNA, 18 nt, Human
aauguccauucuuuauca

SEQ ID NO: 1709162 - RNA, 13 nt, Human
aauguuugcauau

SEQ ID NO: 1709163 - RNA, 14 nt, Human
aauguuugcauaua

SEQ ID NO: 1709164 - RNA, 15 nt, Human
aauacuugucuguuu

SEQ ID NO: 1709165 - RNA, 16 nt, Human
aauagaauguaaaugu

SEQ ID NO: 1709166 - RNA, 14 nt, Human
aauagaauguaaau

SEQ ID NO: 1709167 - RNA, 15 nt, Human
aauccaaugaaauga

SEQ ID NO: 1709168 - RNA, 15 nt, Human
agaugaaauuccauu

SEQ ID NO: 1709169 - RNA, 16 nt, Human
agagaaaacaugcaga

SEQ ID NO: 1709170 - RNA, 17 nt, Human
agagaaaacaugcagaa

SEQ ID NO: 1709171 - RNA, 23 nt, Human
agagaaaacaugcagaacaaaug

SEQ ID NO: 1709172 - RNA, 15 nt, Human
agcacuguuuucuag

SEQ ID NO: 1709173 - RNA, 13 nt, Human
agcaguguuagcu

SEQ ID NO: 1709174 - RNA, 17 nt, Human
agcaguguuagcuuagu

SEQ ID NO: 1709175 - RNA, 20 nt, Human
agcugcucaacuugcaaaau

SEQ ID NO: 1709176 - RNA, 16 nt, Human
agcugcucaacuugca

SEQ ID NO: 1709177 - RNA, 20 nt, Human
agguaaaagcaucacaugaa

SEQ ID NO: 1709178 - RNA, 18 nt, Human
agguuauuaugauuagcu

SEQ ID NO: 1709179 - RNA, 22 nt, Human
auggaaacaagaugaaauucca

SEQ ID NO: 1709180 - RNA, 21 nt, Human
aucauguuaguaauaccucua

SEQ ID NO: 1709181 - RNA, 22 nt, Human
aucauguuaguaauaccucuaa

SEQ ID NO: 1709182 - RNA, 14 nt, Human
aucauguuaguaau

SEQ ID NO: 1709183 - RNA, 19 nt, Human
aucauguuaguaauaccuc

SEQ ID NO: 1709184 - RNA, 15 nt, Human
auagguuuaauaauu

SEQ ID NO: 1709185 - RNA, 20 nt, Human
auaccucaauuuucacugug

SEQ ID NO: 1709186 - RNA, 14 nt, Human
auaccucuaauagu

SEQ ID NO: 1709187 - RNA, 18 nt, Human
auaccucuaauaguauaa

SEQ ID NO: 1709188 - RNA, 19 nt, Human
auaccucuaauaguauaaa

SEQ ID NO: 1709189 - RNA, 20 nt, Human
auaccucuaauaguauaaac

SEQ ID NO: 1709190 - RNA, 18 nt, Human
auaccuuagugcaguuau

SEQ ID NO: 1709191 - RNA, 18 nt, Human
auaaaggauuaaugucaa

SEQ ID NO: 1709192 - RNA, 23 nt, Human
aguugaaaaucuuauaauuuaaa

SEQ ID NO: 1709193 - RNA, 14 nt, Human
aguuguuguagaga

SEQ ID NO: 1709194 - RNA, 22 nt, Human
aguugaaaaucuuauaauuuaa

SEQ ID NO: 1709195 - RNA, 17 nt, Human
aguguaucaaaaugcuc

SEQ ID NO: 1709196 - RNA, 18 nt, Human
aguguaucaaaaugcucu

SEQ ID NO: 1709197 - RNA, 13 nt, Human
aguguaucaaaau

SEQ ID NO: 1709198 - RNA, 14 nt, Human
aguguaucaaaaug

SEQ ID NO: 1709199 - RNA, 15 nt, Human
aguguaucaaaaugc

SEQ ID NO: 1709200 - RNA, 16 nt, Human
aguguaucaaaaugcu

SEQ ID NO: 1709201 - RNA, 12 nt, Human
aguccuguaaug

SEQ ID NO: 1709202 - RNA, 13 nt, Human
aacuaacuaaaac

SEQ ID NO: 1709203 - RNA, 20 nt, Human
aacagauguccaucagauga

SEQ ID NO: 1709204 - RNA, 19 nt, Human
aacagauguccaucagaug

SEQ ID NO: 1709205 - RNA, 14 nt, Human
aagaucccauuuga

SEQ ID NO: 1709206 - RNA, 15 nt, Human
aagaaaggcugcugu

SEQ ID NO: 1709207 - RNA, 22 nt, Human
aagaaagugagcaguguuagcu

SEQ ID NO: 1709208 - RNA, 20 nt, Human
aagaaaggcugcuguacuga

SEQ ID NO: 1709209 - RNA, 21 nt, Human
aagaauucaaauuuuaucugc

SEQ ID NO: 1709210 - RNA, 12 nt, Human
aagaauucaaau

SEQ ID NO: 1709211 - RNA, 13 nt, Human
aagaauucaaauu

SEQ ID NO: 1709212 - RNA, 17 nt, Human
aagaauucaaauuuuau

SEQ ID NO: 1709213 - RNA, 18 nt, Human
aagaauucaaauuuuauc

SEQ ID NO: 1709214 - RNA, 12 nt, Human
aauaaaaauaau

SEQ ID NO: 1709215 - RNA, 15 nt, Human
aauaacaauaaaaga

SEQ ID NO: 1709216 - RNA, 17 nt, Human
aauacaaguuucaucca

SEQ ID NO: 1709217 - RNA, 22 nt, Human
uaaaccccaccccaaaauuagc

SEQ ID NO: 1709218 - RNA, 14 nt, Human
uaaaccauugugca

SEQ ID NO: 1709219 - RNA, 18 nt, Human
uaaacguggauguuacuc

SEQ ID NO: 1709220 - RNA, 14 nt, Human
uaaacguggauguu

SEQ ID NO: 1709221 - RNA, 14 nt, Human
uaaagaauucaaau

SEQ ID NO: 1709222 - RNA, 15 nt, Human
uaaagaauucaaauu

SEQ ID NO: 1709223 - RNA, 21 nt, Human
uaaaauuauagcucuaauguu

SEQ ID NO: 1709224 - RNA, 20 nt, Human
uaaaauuauagcucuaaugu

SEQ ID NO: 1709225 - RNA, 15 nt, Human
uaaaauuauagcucu

SEQ ID NO: 1709226 - RNA, 16 nt, Human
uaaaauuauagcucua

SEQ ID NO: 1709227 - RNA, 18 nt, Human
uaaaauuauagcucuaau

SEQ ID NO: 1709228 - RNA, 16 nt, Human
aaggcugcuguacuga

SEQ ID NO: 1709229 - RNA, 20 nt, Human
aaguaaaacaaacaauaccu

SEQ ID NO: 1709230 - RNA, 17 nt, Human
aaguaaaacaaacaaua

SEQ ID NO: 1709231 - RNA, 23 nt, Human
guuugcauauaagggaaguaguu

SEQ ID NO: 1709232 - RNA, 15 nt, Human
aagucaacuuagcau

SEQ ID NO: 1709233 - RNA, 22 nt, Human
aagucuuauauauuguagauaa

SEQ ID NO: 1709234 - RNA, 13 nt, Human
aaggauaaugaau

SEQ ID NO: 1709235 - RNA, 19 nt, Human
aaggaaaaaauaacaauga

SEQ ID NO: 1709236 - RNA, 16 nt, Human
aaggaaaaaauaacaa

SEQ ID NO: 1709237 - RNA, 14 nt, Human
guguuuacauuuua

SEQ ID NO: 1709238 - RNA, 17 nt, Human
guuccccuguuuauuca

SEQ ID NO: 1709239 - RNA, 18 nt, Human
guuccccuguuuauucau

SEQ ID NO: 1709240 - RNA, 19 nt, Human
guuccccuguuuauucaua

SEQ ID NO: 1709241 - RNA, 14 nt, Human
uacauuaaacauga

SEQ ID NO: 1709242 - RNA, 12 nt, Human
uacauuaaacau

SEQ ID NO: 1709243 - RNA, 20 nt, Human
uacauuaaacaugacuccau

SEQ ID NO: 1709244 - RNA, 15 nt, Human
uacaaguuucaucca

SEQ ID NO: 1709245 - RNA, 20 nt, Human
uacagcaaauccuuugugaa

SEQ ID NO: 1709246 - RNA, 21 nt, Human
aauguacauagugcuaacaug

SEQ ID NO: 1709247 - RNA, 14 nt, Human
uacagcaaauccuu

SEQ ID NO: 1709248 - RNA, 14 nt, Human
uacaaguuucaucc

SEQ ID NO: 1709249 - RNA, 18 nt, Human
uacaaguuucauccagaa

SEQ ID NO: 1709250 - RNA, 21 nt, Human
uaauaccucuaauaguauaaa

SEQ ID NO: 1709251 - RNA, 23 nt, Human
uaauaccucuaauaguauaaacc

SEQ ID NO: 1709252 - RNA, 15 nt, Human
uaauacagcugagcu

SEQ ID NO: 1709253 - RNA, 14 nt, Human
acaaaaaaaucuuc

SEQ ID NO: 1709254 - RNA, 19 nt, Human
acaaaaaaaucuuccaauu

SEQ ID NO: 1709255 - RNA, 21 nt, Human
uagcaugucgucaaagcugaa

SEQ ID NO: 1709256 - RNA, 18 nt, Human
acaagcacuaaacaaaga

SEQ ID NO: 1709257 - RNA, 16 nt, Human
uacugaaguaaaacaa

SEQ ID NO: 1709258 - RNA, 17 nt, Human
uacugaaguaaaacaaa

SEQ ID NO: 1709259 - RNA, 23 nt, Human
uacucaagagugguaucuugcag

SEQ ID NO: 1709260 - RNA, 22 nt, Human
uacucaagagugguaucuugca

SEQ ID NO: 1709261 - RNA, 21 nt, Human
aauucuugccaaauauaaaua

SEQ ID NO: 1709262 - RNA, 12 nt, Human
aauuugaugugg

SEQ ID NO: 1709263 - RNA, 22 nt, Human
aauuugauguggugaaaagcag

SEQ ID NO: 1709264 - RNA, 20 nt, Human
aauuguguuuacauuuuaug

SEQ ID NO: 1709265 - RNA, 21 nt, Human
aauuguguuuacauuuuaugg

SEQ ID NO: 1709266 - RNA, 22 nt, Human
aauuguguuuacauuuuauggu

SEQ ID NO: 1709267 - RNA, 14 nt, Human
aauuguguuuacau

SEQ ID NO: 1709268 - RNA, 19 nt, Human
aauuguguuuacauuuuau

SEQ ID NO: 1709269 - RNA, 13 nt, Human
uauucauaugcau

SEQ ID NO: 1709270 - RNA, 14 nt, Human
uauucauaugcaua

SEQ ID NO: 1709271 - RNA, 15 nt, Human
uauucauaugcauau

SEQ ID NO: 1709272 - RNA, 16 nt, Human
uauucauaugcauauu

SEQ ID NO: 1709273 - RNA, 17 nt, Human
uauucauaugcauauuu

SEQ ID NO: 1709274 - RNA, 20 nt, Human
acagugaaagaaaauaacaa

SEQ ID NO: 1709275 - RNA, 21 nt, Human
uauugacaaaauguuauuucc

SEQ ID NO: 1709276 - RNA, 12 nt, Human
uauugacaaaau

SEQ ID NO: 1709277 - RNA, 13 nt, Human
uauugacaaaaug

SEQ ID NO: 1709278 - RNA, 16 nt, Human
uauugacaaaauguua

SEQ ID NO: 1709279 - RNA, 22 nt, Human
uauugacaaaauguuauuuccc

SEQ ID NO: 1709280 - RNA, 22 nt, Human
acaguucggugagcuacaaaug

SEQ ID NO: 1709281 - RNA, 19 nt, Human
acaguucggugagcuacaa

SEQ ID NO: 1709282 - RNA, 23 nt, Human
acaguucggugagcuacaaaugc

SEQ ID NO: 1709283 - RNA, 14 nt, Human
uauagcucuaaugu

SEQ ID NO: 1709284 - RNA, 16 nt, Human
uauagcucuaauguuu

SEQ ID NO: 1709285 - RNA, 18 nt, Human
uauagcucuaauguuugc

SEQ ID NO: 1709286 - RNA, 17 nt, Human
uaguuccugugcacagc

SEQ ID NO: 1709287 - RNA, 23 nt, Human
uaguuccccuguuuauucauaug

SEQ ID NO: 1709288 - RNA, 19 nt, Human
uaguuccccuguuuauuca

SEQ ID NO: 1709289 - RNA, 22 nt, Human
uagugacuaaaccauugugcau

SEQ ID NO: 1709290 - RNA, 23 nt, Human
uagugacuaaaccauugugcauu

SEQ ID NO: 1709291 - RNA, 14 nt, Human
uauauuuacaaaug

SEQ ID NO: 1709292 - RNA, 15 nt, Human
uauauuuacaaaugg

SEQ ID NO: 1709293 - RNA, 15 nt, Human
uaucuagguuuauga

SEQ ID NO: 1709294 - RNA, 21 nt, Human
uaucuagguuuaugacaguaa

SEQ ID NO: 1709295 - RNA, 17 nt, Human
uaucuagguuuaugaca

SEQ ID NO: 1709296 - RNA, 23 nt, Human
uaucuugcaguaucggcacugua

SEQ ID NO: 1709297 - RNA, 22 nt, Human
uaucuugcaguaucggcacugu

SEQ ID NO: 1709298 - RNA, 21 nt, Human
uaugaugugcuuaacagggaa

SEQ ID NO: 1709299 - RNA, 19 nt, Human
uaugauguauacugccacu

SEQ ID NO: 1709300 - RNA, 21 nt, Human
uaugauguauacugccacuaa

SEQ ID NO: 1709301 - RNA, 14 nt, Human
uaugaugugcuuaa

SEQ ID NO: 1709302 - RNA, 17 nt, Human
uaugaugugcuuaacag

SEQ ID NO: 1709303 - RNA, 14 nt, Human
acuauaugcaaaca

SEQ ID NO: 1709304 - RNA, 18 nt, Human
acuauaugcaaacagggu

SEQ ID NO: 1709305 - RNA, 13 nt, Human
acuauaugcaaac

SEQ ID NO: 1709306 - RNA, 19 nt, Human
acuaaaacaaagccacuuu

SEQ ID NO: 1709307 - RNA, 17 nt, Human
acguuuagcugacaaaa

SEQ ID NO: 1709308 - RNA, 22 nt, Human
acguuuagcugacaaaauacuu

SEQ ID NO: 1709309 - RNA, 16 nt, Human
acuaaaacaaagccac

SEQ ID NO: 1709310 - RNA, 17 nt, Human
acuguacaaaaaaaucu

SEQ ID NO: 1709311 - RNA, 19 nt, Human
acuguacaaaaaaaucuuc

SEQ ID NO: 1709312 - RNA, 22 nt, Human
acuguacaaaaaaaucuuccaa

SEQ ID NO: 1709313 - RNA, 13 nt, Human
uccugugcacagc

SEQ ID NO: 1709314 - RNA, 14 nt, Human
uccugugcacagcc

SEQ ID NO: 1709315 - RNA, 18 nt, Human
ucauuuguggguuuuuau

SEQ ID NO: 1709316 - RNA, 23 nt, Human
ucauuuguggguuuuuauuuccu

SEQ ID NO: 1709317 - RNA, 22 nt, Human
ucauuuguggguuuuuauuucc

SEQ ID NO: 1709318 - RNA, 14 nt, Human
ucauuuuaugucaa

SEQ ID NO: 1709319 - RNA, 16 nt, Human
accugaaugcucugua

SEQ ID NO: 1709320 - RNA, 17 nt, Human
accuuagugcaguuauu

SEQ ID NO: 1709321 - RNA, 21 nt, Human
accuuagugcaguuauuugcu

SEQ ID NO: 1709322 - RNA, 20 nt, Human
accuuccaugucaagauuca

SEQ ID NO: 1709323 - RNA, 18 nt, Human
ucauguuaguaauaccuc

SEQ ID NO: 1709324 - RNA, 19 nt, Human
ucauguuaguaauaccucu

SEQ ID NO: 1709325 - RNA, 21 nt, Human
ucauguuaguaauaccucuaa

SEQ ID NO: 1709326 - RNA, 14 nt, Human
ucauguuaguaaua

SEQ ID NO: 1709327 - RNA, 17 nt, Human
ucauguuaguaauaccu

SEQ ID NO: 1709328 - RNA, 12 nt, Human
accucuaauagu

SEQ ID NO: 1709329 - RNA, 16 nt, Human
accucuaauaguauaa

SEQ ID NO: 1709330 - RNA, 17 nt, Human
accucuaauaguauaaa

SEQ ID NO: 1709331 - RNA, 20 nt, Human
accucuaauaguauaaaccc

SEQ ID NO: 1709332 - RNA, 19 nt, Human
accucuaauaguauaaacc

SEQ ID NO: 1709333 - RNA, 15 nt, Human
ucauauuaagaauga

SEQ ID NO: 1709334 - RNA, 17 nt, Human
ucauauuaagaaugauc

SEQ ID NO: 1709335 - RNA, 18 nt, Human
ucauauuaagaaugaucu

SEQ ID NO: 1709336 - RNA, 22 nt, Human
ucauauuaagaaugaucugauu

SEQ ID NO: 1709337 - RNA, 14 nt, Human
ucauauuaagaaug

SEQ ID NO: 1709338 - RNA, 20 nt, Human
accucaauuuucacuguguc

SEQ ID NO: 1709339 - RNA, 18 nt, Human
accucaauuuucacugug

SEQ ID NO: 1709340 - RNA, 22 nt, Human
accguguuggucuguacugauu

SEQ ID NO: 1709341 - RNA, 16 nt, Human
accguguuggucugua

SEQ ID NO: 1709342 - RNA, 18 nt, Human
ucaggaacguuuagcuga

SEQ ID NO: 1709343 - RNA, 23 nt, Human
ucaggaacguuuagcugacaaaa

SEQ ID NO: 1709344 - RNA, 22 nt, Human
ucaggaacguuuagcugacaaa

SEQ ID NO: 1709345 - RNA, 13 nt, Human
accauugugcauu

SEQ ID NO: 1709346 - RNA, 14 nt, Human
accaguugcugcuu

SEQ ID NO: 1709347 - RNA, 19 nt, Human
uauuucaucauucacuuca

SEQ ID NO: 1709348 - RNA, 16 nt, Human
ugagcuacaaaugcau

SEQ ID NO: 1709349 - RNA, 14 nt, Human
ugagcuacaaaugc

SEQ ID NO: 1709350 - RNA, 13 nt, Human
ugagcuacaaaug

SEQ ID NO: 1709351 - RNA, 18 nt, Human
ugaggaacggaucagaug

SEQ ID NO: 1709352 - RNA, 22 nt, Human
ugagcacuguuuucuaguguau

SEQ ID NO: 1709353 - RNA, 14 nt, Human
ugagcacuguuuuc

SEQ ID NO: 1709354 - RNA, 15 nt, Human
ugagcacuguuuucu

SEQ ID NO: 1709355 - RNA, 21 nt, Human
ugagcacuguuuucuagugua

SEQ ID NO: 1709356 - RNA, 13 nt, Human
ugagcacuguuuu

SEQ ID NO: 1709357 - RNA, 22 nt, Human
ugacuugaagacuuacagcaaa

SEQ ID NO: 1709358 - RNA, 14 nt, Human
ugacaguaauugug

SEQ ID NO: 1709359 - RNA, 15 nt, Human
ugacaguaauugugu

SEQ ID NO: 1709360 - RNA, 20 nt, Human
ugacaguaauuguguuuaca

SEQ ID NO: 1709361 - RNA, 21 nt, Human
ugacaguaauuguguuuacau

SEQ ID NO: 1709362 - RNA, 22 nt, Human
ugacaguaauuguguuuacauu

SEQ ID NO: 1709363 - RNA, 21 nt, Human
agauguccaucagaugacaag

SEQ ID NO: 1709364 - RNA, 23 nt, Human
agauguccaucagaugacaagaa

SEQ ID NO: 1709365 - RNA, 14 nt, Human
agaugucuauauug

SEQ ID NO: 1709366 - RNA, 20 nt, Human
agauaaacguggauguuacu

SEQ ID NO: 1709367 - RNA, 16 nt, Human
ucuguuuuaaaaaccu

SEQ ID NO: 1709368 - RNA, 12 nt, Human
ucuguuccacau

SEQ ID NO: 1709369 - RNA, 22 nt, Human
ucuuccauauggauccacuggc

SEQ ID NO: 1709370 - RNA, 20 nt, Human
agaaaacaugcagaacaaau

SEQ ID NO: 1709371 - RNA, 18 nt, Human
ucucuucuuaauguacau

SEQ ID NO: 1709372 - RNA, 14 nt, Human
ucucuucuuaaugu

SEQ ID NO: 1709373 - RNA, 13 nt, Human
agaagcugcucaa

SEQ ID NO: 1709374 - RNA, 23 nt, Human
agaagcugcucaacuugcaaaau

SEQ ID NO: 1709375 - RNA, 23 nt, Human
ugcaucuccacuuggcauuagcu

SEQ ID NO: 1709376 - RNA, 18 nt, Human
ugcagaacaaaugaagac

SEQ ID NO: 1709377 - RNA, 14 nt, Human
ugcagaacaaauga

SEQ ID NO: 1709378 - RNA, 15 nt, Human
ugcagaacaaaugaa

SEQ ID NO: 1709379 - RNA, 19 nt, Human
agcuauggugucauaggcu

SEQ ID NO: 1709380 - RNA, 19 nt, Human
ugccacacgagaaccugaa

SEQ ID NO: 1709381 - RNA, 20 nt, Human
agcuuauguuaacugacaag

SEQ ID NO: 1709382 - RNA, 14 nt, Human
ugcucuguagccua

SEQ ID NO: 1709383 - RNA, 14 nt, Human
uggacaaaaugacu

SEQ ID NO: 1709384 - RNA, 18 nt, Human
ugggaaacaaaaggauaa

SEQ ID NO: 1709385 - RNA, 13 nt, Human
agggaaauuucag

SEQ ID NO: 1709386 - RNA, 21 nt, Human
agucuaccaaccuguucaagu

SEQ ID NO: 1709387 - RNA, 11 nt, Human
agucuaccaau

SEQ ID NO: 1709388 - RNA, 22 nt, Human
agguuuaugacaguaauugugu

SEQ ID NO: 1709389 - RNA, 22 nt, Human
uguacaaaaaaaucuuccaauu

SEQ ID NO: 1709390 - RNA, 17 nt, Human
uguacaaaaaaaucuuc

SEQ ID NO: 1709391 - RNA, 21 nt, Human
uguacaaaaaaaucuuccaau

SEQ ID NO: 1709392 - RNA, 21 nt, Human
uguacauagugcuaacaugaa

SEQ ID NO: 1709393 - RNA, 14 nt, Human
uguacauagugcua

SEQ ID NO: 1709394 - RNA, 17 nt, Human
uguacauagugcuaaca

SEQ ID NO: 1709395 - RNA, 19 nt, Human
uguacauagugcuaacaug

SEQ ID NO: 1709396 - RNA, 12 nt, Human
aguaauccugua

SEQ ID NO: 1709397 - RNA, 16 nt, Human
aguaauuguguuuaca

SEQ ID NO: 1709398 - RNA, 18 nt, Human
aguaauuguguuuacauu

SEQ ID NO: 1709399 - RNA, 21 nt, Human
aguaauuguguuuacauuuua

SEQ ID NO: 1709400 - RNA, 22 nt, Human
aguaauuguguuuacauuuuau

SEQ ID NO: 1709401 - RNA, 23 nt, Human
aguaauuguguuuacauuuuaug

SEQ ID NO: 1709402 - RNA, 21 nt, Human
aguaauaccucuaauaguaua

SEQ ID NO: 1709403 - RNA, 22 nt, Human
aguaauaccucuaauaguauaa

SEQ ID NO: 1709404 - RNA, 23 nt, Human
aguaauaccucuaauaguauaaa

SEQ ID NO: 1709405 - RNA, 20 nt, Human
aguaauaccucuaauaguau

SEQ ID NO: 1709406 - RNA, 20 nt, Human
uguacauagugcuaacauga

SEQ ID NO: 1709407 - RNA, 20 nt, Human
uguggguuuuuauuuccuau

SEQ ID NO: 1709408 - RNA, 15 nt, Human
agugguaucuugcag

SEQ ID NO: 1709409 - RNA, 16 nt, Human
agucuuucacauuuaa

SEQ ID NO: 1709410 - RNA, 18 nt, Human
agucuuucacauuuaaau

SEQ ID NO: 1709411 - RNA, 15 nt, Human
agugcaguuauuugc

SEQ ID NO: 1709412 - RNA, 17 nt, Human
agugcaguuauuugcuu

SEQ ID NO: 1709413 - RNA, 18 nt, Human
auagauaggucagugcaa

SEQ ID NO: 1709414 - RNA, 17 nt, Human
auagaccuuuucauuug

SEQ ID NO: 1709415 - RNA, 13 nt, Human
auagaaguaaaaa

SEQ ID NO: 1709416 - RNA, 14 nt, Human
auagaauguaaaug

SEQ ID NO: 1709417 - RNA, 15 nt, Human
auagaauguaaaugu

SEQ ID NO: 1709418 - RNA, 17 nt, Human
auagaauguaaaugucu

SEQ ID NO: 1709419 - RNA, 19 nt, Human
auagaauguaaaugucuca

SEQ ID NO: 1709420 - RNA, 20 nt, Human
auagaauguaaaugucucac

SEQ ID NO: 1709421 - RNA, 15 nt, Human
uuauuauauuuacaa

SEQ ID NO: 1709422 - RNA, 14 nt, Human
uuauuauauuuaca

SEQ ID NO: 1709423 - RNA, 14 nt, Human
uuauucauaugcau

SEQ ID NO: 1709424 - RNA, 16 nt, Human
uuauucauaugcauau

SEQ ID NO: 1709425 - RNA, 15 nt, Human
uuauucauaugcaua

SEQ ID NO: 1709426 - RNA, 17 nt, Human
auacugccacuaaccuu

SEQ ID NO: 1709427 - RNA, 13 nt, Human
uuaugacaguaau

SEQ ID NO: 1709428 - RNA, 15 nt, Human
uuaugacaguaauug

SEQ ID NO: 1709429 - RNA, 16 nt, Human
uuaugacaguaauugu

SEQ ID NO: 1709430 - RNA, 24 nt, Human
uuaugacaguaauuguguuuacau

SEQ ID NO: 1709431 - RNA, 11 nt, Human
uuaugaugugc

SEQ ID NO: 1709432 - RNA, 13 nt, Human
uuaugaugugcuu

SEQ ID NO: 1709433 - RNA, 14 nt, Human
uuaugaugugcuua

SEQ ID NO: 1709434 - RNA, 16 nt, Human
uuaugaugugcuuaac

SEQ ID NO: 1709435 - RNA, 17 nt, Human
uuaugaugugcuuaaca

SEQ ID NO: 1709436 - RNA, 18 nt, Human
uuaugaugugcuuaacag

SEQ ID NO: 1709437 - RNA, 13 nt, Human
auacaaguuucau

SEQ ID NO: 1709438 - RNA, 14 nt, Human
auacaaguuucauc

SEQ ID NO: 1709439 - RNA, 20 nt, Human
aguuuaaauuguaauaggcg

SEQ ID NO: 1709440 - RNA, 17 nt, Human
aguuuaaauuguaauag

SEQ ID NO: 1709441 - RNA, 19 nt, Human
uuaagaaugaucugauuga

SEQ ID NO: 1709442 - RNA, 15 nt, Human
uuaagaaugaucuga

SEQ ID NO: 1709443 - RNA, 13 nt, Human
uuaaucauauaaa

SEQ ID NO: 1709444 - RNA, 15 nt, Human
uuaaucauauaaaua

SEQ ID NO: 1709445 - RNA, 16 nt, Human
uuaaucauauaaauag

SEQ ID NO: 1709446 - RNA, 17 nt, Human
uuaaucauauaaauaga

SEQ ID NO: 1709447 - RNA, 19 nt, Human
uuaaucauauaaauagaau

SEQ ID NO: 1709448 - RNA, 24 nt, Human
uuacuccaaaacuucguuuaauga

SEQ ID NO: 1709449 - RNA, 14 nt, Human
uuaguaauaccucu

SEQ ID NO: 1709450 - RNA, 16 nt, Human
uuaguaauaccucuaa

SEQ ID NO: 1709451 - RNA, 17 nt, Human
uuaguaauaccucuaau

SEQ ID NO: 1709452 - RNA, 15 nt, Human
aucugccucucuugu

SEQ ID NO: 1709453 - RNA, 18 nt, Human
aucugccucucuuguaau

SEQ ID NO: 1709454 - RNA, 14 nt, Human
aucuuauaauuuaa

SEQ ID NO: 1709455 - RNA, 24 nt, Human
aucuugcaguaucggcacuguaca

SEQ ID NO: 1709456 - RNA, 21 nt, Human
aucuugcaguaucggcacugu

SEQ ID NO: 1709457 - RNA, 22 nt, Human
aucuugcaguaucggcacugua

SEQ ID NO: 1709458 - RNA, 13 nt, Human
aucuguuugagaa

SEQ ID NO: 1709459 - RNA, 14 nt, Human
aucuguuugagaaa

SEQ ID NO: 1709460 - RNA, 19 nt, Human
aucuguuugagaaagucag

SEQ ID NO: 1709461 - RNA, 15 nt, Human
aucuguuugagaaag

SEQ ID NO: 1709462 - RNA, 16 nt, Human
uugcucauauuuccca

SEQ ID NO: 1709463 - RNA, 21 nt, Human
augaaugcuuaaagaauucaa

SEQ ID NO: 1709464 - RNA, 20 nt, Human
augaaugcuuaaagaauuca

SEQ ID NO: 1709465 - RNA, 18 nt, Human
augaacuuguaaaggaau

SEQ ID NO: 1709466 - RNA, 19 nt, Human
augaagaccuuuuucugca

SEQ ID NO: 1709467 - RNA, 24 nt, Human
augaagaccuuuuucugcacuaua

SEQ ID NO: 1709468 - RNA, 21 nt, Human
augaagaccuuuuucugcacu

SEQ ID NO: 1709469 - RNA, 22 nt, Human
augaagaccuuuuucugcacua

SEQ ID NO: 1709470 - RNA, 13 nt, Human
augaaauuccauu

SEQ ID NO: 1709471 - RNA, 17 nt, Human
uugaagggaaauuucag

SEQ ID NO: 1709472 - RNA, 23 nt, Human
uugcauauaagggaaguaguuau

SEQ ID NO: 1709473 - RNA, 13 nt, Human
aucucuucuuaau

SEQ ID NO: 1709474 - RNA, 17 nt, Human
aucucuucuuaauguac

SEQ ID NO: 1709475 - RNA, 20 nt, Human
aucucuucuuaauguacaua

SEQ ID NO: 1709476 - RNA, 18 nt, Human
aucucuucuuaauguaca

SEQ ID NO: 1709477 - RNA, 19 nt, Human
aucucuucuuaauguacau

SEQ ID NO: 1709478 - RNA, 22 nt, Human
aucucuucuuaauguacauagu

SEQ ID NO: 1709479 - RNA, 22 nt, Human
aucaaauguuuaaucauauaaa

SEQ ID NO: 1709480 - RNA, 14 nt, Human
uuccugugcacagc

SEQ ID NO: 1709481 - RNA, 15 nt, Human
uuccugugcacagcc

SEQ ID NO: 1709482 - RNA, 19 nt, Human
uuccguagguuauuuucag

SEQ ID NO: 1709483 - RNA, 17 nt, Human
uugaaauuguauuacaa

SEQ ID NO: 1709484 - RNA, 14 nt, Human
aucauuuuauguca

SEQ ID NO: 1709485 - RNA, 23 nt, Human
aucauuuuaugucaagggcagcu

SEQ ID NO: 1709486 - RNA, 17 nt, Human
uuguucauauuaagaau

SEQ ID NO: 1709487 - RNA, 19 nt, Human
uuguucauauuaagaauga

SEQ ID NO: 1709488 - RNA, 18 nt, Human
uuuaaauauaugcuaagu

SEQ ID NO: 1709489 - RNA, 22 nt, Human
augucucacugagcacuguuuu

SEQ ID NO: 1709490 - RNA, 19 nt, Human
augucucacugagcacugu

SEQ ID NO: 1709491 - RNA, 20 nt, Human
augucucacugagcacuguu

SEQ ID NO: 1709492 - RNA, 14 nt, Human
augucucacugagc

SEQ ID NO: 1709493 - RNA, 15 nt, Human
augucucacugagca

SEQ ID NO: 1709494 - RNA, 18 nt, Human
augucucacugagcacug

SEQ ID NO: 1709495 - RNA, 15 nt, Human
auguacugcauuauu

SEQ ID NO: 1709496 - RNA, 13 nt, Human
auguacugcauua

SEQ ID NO: 1709497 - RNA, 20 nt, Human
auguacugcauuauuugaga

SEQ ID NO: 1709498 - RNA, 18 nt, Human
auguaaaugucucacuga

SEQ ID NO: 1709499 - RNA, 19 nt, Human
auguaaaugucucacugag

SEQ ID NO: 1709500 - RNA, 23 nt, Human
auguaaaugucucacugagcacu

SEQ ID NO: 1709501 - RNA, 21 nt, Human
auguaaaugucucacugagca

SEQ ID NO: 1709502 - RNA, 16 nt, Human
auggugccuaguauug

SEQ ID NO: 1709503 - RNA, 19 nt, Human
auggugccuaguauugaca

SEQ ID NO: 1709504 - RNA, 21 nt, Human
auggugccuaguauugacaaa

SEQ ID NO: 1709505 - RNA, 20 nt, Human
auggugccuaguauugacaa

SEQ ID NO: 1709506 - RNA, 14 nt, Human
uuucugcacuauau

SEQ ID NO: 1709507 - RNA, 17 nt, Human
uuucugcacuauaugca

SEQ ID NO: 1709508 - RNA, 23 nt, Human
uuucuuuuuacccauuuguucau

SEQ ID NO: 1709509 - RNA, 13 nt, Human
auuauuugagaag

SEQ ID NO: 1709510 - RNA, 21 nt, Human
auuauuugagaagcugcucaa

SEQ ID NO: 1709511 - RNA, 15 nt, Human
auuauauuuacaaau

SEQ ID NO: 1709512 - RNA, 16 nt, Human
auuuuuuagugacuaa

SEQ ID NO: 1709513 - RNA, 22 nt, Human
auuuuugugauuuugugauuga

SEQ ID NO: 1709514 - RNA, 15 nt, Human
auuuucuauaauuua

SEQ ID NO: 1709515 - RNA, 14 nt, Human
auuuucuauaauuu

SEQ ID NO: 1709516 - RNA, 19 nt, Human
auuggacaguaaaauccac

SEQ ID NO: 1709517 - RNA, 20 nt, Human
auuucuugagguaaaagcau

SEQ ID NO: 1709518 - RNA, 15 nt, Human
auuucccuacauuaa

SEQ ID NO: 1709519 - RNA, 17 nt, Human
auuucccuacauuaaac

SEQ ID NO: 1709520 - RNA, 20 nt, Human
auuucccuacauuaaacaug

SEQ ID NO: 1709521 - RNA, 16 nt, Human
gccuaguauugacaaa

SEQ ID NO: 1709522 - RNA, 14 nt, Human
gccuaguauugaca

SEQ ID NO: 1709523 - RNA, 12 nt, Human
gcuuauguuaac

SEQ ID NO: 1709524 - RNA, 20 nt, Human
ggcagacauugugcuagugc

SEQ ID NO: 1709525 - RNA, 13 nt, Human
ggcacuguacaaa

SEQ ID NO: 1709526 - RNA, 21 nt, Human
aaaacaugcagaacaaaugaa

SEQ ID NO: 1709527 - RNA, 23 nt, Human
aaaacaugcagaacaaaugaaga

SEQ ID NO: 1709528 - RNA, 20 nt, Human
aaaacuucguuuaaugaaug

SEQ ID NO: 1709529 - RNA, 11 nt, Human
aaaaccuguuc

SEQ ID NO: 1709530 - RNA, 23 nt, Human
aaaaccuguucaagucuaccaac

SEQ ID NO: 1709531 - RNA, 22 nt, Human
aaaaccuuccaugucaagauuc

SEQ ID NO: 1709532 - RNA, 14 nt, Human
aaaaauaacaauga

SEQ ID NO: 1709533 - RNA, 13 nt, Human
aaagacagugaaa

SEQ ID NO: 1709534 - RNA, 20 nt, Human
aaacaggguaacuaacuaaa

SEQ ID NO: 1709535 - RNA, 12 nt, Human
aaacaauaccug

SEQ ID NO: 1709536 - RNA, 15 nt, Human
aaaauguuauuuccc

SEQ ID NO: 1709537 - RNA, 16 nt, Human
aaaauguuauuucccu

SEQ ID NO: 1709538 - RNA, 20 nt, Human
guaauaggcguaacuaauuu

SEQ ID NO: 1709539 - RNA, 18 nt, Human
guaauuuggaucucuucu

SEQ ID NO: 1709540 - RNA, 17 nt, Human
guaauuguguuuacauu

SEQ ID NO: 1709541 - RNA, 18 nt, Human
guaauuguguuuacauuu

SEQ ID NO: 1709542 - RNA, 20 nt, Human
guaauuguguuuacauuuua

SEQ ID NO: 1709543 - RNA, 13 nt, Human
guaauuguguuua

SEQ ID NO: 1709544 - RNA, 15 nt, Human
guaauuguguuuaca

SEQ ID NO: 1709545 - RNA, 17 nt, Human
aaaucauuuuaugucaa

SEQ ID NO: 1709546 - RNA, 14 nt, Human
aaaucauuuuaugu

SEQ ID NO: 1709547 - RNA, 15 nt, Human
aaaucauuuuauguc

SEQ ID NO: 1709548 - RNA, 17 nt, Human
guaccaaccauccaauu

SEQ ID NO: 1709549 - RNA, 23 nt, Human
guacuguaugaucaaauguuuaa

SEQ ID NO: 1709550 - RNA, 18 nt, Human
guacuguaugaucaaaug

SEQ ID NO: 1709551 - RNA, 20 nt, Human
guacuguaugaucaaauguu

SEQ ID NO: 1709552 - RNA, 21 nt, Human
guacuguaugaucaaauguuu

SEQ ID NO: 1709553 - RNA, 22 nt, Human
guacuguaugaucaaauguuua

SEQ ID NO: 1709554 - RNA, 14 nt, Human
guacuguaugauca

SEQ ID NO: 1709555 - RNA, 17 nt, Human
guacuguaugaucaaau

SEQ ID NO: 1709556 - RNA, 15 nt, Human
guacugcauuauuug

SEQ ID NO: 1709557 - RNA, 16 nt, Human
guacugauucaauuug

SEQ ID NO: 1709558 - RNA, 15 nt, Human
guacugauucaauuu

SEQ ID NO: 1709559 - RNA, 13 nt, Human
guacugcauuauu

SEQ ID NO: 1709560 - RNA, 22 nt, Human
gacaguaauuguguuuacauuu

SEQ ID NO: 1709561 - RNA, 20 nt, Human
gacaguaauuguguuuacau

SEQ ID NO: 1709562 - RNA, 15 nt, Human
gacaguaauuguguu

SEQ ID NO: 1709563 - RNA, 18 nt, Human
gacaguaauuguguuuac

SEQ ID NO: 1709564 - RNA, 19 nt, Human
gacaguaauuguguuuaca

SEQ ID NO: 1709565 - RNA, 21 nt, Human
gacacucgaggucgggcagca

SEQ ID NO: 1709566 - RNA, 13 nt, Human
gagaagcugcuca

SEQ ID NO: 1709567 - RNA, 22 nt, Human
gagaagcugcucaacuugcaaa

SEQ ID NO: 1709568 - RNA, 21 nt, Human
gauuuuuuuuuuuuuccuguc

SEQ ID NO: 1709569 - RNA, 17 nt, Human
gcaauacaaguuucauc

SEQ ID NO: 1709570 - RNA, 18 nt, Human
gcacacagaggggaguca

SEQ ID NO: 1709571 - RNA, 14 nt, Human
gcacuauaugcaaa

SEQ ID NO: 1709572 - RNA, 15 nt, Human
gcacuauaugcaaac

SEQ ID NO: 1709573 - RNA, 18 nt, Human
gcacuauaugcaaacagg

SEQ ID NO: 1709574 - RNA, 15 nt, Human
gcacucuucauggug

SEQ ID NO: 1709575 - RNA, 13 nt, Human
gcacucuucaugg

SEQ ID NO: 1709576 - RNA, 16 nt, Human
cuuggguagcgcacuc

SEQ ID NO: 1709577 - RNA, 20 nt, Human
cuucucacauuuauauuuuu

SEQ ID NO: 1709578 - RNA, 13 nt, Human
cuucucacauuua

SEQ ID NO: 1709579 - RNA, 18 nt, Human
cuucuuaauguacauagu

SEQ ID NO: 1709580 - RNA, 20 nt, Human
cuucuuaauguacauagugc

SEQ ID NO: 1709581 - RNA, 15 nt, Human
cuucuuaauguacau

SEQ ID NO: 1709582 - RNA, 16 nt, Human
cuucuuaauguacaua

SEQ ID NO: 1709583 - RNA, 15 nt, Human
cuugcaaaaucaguu

SEQ ID NO: 1709584 - RNA, 16 nt, Human
cuugcaaaaucaguuu

SEQ ID NO: 1709585 - RNA, 17 nt, Human
cuugcaaaaucaguuuu

SEQ ID NO: 1709586 - RNA, 22 nt, Human
cuugcaaaaucaguuuuccucu

SEQ ID NO: 1709587 - RNA, 23 nt, Human
cuugaagguauaucuagguuuau

SEQ ID NO: 1709588 - RNA, 13 nt, Human
gaacaaaugaaga

SEQ ID NO: 1709589 - RNA, 14 nt, Human
gaagaccuuuuucu

SEQ ID NO: 1709590 - RNA, 17 nt, Human
gaagaccuuuuucugca

SEQ ID NO: 1709591 - RNA, 21 nt, Human
gaagaccuuuuucugcacuau

SEQ ID NO: 1709592 - RNA, 21 nt, Human
cuuagcauuuucugcaucucc

SEQ ID NO: 1709593 - RNA, 19 nt, Human
cuuagcauuuucugcaucu

SEQ ID NO: 1709594 - RNA, 14 nt, Human
cuguacugauucaa

SEQ ID NO: 1709595 - RNA, 17 nt, Human
cuguacugauucaauuu

SEQ ID NO: 1709596 - RNA, 21 nt, Human
cuguacugauucaauuugaug

SEQ ID NO: 1709597 - RNA, 20 nt, Human
cuguacugaaguaaaacaaa

SEQ ID NO: 1709598 - RNA, 19 nt, Human
cuguacugaaguaaaacaa

SEQ ID NO: 1709599 - RNA, 13 nt, Human
cuguacugauuca

SEQ ID NO: 1709600 - RNA, 15 nt, Human
cauuccuugcugaaa

SEQ ID NO: 1709601 - RNA, 14 nt, Human
caugucaagauuca

SEQ ID NO: 1709602 - RNA, 17 nt, Human
caugucaagauucagcu

SEQ ID NO: 1709603 - RNA, 19 nt, Human
caugucaagauucagcuag

SEQ ID NO: 1709604 - RNA, 18 nt, Human
cagugccaggaacccuua

SEQ ID NO: 1709605 - RNA, 22 nt, Human
auuguguuuacauuuuauggug

SEQ ID NO: 1709606 - RNA, 12 nt, Human
auuguguuuaca

SEQ ID NO: 1709607 - RNA, 23 nt, Human
auuguguuuacauuuuauggugc

SEQ ID NO: 1709608 - RNA, 14 nt, Human
auuguguuuacauu

SEQ ID NO: 1709609 - RNA, 15 nt, Human
auuguguuuacauuu

SEQ ID NO: 1709610 - RNA, 18 nt, Human
auuguguuuacauuuuau

SEQ ID NO: 1709611 - RNA, 19 nt, Human
auuguguuuacauuuuaug

SEQ ID NO: 1709612 - RNA, 13 nt, Human
auucaaauuuuau

SEQ ID NO: 1709613 - RNA, 22 nt, Human
auuuuauggugccuaguauuga

SEQ ID NO: 1709614 - RNA, 21 nt, Human
caaaaggauaaugaauacuuu

SEQ ID NO: 1709615 - RNA, 14 nt, Human
caaccauccaauua

SEQ ID NO: 1709616 - RNA, 22 nt, Human
caaagucaggaaucaucaggaa

SEQ ID NO: 1709617 - RNA, 18 nt, Human
caaagucaggaaucauca

SEQ ID NO: 1709618 - RNA, 19 nt, Human
caaaugaagacaaaacaua

SEQ ID NO: 1709619 - RNA, 14 nt, Human
cacucuucauggug

SEQ ID NO: 1709620 - RNA, 21 nt, Human
cacuguuuucuaguguaucaa

SEQ ID NO: 1709621 - RNA, 23 nt, Human
cacuguuuucuaguguaucaaaa

SEQ ID NO: 1709622 - RNA, 14 nt, Human
cacuguuuucuagu

SEQ ID NO: 1709623 - RNA, 16 nt, Human
cacuguuuucuagugu

SEQ ID NO: 1709624 - RNA, 17 nt, Human
cacuguuuucuagugua

SEQ ID NO: 1709625 - RNA, 13 nt, Human
caaguuucaucca

SEQ ID NO: 1709626 - RNA, 20 nt, Human
caaguuucauccagaacuac

SEQ ID NO: 1709627 - RNA, 16 nt, Human
caaguuucauccagaa

SEQ ID NO: 1709628 - RNA, 13 nt, Human
caauaaaauuaua

SEQ ID NO: 1709629 - RNA, 20 nt, Human
caauaaaauuauagcucuaa

SEQ ID NO: 1709630 - RNA, 20 nt, Human
cuaguuccccuguuuauuca

SEQ ID NO: 1709631 - RNA, 21 nt, Human
cuaguuccccuguuuauucau

SEQ ID NO: 1709632 - RNA, 22 nt, Human
cgcaucuaguuccccuguuuau

SEQ ID NO: 1709633 - RNA, 22 nt, Human
cgaggucgggcagcacaagugu

SEQ ID NO: 1709634 - RNA, 18 nt, Human
cucgguauaguuuuguca

SEQ ID NO: 1709635 - RNA, 19 nt, Human
cuccauagaccuuuucauu

SEQ ID NO: 1709636 - RNA, 21 nt, Human
ccaguugcugcuucaauuuau

SEQ ID NO: 1709637 - RNA, 19 nt, Human
ccaguucuucgacuguugu

SEQ ID NO: 1709638 - RNA, 14 nt, Human
ccuggauuugcaua

SEQ ID NO: 1709639 - RNA, 15 nt, Human
ccauuuguucauauu

SEQ ID NO: 1709640 - RNA, 20 nt, Human
ccauuuguucauauuaagaa

SEQ ID NO: 1709641 - RNA, 16 nt, Human
ccauuuguucauauua

SEQ ID NO: 1709642 - RNA, 22 nt, Human
ccauuugaauuuuuuagugacu

SEQ ID NO: 1709643 - RNA, 20 nt, Human
ccauuaaguaaacaauaaaa

SEQ ID NO: 1709644 - RNA, 16 nt, Human
ccauauggauccacug

SEQ ID NO: 1709645 - RNA, 22 nt, Human
ccagcaccggccccauuuaccc

SEQ ID NO: 1709646 - RNA, 17 nt, Human
ccccaccccaaaauuag

SEQ ID NO: 1709647 - RNA, 15 nt, Human
cccauucaagauucc

SEQ ID NO: 1709648 - RNA, 16 nt, Human
cccaugauuucaugua

SEQ ID NO: 1709649 - RNA, 17 nt, Human
cccaugauuucauguac

SEQ ID NO: 1709650 - RNA, 19 nt, Human
cccaugauuucauguacug

SEQ ID NO: 1709651 - RNA, 20 nt, Human
cccuuaaacaguugcacagc

SEQ ID NO: 1709652 - RNA, 21 nt, Human
cccuuaaacaguugcacagca

SEQ ID NO: 1709653 - RNA, 22 nt, Human
cccuuaaacaguugcacagcau

SEQ ID NO: 1709654 - RNA, 20 nt, Human
cuaaacuccaaacauccucu

SEQ ID NO: 1709655 - RNA, 19 nt, Human
cuaaacuccaaacauccuc

SEQ ID NO: 1709656 - RNA, 21 nt, Human
cuaagcuucacuguaaaauaa

SEQ ID NO: 1709657 - RNA, 17 nt, Human
cuaauacagcugagcua

SEQ ID NO: 1709658 - RNA, 14 nt, Human
cuaauaguauaaac

SEQ ID NO: 1709659 - RNA, 23 nt, Human
cuacacgagauacagaauuuuau

SEQ ID NO: 1709660 - RNA, 18 nt, Human
cuacauuaaacaugacuc

SEQ ID NO: 1709661 - RNA, 16 nt, Human
cuaccaaccuguucaa

SEQ ID NO: 1709662 - RNA, 16 nt, Human
cuaugauguauacugc

SEQ ID NO: 1709663 - RNA, 13 nt, Human
cuaugauguauac

SEQ ID NO: 1709664 - RNA, 14 nt, Human
cuaugauguauacu

SEQ ID NO: 1709665 - RNA, 20 nt, Human
cuaugauguauacugccacu

SEQ ID NO: 1709666 - RNA, 13 nt, Human
cuauaauuuaaau

SEQ ID NO: 1709667 - RNA, 12 nt, Human
cuauaauuuaaa

SEQ ID NO: 1709668 - RNA, 18 nt, Human
cuccauuuaaacagaugu

SEQ ID NO: 1709669 - RNA, 15 nt, Human
cucccauucaagauu

SEQ ID NO: 1709670 - RNA, 21 nt, Human
cucagcucaucuucacugcac

SEQ ID NO: 1709671 - RNA, 13 nt, Human
ccuuugugaaaaa

SEQ ID NO: 1709672 - RNA, 11 nt, Human
ccuaugaugua

SEQ ID NO: 1709673 - RNA, 14 nt, Human
ccuaugauguauac

SEQ ID NO: 1709674 - RNA, 15 nt, Human
ccuaugauguauacu

SEQ ID NO: 1709675 - RNA, 18 nt, Human
ccuaugauguauacugcc

SEQ ID NO: 1709676 - RNA, 17 nt, Human
ccugucauacuuuguua

SEQ ID NO: 1709677 - RNA, 19 nt, Human
ccuguaggaagguacugua

SEQ ID NO: 1709678 - RNA, 18 nt, Human
gaaaaucuuauaauuuaa

SEQ ID NO: 1709679 - RNA, 13 nt, Human
cuuuuucugcacu

SEQ ID NO: 1709680 - RNA, 14 nt, Human
cuuuuucugcacua

SEQ ID NO: 1709681 - RNA, 16 nt, Human
cuuuuucugcacuaua

SEQ ID NO: 1709682 - RNA, 20 nt, Human
cuuuuucugcacuauaugca

SEQ ID NO: 1709683 - RNA, 22 nt, Human
cuuuuucugcacuauaugcaaa

SEQ ID NO: 1709684 - RNA, 17 nt, Human
cuuguacuuuauuuucu

SEQ ID NO: 1709685 - RNA, 19 nt, Human
cuugaguuuaaauuguaau

SEQ ID NO: 1709686 - RNA, 23 nt, Human
cuuuauggcagacauugugcuag

SEQ ID NO: 1709687 - RNA, 16 nt, Human
cuuugucacuguuuca

SEQ ID NO: 1709688 - RNA, 17 nt, Human
cuuugcucauauuuccc

SEQ ID NO: 1709689 - RNA, 19 nt, Human
cuuagugcaguuauuugcu

SEQ ID NO: 1709690 - RNA, 18 nt, Human
cuuauuucaucauucacu

SEQ ID NO: 1709691 - RNA, 15 nt, Human
cuuauuucaucauuc

SEQ ID NO: 1709692 - RNA, 17 nt, Human
cuucaauccuugaaggu

SEQ ID NO: 1709693 - RNA, 15 nt, Human
cuucaauuuauaccu

SEQ ID NO: 1709694 - RNA, 19 nt, Human
cuguaugaucaaauguuua

SEQ ID NO: 1709695 - RNA, 21 nt, Human
cuguaugaucaaauguuuaau

SEQ ID NO: 1709696 - RNA, 13 nt, Human
cuguaugaucaaa

SEQ ID NO: 1709697 - RNA, 14 nt, Human
cuguaugaucaaau

SEQ ID NO: 1709698 - RNA, 15 nt, Human
cuguaugaucaaaug

SEQ ID NO: 1709699 - RNA, 16 nt, Human
cuguaugaucaaaugu

SEQ ID NO: 1709700 - RNA, 17 nt, Human
cuguaugaucaaauguu

SEQ ID NO: 1709701 - RNA, 18 nt, Human
cuguaugaucaaauguuu

SEQ ID NO: 1709702 - RNA, 18 nt, Human
cuguccgagugugccaca

SEQ ID NO: 1709703 - RNA, 23 nt, Human
cuguacaaaaaaaucuuccaauu

SEQ ID NO: 1709704 - RNA, 11 nt, Human
cugugcacagc

SEQ ID NO: 1709705 - RNA, 12 nt, Human
cugugcacagcc

SEQ ID NO: 1709706 - RNA, 13 nt, Human
cugugcacagccc

SEQ ID NO: 1709707 - RNA, 13 nt, Human
cugugcuguuguu

SEQ ID NO: 1709708 - RNA, 17 nt, Human
cugugcuguuguuauga

SEQ ID NO: 1709709 - RNA, 19 nt, Human
cugugcuguuguuaugaug

SEQ ID NO: 1709710 - RNA, 21 nt, Human
cugugcuguuguuaugaugug

SEQ ID NO: 1709711 - RNA, 16 nt, Human
cugccucucuuguaau

SEQ ID NO: 1709712 - RNA, 16 nt, Human
gacuugaagacuuaca

SEQ ID NO: 1709713 - RNA, 23 nt, Human
gaaugcuuaaagaauucaaauuu

SEQ ID NO: 1709714 - RNA, 21 nt, Human
gaaugcuuaaagaauucaaau

SEQ ID NO: 1709715 - RNA, 16 nt, Human
gacaaggaaaaaauaa

SEQ ID NO: 1709716 - RNA, 22 nt, Human
gacaagaaaggcugcuguacug

SEQ ID NO: 1709717 - RNA, 22 nt, Human
gacaauuagauaaauguccauu

SEQ ID NO: 1709718 - RNA, 15 nt, Human
gcaaauuggagaaaa

SEQ ID NO: 1709719 - RNA, 14 nt, Human
gcaaauuggagaaa

SEQ ID NO: 1709720 - RNA, 16 nt, Human
gauucaauuugaugug

SEQ ID NO: 1709721 - RNA, 14 nt, Human
gauguggugaaaag

SEQ ID NO: 1709722 - RNA, 17 nt, Human
gauguuacuccaaaacu

SEQ ID NO: 1709723 - RNA, 22 nt, Human
gcaccaguugcugcuucaauuu

SEQ ID NO: 1709724 - RNA, 20 nt, Human
gauaaaucauuuuaugucaa

SEQ ID NO: 1709725 - RNA, 13 nt, Human
gauaaaucauuuu

SEQ ID NO: 1709726 - RNA, 14 nt, Human
gauaaaucauuuua

SEQ ID NO: 1709727 - RNA, 11 nt, Human
ggacaaaauga

SEQ ID NO: 1709728 - RNA, 11 nt, Human
ggacaaacugc

SEQ ID NO: 1709729 - RNA, 19 nt, Human
ggaaguaguuaucauguua

SEQ ID NO: 1709730 - RNA, 13 nt, Human
ggaaguaguuauc

SEQ ID NO: 1709731 - RNA, 16 nt, Human
ggaaguaguuaucaug

SEQ ID NO: 1709732 - RNA, 19 nt, Human
ggaagguacuguaugauca

SEQ ID NO: 1709733 - RNA, 20 nt, Human
gcuccauuuuuagugaaaua

SEQ ID NO: 1709734 - RNA, 19 nt, Human
gcuccauuuaaacagaugu

SEQ ID NO: 1709735 - RNA, 16 nt, Human
gcuccauuuaaacaga

SEQ ID NO: 1709736 - RNA, 23 nt, Human
gcuccauuuaaacagauguccau

SEQ ID NO: 1709737 - RNA, 13 nt, Human
gcuaacaugaaga

SEQ ID NO: 1709738 - RNA, 22 nt, Human
gcuaacaugaagaccuuuuucu

SEQ ID NO: 1709739 - RNA, 23 nt, Human
guacuuuauuuucuauaauuuaa

SEQ ID NO: 1709740 - RNA, 14 nt, Human
guaaugaauaccuu

SEQ ID NO: 1709741 - RNA, 22 nt, Human
guacauagugcuaacaugaaga

SEQ ID NO: 1709742 - RNA, 17 nt, Human
guaaaugucucacugag

SEQ ID NO: 1709743 - RNA, 19 nt, Human
guaaaugucucacugagca

SEQ ID NO: 1709744 - RNA, 19 nt, Human
guaaaacaaacaauaccug

SEQ ID NO: 1709745 - RNA, 14 nt, Human
gguuuuuauuuccu

SEQ ID NO: 1709746 - RNA, 17 nt, Human
ggugccuaguauugaca

SEQ ID NO: 1709747 - RNA, 19 nt, Human
ggugccuaguauugacaaa

SEQ ID NO: 1709748 - RNA, 17 nt, Human
gguacuguaugaucaaa

SEQ ID NO: 1709749 - RNA, 18 nt, Human
gguacuguaugaucaaau

SEQ ID NO: 1709750 - RNA, 20 nt, Human
gguacuguaugaucaaaugu

SEQ ID NO: 1709751 - RNA, 21 nt, Human
gguacuguaugaucaaauguu

SEQ ID NO: 1709752 - RNA, 16 nt, Human
ggggcagcagcagugg

SEQ ID NO: 1709753 - RNA, 15 nt, Human
gucaagauucagcua

SEQ ID NO: 1709754 - RNA, 16 nt, Human
gucaagauucagcuag

SEQ ID NO: 1709755 - RNA, 19 nt, Human
gucaagauucagcuagugg

SEQ ID NO: 1709756 - RNA, 15 nt, Human
gucuaccaauuauaa

SEQ ID NO: 1709757 - RNA, 22 nt, Human
gucuacauaacuaauacagcug

SEQ ID NO: 1709758 - RNA, 19 nt, Human
gugaaagaaaauaacaaua

SEQ ID NO: 1709759 - RNA, 14 nt, Human
gugagcuacaaaug

SEQ ID NO: 1709760 - RNA, 22 nt, Human
gugcuguuguuaugaugugcuu

SEQ ID NO: 1709761 - RNA, 19 nt, Human
gugcuguuguuaugaugug

SEQ ID NO: 1709762 - RNA, 20 nt, Human
gugcuguuguuaugaugugc

SEQ ID NO: 1709763 - RNA, 14 nt, Human
gugcuguuguuaug

SEQ ID NO: 1709764 - RNA, 15 nt, Human
gugcuguuguuauga

SEQ ID NO: 1709765 - RNA, 17 nt, Human
gugcuguuguuaugaug

SEQ ID NO: 1709766 - RNA, 20 nt, Human
uaucugccucucuuguaauu

SEQ ID NO: 1709767 - RNA, 21 nt, Human
uaucugccucucuuguaauuu

SEQ ID NO: 1709768 - RNA, 16 nt, Human
uaucugccucucuugu

SEQ ID NO: 1709769 - RNA, 23 nt, Human
uaugacaguaauuguguuuacau

SEQ ID NO: 1709770 - RNA, 15 nt, Human
uaugacaguaauugu

SEQ ID NO: 1709771 - RNA, 17 nt, Human
uaugacaguaauugugu

SEQ ID NO: 1709772 - RNA, 18 nt, Human
uaugacaguaauuguguu

SEQ ID NO: 1709773 - RNA, 22 nt, Human
uaugacaguaauuguguuuaca

SEQ ID NO: 1709774 - RNA, 19 nt, Human
uaucuguuugagaaaguca

SEQ ID NO: 1709775 - RNA, 15 nt, Human
uaucuguuugagaaa

SEQ ID NO: 1709776 - RNA, 16 nt, Human
uaucuguuugagaaag

SEQ ID NO: 1709777 - RNA, 20 nt, Human
uaugcuuauauuguucacuu

SEQ ID NO: 1709778 - RNA, 21 nt, Human
uaugauuagcuuugucacugu

SEQ ID NO: 1709779 - RNA, 16 nt, Human
uaugcaaacaggguaa

SEQ ID NO: 1709780 - RNA, 15 nt, Human
uagugcuaacaugaa

SEQ ID NO: 1709781 - RNA, 16 nt, Human
uagugcaguuauuugc

SEQ ID NO: 1709782 - RNA, 16 nt, Human
uaggucagugcaaaua

SEQ ID NO: 1709783 - RNA, 19 nt, Human
ucaacucuugaguuuuuca

SEQ ID NO: 1709784 - RNA, 20 nt, Human
ucaaauguuuaaucauauaa

SEQ ID NO: 1709785 - RNA, 17 nt, Human
ucaaauguuuaaucaua

SEQ ID NO: 1709786 - RNA, 18 nt, Human
ucaaauguuuaaucauau

SEQ ID NO: 1709787 - RNA, 12 nt, Human
ucaaauguuuaa

SEQ ID NO: 1709788 - RNA, 14 nt, Human
ucaaauguuuaauc

SEQ ID NO: 1709789 - RNA, 15 nt, Human
ucaaauguuuaauca

SEQ ID NO: 1709790 - RNA, 19 nt, Human
uauuugagaagcugcucaa

SEQ ID NO: 1709791 - RNA, 12 nt, Human
ucacauuuaaau

SEQ ID NO: 1709792 - RNA, 20 nt, Human
uauugcaaagucaggaauca

SEQ ID NO: 1709793 - RNA, 14 nt, Human
uauugcaaagucag

SEQ ID NO: 1709794 - RNA, 14 nt, Human
uauuaugauuagcu

SEQ ID NO: 1709795 - RNA, 17 nt, Human
uauuauauuuacaaaug

SEQ ID NO: 1709796 - RNA, 17 nt, Human
ucaucauucacuucacu

SEQ ID NO: 1709797 - RNA, 19 nt, Human
ucaucauucacuucacugu

SEQ ID NO: 1709798 - RNA, 21 nt, Human
ucaucauucacuucacugugc

SEQ ID NO: 1709799 - RNA, 22 nt, Human
ucaucauucacuucacugugcu

SEQ ID NO: 1709800 - RNA, 23 nt, Human
ucaucauucacuucacugugcug

SEQ ID NO: 1709801 - RNA, 14 nt, Human
uccaaacauccucu

SEQ ID NO: 1709802 - RNA, 22 nt, Human
ucaggaaucaucaggaacguuu

SEQ ID NO: 1709803 - RNA, 21 nt, Human
uccaguucuucgacuguuguu

SEQ ID NO: 1709804 - RNA, 19 nt, Human
uccaguucuucgacuguug

SEQ ID NO: 1709805 - RNA, 23 nt, Human
uccaguucuucgacuguuguuau

SEQ ID NO: 1709806 - RNA, 20 nt, Human
uccaugggccauaugaaaag

SEQ ID NO: 1709807 - RNA, 17 nt, Human
uccauagaccuuuucau

SEQ ID NO: 1709808 - RNA, 16 nt, Human
uccaucagaugacaag

SEQ ID NO: 1709809 - RNA, 15 nt, Human
ucggcacuguacaaa

SEQ ID NO: 1709810 - RNA, 23 nt, Human
ugacaagaaaggcugcuguacug

SEQ ID NO: 1709811 - RNA, 22 nt, Human
ugacaagaaaggcugcuguacu

SEQ ID NO: 1709812 - RNA, 21 nt, Human
ugacaagcuccauuuaaacag

SEQ ID NO: 1709813 - RNA, 18 nt, Human
ugacaagcuccauuuaaa

SEQ ID NO: 1709814 - RNA, 21 nt, Human
ucuugcaguaucggcacugua

SEQ ID NO: 1709815 - RNA, 20 nt, Human
ucuugcaguaucggcacugu

SEQ ID NO: 1709816 - RNA, 12 nt, Human
ucuuugccaagu

SEQ ID NO: 1709817 - RNA, 16 nt, Human
ugaaauuccauuugua

SEQ ID NO: 1709818 - RNA, 15 nt, Human
ugaaauuccauuugu

SEQ ID NO: 1709819 - RNA, 20 nt, Human
ugaaaagcuccauuuuuagu

SEQ ID NO: 1709820 - RNA, 22 nt, Human
ugaaaagcagguugauaaauca

SEQ ID NO: 1709821 - RNA, 18 nt, Human
ugaaaagcagguugauaa

SEQ ID NO: 1709822 - RNA, 19 nt, Human
ugaaaagcagguugauaaa

SEQ ID NO: 1709823 - RNA, 16 nt, Human
ugagcaguguuagcuu

SEQ ID NO: 1709824 - RNA, 20 nt, Human
ugaugcuacaggauuugaaa

SEQ ID NO: 1709825 - RNA, 23 nt, Human
ugaugcuacaggauuugaaauug

SEQ ID NO: 1709826 - RNA, 16 nt, Human
ugauguggugaaaagc

SEQ ID NO: 1709827 - RNA, 21 nt, Human
ugauugaccguguuggucugu

SEQ ID NO: 1709828 - RNA, 13 nt, Human
ugauuauauguca

SEQ ID NO: 1709829 - RNA, 19 nt, Human
ugauuagcuuugucacugu

SEQ ID NO: 1709830 - RNA, 22 nt, Human
ugauuagugaaaggaagauaaa

SEQ ID NO: 1709831 - RNA, 14 nt, Human
ugauucaauuugau

SEQ ID NO: 1709832 - RNA, 16 nt, Human
ugauucaauuugaugu

SEQ ID NO: 1709833 - RNA, 19 nt, Human
ugauucaauuugauguggu

SEQ ID NO: 1709834 - RNA, 13 nt, Human
ugcugcuucaauu

SEQ ID NO: 1709835 - RNA, 14 nt, Human
ugcugcuucaauuu

SEQ ID NO: 1709836 - RNA, 17 nt, Human
ugcuaacaugaagaccu

SEQ ID NO: 1709837 - RNA, 19 nt, Human
ugcuaacaugaagaccuuu

SEQ ID NO: 1709838 - RNA, 14 nt, Human
ugcucauauuuccc

SEQ ID NO: 1709839 - RNA, 15 nt, Human
ugcucauauuuccca

SEQ ID NO: 1709840 - RNA, 22 nt, Human
ugcucauauuucccaugauuuc

SEQ ID NO: 1709841 - RNA, 24 nt, Human
ugcucauauuucccaugauuucau

SEQ ID NO: 1709842 - RNA, 14 nt, Human
ugcaguuauuugcu

SEQ ID NO: 1709843 - RNA, 16 nt, Human
ugccuaguauugacaa

SEQ ID NO: 1709844 - RNA, 17 nt, Human
ugccuaguauugacaaa

SEQ ID NO: 1709845 - RNA, 18 nt, Human
ugccuaguauugacaaaa

SEQ ID NO: 1709846 - RNA, 22 nt, Human
ugccuaguauugacaaaauguu

SEQ ID NO: 1709847 - RNA, 21 nt, Human
ugccuaguauugacaaaaugu

SEQ ID NO: 1709848 - RNA, 19 nt, Human
uggaucucuucuuaaugua

SEQ ID NO: 1709849 - RNA, 20 nt, Human
uggaucucuucuuaauguac

SEQ ID NO: 1709850 - RNA, 21 nt, Human
uggaucucuucuuaauguaca

SEQ ID NO: 1709851 - RNA, 23 nt, Human
uggaucucuucuuaauguacaua

SEQ ID NO: 1709852 - RNA, 22 nt, Human
uggaucucuucuuaauguacau

SEQ ID NO: 1709853 - RNA, 15 nt, Human
ugcuguuguuaugau

SEQ ID NO: 1709854 - RNA, 16 nt, Human
ugcuguuguuaugaug

SEQ ID NO: 1709855 - RNA, 17 nt, Human
ugcuguuguuaugaugu

SEQ ID NO: 1709856 - RNA, 18 nt, Human
ugcuguuguuaugaugug

SEQ ID NO: 1709857 - RNA, 19 nt, Human
ugcuguuguuaugaugugc

SEQ ID NO: 1709858 - RNA, 20 nt, Human
ugcuguuguuaugaugugcu

SEQ ID NO: 1709859 - RNA, 22 nt, Human
ugcuguuguuaugaugugcuua

SEQ ID NO: 1709860 - RNA, 23 nt, Human
ugcuguuguuaugaugugcuuaa

SEQ ID NO: 1709861 - RNA, 18 nt, Human
uuaauguacauagugcua

SEQ ID NO: 1709862 - RNA, 17 nt, Human
uuaauguacauagugcu

SEQ ID NO: 1709863 - RNA, 20 nt, Human
uuaacugacaagcuccauuu

SEQ ID NO: 1709864 - RNA, 15 nt, Human
uuaaagaauucaaau

SEQ ID NO: 1709865 - RNA, 17 nt, Human
uuaaagaauucaaauuu

SEQ ID NO: 1709866 - RNA, 19 nt, Human
uuaaagaauucaaauuuua

SEQ ID NO: 1709867 - RNA, 14 nt, Human
uuaaagaauucaaa

SEQ ID NO: 1709868 - RNA, 20 nt, Human
uuaaagaauucaaauuuuau

SEQ ID NO: 1709869 - RNA, 17 nt, Human
uguuucacuacucagca

SEQ ID NO: 1709870 - RNA, 12 nt, Human
uuagcugacaaa

SEQ ID NO: 1709871 - RNA, 18 nt, Human
uuagcugacaaaauacuu

SEQ ID NO: 1709872 - RNA, 15 nt, Human
uuagcugacaaaaua

SEQ ID NO: 1709873 - RNA, 17 nt, Human
uuagcuuauguuaacug

SEQ ID NO: 1709874 - RNA, 16 nt, Human
uuagcuuugucacugu

SEQ ID NO: 1709875 - RNA, 12 nt, Human
uuagcuuuguca

SEQ ID NO: 1709876 - RNA, 17 nt, Human
uuaguauugcaaaguca

SEQ ID NO: 1709877 - RNA, 11 nt, Human
uuaguauugca

SEQ ID NO: 1709878 - RNA, 13 nt, Human
uuaguauugcaaa

SEQ ID NO: 1709879 - RNA, 13 nt, Human
uuacuuaguauug

SEQ ID NO: 1709880 - RNA, 15 nt, Human
uuacuuaguauugca

SEQ ID NO: 1709881 - RNA, 19 nt, Human
uuacuuaguauugcaaagu

SEQ ID NO: 1709882 - RNA, 18 nt, Human
uuccuaugauguauacug

SEQ ID NO: 1709883 - RNA, 21 nt, Human
uuccuaugauguauacugcca

SEQ ID NO: 1709884 - RNA, 14 nt, Human
uuccuaugauguau

SEQ ID NO: 1709885 - RNA, 16 nt, Human
uucguuuaaugaaugc

SEQ ID NO: 1709886 - RNA, 18 nt, Human
uuccucccauucaagauu

SEQ ID NO: 1709887 - RNA, 13 nt, Human
uucccaugauuuc

SEQ ID NO: 1709888 - RNA, 18 nt, Human
uucccaugauuucaugua

SEQ ID NO: 1709889 - RNA, 20 nt, Human
uucccaugauuucauguacu

SEQ ID NO: 1709890 - RNA, 21 nt, Human
uucccaugauuucauguacug

SEQ ID NO: 1709891 - RNA, 22 nt, Human
uucccaugauuucauguacugc

SEQ ID NO: 1709892 - RNA, 18 nt, Human
uuaucugccucucuugua

SEQ ID NO: 1709893 - RNA, 21 nt, Human
uuaucugccucucuuguaauu

SEQ ID NO: 1709894 - RNA, 12 nt, Human
uuaguuccugug

SEQ ID NO: 1709895 - RNA, 15 nt, Human
uuaguuccugugcac

SEQ ID NO: 1709896 - RNA, 18 nt, Human
uuaguuccugugcacagc

SEQ ID NO: 1709897 - RNA, 15 nt, Human
uucacuacucagcau

SEQ ID NO: 1709898 - RNA, 15 nt, Human
uucaauuuauaccuc

SEQ ID NO: 1709899 - RNA, 15 nt, Human
uucaauuugaugugg

SEQ ID NO: 1709900 - RNA, 22 nt, Human
uucaauuugauguggugaaaag

SEQ ID NO: 1709901 - RNA, 16 nt, Human
uucaauuugauguggu

SEQ ID NO: 1709902 - RNA, 16 nt, Human
uucaauuuauaccuca

SEQ ID NO: 1709903 - RNA, 14 nt, Human
uucacuacucagca

SEQ ID NO: 1709904 - RNA, 21 nt, Human
uuugaaauuguauuacaaauc

SEQ ID NO: 1709905 - RNA, 19 nt, Human
uuugcuuucgguuccaguu

SEQ ID NO: 1709906 - RNA, 16 nt, Human
uuuccacuucuucauu

SEQ ID NO: 1709907 - RNA, 15 nt, Human
uuuccacuucuucau

SEQ ID NO: 1709908 - RNA, 19 nt, Human
uuuaugacaguaauugugu

SEQ ID NO: 1709909 - RNA, 15 nt, Human
uuuaugacaguaauu

SEQ ID NO: 1709910 - RNA, 16 nt, Human
uuuaugacaguaauug

SEQ ID NO: 1709911 - RNA, 14 nt, Human
uuuaugacaguaau

SEQ ID NO: 1709912 - RNA, 20 nt, Human
uuuaucugccucucuuguaa

SEQ ID NO: 1709913 - RNA, 14 nt, Human
uuuaucugccucuc

SEQ ID NO: 1709914 - RNA, 19 nt, Human
uuuaucugccucucuugua

SEQ ID NO: 1709915 - RNA, 21 nt, Human
uuuaucugccucucuuguaau

SEQ ID NO: 1709916 - RNA, 22 nt, Human
uuuauaccucaauuuucacugu

SEQ ID NO: 1709917 - RNA, 19 nt, Human
uuuaguuccugugcacagc

SEQ ID NO: 1709918 - RNA, 13 nt, Human
uuuaguuccugug

SEQ ID NO: 1709919 - RNA, 12 nt, Human
uuuaguuccugu

SEQ ID NO: 1709920 - RNA, 12 nt, Human
uuuaaucauaua

SEQ ID NO: 1709921 - RNA, 13 nt, Human
uuuaaucauauaa

SEQ ID NO: 1709922 - RNA, 12 nt, Human
uuuaaaaugucu

SEQ ID NO: 1709923 - RNA, 23 nt, Human
uuuaaacagauguccaucagaug

SEQ ID NO: 1709924 - RNA, 14 nt, Human
uuuaaacagauguc

SEQ ID NO: 1709925 - RNA, 20 nt, Human
uuggucuguacugauucaau

SEQ ID NO: 1709926 - RNA, 14 nt, Human
uuggucuguacuga

SEQ ID NO: 1709927 - RNA, 16 nt, Human
uuggucuguacugauu

SEQ ID NO: 1709928 - RNA, 13 nt, Human
uuggacaaaauga

SEQ ID NO: 1709929 - RNA, 21 nt, Human
uugaaaaucuuauaauuuaaa

SEQ ID NO: 1709930 - RNA, 20 nt, Human
uuuguggguuuuuauuuccu

SEQ ID NO: 1709931 - RNA, 15 nt, Human
caaauuuuaucugcc

SEQ ID NO: 1709932 - RNA, 13 nt, Human
caaacaauaccug

SEQ ID NO: 1709933 - RNA, 15 nt, Human
caaacaauaccugaa

SEQ ID NO: 1709934 - RNA, 22 nt, Human
caaacaauaccugaaugcucug

SEQ ID NO: 1709935 - RNA, 21 nt, Human
caaaauacuugucuguuuuaa

SEQ ID NO: 1709936 - RNA, 20 nt, Human
caaaauacuugucuguuuua

SEQ ID NO: 1709937 - RNA, 16 nt, Human
caaaaucaguuuuccu

SEQ ID NO: 1709938 - RNA, 12 nt, Human
caaaaucaguuu

SEQ ID NO: 1709939 - RNA, 15 nt, Human
cacaaguguaaugaa

SEQ ID NO: 1709940 - RNA, 17 nt, Human
cacaaguguaaugaaua

SEQ ID NO: 1709941 - RNA, 16 nt, Human
caauuagcuuauguua

SEQ ID NO: 1709942 - RNA, 20 nt, Human
caaggaaaaaauaacaauga

SEQ ID NO: 1709943 - RNA, 18 nt, Human
caaggaaaaaauaacaau

SEQ ID NO: 1709944 - RNA, 19 nt, Human
caauaccugaaugcucugu

SEQ ID NO: 1709945 - RNA, 17 nt, Human
caauaccugaaugcucu

SEQ ID NO: 1709946 - RNA, 22 nt, Human
auggauccacuggcuggacaaa

SEQ ID NO: 1709947 - RNA, 18 nt, Human
augauguauacugccacu

SEQ ID NO: 1709948 - RNA, 14 nt, Human
aucuucaauccuug

SEQ ID NO: 1709949 - RNA, 22 nt, Human
aucuuccaauuuaguuguugua

SEQ ID NO: 1709950 - RNA, 17 nt, Human
aucuaguuccccuguuu

SEQ ID NO: 1709951 - RNA, 22 nt, Human
aucuaguuccccuguuuauuca

SEQ ID NO: 1709952 - RNA, 23 nt, Human
aucuaguuccccuguuuauucau

SEQ ID NO: 1709953 - RNA, 19 nt, Human
aucuaguuccccuguuuau

SEQ ID NO: 1709954 - RNA, 20 nt, Human
aucuaguuccccuguuuauu

SEQ ID NO: 1709955 - RNA, 21 nt, Human
aucuagguuuaugacaguaau

SEQ ID NO: 1709956 - RNA, 22 nt, Human
aucuagguuuaugacaguaauu

SEQ ID NO: 1709957 - RNA, 23 nt, Human
aucuagguuuaugacaguaauug

SEQ ID NO: 1709958 - RNA, 14 nt, Human
aucuagguuuauga

SEQ ID NO: 1709959 - RNA, 15 nt, Human
aucuagguuuaugac

SEQ ID NO: 1709960 - RNA, 18 nt, Human
aucuagguuuaugacagu

SEQ ID NO: 1709961 - RNA, 23 nt, Human
aucaaaaugcucuuauuucauca

SEQ ID NO: 1709962 - RNA, 20 nt, Human
aucaaaaugcucuuauuuca

SEQ ID NO: 1709963 - RNA, 21 nt, Human
aucaaaaugcucuuauuucau

SEQ ID NO: 1709964 - RNA, 15 nt, Human
aucaaaaugcucuua

SEQ ID NO: 1709965 - RNA, 19 nt, Human
aucaaaaugcucuuauuuc

SEQ ID NO: 1709966 - RNA, 19 nt, Human
auauuucccaugauuucau

SEQ ID NO: 1709967 - RNA, 21 nt, Human
auauuucccaugauuucaugu

SEQ ID NO: 1709968 - RNA, 13 nt, Human
aucaggaacguuu

SEQ ID NO: 1709969 - RNA, 23 nt, Human
aucaggaacguuuagcugacaaa

SEQ ID NO: 1709970 - RNA, 19 nt, Human
auccucaguuuuugugaaa

SEQ ID NO: 1709971 - RNA, 16 nt, Human
auccuugaagguauau

SEQ ID NO: 1709972 - RNA, 23 nt, Human
auccuugaagguauaucuagguu

SEQ ID NO: 1709973 - RNA, 18 nt, Human
auauuucccaugauuuca

SEQ ID NO: 1709974 - RNA, 22 nt, Human
auauuucccaugauuucaugua

SEQ ID NO: 1709975 - RNA, 13 nt, Human
auacuugucuguu

SEQ ID NO: 1709976 - RNA, 16 nt, Human
auacuugucuguuuua

SEQ ID NO: 1709977 - RNA, 14 nt, Human
auaacaaugaaagu

SEQ ID NO: 1709978 - RNA, 19 nt, Human
auaagggcaaauuggagaa

SEQ ID NO: 1709979 - RNA, 12 nt, Human
auaagggaagua

SEQ ID NO: 1709980 - RNA, 22 nt, Human
auaagggaaguaguuaucaugu

SEQ ID NO: 1709981 - RNA, 23 nt, Human
auaagggaaguaguuaucauguu

SEQ ID NO: 1709982 - RNA, 22 nt, Human
agugacuaaaccauugugcauu

SEQ ID NO: 1709983 - RNA, 16 nt, Human
agugacuaaaccauug

SEQ ID NO: 1709984 - RNA, 17 nt, Human
agugacuaaaccauugu

SEQ ID NO: 1709985 - RNA, 15 nt, Human
aguaucggcacugua

SEQ ID NO: 1709986 - RNA, 16 nt, Human
aguaucggcacuguac

SEQ ID NO: 1709987 - RNA, 19 nt, Human
aguaucggcacuguacaaa

SEQ ID NO: 1709988 - RNA, 17 nt, Human
agaugaaauuccauuug

SEQ ID NO: 1709989 - RNA, 18 nt, Human
agaugaaauuccauuugu

SEQ ID NO: 1709990 - RNA, 12 nt, Human
agauucuugcau

SEQ ID NO: 1709991 - RNA, 21 nt, Human
agcacaaguguaaugaauacc

SEQ ID NO: 1709992 - RNA, 18 nt, Human
agcacuguuuucuagugu

SEQ ID NO: 1709993 - RNA, 20 nt, Human
agcacuguuuucuaguguau

SEQ ID NO: 1709994 - RNA, 22 nt, Human
agcacuguuuucuaguguauca

SEQ ID NO: 1709995 - RNA, 17 nt, Human
agggcaaauuggagaaa

SEQ ID NO: 1709996 - RNA, 11 nt, Human
agguacuguau

SEQ ID NO: 1709997 - RNA, 18 nt, Human
agcuucacuguaaaauaa

SEQ ID NO: 1709998 - RNA, 20 nt, Human
aggaaucaucaggaacguuu

SEQ ID NO: 1709999 - RNA, 21 nt, Human
aaaauuacuuaguauugcaaa

SEQ ID NO: 1710000 - RNA, 23 nt, Human
aaaauuacuuaguauugcaaagu

SEQ ID NO: 1710001 - RNA, 17 nt, Human
aaaauuagccaguaauc

SEQ ID NO: 1710002 - RNA, 19 nt, Human
aaaauuagccaguaauccu

SEQ ID NO: 1710003 - RNA, 22 nt, Human
aaaauuacuuaguauugcaaag

SEQ ID NO: 1710004 - RNA, 21 nt, Human
aaaauuagccaguaauccugu

SEQ ID NO: 1710005 - RNA, 15 nt, Human
aaaauuauagcucua

SEQ ID NO: 1710006 - RNA, 19 nt, Human
aaaauuauagcucuaaugu

SEQ ID NO: 1710007 - RNA, 24 nt, Human
aaaauuauagcucuaauguuugca

SEQ ID NO: 1710008 - RNA, 20 nt, Human
aaaccccaccccaaaauuag

SEQ ID NO: 1710009 - RNA, 18 nt, Human
aaagucagauucuugcau

SEQ ID NO: 1710010 - RNA, 15 nt, Human
aaagucaggaaucau

SEQ ID NO: 1710011 - RNA, 23 nt, Human
aacccuuaaacaguugcacagca

SEQ ID NO: 1710012 - RNA, 18 nt, Human
aacccuuaaacaguugca

SEQ ID NO: 1710013 - RNA, 22 nt, Human
aacccuuaaacaguugcacagc

SEQ ID NO: 1710014 - RNA, 15 nt, Human
aacaaacaauaccug

SEQ ID NO: 1710015 - RNA, 14 nt, Human
aacaaaugaagaca

SEQ ID NO: 1710016 - RNA, 12 nt, Human
aacaaaugaaga

SEQ ID NO: 1710017 - RNA, 19 nt, Human
aaaugcucuuauuucauca

SEQ ID NO: 1710018 - RNA, 23 nt, Human
aaaugcucuuauuucaucauuca

SEQ ID NO: 1710019 - RNA, 20 nt, Human
aaguggggcagcagcagugg

SEQ ID NO: 1710020 - RNA, 13 nt, Human
aaguaguuaucau

SEQ ID NO: 1710021 - RNA, 15 nt, Human
aaguaguuaucaugu

SEQ ID NO: 1710022 - RNA, 17 nt, Human
aaguaguuaucauguua

SEQ ID NO: 1710023 - RNA, 19 nt, Human
aaguaguuaucauguuagu

SEQ ID NO: 1710024 - RNA, 18 nt, Human
aaguaguuaucauguuag

SEQ ID NO: 1710025 - RNA, 21 nt, Human
aauaugcuuauauuguucacu

SEQ ID NO: 1710026 - RNA, 19 nt, Human
aauaccuuagugcaguuau

SEQ ID NO: 1710027 - RNA, 14 nt, Human
aaugcucuuauuuc

SEQ ID NO: 1710028 - RNA, 16 nt, Human
aaugcucuuauuucau

SEQ ID NO: 1710029 - RNA, 13 nt, Human
aaucauuuuaugu

SEQ ID NO: 1710030 - RNA, 18 nt, Human
aagggcaaauuggagaaa

SEQ ID NO: 1710031 - RNA, 19 nt, Human
aagggcagcuuugcucaua

SEQ ID NO: 1710032 - RNA, 20 nt, Human
aagggcagcuuugcucauau

SEQ ID NO: 1710033 - RNA, 23 nt, Human
aagacagugaaagaaaauaacaa

SEQ ID NO: 1710034 - RNA, 13 nt, Human
aagauucagcuag

SEQ ID NO: 1710035 - RNA, 14 nt, Human
aagauucagcuagu

SEQ ID NO: 1710036 - RNA, 15 nt, Human
aagauucagcuagug

SEQ ID NO: 1710037 - RNA, 16 nt, Human
acauccucuuccauau

SEQ ID NO: 1710038 - RNA, 21 nt, Human
acaauuagauaaauguccauu

SEQ ID NO: 1710039 - RNA, 14 nt, Human
aauuuucacugugu

SEQ ID NO: 1710040 - RNA, 14 nt, Human
acugauucaauuug

SEQ ID NO: 1710041 - RNA, 11 nt, Human
acuuucaaucu

SEQ ID NO: 1710042 - RNA, 20 nt, Human
acuuucaaucuucaauccuu

SEQ ID NO: 1710043 - RNA, 21 nt, Human
acccuuaaacaguugcacagc

SEQ ID NO: 1710044 - RNA, 23 nt, Human
acccuuaaacaguugcacagcau

SEQ ID NO: 1710045 - RNA, 22 nt, Human
acuaaccuuccaaaaauuacuu

SEQ ID NO: 1710046 - RNA, 22 nt, Human
acuaacuaaaacaaagccacuu

SEQ ID NO: 1710047 - RNA, 14 nt, Human
acuaacuaaaacaa

SEQ ID NO: 1710048 - RNA, 15 nt, Human
acuaacuaaaacaaa

SEQ ID NO: 1710049 - RNA, 11 nt, Human
gugcacagccc

SEQ ID NO: 1710050 - RNA, 14 nt, Human
gugcacagccccua

SEQ ID NO: 1710051 - RNA, 20 nt, Human
aacugcaccaguugcugcuu

SEQ ID NO: 1710052 - RNA, 20 nt, Human
aacugcaauacaaguuucau

SEQ ID NO: 1710053 - RNA, 16 nt, Human
aaccauugugcauucu

SEQ ID NO: 1710054 - RNA, 13 nt, Human
aaccauugugcau

SEQ ID NO: 1710055 - RNA, 22 nt, Human
aacaguugcacagcaucucagc

SEQ ID NO: 1710056 - RNA, 15 nt, Human
aacaguugcacagca

SEQ ID NO: 1710057 - RNA, 17 nt, Human
aacaguugcacagcauc

SEQ ID NO: 1710058 - RNA, 18 nt, Human
aacaguugcacagcaucu

SEQ ID NO: 1710059 - RNA, 20 nt, Human
aacaguugcacagcaucuca

SEQ ID NO: 1710060 - RNA, 14 nt, Human
aacaguugcacagc

SEQ ID NO: 1710061 - RNA, 16 nt, Human
gucuguacugauucaa

SEQ ID NO: 1710062 - RNA, 16 nt, Human
gucuuucacauuuaaa

SEQ ID NO: 1710063 - RNA, 17 nt, Human
aacuaccaccugacauu

SEQ ID NO: 1710064 - RNA, 22 nt, Human
guaucaaaaugcucuuauuuca

SEQ ID NO: 1710065 - RNA, 13 nt, Human
guaucaaaaugcu

SEQ ID NO: 1710066 - RNA, 14 nt, Human
guaucaaaaugcuc

SEQ ID NO: 1710067 - RNA, 19 nt, Human
aacaauaaaaguguccauu

SEQ ID NO: 1710068 - RNA, 12 nt, Human
aacaauaaaaga

SEQ ID NO: 1710069 - RNA, 23 nt, Human
aaauuuuaucugccucucuugua

SEQ ID NO: 1710070 - RNA, 17 nt, Human
aacaagaugaaauucca

SEQ ID NO: 1710071 - RNA, 17 nt, Human
guuuaaucauauaaaua

SEQ ID NO: 1710072 - RNA, 19 nt, Human
guuuaaucauauaaauaga

SEQ ID NO: 1710073 - RNA, 15 nt, Human
guuuaaugaaugcuu

SEQ ID NO: 1710074 - RNA, 18 nt, Human
guuuaaugaaugcuuaaa

SEQ ID NO: 1710075 - RNA, 23 nt, Human
aaggcucuguuccacauauauuu

SEQ ID NO: 1710076 - RNA, 16 nt, Human
aagucuuucacauuua

SEQ ID NO: 1710077 - RNA, 22 nt, Human
uaaaaccuuccaugucaagauu

SEQ ID NO: 1710078 - RNA, 20 nt, Human
uaaaagacagugaaagaaaa

SEQ ID NO: 1710079 - RNA, 18 nt, Human
uaaaaguguccauugaaa

SEQ ID NO: 1710080 - RNA, 16 nt, Human
uaaaaguguccauuga

SEQ ID NO: 1710081 - RNA, 14 nt, Human
aagcagguugauaa

SEQ ID NO: 1710082 - RNA, 15 nt, Human
aagcagguugauaaa

SEQ ID NO: 1710083 - RNA, 19 nt, Human
aagcagguugauaaaucau

SEQ ID NO: 1710084 - RNA, 18 nt, Human
guuauuaugauuagcuuu

SEQ ID NO: 1710085 - RNA, 15 nt, Human
aagaccuuuuucugc

SEQ ID NO: 1710086 - RNA, 16 nt, Human
aagaccuuuuucugca

SEQ ID NO: 1710087 - RNA, 20 nt, Human
aagaccuuuuucugcacuau

SEQ ID NO: 1710088 - RNA, 18 nt, Human
aagaccuuuuucugcacu

SEQ ID NO: 1710089 - RNA, 14 nt, Human
aacuugcaaaauca

SEQ ID NO: 1710090 - RNA, 17 nt, Human
aacuugcaaaaucaguu

SEQ ID NO: 1710091 - RNA, 18 nt, Human
aacuugcaaaaucaguuu

SEQ ID NO: 1710092 - RNA, 19 nt, Human
aacuugcaaaaucaguuuu

SEQ ID NO: 1710093 - RNA, 20 nt, Human
uaacuaaaacaaagccacuu

SEQ ID NO: 1710094 - RNA, 17 nt, Human
uaacuaaaacaaagcca

SEQ ID NO: 1710095 - RNA, 17 nt, Human
aauaccugaaugcucug

SEQ ID NO: 1710096 - RNA, 18 nt, Human
aauaccugaaugcucugu

SEQ ID NO: 1710097 - RNA, 15 nt, Human
aauaccucuaauagu

SEQ ID NO: 1710098 - RNA, 14 nt, Human
aaucaguuuuccuc

SEQ ID NO: 1710099 - RNA, 22 nt, Human
uaauuccguagguuauuuucag

SEQ ID NO: 1710100 - RNA, 14 nt, Human
aauguuauuucccu

SEQ ID NO: 1710101 - RNA, 16 nt, Human
uaccugaaugcucugu

SEQ ID NO: 1710102 - RNA, 14 nt, Human
uaccugaaugcucu

SEQ ID NO: 1710103 - RNA, 13 nt, Human
aauuacuuaguau

SEQ ID NO: 1710104 - RNA, 17 nt, Human
aauuacuuaguauugca

SEQ ID NO: 1710105 - RNA, 23 nt, Human
uauagcucuaauguuugcauaua

SEQ ID NO: 1710106 - RNA, 20 nt, Human
uauagcucuaauguuugcau

SEQ ID NO: 1710107 - RNA, 18 nt, Human
uauaucuagguuuaugac

SEQ ID NO: 1710108 - RNA, 22 nt, Human
uauaucuagguuuaugacagua

SEQ ID NO: 1710109 - RNA, 20 nt, Human
uaugaucaaauguuuaauca

SEQ ID NO: 1710110 - RNA, 22 nt, Human
uaugaucaaauguuuaaucaua

SEQ ID NO: 1710111 - RNA, 14 nt, Human
uaugaucaaauguu

SEQ ID NO: 1710112 - RNA, 15 nt, Human
uaugaucaaauguuu

SEQ ID NO: 1710113 - RNA, 16 nt, Human
uaugaucaaauguuua

SEQ ID NO: 1710114 - RNA, 18 nt, Human
uaugaucaaauguuuaau

SEQ ID NO: 1710115 - RNA, 12 nt, Human
uaugaucaaaug

SEQ ID NO: 1710116 - RNA, 13 nt, Human
uaugaucaaaugu

SEQ ID NO: 1710117 - RNA, 17 nt, Human
uauggugccuaguauug

SEQ ID NO: 1710118 - RNA, 19 nt, Human
uauggugccuaguauugac

SEQ ID NO: 1710119 - RNA, 18 nt, Human
uauggugccuaguauuga

SEQ ID NO: 1710120 - RNA, 23 nt, Human
aauuuggaucucuucuuaaugua

SEQ ID NO: 1710121 - RNA, 22 nt, Human
aauuuggaucucuucuuaaugu

SEQ ID NO: 1710122 - RNA, 16 nt, Human
uagcgcacucuucaug

SEQ ID NO: 1710123 - RNA, 20 nt, Human
uccaauuagcuuauguuaac

SEQ ID NO: 1710124 - RNA, 17 nt, Human
uccaauuagcuuauguu

SEQ ID NO: 1710125 - RNA, 16 nt, Human
ucauaauaaguugcau

SEQ ID NO: 1710126 - RNA, 13 nt, Human
uccauuuaaacag

SEQ ID NO: 1710127 - RNA, 14 nt, Human
uccauuuaaacaga

SEQ ID NO: 1710128 - RNA, 15 nt, Human
uccauuuaaacagau

SEQ ID NO: 1710129 - RNA, 18 nt, Human
uccauuuaaacagauguc

SEQ ID NO: 1710130 - RNA, 21 nt, Human
uccauuuaaacagauguccau

SEQ ID NO: 1710131 - RNA, 18 nt, Human
acaugacuccauagaccu

SEQ ID NO: 1710132 - RNA, 20 nt, Human
acaugacuccauagaccuuu

SEQ ID NO: 1710133 - RNA, 20 nt, Human
acauuuuauggugccuagua

SEQ ID NO: 1710134 - RNA, 18 nt, Human
ucaagagugguaucuugc

SEQ ID NO: 1710135 - RNA, 13 nt, Human
ucagauucuugca

SEQ ID NO: 1710136 - RNA, 14 nt, Human
ucagauucuugcau

SEQ ID NO: 1710137 - RNA, 21 nt, Human
ucacuucacugugcuguuguu

SEQ ID NO: 1710138 - RNA, 14 nt, Human
ucacuucacugugc

SEQ ID NO: 1710139 - RNA, 15 nt, Human
ucacuucacugugcu

SEQ ID NO: 1710140 - RNA, 12 nt, Human
ucacuucacugu

SEQ ID NO: 1710141 - RNA, 19 nt, Human
ucacugagcacuguuuucu

SEQ ID NO: 1710142 - RNA, 16 nt, Human
ucacugagcacuguuu

SEQ ID NO: 1710143 - RNA, 18 nt, Human
ucacugagcacuguuuuc

SEQ ID NO: 1710144 - RNA, 22 nt, Human
ucacugagcacuguuuucuagu

SEQ ID NO: 1710145 - RNA, 14 nt, Human
ucacugagcacugu

SEQ ID NO: 1710146 - RNA, 15 nt, Human
ucacugagcacuguu

SEQ ID NO: 1710147 - RNA, 21 nt, Human
ucuaguuccccuguuuauuca

SEQ ID NO: 1710148 - RNA, 17 nt, Human
ucuaguuccccuguuua

SEQ ID NO: 1710149 - RNA, 22 nt, Human
ucuaguguaucaaaaugcucuu

SEQ ID NO: 1710150 - RNA, 19 nt, Human
ucuaguguaucaaaaugcu

SEQ ID NO: 1710151 - RNA, 12 nt, Human
ucuaguguauca

SEQ ID NO: 1710152 - RNA, 13 nt, Human
ucuaguguaucaa

SEQ ID NO: 1710153 - RNA, 14 nt, Human
ucuaguguaucaaa

SEQ ID NO: 1710154 - RNA, 16 nt, Human
ucuaguguaucaaaau

SEQ ID NO: 1710155 - RNA, 13 nt, Human
ucuauaauuuaaa

SEQ ID NO: 1710156 - RNA, 21 nt, Human
acuuagcauuuucugcaucuc

SEQ ID NO: 1710157 - RNA, 20 nt, Human
acuuagcauuuucugcaucu

SEQ ID NO: 1710158 - RNA, 22 nt, Human
acuuagcauuuucugcaucucc

SEQ ID NO: 1710159 - RNA, 13 nt, Human
acuguaugaucaa

SEQ ID NO: 1710160 - RNA, 14 nt, Human
acuguaugaucaaa

SEQ ID NO: 1710161 - RNA, 15 nt, Human
acuguaugaucaaau

SEQ ID NO: 1710162 - RNA, 16 nt, Human
acuguaugaucaaaug

SEQ ID NO: 1710163 - RNA, 17 nt, Human
acuguaugaucaaaugu

SEQ ID NO: 1710164 - RNA, 18 nt, Human
acuguaugaucaaauguu

SEQ ID NO: 1710165 - RNA, 19 nt, Human
acuguaugaucaaauguuu

SEQ ID NO: 1710166 - RNA, 22 nt, Human
acuguaugaucaaauguuuaau

SEQ ID NO: 1710167 - RNA, 20 nt, Human
acuguaugaucaaauguuua

SEQ ID NO: 1710168 - RNA, 21 nt, Human
acuguaugaucaaauguuuaa

SEQ ID NO: 1710169 - RNA, 24 nt, Human
acuguaugaucaaauguuuaauca

SEQ ID NO: 1710170 - RNA, 14 nt, Human
ucguuuaaugaaug

SEQ ID NO: 1710171 - RNA, 18 nt, Human
ucguuuaaugaaugcuua

SEQ ID NO: 1710172 - RNA, 20 nt, Human
ucguuuaaugaaugcuuaaa

SEQ ID NO: 1710173 - RNA, 13 nt, Human
acuugucuguuuu

SEQ ID NO: 1710174 - RNA, 12 nt, Human
acuugucuguuu

SEQ ID NO: 1710175 - RNA, 13 nt, Human
agaaaucuauuuc

SEQ ID NO: 1710176 - RNA, 18 nt, Human
ucucuuguaauuuggauc

SEQ ID NO: 1710177 - RNA, 18 nt, Human
agaacuaccaccugacau

SEQ ID NO: 1710178 - RNA, 20 nt, Human
ugaaaaucuuauaauuuaaa

SEQ ID NO: 1710179 - RNA, 15 nt, Human
ugaaacgcaucuagu

SEQ ID NO: 1710180 - RNA, 16 nt, Human
ucuucaagaucccauu

SEQ ID NO: 1710181 - RNA, 15 nt, Human
ugaauacuuuauaaa

SEQ ID NO: 1710182 - RNA, 16 nt, Human
ugaauaccuuagugca

SEQ ID NO: 1710183 - RNA, 21 nt, Human
ugaauaccuuagugcaguuau

SEQ ID NO: 1710184 - RNA, 22 nt, Human
ugaauaccuuagugcaguuauu

SEQ ID NO: 1710185 - RNA, 15 nt, Human
ugaagguauaucuag

SEQ ID NO: 1710186 - RNA, 22 nt, Human
ugacaaaauacuugucuguuuu

SEQ ID NO: 1710187 - RNA, 12 nt, Human
ugacaaaauguu

SEQ ID NO: 1710188 - RNA, 13 nt, Human
ugacaaaauguua

SEQ ID NO: 1710189 - RNA, 14 nt, Human
ugacaaaauguuau

SEQ ID NO: 1710190 - RNA, 15 nt, Human
ugacaaaauguuauu

SEQ ID NO: 1710191 - RNA, 20 nt, Human
ugacaaaauguuauuucccu

SEQ ID NO: 1710192 - RNA, 15 nt, Human
agaugcagugccagg

SEQ ID NO: 1710193 - RNA, 20 nt, Human
agauuaaccuucucuguccg

SEQ ID NO: 1710194 - RNA, 21 nt, Human
ugacuccauagaccuuuucau

SEQ ID NO: 1710195 - RNA, 17 nt, Human
ugacuccauagaccuuu

SEQ ID NO: 1710196 - RNA, 20 nt, Human
agcaucacaugaacuuguaa

SEQ ID NO: 1710197 - RNA, 13 nt, Human
ugaucaaauguuu

SEQ ID NO: 1710198 - RNA, 14 nt, Human
ugaucaaauguuua

SEQ ID NO: 1710199 - RNA, 15 nt, Human
ugaucaaauguuuaa

SEQ ID NO: 1710200 - RNA, 16 nt, Human
ugaucaaauguuuaau

SEQ ID NO: 1710201 - RNA, 17 nt, Human
ugaucaaauguuuaauc

SEQ ID NO: 1710202 - RNA, 18 nt, Human
ugaucaaauguuuaauca

SEQ ID NO: 1710203 - RNA, 22 nt, Human
ugaucaaauguuuaaucauaua

SEQ ID NO: 1710204 - RNA, 19 nt, Human
ugaucaaauguuuaaucau

SEQ ID NO: 1710205 - RNA, 20 nt, Human
agcaugucgucaaagcugaa

SEQ ID NO: 1710206 - RNA, 17 nt, Human
agcaugucgucaaagcu

SEQ ID NO: 1710207 - RNA, 22 nt, Human
ugaguaacugauuuguaacaag

SEQ ID NO: 1710208 - RNA, 20 nt, Human
agccacuuucaaucuucaau

SEQ ID NO: 1710209 - RNA, 23 nt, Human
agccacuuucaaucuucaauccu

SEQ ID NO: 1710210 - RNA, 13 nt, Human
ugaugauccauua

SEQ ID NO: 1710211 - RNA, 13 nt, Human
agccaguaauccu

SEQ ID NO: 1710212 - RNA, 14 nt, Human
agccaguaauccug

SEQ ID NO: 1710213 - RNA, 15 nt, Human
agccaguaauccugu

SEQ ID NO: 1710214 - RNA, 20 nt, Human
ugcauacauucuucaagauc

SEQ ID NO: 1710215 - RNA, 19 nt, Human
agcuacuaauuuuaaaaug

SEQ ID NO: 1710216 - RNA, 16 nt, Human
agcucaucuucacugc

SEQ ID NO: 1710217 - RNA, 17 nt, Human
agcucaucuucacugca

SEQ ID NO: 1710218 - RNA, 22 nt, Human
agccccuaagucaacuuagcau

SEQ ID NO: 1710219 - RNA, 18 nt, Human
ugcacuauaugcaaacag

SEQ ID NO: 1710220 - RNA, 20 nt, Human
ugcacuauaugcaaacaggg

SEQ ID NO: 1710221 - RNA, 14 nt, Human
ugcacuauaugcaa

SEQ ID NO: 1710222 - RNA, 15 nt, Human
ugcacuauaugcaaa

SEQ ID NO: 1710223 - RNA, 16 nt, Human
ugcacuauaugcaaac

SEQ ID NO: 1710224 - RNA, 17 nt, Human
ugcacuauaugcaaaca

SEQ ID NO: 1710225 - RNA, 12 nt, Human
ugcacuauaugc

SEQ ID NO: 1710226 - RNA, 18 nt, Human
ugccuuuuaguuccugug

SEQ ID NO: 1710227 - RNA, 16 nt, Human
ugccuuuuaguuccug

SEQ ID NO: 1710228 - RNA, 14 nt, Human
ugggaguacaaaag

SEQ ID NO: 1710229 - RNA, 22 nt, Human
agguacuguaugaucaaauguu

SEQ ID NO: 1710230 - RNA, 15 nt, Human
agguacuguaugauc

SEQ ID NO: 1710231 - RNA, 19 nt, Human
agguacuguaugaucaaau

SEQ ID NO: 1710232 - RNA, 21 nt, Human
agguacuguaugaucaaaugu

SEQ ID NO: 1710233 - RNA, 23 nt, Human
agguacuguaugaucaaauguuu

SEQ ID NO: 1710234 - RNA, 18 nt, Human
uguaccaaccauccaauu

SEQ ID NO: 1710235 - RNA, 16 nt, Human
aguaaaacaaacaaua

SEQ ID NO: 1710236 - RNA, 20 nt, Human
aguaaaacaaacaauaccug

SEQ ID NO: 1710237 - RNA, 19 nt, Human
aguaaaacaaacaauaccu

SEQ ID NO: 1710238 - RNA, 22 nt, Human
uguagguuauuaugauuagcuu

SEQ ID NO: 1710239 - RNA, 12 nt, Human
agguugauaaau

SEQ ID NO: 1710240 - RNA, 22 nt, Human
agguugauaaaucauuuuaugu

SEQ ID NO: 1710241 - RNA, 20 nt, Human
agguugauaaaucauuuuau

SEQ ID NO: 1710242 - RNA, 15 nt, Human
aguaguuaucauguu

SEQ ID NO: 1710243 - RNA, 16 nt, Human
aguaguuaucauguua

SEQ ID NO: 1710244 - RNA, 17 nt, Human
aguaguuaucauguuag

SEQ ID NO: 1710245 - RNA, 23 nt, Human
aguaguuaucauguuaguaauac

SEQ ID NO: 1710246 - RNA, 12 nt, Human
aguaguuaucau

SEQ ID NO: 1710247 - RNA, 13 nt, Human
aguaguuaucaug

SEQ ID NO: 1710248 - RNA, 14 nt, Human
aguaguuaucaugu

SEQ ID NO: 1710249 - RNA, 15 nt, Human
ugucaagauucagcu

SEQ ID NO: 1710250 - RNA, 16 nt, Human
ugucaagauucagcua

SEQ ID NO: 1710251 - RNA, 17 nt, Human
uguggugaaaagcaggu

SEQ ID NO: 1710252 - RNA, 13 nt, Human
uguuuauucauau

SEQ ID NO: 1710253 - RNA, 16 nt, Human
uguuuauucauaugca

SEQ ID NO: 1710254 - RNA, 17 nt, Human
uguuuauucauaugcau

SEQ ID NO: 1710255 - RNA, 18 nt, Human
uguuuauucauaugcaua

SEQ ID NO: 1710256 - RNA, 19 nt, Human
uguuuauucauaugcauau

SEQ ID NO: 1710257 - RNA, 14 nt, Human
uguuggucuguacu

SEQ ID NO: 1710258 - RNA, 15 nt, Human
uguuggucuguacug

SEQ ID NO: 1710259 - RNA, 16 nt, Human
uguuggucuguacuga

SEQ ID NO: 1710260 - RNA, 21 nt, Human
uguuguuaucuguuugagaaa

SEQ ID NO: 1710261 - RNA, 17 nt, Human
uguuguuaugaugugcu

SEQ ID NO: 1710262 - RNA, 14 nt, Human
uguuguuaugaugu

SEQ ID NO: 1710263 - RNA, 15 nt, Human
uguuguuaugaugug

SEQ ID NO: 1710264 - RNA, 19 nt, Human
uguuguuaugaugugcuua

SEQ ID NO: 1710265 - RNA, 12 nt, Human
aguuaucauguu

SEQ ID NO: 1710266 - RNA, 13 nt, Human
aguuaucauguua

SEQ ID NO: 1710267 - RNA, 14 nt, Human
aguuaucauguuag

SEQ ID NO: 1710268 - RNA, 15 nt, Human
aguuaucauguuagu

SEQ ID NO: 1710269 - RNA, 17 nt, Human
aguuaucauguuaguaa

SEQ ID NO: 1710270 - RNA, 18 nt, Human
aguuaucauguuaguaau

SEQ ID NO: 1710271 - RNA, 22 nt, Human
aguuaucauguuaguaauaccu

SEQ ID NO: 1710272 - RNA, 19 nt, Human
aguuaucauguuaguaaua

SEQ ID NO: 1710273 - RNA, 19 nt, Human
aguucggugagcuacaaau

SEQ ID NO: 1710274 - RNA, 18 nt, Human
aguuccccuguuuauuca

SEQ ID NO: 1710275 - RNA, 19 nt, Human
aguuccccuguuuauucau

SEQ ID NO: 1710276 - RNA, 20 nt, Human
aguuccccuguuuauucaua

SEQ ID NO: 1710277 - RNA, 20 nt, Human
aguucggugagcuacaaaug

SEQ ID NO: 1710278 - RNA, 20 nt, Human
uguuauuucccuacauuaaa

SEQ ID NO: 1710279 - RNA, 21 nt, Human
uguuauuucccuacauuaaac

SEQ ID NO: 1710280 - RNA, 23 nt, Human
uguuauuucccuacauuaaacau

SEQ ID NO: 1710281 - RNA, 18 nt, Human
uguuaucuguuugagaaa

SEQ ID NO: 1710282 - RNA, 19 nt, Human
uguuaucuguuugagaaag

SEQ ID NO: 1710283 - RNA, 14 nt, Human
uguuaucuguuuga

SEQ ID NO: 1710284 - RNA, 17 nt, Human
uguuaucuguuugagaa

SEQ ID NO: 1710285 - RNA, 23 nt, Human
aguugcugcuucaauuuauaccu

SEQ ID NO: 1710286 - RNA, 14 nt, Human
aguuuaaauuguaa

SEQ ID NO: 1710287 - RNA, 21 nt, Human
uuaaacaguugcacagcaucu

SEQ ID NO: 1710288 - RNA, 13 nt, Human
uuaaacaguugca

SEQ ID NO: 1710289 - RNA, 17 nt, Human
uuaaacaguugcacagc

SEQ ID NO: 1710290 - RNA, 18 nt, Human
uuaaacaguugcacagca

SEQ ID NO: 1710291 - RNA, 19 nt, Human
uuaaacaguugcacagcau

SEQ ID NO: 1710292 - RNA, 23 nt, Human
uuaaacaguugcacagcaucuca

SEQ ID NO: 1710293 - RNA, 16 nt, Human
uuaaacagauguccau

SEQ ID NO: 1710294 - RNA, 14 nt, Human
auaaauaaaaauaa

SEQ ID NO: 1710295 - RNA, 13 nt, Human
auaaauaaaaaua

SEQ ID NO: 1710296 - RNA, 22 nt, Human
auaacgauaaaagacagugaaa

SEQ ID NO: 1710297 - RNA, 14 nt, Human
auaaaucauuuuau

SEQ ID NO: 1710298 - RNA, 15 nt, Human
auaaaucauuuuaug

SEQ ID NO: 1710299 - RNA, 16 nt, Human
auaaaucauuuuaugu

SEQ ID NO: 1710300 - RNA, 18 nt, Human
auaaaucauuuuauguca

SEQ ID NO: 1710301 - RNA, 19 nt, Human
auaaaucauuuuaugucaa

SEQ ID NO: 1710302 - RNA, 19 nt, Human
uuacccauuuguucauauu

SEQ ID NO: 1710303 - RNA, 17 nt, Human
uuacccauuuguucaua

SEQ ID NO: 1710304 - RNA, 18 nt, Human
auaauccuaaacauauga

SEQ ID NO: 1710305 - RNA, 20 nt, Human
uuagcauuuucugcaucucc

SEQ ID NO: 1710306 - RNA, 15 nt, Human
uuagccaguaauccu

SEQ ID NO: 1710307 - RNA, 18 nt, Human
auguccaucagaugacaa

SEQ ID NO: 1710308 - RNA, 20 nt, Human
auguaguaugcuaugauuaa

SEQ ID NO: 1710309 - RNA, 13 nt, Human
uuugcucauauuu

SEQ ID NO: 1710310 - RNA, 16 nt, Human
uuugcucauauuuccc

SEQ ID NO: 1710311 - RNA, 17 nt, Human
uuugcucauauuuccca

SEQ ID NO: 1710312 - RNA, 23 nt, Human
uuuuauggugccuaguauugaca

SEQ ID NO: 1710313 - RNA, 18 nt, Human
uuuuauggugccuaguau

SEQ ID NO: 1710314 - RNA, 20 nt, Human
auguuaguaauaccucuaau

SEQ ID NO: 1710315 - RNA, 15 nt, Human
auguuaguaauaccu

SEQ ID NO: 1710316 - RNA, 16 nt, Human
auguuaguaauaccuc

SEQ ID NO: 1710317 - RNA, 21 nt, Human
auguuaguaauaccucuaaua

SEQ ID NO: 1710318 - RNA, 17 nt, Human
auuauauuuacaaaugg

SEQ ID NO: 1710319 - RNA, 23 nt, Human
auuauaagggcaaauuggagaaa

SEQ ID NO: 1710320 - RNA, 18 nt, Human
auuauaagggcaaauugg

SEQ ID NO: 1710321 - RNA, 16 nt, Human
auuauauuuacaaaug

SEQ ID NO: 1710322 - RNA, 21 nt, Human
auuauagcucuaauguuugca

SEQ ID NO: 1710323 - RNA, 22 nt, Human
auuauagcucuaauguuugcau

SEQ ID NO: 1710324 - RNA, 23 nt, Human
auuauagcucuaauguuugcaua

SEQ ID NO: 1710325 - RNA, 12 nt, Human
auuauagcucua

SEQ ID NO: 1710326 - RNA, 13 nt, Human
auuauagcucuaa

SEQ ID NO: 1710327 - RNA, 15 nt, Human
auuauagcucuaaug

SEQ ID NO: 1710328 - RNA, 16 nt, Human
auuauagcucuaaugu

SEQ ID NO: 1710329 - RNA, 17 nt, Human
auuauagcucuaauguu

SEQ ID NO: 1710330 - RNA, 18 nt, Human
auuauagcucuaauguuu

SEQ ID NO: 1710331 - RNA, 19 nt, Human
auuauagcucuaauguuug

SEQ ID NO: 1710332 - RNA, 16 nt, Human
auuaagaaugaucuga

SEQ ID NO: 1710333 - RNA, 23 nt, Human
auuaagaaugaucugauugaccg

SEQ ID NO: 1710334 - RNA, 14 nt, Human
auuaagaaugaucu

SEQ ID NO: 1710335 - RNA, 15 nt, Human
auuaagaaugaucug

SEQ ID NO: 1710336 - RNA, 13 nt, Human
auugugcuagugc

SEQ ID NO: 1710337 - RNA, 15 nt, Human
auuguauuacaaauc

SEQ ID NO: 1710338 - RNA, 14 nt, Human
auuguauuacaaau

SEQ ID NO: 1710339 - RNA, 16 nt, Human
auuuacaaaugggaaa

SEQ ID NO: 1710340 - RNA, 19 nt, Human
auuuacccaacucuguaca

SEQ ID NO: 1710341 - RNA, 11 nt, Human
auuuaaacaga

SEQ ID NO: 1710342 - RNA, 12 nt, Human
auuuaaacagau

SEQ ID NO: 1710343 - RNA, 18 nt, Human
auuuaaacagauguccau

SEQ ID NO: 1710344 - RNA, 21 nt, Human
auugaccguguuggucuguac

SEQ ID NO: 1710345 - RNA, 16 nt, Human
uucauauuaagaauga

SEQ ID NO: 1710346 - RNA, 22 nt, Human
uucauauuaagaaugaucugau

SEQ ID NO: 1710347 - RNA, 12 nt, Human
uucacuucacug

SEQ ID NO: 1710348 - RNA, 14 nt, Human
uucacuucacugug

SEQ ID NO: 1710349 - RNA, 17 nt, Human
auaucuagguuuaugac

SEQ ID NO: 1710350 - RNA, 18 nt, Human
auaucuagguuuaugaca

SEQ ID NO: 1710351 - RNA, 19 nt, Human
auaucuagguuuaugacag

SEQ ID NO: 1710352 - RNA, 21 nt, Human
auaucuagguuuaugacagua

SEQ ID NO: 1710353 - RNA, 23 nt, Human
auaucuagguuuaugacaguaau

SEQ ID NO: 1710354 - RNA, 22 nt, Human
auaucuagguuuaugacaguaa

SEQ ID NO: 1710355 - RNA, 17 nt, Human
uuccaguucuucgacug

SEQ ID NO: 1710356 - RNA, 14 nt, Human
auagugcuaacaug

SEQ ID NO: 1710357 - RNA, 19 nt, Human
auagugcuaacaugaagac

SEQ ID NO: 1710358 - RNA, 22 nt, Human
auagugcuaacaugaagaccuu

SEQ ID NO: 1710359 - RNA, 21 nt, Human
auagugcuaacaugaagaccu

SEQ ID NO: 1710360 - RNA, 15 nt, Human
auauaaauagaaugu

SEQ ID NO: 1710361 - RNA, 19 nt, Human
auauaaauagaauguaaau

SEQ ID NO: 1710362 - RNA, 21 nt, Human
auauaaauagaauguaaaugu

SEQ ID NO: 1710363 - RNA, 22 nt, Human
auauaaauagaauguaaauguc

SEQ ID NO: 1710364 - RNA, 13 nt, Human
uucacugugcugu

SEQ ID NO: 1710365 - RNA, 12 nt, Human
uucacugugcug

SEQ ID NO: 1710366 - RNA, 18 nt, Human
uucacugugcuguuguua

SEQ ID NO: 1710367 - RNA, 17 nt, Human
auaggcguaacuaauuu

SEQ ID NO: 1710368 - RNA, 20 nt, Human
uucaagucuaccaauuauaa

SEQ ID NO: 1710369 - RNA, 17 nt, Human
uucaagaucccauuuga

SEQ ID NO: 1710370 - RNA, 11 nt, Human
uucaagauucc

SEQ ID NO: 1710371 - RNA, 23 nt, Human
uuauuuuuuaaagaaaucuauuu

SEQ ID NO: 1710372 - RNA, 16 nt, Human
uucugcacuauaugca

SEQ ID NO: 1710373 - RNA, 22 nt, Human
uucuuuuuacccauuuguucau

SEQ ID NO: 1710374 - RNA, 14 nt, Human
uucuuaauguacau

SEQ ID NO: 1710375 - RNA, 15 nt, Human
uucuuaauguacaua

SEQ ID NO: 1710376 - RNA, 21 nt, Human
uucuuaauguacauagugcua

SEQ ID NO: 1710377 - RNA, 16 nt, Human
uucuucgacuguuguu

SEQ ID NO: 1710378 - RNA, 16 nt, Human
uucgacuguuguuauc

SEQ ID NO: 1710379 - RNA, 21 nt, Human
uucgacuguuguuaucuguuu

SEQ ID NO: 1710380 - RNA, 14 nt, Human
uucuauaauuuaaa

SEQ ID NO: 1710381 - RNA, 13 nt, Human
uucuauaauuuaa

SEQ ID NO: 1710382 - RNA, 12 nt, Human
aucaaauguuua

SEQ ID NO: 1710383 - RNA, 13 nt, Human
aucaaauguuuaa

SEQ ID NO: 1710384 - RNA, 14 nt, Human
aucaaauguuuaau

SEQ ID NO: 1710385 - RNA, 15 nt, Human
aucaaauguuuaauc

SEQ ID NO: 1710386 - RNA, 18 nt, Human
aucaaauguuuaaucaua

SEQ ID NO: 1710387 - RNA, 16 nt, Human
aucaaauguuuaauca

SEQ ID NO: 1710388 - RNA, 17 nt, Human
aucaaauguuuaaucau

SEQ ID NO: 1710389 - RNA, 21 nt, Human
aucaaauguuuaaucauauaa

SEQ ID NO: 1710390 - RNA, 18 nt, Human
uuccccuguuuauucaua

SEQ ID NO: 1710391 - RNA, 19 nt, Human
uuccccuguuuauucauau

SEQ ID NO: 1710392 - RNA, 20 nt, Human
uuguggguuuuuauuuccua

SEQ ID NO: 1710393 - RNA, 18 nt, Human
uuguggguuuuuauuucc

SEQ ID NO: 1710394 - RNA, 14 nt, Human
augauuucauguac

SEQ ID NO: 1710395 - RNA, 13 nt, Human
augauuucaugua

SEQ ID NO: 1710396 - RNA, 16 nt, Human
augauuucauguacug

SEQ ID NO: 1710397 - RNA, 18 nt, Human
uuguuguagagaaaacau

SEQ ID NO: 1710398 - RNA, 13 nt, Human
augcagugccagg

SEQ ID NO: 1710399 - RNA, 16 nt, Human
uuuaaugaaugcuuaa

SEQ ID NO: 1710400 - RNA, 22 nt, Human
uuuaaugaaugcuuaaagaauu

SEQ ID NO: 1710401 - RNA, 20 nt, Human
uuucaucauucacuucacug

SEQ ID NO: 1710402 - RNA, 21 nt, Human
uuucaucauucacuucacugu

SEQ ID NO: 1710403 - RNA, 22 nt, Human
uuucaucauucacuucacugug

SEQ ID NO: 1710404 - RNA, 15 nt, Human
uuucccaugauuuca

SEQ ID NO: 1710405 - RNA, 18 nt, Human
uuucccaugauuucaugu

SEQ ID NO: 1710406 - RNA, 21 nt, Human
uuucccaugauuucauguacu

SEQ ID NO: 1710407 - RNA, 15 nt, Human
uuucauguacugcau

SEQ ID NO: 1710408 - RNA, 16 nt, Human
uuucauguacugcauu

SEQ ID NO: 1710409 - RNA, 20 nt, Human
uuucauguacugcauuauuu

SEQ ID NO: 1710410 - RNA, 22 nt, Human
uuucauguacugcauuauuuga

SEQ ID NO: 1710411 - RNA, 14 nt, Human
uuucccaugauuuc

SEQ ID NO: 1710412 - RNA, 24 nt, Human
uuuauggugccuaguauugacaaa

SEQ ID NO: 1710413 - RNA, 19 nt, Human
uuuauggugccuaguauug

SEQ ID NO: 1710414 - RNA, 21 nt, Human
uugauguggugaaaagcaggu

SEQ ID NO: 1710415 - RNA, 19 nt, Human
uugcacagcaucucagcuc

SEQ ID NO: 1710416 - RNA, 15 nt, Human
uugcacagcaucuca

SEQ ID NO: 1710417 - RNA, 18 nt, Human
uugcacagcaucucagcu

SEQ ID NO: 1710418 - RNA, 16 nt, Human
aucucagcucaucuuc

SEQ ID NO: 1710419 - RNA, 12 nt, Human
aucucagcucau

SEQ ID NO: 1710420 - RNA, 23 nt, Human
uuggaucucuucuuaauguacau

SEQ ID NO: 1710421 - RNA, 12 nt, Human
augaaugcuuaa

SEQ ID NO: 1710422 - RNA, 15 nt, Human
augaaugcuuaaaga

SEQ ID NO: 1710423 - RNA, 13 nt, Human
auuagcuuauguu

SEQ ID NO: 1710424 - RNA, 21 nt, Human
auuagcuuauguuaacugaca

SEQ ID NO: 1710425 - RNA, 22 nt, Human
auuagcuuauguuaacugacaa

SEQ ID NO: 1710426 - RNA, 15 nt, Human
auuaugauuagcuuu

SEQ ID NO: 1710427 - RNA, 23 nt, Human
auuagccaguaauccuguaggaa

SEQ ID NO: 1710428 - RNA, 12 nt, Human
auuagccaguaa

SEQ ID NO: 1710429 - RNA, 14 nt, Human
auuagccaguaauc

SEQ ID NO: 1710430 - RNA, 16 nt, Human
auuagccaguaauccu

SEQ ID NO: 1710431 - RNA, 17 nt, Human
auuagccaguaauccug

SEQ ID NO: 1710432 - RNA, 18 nt, Human
auuagccaguaauccugu

SEQ ID NO: 1710433 - RNA, 19 nt, Human
auuagccaguaauccugua

SEQ ID NO: 1710434 - RNA, 19 nt, Human
auuuuauagcuacuaauuu

SEQ ID NO: 1710435 - RNA, 17 nt, Human
auuuuauagcuacuaau

SEQ ID NO: 1710436 - RNA, 21 nt, Human
auuuguggguuuuuauuuccu

SEQ ID NO: 1710437 - RNA, 22 nt, Human
auuuguggguuuuuauuuccua

SEQ ID NO: 1710438 - RNA, 17 nt, Human
auuugcauacauucuuc

SEQ ID NO: 1710439 - RNA, 20 nt, Human
auuuuuuuuuuuuuccuguc

SEQ ID NO: 1710440 - RNA, 15 nt, Human
caauucuugccaaau

SEQ ID NO: 1710441 - RNA, 22 nt, Human
caauuuauaccucaauuuucac

SEQ ID NO: 1710442 - RNA, 17 nt, Human
caauuuaguuguuguag

SEQ ID NO: 1710443 - RNA, 20 nt, Human
caauuuaguuguuguagaga

SEQ ID NO: 1710444 - RNA, 13 nt, Human
caauuuauaccuc

SEQ ID NO: 1710445 - RNA, 14 nt, Human
caauuuauaccuca

SEQ ID NO: 1710446 - RNA, 22 nt, Human
ccaaaaauuacuuaguauugca

SEQ ID NO: 1710447 - RNA, 13 nt, Human
cagguugauaaau

SEQ ID NO: 1710448 - RNA, 18 nt, Human
cagguugauaaaucauuu

SEQ ID NO: 1710449 - RNA, 15 nt, Human
cagguugauaaauca

SEQ ID NO: 1710450 - RNA, 15 nt, Human
ccaugucaagauuca

SEQ ID NO: 1710451 - RNA, 19 nt, Human
ccaugucaagauucagcua

SEQ ID NO: 1710452 - RNA, 17 nt, Human
ccaugucaagauucagc

SEQ ID NO: 1710453 - RNA, 13 nt, Human
ccccaaaauuagc

SEQ ID NO: 1710454 - RNA, 16 nt, Human
ccguagguuauuuuca

SEQ ID NO: 1710455 - RNA, 19 nt, Human
cuacauaacuaauacagcu

SEQ ID NO: 1710456 - RNA, 16 nt, Human
cuaguuccccuguuua

SEQ ID NO: 1710457 - RNA, 18 nt, Human
cuaguuccccuguuuauu

SEQ ID NO: 1710458 - RNA, 14 nt, Human
ccuuuuucugcacu

SEQ ID NO: 1710459 - RNA, 15 nt, Human
ccuuuuucugcacua

SEQ ID NO: 1710460 - RNA, 17 nt, Human
ccuuuuucugcacuaua

SEQ ID NO: 1710461 - RNA, 21 nt, Human
ccuuuuucugcacuauaugca

SEQ ID NO: 1710462 - RNA, 18 nt, Human
ccuuuuucugcacuauau

SEQ ID NO: 1710463 - RNA, 17 nt, Human
cucucaauaaaauuaua

SEQ ID NO: 1710464 - RNA, 13 nt, Human
cucuguagccuaa

SEQ ID NO: 1710465 - RNA, 22 nt, Human
cugaaggggaaggaaauagcuu

SEQ ID NO: 1710466 - RNA, 16 nt, Human
gccauaugaaaaggcu

SEQ ID NO: 1710467 - RNA, 19 nt, Human
gcuguacugaaguaaaaca

SEQ ID NO: 1710468 - RNA, 20 nt, Human
gcuguacugaaguaaaacaa

SEQ ID NO: 1710469 - RNA, 18 nt, Human
gcugaaacgcaucuaguu

SEQ ID NO: 1710470 - RNA, 16 nt, Human
gcugcuguacugaagu

SEQ ID NO: 1710471 - RNA, 16 nt, Human
gggcaaauuggagaaa

SEQ ID NO: 1710472 - RNA, 18 nt, Human
aaaagcagguugauaaau

SEQ ID NO: 1710473 - RNA, 22 nt, Human
aaaagcagguugauaaaucauu

SEQ ID NO: 1710474 - RNA, 18 nt, Human
aaaaugcucuuauuucau

SEQ ID NO: 1710475 - RNA, 17 nt, Human
aaaaugcucuuauuuca

SEQ ID NO: 1710476 - RNA, 20 nt, Human
aaaaugcucuuauuucauca

SEQ ID NO: 1710477 - RNA, 20 nt, Human
aaacaagcacuaaacaaaga

SEQ ID NO: 1710478 - RNA, 19 nt, Human
aaacaguugcacagcaucu

SEQ ID NO: 1710479 - RNA, 21 nt, Human
aaacaguugcacagcaucuca

SEQ ID NO: 1710480 - RNA, 15 nt, Human
aaacaguugcacagc

SEQ ID NO: 1710481 - RNA, 16 nt, Human
aaacaguugcacagca

SEQ ID NO: 1710482 - RNA, 17 nt, Human
aaacaguugcacagcau

SEQ ID NO: 1710483 - RNA, 18 nt, Human
aaacaguugcacagcauc

SEQ ID NO: 1710484 - RNA, 17 nt, Human
aaacauccucuuccaua

SEQ ID NO: 1710485 - RNA, 16 nt, Human
aaacaugcagaacaaa

SEQ ID NO: 1710486 - RNA, 20 nt, Human
aaacaugcagaacaaaugaa

SEQ ID NO: 1710487 - RNA, 19 nt, Human
aaauaaaaaaaaaaaagag

SEQ ID NO: 1710488 - RNA, 21 nt, Human
gguuuaugacaguaauugugu

SEQ ID NO: 1710489 - RNA, 22 nt, Human
ggucgggcagcacaaguguaau

SEQ ID NO: 1710490 - RNA, 19 nt, Human
gaucucuucuuaauguaca

SEQ ID NO: 1710491 - RNA, 21 nt, Human
gaucucuucuuaauguacaua

SEQ ID NO: 1710492 - RNA, 19 nt, Human
gauuagcuuugucacuguu

SEQ ID NO: 1710493 - RNA, 16 nt, Human
gcagguugauaaauca

SEQ ID NO: 1710494 - RNA, 17 nt, Human
gcagguugauaaaucau

SEQ ID NO: 1710495 - RNA, 19 nt, Human
gcagguugauaaaucauuu

SEQ ID NO: 1710496 - RNA, 20 nt, Human
gcaguaucggcacuguacaa

SEQ ID NO: 1710497 - RNA, 22 nt, Human
gcaguaucggcacuguacaaaa

SEQ ID NO: 1710498 - RNA, 14 nt, Human
gcagaacaaaugaa

SEQ ID NO: 1710499 - RNA, 15 nt, Human
gcagaacaaaugaag

SEQ ID NO: 1710500 - RNA, 14 nt, Human
gaagcugcucaacu

SEQ ID NO: 1710501 - RNA, 20 nt, Human
gaagcugcucaacuugcaaa

SEQ ID NO: 1710502 - RNA, 12 nt, Human
gacaaaauguua

SEQ ID NO: 1710503 - RNA, 16 nt, Human
gacaaaauguuauuuc

SEQ ID NO: 1710504 - RNA, 22 nt, Human
gacaaaauacuugucuguuuua

SEQ ID NO: 1710505 - RNA, 13 nt, Human
gacaaaauguuau

SEQ ID NO: 1710506 - RNA, 14 nt, Human
gacagugaaagaaa

SEQ ID NO: 1710507 - RNA, 16 nt, Human
gagaugcagugccagg

SEQ ID NO: 1710508 - RNA, 15 nt, Human
cuuuuaguuccugug

SEQ ID NO: 1710509 - RNA, 22 nt, Human
cuuuuaguuccugugcacagcc

SEQ ID NO: 1710510 - RNA, 21 nt, Human
cuuuuaguuccugugcacagc

SEQ ID NO: 1710511 - RNA, 19 nt, Human
cuuuuggauuggacaaaau

SEQ ID NO: 1710512 - RNA, 21 nt, Human
cuuuuggauuggacaaaauga

SEQ ID NO: 1710513 - RNA, 23 nt, Human
cuuuuggauuggacaaaaugacu

SEQ ID NO: 1710514 - RNA, 18 nt, Human
cuuuuggauuggacaaaa

SEQ ID NO: 1710515 - RNA, 19 nt, Human
gaaaggcugcuguacugaa

SEQ ID NO: 1710516 - RNA, 20 nt, Human
gaaaggcugcuguacugaag

SEQ ID NO: 1710517 - RNA, 23 nt, Human
gaaaggcugcuguacugaaguaa

SEQ ID NO: 1710518 - RNA, 18 nt, Human
gaaaggcugcuguacuga

SEQ ID NO: 1710519 - RNA, 15 nt, Human
cuucacuguaaaaua

SEQ ID NO: 1710520 - RNA, 17 nt, Human
cugcauuauuugagaag

SEQ ID NO: 1710521 - RNA, 24 nt, Human
cugcauuauuugagaagcugcuca

SEQ ID NO: 1710522 - RNA, 22 nt, Human
cauauuucccaugauuucaugu

SEQ ID NO: 1710523 - RNA, 20 nt, Human
cauaugcauauuuuuuuucu

SEQ ID NO: 1710524 - RNA, 22 nt, Human
caucaagucuuucacauuuaaa

SEQ ID NO: 1710525 - RNA, 18 nt, Human
cauagugcuaacaugaag

SEQ ID NO: 1710526 - RNA, 19 nt, Human
cauagugcuaacaugaaga

SEQ ID NO: 1710527 - RNA, 20 nt, Human
cauagugcuaacaugaagac

SEQ ID NO: 1710528 - RNA, 13 nt, Human
cauauaaauagaa

SEQ ID NO: 1710529 - RNA, 15 nt, Human
cauauaaauagaaug

SEQ ID NO: 1710530 - RNA, 16 nt, Human
cauauaaauagaaugu

SEQ ID NO: 1710531 - RNA, 17 nt, Human
cauagaccuuuucauuu

SEQ ID NO: 1710532 - RNA, 19 nt, Human
cauacuuuguuaggaaggg

SEQ ID NO: 1710533 - RNA, 16 nt, Human
cauccaauuagcuuau

SEQ ID NO: 1710534 - RNA, 20 nt, Human
caucuaguuccccuguuuau

SEQ ID NO: 1710535 - RNA, 23 nt, Human
caucuaguuccccuguuuauuca

SEQ ID NO: 1710536 - RNA, 21 nt, Human
caucuaguuccccuguuuauu

SEQ ID NO: 1710537 - RNA, 21 nt, Human
caucucagcucaucuucacug

SEQ ID NO: 1710538 - RNA, 17 nt, Human
cauaacuaauacagcug

SEQ ID NO: 1710539 - RNA, 22 nt, Human
cauaacuaauacagcugagcua

SEQ ID NO: 1710540 - RNA, 18 nt, Human
cauacauucuucaagauc

SEQ ID NO: 1710541 - RNA, 21 nt, Human
cauacauucuucaagauccca

SEQ ID NO: 1710542 - RNA, 17 nt, Human
cauacauuuuguaccaa

SEQ ID NO: 1710543 - RNA, 18 nt, Human
cauaccauggaggaaggc

SEQ ID NO: 1710544 - RNA, 19 nt, Human
caguugcugcuucaauuua

SEQ ID NO: 1710545 - RNA, 18 nt, Human
caguugcugcuucaauuu

SEQ ID NO: 1710546 - RNA, 22 nt, Human
caguugcacagcaucucagcuc

SEQ ID NO: 1710547 - RNA, 12 nt, Human
caguugcacagc

SEQ ID NO: 1710548 - RNA, 13 nt, Human
caguugcacagca

SEQ ID NO: 1710549 - RNA, 15 nt, Human
caguugcacagcauc

SEQ ID NO: 1710550 - RNA, 16 nt, Human
caguugcacagcaucu

SEQ ID NO: 1710551 - RNA, 17 nt, Human
caguugcacagcaucuc

SEQ ID NO: 1710552 - RNA, 18 nt, Human
caguugcacagcaucuca

SEQ ID NO: 1710553 - RNA, 21 nt, Human
caguugcacagcaucucagcu

SEQ ID NO: 1710554 - RNA, 12 nt, Human
caguuacacaug

SEQ ID NO: 1710555 - RNA, 13 nt, Human
caguguuagcuua

SEQ ID NO: 1710556 - RNA, 14 nt, Human
caguguuagcuuag

SEQ ID NO: 1710557 - RNA, 22 nt, Human
caguucggugagcuacaaaugc

SEQ ID NO: 1710558 - RNA, 18 nt, Human
caguucuucgacuguugu

SEQ ID NO: 1710559 - RNA, 19 nt, Human
caguucuucgacuguuguu

SEQ ID NO: 1710560 - RNA, 14 nt, Human
cauuauuugagaag

SEQ ID NO: 1710561 - RNA, 20 nt, Human
cauuauuugagaagcugcuc

SEQ ID NO: 1710562 - RNA, 22 nt, Human
cauuauuugagaagcugcucaa

SEQ ID NO: 1710563 - RNA, 12 nt, Human
cauuuuauggug

SEQ ID NO: 1710564 - RNA, 17 nt, Human
cauuuuauggugccuag

SEQ ID NO: 1710565 - RNA, 14 nt, Human
cauuuuauggugcc

SEQ ID NO: 1710566 - RNA, 21 nt, Human
cauuuaaacagauguccauca

SEQ ID NO: 1710567 - RNA, 14 nt, Human
cauuuaaacagaug

SEQ ID NO: 1710568 - RNA, 16 nt, Human
cauuuaaacagauguc

SEQ ID NO: 1710569 - RNA, 19 nt, Human
cauuuaaacagauguccau

SEQ ID NO: 1710570 - RNA, 13 nt, Human
cauuuaaacagau

SEQ ID NO: 1710571 - RNA, 18 nt, Human
ccaaccuguucaagucua

SEQ ID NO: 1710572 - RNA, 23 nt, Human
ccauggaggaaggcucuguucca

SEQ ID NO: 1710573 - RNA, 19 nt, Human
ccccuguuuauucauaugc

SEQ ID NO: 1710574 - RNA, 13 nt, Human
ccuaaacauauga

SEQ ID NO: 1710575 - RNA, 19 nt, Human
ccguguuggucuguacuga

SEQ ID NO: 1710576 - RNA, 18 nt, Human
ccguguuggucuguacug

SEQ ID NO: 1710577 - RNA, 16 nt, Human
cuaacaugaagaccuu

SEQ ID NO: 1710578 - RNA, 15 nt, Human
cuaauguuugcauau

SEQ ID NO: 1710579 - RNA, 16 nt, Human
cuaauguuugcauaua

SEQ ID NO: 1710580 - RNA, 18 nt, Human
cuaauguuugcauauaag

SEQ ID NO: 1710581 - RNA, 17 nt, Human
cuaauguuugcauauaa

SEQ ID NO: 1710582 - RNA, 14 nt, Human
cuaguauugacaaa

SEQ ID NO: 1710583 - RNA, 15 nt, Human
cuaguauugacaaaa

SEQ ID NO: 1710584 - RNA, 17 nt, Human
cuaguauugacaaaaug

SEQ ID NO: 1710585 - RNA, 18 nt, Human
cuaguauugacaaaaugu

SEQ ID NO: 1710586 - RNA, 18 nt, Human
cuaguguaucaaaaugcu

SEQ ID NO: 1710587 - RNA, 15 nt, Human
cuaguguaucaaaau

SEQ ID NO: 1710588 - RNA, 20 nt, Human
cuaguauugacaaaauguua

SEQ ID NO: 1710589 - RNA, 19 nt, Human
cuaguauugacaaaauguu

SEQ ID NO: 1710590 - RNA, 13 nt, Human
cucacauuuauau

SEQ ID NO: 1710591 - RNA, 15 nt, Human
cuaacaugaagaccu

SEQ ID NO: 1710592 - RNA, 15 nt, Human
cuaaaccauugugca

SEQ ID NO: 1710593 - RNA, 17 nt, Human
cguuggcuagauuaacc

SEQ ID NO: 1710594 - RNA, 18 nt, Human
cguuuaaugaaugcuuaa

SEQ ID NO: 1710595 - RNA, 13 nt, Human
cguuuaaugaaug

SEQ ID NO: 1710596 - RNA, 14 nt, Human
cguuuaaugaaugc

SEQ ID NO: 1710597 - RNA, 23 nt, Human
cuaaaaccuuccaugucaagauu

SEQ ID NO: 1710598 - RNA, 17 nt, Human
cggugagcuacaaaugc

SEQ ID NO: 1710599 - RNA, 16 nt, Human
cugagcuauguaguau

SEQ ID NO: 1710600 - RNA, 23 nt, Human
cucuucuuaauguacauagugcu

SEQ ID NO: 1710601 - RNA, 24 nt, Human
cucuucuuaauguacauagugcua

SEQ ID NO: 1710602 - RNA, 13 nt, Human
cucuucuuaaugu

SEQ ID NO: 1710603 - RNA, 18 nt, Human
cucuucuuaauguacaua

SEQ ID NO: 1710604 - RNA, 22 nt, Human
cucuucuuaauguacauagugc

SEQ ID NO: 1710605 - RNA, 23 nt, Human
cuguaugaucaaauguuuaauca

SEQ ID NO: 1710606 - RNA, 12 nt, Human
cugcuguacuga

SEQ ID NO: 1710607 - RNA, 13 nt, Human
cugcuguacugaa

SEQ ID NO: 1710608 - RNA, 15 nt, Human
cugcuguacugaagu

SEQ ID NO: 1710609 - RNA, 14 nt, Human
cugcuguacugaag

SEQ ID NO: 1710610 - RNA, 20 nt, Human
cugcacccuggauuugcaua

SEQ ID NO: 1710611 - RNA, 22 nt, Human
cuuuuuacccauuuguucauau

SEQ ID NO: 1710612 - RNA, 13 nt, Human
cuuuucauuugug

SEQ ID NO: 1710613 - RNA, 18 nt, Human
cuugcaguaucggcacug

SEQ ID NO: 1710614 - RNA, 20 nt, Human
cuugcaguaucggcacugua

SEQ ID NO: 1710615 - RNA, 19 nt, Human
cuugcaguaucggcacugu

SEQ ID NO: 1710616 - RNA, 18 nt, Human
cuuguaaaggaauuuaaa

SEQ ID NO: 1710617 - RNA, 17 nt, Human
cuugccaaauauaaaua

SEQ ID NO: 1710618 - RNA, 22 nt, Human
gaacuuguaaaggaauuuaaaa

SEQ ID NO: 1710619 - RNA, 15 nt, Human
gaagauaaacgugga

SEQ ID NO: 1710620 - RNA, 20 nt, Human
gaagguauaucuagguuuau

SEQ ID NO: 1710621 - RNA, 15 nt, Human
gaaagugagcagugu

SEQ ID NO: 1710622 - RNA, 16 nt, Human
gaaagugagcaguguu

SEQ ID NO: 1710623 - RNA, 22 nt, Human
gaaagugagcaguguuagcuua

SEQ ID NO: 1710624 - RNA, 19 nt, Human
gaaagucagauucuugcau

SEQ ID NO: 1710625 - RNA, 17 nt, Human
gagauacagaauuuuau

SEQ ID NO: 1710626 - RNA, 23 nt, Human
gaccugauuucugagcauuuaau

SEQ ID NO: 1710627 - RNA, 17 nt, Human
gaccuuuuucugcacua

SEQ ID NO: 1710628 - RNA, 18 nt, Human
gcagcacaaguguaauga

SEQ ID NO: 1710629 - RNA, 15 nt, Human
gcagcuuugcucaua

SEQ ID NO: 1710630 - RNA, 13 nt, Human
gcagcuuugcuca

SEQ ID NO: 1710631 - RNA, 14 nt, Human
gcagcuuugcucau

SEQ ID NO: 1710632 - RNA, 21 nt, Human
gcacuguacaaaaaaaucuuc

SEQ ID NO: 1710633 - RNA, 17 nt, Human
gcauagguuuaauaauu

SEQ ID NO: 1710634 - RNA, 15 nt, Human
gcauauuuuuuuucu

SEQ ID NO: 1710635 - RNA, 13 nt, Human
gcauagaaguaaa

SEQ ID NO: 1710636 - RNA, 12 nt, Human
gcaguuauuugc

SEQ ID NO: 1710637 - RNA, 11 nt, Human
gcauuauuuga

SEQ ID NO: 1710638 - RNA, 15 nt, Human
gcauuauuugagaag

SEQ ID NO: 1710639 - RNA, 21 nt, Human
gcauuauuugagaagcugcuc

SEQ ID NO: 1710640 - RNA, 22 nt, Human
gaugacaagaaaggcugcugua

SEQ ID NO: 1710641 - RNA, 23 nt, Human
gauagauaggucagugcaaauac

SEQ ID NO: 1710642 - RNA, 18 nt, Human
gcaaauccuuugugaaaa

SEQ ID NO: 1710643 - RNA, 17 nt, Human
gcaaauccuuugugaaa

SEQ ID NO: 1710644 - RNA, 14 nt, Human
gccaguaauccugu

SEQ ID NO: 1710645 - RNA, 19 nt, Human
gccaguaauccuguaggaa

SEQ ID NO: 1710646 - RNA, 16 nt, Human
uuuuggauuggacaaa

SEQ ID NO: 1710647 - RNA, 11 nt, Human
uuuuuccuguc

SEQ ID NO: 1710648 - RNA, 18 nt, Human
uuugaaucaucaagucuu

SEQ ID NO: 1710649 - RNA, 22 nt, Human
uuuccugccuuuuaguuccugu

SEQ ID NO: 1710650 - RNA, 23 nt, Human
uuuccugccuuuuaguuccugug

SEQ ID NO: 1710651 - RNA, 14 nt, Human
uuacauuuuauggu

SEQ ID NO: 1710652 - RNA, 23 nt, Human
uuacauuuuauggugccuaguau

SEQ ID NO: 1710653 - RNA, 21 nt, Human
guagguuauuaugauuagcuu

SEQ ID NO: 1710654 - RNA, 15 nt, Human
guaugaucaaauguu

SEQ ID NO: 1710655 - RNA, 16 nt, Human
guaugaucaaauguuu

SEQ ID NO: 1710656 - RNA, 17 nt, Human
guaugaucaaauguuua

SEQ ID NO: 1710657 - RNA, 22 nt, Human
guaugaucaaauguuuaaucau

SEQ ID NO: 1710658 - RNA, 13 nt, Human
guaugaucaaaug

SEQ ID NO: 1710659 - RNA, 14 nt, Human
guaugaucaaaugu

SEQ ID NO: 1710660 - RNA, 14 nt, Human
guaucuugcaguau

SEQ ID NO: 1710661 - RNA, 22 nt, Human
guaucuugcaguaucggcacug

SEQ ID NO: 1710662 - RNA, 19 nt, Human
guauaucuagguuuaugac

SEQ ID NO: 1710663 - RNA, 20 nt, Human
guauaucuagguuuaugaca

SEQ ID NO: 1710664 - RNA, 23 nt, Human
guauaucuagguuuaugacagua

SEQ ID NO: 1710665 - RNA, 13 nt, Human
guaucggcacugu

SEQ ID NO: 1710666 - RNA, 15 nt, Human
guaucggcacuguac

SEQ ID NO: 1710667 - RNA, 16 nt, Human
guaucggcacuguaca

SEQ ID NO: 1710668 - RNA, 18 nt, Human
guaucggcacuguacaaa

SEQ ID NO: 1710669 - RNA, 21 nt, Human
gucaagggcagcuuugcucau

SEQ ID NO: 1710670 - RNA, 16 nt, Human
gucagauucuugcauc

SEQ ID NO: 1710671 - RNA, 15 nt, Human
gucagauucuugcau

SEQ ID NO: 1710672 - RNA, 17 nt, Human
gucagauucuugcaucc

SEQ ID NO: 1710673 - RNA, 22 nt, Human
gucucacugagcacuguuuucu

SEQ ID NO: 1710674 - RNA, 16 nt, Human
gucucacugagcacug

SEQ ID NO: 1710675 - RNA, 18 nt, Human
gucgucaaagcugaaaug

SEQ ID NO: 1710676 - RNA, 20 nt, Human
gucuguuuuaaaaaccuguu

SEQ ID NO: 1710677 - RNA, 16 nt, Human
gugcaguuauuugcuu

SEQ ID NO: 1710678 - RNA, 23 nt, Human
gugauuuuuuuuuuuuuccuguc

SEQ ID NO: 1710679 - RNA, 23 nt, Human
guggugaaaagcagguugauaaa

SEQ ID NO: 1710680 - RNA, 14 nt, Human
gugguaucuugcag

SEQ ID NO: 1710681 - RNA, 16 nt, Human
guguaaugaauaccuu

SEQ ID NO: 1710682 - RNA, 15 nt, Human
guguaucaaaaugcu

SEQ ID NO: 1710683 - RNA, 17 nt, Human
guggguuuuuauuuccu

SEQ ID NO: 1710684 - RNA, 11 nt, Human
guuaucauguu

SEQ ID NO: 1710685 - RNA, 12 nt, Human
guuaucauguua

SEQ ID NO: 1710686 - RNA, 23 nt, Human
guuaucauguuaguaauaccucu

SEQ ID NO: 1710687 - RNA, 22 nt, Human
guuaucauguuaguaauaccuc

SEQ ID NO: 1710688 - RNA, 14 nt, Human
guuaugaugugcuu

SEQ ID NO: 1710689 - RNA, 16 nt, Human
guuaugaugugcuuaa

SEQ ID NO: 1710690 - RNA, 17 nt, Human
guuaugaugugcuuaac

SEQ ID NO: 1710691 - RNA, 22 nt, Human
guuaugaugugcuuaacaggga

SEQ ID NO: 1710692 - RNA, 17 nt, Human
guuaucuguuugagaaa

SEQ ID NO: 1710693 - RNA, 17 nt, Human
guuauuauauuuacaaa

SEQ ID NO: 1710694 - RNA, 21 nt, Human
guuacuccaaaacuucguuua

SEQ ID NO: 1710695 - RNA, 18 nt, Human
guucauauuaagaaugau

SEQ ID NO: 1710696 - RNA, 15 nt, Human
guuccugugcacagc

SEQ ID NO: 1710697 - RNA, 16 nt, Human
guuccugugcacagcc

SEQ ID NO: 1710698 - RNA, 16 nt, Human
guugcacagcaucuca

SEQ ID NO: 1710699 - RNA, 19 nt, Human
guugcacagcaucucagcu

SEQ ID NO: 1710700 - RNA, 10 nt, Human
guugcacagc

SEQ ID NO: 1710701 - RNA, 11 nt, Human
guugcacagca

SEQ ID NO: 1710702 - RNA, 22 nt, Human
guuuacauuuuauggugccuag

SEQ ID NO: 1710703 - RNA, 15 nt, Human
guuuacauuuuaugg

SEQ ID NO: 1710704 - RNA, 23 nt, Human
guuguuaugaugugcuuaacagg

SEQ ID NO: 1710705 - RNA, 15 nt, Human
guuguuaugaugugc

SEQ ID NO: 1710706 - RNA, 14 nt, Human
guuguuaucuguuu

SEQ ID NO: 1710707 - RNA, 17 nt, Human
guuguuaucuguuugag

SEQ ID NO: 1710708 - RNA, 13 nt, Human
guuguuaugaugu

SEQ ID NO: 1710709 - RNA, 14 nt, Human
guuguuaugaugug

SEQ ID NO: 1710710 - RNA, 15 nt, Human
guuggcuagauuaac

SEQ ID NO: 1710711 - RNA, 17 nt, Human
guuuuccucucaauaaa

SEQ ID NO: 1710712 - RNA, 17 nt, Human
guuuuaaaaaccuguuc

SEQ ID NO: 1710713 - RNA, 22 nt, Human
uaaaacaagcacuaaacaaaga

SEQ ID NO: 1710714 - RNA, 18 nt, Human
uaaaacaaacaauaccug

SEQ ID NO: 1710715 - RNA, 14 nt, Human
uaaaacaaagccac

SEQ ID NO: 1710716 - RNA, 22 nt, Human
uaaaacaaagccacuuucaauc

SEQ ID NO: 1710717 - RNA, 14 nt, Human
uaaaguguuugaaa

SEQ ID NO: 1710718 - RNA, 18 nt, Human
uaaacaugacuccauaga

SEQ ID NO: 1710719 - RNA, 22 nt, Human
uaaacaugacuccauagaccuu

SEQ ID NO: 1710720 - RNA, 15 nt, Human
uaaauguccauucuu

SEQ ID NO: 1710721 - RNA, 15 nt, Human
uaaaugucucacuga

SEQ ID NO: 1710722 - RNA, 17 nt, Human
uaaaugucucacugagc

SEQ ID NO: 1710723 - RNA, 22 nt, Human
uaacugacaagcuccauuuaaa

SEQ ID NO: 1710724 - RNA, 21 nt, Human
uaacugacaagcuccauuuaa

SEQ ID NO: 1710725 - RNA, 11 nt, Human
uaacugacaag

SEQ ID NO: 1710726 - RNA, 16 nt, Human
uaagucaacuuagcau

SEQ ID NO: 1710727 - RNA, 19 nt, Human
uaagggaaguaguuaucau

SEQ ID NO: 1710728 - RNA, 22 nt, Human
uaagggaaguaguuaucauguu

SEQ ID NO: 1710729 - RNA, 16 nt, Human
uaauguuugcauauaa

SEQ ID NO: 1710730 - RNA, 14 nt, Human
uaauguuugcauau

SEQ ID NO: 1710731 - RNA, 15 nt, Human
uaauguuugcauaua

SEQ ID NO: 1710732 - RNA, 22 nt, Human
uauaaauagaauguaaaugucu

SEQ ID NO: 1710733 - RNA, 14 nt, Human
uauaaauagaaugu

SEQ ID NO: 1710734 - RNA, 16 nt, Human
uauaaauagaauguaa

SEQ ID NO: 1710735 - RNA, 19 nt, Human
uauaaauagaauguaaaug

SEQ ID NO: 1710736 - RNA, 20 nt, Human
uauaaauagaauguaaaugu

SEQ ID NO: 1710737 - RNA, 20 nt, Human
uaucauguuaguaauaccuc

SEQ ID NO: 1710738 - RNA, 16 nt, Human
uaucauguuaguaaua

SEQ ID NO: 1710739 - RNA, 19 nt, Human
uaucauguuaguaauaccu

SEQ ID NO: 1710740 - RNA, 21 nt, Human
uaucauguuaguaauaccucu

SEQ ID NO: 1710741 - RNA, 22 nt, Human
uaucaaaaugcucuuauuucau

SEQ ID NO: 1710742 - RNA, 14 nt, Human
uaucaaaaugcucu

SEQ ID NO: 1710743 - RNA, 14 nt, Human
uauauuuugccugu

SEQ ID NO: 1710744 - RNA, 13 nt, Human
uaguauugacaaa

SEQ ID NO: 1710745 - RNA, 14 nt, Human
uaguauugacaaaa

SEQ ID NO: 1710746 - RNA, 17 nt, Human
uaguauugacaaaaugu

SEQ ID NO: 1710747 - RNA, 18 nt, Human
uaguauugacaaaauguu

SEQ ID NO: 1710748 - RNA, 19 nt, Human
uaguauugacaaaauguua

SEQ ID NO: 1710749 - RNA, 21 nt, Human
uaguauugacaaaauguuauu

SEQ ID NO: 1710750 - RNA, 22 nt, Human
uaguauugacaaaauguuauuu

SEQ ID NO: 1710751 - RNA, 16 nt, Human
uaguauugcaaaguca

SEQ ID NO: 1710752 - RNA, 17 nt, Human
uaguuguuguagagaaa

SEQ ID NO: 1710753 - RNA, 20 nt, Human
uagguuauuaugauuagcuu

SEQ ID NO: 1710754 - RNA, 22 nt, Human
uagguuauuaugauuagcuuug

SEQ ID NO: 1710755 - RNA, 15 nt, Human
uagccaguaauccug

SEQ ID NO: 1710756 - RNA, 16 nt, Human
uagccaguaauccugu

SEQ ID NO: 1710757 - RNA, 17 nt, Human
uagccaguaauccugua

SEQ ID NO: 1710758 - RNA, 18 nt, Human
uagccaguaauccuguag

SEQ ID NO: 1710759 - RNA, 22 nt, Human
uagccaguaauccuguaggaag

SEQ ID NO: 1710760 - RNA, 18 nt, Human
uagcugacaaaauacuug

SEQ ID NO: 1710761 - RNA, 17 nt, Human
uagaccuuuucauuugu

SEQ ID NO: 1710762 - RNA, 14 nt, Human
uacuugucuguuuu

SEQ ID NO: 1710763 - RNA, 15 nt, Human
uacuugucuguuuua

SEQ ID NO: 1710764 - RNA, 20 nt, Human
uacuugucuguuuuaaaaac

SEQ ID NO: 1710765 - RNA, 14 nt, Human
uagaauguaaaugu

SEQ ID NO: 1710766 - RNA, 15 nt, Human
uagaauguaaauguc

SEQ ID NO: 1710767 - RNA, 16 nt, Human
uagaauguaaaugucu

SEQ ID NO: 1710768 - RNA, 18 nt, Human
uagaauguaaaugucuca

SEQ ID NO: 1710769 - RNA, 17 nt, Human
uagaauguaaaugucuc

SEQ ID NO: 1710770 - RNA, 18 nt, Human
uaccucaauuuucacugu

SEQ ID NO: 1710771 - RNA, 20 nt, Human
uaccucaauuuucacugugu

SEQ ID NO: 1710772 - RNA, 21 nt, Human
uaccucaauuuucacuguguc

SEQ ID NO: 1710773 - RNA, 22 nt, Human
uaccuuagugcaguuauuugcu

SEQ ID NO: 1710774 - RNA, 14 nt, Human
uaccuuagugcagu

SEQ ID NO: 1710775 - RNA, 16 nt, Human
uaccuuagugcaguua

SEQ ID NO: 1710776 - RNA, 17 nt, Human
uaccuuagugcaguuau

SEQ ID NO: 1710777 - RNA, 18 nt, Human
uaccuuagugcaguuauu

SEQ ID NO: 1710778 - RNA, 19 nt, Human
uaccuuagugcaguuauuu

SEQ ID NO: 1710779 - RNA, 20 nt, Human
uaccuuagugcaguuauuug

SEQ ID NO: 1710780 - RNA, 16 nt, Human
uaccucuaauaguaua

SEQ ID NO: 1710781 - RNA, 17 nt, Human
uaccucuaauaguauaa

SEQ ID NO: 1710782 - RNA, 18 nt, Human
uaccucuaauaguauaaa

SEQ ID NO: 1710783 - RNA, 19 nt, Human
uaccucuaauaguauaaac

SEQ ID NO: 1710784 - RNA, 13 nt, Human
uacuugucuguuu

SEQ ID NO: 1710785 - RNA, 19 nt, Human
uacuccaaaacuucguuua

SEQ ID NO: 1710786 - RNA, 22 nt, Human
uacuccaaaacuucguuuaaug

SEQ ID NO: 1710787 - RNA, 16 nt, Human
uacugcauuauuugag

SEQ ID NO: 1710788 - RNA, 23 nt, Human
uacaguucggugagcuacaaaug

SEQ ID NO: 1710789 - RNA, 15 nt, Human
uacagcugagcuaug

SEQ ID NO: 1710790 - RNA, 19 nt, Human
ugaagaccuuuuucugcac

SEQ ID NO: 1710791 - RNA, 21 nt, Human
ugaagaccuuuuucugcacua

SEQ ID NO: 1710792 - RNA, 22 nt, Human
ugaagaccuuuuucugcacuau

SEQ ID NO: 1710793 - RNA, 23 nt, Human
ugaagaccuuuuucugcacuaua

SEQ ID NO: 1710794 - RNA, 15 nt, Human
ugacuaaaccauugu

SEQ ID NO: 1710795 - RNA, 19 nt, Human
ugacuaaaccauugugcau

SEQ ID NO: 1710796 - RNA, 20 nt, Human
ugagaaagucagauucuugc

SEQ ID NO: 1710797 - RNA, 21 nt, Human
ugagaaagucagauucuugca

SEQ ID NO: 1710798 - RNA, 16 nt, Human
ucuuguaauuuggauc

SEQ ID NO: 1710799 - RNA, 19 nt, Human
ucuugccaaauauaaauaa

SEQ ID NO: 1710800 - RNA, 22 nt, Human
ucuucgacuguuguuaucuguu

SEQ ID NO: 1710801 - RNA, 14 nt, Human
ucuucgacuguugu

SEQ ID NO: 1710802 - RNA, 15 nt, Human
ucuucgacuguuguu

SEQ ID NO: 1710803 - RNA, 17 nt, Human
ucuucgacuguuguuau

SEQ ID NO: 1710804 - RNA, 14 nt, Human
ucuuauaauuuaaa

SEQ ID NO: 1710805 - RNA, 13 nt, Human
ucuuauaauuuaa

SEQ ID NO: 1710806 - RNA, 16 nt, Human
ucuucauggugacacu

SEQ ID NO: 1710807 - RNA, 17 nt, Human
ucuucauggugacacuc

SEQ ID NO: 1710808 - RNA, 21 nt, Human
ucuuuuuacccauuuguucau

SEQ ID NO: 1710809 - RNA, 18 nt, Human
ucugcacuauaugcaaac

SEQ ID NO: 1710810 - RNA, 15 nt, Human
ucugccucucuugua

SEQ ID NO: 1710811 - RNA, 16 nt, Human
uccauauggauccacu

SEQ ID NO: 1710812 - RNA, 21 nt, Human
uccauauggauccacuggcug

SEQ ID NO: 1710813 - RNA, 19 nt, Human
uccauauggauccacuggc

SEQ ID NO: 1710814 - RNA, 23 nt, Human
uccaugucaagauucagcuagug

SEQ ID NO: 1710815 - RNA, 19 nt, Human
ucauguacugcauuauuug

SEQ ID NO: 1710816 - RNA, 16 nt, Human
ucauguacugcauuau

SEQ ID NO: 1710817 - RNA, 17 nt, Human
ucucacugagcacuguu

SEQ ID NO: 1710818 - RNA, 18 nt, Human
ucucacugagcacuguuu

SEQ ID NO: 1710819 - RNA, 11 nt, Human
ucucacugagc

SEQ ID NO: 1710820 - RNA, 16 nt, Human
ucucacugagcacugu

SEQ ID NO: 1710821 - RNA, 14 nt, Human
uccuuugugaaaaa

SEQ ID NO: 1710822 - RNA, 23 nt, Human
uccuugcugaaacgcaucuaguu

SEQ ID NO: 1710823 - RNA, 13 nt, Human
uccucucaauaaa

SEQ ID NO: 1710824 - RNA, 16 nt, Human
uccuaugauguauacu

SEQ ID NO: 1710825 - RNA, 22 nt, Human
uccuaugauguauacugccacu

SEQ ID NO: 1710826 - RNA, 12 nt, Human
uccuaugaugua

SEQ ID NO: 1710827 - RNA, 15 nt, Human
uccuaugauguauac

SEQ ID NO: 1710828 - RNA, 13 nt, Human
ucccaugauuuca

SEQ ID NO: 1710829 - RNA, 14 nt, Human
ucccaugauuucau

SEQ ID NO: 1710830 - RNA, 16 nt, Human
ucccaugauuucaugu

SEQ ID NO: 1710831 - RNA, 19 nt, Human
ucccaugauuucauguacu

SEQ ID NO: 1710832 - RNA, 22 nt, Human
ucccaugauuucauguacugca

SEQ ID NO: 1710833 - RNA, 22 nt, Human
uggaauaauccuaaacauauga

SEQ ID NO: 1710834 - RNA, 13 nt, Human
uggaaacaagaug

SEQ ID NO: 1710835 - RNA, 21 nt, Human
uggauccacuggcuggacaaa

SEQ ID NO: 1710836 - RNA, 21 nt, Human
uggcuugaguuuaaauuguaa

SEQ ID NO: 1710837 - RNA, 14 nt, Human
uggcuggacaaacu

SEQ ID NO: 1710838 - RNA, 12 nt, Human
ugggacaauuag

SEQ ID NO: 1710839 - RNA, 22 nt, Human
ugggacaauuagauaaaugucc

SEQ ID NO: 1710840 - RNA, 23 nt, Human
ugcauauaagggaaguaguuauc

SEQ ID NO: 1710841 - RNA, 21 nt, Human
ugcauauaagggaaguaguua

SEQ ID NO: 1710842 - RNA, 22 nt, Human
ugcauauaagggaaguaguuau

SEQ ID NO: 1710843 - RNA, 19 nt, Human
ugccacuaaccuuccaaaa

SEQ ID NO: 1710844 - RNA, 18 nt, Human
ugccaaauauaaauaaaa

SEQ ID NO: 1710845 - RNA, 17 nt, Human
ugccaaauauaaauaaa

SEQ ID NO: 1710846 - RNA, 22 nt, Human
ugccaaauauaaauaaaaauaa

SEQ ID NO: 1710847 - RNA, 19 nt, Human
ugccaaauauaaauaaaaa

SEQ ID NO: 1710848 - RNA, 20 nt, Human
ugcugaaacgcaucuaguuc

SEQ ID NO: 1710849 - RNA, 23 nt, Human
uguaugaucaaauguuuaaucau

SEQ ID NO: 1710850 - RNA, 12 nt, Human
uguaugaucaaa

SEQ ID NO: 1710851 - RNA, 13 nt, Human
uguaugaucaaau

SEQ ID NO: 1710852 - RNA, 14 nt, Human
uguaugaucaaaug

SEQ ID NO: 1710853 - RNA, 15 nt, Human
uguaugaucaaaugu

SEQ ID NO: 1710854 - RNA, 16 nt, Human
uguaugaucaaauguu

SEQ ID NO: 1710855 - RNA, 18 nt, Human
uguaugaucaaauguuua

SEQ ID NO: 1710856 - RNA, 19 nt, Human
uguaugaucaaauguuuaa

SEQ ID NO: 1710857 - RNA, 20 nt, Human
uguaugaucaaauguuuaau

SEQ ID NO: 1710858 - RNA, 14 nt, Human
uguccaucagauga

SEQ ID NO: 1710859 - RNA, 16 nt, Human
uguccaucagaugaca

SEQ ID NO: 1710860 - RNA, 17 nt, Human
uguccaucagaugacaa

SEQ ID NO: 1710861 - RNA, 18 nt, Human
uguccaucagaugacaag

SEQ ID NO: 1710862 - RNA, 20 nt, Human
uguuuacauuuuauggugcc

SEQ ID NO: 1710863 - RNA, 13 nt, Human
uuaaugaaugcuu

SEQ ID NO: 1710864 - RNA, 15 nt, Human
uuaaugaaugcuuaa

SEQ ID NO: 1710865 - RNA, 17 nt, Human
uuaaugaaugcuuaaag

SEQ ID NO: 1710866 - RNA, 21 nt, Human
uuaaugaaugcuuaaagaauu

SEQ ID NO: 1710867 - RNA, 20 nt, Human
uuaaugaaugcuuaaagaau

SEQ ID NO: 1710868 - RNA, 17 nt, Human
uguucauauuaagaaug

SEQ ID NO: 1710869 - RNA, 18 nt, Human
uguucauauuaagaauga

SEQ ID NO: 1710870 - RNA, 23 nt, Human
uguucauauuaagaaugaucuga

SEQ ID NO: 1710871 - RNA, 16 nt, Human
uguuaguaauaccucu

SEQ ID NO: 1710872 - RNA, 14 nt, Human
uguuaguaauaccu

SEQ ID NO: 1710873 - RNA, 15 nt, Human
uguuaguaauaccuc

SEQ ID NO: 1710874 - RNA, 15 nt, Human
caccaguugcugcuu

SEQ ID NO: 1710875 - RNA, 18 nt, Human
caaucuucaauccuugaa

SEQ ID NO: 1710876 - RNA, 14 nt, Human
caaucuucaauccu

SEQ ID NO: 1710877 - RNA, 15 nt, Human
caaucuucaauccuu

SEQ ID NO: 1710878 - RNA, 16 nt, Human
caaauguuuaaucaua

SEQ ID NO: 1710879 - RNA, 17 nt, Human
caaauguuuaaucauau

SEQ ID NO: 1710880 - RNA, 19 nt, Human
caaauguuuaaucauauaa

SEQ ID NO: 1710881 - RNA, 20 nt, Human
caaauguuuaaucauauaaa

SEQ ID NO: 1710882 - RNA, 13 nt, Human
caaauuggagaaa

SEQ ID NO: 1710883 - RNA, 22 nt, Human
caaauguuuaaucauauaaaua

SEQ ID NO: 1710884 - RNA, 12 nt, Human
caacuugcaaaa

SEQ ID NO: 1710885 - RNA, 15 nt, Human
caacuugcaaaauca

SEQ ID NO: 1710886 - RNA, 20 nt, Human
caagaaaggcugcuguacug

SEQ ID NO: 1710887 - RNA, 18 nt, Human
caacuugcaaaaucaguu

SEQ ID NO: 1710888 - RNA, 19 nt, Human
caacuugcaaaaucaguuu

SEQ ID NO: 1710889 - RNA, 20 nt, Human
caacuugcaaaaucaguuuu

SEQ ID NO: 1710890 - RNA, 18 nt, Human
caagggcagcuuugcuca

SEQ ID NO: 1710891 - RNA, 11 nt, Human
caagggcagcu

SEQ ID NO: 1710892 - RNA, 14 nt, Human
caagggcagcuuug

SEQ ID NO: 1710893 - RNA, 15 nt, Human
auccuugaagguaua

SEQ ID NO: 1710894 - RNA, 14 nt, Human
auccuugaagguau

SEQ ID NO: 1710895 - RNA, 22 nt, Human
auauuuuuuuucuuuuuaccca

SEQ ID NO: 1710896 - RNA, 15 nt, Human
augcucuuauuucau

SEQ ID NO: 1710897 - RNA, 17 nt, Human
augcucuuauuucauca

SEQ ID NO: 1710898 - RNA, 19 nt, Human
augcucuuauuucaucauu

SEQ ID NO: 1710899 - RNA, 18 nt, Human
augcucuuauuucaucau

SEQ ID NO: 1710900 - RNA, 23 nt, Human
augcauauuuuuuuucuuuuuac

SEQ ID NO: 1710901 - RNA, 24 nt, Human
augaauaccuuagugcaguuauuu

SEQ ID NO: 1710902 - RNA, 23 nt, Human
agugcuaacaugaagaccuuuuu

SEQ ID NO: 1710903 - RNA, 16 nt, Human
agugcuaacaugaaga

SEQ ID NO: 1710904 - RNA, 17 nt, Human
agugcuaacaugaagac

SEQ ID NO: 1710905 - RNA, 19 nt, Human
agugcuaacaugaagaccu

SEQ ID NO: 1710906 - RNA, 22 nt, Human
agugcuaacaugaagaccuuuu

SEQ ID NO: 1710907 - RNA, 23 nt, Human
aguaaacaauaaaaguguccauu

SEQ ID NO: 1710908 - RNA, 15 nt, Human
auaaaagacagugaa

SEQ ID NO: 1710909 - RNA, 16 nt, Human
auaaaagacagugaaa

SEQ ID NO: 1710910 - RNA, 18 nt, Human
aguuacacaugaucauaa

SEQ ID NO: 1710911 - RNA, 21 nt, Human
aguggccaagagaugcagugc

SEQ ID NO: 1710912 - RNA, 18 nt, Human
agaugacaagaaaggcug

SEQ ID NO: 1710913 - RNA, 12 nt, Human
agcaaauccuuu

SEQ ID NO: 1710914 - RNA, 20 nt, Human
agcaaauccuuugugaaaaa

SEQ ID NO: 1710915 - RNA, 20 nt, Human
agauagauaggucagugcaa

SEQ ID NO: 1710916 - RNA, 15 nt, Human
agcaucucagcucau

SEQ ID NO: 1710917 - RNA, 14 nt, Human
agaaugaucugauu

SEQ ID NO: 1710918 - RNA, 17 nt, Human
agaaugaucugauugac

SEQ ID NO: 1710919 - RNA, 16 nt, Human
agaaugaucugauuga

SEQ ID NO: 1710920 - RNA, 15 nt, Human
agaacaaaugaagac

SEQ ID NO: 1710921 - RNA, 12 nt, Human
agaacaaaugaa

SEQ ID NO: 1710922 - RNA, 19 nt, Human
agacaaggaaaaaauaaca

SEQ ID NO: 1710923 - RNA, 19 nt, Human
agacaaaacauacauuuug

SEQ ID NO: 1710924 - RNA, 14 nt, Human
agaccuuuuucugc

SEQ ID NO: 1710925 - RNA, 18 nt, Human
agaccuuuuucugcacua

SEQ ID NO: 1710926 - RNA, 20 nt, Human
agaccuuuuucugcacuaua

SEQ ID NO: 1710927 - RNA, 14 nt, Human
aggaagguacugua

SEQ ID NO: 1710928 - RNA, 15 nt, Human
aggaagguacuguau

SEQ ID NO: 1710929 - RNA, 17 nt, Human
aggaagguacuguauga

SEQ ID NO: 1710930 - RNA, 18 nt, Human
aggaagguacuguaugau

SEQ ID NO: 1710931 - RNA, 18 nt, Human
aggaaaaaauaacaauga

SEQ ID NO: 1710932 - RNA, 22 nt, Human
agcuuugucacuguuucacuac

SEQ ID NO: 1710933 - RNA, 13 nt, Human
agcuacaaaugca

SEQ ID NO: 1710934 - RNA, 12 nt, Human
agcuacaaaugc

SEQ ID NO: 1710935 - RNA, 17 nt, Human
aggcucuguuccacaua

SEQ ID NO: 1710936 - RNA, 20 nt, Human
acugacaagcuccauuuaaa

SEQ ID NO: 1710937 - RNA, 17 nt, Human
acugacaagcuccauuu

SEQ ID NO: 1710938 - RNA, 17 nt, Human
acuguaaaauaauaacu

SEQ ID NO: 1710939 - RNA, 20 nt, Human
acuguuucacuacucagcau

SEQ ID NO: 1710940 - RNA, 14 nt, Human
acgcuuaaauacag

SEQ ID NO: 1710941 - RNA, 23 nt, Human
aauuauagcucuaauguuugcau

SEQ ID NO: 1710942 - RNA, 17 nt, Human
aauuauagcucuaaugu

SEQ ID NO: 1710943 - RNA, 18 nt, Human
aauuauagcucuaauguu

SEQ ID NO: 1710944 - RNA, 19 nt, Human
aauuauagcucuaauguuu

SEQ ID NO: 1710945 - RNA, 20 nt, Human
aauuauagcucuaauguuug

SEQ ID NO: 1710946 - RNA, 22 nt, Human
aauuauagcucuaauguuugca

SEQ ID NO: 1710947 - RNA, 11 nt, Human
aauuguaauag

SEQ ID NO: 1710948 - RNA, 20 nt, Human
acaaguguaaugaauaccuu

SEQ ID NO: 1710949 - RNA, 13 nt, Human
acaaguguaauga

SEQ ID NO: 1710950 - RNA, 16 nt, Human
acaaguguaaugaaua

SEQ ID NO: 1710951 - RNA, 22 nt, Human
acaaacugcaccaguugcugcu

SEQ ID NO: 1710952 - RNA, 14 nt, Human
acaaacaauaccug

SEQ ID NO: 1710953 - RNA, 20 nt, Human
aaugaauacuuuauaaagga

SEQ ID NO: 1710954 - RNA, 12 nt, Human
aaugaauaccuu

SEQ ID NO: 1710955 - RNA, 13 nt, Human
aaugaauaccuua

SEQ ID NO: 1710956 - RNA, 23 nt, Human
aacgcaucuaguuccccuguuua

SEQ ID NO: 1710957 - RNA, 22 nt, Human
aacgcaucuaguuccccuguuu

SEQ ID NO: 1710958 - RNA, 21 nt, Human
aagacaaggaaaaaauaacaa

SEQ ID NO: 1710959 - RNA, 20 nt, Human
aacaugacuccauagaccuu

SEQ ID NO: 1710960 - RNA, 18 nt, Human
aacaugaagaccuuuuuc

SEQ ID NO: 1710961 - RNA, 22 nt, Human
aacaugaagaccuuuuucugca

SEQ ID NO: 1710962 - RNA, 14 nt, Human
aacaugaagaccuu

SEQ ID NO: 1710963 - RNA, 23 nt, Human
aacaugaagaccuuuuucugcac

SEQ ID NO: 1710964 - RNA, 20 nt, Human
aaaagacaaggaaaaaauaa

SEQ ID NO: 1710965 - RNA, 18 nt, Human
aaauuauagcucuaaugu

SEQ ID NO: 1710966 - RNA, 18 nt, Human
aaauuagccaguaauccu

SEQ ID NO: 1710967 - RNA, 15 nt, Human
aaauuauagcucuaa

SEQ ID NO: 1710968 - RNA, 21 nt, Human
aaauuauagcucuaauguuug

SEQ ID NO: 1710969 - RNA, 22 nt, Human
aaauguuauuucccuacauuaa

SEQ ID NO: 1710970 - RNA, 18 nt, Human
aaauuacuuaguauugca

SEQ ID NO: 1710971 - RNA, 14 nt, Human
aaauguuauuuccc

SEQ ID NO: 1710972 - RNA, 18 nt, Human
aaauuucagcagcugcag

SEQ ID NO: 1710973 - RNA, 17 nt, Human
aaauuucagcagcugca

SEQ ID NO: 1710974 - RNA, 20 nt, Human
guauugacaaaauguuauuu

SEQ ID NO: 1710975 - RNA, 12 nt, Human
guaguuaucaug

SEQ ID NO: 1710976 - RNA, 13 nt, Human
guaguuaucaugu

SEQ ID NO: 1710977 - RNA, 14 nt, Human
guaguuaucauguu

SEQ ID NO: 1710978 - RNA, 16 nt, Human
guaguuaucauguuag

SEQ ID NO: 1710979 - RNA, 15 nt, Human
guaguuaucauguua

SEQ ID NO: 1710980 - RNA, 15 nt, Human
aaauccuuugugaaa

SEQ ID NO: 1710981 - RNA, 22 nt, Human
guaggaagguacuguaugauca

SEQ ID NO: 1710982 - RNA, 17 nt, Human
guaggaagguacuguau

SEQ ID NO: 1710983 - RNA, 19 nt, Human
guaggaagguacuguauga

SEQ ID NO: 1710984 - RNA, 14 nt, Human
aaaugcauuucuaa

SEQ ID NO: 1710985 - RNA, 19 nt, Human
gucuuauauauuguagaua

SEQ ID NO: 1710986 - RNA, 21 nt, Human
aacaagccuccuuuuaaagua

SEQ ID NO: 1710987 - RNA, 12 nt, Human
aacaauaccuga

SEQ ID NO: 1710988 - RNA, 21 nt, Human
aacaauaccugaaugcucugu

SEQ ID NO: 1710989 - RNA, 20 nt, Human
aacaauaccugaaugcucug

SEQ ID NO: 1710990 - RNA, 16 nt, Human
aacauacauuuuguac

SEQ ID NO: 1710991 - RNA, 19 nt, Human
aacauacauuuuguaccaa

SEQ ID NO: 1710992 - RNA, 23 nt, Human
guuauuucccuacauuaaacaug

SEQ ID NO: 1710993 - RNA, 21 nt, Human
guuauuucccuacauuaaaca

SEQ ID NO: 1710994 - RNA, 14 nt, Human
guuaguaauaccuc

SEQ ID NO: 1710995 - RNA, 20 nt, Human
guuguagagaaaacaugcag

SEQ ID NO: 1710996 - RNA, 16 nt, Human
guugcugcuucaauuu

SEQ ID NO: 1710997 - RNA, 15 nt, Human
guuggucuguacuga

SEQ ID NO: 1710998 - RNA, 16 nt, Human
guuggucuguacugau

SEQ ID NO: 1710999 - RNA, 14 nt, Human
aagguacuguauga

SEQ ID NO: 1711000 - RNA, 15 nt, Human
aagguacuguaugau

SEQ ID NO: 1711001 - RNA, 17 nt, Human
aagguacuguaugauca

SEQ ID NO: 1711002 - RNA, 19 nt, Human
aagguacuguaugaucaaa

SEQ ID NO: 1711003 - RNA, 20 nt, Human
aagguacuguaugaucaaau

SEQ ID NO: 1711004 - RNA, 21 nt, Human
aagguacuguaugaucaaaug

SEQ ID NO: 1711005 - RNA, 22 nt, Human
aagguacuguaugaucaaaugu

SEQ ID NO: 1711006 - RNA, 14 nt, Human
guguuggucuguac

SEQ ID NO: 1711007 - RNA, 19 nt, Human
aagaaugaucugauugacc

SEQ ID NO: 1711008 - RNA, 21 nt, Human
aagacaaaacauacauuuugu

SEQ ID NO: 1711009 - RNA, 12 nt, Human
guggauguuacu

SEQ ID NO: 1711010 - RNA, 18 nt, Human
aagaaguggggcagcagc

SEQ ID NO: 1711011 - RNA, 19 nt, Human
aagaaguggggcagcagca

SEQ ID NO: 1711012 - RNA, 16 nt, Human
gugccuaguauugaca

SEQ ID NO: 1711013 - RNA, 18 nt, Human
gugccuaguauugacaaa

SEQ ID NO: 1711014 - RNA, 20 nt, Human
gugccuaguauugacaaaau

SEQ ID NO: 1711015 - RNA, 14 nt, Human
gugccuaguauuga

SEQ ID NO: 1711016 - RNA, 16 nt, Human
uacauagugcuaacau

SEQ ID NO: 1711017 - RNA, 23 nt, Human
uacauagugcuaacaugaagacc

SEQ ID NO: 1711018 - RNA, 21 nt, Human
uacauagugcuaacaugaaga

SEQ ID NO: 1711019 - RNA, 22 nt, Human
uacauagugcuaacaugaagac

SEQ ID NO: 1711020 - RNA, 19 nt, Human
aauggacuuuuguacauag

SEQ ID NO: 1711021 - RNA, 14 nt, Human
uaauaguauaaacc

SEQ ID NO: 1711022 - RNA, 15 nt, Human
aaucuuccaauuuag

SEQ ID NO: 1711023 - RNA, 23 nt, Human
aaucuuccaauuuaguuguugua

SEQ ID NO: 1711024 - RNA, 12 nt, Human
uaaucauauaaa

SEQ ID NO: 1711025 - RNA, 13 nt, Human
uaaucauauaaau

SEQ ID NO: 1711026 - RNA, 17 nt, Human
uaaucauauaaauagaa

SEQ ID NO: 1711027 - RNA, 19 nt, Human
uaaucauauaaauagaaug

SEQ ID NO: 1711028 - RNA, 20 nt, Human
uaaucauauaaauagaaugu

SEQ ID NO: 1711029 - RNA, 21 nt, Human
uaaucauauaaauagaaugua

SEQ ID NO: 1711030 - RNA, 15 nt, Human
aaucaucaagucuuu

SEQ ID NO: 1711031 - RNA, 16 nt, Human
aaucuuauaauuuaaa

SEQ ID NO: 1711032 - RNA, 14 nt, Human
aaucuuauaauuua

SEQ ID NO: 1711033 - RNA, 20 nt, Human
aauccucaguuuuugugaaa

SEQ ID NO: 1711034 - RNA, 15 nt, Human
aauccuugaagguau

SEQ ID NO: 1711035 - RNA, 20 nt, Human
aauccuugaagguauaucua

SEQ ID NO: 1711036 - RNA, 18 nt, Human
aauaggcguaacuaauuu

SEQ ID NO: 1711037 - RNA, 13 nt, Human
uaagaaugaucug

SEQ ID NO: 1711038 - RNA, 16 nt, Human
uaacuaacuaaaacaa

SEQ ID NO: 1711039 - RNA, 20 nt, Human
uaacuaauacagcugagcua

SEQ ID NO: 1711040 - RNA, 20 nt, Human
uaaauagaauguaaaugucu

SEQ ID NO: 1711041 - RNA, 13 nt, Human
uaaauagaaugua

SEQ ID NO: 1711042 - RNA, 16 nt, Human
uaaauagaauguaaau

SEQ ID NO: 1711043 - RNA, 18 nt, Human
uaaauagaauguaaaugu

SEQ ID NO: 1711044 - RNA, 21 nt, Human
aauaacaaugaaaguugauaa

SEQ ID NO: 1711045 - RNA, 15 nt, Human
aauaacgauaaaaga

SEQ ID NO: 1711046 - RNA, 16 nt, Human
uagcuacuaauuuuaa

SEQ ID NO: 1711047 - RNA, 17 nt, Human
acaagcuccauuuaaac

SEQ ID NO: 1711048 - RNA, 18 nt, Human
acaagcuccauuuaaaca

SEQ ID NO: 1711049 - RNA, 22 nt, Human
acaauaaaaguguccauugaaa

SEQ ID NO: 1711050 - RNA, 22 nt, Human
uagauaggucagugcaaauacu

SEQ ID NO: 1711051 - RNA, 18 nt, Human
acaaagccacuuucaauc

SEQ ID NO: 1711052 - RNA, 15 nt, Human
uacuuaguauugcaa

SEQ ID NO: 1711053 - RNA, 20 nt, Human
uacuuaguauugcaaaguca

SEQ ID NO: 1711054 - RNA, 17 nt, Human
uacuuaguauugcaaag

SEQ ID NO: 1711055 - RNA, 16 nt, Human
aauuuaguuguuguag

SEQ ID NO: 1711056 - RNA, 18 nt, Human
aauuuauaccucaauuuu

SEQ ID NO: 1711057 - RNA, 20 nt, Human
aauuuauaccucaauuuuca

SEQ ID NO: 1711058 - RNA, 21 nt, Human
aauuuauaccucaauuuucac

SEQ ID NO: 1711059 - RNA, 22 nt, Human
uauaagggcaaauuggagaaaa

SEQ ID NO: 1711060 - RNA, 21 nt, Human
uauaagggaaguaguuaucau

SEQ ID NO: 1711061 - RNA, 24 nt, Human
uauaagggaaguaguuaucauguu

SEQ ID NO: 1711062 - RNA, 12 nt, Human
uauauuuacaaa

SEQ ID NO: 1711063 - RNA, 14 nt, Human
acagauguccauca

SEQ ID NO: 1711064 - RNA, 16 nt, Human
acagauguccaucaga

SEQ ID NO: 1711065 - RNA, 22 nt, Human
acagauguccaucagaugacaa

SEQ ID NO: 1711066 - RNA, 21 nt, Human
acagauguccaucagaugaca

SEQ ID NO: 1711067 - RNA, 21 nt, Human
uagguuuaugacaguaauugu

SEQ ID NO: 1711068 - RNA, 12 nt, Human
uaguaauaccuc

SEQ ID NO: 1711069 - RNA, 13 nt, Human
uaguaauaccucu

SEQ ID NO: 1711070 - RNA, 15 nt, Human
uaguaauaccucuaa

SEQ ID NO: 1711071 - RNA, 17 nt, Human
uagguuuaugacaguaa

SEQ ID NO: 1711072 - RNA, 19 nt, Human
uagguuuaugacaguaauu

SEQ ID NO: 1711073 - RNA, 20 nt, Human
uagguuuaugacaguaauug

SEQ ID NO: 1711074 - RNA, 14 nt, Human
uagcuuauguuaac

SEQ ID NO: 1711075 - RNA, 11 nt, Human
uaguuaucaug

SEQ ID NO: 1711076 - RNA, 12 nt, Human
uaguuaucaugu

SEQ ID NO: 1711077 - RNA, 13 nt, Human
uaguuaucauguu

SEQ ID NO: 1711078 - RNA, 14 nt, Human
uaguuaucauguua

SEQ ID NO: 1711079 - RNA, 15 nt, Human
uaguuaucauguuag

SEQ ID NO: 1711080 - RNA, 16 nt, Human
uaguuaucauguuagu

SEQ ID NO: 1711081 - RNA, 23 nt, Human
uaguuaucauguuaguaauaccu

SEQ ID NO: 1711082 - RNA, 18 nt, Human
uaguuuugucacaauuau

SEQ ID NO: 1711083 - RNA, 15 nt, Human
ucaauucuugccaaa

SEQ ID NO: 1711084 - RNA, 15 nt, Human
ucaauuuucacugug

SEQ ID NO: 1711085 - RNA, 16 nt, Human
ucaauuuucacugugu

SEQ ID NO: 1711086 - RNA, 23 nt, Human
accaauuauaagggcaaauugga

SEQ ID NO: 1711087 - RNA, 15 nt, Human
ucacuacucagcaug

SEQ ID NO: 1711088 - RNA, 14 nt, Human
ucacuacucagcau

SEQ ID NO: 1711089 - RNA, 23 nt, Human
accauuucuugagguaaaagcau

SEQ ID NO: 1711090 - RNA, 21 nt, Human
uauuuuuaucaguuacacaug

SEQ ID NO: 1711091 - RNA, 14 nt, Human
ucaaaaugcucuua

SEQ ID NO: 1711092 - RNA, 16 nt, Human
ucaaaaugcucuuauu

SEQ ID NO: 1711093 - RNA, 19 nt, Human
ucaaaaugcucuuauuuca

SEQ ID NO: 1711094 - RNA, 20 nt, Human
ucaaaaugcucuuauuucau

SEQ ID NO: 1711095 - RNA, 22 nt, Human
ucaaaaugcucuuauuucauca

SEQ ID NO: 1711096 - RNA, 21 nt, Human
ucaaaaugcucuuauuucauc

SEQ ID NO: 1711097 - RNA, 14 nt, Human
ucaaagcugaaaug

SEQ ID NO: 1711098 - RNA, 13 nt, Human
acaugaagaccuu

SEQ ID NO: 1711099 - RNA, 14 nt, Human
acaugaagaccuuu

SEQ ID NO: 1711100 - RNA, 20 nt, Human
acaugaagaccuuuuucugc

SEQ ID NO: 1711101 - RNA, 21 nt, Human
acaugaagaccuuuuucugca

SEQ ID NO: 1711102 - RNA, 19 nt, Human
ucaagggcagcuuugcuca

SEQ ID NO: 1711103 - RNA, 20 nt, Human
ucaagggcagcuuugcucau

SEQ ID NO: 1711104 - RNA, 21 nt, Human
ucaagggcagcuuugcucaua

SEQ ID NO: 1711105 - RNA, 23 nt, Human
ucaagggcagcuuugcucauauu

SEQ ID NO: 1711106 - RNA, 13 nt, Human
ucaagauucagcu

SEQ ID NO: 1711107 - RNA, 14 nt, Human
ucaagauucagcua

SEQ ID NO: 1711108 - RNA, 15 nt, Human
ucaagauucagcuag

SEQ ID NO: 1711109 - RNA, 20 nt, Human
acauagugcuaacaugaaga

SEQ ID NO: 1711110 - RNA, 14 nt, Human
acauacauuuugua

SEQ ID NO: 1711111 - RNA, 13 nt, Human
acaguugcacagc

SEQ ID NO: 1711112 - RNA, 14 nt, Human
acaguugcacagca

SEQ ID NO: 1711113 - RNA, 15 nt, Human
acaguugcacagcau

SEQ ID NO: 1711114 - RNA, 19 nt, Human
acaguugcacagcaucuca

SEQ ID NO: 1711115 - RNA, 20 nt, Human
acaguugcacagcaucucag

SEQ ID NO: 1711116 - RNA, 23 nt, Human
acaguugcacagcaucucagcuc

SEQ ID NO: 1711117 - RNA, 13 nt, Human
uauuuccacuucu

SEQ ID NO: 1711118 - RNA, 15 nt, Human
uauuuccuaugaugu

SEQ ID NO: 1711119 - RNA, 16 nt, Human
uauuuccuaugaugua

SEQ ID NO: 1711120 - RNA, 17 nt, Human
uauuuccuaugauguau

SEQ ID NO: 1711121 - RNA, 17 nt, Human
uauuucccuacauuaaa

SEQ ID NO: 1711122 - RNA, 22 nt, Human
uauuucccuacauuaaacauga

SEQ ID NO: 1711123 - RNA, 21 nt, Human
uauuucccaugauuucaugua

SEQ ID NO: 1711124 - RNA, 15 nt, Human
uauuucccaugauuu

SEQ ID NO: 1711125 - RNA, 16 nt, Human
uauuucccaugauuuc

SEQ ID NO: 1711126 - RNA, 18 nt, Human
uauuucccaugauuucau

SEQ ID NO: 1711127 - RNA, 15 nt, Human
uauuucccuacauua

SEQ ID NO: 1711128 - RNA, 16 nt, Human
uauuucccuacauuaa

SEQ ID NO: 1711129 - RNA, 14 nt, Human
acgagaaaacaaua

SEQ ID NO: 1711130 - RNA, 21 nt, Human
acgagaaccugaaggggaagg

SEQ ID NO: 1711131 - RNA, 17 nt, Human
acuacucagcauggaaa

SEQ ID NO: 1711132 - RNA, 12 nt, Human
acuacucagcau

SEQ ID NO: 1711133 - RNA, 13 nt, Human
acuacucagcaug

SEQ ID NO: 1711134 - RNA, 17 nt, Human
ucuaccaaccuguucaa

SEQ ID NO: 1711135 - RNA, 20 nt, Human
ucuaaagccauuguaguccu

SEQ ID NO: 1711136 - RNA, 16 nt, Human
acuuaguauugcaaag

SEQ ID NO: 1711137 - RNA, 19 nt, Human
acuuaguauugcaaaguca

SEQ ID NO: 1711138 - RNA, 20 nt, Human
acuuaguauugcaaagucag

SEQ ID NO: 1711139 - RNA, 21 nt, Human
acuguguccaggugguacuuu

SEQ ID NO: 1711140 - RNA, 13 nt, Human
acugugcuguugu

SEQ ID NO: 1711141 - RNA, 14 nt, Human
acugugcuguuguu

SEQ ID NO: 1711142 - RNA, 18 nt, Human
acugugcuguuguuauga

SEQ ID NO: 1711143 - RNA, 23 nt, Human
acugugcuguuguuaugaugugc

SEQ ID NO: 1711144 - RNA, 22 nt, Human
acugugcuguuguuaugaugug

SEQ ID NO: 1711145 - RNA, 22 nt, Human
ucgggcagcacaaguguaauga

SEQ ID NO: 1711146 - RNA, 21 nt, Human
ucgggcagcacaaguguaaug

SEQ ID NO: 1711147 - RNA, 17 nt, Human
acugcauuauuugagaa

SEQ ID NO: 1711148 - RNA, 14 nt, Human
acugcauuauuuga

SEQ ID NO: 1711149 - RNA, 15 nt, Human
ucgacuguuguuauc

SEQ ID NO: 1711150 - RNA, 14 nt, Human
ucgacuguuguuau

SEQ ID NO: 1711151 - RNA, 17 nt, Human
ucgacuguuguuaucug

SEQ ID NO: 1711152 - RNA, 17 nt, Human
acuucguuuaaugaaug

SEQ ID NO: 1711153 - RNA, 20 nt, Human
acuucguuuaaugaaugcuu

SEQ ID NO: 1711154 - RNA, 18 nt, Human
acuucguuuaaugaaugc

SEQ ID NO: 1711155 - RNA, 16 nt, Human
ucuauuucauaccaug

SEQ ID NO: 1711156 - RNA, 16 nt, Human
ucucagcucaucuuca

SEQ ID NO: 1711157 - RNA, 20 nt, Human
ucucagcucaucuucacugc

SEQ ID NO: 1711158 - RNA, 15 nt, Human
ucuguacugauucaa

SEQ ID NO: 1711159 - RNA, 16 nt, Human
ucuguacugauucaau

SEQ ID NO: 1711160 - RNA, 17 nt, Human
ucuguacugauucaauu

SEQ ID NO: 1711161 - RNA, 23 nt, Human
ucuguacugauucaauuugaugu

SEQ ID NO: 1711162 - RNA, 19 nt, Human
ucuuaauguacauagugcu

SEQ ID NO: 1711163 - RNA, 13 nt, Human
ucuuaauguacau

SEQ ID NO: 1711164 - RNA, 14 nt, Human
ucuuaauguacaua

SEQ ID NO: 1711165 - RNA, 18 nt, Human
agacuuacagcaaauccu

SEQ ID NO: 1711166 - RNA, 20 nt, Human
agacuuacagcaaauccuuu

SEQ ID NO: 1711167 - RNA, 15 nt, Human
agacuuacagcaaau

SEQ ID NO: 1711168 - RNA, 16 nt, Human
ucuucuuaauguacau

SEQ ID NO: 1711169 - RNA, 24 nt, Human
ucuucuuaauguacauagugcuaa

SEQ ID NO: 1711170 - RNA, 17 nt, Human
ucuucuuaauguacaua

SEQ ID NO: 1711171 - RNA, 18 nt, Human
ucuugaguuuuucaggua

SEQ ID NO: 1711172 - RNA, 15 nt, Human
ugaaauuguauuaca

SEQ ID NO: 1711173 - RNA, 18 nt, Human
agcagguugauaaaucau

SEQ ID NO: 1711174 - RNA, 15 nt, Human
agcauuuucugcauc

SEQ ID NO: 1711175 - RNA, 18 nt, Human
agcauuuucugcaucucc

SEQ ID NO: 1711176 - RNA, 19 nt, Human
agcauuuucugcaucucca

SEQ ID NO: 1711177 - RNA, 20 nt, Human
agcauuuucugcaucuccac

SEQ ID NO: 1711178 - RNA, 18 nt, Human
ugcaaagucaggaaucau

SEQ ID NO: 1711179 - RNA, 17 nt, Human
ugcaaagucaggaauca

SEQ ID NO: 1711180 - RNA, 20 nt, Human
ugcaguaucggcacuguaca

SEQ ID NO: 1711181 - RNA, 21 nt, Human
ugcaguaucggcacuguacaa

SEQ ID NO: 1711182 - RNA, 14 nt, Human
uggaguugaaaauc

SEQ ID NO: 1711183 - RNA, 20 nt, Human
uggauuggacaaaaugacuu

SEQ ID NO: 1711184 - RNA, 13 nt, Human
uggauuggacaaa

SEQ ID NO: 1711185 - RNA, 15 nt, Human
uggauuggacaaaau

SEQ ID NO: 1711186 - RNA, 19 nt, Human
uggauuggacaaaaugacu

SEQ ID NO: 1711187 - RNA, 13 nt, Human
ugcucaacuugca

SEQ ID NO: 1711188 - RNA, 16 nt, Human
ugcucaacuugcaaaa

SEQ ID NO: 1711189 - RNA, 20 nt, Human
ugcucaacuugcaaaaucag

SEQ ID NO: 1711190 - RNA, 17 nt, Human
ugcucaacuugcaaaau

SEQ ID NO: 1711191 - RNA, 13 nt, Human
ugcucuuauuuca

SEQ ID NO: 1711192 - RNA, 14 nt, Human
ugcucuuauuucau

SEQ ID NO: 1711193 - RNA, 13 nt, Human
agcuuugcucaua

SEQ ID NO: 1711194 - RNA, 19 nt, Human
agcuuugcucauauuuccc

SEQ ID NO: 1711195 - RNA, 20 nt, Human
agcuuugcucauauuuccca

SEQ ID NO: 1711196 - RNA, 21 nt, Human
agcuuugcucauauuucccau

SEQ ID NO: 1711197 - RNA, 24 nt, Human
uggugccuaguauugacaaaaugu

SEQ ID NO: 1711198 - RNA, 15 nt, Human
uggugccuaguauug

SEQ ID NO: 1711199 - RNA, 19 nt, Human
uggugccuaguauugacaa

SEQ ID NO: 1711200 - RNA, 22 nt, Human
uggugccuaguauugacaaaau

SEQ ID NO: 1711201 - RNA, 12 nt, Human
aguauugacaaa

SEQ ID NO: 1711202 - RNA, 13 nt, Human
aguauugacaaaa

SEQ ID NO: 1711203 - RNA, 14 nt, Human
aguauugacaaaau

SEQ ID NO: 1711204 - RNA, 15 nt, Human
aguauugacaaaaug

SEQ ID NO: 1711205 - RNA, 16 nt, Human
aguauugacaaaaugu

SEQ ID NO: 1711206 - RNA, 17 nt, Human
aguauugacaaaauguu

SEQ ID NO: 1711207 - RNA, 18 nt, Human
aguauugacaaaauguua

SEQ ID NO: 1711208 - RNA, 19 nt, Human
aguauugacaaaauguuau

SEQ ID NO: 1711209 - RNA, 20 nt, Human
aguauugacaaaauguuauu

SEQ ID NO: 1711210 - RNA, 23 nt, Human
ugucaagggcagcuuugcucaua

SEQ ID NO: 1711211 - RNA, 13 nt, Human
uguaucaaaaugc

SEQ ID NO: 1711212 - RNA, 14 nt, Human
uguaucaaaaugcu

SEQ ID NO: 1711213 - RNA, 15 nt, Human
uguaucaaaaugcuc

SEQ ID NO: 1711214 - RNA, 18 nt, Human
uguaucaaaaugcucuua

SEQ ID NO: 1711215 - RNA, 23 nt, Human
uguaucaaaaugcucuuauuuca

SEQ ID NO: 1711216 - RNA, 13 nt, Human
uguauuacaaauc

SEQ ID NO: 1711217 - RNA, 22 nt, Human
uguauuacaaauccaaugaaau

SEQ ID NO: 1711218 - RNA, 21 nt, Human
ugucaagggcagcuuugcuca

SEQ ID NO: 1711219 - RNA, 22 nt, Human
ugucaagggcagcuuugcucau

SEQ ID NO: 1711220 - RNA, 13 nt, Human
aguaaaauccaca

SEQ ID NO: 1711221 - RNA, 12 nt, Human
agguuuaugaca

SEQ ID NO: 1711222 - RNA, 16 nt, Human
agguuuaugacaguaa

SEQ ID NO: 1711223 - RNA, 14 nt, Human
agguuuaugacagu

SEQ ID NO: 1711224 - RNA, 18 nt, Human
agggaacgugauuaguga

SEQ ID NO: 1711225 - RNA, 15 nt, Human
agggaaguaguuauc

SEQ ID NO: 1711226 - RNA, 17 nt, Human
agggaaguaguuaucau

SEQ ID NO: 1711227 - RNA, 20 nt, Human
agggaaguaguuaucauguu

SEQ ID NO: 1711228 - RNA, 17 nt, Human
agggcagcuuugcucau

SEQ ID NO: 1711229 - RNA, 16 nt, Human
agggcagcuuugcuca

SEQ ID NO: 1711230 - RNA, 18 nt, Human
aggguaacuaacuaaaac

SEQ ID NO: 1711231 - RNA, 12 nt, Human
auaaaauuauag

SEQ ID NO: 1711232 - RNA, 17 nt, Human
auaaaauuauagcucua

SEQ ID NO: 1711233 - RNA, 21 nt, Human
auaaaauuauagcucuaaugu

SEQ ID NO: 1711234 - RNA, 19 nt, Human
auaaaauuauagcucuaau

SEQ ID NO: 1711235 - RNA, 14 nt, Human
auaaauagaaugua

SEQ ID NO: 1711236 - RNA, 16 nt, Human
auaaauagaauguaaa

SEQ ID NO: 1711237 - RNA, 20 nt, Human
auaaauagaauguaaauguc

SEQ ID NO: 1711238 - RNA, 19 nt, Human
auaaauagaauguaaaugu

SEQ ID NO: 1711239 - RNA, 15 nt, Human
aguucuucgacuguu

SEQ ID NO: 1711240 - RNA, 17 nt, Human
aguucuucgacuguugu

SEQ ID NO: 1711241 - RNA, 18 nt, Human
aguucuucgacuguuguu

SEQ ID NO: 1711242 - RNA, 19 nt, Human
aguucuucgacuguuguua

SEQ ID NO: 1711243 - RNA, 18 nt, Human
uuaaaaaccuguucaagu

SEQ ID NO: 1711244 - RNA, 21 nt, Human
uuaaaaaccuguucaagucua

SEQ ID NO: 1711245 - RNA, 15 nt, Human
uguggguuuuuauuu

SEQ ID NO: 1711246 - RNA, 15 nt, Human
agugaaagaaaauaa

SEQ ID NO: 1711247 - RNA, 20 nt, Human
agugaaaggaagauaaacgu

SEQ ID NO: 1711248 - RNA, 17 nt, Human
auauuaagaaugaucug

SEQ ID NO: 1711249 - RNA, 13 nt, Human
auauuaagaauga

SEQ ID NO: 1711250 - RNA, 14 nt, Human
auauuaagaaugau

SEQ ID NO: 1711251 - RNA, 18 nt, Human
auauugcugaaugcaaga

SEQ ID NO: 1711252 - RNA, 12 nt, Human
aucagaugacaa

SEQ ID NO: 1711253 - RNA, 21 nt, Human
aucauucacuucacugugcug

SEQ ID NO: 1711254 - RNA, 17 nt, Human
aucauucacuucacugu

SEQ ID NO: 1711255 - RNA, 19 nt, Human
aucauucacuucacugugc

SEQ ID NO: 1711256 - RNA, 22 nt, Human
aucauucacuucacugugcugu

SEQ ID NO: 1711257 - RNA, 16 nt, Human
uucugcaucuccacuu

SEQ ID NO: 1711258 - RNA, 19 nt, Human
aucccuggcugggauccac

SEQ ID NO: 1711259 - RNA, 19 nt, Human
uuauuucccuacauuaaac

SEQ ID NO: 1711260 - RNA, 22 nt, Human
uuauuucccuacauuaaacaug

SEQ ID NO: 1711261 - RNA, 18 nt, Human
auagcuacuaauuuuaaa

SEQ ID NO: 1711262 - RNA, 19 nt, Human
auagcucuaauguuugcau

SEQ ID NO: 1711263 - RNA, 20 nt, Human
auagcucuaauguuugcaua

SEQ ID NO: 1711264 - RNA, 21 nt, Human
auagcucuaauguuugcauau

SEQ ID NO: 1711265 - RNA, 22 nt, Human
auagcucuaauguuugcauaua

SEQ ID NO: 1711266 - RNA, 15 nt, Human
auagcucuaauguuu

SEQ ID NO: 1711267 - RNA, 16 nt, Human
auagcucuaauguuug

SEQ ID NO: 1711268 - RNA, 17 nt, Human
auagcucuaauguuugc

SEQ ID NO: 1711269 - RNA, 18 nt, Human
auagcucuaauguuugca

SEQ ID NO: 1711270 - RNA, 17 nt, Human
auagcuacuaauuuuaa

SEQ ID NO: 1711271 - RNA, 14 nt, Human
auagcuacuaauuu

SEQ ID NO: 1711272 - RNA, 11 nt, Human
uuauuuccuau

SEQ ID NO: 1711273 - RNA, 17 nt, Human
uuauuuccuaugaugua

SEQ ID NO: 1711274 - RNA, 22 nt, Human
uuauuuccuaugauguauacug

SEQ ID NO: 1711275 - RNA, 20 nt, Human
uuauuuccuaugauguauac

SEQ ID NO: 1711276 - RNA, 14 nt, Human
auauaagggaagua

SEQ ID NO: 1711277 - RNA, 22 nt, Human
auauaagggaaguaguuaucau

SEQ ID NO: 1711278 - RNA, 23 nt, Human
auauaagggaaguaguuaucaug

SEQ ID NO: 1711279 - RNA, 19 nt, Human
auauauacucaagaguggu

SEQ ID NO: 1711280 - RNA, 20 nt, Human
uucaucauucacuucacugu

SEQ ID NO: 1711281 - RNA, 19 nt, Human
uucaucauucacuucacug

SEQ ID NO: 1711282 - RNA, 16 nt, Human
auaucuagguuuauga

SEQ ID NO: 1711283 - RNA, 15 nt, Human
aucuuauaauuuaaa

SEQ ID NO: 1711284 - RNA, 16 nt, Human
aucuuauaauuuaaaa

SEQ ID NO: 1711285 - RNA, 23 nt, Human
uuuagugacuaaaccauugugca

SEQ ID NO: 1711286 - RNA, 12 nt, Human
uuuagugacuaa

SEQ ID NO: 1711287 - RNA, 18 nt, Human
augcuacaggauuugaaa

SEQ ID NO: 1711288 - RNA, 18 nt, Human
augcuuaaagaauucaaa

SEQ ID NO: 1711289 - RNA, 19 nt, Human
augcuuaaagaauucaaau

SEQ ID NO: 1711290 - RNA, 21 nt, Human
augcuuaaagaauucaaauuu

SEQ ID NO: 1711291 - RNA, 20 nt, Human
augcuuaaagaauucaaauu

SEQ ID NO: 1711292 - RNA, 16 nt, Human
uuucacuacucagcau

SEQ ID NO: 1711293 - RNA, 11 nt, Human
uuucauguacu

SEQ ID NO: 1711294 - RNA, 12 nt, Human
uuucauguacug

SEQ ID NO: 1711295 - RNA, 24 nt, Human
uuucaucauucacuucacugugcu

SEQ ID NO: 1711296 - RNA, 21 nt, Human
uuuaaauauaugcuaagucuu

SEQ ID NO: 1711297 - RNA, 18 nt, Human
uuuaaaaaaauuccaagu

SEQ ID NO: 1711298 - RNA, 15 nt, Human
augcagaacaaauga

SEQ ID NO: 1711299 - RNA, 18 nt, Human
augcagaacaaaugaaga

SEQ ID NO: 1711300 - RNA, 19 nt, Human
augcagaacaaaugaagac

SEQ ID NO: 1711301 - RNA, 18 nt, Human
auuugagaagcugcucaa

SEQ ID NO: 1711302 - RNA, 20 nt, Human
auuugagaagcugcucaacu

SEQ ID NO: 1711303 - RNA, 20 nt, Human
auuugauguggugaaaagca

SEQ ID NO: 1711304 - RNA, 20 nt, Human
auuuggaucucuucuuaaug

SEQ ID NO: 1711305 - RNA, 12 nt, Human
auuucauguacu

SEQ ID NO: 1711306 - RNA, 16 nt, Human
auuucauguacugcau

SEQ ID NO: 1711307 - RNA, 21 nt, Human
auuucauguacugcauuauuu

SEQ ID NO: 1711308 - RNA, 20 nt, Human
auuucauguacugcauuauu

SEQ ID NO: 1711309 - RNA, 14 nt, Human
auuuccuaugaugu

SEQ ID NO: 1711310 - RNA, 15 nt, Human
auuuccuaugaugua

SEQ ID NO: 1711311 - RNA, 16 nt, Human
auuuccuaugauguau

SEQ ID NO: 1711312 - RNA, 21 nt, Human
auuuccuaugauguauacugc

SEQ ID NO: 1711313 - RNA, 20 nt, Human
auuuccuaugauguauacug

SEQ ID NO: 1711314 - RNA, 16 nt, Human
auuguaguccuguaau

SEQ ID NO: 1711315 - RNA, 15 nt, Human
auuuaguuguuguag

SEQ ID NO: 1711316 - RNA, 18 nt, Human
auuuaguuguuguagaga

SEQ ID NO: 1711317 - RNA, 19 nt, Human
auuuaguuguuguagagaa

SEQ ID NO: 1711318 - RNA, 20 nt, Human
auuuaguuguuguagagaaa

SEQ ID NO: 1711319 - RNA, 16 nt, Human
auugacaaaauguuau

SEQ ID NO: 1711320 - RNA, 17 nt, Human
auugacaaaauguuauu

SEQ ID NO: 1711321 - RNA, 22 nt, Human
auugacaaaauguuauuucccu

SEQ ID NO: 1711322 - RNA, 19 nt, Human
auugacaaaauguuauuuc

SEQ ID NO: 1711323 - RNA, 13 nt, Human
auugacaaaaugu

SEQ ID NO: 1711324 - RNA, 14 nt, Human
auugacaaaauguu

SEQ ID NO: 1711325 - RNA, 15 nt, Human
auugacaaaauguua

SEQ ID NO: 1711326 - RNA, 19 nt, Human
uuuuuauuuccuaugaugu

SEQ ID NO: 1711327 - RNA, 15 nt, Human
uuuuugaagcuguau

SEQ ID NO: 1711328 - RNA, 14 nt, Human
auuaaacaugacuc

SEQ ID NO: 1711329 - RNA, 18 nt, Human
auucacuucacugugcug

SEQ ID NO: 1711330 - RNA, 20 nt, Human
auucacuucacugugcuguu

SEQ ID NO: 1711331 - RNA, 15 nt, Human
auucacuucacugug

SEQ ID NO: 1711332 - RNA, 16 nt, Human
auucacuucacugugc

SEQ ID NO: 1711333 - RNA, 17 nt, Human
auucacuucacugugcu

SEQ ID NO: 1711334 - RNA, 23 nt, Human
auucacuucacugugcuguuguu

SEQ ID NO: 1711335 - RNA, 17 nt, Human
auuccaagugauugaaa

SEQ ID NO: 1711336 - RNA, 20 nt, Human
auuauauggcuugaguuuaa

SEQ ID NO: 1711337 - RNA, 13 nt, Human
uuugagaaaguca

SEQ ID NO: 1711338 - RNA, 22 nt, Human
uuuggauuggacaaaaugacuu

SEQ ID NO: 1711339 - RNA, 15 nt, Human
auguauacugccacu

SEQ ID NO: 1711340 - RNA, 21 nt, Human
auguauacugccacuaaccuu

SEQ ID NO: 1711341 - RNA, 23 nt, Human
augucgucaaagcugaaauggac

SEQ ID NO: 1711342 - RNA, 17 nt, Human
auguuuaaucauauaaa

SEQ ID NO: 1711343 - RNA, 16 nt, Human
auguuuaaucauauaa

SEQ ID NO: 1711344 - RNA, 14 nt, Human
auguuuaaucauau

SEQ ID NO: 1711345 - RNA, 15 nt, Human
auguuuaaucauaua

SEQ ID NO: 1711346 - RNA, 12 nt, Human
uuuucugcacua

SEQ ID NO: 1711347 - RNA, 13 nt, Human
uuuucugcacuau

SEQ ID NO: 1711348 - RNA, 19 nt, Human
uuuucugcacuauaugcaa

SEQ ID NO: 1711349 - RNA, 18 nt, Human
uuuuaguuccugugcaca

SEQ ID NO: 1711350 - RNA, 20 nt, Human
uuuuaguuccugugcacagc

SEQ ID NO: 1711351 - RNA, 16 nt, Human
uuuucuauaauuuaaa

SEQ ID NO: 1711352 - RNA, 12 nt, Human
uuuucuagugua

SEQ ID NO: 1711353 - RNA, 13 nt, Human
uuuucuaguguau

SEQ ID NO: 1711354 - RNA, 17 nt, Human
uuuucuaguguaucaaa

SEQ ID NO: 1711355 - RNA, 22 nt, Human
uuuucuaguguaucaaaaugcu

SEQ ID NO: 1711356 - RNA, 20 nt, Human
uuuucuaguguaucaaaaug

SEQ ID NO: 1711357 - RNA, 16 nt, Human
augugcuuaacaggga

SEQ ID NO: 1711358 - RNA, 21 nt, Human
augugcuuaacagggaacgug

SEQ ID NO: 1711359 - RNA, 23 nt, Human
auguuaacugacaagcuccauuu

SEQ ID NO: 1711360 - RNA, 12 nt, Human
auguuauuuccc

SEQ ID NO: 1711361 - RNA, 15 nt, Human
cacccuggauuugca

SEQ ID NO: 1711362 - RNA, 13 nt, Human
caagaucccauuu

SEQ ID NO: 1711363 - RNA, 15 nt, Human
caagaucccauuuga

SEQ ID NO: 1711364 - RNA, 18 nt, Human
caagaugaaauuccauuu

SEQ ID NO: 1711365 - RNA, 20 nt, Human
caagaugaaauuccauuugu

SEQ ID NO: 1711366 - RNA, 19 nt, Human
caaacauccucuuccauau

SEQ ID NO: 1711367 - RNA, 20 nt, Human
auuuuuaucaguuacacaug

SEQ ID NO: 1711368 - RNA, 19 nt, Human
auuuucuauaauuuaaaua

SEQ ID NO: 1711369 - RNA, 18 nt, Human
auuuucuauaauuuaaau

SEQ ID NO: 1711370 - RNA, 17 nt, Human
auuuucuauaauuuaaa

SEQ ID NO: 1711371 - RNA, 19 nt, Human
auuuucugcaucuccacuu

SEQ ID NO: 1711372 - RNA, 15 nt, Human
auuuucugcaucucc

SEQ ID NO: 1711373 - RNA, 16 nt, Human
auuuucugcaucucca

SEQ ID NO: 1711374 - RNA, 13 nt, Human
auuuguucauauu

SEQ ID NO: 1711375 - RNA, 18 nt, Human
auuagauaaauguccauu

SEQ ID NO: 1711376 - RNA, 13 nt, Human
auucauaugcaua

SEQ ID NO: 1711377 - RNA, 14 nt, Human
auucauaugcauau

SEQ ID NO: 1711378 - RNA, 15 nt, Human
auucauaugcauauu

SEQ ID NO: 1711379 - RNA, 18 nt, Human
auucauaugcauauuuuu

SEQ ID NO: 1711380 - RNA, 16 nt, Human
auucauaugcauauuu

SEQ ID NO: 1711381 - RNA, 16 nt, Human
cauagguuuaauaauu

SEQ ID NO: 1711382 - RNA, 20 nt, Human
cauccucuuccauauggauc

SEQ ID NO: 1711383 - RNA, 22 nt, Human
caguuauuauauuuacaaaugg

SEQ ID NO: 1711384 - RNA, 21 nt, Human
caguuauuauauuuacaaaug

SEQ ID NO: 1711385 - RNA, 17 nt, Human
caguuauuauauuuaca

SEQ ID NO: 1711386 - RNA, 13 nt, Human
cauuuguagguag

SEQ ID NO: 1711387 - RNA, 13 nt, Human
cauuuguucauau

SEQ ID NO: 1711388 - RNA, 14 nt, Human
cauuuguucauauu

SEQ ID NO: 1711389 - RNA, 18 nt, Human
cauuuguucauauuaaga

SEQ ID NO: 1711390 - RNA, 19 nt, Human
cauuuguucauauuaagaa

SEQ ID NO: 1711391 - RNA, 20 nt, Human
cauuuguucauauuaagaau

SEQ ID NO: 1711392 - RNA, 24 nt, Human
ccacuuucaaucuucaauccuuga

SEQ ID NO: 1711393 - RNA, 12 nt, Human
ccacuuggcauu

SEQ ID NO: 1711394 - RNA, 12 nt, Human
ccauugugcauu

SEQ ID NO: 1711395 - RNA, 17 nt, Human
ccauugugcauucuaga

SEQ ID NO: 1711396 - RNA, 20 nt, Human
ccauuuaaacagauguccau

SEQ ID NO: 1711397 - RNA, 13 nt, Human
cuaacuaaaacaa

SEQ ID NO: 1711398 - RNA, 20 nt, Human
cuaacuaaaacaaagccacu

SEQ ID NO: 1711399 - RNA, 17 nt, Human
cuaagucaacuuagcau

SEQ ID NO: 1711400 - RNA, 15 nt, Human
ccuuagugcaguuau

SEQ ID NO: 1711401 - RNA, 20 nt, Human
ccuuagugcaguuauuugcu

SEQ ID NO: 1711402 - RNA, 15 nt, Human
gcucuuauuucauca

SEQ ID NO: 1711403 - RNA, 13 nt, Human
gcucuuauuucau

SEQ ID NO: 1711404 - RNA, 14 nt, Human
gcucuuauuucauc

SEQ ID NO: 1711405 - RNA, 19 nt, Human
gcucuaauguuugcauaua

SEQ ID NO: 1711406 - RNA, 15 nt, Human
gcucuaauguuugca

SEQ ID NO: 1711407 - RNA, 16 nt, Human
gcucuaauguuugcau

SEQ ID NO: 1711408 - RNA, 17 nt, Human
gcucuaauguuugcaua

SEQ ID NO: 1711409 - RNA, 18 nt, Human
gcucuaauguuugcauau

SEQ ID NO: 1711410 - RNA, 19 nt, Human
gcuuaacagggaacgugau

SEQ ID NO: 1711411 - RNA, 15 nt, Human
gcuucaauuuauacc

SEQ ID NO: 1711412 - RNA, 18 nt, Human
gcuuaaagaauucaaauu

SEQ ID NO: 1711413 - RNA, 15 nt, Human
aaagaauucaaauuu

SEQ ID NO: 1711414 - RNA, 16 nt, Human
aaagaauucaaauuuu

SEQ ID NO: 1711415 - RNA, 13 nt, Human
aaaggaauuuaaa

SEQ ID NO: 1711416 - RNA, 22 nt, Human
aaaagcuccauuuuuagugaaa

SEQ ID NO: 1711417 - RNA, 16 nt, Human
aaaaauuacuuaguau

SEQ ID NO: 1711418 - RNA, 17 nt, Human
aaaaaucuuccaauuua

SEQ ID NO: 1711419 - RNA, 21 nt, Human
gacuguuguuaucuguuugag

SEQ ID NO: 1711420 - RNA, 14 nt, Human
gacuguuguuaucu

SEQ ID NO: 1711421 - RNA, 19 nt, Human
gacuguuguuaucuguuug

SEQ ID NO: 1711422 - RNA, 20 nt, Human
gacuguuguuaucuguuuga

SEQ ID NO: 1711423 - RNA, 16 nt, Human
gacauuccuugcugaa

SEQ ID NO: 1711424 - RNA, 23 nt, Human
gaacccuuaaacaguugcacagc

SEQ ID NO: 1711425 - RNA, 19 nt, Human
gaagacaaaacauacauuu

SEQ ID NO: 1711426 - RNA, 23 nt, Human
gaagacaaaacauacauuuugua

SEQ ID NO: 1711427 - RNA, 16 nt, Human
gaguuuaaauuguaau

SEQ ID NO: 1711428 - RNA, 14 nt, Human
gcacaaguguaaug

SEQ ID NO: 1711429 - RNA, 17 nt, Human
gcacaaguguaaugaau

SEQ ID NO: 1711430 - RNA, 19 nt, Human
gcacaaguguaaugaauac

SEQ ID NO: 1711431 - RNA, 21 nt, Human
gcacaaguguaaugaauaccu

SEQ ID NO: 1711432 - RNA, 23 nt, Human
cuuaaagaauucaaauuuuaucu

SEQ ID NO: 1711433 - RNA, 18 nt, Human
cuuacagcaaauccuuug

SEQ ID NO: 1711434 - RNA, 16 nt, Human
cuuacagcaaauccuu

SEQ ID NO: 1711435 - RNA, 14 nt, Human
cuucacugugcugu

SEQ ID NO: 1711436 - RNA, 13 nt, Human
cuucacugugcug

SEQ ID NO: 1711437 - RNA, 14 nt, Human
cugcacuauaugca

SEQ ID NO: 1711438 - RNA, 22 nt, Human
cauuuuguaccaaccauccaau

SEQ ID NO: 1711439 - RNA, 12 nt, Human
cauuuuguacca

SEQ ID NO: 1711440 - RNA, 16 nt, Human
cauugugcauucuaga

SEQ ID NO: 1711441 - RNA, 20 nt, Human
ccaaacauccucuuccauau

SEQ ID NO: 1711442 - RNA, 17 nt, Human
ccacacgagaaccugaa

SEQ ID NO: 1711443 - RNA, 14 nt, Human
ccaguaauccugua

SEQ ID NO: 1711444 - RNA, 12 nt, Human
ccaucagaugac

SEQ ID NO: 1711445 - RNA, 15 nt, Human
ccaugauuucaugua

SEQ ID NO: 1711446 - RNA, 18 nt, Human
ccaugauuucauguacug

SEQ ID NO: 1711447 - RNA, 21 nt, Human
ccaugauuucauguacugcau

SEQ ID NO: 1711448 - RNA, 22 nt, Human
ccaugauuucauguacugcauu

SEQ ID NO: 1711449 - RNA, 20 nt, Human
cccaaaauuagccaguaauc

SEQ ID NO: 1711450 - RNA, 18 nt, Human
cguuuagcugacaaaaua

SEQ ID NO: 1711451 - RNA, 16 nt, Human
cguuuagcugacaaaa

SEQ ID NO: 1711452 - RNA, 20 nt, Human
ccuguaggaagguacuguau

SEQ ID NO: 1711453 - RNA, 12 nt, Human
ccugugcacagc

SEQ ID NO: 1711454 - RNA, 13 nt, Human
ccugugcacagcc

SEQ ID NO: 1711455 - RNA, 16 nt, Human
ccugaaugcucuguag

SEQ ID NO: 1711456 - RNA, 15 nt, Human
ccugaaugcucugua

SEQ ID NO: 1711457 - RNA, 16 nt, Human
ccucaauuuucacugu

SEQ ID NO: 1711458 - RNA, 17 nt, Human
ccucaauuuucacugug

SEQ ID NO: 1711459 - RNA, 23 nt, Human
cugauugaccguguuggucugua

SEQ ID NO: 1711460 - RNA, 17 nt, Human
cugcaccaguugcugcu

SEQ ID NO: 1711461 - RNA, 17 nt, Human
cugauucaauuugaugu

SEQ ID NO: 1711462 - RNA, 16 nt, Human
cugauucaauuugaug

SEQ ID NO: 1711463 - RNA, 23 nt, Human
cuggaauaauccuaaacauauga

SEQ ID NO: 1711464 - RNA, 17 nt, Human
cucgaggucgggcagca

SEQ ID NO: 1711465 - RNA, 21 nt, Human
cucgaggucgggcagcacaag

SEQ ID NO: 1711466 - RNA, 12 nt, Human
cucauauuuccc

SEQ ID NO: 1711467 - RNA, 18 nt, Human
cucauucccuccccagaa

SEQ ID NO: 1711468 - RNA, 15 nt, Human
cucuaauguuugcau

SEQ ID NO: 1711469 - RNA, 17 nt, Human
cucuaauguuugcauau

SEQ ID NO: 1711470 - RNA, 18 nt, Human
cucuaauguuugcauaua

SEQ ID NO: 1711471 - RNA, 21 nt, Human
cugaaguaaaacaaacaauac

SEQ ID NO: 1711472 - RNA, 18 nt, Human
cugacauuccuugcugaa

SEQ ID NO: 1711473 - RNA, 16 nt, Human
cugacauuccuugcug

SEQ ID NO: 1711474 - RNA, 16 nt, Human
cuguuuuaaaaaccug

SEQ ID NO: 1711475 - RNA, 16 nt, Human
cuguuuauucauaugc

SEQ ID NO: 1711476 - RNA, 17 nt, Human
cuguuuauucauaugca

SEQ ID NO: 1711477 - RNA, 20 nt, Human
cuguuuauucauaugcauau

SEQ ID NO: 1711478 - RNA, 13 nt, Human
cuuaauguacaua

SEQ ID NO: 1711479 - RNA, 15 nt, Human
cuuaauguacauagu

SEQ ID NO: 1711480 - RNA, 14 nt, Human
cuuauaauuuaaaa

SEQ ID NO: 1711481 - RNA, 13 nt, Human
cuuauaauuuaaa

SEQ ID NO: 1711482 - RNA, 14 nt, Human
cuuauauuguucac

SEQ ID NO: 1711483 - RNA, 16 nt, Human
cuuauauuguucacuu

SEQ ID NO: 1711484 - RNA, 23 nt, Human
cuucgacuguuguuaucuguuug

SEQ ID NO: 1711485 - RNA, 15 nt, Human
cuucguuuaaugaau

SEQ ID NO: 1711486 - RNA, 14 nt, Human
cuucgacuguuguu

SEQ ID NO: 1711487 - RNA, 22 nt, Human
cuucgacuguuguuaucuguuu

SEQ ID NO: 1711488 - RNA, 19 nt, Human
gaaaauaacaauaaaagac

SEQ ID NO: 1711489 - RNA, 20 nt, Human
cuugcuugauuguauggugg

SEQ ID NO: 1711490 - RNA, 22 nt, Human
cuugcugaaacgcaucuaguuc

SEQ ID NO: 1711491 - RNA, 21 nt, Human
cuugcugaaacgcaucuaguu

SEQ ID NO: 1711492 - RNA, 18 nt, Human
gacuuacagcaaauccuu

SEQ ID NO: 1711493 - RNA, 18 nt, Human
gacuaaaccauugugcau

SEQ ID NO: 1711494 - RNA, 19 nt, Human
gacuaaaccauugugcauu

SEQ ID NO: 1711495 - RNA, 22 nt, Human
gacuaaaccauugugcauucua

SEQ ID NO: 1711496 - RNA, 18 nt, Human
gaaauuguauuacaaauc

SEQ ID NO: 1711497 - RNA, 16 nt, Human
gaaauuguauuacaaa

SEQ ID NO: 1711498 - RNA, 23 nt, Human
gaacguuuagcugacaaaauacu

SEQ ID NO: 1711499 - RNA, 21 nt, Human
gaagacuuacagcaaauccuu

SEQ ID NO: 1711500 - RNA, 20 nt, Human
gaagacuuacagcaaauccu

SEQ ID NO: 1711501 - RNA, 21 nt, Human
gaagauaaacguggauguuac

SEQ ID NO: 1711502 - RNA, 19 nt, Human
gaaguaguuaucauguuag

SEQ ID NO: 1711503 - RNA, 13 nt, Human
gaaguaguuauca

SEQ ID NO: 1711504 - RNA, 14 nt, Human
gaaguaguuaucau

SEQ ID NO: 1711505 - RNA, 15 nt, Human
gaaguaguuaucaug

SEQ ID NO: 1711506 - RNA, 16 nt, Human
gaaguaguuaucaugu

SEQ ID NO: 1711507 - RNA, 17 nt, Human
gaaguaguuaucauguu

SEQ ID NO: 1711508 - RNA, 18 nt, Human
gaaguaguuaucauguua

SEQ ID NO: 1711509 - RNA, 21 nt, Human
gaaguaguuaucauguuagua

SEQ ID NO: 1711510 - RNA, 17 nt, Human
gaauaccuuagugcagu

SEQ ID NO: 1711511 - RNA, 20 nt, Human
gaauaccuuagugcaguuau

SEQ ID NO: 1711512 - RNA, 21 nt, Human
gaauaccuuagugcaguuauu

SEQ ID NO: 1711513 - RNA, 18 nt, Human
gaauucaaauuuuaucug

SEQ ID NO: 1711514 - RNA, 16 nt, Human
gaauucaaauuuuauc

SEQ ID NO: 1711515 - RNA, 13 nt, Human
gaauguaaauguc

SEQ ID NO: 1711516 - RNA, 14 nt, Human
gaauguaaaugucu

SEQ ID NO: 1711517 - RNA, 16 nt, Human
gaauguaaaugucuca

SEQ ID NO: 1711518 - RNA, 17 nt, Human
gauaggucagugcaaau

SEQ ID NO: 1711519 - RNA, 17 nt, Human
gaugaaauuccauuugu

SEQ ID NO: 1711520 - RNA, 22 nt, Human
gaugcagugccaggaacccuua

SEQ ID NO: 1711521 - RNA, 19 nt, Human
gauuucauguacugcauua

SEQ ID NO: 1711522 - RNA, 20 nt, Human
gauuucauguacugcauuau

SEQ ID NO: 1711523 - RNA, 12 nt, Human
gauuucauguac

SEQ ID NO: 1711524 - RNA, 13 nt, Human
gauuucauguacu

SEQ ID NO: 1711525 - RNA, 16 nt, Human
gauuucauguacugca

SEQ ID NO: 1711526 - RNA, 21 nt, Human
gauuucauguacugcauuauu

SEQ ID NO: 1711527 - RNA, 15 nt, Human
gcauauaagggaagu

SEQ ID NO: 1711528 - RNA, 23 nt, Human
gcauauaagggaaguaguuauca

SEQ ID NO: 1711529 - RNA, 14 nt, Human
gcaguguuagcuua

SEQ ID NO: 1711530 - RNA, 13 nt, Human
gcaguguuagcuu

SEQ ID NO: 1711531 - RNA, 15 nt, Human
gcauuagcuaaaacc

SEQ ID NO: 1711532 - RNA, 17 nt, Human
gcauuuucugcaucucc

SEQ ID NO: 1711533 - RNA, 18 nt, Human
gcauuuucugcaucucca

SEQ ID NO: 1711534 - RNA, 23 nt, Human
gccucucuuguaauuuggaucuc

SEQ ID NO: 1711535 - RNA, 20 nt, Human
gccuuuuaguuccugugcac

SEQ ID NO: 1711536 - RNA, 17 nt, Human
gccuuuuaguuccugug

SEQ ID NO: 1711537 - RNA, 16 nt, Human
gccuuuuaguuccugu

SEQ ID NO: 1711538 - RNA, 16 nt, Human
ggugagaauagaaucu

SEQ ID NO: 1711539 - RNA, 21 nt, Human
gguugauaaaucauuuuaugu

SEQ ID NO: 1711540 - RNA, 19 nt, Human
ggguaacuaacuaaaacaa

SEQ ID NO: 1711541 - RNA, 22 nt, Human
ggcuugaguuuaaauuguaaua

SEQ ID NO: 1711542 - RNA, 20 nt, Human
gggaaguaguuaucauguua

SEQ ID NO: 1711543 - RNA, 18 nt, Human
gggaaguaguuaucaugu

SEQ ID NO: 1711544 - RNA, 22 nt, Human
gggaaguaguuaucauguuagu

SEQ ID NO: 1711545 - RNA, 20 nt, Human
ggaaaaaauaacaaugaaag

SEQ ID NO: 1711546 - RNA, 17 nt, Human
ggaacggaucagauguc

SEQ ID NO: 1711547 - RNA, 14 nt, Human
ggaacgugauuagu

SEQ ID NO: 1711548 - RNA, 24 nt, Human
ggcauuagcuaaaaccuuccaugu

SEQ ID NO: 1711549 - RNA, 15 nt, Human
ggcagcuuugcucau

SEQ ID NO: 1711550 - RNA, 14 nt, Human
ggcagcuuugcuca

SEQ ID NO: 1711551 - RNA, 22 nt, Human
ggcagcacaaguguaaugaaua

SEQ ID NO: 1711552 - RNA, 20 nt, Human
ggauccacgacgcuuaaaua

SEQ ID NO: 1711553 - RNA, 22 nt, Human
uauaccucaauuuucacugugu

SEQ ID NO: 1711554 - RNA, 21 nt, Human
uauaccucaauuuucacugug

SEQ ID NO: 1711555 - RNA, 19 nt, Human
uaguguaucaaaaugcucu

SEQ ID NO: 1711556 - RNA, 12 nt, Human
uaguguaucaaa

SEQ ID NO: 1711557 - RNA, 14 nt, Human
uaguguaucaaaau

SEQ ID NO: 1711558 - RNA, 17 nt, Human
uaguguaucaaaaugcu

SEQ ID NO: 1711559 - RNA, 15 nt, Human
uaucaguuacacaug

SEQ ID NO: 1711560 - RNA, 13 nt, Human
uaucggcacugua

SEQ ID NO: 1711561 - RNA, 17 nt, Human
uaucggcacuguacaaa

SEQ ID NO: 1711562 - RNA, 16 nt, Human
uauauuuccacuucuu

SEQ ID NO: 1711563 - RNA, 20 nt, Human
uauauacucaagagugguau

SEQ ID NO: 1711564 - RNA, 19 nt, Human
uagagaaaacaugcagaac

SEQ ID NO: 1711565 - RNA, 14 nt, Human
uaggaagguacugu

SEQ ID NO: 1711566 - RNA, 15 nt, Human
uaggaagguacugua

SEQ ID NO: 1711567 - RNA, 16 nt, Human
uaggaagguacuguau

SEQ ID NO: 1711568 - RNA, 18 nt, Human
uaggaagguacuguauga

SEQ ID NO: 1711569 - RNA, 24 nt, Human
uaggaagguacuguaugaucaaau

SEQ ID NO: 1711570 - RNA, 21 nt, Human
uagcucuaauguuugcauaua

SEQ ID NO: 1711571 - RNA, 19 nt, Human
uagcucuaauguuugcaua

SEQ ID NO: 1711572 - RNA, 20 nt, Human
uagcucuaauguuugcauau

SEQ ID NO: 1711573 - RNA, 17 nt, Human
uagcucuaauguuugca

SEQ ID NO: 1711574 - RNA, 18 nt, Human
uagcucuaauguuugcau

SEQ ID NO: 1711575 - RNA, 14 nt, Human
uacaggauuugaaa

SEQ ID NO: 1711576 - RNA, 13 nt, Human
uacagaauuuuau

SEQ ID NO: 1711577 - RNA, 12 nt, Human
uacauuuuaugg

SEQ ID NO: 1711578 - RNA, 14 nt, Human
uacauuuuguacca

SEQ ID NO: 1711579 - RNA, 16 nt, Human
uacauuuuguaccaac

SEQ ID NO: 1711580 - RNA, 17 nt, Human
uacauuuuguaccaacc

SEQ ID NO: 1711581 - RNA, 14 nt, Human
uacccauuuguuca

SEQ ID NO: 1711582 - RNA, 15 nt, Human
uacccauuuguucau

SEQ ID NO: 1711583 - RNA, 22 nt, Human
uacccauuuguucauauuaaga

SEQ ID NO: 1711584 - RNA, 14 nt, Human
uacugauucaauuu

SEQ ID NO: 1711585 - RNA, 17 nt, Human
uacugauucaauuugau

SEQ ID NO: 1711586 - RNA, 20 nt, Human
uacugauucaauuugaugug

SEQ ID NO: 1711587 - RNA, 11 nt, Human
uacuguaugau

SEQ ID NO: 1711588 - RNA, 13 nt, Human
uacuguaugauca

SEQ ID NO: 1711589 - RNA, 14 nt, Human
uacuguaugaucaa

SEQ ID NO: 1711590 - RNA, 15 nt, Human
uacuguaugaucaaa

SEQ ID NO: 1711591 - RNA, 16 nt, Human
uacuguaugaucaaau

SEQ ID NO: 1711592 - RNA, 17 nt, Human
uacuguaugaucaaaug

SEQ ID NO: 1711593 - RNA, 18 nt, Human
uacuguaugaucaaaugu

SEQ ID NO: 1711594 - RNA, 19 nt, Human
uacuguaugaucaaauguu

SEQ ID NO: 1711595 - RNA, 21 nt, Human
uacuguaugaucaaauguuua

SEQ ID NO: 1711596 - RNA, 22 nt, Human
uacuguaugaucaaauguuuaa

SEQ ID NO: 1711597 - RNA, 13 nt, Human
uaauuguguuuac

SEQ ID NO: 1711598 - RNA, 14 nt, Human
uaauuguguuuaca

SEQ ID NO: 1711599 - RNA, 16 nt, Human
uaauuguguuuacauu

SEQ ID NO: 1711600 - RNA, 17 nt, Human
uaauuguguuuacauuu

SEQ ID NO: 1711601 - RNA, 18 nt, Human
uaauuguguuuacauuuu

SEQ ID NO: 1711602 - RNA, 19 nt, Human
uaauuguguuuacauuuua

SEQ ID NO: 1711603 - RNA, 20 nt, Human
uaauuguguuuacauuuuau

SEQ ID NO: 1711604 - RNA, 22 nt, Human
uaauuguguuuacauuuuaugg

SEQ ID NO: 1711605 - RNA, 21 nt, Human
uaauuguguuuacauuuuaug

SEQ ID NO: 1711606 - RNA, 23 nt, Human
uaauuuggaucucuucuuaaugu

SEQ ID NO: 1711607 - RNA, 14 nt, Human
uaauccuguaggaa

SEQ ID NO: 1711608 - RNA, 18 nt, Human
uaauccuguaggaaggua

SEQ ID NO: 1711609 - RNA, 23 nt, Human
uaauccuguaggaagguacugua

SEQ ID NO: 1711610 - RNA, 22 nt, Human
uaauccuguaggaagguacugu

SEQ ID NO: 1711611 - RNA, 23 nt, Human
uaacagggaacgugauuagugaa

SEQ ID NO: 1711612 - RNA, 15 nt, Human
uaacagggaacguga

SEQ ID NO: 1711613 - RNA, 22 nt, Human
uaacagggaacgugauuaguga

SEQ ID NO: 1711614 - RNA, 19 nt, Human
uaaaucauuuuaugucaag

SEQ ID NO: 1711615 - RNA, 13 nt, Human
uaaaucauuuuau

SEQ ID NO: 1711616 - RNA, 15 nt, Human
uaaaucauuuuaugu

SEQ ID NO: 1711617 - RNA, 12 nt, Human
uaaaucauuuua

SEQ ID NO: 1711618 - RNA, 18 nt, Human
uaaauauaugcuaagucu

SEQ ID NO: 1711619 - RNA, 17 nt, Human
uaaauaaaaauaauccu

SEQ ID NO: 1711620 - RNA, 14 nt, Human
uaaaggaauuuaaa

SEQ ID NO: 1711621 - RNA, 22 nt, Human
uaaacaguugcacagcaucuca

SEQ ID NO: 1711622 - RNA, 16 nt, Human
uaaacaguugcacagc

SEQ ID NO: 1711623 - RNA, 17 nt, Human
uaaacaguugcacagca

SEQ ID NO: 1711624 - RNA, 18 nt, Human
uaaacaguugcacagcau

SEQ ID NO: 1711625 - RNA, 19 nt, Human
uaaacaguugcacagcauc

SEQ ID NO: 1711626 - RNA, 23 nt, Human
uaaacagauguccaucagaugac

SEQ ID NO: 1711627 - RNA, 16 nt, Human
uaaacagauguccauc

SEQ ID NO: 1711628 - RNA, 21 nt, Human
uaaacagauguccaucagaug

SEQ ID NO: 1711629 - RNA, 22 nt, Human
uaaacagauguccaucagauga

SEQ ID NO: 1711630 - RNA, 20 nt, Human
guuuagcugacaaaauacuu

SEQ ID NO: 1711631 - RNA, 15 nt, Human
guuuagcugacaaaa

SEQ ID NO: 1711632 - RNA, 17 nt, Human
guuuagcugacaaaaua

SEQ ID NO: 1711633 - RNA, 14 nt, Human
guuuagcugacaaa

SEQ ID NO: 1711634 - RNA, 14 nt, Human
guuuucuaguguau

SEQ ID NO: 1711635 - RNA, 23 nt, Human
guuuucuaguguaucaaaaugcu

SEQ ID NO: 1711636 - RNA, 15 nt, Human
uaaaaaccuguucaa

SEQ ID NO: 1711637 - RNA, 14 nt, Human
guuuuuauuuccua

SEQ ID NO: 1711638 - RNA, 16 nt, Human
guuuuuauuuccuaug

SEQ ID NO: 1711639 - RNA, 19 nt, Human
guuuuuauuuccuaugaug

SEQ ID NO: 1711640 - RNA, 20 nt, Human
guuuuuauuuccuaugaugu

SEQ ID NO: 1711641 - RNA, 21 nt, Human
guuuuuauuuccuaugaugua

SEQ ID NO: 1711642 - RNA, 23 nt, Human
guuuuucagguauauaccuccau

SEQ ID NO: 1711643 - RNA, 16 nt, Human
ucauucacuucacugu

SEQ ID NO: 1711644 - RNA, 17 nt, Human
ucauucacuucacugug

SEQ ID NO: 1711645 - RNA, 19 nt, Human
ucauucacuucacugugcu

SEQ ID NO: 1711646 - RNA, 20 nt, Human
ucauucacuucacugugcug

SEQ ID NO: 1711647 - RNA, 14 nt, Human
uccaugucaagauu

SEQ ID NO: 1711648 - RNA, 16 nt, Human
uccaugucaagauuca

SEQ ID NO: 1711649 - RNA, 20 nt, Human
uccaugucaagauucagcua

SEQ ID NO: 1711650 - RNA, 14 nt, Human
ucccauucaagauu

SEQ ID NO: 1711651 - RNA, 16 nt, Human
ucccauucaagauucc

SEQ ID NO: 1711652 - RNA, 17 nt, Human
uccccagaauggaggca

SEQ ID NO: 1711653 - RNA, 15 nt, Human
uccccuguuuauuca

SEQ ID NO: 1711654 - RNA, 17 nt, Human
ucuagguuuaugacagu

SEQ ID NO: 1711655 - RNA, 20 nt, Human
uccuguaggaagguacugua

SEQ ID NO: 1711656 - RNA, 22 nt, Human
uccuguaggaagguacuguaug

SEQ ID NO: 1711657 - RNA, 21 nt, Human
uccuguaggaagguacuguau

SEQ ID NO: 1711658 - RNA, 19 nt, Human
ugaaauggacuuuuguaca

SEQ ID NO: 1711659 - RNA, 22 nt, Human
ugaacuuguaaaggaauuuaaa

SEQ ID NO: 1711660 - RNA, 18 nt, Human
ugaagaccuuuuucugca

SEQ ID NO: 1711661 - RNA, 23 nt, Human
ugaagacuuacagcaaauccuuu

SEQ ID NO: 1711662 - RNA, 15 nt, Human
ugaagaccuuuuucu

SEQ ID NO: 1711663 - RNA, 17 nt, Human
ucuuucacauuuaaaua

SEQ ID NO: 1711664 - RNA, 19 nt, Human
ugaaaggaagauaaacgug

SEQ ID NO: 1711665 - RNA, 15 nt, Human
ucuguccgagugugc

SEQ ID NO: 1711666 - RNA, 17 nt, Human
ucuguccgagugugcca

SEQ ID NO: 1711667 - RNA, 21 nt, Human
ucuuccaauuuaguuguugua

SEQ ID NO: 1711668 - RNA, 15 nt, Human
ugccuaguauugaca

SEQ ID NO: 1711669 - RNA, 15 nt, Human
ugcacagcaucucag

SEQ ID NO: 1711670 - RNA, 24 nt, Human
ugcacagccccuaagucaacuuag

SEQ ID NO: 1711671 - RNA, 14 nt, Human
ugcacagcaucuca

SEQ ID NO: 1711672 - RNA, 19 nt, Human
uggcucguuggcuagauua

SEQ ID NO: 1711673 - RNA, 17 nt, Human
uguuuuaaaaaccuguu

SEQ ID NO: 1711674 - RNA, 22 nt, Human
uuaaugucaauucuugccaaau

SEQ ID NO: 1711675 - RNA, 15 nt, Human
uuacagcaaauccuu

SEQ ID NO: 1711676 - RNA, 14 nt, Human
uguuuaaucauaua

SEQ ID NO: 1711677 - RNA, 15 nt, Human
uguuuaaucauauaa

SEQ ID NO: 1711678 - RNA, 16 nt, Human
uguuuaaucauauaaa

SEQ ID NO: 1711679 - RNA, 20 nt, Human
uguuuaaucauauaaauaga

SEQ ID NO: 1711680 - RNA, 23 nt, Human
uguuuaaucauauaaauagaaug

SEQ ID NO: 1711681 - RNA, 24 nt, Human
uguuuaaucauauaaauagaaugu

SEQ ID NO: 1711682 - RNA, 21 nt, Human
uguguuuacauuuuauggugc

SEQ ID NO: 1711683 - RNA, 15 nt, Human
uguauacugccacua

SEQ ID NO: 1711684 - RNA, 17 nt, Human
uguagauaauacaguuc

SEQ ID NO: 1711685 - RNA, 17 nt, Human
uguacugauucaauuug

SEQ ID NO: 1711686 - RNA, 15 nt, Human
uguacugauucaauu

SEQ ID NO: 1711687 - RNA, 16 nt, Human
uguacugauucaauuu

SEQ ID NO: 1711688 - RNA, 14 nt, Human
uguacugaaguaaa

SEQ ID NO: 1711689 - RNA, 18 nt, Human
uguacugaaguaaaacaa

SEQ ID NO: 1711690 - RNA, 11 nt, Human
uguaaugaaua

SEQ ID NO: 1711691 - RNA, 14 nt, Human
uguaaugaauaccu

SEQ ID NO: 1711692 - RNA, 15 nt, Human
uguaaugaauaccuu

SEQ ID NO: 1711693 - RNA, 20 nt, Human
uguaaaugucucacugagca

SEQ ID NO: 1711694 - RNA, 22 nt, Human
uguaaaugucucacugagcacu

SEQ ID NO: 1711695 - RNA, 16 nt, Human
uguaaaugucucacug

SEQ ID NO: 1711696 - RNA, 17 nt, Human
uguaaaugucucacuga

SEQ ID NO: 1711697 - RNA, 19 nt, Human
ugugcuguuguuaugaugu

SEQ ID NO: 1711698 - RNA, 20 nt, Human
ugugcuguuguuaugaugug

SEQ ID NO: 1711699 - RNA, 23 nt, Human
ugugcuguuguuaugaugugcuu

SEQ ID NO: 1711700 - RNA, 15 nt, Human
ugugcuuaacaggga

SEQ ID NO: 1711701 - RNA, 19 nt, Human
ugugcuuaacagggaacgu

SEQ ID NO: 1711702 - RNA, 14 nt, Human
ugugcuguuguuau

SEQ ID NO: 1711703 - RNA, 16 nt, Human
ugugcuguuguuauga

SEQ ID NO: 1711704 - RNA, 14 nt, Human
uucugagcauuuaa

SEQ ID NO: 1711705 - RNA, 12 nt, Human
uucuucaagauc

SEQ ID NO: 1711706 - RNA, 17 nt, Human
uucuucaagaucccauu

SEQ ID NO: 1711707 - RNA, 18 nt, Human
uucuucaagaucccauuu

SEQ ID NO: 1711708 - RNA, 22 nt, Human
uugaccguguuggucuguacug

SEQ ID NO: 1711709 - RNA, 15 nt, Human
uugcaaaaucaguuu

SEQ ID NO: 1711710 - RNA, 21 nt, Human
uugcaaaaucaguuuuccucu

SEQ ID NO: 1711711 - RNA, 16 nt, Human
uugcaaaaucaguuuu

SEQ ID NO: 1711712 - RNA, 22 nt, Human
uugcauacauucuucaagaucc

SEQ ID NO: 1711713 - RNA, 23 nt, Human
uugcaguaucggcacuguacaaa

SEQ ID NO: 1711714 - RNA, 16 nt, Human
uuguaaaggaauuuaa

SEQ ID NO: 1711715 - RNA, 21 nt, Human
uuguagagaaaacaugcagaa

SEQ ID NO: 1711716 - RNA, 14 nt, Human
uuguauuacaaauc

SEQ ID NO: 1711717 - RNA, 17 nt, Human
uuggauuggacaaaaug

SEQ ID NO: 1711718 - RNA, 21 nt, Human
uuggauuggacaaaaugacuu

SEQ ID NO: 1711719 - RNA, 17 nt, Human
uucaaauuuuaucugcc

SEQ ID NO: 1711720 - RNA, 22 nt, Human
uucaauccuugaagguauaucu

SEQ ID NO: 1711721 - RNA, 20 nt, Human
uucaaucuucaauccuugaa

SEQ ID NO: 1711722 - RNA, 14 nt, Human
uuuauucauaugca

SEQ ID NO: 1711723 - RNA, 15 nt, Human
uuuauucauaugcau

SEQ ID NO: 1711724 - RNA, 16 nt, Human
uuuauucauaugcaua

SEQ ID NO: 1711725 - RNA, 14 nt, Human
uuuaaucauauaaa

SEQ ID NO: 1711726 - RNA, 18 nt, Human
uuuaaucauauaaauaga

SEQ ID NO: 1711727 - RNA, 23 nt, Human
uuuaaucauauaaauagaaugua

SEQ ID NO: 1711728 - RNA, 22 nt, Human
uuuaaucauauaaauagaaugu

SEQ ID NO: 1711729 - RNA, 15 nt, Human
uuucagcagcugcag

SEQ ID NO: 1711730 - RNA, 15 nt, Human
uuucaaucuucaauc

SEQ ID NO: 1711731 - RNA, 13 nt, Human
uuucaaucuucaa

SEQ ID NO: 1711732 - RNA, 17 nt, Human
uuuauuuccuaugaugu

SEQ ID NO: 1711733 - RNA, 14 nt, Human
uuuccuaugaugua

SEQ ID NO: 1711734 - RNA, 18 nt, Human
uuuccuaugauguauacu

SEQ ID NO: 1711735 - RNA, 19 nt, Human
uuuuccucucaauaaaauu

SEQ ID NO: 1711736 - RNA, 20 nt, Human
uuuuacccauuuguucauau

SEQ ID NO: 1711737 - RNA, 14 nt, Human
uuuguucauauuaa

SEQ ID NO: 1711738 - RNA, 15 nt, Human
uuuguucauauuaag

SEQ ID NO: 1711739 - RNA, 18 nt, Human
uuugcauacauucuucaa

SEQ ID NO: 1711740 - RNA, 17 nt, Human
uuugcauacauucuuca

SEQ ID NO: 1711741 - RNA, 13 nt, Human
uuuuucugcacua

SEQ ID NO: 1711742 - RNA, 22 nt, Human
uuuuucugcacuauaugcaaac

SEQ ID NO: 1711743 - RNA, 18 nt, Human
uuuuucugcacuauaugc

SEQ ID NO: 1711744 - RNA, 13 nt, Human
cugcacuccagcc

SEQ ID NO: 1711745 - RNA, 23 nt, Human
cugcacuauagccuaggugacag

SEQ ID NO: 1711746 - RNA, 22 nt, Human
cugcacuauagccuaggugaca

SEQ ID NO: 1711747 - RNA, 17 nt, Human
cugcacuccagccugag

SEQ ID NO: 1711748 - RNA, 20 nt, Human
cugcacuccagccugagcga

SEQ ID NO: 1711749 - RNA, 16 nt, Human
cugcacuccagccuga

SEQ ID NO: 1711750 - RNA, 15 nt, Human
cugcacuccagccug

SEQ ID NO: 1711751 - RNA, 20 nt, Human
cugcacuauagccuagguga

SEQ ID NO: 1711752 - RNA, 18 nt, Human
cugcacuauagccuaggu

SEQ ID NO: 1711753 - RNA, 17 nt, Human
cugcacuauagccuagg

SEQ ID NO: 1711754 - RNA, 16 nt, Human
cugcacuauagccuag

SEQ ID NO: 1711755 - RNA, 23 nt, Human
cugcagccucaaccuccugggcu

SEQ ID NO: 1711756 - RNA, 19 nt, Human
cugcacuccagccugggug

SEQ ID NO: 1711757 - RNA, 24 nt, Human
cugcagccucaaccuccugggcua

SEQ ID NO: 1711758 - RNA, 17 nt, Human
cugcacuccagccuggg

SEQ ID NO: 1711759 - RNA, 16 nt, Human
cugcacuccagccugg

SEQ ID NO: 1711760 - RNA, 18 nt, Human
cugcacuccagccugggu

SEQ ID NO: 1711761 - RNA, 20 nt, Human
cugcaggcagccaggccaca

SEQ ID NO: 1711762 - RNA, 19 nt, Human
cugcaggcagccaggccac

SEQ ID NO: 1711763 - RNA, 18 nt, Human
cugcaggcagccaggcca

SEQ ID NO: 1711764 - RNA, 17 nt, Human
cugcaggcagccaggcc

SEQ ID NO: 1711765 - RNA, 16 nt, Human
cugcaggcagccaggc

SEQ ID NO: 1711766 - RNA, 15 nt, Human
cugcaggcagccagg

SEQ ID NO: 1711767 - RNA, 14 nt, Human
cugcaggcagccag

SEQ ID NO: 1711768 - RNA, 13 nt, Human
cugcaggcagcca

SEQ ID NO: 1711769 - RNA, 12 nt, Human
cugcagcuuugu

SEQ ID NO: 1711770 - RNA, 17 nt, Human
cugaugcuucuucagag

SEQ ID NO: 1711771 - RNA, 16 nt, Human
cugaugcuucuucaga

SEQ ID NO: 1711772 - RNA, 15 nt, Human
cucuuaugggcuggg

SEQ ID NO: 1711773 - RNA, 14 nt, Human
cucuuaugggcugg

SEQ ID NO: 1711774 - RNA, 22 nt, Human
cugcaaaggguaucaggugcug

SEQ ID NO: 1711775 - RNA, 21 nt, Human
cugcaaaggguaucaggugcu

SEQ ID NO: 1711776 - RNA, 18 nt, Human
cugcaaagcccagcuuga

SEQ ID NO: 1711777 - RNA, 23 nt, Human
cugaugggcaacccccagccugc

SEQ ID NO: 1711778 - RNA, 22 nt, Human
cugaugggcaacccccagccug

SEQ ID NO: 1711779 - RNA, 24 nt, Human
cugaugggcaacccccagccugcu

SEQ ID NO: 1711780 - RNA, 20 nt, Human
cugaugcuucuucagagacu

SEQ ID NO: 1711781 - RNA, 19 nt, Human
cugaugcuucuucagagac

SEQ ID NO: 1711782 - RNA, 18 nt, Human
cugaugcuucuucagaga

SEQ ID NO: 1711783 - RNA, 21 nt, Human
cugaugggcaacccccagccu

SEQ ID NO: 1711784 - RNA, 18 nt, Human
cugaugggcaacccccag

SEQ ID NO: 1711785 - RNA, 20 nt, Human
cugcaagaauugaagcagga

SEQ ID NO: 1711786 - RNA, 12 nt, Human
cugcaagggagu

SEQ ID NO: 1711787 - RNA, 23 nt, Human
cugcaccgggccacagagaaagu

SEQ ID NO: 1711788 - RNA, 21 nt, Human
cugcaaccugauugugucucu

SEQ ID NO: 1711789 - RNA, 19 nt, Human
cugcaaccugauugugucu

SEQ ID NO: 1711790 - RNA, 14 nt, Human
cugcaaccugauug

SEQ ID NO: 1711791 - RNA, 22 nt, Human
cugcaaccuccgccucuugggu

SEQ ID NO: 1711792 - RNA, 20 nt, Human
cugcaaccuccgccucuugg

SEQ ID NO: 1711793 - RNA, 18 nt, Human
cugcaagaauugaagcag

SEQ ID NO: 1711794 - RNA, 19 nt, Human
cugcaacuuguaaaugugg

SEQ ID NO: 1711795 - RNA, 18 nt, Human
cugcaacuuguaaaugug

SEQ ID NO: 1711796 - RNA, 15 nt, Human
cugcaacuucugccu

SEQ ID NO: 1711797 - RNA, 14 nt, Human
cugcaacuucugcc

SEQ ID NO: 1711798 - RNA, 22 nt, Human
cugcaaccugauugugucucuu

SEQ ID NO: 1711799 - RNA, 22 nt, Human
cugcaaccuucgccaccugggu

SEQ ID NO: 1711800 - RNA, 20 nt, Human
cugcaaccuucgccaccugg

SEQ ID NO: 1711801 - RNA, 19 nt, Human
cugcaaccuucgccaccug

SEQ ID NO: 1711802 - RNA, 17 nt, Human
cugcaaccuucgccacc

SEQ ID NO: 1711803 - RNA, 17 nt, Human
cugcccuuaccugccag

SEQ ID NO: 1711804 - RNA, 16 nt, Human
cugcccuuaccugcca

SEQ ID NO: 1711805 - RNA, 12 nt, Human
cugcccuuaccu

SEQ ID NO: 1711806 - RNA, 19 nt, Human
cugccccuccucucugccc

SEQ ID NO: 1711807 - RNA, 18 nt, Human
cugccccuccucucugcc

SEQ ID NO: 1711808 - RNA, 17 nt, Human
cugccccuccucucugc

SEQ ID NO: 1711809 - RNA, 13 nt, Human
cugccccucccuu

SEQ ID NO: 1711810 - RNA, 17 nt, Human
cugccccucccuucaac

SEQ ID NO: 1711811 - RNA, 14 nt, Human
cugccccucccuuc

SEQ ID NO: 1711812 - RNA, 23 nt, Human
cugccagggacagaggggguggc

SEQ ID NO: 1711813 - RNA, 22 nt, Human
cugccagggacagagggggugg

SEQ ID NO: 1711814 - RNA, 20 nt, Human
cugccagggacagagggggu

SEQ ID NO: 1711815 - RNA, 17 nt, Human
cugcauuuaaaagauac

SEQ ID NO: 1711816 - RNA, 18 nt, Human
cugcauuuaaaagauaca

SEQ ID NO: 1711817 - RNA, 17 nt, Human
cugccagucccccugcc

SEQ ID NO: 1711818 - RNA, 21 nt, Human
cugccagucccccugccccag

SEQ ID NO: 1711819 - RNA, 20 nt, Human
cugccagucccccugcccca

SEQ ID NO: 1711820 - RNA, 22 nt, Human
cugccagucccccugccccagg

SEQ ID NO: 1711821 - RNA, 13 nt, Human
cugccccccagcc

SEQ ID NO: 1711822 - RNA, 19 nt, Human
cugccauccagguucagcu

SEQ ID NO: 1711823 - RNA, 18 nt, Human
cugccauccagguucagc

SEQ ID NO: 1711824 - RNA, 16 nt, Human
cugccauccagguuca

SEQ ID NO: 1711825 - RNA, 16 nt, Human
cugccauauucuguug

SEQ ID NO: 1711826 - RNA, 14 nt, Human
cugcauuuaaaaga

SEQ ID NO: 1711827 - RNA, 13 nt, Human
cugcauuggcuuu

SEQ ID NO: 1711828 - RNA, 21 nt, Human
cuggugccucaccccuugcca

SEQ ID NO: 1711829 - RNA, 21 nt, Human
cuggguggcaccagcagccug

SEQ ID NO: 1711830 - RNA, 14 nt, Human
cuggguguggcgca

SEQ ID NO: 1711831 - RNA, 15 nt, Human
cuggguguggcgcag

SEQ ID NO: 1711832 - RNA, 12 nt, Human
cugggcagagga

SEQ ID NO: 1711833 - RNA, 16 nt, Human
cugggcagaggaaagc

SEQ ID NO: 1711834 - RNA, 13 nt, Human
cugggcagaggaa

SEQ ID NO: 1711835 - RNA, 20 nt, Human
cugggcagaggaaagcaaag

SEQ ID NO: 1711836 - RNA, 20 nt, Human
cugggcagguuggugggggc

SEQ ID NO: 1711837 - RNA, 14 nt, Human
cuggggagaaagua

SEQ ID NO: 1711838 - RNA, 13 nt, Human
cuggggagaaagu

SEQ ID NO: 1711839 - RNA, 20 nt, Human
cuggguggcaccagcagccu

SEQ ID NO: 1711840 - RNA, 18 nt, Human
cuggguggcaccagcagc

SEQ ID NO: 1711841 - RNA, 12 nt, Human
cuggcccuuccu

SEQ ID NO: 1711842 - RNA, 22 nt, Human
cuggcuaugcauuugaaaauuu

SEQ ID NO: 1711843 - RNA, 15 nt, Human
cuggcuaugcauuug

SEQ ID NO: 1711844 - RNA, 16 nt, Human
cuggcuaugcauuuga

SEQ ID NO: 1711845 - RNA, 13 nt, Human
cuggcuaugcauu

SEQ ID NO: 1711846 - RNA, 14 nt, Human
cuggcuaugcauuu

SEQ ID NO: 1711847 - RNA, 22 nt, Human
cugggacaugggaaaggggaag

SEQ ID NO: 1711848 - RNA, 18 nt, Human
cugggacaugggaaaggg

SEQ ID NO: 1711849 - RNA, 14 nt, Human
cugggacaugggaa

SEQ ID NO: 1711850 - RNA, 16 nt, Human
cugggacuacaggcac

SEQ ID NO: 1711851 - RNA, 15 nt, Human
cugggacuacaggca

SEQ ID NO: 1711852 - RNA, 13 nt, Human
cugggacuacagg

SEQ ID NO: 1711853 - RNA, 22 nt, Human
cugggagaaccaaaaagaggcu

SEQ ID NO: 1711854 - RNA, 17 nt, Human
cugggagaaaugaaaaa

SEQ ID NO: 1711855 - RNA, 16 nt, Human
cugggagaaaugaaaa

SEQ ID NO: 1711856 - RNA, 15 nt, Human
cuggaugcagccuca

SEQ ID NO: 1711857 - RNA, 22 nt, Human
cuggaugcagccucacaguccu

SEQ ID NO: 1711858 - RNA, 15 nt, Human
cuggaguucugguuc

SEQ ID NO: 1711859 - RNA, 17 nt, Human
cuggaguucugguuccu

SEQ ID NO: 1711860 - RNA, 16 nt, Human
cuggaguucugguucc

SEQ ID NO: 1711861 - RNA, 23 nt, Human
cuggacugugugcucaggagccc

SEQ ID NO: 1711862 - RNA, 22 nt, Human
cuggacugugugcucaggagcc

SEQ ID NO: 1711863 - RNA, 19 nt, Human
cuggacugugugcucagga

SEQ ID NO: 1711864 - RNA, 20 nt, Human
cugcuuaacuucacauauug

SEQ ID NO: 1711865 - RNA, 19 nt, Human
cugcucacauaucugucau

SEQ ID NO: 1711866 - RNA, 16 nt, Human
cugcucacauaucugu

SEQ ID NO: 1711867 - RNA, 12 nt, Human
cugcugacagug

SEQ ID NO: 1711868 - RNA, 15 nt, Human
cugcugaaggcucga

SEQ ID NO: 1711869 - RNA, 14 nt, Human
cugcugaaggcucg

SEQ ID NO: 1711870 - RNA, 13 nt, Human
cugcugaaggcuc

SEQ ID NO: 1711871 - RNA, 15 nt, Human
cugcugacaguguug

SEQ ID NO: 1711872 - RNA, 13 nt, Human
cugcugacagugu

SEQ ID NO: 1711873 - RNA, 23 nt, Human
cugcugagucccaggcugagccu

SEQ ID NO: 1711874 - RNA, 19 nt, Human
cugcugagucccaggcuga

SEQ ID NO: 1711875 - RNA, 20 nt, Human
cuucaccuuuguccccaccg

SEQ ID NO: 1711876 - RNA, 17 nt, Human
cuucaccuuugucccca

SEQ ID NO: 1711877 - RNA, 18 nt, Human
cuuauugcccacgcugga

SEQ ID NO: 1711878 - RNA, 14 nt, Human
cuucaccuuugucc

SEQ ID NO: 1711879 - RNA, 11 nt, Human
cuucagacaua

SEQ ID NO: 1711880 - RNA, 22 nt, Human
cuucagagacuccugcaggcag

SEQ ID NO: 1711881 - RNA, 21 nt, Human
cuucagagacuccugcaggca

SEQ ID NO: 1711882 - RNA, 16 nt, Human
cuucagagacuccugc

SEQ ID NO: 1711883 - RNA, 22 nt, Human
cuucaucucccaaagugcuggg

SEQ ID NO: 1711884 - RNA, 16 nt, Human
cuucauccuccucaga

SEQ ID NO: 1711885 - RNA, 24 nt, Human
cuucagagacuccugcaggcagcc

SEQ ID NO: 1711886 - RNA, 23 nt, Human
cuucagagacuccugcaggcagc

SEQ ID NO: 1711887 - RNA, 18 nt, Human
cuucaguggcagcugcuu

SEQ ID NO: 1711888 - RNA, 17 nt, Human
cuucaguuaagccuuug

SEQ ID NO: 1711889 - RNA, 15 nt, Human
cuucauccuccucag

SEQ ID NO: 1711890 - RNA, 13 nt, Human
cuucaucccucug

SEQ ID NO: 1711891 - RNA, 18 nt, Human
cuucaguuaagccuuugg

SEQ ID NO: 1711892 - RNA, 20 nt, Human
cuuccaugucgccucugcau

SEQ ID NO: 1711893 - RNA, 19 nt, Human
cuuccaugucgccucugca

SEQ ID NO: 1711894 - RNA, 18 nt, Human
cuuccaugucgccucugc

SEQ ID NO: 1711895 - RNA, 17 nt, Human
cuuccaugucgccucug

SEQ ID NO: 1711896 - RNA, 20 nt, Human
cuuccagugaggcucugccc

SEQ ID NO: 1711897 - RNA, 19 nt, Human
cuuccagugaggcucugcc

SEQ ID NO: 1711898 - RNA, 17 nt, Human
cuuccagugaggcucug

SEQ ID NO: 1711899 - RNA, 18 nt, Human
cuuccagugaggcucugc

SEQ ID NO: 1711900 - RNA, 17 nt, Human
cuuccauggacuuuguu

SEQ ID NO: 1711901 - RNA, 16 nt, Human
cuuccauggacuuugu

SEQ ID NO: 1711902 - RNA, 16 nt, Human
cuuccaugucgccucu

SEQ ID NO: 1711903 - RNA, 15 nt, Human
cuuccaugucgccuc

SEQ ID NO: 1711904 - RNA, 21 nt, Human
cuuaugggcuggguucuaccc

SEQ ID NO: 1711905 - RNA, 14 nt, Human
cuuaugggcugggu

SEQ ID NO: 1711906 - RNA, 23 nt, Human
cuuaugggcuggguucuacccag

SEQ ID NO: 1711907 - RNA, 22 nt, Human
cuuaugggcuggguucuaccca

SEQ ID NO: 1711908 - RNA, 13 nt, Human
cuuauugcccacg

SEQ ID NO: 1711909 - RNA, 12 nt, Human
cuuauugcccac

SEQ ID NO: 1711910 - RNA, 21 nt, Human
cuuagcagggaaacagcuaau

SEQ ID NO: 1711911 - RNA, 18 nt, Human
cuuagcagggaaacagcu

SEQ ID NO: 1711912 - RNA, 17 nt, Human
cuuacccucauguucuu

SEQ ID NO: 1711913 - RNA, 18 nt, Human
cuuacccucauguucuua

SEQ ID NO: 1711914 - RNA, 19 nt, Human
cuuacccucauguucuuaa

SEQ ID NO: 1711915 - RNA, 13 nt, Human
cuuaccucggugc

SEQ ID NO: 1711916 - RNA, 13 nt, Human
cuuaccugccagg

SEQ ID NO: 1711917 - RNA, 21 nt, Human
cuuaccucggugccuuccucu

SEQ ID NO: 1711918 - RNA, 19 nt, Human
cuuaccucggugccuuccu

SEQ ID NO: 1711919 - RNA, 13 nt, Human
cuuacacaauggu

SEQ ID NO: 1711920 - RNA, 20 nt, Human
cuguugggccaggagccucc

SEQ ID NO: 1711921 - RNA, 17 nt, Human
cuguugggccaggagcc

SEQ ID NO: 1711922 - RNA, 16 nt, Human
cuguugggccaggagc

SEQ ID NO: 1711923 - RNA, 20 nt, Human
cuuaaaauauuccugcauuu

SEQ ID NO: 1711924 - RNA, 18 nt, Human
cuuaaaauauuccugcau

SEQ ID NO: 1711925 - RNA, 17 nt, Human
cuguugcugccucaugc

SEQ ID NO: 1711926 - RNA, 16 nt, Human
cuguugcugccucaug

SEQ ID NO: 1711927 - RNA, 15 nt, Human
cuguugcugccucau

SEQ ID NO: 1711928 - RNA, 14 nt, Human
cuguugcugccuca

SEQ ID NO: 1711929 - RNA, 14 nt, Human
cuguucagcuccag

SEQ ID NO: 1711930 - RNA, 13 nt, Human
cuguucagcucca

SEQ ID NO: 1711931 - RNA, 19 nt, Human
cugugucuugcaauggcag

SEQ ID NO: 1711932 - RNA, 16 nt, Human
cugugucuugcaaugg

SEQ ID NO: 1711933 - RNA, 20 nt, Human
cugugucuugcaauggcagc

SEQ ID NO: 1711934 - RNA, 15 nt, Human
cuguucacucuacuu

SEQ ID NO: 1711935 - RNA, 17 nt, Human
cugugacuucagcucug

SEQ ID NO: 1711936 - RNA, 22 nt, Human
cugugacuucagcucuguuuua

SEQ ID NO: 1711937 - RNA, 19 nt, Human
cugugucucccuucauccu

SEQ ID NO: 1711938 - RNA, 14 nt, Human
cugugucucccuuc

SEQ ID NO: 1711939 - RNA, 14 nt, Human
cugugucuugcaau

SEQ ID NO: 1711940 - RNA, 19 nt, Human
cugugucagguggggcagc

SEQ ID NO: 1711941 - RNA, 20 nt, Human
cugugucagcauagaaguaa

SEQ ID NO: 1711942 - RNA, 21 nt, Human
cugugucagguggggcagcuu

SEQ ID NO: 1711943 - RNA, 11 nt, Human
cugugcugccc

SEQ ID NO: 1711944 - RNA, 22 nt, Human
cugugcugagucugaaggcugg

SEQ ID NO: 1711945 - RNA, 20 nt, Human
cugugcugagucugaaggcu

SEQ ID NO: 1711946 - RNA, 22 nt, Human
cuuucaauaggaaaaacugauu

SEQ ID NO: 1711947 - RNA, 21 nt, Human
cuuucaauaggaaaaacugau

SEQ ID NO: 1711948 - RNA, 20 nt, Human
cuuucaauaggaaaaacuga

SEQ ID NO: 1711949 - RNA, 23 nt, Human
cuuucaauaggaaaaacugauuu

SEQ ID NO: 1711950 - RNA, 13 nt, Human
cuuguggacacag

SEQ ID NO: 1711951 - RNA, 15 nt, Human
cuuguggacacagcu

SEQ ID NO: 1711952 - RNA, 14 nt, Human
cuuguggacacagc

SEQ ID NO: 1711953 - RNA, 16 nt, Human
cuuguggacacagcuc

SEQ ID NO: 1711954 - RNA, 15 nt, Human
cuuuucaaaacauuu

SEQ ID NO: 1711955 - RNA, 19 nt, Human
cuuuuauuuagcaccaggg

SEQ ID NO: 1711956 - RNA, 19 nt, Human
cuuuuauaaacuuuaccuu

SEQ ID NO: 1711957 - RNA, 16 nt, Human
cuuuuauaaacuuuac

SEQ ID NO: 1711958 - RNA, 18 nt, Human
cuuuuauaaacuuuaccu

SEQ ID NO: 1711959 - RNA, 15 nt, Human
cuuuuauaaacuuua

SEQ ID NO: 1711960 - RNA, 18 nt, Human
cuuuuaggccaaaaaaau

SEQ ID NO: 1711961 - RNA, 16 nt, Human
cuuuuaggccaaaaaa

SEQ ID NO: 1711962 - RNA, 16 nt, Human
cuuuggucuacacugu

SEQ ID NO: 1711963 - RNA, 20 nt, Human
cuuuggucuacacugugcug

SEQ ID NO: 1711964 - RNA, 15 nt, Human
cuuuggugaacauug

SEQ ID NO: 1711965 - RNA, 22 nt, Human
cuuucggggagaggcugaggac

SEQ ID NO: 1711966 - RNA, 17 nt, Human
cuuucuaaugugugaau

SEQ ID NO: 1711967 - RNA, 22 nt, Human
cuuugacgccaucccagcccca

SEQ ID NO: 1711968 - RNA, 21 nt, Human
cuuugacgccaucccagcccc

SEQ ID NO: 1711969 - RNA, 19 nt, Human
cuuugacgccaucccagcc

SEQ ID NO: 1711970 - RNA, 16 nt, Human
cuuugagcuuaagaau

SEQ ID NO: 1711971 - RNA, 21 nt, Human
cuucuucagagacuccugcag

SEQ ID NO: 1711972 - RNA, 20 nt, Human
cuucuucagagacuccugca

SEQ ID NO: 1711973 - RNA, 22 nt, Human
cuucuucagagacuccugcagg

SEQ ID NO: 1711974 - RNA, 20 nt, Human
cuugaaugaugccaugagga

SEQ ID NO: 1711975 - RNA, 13 nt, Human
cuugcucugcuga

SEQ ID NO: 1711976 - RNA, 23 nt, Human
cuugccgucuaccugaggggccu

SEQ ID NO: 1711977 - RNA, 20 nt, Human
cuugccgucuaccugagggg

SEQ ID NO: 1711978 - RNA, 12 nt, Human
cuugacagggca

SEQ ID NO: 1711979 - RNA, 23 nt, Human
cuugaaugaugccaugaggaaca

SEQ ID NO: 1711980 - RNA, 12 nt, Human
cuugcucugcug

SEQ ID NO: 1711981 - RNA, 22 nt, Human
gcacaagcugcacccucaggca

SEQ ID NO: 1711982 - RNA, 14 nt, Human
gcacaccgggcacu

SEQ ID NO: 1711983 - RNA, 14 nt, Human
gcacacauuuuuua

SEQ ID NO: 1711984 - RNA, 20 nt, Human
gcacaccgggcacucagaag

SEQ ID NO: 1711985 - RNA, 19 nt, Human
gcacagugcaucucagccc

SEQ ID NO: 1711986 - RNA, 21 nt, Human
gcacagugcaucucagcccac

SEQ ID NO: 1711987 - RNA, 20 nt, Human
gcacagugcaucucagccca

SEQ ID NO: 1711988 - RNA, 18 nt, Human
gcaagucagaauagaaau

SEQ ID NO: 1711989 - RNA, 22 nt, Human
gcacaucagcacgauuucuguu

SEQ ID NO: 1711990 - RNA, 23 nt, Human
gcacaucagcacgauuucuguuu

SEQ ID NO: 1711991 - RNA, 14 nt, Human
gcaccgggccacag

SEQ ID NO: 1711992 - RNA, 23 nt, Human
gcaccgggccacagagaaaguac

SEQ ID NO: 1711993 - RNA, 21 nt, Human
gcaccuaccaccacgcccggc

SEQ ID NO: 1711994 - RNA, 22 nt, Human
gcaccuaccaccacgcccggcu

SEQ ID NO: 1711995 - RNA, 17 nt, Human
gcacuccccugcugggu

SEQ ID NO: 1711996 - RNA, 17 nt, Human
gcacucagaagacacug

SEQ ID NO: 1711997 - RNA, 16 nt, Human
gcacucagaagacacu

SEQ ID NO: 1711998 - RNA, 13 nt, Human
gcacucagaagac

SEQ ID NO: 1711999 - RNA, 22 nt, Human
gcacuccccugcuggguguggc

SEQ ID NO: 1712000 - RNA, 12 nt, Human
gauucuucugcu

SEQ ID NO: 1712001 - RNA, 18 nt, Human
gauucuuccucccucccu

SEQ ID NO: 1712002 - RNA, 17 nt, Human
gauucuuccucccuccc

SEQ ID NO: 1712003 - RNA, 20 nt, Human
gauuuuuuacagcugccugc

SEQ ID NO: 1712004 - RNA, 17 nt, Human
gauucuccugccucagc

SEQ ID NO: 1712005 - RNA, 15 nt, Human
gauucuccugccuca

SEQ ID NO: 1712006 - RNA, 18 nt, Human
gauucuccugccucagcc

SEQ ID NO: 1712007 - RNA, 20 nt, Human
gauuauaggcaccuaccacc

SEQ ID NO: 1712008 - RNA, 14 nt, Human
gauuauauuaugaa

SEQ ID NO: 1712009 - RNA, 20 nt, Human
gauguauguugaagccuuug

SEQ ID NO: 1712010 - RNA, 21 nt, Human
gauguauguugaagccuuugu

SEQ ID NO: 1712011 - RNA, 12 nt, Human
gauuauuggaaa

SEQ ID NO: 1712012 - RNA, 17 nt, Human
gauguagaggagaaacu

SEQ ID NO: 1712013 - RNA, 18 nt, Human
gauguagaggagaaacug

SEQ ID NO: 1712014 - RNA, 12 nt, Human
gauguaaagaug

SEQ ID NO: 1712015 - RNA, 18 nt, Human
gauguaaaagacuuuuuu

SEQ ID NO: 1712016 - RNA, 14 nt, Human
gaugaucuuugcag

SEQ ID NO: 1712017 - RNA, 21 nt, Human
gaugaucuaggaagacuuugg

SEQ ID NO: 1712018 - RNA, 15 nt, Human
gaugaucuaggaaga

SEQ ID NO: 1712019 - RNA, 16 nt, Human
gaugagugagcaugcc

SEQ ID NO: 1712020 - RNA, 16 nt, Human
gaguuuaaauuguaau

SEQ ID NO: 1712021 - RNA, 22 nt, Human
gaguuguuacauuuuuaagugc

SEQ ID NO: 1712022 - RNA, 18 nt, Human
gaguugauucagcucugc

SEQ ID NO: 1712023 - RNA, 20 nt, Human
gagugacagaggcagcccca

SEQ ID NO: 1712024 - RNA, 19 nt, Human
gagugcaaugacacagucu

SEQ ID NO: 1712025 - RNA, 17 nt, Human
gaguugauucagcucug

SEQ ID NO: 1712026 - RNA, 16 nt, Human
gaguugauucagcucu

SEQ ID NO: 1712027 - RNA, 15 nt, Human
gaguugauucagcuc

SEQ ID NO: 1712028 - RNA, 18 nt, Human
gagugacagaggcagccc

SEQ ID NO: 1712029 - RNA, 13 nt, Human
gagucccaccuug

SEQ ID NO: 1712030 - RNA, 12 nt, Human
gagucccaccuu

SEQ ID NO: 1712031 - RNA, 22 nt, Human
gagucagaaguuucugccgcag

SEQ ID NO: 1712032 - RNA, 16 nt, Human
gagucaccaagcccag

SEQ ID NO: 1712033 - RNA, 17 nt, Human
gagucaccaagcccagu

SEQ ID NO: 1712034 - RNA, 15 nt, Human
gaggucgaggcagga

SEQ ID NO: 1712035 - RNA, 23 nt, Human
gaggugaccccagguuucuaugu

SEQ ID NO: 1712036 - RNA, 19 nt, Human
gaggcuccacuuggucugu

SEQ ID NO: 1712037 - RNA, 14 nt, Human
gaggcucagauugu

SEQ ID NO: 1712038 - RNA, 18 nt, Human
gaggcuacuguaaggcaa

SEQ ID NO: 1712039 - RNA, 12 nt, Human
gaggcuccacuu

SEQ ID NO: 1712040 - RNA, 23 nt, Human
gaggcuccacuuggucugugaga

SEQ ID NO: 1712041 - RNA, 22 nt, Human
gaggcuagugugguguuuccug

SEQ ID NO: 1712042 - RNA, 19 nt, Human
gaggccagagacacaagcc

SEQ ID NO: 1712043 - RNA, 14 nt, Human
gaggccagagacac

SEQ ID NO: 1712044 - RNA, 13 nt, Human
gaggccagagaca

SEQ ID NO: 1712045 - RNA, 17 nt, Human
gaggcaucgcaauguaa

SEQ ID NO: 1712046 - RNA, 14 nt, Human
gaggcagggucuca

SEQ ID NO: 1712047 - RNA, 15 nt, Human
gaggacgcucucugg

SEQ ID NO: 1712048 - RNA, 18 nt, Human
gaggcagggucucacucu

SEQ ID NO: 1712049 - RNA, 15 nt, Human
gaggcagggucucac

SEQ ID NO: 1712050 - RNA, 22 nt, Human
gaggccaaggugggaggauugc

SEQ ID NO: 1712051 - RNA, 17 nt, Human
gaggccaaggugggagg

SEQ ID NO: 1712052 - RNA, 12 nt, Human
gaggggccucuu

SEQ ID NO: 1712053 - RNA, 20 nt, Human
gagccuuccaggggugggac

SEQ ID NO: 1712054 - RNA, 19 nt, Human
gagccuugaacuuugaccu

SEQ ID NO: 1712055 - RNA, 23 nt, Human
gagccuuccaggggugggacacc

SEQ ID NO: 1712056 - RNA, 13 nt, Human
gagccuugaacuu

SEQ ID NO: 1712057 - RNA, 21 nt, Human
gagcgcccacuagacccacug

SEQ ID NO: 1712058 - RNA, 16 nt, Human
gaagacaaugacuuac

SEQ ID NO: 1712059 - RNA, 23 nt, Human
gaagacaaugugaaaagaaaaau

SEQ ID NO: 1712060 - RNA, 22 nt, Human
gaagacaaugacuuacuguaca

SEQ ID NO: 1712061 - RNA, 23 nt, Human
gaagcaacccaaauguucaucaa

SEQ ID NO: 1712062 - RNA, 20 nt, Human
gaagcaaugcuucaucccuu

SEQ ID NO: 1712063 - RNA, 20 nt, Human
gaagcacaugccucucucag

SEQ ID NO: 1712064 - RNA, 17 nt, Human
gaagcacaugccucucu

SEQ ID NO: 1712065 - RNA, 15 nt, Human
gaagcacaugccucu

SEQ ID NO: 1712066 - RNA, 15 nt, Human
gaagcagaggaagga

SEQ ID NO: 1712067 - RNA, 21 nt, Human
gaagcacaugccucucucagg

SEQ ID NO: 1712068 - RNA, 20 nt, Human
gaacucugacaacagacuuc

SEQ ID NO: 1712069 - RNA, 12 nt, Human
gaacuggcugca

SEQ ID NO: 1712070 - RNA, 11 nt, Human
gaacuggcugc

SEQ ID NO: 1712071 - RNA, 20 nt, Human
gaagcuaucguaaaauuaag

SEQ ID NO: 1712072 - RNA, 19 nt, Human
gaagcuccgcuuucuaccc

SEQ ID NO: 1712073 - RNA, 22 nt, Human
gaagcuccgcuuucuacccagc

SEQ ID NO: 1712074 - RNA, 17 nt, Human
gaaggccccgcccaggc

SEQ ID NO: 1712075 - RNA, 19 nt, Human
gaaggcuggguucugaucc

SEQ ID NO: 1712076 - RNA, 15 nt, Human
gaaggcuggguucug

SEQ ID NO: 1712077 - RNA, 21 nt, Human
gaaggcucgagcaugccugga

SEQ ID NO: 1712078 - RNA, 19 nt, Human
gaaggccccgcccaggcuu

SEQ ID NO: 1712079 - RNA, 18 nt, Human
gaaggccccgcccaggcu

SEQ ID NO: 1712080 - RNA, 22 nt, Human
gaaggcuggguucugauccuag

SEQ ID NO: 1712081 - RNA, 20 nt, Human
gaaggcuggguucugauccu

SEQ ID NO: 1712082 - RNA, 21 nt, Human
gaagggcuuggacucaagcaa

SEQ ID NO: 1712083 - RNA, 20 nt, Human
gaauauuagugaccucagcu

SEQ ID NO: 1712084 - RNA, 15 nt, Human
gaauauugcugaugg

SEQ ID NO: 1712085 - RNA, 14 nt, Human
gaauauugcugaug

SEQ ID NO: 1712086 - RNA, 20 nt, Human
gaauauugcugauggugcaa

SEQ ID NO: 1712087 - RNA, 19 nt, Human
gaauauugcugauggugca

SEQ ID NO: 1712088 - RNA, 22 nt, Human
gaaggggagauaaggguaucug

SEQ ID NO: 1712089 - RNA, 18 nt, Human
gaaguuuaauugacuuau

SEQ ID NO: 1712090 - RNA, 15 nt, Human
gacauugcggacagc

SEQ ID NO: 1712091 - RNA, 14 nt, Human
gacauugcggacag

SEQ ID NO: 1712092 - RNA, 21 nt, Human
gacagugagacucugucucag

SEQ ID NO: 1712093 - RNA, 19 nt, Human
gacagcccgggcucugccu

SEQ ID NO: 1712094 - RNA, 18 nt, Human
gacagcccgggcucugcc

SEQ ID NO: 1712095 - RNA, 20 nt, Human
gacagcccgggcucugccuc

SEQ ID NO: 1712096 - RNA, 16 nt, Human
gacagaagcagcucuu

SEQ ID NO: 1712097 - RNA, 19 nt, Human
gacauuguuggccaaagcc

SEQ ID NO: 1712098 - RNA, 18 nt, Human
gaccagggauuuccauga

SEQ ID NO: 1712099 - RNA, 19 nt, Human
gaccaucccugaaggcccc

SEQ ID NO: 1712100 - RNA, 18 nt, Human
gaccaucccugaaggccc

SEQ ID NO: 1712101 - RNA, 13 nt, Human
gaccaucccugaa

SEQ ID NO: 1712102 - RNA, 12 nt, Human
gaccaucccuga

SEQ ID NO: 1712103 - RNA, 20 nt, Human
gaccagggauuuccaugaug

SEQ ID NO: 1712104 - RNA, 13 nt, Human
gaccauacuaauu

SEQ ID NO: 1712105 - RNA, 21 nt, Human
gacagaaagcagaacagugau

SEQ ID NO: 1712106 - RNA, 17 nt, Human
gacagcccgggcucugc

SEQ ID NO: 1712107 - RNA, 15 nt, Human
gacagaagcagcucu

SEQ ID NO: 1712108 - RNA, 16 nt, Human
gacacagcucuucucc

SEQ ID NO: 1712109 - RNA, 14 nt, Human
gacacagcucuucu

SEQ ID NO: 1712110 - RNA, 12 nt, Human
gacacaggcccg

SEQ ID NO: 1712111 - RNA, 23 nt, Human
gacacagcucuucuccaggcugu

SEQ ID NO: 1712112 - RNA, 22 nt, Human
gacacagcucuucuccaggcug

SEQ ID NO: 1712113 - RNA, 17 nt, Human
gacacagcucuucucca

SEQ ID NO: 1712114 - RNA, 22 nt, Human
gacugugugcucaggagcccug

SEQ ID NO: 1712115 - RNA, 14 nt, Human
gacugaauuucuuu

SEQ ID NO: 1712116 - RNA, 16 nt, Human
gacugaauuucuuuug

SEQ ID NO: 1712117 - RNA, 23 nt, Human
gacuguacuccucccaggcgccc

SEQ ID NO: 1712118 - RNA, 18 nt, Human
gacuguacuccucccagg

SEQ ID NO: 1712119 - RNA, 11 nt, Human
gacuguagaaa

SEQ ID NO: 1712120 - RNA, 19 nt, Human
gacucugucucaaaaaaac

SEQ ID NO: 1712121 - RNA, 22 nt, Human
gacucaccucccccaucucuuc

SEQ ID NO: 1712122 - RNA, 15 nt, Human
gacucaccuccccca

SEQ ID NO: 1712123 - RNA, 16 nt, Human
gacucugccuccucuu

SEQ ID NO: 1712124 - RNA, 12 nt, Human
gacucugccucc

SEQ ID NO: 1712125 - RNA, 15 nt, Human
gacgcucucuggccu

SEQ ID NO: 1712126 - RNA, 19 nt, Human
gacgcuacccgggaagggg

SEQ ID NO: 1712127 - RNA, 18 nt, Human
gacgcuacccgggaaggg

SEQ ID NO: 1712128 - RNA, 16 nt, Human
gacgcuacccgggaag

SEQ ID NO: 1712129 - RNA, 18 nt, Human
gacgccaucccagcccca

SEQ ID NO: 1712130 - RNA, 17 nt, Human
gacgccaucccagcccc

SEQ ID NO: 1712131 - RNA, 19 nt, Human
gacgccaucccagccccaa

SEQ ID NO: 1712132 - RNA, 16 nt, Human
gacgcucucuggccuu

SEQ ID NO: 1712133 - RNA, 17 nt, Human
gacgcucucuggccuuc

SEQ ID NO: 1712134 - RNA, 20 nt, Human
gaccaucccugaaggccccg

SEQ ID NO: 1712135 - RNA, 14 nt, Human
gaccucugcagcaa

SEQ ID NO: 1712136 - RNA, 16 nt, Human
gacgccaucccagccc

SEQ ID NO: 1712137 - RNA, 14 nt, Human
gaccugaggcccuu

SEQ ID NO: 1712138 - RNA, 13 nt, Human
gaccugaggcccu

SEQ ID NO: 1712139 - RNA, 11 nt, Human
gaccugaggcc

SEQ ID NO: 1712140 - RNA, 22 nt, Human
gggaacagacuggaagcacagc

SEQ ID NO: 1712141 - RNA, 19 nt, Human
aaaaaucucaaauuucuaa

SEQ ID NO: 1712142 - RNA, 20 nt, Human
aaaaaucucaaauuucuaaa

SEQ ID NO: 1712143 - RNA, 14 nt, Human
gggaacagacugga

SEQ ID NO: 1712144 - RNA, 15 nt, Human
aaaaccaauguucuc

SEQ ID NO: 1712145 - RNA, 18 nt, Human
aaaacguggcugcuucaa

SEQ ID NO: 1712146 - RNA, 17 nt, Human
aaaacguggcugcuuca

SEQ ID NO: 1712147 - RNA, 16 nt, Human
aaaacguggcugcuuc

SEQ ID NO: 1712148 - RNA, 14 nt, Human
aaaacguggcugcu

SEQ ID NO: 1712149 - RNA, 21 nt, Human
aaaacguggcugcuucaagga

SEQ ID NO: 1712150 - RNA, 19 nt, Human
aaaaccaagccguggcuuc

SEQ ID NO: 1712151 - RNA, 22 nt, Human
aaaacugauuuuuuuuuccuuc

SEQ ID NO: 1712152 - RNA, 18 nt, Human
aaaacugauuuuuuuuuc

SEQ ID NO: 1712153 - RNA, 20 nt, Human
aaaacugcugacuguuuucu

SEQ ID NO: 1712154 - RNA, 19 nt, Human
aaaacugcucauaugaugu

SEQ ID NO: 1712155 - RNA, 22 nt, Human
aaaagcuccauuuuuagugaaa

SEQ ID NO: 1712156 - RNA, 14 nt, Human
aaaagcugggcagg

SEQ ID NO: 1712157 - RNA, 21 nt, Human
aaaacuuuaugcuaagugaaa

SEQ ID NO: 1712158 - RNA, 18 nt, Human
aaaagccuguuuaagaga

SEQ ID NO: 1712159 - RNA, 16 nt, Human
aaaagccuguuuaaga

SEQ ID NO: 1712160 - RNA, 20 nt, Human
gggaggcagagguugcagug

SEQ ID NO: 1712161 - RNA, 19 nt, Human
gggaggccaaggugggagg

SEQ ID NO: 1712162 - RNA, 13 nt, Human
gggagggcuccag

SEQ ID NO: 1712163 - RNA, 11 nt, Human
gggagggcucc

SEQ ID NO: 1712164 - RNA, 13 nt, Human
gggagggccuggg

SEQ ID NO: 1712165 - RNA, 15 nt, Human
gggauuuccaugaug

SEQ ID NO: 1712166 - RNA, 19 nt, Human
aaaagggacugagaaauuu

SEQ ID NO: 1712167 - RNA, 16 nt, Human
aaaagggacugagaaa

SEQ ID NO: 1712168 - RNA, 18 nt, Human
aaaagggaacugaacauu

SEQ ID NO: 1712169 - RNA, 14 nt, Human
aaaauaccagccag

SEQ ID NO: 1712170 - RNA, 15 nt, Human
aaaauaccagccagu

SEQ ID NO: 1712171 - RNA, 12 nt, Human
aaaauaaauuau

SEQ ID NO: 1712172 - RNA, 18 nt, Human
aaaauauauaucaaauau

SEQ ID NO: 1712173 - RNA, 13 nt, Human
aaaauauagcuaa

SEQ ID NO: 1712174 - RNA, 12 nt, Human
aaaauagccugc

SEQ ID NO: 1712175 - RNA, 18 nt, Human
aaaauaguggugugauuu

SEQ ID NO: 1712176 - RNA, 17 nt, Human
ggcugcagggaguccga

SEQ ID NO: 1712177 - RNA, 20 nt, Human
ggcugcaugcgggcuuccuc

SEQ ID NO: 1712178 - RNA, 22 nt, Human
ggcugcaugcgggcuuccuccu

SEQ ID NO: 1712179 - RNA, 24 nt, Human
ggcucuuccaggcugggagagccu

SEQ ID NO: 1712180 - RNA, 23 nt, Human
ggcucuuccaggcugggagagcc

SEQ ID NO: 1712181 - RNA, 18 nt, Human
ggcucgagcaugccugga

SEQ ID NO: 1712182 - RNA, 16 nt, Human
ggcucccuucccaccu

SEQ ID NO: 1712183 - RNA, 18 nt, Human
ggcucccuucccaccucu

SEQ ID NO: 1712184 - RNA, 17 nt, Human
ggcucccuucccaccuc

SEQ ID NO: 1712185 - RNA, 22 nt, Human
ggcucccuucccaccucucuca

SEQ ID NO: 1712186 - RNA, 20 nt, Human
ggcucccuucccaccucucu

SEQ ID NO: 1712187 - RNA, 17 nt, Human
ggcuccucccggugccc

SEQ ID NO: 1712188 - RNA, 12 nt, Human
ggcuccugccac

SEQ ID NO: 1712189 - RNA, 13 nt, Human
ggcuccugccacc

SEQ ID NO: 1712190 - RNA, 13 nt, Human
ggcugggagagcc

SEQ ID NO: 1712191 - RNA, 22 nt, Human
ggcuggccuggccccucagggu

SEQ ID NO: 1712192 - RNA, 17 nt, Human
ggcuggccuggccccuc

SEQ ID NO: 1712193 - RNA, 15 nt, Human
ggcuggcccugcccu

SEQ ID NO: 1712194 - RNA, 14 nt, Human
ggcuggcccugccc

SEQ ID NO: 1712195 - RNA, 13 nt, Human
ggcuggcccugcc

SEQ ID NO: 1712196 - RNA, 20 nt, Human
ggcuggcgugcaguggugcg

SEQ ID NO: 1712197 - RNA, 16 nt, Human
ggcuggcgugcagugg

SEQ ID NO: 1712198 - RNA, 14 nt, Human
ggcuggcgugcagu

SEQ ID NO: 1712199 - RNA, 16 nt, Human
ggcuggcccugcccug

SEQ ID NO: 1712200 - RNA, 13 nt, Human
aaaaaaacacaaa

SEQ ID NO: 1712201 - RNA, 20 nt, Human
aaaaagcuccaaaugcagcu

SEQ ID NO: 1712202 - RNA, 23 nt, Human
gggaaaaucagccugcuccagcu

SEQ ID NO: 1712203 - RNA, 13 nt, Human
gggaaaaucagcc

SEQ ID NO: 1712204 - RNA, 16 nt, Human
ggcuucaguggcagcu

SEQ ID NO: 1712205 - RNA, 15 nt, Human
ggcugucaauuacag

SEQ ID NO: 1712206 - RNA, 23 nt, Human
ggcuguaucccaugagccucagc

SEQ ID NO: 1712207 - RNA, 22 nt, Human
ggcuguaucccaugagccucag

SEQ ID NO: 1712208 - RNA, 20 nt, Human
ggcuguaucccaugagccuc

SEQ ID NO: 1712209 - RNA, 15 nt, Human
ggcuucaguggcagc

SEQ ID NO: 1712210 - RNA, 16 nt, Human
ggcuggugucaccuga

SEQ ID NO: 1712211 - RNA, 19 nt, Human
ggcuguaucccaugagccu

SEQ ID NO: 1712212 - RNA, 13 nt, Human
aaaggaauuuaaa

SEQ ID NO: 1712213 - RNA, 11 nt, Human
aaaggaaagag

SEQ ID NO: 1712214 - RNA, 17 nt, Human
aaagcagugcaugcugu

SEQ ID NO: 1712215 - RNA, 22 nt, Human
aaagcagugcaugcugucccuu

SEQ ID NO: 1712216 - RNA, 21 nt, Human
aaagcagugcaugcugucccu

SEQ ID NO: 1712217 - RNA, 18 nt, Human
aaagcuaggccuggccag

SEQ ID NO: 1712218 - RNA, 13 nt, Human
aaagcuagaaaug

SEQ ID NO: 1712219 - RNA, 14 nt, Human
ggucugugagaugc

SEQ ID NO: 1712220 - RNA, 24 nt, Human
ggucugugagaugcuagaacuccc

SEQ ID NO: 1712221 - RNA, 12 nt, Human
ggucuguucuuu

SEQ ID NO: 1712222 - RNA, 22 nt, Human
ggucuugaacuccuggccucaa

SEQ ID NO: 1712223 - RNA, 21 nt, Human
ggucuugaacuccuggccuca

SEQ ID NO: 1712224 - RNA, 17 nt, Human
ggucuguucuuuccaaa

SEQ ID NO: 1712225 - RNA, 19 nt, Human
ggucuguucuuuccaaagu

SEQ ID NO: 1712226 - RNA, 21 nt, Human
ggugauccacucgccuucauc

SEQ ID NO: 1712227 - RNA, 22 nt, Human
ggugcacaagcuccaagcuccc

SEQ ID NO: 1712228 - RNA, 16 nt, Human
ggugcacaagcuccaa

SEQ ID NO: 1712229 - RNA, 18 nt, Human
ggugcaaaguucccuacu

SEQ ID NO: 1712230 - RNA, 17 nt, Human
aaagaauggaaggugga

SEQ ID NO: 1712231 - RNA, 15 nt, Human
aaagacuguacaaag

SEQ ID NO: 1712232 - RNA, 19 nt, Human
aaagacuuuuccaacccuc

SEQ ID NO: 1712233 - RNA, 18 nt, Human
aaagaggcuaugugagca

SEQ ID NO: 1712234 - RNA, 13 nt, Human
aaagaggcuaugu

SEQ ID NO: 1712235 - RNA, 15 nt, Human
aaagaugagugagca

SEQ ID NO: 1712236 - RNA, 16 nt, Human
aaagauguucuggaua

SEQ ID NO: 1712237 - RNA, 20 nt, Human
aaagaugagcuuugucuacu

SEQ ID NO: 1712238 - RNA, 14 nt, Human
aaacuuuaccuuuu

SEQ ID NO: 1712239 - RNA, 14 nt, Human
ggucccaccccaca

SEQ ID NO: 1712240 - RNA, 12 nt, Human
ggucccacccca

SEQ ID NO: 1712241 - RNA, 22 nt, Human
gguccacccaggagccccgagg

SEQ ID NO: 1712242 - RNA, 20 nt, Human
gguccacccaggagccccga

SEQ ID NO: 1712243 - RNA, 23 nt, Human
gguauuggcuagagguucaaaga

SEQ ID NO: 1712244 - RNA, 19 nt, Human
gguccacccaggagccccg

SEQ ID NO: 1712245 - RNA, 18 nt, Human
gguauaaguggugugugu

SEQ ID NO: 1712246 - RNA, 21 nt, Human
aaaauguaggguuauaauaau

SEQ ID NO: 1712247 - RNA, 21 nt, Human
aaaauggacguguuaugacuc

SEQ ID NO: 1712248 - RNA, 19 nt, Human
aaaauuuuuaaucuuuaau

SEQ ID NO: 1712249 - RNA, 16 nt, Human
aaaauuuuuaaucuuu

SEQ ID NO: 1712250 - RNA, 18 nt, Human
aaacaagaccacguuucu

SEQ ID NO: 1712251 - RNA, 13 nt, Human
aaacaaagaaauu

SEQ ID NO: 1712252 - RNA, 16 nt, Human
aaacaugcuacacacu

SEQ ID NO: 1712253 - RNA, 22 nt, Human
aaacaugcuacacacugcaugu

SEQ ID NO: 1712254 - RNA, 17 nt, Human
ggggaccucaggccugg

SEQ ID NO: 1712255 - RNA, 16 nt, Human
ggggaccucaggccug

SEQ ID NO: 1712256 - RNA, 15 nt, Human
ggggaccucaggccu

SEQ ID NO: 1712257 - RNA, 13 nt, Human
ggggaccucaggc

SEQ ID NO: 1712258 - RNA, 23 nt, Human
ggggcccugccuccuuugugagg

SEQ ID NO: 1712259 - RNA, 19 nt, Human
ggggcccugccuccuuugu

SEQ ID NO: 1712260 - RNA, 16 nt, Human
ggggcccugccuccuu

SEQ ID NO: 1712261 - RNA, 19 nt, Human
ggggccaguuggucccccu

SEQ ID NO: 1712262 - RNA, 17 nt, Human
ggggccaguuggucccc

SEQ ID NO: 1712263 - RNA, 16 nt, Human
ggggccaggcuggguc

SEQ ID NO: 1712264 - RNA, 14 nt, Human
ggggccaggcuggg

SEQ ID NO: 1712265 - RNA, 13 nt, Human
ggggccaggcugg

SEQ ID NO: 1712266 - RNA, 23 nt, Human
aaacggccucacuaggcuucugg

SEQ ID NO: 1712267 - RNA, 21 nt, Human
aaaccacauuggagauguuua

SEQ ID NO: 1712268 - RNA, 20 nt, Human
aaacguggcugcuucaagga

SEQ ID NO: 1712269 - RNA, 17 nt, Human
aaacguggcugcuucaa

SEQ ID NO: 1712270 - RNA, 16 nt, Human
aaacguggcugcuuca

SEQ ID NO: 1712271 - RNA, 12 nt, Human
aaacgugaaaau

SEQ ID NO: 1712272 - RNA, 16 nt, Human
aaacuggauuaaacuu

SEQ ID NO: 1712273 - RNA, 21 nt, Human
aaacugcccccucugcccugc

SEQ ID NO: 1712274 - RNA, 20 nt, Human
aaacugcccccucugcccug

SEQ ID NO: 1712275 - RNA, 19 nt, Human
aaacugcccccucugcccu

SEQ ID NO: 1712276 - RNA, 17 nt, Human
aaacugcccccucugcc

SEQ ID NO: 1712277 - RNA, 13 nt, Human
aaacugcccccuc

SEQ ID NO: 1712278 - RNA, 11 nt, Human
aaacugccccc

SEQ ID NO: 1712279 - RNA, 12 nt, Human
aaacugcccccu

SEQ ID NO: 1712280 - RNA, 11 nt, Human
aaacuccugac

SEQ ID NO: 1712281 - RNA, 15 nt, Human
aaacuccagaugcca

SEQ ID NO: 1712282 - RNA, 22 nt, Human
aaacuccagaugccacaaugga

SEQ ID NO: 1712283 - RNA, 14 nt, Human
aaacauuaaaauau

SEQ ID NO: 1712284 - RNA, 16 nt, Human
aaaccaagccguggcu

SEQ ID NO: 1712285 - RNA, 14 nt, Human
aaaccaagccgugg

SEQ ID NO: 1712286 - RNA, 23 nt, Human
gggucucacuauguugcccaggc

SEQ ID NO: 1712287 - RNA, 12 nt, Human
gggucucacucu

SEQ ID NO: 1712288 - RNA, 22 nt, Human
gggucucacuauguugcccagg

SEQ ID NO: 1712289 - RNA, 23 nt, Human
aaacauguuucuuuguaaugaaa

SEQ ID NO: 1712290 - RNA, 22 nt, Human
aaacauguuucuuuguaaugaa

SEQ ID NO: 1712291 - RNA, 19 nt, Human
aaacauguuucuuuguaau

SEQ ID NO: 1712292 - RNA, 20 nt, Human
ggguaucaggugcugccauc

SEQ ID NO: 1712293 - RNA, 23 nt, Human
ggauuaaacuuaaucuaaaugga

SEQ ID NO: 1712294 - RNA, 21 nt, Human
ggauuuugauccaagcugguc

SEQ ID NO: 1712295 - RNA, 13 nt, Human
ggauguucuggga

SEQ ID NO: 1712296 - RNA, 21 nt, Human
ggaugaauuccaaauucugcu

SEQ ID NO: 1712297 - RNA, 22 nt, Human
ggaugagaaagguugaagcacc

SEQ ID NO: 1712298 - RNA, 12 nt, Human
ggaugagaaagg

SEQ ID NO: 1712299 - RNA, 12 nt, Human
ggcagaaggaag

SEQ ID NO: 1712300 - RNA, 17 nt, Human
ggcagccaggccacaag

SEQ ID NO: 1712301 - RNA, 15 nt, Human
ggcagccaggccaca

SEQ ID NO: 1712302 - RNA, 12 nt, Human
ggcagagcagag

SEQ ID NO: 1712303 - RNA, 10 nt, Human
ggcagagcag

SEQ ID NO: 1712304 - RNA, 18 nt, Human
ggcagccgugccuucagc

SEQ ID NO: 1712305 - RNA, 21 nt, Human
ggcagccgugccuucagcucu

SEQ ID NO: 1712306 - RNA, 19 nt, Human
ggcagccgugccuucagcu

SEQ ID NO: 1712307 - RNA, 22 nt, Human
ggcagccgugccuucagcucua

SEQ ID NO: 1712308 - RNA, 14 nt, Human
ggccucccaacuca

SEQ ID NO: 1712309 - RNA, 13 nt, Human
ggccucccaacuc

SEQ ID NO: 1712310 - RNA, 14 nt, Human
ggcccuuccuuuuc

SEQ ID NO: 1712311 - RNA, 13 nt, Human
ggccucccaaagu

SEQ ID NO: 1712312 - RNA, 22 nt, Human
ggcccuuccucuccacugccuu

SEQ ID NO: 1712313 - RNA, 19 nt, Human
ggcccuuccucuccacugc

SEQ ID NO: 1712314 - RNA, 23 nt, Human
ggcccuuccucuccacugccuuc

SEQ ID NO: 1712315 - RNA, 17 nt, Human
ggcccgacagccuggca

SEQ ID NO: 1712316 - RNA, 16 nt, Human
ggcccgacagccuggc

SEQ ID NO: 1712317 - RNA, 19 nt, Human
ggccagguggccacuccag

SEQ ID NO: 1712318 - RNA, 12 nt, Human
ggcauuguggga

SEQ ID NO: 1712319 - RNA, 12 nt, Human
ggccaaaggaag

SEQ ID NO: 1712320 - RNA, 15 nt, Human
ggccaaagccaaagc

SEQ ID NO: 1712321 - RNA, 13 nt, Human
ggccaaaggaagc

SEQ ID NO: 1712322 - RNA, 20 nt, Human
ggccagaugcaccagcccuu

SEQ ID NO: 1712323 - RNA, 19 nt, Human
ggccagaugcaccagcccu

SEQ ID NO: 1712324 - RNA, 23 nt, Human
ggccagagggagugacagaggca

SEQ ID NO: 1712325 - RNA, 13 nt, Human
ggccaagguggga

SEQ ID NO: 1712326 - RNA, 21 nt, Human
ggccaaggaugccccgucccc

SEQ ID NO: 1712327 - RNA, 15 nt, Human
ggaggcugagauggg

SEQ ID NO: 1712328 - RNA, 19 nt, Human
ggaggcugagaugggagaa

SEQ ID NO: 1712329 - RNA, 21 nt, Human
ggaggcucuggagcccacugu

SEQ ID NO: 1712330 - RNA, 16 nt, Human
ggaggucgaggcagga

SEQ ID NO: 1712331 - RNA, 15 nt, Human
ggaggucgaggcagg

SEQ ID NO: 1712332 - RNA, 18 nt, Human
ggaggucgaggcaggagg

SEQ ID NO: 1712333 - RNA, 21 nt, Human
ggaggcaugugaugagaggaa

SEQ ID NO: 1712334 - RNA, 12 nt, Human
ggaggaagagaa

SEQ ID NO: 1712335 - RNA, 20 nt, Human
ggaggaaaaccaagccgugg

SEQ ID NO: 1712336 - RNA, 22 nt, Human
ggaggaaaaccaagccguggcu

SEQ ID NO: 1712337 - RNA, 21 nt, Human
ggaggaaaaccaagccguggc

SEQ ID NO: 1712338 - RNA, 13 nt, Human
ggaggccagccuu

SEQ ID NO: 1712339 - RNA, 20 nt, Human
ggaggccaaggugggaggau

SEQ ID NO: 1712340 - RNA, 18 nt, Human
ggaggccaaggugggagg

SEQ ID NO: 1712341 - RNA, 20 nt, Human
ggaggcucuggagcccacug

SEQ ID NO: 1712342 - RNA, 17 nt, Human
ggaggcucuggagccca

SEQ ID NO: 1712343 - RNA, 16 nt, Human
ggagcugaguggggga

SEQ ID NO: 1712344 - RNA, 22 nt, Human
ggagcugccuguucagcuccag

SEQ ID NO: 1712345 - RNA, 22 nt, Human
ggagcccacuguacuugcucuu

SEQ ID NO: 1712346 - RNA, 18 nt, Human
ggagcccacuguacuugc

SEQ ID NO: 1712347 - RNA, 21 nt, Human
ggagcagccacauuccugaug

SEQ ID NO: 1712348 - RNA, 13 nt, Human
ggagcagccacau

SEQ ID NO: 1712349 - RNA, 15 nt, Human
ggagcccacuguacu

SEQ ID NO: 1712350 - RNA, 18 nt, Human
ggacuuuuauuuccagug

SEQ ID NO: 1712351 - RNA, 19 nt, Human
ggagaaaauggacguguua

SEQ ID NO: 1712352 - RNA, 17 nt, Human
ggacuuggaagcuccgc

SEQ ID NO: 1712353 - RNA, 15 nt, Human
ggacuuggaagcucc

SEQ ID NO: 1712354 - RNA, 22 nt, Human
ggagaaccaaaaagaggcuaug

SEQ ID NO: 1712355 - RNA, 18 nt, Human
ggagaaaugaaaaaauau

SEQ ID NO: 1712356 - RNA, 13 nt, Human
ggagaacuagaga

SEQ ID NO: 1712357 - RNA, 16 nt, Human
ggagacugucucaaga

SEQ ID NO: 1712358 - RNA, 22 nt, Human
ggacucaaugcacugacauugu

SEQ ID NO: 1712359 - RNA, 16 nt, Human
ggacuaggguccuggg

SEQ ID NO: 1712360 - RNA, 12 nt, Human
ggaccucaggcc

SEQ ID NO: 1712361 - RNA, 20 nt, Human
ggacuacaggugugagucac

SEQ ID NO: 1712362 - RNA, 23 nt, Human
ggacugugugcucaggagcccug

SEQ ID NO: 1712363 - RNA, 22 nt, Human
ggacugugugcucaggagcccu

SEQ ID NO: 1712364 - RNA, 17 nt, Human
ggacuuagcugggagaa

SEQ ID NO: 1712365 - RNA, 15 nt, Human
ggagagcuagcagca

SEQ ID NO: 1712366 - RNA, 18 nt, Human
ggagagccuuccaggggu

SEQ ID NO: 1712367 - RNA, 17 nt, Human
ggagagccuuccagggg

SEQ ID NO: 1712368 - RNA, 22 nt, Human
ggagagccuuccagggguggga

SEQ ID NO: 1712369 - RNA, 16 nt, Human
ggagagccuuccaggg

SEQ ID NO: 1712370 - RNA, 13 nt, Human
ggagagccuucca

SEQ ID NO: 1712371 - RNA, 14 nt, Human
ggagagagacucca

SEQ ID NO: 1712372 - RNA, 19 nt, Human
gcuuguacauaaugcgugc

SEQ ID NO: 1712373 - RNA, 18 nt, Human
ggacccugaggcccagag

SEQ ID NO: 1712374 - RNA, 15 nt, Human
ggacccugaggccca

SEQ ID NO: 1712375 - RNA, 14 nt, Human
ggacccugaggccc

SEQ ID NO: 1712376 - RNA, 21 nt, Human
ggacccggaggggccuggcag

SEQ ID NO: 1712377 - RNA, 20 nt, Human
ggacccggaggggccuggca

SEQ ID NO: 1712378 - RNA, 19 nt, Human
ggacccugaggcccagagg

SEQ ID NO: 1712379 - RNA, 21 nt, Human
ggaccccgagccuggcuccaa

SEQ ID NO: 1712380 - RNA, 22 nt, Human
gcuucaaggauccugagccaga

SEQ ID NO: 1712381 - RNA, 14 nt, Human
gcuuaacuucacau

SEQ ID NO: 1712382 - RNA, 20 nt, Human
gcuucacggaagagccuugc

SEQ ID NO: 1712383 - RNA, 13 nt, Human
gcugugcugcccu

SEQ ID NO: 1712384 - RNA, 12 nt, Human
gcugugcugccc

SEQ ID NO: 1712385 - RNA, 21 nt, Human
gcugugcucuggacaggcaug

SEQ ID NO: 1712386 - RNA, 22 nt, Human
gcugugcugcccugcccaccug

SEQ ID NO: 1712387 - RNA, 19 nt, Human
gcugugcugcccugcccac

SEQ ID NO: 1712388 - RNA, 22 nt, Human
gcuguuggcugggggccucagu

SEQ ID NO: 1712389 - RNA, 21 nt, Human
gcuguuggcugggggccucag

SEQ ID NO: 1712390 - RNA, 23 nt, Human
gcuguaucccaugagccucagca

SEQ ID NO: 1712391 - RNA, 20 nt, Human
gcuguaucccaugagccuca

SEQ ID NO: 1712392 - RNA, 14 nt, Human
gcugguuuuucagu

SEQ ID NO: 1712393 - RNA, 15 nt, Human
gcugguuuuucaguu

SEQ ID NO: 1712394 - RNA, 21 nt, Human
gcuggguuggaggguguccca

SEQ ID NO: 1712395 - RNA, 14 nt, Human
gcuggguuggaggg

SEQ ID NO: 1712396 - RNA, 15 nt, Human
gcuggguucugaucc

SEQ ID NO: 1712397 - RNA, 15 nt, Human
gcuggguucuaccca

SEQ ID NO: 1712398 - RNA, 23 nt, Human
gcuucccgcucagcccucccugc

SEQ ID NO: 1712399 - RNA, 18 nt, Human
gcuucccgcucagcccuc

SEQ ID NO: 1712400 - RNA, 17 nt, Human
gcuucccgcucagcccu

SEQ ID NO: 1712401 - RNA, 16 nt, Human
gcuucccgcucagccc

SEQ ID NO: 1712402 - RNA, 15 nt, Human
gcuucccgcucagcc

SEQ ID NO: 1712403 - RNA, 14 nt, Human
gcuuguacauaaug

SEQ ID NO: 1712404 - RNA, 16 nt, Human
gcuuguacauaaugcg

SEQ ID NO: 1712405 - RNA, 19 nt, Human
gcuugggcuucauccuccu

SEQ ID NO: 1712406 - RNA, 15 nt, Human
gcuugggaauuuuau

SEQ ID NO: 1712407 - RNA, 19 nt, Human
gcuugaaacccguggcgcu

SEQ ID NO: 1712408 - RNA, 14 nt, Human
gcuggagcucugcc

SEQ ID NO: 1712409 - RNA, 17 nt, Human
gcuggagcucugcccau

SEQ ID NO: 1712410 - RNA, 12 nt, Human
gcuggagugcag

SEQ ID NO: 1712411 - RNA, 19 nt, Human
gcugggauuacagguguga

SEQ ID NO: 1712412 - RNA, 18 nt, Human
gcugggauuacaggugug

SEQ ID NO: 1712413 - RNA, 17 nt, Human
gcugggauuacaggugu

SEQ ID NO: 1712414 - RNA, 17 nt, Human
gcugggauuacagggau

SEQ ID NO: 1712415 - RNA, 15 nt, Human
gcugggcagaggaaa

SEQ ID NO: 1712416 - RNA, 14 nt, Human
gcugggcagaggaa

SEQ ID NO: 1712417 - RNA, 13 nt, Human
gcugggcagagga

SEQ ID NO: 1712418 - RNA, 19 nt, Human
gcuggccuggccccucagg

SEQ ID NO: 1712419 - RNA, 18 nt, Human
gcuggccuggccccucag

SEQ ID NO: 1712420 - RNA, 16 nt, Human
gcugggauuacaggug

SEQ ID NO: 1712421 - RNA, 23 nt, Human
gcugggauuacaggcuccugcca

SEQ ID NO: 1712422 - RNA, 22 nt, Human
gcugggauuacaggcuccugcc

SEQ ID NO: 1712423 - RNA, 17 nt, Human
gcuggccuggccccuca

SEQ ID NO: 1712424 - RNA, 16 nt, Human
gcuggccuggccccuc

SEQ ID NO: 1712425 - RNA, 15 nt, Human
gcuggagugcaguga

SEQ ID NO: 1712426 - RNA, 14 nt, Human
gcuggagugcagug

SEQ ID NO: 1712427 - RNA, 20 nt, Human
gcugggcucccuucccaccu

SEQ ID NO: 1712428 - RNA, 17 nt, Human
gcugggcucccuuccca

SEQ ID NO: 1712429 - RNA, 16 nt, Human
gcugggcucccuuccc

SEQ ID NO: 1712430 - RNA, 12 nt, Human
gcugggcucccu

SEQ ID NO: 1712431 - RNA, 19 nt, Human
gcugggcagaggaaagcaa

SEQ ID NO: 1712432 - RNA, 17 nt, Human
gcugggcagaggaaagc

SEQ ID NO: 1712433 - RNA, 16 nt, Human
gcugggcagaggaaag

SEQ ID NO: 1712434 - RNA, 14 nt, Human
gcugggcagguugg

SEQ ID NO: 1712435 - RNA, 16 nt, Human
gcugggucgcccugga

SEQ ID NO: 1712436 - RNA, 18 nt, Human
gcugggucgcccuggacu

SEQ ID NO: 1712437 - RNA, 17 nt, Human
gcugggucgcccuggac

SEQ ID NO: 1712438 - RNA, 15 nt, Human
gcuggguguggcgca

SEQ ID NO: 1712439 - RNA, 19 nt, Human
gcugggucgcccuggacug

SEQ ID NO: 1712440 - RNA, 18 nt, Human
gcugccugggaucccuca

SEQ ID NO: 1712441 - RNA, 16 nt, Human
gcugccugggaucccu

SEQ ID NO: 1712442 - RNA, 19 nt, Human
gcugccugggaucccucau

SEQ ID NO: 1712443 - RNA, 13 nt, Human
gcugccugggauc

SEQ ID NO: 1712444 - RNA, 18 nt, Human
gcugagggugagugggug

SEQ ID NO: 1712445 - RNA, 17 nt, Human
gcugcaccggcuggccu

SEQ ID NO: 1712446 - RNA, 16 nt, Human
gcugcaccggcuggcc

SEQ ID NO: 1712447 - RNA, 22 nt, Human
gcugcaccggcuggccuggccc

SEQ ID NO: 1712448 - RNA, 19 nt, Human
gcugcaccggcuggccugg

SEQ ID NO: 1712449 - RNA, 18 nt, Human
gcugcaccggcuggccug

SEQ ID NO: 1712450 - RNA, 23 nt, Human
gcugccauccagguucagcuugu

SEQ ID NO: 1712451 - RNA, 21 nt, Human
gcugccauccagguucagcuu

SEQ ID NO: 1712452 - RNA, 21 nt, Human
gcugccagccgagauagccaa

SEQ ID NO: 1712453 - RNA, 19 nt, Human
gcugccagccgagauagcc

SEQ ID NO: 1712454 - RNA, 22 nt, Human
gcuccugccaccacgcccggcu

SEQ ID NO: 1712455 - RNA, 21 nt, Human
gcucccaggcauuccccagga

SEQ ID NO: 1712456 - RNA, 20 nt, Human
gcucccaggcauuccccagg

SEQ ID NO: 1712457 - RNA, 23 nt, Human
gcucccaggcauuccccaggagg

SEQ ID NO: 1712458 - RNA, 22 nt, Human
gcucccaggcauuccccaggag

SEQ ID NO: 1712459 - RNA, 14 nt, Human
gcuccccagcccca

SEQ ID NO: 1712460 - RNA, 19 nt, Human
gcuccccuaaagccucaaa

SEQ ID NO: 1712461 - RNA, 16 nt, Human
gcucucaggccagcug

SEQ ID NO: 1712462 - RNA, 15 nt, Human
gcucucaggccagcu

SEQ ID NO: 1712463 - RNA, 14 nt, Human
gcucucaggccagc

SEQ ID NO: 1712464 - RNA, 13 nt, Human
gcucucaggccag

SEQ ID NO: 1712465 - RNA, 22 nt, Human
gcucuacagcuaaucagcauuc

SEQ ID NO: 1712466 - RNA, 20 nt, Human
gcucuacagcuaaucagcau

SEQ ID NO: 1712467 - RNA, 12 nt, Human
gcucuuccaggc

SEQ ID NO: 1712468 - RNA, 16 nt, Human
gcucuuccaggcuggg

SEQ ID NO: 1712469 - RNA, 15 nt, Human
gcucuuccaggcugg

SEQ ID NO: 1712470 - RNA, 15 nt, Human
gcucuguccugggag

SEQ ID NO: 1712471 - RNA, 15 nt, Human
gcucuggccuccaag

SEQ ID NO: 1712472 - RNA, 17 nt, Human
gcucuggccuccaaguc

SEQ ID NO: 1712473 - RNA, 16 nt, Human
gcucuguccugggagu

SEQ ID NO: 1712474 - RNA, 19 nt, Human
gcucugucgcccaggcugg

SEQ ID NO: 1712475 - RNA, 17 nt, Human
gcugaaugguuuucaaa

SEQ ID NO: 1712476 - RNA, 20 nt, Human
gcugaaggcucgagcaugcc

SEQ ID NO: 1712477 - RNA, 12 nt, Human
gcugaaggcucg

SEQ ID NO: 1712478 - RNA, 15 nt, Human
gcugacagacacagg

SEQ ID NO: 1712479 - RNA, 14 nt, Human
gcugacagacacag

SEQ ID NO: 1712480 - RNA, 16 nt, Human
gcugacagacacaggc

SEQ ID NO: 1712481 - RNA, 17 nt, Human
gcugacagacacaggcc

SEQ ID NO: 1712482 - RNA, 23 nt, Human
gcucuggagcccacuguacuugc

SEQ ID NO: 1712483 - RNA, 21 nt, Human
gcucugagcaaauguggcucc

SEQ ID NO: 1712484 - RNA, 20 nt, Human
gcucugagcaaauguggcuc

SEQ ID NO: 1712485 - RNA, 16 nt, Human
gcuaguaucaaaagaa

SEQ ID NO: 1712486 - RNA, 15 nt, Human
gcuaggccuggccag

SEQ ID NO: 1712487 - RNA, 14 nt, Human
gcuaggccuggcca

SEQ ID NO: 1712488 - RNA, 21 nt, Human
gcuauugucaccagggcugga

SEQ ID NO: 1712489 - RNA, 20 nt, Human
gcuauugucaccagggcugg

SEQ ID NO: 1712490 - RNA, 16 nt, Human
gcuauugucaccaggg

SEQ ID NO: 1712491 - RNA, 18 nt, Human
gcuaggaacacuccuuca

SEQ ID NO: 1712492 - RNA, 21 nt, Human
gcuaggaacacuccuucacag

SEQ ID NO: 1712493 - RNA, 19 nt, Human
gcuaggaacacuccuucac

SEQ ID NO: 1712494 - RNA, 19 nt, Human
gccuguucagcuccagcuc

SEQ ID NO: 1712495 - RNA, 20 nt, Human
gccuguucagcuccagcuca

SEQ ID NO: 1712496 - RNA, 14 nt, Human
gccuguucagcucc

SEQ ID NO: 1712497 - RNA, 22 nt, Human
gcucagguggggucacucuggc

SEQ ID NO: 1712498 - RNA, 21 nt, Human
gcucagguggggucacucugg

SEQ ID NO: 1712499 - RNA, 15 nt, Human
gcucagagagggugg

SEQ ID NO: 1712500 - RNA, 20 nt, Human
gcucagagagggugggagug

SEQ ID NO: 1712501 - RNA, 18 nt, Human
gcucagagagggugggag

SEQ ID NO: 1712502 - RNA, 22 nt, Human
gcucagagagggugggaguggg

SEQ ID NO: 1712503 - RNA, 14 nt, Human
gcucaggagcccug

SEQ ID NO: 1712504 - RNA, 16 nt, Human
gcucagggccuggcuc

SEQ ID NO: 1712505 - RNA, 13 nt, Human
gcucagggccugg

SEQ ID NO: 1712506 - RNA, 17 nt, Human
gcucagggccuggcuca

SEQ ID NO: 1712507 - RNA, 12 nt, Human
gcucagggccug

SEQ ID NO: 1712508 - RNA, 21 nt, Human
gcucaggagcccugggaggcu

SEQ ID NO: 1712509 - RNA, 18 nt, Human
gcucaggagcccugggag

SEQ ID NO: 1712510 - RNA, 15 nt, Human
gcucaggagcccugg

SEQ ID NO: 1712511 - RNA, 22 nt, Human
gccagacaucaacagauaaaua

SEQ ID NO: 1712512 - RNA, 15 nt, Human
gccagaauuucaaac

SEQ ID NO: 1712513 - RNA, 23 nt, Human
gccagcaggcucucaggccagcu

SEQ ID NO: 1712514 - RNA, 21 nt, Human
gccagcaggcucucaggccag

SEQ ID NO: 1712515 - RNA, 20 nt, Human
gccagcaggcucucaggcca

SEQ ID NO: 1712516 - RNA, 19 nt, Human
gccagcaggcucucaggcc

SEQ ID NO: 1712517 - RNA, 18 nt, Human
gccagcaggcucucaggc

SEQ ID NO: 1712518 - RNA, 17 nt, Human
gccagcaggcucucagg

SEQ ID NO: 1712519 - RNA, 16 nt, Human
gccagcaggcucucag

SEQ ID NO: 1712520 - RNA, 13 nt, Human
gccagcaggcucu

SEQ ID NO: 1712521 - RNA, 13 nt, Human
gccaggccagagg

SEQ ID NO: 1712522 - RNA, 17 nt, Human
gccaggcccucugccca

SEQ ID NO: 1712523 - RNA, 16 nt, Human
gccaggcccucugccc

SEQ ID NO: 1712524 - RNA, 21 nt, Human
gccaggcccucugcccacucc

SEQ ID NO: 1712525 - RNA, 20 nt, Human
gccaggcccucugcccacuc

SEQ ID NO: 1712526 - RNA, 19 nt, Human
gccaggcccucugcccacu

SEQ ID NO: 1712527 - RNA, 23 nt, Human
gccaggccacaagacccuugugg

SEQ ID NO: 1712528 - RNA, 12 nt, Human
gccaggccagag

SEQ ID NO: 1712529 - RNA, 20 nt, Human
gccauauucuguuggccagu

SEQ ID NO: 1712530 - RNA, 19 nt, Human
gccauauucuguuggccag

SEQ ID NO: 1712531 - RNA, 14 nt, Human
gccauguuggccag

SEQ ID NO: 1712532 - RNA, 18 nt, Human
gccauguuggccaggcug

SEQ ID NO: 1712533 - RNA, 17 nt, Human
gccauguuggccaggcu

SEQ ID NO: 1712534 - RNA, 16 nt, Human
gccauguuggccaggc

SEQ ID NO: 1712535 - RNA, 15 nt, Human
gccauguuggccagg

SEQ ID NO: 1712536 - RNA, 24 nt, Human
gccauguuggccaggcuggucuca

SEQ ID NO: 1712537 - RNA, 22 nt, Human
gccauguuggccaggcuggucu

SEQ ID NO: 1712538 - RNA, 20 nt, Human
gccauguuggccaggcuggu

SEQ ID NO: 1712539 - RNA, 19 nt, Human
gccauguuggccaggcugg

SEQ ID NO: 1712540 - RNA, 18 nt, Human
gccauuccccgucucugg

SEQ ID NO: 1712541 - RNA, 17 nt, Human
gccauuccccgucucug

SEQ ID NO: 1712542 - RNA, 17 nt, Human
gcccacgcuggagugca

SEQ ID NO: 1712543 - RNA, 16 nt, Human
gcccacgcuggagugc

SEQ ID NO: 1712544 - RNA, 15 nt, Human
gcccacgcuggagug

SEQ ID NO: 1712545 - RNA, 14 nt, Human
gcccacgcccccac

SEQ ID NO: 1712546 - RNA, 13 nt, Human
gcccacgccccca

SEQ ID NO: 1712547 - RNA, 18 nt, Human
gcccaccuuggcucaagu

SEQ ID NO: 1712548 - RNA, 18 nt, Human
gcacuuggagacuuguau

SEQ ID NO: 1712549 - RNA, 20 nt, Human
gccacauuccugaugcuucu

SEQ ID NO: 1712550 - RNA, 16 nt, Human
gccacauuccugaugc

SEQ ID NO: 1712551 - RNA, 21 nt, Human
gccaccaacauacucccaucu

SEQ ID NO: 1712552 - RNA, 20 nt, Human
gccaccaacauacucccauc

SEQ ID NO: 1712553 - RNA, 19 nt, Human
gccaccaacauacucccau

SEQ ID NO: 1712554 - RNA, 22 nt, Human
gccaccaacauacucccaucug

SEQ ID NO: 1712555 - RNA, 13 nt, Human
gccaccacgcccg

SEQ ID NO: 1712556 - RNA, 14 nt, Human
gccaccacgcccgg

SEQ ID NO: 1712557 - RNA, 19 nt, Human
gccacugugaagagaacca

SEQ ID NO: 1712558 - RNA, 18 nt, Human
gccacugugaagagaacc

SEQ ID NO: 1712559 - RNA, 17 nt, Human
gccacugccucuuccuc

SEQ ID NO: 1712560 - RNA, 16 nt, Human
gccacugccucuuccu

SEQ ID NO: 1712561 - RNA, 13 nt, Human
gccacugccucuu

SEQ ID NO: 1712562 - RNA, 12 nt, Human
gccacugccucu

SEQ ID NO: 1712563 - RNA, 21 nt, Human
gccacuugaugacccccaacc

SEQ ID NO: 1712564 - RNA, 23 nt, Human
gccacugcaccgggccacagaga

SEQ ID NO: 1712565 - RNA, 19 nt, Human
gccacccuggggagaaagu

SEQ ID NO: 1712566 - RNA, 13 nt, Human
gccacccugggga

SEQ ID NO: 1712567 - RNA, 21 nt, Human
gccacugcacuauagccuagg

SEQ ID NO: 1712568 - RNA, 15 nt, Human
gccuggccccucagg

SEQ ID NO: 1712569 - RNA, 17 nt, Human
gccuggccccucagggu

SEQ ID NO: 1712570 - RNA, 16 nt, Human
gccuggccccucaggg

SEQ ID NO: 1712571 - RNA, 10 nt, Human
gccuggccug

SEQ ID NO: 1712572 - RNA, 22 nt, Human
gccuggccccucagggucccug

SEQ ID NO: 1712573 - RNA, 20 nt, Human
gccuggccccucaggguccc

SEQ ID NO: 1712574 - RNA, 18 nt, Human
gccugggaucccucaucc

SEQ ID NO: 1712575 - RNA, 21 nt, Human
gccugggaucccucauccuca

SEQ ID NO: 1712576 - RNA, 14 nt, Human
gccugggaucccuc

SEQ ID NO: 1712577 - RNA, 22 nt, Human
gccugggaggucaaggcugcag

SEQ ID NO: 1712578 - RNA, 21 nt, Human
gccugggaggucaaggcugca

SEQ ID NO: 1712579 - RNA, 16 nt, Human
gccugccucuucucua

SEQ ID NO: 1712580 - RNA, 17 nt, Human
gccugccuguucccauu

SEQ ID NO: 1712581 - RNA, 13 nt, Human
gccuccuccagcc

SEQ ID NO: 1712582 - RNA, 13 nt, Human
gccuccugugugu

SEQ ID NO: 1712583 - RNA, 12 nt, Human
gccucugggacu

SEQ ID NO: 1712584 - RNA, 14 nt, Human
gccucugggacugg

SEQ ID NO: 1712585 - RNA, 20 nt, Human
gccugcccaggccccugcca

SEQ ID NO: 1712586 - RNA, 19 nt, Human
gccugcccaggccccugcc

SEQ ID NO: 1712587 - RNA, 18 nt, Human
gccugcccaggccccugc

SEQ ID NO: 1712588 - RNA, 23 nt, Human
gccucuucucuacucuagggaaa

SEQ ID NO: 1712589 - RNA, 12 nt, Human
gccucuucucua

SEQ ID NO: 1712590 - RNA, 12 nt, Human
gccucuuccucc

SEQ ID NO: 1712591 - RNA, 22 nt, Human
gccucuuccucccucauuccac

SEQ ID NO: 1712592 - RNA, 19 nt, Human
gccccaaaacucuccucug

SEQ ID NO: 1712593 - RNA, 18 nt, Human
gccccaaaacucuccucu

SEQ ID NO: 1712594 - RNA, 14 nt, Human
gccccugcccggcu

SEQ ID NO: 1712595 - RNA, 13 nt, Human
gccccugcccggc

SEQ ID NO: 1712596 - RNA, 14 nt, Human
gcccccucugcccu

SEQ ID NO: 1712597 - RNA, 22 nt, Human
gccccuggaugcagccucacag

SEQ ID NO: 1712598 - RNA, 18 nt, Human
gccccuggaugcagccuc

SEQ ID NO: 1712599 - RNA, 16 nt, Human
gccccuggaugcagcc

SEQ ID NO: 1712600 - RNA, 15 nt, Human
gccccugcccggcug

SEQ ID NO: 1712601 - RNA, 22 nt, Human
gcccuaaaguguauuuuuuuac

SEQ ID NO: 1712602 - RNA, 15 nt, Human
gcccacucccugcaa

SEQ ID NO: 1712603 - RNA, 14 nt, Human
gcccacucccugca

SEQ ID NO: 1712604 - RNA, 19 nt, Human
gcccacucccugcaaccug

SEQ ID NO: 1712605 - RNA, 13 nt, Human
gcccacucccugc

SEQ ID NO: 1712606 - RNA, 23 nt, Human
gcccacuagacccacuggacuca

SEQ ID NO: 1712607 - RNA, 17 nt, Human
gcccacuagacccacug

SEQ ID NO: 1712608 - RNA, 23 nt, Human
gcccugcugagucccaggcugag

SEQ ID NO: 1712609 - RNA, 22 nt, Human
gcccugcugagucccaggcuga

SEQ ID NO: 1712610 - RNA, 21 nt, Human
gcccugcugagucccaggcug

SEQ ID NO: 1712611 - RNA, 22 nt, Human
gcccugccuccuuugugaggaa

SEQ ID NO: 1712612 - RNA, 16 nt, Human
gcccugccuccuuugu

SEQ ID NO: 1712613 - RNA, 16 nt, Human
gcccugcugaguccca

SEQ ID NO: 1712614 - RNA, 16 nt, Human
gccgccaugcuccugg

SEQ ID NO: 1712615 - RNA, 15 nt, Human
gccgccaugcuccug

SEQ ID NO: 1712616 - RNA, 20 nt, Human
gcccuuaccugccaggaagc

SEQ ID NO: 1712617 - RNA, 16 nt, Human
gcccuuaccugccagg

SEQ ID NO: 1712618 - RNA, 13 nt, Human
ccuuaucaaagga

SEQ ID NO: 1712619 - RNA, 20 nt, Human
ccuuaggugauccacucgcc

SEQ ID NO: 1712620 - RNA, 12 nt, Human
ccuuauggaaca

SEQ ID NO: 1712621 - RNA, 18 nt, Human
ccuuaucaaaggacacca

SEQ ID NO: 1712622 - RNA, 14 nt, Human
ccuuaucaaaggac

SEQ ID NO: 1712623 - RNA, 18 nt, Human
ccuuauggaacacucuga

SEQ ID NO: 1712624 - RNA, 17 nt, Human
ccuuauggaacacucug

SEQ ID NO: 1712625 - RNA, 16 nt, Human
ccuuauggaacacucu

SEQ ID NO: 1712626 - RNA, 14 nt, Human
ccuuauggaacacu

SEQ ID NO: 1712627 - RNA, 20 nt, Human
ccuuauggaacacucugaga

SEQ ID NO: 1712628 - RNA, 19 nt, Human
ccuuauggaacacucugag

SEQ ID NO: 1712629 - RNA, 22 nt, Human
ccuuauggaacacucugagacu

SEQ ID NO: 1712630 - RNA, 19 nt, Human
ccuucccaccucucucacu

SEQ ID NO: 1712631 - RNA, 14 nt, Human
ccuucccaccucuc

SEQ ID NO: 1712632 - RNA, 12 nt, Human
ccuucccaccuc

SEQ ID NO: 1712633 - RNA, 15 nt, Human
ccuucccaugcccug

SEQ ID NO: 1712634 - RNA, 19 nt, Human
ccuguucagcuccagcuca

SEQ ID NO: 1712635 - RNA, 16 nt, Human
ccuguucagcuccagc

SEQ ID NO: 1712636 - RNA, 15 nt, Human
ccuguucagcuccag

SEQ ID NO: 1712637 - RNA, 14 nt, Human
ccuguucagcucca

SEQ ID NO: 1712638 - RNA, 21 nt, Human
ccuguucagcuccagcucacc

SEQ ID NO: 1712639 - RNA, 20 nt, Human
ccuguucagcuccagcucac

SEQ ID NO: 1712640 - RNA, 23 nt, Human
ccuguucagcuccagcucaccag

SEQ ID NO: 1712641 - RNA, 17 nt, Human
ccuguucuggcagaguu

SEQ ID NO: 1712642 - RNA, 12 nt, Human
ccuguucuggca

SEQ ID NO: 1712643 - RNA, 16 nt, Human
ccuguucugcuuuccu

SEQ ID NO: 1712644 - RNA, 18 nt, Human
ccuguucccaugagauga

SEQ ID NO: 1712645 - RNA, 12 nt, Human
ccuguucccauu

SEQ ID NO: 1712646 - RNA, 20 nt, Human
ccuguugggccaggagccuc

SEQ ID NO: 1712647 - RNA, 19 nt, Human
ccuguugggccaggagccu

SEQ ID NO: 1712648 - RNA, 18 nt, Human
ccuguugggccaggagcc

SEQ ID NO: 1712649 - RNA, 17 nt, Human
ccuguugggccaggagc

SEQ ID NO: 1712650 - RNA, 16 nt, Human
ccuguugggccaggag

SEQ ID NO: 1712651 - RNA, 20 nt, Human
ccuuagcagggaaacagcua

SEQ ID NO: 1712652 - RNA, 19 nt, Human
ccuuagcagggaaacagcu

SEQ ID NO: 1712653 - RNA, 16 nt, Human
ccuuagcaaauucugu

SEQ ID NO: 1712654 - RNA, 13 nt, Human
ccuguucagcucc

SEQ ID NO: 1712655 - RNA, 21 nt, Human
ccuguucacucuacuuagcau

SEQ ID NO: 1712656 - RNA, 17 nt, Human
ccuucucuucacaguca

SEQ ID NO: 1712657 - RNA, 21 nt, Human
ccuucuguccuacucuguguc

SEQ ID NO: 1712658 - RNA, 20 nt, Human
ccuucuguccuacucugugu

SEQ ID NO: 1712659 - RNA, 22 nt, Human
ccuucuguccuacucuguguca

SEQ ID NO: 1712660 - RNA, 19 nt, Human
ccuucccccuccaauccca

SEQ ID NO: 1712661 - RNA, 18 nt, Human
ccuuccuaauuccacagc

SEQ ID NO: 1712662 - RNA, 20 nt, Human
ccuuccuaauuccacagcug

SEQ ID NO: 1712663 - RNA, 19 nt, Human
ccuuccuaauuccacagcu

SEQ ID NO: 1712664 - RNA, 16 nt, Human
ccuucucugaaggaca

SEQ ID NO: 1712665 - RNA, 14 nt, Human
ccuucucugaagga

SEQ ID NO: 1712666 - RNA, 23 nt, Human
ccuucucuccagccccuggaugc

SEQ ID NO: 1712667 - RNA, 21 nt, Human
ccuucucuccagccccuggau

SEQ ID NO: 1712668 - RNA, 20 nt, Human
ccuuccucuccacugccuuc

SEQ ID NO: 1712669 - RNA, 20 nt, Human
ccuucucuccagccccugga

SEQ ID NO: 1712670 - RNA, 17 nt, Human
ccuuccucuccacugcc

SEQ ID NO: 1712671 - RNA, 16 nt, Human
ccuuccucuccacugc

SEQ ID NO: 1712672 - RNA, 15 nt, Human
ccuuccucuccacug

SEQ ID NO: 1712673 - RNA, 14 nt, Human
ccuuccucuccacu

SEQ ID NO: 1712674 - RNA, 21 nt, Human
ccuuccuaauuccacagcugc

SEQ ID NO: 1712675 - RNA, 15 nt, Human
ccuuucaauaggaaa

SEQ ID NO: 1712676 - RNA, 14 nt, Human
ccuuuauucuggca

SEQ ID NO: 1712677 - RNA, 17 nt, Human
ccuuucaauaggaaaaa

SEQ ID NO: 1712678 - RNA, 18 nt, Human
ccuuucaauaggaaaaac

SEQ ID NO: 1712679 - RNA, 14 nt, Human
ccuugcauaauggu

SEQ ID NO: 1712680 - RNA, 14 nt, Human
cuaaguuuuuaugg

SEQ ID NO: 1712681 - RNA, 19 nt, Human
cuacaaaaagcauaaaaau

SEQ ID NO: 1712682 - RNA, 20 nt, Human
cuaauaaaauuuaaaagucu

SEQ ID NO: 1712683 - RNA, 22 nt, Human
cuaacuugucuuuggacccuga

SEQ ID NO: 1712684 - RNA, 14 nt, Human
cuaacuugucuuug

SEQ ID NO: 1712685 - RNA, 16 nt, Human
cuaacuuuccuucauu

SEQ ID NO: 1712686 - RNA, 22 nt, Human
cuaagaaagcccuuaggaagaa

SEQ ID NO: 1712687 - RNA, 20 nt, Human
cuaacgaaguauccuucagc

SEQ ID NO: 1712688 - RNA, 19 nt, Human
cuaaaguguauuuuuuuac

SEQ ID NO: 1712689 - RNA, 23 nt, Human
cuaaaguaaaaacaaagaaauua

SEQ ID NO: 1712690 - RNA, 16 nt, Human
cuaaagccucaaaaca

SEQ ID NO: 1712691 - RNA, 11 nt, Human
cuaaagcugcc

SEQ ID NO: 1712692 - RNA, 19 nt, Human
cguguuaugacuccagaau

SEQ ID NO: 1712693 - RNA, 15 nt, Human
cguguuaugacucca

SEQ ID NO: 1712694 - RNA, 18 nt, Human
cgugaguccuggcauggg

SEQ ID NO: 1712695 - RNA, 19 nt, Human
cgugaguccuggcauggga

SEQ ID NO: 1712696 - RNA, 16 nt, Human
cgugaggccagagaca

SEQ ID NO: 1712697 - RNA, 15 nt, Human
cgugacaacacuugu

SEQ ID NO: 1712698 - RNA, 14 nt, Human
cgugacaacacuug

SEQ ID NO: 1712699 - RNA, 20 nt, Human
cgugagccacugcaccgggc

SEQ ID NO: 1712700 - RNA, 15 nt, Human
cgugagccacugcac

SEQ ID NO: 1712701 - RNA, 14 nt, Human
cgugagccacugca

SEQ ID NO: 1712702 - RNA, 14 nt, Human
cgugaggccagaga

SEQ ID NO: 1712703 - RNA, 22 nt, Human
cgugagccacugcaccgggcca

SEQ ID NO: 1712704 - RNA, 20 nt, Human
cgcugccccuggcagccccu

SEQ ID NO: 1712705 - RNA, 19 nt, Human
cgcugccccuggcagcccc

SEQ ID NO: 1712706 - RNA, 21 nt, Human
cgcucuuggcagguacucagc

SEQ ID NO: 1712707 - RNA, 22 nt, Human
cgcucuguugcccaggcuggag

SEQ ID NO: 1712708 - RNA, 20 nt, Human
cgcucugucgcccaggcugg

SEQ ID NO: 1712709 - RNA, 19 nt, Human
cgcucuguugcccaggcug

SEQ ID NO: 1712710 - RNA, 18 nt, Human
cgcuggagugcagugagc

SEQ ID NO: 1712711 - RNA, 17 nt, Human
cgcuggagugcagugag

SEQ ID NO: 1712712 - RNA, 20 nt, Human
ccuuuucgcaggauucuucc

SEQ ID NO: 1712713 - RNA, 22 nt, Human
cgcaggcuggcccugcccuggu

SEQ ID NO: 1712714 - RNA, 21 nt, Human
cgcaggcuggcccugcccugg

SEQ ID NO: 1712715 - RNA, 21 nt, Human
cgagucucuucuccacuggau

SEQ ID NO: 1712716 - RNA, 20 nt, Human
cgagucucuucuccacugga

SEQ ID NO: 1712717 - RNA, 18 nt, Human
cgagucucuucuccacug

SEQ ID NO: 1712718 - RNA, 17 nt, Human
cgagucucuucuccacu

SEQ ID NO: 1712719 - RNA, 18 nt, Human
cggcuaauuuuuguauuu

SEQ ID NO: 1712720 - RNA, 23 nt, Human
cggagucccaccuuggcugcagg

SEQ ID NO: 1712721 - RNA, 15 nt, Human
cggaggggccuggca

SEQ ID NO: 1712722 - RNA, 22 nt, Human
cggagucccaccuuggcugcag

SEQ ID NO: 1712723 - RNA, 21 nt, Human
cggagucccaccuuggcugca

SEQ ID NO: 1712724 - RNA, 17 nt, Human
cggagacggagucccac

SEQ ID NO: 1712725 - RNA, 20 nt, Human
cggagacggagucccaccuu

SEQ ID NO: 1712726 - RNA, 14 nt, Human
cggcucacugcagc

SEQ ID NO: 1712727 - RNA, 13 nt, Human
cgggcucugccuc

SEQ ID NO: 1712728 - RNA, 12 nt, Human
cgggcucugccu

SEQ ID NO: 1712729 - RNA, 20 nt, Human
cgggcugggagcucugcaga

SEQ ID NO: 1712730 - RNA, 16 nt, Human
cgggcugggagcucug

SEQ ID NO: 1712731 - RNA, 19 nt, Human
cgggcucagcaaaagaugc

SEQ ID NO: 1712732 - RNA, 20 nt, Human
cgggccuggagaacuagaga

SEQ ID NO: 1712733 - RNA, 16 nt, Human
cgggccuggagaacua

SEQ ID NO: 1712734 - RNA, 22 nt, Human
cguacacauuuuauuuuauuau

SEQ ID NO: 1712735 - RNA, 20 nt, Human
cgguggcucacgccuguaau

SEQ ID NO: 1712736 - RNA, 17 nt, Human
cguaaagcuagaaauga

SEQ ID NO: 1712737 - RNA, 23 nt, Human
cucagaagacacugaugggcaac

SEQ ID NO: 1712738 - RNA, 22 nt, Human
cucagccucccgaauagcuggg

SEQ ID NO: 1712739 - RNA, 21 nt, Human
cucagccucccgaauagcugg

SEQ ID NO: 1712740 - RNA, 19 nt, Human
cucagccucccgaauagcu

SEQ ID NO: 1712741 - RNA, 22 nt, Human
cucagaagacacugaugggcaa

SEQ ID NO: 1712742 - RNA, 20 nt, Human
cucagaagacacugaugggc

SEQ ID NO: 1712743 - RNA, 17 nt, Human
cucagaagacacugaug

SEQ ID NO: 1712744 - RNA, 15 nt, Human
cucagaagacacuga

SEQ ID NO: 1712745 - RNA, 13 nt, Human
cucagaagacacu

SEQ ID NO: 1712746 - RNA, 17 nt, Human
cucaccuuucccaucuu

SEQ ID NO: 1712747 - RNA, 13 nt, Human
cucaggccugggg

SEQ ID NO: 1712748 - RNA, 20 nt, Human
cucaggccagcugcuugggc

SEQ ID NO: 1712749 - RNA, 18 nt, Human
cucaggccagcugcuugg

SEQ ID NO: 1712750 - RNA, 17 nt, Human
cucaggccagcugcuug

SEQ ID NO: 1712751 - RNA, 16 nt, Human
cucaggccagcugcuu

SEQ ID NO: 1712752 - RNA, 11 nt, Human
cucaggccugg

SEQ ID NO: 1712753 - RNA, 22 nt, Human
cucaggccugggggcugggcag

SEQ ID NO: 1712754 - RNA, 20 nt, Human
cucaggccaaacucaccugc

SEQ ID NO: 1712755 - RNA, 19 nt, Human
cucaggccaaacucaccug

SEQ ID NO: 1712756 - RNA, 21 nt, Human
cucaggccaaacucaccugcc

SEQ ID NO: 1712757 - RNA, 16 nt, Human
cucaguccaugaagau

SEQ ID NO: 1712758 - RNA, 17 nt, Human
cucaguccauagcagag

SEQ ID NO: 1712759 - RNA, 15 nt, Human
cucaguccauagcag

SEQ ID NO: 1712760 - RNA, 14 nt, Human
cucagguugucuga

SEQ ID NO: 1712761 - RNA, 22 nt, Human
cucagucuggcccuuccuuuuc

SEQ ID NO: 1712762 - RNA, 23 nt, Human
cucaggugucccugcacuugcag

SEQ ID NO: 1712763 - RNA, 22 nt, Human
cucagguugucugaagucacug

SEQ ID NO: 1712764 - RNA, 14 nt, Human
cuaucucccccagc

SEQ ID NO: 1712765 - RNA, 13 nt, Human
cuaucucccccag

SEQ ID NO: 1712766 - RNA, 14 nt, Human
cuaugugagaccau

SEQ ID NO: 1712767 - RNA, 18 nt, Human
cuauguucuaagaaguga

SEQ ID NO: 1712768 - RNA, 14 nt, Human
cuauguugcccagg

SEQ ID NO: 1712769 - RNA, 17 nt, Human
cuaugugagcacaaagg

SEQ ID NO: 1712770 - RNA, 22 nt, Human
cuauguugcccaggcaggucuu

SEQ ID NO: 1712771 - RNA, 21 nt, Human
cuauguugcccaggcaggucu

SEQ ID NO: 1712772 - RNA, 19 nt, Human
cuauguugcccaggcaggu

SEQ ID NO: 1712773 - RNA, 18 nt, Human
cuauguugcccaggcagg

SEQ ID NO: 1712774 - RNA, 17 nt, Human
cuauccuacuuccccuu

SEQ ID NO: 1712775 - RNA, 23 nt, Human
cucaauuauuuugcauuuuuucu

SEQ ID NO: 1712776 - RNA, 19 nt, Human
cucuauguucuaagaagug

SEQ ID NO: 1712777 - RNA, 14 nt, Human
cucucuggccuucg

SEQ ID NO: 1712778 - RNA, 16 nt, Human
cucucuggccuucggc

SEQ ID NO: 1712779 - RNA, 13 nt, Human
cucucuggccuuc

SEQ ID NO: 1712780 - RNA, 16 nt, Human
cucuccuccagaguca

SEQ ID NO: 1712781 - RNA, 15 nt, Human
cucuccuccagaguc

SEQ ID NO: 1712782 - RNA, 13 nt, Human
cucuccuccagag

SEQ ID NO: 1712783 - RNA, 16 nt, Human
cucgguguggagaagc

SEQ ID NO: 1712784 - RNA, 23 nt, Human
cucgguguggagaagcggcuggc

SEQ ID NO: 1712785 - RNA, 17 nt, Human
cucgguguggagaagcg

SEQ ID NO: 1712786 - RNA, 23 nt, Human
cuccuuugugaggaagccgcugg

SEQ ID NO: 1712787 - RNA, 18 nt, Human
cuccuuugugaggaagcc

SEQ ID NO: 1712788 - RNA, 17 nt, Human
cuccuuugugaggaagc

SEQ ID NO: 1712789 - RNA, 20 nt, Human
cuccuuucacaaccuucugu

SEQ ID NO: 1712790 - RNA, 21 nt, Human
cucugcacaagcugcacccuc

SEQ ID NO: 1712791 - RNA, 20 nt, Human
cucugcacaagcugcacccu

SEQ ID NO: 1712792 - RNA, 16 nt, Human
cucugcacuccccugc

SEQ ID NO: 1712793 - RNA, 15 nt, Human
cucugcacuccccug

SEQ ID NO: 1712794 - RNA, 13 nt, Human
cucuguacagagc

SEQ ID NO: 1712795 - RNA, 15 nt, Human
cucuguacagagccc

SEQ ID NO: 1712796 - RNA, 14 nt, Human
cucuguacagagcc

SEQ ID NO: 1712797 - RNA, 15 nt, Human
cucugcugcuggcug

SEQ ID NO: 1712798 - RNA, 14 nt, Human
cucugcugcuggcu

SEQ ID NO: 1712799 - RNA, 16 nt, Human
cucugcugcuggcugg

SEQ ID NO: 1712800 - RNA, 16 nt, Human
cucuguacagagccca

SEQ ID NO: 1712801 - RNA, 13 nt, Human
cucuguccuggga

SEQ ID NO: 1712802 - RNA, 13 nt, Human
cucugcugcuggc

SEQ ID NO: 1712803 - RNA, 23 nt, Human
cucugcugacagacacaggcccg

SEQ ID NO: 1712804 - RNA, 22 nt, Human
cucugcugacagacacaggccc

SEQ ID NO: 1712805 - RNA, 21 nt, Human
cucugcugacagacacaggcc

SEQ ID NO: 1712806 - RNA, 18 nt, Human
cucugcacuccccugcug

SEQ ID NO: 1712807 - RNA, 17 nt, Human
cucugcacuccccugcu

SEQ ID NO: 1712808 - RNA, 21 nt, Human
cucugcuccucuccccagcaa

SEQ ID NO: 1712809 - RNA, 13 nt, Human
cucugcagguccc

SEQ ID NO: 1712810 - RNA, 16 nt, Human
cuccccuaaagccuca

SEQ ID NO: 1712811 - RNA, 23 nt, Human
cuccccuaaagccucaaaacaaa

SEQ ID NO: 1712812 - RNA, 15 nt, Human
cucccaggcauuccc

SEQ ID NO: 1712813 - RNA, 20 nt, Human
cucccucuuucccucccuuc

SEQ ID NO: 1712814 - RNA, 20 nt, Human
cucccugaaguaagcaaaga

SEQ ID NO: 1712815 - RNA, 22 nt, Human
cuccaggcuguaucccaugagc

SEQ ID NO: 1712816 - RNA, 20 nt, Human
cuccaggcuguaucccauga

SEQ ID NO: 1712817 - RNA, 23 nt, Human
cuccaggcuccuuuagcgcccag

SEQ ID NO: 1712818 - RNA, 15 nt, Human
cuccaggcuccuuua

SEQ ID NO: 1712819 - RNA, 23 nt, Human
cuccaggugcacaagcuccaagc

SEQ ID NO: 1712820 - RNA, 21 nt, Human
cucccacaggcccuuccucuc

SEQ ID NO: 1712821 - RNA, 20 nt, Human
cucccacaggcccuuccucu

SEQ ID NO: 1712822 - RNA, 16 nt, Human
cucccacaggcccuuc

SEQ ID NO: 1712823 - RNA, 14 nt, Human
cucccacaggcccu

SEQ ID NO: 1712824 - RNA, 15 nt, Human
cucccacaggcccuu

SEQ ID NO: 1712825 - RNA, 13 nt, Human
cuccuaccuggua

SEQ ID NO: 1712826 - RNA, 18 nt, Human
cuccugggcuaagugauc

SEQ ID NO: 1712827 - RNA, 19 nt, Human
cuccuggccucaagugauu

SEQ ID NO: 1712828 - RNA, 19 nt, Human
cuccuggcccacugcaucg

SEQ ID NO: 1712829 - RNA, 18 nt, Human
cuccucuugccacugccu

SEQ ID NO: 1712830 - RNA, 12 nt, Human
cuccucuugcca

SEQ ID NO: 1712831 - RNA, 16 nt, Human
cuccucuugccacugc

SEQ ID NO: 1712832 - RNA, 15 nt, Human
cuccucuugccacug

SEQ ID NO: 1712833 - RNA, 14 nt, Human
cuccucugcugcug

SEQ ID NO: 1712834 - RNA, 13 nt, Human
cuccucugcugcu

SEQ ID NO: 1712835 - RNA, 15 nt, Human
cuccucugcugcugg

SEQ ID NO: 1712836 - RNA, 15 nt, Human
cuccucuguccaggc

SEQ ID NO: 1712837 - RNA, 12 nt, Human
cuccucugucca

SEQ ID NO: 1712838 - RNA, 16 nt, Human
cuccuguaccucuuga

SEQ ID NO: 1712839 - RNA, 14 nt, Human
cuccuggggguucu

SEQ ID NO: 1712840 - RNA, 15 nt, Human
cuccuuucaccacau

SEQ ID NO: 1712841 - RNA, 17 nt, Human
cuccuuucacaaccuuc

SEQ ID NO: 1712842 - RNA, 16 nt, Human
cuccuuucacaaccuu

SEQ ID NO: 1712843 - RNA, 13 nt, Human
cuccuuucacaac

SEQ ID NO: 1712844 - RNA, 14 nt, Human
cuccuuguguuacu

SEQ ID NO: 1712845 - RNA, 21 nt, Human
cccaaccugcucuccucuugc

SEQ ID NO: 1712846 - RNA, 14 nt, Human
cccaaccugcucuc

SEQ ID NO: 1712847 - RNA, 13 nt, Human
cccaaccugcucu

SEQ ID NO: 1712848 - RNA, 23 nt, Human
cccaaccugcucuccucuugcca

SEQ ID NO: 1712849 - RNA, 22 nt, Human
ccauuguggucacaggaaguag

SEQ ID NO: 1712850 - RNA, 15 nt, Human
cccacccaagggccu

SEQ ID NO: 1712851 - RNA, 18 nt, Human
cccacccaagggccuggc

SEQ ID NO: 1712852 - RNA, 17 nt, Human
cccaagcucugcuccuc

SEQ ID NO: 1712853 - RNA, 21 nt, Human
cccaagaauagaugcugacug

SEQ ID NO: 1712854 - RNA, 20 nt, Human
cccaagaauagaugcugacu

SEQ ID NO: 1712855 - RNA, 23 nt, Human
cccaagccuacuuuugccauuga

SEQ ID NO: 1712856 - RNA, 16 nt, Human
cccaagccuggcaagg

SEQ ID NO: 1712857 - RNA, 18 nt, Human
cccaccgcagacaggacc

SEQ ID NO: 1712858 - RNA, 15 nt, Human
cccaccgcagacagg

SEQ ID NO: 1712859 - RNA, 23 nt, Human
cccacuguacuugcucuugaugc

SEQ ID NO: 1712860 - RNA, 19 nt, Human
cccacuguacuugcucuug

SEQ ID NO: 1712861 - RNA, 18 nt, Human
cccacuguacuugcucuu

SEQ ID NO: 1712862 - RNA, 18 nt, Human
ccaugaggaacaaggcaa

SEQ ID NO: 1712863 - RNA, 17 nt, Human
ccaugaggaacaaggca

SEQ ID NO: 1712864 - RNA, 16 nt, Human
ccaugaggaacaaggc

SEQ ID NO: 1712865 - RNA, 13 nt, Human
ccaugagccucag

SEQ ID NO: 1712866 - RNA, 20 nt, Human
ccaugucucugagcauuaga

SEQ ID NO: 1712867 - RNA, 15 nt, Human
ccaugucucgacuca

SEQ ID NO: 1712868 - RNA, 14 nt, Human
ccaugucucgacuc

SEQ ID NO: 1712869 - RNA, 15 nt, Human
ccccauuguggucac

SEQ ID NO: 1712870 - RNA, 14 nt, Human
cccccuuccaugga

SEQ ID NO: 1712871 - RNA, 12 nt, Human
ccccgcccaggc

SEQ ID NO: 1712872 - RNA, 14 nt, Human
ccccgcccaggcuu

SEQ ID NO: 1712873 - RNA, 13 nt, Human
ccccggccaccug

SEQ ID NO: 1712874 - RNA, 18 nt, Human
ccccggccaccugcggug

SEQ ID NO: 1712875 - RNA, 14 nt, Human
ccccggccaccugc

SEQ ID NO: 1712876 - RNA, 21 nt, Human
ccccaaaacucuccucugcug

SEQ ID NO: 1712877 - RNA, 20 nt, Human
ccccaaaacucuccucugcu

SEQ ID NO: 1712878 - RNA, 18 nt, Human
ccccaaaacucuccucug

SEQ ID NO: 1712879 - RNA, 14 nt, Human
ccccagccccaaaa

SEQ ID NO: 1712880 - RNA, 14 nt, Human
ccccagccccaucc

SEQ ID NO: 1712881 - RNA, 21 nt, Human
ccccauucugccugcccaggc

SEQ ID NO: 1712882 - RNA, 12 nt, Human
ccccagccccaa

SEQ ID NO: 1712883 - RNA, 10 nt, Human
ccccagcccc

SEQ ID NO: 1712884 - RNA, 23 nt, Human
cccagccccaaaacucuccucug

SEQ ID NO: 1712885 - RNA, 21 nt, Human
cccagccccaaaacucuccuc

SEQ ID NO: 1712886 - RNA, 19 nt, Human
cccagcccacuucugccau

SEQ ID NO: 1712887 - RNA, 19 nt, Human
cccauccucuguacagagc

SEQ ID NO: 1712888 - RNA, 15 nt, Human
cccauccucuguaca

SEQ ID NO: 1712889 - RNA, 20 nt, Human
cccauccucuguacagagcc

SEQ ID NO: 1712890 - RNA, 14 nt, Human
cccauccucuguac

SEQ ID NO: 1712891 - RNA, 20 nt, Human
cccaggcuggcgugcagugg

SEQ ID NO: 1712892 - RNA, 19 nt, Human
cccaggcuggcgugcagug

SEQ ID NO: 1712893 - RNA, 21 nt, Human
cccaggcuggcgugcaguggu

SEQ ID NO: 1712894 - RNA, 18 nt, Human
cccaggcuggcgugcagu

SEQ ID NO: 1712895 - RNA, 23 nt, Human
cccagcuggggccaggcuggguc

SEQ ID NO: 1712896 - RNA, 22 nt, Human
cccagcuggggccaggcugggu

SEQ ID NO: 1712897 - RNA, 12 nt, Human
ccacuuggucug

SEQ ID NO: 1712898 - RNA, 19 nt, Human
ccacugcaccgggccacag

SEQ ID NO: 1712899 - RNA, 17 nt, Human
ccacugcaccgggccac

SEQ ID NO: 1712900 - RNA, 14 nt, Human
ccacugcaccgggc

SEQ ID NO: 1712901 - RNA, 13 nt, Human
ccacugcaccggg

SEQ ID NO: 1712902 - RNA, 20 nt, Human
ccacugcacuauagccuagg

SEQ ID NO: 1712903 - RNA, 19 nt, Human
ccacugcacuauagccuag

SEQ ID NO: 1712904 - RNA, 18 nt, Human
ccacugcacuccagccug

SEQ ID NO: 1712905 - RNA, 13 nt, Human
ccacuuucuagcc

SEQ ID NO: 1712906 - RNA, 19 nt, Human
ccacuuucuagccagagga

SEQ ID NO: 1712907 - RNA, 18 nt, Human
ccacuuucuagccagagg

SEQ ID NO: 1712908 - RNA, 20 nt, Human
ccacuuucuagccagaggag

SEQ ID NO: 1712909 - RNA, 20 nt, Human
ccacuuggucugugagaugc

SEQ ID NO: 1712910 - RNA, 22 nt, Human
ccacuuggucugugagaugcua

SEQ ID NO: 1712911 - RNA, 15 nt, Human
ccacuuggucuguga

SEQ ID NO: 1712912 - RNA, 16 nt, Human
ccacuuggucugugag

SEQ ID NO: 1712913 - RNA, 17 nt, Human
ccacuuggucugugaga

SEQ ID NO: 1712914 - RNA, 19 nt, Human
ccacuuggucugugagaug

SEQ ID NO: 1712915 - RNA, 17 nt, Human
ccagacccggcugcgug

SEQ ID NO: 1712916 - RNA, 14 nt, Human
ccacuuuuguucuu

SEQ ID NO: 1712917 - RNA, 15 nt, Human
ccacuuuuguucuug

SEQ ID NO: 1712918 - RNA, 21 nt, Human
ccacuuuuguucuugguuugu

SEQ ID NO: 1712919 - RNA, 22 nt, Human
ccacuuuuguucuugguuugua

SEQ ID NO: 1712920 - RNA, 18 nt, Human
ccagagacacaagccuuc

SEQ ID NO: 1712921 - RNA, 16 nt, Human
ccagagacacaagccu

SEQ ID NO: 1712922 - RNA, 14 nt, Human
ccagaugcaccagc

SEQ ID NO: 1712923 - RNA, 13 nt, Human
ccagaugcaccag

SEQ ID NO: 1712924 - RNA, 13 nt, Human
ccagagagggugg

SEQ ID NO: 1712925 - RNA, 16 nt, Human
ccagucaccccggcca

SEQ ID NO: 1712926 - RNA, 22 nt, Human
ccaguaucuugaagacuuuucu

SEQ ID NO: 1712927 - RNA, 19 nt, Human
ccaguaucuugaagacuuu

SEQ ID NO: 1712928 - RNA, 23 nt, Human
ccaggggugggacacccugugau

SEQ ID NO: 1712929 - RNA, 22 nt, Human
ccaggggugggacacccuguga

SEQ ID NO: 1712930 - RNA, 21 nt, Human
ccaggggugggacacccugug

SEQ ID NO: 1712931 - RNA, 20 nt, Human
ccaggggugggacacccugu

SEQ ID NO: 1712932 - RNA, 13 nt, Human
ccaggcugagccu

SEQ ID NO: 1712933 - RNA, 16 nt, Human
ccaggcugagccucag

SEQ ID NO: 1712934 - RNA, 14 nt, Human
ccaggcugagccuc

SEQ ID NO: 1712935 - RNA, 22 nt, Human
ccaggcugagccucagucuccc

SEQ ID NO: 1712936 - RNA, 19 nt, Human
ccaggcugagccucagucu

SEQ ID NO: 1712937 - RNA, 17 nt, Human
ccaggcugagccucagu

SEQ ID NO: 1712938 - RNA, 18 nt, Human
ccagucaccccggccacc

SEQ ID NO: 1712939 - RNA, 17 nt, Human
ccagucaccccggccac

SEQ ID NO: 1712940 - RNA, 19 nt, Human
ccagucaccccggccaccu

SEQ ID NO: 1712941 - RNA, 19 nt, Human
ccaggaaaggcuccaggag

SEQ ID NO: 1712942 - RNA, 18 nt, Human
ccaggaaaggcuccagga

SEQ ID NO: 1712943 - RNA, 17 nt, Human
ccaggaaaggcuccagg

SEQ ID NO: 1712944 - RNA, 20 nt, Human
ccaggaaaggcuccaggagc

SEQ ID NO: 1712945 - RNA, 17 nt, Human
ccagccccuucugaccc

SEQ ID NO: 1712946 - RNA, 16 nt, Human
ccagccccuucugacc

SEQ ID NO: 1712947 - RNA, 15 nt, Human
ccagccccuucugac

SEQ ID NO: 1712948 - RNA, 18 nt, Human
ccagccccuggaugcagc

SEQ ID NO: 1712949 - RNA, 21 nt, Human
ccagcgagcccugguggcagu

SEQ ID NO: 1712950 - RNA, 18 nt, Human
ccagccccuucugaccca

SEQ ID NO: 1712951 - RNA, 15 nt, Human
ccagccccuggaugc

SEQ ID NO: 1712952 - RNA, 14 nt, Human
ccagccccuggaug

SEQ ID NO: 1712953 - RNA, 13 nt, Human
ccagccccuggau

SEQ ID NO: 1712954 - RNA, 23 nt, Human
ccagccccauccucuguacagag

SEQ ID NO: 1712955 - RNA, 13 nt, Human
ccagcagccugga

SEQ ID NO: 1712956 - RNA, 14 nt, Human
ccagcagccuggac

SEQ ID NO: 1712957 - RNA, 12 nt, Human
ccagcagccugg

SEQ ID NO: 1712958 - RNA, 11 nt, Human
ccagcagccug

SEQ ID NO: 1712959 - RNA, 16 nt, Human
ccagcagaaaugccuu

SEQ ID NO: 1712960 - RNA, 17 nt, Human
ccagcagaaaugccuua

SEQ ID NO: 1712961 - RNA, 22 nt, Human
ccagcagaaaugccuuacccuc

SEQ ID NO: 1712962 - RNA, 14 nt, Human
ccuaaucuucugaa

SEQ ID NO: 1712963 - RNA, 19 nt, Human
ccuagcauacguacacauu

SEQ ID NO: 1712964 - RNA, 20 nt, Human
ccuaaugcgcaggcuggccc

SEQ ID NO: 1712965 - RNA, 17 nt, Human
ccuagcacuuugggagg

SEQ ID NO: 1712966 - RNA, 20 nt, Human
ccuagccugugccucuggga

SEQ ID NO: 1712967 - RNA, 21 nt, Human
ccuagcauacguacacauuuu

SEQ ID NO: 1712968 - RNA, 20 nt, Human
ccuaacgaaguauccuucag

SEQ ID NO: 1712969 - RNA, 16 nt, Human
ccgugaggccagagac

SEQ ID NO: 1712970 - RNA, 14 nt, Human
ccgugaggccagag

SEQ ID NO: 1712971 - RNA, 13 nt, Human
ccgugaggccaga

SEQ ID NO: 1712972 - RNA, 12 nt, Human
ccgugaggccag

SEQ ID NO: 1712973 - RNA, 17 nt, Human
ccgucuaccugaggggc

SEQ ID NO: 1712974 - RNA, 14 nt, Human
ccggcuccaggcuc

SEQ ID NO: 1712975 - RNA, 13 nt, Human
ccggcuccaggcu

SEQ ID NO: 1712976 - RNA, 15 nt, Human
ccgucuaccugaggg

SEQ ID NO: 1712977 - RNA, 14 nt, Human
ccgucuaccugagg

SEQ ID NO: 1712978 - RNA, 15 nt, Human
ccggcuccaggcucc

SEQ ID NO: 1712979 - RNA, 15 nt, Human
ccggccccugcuggu

SEQ ID NO: 1712980 - RNA, 16 nt, Human
ccggccaccugcggug

SEQ ID NO: 1712981 - RNA, 18 nt, Human
ccggcaggguccuagaaa

SEQ ID NO: 1712982 - RNA, 22 nt, Human
cccugugauggggcccugccuc

SEQ ID NO: 1712983 - RNA, 21 nt, Human
cccugugauggggcccugccu

SEQ ID NO: 1712984 - RNA, 23 nt, Human
cccugugauggggcccugccucc

SEQ ID NO: 1712985 - RNA, 13 nt, Human
cccugucuaauga

SEQ ID NO: 1712986 - RNA, 17 nt, Human
ccgcagacaggaccagg

SEQ ID NO: 1712987 - RNA, 16 nt, Human
ccgcagacaggaccag

SEQ ID NO: 1712988 - RNA, 12 nt, Human
ccgcccaggcuu

SEQ ID NO: 1712989 - RNA, 15 nt, Human
cccuuccucuuucca

SEQ ID NO: 1712990 - RNA, 17 nt, Human
ccgaaaacguggcugcu

SEQ ID NO: 1712991 - RNA, 16 nt, Human
ccgaaaacguggcugc

SEQ ID NO: 1712992 - RNA, 19 nt, Human
ccgaaagggacuuggaagc

SEQ ID NO: 1712993 - RNA, 17 nt, Human
ccgaccagacaccuuga

SEQ ID NO: 1712994 - RNA, 13 nt, Human
ccgaccagacacc

SEQ ID NO: 1712995 - RNA, 18 nt, Human
ccgaccagacaccuugac

SEQ ID NO: 1712996 - RNA, 15 nt, Human
ccgaccaccugccca

SEQ ID NO: 1712997 - RNA, 17 nt, Human
ccgaauagcugggacua

SEQ ID NO: 1712998 - RNA, 16 nt, Human
ccgaauagcugggacu

SEQ ID NO: 1712999 - RNA, 23 nt, Human
ccgaaggugaggagcuugaaacc

SEQ ID NO: 1713000 - RNA, 16 nt, Human
cccugagcuuucugcu

SEQ ID NO: 1713001 - RNA, 20 nt, Human
cccugcccaccuggccucug

SEQ ID NO: 1713002 - RNA, 17 nt, Human
cccugcccggcugcgga

SEQ ID NO: 1713003 - RNA, 14 nt, Human
cccugcccggcugc

SEQ ID NO: 1713004 - RNA, 17 nt, Human
cccugccccucccuuca

SEQ ID NO: 1713005 - RNA, 23 nt, Human
cccugccccucccuucaaccauu

SEQ ID NO: 1713006 - RNA, 19 nt, Human
cccugccccucccuucaac

SEQ ID NO: 1713007 - RNA, 18 nt, Human
cccugccccucccuucaa

SEQ ID NO: 1713008 - RNA, 14 nt, Human
cccugccccccagc

SEQ ID NO: 1713009 - RNA, 15 nt, Human
cccugccccccagcc

SEQ ID NO: 1713010 - RNA, 20 nt, Human
cccugccccccagcccuccu

SEQ ID NO: 1713011 - RNA, 22 nt, Human
cccugcccaccuggccucugca

SEQ ID NO: 1713012 - RNA, 19 nt, Human
cccuggauccaucaggcca

SEQ ID NO: 1713013 - RNA, 21 nt, Human
cccuggaugcagccucacagu

SEQ ID NO: 1713014 - RNA, 17 nt, Human
cccuggaugcagccuca

SEQ ID NO: 1713015 - RNA, 13 nt, Human
cccuggaugcagc

SEQ ID NO: 1713016 - RNA, 11 nt, Human
cccugcccugu

SEQ ID NO: 1713017 - RNA, 23 nt, Human
cccugcccugguuuccugcccug

SEQ ID NO: 1713018 - RNA, 22 nt, Human
cccugcccugguuuccugcccu

SEQ ID NO: 1713019 - RNA, 12 nt, Human
cccugcccuggu

SEQ ID NO: 1713020 - RNA, 11 nt, Human
cccugcccugg

SEQ ID NO: 1713021 - RNA, 20 nt, Human
cccuggcucccacaggcccu

SEQ ID NO: 1713022 - RNA, 18 nt, Human
cccugaaagcccugagcu

SEQ ID NO: 1713023 - RNA, 14 nt, Human
cccuccucucugcc

SEQ ID NO: 1713024 - RNA, 23 nt, Human
cccucgaggcggaucuuuggaca

SEQ ID NO: 1713025 - RNA, 22 nt, Human
cccucgaggcggaucuuuggac

SEQ ID NO: 1713026 - RNA, 18 nt, Human
cccuccuccuggacuccu

SEQ ID NO: 1713027 - RNA, 16 nt, Human
cccuccuccuggacuc

SEQ ID NO: 1713028 - RNA, 11 nt, Human
cccuccuccug

SEQ ID NO: 1713029 - RNA, 22 nt, Human
cccugacaacacucauugaccu

SEQ ID NO: 1713030 - RNA, 16 nt, Human
cccugacaacacucau

SEQ ID NO: 1713031 - RNA, 22 nt, Human
cccugaaggccccgcccaggcu

SEQ ID NO: 1713032 - RNA, 20 nt, Human
cccugaaggccccgcccagg

SEQ ID NO: 1713033 - RNA, 14 nt, Human
cccugacaacacuc

SEQ ID NO: 1713034 - RNA, 19 nt, Human
cccugaaggccccgcccag

SEQ ID NO: 1713035 - RNA, 16 nt, Human
cccugaaggccccgcc

SEQ ID NO: 1713036 - RNA, 14 nt, Human
cccugaaggccccg

SEQ ID NO: 1713037 - RNA, 13 nt, Human
cccugaaggcccc

SEQ ID NO: 1713038 - RNA, 12 nt, Human
cccugaaggccc

SEQ ID NO: 1713039 - RNA, 20 nt, Human
ccucugccugaagucacaca

SEQ ID NO: 1713040 - RNA, 11 nt, Human
ccucugccuga

SEQ ID NO: 1713041 - RNA, 23 nt, Human
ccucugccucugacacacagcuc

SEQ ID NO: 1713042 - RNA, 21 nt, Human
ccucugccucugacacacagc

SEQ ID NO: 1713043 - RNA, 20 nt, Human
ccucugccucugacacacag

SEQ ID NO: 1713044 - RNA, 14 nt, Human
ccucugcccugcgg

SEQ ID NO: 1713045 - RNA, 13 nt, Human
ccucugcccugcg

SEQ ID NO: 1713046 - RNA, 12 nt, Human
ccucugcccugc

SEQ ID NO: 1713047 - RNA, 11 nt, Human
ccucugcccug

SEQ ID NO: 1713048 - RNA, 12 nt, Human
ccucucucacuc

SEQ ID NO: 1713049 - RNA, 20 nt, Human
ccucucugcaggucccuaau

SEQ ID NO: 1713050 - RNA, 19 nt, Human
ccucucugcaggucccuaa

SEQ ID NO: 1713051 - RNA, 18 nt, Human
ccucucugcaggucccua

SEQ ID NO: 1713052 - RNA, 17 nt, Human
ccucucugcaggucccu

SEQ ID NO: 1713053 - RNA, 16 nt, Human
ccucucugcagguccc

SEQ ID NO: 1713054 - RNA, 16 nt, Human
ccuccgccucccgggu

SEQ ID NO: 1713055 - RNA, 13 nt, Human
ccuccgccucccg

SEQ ID NO: 1713056 - RNA, 15 nt, Human
ccucgaacuggcugc

SEQ ID NO: 1713057 - RNA, 16 nt, Human
ccucgaacuggcugca

SEQ ID NO: 1713058 - RNA, 16 nt, Human
ccucgagguuucucaa

SEQ ID NO: 1713059 - RNA, 20 nt, Human
ccuccuuugugaggaagccg

SEQ ID NO: 1713060 - RNA, 19 nt, Human
ccuccuuugugaggaagcc

SEQ ID NO: 1713061 - RNA, 18 nt, Human
ccuccuuugugaggaagc

SEQ ID NO: 1713062 - RNA, 18 nt, Human
ccucagccuccugaguag

SEQ ID NO: 1713063 - RNA, 15 nt, Human
ccucagccuccugag

SEQ ID NO: 1713064 - RNA, 23 nt, Human
ccucccaacucaccccagcccca

SEQ ID NO: 1713065 - RNA, 21 nt, Human
ccucccaacucaccccagccc

SEQ ID NO: 1713066 - RNA, 20 nt, Human
ccucccaacucaccccagcc

SEQ ID NO: 1713067 - RNA, 17 nt, Human
ccucccaacucacccca

SEQ ID NO: 1713068 - RNA, 11 nt, Human
ccucaggcagg

SEQ ID NO: 1713069 - RNA, 16 nt, Human
ccugaggggccucuua

SEQ ID NO: 1713070 - RNA, 12 nt, Human
ccugaggggccu

SEQ ID NO: 1713071 - RNA, 21 nt, Human
ccugaggcugggcucccuucc

SEQ ID NO: 1713072 - RNA, 19 nt, Human
ccugaggcugggcucccuu

SEQ ID NO: 1713073 - RNA, 17 nt, Human
ccugaggcugggcuccc

SEQ ID NO: 1713074 - RNA, 21 nt, Human
ccugcaggcagccaggccaca

SEQ ID NO: 1713075 - RNA, 20 nt, Human
ccugcaggcagccaggccac

SEQ ID NO: 1713076 - RNA, 19 nt, Human
ccugcaggcagccaggcca

SEQ ID NO: 1713077 - RNA, 18 nt, Human
ccugcaggcagccaggcc

SEQ ID NO: 1713078 - RNA, 23 nt, Human
ccugcaggcagccaggccacaag

SEQ ID NO: 1713079 - RNA, 14 nt, Human
ccugcagagggcac

SEQ ID NO: 1713080 - RNA, 17 nt, Human
ccugcaggcagccaggc

SEQ ID NO: 1713081 - RNA, 16 nt, Human
ccugcaggcagccagg

SEQ ID NO: 1713082 - RNA, 12 nt, Human
ccugcagagggc

SEQ ID NO: 1713083 - RNA, 15 nt, Human
ccugcaggcagccag

SEQ ID NO: 1713084 - RNA, 21 nt, Human
ccucugccugaagucacacag

SEQ ID NO: 1713085 - RNA, 15 nt, Human
ccucugccugucucc

SEQ ID NO: 1713086 - RNA, 19 nt, Human
ccucugccugucuccccca

SEQ ID NO: 1713087 - RNA, 19 nt, Human
ccucuuuggucuacacugu

SEQ ID NO: 1713088 - RNA, 16 nt, Human
ccucuuugagugaagc

SEQ ID NO: 1713089 - RNA, 20 nt, Human
ccugccuccuuugugaggaa

SEQ ID NO: 1713090 - RNA, 19 nt, Human
ccugccuccuuugugagga

SEQ ID NO: 1713091 - RNA, 15 nt, Human
ccugccuccuuugug

SEQ ID NO: 1713092 - RNA, 13 nt, Human
ccugccuccuuug

SEQ ID NO: 1713093 - RNA, 22 nt, Human
ccugccuccuuugugaggaagc

SEQ ID NO: 1713094 - RNA, 21 nt, Human
ccugccuccuuugugaggaag

SEQ ID NO: 1713095 - RNA, 23 nt, Human
ccugccuccuuugugaggaagcc

SEQ ID NO: 1713096 - RNA, 17 nt, Human
ccugccucucugcaggu

SEQ ID NO: 1713097 - RNA, 16 nt, Human
ccugcugcaguugcca

SEQ ID NO: 1713098 - RNA, 12 nt, Human
ccugcugcaguu

SEQ ID NO: 1713099 - RNA, 11 nt, Human
ccugcugcagu

SEQ ID NO: 1713100 - RNA, 22 nt, Human
ccugcugcaguugccagucacc

SEQ ID NO: 1713101 - RNA, 15 nt, Human
ccugccucuucucua

SEQ ID NO: 1713102 - RNA, 21 nt, Human
ccugccucucugcaggucccu

SEQ ID NO: 1713103 - RNA, 20 nt, Human
ccugccucucugcagguccc

SEQ ID NO: 1713104 - RNA, 21 nt, Human
cauuuguuucuuucucugagg

SEQ ID NO: 1713105 - RNA, 22 nt, Human
cauuuguuucuuucucugagga

SEQ ID NO: 1713106 - RNA, 23 nt, Human
cauuuuuuuuaagaaaaaggaug

SEQ ID NO: 1713107 - RNA, 23 nt, Human
cauuuguuucuuucucugaggac

SEQ ID NO: 1713108 - RNA, 21 nt, Human
cauuuggugguuucagaaaug

SEQ ID NO: 1713109 - RNA, 14 nt, Human
ccaaaaggcagaag

SEQ ID NO: 1713110 - RNA, 17 nt, Human
ccaaaaaaugcuugcuu

SEQ ID NO: 1713111 - RNA, 16 nt, Human
cauuuaggugaggaag

SEQ ID NO: 1713112 - RNA, 18 nt, Human
cauuuaggugaggaagca

SEQ ID NO: 1713113 - RNA, 16 nt, Human
cauuggagauguuuag

SEQ ID NO: 1713114 - RNA, 21 nt, Human
ccaacucaccccagccccaaa

SEQ ID NO: 1713115 - RNA, 15 nt, Human
ccaagcucugcuccu

SEQ ID NO: 1713116 - RNA, 14 nt, Human
ccaagcucugcucc

SEQ ID NO: 1713117 - RNA, 16 nt, Human
ccaagcucugcuccuc

SEQ ID NO: 1713118 - RNA, 17 nt, Human
ccaagcucugcuccucu

SEQ ID NO: 1713119 - RNA, 16 nt, Human
ccaaaucauaguggcu

SEQ ID NO: 1713120 - RNA, 23 nt, Human
ccaaaucagcugcuacuacuccu

SEQ ID NO: 1713121 - RNA, 15 nt, Human
ccaaaucagcugcua

SEQ ID NO: 1713122 - RNA, 13 nt, Human
ccaacucacccca

SEQ ID NO: 1713123 - RNA, 16 nt, Human
ccaacuauggccugug

SEQ ID NO: 1713124 - RNA, 15 nt, Human
ccaacuauggccugu

SEQ ID NO: 1713125 - RNA, 14 nt, Human
ccaacuauggccug

SEQ ID NO: 1713126 - RNA, 14 nt, Human
ccaaugggagcuca

SEQ ID NO: 1713127 - RNA, 23 nt, Human
ccaauggacuaacuugucuuugg

SEQ ID NO: 1713128 - RNA, 21 nt, Human
ccaauggagacugucucaaga

SEQ ID NO: 1713129 - RNA, 22 nt, Human
ccaaaguacacuguuucaaacu

SEQ ID NO: 1713130 - RNA, 14 nt, Human
ccaaagugcuggga

SEQ ID NO: 1713131 - RNA, 21 nt, Human
cauucuccaccugccagggac

SEQ ID NO: 1713132 - RNA, 19 nt, Human
cauucuccaccugccaggg

SEQ ID NO: 1713133 - RNA, 18 nt, Human
cauucuccaccugccagg

SEQ ID NO: 1713134 - RNA, 17 nt, Human
cauucuccaccugccag

SEQ ID NO: 1713135 - RNA, 20 nt, Human
cauucuccuuguguuacuaa

SEQ ID NO: 1713136 - RNA, 19 nt, Human
cauguuggccaggcugguc

SEQ ID NO: 1713137 - RNA, 20 nt, Human
cauguuggccaggcugcucu

SEQ ID NO: 1713138 - RNA, 17 nt, Human
cauguuggccaggcugg

SEQ ID NO: 1713139 - RNA, 18 nt, Human
cauguuggccaggcuggu

SEQ ID NO: 1713140 - RNA, 18 nt, Human
cauguucuuaauucuuag

SEQ ID NO: 1713141 - RNA, 17 nt, Human
cauguuacauaagauaa

SEQ ID NO: 1713142 - RNA, 16 nt, Human
cauguuacauaagaua

SEQ ID NO: 1713143 - RNA, 16 nt, Human
cauguccaagaagccc

SEQ ID NO: 1713144 - RNA, 15 nt, Human
cauguccaagaagcc

SEQ ID NO: 1713145 - RNA, 13 nt, Human
cauguucuuaauu

SEQ ID NO: 1713146 - RNA, 16 nt, Human
cauguucuuaauucuu

SEQ ID NO: 1713147 - RNA, 21 nt, Human
cauguuacauaagauaaaugu

SEQ ID NO: 1713148 - RNA, 18 nt, Human
caugggaaaggggaaguu

SEQ ID NO: 1713149 - RNA, 20 nt, Human
caugggaaaugucaacaagu

SEQ ID NO: 1713150 - RNA, 21 nt, Human
cauggccucuucagaucucua

SEQ ID NO: 1713151 - RNA, 14 nt, Human
cauggccgugaacu

SEQ ID NO: 1713152 - RNA, 22 nt, Human
cauggccucuucagaucucuaa

SEQ ID NO: 1713153 - RNA, 16 nt, Human
caugcuccuggcccac

SEQ ID NO: 1713154 - RNA, 14 nt, Human
caugcuccuggccc

SEQ ID NO: 1713155 - RNA, 17 nt, Human
caugcuccuggcccacu

SEQ ID NO: 1713156 - RNA, 20 nt, Human
caugcuccuggcccacugca

SEQ ID NO: 1713157 - RNA, 15 nt, Human
cauggccagguggcc

SEQ ID NO: 1713158 - RNA, 12 nt, Human
caugcaagguca

SEQ ID NO: 1713159 - RNA, 15 nt, Human
caugcaaggucauuu

SEQ ID NO: 1713160 - RNA, 13 nt, Human
caugacaaagacu

SEQ ID NO: 1713161 - RNA, 16 nt, Human
caugaauuugugaagg

SEQ ID NO: 1713162 - RNA, 21 nt, Human
caugaauauuuaguguucaua

SEQ ID NO: 1713163 - RNA, 17 nt, Human
caguuauuauauuuaca

SEQ ID NO: 1713164 - RNA, 21 nt, Human
caguuauuauauuuacaaaug

SEQ ID NO: 1713165 - RNA, 20 nt, Human
caguggugcgaucuggguuc

SEQ ID NO: 1713166 - RNA, 19 nt, Human
caguggugcgaucuggguu

SEQ ID NO: 1713167 - RNA, 21 nt, Human
cagugguaugaucacggcuca

SEQ ID NO: 1713168 - RNA, 20 nt, Human
caguuacucagaauucucua

SEQ ID NO: 1713169 - RNA, 22 nt, Human
cagugauuaccagggacugagg

SEQ ID NO: 1713170 - RNA, 23 nt, Human
cagucugauucccaagcucugcu

SEQ ID NO: 1713171 - RNA, 22 nt, Human
cagugcccacaggaucagucug

SEQ ID NO: 1713172 - RNA, 21 nt, Human
cagugcccacaggaucagucu

SEQ ID NO: 1713173 - RNA, 18 nt, Human
cagugggagcugccuguu

SEQ ID NO: 1713174 - RNA, 17 nt, Human
cagugggagcugccugu

SEQ ID NO: 1713175 - RNA, 16 nt, Human
cagugggagcugccug

SEQ ID NO: 1713176 - RNA, 20 nt, Human
cagugguaugaucacggcuc

SEQ ID NO: 1713177 - RNA, 22 nt, Human
cagucugauucccaagcucugc

SEQ ID NO: 1713178 - RNA, 21 nt, Human
cagucugauucccaagcucug

SEQ ID NO: 1713179 - RNA, 22 nt, Human
caguuauuauauuuacaaaugg

SEQ ID NO: 1713180 - RNA, 22 nt, Human
cauccucuguacagagcccacg

SEQ ID NO: 1713181 - RNA, 12 nt, Human
caucccagcccc

SEQ ID NO: 1713182 - RNA, 11 nt, Human
caucccagccc

SEQ ID NO: 1713183 - RNA, 20 nt, Human
caucccaaacccuucagugc

SEQ ID NO: 1713184 - RNA, 19 nt, Human
caucccaaacccuucagug

SEQ ID NO: 1713185 - RNA, 21 nt, Human
caucagcacgauuucuguuua

SEQ ID NO: 1713186 - RNA, 18 nt, Human
cauccugaggcuccacuu

SEQ ID NO: 1713187 - RNA, 19 nt, Human
cauccugaggcuccacuug

SEQ ID NO: 1713188 - RNA, 21 nt, Human
caucuaaacugcccccucugc

SEQ ID NO: 1713189 - RNA, 15 nt, Human
caucuaaacugcccc

SEQ ID NO: 1713190 - RNA, 16 nt, Human
cauagguuuaauaauu

SEQ ID NO: 1713191 - RNA, 20 nt, Human
cauagcagcuuauucacaag

SEQ ID NO: 1713192 - RNA, 19 nt, Human
cauagcagcuuauucacaa

SEQ ID NO: 1713193 - RNA, 23 nt, Human
cauagcagagaaugaaagggccc

SEQ ID NO: 1713194 - RNA, 21 nt, Human
cauauuauuuuauguugcaua

SEQ ID NO: 1713195 - RNA, 23 nt, Human
cauaaugcgugcauaccacuuuu

SEQ ID NO: 1713196 - RNA, 11 nt, Human
caguuuuccuu

SEQ ID NO: 1713197 - RNA, 16 nt, Human
cauacaguuugcacuu

SEQ ID NO: 1713198 - RNA, 23 nt, Human
cauacaggaagguagaaauaucu

SEQ ID NO: 1713199 - RNA, 18 nt, Human
cauaauuauuauuuggcc

SEQ ID NO: 1713200 - RNA, 22 nt, Human
caguuguuagugugucuuagug

SEQ ID NO: 1713201 - RNA, 18 nt, Human
caguuguuagugugucuu

SEQ ID NO: 1713202 - RNA, 23 nt, Human
caguuuguuaguaugaggcauuu

SEQ ID NO: 1713203 - RNA, 17 nt, Human
cagaggggguggccucc

SEQ ID NO: 1713204 - RNA, 19 nt, Human
cagauacuuggggggcuga

SEQ ID NO: 1713205 - RNA, 16 nt, Human
cagaggggguggccuc

SEQ ID NO: 1713206 - RNA, 14 nt, Human
cagaggggguggcc

SEQ ID NO: 1713207 - RNA, 19 nt, Human
cagauagauauaugcucug

SEQ ID NO: 1713208 - RNA, 22 nt, Human
cagauauaaaagacugaccaau

SEQ ID NO: 1713209 - RNA, 14 nt, Human
cagauccccaagcc

SEQ ID NO: 1713210 - RNA, 19 nt, Human
cagaggaaagcaaaggaga

SEQ ID NO: 1713211 - RNA, 17 nt, Human
cagaggaaagcaaagga

SEQ ID NO: 1713212 - RNA, 13 nt, Human
cagaggggguggc

SEQ ID NO: 1713213 - RNA, 20 nt, Human
cagaggaaagcaaaggagau

SEQ ID NO: 1713214 - RNA, 23 nt, Human
cagagaggguggugaccucugcc

SEQ ID NO: 1713215 - RNA, 20 nt, Human
cagagagguuaaggugggua

SEQ ID NO: 1713216 - RNA, 13 nt, Human
cagagcugccacc

SEQ ID NO: 1713217 - RNA, 22 nt, Human
cagagaggguggugaccucugc

SEQ ID NO: 1713218 - RNA, 20 nt, Human
cagagaggguggugaccucu

SEQ ID NO: 1713219 - RNA, 17 nt, Human
cagagaggguggugacc

SEQ ID NO: 1713220 - RNA, 13 nt, Human
cagagaggguggg

SEQ ID NO: 1713221 - RNA, 12 nt, Human
cagagagggugg

SEQ ID NO: 1713222 - RNA, 14 nt, Human
cagcacgauuucug

SEQ ID NO: 1713223 - RNA, 15 nt, Human
cagcacgauuucugu

SEQ ID NO: 1713224 - RNA, 18 nt, Human
cagcacgggggccaagga

SEQ ID NO: 1713225 - RNA, 18 nt, Human
cagauugcaacaggcugg

SEQ ID NO: 1713226 - RNA, 20 nt, Human
cagauugcaacaggcugggc

SEQ ID NO: 1713227 - RNA, 19 nt, Human
cagauugcaacaggcuggg

SEQ ID NO: 1713228 - RNA, 20 nt, Human
cagauuucacucuccuuggu

SEQ ID NO: 1713229 - RNA, 13 nt, Human
cagauuucacucu

SEQ ID NO: 1713230 - RNA, 13 nt, Human
cagauuuaugcau

SEQ ID NO: 1713231 - RNA, 19 nt, Human
cagcaccaucucuccuccu

SEQ ID NO: 1713232 - RNA, 17 nt, Human
cagcaccaucucuccuc

SEQ ID NO: 1713233 - RNA, 19 nt, Human
cagauuugaacucuucaau

SEQ ID NO: 1713234 - RNA, 21 nt, Human
cagacuggaagcacagcuuca

SEQ ID NO: 1713235 - RNA, 20 nt, Human
cagacuggaagcacagcuuc

SEQ ID NO: 1713236 - RNA, 18 nt, Human
cagacuggaagcacagcu

SEQ ID NO: 1713237 - RNA, 17 nt, Human
cagacuggaagcacagc

SEQ ID NO: 1713238 - RNA, 16 nt, Human
cagacuggaagcacag

SEQ ID NO: 1713239 - RNA, 14 nt, Human
cagacuggaagcac

SEQ ID NO: 1713240 - RNA, 13 nt, Human
cagacuggaagca

SEQ ID NO: 1713241 - RNA, 23 nt, Human
cagacaggcaagcaccuccugcc

SEQ ID NO: 1713242 - RNA, 22 nt, Human
cagacaggcaagcaccuccugc

SEQ ID NO: 1713243 - RNA, 17 nt, Human
cagacucuacagaggcc

SEQ ID NO: 1713244 - RNA, 21 nt, Human
cagacucuacagaggccaugg

SEQ ID NO: 1713245 - RNA, 20 nt, Human
cagacucuacagaggccaug

SEQ ID NO: 1713246 - RNA, 19 nt, Human
cagacucuacagaggccau

SEQ ID NO: 1713247 - RNA, 18 nt, Human
cagacucuacagaggcca

SEQ ID NO: 1713248 - RNA, 23 nt, Human
cagacucuacagaggccaugggc

SEQ ID NO: 1713249 - RNA, 21 nt, Human
cagacaggcaagcaccuccug

SEQ ID NO: 1713250 - RNA, 20 nt, Human
cagacaggcaagcaccuccu

SEQ ID NO: 1713251 - RNA, 18 nt, Human
cagacaggcaagcaccuc

SEQ ID NO: 1713252 - RNA, 13 nt, Human
cagacaggcaagc

SEQ ID NO: 1713253 - RNA, 11 nt, Human
cagacaggcaa

SEQ ID NO: 1713254 - RNA, 24 nt, Human
cagacaggaccagggauuuccaug

SEQ ID NO: 1713255 - RNA, 17 nt, Human
cagacaggaccagggau

SEQ ID NO: 1713256 - RNA, 18 nt, Human
cagacagcugccugggau

SEQ ID NO: 1713257 - RNA, 17 nt, Human
cagacagcugccuggga

SEQ ID NO: 1713258 - RNA, 16 nt, Human
cagacagcugccuggg

SEQ ID NO: 1713259 - RNA, 15 nt, Human
cagacagcugccugg

SEQ ID NO: 1713260 - RNA, 16 nt, Human
cagacaggaccaggga

SEQ ID NO: 1713261 - RNA, 15 nt, Human
cagacaggaccaggg

SEQ ID NO: 1713262 - RNA, 13 nt, Human
cagacaggaccag

SEQ ID NO: 1713263 - RNA, 14 nt, Human
cagacagcugccug

SEQ ID NO: 1713264 - RNA, 13 nt, Human
cagacagcugccu

SEQ ID NO: 1713265 - RNA, 14 nt, Human
cagacagcccucca

SEQ ID NO: 1713266 - RNA, 16 nt, Human
cagcugucaaggcuca

SEQ ID NO: 1713267 - RNA, 17 nt, Human
caggaaaggcuccagga

SEQ ID NO: 1713268 - RNA, 16 nt, Human
caggaaaggcuccagg

SEQ ID NO: 1713269 - RNA, 20 nt, Human
caggaaaggcuccaggagca

SEQ ID NO: 1713270 - RNA, 19 nt, Human
caggaaaggcuccaggagc

SEQ ID NO: 1713271 - RNA, 21 nt, Human
cagcugacuuuucuguccgag

SEQ ID NO: 1713272 - RNA, 14 nt, Human
cagcugagaggcug

SEQ ID NO: 1713273 - RNA, 16 nt, Human
cagccugcuccagcug

SEQ ID NO: 1713274 - RNA, 19 nt, Human
cagccugcuccagcuguuc

SEQ ID NO: 1713275 - RNA, 17 nt, Human
cagccugcuccagcugu

SEQ ID NO: 1713276 - RNA, 15 nt, Human
cagcuaacauggaag

SEQ ID NO: 1713277 - RNA, 20 nt, Human
cagcgcuggccgggaccccg

SEQ ID NO: 1713278 - RNA, 21 nt, Human
caggcugggagagccuuccag

SEQ ID NO: 1713279 - RNA, 21 nt, Human
caggcgugagccaccgugccu

SEQ ID NO: 1713280 - RNA, 14 nt, Human
caggccuccuacag

SEQ ID NO: 1713281 - RNA, 15 nt, Human
caggccuguccaaca

SEQ ID NO: 1713282 - RNA, 12 nt, Human
caggccuccuac

SEQ ID NO: 1713283 - RNA, 16 nt, Human
caggggaaaagaggag

SEQ ID NO: 1713284 - RNA, 14 nt, Human
caggggaaaagagg

SEQ ID NO: 1713285 - RNA, 17 nt, Human
caggggaaaaucagccu

SEQ ID NO: 1713286 - RNA, 23 nt, Human
caggcugggagagccuuccaggg

SEQ ID NO: 1713287 - RNA, 22 nt, Human
caggcugggagagccuuccagg

SEQ ID NO: 1713288 - RNA, 19 nt, Human
caggaggaucacuugaguc

SEQ ID NO: 1713289 - RNA, 19 nt, Human
caggaggccagccuugacc

SEQ ID NO: 1713290 - RNA, 18 nt, Human
caggaggccagccuugac

SEQ ID NO: 1713291 - RNA, 22 nt, Human
caggaggccagccuugaccauu

SEQ ID NO: 1713292 - RNA, 17 nt, Human
caggcaaugcuggcugu

SEQ ID NO: 1713293 - RNA, 16 nt, Human
caggcaaugcuggcug

SEQ ID NO: 1713294 - RNA, 15 nt, Human
caggcaaugcuggcu

SEQ ID NO: 1713295 - RNA, 23 nt, Human
caggaccucaggugagaagcaga

SEQ ID NO: 1713296 - RNA, 16 nt, Human
caggaccucaggugag

SEQ ID NO: 1713297 - RNA, 12 nt, Human
caggccaggccc

SEQ ID NO: 1713298 - RNA, 11 nt, Human
caggccaggcc

SEQ ID NO: 1713299 - RNA, 14 nt, Human
auucauauuuacuu

SEQ ID NO: 1713300 - RNA, 16 nt, Human
auuacaggugugaacc

SEQ ID NO: 1713301 - RNA, 23 nt, Human
auuaugugccagauuuaugcaua

SEQ ID NO: 1713302 - RNA, 21 nt, Human
auuaugugccagauuuaugca

SEQ ID NO: 1713303 - RNA, 13 nt, Human
auuaugugccaga

SEQ ID NO: 1713304 - RNA, 15 nt, Human
auucucuuauccaac

SEQ ID NO: 1713305 - RNA, 16 nt, Human
auucucuccuguaccu

SEQ ID NO: 1713306 - RNA, 20 nt, Human
auucucuaguuugauuaaau

SEQ ID NO: 1713307 - RNA, 14 nt, Human
auucucuuauccaa

SEQ ID NO: 1713308 - RNA, 12 nt, Human
auucucuuaucc

SEQ ID NO: 1713309 - RNA, 23 nt, Human
auucucuaguuugauuaaauucu

SEQ ID NO: 1713310 - RNA, 21 nt, Human
auucgcuacuaugauuuaauu

SEQ ID NO: 1713311 - RNA, 21 nt, Human
auuaacaugaauauuuagugu

SEQ ID NO: 1713312 - RNA, 16 nt, Human
auuacaggcuccugcc

SEQ ID NO: 1713313 - RNA, 15 nt, Human
auuacaggcuccugc

SEQ ID NO: 1713314 - RNA, 13 nt, Human
auuacagguguga

SEQ ID NO: 1713315 - RNA, 19 nt, Human
auuacaggcuccugccacc

SEQ ID NO: 1713316 - RNA, 17 nt, Human
auuacaggcuccugcca

SEQ ID NO: 1713317 - RNA, 15 nt, Human
auuaauggaaauguu

SEQ ID NO: 1713318 - RNA, 19 nt, Human
auuuguucuauagcuuuuc

SEQ ID NO: 1713319 - RNA, 14 nt, Human
auuuguuauaauga

SEQ ID NO: 1713320 - RNA, 15 nt, Human
auuuugaaaaacugc

SEQ ID NO: 1713321 - RNA, 13 nt, Human
auuuugaaaaacu

SEQ ID NO: 1713322 - RNA, 17 nt, Human
auuuucuauaauuuaaa

SEQ ID NO: 1713323 - RNA, 18 nt, Human
auuuucuauaauuuaaau

SEQ ID NO: 1713324 - RNA, 19 nt, Human
auuuucuauaauuuaaaua

SEQ ID NO: 1713325 - RNA, 22 nt, Human
auuuuguuuuugucuuaaaaag

SEQ ID NO: 1713326 - RNA, 13 nt, Human
auuuuuaaagaaa

SEQ ID NO: 1713327 - RNA, 15 nt, Human
auuuuuuucugaauu

SEQ ID NO: 1713328 - RNA, 16 nt, Human
auuuuuauuaaauuau

SEQ ID NO: 1713329 - RNA, 20 nt, Human
caaaagguuaauaaaguaau

SEQ ID NO: 1713330 - RNA, 21 nt, Human
caaaagguauuuuaaucacca

SEQ ID NO: 1713331 - RNA, 19 nt, Human
caaaagcaucuaugugaga

SEQ ID NO: 1713332 - RNA, 13 nt, Human
caaaagcauguga

SEQ ID NO: 1713333 - RNA, 15 nt, Human
auuuuuuuuguuuca

SEQ ID NO: 1713334 - RNA, 17 nt, Human
caaaccaucauugaaau

SEQ ID NO: 1713335 - RNA, 16 nt, Human
caaaccaucauugaaa

SEQ ID NO: 1713336 - RNA, 14 nt, Human
caaaccaucauuga

SEQ ID NO: 1713337 - RNA, 18 nt, Human
auuuaauuugaaauaugg

SEQ ID NO: 1713338 - RNA, 15 nt, Human
auuuauauaaauuuu

SEQ ID NO: 1713339 - RNA, 14 nt, Human
auuucacucuccuu

SEQ ID NO: 1713340 - RNA, 12 nt, Human
auuucacucucc

SEQ ID NO: 1713341 - RNA, 20 nt, Human
auuucuguuuagauaauaca

SEQ ID NO: 1713342 - RNA, 19 nt, Human
auuucuguuuagauaauac

SEQ ID NO: 1713343 - RNA, 21 nt, Human
auuucuguuuagauaauacac

SEQ ID NO: 1713344 - RNA, 14 nt, Human
caagaccacguuuc

SEQ ID NO: 1713345 - RNA, 16 nt, Human
caagaccacguuucua

SEQ ID NO: 1713346 - RNA, 18 nt, Human
caagcaagaaacacuggg

SEQ ID NO: 1713347 - RNA, 13 nt, Human
caagcaagaaaca

SEQ ID NO: 1713348 - RNA, 19 nt, Human
caagcaaaugugaaucauu

SEQ ID NO: 1713349 - RNA, 17 nt, Human
caagcaaaugugaauca

SEQ ID NO: 1713350 - RNA, 15 nt, Human
caagcaaaugugaau

SEQ ID NO: 1713351 - RNA, 13 nt, Human
caagcaccuccug

SEQ ID NO: 1713352 - RNA, 14 nt, Human
caagcaccuccugc

SEQ ID NO: 1713353 - RNA, 18 nt, Human
caagcaccuagccucgcu

SEQ ID NO: 1713354 - RNA, 13 nt, Human
caacuauggccug

SEQ ID NO: 1713355 - RNA, 16 nt, Human
caaccccuucgcuccu

SEQ ID NO: 1713356 - RNA, 14 nt, Human
caaccccuucgcuc

SEQ ID NO: 1713357 - RNA, 17 nt, Human
caaccccuucgcuccug

SEQ ID NO: 1713358 - RNA, 14 nt, Human
caacccccagccug

SEQ ID NO: 1713359 - RNA, 14 nt, Human
caacuauggccugu

SEQ ID NO: 1713360 - RNA, 20 nt, Human
caacucccugccccccagcc

SEQ ID NO: 1713361 - RNA, 19 nt, Human
caacucccugccccccagc

SEQ ID NO: 1713362 - RNA, 15 nt, Human
caagaagcccaggaa

SEQ ID NO: 1713363 - RNA, 21 nt, Human
caacucccugccccccagccc

SEQ ID NO: 1713364 - RNA, 17 nt, Human
caagaaggaugauucaa

SEQ ID NO: 1713365 - RNA, 18 nt, Human
caagaagcccaggaaagg

SEQ ID NO: 1713366 - RNA, 18 nt, Human
caagaauagaugcugacu

SEQ ID NO: 1713367 - RNA, 19 nt, Human
caagaauagcauuguaaaa

SEQ ID NO: 1713368 - RNA, 14 nt, Human
caaucaaaucugcu

SEQ ID NO: 1713369 - RNA, 15 nt, Human
caauggcagccuugg

SEQ ID NO: 1713370 - RNA, 14 nt, Human
caauggcagccuug

SEQ ID NO: 1713371 - RNA, 13 nt, Human
caauggcagccuu

SEQ ID NO: 1713372 - RNA, 16 nt, Human
caauggcagccuuggc

SEQ ID NO: 1713373 - RNA, 12 nt, Human
caaugcuggcug

SEQ ID NO: 1713374 - RNA, 20 nt, Human
caauuggauacgacaacuug

SEQ ID NO: 1713375 - RNA, 17 nt, Human
caauauuguacaguuuu

SEQ ID NO: 1713376 - RNA, 18 nt, Human
caauauuguacaguuuuu

SEQ ID NO: 1713377 - RNA, 16 nt, Human
caauauuguacaguuu

SEQ ID NO: 1713378 - RNA, 20 nt, Human
caauuuauuauggcacauca

SEQ ID NO: 1713379 - RNA, 18 nt, Human
caagcuccaagcucccag

SEQ ID NO: 1713380 - RNA, 17 nt, Human
caagcuccaagcuccca

SEQ ID NO: 1713381 - RNA, 21 nt, Human
caagcuccaagcucccaggca

SEQ ID NO: 1713382 - RNA, 19 nt, Human
caagcuccaagcucccagg

SEQ ID NO: 1713383 - RNA, 17 nt, Human
caagcuccaucuccacu

SEQ ID NO: 1713384 - RNA, 21 nt, Human
caagcuccaucuccacuccag

SEQ ID NO: 1713385 - RNA, 17 nt, Human
caagcucccaggcauuc

SEQ ID NO: 1713386 - RNA, 15 nt, Human
caagcucccaggcau

SEQ ID NO: 1713387 - RNA, 14 nt, Human
caagcucccaggca

SEQ ID NO: 1713388 - RNA, 12 nt, Human
caagcucccagg

SEQ ID NO: 1713389 - RNA, 16 nt, Human
caagcucugcuccucu

SEQ ID NO: 1713390 - RNA, 15 nt, Human
caagcucugcuccuc

SEQ ID NO: 1713391 - RNA, 16 nt, Human
caaggcaaggcuguca

SEQ ID NO: 1713392 - RNA, 14 nt, Human
caaggcaaggcugu

SEQ ID NO: 1713393 - RNA, 20 nt, Human
caaggauugcuacuguccua

SEQ ID NO: 1713394 - RNA, 17 nt, Human
caaguauuauaccuuuu

SEQ ID NO: 1713395 - RNA, 22 nt, Human
caaguauuauaccuuuuuuaga

SEQ ID NO: 1713396 - RNA, 12 nt, Human
cacccugcucuc

SEQ ID NO: 1713397 - RNA, 12 nt, Human
cacccuccuuuc

SEQ ID NO: 1713398 - RNA, 12 nt, Human
caccugccaggg

SEQ ID NO: 1713399 - RNA, 11 nt, Human
caccugccagg

SEQ ID NO: 1713400 - RNA, 21 nt, Human
caccugccccucaacucuccu

SEQ ID NO: 1713401 - RNA, 18 nt, Human
caccugccccucaacucu

SEQ ID NO: 1713402 - RNA, 13 nt, Human
caccugccaggga

SEQ ID NO: 1713403 - RNA, 20 nt, Human
caccugcggugcuaucuccc

SEQ ID NO: 1713404 - RNA, 19 nt, Human
caccugcggugcuaucucc

SEQ ID NO: 1713405 - RNA, 17 nt, Human
caccugcggugcuaucu

SEQ ID NO: 1713406 - RNA, 16 nt, Human
caccugcggugcuauc

SEQ ID NO: 1713407 - RNA, 16 nt, Human
cacuccagaccccugg

SEQ ID NO: 1713408 - RNA, 14 nt, Human
cacuccagaccccu

SEQ ID NO: 1713409 - RNA, 15 nt, Human
cacuacauucuguua

SEQ ID NO: 1713410 - RNA, 16 nt, Human
cacuagacccacugga

SEQ ID NO: 1713411 - RNA, 13 nt, Human
cacuacauucugu

SEQ ID NO: 1713412 - RNA, 14 nt, Human
cacuacauucuguu

SEQ ID NO: 1713413 - RNA, 22 nt, Human
cacggaagagccuugcggaagg

SEQ ID NO: 1713414 - RNA, 16 nt, Human
cacggaagagccuugc

SEQ ID NO: 1713415 - RNA, 15 nt, Human
cacgcuggagugcag

SEQ ID NO: 1713416 - RNA, 20 nt, Human
cacgcuggagugcagugagc

SEQ ID NO: 1713417 - RNA, 18 nt, Human
cacgcuggagugcaguga

SEQ ID NO: 1713418 - RNA, 17 nt, Human
cacgcuggagugcagug

SEQ ID NO: 1713419 - RNA, 16 nt, Human
cacgcuggagugcagu

SEQ ID NO: 1713420 - RNA, 21 nt, Human
cacgcuggagugcagugagcc

SEQ ID NO: 1713421 - RNA, 21 nt, Human
cacuccagugagacagcucug

SEQ ID NO: 1713422 - RNA, 17 nt, Human
cacuccagaccccuggc

SEQ ID NO: 1713423 - RNA, 22 nt, Human
cacaucuugcucugcugacaga

SEQ ID NO: 1713424 - RNA, 21 nt, Human
cacaucuugcucugcugacag

SEQ ID NO: 1713425 - RNA, 20 nt, Human
cacaucuugcucugcugaca

SEQ ID NO: 1713426 - RNA, 15 nt, Human
cacaucuugcucugc

SEQ ID NO: 1713427 - RNA, 14 nt, Human
cacaucuugcucug

SEQ ID NO: 1713428 - RNA, 13 nt, Human
cacaucuugcucu

SEQ ID NO: 1713429 - RNA, 12 nt, Human
cacccagcccac

SEQ ID NO: 1713430 - RNA, 22 nt, Human
caccagccccagugcccacagg

SEQ ID NO: 1713431 - RNA, 21 nt, Human
caccagccccagugcccacag

SEQ ID NO: 1713432 - RNA, 18 nt, Human
caccagccccagugccca

SEQ ID NO: 1713433 - RNA, 19 nt, Human
caccagcccuuagcaggga

SEQ ID NO: 1713434 - RNA, 21 nt, Human
caccagcccuuagcagggaaa

SEQ ID NO: 1713435 - RNA, 17 nt, Human
caccagccccagugccc

SEQ ID NO: 1713436 - RNA, 18 nt, Human
cacauuuauucugcucac

SEQ ID NO: 1713437 - RNA, 17 nt, Human
cacauuuauucugcuca

SEQ ID NO: 1713438 - RNA, 23 nt, Human
cacaucuugcucugcugacagac

SEQ ID NO: 1713439 - RNA, 20 nt, Human
auguuacauaagauaaaugu

SEQ ID NO: 1713440 - RNA, 19 nt, Human
auguuacauaagauaaaug

SEQ ID NO: 1713441 - RNA, 13 nt, Human
auguuggccaggc

SEQ ID NO: 1713442 - RNA, 21 nt, Human
uuuuagacccuauugcugcuu

SEQ ID NO: 1713443 - RNA, 17 nt, Human
uuuuagaguugauacua

SEQ ID NO: 1713444 - RNA, 16 nt, Human
auguugcccaggcagg

SEQ ID NO: 1713445 - RNA, 15 nt, Human
auguugcccaggcag

SEQ ID NO: 1713446 - RNA, 14 nt, Human
auguugcccaggca

SEQ ID NO: 1713447 - RNA, 13 nt, Human
auguugcccaggc

SEQ ID NO: 1713448 - RNA, 18 nt, Human
auguugaaagaucaaaag

SEQ ID NO: 1713449 - RNA, 12 nt, Human
auguugaaagau

SEQ ID NO: 1713450 - RNA, 15 nt, Human
auguguguuuuaaaa

SEQ ID NO: 1713451 - RNA, 21 nt, Human
augugccagguuuuuggucug

SEQ ID NO: 1713452 - RNA, 18 nt, Human
uuuuaaaaaacugcugac

SEQ ID NO: 1713453 - RNA, 21 nt, Human
uuuuaaaaaacugcugacugu

SEQ ID NO: 1713454 - RNA, 16 nt, Human
uuuucuauaauuuaaa

SEQ ID NO: 1713455 - RNA, 14 nt, Human
uuuucaguguacau

SEQ ID NO: 1713456 - RNA, 18 nt, Human
uuuuauggcuuuugugca

SEQ ID NO: 1713457 - RNA, 19 nt, Human
uuuuauggcuuuugugcau

SEQ ID NO: 1713458 - RNA, 15 nt, Human
uuuuaguagagacag

SEQ ID NO: 1713459 - RNA, 12 nt, Human
uuuuauuaaauu

SEQ ID NO: 1713460 - RNA, 21 nt, Human
uuuuauggcuuuugugcauua

SEQ ID NO: 1713461 - RNA, 13 nt, Human
uuuucuguucuuu

SEQ ID NO: 1713462 - RNA, 21 nt, Human
uuuucuuaaccagaucauugu

SEQ ID NO: 1713463 - RNA, 17 nt, Human
auguuggccaggcuggu

SEQ ID NO: 1713464 - RNA, 19 nt, Human
auuaaaacacaacaucuuu

SEQ ID NO: 1713465 - RNA, 23 nt, Human
auuaaaaaucucaaauuucuaaa

SEQ ID NO: 1713466 - RNA, 15 nt, Human
auguuuuuuuuuaaa

SEQ ID NO: 1713467 - RNA, 23 nt, Human
augucgucaaagcugaaauggac

SEQ ID NO: 1713468 - RNA, 13 nt, Human
augugagaccauu

SEQ ID NO: 1713469 - RNA, 14 nt, Human
augugagacugguu

SEQ ID NO: 1713470 - RNA, 19 nt, Human
auguauauuuuauaucaau

SEQ ID NO: 1713471 - RNA, 12 nt, Human
auguaucaauga

SEQ ID NO: 1713472 - RNA, 17 nt, Human
auguaucaaauacauuu

SEQ ID NO: 1713473 - RNA, 17 nt, Human
auguccaagaagcccag

SEQ ID NO: 1713474 - RNA, 16 nt, Human
auguccaagaagccca

SEQ ID NO: 1713475 - RNA, 14 nt, Human
uuuguacagacaac

SEQ ID NO: 1713476 - RNA, 16 nt, Human
uuuguaauuuuuuuau

SEQ ID NO: 1713477 - RNA, 15 nt, Human
augugaugagaggaa

SEQ ID NO: 1713478 - RNA, 18 nt, Human
augugauccuuuuggagu

SEQ ID NO: 1713479 - RNA, 14 nt, Human
uuugucuuaaaaag

SEQ ID NO: 1713480 - RNA, 13 nt, Human
uuugucuuaaaaa

SEQ ID NO: 1713481 - RNA, 23 nt, Human
uuugucuuaaaaaguggaaaaau

SEQ ID NO: 1713482 - RNA, 16 nt, Human
uuugugauacaaugcu

SEQ ID NO: 1713483 - RNA, 22 nt, Human
uuugugauacaaugcugugccc

SEQ ID NO: 1713484 - RNA, 15 nt, Human
uuugugauacaaugc

SEQ ID NO: 1713485 - RNA, 19 nt, Human
uuugugcauuaucuagaua

SEQ ID NO: 1713486 - RNA, 22 nt, Human
uuugugcauuaucuagauacug

SEQ ID NO: 1713487 - RNA, 13 nt, Human
uuuguuucauauu

SEQ ID NO: 1713488 - RNA, 16 nt, Human
uuuguuucugaaaggg

SEQ ID NO: 1713489 - RNA, 14 nt, Human
uuuguuucugaaag

SEQ ID NO: 1713490 - RNA, 22 nt, Human
uuugggguacccacugcucugg

SEQ ID NO: 1713491 - RNA, 21 nt, Human
uuugggguacccacugcucug

SEQ ID NO: 1713492 - RNA, 13 nt, Human
uuuggggaagaac

SEQ ID NO: 1713493 - RNA, 13 nt, Human
uuuggcugcugaa

SEQ ID NO: 1713494 - RNA, 12 nt, Human
uuuggcugcuga

SEQ ID NO: 1713495 - RNA, 14 nt, Human
uuugggcugcccug

SEQ ID NO: 1713496 - RNA, 22 nt, Human
uuuggauuggaugaauuccaaa

SEQ ID NO: 1713497 - RNA, 13 nt, Human
uuugcuguagaag

SEQ ID NO: 1713498 - RNA, 20 nt, Human
uuugcuggagcucugcccau

SEQ ID NO: 1713499 - RNA, 19 nt, Human
uuugcuggggccgaaagaa

SEQ ID NO: 1713500 - RNA, 22 nt, Human
uuugcuggggccgaaagaacag

SEQ ID NO: 1713501 - RNA, 18 nt, Human
uuugauucagacagcugc

SEQ ID NO: 1713502 - RNA, 18 nt, Human
uuugaccucugcagcaau

SEQ ID NO: 1713503 - RNA, 13 nt, Human
uuugagacagagu

SEQ ID NO: 1713504 - RNA, 15 nt, Human
uuugauccaagcugg

SEQ ID NO: 1713505 - RNA, 15 nt, Human
uuugauucagacagc

SEQ ID NO: 1713506 - RNA, 23 nt, Human
uuucccucccuuccucuuuccau

SEQ ID NO: 1713507 - RNA, 19 nt, Human
uuugaccucugcagcaaua

SEQ ID NO: 1713508 - RNA, 21 nt, Human
uuugaccucugcagcaauaaa

SEQ ID NO: 1713509 - RNA, 14 nt, Human
uuugacaaggggca

SEQ ID NO: 1713510 - RNA, 18 nt, Human
uuugacaaagguaaauca

SEQ ID NO: 1713511 - RNA, 20 nt, Human
auuauauggcuugaguuuaa

SEQ ID NO: 1713512 - RNA, 17 nt, Human
auuccaagugauugaaa

SEQ ID NO: 1713513 - RNA, 12 nt, Human
auuccacagcug

SEQ ID NO: 1713514 - RNA, 13 nt, Human
auuccacagcugc

SEQ ID NO: 1713515 - RNA, 18 nt, Human
auuccagagaguggcucc

SEQ ID NO: 1713516 - RNA, 17 nt, Human
auucccaagcucugcuc

SEQ ID NO: 1713517 - RNA, 19 nt, Human
auucccaagcucugcuccu

SEQ ID NO: 1713518 - RNA, 18 nt, Human
auucccaagcucugcucc

SEQ ID NO: 1713519 - RNA, 20 nt, Human
auuccccaggaggccagccu

SEQ ID NO: 1713520 - RNA, 22 nt, Human
auuccccaggaggccagccuug

SEQ ID NO: 1713521 - RNA, 14 nt, Human
auucagccuggcuu

SEQ ID NO: 1713522 - RNA, 15 nt, Human
auucagccuggcuuc

SEQ ID NO: 1713523 - RNA, 21 nt, Human
uuuugugaaguuuaauugacu

SEQ ID NO: 1713524 - RNA, 16 nt, Human
uuuuguuuuugucuua

SEQ ID NO: 1713525 - RNA, 15 nt, Human
uuuuugaagcuguau

SEQ ID NO: 1713526 - RNA, 15 nt, Human
uuuuuggaagugaaa

SEQ ID NO: 1713527 - RNA, 19 nt, Human
uuuuuggaagugaaaacuu

SEQ ID NO: 1713528 - RNA, 22 nt, Human
uuuuugggaaaagaaaagucaa

SEQ ID NO: 1713529 - RNA, 19 nt, Human
auuaaguacuauguaucaa

SEQ ID NO: 1713530 - RNA, 18 nt, Human
auuaaguacuauguauca

SEQ ID NO: 1713531 - RNA, 13 nt, Human
auuaaggaagaca

SEQ ID NO: 1713532 - RNA, 11 nt, Human
uuuuuguauuu

SEQ ID NO: 1713533 - RNA, 13 nt, Human
auuaaguuguuaa

SEQ ID NO: 1713534 - RNA, 13 nt, Human
auuacuucugcua

SEQ ID NO: 1713535 - RNA, 14 nt, Human
auuacuucugcuac

SEQ ID NO: 1713536 - RNA, 13 nt, Human
auuagagaagaga

SEQ ID NO: 1713537 - RNA, 12 nt, Human
auugcaccacug

SEQ ID NO: 1713538 - RNA, 19 nt, Human
auugcaacaggcugggcuu

SEQ ID NO: 1713539 - RNA, 18 nt, Human
auugcaacaggcugggcu

SEQ ID NO: 1713540 - RNA, 17 nt, Human
auugcaacaggcugggc

SEQ ID NO: 1713541 - RNA, 23 nt, Human
auuggcuagagguucaaagauau

SEQ ID NO: 1713542 - RNA, 19 nt, Human
auuggcuagagguucaaag

SEQ ID NO: 1713543 - RNA, 20 nt, Human
auuggcuagagguucaaaga

SEQ ID NO: 1713544 - RNA, 22 nt, Human
auuggcuagagguucaaagaua

SEQ ID NO: 1713545 - RNA, 16 nt, Human
auugcauuuccugaca

SEQ ID NO: 1713546 - RNA, 23 nt, Human
auuuauaaaaauaaaaaacacug

SEQ ID NO: 1713547 - RNA, 17 nt, Human
auuuaguguucauaaau

SEQ ID NO: 1713548 - RNA, 20 nt, Human
auuuacuucuuauacauuug

SEQ ID NO: 1713549 - RNA, 19 nt, Human
auuuacuucuuauacauuu

SEQ ID NO: 1713550 - RNA, 16 nt, Human
auuuaguguucauaaa

SEQ ID NO: 1713551 - RNA, 15 nt, Human
auuuauaaacuuuuu

SEQ ID NO: 1713552 - RNA, 16 nt, Human
auuguaguccuguaau

SEQ ID NO: 1713553 - RNA, 17 nt, Human
auuguuuucaguguaca

SEQ ID NO: 1713554 - RNA, 17 nt, Human
auuuaaaaaaaaaccug

SEQ ID NO: 1713555 - RNA, 19 nt, Human
auuguuuucaguguacaug

SEQ ID NO: 1713556 - RNA, 18 nt, Human
auuguuuucaguguacau

SEQ ID NO: 1713557 - RNA, 14 nt, Human
auuuaaaaaaaauc

SEQ ID NO: 1713558 - RNA, 21 nt, Human
auuuccuaaauauauuuuaag

SEQ ID NO: 1713559 - RNA, 16 nt, Human
auuucccaaagcagug

SEQ ID NO: 1713560 - RNA, 14 nt, Human
auuucccaaagcag

SEQ ID NO: 1713561 - RNA, 17 nt, Human
auuuccguuaaaauacc

SEQ ID NO: 1713562 - RNA, 14 nt, Human
auuuccuaaauaua

SEQ ID NO: 1713563 - RNA, 21 nt, Human
auuuggugguuucagaaaugu

SEQ ID NO: 1713564 - RNA, 21 nt, Human
auuugaggucuguucuuucca

SEQ ID NO: 1713565 - RNA, 22 nt, Human
auuugaggucuguucuuuccaa

SEQ ID NO: 1713566 - RNA, 16 nt, Human
auuugagcagggcuca

SEQ ID NO: 1713567 - RNA, 15 nt, Human
auuugagcagggcuc

SEQ ID NO: 1713568 - RNA, 17 nt, Human
auuugaggucuguucuu

SEQ ID NO: 1713569 - RNA, 18 nt, Human
auuugaggucuguucuuu

SEQ ID NO: 1713570 - RNA, 16 nt, Human
auuucuuccacaagag

SEQ ID NO: 1713571 - RNA, 23 nt, Human
augcacuuuguucuggcucuucc

SEQ ID NO: 1713572 - RNA, 18 nt, Human
uuuaaaaaaauuccaagu

SEQ ID NO: 1713573 - RNA, 18 nt, Human
augcagagguccacaaca

SEQ ID NO: 1713574 - RNA, 17 nt, Human
augcagagguccacaac

SEQ ID NO: 1713575 - RNA, 21 nt, Human
augcacuuuguucuggcucuu

SEQ ID NO: 1713576 - RNA, 13 nt, Human
augauuucauuca

SEQ ID NO: 1713577 - RNA, 17 nt, Human
uuguucuugguuuguaa

SEQ ID NO: 1713578 - RNA, 19 nt, Human
uuguucuugguuuguaaau

SEQ ID NO: 1713579 - RNA, 20 nt, Human
uuguucuugguuuguaaauu

SEQ ID NO: 1713580 - RNA, 17 nt, Human
augauuuaauuugaaau

SEQ ID NO: 1713581 - RNA, 21 nt, Human
uuuaaauauaugcuaagucuu

SEQ ID NO: 1713582 - RNA, 13 nt, Human
uuuaaaugaaagu

SEQ ID NO: 1713583 - RNA, 21 nt, Human
uuuaaaugaaagugagacuuu

SEQ ID NO: 1713584 - RNA, 11 nt, Human
uuuaaaugcac

SEQ ID NO: 1713585 - RNA, 21 nt, Human
uuuaaaaaauuaaucugggcc

SEQ ID NO: 1713586 - RNA, 23 nt, Human
uuuaaaaauacagauagauauau

SEQ ID NO: 1713587 - RNA, 16 nt, Human
uuuaaugaaagacugu

SEQ ID NO: 1713588 - RNA, 22 nt, Human
uuuaaggguuuguggaaaauga

SEQ ID NO: 1713589 - RNA, 20 nt, Human
uuuaaggguuuguggaaaau

SEQ ID NO: 1713590 - RNA, 17 nt, Human
uuuaaggguuuguggaa

SEQ ID NO: 1713591 - RNA, 20 nt, Human
uuuaaggaugcuuguacaua

SEQ ID NO: 1713592 - RNA, 21 nt, Human
uuuaaggaugcuuguacauaa

SEQ ID NO: 1713593 - RNA, 22 nt, Human
uuuaaggaugcuuguacauaau

SEQ ID NO: 1713594 - RNA, 21 nt, Human
uuuaagcuguuacugucuuca

SEQ ID NO: 1713595 - RNA, 19 nt, Human
uuuaaggaugcuuguacau

SEQ ID NO: 1713596 - RNA, 12 nt, Human
uuuaagagaaau

SEQ ID NO: 1713597 - RNA, 14 nt, Human
uuuaagaggcaggg

SEQ ID NO: 1713598 - RNA, 14 nt, Human
uuuaagagacagcc

SEQ ID NO: 1713599 - RNA, 23 nt, Human
augaguccccuguuuguuucuga

SEQ ID NO: 1713600 - RNA, 13 nt, Human
augaguccccugu

SEQ ID NO: 1713601 - RNA, 21 nt, Human
uugucauauaagauucauauu

SEQ ID NO: 1713602 - RNA, 17 nt, Human
uugucacacacuuuggc

SEQ ID NO: 1713603 - RNA, 17 nt, Human
augagguacugagagug

SEQ ID NO: 1713604 - RNA, 18 nt, Human
augagguacugagaguga

SEQ ID NO: 1713605 - RNA, 15 nt, Human
augagguacugagag

SEQ ID NO: 1713606 - RNA, 18 nt, Human
augaggucagagccugca

SEQ ID NO: 1713607 - RNA, 16 nt, Human
augaggucagagccug

SEQ ID NO: 1713608 - RNA, 15 nt, Human
augaggucagagccu

SEQ ID NO: 1713609 - RNA, 21 nt, Human
augagguacaaccuguucugc

SEQ ID NO: 1713610 - RNA, 20 nt, Human
augaggucagagccugcagu

SEQ ID NO: 1713611 - RNA, 19 nt, Human
augaggucagagccugcag

SEQ ID NO: 1713612 - RNA, 22 nt, Human
augaggucagagccugcaguua

SEQ ID NO: 1713613 - RNA, 22 nt, Human
uugugaugucccaacuuguaaa

SEQ ID NO: 1713614 - RNA, 18 nt, Human
uugugaugucccaacuug

SEQ ID NO: 1713615 - RNA, 20 nt, Human
uuguccccaccgcagacagg

SEQ ID NO: 1713616 - RNA, 18 nt, Human
uuguccccaccgcagaca

SEQ ID NO: 1713617 - RNA, 16 nt, Human
uuguccccgacccuug

SEQ ID NO: 1713618 - RNA, 15 nt, Human
uuguccccgacccuu

SEQ ID NO: 1713619 - RNA, 18 nt, Human
uugugaggaagccgcugg

SEQ ID NO: 1713620 - RNA, 17 nt, Human
uugugaggaagccgcug

SEQ ID NO: 1713621 - RNA, 20 nt, Human
uugugauacaaugcugugcc

SEQ ID NO: 1713622 - RNA, 13 nt, Human
uugugaggaagcc

SEQ ID NO: 1713623 - RNA, 11 nt, Human
uuucagaaaug

SEQ ID NO: 1713624 - RNA, 12 nt, Human
uuucagaaaugu

SEQ ID NO: 1713625 - RNA, 16 nt, Human
uuucccuauuagagaa

SEQ ID NO: 1713626 - RNA, 21 nt, Human
uuucagaaagaaguggggaca

SEQ ID NO: 1713627 - RNA, 12 nt, Human
uuucaaacuuua

SEQ ID NO: 1713628 - RNA, 15 nt, Human
uuucaaacuuuacua

SEQ ID NO: 1713629 - RNA, 20 nt, Human
augcuucucacugccaugcc

SEQ ID NO: 1713630 - RNA, 16 nt, Human
augcuucucacugcca

SEQ ID NO: 1713631 - RNA, 18 nt, Human
auggaagacagcucuuau

SEQ ID NO: 1713632 - RNA, 17 nt, Human
auggaagacagcucuua

SEQ ID NO: 1713633 - RNA, 14 nt, Human
auggaaggggcuga

SEQ ID NO: 1713634 - RNA, 20 nt, Human
augcuggcuguuggcugggg

SEQ ID NO: 1713635 - RNA, 19 nt, Human
augcuggcuguuggcuggg

SEQ ID NO: 1713636 - RNA, 18 nt, Human
augcuggcuguuggcugg

SEQ ID NO: 1713637 - RNA, 19 nt, Human
augcuccuggcccacugca

SEQ ID NO: 1713638 - RNA, 14 nt, Human
augcuccuggccca

SEQ ID NO: 1713639 - RNA, 14 nt, Human
uuuaucagaauucu

SEQ ID NO: 1713640 - RNA, 18 nt, Human
augcuacaggauuugaaa

SEQ ID NO: 1713641 - RNA, 22 nt, Human
augcgugcauaccacuuuuguu

SEQ ID NO: 1713642 - RNA, 12 nt, Human
augcgugugugu

SEQ ID NO: 1713643 - RNA, 17 nt, Human
augccucucucaggcca

SEQ ID NO: 1713644 - RNA, 13 nt, Human
augcgcaggcugg

SEQ ID NO: 1713645 - RNA, 22 nt, Human
augcgcaggcuggcccugcccu

SEQ ID NO: 1713646 - RNA, 20 nt, Human
augcgcaggcuggcccugcc

SEQ ID NO: 1713647 - RNA, 18 nt, Human
augcgcaggcuggcccug

SEQ ID NO: 1713648 - RNA, 14 nt, Human
augcgcaggcuggc

SEQ ID NO: 1713649 - RNA, 15 nt, Human
augccucucucaggc

SEQ ID NO: 1713650 - RNA, 14 nt, Human
augccucucucagg

SEQ ID NO: 1713651 - RNA, 13 nt, Human
augccucucucag

SEQ ID NO: 1713652 - RNA, 23 nt, Human
uuuaaugaaagacuguacaaagu

SEQ ID NO: 1713653 - RNA, 21 nt, Human
uuuaaugaaagacuguacaaa

SEQ ID NO: 1713654 - RNA, 16 nt, Human
augcccagccccuucu

SEQ ID NO: 1713655 - RNA, 21 nt, Human
augccaugaggaacaaggcaa

SEQ ID NO: 1713656 - RNA, 17 nt, Human
augcccagccccuucug

SEQ ID NO: 1713657 - RNA, 18 nt, Human
augccccgucccccucug

SEQ ID NO: 1713658 - RNA, 21 nt, Human
augccccgucccccucuggcu

SEQ ID NO: 1713659 - RNA, 15 nt, Human
uuuacuucuuauaca

SEQ ID NO: 1713660 - RNA, 14 nt, Human
uuuacuucuuauac

SEQ ID NO: 1713661 - RNA, 13 nt, Human
uuuacuucuuaua

SEQ ID NO: 1713662 - RNA, 11 nt, Human
uuuacuuaaac

SEQ ID NO: 1713663 - RNA, 16 nt, Human
uuuacugcagcuuugu

SEQ ID NO: 1713664 - RNA, 18 nt, Human
uuuaccugaagucuuugu

SEQ ID NO: 1713665 - RNA, 22 nt, Human
uuuaccugaagucuuuguacag

SEQ ID NO: 1713666 - RNA, 20 nt, Human
uuuacccuucuuuucugacu

SEQ ID NO: 1713667 - RNA, 16 nt, Human
augcgugugugugugu

SEQ ID NO: 1713668 - RNA, 16 nt, Human
aucuuauaauuuaaaa

SEQ ID NO: 1713669 - RNA, 14 nt, Human
aucuugcucugcug

SEQ ID NO: 1713670 - RNA, 15 nt, Human
aucuuauaauuuaaa

SEQ ID NO: 1713671 - RNA, 16 nt, Human
aucuugcucugcugac

SEQ ID NO: 1713672 - RNA, 15 nt, Human
aucuugcucugcuga

SEQ ID NO: 1713673 - RNA, 17 nt, Human
aucuugcucugcugaca

SEQ ID NO: 1713674 - RNA, 22 nt, Human
aucugucauuugagcagggcuc

SEQ ID NO: 1713675 - RNA, 17 nt, Human
aucugucauuugagcag

SEQ ID NO: 1713676 - RNA, 12 nt, Human
aucugucauuug

SEQ ID NO: 1713677 - RNA, 17 nt, Human
uuggaaaauaaauuauu

SEQ ID NO: 1713678 - RNA, 15 nt, Human
uuggaaaauaaauca

SEQ ID NO: 1713679 - RNA, 12 nt, Human
uuggaaaauaaa

SEQ ID NO: 1713680 - RNA, 20 nt, Human
uugcuuugugauuuuuguaa

SEQ ID NO: 1713681 - RNA, 16 nt, Human
uugcuuuguaugcacu

SEQ ID NO: 1713682 - RNA, 16 nt, Human
uugcuuuuaaaaucca

SEQ ID NO: 1713683 - RNA, 18 nt, Human
uugcucuugaugccuggc

SEQ ID NO: 1713684 - RNA, 17 nt, Human
uugcucuugaugccugg

SEQ ID NO: 1713685 - RNA, 14 nt, Human
uugcucuugaugcc

SEQ ID NO: 1713686 - RNA, 15 nt, Human
uugcuuugugauuuu

SEQ ID NO: 1713687 - RNA, 13 nt, Human
uugcuuuguaugc

SEQ ID NO: 1713688 - RNA, 17 nt, Human
uugcuuuggaaguuuua

SEQ ID NO: 1713689 - RNA, 23 nt, Human
augaaccacaucuugcucugcug

SEQ ID NO: 1713690 - RNA, 16 nt, Human
augaaagugagacuuu

SEQ ID NO: 1713691 - RNA, 17 nt, Human
augaaugaaacauuuug

SEQ ID NO: 1713692 - RNA, 15 nt, Human
augaagcaaugcuuc

SEQ ID NO: 1713693 - RNA, 14 nt, Human
augaagcaaugcuu

SEQ ID NO: 1713694 - RNA, 18 nt, Human
augaaugucagugugacu

SEQ ID NO: 1713695 - RNA, 16 nt, Human
augaaugucaguguga

SEQ ID NO: 1713696 - RNA, 18 nt, Human
uuggugguuucagaaaug

SEQ ID NO: 1713697 - RNA, 19 nt, Human
uuggugguuucagaaaugu

SEQ ID NO: 1713698 - RNA, 19 nt, Human
uuggugucgggcaugacac

SEQ ID NO: 1713699 - RNA, 18 nt, Human
uuggugucgggcaugaca

SEQ ID NO: 1713700 - RNA, 17 nt, Human
uuggugucgggcaugac

SEQ ID NO: 1713701 - RNA, 14 nt, Human
uugguuuguaaauu

SEQ ID NO: 1713702 - RNA, 13 nt, Human
uuguaaauuguca

SEQ ID NO: 1713703 - RNA, 14 nt, Human
uuguaaauuucucu

SEQ ID NO: 1713704 - RNA, 12 nt, Human
uuguaaugaaaa

SEQ ID NO: 1713705 - RNA, 22 nt, Human
uuguaagcaugcacaaauucug

SEQ ID NO: 1713706 - RNA, 14 nt, Human
uuguaauauguaaa

SEQ ID NO: 1713707 - RNA, 15 nt, Human
uuguaauauguaaau

SEQ ID NO: 1713708 - RNA, 15 nt, Human
uuguaauaauaaaga

SEQ ID NO: 1713709 - RNA, 12 nt, Human
aucugaaaaugu

SEQ ID NO: 1713710 - RNA, 16 nt, Human
aucucuuguuuaaauu

SEQ ID NO: 1713711 - RNA, 22 nt, Human
aucucuuuguucuaaagaugga

SEQ ID NO: 1713712 - RNA, 23 nt, Human
aucucacacaugagcaucaggcc

SEQ ID NO: 1713713 - RNA, 16 nt, Human
aucucaaauuucuaaa

SEQ ID NO: 1713714 - RNA, 17 nt, Human
aucucaaauuucuaaau

SEQ ID NO: 1713715 - RNA, 23 nt, Human
uugauguucuuucacccuuuucu

SEQ ID NO: 1713716 - RNA, 18 nt, Human
uugcaacuuuguauaaaa

SEQ ID NO: 1713717 - RNA, 17 nt, Human
uugcaacuuuguauaaa

SEQ ID NO: 1713718 - RNA, 16 nt, Human
uugcaacuuuguauaa

SEQ ID NO: 1713719 - RNA, 15 nt, Human
uugauuaaauucuug

SEQ ID NO: 1713720 - RNA, 16 nt, Human
uugauuaaauucuugc

SEQ ID NO: 1713721 - RNA, 20 nt, Human
uugauuaaauucuugcaaag

SEQ ID NO: 1713722 - RNA, 21 nt, Human
uugauuaaauucuugcaaagu

SEQ ID NO: 1713723 - RNA, 23 nt, Human
uugcccaggcuggcgugcagugg

SEQ ID NO: 1713724 - RNA, 14 nt, Human
uugcccaggcuggc

SEQ ID NO: 1713725 - RNA, 12 nt, Human
uugcccaggcug

SEQ ID NO: 1713726 - RNA, 11 nt, Human
uugcccaggcu

SEQ ID NO: 1713727 - RNA, 18 nt, Human
uugcccaggcaggucuug

SEQ ID NO: 1713728 - RNA, 16 nt, Human
uugcccaggcaggucu

SEQ ID NO: 1713729 - RNA, 14 nt, Human
uugcccaggcaggu

SEQ ID NO: 1713730 - RNA, 13 nt, Human
uugcccaggcagg

SEQ ID NO: 1713731 - RNA, 14 nt, Human
uugcaauggcagcc

SEQ ID NO: 1713732 - RNA, 22 nt, Human
uugcaauagaaauccaauugga

SEQ ID NO: 1713733 - RNA, 15 nt, Human
uugcaauagaaaucc

SEQ ID NO: 1713734 - RNA, 21 nt, Human
uugcaccacugcacuccagcc

SEQ ID NO: 1713735 - RNA, 14 nt, Human
uugcaugaggcuag

SEQ ID NO: 1713736 - RNA, 16 nt, Human
uugacaucaacugcau

SEQ ID NO: 1713737 - RNA, 19 nt, Human
uugacagggcacaccgggc

SEQ ID NO: 1713738 - RNA, 12 nt, Human
uugacagggcac

SEQ ID NO: 1713739 - RNA, 10 nt, Human
uugacagggc

SEQ ID NO: 1713740 - RNA, 19 nt, Human
uugacaggauuauuggaaa

SEQ ID NO: 1713741 - RNA, 17 nt, Human
uugaccauucuccaccu

SEQ ID NO: 1713742 - RNA, 11 nt, Human
uugagacagag

SEQ ID NO: 1713743 - RNA, 10 nt, Human
uugagacaga

SEQ ID NO: 1713744 - RNA, 12 nt, Human
uugagcagggcu

SEQ ID NO: 1713745 - RNA, 16 nt, Human
uugagcagggcucagc

SEQ ID NO: 1713746 - RNA, 21 nt, Human
aucucaaauaacuaaaaggua

SEQ ID NO: 1713747 - RNA, 14 nt, Human
aucucaaauaacua

SEQ ID NO: 1713748 - RNA, 23 nt, Human
aucucaaauaacuaaaagguaug

SEQ ID NO: 1713749 - RNA, 14 nt, Human
aucucaaauuucua

SEQ ID NO: 1713750 - RNA, 19 nt, Human
aucuaggaagacuuuggaa

SEQ ID NO: 1713751 - RNA, 18 nt, Human
aucuaggaagacuuugga

SEQ ID NO: 1713752 - RNA, 17 nt, Human
aucuaggaagacuuugg

SEQ ID NO: 1713753 - RNA, 19 nt, Human
aucuagauacuguaucaug

SEQ ID NO: 1713754 - RNA, 21 nt, Human
uugagugcugucuccauguuu

SEQ ID NO: 1713755 - RNA, 11 nt, Human
uugagugccuu

SEQ ID NO: 1713756 - RNA, 17 nt, Human
uugauacuacaguuugu

SEQ ID NO: 1713757 - RNA, 18 nt, Human
uugauagcacagacccug

SEQ ID NO: 1713758 - RNA, 18 nt, Human
aucuagauacuguaucau

SEQ ID NO: 1713759 - RNA, 23 nt, Human
aucuaauauguaacaagccaccc

SEQ ID NO: 1713760 - RNA, 18 nt, Human
auauauucagccuggcuu

SEQ ID NO: 1713761 - RNA, 21 nt, Human
uucauauuuuaaacagaggau

SEQ ID NO: 1713762 - RNA, 17 nt, Human
uucauauuuuaaacaga

SEQ ID NO: 1713763 - RNA, 21 nt, Human
uucaucauccuaagcuauuca

SEQ ID NO: 1713764 - RNA, 18 nt, Human
uucaucauccuaagcuau

SEQ ID NO: 1713765 - RNA, 21 nt, Human
uucauauuuacuucuuauaca

SEQ ID NO: 1713766 - RNA, 16 nt, Human
uucauauuuacuucuu

SEQ ID NO: 1713767 - RNA, 14 nt, Human
uucaguaauaacuc

SEQ ID NO: 1713768 - RNA, 22 nt, Human
auaucugaaaauguauguguaa

SEQ ID NO: 1713769 - RNA, 20 nt, Human
auaugauuuaaaucagccgu

SEQ ID NO: 1713770 - RNA, 13 nt, Human
auaugcacacauu

SEQ ID NO: 1713771 - RNA, 14 nt, Human
auaugucaagccau

SEQ ID NO: 1713772 - RNA, 19 nt, Human
uucacugcuggcugccuua

SEQ ID NO: 1713773 - RNA, 18 nt, Human
uucacugcuggcugccuu

SEQ ID NO: 1713774 - RNA, 17 nt, Human
uucacugcuggcugccu

SEQ ID NO: 1713775 - RNA, 16 nt, Human
uucacugcuggcugcc

SEQ ID NO: 1713776 - RNA, 15 nt, Human
uucacugcuggcugc

SEQ ID NO: 1713777 - RNA, 13 nt, Human
uucacugcuggcu

SEQ ID NO: 1713778 - RNA, 15 nt, Human
uucagaaagaagugg

SEQ ID NO: 1713779 - RNA, 17 nt, Human
uucagaucucuaacuuc

SEQ ID NO: 1713780 - RNA, 19 nt, Human
uucagccaagaauucuuaa

SEQ ID NO: 1713781 - RNA, 22 nt, Human
uucagcaccuacaguguacagu

SEQ ID NO: 1713782 - RNA, 23 nt, Human
uucagcaccuacaguguacaguc

SEQ ID NO: 1713783 - RNA, 17 nt, Human
auauaaauuuuuuuugu

SEQ ID NO: 1713784 - RNA, 22 nt, Human
auauaaauuuuuuuuguuucau

SEQ ID NO: 1713785 - RNA, 16 nt, Human
uucaaaauuguuacaa

SEQ ID NO: 1713786 - RNA, 15 nt, Human
uucaaggauccugag

SEQ ID NO: 1713787 - RNA, 21 nt, Human
uucaaggauccugagccagau

SEQ ID NO: 1713788 - RNA, 19 nt, Human
uucaaggauccugagccag

SEQ ID NO: 1713789 - RNA, 18 nt, Human
uucaaggauccugagcca

SEQ ID NO: 1713790 - RNA, 16 nt, Human
uucaaggauccugagc

SEQ ID NO: 1713791 - RNA, 22 nt, Human
uucaagugauucucaugccuca

SEQ ID NO: 1713792 - RNA, 20 nt, Human
uucaagugauucucaugccu

SEQ ID NO: 1713793 - RNA, 20 nt, Human
uucaagugauucuccugccu

SEQ ID NO: 1713794 - RNA, 22 nt, Human
auaggaauugacccacaagaaa

SEQ ID NO: 1713795 - RNA, 17 nt, Human
auaggcacaggaaacca

SEQ ID NO: 1713796 - RNA, 22 nt, Human
auaggcaccuaccaccacgccc

SEQ ID NO: 1713797 - RNA, 21 nt, Human
auaggaauugacccacaagaa

SEQ ID NO: 1713798 - RNA, 19 nt, Human
auaggaacuuaaauaaugu

SEQ ID NO: 1713799 - RNA, 22 nt, Human
uucaccauguuggccaggcugg

SEQ ID NO: 1713800 - RNA, 22 nt, Human
uucaccauguuggccaggcugc

SEQ ID NO: 1713801 - RNA, 22 nt, Human
auagcuuacaagccagcuggag

SEQ ID NO: 1713802 - RNA, 17 nt, Human
uucacauauugauuucc

SEQ ID NO: 1713803 - RNA, 19 nt, Human
uucacauuguauucagagu

SEQ ID NO: 1713804 - RNA, 22 nt, Human
uucaccacaugugcacaugcac

SEQ ID NO: 1713805 - RNA, 13 nt, Human
uucacaguucucu

SEQ ID NO: 1713806 - RNA, 14 nt, Human
auagcuacuaauuu

SEQ ID NO: 1713807 - RNA, 17 nt, Human
auagcuacuaauuuuaa

SEQ ID NO: 1713808 - RNA, 20 nt, Human
auagcgucauaacuagaacu

SEQ ID NO: 1713809 - RNA, 18 nt, Human
auagcgucauaacuagaa

SEQ ID NO: 1713810 - RNA, 17 nt, Human
auaagauaaaugugcug

SEQ ID NO: 1713811 - RNA, 13 nt, Human
auaagauaaaugu

SEQ ID NO: 1713812 - RNA, 18 nt, Human
auagccugccucuucucu

SEQ ID NO: 1713813 - RNA, 12 nt, Human
auagcugggacu

SEQ ID NO: 1713814 - RNA, 21 nt, Human
auagcucaggugucccugcac

SEQ ID NO: 1713815 - RNA, 20 nt, Human
auagcucaggugucccugca

SEQ ID NO: 1713816 - RNA, 22 nt, Human
auagcucaggugucccugcacu

SEQ ID NO: 1713817 - RNA, 18 nt, Human
auagcuacuaauuuuaaa

SEQ ID NO: 1713818 - RNA, 19 nt, Human
auagcucaggugucccugc

SEQ ID NO: 1713819 - RNA, 15 nt, Human
uuauuuaguauuuau

SEQ ID NO: 1713820 - RNA, 16 nt, Human
uuauuuaguuccuuga

SEQ ID NO: 1713821 - RNA, 17 nt, Human
uuauuuagcaccaggga

SEQ ID NO: 1713822 - RNA, 17 nt, Human
auagcugggacuacagg

SEQ ID NO: 1713823 - RNA, 22 nt, Human
auagcuggucuuauuuguaaag

SEQ ID NO: 1713824 - RNA, 23 nt, Human
auagcuggucuuauuuguaaagc

SEQ ID NO: 1713825 - RNA, 14 nt, Human
uuauuuaaauuuua

SEQ ID NO: 1713826 - RNA, 22 nt, Human
uuauuuaaugaaagacuguaca

SEQ ID NO: 1713827 - RNA, 18 nt, Human
uuauuuaaugaaagacug

SEQ ID NO: 1713828 - RNA, 16 nt, Human
aucccauaugccuggg

SEQ ID NO: 1713829 - RNA, 17 nt, Human
aucccauaugccugggc

SEQ ID NO: 1713830 - RNA, 16 nt, Human
auccagguucagcuug

SEQ ID NO: 1713831 - RNA, 15 nt, Human
auccagguucagcuu

SEQ ID NO: 1713832 - RNA, 17 nt, Human
auccaggguggugguga

SEQ ID NO: 1713833 - RNA, 17 nt, Human
aucccaggauguacaag

SEQ ID NO: 1713834 - RNA, 15 nt, Human
uucugaaagggacgc

SEQ ID NO: 1713835 - RNA, 19 nt, Human
aucauugaaaucuuuuugc

SEQ ID NO: 1713836 - RNA, 20 nt, Human
aucauugaaaucuuuuugcu

SEQ ID NO: 1713837 - RNA, 22 nt, Human
uucugggacacaguucaauucu

SEQ ID NO: 1713838 - RNA, 11 nt, Human
uucugggacac

SEQ ID NO: 1713839 - RNA, 10 nt, Human
uucugggaca

SEQ ID NO: 1713840 - RNA, 23 nt, Human
uucugccgcagcccugcagaggg

SEQ ID NO: 1713841 - RNA, 14 nt, Human
aucauucauuuucu

SEQ ID NO: 1713842 - RNA, 22 nt, Human
aucauuaaagccugaguuugcu

SEQ ID NO: 1713843 - RNA, 15 nt, Human
aucauugaaaucuuu

SEQ ID NO: 1713844 - RNA, 14 nt, Human
aucauugaaaucuu

SEQ ID NO: 1713845 - RNA, 23 nt, Human
aucauaguggcuuaaaacaacac

SEQ ID NO: 1713846 - RNA, 15 nt, Human
aucagcacgauuucu

SEQ ID NO: 1713847 - RNA, 16 nt, Human
aucagcacgauuucug

SEQ ID NO: 1713848 - RNA, 17 nt, Human
aucagcacgauuucugu

SEQ ID NO: 1713849 - RNA, 18 nt, Human
aucagcacgauuucuguu

SEQ ID NO: 1713850 - RNA, 13 nt, Human
uucuaggccuggg

SEQ ID NO: 1713851 - RNA, 23 nt, Human
uucucagaaucucaaauaacuaa

SEQ ID NO: 1713852 - RNA, 22 nt, Human
uucucagaaucucaaauaacua

SEQ ID NO: 1713853 - RNA, 19 nt, Human
uucucagaaucucaaauaa

SEQ ID NO: 1713854 - RNA, 21 nt, Human
auauugcugauggugcaauga

SEQ ID NO: 1713855 - RNA, 17 nt, Human
auauugcugauggugca

SEQ ID NO: 1713856 - RNA, 17 nt, Human
auauugccauuaugcuu

SEQ ID NO: 1713857 - RNA, 20 nt, Human
auauuguuuucaguguacau

SEQ ID NO: 1713858 - RNA, 20 nt, Human
auauuuguauuuaaaugaaa

SEQ ID NO: 1713859 - RNA, 14 nt, Human
auauuuuaaacaga

SEQ ID NO: 1713860 - RNA, 22 nt, Human
auauuaaggaagacaaugugaa

SEQ ID NO: 1713861 - RNA, 24 nt, Human
auauuaagaaagacuaucuaaaug

SEQ ID NO: 1713862 - RNA, 18 nt, Human
auauguuuuaagaggcag

SEQ ID NO: 1713863 - RNA, 20 nt, Human
auauguuuuaagaggcaggg

SEQ ID NO: 1713864 - RNA, 19 nt, Human
auauugauuuccguuaaaa

SEQ ID NO: 1713865 - RNA, 13 nt, Human
auauugaugugug

SEQ ID NO: 1713866 - RNA, 21 nt, Human
auauugauuuccguuaaaaua

SEQ ID NO: 1713867 - RNA, 22 nt, Human
auauugauuuccguuaaaauac

SEQ ID NO: 1713868 - RNA, 22 nt, Human
auauugauccagaaagaaaacu

SEQ ID NO: 1713869 - RNA, 15 nt, Human
auauugauccagaaa

SEQ ID NO: 1713870 - RNA, 16 nt, Human
auauucuguuggccag

SEQ ID NO: 1713871 - RNA, 21 nt, Human
aucaagaugugacauguuuua

SEQ ID NO: 1713872 - RNA, 13 nt, Human
aucaaguauuaua

SEQ ID NO: 1713873 - RNA, 14 nt, Human
aucaaguauuauac

SEQ ID NO: 1713874 - RNA, 18 nt, Human
aucaaguauuauaccuuu

SEQ ID NO: 1713875 - RNA, 22 nt, Human
aucacggcucacugcagccuca

SEQ ID NO: 1713876 - RNA, 14 nt, Human
aucacguaaagcua

SEQ ID NO: 1713877 - RNA, 21 nt, Human
aucacguaaagcuagaaauga

SEQ ID NO: 1713878 - RNA, 20 nt, Human
uuccuuuuaaaacacuucca

SEQ ID NO: 1713879 - RNA, 22 nt, Human
uuccuuuuaaaacacuuccaua

SEQ ID NO: 1713880 - RNA, 21 nt, Human
uuccuuuuaaaacacuuccau

SEQ ID NO: 1713881 - RNA, 14 nt, Human
auauuuuaagacga

SEQ ID NO: 1713882 - RNA, 15 nt, Human
uuccuaauccucuag

SEQ ID NO: 1713883 - RNA, 13 nt, Human
uuccuaauccucu

SEQ ID NO: 1713884 - RNA, 17 nt, Human
uuccuaauccucuagga

SEQ ID NO: 1713885 - RNA, 17 nt, Human
uuccuguucccaugaga

SEQ ID NO: 1713886 - RNA, 11 nt, Human
uuccucuuucc

SEQ ID NO: 1713887 - RNA, 14 nt, Human
uuccuucagugccu

SEQ ID NO: 1713888 - RNA, 11 nt, Human
uuccuucagug

SEQ ID NO: 1713889 - RNA, 17 nt, Human
uuccuguugucaagaau

SEQ ID NO: 1713890 - RNA, 20 nt, Human
uuccuguucuuaagacguga

SEQ ID NO: 1713891 - RNA, 15 nt, Human
uuccuucagugccuu

SEQ ID NO: 1713892 - RNA, 20 nt, Human
auauuuucaacgcagcccug

SEQ ID NO: 1713893 - RNA, 19 nt, Human
auauuuucaacgcagcccu

SEQ ID NO: 1713894 - RNA, 15 nt, Human
agugaaagaaaauaa

SEQ ID NO: 1713895 - RNA, 16 nt, Human
agugaacaaauuuaca

SEQ ID NO: 1713896 - RNA, 20 nt, Human
agugaacaaauuuacagaga

SEQ ID NO: 1713897 - RNA, 20 nt, Human
ugugauggggcccugccucc

SEQ ID NO: 1713898 - RNA, 19 nt, Human
ugugauggggcccugccuc

SEQ ID NO: 1713899 - RNA, 18 nt, Human
ugugaugagaggaaauca

SEQ ID NO: 1713900 - RNA, 18 nt, Human
ugugccagauuuaugcau

SEQ ID NO: 1713901 - RNA, 16 nt, Human
ugugccaugugccagg

SEQ ID NO: 1713902 - RNA, 12 nt, Human
ugugccaugugc

SEQ ID NO: 1713903 - RNA, 20 nt, Human
ugugccagguuuuuggucug

SEQ ID NO: 1713904 - RNA, 20 nt, Human
ugugccagauuuaugcauau

SEQ ID NO: 1713905 - RNA, 17 nt, Human
uguggaguucaucuuga

SEQ ID NO: 1713906 - RNA, 21 nt, Human
uguggaguucaucuugaauug

SEQ ID NO: 1713907 - RNA, 21 nt, Human
ugugcccccauguaagcaccc

SEQ ID NO: 1713908 - RNA, 21 nt, Human
agugaguugauagcacagacc

SEQ ID NO: 1713909 - RNA, 15 nt, Human
agugagucgaggaca

SEQ ID NO: 1713910 - RNA, 20 nt, Human
agugaggcucugcccuuggu

SEQ ID NO: 1713911 - RNA, 19 nt, Human
agugaggcucugcccuugg

SEQ ID NO: 1713912 - RNA, 21 nt, Human
agugaggcucugcccuugguu

SEQ ID NO: 1713913 - RNA, 14 nt, Human
agugagggauuauc

SEQ ID NO: 1713914 - RNA, 17 nt, Human
agugaggcucugcccuu

SEQ ID NO: 1713915 - RNA, 16 nt, Human
agugaggcucugcccu

SEQ ID NO: 1713916 - RNA, 14 nt, Human
agugaggcucugcc

SEQ ID NO: 1713917 - RNA, 15 nt, Human
agugaggcucugccc

SEQ ID NO: 1713918 - RNA, 18 nt, Human
uguggccaaguucuuagu

SEQ ID NO: 1713919 - RNA, 21 nt, Human
ugugaaccaccacacccagcc

SEQ ID NO: 1713920 - RNA, 20 nt, Human
ugugaaccaccacacccagc

SEQ ID NO: 1713921 - RNA, 19 nt, Human
ugugaaccaccacacccag

SEQ ID NO: 1713922 - RNA, 14 nt, Human
ugugaagagaacca

SEQ ID NO: 1713923 - RNA, 21 nt, Human
ugugaaaggaaagagggaggu

SEQ ID NO: 1713924 - RNA, 18 nt, Human
ugugaaaggaaagaggcu

SEQ ID NO: 1713925 - RNA, 15 nt, Human
ugugaaaggaaagag

SEQ ID NO: 1713926 - RNA, 12 nt, Human
ugugaaauuauu

SEQ ID NO: 1713927 - RNA, 18 nt, Human
ugucuuguguuucuuuag

SEQ ID NO: 1713928 - RNA, 15 nt, Human
ugucuuguguuucuu

SEQ ID NO: 1713929 - RNA, 14 nt, Human
agucuuuguacaga

SEQ ID NO: 1713930 - RNA, 22 nt, Human
agucuuguauuaaguuguuaau

SEQ ID NO: 1713931 - RNA, 15 nt, Human
agucuuggcucacug

SEQ ID NO: 1713932 - RNA, 16 nt, Human
agucuuguauuaaguu

SEQ ID NO: 1713933 - RNA, 18 nt, Human
agucuuguauuaaguugu

SEQ ID NO: 1713934 - RNA, 17 nt, Human
agucucuucuccacugg

SEQ ID NO: 1713935 - RNA, 18 nt, Human
agucucuucuccacugga

SEQ ID NO: 1713936 - RNA, 16 nt, Human
agucucuucuccacug

SEQ ID NO: 1713937 - RNA, 15 nt, Human
agucucuucuccacu

SEQ ID NO: 1713938 - RNA, 15 nt, Human
ugugagaugcuagaa

SEQ ID NO: 1713939 - RNA, 19 nt, Human
ugugagaugcuagaacucc

SEQ ID NO: 1713940 - RNA, 22 nt, Human
ugugagaugcuagaacucccuu

SEQ ID NO: 1713941 - RNA, 16 nt, Human
ugugacugaauuucuu

SEQ ID NO: 1713942 - RNA, 15 nt, Human
ugugacugaauuucu

SEQ ID NO: 1713943 - RNA, 14 nt, Human
agucucuucuccac

SEQ ID NO: 1713944 - RNA, 13 nt, Human
agucucuucucca

SEQ ID NO: 1713945 - RNA, 16 nt, Human
uguggucccaccccac

SEQ ID NO: 1713946 - RNA, 15 nt, Human
uguggucccacccca

SEQ ID NO: 1713947 - RNA, 13 nt, Human
uguggucccaccc

SEQ ID NO: 1713948 - RNA, 16 nt, Human
ugugguguuuccuggc

SEQ ID NO: 1713949 - RNA, 14 nt, Human
ugugguguuuccug

SEQ ID NO: 1713950 - RNA, 20 nt, Human
ugugguguuuccuggcacug

SEQ ID NO: 1713951 - RNA, 20 nt, Human
uguggucacaggaaguagag

SEQ ID NO: 1713952 - RNA, 23 nt, Human
uguggguuucuaaagcugccagc

SEQ ID NO: 1713953 - RNA, 21 nt, Human
uguggguuucuaaagcugcca

SEQ ID NO: 1713954 - RNA, 23 nt, Human
agugaguugauagcacagacccu

SEQ ID NO: 1713955 - RNA, 22 nt, Human
agugaguugauagcacagaccc

SEQ ID NO: 1713956 - RNA, 12 nt, Human
agugcugcauuu

SEQ ID NO: 1713957 - RNA, 13 nt, Human
agugcugcauuua

SEQ ID NO: 1713958 - RNA, 21 nt, Human
agugcugggauuacaggugug

SEQ ID NO: 1713959 - RNA, 16 nt, Human
agugcugcauuuaaaa

SEQ ID NO: 1713960 - RNA, 17 nt, Human
agugcugcauuuaaaag

SEQ ID NO: 1713961 - RNA, 20 nt, Human
agugcugggauuacaggugu

SEQ ID NO: 1713962 - RNA, 19 nt, Human
agugcugcauuuaaaagau

SEQ ID NO: 1713963 - RNA, 23 nt, Human
uguguguuuauugucaaaguggu

SEQ ID NO: 1713964 - RNA, 19 nt, Human
uguguguuuauugucaaag

SEQ ID NO: 1713965 - RNA, 11 nt, Human
ugugugugugc

SEQ ID NO: 1713966 - RNA, 17 nt, Human
uguguaagaaauacaga

SEQ ID NO: 1713967 - RNA, 20 nt, Human
ugugucucuugguccugcug

SEQ ID NO: 1713968 - RNA, 17 nt, Human
ugugucucuugguccug

SEQ ID NO: 1713969 - RNA, 22 nt, Human
ugugucucuugguccugcugca

SEQ ID NO: 1713970 - RNA, 21 nt, Human
ugugucucuugguccugcugc

SEQ ID NO: 1713971 - RNA, 21 nt, Human
ugugucuugcaauggcagccu

SEQ ID NO: 1713972 - RNA, 20 nt, Human
uguuccacaaguuaaauaaa

SEQ ID NO: 1713973 - RNA, 20 nt, Human
agugugucuuagugugugca

SEQ ID NO: 1713974 - RNA, 16 nt, Human
uguucugggacacagu

SEQ ID NO: 1713975 - RNA, 18 nt, Human
uguugcccaggcaggucu

SEQ ID NO: 1713976 - RNA, 17 nt, Human
uguugcccaggcagguc

SEQ ID NO: 1713977 - RNA, 16 nt, Human
uguugcccaggcaggu

SEQ ID NO: 1713978 - RNA, 15 nt, Human
uguugcccaggcagg

SEQ ID NO: 1713979 - RNA, 12 nt, Human
uguugcccaggc

SEQ ID NO: 1713980 - RNA, 13 nt, Human
uguugcccaggca

SEQ ID NO: 1713981 - RNA, 18 nt, Human
uguucugugauauaagug

SEQ ID NO: 1713982 - RNA, 15 nt, Human
uguucugugauauaa

SEQ ID NO: 1713983 - RNA, 20 nt, Human
agugugguguuuccuggcac

SEQ ID NO: 1713984 - RNA, 19 nt, Human
agugugguguuuccuggca

SEQ ID NO: 1713985 - RNA, 17 nt, Human
agugugguguuuccugg

SEQ ID NO: 1713986 - RNA, 20 nt, Human
agugugccugaagucccaga

SEQ ID NO: 1713987 - RNA, 16 nt, Human
agugugguguuuccug

SEQ ID NO: 1713988 - RNA, 21 nt, Human
agugguggugaacagaacaaa

SEQ ID NO: 1713989 - RNA, 17 nt, Human
aguggugguuuucuguu

SEQ ID NO: 1713990 - RNA, 18 nt, Human
aguggugguuuucuguuc

SEQ ID NO: 1713991 - RNA, 19 nt, Human
aguggugguuuucuguucu

SEQ ID NO: 1713992 - RNA, 20 nt, Human
aguggugguuuucuguucuu

SEQ ID NO: 1713993 - RNA, 21 nt, Human
aguggugguuuucuguucuuu

SEQ ID NO: 1713994 - RNA, 23 nt, Human
aguggugguuuucuguucuuucu

SEQ ID NO: 1713995 - RNA, 17 nt, Human
aguggugcgaucugggu

SEQ ID NO: 1713996 - RNA, 14 nt, Human
uguuacaaauugua

SEQ ID NO: 1713997 - RNA, 17 nt, Human
aguggaaguaguggagc

SEQ ID NO: 1713998 - RNA, 13 nt, Human
uuaaauaauguga

SEQ ID NO: 1713999 - RNA, 20 nt, Human
uuaaauucuugcaaaguauc

SEQ ID NO: 1714000 - RNA, 15 nt, Human
uuaaauuucuaccgc

SEQ ID NO: 1714001 - RNA, 20 nt, Human
aguucuuaguugcuguaugu

SEQ ID NO: 1714002 - RNA, 21 nt, Human
aguucuuaguugcuguauguc

SEQ ID NO: 1714003 - RNA, 21 nt, Human
aguuggguggaugccuggugg

SEQ ID NO: 1714004 - RNA, 13 nt, Human
aguuggcuucuaa

SEQ ID NO: 1714005 - RNA, 16 nt, Human
aguuggcuaggacccc

SEQ ID NO: 1714006 - RNA, 18 nt, Human
aguuggucccccuuccau

SEQ ID NO: 1714007 - RNA, 23 nt, Human
aguuguuugauucagacagcugc

SEQ ID NO: 1714008 - RNA, 21 nt, Human
aguuguuugauucagacagcu

SEQ ID NO: 1714009 - RNA, 22 nt, Human
uguuugauucagacagcugccu

SEQ ID NO: 1714010 - RNA, 17 nt, Human
uguuugauucagacagc

SEQ ID NO: 1714011 - RNA, 19 nt, Human
uguuucuuuguaaugaaaa

SEQ ID NO: 1714012 - RNA, 18 nt, Human
uguuucuuuguaaugaaa

SEQ ID NO: 1714013 - RNA, 20 nt, Human
uguuucuuucucugaggaca

SEQ ID NO: 1714014 - RNA, 21 nt, Human
uguuucuuucucugaggacaa

SEQ ID NO: 1714015 - RNA, 19 nt, Human
uguuuauugucaaaguggu

SEQ ID NO: 1714016 - RNA, 19 nt, Human
uguugcccaggcaggucuu

SEQ ID NO: 1714017 - RNA, 19 nt, Human
uguugccuugcauaauggu

SEQ ID NO: 1714018 - RNA, 13 nt, Human
uguuuggagacag

SEQ ID NO: 1714019 - RNA, 21 nt, Human
uguuuuauuuuaauucaguug

SEQ ID NO: 1714020 - RNA, 20 nt, Human
uguuuuccaugaguccccug

SEQ ID NO: 1714021 - RNA, 21 nt, Human
aguucugcagauaaacaguag

SEQ ID NO: 1714022 - RNA, 16 nt, Human
aguucugcagauaaac

SEQ ID NO: 1714023 - RNA, 14 nt, Human
aguucugguuccua

SEQ ID NO: 1714024 - RNA, 16 nt, Human
aguucuuaguugcugu

SEQ ID NO: 1714025 - RNA, 14 nt, Human
auaaauaacuuuuu

SEQ ID NO: 1714026 - RNA, 18 nt, Human
auaaacacucuugaaaaa

SEQ ID NO: 1714027 - RNA, 19 nt, Human
auaacuagaacugaauuuu

SEQ ID NO: 1714028 - RNA, 14 nt, Human
uuacaggaaguacu

SEQ ID NO: 1714029 - RNA, 14 nt, Human
uuacagcugccugc

SEQ ID NO: 1714030 - RNA, 13 nt, Human
uuacagcugccug

SEQ ID NO: 1714031 - RNA, 14 nt, Human
uuagaaauauaauu

SEQ ID NO: 1714032 - RNA, 12 nt, Human
uuagaaauauaa

SEQ ID NO: 1714033 - RNA, 11 nt, Human
uuagaaauaua

SEQ ID NO: 1714034 - RNA, 11 nt, Human
uuagacagagu

SEQ ID NO: 1714035 - RNA, 13 nt, Human
uuagaaccuuucu

SEQ ID NO: 1714036 - RNA, 20 nt, Human
uuacauaagauaaaugugcu

SEQ ID NO: 1714037 - RNA, 18 nt, Human
uuacucagaauucucuag

SEQ ID NO: 1714038 - RNA, 23 nt, Human
uuacucagaauucucuaguuuga

SEQ ID NO: 1714039 - RNA, 20 nt, Human
auaaaauuuuuaaucuuuaa

SEQ ID NO: 1714040 - RNA, 23 nt, Human
auaaacaagaccacguuucuaaa

SEQ ID NO: 1714041 - RNA, 15 nt, Human
auaaacaagaccacg

SEQ ID NO: 1714042 - RNA, 22 nt, Human
auaaacaagaccacguuucuaa

SEQ ID NO: 1714043 - RNA, 16 nt, Human
auaaaauuaaagcuga

SEQ ID NO: 1714044 - RNA, 19 nt, Human
uuaauuuuuuugagacaga

SEQ ID NO: 1714045 - RNA, 15 nt, Human
uuaauucuuagcuca

SEQ ID NO: 1714046 - RNA, 20 nt, Human
uuaaugaaagacuguacaaa

SEQ ID NO: 1714047 - RNA, 23 nt, Human
uuaaugaaagacuguacaaagua

SEQ ID NO: 1714048 - RNA, 13 nt, Human
uuaauaaagacag

SEQ ID NO: 1714049 - RNA, 14 nt, Human
uuaauaaagacagg

SEQ ID NO: 1714050 - RNA, 17 nt, Human
uuaauaaacacucuuga

SEQ ID NO: 1714051 - RNA, 13 nt, Human
uuaauaaacacuc

SEQ ID NO: 1714052 - RNA, 20 nt, Human
uuaaguuaguuccacugaga

SEQ ID NO: 1714053 - RNA, 17 nt, Human
uuaagugaaaauauagc

SEQ ID NO: 1714054 - RNA, 17 nt, Human
uuaaguacuauguauca

SEQ ID NO: 1714055 - RNA, 14 nt, Human
uuaagugcugcauu

SEQ ID NO: 1714056 - RNA, 22 nt, Human
uuaaguuacacauuuuucagau

SEQ ID NO: 1714057 - RNA, 22 nt, Human
uuaagugcugcauuuaaaagau

SEQ ID NO: 1714058 - RNA, 13 nt, Human
uuaagaggcaggg

SEQ ID NO: 1714059 - RNA, 16 nt, Human
uuaagaggcagggucu

SEQ ID NO: 1714060 - RNA, 15 nt, Human
uuaagaggcaggguc

SEQ ID NO: 1714061 - RNA, 18 nt, Human
uuaaguaaggaauuuuau

SEQ ID NO: 1714062 - RNA, 15 nt, Human
auaaaaguacauguu

SEQ ID NO: 1714063 - RNA, 21 nt, Human
auaaaaguacauguuaaacuu

SEQ ID NO: 1714064 - RNA, 21 nt, Human
agggucucacucugucgccca

SEQ ID NO: 1714065 - RNA, 16 nt, Human
agggucucacucuguc

SEQ ID NO: 1714066 - RNA, 15 nt, Human
agggucucacucugu

SEQ ID NO: 1714067 - RNA, 14 nt, Human
agggucucacucug

SEQ ID NO: 1714068 - RNA, 15 nt, Human
aggguaaggcugugg

SEQ ID NO: 1714069 - RNA, 18 nt, Human
aggggugggacacccugu

SEQ ID NO: 1714070 - RNA, 20 nt, Human
aggggguggccucccaacuc

SEQ ID NO: 1714071 - RNA, 21 nt, Human
aggggaauguuugccucugcc

SEQ ID NO: 1714072 - RNA, 20 nt, Human
aggggaauguuugccucugc

SEQ ID NO: 1714073 - RNA, 19 nt, Human
aggggaauguuugccucug

SEQ ID NO: 1714074 - RNA, 18 nt, Human
aggggagcaugggaagug

SEQ ID NO: 1714075 - RNA, 22 nt, Human
uggguggcaccagcagccugga

SEQ ID NO: 1714076 - RNA, 21 nt, Human
uggguggcaccagcagccugg

SEQ ID NO: 1714077 - RNA, 20 nt, Human
uggguggcaccagcagccug

SEQ ID NO: 1714078 - RNA, 17 nt, Human
uggguggcaccagcagc

SEQ ID NO: 1714079 - RNA, 20 nt, Human
ugguagagugugccugaagu

SEQ ID NO: 1714080 - RNA, 17 nt, Human
ugguagcuuuucccuuc

SEQ ID NO: 1714081 - RNA, 16 nt, Human
aggguggugaccucug

SEQ ID NO: 1714082 - RNA, 18 nt, Human
ugggucgcccuggacugu

SEQ ID NO: 1714083 - RNA, 16 nt, Human
ugggucgcccuggacu

SEQ ID NO: 1714084 - RNA, 15 nt, Human
uggggaggggcugug

SEQ ID NO: 1714085 - RNA, 21 nt, Human
uggggccaguuggucccccuu

SEQ ID NO: 1714086 - RNA, 12 nt, Human
uggggcccugcc

SEQ ID NO: 1714087 - RNA, 23 nt, Human
uggggcugcaccggcuggccugg

SEQ ID NO: 1714088 - RNA, 22 nt, Human
uggggcugcaccggcuggccug

SEQ ID NO: 1714089 - RNA, 15 nt, Human
uggggaccucaggcc

SEQ ID NO: 1714090 - RNA, 14 nt, Human
uggggaccucaggc

SEQ ID NO: 1714091 - RNA, 15 nt, Human
agggcuccagacaca

SEQ ID NO: 1714092 - RNA, 12 nt, Human
agggcuccagac

SEQ ID NO: 1714093 - RNA, 17 nt, Human
uggggaccucaggccug

SEQ ID NO: 1714094 - RNA, 16 nt, Human
uggggaccucaggccu

SEQ ID NO: 1714095 - RNA, 12 nt, Human
uggggaggacaa

SEQ ID NO: 1714096 - RNA, 22 nt, Human
uggggucacucuggcagcucag

SEQ ID NO: 1714097 - RNA, 16 nt, Human
uggggucacucuggca

SEQ ID NO: 1714098 - RNA, 14 nt, Human
uggggucacucugg

SEQ ID NO: 1714099 - RNA, 13 nt, Human
uggggucacucug

SEQ ID NO: 1714100 - RNA, 20 nt, Human
ugggguacccacugcucugg

SEQ ID NO: 1714101 - RNA, 19 nt, Human
ugggguacccacugcucug

SEQ ID NO: 1714102 - RNA, 18 nt, Human
ugggguacccacugcucu

SEQ ID NO: 1714103 - RNA, 17 nt, Human
ugggguacccacugcuc

SEQ ID NO: 1714104 - RNA, 13 nt, Human
aggggaaaagagg

SEQ ID NO: 1714105 - RNA, 14 nt, Human
aggggaacagacug

SEQ ID NO: 1714106 - RNA, 22 nt, Human
aggggaaaaucagccugcucca

SEQ ID NO: 1714107 - RNA, 18 nt, Human
aggggaaaaucagccugc

SEQ ID NO: 1714108 - RNA, 13 nt, Human
aggggaauguuug

SEQ ID NO: 1714109 - RNA, 21 nt, Human
aggggaauaaacuguugaguc

SEQ ID NO: 1714110 - RNA, 17 nt, Human
agggcauggccaggugg

SEQ ID NO: 1714111 - RNA, 15 nt, Human
agggagggcuccaga

SEQ ID NO: 1714112 - RNA, 14 nt, Human
agggagggcuccag

SEQ ID NO: 1714113 - RNA, 16 nt, Human
agggagggcuccagac

SEQ ID NO: 1714114 - RNA, 17 nt, Human
agggagggcuccagaca

SEQ ID NO: 1714115 - RNA, 14 nt, Human
agggcacugguggc

SEQ ID NO: 1714116 - RNA, 16 nt, Human
agggcacugguggccc

SEQ ID NO: 1714117 - RNA, 23 nt, Human
agggcucagcggggacagcuccu

SEQ ID NO: 1714118 - RNA, 22 nt, Human
agggcucagcggggacagcucc

SEQ ID NO: 1714119 - RNA, 20 nt, Human
agggcucagcggggacagcu

SEQ ID NO: 1714120 - RNA, 19 nt, Human
agggcucagcggggacagc

SEQ ID NO: 1714121 - RNA, 17 nt, Human
agggagggagggcucca

SEQ ID NO: 1714122 - RNA, 15 nt, Human
agggagggagggcuc

SEQ ID NO: 1714123 - RNA, 19 nt, Human
ugggccccugccucucugc

SEQ ID NO: 1714124 - RNA, 15 nt, Human
ugggccccugccucu

SEQ ID NO: 1714125 - RNA, 20 nt, Human
ugggccccugccucucugca

SEQ ID NO: 1714126 - RNA, 21 nt, Human
ugggcccccaaauggaaaugg

SEQ ID NO: 1714127 - RNA, 16 nt, Human
ugggcccccaaaugga

SEQ ID NO: 1714128 - RNA, 22 nt, Human
ugggccccaguuguauuuauuu

SEQ ID NO: 1714129 - RNA, 18 nt, Human
ugggccccaguuguauuu

SEQ ID NO: 1714130 - RNA, 20 nt, Human
ugggaggccaaggugggagg

SEQ ID NO: 1714131 - RNA, 19 nt, Human
ugggaggccaaggugggag

SEQ ID NO: 1714132 - RNA, 22 nt, Human
ugggaggaucucuugagccugg

SEQ ID NO: 1714133 - RNA, 21 nt, Human
ugggaggaucucuugagccug

SEQ ID NO: 1714134 - RNA, 20 nt, Human
ugggaggaucucuugagccu

SEQ ID NO: 1714135 - RNA, 13 nt, Human
ugggcagagcaga

SEQ ID NO: 1714136 - RNA, 18 nt, Human
ugggccaggagccuccug

SEQ ID NO: 1714137 - RNA, 12 nt, Human
ugggcagagcag

SEQ ID NO: 1714138 - RNA, 11 nt, Human
ugggcagagca

SEQ ID NO: 1714139 - RNA, 12 nt, Human
ugggcagaagga

SEQ ID NO: 1714140 - RNA, 21 nt, Human
agggaauuucuucaacucccu

SEQ ID NO: 1714141 - RNA, 22 nt, Human
agggaaggauacaaaagcaugu

SEQ ID NO: 1714142 - RNA, 22 nt, Human
agggaaggggacaaggacuagg

SEQ ID NO: 1714143 - RNA, 13 nt, Human
agggaaggggaca

SEQ ID NO: 1714144 - RNA, 20 nt, Human
aggcccggcuccaggcuccu

SEQ ID NO: 1714145 - RNA, 18 nt, Human
aggcccggcuccaggcuc

SEQ ID NO: 1714146 - RNA, 21 nt, Human
aggcccggcuccaggcuccuu

SEQ ID NO: 1714147 - RNA, 23 nt, Human
agggaggacgcucucuggccuuc

SEQ ID NO: 1714148 - RNA, 21 nt, Human
agggaggacgcucucuggccu

SEQ ID NO: 1714149 - RNA, 22 nt, Human
agggaggacgcucucuggccuu

SEQ ID NO: 1714150 - RNA, 16 nt, Human
ugggacuacaggcacc

SEQ ID NO: 1714151 - RNA, 15 nt, Human
ugggacuacaggcac

SEQ ID NO: 1714152 - RNA, 14 nt, Human
ugggacuacaggca

SEQ ID NO: 1714153 - RNA, 20 nt, Human
ugggacucaaugcacugaca

SEQ ID NO: 1714154 - RNA, 16 nt, Human
ugggagagccuuccag

SEQ ID NO: 1714155 - RNA, 18 nt, Human
ugggagacugcugaguca

SEQ ID NO: 1714156 - RNA, 21 nt, Human
ugggagagaagagaaugcaca

SEQ ID NO: 1714157 - RNA, 19 nt, Human
ugggagagaagagaaugca

SEQ ID NO: 1714158 - RNA, 18 nt, Human
uguagaaaagggaacuga

SEQ ID NO: 1714159 - RNA, 19 nt, Human
uguagaaaagggaacugaa

SEQ ID NO: 1714160 - RNA, 20 nt, Human
uguagaaaagggaacugaac

SEQ ID NO: 1714161 - RNA, 21 nt, Human
uguagaaaagggaacugaaca

SEQ ID NO: 1714162 - RNA, 23 nt, Human
uguacuugcucuugaugccuggc

SEQ ID NO: 1714163 - RNA, 22 nt, Human
uguacuugcucuugaugccugg

SEQ ID NO: 1714164 - RNA, 16 nt, Human
uguagaggagaaacug

SEQ ID NO: 1714165 - RNA, 14 nt, Human
uguagagcuucugg

SEQ ID NO: 1714166 - RNA, 18 nt, Human
uguagagccagggucuca

SEQ ID NO: 1714167 - RNA, 16 nt, Human
uguagagccagggucu

SEQ ID NO: 1714168 - RNA, 23 nt, Human
uguagaaaagggaacugaacauu

SEQ ID NO: 1714169 - RNA, 13 nt, Human
aguaaaauccaca

SEQ ID NO: 1714170 - RNA, 17 nt, Human
aguaauaugcacacauu

SEQ ID NO: 1714171 - RNA, 14 nt, Human
aguaauaugcacac

SEQ ID NO: 1714172 - RNA, 15 nt, Human
aguaauaugcacaca

SEQ ID NO: 1714173 - RNA, 20 nt, Human
aguagaagucuuagauguau

SEQ ID NO: 1714174 - RNA, 19 nt, Human
aguagaagucuuagaugua

SEQ ID NO: 1714175 - RNA, 21 nt, Human
aguagaagucuuagauguaua

SEQ ID NO: 1714176 - RNA, 12 nt, Human
aguaccauuuaa

SEQ ID NO: 1714177 - RNA, 23 nt, Human
aguaccauuuaauggggaggaca

SEQ ID NO: 1714178 - RNA, 14 nt, Human
aguacauguuaaac

SEQ ID NO: 1714179 - RNA, 20 nt, Human
uguaggcauaaagucagggg

SEQ ID NO: 1714180 - RNA, 17 nt, Human
uguaggcauaaagucag

SEQ ID NO: 1714181 - RNA, 11 nt, Human
aguagagacag

SEQ ID NO: 1714182 - RNA, 19 nt, Human
uguauucucuccuguaccu

SEQ ID NO: 1714183 - RNA, 20 nt, Human
uguauucucuccuguaccuc

SEQ ID NO: 1714184 - RNA, 22 nt, Human
uguauuacaaauccaaugaaau

SEQ ID NO: 1714185 - RNA, 13 nt, Human
uguauuacaaauc

SEQ ID NO: 1714186 - RNA, 17 nt, Human
uguaucaaugaguaaca

SEQ ID NO: 1714187 - RNA, 14 nt, Human
uguaucaaauacau

SEQ ID NO: 1714188 - RNA, 21 nt, Human
uguaucaaauacauuuaaaac

SEQ ID NO: 1714189 - RNA, 23 nt, Human
uguaucaaauacauuuaaaacau

SEQ ID NO: 1714190 - RNA, 18 nt, Human
uguaugucucgugguagg

SEQ ID NO: 1714191 - RNA, 15 nt, Human
ugucaauuacaggaa

SEQ ID NO: 1714192 - RNA, 14 nt, Human
ugucaauuacagga

SEQ ID NO: 1714193 - RNA, 17 nt, Human
ugucaauuacaggaagu

SEQ ID NO: 1714194 - RNA, 19 nt, Human
ugucaauuacaggaaguac

SEQ ID NO: 1714195 - RNA, 18 nt, Human
aguauuacuucugcuaca

SEQ ID NO: 1714196 - RNA, 17 nt, Human
aguaugguggcuggguu

SEQ ID NO: 1714197 - RNA, 15 nt, Human
aguauuacuucugcu

SEQ ID NO: 1714198 - RNA, 16 nt, Human
aguaugguggcugggu

SEQ ID NO: 1714199 - RNA, 15 nt, Human
aguaugguggcuggg

SEQ ID NO: 1714200 - RNA, 19 nt, Human
agucaccccggccaccugc

SEQ ID NO: 1714201 - RNA, 23 nt, Human
agucacacagugagucgaggaca

SEQ ID NO: 1714202 - RNA, 15 nt, Human
agucacacagugagu

SEQ ID NO: 1714203 - RNA, 23 nt, Human
agucacacaguauuacuucugcu

SEQ ID NO: 1714204 - RNA, 17 nt, Human
uggugcgaucuggguuc

SEQ ID NO: 1714205 - RNA, 16 nt, Human
uggugcgaucuggguu

SEQ ID NO: 1714206 - RNA, 18 nt, Human
uggugcugccacacuuca

SEQ ID NO: 1714207 - RNA, 13 nt, Human
uggugcugccaca

SEQ ID NO: 1714208 - RNA, 23 nt, Human
uggugugaccacugcagaagaca

SEQ ID NO: 1714209 - RNA, 20 nt, Human
ugguuaggcauugugggaag

SEQ ID NO: 1714210 - RNA, 18 nt, Human
ugguuaggcauuguggga

SEQ ID NO: 1714211 - RNA, 12 nt, Human
ugguggcagugg

SEQ ID NO: 1714212 - RNA, 15 nt, Human
ugguggcagcugcgg

SEQ ID NO: 1714213 - RNA, 13 nt, Human
ugguggcagcugc

SEQ ID NO: 1714214 - RNA, 14 nt, Human
ugguggcagcugcg

SEQ ID NO: 1714215 - RNA, 21 nt, Human
ugguggagaggcccggccucu

SEQ ID NO: 1714216 - RNA, 18 nt, Human
aggucagagccugcaguu

SEQ ID NO: 1714217 - RNA, 17 nt, Human
aggucagagccugcagu

SEQ ID NO: 1714218 - RNA, 15 nt, Human
aggucagagccugca

SEQ ID NO: 1714219 - RNA, 14 nt, Human
aggucagagccugc

SEQ ID NO: 1714220 - RNA, 13 nt, Human
aggucagagccug

SEQ ID NO: 1714221 - RNA, 16 nt, Human
uggucagauuugaacu

SEQ ID NO: 1714222 - RNA, 15 nt, Human
uggucagauuugaac

SEQ ID NO: 1714223 - RNA, 16 nt, Human
aggucuugaacuccug

SEQ ID NO: 1714224 - RNA, 19 nt, Human
agguccacaacacacagau

SEQ ID NO: 1714225 - RNA, 15 nt, Human
aggugacagagugag

SEQ ID NO: 1714226 - RNA, 13 nt, Human
aggugacagagug

SEQ ID NO: 1714227 - RNA, 17 nt, Human
aggucuugaacuccugg

SEQ ID NO: 1714228 - RNA, 18 nt, Human
aggucuugaacuccuggc

SEQ ID NO: 1714229 - RNA, 13 nt, Human
aggugaccccagg

SEQ ID NO: 1714230 - RNA, 22 nt, Human
aggugacagagugagacucugu

SEQ ID NO: 1714231 - RNA, 16 nt, Human
aggugagaagcagagg

SEQ ID NO: 1714232 - RNA, 23 nt, Human
aggugagaagcagaggaaggaga

SEQ ID NO: 1714233 - RNA, 21 nt, Human
aggugagaagcagaggaagga

SEQ ID NO: 1714234 - RNA, 19 nt, Human
uguaaauaaagaacuagca

SEQ ID NO: 1714235 - RNA, 21 nt, Human
uguaaauacuguuuuuaacaa

SEQ ID NO: 1714236 - RNA, 16 nt, Human
uguaaauagcucaggu

SEQ ID NO: 1714237 - RNA, 15 nt, Human
uguaaauagcucagg

SEQ ID NO: 1714238 - RNA, 14 nt, Human
ugguuauggagagg

SEQ ID NO: 1714239 - RNA, 13 nt, Human
ugguuuccugccc

SEQ ID NO: 1714240 - RNA, 12 nt, Human
ugguuuccugcc

SEQ ID NO: 1714241 - RNA, 17 nt, Human
ugguuaugaauacuuug

SEQ ID NO: 1714242 - RNA, 20 nt, Human
ugguuuccugcccugggagg

SEQ ID NO: 1714243 - RNA, 15 nt, Human
ugguuuccugcccug

SEQ ID NO: 1714244 - RNA, 14 nt, Human
ugguuuccugcccu

SEQ ID NO: 1714245 - RNA, 17 nt, Human
ugguuuucaaaauaaaa

SEQ ID NO: 1714246 - RNA, 15 nt, Human
ugguuuucaaaauaa

SEQ ID NO: 1714247 - RNA, 14 nt, Human
ugguuuucaaaaua

SEQ ID NO: 1714248 - RNA, 15 nt, Human
ugguuuguaaauuaa

SEQ ID NO: 1714249 - RNA, 14 nt, Human
agguuuaagcuguu

SEQ ID NO: 1714250 - RNA, 20 nt, Human
aggugugcucugaucaucca

SEQ ID NO: 1714251 - RNA, 15 nt, Human
aggugugcucugauc

SEQ ID NO: 1714252 - RNA, 17 nt, Human
aggugugaaccaccaca

SEQ ID NO: 1714253 - RNA, 19 nt, Human
agguggggucacucuggca

SEQ ID NO: 1714254 - RNA, 21 nt, Human
aggugauccacccaccucagc

SEQ ID NO: 1714255 - RNA, 20 nt, Human
aggugcauauuuauaaaaau

SEQ ID NO: 1714256 - RNA, 20 nt, Human
aggugauccacccaccucag

SEQ ID NO: 1714257 - RNA, 14 nt, Human
aggugauccaccca

SEQ ID NO: 1714258 - RNA, 23 nt, Human
agguggggcagcuugaggguugg

SEQ ID NO: 1714259 - RNA, 18 nt, Human
aggugggauccuccaggu

SEQ ID NO: 1714260 - RNA, 17 nt, Human
aggugggauccuccagg

SEQ ID NO: 1714261 - RNA, 16 nt, Human
aggugggauccuccag

SEQ ID NO: 1714262 - RNA, 18 nt, Human
aggugccucaagagaagg

SEQ ID NO: 1714263 - RNA, 15 nt, Human
aggugggauccucca

SEQ ID NO: 1714264 - RNA, 14 nt, Human
aggaaaagcugcug

SEQ ID NO: 1714265 - RNA, 22 nt, Human
agcuuuccccaugucucgacuc

SEQ ID NO: 1714266 - RNA, 20 nt, Human
agcuugcccuggugccucac

SEQ ID NO: 1714267 - RNA, 23 nt, Human
agcuugaccgugaggccagagac

SEQ ID NO: 1714268 - RNA, 22 nt, Human
agcuugaccgugaggccagaga

SEQ ID NO: 1714269 - RNA, 20 nt, Human
agcuugaccgugaggccaga

SEQ ID NO: 1714270 - RNA, 15 nt, Human
agcuuacaagccagc

SEQ ID NO: 1714271 - RNA, 17 nt, Human
agcuuacaagccagcug

SEQ ID NO: 1714272 - RNA, 19 nt, Human
agcuuacaagccagcugga

SEQ ID NO: 1714273 - RNA, 15 nt, Human
ugcgguccacccagg

SEQ ID NO: 1714274 - RNA, 14 nt, Human
ugcgguccacccag

SEQ ID NO: 1714275 - RNA, 17 nt, Human
ugcgguccacccaggag

SEQ ID NO: 1714276 - RNA, 20 nt, Human
ugcuaauuuugaaaaacugc

SEQ ID NO: 1714277 - RNA, 19 nt, Human
ugcuaauuuugaaaaacug

SEQ ID NO: 1714278 - RNA, 18 nt, Human
ugcuaauuuugaaaaacu

SEQ ID NO: 1714279 - RNA, 16 nt, Human
ugcuaauuuugaaaaa

SEQ ID NO: 1714280 - RNA, 13 nt, Human
agcuuaacagugu

SEQ ID NO: 1714281 - RNA, 13 nt, Human
agcuguuuaugca

SEQ ID NO: 1714282 - RNA, 15 nt, Human
ugcucuugaacuccu

SEQ ID NO: 1714283 - RNA, 22 nt, Human
ugcucuugaacuccugaccuca

SEQ ID NO: 1714284 - RNA, 20 nt, Human
ugcucuugaacuccugaccu

SEQ ID NO: 1714285 - RNA, 17 nt, Human
ugcucuugaugccuggc

SEQ ID NO: 1714286 - RNA, 16 nt, Human
ugcucugcugacagac

SEQ ID NO: 1714287 - RNA, 15 nt, Human
ugcucugcugacaga

SEQ ID NO: 1714288 - RNA, 14 nt, Human
ugcucugcugacag

SEQ ID NO: 1714289 - RNA, 19 nt, Human
ugcucugaucauccacugu

SEQ ID NO: 1714290 - RNA, 21 nt, Human
ugcuccagcuguucagcuggu

SEQ ID NO: 1714291 - RNA, 18 nt, Human
ugcuaucucccccagccc

SEQ ID NO: 1714292 - RNA, 16 nt, Human
aggaaaagcugcugac

SEQ ID NO: 1714293 - RNA, 17 nt, Human
ugcuaucucccccagcc

SEQ ID NO: 1714294 - RNA, 14 nt, Human
ugcuaucuccccca

SEQ ID NO: 1714295 - RNA, 13 nt, Human
ugcuaucuccccc

SEQ ID NO: 1714296 - RNA, 23 nt, Human
aggaaaccaguuaggucucaaua

SEQ ID NO: 1714297 - RNA, 14 nt, Human
aggaagcucagggc

SEQ ID NO: 1714298 - RNA, 13 nt, Human
aggaagcucaggg

SEQ ID NO: 1714299 - RNA, 13 nt, Human
aggaagccagcag

SEQ ID NO: 1714300 - RNA, 18 nt, Human
aggaagcagcuuucccca

SEQ ID NO: 1714301 - RNA, 16 nt, Human
aggaagcucagggccu

SEQ ID NO: 1714302 - RNA, 15 nt, Human
aggaagcucagggcc

SEQ ID NO: 1714303 - RNA, 15 nt, Human
aggaaggcugagagg

SEQ ID NO: 1714304 - RNA, 15 nt, Human
agcuccuucuguccu

SEQ ID NO: 1714305 - RNA, 23 nt, Human
agcucccaggcauuccccaggag

SEQ ID NO: 1714306 - RNA, 13 nt, Human
agcucccaggcau

SEQ ID NO: 1714307 - RNA, 16 nt, Human
agcuccaucuccacuc

SEQ ID NO: 1714308 - RNA, 15 nt, Human
agcuccaucuccacu

SEQ ID NO: 1714309 - RNA, 13 nt, Human
agcuccaucucca

SEQ ID NO: 1714310 - RNA, 21 nt, Human
agcuccuucuguccuacucug

SEQ ID NO: 1714311 - RNA, 16 nt, Human
agcuccuucuguccua

SEQ ID NO: 1714312 - RNA, 17 nt, Human
agcucugguccauagag

SEQ ID NO: 1714313 - RNA, 12 nt, Human
agcucuggucca

SEQ ID NO: 1714314 - RNA, 19 nt, Human
ugcccuuaccugccaggaa

SEQ ID NO: 1714315 - RNA, 18 nt, Human
ugcccuuaccugccagga

SEQ ID NO: 1714316 - RNA, 13 nt, Human
ugccucagccucc

SEQ ID NO: 1714317 - RNA, 12 nt, Human
ugccucagccuc

SEQ ID NO: 1714318 - RNA, 14 nt, Human
ugccgcagcccugc

SEQ ID NO: 1714319 - RNA, 12 nt, Human
ugccgcagcccu

SEQ ID NO: 1714320 - RNA, 23 nt, Human
agcucuguccugggagugagcug

SEQ ID NO: 1714321 - RNA, 21 nt, Human
agcucuguccugggagugagc

SEQ ID NO: 1714322 - RNA, 16 nt, Human
agcucuguccugggag

SEQ ID NO: 1714323 - RNA, 20 nt, Human
agcugccagccgagauagcc

SEQ ID NO: 1714324 - RNA, 19 nt, Human
agcuguuacugucuucagu

SEQ ID NO: 1714325 - RNA, 14 nt, Human
ugccuguucccauu

SEQ ID NO: 1714326 - RNA, 17 nt, Human
ugccuguugggccagga

SEQ ID NO: 1714327 - RNA, 16 nt, Human
ugccuguugggccagg

SEQ ID NO: 1714328 - RNA, 20 nt, Human
ugccuuacccucauguucuu

SEQ ID NO: 1714329 - RNA, 16 nt, Human
ugccuuggggacaaga

SEQ ID NO: 1714330 - RNA, 21 nt, Human
ugccuuacccucauguucuua

SEQ ID NO: 1714331 - RNA, 20 nt, Human
agcugggguggggaccucag

SEQ ID NO: 1714332 - RNA, 16 nt, Human
agcugggacuacaggu

SEQ ID NO: 1714333 - RNA, 23 nt, Human
agcugggacuacaggcacccacc

SEQ ID NO: 1714334 - RNA, 20 nt, Human
agcugggacuacaggcaccc

SEQ ID NO: 1714335 - RNA, 23 nt, Human
agcugggguggggaccucaggcc

SEQ ID NO: 1714336 - RNA, 22 nt, Human
agcugggguggggaccucaggc

SEQ ID NO: 1714337 - RNA, 18 nt, Human
agcugugcucuggacagg

SEQ ID NO: 1714338 - RNA, 17 nt, Human
agcugugcucuggacag

SEQ ID NO: 1714339 - RNA, 19 nt, Human
agcugugcucuggacaggc

SEQ ID NO: 1714340 - RNA, 18 nt, Human
agcuguuacugucuucag

SEQ ID NO: 1714341 - RNA, 19 nt, Human
agcuggccgggagccugau

SEQ ID NO: 1714342 - RNA, 18 nt, Human
agcuggccgggagccuga

SEQ ID NO: 1714343 - RNA, 16 nt, Human
agcugcuugggcuuca

SEQ ID NO: 1714344 - RNA, 20 nt, Human
agcugcuugggcuucauccu

SEQ ID NO: 1714345 - RNA, 21 nt, Human
ugccuggauggggcugcaccg

SEQ ID NO: 1714346 - RNA, 20 nt, Human
ugccuggauggggcugcacc

SEQ ID NO: 1714347 - RNA, 17 nt, Human
ugccuggauggggcugc

SEQ ID NO: 1714348 - RNA, 16 nt, Human
ugccuggauggggcug

SEQ ID NO: 1714349 - RNA, 16 nt, Human
agcugccuguucagcu

SEQ ID NO: 1714350 - RNA, 14 nt, Human
agcugccuguucag

SEQ ID NO: 1714351 - RNA, 18 nt, Human
agcugccuguucagcucc

SEQ ID NO: 1714352 - RNA, 19 nt, Human
agcugccuguucagcucca

SEQ ID NO: 1714353 - RNA, 17 nt, Human
ugccucugccucugaca

SEQ ID NO: 1714354 - RNA, 20 nt, Human
ugccucugccucugacacac

SEQ ID NO: 1714355 - RNA, 18 nt, Human
ugccucugccucugacac

SEQ ID NO: 1714356 - RNA, 14 nt, Human
ugccucagccuccc

SEQ ID NO: 1714357 - RNA, 23 nt, Human
ugccugcccaggccccugccacc

SEQ ID NO: 1714358 - RNA, 22 nt, Human
ugccugcccaggccccugccac

SEQ ID NO: 1714359 - RNA, 12 nt, Human
ugccucugccug

SEQ ID NO: 1714360 - RNA, 24 nt, Human
ugccugcccaggccccugccaccc

SEQ ID NO: 1714361 - RNA, 22 nt, Human
ugccugcuuuuuauggccugug

SEQ ID NO: 1714362 - RNA, 21 nt, Human
ugccugcuuuuuauggccugu

SEQ ID NO: 1714363 - RNA, 20 nt, Human
ugccugcuuuuuauggccug

SEQ ID NO: 1714364 - RNA, 23 nt, Human
uggcacaucagcacgauuucugu

SEQ ID NO: 1714365 - RNA, 13 nt, Human
uggauggaagggg

SEQ ID NO: 1714366 - RNA, 23 nt, Human
uggaugccugguggcagcugcgg

SEQ ID NO: 1714367 - RNA, 21 nt, Human
uggaugccugguggcagcugc

SEQ ID NO: 1714368 - RNA, 14 nt, Human
uggaguugaaaauc

SEQ ID NO: 1714369 - RNA, 14 nt, Human
uggagugcagugag

SEQ ID NO: 1714370 - RNA, 17 nt, Human
uggagugcaaugacaca

SEQ ID NO: 1714371 - RNA, 20 nt, Human
aggcauuugcugaauacaga

SEQ ID NO: 1714372 - RNA, 16 nt, Human
aggcauuugcugaaua

SEQ ID NO: 1714373 - RNA, 14 nt, Human
aggccccgcccagg

SEQ ID NO: 1714374 - RNA, 13 nt, Human
aggcccggcucca

SEQ ID NO: 1714375 - RNA, 15 nt, Human
aggcccggccucuca

SEQ ID NO: 1714376 - RNA, 14 nt, Human
aggcccggccucuc

SEQ ID NO: 1714377 - RNA, 13 nt, Human
aggcccggccucu

SEQ ID NO: 1714378 - RNA, 13 nt, Human
aggcccagagggc

SEQ ID NO: 1714379 - RNA, 15 nt, Human
aggccagccuugacc

SEQ ID NO: 1714380 - RNA, 12 nt, Human
aggccagcugcu

SEQ ID NO: 1714381 - RNA, 13 nt, Human
aggccagccuuga

SEQ ID NO: 1714382 - RNA, 22 nt, Human
uggcagcucaccucucccuugg

SEQ ID NO: 1714383 - RNA, 21 nt, Human
uggcagcucaccucucccuug

SEQ ID NO: 1714384 - RNA, 23 nt, Human
uggcagcucaccucucccuugga

SEQ ID NO: 1714385 - RNA, 13 nt, Human
uggcagcucagag

SEQ ID NO: 1714386 - RNA, 20 nt, Human
uggcacccggccccugcugg

SEQ ID NO: 1714387 - RNA, 19 nt, Human
uggcacccggccccugcug

SEQ ID NO: 1714388 - RNA, 18 nt, Human
uggcacccggccccugcu

SEQ ID NO: 1714389 - RNA, 17 nt, Human
aggcaagcaccuccugc

SEQ ID NO: 1714390 - RNA, 17 nt, Human
uggagccaauggagacu

SEQ ID NO: 1714391 - RNA, 19 nt, Human
aggcaagcaccuccugccu

SEQ ID NO: 1714392 - RNA, 18 nt, Human
aggcaagcaccuccugcc

SEQ ID NO: 1714393 - RNA, 20 nt, Human
aggcaagcaccuccugccuc

SEQ ID NO: 1714394 - RNA, 16 nt, Human
aggcaaggcugucaau

SEQ ID NO: 1714395 - RNA, 17 nt, Human
aggcaaggcugucaauu

SEQ ID NO: 1714396 - RNA, 14 nt, Human
uggagaaaauggac

SEQ ID NO: 1714397 - RNA, 17 nt, Human
aggauugcuacuguccu

SEQ ID NO: 1714398 - RNA, 15 nt, Human
aggauugcuacuguc

SEQ ID NO: 1714399 - RNA, 18 nt, Human
aggauugcuacuguccua

SEQ ID NO: 1714400 - RNA, 20 nt, Human
aggcauuuaggccaugggac

SEQ ID NO: 1714401 - RNA, 18 nt, Human
aggcauugugggaagggg

SEQ ID NO: 1714402 - RNA, 22 nt, Human
aggcauaaagucagggguuccc

SEQ ID NO: 1714403 - RNA, 22 nt, Human
aggcaggucuugaacuccuggc

SEQ ID NO: 1714404 - RNA, 12 nt, Human
aggcagggucuc

SEQ ID NO: 1714405 - RNA, 17 nt, Human
aggcaggugggauggau

SEQ ID NO: 1714406 - RNA, 15 nt, Human
aggcauaaagucagg

SEQ ID NO: 1714407 - RNA, 19 nt, Human
aggacuuuucuuuguggcu

SEQ ID NO: 1714408 - RNA, 17 nt, Human
aggacuuuucuuugugg

SEQ ID NO: 1714409 - RNA, 18 nt, Human
aggagaaacuggaacucu

SEQ ID NO: 1714410 - RNA, 19 nt, Human
aggagaaacuggaacucuc

SEQ ID NO: 1714411 - RNA, 23 nt, Human
aggacuuuucuuuguggcuuccu

SEQ ID NO: 1714412 - RNA, 22 nt, Human
aggacuuuucuuuguggcuucc

SEQ ID NO: 1714413 - RNA, 19 nt, Human
aggacucugccuccucuuc

SEQ ID NO: 1714414 - RNA, 18 nt, Human
aggacucugccuccucuu

SEQ ID NO: 1714415 - RNA, 17 nt, Human
aggacucugccuccucu

SEQ ID NO: 1714416 - RNA, 16 nt, Human
aggacucugccuccuc

SEQ ID NO: 1714417 - RNA, 14 nt, Human
aggacucugccucc

SEQ ID NO: 1714418 - RNA, 13 nt, Human
aggacucugccuc

SEQ ID NO: 1714419 - RNA, 12 nt, Human
aggacucugccu

SEQ ID NO: 1714420 - RNA, 13 nt, Human
aggagcagccaca

SEQ ID NO: 1714421 - RNA, 12 nt, Human
aggagcagccac

SEQ ID NO: 1714422 - RNA, 16 nt, Human
aggagccuccugcccu

SEQ ID NO: 1714423 - RNA, 17 nt, Human
aggagccccgaggccuu

SEQ ID NO: 1714424 - RNA, 23 nt, Human
aggagcccugggaggcucuggag

SEQ ID NO: 1714425 - RNA, 13 nt, Human
aggacgcucucug

SEQ ID NO: 1714426 - RNA, 14 nt, Human
aggacgcucucugg

SEQ ID NO: 1714427 - RNA, 16 nt, Human
aggacgcucucuggcc

SEQ ID NO: 1714428 - RNA, 17 nt, Human
aggacgcucucuggccu

SEQ ID NO: 1714429 - RNA, 19 nt, Human
aggacgcucucuggccuuc

SEQ ID NO: 1714430 - RNA, 20 nt, Human
aggacgcucucuggccuucg

SEQ ID NO: 1714431 - RNA, 15 nt, Human
aggacuaggguccug

SEQ ID NO: 1714432 - RNA, 18 nt, Human
aggacuaggguccugggg

SEQ ID NO: 1714433 - RNA, 16 nt, Human
aggacuaggguccugg

SEQ ID NO: 1714434 - RNA, 19 nt, Human
aggacuaggguccugggga

SEQ ID NO: 1714435 - RNA, 18 nt, Human
ugcuuuuggucuguguga

SEQ ID NO: 1714436 - RNA, 23 nt, Human
ugcuuuuuaauauugauaugcuu

SEQ ID NO: 1714437 - RNA, 20 nt, Human
ugcuuuugucuaugggacuc

SEQ ID NO: 1714438 - RNA, 22 nt, Human
ugcuuugugauuuuuguaauuu

SEQ ID NO: 1714439 - RNA, 17 nt, Human
ugcuuugggcugcccug

SEQ ID NO: 1714440 - RNA, 16 nt, Human
ugcuuugggcugcccu

SEQ ID NO: 1714441 - RNA, 15 nt, Human
ugcuugagcucagga

SEQ ID NO: 1714442 - RNA, 17 nt, Human
aggagccuccugcccuu

SEQ ID NO: 1714443 - RNA, 15 nt, Human
ugcuuugggcugccc

SEQ ID NO: 1714444 - RNA, 14 nt, Human
ugcuuugggcugcc

SEQ ID NO: 1714445 - RNA, 16 nt, Human
uggaagacagcucuua

SEQ ID NO: 1714446 - RNA, 23 nt, Human
uggaaauuuguuauaaugaauga

SEQ ID NO: 1714447 - RNA, 21 nt, Human
uggaaauuuguuauaaugaau

SEQ ID NO: 1714448 - RNA, 16 nt, Human
ugcuuuuuauggccug

SEQ ID NO: 1714449 - RNA, 19 nt, Human
aggauucuuccucccuccc

SEQ ID NO: 1714450 - RNA, 17 nt, Human
aggauucuuccucccuc

SEQ ID NO: 1714451 - RNA, 23 nt, Human
aggaugaucuaggaagacuuugg

SEQ ID NO: 1714452 - RNA, 22 nt, Human
aggaugaucuaggaagacuuug

SEQ ID NO: 1714453 - RNA, 22 nt, Human
aggaugcacagaguuguuacau

SEQ ID NO: 1714454 - RNA, 13 nt, Human
aggaucagucuga

SEQ ID NO: 1714455 - RNA, 17 nt, Human
aggauaucggcauuugu

SEQ ID NO: 1714456 - RNA, 21 nt, Human
aggauaucggcauuuguuucu

SEQ ID NO: 1714457 - RNA, 16 nt, Human
ugcauaccacuuuugu

SEQ ID NO: 1714458 - RNA, 18 nt, Human
ugcauaccacuuuuguuc

SEQ ID NO: 1714459 - RNA, 20 nt, Human
ugcauaccacuuuuguucuu

SEQ ID NO: 1714460 - RNA, 13 nt, Human
ugcauacucauua

SEQ ID NO: 1714461 - RNA, 21 nt, Human
ugcauaccacuuuuguucuug

SEQ ID NO: 1714462 - RNA, 19 nt, Human
ugcauacucauuaggaugg

SEQ ID NO: 1714463 - RNA, 17 nt, Human
ugcauagaauaaaauuu

SEQ ID NO: 1714464 - RNA, 15 nt, Human
ugcaucucagcccac

SEQ ID NO: 1714465 - RNA, 14 nt, Human
ugcaucucagccca

SEQ ID NO: 1714466 - RNA, 13 nt, Human
ugcaucucagccc

SEQ ID NO: 1714467 - RNA, 18 nt, Human
ugcaugcugucccuuacg

SEQ ID NO: 1714468 - RNA, 21 nt, Human
ugcaugcugucccuuacguga

SEQ ID NO: 1714469 - RNA, 19 nt, Human
ugcaugcugucccuuacgu

SEQ ID NO: 1714470 - RNA, 18 nt, Human
ugcagccucacaguccuu

SEQ ID NO: 1714471 - RNA, 21 nt, Human
ugcagccucacaguccuuacc

SEQ ID NO: 1714472 - RNA, 22 nt, Human
ugcaggucccuaauaaagcugu

SEQ ID NO: 1714473 - RNA, 11 nt, Human
ugcaggucccu

SEQ ID NO: 1714474 - RNA, 18 nt, Human
agccuccugcccuuaccu

SEQ ID NO: 1714475 - RNA, 14 nt, Human
agccuccugcccuu

SEQ ID NO: 1714476 - RNA, 13 nt, Human
agccuccugcccu

SEQ ID NO: 1714477 - RNA, 21 nt, Human
ugcagacaggcaagcaccucc

SEQ ID NO: 1714478 - RNA, 13 nt, Human
ugcagacaggcaa

SEQ ID NO: 1714479 - RNA, 12 nt, Human
ugcagacaggca

SEQ ID NO: 1714480 - RNA, 13 nt, Human
ugccauaauuacu

SEQ ID NO: 1714481 - RNA, 22 nt, Human
ugccagccgagauagccaaggc

SEQ ID NO: 1714482 - RNA, 17 nt, Human
ugccagccgagauagcc

SEQ ID NO: 1714483 - RNA, 16 nt, Human
ugcauuuaaaagauac

SEQ ID NO: 1714484 - RNA, 14 nt, Human
ugccaaugggagcu

SEQ ID NO: 1714485 - RNA, 13 nt, Human
ugccaauggacua

SEQ ID NO: 1714486 - RNA, 18 nt, Human
ugccaaugggagcucaug

SEQ ID NO: 1714487 - RNA, 19 nt, Human
agccuugcggaagguucua

SEQ ID NO: 1714488 - RNA, 21 nt, Human
agccuugaccauucuccaccu

SEQ ID NO: 1714489 - RNA, 19 nt, Human
agccuugaccauucuccac

SEQ ID NO: 1714490 - RNA, 18 nt, Human
agccuugaccauucucca

SEQ ID NO: 1714491 - RNA, 16 nt, Human
agccuugggaccccug

SEQ ID NO: 1714492 - RNA, 20 nt, Human
agccuuagaagucacacagu

SEQ ID NO: 1714493 - RNA, 22 nt, Human
agccuuagaagucacacaguau

SEQ ID NO: 1714494 - RNA, 15 nt, Human
agccuguuuaagaga

SEQ ID NO: 1714495 - RNA, 13 nt, Human
agccuugaacuuu

SEQ ID NO: 1714496 - RNA, 19 nt, Human
agccugugccucugggacu

SEQ ID NO: 1714497 - RNA, 18 nt, Human
agccugugccucugggac

SEQ ID NO: 1714498 - RNA, 17 nt, Human
agccugugccucuggga

SEQ ID NO: 1714499 - RNA, 23 nt, Human
ugcaaaguucccuacuuccugug

SEQ ID NO: 1714500 - RNA, 20 nt, Human
ugcaaaguaucccuacugua

SEQ ID NO: 1714501 - RNA, 21 nt, Human
ugcaaaggguaucaggugcug

SEQ ID NO: 1714502 - RNA, 17 nt, Human
ugcaaagcccagcuuga

SEQ ID NO: 1714503 - RNA, 15 nt, Human
ugcaaagcccagcuu

SEQ ID NO: 1714504 - RNA, 14 nt, Human
ugcaaagcccagcu

SEQ ID NO: 1714505 - RNA, 20 nt, Human
ugcaaaccaucauugaaauc

SEQ ID NO: 1714506 - RNA, 18 nt, Human
ugcaaaccaucauugaaa

SEQ ID NO: 1714507 - RNA, 18 nt, Human
ugauuuccguuaaaauac

SEQ ID NO: 1714508 - RNA, 13 nt, Human
ugcaaaccaucau

SEQ ID NO: 1714509 - RNA, 12 nt, Human
ugcaaaccauca

SEQ ID NO: 1714510 - RNA, 12 nt, Human
ugauuuggaaaa

SEQ ID NO: 1714511 - RNA, 13 nt, Human
ugauuucauucaa

SEQ ID NO: 1714512 - RNA, 20 nt, Human
ugauuucagcaccuacagug

SEQ ID NO: 1714513 - RNA, 18 nt, Human
agccacggccaggccaga

SEQ ID NO: 1714514 - RNA, 17 nt, Human
agccacggccaggccag

SEQ ID NO: 1714515 - RNA, 13 nt, Human
ugcaacaggcugg

SEQ ID NO: 1714516 - RNA, 12 nt, Human
agcccaggccuc

SEQ ID NO: 1714517 - RNA, 15 nt, Human
ugcaaggucauuuuu

SEQ ID NO: 1714518 - RNA, 22 nt, Human
ugcagaagacaguauggcagcu

SEQ ID NO: 1714519 - RNA, 17 nt, Human
ugcacuccagccugagc

SEQ ID NO: 1714520 - RNA, 15 nt, Human
ugcacuccagccugg

SEQ ID NO: 1714521 - RNA, 16 nt, Human
ugcacuccagccuggg

SEQ ID NO: 1714522 - RNA, 15 nt, Human
ugcacuccagccuga

SEQ ID NO: 1714523 - RNA, 14 nt, Human
ugcacuccagccug

SEQ ID NO: 1714524 - RNA, 16 nt, Human
ugcaccggcuggccug

SEQ ID NO: 1714525 - RNA, 15 nt, Human
ugcaccggcuggccu

SEQ ID NO: 1714526 - RNA, 14 nt, Human
ugcaccggcuggcc

SEQ ID NO: 1714527 - RNA, 13 nt, Human
ugcaccagcccuu

SEQ ID NO: 1714528 - RNA, 21 nt, Human
ugcaccacugcacuccagccu

SEQ ID NO: 1714529 - RNA, 20 nt, Human
agcccugggaggcucuggag

SEQ ID NO: 1714530 - RNA, 18 nt, Human
agcccugggaggcucugg

SEQ ID NO: 1714531 - RNA, 17 nt, Human
agcccugggaggcucug

SEQ ID NO: 1714532 - RNA, 18 nt, Human
agccccgugggguuccuc

SEQ ID NO: 1714533 - RNA, 21 nt, Human
agcccaggccuccuacagcuu

SEQ ID NO: 1714534 - RNA, 19 nt, Human
agcccaggccuccuacagc

SEQ ID NO: 1714535 - RNA, 14 nt, Human
agcccaggccuccu

SEQ ID NO: 1714536 - RNA, 14 nt, Human
agccccgaggccuu

SEQ ID NO: 1714537 - RNA, 15 nt, Human
agcccgggcucugcc

SEQ ID NO: 1714538 - RNA, 14 nt, Human
agcccgggcucugc

SEQ ID NO: 1714539 - RNA, 13 nt, Human
agcccgggcucug

SEQ ID NO: 1714540 - RNA, 19 nt, Human
agccccuucugacccaugc

SEQ ID NO: 1714541 - RNA, 16 nt, Human
agccccuucugaccca

SEQ ID NO: 1714542 - RNA, 15 nt, Human
agccccuucugaccc

SEQ ID NO: 1714543 - RNA, 14 nt, Human
agccccuucugacc

SEQ ID NO: 1714544 - RNA, 19 nt, Human
agcccugcagagggcacag

SEQ ID NO: 1714545 - RNA, 16 nt, Human
agcccugcagagggca

SEQ ID NO: 1714546 - RNA, 15 nt, Human
agcccugcagagggc

SEQ ID NO: 1714547 - RNA, 14 nt, Human
agcccugcagaggg

SEQ ID NO: 1714548 - RNA, 16 nt, Human
agcccgggcucugccu

SEQ ID NO: 1714549 - RNA, 13 nt, Human
agcauuuuguaau

SEQ ID NO: 1714550 - RNA, 22 nt, Human
agcauuuugcuaaaugugaaug

SEQ ID NO: 1714551 - RNA, 15 nt, Human
agcauuuugcuaaau

SEQ ID NO: 1714552 - RNA, 18 nt, Human
agccaaacauccuacaag

SEQ ID NO: 1714553 - RNA, 16 nt, Human
agcauuugucaacaaa

SEQ ID NO: 1714554 - RNA, 22 nt, Human
agcauucucacuccuaccuggu

SEQ ID NO: 1714555 - RNA, 20 nt, Human
agcauucucacuccuaccug

SEQ ID NO: 1714556 - RNA, 18 nt, Human
agcauucucacuccuacc

SEQ ID NO: 1714557 - RNA, 19 nt, Human
agcauggcugccaauggga

SEQ ID NO: 1714558 - RNA, 17 nt, Human
agcauuagauuucucau

SEQ ID NO: 1714559 - RNA, 21 nt, Human
agcauauucaggaagcucagg

SEQ ID NO: 1714560 - RNA, 19 nt, Human
agcauauucaggaagcuca

SEQ ID NO: 1714561 - RNA, 17 nt, Human
agcauauucaggaagcu

SEQ ID NO: 1714562 - RNA, 14 nt, Human
ugaucacggcucac

SEQ ID NO: 1714563 - RNA, 13 nt, Human
ugaucacggcuca

SEQ ID NO: 1714564 - RNA, 15 nt, Human
ugaucacggcucacu

SEQ ID NO: 1714565 - RNA, 18 nt, Human
ugaucacggcucacugca

SEQ ID NO: 1714566 - RNA, 14 nt, Human
ugaucaccugcccu

SEQ ID NO: 1714567 - RNA, 18 nt, Human
ugauacaaugcugugccc

SEQ ID NO: 1714568 - RNA, 12 nt, Human
agcaucaggcca

SEQ ID NO: 1714569 - RNA, 21 nt, Human
agcaucaggccaggcccucug

SEQ ID NO: 1714570 - RNA, 22 nt, Human
agcaucaggccaggcccucugc

SEQ ID NO: 1714571 - RNA, 23 nt, Human
agcaucaggccaggcccucugcc

SEQ ID NO: 1714572 - RNA, 13 nt, Human
agcauggcugcca

SEQ ID NO: 1714573 - RNA, 23 nt, Human
ugauccagaaagaaaacuuguau

SEQ ID NO: 1714574 - RNA, 13 nt, Human
ugauccagaaaga

SEQ ID NO: 1714575 - RNA, 14 nt, Human
ugauccacucgccu

SEQ ID NO: 1714576 - RNA, 18 nt, Human
ugauccacucgccuucau

SEQ ID NO: 1714577 - RNA, 20 nt, Human
ugauccucccaccucagccu

SEQ ID NO: 1714578 - RNA, 19 nt, Human
ugauccucccaccucagcc

SEQ ID NO: 1714579 - RNA, 13 nt, Human
ugaucuaggaaga

SEQ ID NO: 1714580 - RNA, 18 nt, Human
ugauccucccaccucagc

SEQ ID NO: 1714581 - RNA, 13 nt, Human
agccaccacgccc

SEQ ID NO: 1714582 - RNA, 16 nt, Human
agccacggccaggcca

SEQ ID NO: 1714583 - RNA, 17 nt, Human
ugauuaaauucuugcaa

SEQ ID NO: 1714584 - RNA, 13 nt, Human
ugauuaaauucuu

SEQ ID NO: 1714585 - RNA, 16 nt, Human
ugauuaaauucuugca

SEQ ID NO: 1714586 - RNA, 22 nt, Human
ugauggggcccugccuccuuug

SEQ ID NO: 1714587 - RNA, 23 nt, Human
ugauggguuaguggauggaaggg

SEQ ID NO: 1714588 - RNA, 19 nt, Human
ugauggguuaguggaugga

SEQ ID NO: 1714589 - RNA, 19 nt, Human
ugauguuuuccaugagucc

SEQ ID NO: 1714590 - RNA, 23 nt, Human
ugauguuuuccaugaguccccug

SEQ ID NO: 1714591 - RNA, 17 nt, Human
ugauguuuuccaugagu

SEQ ID NO: 1714592 - RNA, 21 nt, Human
ugauguuuuaaggaugcuugu

SEQ ID NO: 1714593 - RNA, 13 nt, Human
ugauggggcccug

SEQ ID NO: 1714594 - RNA, 22 nt, Human
ugaugggcaacccccagccugc

SEQ ID NO: 1714595 - RNA, 17 nt, Human
ugauggcuuaugauagc

SEQ ID NO: 1714596 - RNA, 21 nt, Human
ugaugaucuuugcagacaggc

SEQ ID NO: 1714597 - RNA, 20 nt, Human
ugaugaucuuugcagacagg

SEQ ID NO: 1714598 - RNA, 19 nt, Human
ugaugaucuuugcagacag

SEQ ID NO: 1714599 - RNA, 23 nt, Human
ugaugaaaugaggucagagccug

SEQ ID NO: 1714600 - RNA, 18 nt, Human
ugaugaaauguaaauacu

SEQ ID NO: 1714601 - RNA, 15 nt, Human
ugaucuaggaagacu

SEQ ID NO: 1714602 - RNA, 14 nt, Human
ugaucuaggaagac

SEQ ID NO: 1714603 - RNA, 22 nt, Human
ugaugaaaugaggucagagccu

SEQ ID NO: 1714604 - RNA, 19 nt, Human
agcauaaaaauuagccaag

SEQ ID NO: 1714605 - RNA, 14 nt, Human
agcaguuugcuuug

SEQ ID NO: 1714606 - RNA, 23 nt, Human
agcauaaaaauuagccaagugug

SEQ ID NO: 1714607 - RNA, 16 nt, Human
ugaguacguugugcau

SEQ ID NO: 1714608 - RNA, 17 nt, Human
ugaguacguugugcauu

SEQ ID NO: 1714609 - RNA, 18 nt, Human
ugaguacguugugcauuu

SEQ ID NO: 1714610 - RNA, 19 nt, Human
ugaguacguugugcauuug

SEQ ID NO: 1714611 - RNA, 14 nt, Human
ugauacaaugcugu

SEQ ID NO: 1714612 - RNA, 15 nt, Human
ugauacaaugcugug

SEQ ID NO: 1714613 - RNA, 23 nt, Human
ugagugggggaucacagccucug

SEQ ID NO: 1714614 - RNA, 21 nt, Human
ugagugggggaucacagccuc

SEQ ID NO: 1714615 - RNA, 14 nt, Human
ugagugccuuacac

SEQ ID NO: 1714616 - RNA, 13 nt, Human
ugagugccuuaca

SEQ ID NO: 1714617 - RNA, 17 nt, Human
ugagugcagcucuggag

SEQ ID NO: 1714618 - RNA, 16 nt, Human
ugagugccuuacacaa

SEQ ID NO: 1714619 - RNA, 13 nt, Human
ugaguccagaagu

SEQ ID NO: 1714620 - RNA, 14 nt, Human
ugaguacuacaguc

SEQ ID NO: 1714621 - RNA, 20 nt, Human
ugaguacguugugcauuugg

SEQ ID NO: 1714622 - RNA, 18 nt, Human
ugagucaccaagcccagu

SEQ ID NO: 1714623 - RNA, 11 nt, Human
agcagccacau

SEQ ID NO: 1714624 - RNA, 15 nt, Human
agcagccacauuccu

SEQ ID NO: 1714625 - RNA, 13 nt, Human
agcaggacaugga

SEQ ID NO: 1714626 - RNA, 16 nt, Human
agcagcagggagggcu

SEQ ID NO: 1714627 - RNA, 19 nt, Human
ugacccaugcugcccugug

SEQ ID NO: 1714628 - RNA, 18 nt, Human
ugacccaugcugcccugu

SEQ ID NO: 1714629 - RNA, 17 nt, Human
ugacccaugcugcccug

SEQ ID NO: 1714630 - RNA, 20 nt, Human
ugacccaugcugcccuguga

SEQ ID NO: 1714631 - RNA, 20 nt, Human
agcagggagggcuucugcca

SEQ ID NO: 1714632 - RNA, 15 nt, Human
agcagggcucagcgg

SEQ ID NO: 1714633 - RNA, 14 nt, Human
agcagggcucagcg

SEQ ID NO: 1714634 - RNA, 13 nt, Human
agcagggcucagc

SEQ ID NO: 1714635 - RNA, 22 nt, Human
agcagggcucagcggggacagc

SEQ ID NO: 1714636 - RNA, 19 nt, Human
agcaggcucucaggccagc

SEQ ID NO: 1714637 - RNA, 18 nt, Human
agcaggcucucaggccag

SEQ ID NO: 1714638 - RNA, 17 nt, Human
agcaggcucucaggcca

SEQ ID NO: 1714639 - RNA, 16 nt, Human
agcaggcucucaggcc

SEQ ID NO: 1714640 - RNA, 15 nt, Human
agcaggcucucaggc

SEQ ID NO: 1714641 - RNA, 14 nt, Human
agcaggcucucagg

SEQ ID NO: 1714642 - RNA, 13 nt, Human
agcaggcucucag

SEQ ID NO: 1714643 - RNA, 17 nt, Human
agcaggcucgggcuccc

SEQ ID NO: 1714644 - RNA, 23 nt, Human
agcaggcucucaggccagcugcu

SEQ ID NO: 1714645 - RNA, 22 nt, Human
agcaggcucucaggccagcugc

SEQ ID NO: 1714646 - RNA, 21 nt, Human
agcaggcucucaggccagcug

SEQ ID NO: 1714647 - RNA, 15 nt, Human
agcagggaaacagcu

SEQ ID NO: 1714648 - RNA, 14 nt, Human
agcagggaaacagc

SEQ ID NO: 1714649 - RNA, 13 nt, Human
agcagggaaacag

SEQ ID NO: 1714650 - RNA, 15 nt, Human
agcaggcugugaguu

SEQ ID NO: 1714651 - RNA, 15 nt, Human
ugaaauuguauuaca

SEQ ID NO: 1714652 - RNA, 17 nt, Human
ugaaauaagccagacau

SEQ ID NO: 1714653 - RNA, 18 nt, Human
ugaaauaagccagacauc

SEQ ID NO: 1714654 - RNA, 20 nt, Human
ugaaauaagccagacaucaa

SEQ ID NO: 1714655 - RNA, 23 nt, Human
ugaaauaagccagacaucaacag

SEQ ID NO: 1714656 - RNA, 18 nt, Human
agagcugccaccugccug

SEQ ID NO: 1714657 - RNA, 21 nt, Human
ucuuuggacccugaggcccag

SEQ ID NO: 1714658 - RNA, 17 nt, Human
ucuuuggacccugaggc

SEQ ID NO: 1714659 - RNA, 12 nt, Human
agagcagagacc

SEQ ID NO: 1714660 - RNA, 21 nt, Human
agagcaccuuagacagucccu

SEQ ID NO: 1714661 - RNA, 18 nt, Human
agagcagagaccaucccu

SEQ ID NO: 1714662 - RNA, 17 nt, Human
agagcagagaccauccc

SEQ ID NO: 1714663 - RNA, 20 nt, Human
agagcagagaccaucccuga

SEQ ID NO: 1714664 - RNA, 21 nt, Human
agagccuugcggaagguucua

SEQ ID NO: 1714665 - RNA, 11 nt, Human
agagccuugcg

SEQ ID NO: 1714666 - RNA, 15 nt, Human
agagguugcagugag

SEQ ID NO: 1714667 - RNA, 19 nt, Human
agagguccacaacacacag

SEQ ID NO: 1714668 - RNA, 13 nt, Human
agaggcugaggac

SEQ ID NO: 1714669 - RNA, 19 nt, Human
agaggcagccccauucugc

SEQ ID NO: 1714670 - RNA, 13 nt, Human
agaggcagcccca

SEQ ID NO: 1714671 - RNA, 13 nt, Human
agaggcagggucu

SEQ ID NO: 1714672 - RNA, 10 nt, Human
agaggcaggg

SEQ ID NO: 1714673 - RNA, 19 nt, Human
agaggccaugggccuccug

SEQ ID NO: 1714674 - RNA, 10 nt, Human
agaggcucag

SEQ ID NO: 1714675 - RNA, 18 nt, Human
agaggcucagauuguaau

SEQ ID NO: 1714676 - RNA, 19 nt, Human
ugaacaaauuuacagagac

SEQ ID NO: 1714677 - RNA, 20 nt, Human
ugaacaaauuuacagagaca

SEQ ID NO: 1714678 - RNA, 15 nt, Human
ugaaauuuuuauuaa

SEQ ID NO: 1714679 - RNA, 12 nt, Human
ugaaccugaaua

SEQ ID NO: 1714680 - RNA, 22 nt, Human
ugaaccgaugagaaauaaaguu

SEQ ID NO: 1714681 - RNA, 15 nt, Human
ugaacuccuggccuc

SEQ ID NO: 1714682 - RNA, 14 nt, Human
ugaacuccuggccu

SEQ ID NO: 1714683 - RNA, 12 nt, Human
ugaacuccuggc

SEQ ID NO: 1714684 - RNA, 21 nt, Human
ugaacuaggauuguaguccca

SEQ ID NO: 1714685 - RNA, 19 nt, Human
ugaacuuugaccucugcag

SEQ ID NO: 1714686 - RNA, 20 nt, Human
ugaacuuugaccucugcagc

SEQ ID NO: 1714687 - RNA, 22 nt, Human
ugaacuuugaccucugcagcaa

SEQ ID NO: 1714688 - RNA, 15 nt, Human
agagcuuaacagugu

SEQ ID NO: 1714689 - RNA, 22 nt, Human
agagcuucuguugcugccucau

SEQ ID NO: 1714690 - RNA, 18 nt, Human
agaucacgccacugcacu

SEQ ID NO: 1714691 - RNA, 17 nt, Human
agaucacgccacugcac

SEQ ID NO: 1714692 - RNA, 15 nt, Human
ugaauuucuuuugcc

SEQ ID NO: 1714693 - RNA, 16 nt, Human
agaucacgccacugca

SEQ ID NO: 1714694 - RNA, 15 nt, Human
agaucacgccacugc

SEQ ID NO: 1714695 - RNA, 14 nt, Human
agaucacgccacug

SEQ ID NO: 1714696 - RNA, 12 nt, Human
agauaaaugugc

SEQ ID NO: 1714697 - RNA, 17 nt, Human
agauaaagguucaugca

SEQ ID NO: 1714698 - RNA, 16 nt, Human
agaguuguuacauuuu

SEQ ID NO: 1714699 - RNA, 12 nt, Human
agaguuguuaca

SEQ ID NO: 1714700 - RNA, 20 nt, Human
agaguugaugguuguacaua

SEQ ID NO: 1714701 - RNA, 17 nt, Human
agaguugauacuacagu

SEQ ID NO: 1714702 - RNA, 20 nt, Human
agaguugauacuacaguuug

SEQ ID NO: 1714703 - RNA, 22 nt, Human
agaguugauacuacaguuuguu

SEQ ID NO: 1714704 - RNA, 20 nt, Human
ugaaugguuuucaaaauaaa

SEQ ID NO: 1714705 - RNA, 19 nt, Human
ugaaugucagugugacuga

SEQ ID NO: 1714706 - RNA, 15 nt, Human
agaugcaccagcccu

SEQ ID NO: 1714707 - RNA, 14 nt, Human
agaugcaccagccc

SEQ ID NO: 1714708 - RNA, 14 nt, Human
agaugcuagaacuc

SEQ ID NO: 1714709 - RNA, 15 nt, Human
agaugcuagaacucc

SEQ ID NO: 1714710 - RNA, 17 nt, Human
ugacccacaagaaauga

SEQ ID NO: 1714711 - RNA, 13 nt, Human
ugacccacugcuu

SEQ ID NO: 1714712 - RNA, 12 nt, Human
ugacccacugcu

SEQ ID NO: 1714713 - RNA, 15 nt, Human
agaugcuucucacug

SEQ ID NO: 1714714 - RNA, 21 nt, Human
ugacauuguuggccaaagcca

SEQ ID NO: 1714715 - RNA, 20 nt, Human
ugacauuguuggccaaagcc

SEQ ID NO: 1714716 - RNA, 22 nt, Human
ugacauuguagagcuucuggca

SEQ ID NO: 1714717 - RNA, 18 nt, Human
ugaccaaugauggucacc

SEQ ID NO: 1714718 - RNA, 19 nt, Human
ugaccaauauuguacaguu

SEQ ID NO: 1714719 - RNA, 21 nt, Human
ugaccaauauuguacaguuuu

SEQ ID NO: 1714720 - RNA, 17 nt, Human
ugaccaauauuguacag

SEQ ID NO: 1714721 - RNA, 18 nt, Human
ugaccaauauuguacagu

SEQ ID NO: 1714722 - RNA, 15 nt, Human
agaucagccugggca

SEQ ID NO: 1714723 - RNA, 13 nt, Human
agaucagccuggg

SEQ ID NO: 1714724 - RNA, 12 nt, Human
agaucauuguga

SEQ ID NO: 1714725 - RNA, 20 nt, Human
ugacagggcacaccgggcac

SEQ ID NO: 1714726 - RNA, 21 nt, Human
ugacagggcacaccgggcacu

SEQ ID NO: 1714727 - RNA, 16 nt, Human
ugacagggcacaccgg

SEQ ID NO: 1714728 - RNA, 11 nt, Human
ugacagggcac

SEQ ID NO: 1714729 - RNA, 14 nt, Human
ugacaggccugucc

SEQ ID NO: 1714730 - RNA, 21 nt, Human
ugacacacagcucuguccugg

SEQ ID NO: 1714731 - RNA, 20 nt, Human
ugacaggcaaugcuggcugu

SEQ ID NO: 1714732 - RNA, 20 nt, Human
ucuugagccuugaacuuuga

SEQ ID NO: 1714733 - RNA, 18 nt, Human
ucuugagccuugaacuuu

SEQ ID NO: 1714734 - RNA, 19 nt, Human
ucuugagccuugaacuuug

SEQ ID NO: 1714735 - RNA, 15 nt, Human
agacucauucuucug

SEQ ID NO: 1714736 - RNA, 17 nt, Human
ucuugagccuugaacuu

SEQ ID NO: 1714737 - RNA, 21 nt, Human
agacucaguggggaggggcug

SEQ ID NO: 1714738 - RNA, 16 nt, Human
agaccugccccuccuc

SEQ ID NO: 1714739 - RNA, 23 nt, Human
agaccugccccuccucucugccc

SEQ ID NO: 1714740 - RNA, 22 nt, Human
agaccugccccuccucucugcc

SEQ ID NO: 1714741 - RNA, 14 nt, Human
agacccggcugcgu

SEQ ID NO: 1714742 - RNA, 21 nt, Human
agaccccuggcuuuucacugc

SEQ ID NO: 1714743 - RNA, 15 nt, Human
agaccccuggcuuuu

SEQ ID NO: 1714744 - RNA, 23 nt, Human
ucuucuguacgucugacaggcaa

SEQ ID NO: 1714745 - RNA, 23 nt, Human
agacauacuaaccagcagaaaug

SEQ ID NO: 1714746 - RNA, 14 nt, Human
agacauagaauuaa

SEQ ID NO: 1714747 - RNA, 17 nt, Human
ucuuauuuaaugaaaga

SEQ ID NO: 1714748 - RNA, 22 nt, Human
ucuucugcuucagccucccgag

SEQ ID NO: 1714749 - RNA, 22 nt, Human
ucuucuguacgucugacaggca

SEQ ID NO: 1714750 - RNA, 21 nt, Human
ucuucuguacgucugacaggc

SEQ ID NO: 1714751 - RNA, 14 nt, Human
agacugucucaaga

SEQ ID NO: 1714752 - RNA, 15 nt, Human
agacuuccagagccu

SEQ ID NO: 1714753 - RNA, 16 nt, Human
agacuguacaaaguag

SEQ ID NO: 1714754 - RNA, 15 nt, Human
agacuguacaaagua

SEQ ID NO: 1714755 - RNA, 20 nt, Human
agacucgcgacaaugcaaac

SEQ ID NO: 1714756 - RNA, 24 nt, Human
agagacagaaagcagaacagugau

SEQ ID NO: 1714757 - RNA, 15 nt, Human
agagacacaagccuu

SEQ ID NO: 1714758 - RNA, 14 nt, Human
agagaaaaaagcca

SEQ ID NO: 1714759 - RNA, 22 nt, Human
agagaaaaaauauuuuccugcc

SEQ ID NO: 1714760 - RNA, 19 nt, Human
agacuuuuuuuaaauagua

SEQ ID NO: 1714761 - RNA, 18 nt, Human
agacuuguaugaaagaug

SEQ ID NO: 1714762 - RNA, 19 nt, Human
agacucgcgacaaugcaaa

SEQ ID NO: 1714763 - RNA, 18 nt, Human
agacucgcgacaaugcaa

SEQ ID NO: 1714764 - RNA, 17 nt, Human
agacucgcgacaaugca

SEQ ID NO: 1714765 - RNA, 15 nt, Human
agacucgcgacaaug

SEQ ID NO: 1714766 - RNA, 17 nt, Human
ucuuucuuccucugcug

SEQ ID NO: 1714767 - RNA, 16 nt, Human
ucuuucuuccucugcu

SEQ ID NO: 1714768 - RNA, 15 nt, Human
ucuuucuuccucugc

SEQ ID NO: 1714769 - RNA, 13 nt, Human
ucuuucugcuuug

SEQ ID NO: 1714770 - RNA, 20 nt, Human
ucuuuauaauucuacuuuga

SEQ ID NO: 1714771 - RNA, 18 nt, Human
ucuuucuggcuaugcauu

SEQ ID NO: 1714772 - RNA, 22 nt, Human
ucuuucugcagaaacagaaagg

SEQ ID NO: 1714773 - RNA, 19 nt, Human
ucuuucuggcuaugcauuu

SEQ ID NO: 1714774 - RNA, 14 nt, Human
ucuuucuuccucug

SEQ ID NO: 1714775 - RNA, 14 nt, Human
ucuugguuuguaaa

SEQ ID NO: 1714776 - RNA, 20 nt, Human
ucuuuaaugucacaggcagg

SEQ ID NO: 1714777 - RNA, 16 nt, Human
ucuugguuuguaaauu

SEQ ID NO: 1714778 - RNA, 22 nt, Human
ucuuuaaugucacaggcagguc

SEQ ID NO: 1714779 - RNA, 14 nt, Human
ucuuuaauuuuaca

SEQ ID NO: 1714780 - RNA, 15 nt, Human
ucuuuaguuuuugug

SEQ ID NO: 1714781 - RNA, 12 nt, Human
agacagucccug

SEQ ID NO: 1714782 - RNA, 16 nt, Human
agacagcugccuggga

SEQ ID NO: 1714783 - RNA, 15 nt, Human
agacagcugccuggg

SEQ ID NO: 1714784 - RNA, 14 nt, Human
agacagucccugcc

SEQ ID NO: 1714785 - RNA, 13 nt, Human
agacagucccugc

SEQ ID NO: 1714786 - RNA, 12 nt, Human
ucuuagauguau

SEQ ID NO: 1714787 - RNA, 14 nt, Human
ucuuagauguauau

SEQ ID NO: 1714788 - RNA, 19 nt, Human
ucuuacugucuuuuuucua

SEQ ID NO: 1714789 - RNA, 17 nt, Human
agacacaggcccggcuc

SEQ ID NO: 1714790 - RNA, 22 nt, Human
agacacaggcccggcuccaggc

SEQ ID NO: 1714791 - RNA, 21 nt, Human
agacacaggcccggcuccagg

SEQ ID NO: 1714792 - RNA, 20 nt, Human
agacacaggcccggcuccag

SEQ ID NO: 1714793 - RNA, 19 nt, Human
agacacaggcccggcucca

SEQ ID NO: 1714794 - RNA, 13 nt, Human
agacacaagccuu

SEQ ID NO: 1714795 - RNA, 14 nt, Human
agacacaagccuuc

SEQ ID NO: 1714796 - RNA, 17 nt, Human
agaauucucuuauccaa

SEQ ID NO: 1714797 - RNA, 18 nt, Human
agaauucucuaguuugau

SEQ ID NO: 1714798 - RNA, 19 nt, Human
agaauucucuaguuugauu

SEQ ID NO: 1714799 - RNA, 24 nt, Human
agacacauguccaagaagcccagg

SEQ ID NO: 1714800 - RNA, 22 nt, Human
agacaccuugacagggcacacc

SEQ ID NO: 1714801 - RNA, 22 nt, Human
agacacauguccaagaagccca

SEQ ID NO: 1714802 - RNA, 21 nt, Human
agacacauguccaagaagccc

SEQ ID NO: 1714803 - RNA, 23 nt, Human
agacacaggcccggcuccaggcu

SEQ ID NO: 1714804 - RNA, 14 nt, Human
agacagcugccugg

SEQ ID NO: 1714805 - RNA, 13 nt, Human
agacagcugccug

SEQ ID NO: 1714806 - RNA, 12 nt, Human
agacagaaaaaa

SEQ ID NO: 1714807 - RNA, 18 nt, Human
ucuguacgucugacaggc

SEQ ID NO: 1714808 - RNA, 23 nt, Human
ucuguuuagauaauacaccacua

SEQ ID NO: 1714809 - RNA, 16 nt, Human
ucuguuuagauaauac

SEQ ID NO: 1714810 - RNA, 19 nt, Human
ucuguuuagauaauacacc

SEQ ID NO: 1714811 - RNA, 19 nt, Human
ucuguucugcacacagcac

SEQ ID NO: 1714812 - RNA, 18 nt, Human
ucuguucugcacacagca

SEQ ID NO: 1714813 - RNA, 17 nt, Human
ucuguucugcacacagc

SEQ ID NO: 1714814 - RNA, 20 nt, Human
agaauucucagaaucucaaa

SEQ ID NO: 1714815 - RNA, 20 nt, Human
agaauuauaauuaguuccuc

SEQ ID NO: 1714816 - RNA, 14 nt, Human
agaauucucuaguu

SEQ ID NO: 1714817 - RNA, 23 nt, Human
ucuggguuccuuccucugagccu

SEQ ID NO: 1714818 - RNA, 22 nt, Human
ucuggguuccuuccucugagcc

SEQ ID NO: 1714819 - RNA, 19 nt, Human
agaauuaguggcacuugcu

SEQ ID NO: 1714820 - RNA, 21 nt, Human
agaauguguuuaaacuugguu

SEQ ID NO: 1714821 - RNA, 23 nt, Human
agaaccccaggguccuguagccc

SEQ ID NO: 1714822 - RNA, 16 nt, Human
agaaauuuccacucag

SEQ ID NO: 1714823 - RNA, 22 nt, Human
agaaauuuccacucaggucugu

SEQ ID NO: 1714824 - RNA, 13 nt, Human
ucucagggccugg

SEQ ID NO: 1714825 - RNA, 12 nt, Human
ucucagggccug

SEQ ID NO: 1714826 - RNA, 15 nt, Human
ucucagggccugguc

SEQ ID NO: 1714827 - RNA, 14 nt, Human
ucucagggccuggu

SEQ ID NO: 1714828 - RNA, 19 nt, Human
ucucagggccuggucguuu

SEQ ID NO: 1714829 - RNA, 16 nt, Human
ucuccaggcuguaucc

SEQ ID NO: 1714830 - RNA, 15 nt, Human
ucuccaagcaggaca

SEQ ID NO: 1714831 - RNA, 17 nt, Human
ucuccaaaauaaaacuu

SEQ ID NO: 1714832 - RNA, 19 nt, Human
ucuccaaaauaaaacuuuu

SEQ ID NO: 1714833 - RNA, 22 nt, Human
ucuccaaaauaaaacuuuuuaa

SEQ ID NO: 1714834 - RNA, 21 nt, Human
ucuccuccuuuucacaguucu

SEQ ID NO: 1714835 - RNA, 17 nt, Human
acuuucuagccagagga

SEQ ID NO: 1714836 - RNA, 14 nt, Human
acuuugaccucugc

SEQ ID NO: 1714837 - RNA, 16 nt, Human
ucuccauguuugaugu

SEQ ID NO: 1714838 - RNA, 16 nt, Human
acuucaggcucuucuc

SEQ ID NO: 1714839 - RNA, 14 nt, Human
acuucaggcucuuc

SEQ ID NO: 1714840 - RNA, 16 nt, Human
acuucagcugacuuuu

SEQ ID NO: 1714841 - RNA, 11 nt, Human
acuucagcuga

SEQ ID NO: 1714842 - RNA, 11 nt, Human
ucucacuccuu

SEQ ID NO: 1714843 - RNA, 14 nt, Human
acuucuccacccug

SEQ ID NO: 1714844 - RNA, 12 nt, Human
ucucacucuguc

SEQ ID NO: 1714845 - RNA, 16 nt, Human
ucucacucugucgccc

SEQ ID NO: 1714846 - RNA, 13 nt, Human
ucucacuccuuga

SEQ ID NO: 1714847 - RNA, 16 nt, Human
ucucacuauguugccc

SEQ ID NO: 1714848 - RNA, 15 nt, Human
acuuccugugacuuc

SEQ ID NO: 1714849 - RNA, 18 nt, Human
acuucuccacccugcucu

SEQ ID NO: 1714850 - RNA, 16 nt, Human
acuucuccacccugcu

SEQ ID NO: 1714851 - RNA, 15 nt, Human
acuucuccacccugc

SEQ ID NO: 1714852 - RNA, 21 nt, Human
acuugaacccauauuuguaca

SEQ ID NO: 1714853 - RNA, 19 nt, Human
acuugaacccgggaggcag

SEQ ID NO: 1714854 - RNA, 20 nt, Human
acuugaacccgggaggcaga

SEQ ID NO: 1714855 - RNA, 21 nt, Human
acuugaacccgggaggcagag

SEQ ID NO: 1714856 - RNA, 19 nt, Human
acuugagcccagagugaac

SEQ ID NO: 1714857 - RNA, 18 nt, Human
acuuguggacacagcucu

SEQ ID NO: 1714858 - RNA, 17 nt, Human
acuuguggacacagcuc

SEQ ID NO: 1714859 - RNA, 16 nt, Human
acuuguggacacagcu

SEQ ID NO: 1714860 - RNA, 14 nt, Human
acuugcucuugaug

SEQ ID NO: 1714861 - RNA, 18 nt, Human
ucugaagucacugcacag

SEQ ID NO: 1714862 - RNA, 16 nt, Human
ucugaagucacugcac

SEQ ID NO: 1714863 - RNA, 15 nt, Human
ucugaagucacugca

SEQ ID NO: 1714864 - RNA, 12 nt, Human
ucugacacacag

SEQ ID NO: 1714865 - RNA, 16 nt, Human
ucugacaacagacuuc

SEQ ID NO: 1714866 - RNA, 15 nt, Human
ucugacaacagacuu

SEQ ID NO: 1714867 - RNA, 14 nt, Human
agaaaugaaagcag

SEQ ID NO: 1714868 - RNA, 23 nt, Human
agaaaugaaaaaauauauaucaa

SEQ ID NO: 1714869 - RNA, 18 nt, Human
agaaaugaaaaaauauau

SEQ ID NO: 1714870 - RNA, 14 nt, Human
agaaagaaaaucag

SEQ ID NO: 1714871 - RNA, 20 nt, Human
agaaauaucugaaaauguau

SEQ ID NO: 1714872 - RNA, 19 nt, Human
agaaauaucugaaaaugua

SEQ ID NO: 1714873 - RNA, 14 nt, Human
agaaauauaauuga

SEQ ID NO: 1714874 - RNA, 17 nt, Human
agaaaugaaaaaauaua

SEQ ID NO: 1714875 - RNA, 15 nt, Human
agaaaucuaaaaaac

SEQ ID NO: 1714876 - RNA, 12 nt, Human
agaaaucuaaaa

SEQ ID NO: 1714877 - RNA, 23 nt, Human
ucugagacucgcgacaaugcaaa

SEQ ID NO: 1714878 - RNA, 14 nt, Human
ucugaccuuaaaug

SEQ ID NO: 1714879 - RNA, 19 nt, Human
ucugcacuccccugcuggg

SEQ ID NO: 1714880 - RNA, 18 nt, Human
ucugcacuccccugcugg

SEQ ID NO: 1714881 - RNA, 18 nt, Human
ucugauucccaagcucug

SEQ ID NO: 1714882 - RNA, 23 nt, Human
ucugaugcaagcaagaaacacug

SEQ ID NO: 1714883 - RNA, 22 nt, Human
ucugcacuccccugcugggugu

SEQ ID NO: 1714884 - RNA, 18 nt, Human
ucugcagcaauaaagcag

SEQ ID NO: 1714885 - RNA, 20 nt, Human
ucugcacuccccugcugggu

SEQ ID NO: 1714886 - RNA, 17 nt, Human
ucugcaggucccuaaua

SEQ ID NO: 1714887 - RNA, 16 nt, Human
ucugcaggucccuaau

SEQ ID NO: 1714888 - RNA, 15 nt, Human
ucugcaggucccuaa

SEQ ID NO: 1714889 - RNA, 17 nt, Human
agaaauuuauaaacuuu

SEQ ID NO: 1714890 - RNA, 16 nt, Human
agaaauuuauaaacuu

SEQ ID NO: 1714891 - RNA, 22 nt, Human
agaaauuaugugccagauuuau

SEQ ID NO: 1714892 - RNA, 21 nt, Human
agaaauuaugugccagauuua

SEQ ID NO: 1714893 - RNA, 13 nt, Human
agaaauuaugugc

SEQ ID NO: 1714894 - RNA, 18 nt, Human
ucugcaggucccuaauaa

SEQ ID NO: 1714895 - RNA, 12 nt, Human
ucucuggccuuc

SEQ ID NO: 1714896 - RNA, 19 nt, Human
ucucuggaauuugaaacac

SEQ ID NO: 1714897 - RNA, 15 nt, Human
ucucuggaauuugaa

SEQ ID NO: 1714898 - RNA, 17 nt, Human
ucucugcccuccaagac

SEQ ID NO: 1714899 - RNA, 16 nt, Human
ucucugcccuccaaga

SEQ ID NO: 1714900 - RNA, 15 nt, Human
ucucugcccuccaag

SEQ ID NO: 1714901 - RNA, 11 nt, Human
ucucugcccuc

SEQ ID NO: 1714902 - RNA, 14 nt, Human
ucucuccuguaccu

SEQ ID NO: 1714903 - RNA, 16 nt, Human
ucucuccuguaccucu

SEQ ID NO: 1714904 - RNA, 17 nt, Human
ucucuccuguaccucuu

SEQ ID NO: 1714905 - RNA, 19 nt, Human
ucucuccagccccuggaug

SEQ ID NO: 1714906 - RNA, 18 nt, Human
ucucuccagccccuggau

SEQ ID NO: 1714907 - RNA, 17 nt, Human
ucucuccagccccugga

SEQ ID NO: 1714908 - RNA, 15 nt, Human
acuuugaccucugca

SEQ ID NO: 1714909 - RNA, 16 nt, Human
acuuugaccucugcag

SEQ ID NO: 1714910 - RNA, 18 nt, Human
acuuugaccucugcagca

SEQ ID NO: 1714911 - RNA, 15 nt, Human
ucucucacuccuuga

SEQ ID NO: 1714912 - RNA, 13 nt, Human
ucucucacuccuu

SEQ ID NO: 1714913 - RNA, 21 nt, Human
ucucuggccuucggccuccau

SEQ ID NO: 1714914 - RNA, 22 nt, Human
ucucuggccuucggccuccauc

SEQ ID NO: 1714915 - RNA, 23 nt, Human
ucucuggccuucggccuccaucc

SEQ ID NO: 1714916 - RNA, 18 nt, Human
ucucuugagccugggagg

SEQ ID NO: 1714917 - RNA, 16 nt, Human
ucucuugauucauaau

SEQ ID NO: 1714918 - RNA, 14 nt, Human
ucucuugauucaua

SEQ ID NO: 1714919 - RNA, 21 nt, Human
ucucuuuaaugucacaggcag

SEQ ID NO: 1714920 - RNA, 20 nt, Human
ucucuuuaaugucacaggca

SEQ ID NO: 1714921 - RNA, 13 nt, Human
agaaaaagaaaaa

SEQ ID NO: 1714922 - RNA, 17 nt, Human
agaaaaaggaugcacag

SEQ ID NO: 1714923 - RNA, 19 nt, Human
agaaaacuuguauuaugug

SEQ ID NO: 1714924 - RNA, 18 nt, Human
agaaaaaggaugcacaga

SEQ ID NO: 1714925 - RNA, 21 nt, Human
agaaaacuuguauuaugugug

SEQ ID NO: 1714926 - RNA, 23 nt, Human
uccuuuagcgcccaguugggugg

SEQ ID NO: 1714927 - RNA, 22 nt, Human
uccuuuagcgcccaguugggug

SEQ ID NO: 1714928 - RNA, 16 nt, Human
ucgcgacaaugcaaac

SEQ ID NO: 1714929 - RNA, 13 nt, Human
ucgaggacaggga

SEQ ID NO: 1714930 - RNA, 19 nt, Human
ucgcgacaaugcaaaccau

SEQ ID NO: 1714931 - RNA, 18 nt, Human
ucgagcaugccuggaugg

SEQ ID NO: 1714932 - RNA, 16 nt, Human
ucgagcaugccuggau

SEQ ID NO: 1714933 - RNA, 18 nt, Human
ucgcuauugucaccaggg

SEQ ID NO: 1714934 - RNA, 23 nt, Human
ucgcuagcauuucccaacacaaa

SEQ ID NO: 1714935 - RNA, 19 nt, Human
uccuuuagcgcccaguugg

SEQ ID NO: 1714936 - RNA, 15 nt, Human
uccuuuagcgcccag

SEQ ID NO: 1714937 - RNA, 21 nt, Human
uccuuuaauuuuuuacuauuu

SEQ ID NO: 1714938 - RNA, 14 nt, Human
uccuuguguuacua

SEQ ID NO: 1714939 - RNA, 23 nt, Human
uccuuguguuacuaaguuuuuau

SEQ ID NO: 1714940 - RNA, 17 nt, Human
uccuucagugccuuaug

SEQ ID NO: 1714941 - RNA, 16 nt, Human
uccuucagugccuuau

SEQ ID NO: 1714942 - RNA, 15 nt, Human
uccuucagugccuua

SEQ ID NO: 1714943 - RNA, 16 nt, Human
acuggccucugcugau

SEQ ID NO: 1714944 - RNA, 14 nt, Human
acuggccucugcug

SEQ ID NO: 1714945 - RNA, 21 nt, Human
acugccuauuuuaauaaacac

SEQ ID NO: 1714946 - RNA, 16 nt, Human
acugccuauuuuaaua

SEQ ID NO: 1714947 - RNA, 15 nt, Human
acugccucuuccucc

SEQ ID NO: 1714948 - RNA, 14 nt, Human
acugccucuuccuc

SEQ ID NO: 1714949 - RNA, 22 nt, Human
uccuagaaauuccccacccuga

SEQ ID NO: 1714950 - RNA, 21 nt, Human
uccuagaaauuccccacccug

SEQ ID NO: 1714951 - RNA, 16 nt, Human
acugcauaugaaagga

SEQ ID NO: 1714952 - RNA, 15 nt, Human
acugcauguuuguga

SEQ ID NO: 1714953 - RNA, 16 nt, Human
acugcauguuugugau

SEQ ID NO: 1714954 - RNA, 23 nt, Human
acugcauccuccgccucccgggu

SEQ ID NO: 1714955 - RNA, 22 nt, Human
acugcaucaagaugugacaugu

SEQ ID NO: 1714956 - RNA, 20 nt, Human
acugcaucaagaugugacau

SEQ ID NO: 1714957 - RNA, 20 nt, Human
acugcauccuccgccucccg

SEQ ID NO: 1714958 - RNA, 17 nt, Human
acugcauccuccgccuc

SEQ ID NO: 1714959 - RNA, 14 nt, Human
acugcuuuuggucu

SEQ ID NO: 1714960 - RNA, 20 nt, Human
acugcuuaacuucacauauu

SEQ ID NO: 1714961 - RNA, 17 nt, Human
acugcuuccagugaggc

SEQ ID NO: 1714962 - RNA, 15 nt, Human
acuggauuaaacuua

SEQ ID NO: 1714963 - RNA, 18 nt, Human
acugcuuaacuucacaua

SEQ ID NO: 1714964 - RNA, 15 nt, Human
acugcuggcugccuu

SEQ ID NO: 1714965 - RNA, 14 nt, Human
acugcuggcugccu

SEQ ID NO: 1714966 - RNA, 12 nt, Human
ucgggcaugaca

SEQ ID NO: 1714967 - RNA, 11 nt, Human
ucgggcaugac

SEQ ID NO: 1714968 - RNA, 21 nt, Human
ucgggaggucgaggcaggagg

SEQ ID NO: 1714969 - RNA, 19 nt, Human
ucgggaggucgaggcagga

SEQ ID NO: 1714970 - RNA, 17 nt, Human
ucgggaggucgaggcag

SEQ ID NO: 1714971 - RNA, 18 nt, Human
ucggcucacugcauccuc

SEQ ID NO: 1714972 - RNA, 13 nt, Human
ucguaaaauuaag

SEQ ID NO: 1714973 - RNA, 16 nt, Human
ucguaaaauuaagaaa

SEQ ID NO: 1714974 - RNA, 22 nt, Human
ucguuuucaaaauuguuacaaa

SEQ ID NO: 1714975 - RNA, 17 nt, Human
ucguuugaaucacagua

SEQ ID NO: 1714976 - RNA, 17 nt, Human
acuguccuacccacccu

SEQ ID NO: 1714977 - RNA, 23 nt, Human
acuguccuacccacccuccuuuc

SEQ ID NO: 1714978 - RNA, 18 nt, Human
acuguccuacccacccuc

SEQ ID NO: 1714979 - RNA, 16 nt, Human
acugggagaaaugaaa

SEQ ID NO: 1714980 - RNA, 12 nt, Human
acugugugcuca

SEQ ID NO: 1714981 - RNA, 21 nt, Human
acugugugcucaggagcccug

SEQ ID NO: 1714982 - RNA, 20 nt, Human
acugugugcucaggagcccu

SEQ ID NO: 1714983 - RNA, 19 nt, Human
acugugugcucaggagccc

SEQ ID NO: 1714984 - RNA, 15 nt, Human
acugugugcucagga

SEQ ID NO: 1714985 - RNA, 16 nt, Human
acuuagaaauugcauu

SEQ ID NO: 1714986 - RNA, 14 nt, Human
acuucagcucuguu

SEQ ID NO: 1714987 - RNA, 13 nt, Human
acuuaaucuaaau

SEQ ID NO: 1714988 - RNA, 15 nt, Human
acuuaaucuaaaugg

SEQ ID NO: 1714989 - RNA, 16 nt, Human
acuuaaucuaaaugga

SEQ ID NO: 1714990 - RNA, 18 nt, Human
acuguugcccaggcuggc

SEQ ID NO: 1714991 - RNA, 17 nt, Human
acuguugcccaggcugg

SEQ ID NO: 1714992 - RNA, 14 nt, Human
acuguugcccaggc

SEQ ID NO: 1714993 - RNA, 13 nt, Human
acuguugcccagg

SEQ ID NO: 1714994 - RNA, 12 nt, Human
acuguugcccag

SEQ ID NO: 1714995 - RNA, 17 nt, Human
acuuaaauaaugugaaa

SEQ ID NO: 1714996 - RNA, 18 nt, Human
acuuaaauaaugugaaac

SEQ ID NO: 1714997 - RNA, 16 nt, Human
acuuaaauaaugugaa

SEQ ID NO: 1714998 - RNA, 15 nt, Human
acuuaaauaauguga

SEQ ID NO: 1714999 - RNA, 20 nt, Human
ucuaaagccauuguaguccu

SEQ ID NO: 1715000 - RNA, 14 nt, Human
ucuaaagcugccag

SEQ ID NO: 1715001 - RNA, 13 nt, Human
ucuaaagcugcca

SEQ ID NO: 1715002 - RNA, 15 nt, Human
ucuaaagcugccagc

SEQ ID NO: 1715003 - RNA, 16 nt, Human
ucuaaagcugccagcc

SEQ ID NO: 1715004 - RNA, 14 nt, Human
acuguucucugccc

SEQ ID NO: 1715005 - RNA, 20 nt, Human
acuguucucugcccuccaag

SEQ ID NO: 1715006 - RNA, 15 nt, Human
acuguucucugcccu

SEQ ID NO: 1715007 - RNA, 21 nt, Human
acuguucucugcccuccaaga

SEQ ID NO: 1715008 - RNA, 17 nt, Human
acuacucccccaggugg

SEQ ID NO: 1715009 - RNA, 21 nt, Human
acuacuagggaaaugccuuug

SEQ ID NO: 1715010 - RNA, 12 nt, Human
acucaccccagc

SEQ ID NO: 1715011 - RNA, 17 nt, Human
ucccgaguagcugggac

SEQ ID NO: 1715012 - RNA, 16 nt, Human
ucccgaguagcuggga

SEQ ID NO: 1715013 - RNA, 18 nt, Human
ucccgaguagcugggacu

SEQ ID NO: 1715014 - RNA, 20 nt, Human
ucccgaguagcugggacuac

SEQ ID NO: 1715015 - RNA, 20 nt, Human
ucccgaguagcugagauuau

SEQ ID NO: 1715016 - RNA, 15 nt, Human
ucccgaguagcuggg

SEQ ID NO: 1715017 - RNA, 20 nt, Human
ucccgaauagcugggacuac

SEQ ID NO: 1715018 - RNA, 17 nt, Human
ucccugaaggccccgcc

SEQ ID NO: 1715019 - RNA, 16 nt, Human
ucccugaaggccccgc

SEQ ID NO: 1715020 - RNA, 14 nt, Human
ucccucuuucccuc

SEQ ID NO: 1715021 - RNA, 20 nt, Human
ucccucuuucccucccuucc

SEQ ID NO: 1715022 - RNA, 18 nt, Human
ucccucuuucccucccuu

SEQ ID NO: 1715023 - RNA, 21 nt, Human
ucccucuuucccucccuuccu

SEQ ID NO: 1715024 - RNA, 15 nt, Human
ucccugaaggccccg

SEQ ID NO: 1715025 - RNA, 11 nt, Human
ucccugaaggc

SEQ ID NO: 1715026 - RNA, 22 nt, Human
ucccggcugcccuuucugggca

SEQ ID NO: 1715027 - RNA, 18 nt, Human
ucccggcugcccuuucug

SEQ ID NO: 1715028 - RNA, 15 nt, Human
ucccggcugcccuuu

SEQ ID NO: 1715029 - RNA, 14 nt, Human
ucccggcugcccuu

SEQ ID NO: 1715030 - RNA, 13 nt, Human
ucccggcugcccu

SEQ ID NO: 1715031 - RNA, 12 nt, Human
ucccuuuuccuu

SEQ ID NO: 1715032 - RNA, 14 nt, Human
ucccuuuuccauga

SEQ ID NO: 1715033 - RNA, 16 nt, Human
uccuagaaauucccca

SEQ ID NO: 1715034 - RNA, 14 nt, Human
uccuacuuccccuu

SEQ ID NO: 1715035 - RNA, 17 nt, Human
uccggucccugucccag

SEQ ID NO: 1715036 - RNA, 19 nt, Human
uccuaaauauauuuuaaga

SEQ ID NO: 1715037 - RNA, 12 nt, Human
ucccugucccag

SEQ ID NO: 1715038 - RNA, 15 nt, Human
ucccugguggcagcu

SEQ ID NO: 1715039 - RNA, 21 nt, Human
acuccugcaggcagccaggcc

SEQ ID NO: 1715040 - RNA, 17 nt, Human
ucccuuacgugaguccu

SEQ ID NO: 1715041 - RNA, 17 nt, Human
acuccagaauuucccaa

SEQ ID NO: 1715042 - RNA, 15 nt, Human
acuccagaauuuccc

SEQ ID NO: 1715043 - RNA, 15 nt, Human
acucauugaccugag

SEQ ID NO: 1715044 - RNA, 14 nt, Human
acucauugaccuga

SEQ ID NO: 1715045 - RNA, 15 nt, Human
acucauucuucugua

SEQ ID NO: 1715046 - RNA, 13 nt, Human
acuccagccuggg

SEQ ID NO: 1715047 - RNA, 12 nt, Human
acuccagccugg

SEQ ID NO: 1715048 - RNA, 23 nt, Human
acuccagaauuucccaaagcagu

SEQ ID NO: 1715049 - RNA, 17 nt, Human
acuccugcaggcagcca

SEQ ID NO: 1715050 - RNA, 15 nt, Human
acuccugaccucaag

SEQ ID NO: 1715051 - RNA, 19 nt, Human
acuccugcaggcagccagg

SEQ ID NO: 1715052 - RNA, 18 nt, Human
acuccugcaggcagccag

SEQ ID NO: 1715053 - RNA, 13 nt, Human
acuccucugucca

SEQ ID NO: 1715054 - RNA, 14 nt, Human
acuccucuguccag

SEQ ID NO: 1715055 - RNA, 13 nt, Human
uccaugaagaugu

SEQ ID NO: 1715056 - RNA, 21 nt, Human
uccaugaagauguagaggaga

SEQ ID NO: 1715057 - RNA, 20 nt, Human
uccauccugaggcuccacuu

SEQ ID NO: 1715058 - RNA, 21 nt, Human
uccauccugaggcuccacuug

SEQ ID NO: 1715059 - RNA, 23 nt, Human
acgccagauucuuuccugaggcu

SEQ ID NO: 1715060 - RNA, 22 nt, Human
acgccagauucuuuccugaggc

SEQ ID NO: 1715061 - RNA, 16 nt, Human
uccaucuaaacugccc

SEQ ID NO: 1715062 - RNA, 18 nt, Human
uccaucuaaacugccccc

SEQ ID NO: 1715063 - RNA, 18 nt, Human
ucccaaacccuucagugc

SEQ ID NO: 1715064 - RNA, 16 nt, Human
ucccaaagcagugcau

SEQ ID NO: 1715065 - RNA, 18 nt, Human
ucccaaagcagugcaugc

SEQ ID NO: 1715066 - RNA, 17 nt, Human
ucccaaagcagugcaug

SEQ ID NO: 1715067 - RNA, 21 nt, Human
ucccaaagcagugcaugcugu

SEQ ID NO: 1715068 - RNA, 14 nt, Human
ucccaaagugcugg

SEQ ID NO: 1715069 - RNA, 13 nt, Human
ucccaaagugcug

SEQ ID NO: 1715070 - RNA, 20 nt, Human
acgggaggguaaggcugugg

SEQ ID NO: 1715071 - RNA, 13 nt, Human
ucccacagcgcug

SEQ ID NO: 1715072 - RNA, 20 nt, Human
ucccaccccacacacgccag

SEQ ID NO: 1715073 - RNA, 15 nt, Human
ucccaccccacacac

SEQ ID NO: 1715074 - RNA, 16 nt, Human
ucccacaaaggagagc

SEQ ID NO: 1715075 - RNA, 23 nt, Human
acguggcugcuucaaggauccug

SEQ ID NO: 1715076 - RNA, 17 nt, Human
acgguuuuacugcagcu

SEQ ID NO: 1715077 - RNA, 15 nt, Human
acgguuuuacugcag

SEQ ID NO: 1715078 - RNA, 22 nt, Human
acguauaaaagccuguuuaaga

SEQ ID NO: 1715079 - RNA, 22 nt, Human
ucccauaugccugggcagaagg

SEQ ID NO: 1715080 - RNA, 15 nt, Human
ucccaucacccgcua

SEQ ID NO: 1715081 - RNA, 21 nt, Human
uccccaccgcagacaggacca

SEQ ID NO: 1715082 - RNA, 18 nt, Human
uccccaccgcagacagga

SEQ ID NO: 1715083 - RNA, 17 nt, Human
uccccaccgcagacagg

SEQ ID NO: 1715084 - RNA, 22 nt, Human
uccccaccgcagacaggaccag

SEQ ID NO: 1715085 - RNA, 12 nt, Human
uccccacccuga

SEQ ID NO: 1715086 - RNA, 17 nt, Human
uccccaugucucgacuc

SEQ ID NO: 1715087 - RNA, 15 nt, Human
acuacauucuguuaa

SEQ ID NO: 1715088 - RNA, 17 nt, Human
ucccagcugugcucugg

SEQ ID NO: 1715089 - RNA, 12 nt, Human
ucccagccccaa

SEQ ID NO: 1715090 - RNA, 15 nt, Human
acuacaguuuguuag

SEQ ID NO: 1715091 - RNA, 11 nt, Human
acuacauucug

SEQ ID NO: 1715092 - RNA, 12 nt, Human
acuacauucugu

SEQ ID NO: 1715093 - RNA, 13 nt, Human
acuacauucuguu

SEQ ID NO: 1715094 - RNA, 14 nt, Human
acuacauucuguua

SEQ ID NO: 1715095 - RNA, 12 nt, Human
acuaaccacgcu

SEQ ID NO: 1715096 - RNA, 11 nt, Human
acuacaggcac

SEQ ID NO: 1715097 - RNA, 13 nt, Human
acuacaguuuguu

SEQ ID NO: 1715098 - RNA, 14 nt, Human
acuacaguuuguua

SEQ ID NO: 1715099 - RNA, 15 nt, Human
acuacaggcacccac

SEQ ID NO: 1715100 - RNA, 19 nt, Human
acgccagauucuuuccuga

SEQ ID NO: 1715101 - RNA, 16 nt, Human
acgagcaggcuucuuc

SEQ ID NO: 1715102 - RNA, 14 nt, Human
acgagaaaacaaua

SEQ ID NO: 1715103 - RNA, 21 nt, Human
accuuuuuuauacauaaacaa

SEQ ID NO: 1715104 - RNA, 22 nt, Human
accuuuuuuauacauaaacaag

SEQ ID NO: 1715105 - RNA, 19 nt, Human
accuuuuuuauacauaaac

SEQ ID NO: 1715106 - RNA, 20 nt, Human
accuuuuuuauacauaaaca

SEQ ID NO: 1715107 - RNA, 21 nt, Human
uccaggcuguaucccaugagc

SEQ ID NO: 1715108 - RNA, 12 nt, Human
uccagccccugg

SEQ ID NO: 1715109 - RNA, 15 nt, Human
uccagagaguggcuc

SEQ ID NO: 1715110 - RNA, 17 nt, Human
uccagagaguggcuccu

SEQ ID NO: 1715111 - RNA, 16 nt, Human
uccagagaguggcucc

SEQ ID NO: 1715112 - RNA, 13 nt, Human
uccagccccugga

SEQ ID NO: 1715113 - RNA, 14 nt, Human
uccagccccuggau

SEQ ID NO: 1715114 - RNA, 14 nt, Human
uccaggcuguaucc

SEQ ID NO: 1715115 - RNA, 20 nt, Human
accuuuugagugccuuacac

SEQ ID NO: 1715116 - RNA, 17 nt, Human
accuuuugagugccuua

SEQ ID NO: 1715117 - RNA, 14 nt, Human
accuuuugagugcc

SEQ ID NO: 1715118 - RNA, 19 nt, Human
uccaccuucccaugcccug

SEQ ID NO: 1715119 - RNA, 18 nt, Human
uccaccuucccaugcccu

SEQ ID NO: 1715120 - RNA, 16 nt, Human
uccaccuucccaugcc

SEQ ID NO: 1715121 - RNA, 17 nt, Human
uccacucaggucuguuu

SEQ ID NO: 1715122 - RNA, 13 nt, Human
uccagacacaugu

SEQ ID NO: 1715123 - RNA, 22 nt, Human
uccagaauuucccaaagcagug

SEQ ID NO: 1715124 - RNA, 20 nt, Human
uccagaauuucccaaagcag

SEQ ID NO: 1715125 - RNA, 22 nt, Human
uccacugccuucgauacaccgg

SEQ ID NO: 1715126 - RNA, 15 nt, Human
uccacugccuucgau

SEQ ID NO: 1715127 - RNA, 13 nt, Human
uccacugccuucg

SEQ ID NO: 1715128 - RNA, 16 nt, Human
uccagaauuucccaaa

SEQ ID NO: 1715129 - RNA, 18 nt, Human
uccagacccggcugcgug

SEQ ID NO: 1715130 - RNA, 15 nt, Human
uccagacccggcugc

SEQ ID NO: 1715131 - RNA, 19 nt, Human
uccagacccggcugcgugg

SEQ ID NO: 1715132 - RNA, 14 nt, Human
uccagagacuggga

SEQ ID NO: 1715133 - RNA, 17 nt, Human
accuggccucugcacuc

SEQ ID NO: 1715134 - RNA, 16 nt, Human
accuggccucugcacu

SEQ ID NO: 1715135 - RNA, 14 nt, Human
accuggccucugca

SEQ ID NO: 1715136 - RNA, 17 nt, Human
uccacccaggagccccg

SEQ ID NO: 1715137 - RNA, 15 nt, Human
uccacccaggagccc

SEQ ID NO: 1715138 - RNA, 14 nt, Human
uccacccaggagcc

SEQ ID NO: 1715139 - RNA, 12 nt, Human
uccacccaggag

SEQ ID NO: 1715140 - RNA, 19 nt, Human
uccacccaccucagccucc

SEQ ID NO: 1715141 - RNA, 18 nt, Human
uccacccaccucagccuc

SEQ ID NO: 1715142 - RNA, 20 nt, Human
accuuagacagucccugcca

SEQ ID NO: 1715143 - RNA, 19 nt, Human
accuuagacagucccugcc

SEQ ID NO: 1715144 - RNA, 18 nt, Human
accuuagacagucccugc

SEQ ID NO: 1715145 - RNA, 19 nt, Human
accuguuucugcagccacu

SEQ ID NO: 1715146 - RNA, 21 nt, Human
accuggucacaggacucugcc

SEQ ID NO: 1715147 - RNA, 20 nt, Human
accuggccucugcacucccc

SEQ ID NO: 1715148 - RNA, 18 nt, Human
accuggccucugcacucc

SEQ ID NO: 1715149 - RNA, 23 nt, Human
accuggccucugcacuccccugc

SEQ ID NO: 1715150 - RNA, 21 nt, Human
uccaagcuggucccacucagu

SEQ ID NO: 1715151 - RNA, 19 nt, Human
uccaaguccacaguggaac

SEQ ID NO: 1715152 - RNA, 18 nt, Human
uccaaucccaccaacccu

SEQ ID NO: 1715153 - RNA, 20 nt, Human
uccaagcuggucccacucag

SEQ ID NO: 1715154 - RNA, 16 nt, Human
uccaagcuggucccac

SEQ ID NO: 1715155 - RNA, 12 nt, Human
uccaagaagccc

SEQ ID NO: 1715156 - RNA, 15 nt, Human
accugccaggaagcc

SEQ ID NO: 1715157 - RNA, 14 nt, Human
accugccaggaagc

SEQ ID NO: 1715158 - RNA, 12 nt, Human
accugccaggaa

SEQ ID NO: 1715159 - RNA, 14 nt, Human
uccaacccucauca

SEQ ID NO: 1715160 - RNA, 17 nt, Human
uccaacccucaucacca

SEQ ID NO: 1715161 - RNA, 16 nt, Human
uccaacccucaucacc

SEQ ID NO: 1715162 - RNA, 23 nt, Human
uccaacccucaucaccaacgucu

SEQ ID NO: 1715163 - RNA, 16 nt, Human
accuacaguguacagu

SEQ ID NO: 1715164 - RNA, 17 nt, Human
accuacaguguacaguc

SEQ ID NO: 1715165 - RNA, 18 nt, Human
accuacaguguacagucu

SEQ ID NO: 1715166 - RNA, 20 nt, Human
accuacaguguacagucuug

SEQ ID NO: 1715167 - RNA, 15 nt, Human
accuacaguguacag

SEQ ID NO: 1715168 - RNA, 20 nt, Human
accuaccaccacgcccggcu

SEQ ID NO: 1715169 - RNA, 16 nt, Human
accuaccaccacgccc

SEQ ID NO: 1715170 - RNA, 15 nt, Human
ucaggaagcucaggg

SEQ ID NO: 1715171 - RNA, 14 nt, Human
ucaggaagcucagg

SEQ ID NO: 1715172 - RNA, 13 nt, Human
ucaggaagcucag

SEQ ID NO: 1715173 - RNA, 20 nt, Human
accuaacaacauuguagccu

SEQ ID NO: 1715174 - RNA, 22 nt, Human
ucauccuucuggaauaaggaga

SEQ ID NO: 1715175 - RNA, 14 nt, Human
ucaucuaggauuuu

SEQ ID NO: 1715176 - RNA, 18 nt, Human
ucaucuagguaaauuaca

SEQ ID NO: 1715177 - RNA, 19 nt, Human
ucauccuccucagaucuuc

SEQ ID NO: 1715178 - RNA, 13 nt, Human
ucauccuccucag

SEQ ID NO: 1715179 - RNA, 18 nt, Human
ucauccucauacccaccc

SEQ ID NO: 1715180 - RNA, 14 nt, Human
ucauccuucuggaa

SEQ ID NO: 1715181 - RNA, 12 nt, Human
accuccugccuc

SEQ ID NO: 1715182 - RNA, 13 nt, Human
accuccugccucg

SEQ ID NO: 1715183 - RNA, 23 nt, Human
accuccugccucgaacuggcugc

SEQ ID NO: 1715184 - RNA, 15 nt, Human
ucauccuaagcuauu

SEQ ID NO: 1715185 - RNA, 13 nt, Human
ucauugaaaucuu

SEQ ID NO: 1715186 - RNA, 12 nt, Human
ucauugaaaucu

SEQ ID NO: 1715187 - RNA, 12 nt, Human
ucauucuucugu

SEQ ID NO: 1715188 - RNA, 19 nt, Human
accucggugccuuccucuu

SEQ ID NO: 1715189 - RNA, 13 nt, Human
accuccugggcua

SEQ ID NO: 1715190 - RNA, 15 nt, Human
ucauugaccugaggc

SEQ ID NO: 1715191 - RNA, 14 nt, Human
ucauugaccugagg

SEQ ID NO: 1715192 - RNA, 12 nt, Human
ucauugaccuga

SEQ ID NO: 1715193 - RNA, 22 nt, Human
ucauugaaaucuuuuugcuuug

SEQ ID NO: 1715194 - RNA, 19 nt, Human
ucauugaccugaggcccuu

SEQ ID NO: 1715195 - RNA, 18 nt, Human
accugauugugucucuug

SEQ ID NO: 1715196 - RNA, 17 nt, Human
accugauugugucucuu

SEQ ID NO: 1715197 - RNA, 15 nt, Human
accugauugugucuc

SEQ ID NO: 1715198 - RNA, 21 nt, Human
accugaggcccuucucuccag

SEQ ID NO: 1715199 - RNA, 20 nt, Human
accugaggcccuucucucca

SEQ ID NO: 1715200 - RNA, 16 nt, Human
accugaggcccuucuc

SEQ ID NO: 1715201 - RNA, 15 nt, Human
accugaggcccuucu

SEQ ID NO: 1715202 - RNA, 22 nt, Human
accugaggcccuucucuccagc

SEQ ID NO: 1715203 - RNA, 14 nt, Human
accugaggcccuuc

SEQ ID NO: 1715204 - RNA, 22 nt, Human
uauuucccucaccuuucccauc

SEQ ID NO: 1715205 - RNA, 23 nt, Human
uauuuccuauauuguuuucagug

SEQ ID NO: 1715206 - RNA, 20 nt, Human
acaguugaaaaacagcugag

SEQ ID NO: 1715207 - RNA, 16 nt, Human
acaguugaaaaacagc

SEQ ID NO: 1715208 - RNA, 15 nt, Human
acaguugaaaaacag

SEQ ID NO: 1715209 - RNA, 13 nt, Human
acauacuaaccag

SEQ ID NO: 1715210 - RNA, 21 nt, Human
acauacuaaccagcagaaaug

SEQ ID NO: 1715211 - RNA, 22 nt, Human
acauacuaaccagcagaaaugc

SEQ ID NO: 1715212 - RNA, 13 nt, Human
acauacucccauc

SEQ ID NO: 1715213 - RNA, 14 nt, Human
acauacucugcuua

SEQ ID NO: 1715214 - RNA, 17 nt, Human
acauacucccaucugug

SEQ ID NO: 1715215 - RNA, 15 nt, Human
acaguuuuuauugcu

SEQ ID NO: 1715216 - RNA, 16 nt, Human
acaguuuguuaguaug

SEQ ID NO: 1715217 - RNA, 20 nt, Human
acaguuuguuaguaugaggc

SEQ ID NO: 1715218 - RNA, 21 nt, Human
acauagugaugguuccccugu

SEQ ID NO: 1715219 - RNA, 16 nt, Human
acauagugaugguucc

SEQ ID NO: 1715220 - RNA, 14 nt, Human
acauagaauuaaca

SEQ ID NO: 1715221 - RNA, 18 nt, Human
acauagaauuaacacaug

SEQ ID NO: 1715222 - RNA, 21 nt, Human
acauagcuuacaagccagcug

SEQ ID NO: 1715223 - RNA, 14 nt, Human
acauauugauuucc

SEQ ID NO: 1715224 - RNA, 16 nt, Human
acauauugauuuccgu

SEQ ID NO: 1715225 - RNA, 18 nt, Human
acauauugauuuccguua

SEQ ID NO: 1715226 - RNA, 22 nt, Human
acauauugauuuccguuaaaau

SEQ ID NO: 1715227 - RNA, 23 nt, Human
acauauugauuuccguuaaaaua

SEQ ID NO: 1715228 - RNA, 13 nt, Human
acaucaacagaua

SEQ ID NO: 1715229 - RNA, 18 nt, Human
acaucaacaucuugguca

SEQ ID NO: 1715230 - RNA, 16 nt, Human
acaucaacaucuuggu

SEQ ID NO: 1715231 - RNA, 23 nt, Human
acaucucccuuuuccaugacugu

SEQ ID NO: 1715232 - RNA, 14 nt, Human
acaucuugcucugc

SEQ ID NO: 1715233 - RNA, 13 nt, Human
acaucuugcucug

SEQ ID NO: 1715234 - RNA, 19 nt, Human
acaucuugcucugcugaca

SEQ ID NO: 1715235 - RNA, 18 nt, Human
acaucuugcucugcugac

SEQ ID NO: 1715236 - RNA, 21 nt, Human
acaucuugcucugcugacaga

SEQ ID NO: 1715237 - RNA, 17 nt, Human
acaugaaaacacauuuu

SEQ ID NO: 1715238 - RNA, 18 nt, Human
acaugaaaacacauuuuu

SEQ ID NO: 1715239 - RNA, 19 nt, Human
acaugaaaacacauuuuuc

SEQ ID NO: 1715240 - RNA, 23 nt, Human
ucaaguauuauaccuuuuuuaga

SEQ ID NO: 1715241 - RNA, 16 nt, Human
ucaaguauuauaccuu

SEQ ID NO: 1715242 - RNA, 21 nt, Human
ucaaguauuauaccuuuuuua

SEQ ID NO: 1715243 - RNA, 15 nt, Human
ucaaguauuauaccu

SEQ ID NO: 1715244 - RNA, 11 nt, Human
ucaaguauuau

SEQ ID NO: 1715245 - RNA, 15 nt, Human
ucaagacuuccagag

SEQ ID NO: 1715246 - RNA, 19 nt, Human
ucaagaauagcauuguaaa

SEQ ID NO: 1715247 - RNA, 15 nt, Human
acauucuguuaauca

SEQ ID NO: 1715248 - RNA, 15 nt, Human
ucaaauuucuaaauc

SEQ ID NO: 1715249 - RNA, 16 nt, Human
ucaaauuucuaaaucu

SEQ ID NO: 1715250 - RNA, 12 nt, Human
acauucuguuaa

SEQ ID NO: 1715251 - RNA, 16 nt, Human
ucaacagguuuuccug

SEQ ID NO: 1715252 - RNA, 17 nt, Human
ucaaauuucuaaaucuc

SEQ ID NO: 1715253 - RNA, 21 nt, Human
acauguccaagaagcccagga

SEQ ID NO: 1715254 - RNA, 22 nt, Human
acauuagcaguuugcuuuguau

SEQ ID NO: 1715255 - RNA, 18 nt, Human
acauuagcaguuugcuuu

SEQ ID NO: 1715256 - RNA, 18 nt, Human
ucaaauaacuaaaaggua

SEQ ID NO: 1715257 - RNA, 21 nt, Human
ucaaauacauuuaaaacauua

SEQ ID NO: 1715258 - RNA, 22 nt, Human
ucaaauacauuuaaaacauuaa

SEQ ID NO: 1715259 - RNA, 19 nt, Human
acaugauccugcaauucca

SEQ ID NO: 1715260 - RNA, 19 nt, Human
acaugagcaucaggccagg

SEQ ID NO: 1715261 - RNA, 18 nt, Human
acaugagcaucaggccag

SEQ ID NO: 1715262 - RNA, 17 nt, Human
acaugagcaucaggcca

SEQ ID NO: 1715263 - RNA, 17 nt, Human
acaugaucuucuuuaua

SEQ ID NO: 1715264 - RNA, 15 nt, Human
acaugaucuucuuua

SEQ ID NO: 1715265 - RNA, 22 nt, Human
acaugcuacacacugcauguuu

SEQ ID NO: 1715266 - RNA, 20 nt, Human
acaugagcaucaggccaggc

SEQ ID NO: 1715267 - RNA, 14 nt, Human
ucaaagcugaaaug

SEQ ID NO: 1715268 - RNA, 19 nt, Human
ucaaaauuguuacaaauug

SEQ ID NO: 1715269 - RNA, 16 nt, Human
ucaaaauuguuacaaa

SEQ ID NO: 1715270 - RNA, 13 nt, Human
ucaaaaguuuguu

SEQ ID NO: 1715271 - RNA, 14 nt, Human
ucaaaaguuuguuu

SEQ ID NO: 1715272 - RNA, 18 nt, Human
ucaaaagaaagaaaauca

SEQ ID NO: 1715273 - RNA, 23 nt, Human
accauuucuugagguaaaagcau

SEQ ID NO: 1715274 - RNA, 11 nt, Human
acccacugcuc

SEQ ID NO: 1715275 - RNA, 10 nt, Human
acccacugcu

SEQ ID NO: 1715276 - RNA, 11 nt, Human
acccacugcuu

SEQ ID NO: 1715277 - RNA, 15 nt, Human
acccacugcucuggu

SEQ ID NO: 1715278 - RNA, 14 nt, Human
acccacugcucugg

SEQ ID NO: 1715279 - RNA, 13 nt, Human
acccacugcucug

SEQ ID NO: 1715280 - RNA, 21 nt, Human
acccagauaaagguucaugca

SEQ ID NO: 1715281 - RNA, 22 nt, Human
accauggucggaaaacaugcua

SEQ ID NO: 1715282 - RNA, 23 nt, Human
ucacucuuauugcccacgcugga

SEQ ID NO: 1715283 - RNA, 21 nt, Human
ucacucuuauugcccacgcug

SEQ ID NO: 1715284 - RNA, 15 nt, Human
ucacuccuaccuggu

SEQ ID NO: 1715285 - RNA, 22 nt, Human
ucagaaguuucugccgcagccc

SEQ ID NO: 1715286 - RNA, 19 nt, Human
ucagaaguuucugccgcag

SEQ ID NO: 1715287 - RNA, 19 nt, Human
ucagaaguuucucagcucc

SEQ ID NO: 1715288 - RNA, 14 nt, Human
ucagaagacacuga

SEQ ID NO: 1715289 - RNA, 18 nt, Human
ucagagccugcaguuauu

SEQ ID NO: 1715290 - RNA, 15 nt, Human
ucagagccugcaguu

SEQ ID NO: 1715291 - RNA, 14 nt, Human
ucagagccugcagu

SEQ ID NO: 1715292 - RNA, 13 nt, Human
ucagagccugcag

SEQ ID NO: 1715293 - RNA, 12 nt, Human
ucagagccugca

SEQ ID NO: 1715294 - RNA, 23 nt, Human
ucagagagggugggagugggccc

SEQ ID NO: 1715295 - RNA, 21 nt, Human
ucagagagggugggagugggc

SEQ ID NO: 1715296 - RNA, 16 nt, Human
ucagagagggugggag

SEQ ID NO: 1715297 - RNA, 20 nt, Human
ucagagacuccugcaggcag

SEQ ID NO: 1715298 - RNA, 17 nt, Human
ucagagacuccugcagg

SEQ ID NO: 1715299 - RNA, 21 nt, Human
ucagagacuccugcaggcagc

SEQ ID NO: 1715300 - RNA, 19 nt, Human
ucagaaucucaaauaacua

SEQ ID NO: 1715301 - RNA, 18 nt, Human
ucagaaucucaaauaacu

SEQ ID NO: 1715302 - RNA, 17 nt, Human
ucagaaucucucuucuu

SEQ ID NO: 1715303 - RNA, 23 nt, Human
accccagcuggggccaggcuggg

SEQ ID NO: 1715304 - RNA, 24 nt, Human
acccagcgagcccugguggcagug

SEQ ID NO: 1715305 - RNA, 22 nt, Human
ucagccaagaauucuuaaauau

SEQ ID NO: 1715306 - RNA, 23 nt, Human
ucagccguguaaccauggaccca

SEQ ID NO: 1715307 - RNA, 23 nt, Human
acccagcgagcccugguggcagu

SEQ ID NO: 1715308 - RNA, 19 nt, Human
acccagcgagcccuggugg

SEQ ID NO: 1715309 - RNA, 14 nt, Human
ucagcggggacagc

SEQ ID NO: 1715310 - RNA, 16 nt, Human
ucagcucacugcaacc

SEQ ID NO: 1715311 - RNA, 13 nt, Human
ucagcucacugca

SEQ ID NO: 1715312 - RNA, 20 nt, Human
ucagcuuguaaauagcucag

SEQ ID NO: 1715313 - RNA, 12 nt, Human
ucagcucaugga

SEQ ID NO: 1715314 - RNA, 15 nt, Human
accccuucgcuccug

SEQ ID NO: 1715315 - RNA, 14 nt, Human
accccuucgcuccu

SEQ ID NO: 1715316 - RNA, 16 nt, Human
accccuucgcuccugu

SEQ ID NO: 1715317 - RNA, 12 nt, Human
acccccacccaa

SEQ ID NO: 1715318 - RNA, 15 nt, Human
accccuguaggccuc

SEQ ID NO: 1715319 - RNA, 16 nt, Human
accccuguaggccuca

SEQ ID NO: 1715320 - RNA, 17 nt, Human
accccuguaggccucag

SEQ ID NO: 1715321 - RNA, 20 nt, Human
ucacuauguugcccaggcag

SEQ ID NO: 1715322 - RNA, 19 nt, Human
ucacuauguugcccaggca

SEQ ID NO: 1715323 - RNA, 18 nt, Human
ucacuauguugcccaggc

SEQ ID NO: 1715324 - RNA, 14 nt, Human
accagggacugagg

SEQ ID NO: 1715325 - RNA, 17 nt, Human
accagagcccaccuugg

SEQ ID NO: 1715326 - RNA, 21 nt, Human
accagccuccaugcugccucc

SEQ ID NO: 1715327 - RNA, 20 nt, Human
accagccuccaugcugccuc

SEQ ID NO: 1715328 - RNA, 19 nt, Human
accagccuccaugcugccu

SEQ ID NO: 1715329 - RNA, 14 nt, Human
accagccuccaugc

SEQ ID NO: 1715330 - RNA, 16 nt, Human
ucaccugaagacucau

SEQ ID NO: 1715331 - RNA, 15 nt, Human
ucaccucucccuugg

SEQ ID NO: 1715332 - RNA, 15 nt, Human
ucaccugccccucaa

SEQ ID NO: 1715333 - RNA, 13 nt, Human
ucaccugccccuc

SEQ ID NO: 1715334 - RNA, 15 nt, Human
accacuuuuguucuu

SEQ ID NO: 1715335 - RNA, 16 nt, Human
accacuuuuguucuug

SEQ ID NO: 1715336 - RNA, 21 nt, Human
accacuuuuguucuugguuug

SEQ ID NO: 1715337 - RNA, 22 nt, Human
ucaccccggccaccugcggugc

SEQ ID NO: 1715338 - RNA, 21 nt, Human
accacugcacuccagccuggg

SEQ ID NO: 1715339 - RNA, 23 nt, Human
accacugcucugaugaagaggag

SEQ ID NO: 1715340 - RNA, 17 nt, Human
accacugcucugaugaa

SEQ ID NO: 1715341 - RNA, 15 nt, Human
accacugcucugaug

SEQ ID NO: 1715342 - RNA, 20 nt, Human
accacugcacuccagccugg

SEQ ID NO: 1715343 - RNA, 17 nt, Human
accacugcacuccagcc

SEQ ID NO: 1715344 - RNA, 18 nt, Human
ucaccccggccaccugcg

SEQ ID NO: 1715345 - RNA, 17 nt, Human
ucaccccggccaccugc

SEQ ID NO: 1715346 - RNA, 17 nt, Human
accagacaccuugacag

SEQ ID NO: 1715347 - RNA, 14 nt, Human
accagacaccuuga

SEQ ID NO: 1715348 - RNA, 16 nt, Human
accagagcccaccuug

SEQ ID NO: 1715349 - RNA, 14 nt, Human
accagagcccaccu

SEQ ID NO: 1715350 - RNA, 12 nt, Human
accagagcccac

SEQ ID NO: 1715351 - RNA, 22 nt, Human
accacuuuuguucuugguuugu

SEQ ID NO: 1715352 - RNA, 14 nt, Human
accacacuccagcu

SEQ ID NO: 1715353 - RNA, 15 nt, Human
ucaauucuugccaaa

SEQ ID NO: 1715354 - RNA, 15 nt, Human
accaauguucucucu

SEQ ID NO: 1715355 - RNA, 18 nt, Human
accaauauuguacaguuu

SEQ ID NO: 1715356 - RNA, 19 nt, Human
accaauauuguacaguuuu

SEQ ID NO: 1715357 - RNA, 15 nt, Human
accaauauuguacag

SEQ ID NO: 1715358 - RNA, 16 nt, Human
accaauauuguacagu

SEQ ID NO: 1715359 - RNA, 17 nt, Human
accaauauuguacaguu

SEQ ID NO: 1715360 - RNA, 22 nt, Human
accaacauacucccaucuguga

SEQ ID NO: 1715361 - RNA, 21 nt, Human
accaacauacucccaucugug

SEQ ID NO: 1715362 - RNA, 19 nt, Human
accaacauacucccaucug

SEQ ID NO: 1715363 - RNA, 20 nt, Human
ucaagugauucucaugccuc

SEQ ID NO: 1715364 - RNA, 23 nt, Human
ucaagugaaaaaggaggaagaga

SEQ ID NO: 1715365 - RNA, 17 nt, Human
ucaagugauucucaugc

SEQ ID NO: 1715366 - RNA, 15 nt, Human
ucaagugaaaaagga

SEQ ID NO: 1715367 - RNA, 22 nt, Human
ucaaguccucuuuucugagagg

SEQ ID NO: 1715368 - RNA, 15 nt, Human
ucacaguucucuccu

SEQ ID NO: 1715369 - RNA, 15 nt, Human
ucacauaucugucau

SEQ ID NO: 1715370 - RNA, 12 nt, Human
ucacauaucugu

SEQ ID NO: 1715371 - RNA, 22 nt, Human
ucacacgucuggcuucacagau

SEQ ID NO: 1715372 - RNA, 16 nt, Human
ucacaacaaccugguc

SEQ ID NO: 1715373 - RNA, 15 nt, Human
ucaccccggccaccu

SEQ ID NO: 1715374 - RNA, 20 nt, Human
ucaccccagccccaaaacuc

SEQ ID NO: 1715375 - RNA, 14 nt, Human
ucaccccagcccca

SEQ ID NO: 1715376 - RNA, 13 nt, Human
ucaccccagcccc

SEQ ID NO: 1715377 - RNA, 10 nt, Human
uaguuuuugu

SEQ ID NO: 1715378 - RNA, 18 nt, Human
uaguucagguaacaggca

SEQ ID NO: 1715379 - RNA, 21 nt, Human
uauaaaaauaaaaaacacugg

SEQ ID NO: 1715380 - RNA, 20 nt, Human
uauaaaaauaaaaaacacug

SEQ ID NO: 1715381 - RNA, 14 nt, Human
uauaaaagacugac

SEQ ID NO: 1715382 - RNA, 22 nt, Human
acacauguccaagaagcccagg

SEQ ID NO: 1715383 - RNA, 21 nt, Human
acacauguccaagaagcccag

SEQ ID NO: 1715384 - RNA, 13 nt, Human
acacccagcccac

SEQ ID NO: 1715385 - RNA, 12 nt, Human
acacccagccca

SEQ ID NO: 1715386 - RNA, 13 nt, Human
acacauuuuauuu

SEQ ID NO: 1715387 - RNA, 19 nt, Human
acacauguccaagaagccc

SEQ ID NO: 1715388 - RNA, 18 nt, Human
acacauguccaagaagcc

SEQ ID NO: 1715389 - RNA, 13 nt, Human
acacauguccaag

SEQ ID NO: 1715390 - RNA, 18 nt, Human
acaccucugcacaagcug

SEQ ID NO: 1715391 - RNA, 19 nt, Human
acaccucugcacaagcugc

SEQ ID NO: 1715392 - RNA, 16 nt, Human
acaccuugacagggca

SEQ ID NO: 1715393 - RNA, 15 nt, Human
acaccuugacagggc

SEQ ID NO: 1715394 - RNA, 14 nt, Human
acaccuugacaggg

SEQ ID NO: 1715395 - RNA, 19 nt, Human
acacuaaccacgcuggacc

SEQ ID NO: 1715396 - RNA, 17 nt, Human
acacuaaccacgcugga

SEQ ID NO: 1715397 - RNA, 16 nt, Human
acacuaaccacgcugg

SEQ ID NO: 1715398 - RNA, 22 nt, Human
uauaaccaguguuguggauuua

SEQ ID NO: 1715399 - RNA, 19 nt, Human
uauaacuauguugauaaaa

SEQ ID NO: 1715400 - RNA, 15 nt, Human
acaaugguuuucuug

SEQ ID NO: 1715401 - RNA, 21 nt, Human
acaaugguuuucuuguguguu

SEQ ID NO: 1715402 - RNA, 14 nt, Human
acacacacauacac

SEQ ID NO: 1715403 - RNA, 12 nt, Human
acacacagcucu

SEQ ID NO: 1715404 - RNA, 11 nt, Human
acacacagcuc

SEQ ID NO: 1715405 - RNA, 21 nt, Human
uagguuggcaaaaaggcagga

SEQ ID NO: 1715406 - RNA, 13 nt, Human
acacagugagucg

SEQ ID NO: 1715407 - RNA, 17 nt, Human
acacagugaccauacua

SEQ ID NO: 1715408 - RNA, 11 nt, Human
acacagugagu

SEQ ID NO: 1715409 - RNA, 19 nt, Human
acacagucuuggcucacug

SEQ ID NO: 1715410 - RNA, 13 nt, Human
uaguagagacagg

SEQ ID NO: 1715411 - RNA, 14 nt, Human
uaguagagacaggg

SEQ ID NO: 1715412 - RNA, 23 nt, Human
acagaugggugcuuggaggaagg

SEQ ID NO: 1715413 - RNA, 20 nt, Human
acagauguaaaagacuuuuu

SEQ ID NO: 1715414 - RNA, 21 nt, Human
acagaguuguuacauuuuuaa

SEQ ID NO: 1715415 - RNA, 22 nt, Human
acagaguuguuacauuuuuaag

SEQ ID NO: 1715416 - RNA, 20 nt, Human
acagauagauauaugcucug

SEQ ID NO: 1715417 - RNA, 20 nt, Human
acagauacuccuccaagguu

SEQ ID NO: 1715418 - RNA, 23 nt, Human
acagcccgggcucugccucccau

SEQ ID NO: 1715419 - RNA, 22 nt, Human
acagcccgggcucugccuccca

SEQ ID NO: 1715420 - RNA, 21 nt, Human
acagcccgggcucugccuccc

SEQ ID NO: 1715421 - RNA, 16 nt, Human
acagcaaggagauuua

SEQ ID NO: 1715422 - RNA, 23 nt, Human
uaugaaagauggcugugccucug

SEQ ID NO: 1715423 - RNA, 22 nt, Human
uaugaaagauggcugugccucu

SEQ ID NO: 1715424 - RNA, 20 nt, Human
uaugaaagauggcugugccu

SEQ ID NO: 1715425 - RNA, 19 nt, Human
uaucccuacuguaauuugu

SEQ ID NO: 1715426 - RNA, 20 nt, Human
uaucccuacuguaauuugug

SEQ ID NO: 1715427 - RNA, 16 nt, Human
uaucccggcugcccuu

SEQ ID NO: 1715428 - RNA, 15 nt, Human
uaucucagggccugg

SEQ ID NO: 1715429 - RNA, 13 nt, Human
uaucucagggccu

SEQ ID NO: 1715430 - RNA, 17 nt, Human
uauccuacuuccccuuc

SEQ ID NO: 1715431 - RNA, 14 nt, Human
uauccuacuucccc

SEQ ID NO: 1715432 - RNA, 14 nt, Human
acagagcccacgcc

SEQ ID NO: 1715433 - RNA, 21 nt, Human
acagagcaagugagacccugu

SEQ ID NO: 1715434 - RNA, 17 nt, Human
acagaguuguuacauuu

SEQ ID NO: 1715435 - RNA, 18 nt, Human
acagaguuguuacauuuu

SEQ ID NO: 1715436 - RNA, 19 nt, Human
acagaguuguuacauuuuu

SEQ ID NO: 1715437 - RNA, 20 nt, Human
acagaguuguuacauuuuua

SEQ ID NO: 1715438 - RNA, 16 nt, Human
acagaguuguuacauu

SEQ ID NO: 1715439 - RNA, 12 nt, Human
uauauuuacaaa

SEQ ID NO: 1715440 - RNA, 19 nt, Human
acagaaagcagaacaguga

SEQ ID NO: 1715441 - RNA, 17 nt, Human
acagacacaggcccggc

SEQ ID NO: 1715442 - RNA, 22 nt, Human
acagacacaggcccggcuccag

SEQ ID NO: 1715443 - RNA, 18 nt, Human
acagacacaggcccggcu

SEQ ID NO: 1715444 - RNA, 22 nt, Human
acagacuggaagcacagcuuca

SEQ ID NO: 1715445 - RNA, 21 nt, Human
acagacuggaagcacagcuuc

SEQ ID NO: 1715446 - RNA, 19 nt, Human
acagacuggaagcacagcu

SEQ ID NO: 1715447 - RNA, 17 nt, Human
acagacuggaagcacag

SEQ ID NO: 1715448 - RNA, 13 nt, Human
acacuuaaaaaug

SEQ ID NO: 1715449 - RNA, 15 nt, Human
acacuuaaaaauggu

SEQ ID NO: 1715450 - RNA, 16 nt, Human
acacuguuucaaacuu

SEQ ID NO: 1715451 - RNA, 15 nt, Human
acacuguuucaaacu

SEQ ID NO: 1715452 - RNA, 23 nt, Human
acacuuguugauuaauggaaaug

SEQ ID NO: 1715453 - RNA, 20 nt, Human
acacuuguugauuaauggaa

SEQ ID NO: 1715454 - RNA, 14 nt, Human
acacuccagugaga

SEQ ID NO: 1715455 - RNA, 13 nt, Human
acacucugagacu

SEQ ID NO: 1715456 - RNA, 11 nt, Human
acacucugaga

SEQ ID NO: 1715457 - RNA, 15 nt, Human
acacuguucucugcc

SEQ ID NO: 1715458 - RNA, 14 nt, Human
acacuguucucugc

SEQ ID NO: 1715459 - RNA, 20 nt, Human
acacuguucucugcccucca

SEQ ID NO: 1715460 - RNA, 18 nt, Human
acacuguucucugcccuc

SEQ ID NO: 1715461 - RNA, 17 nt, Human
acacuguucucugcccu

SEQ ID NO: 1715462 - RNA, 16 nt, Human
acacuguucucugccc

SEQ ID NO: 1715463 - RNA, 23 nt, Human
acacuguucucugcccuccaaga

SEQ ID NO: 1715464 - RNA, 22 nt, Human
acacuguucucugcccuccaag

SEQ ID NO: 1715465 - RNA, 22 nt, Human
aauuuauaaacuuuuuucuuac

SEQ ID NO: 1715466 - RNA, 13 nt, Human
aauuuauuauggc

SEQ ID NO: 1715467 - RNA, 14 nt, Human
aauuuauuauggca

SEQ ID NO: 1715468 - RNA, 17 nt, Human
aauuuauuauggcacau

SEQ ID NO: 1715469 - RNA, 17 nt, Human
aauuuacagagacagaa

SEQ ID NO: 1715470 - RNA, 18 nt, Human
aauuuacagagacagaaa

SEQ ID NO: 1715471 - RNA, 17 nt, Human
aauuuaccugaagucuu

SEQ ID NO: 1715472 - RNA, 15 nt, Human
aauuuacauacucug

SEQ ID NO: 1715473 - RNA, 15 nt, Human
aauuugaaacacuuu

SEQ ID NO: 1715474 - RNA, 18 nt, Human
uacuucuccacccugcuc

SEQ ID NO: 1715475 - RNA, 13 nt, Human
uacuucuccaccc

SEQ ID NO: 1715476 - RNA, 23 nt, Human
uacuuccugugacuucagcucug

SEQ ID NO: 1715477 - RNA, 20 nt, Human
uacuuccccuuccuaauucc

SEQ ID NO: 1715478 - RNA, 18 nt, Human
uacuuccccuuccuaauu

SEQ ID NO: 1715479 - RNA, 15 nt, Human
uacuuccccuuccua

SEQ ID NO: 1715480 - RNA, 14 nt, Human
uacuuccccuuccu

SEQ ID NO: 1715481 - RNA, 15 nt, Human
uacuucugcuacaua

SEQ ID NO: 1715482 - RNA, 20 nt, Human
uacuucuccacccugcucuc

SEQ ID NO: 1715483 - RNA, 15 nt, Human
uacuucuuauacauu

SEQ ID NO: 1715484 - RNA, 14 nt, Human
uacuucuuauacau

SEQ ID NO: 1715485 - RNA, 16 nt, Human
uacuucuuauacauuu

SEQ ID NO: 1715486 - RNA, 15 nt, Human
uacuugaaaauuaac

SEQ ID NO: 1715487 - RNA, 23 nt, Human
uacuuugauauuuucaacgcagc

SEQ ID NO: 1715488 - RNA, 17 nt, Human
uacugagagugaacaaa

SEQ ID NO: 1715489 - RNA, 19 nt, Human
uacugagagugaacaaauu

SEQ ID NO: 1715490 - RNA, 16 nt, Human
uacuguaauuugugau

SEQ ID NO: 1715491 - RNA, 17 nt, Human
uacuguaauuugugaua

SEQ ID NO: 1715492 - RNA, 15 nt, Human
uacuguaauuuguga

SEQ ID NO: 1715493 - RNA, 18 nt, Human
uacuguacaugaaaacac

SEQ ID NO: 1715494 - RNA, 23 nt, Human
uacuguacagacagaaaaaacug

SEQ ID NO: 1715495 - RNA, 19 nt, Human
uacuguacagacagaaaaa

SEQ ID NO: 1715496 - RNA, 18 nt, Human
uacuaaaaauacaaaaaa

SEQ ID NO: 1715497 - RNA, 14 nt, Human
uacuaaaaauacaa

SEQ ID NO: 1715498 - RNA, 13 nt, Human
uacgugaguccug

SEQ ID NO: 1715499 - RNA, 16 nt, Human
uacgucugacaggcaa

SEQ ID NO: 1715500 - RNA, 22 nt, Human
uacucuacccucuuagaaaaac

SEQ ID NO: 1715501 - RNA, 18 nt, Human
uacuagggaaaugccuuu

SEQ ID NO: 1715502 - RNA, 13 nt, Human
aauugacccacaa

SEQ ID NO: 1715503 - RNA, 24 nt, Human
uacgcuccaucgcugucaucucag

SEQ ID NO: 1715504 - RNA, 15 nt, Human
uacgucugacaggca

SEQ ID NO: 1715505 - RNA, 21 nt, Human
acaaagcgugguggacaugca

SEQ ID NO: 1715506 - RNA, 18 nt, Human
acaaagcccuuccauguc

SEQ ID NO: 1715507 - RNA, 14 nt, Human
acaaaacuuuucua

SEQ ID NO: 1715508 - RNA, 22 nt, Human
uagauaggucagugcaaauacu

SEQ ID NO: 1715509 - RNA, 22 nt, Human
aauuuuuaaucuuuaauuuuac

SEQ ID NO: 1715510 - RNA, 22 nt, Human
aauuuuuuuaucgucacugcuu

SEQ ID NO: 1715511 - RNA, 16 nt, Human
aauuuguuauaaugaa

SEQ ID NO: 1715512 - RNA, 20 nt, Human
acaaucucggcucacugcau

SEQ ID NO: 1715513 - RNA, 18 nt, Human
acaaucucggcucacugc

SEQ ID NO: 1715514 - RNA, 18 nt, Human
acaagcgugagccacugc

SEQ ID NO: 1715515 - RNA, 22 nt, Human
acaagcuccaagcucccaggca

SEQ ID NO: 1715516 - RNA, 19 nt, Human
acaagcuccaagcucccag

SEQ ID NO: 1715517 - RNA, 17 nt, Human
acaagcuccaagcuccc

SEQ ID NO: 1715518 - RNA, 16 nt, Human
acaagcuccaagcucc

SEQ ID NO: 1715519 - RNA, 15 nt, Human
acaagcuccaagcuc

SEQ ID NO: 1715520 - RNA, 16 nt, Human
uagcuacuaauuuuaa

SEQ ID NO: 1715521 - RNA, 16 nt, Human
uagcucaggugucccu

SEQ ID NO: 1715522 - RNA, 17 nt, Human
acaacaucuuuuucuac

SEQ ID NO: 1715523 - RNA, 13 nt, Human
acaagacacagug

SEQ ID NO: 1715524 - RNA, 17 nt, Human
acaaauuuacagagaca

SEQ ID NO: 1715525 - RNA, 21 nt, Human
acaaauucugucucuggauua

SEQ ID NO: 1715526 - RNA, 13 nt, Human
acaagcuccaagc

SEQ ID NO: 1715527 - RNA, 17 nt, Human
acaagcgugagccacug

SEQ ID NO: 1715528 - RNA, 22 nt, Human
acaagagcccaggccuccuaca

SEQ ID NO: 1715529 - RNA, 19 nt, Human
acaagagcuuaacagugug

SEQ ID NO: 1715530 - RNA, 18 nt, Human
acaagagcuuaacagugu

SEQ ID NO: 1715531 - RNA, 16 nt, Human
acaagaccacguuucu

SEQ ID NO: 1715532 - RNA, 14 nt, Human
acaagacacaguga

SEQ ID NO: 1715533 - RNA, 17 nt, Human
acaagaccacguuucua

SEQ ID NO: 1715534 - RNA, 18 nt, Human
acaagaccacguuucuaa

SEQ ID NO: 1715535 - RNA, 15 nt, Human
aauaacgauaaaaga

SEQ ID NO: 1715536 - RNA, 21 nt, Human
aauaacaaugaaaguugauaa

SEQ ID NO: 1715537 - RNA, 20 nt, Human
aauaaauugcuccuugacau

SEQ ID NO: 1715538 - RNA, 16 nt, Human
aauaaauugcuccuug

SEQ ID NO: 1715539 - RNA, 18 nt, Human
aauaaaacuuuuuaaaau

SEQ ID NO: 1715540 - RNA, 12 nt, Human
aauaaaacuuuu

SEQ ID NO: 1715541 - RNA, 14 nt, Human
aauaaaacuuuuua

SEQ ID NO: 1715542 - RNA, 15 nt, Human
aauaaaacuuuuuaa

SEQ ID NO: 1715543 - RNA, 16 nt, Human
aauaaaucauaaaacu

SEQ ID NO: 1715544 - RNA, 20 nt, Human
aaguuuuuauggcuuuugug

SEQ ID NO: 1715545 - RNA, 15 nt, Human
aaguuuuguaaauuu

SEQ ID NO: 1715546 - RNA, 22 nt, Human
uaaaguaaaaacaaagaaauua

SEQ ID NO: 1715547 - RNA, 21 nt, Human
uaaaguaaaaacaaagaaauu

SEQ ID NO: 1715548 - RNA, 19 nt, Human
uaaaguaaaaacaaagaaa

SEQ ID NO: 1715549 - RNA, 22 nt, Human
uaaagguucaugcaaacuuuau

SEQ ID NO: 1715550 - RNA, 14 nt, Human
uaaaucuccaaaau

SEQ ID NO: 1715551 - RNA, 15 nt, Human
uaaaucuccaaaaua

SEQ ID NO: 1715552 - RNA, 18 nt, Human
uaaaucuccaaaauaaaa

SEQ ID NO: 1715553 - RNA, 18 nt, Human
uaaauuaacuuuuauaaa

SEQ ID NO: 1715554 - RNA, 17 nt, Human
uaaauuaacuuuuauaa

SEQ ID NO: 1715555 - RNA, 15 nt, Human
uaaauuaacuuuuau

SEQ ID NO: 1715556 - RNA, 16 nt, Human
uaaauuaacuuuuaua

SEQ ID NO: 1715557 - RNA, 12 nt, Human
uaaauuaacuuu

SEQ ID NO: 1715558 - RNA, 14 nt, Human
uaaauuaacuuuua

SEQ ID NO: 1715559 - RNA, 24 nt, Human
uaaauguuuuuuuuuaaagacuuu

SEQ ID NO: 1715560 - RNA, 20 nt, Human
uaaauguugaaagaucaaaa

SEQ ID NO: 1715561 - RNA, 15 nt, Human
uaaauguugaaagau

SEQ ID NO: 1715562 - RNA, 23 nt, Human
uaaaugcaccuggaauauauaac

SEQ ID NO: 1715563 - RNA, 19 nt, Human
uaaaugcaaccauuugaaa

SEQ ID NO: 1715564 - RNA, 21 nt, Human
uaaauaaaguuuguugaaaca

SEQ ID NO: 1715565 - RNA, 12 nt, Human
uaaauaaaguuu

SEQ ID NO: 1715566 - RNA, 19 nt, Human
uaaauaaugugaaacugga

SEQ ID NO: 1715567 - RNA, 13 nt, Human
aauaauuuuguaa

SEQ ID NO: 1715568 - RNA, 14 nt, Human
aauaauuuuguaau

SEQ ID NO: 1715569 - RNA, 15 nt, Human
aauaauuuuguaaug

SEQ ID NO: 1715570 - RNA, 12 nt, Human
aauaacuuuuuu

SEQ ID NO: 1715571 - RNA, 21 nt, Human
uaacuaaaauaauuuuguaau

SEQ ID NO: 1715572 - RNA, 20 nt, Human
uaacuaaaauaauuuuguaa

SEQ ID NO: 1715573 - RNA, 15 nt, Human
uaacuuuuauaaacu

SEQ ID NO: 1715574 - RNA, 17 nt, Human
uaacuuuuauaaacuuu

SEQ ID NO: 1715575 - RNA, 18 nt, Human
uaacuuuuauaaacuuua

SEQ ID NO: 1715576 - RNA, 19 nt, Human
uaacuuuuauaaacuuuac

SEQ ID NO: 1715577 - RNA, 17 nt, Human
uaagacauuuuuggaag

SEQ ID NO: 1715578 - RNA, 19 nt, Human
aauaucuuuuuuuuaauaa

SEQ ID NO: 1715579 - RNA, 20 nt, Human
aauaucugaaaauguaugug

SEQ ID NO: 1715580 - RNA, 19 nt, Human
aauaucugaaaauguaugu

SEQ ID NO: 1715581 - RNA, 18 nt, Human
aauaucugaaaauguaug

SEQ ID NO: 1715582 - RNA, 17 nt, Human
aauaucugaaaauguau

SEQ ID NO: 1715583 - RNA, 16 nt, Human
aauaucugaaaaugua

SEQ ID NO: 1715584 - RNA, 13 nt, Human
aauauuguacagu

SEQ ID NO: 1715585 - RNA, 14 nt, Human
aauauuguacaguu

SEQ ID NO: 1715586 - RNA, 15 nt, Human
aauaugcacacauuu

SEQ ID NO: 1715587 - RNA, 18 nt, Human
aauauugauaugcuuaua

SEQ ID NO: 1715588 - RNA, 22 nt, Human
aauauugcugauggugcaauga

SEQ ID NO: 1715589 - RNA, 21 nt, Human
aauauugcugauggugcaaug

SEQ ID NO: 1715590 - RNA, 18 nt, Human
aauauugcugauggugca

SEQ ID NO: 1715591 - RNA, 15 nt, Human
aauauugcugauggu

SEQ ID NO: 1715592 - RNA, 13 nt, Human
aauauugcugaug

SEQ ID NO: 1715593 - RNA, 12 nt, Human
aauauugcugau

SEQ ID NO: 1715594 - RNA, 11 nt, Human
aauauugcuga

SEQ ID NO: 1715595 - RNA, 18 nt, Human
aauaggcguaacuaauuu

SEQ ID NO: 1715596 - RNA, 16 nt, Human
aauaggaaaaacugau

SEQ ID NO: 1715597 - RNA, 15 nt, Human
aauaggaaaaacuga

SEQ ID NO: 1715598 - RNA, 15 nt, Human
aauagcuuuaaugau

SEQ ID NO: 1715599 - RNA, 16 nt, Human
aauagcuuuaaugaua

SEQ ID NO: 1715600 - RNA, 18 nt, Human
aauaggaaaaacugauuu

SEQ ID NO: 1715601 - RNA, 17 nt, Human
aauaggaaaaacugauu

SEQ ID NO: 1715602 - RNA, 19 nt, Human
aauaggaaaaacugauuuu

SEQ ID NO: 1715603 - RNA, 18 nt, Human
aauagacaauuuauuaug

SEQ ID NO: 1715604 - RNA, 23 nt, Human
aauagacaauuuauuauggcaca

SEQ ID NO: 1715605 - RNA, 16 nt, Human
aauagacagcaugaga

SEQ ID NO: 1715606 - RNA, 18 nt, Human
aauagacccacaagaggc

SEQ ID NO: 1715607 - RNA, 14 nt, Human
aauagcugggacua

SEQ ID NO: 1715608 - RNA, 13 nt, Human
aauagcugggacu

SEQ ID NO: 1715609 - RNA, 20 nt, Human
aauagccugccucuucucua

SEQ ID NO: 1715610 - RNA, 16 nt, Human
aauagaugcugacugu

SEQ ID NO: 1715611 - RNA, 14 nt, Human
uaacaugauuuggg

SEQ ID NO: 1715612 - RNA, 14 nt, Human
uaacauggaaguac

SEQ ID NO: 1715613 - RNA, 15 nt, Human
uaacuaaaagguaug

SEQ ID NO: 1715614 - RNA, 12 nt, Human
uaacuaaaauaa

SEQ ID NO: 1715615 - RNA, 18 nt, Human
uaacuaaaauaauuuugu

SEQ ID NO: 1715616 - RNA, 19 nt, Human
uaacuaaaauaauuuugua

SEQ ID NO: 1715617 - RNA, 14 nt, Human
uaacuaaaagguau

SEQ ID NO: 1715618 - RNA, 16 nt, Human
uaacauggaaguacua

SEQ ID NO: 1715619 - RNA, 15 nt, Human
uaacauggaaguacu

SEQ ID NO: 1715620 - RNA, 12 nt, Human
aaucuaaaugga

SEQ ID NO: 1715621 - RNA, 18 nt, Human
aaucuaaauggaaccacu

SEQ ID NO: 1715622 - RNA, 13 nt, Human
aaucuaaauggaa

SEQ ID NO: 1715623 - RNA, 15 nt, Human
aaucuaaauggaacc

SEQ ID NO: 1715624 - RNA, 14 nt, Human
aaucuuauaauuua

SEQ ID NO: 1715625 - RNA, 16 nt, Human
aaucuuauaauuuaaa

SEQ ID NO: 1715626 - RNA, 14 nt, Human
aaucucaaauuucu

SEQ ID NO: 1715627 - RNA, 15 nt, Human
aaucucaaauaacua

SEQ ID NO: 1715628 - RNA, 12 nt, Human
aaucucaaauuu

SEQ ID NO: 1715629 - RNA, 15 nt, Human
aaucaucaagucuuu

SEQ ID NO: 1715630 - RNA, 17 nt, Human
uaauaaaaguacauguu

SEQ ID NO: 1715631 - RNA, 17 nt, Human
aaucauggugcucagag

SEQ ID NO: 1715632 - RNA, 12 nt, Human
aaucagcauucu

SEQ ID NO: 1715633 - RNA, 17 nt, Human
aaucagacuaugaaguu

SEQ ID NO: 1715634 - RNA, 14 nt, Human
aaucagacuaugaa

SEQ ID NO: 1715635 - RNA, 20 nt, Human
uaaguuuuuauggcuuuugu

SEQ ID NO: 1715636 - RNA, 19 nt, Human
uaaugaaagacuguacaaa

SEQ ID NO: 1715637 - RNA, 18 nt, Human
uaaugaaagacuguacaa

SEQ ID NO: 1715638 - RNA, 17 nt, Human
uaaugaaagacuguaca

SEQ ID NO: 1715639 - RNA, 14 nt, Human
uaaugaaagacugu

SEQ ID NO: 1715640 - RNA, 23 nt, Human
uaaugaaagacuguacaaaguag

SEQ ID NO: 1715641 - RNA, 22 nt, Human
uaaugaaagacuguacaaagua

SEQ ID NO: 1715642 - RNA, 15 nt, Human
uaaugacaggccugu

SEQ ID NO: 1715643 - RNA, 20 nt, Human
uaaugacaggccuguccaac

SEQ ID NO: 1715644 - RNA, 21 nt, Human
uaaugacuuaagcacacuuga

SEQ ID NO: 1715645 - RNA, 15 nt, Human
uaaugacuuaagcac

SEQ ID NO: 1715646 - RNA, 20 nt, Human
aaucuucugaacuuggcgcu

SEQ ID NO: 1715647 - RNA, 13 nt, Human
aaucuucugaacu

SEQ ID NO: 1715648 - RNA, 21 nt, Human
uaauagcgucauaacuagaac

SEQ ID NO: 1715649 - RNA, 13 nt, Human
uaaugaggaaacu

SEQ ID NO: 1715650 - RNA, 15 nt, Human
aaugagccuggcaag

SEQ ID NO: 1715651 - RNA, 18 nt, Human
aaugacuuacuguacaug

SEQ ID NO: 1715652 - RNA, 14 nt, Human
aaugacuuacugua

SEQ ID NO: 1715653 - RNA, 17 nt, Human
aaugacuuacuguacau

SEQ ID NO: 1715654 - RNA, 15 nt, Human
aaugaaaaccacauu

SEQ ID NO: 1715655 - RNA, 15 nt, Human
aaugacaggccuguc

SEQ ID NO: 1715656 - RNA, 19 nt, Human
aauggacuuuuguacauag

SEQ ID NO: 1715657 - RNA, 21 nt, Human
aauggacguguuaugacucca

SEQ ID NO: 1715658 - RNA, 15 nt, Human
uacacauuuuucaga

SEQ ID NO: 1715659 - RNA, 17 nt, Human
uacacauuuuucagaua

SEQ ID NO: 1715660 - RNA, 21 nt, Human
uacacauuuuucagauauaaa

SEQ ID NO: 1715661 - RNA, 19 nt, Human
uacacauuuuucagauaua

SEQ ID NO: 1715662 - RNA, 19 nt, Human
uacaccacuacauucuguu

SEQ ID NO: 1715663 - RNA, 20 nt, Human
uacaccacuacauucuguua

SEQ ID NO: 1715664 - RNA, 15 nt, Human
uacaccacuacauuc

SEQ ID NO: 1715665 - RNA, 16 nt, Human
uacaccacuacauucu

SEQ ID NO: 1715666 - RNA, 17 nt, Human
uacaccacuacauucug

SEQ ID NO: 1715667 - RNA, 18 nt, Human
uacaccacuacauucugu

SEQ ID NO: 1715668 - RNA, 22 nt, Human
uacaggcgugagccaccgugcc

SEQ ID NO: 1715669 - RNA, 15 nt, Human
uacaggcuccugcca

SEQ ID NO: 1715670 - RNA, 14 nt, Human
uacaggcuccugcc

SEQ ID NO: 1715671 - RNA, 17 nt, Human
uacaggcuccugccacc

SEQ ID NO: 1715672 - RNA, 14 nt, Human
uacacuccagugag

SEQ ID NO: 1715673 - RNA, 18 nt, Human
uacagaggccaugggccu

SEQ ID NO: 1715674 - RNA, 15 nt, Human
uacaggcauagaguu

SEQ ID NO: 1715675 - RNA, 19 nt, Human
uacauauaagugauugcug

SEQ ID NO: 1715676 - RNA, 22 nt, Human
uacauauaagugauugcugguu

SEQ ID NO: 1715677 - RNA, 12 nt, Human
aauguacugcau

SEQ ID NO: 1715678 - RNA, 21 nt, Human
uacauaaugcgugcauaccac

SEQ ID NO: 1715679 - RNA, 19 nt, Human
uacauaaugcgugcauacc

SEQ ID NO: 1715680 - RNA, 20 nt, Human
uacauaaugcgugcauacca

SEQ ID NO: 1715681 - RNA, 15 nt, Human
uacaguaucucaggg

SEQ ID NO: 1715682 - RNA, 17 nt, Human
uacauaaugcgugcaua

SEQ ID NO: 1715683 - RNA, 11 nt, Human
aaugugauaug

SEQ ID NO: 1715684 - RNA, 14 nt, Human
aauguggcuccugg

SEQ ID NO: 1715685 - RNA, 14 nt, Human
aauguauuuuuccu

SEQ ID NO: 1715686 - RNA, 14 nt, Human
aaugugacucaaga

SEQ ID NO: 1715687 - RNA, 14 nt, Human
aauguauguguaag

SEQ ID NO: 1715688 - RNA, 12 nt, Human
aauguaugugua

SEQ ID NO: 1715689 - RNA, 18 nt, Human
aauguacugcauaugaaa

SEQ ID NO: 1715690 - RNA, 14 nt, Human
aauguacugcauau

SEQ ID NO: 1715691 - RNA, 16 nt, Human
aauggacguguuauga

SEQ ID NO: 1715692 - RNA, 24 nt, Human
aaugcccagccccuucugacccau

SEQ ID NO: 1715693 - RNA, 23 nt, Human
aaugcccagccccuucugaccca

SEQ ID NO: 1715694 - RNA, 22 nt, Human
aaugcccagccccuucugaccc

SEQ ID NO: 1715695 - RNA, 20 nt, Human
aaugcccagccccuucugac

SEQ ID NO: 1715696 - RNA, 20 nt, Human
aaugcugugcccuaaagugu

SEQ ID NO: 1715697 - RNA, 21 nt, Human
aaugcugugcccuaaagugua

SEQ ID NO: 1715698 - RNA, 13 nt, Human
aaugcugugcccu

SEQ ID NO: 1715699 - RNA, 15 nt, Human
aaugcccagccccuu

SEQ ID NO: 1715700 - RNA, 14 nt, Human
aaugcccagccccu

SEQ ID NO: 1715701 - RNA, 16 nt, Human
aaugcauaaaauguua

SEQ ID NO: 1715702 - RNA, 14 nt, Human
uacaaggacagccc

SEQ ID NO: 1715703 - RNA, 13 nt, Human
aaugcauaaaaug

SEQ ID NO: 1715704 - RNA, 13 nt, Human
uaauuccacagcu

SEQ ID NO: 1715705 - RNA, 17 nt, Human
uaauuccacagcugcuc

SEQ ID NO: 1715706 - RNA, 14 nt, Human
uaauuccacagcug

SEQ ID NO: 1715707 - RNA, 20 nt, Human
uacaaaaagcauaaaaauua

SEQ ID NO: 1715708 - RNA, 15 nt, Human
uacaaaagcauguga

SEQ ID NO: 1715709 - RNA, 15 nt, Human
gugccucaagagaag

SEQ ID NO: 1715710 - RNA, 21 nt, Human
gugaaccaccacacccagccc

SEQ ID NO: 1715711 - RNA, 23 nt, Human
gugccuuauggaacacucugaga

SEQ ID NO: 1715712 - RNA, 21 nt, Human
gugccuuauggaacacucuga

SEQ ID NO: 1715713 - RNA, 14 nt, Human
gugccuuauggaac

SEQ ID NO: 1715714 - RNA, 14 nt, Human
gugccucugggacu

SEQ ID NO: 1715715 - RNA, 15 nt, Human
gugccucugccuguc

SEQ ID NO: 1715716 - RNA, 13 nt, Human
gugccucugggac

SEQ ID NO: 1715717 - RNA, 12 nt, Human
gugccucuggga

SEQ ID NO: 1715718 - RNA, 13 nt, Human
gugccucugccug

SEQ ID NO: 1715719 - RNA, 13 nt, Human
aacuuuaccuuuu

SEQ ID NO: 1715720 - RNA, 18 nt, Human
aacuugucuuuggacccu

SEQ ID NO: 1715721 - RNA, 22 nt, Human
aacuugucuuuggacccugagg

SEQ ID NO: 1715722 - RNA, 16 nt, Human
aacuuguauuaugugu

SEQ ID NO: 1715723 - RNA, 15 nt, Human
aacuuguauuaugug

SEQ ID NO: 1715724 - RNA, 12 nt, Human
aacuugggaacu

SEQ ID NO: 1715725 - RNA, 16 nt, Human
aagaagugaaaaucua

SEQ ID NO: 1715726 - RNA, 22 nt, Human
aagaagugaaaaucuacacucc

SEQ ID NO: 1715727 - RNA, 21 nt, Human
gugcuaucucccccagcccca

SEQ ID NO: 1715728 - RNA, 22 nt, Human
gugcuaggaacacuccuucaca

SEQ ID NO: 1715729 - RNA, 18 nt, Human
gugcuaggaacacuccuu

SEQ ID NO: 1715730 - RNA, 17 nt, Human
aagaauagcuuuaauga

SEQ ID NO: 1715731 - RNA, 17 nt, Human
aagaauagcauuguaaa

SEQ ID NO: 1715732 - RNA, 18 nt, Human
aagaauagcauuguaaaa

SEQ ID NO: 1715733 - RNA, 23 nt, Human
aagaauagcauuguaaaagcauu

SEQ ID NO: 1715734 - RNA, 13 nt, Human
aagaaagaaaauc

SEQ ID NO: 1715735 - RNA, 22 nt, Human
aagaaagacuaucuaaauguug

SEQ ID NO: 1715736 - RNA, 20 nt, Human
aagaaagacuaucuaaaugu

SEQ ID NO: 1715737 - RNA, 13 nt, Human
aagaaauauaccu

SEQ ID NO: 1715738 - RNA, 15 nt, Human
aagaaaaaggaugca

SEQ ID NO: 1715739 - RNA, 17 nt, Human
aagaaaaaggaugcaca

SEQ ID NO: 1715740 - RNA, 18 nt, Human
aagaaaaaggaugcacag

SEQ ID NO: 1715741 - RNA, 21 nt, Human
guggaugccugguggcagcug

SEQ ID NO: 1715742 - RNA, 21 nt, Human
guggauggaaggggcugacag

SEQ ID NO: 1715743 - RNA, 22 nt, Human
guggacacagcucuucuccagg

SEQ ID NO: 1715744 - RNA, 18 nt, Human
guggacacagcucuucuc

SEQ ID NO: 1715745 - RNA, 23 nt, Human
guggacacagcucuucuccaggc

SEQ ID NO: 1715746 - RNA, 20 nt, Human
gugcugggauuacaggugug

SEQ ID NO: 1715747 - RNA, 20 nt, Human
gugcugggauuacaggcgug

SEQ ID NO: 1715748 - RNA, 19 nt, Human
guggaaguaguggagcccc

SEQ ID NO: 1715749 - RNA, 22 nt, Human
gugcugggauuacaagcgugag

SEQ ID NO: 1715750 - RNA, 21 nt, Human
gugcugggauuacaagcguga

SEQ ID NO: 1715751 - RNA, 22 nt, Human
gugcuaucucccccagccccau

SEQ ID NO: 1715752 - RNA, 12 nt, Human
gugcuauguucu

SEQ ID NO: 1715753 - RNA, 15 nt, Human
gugcucaggagcccu

SEQ ID NO: 1715754 - RNA, 16 nt, Human
aagaauugaagcagga

SEQ ID NO: 1715755 - RNA, 16 nt, Human
guggcagcucaccucu

SEQ ID NO: 1715756 - RNA, 14 nt, Human
guggcagcucaccu

SEQ ID NO: 1715757 - RNA, 20 nt, Human
guggcagcucaccucucccu

SEQ ID NO: 1715758 - RNA, 19 nt, Human
guggcaccagcagccugga

SEQ ID NO: 1715759 - RNA, 20 nt, Human
guggauuuaacagaaaugua

SEQ ID NO: 1715760 - RNA, 18 nt, Human
guggauuuaacagaaaug

SEQ ID NO: 1715761 - RNA, 19 nt, Human
guggauuuaacagaaaugu

SEQ ID NO: 1715762 - RNA, 23 nt, Human
guguuuccuggcacugcuuccag

SEQ ID NO: 1715763 - RNA, 18 nt, Human
guguguaugcgugugugu

SEQ ID NO: 1715764 - RNA, 17 nt, Human
gugugacuacuccccca

SEQ ID NO: 1715765 - RNA, 18 nt, Human
gugucuuuuuucacuaca

SEQ ID NO: 1715766 - RNA, 17 nt, Human
gugugaaaaugugugug

SEQ ID NO: 1715767 - RNA, 18 nt, Human
gugucuugcaauggcagc

SEQ ID NO: 1715768 - RNA, 17 nt, Human
gugucuugcaauggcag

SEQ ID NO: 1715769 - RNA, 18 nt, Human
aagagguuuuaaaaaaau

SEQ ID NO: 1715770 - RNA, 20 nt, Human
guggugguuuucuguucuuu

SEQ ID NO: 1715771 - RNA, 17 nt, Human
gugguuuucuguucuuu

SEQ ID NO: 1715772 - RNA, 12 nt, Human
aagaugcagccg

SEQ ID NO: 1715773 - RNA, 18 nt, Human
aagaugugacauguuuua

SEQ ID NO: 1715774 - RNA, 14 nt, Human
aagaugugacaugu

SEQ ID NO: 1715775 - RNA, 22 nt, Human
aagcaaagacuuuccucuuagu

SEQ ID NO: 1715776 - RNA, 13 nt, Human
aagcaaaggagau

SEQ ID NO: 1715777 - RNA, 12 nt, Human
aagcaaaggaga

SEQ ID NO: 1715778 - RNA, 15 nt, Human
aagcaagauuucaga

SEQ ID NO: 1715779 - RNA, 22 nt, Human
gugggacacccugugauggggc

SEQ ID NO: 1715780 - RNA, 23 nt, Human
guggcgcagcauauucaggaagc

SEQ ID NO: 1715781 - RNA, 13 nt, Human
gugggauccucca

SEQ ID NO: 1715782 - RNA, 14 nt, Human
gugggagugggccc

SEQ ID NO: 1715783 - RNA, 13 nt, Human
gugggagugggcc

SEQ ID NO: 1715784 - RNA, 16 nt, Human
gugguuucagaaaugu

SEQ ID NO: 1715785 - RNA, 14 nt, Human
guggugguuuucug

SEQ ID NO: 1715786 - RNA, 14 nt, Human
guggguacgggagg

SEQ ID NO: 1715787 - RNA, 20 nt, Human
gugggggaucacagccucug

SEQ ID NO: 1715788 - RNA, 18 nt, Human
aagacuaucuaaauguug

SEQ ID NO: 1715789 - RNA, 17 nt, Human
aagacugaguacguugu

SEQ ID NO: 1715790 - RNA, 17 nt, Human
aagacuguacaaaguag

SEQ ID NO: 1715791 - RNA, 21 nt, Human
aagacugaguacguugugcau

SEQ ID NO: 1715792 - RNA, 22 nt, Human
aagacugaguacguugugcauu

SEQ ID NO: 1715793 - RNA, 17 nt, Human
aagacuaucuaaauguu

SEQ ID NO: 1715794 - RNA, 16 nt, Human
aagacuaucuaaaugu

SEQ ID NO: 1715795 - RNA, 21 nt, Human
aagacccuuguggucccaccc

SEQ ID NO: 1715796 - RNA, 18 nt, Human
aagacccuugugguccca

SEQ ID NO: 1715797 - RNA, 22 nt, Human
aagacccuuguggucccacccc

SEQ ID NO: 1715798 - RNA, 19 nt, Human
guggcccgacagccuggca

SEQ ID NO: 1715799 - RNA, 18 nt, Human
guggcccgacagccuggc

SEQ ID NO: 1715800 - RNA, 16 nt, Human
aagagcuuaacagugu

SEQ ID NO: 1715801 - RNA, 16 nt, Human
aaggguaucaggugcu

SEQ ID NO: 1715802 - RNA, 17 nt, Human
aaggguaucaggugcug

SEQ ID NO: 1715803 - RNA, 15 nt, Human
aaguaauaugcacac

SEQ ID NO: 1715804 - RNA, 16 nt, Human
aaguaauaugcacaca

SEQ ID NO: 1715805 - RNA, 19 nt, Human
guuucuaaaggcuaccuuu

SEQ ID NO: 1715806 - RNA, 12 nt, Human
aaguaauaugca

SEQ ID NO: 1715807 - RNA, 22 nt, Human
aaguaaaaacaaagaaauuaug

SEQ ID NO: 1715808 - RNA, 20 nt, Human
aaguaaaaacaaagaaauua

SEQ ID NO: 1715809 - RNA, 13 nt, Human
aaguaaaaacaaa

SEQ ID NO: 1715810 - RNA, 23 nt, Human
aaggggaauguuugccucugccu

SEQ ID NO: 1715811 - RNA, 22 nt, Human
aaggggaauguuugccucugcc

SEQ ID NO: 1715812 - RNA, 17 nt, Human
aagggccuggccugagc

SEQ ID NO: 1715813 - RNA, 14 nt, Human
aagggccuggccug

SEQ ID NO: 1715814 - RNA, 19 nt, Human
aagggccuggccugagcug

SEQ ID NO: 1715815 - RNA, 17 nt, Human
guuucugucguuaaaaa

SEQ ID NO: 1715816 - RNA, 22 nt, Human
guuucuaaaggcuaccuuugua

SEQ ID NO: 1715817 - RNA, 23 nt, Human
guuucuaaaggcuaccuuuguau

SEQ ID NO: 1715818 - RNA, 22 nt, Human
guuugauucagacagcugccug

SEQ ID NO: 1715819 - RNA, 22 nt, Human
guuucugucguuaaaaacagau

SEQ ID NO: 1715820 - RNA, 16 nt, Human
guuugccucugccucu

SEQ ID NO: 1715821 - RNA, 13 nt, Human
guuugccucugcc

SEQ ID NO: 1715822 - RNA, 11 nt, Human
guuuucuguuc

SEQ ID NO: 1715823 - RNA, 12 nt, Human
guuuucuguucu

SEQ ID NO: 1715824 - RNA, 20 nt, Human
guuuucuuaaccagaucauu

SEQ ID NO: 1715825 - RNA, 15 nt, Human
guuuuacugcagcuu

SEQ ID NO: 1715826 - RNA, 18 nt, Human
guuuggggaugagaaagg

SEQ ID NO: 1715827 - RNA, 20 nt, Human
guuugggccccagaggcugg

SEQ ID NO: 1715828 - RNA, 23 nt, Human
guuuuacaauaaaaucuugaaaa

SEQ ID NO: 1715829 - RNA, 18 nt, Human
guuggucccccuuccaug

SEQ ID NO: 1715830 - RNA, 13 nt, Human
guuggguggaugc

SEQ ID NO: 1715831 - RNA, 18 nt, Human
guuguaccgcaaugugac

SEQ ID NO: 1715832 - RNA, 12 nt, Human
guuguauucauu

SEQ ID NO: 1715833 - RNA, 20 nt, Human
guuuaagacauuuuuggaag

SEQ ID NO: 1715834 - RNA, 21 nt, Human
guugcccaggcuggcgugcag

SEQ ID NO: 1715835 - RNA, 19 nt, Human
guugcccaggcaggucuug

SEQ ID NO: 1715836 - RNA, 18 nt, Human
guugcccaggcaggucuu

SEQ ID NO: 1715837 - RNA, 17 nt, Human
guugcccaggcaggucu

SEQ ID NO: 1715838 - RNA, 14 nt, Human
aaggcuccaggagc

SEQ ID NO: 1715839 - RNA, 19 nt, Human
aaggcuaccuuuguauucu

SEQ ID NO: 1715840 - RNA, 18 nt, Human
aaggccaaaggaagcaca

SEQ ID NO: 1715841 - RNA, 23 nt, Human
aaggaugaucuaggaagacuuug

SEQ ID NO: 1715842 - RNA, 18 nt, Human
aaggaugaucuaggaaga

SEQ ID NO: 1715843 - RNA, 17 nt, Human
aaggauccugagccaga

SEQ ID NO: 1715844 - RNA, 15 nt, Human
aaggauccugagcca

SEQ ID NO: 1715845 - RNA, 14 nt, Human
aaggauccugagcc

SEQ ID NO: 1715846 - RNA, 23 nt, Human
guugaugaucuuugcagacaggc

SEQ ID NO: 1715847 - RNA, 21 nt, Human
guugaugccugugaacugaac

SEQ ID NO: 1715848 - RNA, 20 nt, Human
aaggauccugagccagauuu

SEQ ID NO: 1715849 - RNA, 22 nt, Human
aaggaugcacagaguuguuaca

SEQ ID NO: 1715850 - RNA, 18 nt, Human
aaggaugcacagaguugu

SEQ ID NO: 1715851 - RNA, 15 nt, Human
aaggaugcuuguaca

SEQ ID NO: 1715852 - RNA, 16 nt, Human
aaggaugcuuguacau

SEQ ID NO: 1715853 - RNA, 17 nt, Human
aaggaugcuuguacaua

SEQ ID NO: 1715854 - RNA, 19 nt, Human
aaggaugcuuguacauaau

SEQ ID NO: 1715855 - RNA, 19 nt, Human
aaggaugccccgucccccu

SEQ ID NO: 1715856 - RNA, 17 nt, Human
guuaguaugaggcauuu

SEQ ID NO: 1715857 - RNA, 20 nt, Human
guuaguaugaggcauuuguu

SEQ ID NO: 1715858 - RNA, 13 nt, Human
guuagauuaagaa

SEQ ID NO: 1715859 - RNA, 16 nt, Human
guuagauuaagaaaua

SEQ ID NO: 1715860 - RNA, 16 nt, Human
guuacacauuuuucag

SEQ ID NO: 1715861 - RNA, 22 nt, Human
guuaaguugauggugaugaaau

SEQ ID NO: 1715862 - RNA, 18 nt, Human
guuaaugauagcuacugu

SEQ ID NO: 1715863 - RNA, 12 nt, Human
guuaauaaaagu

SEQ ID NO: 1715864 - RNA, 18 nt, Human
guguuuuaaaaugagaaa

SEQ ID NO: 1715865 - RNA, 16 nt, Human
guuaagccuuuggaaa

SEQ ID NO: 1715866 - RNA, 13 nt, Human
guuaagccuuugg

SEQ ID NO: 1715867 - RNA, 12 nt, Human
guuaagccuuug

SEQ ID NO: 1715868 - RNA, 17 nt, Human
guucagcuccagcucac

SEQ ID NO: 1715869 - RNA, 16 nt, Human
guucagcuccagcuca

SEQ ID NO: 1715870 - RNA, 18 nt, Human
guucagcuccagcucacc

SEQ ID NO: 1715871 - RNA, 19 nt, Human
guucaggguuggccccugc

SEQ ID NO: 1715872 - RNA, 18 nt, Human
guucaggguuggccccug

SEQ ID NO: 1715873 - RNA, 17 nt, Human
guucaggguuggccccu

SEQ ID NO: 1715874 - RNA, 22 nt, Human
aagcuaggccuggccagaugca

SEQ ID NO: 1715875 - RNA, 18 nt, Human
aagcuaggccuggccaga

SEQ ID NO: 1715876 - RNA, 17 nt, Human
aagcuaggccuggccag

SEQ ID NO: 1715877 - RNA, 19 nt, Human
aagccuccuccagccgcca

SEQ ID NO: 1715878 - RNA, 13 nt, Human
guucucuccuucu

SEQ ID NO: 1715879 - RNA, 16 nt, Human
guucuacccaggugcu

SEQ ID NO: 1715880 - RNA, 22 nt, Human
guucccuuugacgccaucccag

SEQ ID NO: 1715881 - RNA, 21 nt, Human
guucccuuugacgccauccca

SEQ ID NO: 1715882 - RNA, 20 nt, Human
guucccuuugacgccauccc

SEQ ID NO: 1715883 - RNA, 14 nt, Human
guucuucaucuaag

SEQ ID NO: 1715884 - RNA, 21 nt, Human
guucuugguuuguaaauuaac

SEQ ID NO: 1715885 - RNA, 19 nt, Human
guucuuaguugcuguaugu

SEQ ID NO: 1715886 - RNA, 17 nt, Human
guucuuaguuugcaguu

SEQ ID NO: 1715887 - RNA, 22 nt, Human
guugaugaucuuugcagacagg

SEQ ID NO: 1715888 - RNA, 20 nt, Human
guuccauggccucuucagau

SEQ ID NO: 1715889 - RNA, 20 nt, Human
guucccauuugcuccuuucu

SEQ ID NO: 1715890 - RNA, 16 nt, Human
guucccauuugcuccu

SEQ ID NO: 1715891 - RNA, 20 nt, Human
guucccuacuuccugugacu

SEQ ID NO: 1715892 - RNA, 21 nt, Human
aagcucuacugaggugcuaug

SEQ ID NO: 1715893 - RNA, 22 nt, Human
aagcuauucaguaauaacucua

SEQ ID NO: 1715894 - RNA, 17 nt, Human
aagcuaucguaaaauua

SEQ ID NO: 1715895 - RNA, 15 nt, Human
aacauacucccaucu

SEQ ID NO: 1715896 - RNA, 14 nt, Human
aacauacucccauc

SEQ ID NO: 1715897 - RNA, 14 nt, Human
aacauugcaauaga

SEQ ID NO: 1715898 - RNA, 15 nt, Human
aacauugcaauagaa

SEQ ID NO: 1715899 - RNA, 16 nt, Human
aacauugcaauagaaa

SEQ ID NO: 1715900 - RNA, 20 nt, Human
aacauuuguucuauagcuuu

SEQ ID NO: 1715901 - RNA, 16 nt, Human
aacauuguagccucaa

SEQ ID NO: 1715902 - RNA, 17 nt, Human
aacauugcaauagaaau

SEQ ID NO: 1715903 - RNA, 22 nt, Human
aacauuuguucuauagcuuuuc

SEQ ID NO: 1715904 - RNA, 22 nt, Human
aacaguagugauaguuguaccg

SEQ ID NO: 1715905 - RNA, 23 nt, Human
aacaggcugggcuucaguggcag

SEQ ID NO: 1715906 - RNA, 13 nt, Human
aacaggcugggcu

SEQ ID NO: 1715907 - RNA, 22 nt, Human
aacaggcugggcuucaguggca

SEQ ID NO: 1715908 - RNA, 19 nt, Human
aacagacuggaagcacagc

SEQ ID NO: 1715909 - RNA, 21 nt, Human
guccggucccugucccagugc

SEQ ID NO: 1715910 - RNA, 13 nt, Human
guccgagcuuuga

SEQ ID NO: 1715911 - RNA, 15 nt, Human
gucccaacuuguaaa

SEQ ID NO: 1715912 - RNA, 10 nt, Human
aacagaaaug

SEQ ID NO: 1715913 - RNA, 11 nt, Human
aacagaaaugu

SEQ ID NO: 1715914 - RNA, 21 nt, Human
aacagaaauguacagcaagga

SEQ ID NO: 1715915 - RNA, 23 nt, Human
aacaaggcaaggcugucaauuac

SEQ ID NO: 1715916 - RNA, 21 nt, Human
aacaagccuccuuuuaaagua

SEQ ID NO: 1715917 - RNA, 15 nt, Human
aacaaggcaaggcug

SEQ ID NO: 1715918 - RNA, 16 nt, Human
aacaagaccacguuuc

SEQ ID NO: 1715919 - RNA, 17 nt, Human
aacaagaccacguuucu

SEQ ID NO: 1715920 - RNA, 19 nt, Human
aacaagaccacguuucuaa

SEQ ID NO: 1715921 - RNA, 20 nt, Human
aacaagaccacguuucuaaa

SEQ ID NO: 1715922 - RNA, 15 nt, Human
gucacaggcaggucc

SEQ ID NO: 1715923 - RNA, 13 nt, Human
gucacaggcaggu

SEQ ID NO: 1715924 - RNA, 16 nt, Human
gucacaggcaggucca

SEQ ID NO: 1715925 - RNA, 23 nt, Human
aaauuuuuaaucuuuaauuuuac

SEQ ID NO: 1715926 - RNA, 21 nt, Human
aacacucauugaccugaggcc

SEQ ID NO: 1715927 - RNA, 11 nt, Human
aacacucugag

SEQ ID NO: 1715928 - RNA, 12 nt, Human
aacacuccuuca

SEQ ID NO: 1715929 - RNA, 13 nt, Human
aacacucugagac

SEQ ID NO: 1715930 - RNA, 12 nt, Human
aacacucugaga

SEQ ID NO: 1715931 - RNA, 14 nt, Human
aacacucugagacu

SEQ ID NO: 1715932 - RNA, 20 nt, Human
aacacuguucucugcccucc

SEQ ID NO: 1715933 - RNA, 15 nt, Human
aacacuguucucugc

SEQ ID NO: 1715934 - RNA, 15 nt, Human
guccacaacacacag

SEQ ID NO: 1715935 - RNA, 22 nt, Human
gucauuugagcagggcucagcg

SEQ ID NO: 1715936 - RNA, 21 nt, Human
aacacuguucucugcccucca

SEQ ID NO: 1715937 - RNA, 21 nt, Human
gucauuugagcagggcucagc

SEQ ID NO: 1715938 - RNA, 11 nt, Human
aacacuuccau

SEQ ID NO: 1715939 - RNA, 19 nt, Human
gucuuauauauuguagaua

SEQ ID NO: 1715940 - RNA, 15 nt, Human
gucuuagauguauau

SEQ ID NO: 1715941 - RNA, 15 nt, Human
gucuuuggacccuga

SEQ ID NO: 1715942 - RNA, 14 nt, Human
gucuuuggacccug

SEQ ID NO: 1715943 - RNA, 17 nt, Human
gucuuuggacccugagg

SEQ ID NO: 1715944 - RNA, 18 nt, Human
gucuuuggacccugaggc

SEQ ID NO: 1715945 - RNA, 19 nt, Human
gucuuuucuugcaugaggc

SEQ ID NO: 1715946 - RNA, 14 nt, Human
gucuuuucuugcau

SEQ ID NO: 1715947 - RNA, 24 nt, Human
gucuuuucuugcaugaggcuagug

SEQ ID NO: 1715948 - RNA, 15 nt, Human
gucuggcuucacaga

SEQ ID NO: 1715949 - RNA, 15 nt, Human
aacguggcugcuuca

SEQ ID NO: 1715950 - RNA, 20 nt, Human
aaccugcucuccucuugcca

SEQ ID NO: 1715951 - RNA, 11 nt, Human
aaccugcucuc

SEQ ID NO: 1715952 - RNA, 15 nt, Human
aaccugcucuccucu

SEQ ID NO: 1715953 - RNA, 19 nt, Human
aacguggcugcuucaagga

SEQ ID NO: 1715954 - RNA, 16 nt, Human
aacguggcugcuucaa

SEQ ID NO: 1715955 - RNA, 22 nt, Human
aacguggcugcuucaaggaucc

SEQ ID NO: 1715956 - RNA, 19 nt, Human
aacucccugccccccagcc

SEQ ID NO: 1715957 - RNA, 13 nt, Human
aacucccugcccc

SEQ ID NO: 1715958 - RNA, 13 nt, Human
aacucccuuucaa

SEQ ID NO: 1715959 - RNA, 14 nt, Human
aacucccuuucaac

SEQ ID NO: 1715960 - RNA, 19 nt, Human
gugaaccaccacacccagc

SEQ ID NO: 1715961 - RNA, 13 nt, Human
aacccaaauguuc

SEQ ID NO: 1715962 - RNA, 18 nt, Human
aacccaaauguucaucaa

SEQ ID NO: 1715963 - RNA, 11 nt, Human
aacccagcucu

SEQ ID NO: 1715964 - RNA, 14 nt, Human
aacccagcucuggu

SEQ ID NO: 1715965 - RNA, 13 nt, Human
aacccagcucugg

SEQ ID NO: 1715966 - RNA, 20 nt, Human
aacccauauuuguacaccaa

SEQ ID NO: 1715967 - RNA, 17 nt, Human
aacccagcucuggucca

SEQ ID NO: 1715968 - RNA, 15 nt, Human
aacccccagccugcu

SEQ ID NO: 1715969 - RNA, 14 nt, Human
aacccccagccugc

SEQ ID NO: 1715970 - RNA, 13 nt, Human
aacccccagccug

SEQ ID NO: 1715971 - RNA, 14 nt, Human
aaccuccugggcua

SEQ ID NO: 1715972 - RNA, 17 nt, Human
aaccuccgccucuuggg

SEQ ID NO: 1715973 - RNA, 21 nt, Human
aaccaucauugaaaucuuuuu

SEQ ID NO: 1715974 - RNA, 23 nt, Human
aaccaucauugaaaucuuuuugc

SEQ ID NO: 1715975 - RNA, 20 nt, Human
aaccaucauugaaaucuuuu

SEQ ID NO: 1715976 - RNA, 19 nt, Human
aaccaucauugaaaucuuu

SEQ ID NO: 1715977 - RNA, 22 nt, Human
aaccacaucuugcucugcugac

SEQ ID NO: 1715978 - RNA, 20 nt, Human
aaccacaucuugcucugcug

SEQ ID NO: 1715979 - RNA, 16 nt, Human
gucucccucccuuggg

SEQ ID NO: 1715980 - RNA, 14 nt, Human
aaaugcauuucuaa

SEQ ID NO: 1715981 - RNA, 13 nt, Human
aaaugcccagccc

SEQ ID NO: 1715982 - RNA, 13 nt, Human
aaaugcccagcuu

SEQ ID NO: 1715983 - RNA, 18 nt, Human
aaaugcccagccccuucu

SEQ ID NO: 1715984 - RNA, 15 nt, Human
aaaugcccagccccu

SEQ ID NO: 1715985 - RNA, 14 nt, Human
aaaugcccagcccc

SEQ ID NO: 1715986 - RNA, 23 nt, Human
aaaugccuuacccucauguucuu

SEQ ID NO: 1715987 - RNA, 20 nt, Human
aaaugggcagagcagagacc

SEQ ID NO: 1715988 - RNA, 18 nt, Human
aaaugggcagagcagaga

SEQ ID NO: 1715989 - RNA, 15 nt, Human
aaaugggcagagcag

SEQ ID NO: 1715990 - RNA, 14 nt, Human
aaaugcaccuggaa

SEQ ID NO: 1715991 - RNA, 18 nt, Human
aaaugcaccuggaauaua

SEQ ID NO: 1715992 - RNA, 22 nt, Human
aaaugcaccuggaauauauaac

SEQ ID NO: 1715993 - RNA, 13 nt, Human
aaaugcauguugc

SEQ ID NO: 1715994 - RNA, 21 nt, Human
aaaugaaagcagggacuugaa

SEQ ID NO: 1715995 - RNA, 22 nt, Human
aaaugaaagcagggacuugaac

SEQ ID NO: 1715996 - RNA, 14 nt, Human
aaaugaaagugaga

SEQ ID NO: 1715997 - RNA, 11 nt, Human
aaaugagaaau

SEQ ID NO: 1715998 - RNA, 19 nt, Human
aaaugaggucagagccugc

SEQ ID NO: 1715999 - RNA, 17 nt, Human
aaaugaggucagagccu

SEQ ID NO: 1716000 - RNA, 23 nt, Human
aaaugagguacucuccuggaaau

SEQ ID NO: 1716001 - RNA, 16 nt, Human
aaaugagguacucucc

SEQ ID NO: 1716002 - RNA, 23 nt, Human
aaaugauccccagcuguuuaugc

SEQ ID NO: 1716003 - RNA, 19 nt, Human
aaaugagccuggcaagaau

SEQ ID NO: 1716004 - RNA, 13 nt, Human
aaaugagccuggc

SEQ ID NO: 1716005 - RNA, 16 nt, Human
aaaugagaaaucuaaa

SEQ ID NO: 1716006 - RNA, 14 nt, Human
aaaugagaaaucua

SEQ ID NO: 1716007 - RNA, 13 nt, Human
aaaugagaaaucu

SEQ ID NO: 1716008 - RNA, 18 nt, Human
guaggaagguuaauguuc

SEQ ID NO: 1716009 - RNA, 15 nt, Human
guaggacuguagaaa

SEQ ID NO: 1716010 - RNA, 15 nt, Human
guaggaagacuuugg

SEQ ID NO: 1716011 - RNA, 21 nt, Human
guagcugggacuacaggcacc

SEQ ID NO: 1716012 - RNA, 18 nt, Human
guagcugggauuacaggc

SEQ ID NO: 1716013 - RNA, 19 nt, Human
guagcugggacuacaggca

SEQ ID NO: 1716014 - RNA, 18 nt, Human
guagcugggacuacaggc

SEQ ID NO: 1716015 - RNA, 12 nt, Human
guagcugggacu

SEQ ID NO: 1716016 - RNA, 17 nt, Human
guagcuggauuacaggc

SEQ ID NO: 1716017 - RNA, 14 nt, Human
aaaggaugcacaga

SEQ ID NO: 1716018 - RNA, 17 nt, Human
aaaggagagcuagcagc

SEQ ID NO: 1716019 - RNA, 13 nt, Human
aaaucgaugcagu

SEQ ID NO: 1716020 - RNA, 18 nt, Human
aaaucccuuaccucggug

SEQ ID NO: 1716021 - RNA, 15 nt, Human
aaaucccauuuaaaa

SEQ ID NO: 1716022 - RNA, 19 nt, Human
aaaucuacacuccagugag

SEQ ID NO: 1716023 - RNA, 17 nt, Human
aaaugaaaaucgugaca

SEQ ID NO: 1716024 - RNA, 11 nt, Human
aaaugaaaauu

SEQ ID NO: 1716025 - RNA, 15 nt, Human
aaaucucaaauuucu

SEQ ID NO: 1716026 - RNA, 16 nt, Human
aaaucucaaauuucua

SEQ ID NO: 1716027 - RNA, 17 nt, Human
aaaucucaaauuucuaa

SEQ ID NO: 1716028 - RNA, 19 nt, Human
aaaucucaaauuucuaaau

SEQ ID NO: 1716029 - RNA, 17 nt, Human
guauaaaagccuguuua

SEQ ID NO: 1716030 - RNA, 19 nt, Human
aaaugggggugcauuugag

SEQ ID NO: 1716031 - RNA, 17 nt, Human
aaaugggggugcauuug

SEQ ID NO: 1716032 - RNA, 18 nt, Human
aaaugggggugcauuuga

SEQ ID NO: 1716033 - RNA, 15 nt, Human
aaaugggggugcauu

SEQ ID NO: 1716034 - RNA, 16 nt, Human
aaaugggggugcauuu

SEQ ID NO: 1716035 - RNA, 22 nt, Human
guauauugauccagaaagaaaa

SEQ ID NO: 1716036 - RNA, 18 nt, Human
guauaaaagggacugaga

SEQ ID NO: 1716037 - RNA, 21 nt, Human
guauaaaagccuguuuaagag

SEQ ID NO: 1716038 - RNA, 18 nt, Human
guauaaaagccuguuuaa

SEQ ID NO: 1716039 - RNA, 15 nt, Human
guauucuuauuuaau

SEQ ID NO: 1716040 - RNA, 13 nt, Human
guaugguggcugg

SEQ ID NO: 1716041 - RNA, 15 nt, Human
guaugggagagaaga

SEQ ID NO: 1716042 - RNA, 16 nt, Human
guaugggacuggccuc

SEQ ID NO: 1716043 - RNA, 14 nt, Human
guaugggagagaag

SEQ ID NO: 1716044 - RNA, 15 nt, Human
guaucccuacuguaa

SEQ ID NO: 1716045 - RNA, 17 nt, Human
aaauuucagcagcugca

SEQ ID NO: 1716046 - RNA, 18 nt, Human
aaauuucagcagcugcag

SEQ ID NO: 1716047 - RNA, 12 nt, Human
aaauuucuaaau

SEQ ID NO: 1716048 - RNA, 14 nt, Human
guauuuuuuuacua

SEQ ID NO: 1716049 - RNA, 15 nt, Human
guauuuuuuuacuaa

SEQ ID NO: 1716050 - RNA, 22 nt, Human
aaauuuccacucaggucuguuu

SEQ ID NO: 1716051 - RNA, 14 nt, Human
aaauuuccacucag

SEQ ID NO: 1716052 - RNA, 20 nt, Human
gucacacaguauuacuucug

SEQ ID NO: 1716053 - RNA, 16 nt, Human
gucacacacuuuggcu

SEQ ID NO: 1716054 - RNA, 17 nt, Human
guauuuuuuuacuaaua

SEQ ID NO: 1716055 - RNA, 21 nt, Human
guauuuuuuuacuaauagaca

SEQ ID NO: 1716056 - RNA, 18 nt, Human
gucaaaguggugagaggc

SEQ ID NO: 1716057 - RNA, 19 nt, Human
gucaaaguggugagaggca

SEQ ID NO: 1716058 - RNA, 21 nt, Human
aaauuaacuuuuauaaacuuu

SEQ ID NO: 1716059 - RNA, 20 nt, Human
aaauguuaaguugaugguga

SEQ ID NO: 1716060 - RNA, 22 nt, Human
aaauuaacuuuuauaaacuuua

SEQ ID NO: 1716061 - RNA, 23 nt, Human
aaauuaacuuuuauaaacuuuac

SEQ ID NO: 1716062 - RNA, 22 nt, Human
guauuggcuagagguucaaaga

SEQ ID NO: 1716063 - RNA, 16 nt, Human
guauuuaauucauguu

SEQ ID NO: 1716064 - RNA, 14 nt, Human
aaauucaugcugcu

SEQ ID NO: 1716065 - RNA, 20 nt, Human
aaaagacaaggaaaaaauaa

SEQ ID NO: 1716066 - RNA, 17 nt, Human
aaaagaaagaaaaucag

SEQ ID NO: 1716067 - RNA, 16 nt, Human
aaaagaaaagucaagg

SEQ ID NO: 1716068 - RNA, 17 nt, Human
aaaacacauuuuucuua

SEQ ID NO: 1716069 - RNA, 19 nt, Human
aaaacacuguucucugccc

SEQ ID NO: 1716070 - RNA, 11 nt, Human
aaaagaaaaag

SEQ ID NO: 1716071 - RNA, 14 nt, Human
aaaauaaaacuuuu

SEQ ID NO: 1716072 - RNA, 21 nt, Human
aaaaucagccugcuccagcug

SEQ ID NO: 1716073 - RNA, 17 nt, Human
aaaaucagccugcucca

SEQ ID NO: 1716074 - RNA, 13 nt, Human
aaaaucagccugc

SEQ ID NO: 1716075 - RNA, 16 nt, Human
aaaauaaaacuuuuua

SEQ ID NO: 1716076 - RNA, 15 nt, Human
aaagcccaaaguggu

SEQ ID NO: 1716077 - RNA, 23 nt, Human
aaacugauuuuuuuuuccuucag

SEQ ID NO: 1716078 - RNA, 22 nt, Human
aaacugauuuuuuuuuccuuca

SEQ ID NO: 1716079 - RNA, 23 nt, Human
aaacucuuaaaacccaagugccu

SEQ ID NO: 1716080 - RNA, 12 nt, Human
aaacucuuaaaa

SEQ ID NO: 1716081 - RNA, 16 nt, Human
aaaccgccaaggcugg

SEQ ID NO: 1716082 - RNA, 15 nt, Human
aaaccgccaaggcug

SEQ ID NO: 1716083 - RNA, 18 nt, Human
aaacucuguuacacuuuu

SEQ ID NO: 1716084 - RNA, 22 nt, Human
aaacucuguuacacuuuuugga

SEQ ID NO: 1716085 - RNA, 16 nt, Human
aaacccagcucugguc

SEQ ID NO: 1716086 - RNA, 12 nt, Human
aaacccagcucu

SEQ ID NO: 1716087 - RNA, 18 nt, Human
aaacccagcucuggucca

SEQ ID NO: 1716088 - RNA, 15 nt, Human
aaaaucucaaauuuc

SEQ ID NO: 1716089 - RNA, 16 nt, Human
aaaaucucaaauuucu

SEQ ID NO: 1716090 - RNA, 18 nt, Human
aaaaucucaaauuucuaa

SEQ ID NO: 1716091 - RNA, 22 nt, Human
aacauggccuuugcuugaaaga

SEQ ID NO: 1716092 - RNA, 11 nt, Human
aacaggcagau

SEQ ID NO: 1716093 - RNA, 23 nt, Human
aaauucuucuccacuuucuagcc

SEQ ID NO: 1716094 - RNA, 15 nt, Human
aaauucuugcaaagu

SEQ ID NO: 1716095 - RNA, 18 nt, Human
aaauucuugcaaaguauc

SEQ ID NO: 1716096 - RNA, 23 nt, Human
aacauggccuuugcuugaaagaa

SEQ ID NO: 1716097 - RNA, 12 nt, Human
aacccucagagc

SEQ ID NO: 1716098 - RNA, 19 nt, Human
aacccucagagccaccccu

SEQ ID NO: 1716099 - RNA, 23 nt, Human
aaccuuuugagugccuuacacaa

SEQ ID NO: 1716100 - RNA, 16 nt, Human
aaccuuuugagugccu

SEQ ID NO: 1716101 - RNA, 18 nt, Human
aaccuuuguuugcaucug

SEQ ID NO: 1716102 - RNA, 19 nt, Human
aaaugcuguaacuuucuga

SEQ ID NO: 1716103 - RNA, 22 nt, Human
aaaugcugguuuuucaguuuuc

SEQ ID NO: 1716104 - RNA, 14 nt, Human
aaaugaaaaaauau

SEQ ID NO: 1716105 - RNA, 14 nt, Human
aaaucuuuuugcuu

SEQ ID NO: 1716106 - RNA, 13 nt, Human
aaaucuuuuugcu

SEQ ID NO: 1716107 - RNA, 19 nt, Human
aaaucuccaaaauaaaacu

SEQ ID NO: 1716108 - RNA, 22 nt, Human
aaauauuuagauguaauuuugu

SEQ ID NO: 1716109 - RNA, 20 nt, Human
aaaggaugcccaaagaugca

SEQ ID NO: 1716110 - RNA, 17 nt, Human
aaauguucaucaaugaa

SEQ ID NO: 1716111 - RNA, 13 nt, Human
aaauguucaucaa

SEQ ID NO: 1716112 - RNA, 21 nt, Human
aagacaaggaaaaaauaacaa

SEQ ID NO: 1716113 - RNA, 20 nt, Human
aagacaaugugaaaagaaaa

SEQ ID NO: 1716114 - RNA, 19 nt, Human
aagacaaugugaaaagaaa

SEQ ID NO: 1716115 - RNA, 22 nt, Human
aagacaaugacuuacuguacau

SEQ ID NO: 1716116 - RNA, 16 nt, Human
aacgcagcccugcuuu

SEQ ID NO: 1716117 - RNA, 12 nt, Human
aacgcagcccug

SEQ ID NO: 1716118 - RNA, 14 nt, Human
aagaacuagcauaa

SEQ ID NO: 1716119 - RNA, 13 nt, Human
aagagaaaaaaua

SEQ ID NO: 1716120 - RNA, 19 nt, Human
aagacuuuucuuucagcca

SEQ ID NO: 1716121 - RNA, 12 nt, Human
aagacuuuucuu

SEQ ID NO: 1716122 - RNA, 21 nt, Human
aagacuuuuccaacccucauc

SEQ ID NO: 1716123 - RNA, 15 nt, Human
aagaccacguuucua

SEQ ID NO: 1716124 - RNA, 17 nt, Human
aagaccacguuucuaaa

SEQ ID NO: 1716125 - RNA, 23 nt, Human
aagacagauacuccuccaagguu

SEQ ID NO: 1716126 - RNA, 12 nt, Human
aagacagagucu

SEQ ID NO: 1716127 - RNA, 19 nt, Human
aagcugcacccucaggcag

SEQ ID NO: 1716128 - RNA, 13 nt, Human
aagcugcacccuc

SEQ ID NO: 1716129 - RNA, 22 nt, Human
aagcuagacgagcaggcuucuu

SEQ ID NO: 1716130 - RNA, 13 nt, Human
aaggcaaggcugu

SEQ ID NO: 1716131 - RNA, 15 nt, Human
aaggcaaggcuguca

SEQ ID NO: 1716132 - RNA, 16 nt, Human
aaggcaaggcugucaa

SEQ ID NO: 1716133 - RNA, 22 nt, Human
aaggcagggagggccugggccc

SEQ ID NO: 1716134 - RNA, 19 nt, Human
aaggcagggagggccuggg

SEQ ID NO: 1716135 - RNA, 17 nt, Human
aagauacaguuacucag

SEQ ID NO: 1716136 - RNA, 23 nt, Human
aagauacaguuacucagaauucu

SEQ ID NO: 1716137 - RNA, 21 nt, Human
aagauaauauuaaggaagaca

SEQ ID NO: 1716138 - RNA, 19 nt, Human
aagauaauauuaaggaaga

SEQ ID NO: 1716139 - RNA, 18 nt, Human
aagccauaauuguucuua

SEQ ID NO: 1716140 - RNA, 21 nt, Human
aagccagguuccacagaggac

SEQ ID NO: 1716141 - RNA, 23 nt, Human
aagccagguuccacagaggacac

SEQ ID NO: 1716142 - RNA, 14 nt, Human
aagcggcuggcagc

SEQ ID NO: 1716143 - RNA, 15 nt, Human
aagcgugagccacug

SEQ ID NO: 1716144 - RNA, 16 nt, Human
aagcgugagccacugc

SEQ ID NO: 1716145 - RNA, 13 nt, Human
aagcuagaaauga

SEQ ID NO: 1716146 - RNA, 10 nt, Human
aagccuuugu

SEQ ID NO: 1716147 - RNA, 20 nt, Human
aaugaauacuuuauaaagga

SEQ ID NO: 1716148 - RNA, 20 nt, Human
aaugaugccaugaggaacaa

SEQ ID NO: 1716149 - RNA, 20 nt, Human
aaugauguauguugaagccu

SEQ ID NO: 1716150 - RNA, 20 nt, Human
aaugaaagacuguacaaagu

SEQ ID NO: 1716151 - RNA, 18 nt, Human
aaugaaagacuguacaaa

SEQ ID NO: 1716152 - RNA, 21 nt, Human
aaugaaagacuguacaaagua

SEQ ID NO: 1716153 - RNA, 14 nt, Human
aaugaagcaaugcu

SEQ ID NO: 1716154 - RNA, 13 nt, Human
aauauuaagaaag

SEQ ID NO: 1716155 - RNA, 23 nt, Human
aauauguggaguucaucuugaau

SEQ ID NO: 1716156 - RNA, 16 nt, Human
aauauauaucaaauau

SEQ ID NO: 1716157 - RNA, 21 nt, Human
aaucaccgaaaacguggcugc

SEQ ID NO: 1716158 - RNA, 22 nt, Human
aaucaaugcuauaacuauguug

SEQ ID NO: 1716159 - RNA, 23 nt, Human
aaucaccgaaaacguggcugcuu

SEQ ID NO: 1716160 - RNA, 15 nt, Human
aaucacguaaagcua

SEQ ID NO: 1716161 - RNA, 23 nt, Human
aaucaaguuggcuucuaaucaaa

SEQ ID NO: 1716162 - RNA, 11 nt, Human
aauaaagacag

SEQ ID NO: 1716163 - RNA, 12 nt, Human
aauaaagacagg

SEQ ID NO: 1716164 - RNA, 14 nt, Human
aauaaagcagcguu

SEQ ID NO: 1716165 - RNA, 17 nt, Human
aauaaugugaaacugga

SEQ ID NO: 1716166 - RNA, 22 nt, Human
aauaaugugaaacuggauuaaa

SEQ ID NO: 1716167 - RNA, 19 nt, Human
aauaauguuaacauggaca

SEQ ID NO: 1716168 - RNA, 12 nt, Human
aagugcugggau

SEQ ID NO: 1716169 - RNA, 22 nt, Human
aagugcugggauuacaggugug

SEQ ID NO: 1716170 - RNA, 22 nt, Human
aagugcugcauuuaaaagauac

SEQ ID NO: 1716171 - RNA, 22 nt, Human
aaguuguaggcauaaagucagg

SEQ ID NO: 1716172 - RNA, 16 nt, Human
aauaaacacucuugaa

SEQ ID NO: 1716173 - RNA, 11 nt, Human
aauaaacacuc

SEQ ID NO: 1716174 - RNA, 19 nt, Human
aauaaacacucuugaaaaa

SEQ ID NO: 1716175 - RNA, 15 nt, Human
acaaguuaaauaaau

SEQ ID NO: 1716176 - RNA, 20 nt, Human
acaaggcaaggcugucaauu

SEQ ID NO: 1716177 - RNA, 19 nt, Human
acaaggcaaggcugucaau

SEQ ID NO: 1716178 - RNA, 17 nt, Human
acaaggcaaggcuguca

SEQ ID NO: 1716179 - RNA, 16 nt, Human
acaaggcaaggcuguc

SEQ ID NO: 1716180 - RNA, 15 nt, Human
acaccaauauucaua

SEQ ID NO: 1716181 - RNA, 23 nt, Human
acaccagagcccaccuuggcuca

SEQ ID NO: 1716182 - RNA, 18 nt, Human
acaccagagcccaccuug

SEQ ID NO: 1716183 - RNA, 18 nt, Human
acacagcucuucuccagg

SEQ ID NO: 1716184 - RNA, 19 nt, Human
acacagcucuucuccaggc

SEQ ID NO: 1716185 - RNA, 16 nt, Human
acacagcucuucucca

SEQ ID NO: 1716186 - RNA, 14 nt, Human
acacagcucuucuc

SEQ ID NO: 1716187 - RNA, 11 nt, Human
aauuguaauag

SEQ ID NO: 1716188 - RNA, 17 nt, Human
aauuucccaaagcagug

SEQ ID NO: 1716189 - RNA, 15 nt, Human
aauuucccaaagcag

SEQ ID NO: 1716190 - RNA, 21 nt, Human
aauuuccacucaggucuguuu

SEQ ID NO: 1716191 - RNA, 19 nt, Human
aauuauacccccugcaaag

SEQ ID NO: 1716192 - RNA, 19 nt, Human
aauuaugaguuauuuuuau

SEQ ID NO: 1716193 - RNA, 22 nt, Human
aauuguaaggaaugauuaauua

SEQ ID NO: 1716194 - RNA, 13 nt, Human
aauucuuaaauau

SEQ ID NO: 1716195 - RNA, 22 nt, Human
aauuggauacgacaacuugcac

SEQ ID NO: 1716196 - RNA, 18 nt, Human
aauucuguuuuucuaggc

SEQ ID NO: 1716197 - RNA, 14 nt, Human
aauucuguuuuucu

SEQ ID NO: 1716198 - RNA, 21 nt, Human
aauucucauuugucacacacu

SEQ ID NO: 1716199 - RNA, 14 nt, Human
aauucuccugccuc

SEQ ID NO: 1716200 - RNA, 16 nt, Human
aauucuccugccucag

SEQ ID NO: 1716201 - RNA, 15 nt, Human
aauucuccugccuca

SEQ ID NO: 1716202 - RNA, 15 nt, Human
aauucucuuauccaa

SEQ ID NO: 1716203 - RNA, 15 nt, Human
aauucucuaguuuga

SEQ ID NO: 1716204 - RNA, 17 nt, Human
aauucucuaguuugauu

SEQ ID NO: 1716205 - RNA, 19 nt, Human
aauucucagaaucucaaau

SEQ ID NO: 1716206 - RNA, 13 nt, Human
aauucuaugccug

SEQ ID NO: 1716207 - RNA, 15 nt, Human
aauucuaugccuguc

SEQ ID NO: 1716208 - RNA, 14 nt, Human
aauucuacuuugag

SEQ ID NO: 1716209 - RNA, 22 nt, Human
aauucuagcuuugagcuuaaga

SEQ ID NO: 1716210 - RNA, 17 nt, Human
acauguguuggcagccu

SEQ ID NO: 1716211 - RNA, 17 nt, Human
acauguuaaacuuacuu

SEQ ID NO: 1716212 - RNA, 19 nt, Human
acauguuuuucuucucccu

SEQ ID NO: 1716213 - RNA, 15 nt, Human
acauaagauaaaugu

SEQ ID NO: 1716214 - RNA, 20 nt, Human
acauaaguauuuaauucaug

SEQ ID NO: 1716215 - RNA, 20 nt, Human
acauacaggaagguagaaau

SEQ ID NO: 1716216 - RNA, 16 nt, Human
acauacaauuccaaac

SEQ ID NO: 1716217 - RNA, 13 nt, Human
acaugcacgugug

SEQ ID NO: 1716218 - RNA, 17 nt, Human
accaacgucugugccau

SEQ ID NO: 1716219 - RNA, 14 nt, Human
accaacgucugugc

SEQ ID NO: 1716220 - RNA, 13 nt, Human
accacguuucuaa

SEQ ID NO: 1716221 - RNA, 14 nt, Human
accacguuucuaaa

SEQ ID NO: 1716222 - RNA, 16 nt, Human
accacgcuggaccuug

SEQ ID NO: 1716223 - RNA, 14 nt, Human
accacgcuggaccu

SEQ ID NO: 1716224 - RNA, 18 nt, Human
accacgcuggaccuugaa

SEQ ID NO: 1716225 - RNA, 21 nt, Human
accaacgucugugccauuuug

SEQ ID NO: 1716226 - RNA, 14 nt, Human
accaagccguggcu

SEQ ID NO: 1716227 - RNA, 18 nt, Human
accaagccguggcuuccc

SEQ ID NO: 1716228 - RNA, 17 nt, Human
accaagccguggcuucc

SEQ ID NO: 1716229 - RNA, 16 nt, Human
accaagccguggcuuc

SEQ ID NO: 1716230 - RNA, 15 nt, Human
accaagccguggcuu

SEQ ID NO: 1716231 - RNA, 16 nt, Human
accagagcugccaccu

SEQ ID NO: 1716232 - RNA, 14 nt, Human
accagagcugccac

SEQ ID NO: 1716233 - RNA, 13 nt, Human
accagagcugcca

SEQ ID NO: 1716234 - RNA, 19 nt, Human
acagugauuaccagggacu

SEQ ID NO: 1716235 - RNA, 13 nt, Human
acagugcaucuca

SEQ ID NO: 1716236 - RNA, 18 nt, Human
acagugcaucucagccca

SEQ ID NO: 1716237 - RNA, 17 nt, Human
acagugcaucucagccc

SEQ ID NO: 1716238 - RNA, 15 nt, Human
acagugcaucucagc

SEQ ID NO: 1716239 - RNA, 23 nt, Human
acaggcacccaccaucaugucug

SEQ ID NO: 1716240 - RNA, 18 nt, Human
acaguggaaccagcccag

SEQ ID NO: 1716241 - RNA, 14 nt, Human
acaggauuauugga

SEQ ID NO: 1716242 - RNA, 17 nt, Human
acaggcaaugcuggcug

SEQ ID NO: 1716243 - RNA, 14 nt, Human
acaggcacccacca

SEQ ID NO: 1716244 - RNA, 16 nt, Human
acaggcaaugcuggcu

SEQ ID NO: 1716245 - RNA, 15 nt, Human
acaggcaaugcuggc

SEQ ID NO: 1716246 - RNA, 20 nt, Human
acagcucuucuccaggcugu

SEQ ID NO: 1716247 - RNA, 19 nt, Human
acagcucuucuccaggcug

SEQ ID NO: 1716248 - RNA, 19 nt, Human
acgcugugcugcccugccc

SEQ ID NO: 1716249 - RNA, 22 nt, Human
acgcugugcugcccugcccacc

SEQ ID NO: 1716250 - RNA, 23 nt, Human
acgcagcccugcuuugggcugcc

SEQ ID NO: 1716251 - RNA, 22 nt, Human
acgcagcccugcuuugggcugc

SEQ ID NO: 1716252 - RNA, 12 nt, Human
acgcagcccugc

SEQ ID NO: 1716253 - RNA, 19 nt, Human
acggacacucaaaagcugg

SEQ ID NO: 1716254 - RNA, 17 nt, Human
acggacacucaaaagcu

SEQ ID NO: 1716255 - RNA, 19 nt, Human
acggaauaguuggcuagga

SEQ ID NO: 1716256 - RNA, 13 nt, Human
acgucugugccau

SEQ ID NO: 1716257 - RNA, 12 nt, Human
acgucugugcca

SEQ ID NO: 1716258 - RNA, 20 nt, Human
acgauuucuguuuagauaau

SEQ ID NO: 1716259 - RNA, 23 nt, Human
acgauuucuguuuagauaauaca

SEQ ID NO: 1716260 - RNA, 19 nt, Human
acgauuucuguuuagauaa

SEQ ID NO: 1716261 - RNA, 18 nt, Human
acuaauggggcggugaga

SEQ ID NO: 1716262 - RNA, 12 nt, Human
accuuggcucaa

SEQ ID NO: 1716263 - RNA, 23 nt, Human
accucugccugaagucacacagu

SEQ ID NO: 1716264 - RNA, 20 nt, Human
accucugccugaagucacac

SEQ ID NO: 1716265 - RNA, 12 nt, Human
accucugccuga

SEQ ID NO: 1716266 - RNA, 20 nt, Human
accugccccucaacucuccu

SEQ ID NO: 1716267 - RNA, 15 nt, Human
accugccccucaacu

SEQ ID NO: 1716268 - RNA, 12 nt, Human
accugccccuca

SEQ ID NO: 1716269 - RNA, 23 nt, Human
accugccaggaagccagcaggcu

SEQ ID NO: 1716270 - RNA, 22 nt, Human
accugccaggaagccagcaggc

SEQ ID NO: 1716271 - RNA, 21 nt, Human
accugccaggaagccagcagg

SEQ ID NO: 1716272 - RNA, 18 nt, Human
accuguggccaaguucuu

SEQ ID NO: 1716273 - RNA, 17 nt, Human
accuguggccaaguucu

SEQ ID NO: 1716274 - RNA, 21 nt, Human
acccugucucuacuaaaaaua

SEQ ID NO: 1716275 - RNA, 16 nt, Human
acccugugauggggcc

SEQ ID NO: 1716276 - RNA, 16 nt, Human
acccuggggagaaagu

SEQ ID NO: 1716277 - RNA, 16 nt, Human
acccucaggcaggugg

SEQ ID NO: 1716278 - RNA, 15 nt, Human
acccucaggcaggug

SEQ ID NO: 1716279 - RNA, 13 nt, Human
acccucaucacca

SEQ ID NO: 1716280 - RNA, 14 nt, Human
acccucaggcaggu

SEQ ID NO: 1716281 - RNA, 13 nt, Human
acccucaggcagg

SEQ ID NO: 1716282 - RNA, 18 nt, Human
acccucagagccaccccu

SEQ ID NO: 1716283 - RNA, 23 nt, Human
acccuggcacuauaauguaagcu

SEQ ID NO: 1716284 - RNA, 18 nt, Human
acccuggcacccagggug

SEQ ID NO: 1716285 - RNA, 23 nt, Human
acccucaucaccaacgucugugc

SEQ ID NO: 1716286 - RNA, 13 nt, Human
acccuauugcugc

SEQ ID NO: 1716287 - RNA, 19 nt, Human
acccuauugcugcuugagg

SEQ ID NO: 1716288 - RNA, 14 nt, Human
acccuauugcugcu

SEQ ID NO: 1716289 - RNA, 11 nt, Human
acccucagagc

SEQ ID NO: 1716290 - RNA, 21 nt, Human
accucaggugauccacccacc

SEQ ID NO: 1716291 - RNA, 20 nt, Human
accucaggugauccacccac

SEQ ID NO: 1716292 - RNA, 11 nt, Human
accucaggccu

SEQ ID NO: 1716293 - RNA, 16 nt, Human
accgggcacucagaag

SEQ ID NO: 1716294 - RNA, 14 nt, Human
accgggcacucaga

SEQ ID NO: 1716295 - RNA, 12 nt, Human
accgggcacuca

SEQ ID NO: 1716296 - RNA, 21 nt, Human
acccugugauggggcccugcc

SEQ ID NO: 1716297 - RNA, 20 nt, Human
acccugugauggggcccugc

SEQ ID NO: 1716298 - RNA, 19 nt, Human
acccugugauggggcccug

SEQ ID NO: 1716299 - RNA, 17 nt, Human
acccugugauggggccc

SEQ ID NO: 1716300 - RNA, 23 nt, Human
accgugaggccagagacacaagc

SEQ ID NO: 1716301 - RNA, 19 nt, Human
accgugccuggccacgccc

SEQ ID NO: 1716302 - RNA, 11 nt, Human
accucagccuc

SEQ ID NO: 1716303 - RNA, 12 nt, Human
accucagccucc

SEQ ID NO: 1716304 - RNA, 18 nt, Human
accgugaggccagagaca

SEQ ID NO: 1716305 - RNA, 23 nt, Human
accgggcugggagcucugcagag

SEQ ID NO: 1716306 - RNA, 21 nt, Human
accgggcugggagcucugcag

SEQ ID NO: 1716307 - RNA, 19 nt, Human
acuguuucaaacuuuacua

SEQ ID NO: 1716308 - RNA, 15 nt, Human
acuguuucaaacuuu

SEQ ID NO: 1716309 - RNA, 18 nt, Human
acuguuucaaacuuuacu

SEQ ID NO: 1716310 - RNA, 20 nt, Human
acuuaaaauauuccugcauu

SEQ ID NO: 1716311 - RNA, 15 nt, Human
acuucaaaaguuugu

SEQ ID NO: 1716312 - RNA, 22 nt, Human
acuuaaaaaugguuuaaauggu

SEQ ID NO: 1716313 - RNA, 21 nt, Human
acuucagacauagaauuaaca

SEQ ID NO: 1716314 - RNA, 13 nt, Human
acuuggucuguga

SEQ ID NO: 1716315 - RNA, 23 nt, Human
acuuggggggcugaggugggagg

SEQ ID NO: 1716316 - RNA, 16 nt, Human
acuugaaaauuaacau

SEQ ID NO: 1716317 - RNA, 14 nt, Human
acuugaaaauuaac

SEQ ID NO: 1716318 - RNA, 12 nt, Human
acuugaaaauua

SEQ ID NO: 1716319 - RNA, 17 nt, Human
acuguaaaauaauaacu

SEQ ID NO: 1716320 - RNA, 12 nt, Human
acugguggcccg

SEQ ID NO: 1716321 - RNA, 12 nt, Human
acuggaacucuc

SEQ ID NO: 1716322 - RNA, 15 nt, Human
acugccuauuuuaau

SEQ ID NO: 1716323 - RNA, 19 nt, Human
acugcccaggccugccugu

SEQ ID NO: 1716324 - RNA, 14 nt, Human
acugccaugccagc

SEQ ID NO: 1716325 - RNA, 18 nt, Human
acugugccaugugccagg

SEQ ID NO: 1716326 - RNA, 17 nt, Human
acugugccaugugccag

SEQ ID NO: 1716327 - RNA, 16 nt, Human
acugugaagagaacca

SEQ ID NO: 1716328 - RNA, 23 nt, Human
acugucuuuuuucuaaaguaaaa

SEQ ID NO: 1716329 - RNA, 22 nt, Human
acugucuuuuuucuaaaguaaa

SEQ ID NO: 1716330 - RNA, 16 nt, Human
acugucuuuuuucuaa

SEQ ID NO: 1716331 - RNA, 23 nt, Human
acugaauuucuuuugccguuauu

SEQ ID NO: 1716332 - RNA, 18 nt, Human
acugacauuguuggccaa

SEQ ID NO: 1716333 - RNA, 17 nt, Human
acugacauuguuggcca

SEQ ID NO: 1716334 - RNA, 12 nt, Human
acugaauuucuu

SEQ ID NO: 1716335 - RNA, 16 nt, Human
acugauuuuuuuuucc

SEQ ID NO: 1716336 - RNA, 20 nt, Human
acugauuuuuuuuuccuuca

SEQ ID NO: 1716337 - RNA, 19 nt, Human
acugauuuuuuuuuccuuc

SEQ ID NO: 1716338 - RNA, 18 nt, Human
acugauuuuuuuuuccuu

SEQ ID NO: 1716339 - RNA, 17 nt, Human
acugauuuuuuuuuccu

SEQ ID NO: 1716340 - RNA, 22 nt, Human
acugacauuguuggccaaagcc

SEQ ID NO: 1716341 - RNA, 14 nt, Human
acugauuacugccu

SEQ ID NO: 1716342 - RNA, 20 nt, Human
acugauguaugaggaauuuc

SEQ ID NO: 1716343 - RNA, 15 nt, Human
acucuacagaggcca

SEQ ID NO: 1716344 - RNA, 14 nt, Human
acucccuuucaaca

SEQ ID NO: 1716345 - RNA, 18 nt, Human
acucccugccccccagcc

SEQ ID NO: 1716346 - RNA, 22 nt, Human
acucccaucugugaaaggaaag

SEQ ID NO: 1716347 - RNA, 15 nt, Human
acucccaagcuggac

SEQ ID NO: 1716348 - RNA, 22 nt, Human
aggcucuggagcccacuguacu

SEQ ID NO: 1716349 - RNA, 13 nt, Human
aggcugaggacuu

SEQ ID NO: 1716350 - RNA, 11 nt, Human
aggcugaggac

SEQ ID NO: 1716351 - RNA, 13 nt, Human
aggcugagccuca

SEQ ID NO: 1716352 - RNA, 11 nt, Human
aggcugagccu

SEQ ID NO: 1716353 - RNA, 13 nt, Human
aggcucuucuccu

SEQ ID NO: 1716354 - RNA, 23 nt, Human
aggcuguaucccaugagccucag

SEQ ID NO: 1716355 - RNA, 19 nt, Human
aggcugcagugagccgaga

SEQ ID NO: 1716356 - RNA, 17 nt, Human
aggcugcagugagccga

SEQ ID NO: 1716357 - RNA, 12 nt, Human
aggcugucaauu

SEQ ID NO: 1716358 - RNA, 19 nt, Human
aggcugucaauuacaggaa

SEQ ID NO: 1716359 - RNA, 24 nt, Human
aggcuguaucccaugagccucagc

SEQ ID NO: 1716360 - RNA, 20 nt, Human
aggcccucugcccacucccu

SEQ ID NO: 1716361 - RNA, 19 nt, Human
aggcccucugcccacuccc

SEQ ID NO: 1716362 - RNA, 21 nt, Human
aggcccucugcccacucccug

SEQ ID NO: 1716363 - RNA, 14 nt, Human
agggccuggcucag

SEQ ID NO: 1716364 - RNA, 13 nt, Human
agggccuggcuca

SEQ ID NO: 1716365 - RNA, 18 nt, Human
agggccuggcucaggugg

SEQ ID NO: 1716366 - RNA, 14 nt, Human
agggacugagaaau

SEQ ID NO: 1716367 - RNA, 13 nt, Human
agggacugagaaa

SEQ ID NO: 1716368 - RNA, 15 nt, Human
agggacugagaaauu

SEQ ID NO: 1716369 - RNA, 17 nt, Human
agggacugagaaauuua

SEQ ID NO: 1716370 - RNA, 13 nt, Human
aggaaguagagga

SEQ ID NO: 1716371 - RNA, 19 nt, Human
aggaaguacuggagaaaau

SEQ ID NO: 1716372 - RNA, 16 nt, Human
aggagagcccuucauu

SEQ ID NO: 1716373 - RNA, 14 nt, Human
aggaggucucuaag

SEQ ID NO: 1716374 - RNA, 12 nt, Human
aggagugagcac

SEQ ID NO: 1716375 - RNA, 15 nt, Human
aggaggucucuaaga

SEQ ID NO: 1716376 - RNA, 14 nt, Human
aggagugagcacua

SEQ ID NO: 1716377 - RNA, 18 nt, Human
aggaguuucguuuucaaa

SEQ ID NO: 1716378 - RNA, 23 nt, Human
aggccagcugcuugggcuucauc

SEQ ID NO: 1716379 - RNA, 17 nt, Human
aggcccucugcccacuc

SEQ ID NO: 1716380 - RNA, 17 nt, Human
aggccaugggccuccug

SEQ ID NO: 1716381 - RNA, 16 nt, Human
aggccaugggccuccu

SEQ ID NO: 1716382 - RNA, 14 nt, Human
aggccaugggccuc

SEQ ID NO: 1716383 - RNA, 23 nt, Human
aggccaggcccucugcccacucc

SEQ ID NO: 1716384 - RNA, 19 nt, Human
aggccaggcccucugccca

SEQ ID NO: 1716385 - RNA, 18 nt, Human
aggccaggcccucugccc

SEQ ID NO: 1716386 - RNA, 17 nt, Human
aggccaggcccucugcc

SEQ ID NO: 1716387 - RNA, 16 nt, Human
aggccaggcccucugc

SEQ ID NO: 1716388 - RNA, 16 nt, Human
aggccagcugcuuggg

SEQ ID NO: 1716389 - RNA, 14 nt, Human
aggccagcugcuug

SEQ ID NO: 1716390 - RNA, 13 nt, Human
aggccagcugcuu

SEQ ID NO: 1716391 - RNA, 23 nt, Human
aggcauuccccaggaggccagcc

SEQ ID NO: 1716392 - RNA, 22 nt, Human
aggcauuccccaggaggccagc

SEQ ID NO: 1716393 - RNA, 17 nt, Human
aggcauuccccaggagg

SEQ ID NO: 1716394 - RNA, 22 nt, Human
aggcauguucucugaggacacu

SEQ ID NO: 1716395 - RNA, 20 nt, Human
aggcauguucucugaggaca

SEQ ID NO: 1716396 - RNA, 21 nt, Human
aggcauuccccaggaggccag

SEQ ID NO: 1716397 - RNA, 18 nt, Human
aggcagccaggccacaag

SEQ ID NO: 1716398 - RNA, 17 nt, Human
aggcaucgcaauguaag

SEQ ID NO: 1716399 - RNA, 24 nt, Human
aggcaugugaugagaggaaaucac

SEQ ID NO: 1716400 - RNA, 23 nt, Human
aggcaugugaugagaggaaauca

SEQ ID NO: 1716401 - RNA, 12 nt, Human
aggcauguucuc

SEQ ID NO: 1716402 - RNA, 22 nt, Human
aggcaugugccacccacccaac

SEQ ID NO: 1716403 - RNA, 20 nt, Human
aggcagagguugcagugagc

SEQ ID NO: 1716404 - RNA, 13 nt, Human
aggcagauacagg

SEQ ID NO: 1716405 - RNA, 22 nt, Human
aggcagaacucaucuagguaaa

SEQ ID NO: 1716406 - RNA, 16 nt, Human
aggcagccaggccaca

SEQ ID NO: 1716407 - RNA, 15 nt, Human
aggcagccaggccac

SEQ ID NO: 1716408 - RNA, 14 nt, Human
aggcagccaggcca

SEQ ID NO: 1716409 - RNA, 12 nt, Human
agcuacaaaugc

SEQ ID NO: 1716410 - RNA, 15 nt, Human
agcuaaugggacacu

SEQ ID NO: 1716411 - RNA, 14 nt, Human
agcuaaugggacac

SEQ ID NO: 1716412 - RNA, 13 nt, Human
agcuaaugggaca

SEQ ID NO: 1716413 - RNA, 19 nt, Human
agcuaagguuuagauaaau

SEQ ID NO: 1716414 - RNA, 13 nt, Human
agcuacaaaugca

SEQ ID NO: 1716415 - RNA, 21 nt, Human
agcucaccagccccagugccc

SEQ ID NO: 1716416 - RNA, 15 nt, Human
agcucaccagcccca

SEQ ID NO: 1716417 - RNA, 14 nt, Human
agcucaccagcccc

SEQ ID NO: 1716418 - RNA, 13 nt, Human
agcucaccagccc

SEQ ID NO: 1716419 - RNA, 13 nt, Human
agcgacagugaga

SEQ ID NO: 1716420 - RNA, 15 nt, Human
agcgacagugagacu

SEQ ID NO: 1716421 - RNA, 17 nt, Human
agcgacagugagacucu

SEQ ID NO: 1716422 - RNA, 15 nt, Human
agcgauucuucugcu

SEQ ID NO: 1716423 - RNA, 19 nt, Human
agcgauucuucugcuucag

SEQ ID NO: 1716424 - RNA, 17 nt, Human
agcgauucuucugcuuc

SEQ ID NO: 1716425 - RNA, 20 nt, Human
agcuaacauggaaguacuau

SEQ ID NO: 1716426 - RNA, 19 nt, Human
agcuaacauggaaguacua

SEQ ID NO: 1716427 - RNA, 18 nt, Human
agccugggcaaugugaua

SEQ ID NO: 1716428 - RNA, 14 nt, Human
agccuggacccugu

SEQ ID NO: 1716429 - RNA, 18 nt, Human
agccuggcacagggcagu

SEQ ID NO: 1716430 - RNA, 17 nt, Human
agccuggcacagggcag

SEQ ID NO: 1716431 - RNA, 20 nt, Human
agccuggcacagggcagugg

SEQ ID NO: 1716432 - RNA, 17 nt, Human
agccugcugccugcuuu

SEQ ID NO: 1716433 - RNA, 22 nt, Human
agcuuuguuuguugucagcuga

SEQ ID NO: 1716434 - RNA, 21 nt, Human
agcuuuguuuguugucagcug

SEQ ID NO: 1716435 - RNA, 18 nt, Human
aggaaaaaauaacaauga

SEQ ID NO: 1716436 - RNA, 19 nt, Human
aggaaaaccaagccguggc

SEQ ID NO: 1716437 - RNA, 14 nt, Human
aggaagguagaaau

SEQ ID NO: 1716438 - RNA, 15 nt, Human
aggaaguacuggaga

SEQ ID NO: 1716439 - RNA, 11 nt, Human
aggaaguacug

SEQ ID NO: 1716440 - RNA, 12 nt, Human
aggaacacuccu

SEQ ID NO: 1716441 - RNA, 23 nt, Human
aggaaaaccaagccguggcuucc

SEQ ID NO: 1716442 - RNA, 22 nt, Human
aggaaaaccaagccguggcuuc

SEQ ID NO: 1716443 - RNA, 21 nt, Human
aggaaaaccaagccguggcuu

SEQ ID NO: 1716444 - RNA, 20 nt, Human
aggaaaaccaagccguggcu

SEQ ID NO: 1716445 - RNA, 15 nt, Human
aggaacacuccuuca

SEQ ID NO: 1716446 - RNA, 16 nt, Human
agcugucaaggcucag

SEQ ID NO: 1716447 - RNA, 15 nt, Human
agcuggucccacuca

SEQ ID NO: 1716448 - RNA, 16 nt, Human
agcuggguuggaaaac

SEQ ID NO: 1716449 - RNA, 20 nt, Human
agcuggguuggaaaacagua

SEQ ID NO: 1716450 - RNA, 16 nt, Human
agcugguugagguuuc

SEQ ID NO: 1716451 - RNA, 21 nt, Human
agcugacuuuucuguccgagc

SEQ ID NO: 1716452 - RNA, 15 nt, Human
agcugacuuuucugu

SEQ ID NO: 1716453 - RNA, 23 nt, Human
agcucaccagccccagugcccac

SEQ ID NO: 1716454 - RNA, 22 nt, Human
agcucaccagccccagugccca

SEQ ID NO: 1716455 - RNA, 18 nt, Human
agacgaaacauuuguucu

SEQ ID NO: 1716456 - RNA, 17 nt, Human
agacccaaaaggcagaa

SEQ ID NO: 1716457 - RNA, 23 nt, Human
agaccaucccugaaggccccgcc

SEQ ID NO: 1716458 - RNA, 14 nt, Human
agaccacguuucua

SEQ ID NO: 1716459 - RNA, 23 nt, Human
agacagcccgggcucugccuccc

SEQ ID NO: 1716460 - RNA, 22 nt, Human
agacagcccgggcucugccucc

SEQ ID NO: 1716461 - RNA, 14 nt, Human
agacaauuuauuau

SEQ ID NO: 1716462 - RNA, 21 nt, Human
agacagcccgggcucugccuc

SEQ ID NO: 1716463 - RNA, 13 nt, Human
agacagcccucca

SEQ ID NO: 1716464 - RNA, 20 nt, Human
agacgcugugcugcccugcc

SEQ ID NO: 1716465 - RNA, 19 nt, Human
agacgcugugcugcccugc

SEQ ID NO: 1716466 - RNA, 18 nt, Human
agacgcugugcugcccug

SEQ ID NO: 1716467 - RNA, 17 nt, Human
agacgcugugcugcccu

SEQ ID NO: 1716468 - RNA, 15 nt, Human
agacuaucuaaaugu

SEQ ID NO: 1716469 - RNA, 19 nt, Human
agacaaggaaaaaauaaca

SEQ ID NO: 1716470 - RNA, 20 nt, Human
agacaaugugaaaagaaaaa

SEQ ID NO: 1716471 - RNA, 15 nt, Human
agaauuuugagcagg

SEQ ID NO: 1716472 - RNA, 16 nt, Human
agacucuuuggacacu

SEQ ID NO: 1716473 - RNA, 23 nt, Human
agagagcaagacgcugugcugcc

SEQ ID NO: 1716474 - RNA, 19 nt, Human
agagagcaagacgcugugc

SEQ ID NO: 1716475 - RNA, 11 nt, Human
agagagcaaga

SEQ ID NO: 1716476 - RNA, 18 nt, Human
agagcccacgcccccacu

SEQ ID NO: 1716477 - RNA, 12 nt, Human
agacugaccaau

SEQ ID NO: 1716478 - RNA, 21 nt, Human
agacugaccaauauuguacag

SEQ ID NO: 1716479 - RNA, 22 nt, Human
agaacagugauuaccagggacu

SEQ ID NO: 1716480 - RNA, 18 nt, Human
agaaccaaaaagaggcua

SEQ ID NO: 1716481 - RNA, 17 nt, Human
agaaccaaaaagaggcu

SEQ ID NO: 1716482 - RNA, 17 nt, Human
agaacaucccuccuggg

SEQ ID NO: 1716483 - RNA, 13 nt, Human
agaacaucccucc

SEQ ID NO: 1716484 - RNA, 18 nt, Human
agaaugcucuuuacuuca

SEQ ID NO: 1716485 - RNA, 23 nt, Human
agaaugcacaaacagaggccgcc

SEQ ID NO: 1716486 - RNA, 17 nt, Human
agaaucucaaauaacua

SEQ ID NO: 1716487 - RNA, 16 nt, Human
agaaugaaagggccca

SEQ ID NO: 1716488 - RNA, 20 nt, Human
agaaccaggcaacuugggaa

SEQ ID NO: 1716489 - RNA, 21 nt, Human
agaaccaaaaagaggcuaugu

SEQ ID NO: 1716490 - RNA, 17 nt, Human
agaaccaggcaacuugg

SEQ ID NO: 1716491 - RNA, 23 nt, Human
agaagagaaugcacaaacagagg

SEQ ID NO: 1716492 - RNA, 15 nt, Human
agaagagaaugcaca

SEQ ID NO: 1716493 - RNA, 14 nt, Human
agaagucacacagu

SEQ ID NO: 1716494 - RNA, 19 nt, Human
agaagucuuagauguauau

SEQ ID NO: 1716495 - RNA, 17 nt, Human
agaagucuuagauguau

SEQ ID NO: 1716496 - RNA, 18 nt, Human
agaagaugaaugagcaaa

SEQ ID NO: 1716497 - RNA, 19 nt, Human
agaagauggcacuuauaac

SEQ ID NO: 1716498 - RNA, 16 nt, Human
agcaucuaugugagac

SEQ ID NO: 1716499 - RNA, 23 nt, Human
agccagcaggcucucaggccagc

SEQ ID NO: 1716500 - RNA, 21 nt, Human
agccagcaggcucucaggcca

SEQ ID NO: 1716501 - RNA, 22 nt, Human
agccagcaggcucucaggccag

SEQ ID NO: 1716502 - RNA, 20 nt, Human
agcccacgcccccacuggug

SEQ ID NO: 1716503 - RNA, 19 nt, Human
agcccacgcccccacuggu

SEQ ID NO: 1716504 - RNA, 18 nt, Human
agcccacgcccccacugg

SEQ ID NO: 1716505 - RNA, 17 nt, Human
agcccacgcccccacug

SEQ ID NO: 1716506 - RNA, 13 nt, Human
agcccaccuuggc

SEQ ID NO: 1716507 - RNA, 23 nt, Human
agcccaccccucaacaccucugc

SEQ ID NO: 1716508 - RNA, 22 nt, Human
agccagauuucacucuccuugg

SEQ ID NO: 1716509 - RNA, 20 nt, Human
agccagauuucacucuccuu

SEQ ID NO: 1716510 - RNA, 17 nt, Human
agccagauuucacucuc

SEQ ID NO: 1716511 - RNA, 14 nt, Human
agccagauuucacu

SEQ ID NO: 1716512 - RNA, 17 nt, Human
agccaacuauggccugu

SEQ ID NO: 1716513 - RNA, 16 nt, Human
agcagccuggacccug

SEQ ID NO: 1716514 - RNA, 16 nt, Human
agcagugcaugcuguc

SEQ ID NO: 1716515 - RNA, 13 nt, Human
agcagugcaugcu

SEQ ID NO: 1716516 - RNA, 19 nt, Human
agcagcguuucuaugacac

SEQ ID NO: 1716517 - RNA, 20 nt, Human
agcagccuggacccugugga

SEQ ID NO: 1716518 - RNA, 18 nt, Human
agcagugcaugcuguccc

SEQ ID NO: 1716519 - RNA, 17 nt, Human
agcagugcaugcugucc

SEQ ID NO: 1716520 - RNA, 21 nt, Human
agcacagacccugcccugugg

SEQ ID NO: 1716521 - RNA, 20 nt, Human
agcaauucuccugccucagc

SEQ ID NO: 1716522 - RNA, 19 nt, Human
agcaauucuccugccucag

SEQ ID NO: 1716523 - RNA, 18 nt, Human
agcaauucuccugccuca

SEQ ID NO: 1716524 - RNA, 17 nt, Human
agcaauucuccugccuc

SEQ ID NO: 1716525 - RNA, 15 nt, Human
agcaauucuccugcc

SEQ ID NO: 1716526 - RNA, 20 nt, Human
agauagauaggucagugcaa

SEQ ID NO: 1716527 - RNA, 20 nt, Human
agauagccaaggccaaagga

SEQ ID NO: 1716528 - RNA, 15 nt, Human
agauauaaaagacug

SEQ ID NO: 1716529 - RNA, 13 nt, Human
agaguugaagaca

SEQ ID NO: 1716530 - RNA, 15 nt, Human
agaguugaagacaga

SEQ ID NO: 1716531 - RNA, 14 nt, Human
agaguugaagacag

SEQ ID NO: 1716532 - RNA, 20 nt, Human
agagggucugaggaauccag

SEQ ID NO: 1716533 - RNA, 15 nt, Human
agaguggcuccuccc

SEQ ID NO: 1716534 - RNA, 14 nt, Human
agaguggcuccucc

SEQ ID NO: 1716535 - RNA, 13 nt, Human
agaguggcuccuc

SEQ ID NO: 1716536 - RNA, 12 nt, Human
agaguggcuccu

SEQ ID NO: 1716537 - RNA, 19 nt, Human
agcaaauucuguuuuucua

SEQ ID NO: 1716538 - RNA, 19 nt, Human
agauugcaacaggcugggc

SEQ ID NO: 1716539 - RNA, 17 nt, Human
agauugcaacaggcugg

SEQ ID NO: 1716540 - RNA, 16 nt, Human
agauugcaccacugca

SEQ ID NO: 1716541 - RNA, 16 nt, Human
agauucuuuccugagg

SEQ ID NO: 1716542 - RNA, 15 nt, Human
agauucuuuccugag

SEQ ID NO: 1716543 - RNA, 18 nt, Human
agauucuuuccugaggcu

SEQ ID NO: 1716544 - RNA, 16 nt, Human
agauugcaacaggcug

SEQ ID NO: 1716545 - RNA, 17 nt, Human
agauugagauguguuca

SEQ ID NO: 1716546 - RNA, 18 nt, Human
agaugacaucugucuagg

SEQ ID NO: 1716547 - RNA, 22 nt, Human
agauggcugugccucugccugu

SEQ ID NO: 1716548 - RNA, 21 nt, Human
agauggcugugccucugccug

SEQ ID NO: 1716549 - RNA, 20 nt, Human
agauggcugugccucugccu

SEQ ID NO: 1716550 - RNA, 19 nt, Human
agauggcugugccucugcc

SEQ ID NO: 1716551 - RNA, 18 nt, Human
agauggcugugccucugc

SEQ ID NO: 1716552 - RNA, 17 nt, Human
agauggcugugccucug

SEQ ID NO: 1716553 - RNA, 14 nt, Human
agauucuuuccuga

SEQ ID NO: 1716554 - RNA, 20 nt, Human
agaugggugcuuggaggaag

SEQ ID NO: 1716555 - RNA, 22 nt, Human
agaugggugcuuggaggaagga

SEQ ID NO: 1716556 - RNA, 23 nt, Human
agaucucugcuuuggaaaucaca

SEQ ID NO: 1716557 - RNA, 18 nt, Human
agaucucugcuuuggaaa

SEQ ID NO: 1716558 - RNA, 13 nt, Human
aguuacacauuuu

SEQ ID NO: 1716559 - RNA, 16 nt, Human
aguuacacauuuuuca

SEQ ID NO: 1716560 - RNA, 19 nt, Human
aguuacacauuuuucagau

SEQ ID NO: 1716561 - RNA, 18 nt, Human
aguuacacuaaaagguga

SEQ ID NO: 1716562 - RNA, 14 nt, Human
aguucauacccugu

SEQ ID NO: 1716563 - RNA, 21 nt, Human
aguuccaccaucaagccacca

SEQ ID NO: 1716564 - RNA, 18 nt, Human
aguuccaccaucaagcca

SEQ ID NO: 1716565 - RNA, 18 nt, Human
aguugaaaaacagcugag

SEQ ID NO: 1716566 - RNA, 17 nt, Human
aguugaagacagagcua

SEQ ID NO: 1716567 - RNA, 16 nt, Human
aguugaagacagagcu

SEQ ID NO: 1716568 - RNA, 17 nt, Human
aguugaaaaacagcuga

SEQ ID NO: 1716569 - RNA, 13 nt, Human
aguuccacugaga

SEQ ID NO: 1716570 - RNA, 15 nt, Human
aguuccacugagacc

SEQ ID NO: 1716571 - RNA, 22 nt, Human
aguuguuagugugucuuagugu

SEQ ID NO: 1716572 - RNA, 17 nt, Human
aguuguuagugugucuu

SEQ ID NO: 1716573 - RNA, 20 nt, Human
aguuguuagauuaagaaaua

SEQ ID NO: 1716574 - RNA, 16 nt, Human
auaaaagacagugaaa

SEQ ID NO: 1716575 - RNA, 15 nt, Human
auaaaagacagugaa

SEQ ID NO: 1716576 - RNA, 11 nt, Human
aguuugcaguu

SEQ ID NO: 1716577 - RNA, 14 nt, Human
aguuugauuaaauu

SEQ ID NO: 1716578 - RNA, 20 nt, Human
aguuucugucguuaaaaaca

SEQ ID NO: 1716579 - RNA, 22 nt, Human
aguuucugucguuaaaaacaga

SEQ ID NO: 1716580 - RNA, 23 nt, Human
aguuucugucguuaaaaacagau

SEQ ID NO: 1716581 - RNA, 15 nt, Human
auacaccacuacauu

SEQ ID NO: 1716582 - RNA, 12 nt, Human
auaauguuaaca

SEQ ID NO: 1716583 - RNA, 23 nt, Human
auacaaugcugugcccuaaagug

SEQ ID NO: 1716584 - RNA, 21 nt, Human
auaaagaugagugagcaugcc

SEQ ID NO: 1716585 - RNA, 17 nt, Human
auacaccacuacauucu

SEQ ID NO: 1716586 - RNA, 18 nt, Human
auacaccgggccuggaga

SEQ ID NO: 1716587 - RNA, 14 nt, Human
auacaccgggccug

SEQ ID NO: 1716588 - RNA, 21 nt, Human
aguaaaugggggugcauuuga

SEQ ID NO: 1716589 - RNA, 19 nt, Human
aguaaaugggggugcauuu

SEQ ID NO: 1716590 - RNA, 20 nt, Human
aguaaaugggggugcauuug

SEQ ID NO: 1716591 - RNA, 17 nt, Human
aguaacuuacuuaggug

SEQ ID NO: 1716592 - RNA, 15 nt, Human
aguacuggagaaaau

SEQ ID NO: 1716593 - RNA, 22 nt, Human
aguacuucuccacccugcucuc

SEQ ID NO: 1716594 - RNA, 21 nt, Human
aguacuucuccacccugcucu

SEQ ID NO: 1716595 - RNA, 20 nt, Human
aguacuucuccacccugcuc

SEQ ID NO: 1716596 - RNA, 22 nt, Human
aguauauugauccagaaagaaa

SEQ ID NO: 1716597 - RNA, 20 nt, Human
agugauucuccugccucagc

SEQ ID NO: 1716598 - RNA, 19 nt, Human
agugauucuccugccucag

SEQ ID NO: 1716599 - RNA, 18 nt, Human
agugauucuccugccuca

SEQ ID NO: 1716600 - RNA, 22 nt, Human
agugccuuauggaacacucuga

SEQ ID NO: 1716601 - RNA, 21 nt, Human
agugccuuauggaacacucug

SEQ ID NO: 1716602 - RNA, 20 nt, Human
agugccuuauggaacacucu

SEQ ID NO: 1716603 - RNA, 19 nt, Human
agugccuuauggaacacuc

SEQ ID NO: 1716604 - RNA, 13 nt, Human
agugauuaccagg

SEQ ID NO: 1716605 - RNA, 23 nt, Human
agugauccucccaccucagccuc

SEQ ID NO: 1716606 - RNA, 22 nt, Human
agugauccucccaccucagccu

SEQ ID NO: 1716607 - RNA, 20 nt, Human
agugauccucccaccucagc

SEQ ID NO: 1716608 - RNA, 14 nt, Human
agugacagaggcag

SEQ ID NO: 1716609 - RNA, 19 nt, Human
agugacagaggcagcccca

SEQ ID NO: 1716610 - RNA, 16 nt, Human
agugacagaggcagcc

SEQ ID NO: 1716611 - RNA, 18 nt, Human
agucuggcccuuccuuuu

SEQ ID NO: 1716612 - RNA, 16 nt, Human
agucgaggacagggag

SEQ ID NO: 1716613 - RNA, 19 nt, Human
aguccuuaccagcagagca

SEQ ID NO: 1716614 - RNA, 22 nt, Human
agucugauucccaagcucugcu

SEQ ID NO: 1716615 - RNA, 21 nt, Human
agucugauucccaagcucugc

SEQ ID NO: 1716616 - RNA, 18 nt, Human
aguccuuaccagcagagc

SEQ ID NO: 1716617 - RNA, 16 nt, Human
aguccuuaccagcaga

SEQ ID NO: 1716618 - RNA, 14 nt, Human
aguccucuuuucug

SEQ ID NO: 1716619 - RNA, 12 nt, Human
augaauacuuug

SEQ ID NO: 1716620 - RNA, 17 nt, Human
augaauaaagacaccua

SEQ ID NO: 1716621 - RNA, 13 nt, Human
augaaguacucau

SEQ ID NO: 1716622 - RNA, 23 nt, Human
augaaguaauaugcacacauuuu

SEQ ID NO: 1716623 - RNA, 14 nt, Human
augaaguaauaugc

SEQ ID NO: 1716624 - RNA, 21 nt, Human
augaaguaauaugcacacauu

SEQ ID NO: 1716625 - RNA, 12 nt, Human
augaaagacugu

SEQ ID NO: 1716626 - RNA, 23 nt, Human
augaagcauuuacuuuguguuca

SEQ ID NO: 1716627 - RNA, 21 nt, Human
augagcuuugucuacuucaaa

SEQ ID NO: 1716628 - RNA, 12 nt, Human
augagccuggca

SEQ ID NO: 1716629 - RNA, 11 nt, Human
augagccuggc

SEQ ID NO: 1716630 - RNA, 21 nt, Human
augagccucagcauccuggca

SEQ ID NO: 1716631 - RNA, 18 nt, Human
augaccuuucaauaggaa

SEQ ID NO: 1716632 - RNA, 15 nt, Human
augaccuuucaauag

SEQ ID NO: 1716633 - RNA, 13 nt, Human
augaccuuucaau

SEQ ID NO: 1716634 - RNA, 23 nt, Human
aucuaggaagacuuuggaaagag

SEQ ID NO: 1716635 - RNA, 11 nt, Human
aucuaggauuu

SEQ ID NO: 1716636 - RNA, 19 nt, Human
aucuaggauuuuaagggaa

SEQ ID NO: 1716637 - RNA, 24 nt, Human
augcauauuauuuuauguugcaua

SEQ ID NO: 1716638 - RNA, 21 nt, Human
augccugguggcagcugcggu

SEQ ID NO: 1716639 - RNA, 18 nt, Human
augccugguggcagcugc

SEQ ID NO: 1716640 - RNA, 19 nt, Human
augccugguggcagcugcg

SEQ ID NO: 1716641 - RNA, 14 nt, Human
augccugguggcag

SEQ ID NO: 1716642 - RNA, 13 nt, Human
augccugguggca

SEQ ID NO: 1716643 - RNA, 12 nt, Human
augccugguggc

SEQ ID NO: 1716644 - RNA, 11 nt, Human
augccuggugg

SEQ ID NO: 1716645 - RNA, 16 nt, Human
augcuuugaucccuuc

SEQ ID NO: 1716646 - RNA, 19 nt, Human
augcucugcauguuacaua

SEQ ID NO: 1716647 - RNA, 18 nt, Human
augcucugcauguuacau

SEQ ID NO: 1716648 - RNA, 22 nt, Human
augcuucuucagagacuccugc

SEQ ID NO: 1716649 - RNA, 20 nt, Human
augcuucuucagagacuccu

SEQ ID NO: 1716650 - RNA, 17 nt, Human
augcuucuucagagacu

SEQ ID NO: 1716651 - RNA, 14 nt, Human
augcuucuucagag

SEQ ID NO: 1716652 - RNA, 15 nt, Human
augggacagggagga

SEQ ID NO: 1716653 - RNA, 14 nt, Human
aucaaaagaaagaa

SEQ ID NO: 1716654 - RNA, 18 nt, Human
auauuuuuuucuuuucuu

SEQ ID NO: 1716655 - RNA, 12 nt, Human
aucaaaggacac

SEQ ID NO: 1716656 - RNA, 19 nt, Human
aucaaagagguuuuaaaaa

SEQ ID NO: 1716657 - RNA, 20 nt, Human
aucaaaagguuaauaaagua

SEQ ID NO: 1716658 - RNA, 24 nt, Human
aucaaaagguuaauaaaguaauua

SEQ ID NO: 1716659 - RNA, 14 nt, Human
auagcacagacccu

SEQ ID NO: 1716660 - RNA, 15 nt, Human
auagcacagacccug

SEQ ID NO: 1716661 - RNA, 14 nt, Human
aucgaccugccucg

SEQ ID NO: 1716662 - RNA, 22 nt, Human
aucuaggaagacuuuggaaaga

SEQ ID NO: 1716663 - RNA, 21 nt, Human
auccacugugccaugugccag

SEQ ID NO: 1716664 - RNA, 23 nt, Human
auccacuuuaucuugaauaaugu

SEQ ID NO: 1716665 - RNA, 20 nt, Human
aucaugacaaagacugagua

SEQ ID NO: 1716666 - RNA, 15 nt, Human
aucauccuaagcuau

SEQ ID NO: 1716667 - RNA, 13 nt, Human
aucaaauacauuu

SEQ ID NO: 1716668 - RNA, 14 nt, Human
aucaaauacauuua

SEQ ID NO: 1716669 - RNA, 19 nt, Human
aucauggagguuugaagau

SEQ ID NO: 1716670 - RNA, 21 nt, Human
caaggggaauguuugccucug

SEQ ID NO: 1716671 - RNA, 15 nt, Human
caagggccuggccug

SEQ ID NO: 1716672 - RNA, 14 nt, Human
caagggccuggccu

SEQ ID NO: 1716673 - RNA, 13 nt, Human
caagggccuggcc

SEQ ID NO: 1716674 - RNA, 13 nt, Human
caaggucauuuuu

SEQ ID NO: 1716675 - RNA, 23 nt, Human
caaggggaauguuugccucugcc

SEQ ID NO: 1716676 - RNA, 18 nt, Human
caagugauucuccugccu

SEQ ID NO: 1716677 - RNA, 19 nt, Human
caagugauucuccugccuc

SEQ ID NO: 1716678 - RNA, 19 nt, Human
caagugagacccugucuca

SEQ ID NO: 1716679 - RNA, 15 nt, Human
caagugagacccugu

SEQ ID NO: 1716680 - RNA, 20 nt, Human
caagugauucuccugccuca

SEQ ID NO: 1716681 - RNA, 21 nt, Human
caagugauucuccugccucag

SEQ ID NO: 1716682 - RNA, 14 nt, Human
caagugagacccug

SEQ ID NO: 1716683 - RNA, 23 nt, Human
caagugaaaaaggaggaagagaa

SEQ ID NO: 1716684 - RNA, 22 nt, Human
caagugaaaaaggaggaagaga

SEQ ID NO: 1716685 - RNA, 16 nt, Human
caagggccuggccuga

SEQ ID NO: 1716686 - RNA, 15 nt, Human
caagaaaugaaagca

SEQ ID NO: 1716687 - RNA, 13 nt, Human
caagaaaugaaag

SEQ ID NO: 1716688 - RNA, 13 nt, Human
caagaccuucucc

SEQ ID NO: 1716689 - RNA, 20 nt, Human
caagacgcugugcugcccug

SEQ ID NO: 1716690 - RNA, 22 nt, Human
caagacgcugugcugcccugcc

SEQ ID NO: 1716691 - RNA, 21 nt, Human
caagacgcugugcugcccugc

SEQ ID NO: 1716692 - RNA, 23 nt, Human
caagacgcugugcugcccugccc

SEQ ID NO: 1716693 - RNA, 17 nt, Human
caagagggucugaggaa

SEQ ID NO: 1716694 - RNA, 16 nt, Human
caagagggucugagga

SEQ ID NO: 1716695 - RNA, 12 nt, Human
caagagggucug

SEQ ID NO: 1716696 - RNA, 20 nt, Human
caagagggcacugguggccc

SEQ ID NO: 1716697 - RNA, 19 nt, Human
caagagggcacugguggcc

SEQ ID NO: 1716698 - RNA, 18 nt, Human
caagagggcacugguggc

SEQ ID NO: 1716699 - RNA, 17 nt, Human
caagagggcacuggugg

SEQ ID NO: 1716700 - RNA, 21 nt, Human
caaggcugucaauuacaggaa

SEQ ID NO: 1716701 - RNA, 23 nt, Human
caagggaauuucuucaacucccu

SEQ ID NO: 1716702 - RNA, 14 nt, Human
caaggcugucaauu

SEQ ID NO: 1716703 - RNA, 13 nt, Human
caaggcugucaau

SEQ ID NO: 1716704 - RNA, 21 nt, Human
caaggcugggggaagaagcuc

SEQ ID NO: 1716705 - RNA, 17 nt, Human
caaggauccugagccag

SEQ ID NO: 1716706 - RNA, 16 nt, Human
caaggauccugagcca

SEQ ID NO: 1716707 - RNA, 15 nt, Human
caaggauccugagcc

SEQ ID NO: 1716708 - RNA, 14 nt, Human
caaggauccugagc

SEQ ID NO: 1716709 - RNA, 21 nt, Human
caaggacuaggguccugggga

SEQ ID NO: 1716710 - RNA, 20 nt, Human
caaggacuaggguccugggg

SEQ ID NO: 1716711 - RNA, 19 nt, Human
caaggacuaggguccuggg

SEQ ID NO: 1716712 - RNA, 18 nt, Human
caaggacuaggguccugg

SEQ ID NO: 1716713 - RNA, 16 nt, Human
caaggacuaggguccu

SEQ ID NO: 1716714 - RNA, 17 nt, Human
caaauuuacagagacag

SEQ ID NO: 1716715 - RNA, 23 nt, Human
caaauuuacagagacagaaagca

SEQ ID NO: 1716716 - RNA, 14 nt, Human
caacaggcugggcu

SEQ ID NO: 1716717 - RNA, 17 nt, Human
caacaggcugggcuuca

SEQ ID NO: 1716718 - RNA, 15 nt, Human
caacauacucccauc

SEQ ID NO: 1716719 - RNA, 14 nt, Human
caacauacucccau

SEQ ID NO: 1716720 - RNA, 16 nt, Human
caacauacucccaucu

SEQ ID NO: 1716721 - RNA, 23 nt, Human
caacugcaucaagaugugacaug

SEQ ID NO: 1716722 - RNA, 20 nt, Human
caacugcaucaagaugugac

SEQ ID NO: 1716723 - RNA, 17 nt, Human
caacugcaucaagaugu

SEQ ID NO: 1716724 - RNA, 16 nt, Human
caacugcauuggcuuu

SEQ ID NO: 1716725 - RNA, 21 nt, Human
caaccugauugugucucuugg

SEQ ID NO: 1716726 - RNA, 19 nt, Human
caaccugauugugucucuu

SEQ ID NO: 1716727 - RNA, 17 nt, Human
caaccugauugugucuc

SEQ ID NO: 1716728 - RNA, 17 nt, Human
caaauuguaagcaugca

SEQ ID NO: 1716729 - RNA, 22 nt, Human
caaauauuuagauguaauuuug

SEQ ID NO: 1716730 - RNA, 23 nt, Human
caaauauuuagauguaauuuugu

SEQ ID NO: 1716731 - RNA, 17 nt, Human
caaauauuccagagacu

SEQ ID NO: 1716732 - RNA, 13 nt, Human
caaauauuccaga

SEQ ID NO: 1716733 - RNA, 21 nt, Human
caaauauuuagauguaauuuu

SEQ ID NO: 1716734 - RNA, 19 nt, Human
caaaguggugagaggcauc

SEQ ID NO: 1716735 - RNA, 21 nt, Human
caaaguucccuacuuccugug

SEQ ID NO: 1716736 - RNA, 22 nt, Human
caaaguucccuacuuccuguga

SEQ ID NO: 1716737 - RNA, 14 nt, Human
caaaggagauugga

SEQ ID NO: 1716738 - RNA, 18 nt, Human
caaagcccuuccaugucg

SEQ ID NO: 1716739 - RNA, 20 nt, Human
caaaggagauuggaaggaac

SEQ ID NO: 1716740 - RNA, 17 nt, Human
caaaguggugagaggca

SEQ ID NO: 1716741 - RNA, 16 nt, Human
caaaguggugagaggc

SEQ ID NO: 1716742 - RNA, 23 nt, Human
caaaggguaucaggugcugccau

SEQ ID NO: 1716743 - RNA, 18 nt, Human
caaagugguauagaaaug

SEQ ID NO: 1716744 - RNA, 19 nt, Human
caaagugguauagaaaugc

SEQ ID NO: 1716745 - RNA, 21 nt, Human
caaaggguaucaggugcugcc

SEQ ID NO: 1716746 - RNA, 20 nt, Human
caaaggguaucaggugcugc

SEQ ID NO: 1716747 - RNA, 12 nt, Human
caaagaaauuau

SEQ ID NO: 1716748 - RNA, 15 nt, Human
caaagaaauuaugug

SEQ ID NO: 1716749 - RNA, 13 nt, Human
caaagaaauuaug

SEQ ID NO: 1716750 - RNA, 21 nt, Human
caaagagguuuuaaaaaaauc

SEQ ID NO: 1716751 - RNA, 14 nt, Human
caaagagguuuuaa

SEQ ID NO: 1716752 - RNA, 13 nt, Human
caaagcccagcuu

SEQ ID NO: 1716753 - RNA, 19 nt, Human
caaagcccaaagugguaua

SEQ ID NO: 1716754 - RNA, 17 nt, Human
caaagcccaaaguggua

SEQ ID NO: 1716755 - RNA, 20 nt, Human
caacaggcugggcuucagug

SEQ ID NO: 1716756 - RNA, 18 nt, Human
caaucucggcucacugca

SEQ ID NO: 1716757 - RNA, 13 nt, Human
caaugcacuuugu

SEQ ID NO: 1716758 - RNA, 14 nt, Human
caaugcacugacau

SEQ ID NO: 1716759 - RNA, 23 nt, Human
caaugcaaaccaucauugaaauc

SEQ ID NO: 1716760 - RNA, 22 nt, Human
caaugcaaaccaucauugaaau

SEQ ID NO: 1716761 - RNA, 21 nt, Human
caaugcaaaccaucauugaaa

SEQ ID NO: 1716762 - RNA, 14 nt, Human
caaugcaaaccauc

SEQ ID NO: 1716763 - RNA, 14 nt, Human
caaugauggucacc

SEQ ID NO: 1716764 - RNA, 14 nt, Human
caaugaccuuucaa

SEQ ID NO: 1716765 - RNA, 16 nt, Human
caaugaccuuucaaua

SEQ ID NO: 1716766 - RNA, 15 nt, Human
caaugaccuuucaau

SEQ ID NO: 1716767 - RNA, 13 nt, Human
caaugauggucac

SEQ ID NO: 1716768 - RNA, 21 nt, Human
caaugaccuuucaauaggaaa

SEQ ID NO: 1716769 - RNA, 17 nt, Human
cacaaacgggcucagca

SEQ ID NO: 1716770 - RNA, 18 nt, Human
caaugguuuucuugugug

SEQ ID NO: 1716771 - RNA, 14 nt, Human
caaugcacuuuguu

SEQ ID NO: 1716772 - RNA, 13 nt, Human
cacaagaaaugaa

SEQ ID NO: 1716773 - RNA, 15 nt, Human
cacaagaaaugaaag

SEQ ID NO: 1716774 - RNA, 17 nt, Human
cacaaagguagcuuuuc

SEQ ID NO: 1716775 - RNA, 23 nt, Human
cacaagaaaugaaagcagggacu

SEQ ID NO: 1716776 - RNA, 23 nt, Human
cacaagacccaaaaggcagaagc

SEQ ID NO: 1716777 - RNA, 19 nt, Human
cacaaucucggcucacugc

SEQ ID NO: 1716778 - RNA, 14 nt, Human
cacacacuuuggcu

SEQ ID NO: 1716779 - RNA, 20 nt, Human
cacacagauuugagcucagc

SEQ ID NO: 1716780 - RNA, 18 nt, Human
cacacagauuugagcuca

SEQ ID NO: 1716781 - RNA, 20 nt, Human
cacacaccagagcccaccuu

SEQ ID NO: 1716782 - RNA, 16 nt, Human
cacacaccagagccca

SEQ ID NO: 1716783 - RNA, 15 nt, Human
cacacaccagagccc

SEQ ID NO: 1716784 - RNA, 24 nt, Human
cacaaucucggcucacugcauccu

SEQ ID NO: 1716785 - RNA, 23 nt, Human
cacaaucucggcucacugcaucc

SEQ ID NO: 1716786 - RNA, 22 nt, Human
cacaaucucggcucacugcauc

SEQ ID NO: 1716787 - RNA, 20 nt, Human
cacaaucucggcucacugca

SEQ ID NO: 1716788 - RNA, 15 nt, Human
cacacagcucugucc

SEQ ID NO: 1716789 - RNA, 14 nt, Human
cacacagcucuguc

SEQ ID NO: 1716790 - RNA, 13 nt, Human
cacacagcucugu

SEQ ID NO: 1716791 - RNA, 22 nt, Human
cacacagauuugagcucagccc

SEQ ID NO: 1716792 - RNA, 22 nt, Human
cacaccagagcccaccuuggcu

SEQ ID NO: 1716793 - RNA, 21 nt, Human
cacaccagagcccaccuuggc

SEQ ID NO: 1716794 - RNA, 16 nt, Human
cacacagcucuguccu

SEQ ID NO: 1716795 - RNA, 20 nt, Human
cacacccagcccacuucugc

SEQ ID NO: 1716796 - RNA, 14 nt, Human
cacacccagcccac

SEQ ID NO: 1716797 - RNA, 21 nt, Human
caccauauuaccacagacaua

SEQ ID NO: 1716798 - RNA, 18 nt, Human
caccauaggucaccuuua

SEQ ID NO: 1716799 - RNA, 15 nt, Human
caccaucaagccacc

SEQ ID NO: 1716800 - RNA, 14 nt, Human
caccaucaagccac

SEQ ID NO: 1716801 - RNA, 13 nt, Human
caccaucaagcca

SEQ ID NO: 1716802 - RNA, 18 nt, Human
caccaucaugucuggcua

SEQ ID NO: 1716803 - RNA, 17 nt, Human
caccaucaugucuggcu

SEQ ID NO: 1716804 - RNA, 15 nt, Human
caccaucaugucugg

SEQ ID NO: 1716805 - RNA, 24 nt, Human
caccaucaagccaccaacauacuc

SEQ ID NO: 1716806 - RNA, 19 nt, Human
caccaucaagccaccaaca

SEQ ID NO: 1716807 - RNA, 17 nt, Human
caccaucaagccaccaa

SEQ ID NO: 1716808 - RNA, 16 nt, Human
caccaucaagccacca

SEQ ID NO: 1716809 - RNA, 20 nt, Human
caccauguuggccaggcugg

SEQ ID NO: 1716810 - RNA, 20 nt, Human
caccauguuggccaggcugc

SEQ ID NO: 1716811 - RNA, 19 nt, Human
caccauguuggccaggcug

SEQ ID NO: 1716812 - RNA, 15 nt, Human
caccagagcccaccu

SEQ ID NO: 1716813 - RNA, 22 nt, Human
caccagagcccaccuuggcuca

SEQ ID NO: 1716814 - RNA, 20 nt, Human
caccagagcccaccuuggcu

SEQ ID NO: 1716815 - RNA, 18 nt, Human
caccagagcccaccuugg

SEQ ID NO: 1716816 - RNA, 17 nt, Human
caccagagcccaccuug

SEQ ID NO: 1716817 - RNA, 19 nt, Human
caccacacccagcccacuu

SEQ ID NO: 1716818 - RNA, 15 nt, Human
caccacgcccggcua

SEQ ID NO: 1716819 - RNA, 14 nt, Human
caccacgcccggcu

SEQ ID NO: 1716820 - RNA, 22 nt, Human
cacauguccaagaagcccagga

SEQ ID NO: 1716821 - RNA, 21 nt, Human
cacauguccaagaagcccagg

SEQ ID NO: 1716822 - RNA, 19 nt, Human
cacauguccaagaagccca

SEQ ID NO: 1716823 - RNA, 18 nt, Human
cacauguccaagaagccc

SEQ ID NO: 1716824 - RNA, 17 nt, Human
caccaacgucugugcca

SEQ ID NO: 1716825 - RNA, 23 nt, Human
cacauguccaagaagcccaggaa

SEQ ID NO: 1716826 - RNA, 18 nt, Human
caccaacuacuaccugua

SEQ ID NO: 1716827 - RNA, 12 nt, Human
caccaagcccag

SEQ ID NO: 1716828 - RNA, 13 nt, Human
caccaagcccagu

SEQ ID NO: 1716829 - RNA, 17 nt, Human
cacaugagcaucaggcc

SEQ ID NO: 1716830 - RNA, 13 nt, Human
cacaugagcauca

SEQ ID NO: 1716831 - RNA, 21 nt, Human
cacaugagcaucaggccaggc

SEQ ID NO: 1716832 - RNA, 20 nt, Human
cacaugagcaucaggccagg

SEQ ID NO: 1716833 - RNA, 19 nt, Human
cacaugagcaucaggccag

SEQ ID NO: 1716834 - RNA, 18 nt, Human
cacaugagcaucaggcca

SEQ ID NO: 1716835 - RNA, 21 nt, Human
cacaugccucucucaggccaa

SEQ ID NO: 1716836 - RNA, 20 nt, Human
cacaugccucucucaggcca

SEQ ID NO: 1716837 - RNA, 17 nt, Human
cacauguccaagaagcc

SEQ ID NO: 1716838 - RNA, 16 nt, Human
cacauguccaagaagc

SEQ ID NO: 1716839 - RNA, 18 nt, Human
cacaugcacgugugugca

SEQ ID NO: 1716840 - RNA, 20 nt, Human
cacaugcaaggucauuuuuu

SEQ ID NO: 1716841 - RNA, 17 nt, Human
cacaugcaaggucauuu

SEQ ID NO: 1716842 - RNA, 19 nt, Human
cacaugcaaggucauuuuu

SEQ ID NO: 1716843 - RNA, 20 nt, Human
cacagcucuucuccaggcug

SEQ ID NO: 1716844 - RNA, 19 nt, Human
cacagcucuucuccaggcu

SEQ ID NO: 1716845 - RNA, 21 nt, Human
cacagcucuucuccaggcugu

SEQ ID NO: 1716846 - RNA, 16 nt, Human
cacaggacucugccuc

SEQ ID NO: 1716847 - RNA, 15 nt, Human
cacaggacucugccu

SEQ ID NO: 1716848 - RNA, 17 nt, Human
cacaggaucagucugau

SEQ ID NO: 1716849 - RNA, 23 nt, Human
cacaguccuuaccagcagagcac

SEQ ID NO: 1716850 - RNA, 14 nt, Human
cacaggcccggcuc

SEQ ID NO: 1716851 - RNA, 22 nt, Human
cacacggacacucaaaagcugg

SEQ ID NO: 1716852 - RNA, 18 nt, Human
cacagcucuucuccaggc

SEQ ID NO: 1716853 - RNA, 13 nt, Human
cacccaagggccu

SEQ ID NO: 1716854 - RNA, 13 nt, Human
uuuugaaaaacug

SEQ ID NO: 1716855 - RNA, 12 nt, Human
uuuuuuacuaau

SEQ ID NO: 1716856 - RNA, 20 nt, Human
uuuuuuauacaggaugauga

SEQ ID NO: 1716857 - RNA, 17 nt, Human
uuuuuuccuucagugcc

SEQ ID NO: 1716858 - RNA, 16 nt, Human
uuugccagugggaacu

SEQ ID NO: 1716859 - RNA, 15 nt, Human
uuugccagugggaac

SEQ ID NO: 1716860 - RNA, 18 nt, Human
uuugccauguuggccagg

SEQ ID NO: 1716861 - RNA, 14 nt, Human
uuugcagacaggca

SEQ ID NO: 1716862 - RNA, 23 nt, Human
uuugcauaacguauaaaagccug

SEQ ID NO: 1716863 - RNA, 19 nt, Human
uuugcauaacguauaaaag

SEQ ID NO: 1716864 - RNA, 13 nt, Human
uuugagugccuua

SEQ ID NO: 1716865 - RNA, 17 nt, Human
uuugaggucuguucuuu

SEQ ID NO: 1716866 - RNA, 22 nt, Human
uuugaggucuguucuuuccaaa

SEQ ID NO: 1716867 - RNA, 14 nt, Human
uuugagcucagccc

SEQ ID NO: 1716868 - RNA, 15 nt, Human
uuugagcagggcuca

SEQ ID NO: 1716869 - RNA, 22 nt, Human
uuucuuacugucuuuuuucuaa

SEQ ID NO: 1716870 - RNA, 21 nt, Human
uuuguccccaccgcagacagg

SEQ ID NO: 1716871 - RNA, 13 nt, Human
uuuguccccaccg

SEQ ID NO: 1716872 - RNA, 22 nt, Human
uuuguaaauuaacuuuuauaaa

SEQ ID NO: 1716873 - RNA, 20 nt, Human
uuugguuaugaauacuuugc

SEQ ID NO: 1716874 - RNA, 15 nt, Human
uuuguaaauuaacuu

SEQ ID NO: 1716875 - RNA, 16 nt, Human
uuuguaaauuaacuuu

SEQ ID NO: 1716876 - RNA, 17 nt, Human
uuuguaaauuaacuuuu

SEQ ID NO: 1716877 - RNA, 16 nt, Human
uuuuacagcugccugc

SEQ ID NO: 1716878 - RNA, 15 nt, Human
uuuuaaaaugagaaa

SEQ ID NO: 1716879 - RNA, 22 nt, Human
uuuuaaaaugagaaaucuaaaa

SEQ ID NO: 1716880 - RNA, 20 nt, Human
uuuuauaucaauuuaaaaaa

SEQ ID NO: 1716881 - RNA, 14 nt, Human
uuuuacuguacaga

SEQ ID NO: 1716882 - RNA, 19 nt, Human
uuuuaucgucacugcuuaa

SEQ ID NO: 1716883 - RNA, 18 nt, Human
uuuuaucgucacugcuua

SEQ ID NO: 1716884 - RNA, 20 nt, Human
uuuuaugauacuugaaaauu

SEQ ID NO: 1716885 - RNA, 16 nt, Human
uuuuaugauacuugaa

SEQ ID NO: 1716886 - RNA, 15 nt, Human
uuuuccuucagugcc

SEQ ID NO: 1716887 - RNA, 14 nt, Human
uuuucuucucccuc

SEQ ID NO: 1716888 - RNA, 17 nt, Human
uuuucuugcaugaggcu

SEQ ID NO: 1716889 - RNA, 19 nt, Human
uuuuccaugaguccccugu

SEQ ID NO: 1716890 - RNA, 18 nt, Human
uuuuccaugaguccccug

SEQ ID NO: 1716891 - RNA, 22 nt, Human
uuuucaacgcagcccugcuuug

SEQ ID NO: 1716892 - RNA, 21 nt, Human
uuuucaacgcagcccugcuuu

SEQ ID NO: 1716893 - RNA, 17 nt, Human
uuuucaacgcagcccug

SEQ ID NO: 1716894 - RNA, 20 nt, Human
uuuucacugcuggcugccuu

SEQ ID NO: 1716895 - RNA, 19 nt, Human
uuuucacugcuggcugccu

SEQ ID NO: 1716896 - RNA, 15 nt, Human
uuuucacaguucucu

SEQ ID NO: 1716897 - RNA, 22 nt, Human
uuuccucaaaacuucagacaua

SEQ ID NO: 1716898 - RNA, 21 nt, Human
uuuccucuuuggucuacacug

SEQ ID NO: 1716899 - RNA, 23 nt, Human
uuuccugacagaaggacucaggu

SEQ ID NO: 1716900 - RNA, 17 nt, Human
uuucuaaagcugccagc

SEQ ID NO: 1716901 - RNA, 14 nt, Human
uuucuaaagcugcc

SEQ ID NO: 1716902 - RNA, 14 nt, Human
uuucuaaaggcuac

SEQ ID NO: 1716903 - RNA, 18 nt, Human
uuucuaaaggcuaccuuu

SEQ ID NO: 1716904 - RNA, 15 nt, Human
uuucuagccagagga

SEQ ID NO: 1716905 - RNA, 15 nt, Human
uuucuaaugugugaa

SEQ ID NO: 1716906 - RNA, 13 nt, Human
uuuauuuccagug

SEQ ID NO: 1716907 - RNA, 22 nt, Human
uuucaauaggaaaaacugauuu

SEQ ID NO: 1716908 - RNA, 20 nt, Human
uuucaauaggaaaaacugau

SEQ ID NO: 1716909 - RNA, 15 nt, Human
uuucagcagcugcag

SEQ ID NO: 1716910 - RNA, 12 nt, Human
uuuccaaaguac

SEQ ID NO: 1716911 - RNA, 15 nt, Human
uuuccaaaguacacu

SEQ ID NO: 1716912 - RNA, 13 nt, Human
uuuccaggaaggc

SEQ ID NO: 1716913 - RNA, 22 nt, Human
uuucauugcugggcuugucugu

SEQ ID NO: 1716914 - RNA, 16 nt, Human
uuucagccaagaauuc

SEQ ID NO: 1716915 - RNA, 15 nt, Human
uuucagccaagaauu

SEQ ID NO: 1716916 - RNA, 20 nt, Human
uuguauuuuacuaauaaaau

SEQ ID NO: 1716917 - RNA, 15 nt, Human
uuguauuuauuuagu

SEQ ID NO: 1716918 - RNA, 23 nt, Human
uuguauuuaaaugaaagugagac

SEQ ID NO: 1716919 - RNA, 15 nt, Human
uuuacuuuguguuca

SEQ ID NO: 1716920 - RNA, 13 nt, Human
uuuauugcuuguu

SEQ ID NO: 1716921 - RNA, 14 nt, Human
uuuaugcauauuau

SEQ ID NO: 1716922 - RNA, 16 nt, Human
uuuauugucaaagugg

SEQ ID NO: 1716923 - RNA, 14 nt, Human
uuuauugucaaagu

SEQ ID NO: 1716924 - RNA, 14 nt, Human
uuuauaaacuuuac

SEQ ID NO: 1716925 - RNA, 16 nt, Human
uuuaucgucacugcuu

SEQ ID NO: 1716926 - RNA, 16 nt, Human
uuuauaaacuuuaccu

SEQ ID NO: 1716927 - RNA, 21 nt, Human
uuuaucgucacugcuuaacuu

SEQ ID NO: 1716928 - RNA, 18 nt, Human
uucaauucucauuuguca

SEQ ID NO: 1716929 - RNA, 16 nt, Human
uucaaucccaggaugu

SEQ ID NO: 1716930 - RNA, 15 nt, Human
uucaacgcagcccug

SEQ ID NO: 1716931 - RNA, 14 nt, Human
uucaacgcagcccu

SEQ ID NO: 1716932 - RNA, 21 nt, Human
uucaacagguuuuccugaaga

SEQ ID NO: 1716933 - RNA, 13 nt, Human
uucaacgcagccc

SEQ ID NO: 1716934 - RNA, 20 nt, Human
uucaaccauuccccauggga

SEQ ID NO: 1716935 - RNA, 17 nt, Human
uucaaccauuccccaug

SEQ ID NO: 1716936 - RNA, 23 nt, Human
uucaaauuguaagcaugcacaaa

SEQ ID NO: 1716937 - RNA, 13 nt, Human
uucaaagauauuu

SEQ ID NO: 1716938 - RNA, 15 nt, Human
uucaaagcaaauguc

SEQ ID NO: 1716939 - RNA, 13 nt, Human
uuauuuugaugua

SEQ ID NO: 1716940 - RNA, 16 nt, Human
uuauuuugauguaaag

SEQ ID NO: 1716941 - RNA, 14 nt, Human
uuacgugaguccug

SEQ ID NO: 1716942 - RNA, 13 nt, Human
uuacgugaguccu

SEQ ID NO: 1716943 - RNA, 15 nt, Human
uucagagacuccugc

SEQ ID NO: 1716944 - RNA, 12 nt, Human
uucagaggcuca

SEQ ID NO: 1716945 - RNA, 13 nt, Human
uucagaggcucag

SEQ ID NO: 1716946 - RNA, 22 nt, Human
uucagaggcucagauuguaaua

SEQ ID NO: 1716947 - RNA, 14 nt, Human
uucacucuccuugg

SEQ ID NO: 1716948 - RNA, 19 nt, Human
uucaggaagcucagggccu

SEQ ID NO: 1716949 - RNA, 17 nt, Human
uucaggaagcucagggc

SEQ ID NO: 1716950 - RNA, 20 nt, Human
uucaggaagcucagggccug

SEQ ID NO: 1716951 - RNA, 15 nt, Human
uucaggcucuucucc

SEQ ID NO: 1716952 - RNA, 17 nt, Human
uucagcugacuuuucug

SEQ ID NO: 1716953 - RNA, 18 nt, Human
uucagcugcauacaguuu

SEQ ID NO: 1716954 - RNA, 16 nt, Human
uucaggaagcucaggg

SEQ ID NO: 1716955 - RNA, 21 nt, Human
uucagcugguugagguuucaa

SEQ ID NO: 1716956 - RNA, 24 nt, Human
uucagcucugcaagaauugaagca

SEQ ID NO: 1716957 - RNA, 17 nt, Human
uucagcucugcaagaau

SEQ ID NO: 1716958 - RNA, 23 nt, Human
uucagcuccagcucaccagcccc

SEQ ID NO: 1716959 - RNA, 19 nt, Human
uuccacuuauaggaauuga

SEQ ID NO: 1716960 - RNA, 21 nt, Human
uuccacuuagaaauugcauuu

SEQ ID NO: 1716961 - RNA, 17 nt, Human
uuccaugaguccccugu

SEQ ID NO: 1716962 - RNA, 19 nt, Human
uuccaugucgccucugcau

SEQ ID NO: 1716963 - RNA, 18 nt, Human
uuccaugucgccucugca

SEQ ID NO: 1716964 - RNA, 17 nt, Human
uuccaugucgccucugc

SEQ ID NO: 1716965 - RNA, 14 nt, Human
uuccccaagacauu

SEQ ID NO: 1716966 - RNA, 21 nt, Human
uuccaugucgccucugcauuc

SEQ ID NO: 1716967 - RNA, 20 nt, Human
uuccaugucgccucugcauu

SEQ ID NO: 1716968 - RNA, 17 nt, Human
uucaucuugaauuguaa

SEQ ID NO: 1716969 - RNA, 12 nt, Human
uucaucuugaau

SEQ ID NO: 1716970 - RNA, 11 nt, Human
uucaucuugaa

SEQ ID NO: 1716971 - RNA, 20 nt, Human
uucaucuuccaacucaaacu

SEQ ID NO: 1716972 - RNA, 19 nt, Human
uucauuuaggugaggaagc

SEQ ID NO: 1716973 - RNA, 13 nt, Human
uucaguggcagcu

SEQ ID NO: 1716974 - RNA, 21 nt, Human
uucagugccuuauggaacacu

SEQ ID NO: 1716975 - RNA, 19 nt, Human
uucagugccuuauggaaca

SEQ ID NO: 1716976 - RNA, 16 nt, Human
uucaggcucuucuccu

SEQ ID NO: 1716977 - RNA, 23 nt, Human
uucauaaugacuuaagcacacuu

SEQ ID NO: 1716978 - RNA, 13 nt, Human
uucauaaugacuu

SEQ ID NO: 1716979 - RNA, 15 nt, Human
uucaucuaggauuuu

SEQ ID NO: 1716980 - RNA, 12 nt, Human
uucaguuuucag

SEQ ID NO: 1716981 - RNA, 20 nt, Human
uuccuagguauaauucacau

SEQ ID NO: 1716982 - RNA, 23 nt, Human
uuccucauaguaugguggcuggg

SEQ ID NO: 1716983 - RNA, 21 nt, Human
uuccucccucccucuuucccu

SEQ ID NO: 1716984 - RNA, 19 nt, Human
uuccucccucccucuuucc

SEQ ID NO: 1716985 - RNA, 12 nt, Human
uuccucccuccc

SEQ ID NO: 1716986 - RNA, 22 nt, Human
uuccucccucccucuuucccuc

SEQ ID NO: 1716987 - RNA, 19 nt, Human
uucccuuugacgccauccc

SEQ ID NO: 1716988 - RNA, 22 nt, Human
uuccccacuugagaauuacccu

SEQ ID NO: 1716989 - RNA, 22 nt, Human
uucggccuccauccugaggcuc

SEQ ID NO: 1716990 - RNA, 18 nt, Human
uucggccuccauccugag

SEQ ID NO: 1716991 - RNA, 19 nt, Human
uucggccuccauccugagg

SEQ ID NO: 1716992 - RNA, 17 nt, Human
uucuaaaggcuaccuuu

SEQ ID NO: 1716993 - RNA, 18 nt, Human
uucuaaaggcuaccuuug

SEQ ID NO: 1716994 - RNA, 16 nt, Human
uucuaaaggcuaccuu

SEQ ID NO: 1716995 - RNA, 13 nt, Human
uucuaaagaugga

SEQ ID NO: 1716996 - RNA, 17 nt, Human
uuccuuccucugagccu

SEQ ID NO: 1716997 - RNA, 13 nt, Human
uuccuuccucuga

SEQ ID NO: 1716998 - RNA, 19 nt, Human
uuccuucauucaacccacc

SEQ ID NO: 1716999 - RNA, 23 nt, Human
uuccuucagugccuuauggaaca

SEQ ID NO: 1717000 - RNA, 19 nt, Human
uuccuucagugccuuaugg

SEQ ID NO: 1717001 - RNA, 16 nt, Human
uuccuucagugccuua

SEQ ID NO: 1717002 - RNA, 11 nt, Human
uuccugcccug

SEQ ID NO: 1717003 - RNA, 22 nt, Human
uuccugcccugggaggcaguga

SEQ ID NO: 1717004 - RNA, 16 nt, Human
uuccugcccugggagg

SEQ ID NO: 1717005 - RNA, 13 nt, Human
uuccugcccuggg

SEQ ID NO: 1717006 - RNA, 16 nt, Human
uucuaugacacaugca

SEQ ID NO: 1717007 - RNA, 17 nt, Human
uucuaugacacaugcaa

SEQ ID NO: 1717008 - RNA, 14 nt, Human
uucuauuguuucuu

SEQ ID NO: 1717009 - RNA, 12 nt, Human
uucucaugccuc

SEQ ID NO: 1717010 - RNA, 11 nt, Human
uucucaugccu

SEQ ID NO: 1717011 - RNA, 21 nt, Human
uucucaugccucagccuccug

SEQ ID NO: 1717012 - RNA, 14 nt, Human
uucucaugccucag

SEQ ID NO: 1717013 - RNA, 13 nt, Human
uucucaaagaaau

SEQ ID NO: 1717014 - RNA, 15 nt, Human
uucucaaagaaauuu

SEQ ID NO: 1717015 - RNA, 19 nt, Human
uucucaaagaaauuuccac

SEQ ID NO: 1717016 - RNA, 20 nt, Human
uucucaaagaaauuuccacu

SEQ ID NO: 1717017 - RNA, 18 nt, Human
uucucuccagccccugga

SEQ ID NO: 1717018 - RNA, 13 nt, Human
uucuccacccugc

SEQ ID NO: 1717019 - RNA, 16 nt, Human
uucuccaagcaggaca

SEQ ID NO: 1717020 - RNA, 11 nt, Human
uucuccaggcu

SEQ ID NO: 1717021 - RNA, 20 nt, Human
uucugacccaugcugcccug

SEQ ID NO: 1717022 - RNA, 18 nt, Human
uucugacccaugcugccc

SEQ ID NO: 1717023 - RNA, 21 nt, Human
uucugacccaugcugcccugu

SEQ ID NO: 1717024 - RNA, 17 nt, Human
uuggcaaaaaggcagga

SEQ ID NO: 1717025 - RNA, 14 nt, Human
uuggauuguccccg

SEQ ID NO: 1717026 - RNA, 18 nt, Human
uuggauuuuugucuugug

SEQ ID NO: 1717027 - RNA, 20 nt, Human
uuggaagugaaaacuuugua

SEQ ID NO: 1717028 - RNA, 15 nt, Human
uuggaaguuuuaauc

SEQ ID NO: 1717029 - RNA, 19 nt, Human
uuggaaggaacguccccug

SEQ ID NO: 1717030 - RNA, 11 nt, Human
uuggaaggaac

SEQ ID NO: 1717031 - RNA, 20 nt, Human
uugcuggggccgaaagaaca

SEQ ID NO: 1717032 - RNA, 20 nt, Human
uugcuguagaagauggcacu

SEQ ID NO: 1717033 - RNA, 11 nt, Human
uugcccaggca

SEQ ID NO: 1717034 - RNA, 23 nt, Human
uugcccacgcuggagugcaguga

SEQ ID NO: 1717035 - RNA, 18 nt, Human
uugccagucaccccggcc

SEQ ID NO: 1717036 - RNA, 18 nt, Human
uugccacugccucuuccu

SEQ ID NO: 1717037 - RNA, 14 nt, Human
uugccucugccucu

SEQ ID NO: 1717038 - RNA, 11 nt, Human
uugccucugcc

SEQ ID NO: 1717039 - RNA, 18 nt, Human
uugccucugccucugaca

SEQ ID NO: 1717040 - RNA, 16 nt, Human
uugccucugccucuga

SEQ ID NO: 1717041 - RNA, 22 nt, Human
uugcugauggugcaaugaccuu

SEQ ID NO: 1717042 - RNA, 20 nt, Human
uugcugauggugcaaugacc

SEQ ID NO: 1717043 - RNA, 11 nt, Human
uugcugccuca

SEQ ID NO: 1717044 - RNA, 15 nt, Human
uugcugccucaugcu

SEQ ID NO: 1717045 - RNA, 12 nt, Human
uugcugccucau

SEQ ID NO: 1717046 - RNA, 14 nt, Human
uuguauuacaaauc

SEQ ID NO: 1717047 - RNA, 21 nt, Human
uuguauucucuccuguaccuc

SEQ ID NO: 1717048 - RNA, 14 nt, Human
uuguauucagaguu

SEQ ID NO: 1717049 - RNA, 15 nt, Human
uuguagagccagggu

SEQ ID NO: 1717050 - RNA, 14 nt, Human
uuguagagccaggg

SEQ ID NO: 1717051 - RNA, 14 nt, Human
uuguacauaaugcg

SEQ ID NO: 1717052 - RNA, 16 nt, Human
uuguacaguuuuuauu

SEQ ID NO: 1717053 - RNA, 12 nt, Human
uuguacaguuuu

SEQ ID NO: 1717054 - RNA, 13 nt, Human
uuguacaguuuuu

SEQ ID NO: 1717055 - RNA, 16 nt, Human
uuguaaaggaauuuaa

SEQ ID NO: 1717056 - RNA, 13 nt, Human
uugguccugcugc

SEQ ID NO: 1717057 - RNA, 12 nt, Human
uugguccugcug

SEQ ID NO: 1717058 - RNA, 16 nt, Human
uuggucccccuuccau

SEQ ID NO: 1717059 - RNA, 22 nt, Human
uuggucccccuuccauggacuu

SEQ ID NO: 1717060 - RNA, 13 nt, Human
uuguacagacaac

SEQ ID NO: 1717061 - RNA, 12 nt, Human
uuguacagacaa

SEQ ID NO: 1717062 - RNA, 22 nt, Human
uuggcuuuggguugcaggaccu

SEQ ID NO: 1717063 - RNA, 12 nt, Human
uugggaggcuga

SEQ ID NO: 1717064 - RNA, 16 nt, Human
uugggaggccauuugu

SEQ ID NO: 1717065 - RNA, 16 nt, Human
uuggguggaugccugg

SEQ ID NO: 1717066 - RNA, 14 nt, Human
uugguaaaccuuuu

SEQ ID NO: 1717067 - RNA, 12 nt, Human
uugguaaaccuu

SEQ ID NO: 1717068 - RNA, 22 nt, Human
uuggcugggggccucagugcca

SEQ ID NO: 1717069 - RNA, 21 nt, Human
uuggcugggggccucagugcc

SEQ ID NO: 1717070 - RNA, 18 nt, Human
uuggcugggggccucagu

SEQ ID NO: 1717071 - RNA, 24 nt, Human
uuggccaaagccaaagcuaggccu

SEQ ID NO: 1717072 - RNA, 14 nt, Human
uuggccaggcuggu

SEQ ID NO: 1717073 - RNA, 13 nt, Human
uuggcauucccca

SEQ ID NO: 1717074 - RNA, 22 nt, Human
uugcagacaggcaagcaccucc

SEQ ID NO: 1717075 - RNA, 16 nt, Human
uugcagacaggcaagc

SEQ ID NO: 1717076 - RNA, 14 nt, Human
uugcauagaauaaa

SEQ ID NO: 1717077 - RNA, 15 nt, Human
uugccacugccucuu

SEQ ID NO: 1717078 - RNA, 14 nt, Human
uugccacugccucu

SEQ ID NO: 1717079 - RNA, 17 nt, Human
uugcaacaggcugggcu

SEQ ID NO: 1717080 - RNA, 14 nt, Human
uugcaacaggcugg

SEQ ID NO: 1717081 - RNA, 18 nt, Human
uugauuuccguuaaaaua

SEQ ID NO: 1717082 - RNA, 23 nt, Human
uugauagcacagacccugcccug

SEQ ID NO: 1717083 - RNA, 21 nt, Human
uugauagcacagacccugccc

SEQ ID NO: 1717084 - RNA, 22 nt, Human
uugaccugaggcccuucucucc

SEQ ID NO: 1717085 - RNA, 19 nt, Human
uugaccugaggcccuucuc

SEQ ID NO: 1717086 - RNA, 12 nt, Human
uugaccugaggc

SEQ ID NO: 1717087 - RNA, 22 nt, Human
uugacgccaucccagccccaau

SEQ ID NO: 1717088 - RNA, 15 nt, Human
uugacgccaucccag

SEQ ID NO: 1717089 - RNA, 14 nt, Human
uugacgccauccca

SEQ ID NO: 1717090 - RNA, 15 nt, Human
uugaccucaggugau

SEQ ID NO: 1717091 - RNA, 21 nt, Human
uugaccgugaggccagagaca

SEQ ID NO: 1717092 - RNA, 20 nt, Human
uugaccgugaggccagagac

SEQ ID NO: 1717093 - RNA, 20 nt, Human
uugauagcacagacccugcc

SEQ ID NO: 1717094 - RNA, 19 nt, Human
uugauagcacagacccugc

SEQ ID NO: 1717095 - RNA, 13 nt, Human
uucuugguuugua

SEQ ID NO: 1717096 - RNA, 16 nt, Human
uucuugguuuguaaau

SEQ ID NO: 1717097 - RNA, 23 nt, Human
uucuugguuuguaaauuaacuuu

SEQ ID NO: 1717098 - RNA, 17 nt, Human
uucuugguuuguaaauu

SEQ ID NO: 1717099 - RNA, 18 nt, Human
uucuugguuuguaaauua

SEQ ID NO: 1717100 - RNA, 14 nt, Human
uucuucaacucccu

SEQ ID NO: 1717101 - RNA, 23 nt, Human
uucuuauuuaaugaaagacugua

SEQ ID NO: 1717102 - RNA, 19 nt, Human
uucuuauuuaaugaaagac

SEQ ID NO: 1717103 - RNA, 11 nt, Human
uucuguucuuu

SEQ ID NO: 1717104 - RNA, 14 nt, Human
uucugagcauuuaa

SEQ ID NO: 1717105 - RNA, 21 nt, Human
uucuguccgagcuuugaaaau

SEQ ID NO: 1717106 - RNA, 17 nt, Human
uucuguccgagcuuuga

SEQ ID NO: 1717107 - RNA, 23 nt, Human
uucuguggguuucuaaagcugcc

SEQ ID NO: 1717108 - RNA, 16 nt, Human
uucuguggcucacaga

SEQ ID NO: 1717109 - RNA, 12 nt, Human
uucuguggcuca

SEQ ID NO: 1717110 - RNA, 17 nt, Human
uucuguccuacucugug

SEQ ID NO: 1717111 - RNA, 19 nt, Human
uucuguccuacucuguguc

SEQ ID NO: 1717112 - RNA, 22 nt, Human
uugaaaacacuguucucugccc

SEQ ID NO: 1717113 - RNA, 18 nt, Human
uucuuuauaauucuacuu

SEQ ID NO: 1717114 - RNA, 21 nt, Human
uugaaaacacuguucucugcc

SEQ ID NO: 1717115 - RNA, 19 nt, Human
uugaaaacacuguucucug

SEQ ID NO: 1717116 - RNA, 15 nt, Human
uugaaaaaugcaugu

SEQ ID NO: 1717117 - RNA, 17 nt, Human
uugaagacagagcuaca

SEQ ID NO: 1717118 - RNA, 19 nt, Human
uugaagacuuuucuuucag

SEQ ID NO: 1717119 - RNA, 22 nt, Human
uugaacuuugaccucugcagca

SEQ ID NO: 1717120 - RNA, 16 nt, Human
uugaacugauaaagau

SEQ ID NO: 1717121 - RNA, 19 nt, Human
uugaacucuucaaucucuu

SEQ ID NO: 1717122 - RNA, 22 nt, Human
ugugcuuauguaugagguacaa

SEQ ID NO: 1717123 - RNA, 20 nt, Human
ugugcgugcauguguguuca

SEQ ID NO: 1717124 - RNA, 17 nt, Human
ugugccucugggacugg

SEQ ID NO: 1717125 - RNA, 15 nt, Human
ugugccucugccugu

SEQ ID NO: 1717126 - RNA, 16 nt, Human
ugugccucugggacug

SEQ ID NO: 1717127 - RNA, 15 nt, Human
ugugccucugggacu

SEQ ID NO: 1717128 - RNA, 13 nt, Human
ugugccucuggga

SEQ ID NO: 1717129 - RNA, 14 nt, Human
ugugccucugccug

SEQ ID NO: 1717130 - RNA, 22 nt, Human
ugugcacaugcacgugugugca

SEQ ID NO: 1717131 - RNA, 12 nt, Human
ugugggaagggg

SEQ ID NO: 1717132 - RNA, 14 nt, Human
uguggacacagcuc

SEQ ID NO: 1717133 - RNA, 17 nt, Human
uguggaaaaugaaaauu

SEQ ID NO: 1717134 - RNA, 21 nt, Human
uguggagaagcggcuggcagc

SEQ ID NO: 1717135 - RNA, 12 nt, Human
uguggagaagcg

SEQ ID NO: 1717136 - RNA, 21 nt, Human
uguggcuccuggggguucuuu

SEQ ID NO: 1717137 - RNA, 16 nt, Human
uguggacacagcucuu

SEQ ID NO: 1717138 - RNA, 15 nt, Human
uguggacacagcucu

SEQ ID NO: 1717139 - RNA, 22 nt, Human
ugugaccacugcagaagacagu

SEQ ID NO: 1717140 - RNA, 15 nt, Human
ugugacauguuuuau

SEQ ID NO: 1717141 - RNA, 21 nt, Human
ugugacaaggauugcuacugu

SEQ ID NO: 1717142 - RNA, 16 nt, Human
ugugaaucauuuuacc

SEQ ID NO: 1717143 - RNA, 23 nt, Human
ugugaguacuacaguccucccau

SEQ ID NO: 1717144 - RNA, 20 nt, Human
ugugaguacuacaguccucc

SEQ ID NO: 1717145 - RNA, 19 nt, Human
ugugaguacuacaguccuc

SEQ ID NO: 1717146 - RNA, 18 nt, Human
ugugaguacuacaguccu

SEQ ID NO: 1717147 - RNA, 21 nt, Human
ugugauacaaugcugugcccu

SEQ ID NO: 1717148 - RNA, 13 nt, Human
ugugauauaagug

SEQ ID NO: 1717149 - RNA, 21 nt, Human
ugucucaguccaugaagaugu

SEQ ID NO: 1717150 - RNA, 22 nt, Human
ugucucaguccaugaagaugua

SEQ ID NO: 1717151 - RNA, 13 nt, Human
uguccccaccgca

SEQ ID NO: 1717152 - RNA, 23 nt, Human
ugucucaagagggcacugguggc

SEQ ID NO: 1717153 - RNA, 21 nt, Human
ugucucaagagggcacuggug

SEQ ID NO: 1717154 - RNA, 20 nt, Human
ugucucaagagggcacuggu

SEQ ID NO: 1717155 - RNA, 17 nt, Human
ugucucaggucccugca

SEQ ID NO: 1717156 - RNA, 16 nt, Human
ugucucaggucccugc

SEQ ID NO: 1717157 - RNA, 14 nt, Human
ugugaaaggaaaga

SEQ ID NO: 1717158 - RNA, 13 nt, Human
ugugaaaggaaag

SEQ ID NO: 1717159 - RNA, 13 nt, Human
ugugaaacauguu

SEQ ID NO: 1717160 - RNA, 18 nt, Human
ugucuuuggacccugagg

SEQ ID NO: 1717161 - RNA, 17 nt, Human
ugucuuuggacccugag

SEQ ID NO: 1717162 - RNA, 22 nt, Human
ugucuuuggacccugaggccca

SEQ ID NO: 1717163 - RNA, 19 nt, Human
ugucuuuggacccugaggc

SEQ ID NO: 1717164 - RNA, 14 nt, Human
ugucuuuuuucuaa

SEQ ID NO: 1717165 - RNA, 16 nt, Human
ugucuuuuuucacuac

SEQ ID NO: 1717166 - RNA, 13 nt, Human
uguaaauuaacuu

SEQ ID NO: 1717167 - RNA, 14 nt, Human
uguaaauuaacuuu

SEQ ID NO: 1717168 - RNA, 15 nt, Human
uguaaauuaacuuuu

SEQ ID NO: 1717169 - RNA, 16 nt, Human
uguaaauuaacuuuua

SEQ ID NO: 1717170 - RNA, 17 nt, Human
uguaaauuaacuuuuau

SEQ ID NO: 1717171 - RNA, 17 nt, Human
ugguaggacuguagaaa

SEQ ID NO: 1717172 - RNA, 18 nt, Human
ugguaggacuguagaaaa

SEQ ID NO: 1717173 - RNA, 23 nt, Human
uguaacuaaaauaauuuuguaau

SEQ ID NO: 1717174 - RNA, 14 nt, Human
uguaacuaaaauaa

SEQ ID NO: 1717175 - RNA, 15 nt, Human
uguaacuaaaauaau

SEQ ID NO: 1717176 - RNA, 15 nt, Human
uguaaucacagcuac

SEQ ID NO: 1717177 - RNA, 12 nt, Human
uguaaugacagg

SEQ ID NO: 1717178 - RNA, 23 nt, Human
uguaauguaucaaauacauuuaa

SEQ ID NO: 1717179 - RNA, 12 nt, Human
uguacagucuug

SEQ ID NO: 1717180 - RNA, 14 nt, Human
uguacagucuugua

SEQ ID NO: 1717181 - RNA, 15 nt, Human
uguacagucuuguau

SEQ ID NO: 1717182 - RNA, 17 nt, Human
uguacagucuuguauua

SEQ ID NO: 1717183 - RNA, 15 nt, Human
uguaccgcaauguga

SEQ ID NO: 1717184 - RNA, 23 nt, Human
uguaccucuugagccuugaacuu

SEQ ID NO: 1717185 - RNA, 22 nt, Human
uguaccucuugagccuugaacu

SEQ ID NO: 1717186 - RNA, 14 nt, Human
uguaccucuugagc

SEQ ID NO: 1717187 - RNA, 17 nt, Human
uguagauaauacaguuc

SEQ ID NO: 1717188 - RNA, 13 nt, Human
uguacuccuccca

SEQ ID NO: 1717189 - RNA, 12 nt, Human
uguacuccuccc

SEQ ID NO: 1717190 - RNA, 16 nt, Human
uguacgucugacaggc

SEQ ID NO: 1717191 - RNA, 17 nt, Human
uguacgucugacaggca

SEQ ID NO: 1717192 - RNA, 23 nt, Human
uguaucccaugagccucagcauc

SEQ ID NO: 1717193 - RNA, 19 nt, Human
uguaucccaugagccucag

SEQ ID NO: 1717194 - RNA, 14 nt, Human
uguaugcacuuugu

SEQ ID NO: 1717195 - RNA, 20 nt, Human
ugucagugugacugaucucu

SEQ ID NO: 1717196 - RNA, 12 nt, Human
ugucagugugac

SEQ ID NO: 1717197 - RNA, 23 nt, Human
ugucccaaaaagaaaggagggga

SEQ ID NO: 1717198 - RNA, 23 nt, Human
ugucauucgcuacuaugauuuaa

SEQ ID NO: 1717199 - RNA, 22 nt, Human
ugugugucuaggcaggaccugu

SEQ ID NO: 1717200 - RNA, 13 nt, Human
uguguuuauuguc

SEQ ID NO: 1717201 - RNA, 22 nt, Human
uguguuuaggaacuacugagga

SEQ ID NO: 1717202 - RNA, 17 nt, Human
uguuagauuaagaaaua

SEQ ID NO: 1717203 - RNA, 20 nt, Human
uguuagauuaagaaauagac

SEQ ID NO: 1717204 - RNA, 14 nt, Human
uguucagcuccagc

SEQ ID NO: 1717205 - RNA, 11 nt, Human
uguucagcugg

SEQ ID NO: 1717206 - RNA, 18 nt, Human
uguucagcuccagcucac

SEQ ID NO: 1717207 - RNA, 16 nt, Human
uguucagcuccagcuc

SEQ ID NO: 1717208 - RNA, 15 nt, Human
uguucagcuccagcu

SEQ ID NO: 1717209 - RNA, 16 nt, Human
uguuacugucuucagu

SEQ ID NO: 1717210 - RNA, 15 nt, Human
uguuacugucuucag

SEQ ID NO: 1717211 - RNA, 22 nt, Human
uguuacauuuuuaagugcugca

SEQ ID NO: 1717212 - RNA, 13 nt, Human
uguuacauuuuua

SEQ ID NO: 1717213 - RNA, 17 nt, Human
uguuuacagauccccaa

SEQ ID NO: 1717214 - RNA, 14 nt, Human
uguuggccaggcug

SEQ ID NO: 1717215 - RNA, 18 nt, Human
uguuggccaggcugcucu

SEQ ID NO: 1717216 - RNA, 13 nt, Human
uguuggccaggcu

SEQ ID NO: 1717217 - RNA, 14 nt, Human
uguugcugccucau

SEQ ID NO: 1717218 - RNA, 11 nt, Human
uguuggccagg

SEQ ID NO: 1717219 - RNA, 20 nt, Human
uguuggauuuuugucuugug

SEQ ID NO: 1717220 - RNA, 17 nt, Human
uguuggauuuuugucuu

SEQ ID NO: 1717221 - RNA, 13 nt, Human
uguugcugccuca

SEQ ID NO: 1717222 - RNA, 11 nt, Human
uguugaaagau

SEQ ID NO: 1717223 - RNA, 20 nt, Human
uguucuuucuggcuaugcau

SEQ ID NO: 1717224 - RNA, 22 nt, Human
uguucuuucuggcuaugcauuu

SEQ ID NO: 1717225 - RNA, 15 nt, Human
uguucugacccugcu

SEQ ID NO: 1717226 - RNA, 19 nt, Human
uguucucugcccuccaaga

SEQ ID NO: 1717227 - RNA, 14 nt, Human
uguucuuucuggcu

SEQ ID NO: 1717228 - RNA, 17 nt, Human
uguucugcacacagcac

SEQ ID NO: 1717229 - RNA, 18 nt, Human
uguucugacccugcuuca

SEQ ID NO: 1717230 - RNA, 12 nt, Human
uguucucugccc

SEQ ID NO: 1717231 - RNA, 18 nt, Human
uguucucugaggacacua

SEQ ID NO: 1717232 - RNA, 16 nt, Human
uguucucugaggacac

SEQ ID NO: 1717233 - RNA, 12 nt, Human
uguucuauagcu

SEQ ID NO: 1717234 - RNA, 13 nt, Human
uguucauaaauaa

SEQ ID NO: 1717235 - RNA, 14 nt, Human
uuacauuuccuaaa

SEQ ID NO: 1717236 - RNA, 20 nt, Human
uuacagagacagaaagcaga

SEQ ID NO: 1717237 - RNA, 23 nt, Human
uuacaauaaaaucuugaaaaugc

SEQ ID NO: 1717238 - RNA, 14 nt, Human
uuaccagcagagca

SEQ ID NO: 1717239 - RNA, 20 nt, Human
uuacauuuuuaagugcugca

SEQ ID NO: 1717240 - RNA, 21 nt, Human
uuacauuuuuaagugcugcau

SEQ ID NO: 1717241 - RNA, 22 nt, Human
uuacauuuuuaagugcugcauu

SEQ ID NO: 1717242 - RNA, 23 nt, Human
uuacauuuuuaagugcugcauuu

SEQ ID NO: 1717243 - RNA, 19 nt, Human
uuaccuuuuuuauacauaa

SEQ ID NO: 1717244 - RNA, 20 nt, Human
uuaccuuuuuuauacauaaa

SEQ ID NO: 1717245 - RNA, 22 nt, Human
uuaccuuuuuuauacauaaaca

SEQ ID NO: 1717246 - RNA, 20 nt, Human
uuacgguuuuccagguuuaa

SEQ ID NO: 1717247 - RNA, 22 nt, Human
uuaaugucaauucuugccaaau

SEQ ID NO: 1717248 - RNA, 17 nt, Human
uuaaugucacaggcagg

SEQ ID NO: 1717249 - RNA, 14 nt, Human
uuaauggaaauguu

SEQ ID NO: 1717250 - RNA, 18 nt, Human
uuaaugucacaggcaggu

SEQ ID NO: 1717251 - RNA, 22 nt, Human
uuaaggaugcuuguacauaaug

SEQ ID NO: 1717252 - RNA, 17 nt, Human
uuaaggaugcuuguaca

SEQ ID NO: 1717253 - RNA, 18 nt, Human
uuaaggaugcuuguacau

SEQ ID NO: 1717254 - RNA, 19 nt, Human
uuaaggaugcuuguacaua

SEQ ID NO: 1717255 - RNA, 20 nt, Human
uuaaggaugcuuguacauaa

SEQ ID NO: 1717256 - RNA, 21 nt, Human
uuaaggaagacaaugugaaaa

SEQ ID NO: 1717257 - RNA, 18 nt, Human
uguuuuaaaaugagaaau

SEQ ID NO: 1717258 - RNA, 17 nt, Human
uguuuguugucagcuga

SEQ ID NO: 1717259 - RNA, 22 nt, Human
uguuuccuggcacugcuuccag

SEQ ID NO: 1717260 - RNA, 21 nt, Human
uguuuccuggcacugcuucca

SEQ ID NO: 1717261 - RNA, 20 nt, Human
uguuuccuggcacugcuucc

SEQ ID NO: 1717262 - RNA, 23 nt, Human
uguuuccuggcacugcuuccagu

SEQ ID NO: 1717263 - RNA, 13 nt, Human
uguuuuugucuua

SEQ ID NO: 1717264 - RNA, 23 nt, Human
uguuuuaaaaugagaaaucuaaa

SEQ ID NO: 1717265 - RNA, 15 nt, Human
uuaaauguagaaagu

SEQ ID NO: 1717266 - RNA, 18 nt, Human
uuaaaugcccagccccuu

SEQ ID NO: 1717267 - RNA, 13 nt, Human
uuaaaugcccagc

SEQ ID NO: 1717268 - RNA, 16 nt, Human
uuaaaugcaccuggaa

SEQ ID NO: 1717269 - RNA, 17 nt, Human
uuaaaugcaccuggaau

SEQ ID NO: 1717270 - RNA, 18 nt, Human
uuaaaugcaccuggaaua

SEQ ID NO: 1717271 - RNA, 18 nt, Human
uuaaauaguaaaaauaaa

SEQ ID NO: 1717272 - RNA, 15 nt, Human
uuaaaacauuaaaau

SEQ ID NO: 1717273 - RNA, 16 nt, Human
uuaaacuuaaucuaaa

SEQ ID NO: 1717274 - RNA, 18 nt, Human
uuaaacuuaaucuaaaug

SEQ ID NO: 1717275 - RNA, 20 nt, Human
uuaaacuuaaucuaaaugga

SEQ ID NO: 1717276 - RNA, 22 nt, Human
uuaaacuuaaucuaaauggaac

SEQ ID NO: 1717277 - RNA, 14 nt, Human
uuaaagacuuuuau

SEQ ID NO: 1717278 - RNA, 15 nt, Human
uggcucuuccaggcu

SEQ ID NO: 1717279 - RNA, 13 nt, Human
uggcucuuccagg

SEQ ID NO: 1717280 - RNA, 12 nt, Human
uggcugggggcc

SEQ ID NO: 1717281 - RNA, 16 nt, Human
uggcucuuccaggcug

SEQ ID NO: 1717282 - RNA, 20 nt, Human
uggcucagguggggucacuc

SEQ ID NO: 1717283 - RNA, 22 nt, Human
uggcucagguggggucacucug

SEQ ID NO: 1717284 - RNA, 14 nt, Human
uggcuaaauucaug

SEQ ID NO: 1717285 - RNA, 20 nt, Human
uggcuccaaacccucgaggc

SEQ ID NO: 1717286 - RNA, 18 nt, Human
uggcuccaaacccucgag

SEQ ID NO: 1717287 - RNA, 16 nt, Human
uggcuccaaacccucg

SEQ ID NO: 1717288 - RNA, 20 nt, Human
uggccuucggccuccauccu

SEQ ID NO: 1717289 - RNA, 17 nt, Human
uggccuucggccuccau

SEQ ID NO: 1717290 - RNA, 18 nt, Human
uggccuucggccuccauc

SEQ ID NO: 1717291 - RNA, 15 nt, Human
uggccagaugcacca

SEQ ID NO: 1717292 - RNA, 22 nt, Human
uggcgugcaguggugcgaucug

SEQ ID NO: 1717293 - RNA, 14 nt, Human
uggcgcugccccug

SEQ ID NO: 1717294 - RNA, 15 nt, Human
uggcgcugccccugg

SEQ ID NO: 1717295 - RNA, 15 nt, Human
uggcugggggccuca

SEQ ID NO: 1717296 - RNA, 22 nt, Human
uggcugguuagagguucccuuu

SEQ ID NO: 1717297 - RNA, 14 nt, Human
uggcugggggccuc

SEQ ID NO: 1717298 - RNA, 22 nt, Human
ugggaaugaaugucagugugac

SEQ ID NO: 1717299 - RNA, 15 nt, Human
uggcuuuucacugcu

SEQ ID NO: 1717300 - RNA, 14 nt, Human
uggcuuuucacugc

SEQ ID NO: 1717301 - RNA, 16 nt, Human
ugggacaugggaaagg

SEQ ID NO: 1717302 - RNA, 16 nt, Human
ugggacagggcauggc

SEQ ID NO: 1717303 - RNA, 23 nt, Human
ugggagcugccuguucagcucca

SEQ ID NO: 1717304 - RNA, 22 nt, Human
ugggguggggggggugcugggc

SEQ ID NO: 1717305 - RNA, 21 nt, Human
ugggguggggggggugcuggg

SEQ ID NO: 1717306 - RNA, 17 nt, Human
ugggguggggaccucag

SEQ ID NO: 1717307 - RNA, 19 nt, Human
ugggguggggggggugcug

SEQ ID NO: 1717308 - RNA, 17 nt, Human
uggguuggaaaacagua

SEQ ID NO: 1717309 - RNA, 21 nt, Human
uggguuccagcaauucuccug

SEQ ID NO: 1717310 - RNA, 22 nt, Human
uggguuccuuccucugagccuu

SEQ ID NO: 1717311 - RNA, 21 nt, Human
uggguuccuuccucugagccu

SEQ ID NO: 1717312 - RNA, 16 nt, Human
uggguucacugcaacc

SEQ ID NO: 1717313 - RNA, 23 nt, Human
uggguucaagcgauucuucugcu

SEQ ID NO: 1717314 - RNA, 14 nt, Human
uggguguggcgcag

SEQ ID NO: 1717315 - RNA, 23 nt, Human
ugggugucaagagggucugagga

SEQ ID NO: 1717316 - RNA, 21 nt, Human
ugggugucaagagggucugag

SEQ ID NO: 1717317 - RNA, 22 nt, Human
ugggcuuggggaccagagcugc

SEQ ID NO: 1717318 - RNA, 21 nt, Human
ugggcuuggggaccagagcug

SEQ ID NO: 1717319 - RNA, 16 nt, Human
uggggcagcuugaggg

SEQ ID NO: 1717320 - RNA, 20 nt, Human
ugggcuucaguggcagcugc

SEQ ID NO: 1717321 - RNA, 19 nt, Human
ugggcuuggggaccagagc

SEQ ID NO: 1717322 - RNA, 19 nt, Human
ugggcuucaguggcagcug

SEQ ID NO: 1717323 - RNA, 18 nt, Human
ugggcuucaguggcagcu

SEQ ID NO: 1717324 - RNA, 19 nt, Human
ugggcgugagaccugcccc

SEQ ID NO: 1717325 - RNA, 18 nt, Human
ugggcgugagaccugccc

SEQ ID NO: 1717326 - RNA, 17 nt, Human
ugggcgugagaccugcc

SEQ ID NO: 1717327 - RNA, 24 nt, Human
ugggagcugccuguucagcuccag

SEQ ID NO: 1717328 - RNA, 22 nt, Human
ugggccuccugugugugcgccu

SEQ ID NO: 1717329 - RNA, 16 nt, Human
ugggccuccugugugu

SEQ ID NO: 1717330 - RNA, 18 nt, Human
ugggccuucagggaguga

SEQ ID NO: 1717331 - RNA, 14 nt, Human
ugggccuccugugu

SEQ ID NO: 1717332 - RNA, 22 nt, Human
uggccacuccagaccccuggcu

SEQ ID NO: 1717333 - RNA, 20 nt, Human
uggcagugggagcugccugu

SEQ ID NO: 1717334 - RNA, 19 nt, Human
uggcagugggagcugccug

SEQ ID NO: 1717335 - RNA, 16 nt, Human
uggcagugggagcugc

SEQ ID NO: 1717336 - RNA, 15 nt, Human
uggcagugggagcug

SEQ ID NO: 1717337 - RNA, 14 nt, Human
uggcagugggagcu

SEQ ID NO: 1717338 - RNA, 15 nt, Human
uggaugccugguggc

SEQ ID NO: 1717339 - RNA, 14 nt, Human
uggaugccuggugg

SEQ ID NO: 1717340 - RNA, 18 nt, Human
uggcacugcuuccaguga

SEQ ID NO: 1717341 - RNA, 16 nt, Human
uggcacugcuuccagu

SEQ ID NO: 1717342 - RNA, 14 nt, Human
uggcacugcuucca

SEQ ID NO: 1717343 - RNA, 22 nt, Human
uggcagcugcgguccacccagg

SEQ ID NO: 1717344 - RNA, 21 nt, Human
uggcagcugcgguccacccag

SEQ ID NO: 1717345 - RNA, 23 nt, Human
uggcagcugcgguccacccagga

SEQ ID NO: 1717346 - RNA, 22 nt, Human
uggaggcaugugaugagaggaa

SEQ ID NO: 1717347 - RNA, 13 nt, Human
uggauaccauuau

SEQ ID NO: 1717348 - RNA, 15 nt, Human
uggauaccauuauau

SEQ ID NO: 1717349 - RNA, 19 nt, Human
uggauacgacaacuugcac

SEQ ID NO: 1717350 - RNA, 17 nt, Human
uggacaggcauguucuc

SEQ ID NO: 1717351 - RNA, 16 nt, Human
uggacaggcauguucu

SEQ ID NO: 1717352 - RNA, 12 nt, Human
uggacaggcaug

SEQ ID NO: 1717353 - RNA, 13 nt, Human
uggagauguuuag

SEQ ID NO: 1717354 - RNA, 20 nt, Human
uggagaggcccggccucuca

SEQ ID NO: 1717355 - RNA, 14 nt, Human
ugcuuguuggauuu

SEQ ID NO: 1717356 - RNA, 18 nt, Human
ugcuuguuaacugagugc

SEQ ID NO: 1717357 - RNA, 16 nt, Human
ugcuucuucagagacu

SEQ ID NO: 1717358 - RNA, 12 nt, Human
ugcuucucacug

SEQ ID NO: 1717359 - RNA, 18 nt, Human
ugcuuccagugaggcucu

SEQ ID NO: 1717360 - RNA, 14 nt, Human
ugcugccuccagaa

SEQ ID NO: 1717361 - RNA, 13 nt, Human
ugcugccucaugc

SEQ ID NO: 1717362 - RNA, 20 nt, Human
ugcuuccagugaggcucugc

SEQ ID NO: 1717363 - RNA, 19 nt, Human
ugcuuccagugaggcucug

SEQ ID NO: 1717364 - RNA, 21 nt, Human
ugcuuccagugaggcucugcc

SEQ ID NO: 1717365 - RNA, 14 nt, Human
uggaacucucgagc

SEQ ID NO: 1717366 - RNA, 12 nt, Human
uggaagacagcu

SEQ ID NO: 1717367 - RNA, 11 nt, Human
uggaagacagc

SEQ ID NO: 1717368 - RNA, 15 nt, Human
uggaaaauaaaucaa

SEQ ID NO: 1717369 - RNA, 11 nt, Human
uggaaaauaaa

SEQ ID NO: 1717370 - RNA, 20 nt, Human
uggaaaaaccacccccaaau

SEQ ID NO: 1717371 - RNA, 16 nt, Human
uggaaaauaaauuauu

SEQ ID NO: 1717372 - RNA, 15 nt, Human
uggaaaauaaauuau

SEQ ID NO: 1717373 - RNA, 15 nt, Human
uggaagacagcucuu

SEQ ID NO: 1717374 - RNA, 14 nt, Human
uggaagacagcucu

SEQ ID NO: 1717375 - RNA, 21 nt, Human
uggaagugugugaucuguggg

SEQ ID NO: 1717376 - RNA, 23 nt, Human
ugcacagcuaacauggaaguacu

SEQ ID NO: 1717377 - RNA, 20 nt, Human
ugcacagcuaacauggaagu

SEQ ID NO: 1717378 - RNA, 18 nt, Human
ugcacagcuaacauggaa

SEQ ID NO: 1717379 - RNA, 18 nt, Human
ugcacagugcaucucagc

SEQ ID NO: 1717380 - RNA, 20 nt, Human
ugcacagugcaucucagccc

SEQ ID NO: 1717381 - RNA, 19 nt, Human
ugcacagugcaucucagcc

SEQ ID NO: 1717382 - RNA, 17 nt, Human
ugcacagcuaacaugga

SEQ ID NO: 1717383 - RNA, 23 nt, Human
ugcacagaguuguuacauuuuua

SEQ ID NO: 1717384 - RNA, 21 nt, Human
ugcacagaguuguuacauuuu

SEQ ID NO: 1717385 - RNA, 22 nt, Human
ugcacagaguuguuacauuuuu

SEQ ID NO: 1717386 - RNA, 16 nt, Human
ugaaggcuggguucug

SEQ ID NO: 1717387 - RNA, 20 nt, Human
ugaagucuuuguacagacaa

SEQ ID NO: 1717388 - RNA, 17 nt, Human
ugaagucuuuguacaga

SEQ ID NO: 1717389 - RNA, 22 nt, Human
ugaagucuuuguacagacaaca

SEQ ID NO: 1717390 - RNA, 16 nt, Human
ugcacguacacacaca

SEQ ID NO: 1717391 - RNA, 19 nt, Human
ugcacguacacacacauac

SEQ ID NO: 1717392 - RNA, 21 nt, Human
ugcacuugcagacucuacaga

SEQ ID NO: 1717393 - RNA, 16 nt, Human
ugcagauaaacaguag

SEQ ID NO: 1717394 - RNA, 17 nt, Human
ugcagauaaacaguagu

SEQ ID NO: 1717395 - RNA, 20 nt, Human
ugcacuuuguucuggcucuu

SEQ ID NO: 1717396 - RNA, 19 nt, Human
ugcacuuuguucuggcucu

SEQ ID NO: 1717397 - RNA, 18 nt, Human
ugcacuuuguucuggcuc

SEQ ID NO: 1717398 - RNA, 15 nt, Human
ugcacuuuguucugg

SEQ ID NO: 1717399 - RNA, 14 nt, Human
ugcaggaccucagg

SEQ ID NO: 1717400 - RNA, 22 nt, Human
ugcagcuuuaaaaaauuaaucu

SEQ ID NO: 1717401 - RNA, 16 nt, Human
ugcaggaccucaggug

SEQ ID NO: 1717402 - RNA, 15 nt, Human
ugcaggaccucaggu

SEQ ID NO: 1717403 - RNA, 18 nt, Human
ugcaggaccucaggugag

SEQ ID NO: 1717404 - RNA, 14 nt, Human
ugcagcaauaaagc

SEQ ID NO: 1717405 - RNA, 15 nt, Human
ugcagcaauaaagca

SEQ ID NO: 1717406 - RNA, 16 nt, Human
ugcagcaauaaagcag

SEQ ID NO: 1717407 - RNA, 13 nt, Human
ugcagcuuuaaaa

SEQ ID NO: 1717408 - RNA, 19 nt, Human
ugcauguuacauaagauaa

SEQ ID NO: 1717409 - RNA, 19 nt, Human
ugcaggcagccaggccaca

SEQ ID NO: 1717410 - RNA, 18 nt, Human
ugcaggcagccaggccac

SEQ ID NO: 1717411 - RNA, 17 nt, Human
ugcaggcagccaggcca

SEQ ID NO: 1717412 - RNA, 16 nt, Human
ugcaggcagccaggcc

SEQ ID NO: 1717413 - RNA, 15 nt, Human
ugcaucguuucaucu

SEQ ID NO: 1717414 - RNA, 17 nt, Human
ugcaucguuucaucuuc

SEQ ID NO: 1717415 - RNA, 21 nt, Human
ugcauccuccgccucccgggu

SEQ ID NO: 1717416 - RNA, 18 nt, Human
ugcauccuccgccucccg

SEQ ID NO: 1717417 - RNA, 14 nt, Human
ugccagucaccccg

SEQ ID NO: 1717418 - RNA, 22 nt, Human
ugccagggacagaggggguggc

SEQ ID NO: 1717419 - RNA, 11 nt, Human
ugccagggaca

SEQ ID NO: 1717420 - RNA, 10 nt, Human
ugcccagccc

SEQ ID NO: 1717421 - RNA, 19 nt, Human
ugcccaccuggccucugca

SEQ ID NO: 1717422 - RNA, 18 nt, Human
ugcccaccuggccucugc

SEQ ID NO: 1717423 - RNA, 17 nt, Human
ugcccaccuggccucug

SEQ ID NO: 1717424 - RNA, 15 nt, Human
ugcccaccuggccuc

SEQ ID NO: 1717425 - RNA, 16 nt, Human
ugccuccuuugugagg

SEQ ID NO: 1717426 - RNA, 18 nt, Human
ugccuccuuugugaggaa

SEQ ID NO: 1717427 - RNA, 17 nt, Human
ugccuccuuugugagga

SEQ ID NO: 1717428 - RNA, 18 nt, Human
ugccugaagucacacagu

SEQ ID NO: 1717429 - RNA, 22 nt, Human
ugccugaagucacacagugagu

SEQ ID NO: 1717430 - RNA, 19 nt, Human
ugccuaaggcugaacuugu

SEQ ID NO: 1717431 - RNA, 23 nt, Human
ugcccaggcuggcgugcaguggu

SEQ ID NO: 1717432 - RNA, 12 nt, Human
ugcccagccccu

SEQ ID NO: 1717433 - RNA, 11 nt, Human
ugcccagcccc

SEQ ID NO: 1717434 - RNA, 23 nt, Human
ugcggugcuaucucccccagccc

SEQ ID NO: 1717435 - RNA, 13 nt, Human
ugcgccuacagga

SEQ ID NO: 1717436 - RNA, 19 nt, Human
ugcgcaggcuggcccugcc

SEQ ID NO: 1717437 - RNA, 17 nt, Human
ugcgcaggcuggcccug

SEQ ID NO: 1717438 - RNA, 16 nt, Human
ugcgcaggcuggcccu

SEQ ID NO: 1717439 - RNA, 13 nt, Human
ugcgcaggcuggc

SEQ ID NO: 1717440 - RNA, 22 nt, Human
ugccuuauggaacacucugaga

SEQ ID NO: 1717441 - RNA, 21 nt, Human
ugccuuauggaacacucugag

SEQ ID NO: 1717442 - RNA, 20 nt, Human
ugccuuauggaacacucuga

SEQ ID NO: 1717443 - RNA, 18 nt, Human
ugccuuauggaacacucu

SEQ ID NO: 1717444 - RNA, 15 nt, Human
ugccuggcggggugg

SEQ ID NO: 1717445 - RNA, 18 nt, Human
ugccuucagcucuacagc

SEQ ID NO: 1717446 - RNA, 17 nt, Human
ugccuucagcucuacag

SEQ ID NO: 1717447 - RNA, 13 nt, Human
ugccuucagcucu

SEQ ID NO: 1717448 - RNA, 19 nt, Human
ugcugacagacacaggccc

SEQ ID NO: 1717449 - RNA, 16 nt, Human
ugcugacagacacagg

SEQ ID NO: 1717450 - RNA, 15 nt, Human
ugcugacagacacag

SEQ ID NO: 1717451 - RNA, 16 nt, Human
ugcugcaguugccagu

SEQ ID NO: 1717452 - RNA, 15 nt, Human
ugcugcaguugccag

SEQ ID NO: 1717453 - RNA, 23 nt, Human
ugcugauggugcaaugaccuuuc

SEQ ID NO: 1717454 - RNA, 20 nt, Human
ugcugauggugcaaugaccu

SEQ ID NO: 1717455 - RNA, 23 nt, Human
ugcugaauacagaggcaacugca

SEQ ID NO: 1717456 - RNA, 18 nt, Human
ugcugaauacagaggcaa

SEQ ID NO: 1717457 - RNA, 22 nt, Human
ugcugaaugguuuucaaaauaa

SEQ ID NO: 1717458 - RNA, 18 nt, Human
ugcugaaugguuuucaaa

SEQ ID NO: 1717459 - RNA, 17 nt, Human
ugcugaaugguuuucaa

SEQ ID NO: 1717460 - RNA, 19 nt, Human
ugcuccuggcccacugcau

SEQ ID NO: 1717461 - RNA, 19 nt, Human
ugcuagaacucccuuucaa

SEQ ID NO: 1717462 - RNA, 18 nt, Human
ugcuagaacucccuuuca

SEQ ID NO: 1717463 - RNA, 15 nt, Human
ugcgugcauaccacu

SEQ ID NO: 1717464 - RNA, 20 nt, Human
ugcuagaacucccuuucaac

SEQ ID NO: 1717465 - RNA, 21 nt, Human
ugcuagaacucccuuucaaca

SEQ ID NO: 1717466 - RNA, 19 nt, Human
ugcuaggaacacuccuuca

SEQ ID NO: 1717467 - RNA, 17 nt, Human
ugcuaggaacacuccuu

SEQ ID NO: 1717468 - RNA, 16 nt, Human
ugcuaggaacacuccu

SEQ ID NO: 1717469 - RNA, 19 nt, Human
ugcuccucuccccagcaag

SEQ ID NO: 1717470 - RNA, 20 nt, Human
ugcuaggaacacuccuucac

SEQ ID NO: 1717471 - RNA, 14 nt, Human
ugcucaggagcccu

SEQ ID NO: 1717472 - RNA, 16 nt, Human
ugcucagcugucaagg

SEQ ID NO: 1717473 - RNA, 20 nt, Human
ugcucagcugucaaggcuca

SEQ ID NO: 1717474 - RNA, 21 nt, Human
ucuuccacaagagcccaggcc

SEQ ID NO: 1717475 - RNA, 16 nt, Human
ucuucaguaagccgug

SEQ ID NO: 1717476 - RNA, 14 nt, Human
ucuuccaggcuggg

SEQ ID NO: 1717477 - RNA, 13 nt, Human
ucuucuccacugg

SEQ ID NO: 1717478 - RNA, 21 nt, Human
ucuucuccacuuucuagccag

SEQ ID NO: 1717479 - RNA, 19 nt, Human
ucuucuccacuuucuagcc

SEQ ID NO: 1717480 - RNA, 15 nt, Human
ucuucaguaagccgu

SEQ ID NO: 1717481 - RNA, 13 nt, Human
ucuuaugggcugg

SEQ ID NO: 1717482 - RNA, 15 nt, Human
ucuuauacauuugau

SEQ ID NO: 1717483 - RNA, 16 nt, Human
ucuuaguggauguucu

SEQ ID NO: 1717484 - RNA, 14 nt, Human
ucuuagugugugca

SEQ ID NO: 1717485 - RNA, 16 nt, Human
ucuucuccacuggaug

SEQ ID NO: 1717486 - RNA, 12 nt, Human
ucuucuccaggc

SEQ ID NO: 1717487 - RNA, 14 nt, Human
ucuucuccaggcug

SEQ ID NO: 1717488 - RNA, 13 nt, Human
ucuucuccaggcu

SEQ ID NO: 1717489 - RNA, 18 nt, Human
ucuugaacuccuggccuc

SEQ ID NO: 1717490 - RNA, 17 nt, Human
ucuugaacuccuggccu

SEQ ID NO: 1717491 - RNA, 16 nt, Human
ucuugaacuccuggcc

SEQ ID NO: 1717492 - RNA, 15 nt, Human
ucuucuccaggcugu

SEQ ID NO: 1717493 - RNA, 21 nt, Human
ucuugaauuguaaggaaugau

SEQ ID NO: 1717494 - RNA, 16 nt, Human
ucuuguauuaaguugu

SEQ ID NO: 1717495 - RNA, 18 nt, Human
ucuuguauuaaguuguua

SEQ ID NO: 1717496 - RNA, 22 nt, Human
ucuuguauuaaguuguuaauaa

SEQ ID NO: 1717497 - RNA, 11 nt, Human
ucuugcucugc

SEQ ID NO: 1717498 - RNA, 13 nt, Human
ucuugcucugcug

SEQ ID NO: 1717499 - RNA, 12 nt, Human
ucuugcucugcu

SEQ ID NO: 1717500 - RNA, 21 nt, Human
ucuuguuuuuuuuuuccacuu

SEQ ID NO: 1717501 - RNA, 18 nt, Human
ucuuguuuuuuuuuucca

SEQ ID NO: 1717502 - RNA, 22 nt, Human
ucuguggguuucuaaagcugcc

SEQ ID NO: 1717503 - RNA, 19 nt, Human
ucuguccgagcuuugaaaa

SEQ ID NO: 1717504 - RNA, 17 nt, Human
ucuguacgucugacagg

SEQ ID NO: 1717505 - RNA, 23 nt, Human
ucuguggguuucuaaagcugcca

SEQ ID NO: 1717506 - RNA, 18 nt, Human
ucuuaaaaaguggaaaaa

SEQ ID NO: 1717507 - RNA, 19 nt, Human
ucuguuacacuuuuuggaa

SEQ ID NO: 1717508 - RNA, 18 nt, Human
ucuggagguacgaaaaga

SEQ ID NO: 1717509 - RNA, 14 nt, Human
ucuggcuaugcauu

SEQ ID NO: 1717510 - RNA, 17 nt, Human
ucuggcuaugcauuuga

SEQ ID NO: 1717511 - RNA, 23 nt, Human
ucuggagcccacuguacuugcuc

SEQ ID NO: 1717512 - RNA, 23 nt, Human
ucuguacagagcccacgccccca

SEQ ID NO: 1717513 - RNA, 12 nt, Human
ucugggacacag

SEQ ID NO: 1717514 - RNA, 13 nt, Human
ucugggacacagu

SEQ ID NO: 1717515 - RNA, 16 nt, Human
ucuggcucuuccaggc

SEQ ID NO: 1717516 - RNA, 15 nt, Human
ucuggcucuuccagg

SEQ ID NO: 1717517 - RNA, 17 nt, Human
ucuggcucuuccaggcu

SEQ ID NO: 1717518 - RNA, 17 nt, Human
ugaaaggaaagaggcuc

SEQ ID NO: 1717519 - RNA, 12 nt, Human
ugaaaggaaaga

SEQ ID NO: 1717520 - RNA, 18 nt, Human
ugaaagcagggacuugaa

SEQ ID NO: 1717521 - RNA, 19 nt, Human
ugaaagcagggacuugaac

SEQ ID NO: 1717522 - RNA, 23 nt, Human
ugaaagcagggacuugaacccau

SEQ ID NO: 1717523 - RNA, 18 nt, Human
ugaaacccugucucuacu

SEQ ID NO: 1717524 - RNA, 21 nt, Human
ugaaagauggcugugccucug

SEQ ID NO: 1717525 - RNA, 23 nt, Human
ugaaagauggcugugccucugcc

SEQ ID NO: 1717526 - RNA, 22 nt, Human
ugaaagauggcugugccucugc

SEQ ID NO: 1717527 - RNA, 18 nt, Human
ugaaagggcccagagagg

SEQ ID NO: 1717528 - RNA, 17 nt, Human
ugaaagggcccagagag

SEQ ID NO: 1717529 - RNA, 16 nt, Human
ugaaagggcccagaga

SEQ ID NO: 1717530 - RNA, 17 nt, Human
ugaaaucuuuuugcuuu

SEQ ID NO: 1717531 - RNA, 15 nt, Human
ugaaaucauucauuu

SEQ ID NO: 1717532 - RNA, 20 nt, Human
ugaaaugaggucagagccug

SEQ ID NO: 1717533 - RNA, 19 nt, Human
ugaaaugaggucagagccu

SEQ ID NO: 1717534 - RNA, 22 nt, Human
ugaaaugaggucagagccugca

SEQ ID NO: 1717535 - RNA, 21 nt, Human
ugaaaugaggucagagccugc

SEQ ID NO: 1717536 - RNA, 23 nt, Human
ugaaaugaggucagagccugcag

SEQ ID NO: 1717537 - RNA, 17 nt, Human
ucuuucacauuuaaaua

SEQ ID NO: 1717538 - RNA, 17 nt, Human
ucuuuugccguuauuaa

SEQ ID NO: 1717539 - RNA, 19 nt, Human
ucuuuugccguuauuaaaa

SEQ ID NO: 1717540 - RNA, 20 nt, Human
ucuuuugguuaugaauacuu

SEQ ID NO: 1717541 - RNA, 19 nt, Human
ugaaaacuuuaugcuaagu

SEQ ID NO: 1717542 - RNA, 15 nt, Human
ugaaaagaaaaauga

SEQ ID NO: 1717543 - RNA, 13 nt, Human
ugaaaacuuugua

SEQ ID NO: 1717544 - RNA, 16 nt, Human
ugaaaacuuuguagua

SEQ ID NO: 1717545 - RNA, 16 nt, Human
ucuuuuugcuuugcuu

SEQ ID NO: 1717546 - RNA, 22 nt, Human
ugaagacuuuucuuucagccaa

SEQ ID NO: 1717547 - RNA, 17 nt, Human
ugaagacuuuucuuuca

SEQ ID NO: 1717548 - RNA, 14 nt, Human
ugaagacuuuucuu

SEQ ID NO: 1717549 - RNA, 23 nt, Human
ugaacuggguacuuguggacaca

SEQ ID NO: 1717550 - RNA, 22 nt, Human
ugaacuuguaaaggaauuuaaa

SEQ ID NO: 1717551 - RNA, 16 nt, Human
ugaagacagagcuaca

SEQ ID NO: 1717552 - RNA, 14 nt, Human
ugaagacagagcua

SEQ ID NO: 1717553 - RNA, 12 nt, Human
ugaacuugguuc

SEQ ID NO: 1717554 - RNA, 14 nt, Human
ugaacuuggcgcug

SEQ ID NO: 1717555 - RNA, 19 nt, Human
ugaacuggguacuugugga

SEQ ID NO: 1717556 - RNA, 21 nt, Human
ugaaggcucgagcaugccugg

SEQ ID NO: 1717557 - RNA, 20 nt, Human
ugaaggcucgagcaugccug

SEQ ID NO: 1717558 - RNA, 19 nt, Human
ugaaauggacuuuuguaca

SEQ ID NO: 1717559 - RNA, 13 nt, Human
ugaacauuccaga

SEQ ID NO: 1717560 - RNA, 14 nt, Human
ugaacauuccagag

SEQ ID NO: 1717561 - RNA, 15 nt, Human
ugaacauugcaauag

SEQ ID NO: 1717562 - RNA, 17 nt, Human
ugaacauugcaauagaa

SEQ ID NO: 1717563 - RNA, 18 nt, Human
ugaacauugcaauagaaa

SEQ ID NO: 1717564 - RNA, 15 nt, Human
ugaacucuucaaucu

SEQ ID NO: 1717565 - RNA, 22 nt, Human
ugaaccacaucuugcucugcug

SEQ ID NO: 1717566 - RNA, 21 nt, Human
ugaaccacaucuugcucugcu

SEQ ID NO: 1717567 - RNA, 20 nt, Human
ugaaccacaucuugcucugc

SEQ ID NO: 1717568 - RNA, 18 nt, Human
ugaacucuucaaucucuu

SEQ ID NO: 1717569 - RNA, 14 nt, Human
ugaacugaacucug

SEQ ID NO: 1717570 - RNA, 15 nt, Human
ugaacugauaaagau

SEQ ID NO: 1717571 - RNA, 13 nt, Human
ugaacugauaaag

SEQ ID NO: 1717572 - RNA, 19 nt, Human
ugaacugaacucugacaac

SEQ ID NO: 1717573 - RNA, 17 nt, Human
ugaacugaacucugaca

SEQ ID NO: 1717574 - RNA, 15 nt, Human
uccugguguggaaga

SEQ ID NO: 1717575 - RNA, 17 nt, Human
uccuggcccacugcauc

SEQ ID NO: 1717576 - RNA, 22 nt, Human
uccuggcaugggaaugaauguc

SEQ ID NO: 1717577 - RNA, 10 nt, Human
ucccucccuu

SEQ ID NO: 1717578 - RNA, 19 nt, Human
uccuucuguccuacucugu

SEQ ID NO: 1717579 - RNA, 12 nt, Human
uccuucuguccu

SEQ ID NO: 1717580 - RNA, 14 nt, Human
uccuuaccagcaga

SEQ ID NO: 1717581 - RNA, 16 nt, Human
uccuucaaagcaaaug

SEQ ID NO: 1717582 - RNA, 17 nt, Human
ucgaguuacagacaaag

SEQ ID NO: 1717583 - RNA, 15 nt, Human
ucgaguuacagacaa

SEQ ID NO: 1717584 - RNA, 14 nt, Human
ucgagugagacaga

SEQ ID NO: 1717585 - RNA, 23 nt, Human
ucgagugagacagacuagaaguu

SEQ ID NO: 1717586 - RNA, 23 nt, Human
uccuuuuggagucagacagaugu

SEQ ID NO: 1717587 - RNA, 14 nt, Human
uccuuuuggaguca

SEQ ID NO: 1717588 - RNA, 14 nt, Human
ucgcccaggcugga

SEQ ID NO: 1717589 - RNA, 12 nt, Human
ucgcccaggcug

SEQ ID NO: 1717590 - RNA, 19 nt, Human
ucgcccaggcuggagugca

SEQ ID NO: 1717591 - RNA, 17 nt, Human
ucgcaauguaagacucg

SEQ ID NO: 1717592 - RNA, 14 nt, Human
ucucaaacuccuga

SEQ ID NO: 1717593 - RNA, 19 nt, Human
ucucaaagaaauuuccacu

SEQ ID NO: 1717594 - RNA, 21 nt, Human
ucucaaacucuugaccucagg

SEQ ID NO: 1717595 - RNA, 13 nt, Human
ucucaaacucuug

SEQ ID NO: 1717596 - RNA, 22 nt, Human
ucucaaacucuugaccucaggu

SEQ ID NO: 1717597 - RNA, 17 nt, Human
ucucaaagaaauuucca

SEQ ID NO: 1717598 - RNA, 21 nt, Human
ucucagaaucucaaauaacua

SEQ ID NO: 1717599 - RNA, 17 nt, Human
ucucagaaucucaaaua

SEQ ID NO: 1717600 - RNA, 17 nt, Human
ucucacucugucgccca

SEQ ID NO: 1717601 - RNA, 22 nt, Human
ucucacucugucgcccagucug

SEQ ID NO: 1717602 - RNA, 18 nt, Human
ucucacucugucgcccag

SEQ ID NO: 1717603 - RNA, 21 nt, Human
ucucacuguugcccaggcugg

SEQ ID NO: 1717604 - RNA, 20 nt, Human
ucucacuguugcccaggcug

SEQ ID NO: 1717605 - RNA, 19 nt, Human
ucucacuguugcccaggcu

SEQ ID NO: 1717606 - RNA, 18 nt, Human
ucucacuguugcccaggc

SEQ ID NO: 1717607 - RNA, 17 nt, Human
ucuacacuccagugaga

SEQ ID NO: 1717608 - RNA, 14 nt, Human
ucuacacugugcug

SEQ ID NO: 1717609 - RNA, 12 nt, Human
ucuacacugugc

SEQ ID NO: 1717610 - RNA, 19 nt, Human
ucuacugaggugcuauguu

SEQ ID NO: 1717611 - RNA, 18 nt, Human
ucuacugaggugcuaugu

SEQ ID NO: 1717612 - RNA, 15 nt, Human
ucuacacugugcuga

SEQ ID NO: 1717613 - RNA, 21 nt, Human
ucuacacugugcugagucuga

SEQ ID NO: 1717614 - RNA, 22 nt, Human
ucuagggaaaaaccagcgugug

SEQ ID NO: 1717615 - RNA, 22 nt, Human
ucuacugaggugcuauguucuu

SEQ ID NO: 1717616 - RNA, 22 nt, Human
ucuaacuucaccauauuaccac

SEQ ID NO: 1717617 - RNA, 15 nt, Human
ucuaacuucaccaua

SEQ ID NO: 1717618 - RNA, 16 nt, Human
ucuaacuucaccauau

SEQ ID NO: 1717619 - RNA, 11 nt, Human
ucucugcaggu

SEQ ID NO: 1717620 - RNA, 18 nt, Human
ucucuucacagucacauu

SEQ ID NO: 1717621 - RNA, 11 nt, Human
ucucuucucca

SEQ ID NO: 1717622 - RNA, 16 nt, Human
ucucuucuccacugga

SEQ ID NO: 1717623 - RNA, 15 nt, Human
ucucuucuccacugg

SEQ ID NO: 1717624 - RNA, 14 nt, Human
ucucuucuccacug

SEQ ID NO: 1717625 - RNA, 13 nt, Human
ucucuucuccacu

SEQ ID NO: 1717626 - RNA, 16 nt, Human
ucugaaaauguaugug

SEQ ID NO: 1717627 - RNA, 16 nt, Human
ucucuuuucaaaacau

SEQ ID NO: 1717628 - RNA, 15 nt, Human
ucucuuuucaaaaca

SEQ ID NO: 1717629 - RNA, 17 nt, Human
ucucuuuguucuaaaga

SEQ ID NO: 1717630 - RNA, 13 nt, Human
ucugaaagggacg

SEQ ID NO: 1717631 - RNA, 23 nt, Human
ucugaaaauguauguguaaguau

SEQ ID NO: 1717632 - RNA, 14 nt, Human
ucugaggacaagag

SEQ ID NO: 1717633 - RNA, 17 nt, Human
ucugaggacaagagaaa

SEQ ID NO: 1717634 - RNA, 23 nt, Human
ucugaggacacuaaccacgcugg

SEQ ID NO: 1717635 - RNA, 20 nt, Human
ucugaggacacuaaccacgc

SEQ ID NO: 1717636 - RNA, 17 nt, Human
ucugaggaauccagacc

SEQ ID NO: 1717637 - RNA, 16 nt, Human
ucugaggaauccagac

SEQ ID NO: 1717638 - RNA, 22 nt, Human
ucugagcauuagauuucucauu

SEQ ID NO: 1717639 - RNA, 14 nt, Human
ucugcacaagcugc

SEQ ID NO: 1717640 - RNA, 19 nt, Human
ucugcacaagcugcacccu

SEQ ID NO: 1717641 - RNA, 23 nt, Human
ucugauucccaagcucugcuccu

SEQ ID NO: 1717642 - RNA, 18 nt, Human
ucugaggacaagagaaaa

SEQ ID NO: 1717643 - RNA, 20 nt, Human
ucugaacuuggcgcugcccc

SEQ ID NO: 1717644 - RNA, 21 nt, Human
ucugaacuuggcgcugccccu

SEQ ID NO: 1717645 - RNA, 14 nt, Human
ucugacccaugcug

SEQ ID NO: 1717646 - RNA, 18 nt, Human
ucugacccaugcugcccu

SEQ ID NO: 1717647 - RNA, 17 nt, Human
ucugacccaugcugccc

SEQ ID NO: 1717648 - RNA, 16 nt, Human
ucugacccaugcugcc

SEQ ID NO: 1717649 - RNA, 15 nt, Human
ucugacccaugcugc

SEQ ID NO: 1717650 - RNA, 20 nt, Human
ucugagcauuagauuucuca

SEQ ID NO: 1717651 - RNA, 21 nt, Human
ucucagugucaaugcagcccc

SEQ ID NO: 1717652 - RNA, 15 nt, Human
ucucaggucccugca

SEQ ID NO: 1717653 - RNA, 17 nt, Human
ucucccccagccccauc

SEQ ID NO: 1717654 - RNA, 15 nt, Human
ucucccccagcccca

SEQ ID NO: 1717655 - RNA, 14 nt, Human
ucucccccagcccc

SEQ ID NO: 1717656 - RNA, 20 nt, Human
ucucccccagccccauccuc

SEQ ID NO: 1717657 - RNA, 18 nt, Human
ucucccccagccccaucc

SEQ ID NO: 1717658 - RNA, 22 nt, Human
ucucccccagccccauccucug

SEQ ID NO: 1717659 - RNA, 22 nt, Human
ucuccugccucagccucccaaa

SEQ ID NO: 1717660 - RNA, 18 nt, Human
ucucuaguuugauuaaau

SEQ ID NO: 1717661 - RNA, 19 nt, Human
ucucuaguuugauuaaauu

SEQ ID NO: 1717662 - RNA, 15 nt, Human
ucucuacaaaaagca

SEQ ID NO: 1717663 - RNA, 13 nt, Human
ucuccuguaccuc

SEQ ID NO: 1717664 - RNA, 21 nt, Human
ucucuacugucucaguuuaca

SEQ ID NO: 1717665 - RNA, 13 nt, Human
ucucugaggacac

SEQ ID NO: 1717666 - RNA, 14 nt, Human
ucucugaggacacu

SEQ ID NO: 1717667 - RNA, 15 nt, Human
ucucucgugaguaua

SEQ ID NO: 1717668 - RNA, 18 nt, Human
uccccuguuuguuucuga

SEQ ID NO: 1717669 - RNA, 22 nt, Human
uccccuuccuaauuccacagcu

SEQ ID NO: 1717670 - RNA, 21 nt, Human
uccccuuccuaauuccacagc

SEQ ID NO: 1717671 - RNA, 12 nt, Human
ucccuaauaaag

SEQ ID NO: 1717672 - RNA, 11 nt, Human
ucccuaauaaa

SEQ ID NO: 1717673 - RNA, 15 nt, Human
ucccucccucuuucc

SEQ ID NO: 1717674 - RNA, 16 nt, Human
ucccuacuuccuguga

SEQ ID NO: 1717675 - RNA, 15 nt, Human
ucccuacuuccugug

SEQ ID NO: 1717676 - RNA, 17 nt, Human
ucccucccucuuucccu

SEQ ID NO: 1717677 - RNA, 15 nt, Human
ucccuacuguaauuu

SEQ ID NO: 1717678 - RNA, 13 nt, Human
ucccuaauaaagc

SEQ ID NO: 1717679 - RNA, 21 nt, Human
uccccugcuggguguggcgca

SEQ ID NO: 1717680 - RNA, 20 nt, Human
uccccugcuggguguggcgc

SEQ ID NO: 1717681 - RNA, 15 nt, Human
uccccugcugggugu

SEQ ID NO: 1717682 - RNA, 14 nt, Human
uccccugcugggug

SEQ ID NO: 1717683 - RNA, 23 nt, Human
uccccuguccccgcacugggcuu

SEQ ID NO: 1717684 - RNA, 22 nt, Human
uccccuguagagugggagcuga

SEQ ID NO: 1717685 - RNA, 15 nt, Human
uccccuguucacucu

SEQ ID NO: 1717686 - RNA, 19 nt, Human
uccccuguagagugggagc

SEQ ID NO: 1717687 - RNA, 24 nt, Human
uccccugcuggguguggcgcagca

SEQ ID NO: 1717688 - RNA, 21 nt, Human
ucccccuuccauggacuuugu

SEQ ID NO: 1717689 - RNA, 20 nt, Human
uccccgcacugggcuugggg

SEQ ID NO: 1717690 - RNA, 13 nt, Human
uccccaggaggcc

SEQ ID NO: 1717691 - RNA, 15 nt, Human
uccccagcuguuuau

SEQ ID NO: 1717692 - RNA, 14 nt, Human
uccccagcuguuua

SEQ ID NO: 1717693 - RNA, 13 nt, Human
ucccccucuggcu

SEQ ID NO: 1717694 - RNA, 13 nt, Human
ucccccugcccca

SEQ ID NO: 1717695 - RNA, 17 nt, Human
ucccccaucucuucugg

SEQ ID NO: 1717696 - RNA, 23 nt, Human
ucccaucucacacaugagcauca

SEQ ID NO: 1717697 - RNA, 20 nt, Human
ucccaucucacacaugagca

SEQ ID NO: 1717698 - RNA, 18 nt, Human
ucccaggcugagccucag

SEQ ID NO: 1717699 - RNA, 16 nt, Human
ucccaggcugagccuc

SEQ ID NO: 1717700 - RNA, 21 nt, Human
ucccaucugugaaaggaaaga

SEQ ID NO: 1717701 - RNA, 12 nt, Human
ucccaugcccug

SEQ ID NO: 1717702 - RNA, 22 nt, Human
ucccaggcauuccccaggaggc

SEQ ID NO: 1717703 - RNA, 23 nt, Human
ucccaggcauuccccaggaggcc

SEQ ID NO: 1717704 - RNA, 15 nt, Human
ucccaggcugagccu

SEQ ID NO: 1717705 - RNA, 21 nt, Human
ucccaggcgccccuucccccu

SEQ ID NO: 1717706 - RNA, 18 nt, Human
ucccaggcgccccuuccc

SEQ ID NO: 1717707 - RNA, 20 nt, Human
ucccaggcgccccuuccccc

SEQ ID NO: 1717708 - RNA, 21 nt, Human
ucccaggcauuccccaggagg

SEQ ID NO: 1717709 - RNA, 20 nt, Human
ucccaggcauuccccaggag

SEQ ID NO: 1717710 - RNA, 15 nt, Human
ucccaccucagccuc

SEQ ID NO: 1717711 - RNA, 14 nt, Human
ucccaccucagccu

SEQ ID NO: 1717712 - RNA, 13 nt, Human
ucccaccucagcc

SEQ ID NO: 1717713 - RNA, 22 nt, Human
ucccaaggcucugagcaaaugu

SEQ ID NO: 1717714 - RNA, 13 nt, Human
ucccaacucaccc

SEQ ID NO: 1717715 - RNA, 15 nt, Human
ucccaacucacccca

SEQ ID NO: 1717716 - RNA, 14 nt, Human
ucccaacucacccc

SEQ ID NO: 1717717 - RNA, 16 nt, Human
ucccaacucaccccag

SEQ ID NO: 1717718 - RNA, 15 nt, Human
ucccaagcucugcuc

SEQ ID NO: 1717719 - RNA, 14 nt, Human
ucccaagcucugcu

SEQ ID NO: 1717720 - RNA, 13 nt, Human
ucccaagcucugc

SEQ ID NO: 1717721 - RNA, 12 nt, Human
ucccaagcucug

SEQ ID NO: 1717722 - RNA, 17 nt, Human
ucccaagcucugcuccu

SEQ ID NO: 1717723 - RNA, 18 nt, Human
ucccaaggcucugagcaa

SEQ ID NO: 1717724 - RNA, 23 nt, Human
uccagcucaccagccccagugcc

SEQ ID NO: 1717725 - RNA, 16 nt, Human
uccauccaggccauuc

SEQ ID NO: 1717726 - RNA, 15 nt, Human
uccauggacuuuguu

SEQ ID NO: 1717727 - RNA, 14 nt, Human
uccauggacuuugu

SEQ ID NO: 1717728 - RNA, 16 nt, Human
uccaaaauaaaacuuu

SEQ ID NO: 1717729 - RNA, 17 nt, Human
uccaaaauaaaacuuuu

SEQ ID NO: 1717730 - RNA, 19 nt, Human
uccaaacuaccuuccaguu

SEQ ID NO: 1717731 - RNA, 13 nt, Human
uccaagcaaaugu

SEQ ID NO: 1717732 - RNA, 19 nt, Human
uccaagaccuucuccuuca

SEQ ID NO: 1717733 - RNA, 20 nt, Human
uccaagaagcccaggaaagg

SEQ ID NO: 1717734 - RNA, 22 nt, Human
uccaagaagcccaggaaaggcu

SEQ ID NO: 1717735 - RNA, 23 nt, Human
uccagccaaagccuccuccagcc

SEQ ID NO: 1717736 - RNA, 14 nt, Human
uccacuuggucugu

SEQ ID NO: 1717737 - RNA, 12 nt, Human
uccacuuggucu

SEQ ID NO: 1717738 - RNA, 13 nt, Human
uccacuuggucug

SEQ ID NO: 1717739 - RNA, 13 nt, Human
uccaccugccagg

SEQ ID NO: 1717740 - RNA, 14 nt, Human
uccaccuacaugag

SEQ ID NO: 1717741 - RNA, 12 nt, Human
uccaccugccag

SEQ ID NO: 1717742 - RNA, 14 nt, Human
uccacaacacacag

SEQ ID NO: 1717743 - RNA, 14 nt, Human
uccacaagagccca

SEQ ID NO: 1717744 - RNA, 15 nt, Human
uccacaagagcccag

SEQ ID NO: 1717745 - RNA, 18 nt, Human
ucauuaggugugacugaa

SEQ ID NO: 1717746 - RNA, 21 nt, Human
ucauuaggugugacugaauuu

SEQ ID NO: 1717747 - RNA, 22 nt, Human
ucauuaggugugacugaauuuc

SEQ ID NO: 1717748 - RNA, 16 nt, Human
ucauuaggugugacug

SEQ ID NO: 1717749 - RNA, 15 nt, Human
ucauacccaccccca

SEQ ID NO: 1717750 - RNA, 14 nt, Human
ucauacccaccccc

SEQ ID NO: 1717751 - RNA, 20 nt, Human
ucauacccacccccacccaa

SEQ ID NO: 1717752 - RNA, 21 nt, Human
ucauacccacccccacccaag

SEQ ID NO: 1717753 - RNA, 15 nt, Human
ucaguuacucuucag

SEQ ID NO: 1717754 - RNA, 13 nt, Human
ucauaaugacuua

SEQ ID NO: 1717755 - RNA, 17 nt, Human
ucaguuguuaguguguc

SEQ ID NO: 1717756 - RNA, 15 nt, Human
ucauaauuauuauuu

SEQ ID NO: 1717757 - RNA, 13 nt, Human
ucauacccacccc

SEQ ID NO: 1717758 - RNA, 17 nt, Human
ucagugugacugaucuc

SEQ ID NO: 1717759 - RNA, 13 nt, Human
ucagugugacuga

SEQ ID NO: 1717760 - RNA, 11 nt, Human
ucaguguacau

SEQ ID NO: 1717761 - RNA, 23 nt, Human
ucagugguuggcaauuguuucaa

SEQ ID NO: 1717762 - RNA, 15 nt, Human
ucagucuggcccuuc

SEQ ID NO: 1717763 - RNA, 20 nt, Human
ucaguggggcccauggaugu

SEQ ID NO: 1717764 - RNA, 24 nt, Human
ucagucugauucccaagcucugcu

SEQ ID NO: 1717765 - RNA, 22 nt, Human
ucacuuuuauuuagcaccaggg

SEQ ID NO: 1717766 - RNA, 12 nt, Human
ucacuuuuauuu

SEQ ID NO: 1717767 - RNA, 15 nt, Human
ucacugcuuaacuuc

SEQ ID NO: 1717768 - RNA, 17 nt, Human
ucacugcuuaacuucac

SEQ ID NO: 1717769 - RNA, 18 nt, Human
ucacugcuuaacuucaca

SEQ ID NO: 1717770 - RNA, 20 nt, Human
ucacugcuuaacuucacaua

SEQ ID NO: 1717771 - RNA, 16 nt, Human
ucacucugucgcccag

SEQ ID NO: 1717772 - RNA, 12 nt, Human
ucacucugucgc

SEQ ID NO: 1717773 - RNA, 19 nt, Human
ucacucugucgcccagucu

SEQ ID NO: 1717774 - RNA, 22 nt, Human
ucacucugucgcccagucugga

SEQ ID NO: 1717775 - RNA, 22 nt, Human
ucagaguugaugguuguacaua

SEQ ID NO: 1717776 - RNA, 21 nt, Human
ucagaggggaauaaacuguug

SEQ ID NO: 1717777 - RNA, 19 nt, Human
ucagcacgauuucuguuua

SEQ ID NO: 1717778 - RNA, 22 nt, Human
ucagacauagaauuaacacaug

SEQ ID NO: 1717779 - RNA, 19 nt, Human
ucagacauagaauuaacac

SEQ ID NO: 1717780 - RNA, 20 nt, Human
ucagacagcugccugggauc

SEQ ID NO: 1717781 - RNA, 19 nt, Human
ucagacagcugccugggau

SEQ ID NO: 1717782 - RNA, 18 nt, Human
ucagacagcugccuggga

SEQ ID NO: 1717783 - RNA, 17 nt, Human
ucagacagcugccuggg

SEQ ID NO: 1717784 - RNA, 16 nt, Human
ucagacagcugccugg

SEQ ID NO: 1717785 - RNA, 15 nt, Human
ucagacagcugccug

SEQ ID NO: 1717786 - RNA, 20 nt, Human
ucacucuacuuagcaugucc

SEQ ID NO: 1717787 - RNA, 19 nt, Human
ucacucuacuuagcauguc

SEQ ID NO: 1717788 - RNA, 14 nt, Human
ucacucuccuuggu

SEQ ID NO: 1717789 - RNA, 12 nt, Human
ucacucuccuug

SEQ ID NO: 1717790 - RNA, 13 nt, Human
ucacucuggcagc

SEQ ID NO: 1717791 - RNA, 12 nt, Human
ucacucuggcag

SEQ ID NO: 1717792 - RNA, 23 nt, Human
ucacucuccuuggugucgggcau

SEQ ID NO: 1717793 - RNA, 22 nt, Human
ucacucuggcagcucagagagg

SEQ ID NO: 1717794 - RNA, 20 nt, Human
ucacucuggcagcucagaga

SEQ ID NO: 1717795 - RNA, 19 nt, Human
ucacucuggcagcucagag

SEQ ID NO: 1717796 - RNA, 18 nt, Human
ucacucuggcagcucaga

SEQ ID NO: 1717797 - RNA, 17 nt, Human
ucacucuggcagcucag

SEQ ID NO: 1717798 - RNA, 16 nt, Human
ucacucuggcagcuca

SEQ ID NO: 1717799 - RNA, 15 nt, Human
ucacucuggcagcuc

SEQ ID NO: 1717800 - RNA, 14 nt, Human
ucacucuggcagcu

SEQ ID NO: 1717801 - RNA, 13 nt, Human
ucacuccuugaaa

SEQ ID NO: 1717802 - RNA, 18 nt, Human
ucacuccuaccugguaau

SEQ ID NO: 1717803 - RNA, 17 nt, Human
ucacggaagagccuugc

SEQ ID NO: 1717804 - RNA, 16 nt, Human
ucacggaagagccuug

SEQ ID NO: 1717805 - RNA, 14 nt, Human
ucacggaagagccu

SEQ ID NO: 1717806 - RNA, 20 nt, Human
ucacggcucacugcagccuc

SEQ ID NO: 1717807 - RNA, 15 nt, Human
ucacggcucacugca

SEQ ID NO: 1717808 - RNA, 13 nt, Human
ucacggcucacug

SEQ ID NO: 1717809 - RNA, 12 nt, Human
ucaccuuugucc

SEQ ID NO: 1717810 - RNA, 14 nt, Human
ucaccuuucccauc

SEQ ID NO: 1717811 - RNA, 13 nt, Human
ucaccuuuauucu

SEQ ID NO: 1717812 - RNA, 15 nt, Human
ucacaggcaggucca

SEQ ID NO: 1717813 - RNA, 12 nt, Human
ucacaggcaggu

SEQ ID NO: 1717814 - RNA, 22 nt, Human
ucaccuuuguccccaccgcaga

SEQ ID NO: 1717815 - RNA, 18 nt, Human
ucaccuuuguccccaccg

SEQ ID NO: 1717816 - RNA, 17 nt, Human
ucaccuuuguccccacc

SEQ ID NO: 1717817 - RNA, 15 nt, Human
ucaccuuugucccca

SEQ ID NO: 1717818 - RNA, 14 nt, Human
ucaccuuugucccc

SEQ ID NO: 1717819 - RNA, 20 nt, Human
ucacgccuguaauccuagca

SEQ ID NO: 1717820 - RNA, 19 nt, Human
ucacgccuguaauccuagc

SEQ ID NO: 1717821 - RNA, 14 nt, Human
ucacgccacugcac

SEQ ID NO: 1717822 - RNA, 13 nt, Human
ucacgccacugca

SEQ ID NO: 1717823 - RNA, 16 nt, Human
ucacgccacugcacua

SEQ ID NO: 1717824 - RNA, 23 nt, Human
uauuuauuaaaugcccagccccu

SEQ ID NO: 1717825 - RNA, 20 nt, Human
uaucugaaaauguaugugua

SEQ ID NO: 1717826 - RNA, 15 nt, Human
uaucugaaaauguau

SEQ ID NO: 1717827 - RNA, 14 nt, Human
uaucugaaaaugua

SEQ ID NO: 1717828 - RNA, 16 nt, Human
uauuuuauguugcaua

SEQ ID NO: 1717829 - RNA, 15 nt, Human
uauuuuauguugcau

SEQ ID NO: 1717830 - RNA, 21 nt, Human
uauuuucaacgcagcccugcu

SEQ ID NO: 1717831 - RNA, 23 nt, Human
ucaaacggccucacuaggcuucu

SEQ ID NO: 1717832 - RNA, 22 nt, Human
ucaaaacgguuuuacugcagcu

SEQ ID NO: 1717833 - RNA, 14 nt, Human
ucaaacucuuaaaa

SEQ ID NO: 1717834 - RNA, 16 nt, Human
ucaaacgugaaaaugc

SEQ ID NO: 1717835 - RNA, 15 nt, Human
ucaaacgugaaaaug

SEQ ID NO: 1717836 - RNA, 15 nt, Human
uauuuuuuuacuaau

SEQ ID NO: 1717837 - RNA, 22 nt, Human
uauuuuuuucugaauuauuuuc

SEQ ID NO: 1717838 - RNA, 15 nt, Human
ucaaaaacauucuua

SEQ ID NO: 1717839 - RNA, 14 nt, Human
ucaaccuccugggc

SEQ ID NO: 1717840 - RNA, 13 nt, Human
ucaaccuccuggg

SEQ ID NO: 1717841 - RNA, 15 nt, Human
ucaaacuuuacuaug

SEQ ID NO: 1717842 - RNA, 13 nt, Human
ucaaacuuuacua

SEQ ID NO: 1717843 - RNA, 22 nt, Human
ucaaacucuugaccucagguga

SEQ ID NO: 1717844 - RNA, 16 nt, Human
ucaaacuuuacuaugg

SEQ ID NO: 1717845 - RNA, 22 nt, Human
ucaagugauucuccugccucag

SEQ ID NO: 1717846 - RNA, 20 nt, Human
ucaaggauccugagccagau

SEQ ID NO: 1717847 - RNA, 23 nt, Human
ucaaggauccugagccagauuuc

SEQ ID NO: 1717848 - RNA, 19 nt, Human
ucaaggauccugagccaga

SEQ ID NO: 1717849 - RNA, 18 nt, Human
ucaaggauccugagccag

SEQ ID NO: 1717850 - RNA, 17 nt, Human
ucaagcgauucuucugc

SEQ ID NO: 1717851 - RNA, 16 nt, Human
ucaagcgauucuucug

SEQ ID NO: 1717852 - RNA, 11 nt, Human
ucacaggcagg

SEQ ID NO: 1717853 - RNA, 19 nt, Human
ucacaggaaguagaggagg

SEQ ID NO: 1717854 - RNA, 23 nt, Human
ucacacagugagucgaggacagg

SEQ ID NO: 1717855 - RNA, 22 nt, Human
ucacacagugagucgaggacag

SEQ ID NO: 1717856 - RNA, 21 nt, Human
ucacacaugagcaucaggcca

SEQ ID NO: 1717857 - RNA, 13 nt, Human
ucacacagugagu

SEQ ID NO: 1717858 - RNA, 22 nt, Human
ucacacaguauuacuucugcua

SEQ ID NO: 1717859 - RNA, 21 nt, Human
ucacacaguauuacuucugcu

SEQ ID NO: 1717860 - RNA, 20 nt, Human
ucaauuacaggaaguacugg

SEQ ID NO: 1717861 - RNA, 19 nt, Human
ucaauuacaggaaguacug

SEQ ID NO: 1717862 - RNA, 17 nt, Human
ucaaugcuauaacuaug

SEQ ID NO: 1717863 - RNA, 18 nt, Human
ucaaugcacugacauugu

SEQ ID NO: 1717864 - RNA, 18 nt, Human
ucaauuacaggaaguacu

SEQ ID NO: 1717865 - RNA, 13 nt, Human
ucaauuacaggaa

SEQ ID NO: 1717866 - RNA, 14 nt, Human
ucaaugcacugaca

SEQ ID NO: 1717867 - RNA, 14 nt, Human
ucaauaggaaaaac

SEQ ID NO: 1717868 - RNA, 17 nt, Human
ucaauaggaaaaacuga

SEQ ID NO: 1717869 - RNA, 13 nt, Human
ucaauaggaaaaa

SEQ ID NO: 1717870 - RNA, 12 nt, Human
guuuuucaguuu

SEQ ID NO: 1717871 - RNA, 14 nt, Human
guuuuucaguuuuc

SEQ ID NO: 1717872 - RNA, 11 nt, Human
uaaaaaacacu

SEQ ID NO: 1717873 - RNA, 23 nt, Human
uaaaaaacugcugacuguuuucu

SEQ ID NO: 1717874 - RNA, 20 nt, Human
uaaaaaacugcugacuguuu

SEQ ID NO: 1717875 - RNA, 12 nt, Human
uaaaaaacacug

SEQ ID NO: 1717876 - RNA, 16 nt, Human
guuuguugugaggauu

SEQ ID NO: 1717877 - RNA, 16 nt, Human
guuuucaguguacaug

SEQ ID NO: 1717878 - RNA, 17 nt, Human
guuuucaguguacaugg

SEQ ID NO: 1717879 - RNA, 19 nt, Human
guuuucucuugagagggug

SEQ ID NO: 1717880 - RNA, 12 nt, Human
guuuucucuuga

SEQ ID NO: 1717881 - RNA, 19 nt, Human
guuuuuauggcuuuugugc

SEQ ID NO: 1717882 - RNA, 22 nt, Human
guuuuuauggcuuuugugcauu

SEQ ID NO: 1717883 - RNA, 23 nt, Human
guuuuuauggcuuuugugcauua

SEQ ID NO: 1717884 - RNA, 16 nt, Human
guuuaguaaucauauu

SEQ ID NO: 1717885 - RNA, 13 nt, Human
guuuagaaagcuu

SEQ ID NO: 1717886 - RNA, 17 nt, Human
guuuagaaagcuugccc

SEQ ID NO: 1717887 - RNA, 21 nt, Human
gguuggccccugcccggcugc

SEQ ID NO: 1717888 - RNA, 14 nt, Human
guuucagaaaugug

SEQ ID NO: 1717889 - RNA, 18 nt, Human
guuucagaaauguguuau

SEQ ID NO: 1717890 - RNA, 20 nt, Human
guuuccuggcacugcuucca

SEQ ID NO: 1717891 - RNA, 16 nt, Human
guuuccuggcacugcu

SEQ ID NO: 1717892 - RNA, 17 nt, Human
guuuccugcccugggag

SEQ ID NO: 1717893 - RNA, 13 nt, Human
guuuccugcccug

SEQ ID NO: 1717894 - RNA, 22 nt, Human
guuuccuggcacugcuuccagu

SEQ ID NO: 1717895 - RNA, 21 nt, Human
guuuccuggcacugcuuccag

SEQ ID NO: 1717896 - RNA, 16 nt, Human
guuuccuuauauuaug

SEQ ID NO: 1717897 - RNA, 22 nt, Human
guuuccugcccugggaggcagu

SEQ ID NO: 1717898 - RNA, 19 nt, Human
guuuguggaaaaugaaaau

SEQ ID NO: 1717899 - RNA, 18 nt, Human
guuuguuccccaagacau

SEQ ID NO: 1717900 - RNA, 17 nt, Human
guuuguaaauuaacuuu

SEQ ID NO: 1717901 - RNA, 19 nt, Human
guuuguaaauuaacuuuua

SEQ ID NO: 1717902 - RNA, 20 nt, Human
guuuguaaauuaacuuuuau

SEQ ID NO: 1717903 - RNA, 17 nt, Human
guuugauuaaauucuug

SEQ ID NO: 1717904 - RNA, 19 nt, Human
guuugauuaaauucuugca

SEQ ID NO: 1717905 - RNA, 22 nt, Human
guuugauuaaauucuugcaaag

SEQ ID NO: 1717906 - RNA, 15 nt, Human
guuucuaaagcugcc

SEQ ID NO: 1717907 - RNA, 14 nt, Human
guuucuaaagcugc

SEQ ID NO: 1717908 - RNA, 16 nt, Human
guuucuaaagcugcca

SEQ ID NO: 1717909 - RNA, 20 nt, Human
guuucuaaagcugccagccg

SEQ ID NO: 1717910 - RNA, 16 nt, Human
guuugaaccaagaacu

SEQ ID NO: 1717911 - RNA, 17 nt, Human
guuucuuuguaaugaaa

SEQ ID NO: 1717912 - RNA, 14 nt, Human
guuucuuuguaaug

SEQ ID NO: 1717913 - RNA, 19 nt, Human
guuucuuucucugaggaca

SEQ ID NO: 1717914 - RNA, 20 nt, Human
guuucuuucucugaggacaa

SEQ ID NO: 1717915 - RNA, 21 nt, Human
uaaacacucuugaaaaaugca

SEQ ID NO: 1717916 - RNA, 23 nt, Human
uaaacaagaccacguuucuaaag

SEQ ID NO: 1717917 - RNA, 19 nt, Human
uaaacaagaccacguuucu

SEQ ID NO: 1717918 - RNA, 18 nt, Human
uaaacaagaccacguuuc

SEQ ID NO: 1717919 - RNA, 21 nt, Human
uaaacugcccccucugcccug

SEQ ID NO: 1717920 - RNA, 20 nt, Human
uaaacugcccccucugcccu

SEQ ID NO: 1717921 - RNA, 23 nt, Human
uaaacugcccccucugcccugcg

SEQ ID NO: 1717922 - RNA, 22 nt, Human
uaaacugcccccucugcccugc

SEQ ID NO: 1717923 - RNA, 22 nt, Human
uaaacuuuaccuuuuuuauaca

SEQ ID NO: 1717924 - RNA, 16 nt, Human
uaaacuuuaccuuuuu

SEQ ID NO: 1717925 - RNA, 14 nt, Human
uaaacuuaaucuaa

SEQ ID NO: 1717926 - RNA, 13 nt, Human
uaaacuuaaucua

SEQ ID NO: 1717927 - RNA, 18 nt, Human
uaaacuuaaucuaaaugg

SEQ ID NO: 1717928 - RNA, 19 nt, Human
uaaacuuaaucuaaaugga

SEQ ID NO: 1717929 - RNA, 16 nt, Human
uaaaaugagaaaucua

SEQ ID NO: 1717930 - RNA, 15 nt, Human
uaaaaugagaaaucu

SEQ ID NO: 1717931 - RNA, 13 nt, Human
uaaaaugagaaau

SEQ ID NO: 1717932 - RNA, 15 nt, Human
uaaaaaugguuuaaa

SEQ ID NO: 1717933 - RNA, 21 nt, Human
uaaaagggacugagaaauuua

SEQ ID NO: 1717934 - RNA, 20 nt, Human
uaaaagggacugagaaauuu

SEQ ID NO: 1717935 - RNA, 19 nt, Human
uaaaagggacugagaaauu

SEQ ID NO: 1717936 - RNA, 17 nt, Human
uaaaagggacugagaaa

SEQ ID NO: 1717937 - RNA, 14 nt, Human
uaaaagcauuuugu

SEQ ID NO: 1717938 - RNA, 15 nt, Human
uaaaagcauuuugua

SEQ ID NO: 1717939 - RNA, 16 nt, Human
uaaaagcauuuuguaa

SEQ ID NO: 1717940 - RNA, 17 nt, Human
uaaaagcauuuuguaau

SEQ ID NO: 1717941 - RNA, 18 nt, Human
uaaaagcauuuuguaaua

SEQ ID NO: 1717942 - RNA, 14 nt, Human
uaaaggaauuuaaa

SEQ ID NO: 1717943 - RNA, 14 nt, Human
uaaagcuagaaaug

SEQ ID NO: 1717944 - RNA, 15 nt, Human
uaaagcuagaaauga

SEQ ID NO: 1717945 - RNA, 20 nt, Human
uaaacuuuuuucuuacuguc

SEQ ID NO: 1717946 - RNA, 17 nt, Human
uaaauaaaaauaauccu

SEQ ID NO: 1717947 - RNA, 13 nt, Human
uaaaguuucuguu

SEQ ID NO: 1717948 - RNA, 14 nt, Human
uaaaguuuguugaa

SEQ ID NO: 1717949 - RNA, 22 nt, Human
uaaaguguauuuuuuuacuaau

SEQ ID NO: 1717950 - RNA, 23 nt, Human
uaaaguguauuuuuuuacuaaua

SEQ ID NO: 1717951 - RNA, 21 nt, Human
uaaaguguauuuuuuuacuaa

SEQ ID NO: 1717952 - RNA, 18 nt, Human
uaaauauaugcuaagucu

SEQ ID NO: 1717953 - RNA, 22 nt, Human
uaaauauauuuuaagacgaaac

SEQ ID NO: 1717954 - RNA, 16 nt, Human
uaaauauauuuuaaga

SEQ ID NO: 1717955 - RNA, 19 nt, Human
uaaaucagccguguaacca

SEQ ID NO: 1717956 - RNA, 20 nt, Human
uaaaucagacuaugaaguuu

SEQ ID NO: 1717957 - RNA, 19 nt, Human
uaaaucaaguuggcuucua

SEQ ID NO: 1717958 - RNA, 15 nt, Human
uaaauugcuccuuga

SEQ ID NO: 1717959 - RNA, 14 nt, Human
uaacagaaauguac

SEQ ID NO: 1717960 - RNA, 15 nt, Human
uaacagaaauguaca

SEQ ID NO: 1717961 - RNA, 13 nt, Human
uaacagaaaugua

SEQ ID NO: 1717962 - RNA, 19 nt, Human
uaacaggcagauacaggaa

SEQ ID NO: 1717963 - RNA, 14 nt, Human
uaaccagcagaaau

SEQ ID NO: 1717964 - RNA, 16 nt, Human
uaaccagcagaaaugc

SEQ ID NO: 1717965 - RNA, 19 nt, Human
uaaccagcagaaaugccuu

SEQ ID NO: 1717966 - RNA, 20 nt, Human
uaacuuuuauaaacuuuacc

SEQ ID NO: 1717967 - RNA, 17 nt, Human
uaacugagugccuuuug

SEQ ID NO: 1717968 - RNA, 16 nt, Human
uaacugagugccuuuu

SEQ ID NO: 1717969 - RNA, 15 nt, Human
uaagcaugcacaaau

SEQ ID NO: 1717970 - RNA, 13 nt, Human
uaagccagacauc

SEQ ID NO: 1717971 - RNA, 20 nt, Human
uaagccagacaucaacagau

SEQ ID NO: 1717972 - RNA, 21 nt, Human
uaagccagacaucaacagaua

SEQ ID NO: 1717973 - RNA, 19 nt, Human
uaaggaugcuuguacauaa

SEQ ID NO: 1717974 - RNA, 21 nt, Human
uaagccuuuggaaacagcucg

SEQ ID NO: 1717975 - RNA, 17 nt, Human
uaagccuuuggaaacag

SEQ ID NO: 1717976 - RNA, 14 nt, Human
uaagccuuuggaaa

SEQ ID NO: 1717977 - RNA, 20 nt, Human
uaaggaugcuuguacauaau

SEQ ID NO: 1717978 - RNA, 21 nt, Human
uaaggaugcuuguacauaaug

SEQ ID NO: 1717979 - RNA, 22 nt, Human
uaaggaugcuuguacauaaugc

SEQ ID NO: 1717980 - RNA, 23 nt, Human
uaaggaugcuuguacauaaugcg

SEQ ID NO: 1717981 - RNA, 15 nt, Human
uaaggcaaucauggu

SEQ ID NO: 1717982 - RNA, 21 nt, Human
uaacuuuuauaaacuuuaccu

SEQ ID NO: 1717983 - RNA, 22 nt, Human
uaacuuuuauaaacuuuaccuu

SEQ ID NO: 1717984 - RNA, 22 nt, Human
uaagaaccuuuugagugccuua

SEQ ID NO: 1717985 - RNA, 15 nt, Human
uaagaaauacagacu

SEQ ID NO: 1717986 - RNA, 22 nt, Human
uaagaggcagggucucacucug

SEQ ID NO: 1717987 - RNA, 23 nt, Human
uaagagggagggagggcuccaga

SEQ ID NO: 1717988 - RNA, 22 nt, Human
uaagagggagggagggcuccag

SEQ ID NO: 1717989 - RNA, 12 nt, Human
uaagagggaggg

SEQ ID NO: 1717990 - RNA, 14 nt, Human
uaagauaaaugugc

SEQ ID NO: 1717991 - RNA, 17 nt, Human
uaagauaaaugugcuga

SEQ ID NO: 1717992 - RNA, 16 nt, Human
uaagauaaaugugcug

SEQ ID NO: 1717993 - RNA, 18 nt, Human
uaagaucguucucugccu

SEQ ID NO: 1717994 - RNA, 16 nt, Human
uaaucguguccccuau

SEQ ID NO: 1717995 - RNA, 16 nt, Human
uaaucgaccugccucg

SEQ ID NO: 1717996 - RNA, 14 nt, Human
uaaucgaccugccu

SEQ ID NO: 1717997 - RNA, 13 nt, Human
uaaucgaccugcc

SEQ ID NO: 1717998 - RNA, 19 nt, Human
uaaugccacuaaauugaca

SEQ ID NO: 1717999 - RNA, 23 nt, Human
uaaugaugucguuugaaucacag

SEQ ID NO: 1718000 - RNA, 17 nt, Human
uaaugaugucguuugaa

SEQ ID NO: 1718001 - RNA, 16 nt, Human
uaaugauaugcuugua

SEQ ID NO: 1718002 - RNA, 15 nt, Human
uaaugauaugcuugu

SEQ ID NO: 1718003 - RNA, 11 nt, Human
uaaucuaaaug

SEQ ID NO: 1718004 - RNA, 11 nt, Human
uaauaaagcug

SEQ ID NO: 1718005 - RNA, 20 nt, Human
uaagugguacuaacuuuccu

SEQ ID NO: 1718006 - RNA, 13 nt, Human
uaauaaagacagg

SEQ ID NO: 1718007 - RNA, 16 nt, Human
uaauaauaaagaauag

SEQ ID NO: 1718008 - RNA, 21 nt, Human
uaauaguucagguaacaggca

SEQ ID NO: 1718009 - RNA, 14 nt, Human
uaauacaccacuac

SEQ ID NO: 1718010 - RNA, 14 nt, Human
uaauuugugauaca

SEQ ID NO: 1718011 - RNA, 15 nt, Human
uaauuugugauacaa

SEQ ID NO: 1718012 - RNA, 18 nt, Human
uaauuugugauacaaugc

SEQ ID NO: 1718013 - RNA, 19 nt, Human
uaauuugugauacaaugcu

SEQ ID NO: 1718014 - RNA, 22 nt, Human
uaauuugugauacaaugcugug

SEQ ID NO: 1718015 - RNA, 17 nt, Human
uaauuaaaacacaacau

SEQ ID NO: 1718016 - RNA, 23 nt, Human
uaaugcgcaggcuggcccugccc

SEQ ID NO: 1718017 - RNA, 14 nt, Human
uaaugcgugcauac

SEQ ID NO: 1718018 - RNA, 22 nt, Human
uaaugcgcaggcuggcccugcc

SEQ ID NO: 1718019 - RNA, 19 nt, Human
uaaugcgcaggcuggcccu

SEQ ID NO: 1718020 - RNA, 20 nt, Human
uaauugacaggauuauugga

SEQ ID NO: 1718021 - RNA, 22 nt, Human
uaauugacaggauuauuggaaa

SEQ ID NO: 1718022 - RNA, 18 nt, Human
uaauucuuagcucauucu

SEQ ID NO: 1718023 - RNA, 21 nt, Human
uacuguaucaugacaaagacu

SEQ ID NO: 1718024 - RNA, 17 nt, Human
uacugcauaugaaagga

SEQ ID NO: 1718025 - RNA, 21 nt, Human
uacuugcucuugaugccuggc

SEQ ID NO: 1718026 - RNA, 18 nt, Human
uacuuguggacacagcuc

SEQ ID NO: 1718027 - RNA, 15 nt, Human
uacuuguggacacag

SEQ ID NO: 1718028 - RNA, 19 nt, Human
uacuuguggacacagcucu

SEQ ID NO: 1718029 - RNA, 23 nt, Human
uagaaauaucugaaaauguaugu

SEQ ID NO: 1718030 - RNA, 21 nt, Human
uagaaauaucugaaaauguau

SEQ ID NO: 1718031 - RNA, 20 nt, Human
uagaaauaucugaaaaugua

SEQ ID NO: 1718032 - RNA, 15 nt, Human
uagaaauauaauuga

SEQ ID NO: 1718033 - RNA, 15 nt, Human
uagaaagaagaugaa

SEQ ID NO: 1718034 - RNA, 15 nt, Human
uacugaggugcuaug

SEQ ID NO: 1718035 - RNA, 17 nt, Human
uacucccaucugugaaa

SEQ ID NO: 1718036 - RNA, 16 nt, Human
uacucccaucugugaa

SEQ ID NO: 1718037 - RNA, 14 nt, Human
uacucccaucugug

SEQ ID NO: 1718038 - RNA, 12 nt, Human
uacucccaucug

SEQ ID NO: 1718039 - RNA, 20 nt, Human
uacuacaguuuguuaguaug

SEQ ID NO: 1718040 - RNA, 20 nt, Human
uacuacaguccucccaucuc

SEQ ID NO: 1718041 - RNA, 14 nt, Human
uacuaccuguaaug

SEQ ID NO: 1718042 - RNA, 12 nt, Human
uacucaccucac

SEQ ID NO: 1718043 - RNA, 14 nt, Human
uacucaccucaccc

SEQ ID NO: 1718044 - RNA, 16 nt, Human
uacucagaauucucua

SEQ ID NO: 1718045 - RNA, 22 nt, Human
uacucagaauucucuaguuuga

SEQ ID NO: 1718046 - RNA, 22 nt, Human
uacccaucccauaugccugggc

SEQ ID NO: 1718047 - RNA, 18 nt, Human
uaccuuuuuuauacauaa

SEQ ID NO: 1718048 - RNA, 19 nt, Human
uaccuuuuuuauacauaaa

SEQ ID NO: 1718049 - RNA, 20 nt, Human
uaccuuuuuuauacauaaac

SEQ ID NO: 1718050 - RNA, 20 nt, Human
uaccuuuguauucucuccug

SEQ ID NO: 1718051 - RNA, 19 nt, Human
uaccuuugacaaagguaaa

SEQ ID NO: 1718052 - RNA, 22 nt, Human
uaccuuuuuuauacauaaacaa

SEQ ID NO: 1718053 - RNA, 14 nt, Human
uacgacaacuugca

SEQ ID NO: 1718054 - RNA, 15 nt, Human
uacgacaacuugcac

SEQ ID NO: 1718055 - RNA, 19 nt, Human
uacuaaccagcagaaaugc

SEQ ID NO: 1718056 - RNA, 18 nt, Human
uacuaaccagcagaaaug

SEQ ID NO: 1718057 - RNA, 17 nt, Human
uacuacaguccucccau

SEQ ID NO: 1718058 - RNA, 12 nt, Human
uacuacaguccu

SEQ ID NO: 1718059 - RNA, 13 nt, Human
uacuaacuuuccu

SEQ ID NO: 1718060 - RNA, 22 nt, Human
uacuaauaaaauuuaaaagucu

SEQ ID NO: 1718061 - RNA, 15 nt, Human
uacuaauagacaauu

SEQ ID NO: 1718062 - RNA, 17 nt, Human
uacuaauagacaauuua

SEQ ID NO: 1718063 - RNA, 21 nt, Human
uacauuuuguauauuuguauu

SEQ ID NO: 1718064 - RNA, 21 nt, Human
uacaugagguacugagaguga

SEQ ID NO: 1718065 - RNA, 22 nt, Human
uacaugagguacugagagugaa

SEQ ID NO: 1718066 - RNA, 22 nt, Human
uacauaagauaaaugugcugaa

SEQ ID NO: 1718067 - RNA, 19 nt, Human
uacaguuacucagaauucu

SEQ ID NO: 1718068 - RNA, 23 nt, Human
uacaguuacucagaauucucuag

SEQ ID NO: 1718069 - RNA, 19 nt, Human
uacauaagauaaaugugcu

SEQ ID NO: 1718070 - RNA, 18 nt, Human
uacauaagauaaaugugc

SEQ ID NO: 1718071 - RNA, 18 nt, Human
uacaguuccuagguauaa

SEQ ID NO: 1718072 - RNA, 15 nt, Human
uaccaccacgcccgg

SEQ ID NO: 1718073 - RNA, 23 nt, Human
uaccauuuugggguacccacugc

SEQ ID NO: 1718074 - RNA, 13 nt, Human
uaccacagacaua

SEQ ID NO: 1718075 - RNA, 22 nt, Human
uacccaggugcuaggaacacuc

SEQ ID NO: 1718076 - RNA, 18 nt, Human
uacccagcgagcccuggu

SEQ ID NO: 1718077 - RNA, 14 nt, Human
uacccacugcucug

SEQ ID NO: 1718078 - RNA, 13 nt, Human
uacccacugcucu

SEQ ID NO: 1718079 - RNA, 12 nt, Human
uacccacugcuc

SEQ ID NO: 1718080 - RNA, 11 nt, Human
uacccacugcu

SEQ ID NO: 1718081 - RNA, 19 nt, Human
uacccacccccacccaagg

SEQ ID NO: 1718082 - RNA, 17 nt, Human
uacccacccccacccaa

SEQ ID NO: 1718083 - RNA, 23 nt, Human
uacccacccccacccaagggccu

SEQ ID NO: 1718084 - RNA, 15 nt, Human
uacccacccccaccc

SEQ ID NO: 1718085 - RNA, 12 nt, Human
uacccaccccca

SEQ ID NO: 1718086 - RNA, 13 nt, Human
uacagaauuuuau

SEQ ID NO: 1718087 - RNA, 24 nt, Human
uacagcaaggagauuuacaacugg

SEQ ID NO: 1718088 - RNA, 17 nt, Human
uacacuguuucaaacuu

SEQ ID NO: 1718089 - RNA, 18 nt, Human
uacacuguuucaaacuuu

SEQ ID NO: 1718090 - RNA, 19 nt, Human
uacacuguuucaaacuuua

SEQ ID NO: 1718091 - RNA, 13 nt, Human
uacacuuuaugca

SEQ ID NO: 1718092 - RNA, 14 nt, Human
uacaggauuugaaa

SEQ ID NO: 1718093 - RNA, 16 nt, Human
uacaggcacccaccau

SEQ ID NO: 1718094 - RNA, 19 nt, Human
uacaggaaaagcugcugac

SEQ ID NO: 1718095 - RNA, 13 nt, Human
uacaguguacagu

SEQ ID NO: 1718096 - RNA, 22 nt, Human
uacaguguacagucuuguauua

SEQ ID NO: 1718097 - RNA, 15 nt, Human
uacaguguacagucu

SEQ ID NO: 1718098 - RNA, 16 nt, Human
uacaguguacagucuu

SEQ ID NO: 1718099 - RNA, 22 nt, Human
uacagcuugaccgugaggccag

SEQ ID NO: 1718100 - RNA, 18 nt, Human
uacaggaaaagcugcuga

SEQ ID NO: 1718101 - RNA, 17 nt, Human
uacaggaaaagcugcug

SEQ ID NO: 1718102 - RNA, 23 nt, Human
uacagcuugaccgugaggccaga

SEQ ID NO: 1718103 - RNA, 12 nt, Human
uaauuuuguaau

SEQ ID NO: 1718104 - RNA, 19 nt, Human
uaauuuuguaauguaucaa

SEQ ID NO: 1718105 - RNA, 17 nt, Human
uaauuuugaaaaacugc

SEQ ID NO: 1718106 - RNA, 13 nt, Human
uaauuuugaaaaa

SEQ ID NO: 1718107 - RNA, 19 nt, Human
uacaagagcuuaacagugu

SEQ ID NO: 1718108 - RNA, 15 nt, Human
uacaagacacaguga

SEQ ID NO: 1718109 - RNA, 22 nt, Human
uacacacugcauguuugugauu

SEQ ID NO: 1718110 - RNA, 16 nt, Human
uacacugugcugaguc

SEQ ID NO: 1718111 - RNA, 14 nt, Human
uacacuguuucaaa

SEQ ID NO: 1718112 - RNA, 15 nt, Human
uacacacacauacac

SEQ ID NO: 1718113 - RNA, 21 nt, Human
uacacacacacgcgugcacac

SEQ ID NO: 1718114 - RNA, 17 nt, Human
uacacacugcauguuug

SEQ ID NO: 1718115 - RNA, 23 nt, Human
uacacaaugguuuucuugugugu

SEQ ID NO: 1718116 - RNA, 21 nt, Human
uacacaaugguuuucuugugu

SEQ ID NO: 1718117 - RNA, 17 nt, Human
uacacaaugguuuucuu

SEQ ID NO: 1718118 - RNA, 21 nt, Human
uagcucuaggagggcuggcaa

SEQ ID NO: 1718119 - RNA, 17 nt, Human
uagccugccucuucucu

SEQ ID NO: 1718120 - RNA, 22 nt, Human
uagcucauucuccuuguguuac

SEQ ID NO: 1718121 - RNA, 20 nt, Human
uagcugggacuacaggcacc

SEQ ID NO: 1718122 - RNA, 12 nt, Human
uagcugggacua

SEQ ID NO: 1718123 - RNA, 18 nt, Human
uagcugggacuacaggug

SEQ ID NO: 1718124 - RNA, 22 nt, Human
uagcugggagaaagagagagcu

SEQ ID NO: 1718125 - RNA, 11 nt, Human
uagcugggacu

SEQ ID NO: 1718126 - RNA, 14 nt, Human
uagcccaaaaccaa

SEQ ID NO: 1718127 - RNA, 18 nt, Human
uagcccucacccuggggc

SEQ ID NO: 1718128 - RNA, 13 nt, Human
uagccccauaauu

SEQ ID NO: 1718129 - RNA, 15 nt, Human
uaggaagguuaaugu

SEQ ID NO: 1718130 - RNA, 23 nt, Human
uaggaauugacccacaagaaaug

SEQ ID NO: 1718131 - RNA, 20 nt, Human
uaggaauugacccacaagaa

SEQ ID NO: 1718132 - RNA, 16 nt, Human
uaggaauuguguuuau

SEQ ID NO: 1718133 - RNA, 14 nt, Human
uaggaauuguguuu

SEQ ID NO: 1718134 - RNA, 13 nt, Human
uaggccaugggac

SEQ ID NO: 1718135 - RNA, 17 nt, Human
uaggccguuccuucaaa

SEQ ID NO: 1718136 - RNA, 13 nt, Human
uaggccuggccag

SEQ ID NO: 1718137 - RNA, 14 nt, Human
uaggccuggccaga

SEQ ID NO: 1718138 - RNA, 19 nt, Human
uaggccucaggugaaacuc

SEQ ID NO: 1718139 - RNA, 17 nt, Human
uaggaagacuuuggaaa

SEQ ID NO: 1718140 - RNA, 16 nt, Human
uaggaagacuuuggaa

SEQ ID NO: 1718141 - RNA, 15 nt, Human
uaggaagacuuugga

SEQ ID NO: 1718142 - RNA, 14 nt, Human
uaggaagacuuugg

SEQ ID NO: 1718143 - RNA, 13 nt, Human
uaggaagacuuug

SEQ ID NO: 1718144 - RNA, 17 nt, Human
uaggaacacuccuucac

SEQ ID NO: 1718145 - RNA, 21 nt, Human
uaggaacuuaaauaaugugaa

SEQ ID NO: 1718146 - RNA, 14 nt, Human
uaggaacacuccuu

SEQ ID NO: 1718147 - RNA, 13 nt, Human
uaggaacacuccu

SEQ ID NO: 1718148 - RNA, 23 nt, Human
uagaaccaggcaacuugggaacu

SEQ ID NO: 1718149 - RNA, 12 nt, Human
uagaaccaggca

SEQ ID NO: 1718150 - RNA, 21 nt, Human
uagaaccucgagguuucucaa

SEQ ID NO: 1718151 - RNA, 16 nt, Human
uagagagagaccacuu

SEQ ID NO: 1718152 - RNA, 19 nt, Human
uagagguucaaagauauuu

SEQ ID NO: 1718153 - RNA, 16 nt, Human
uagagguucaaagaua

SEQ ID NO: 1718154 - RNA, 21 nt, Human
uagagguucaaagauauuuug

SEQ ID NO: 1718155 - RNA, 12 nt, Human
uagauguauaua

SEQ ID NO: 1718156 - RNA, 16 nt, Human
uagauguaauuuugug

SEQ ID NO: 1718157 - RNA, 18 nt, Human
uagauaauacaccacuac

SEQ ID NO: 1718158 - RNA, 23 nt, Human
uagcagagaaugaaagggcccag

SEQ ID NO: 1718159 - RNA, 19 nt, Human
uagcagagaaugaaagggc

SEQ ID NO: 1718160 - RNA, 16 nt, Human
uagcacuuugggaggc

SEQ ID NO: 1718161 - RNA, 20 nt, Human
uauaugcucugcauguuaca

SEQ ID NO: 1718162 - RNA, 14 nt, Human
uauauuuuaagacg

SEQ ID NO: 1718163 - RNA, 13 nt, Human
uauauuuuaagac

SEQ ID NO: 1718164 - RNA, 19 nt, Human
uaucgucacugcuuaacuu

SEQ ID NO: 1718165 - RNA, 15 nt, Human
uaucuaaauguugaa

SEQ ID NO: 1718166 - RNA, 22 nt, Human
uaucaugugaaaucauucauuu

SEQ ID NO: 1718167 - RNA, 17 nt, Human
uaucaugugaaaucauu

SEQ ID NO: 1718168 - RNA, 21 nt, Human
uaucaugucaaacgugaaaau

SEQ ID NO: 1718169 - RNA, 22 nt, Human
uauccugcuucugauaugcagu

SEQ ID NO: 1718170 - RNA, 17 nt, Human
uaucaugacaaagacug

SEQ ID NO: 1718171 - RNA, 16 nt, Human
uaucaugucaaacgug

SEQ ID NO: 1718172 - RNA, 16 nt, Human
uaucaugacaaagacu

SEQ ID NO: 1718173 - RNA, 19 nt, Human
uauauuuuuuguuaaauga

SEQ ID NO: 1718174 - RNA, 17 nt, Human
uaucaggugcugccauc

SEQ ID NO: 1718175 - RNA, 15 nt, Human
uaguggauguucuga

SEQ ID NO: 1718176 - RNA, 15 nt, Human
uaguggauggaaggg

SEQ ID NO: 1718177 - RNA, 18 nt, Human
uaguggauggaaggggcu

SEQ ID NO: 1718178 - RNA, 21 nt, Human
uaguuguaccgcaaugugacu

SEQ ID NO: 1718179 - RNA, 12 nt, Human
uaguuugcaguu

SEQ ID NO: 1718180 - RNA, 23 nt, Human
uaguuugauuaaauucuugcaaa

SEQ ID NO: 1718181 - RNA, 13 nt, Human
uaguuucuccaag

SEQ ID NO: 1718182 - RNA, 13 nt, Human
uagugaugguucc

SEQ ID NO: 1718183 - RNA, 18 nt, Human
uagugaugguuccccugu

SEQ ID NO: 1718184 - RNA, 14 nt, Human
uagugaugguuccc

SEQ ID NO: 1718185 - RNA, 17 nt, Human
uauacccccugcaaagc

SEQ ID NO: 1718186 - RNA, 20 nt, Human
uauacucuuauagacaacau

SEQ ID NO: 1718187 - RNA, 17 nt, Human
uauaauucuacuuugag

SEQ ID NO: 1718188 - RNA, 20 nt, Human
uauaauucacauuguauuca

SEQ ID NO: 1718189 - RNA, 20 nt, Human
uauaauguaagcucuacuga

SEQ ID NO: 1718190 - RNA, 19 nt, Human
uauaauguaagcucuacug

SEQ ID NO: 1718191 - RNA, 14 nt, Human
uauaauguaagcuc

SEQ ID NO: 1718192 - RNA, 17 nt, Human
uauaaauuuuuuuuguu

SEQ ID NO: 1718193 - RNA, 21 nt, Human
uauaaauuuuuuuuguuucau

SEQ ID NO: 1718194 - RNA, 18 nt, Human
uauaaugaaugaaacauu

SEQ ID NO: 1718195 - RNA, 20 nt, Human
uauaaugaaugaaacauuuu

SEQ ID NO: 1718196 - RNA, 19 nt, Human
ggcaacccccagccugcua

SEQ ID NO: 1718197 - RNA, 21 nt, Human
ggaucagucugauucccaagc

SEQ ID NO: 1718198 - RNA, 19 nt, Human
ggcaacugcauuggcuuug

SEQ ID NO: 1718199 - RNA, 15 nt, Human
ggcaaggcugucaau

SEQ ID NO: 1718200 - RNA, 23 nt, Human
ggcaacuugggaacuagacuccc

SEQ ID NO: 1718201 - RNA, 18 nt, Human
ggcaacuugggaacuaga

SEQ ID NO: 1718202 - RNA, 18 nt, Human
ggcaacugcauuggcuuu

SEQ ID NO: 1718203 - RNA, 16 nt, Human
ggcagagcagagacca

SEQ ID NO: 1718204 - RNA, 15 nt, Human
ggcagagcagagacc

SEQ ID NO: 1718205 - RNA, 20 nt, Human
ggcagagcagagaccauccc

SEQ ID NO: 1718206 - RNA, 16 nt, Human
ggcacccggccccugc

SEQ ID NO: 1718207 - RNA, 15 nt, Human
ggcacccggccccug

SEQ ID NO: 1718208 - RNA, 17 nt, Human
ggcacccggccccugcu

SEQ ID NO: 1718209 - RNA, 16 nt, Human
ggcaaggcugucaauu

SEQ ID NO: 1718210 - RNA, 23 nt, Human
ggcagauacaggaaaagcugcug

SEQ ID NO: 1718211 - RNA, 23 nt, Human
ggcagaguugaagacagagcuac

SEQ ID NO: 1718212 - RNA, 17 nt, Human
ggcagaggaaagcaaag

SEQ ID NO: 1718213 - RNA, 13 nt, Human
ggcagguccaggg

SEQ ID NO: 1718214 - RNA, 14 nt, Human
ggcaggaaggcuga

SEQ ID NO: 1718215 - RNA, 23 nt, Human
ggcaggucuugaacuccuggccu

SEQ ID NO: 1718216 - RNA, 19 nt, Human
ggcagcugcgguccaccca

SEQ ID NO: 1718217 - RNA, 21 nt, Human
ggcagcuugaggguugggcug

SEQ ID NO: 1718218 - RNA, 21 nt, Human
ggcagcucaccucucccuugg

SEQ ID NO: 1718219 - RNA, 18 nt, Human
ggcagcucaccucucccu

SEQ ID NO: 1718220 - RNA, 22 nt, Human
ggcagcucaccucucccuugga

SEQ ID NO: 1718221 - RNA, 13 nt, Human
ggcagcucagaga

SEQ ID NO: 1718222 - RNA, 23 nt, Human
ggcauguucucugaggacacuaa

SEQ ID NO: 1718223 - RNA, 15 nt, Human
ggcagguuggugggg

SEQ ID NO: 1718224 - RNA, 17 nt, Human
ggccacaagacccuugu

SEQ ID NO: 1718225 - RNA, 16 nt, Human
ggccacaagacccuug

SEQ ID NO: 1718226 - RNA, 15 nt, Human
ggcauuccccaggag

SEQ ID NO: 1718227 - RNA, 16 nt, Human
ggcauuccccaggagg

SEQ ID NO: 1718228 - RNA, 12 nt, Human
ggccaaguucuu

SEQ ID NO: 1718229 - RNA, 22 nt, Human
ggccaccugcggugcuaucucc

SEQ ID NO: 1718230 - RNA, 16 nt, Human
ggccaccugcggugcu

SEQ ID NO: 1718231 - RNA, 11 nt, Human
ggccacuguga

SEQ ID NO: 1718232 - RNA, 14 nt, Human
ggccaggagccucc

SEQ ID NO: 1718233 - RNA, 16 nt, Human
ggccacugugaagaga

SEQ ID NO: 1718234 - RNA, 16 nt, Human
ggccaggagccuccug

SEQ ID NO: 1718235 - RNA, 11 nt, Human
ggccaggcugg

SEQ ID NO: 1718236 - RNA, 22 nt, Human
ggccaggcugggucgcccugga

SEQ ID NO: 1718237 - RNA, 18 nt, Human
ggccaggcugggucgccc

SEQ ID NO: 1718238 - RNA, 16 nt, Human
ggccaggccagaggga

SEQ ID NO: 1718239 - RNA, 14 nt, Human
ggccaggccagagg

SEQ ID NO: 1718240 - RNA, 22 nt, Human
ggccaugggacagggaggacgc

SEQ ID NO: 1718241 - RNA, 13 nt, Human
ggccaugggccuc

SEQ ID NO: 1718242 - RNA, 12 nt, Human
ggccaggcuggu

SEQ ID NO: 1718243 - RNA, 12 nt, Human
ggccccugccac

SEQ ID NO: 1718244 - RNA, 16 nt, Human
ggccccugccacccug

SEQ ID NO: 1718245 - RNA, 13 nt, Human
ggccccugccacc

SEQ ID NO: 1718246 - RNA, 13 nt, Human
ggccccugcccgg

SEQ ID NO: 1718247 - RNA, 18 nt, Human
ggccccugccacccuggg

SEQ ID NO: 1718248 - RNA, 17 nt, Human
ggccccugccacccugg

SEQ ID NO: 1718249 - RNA, 21 nt, Human
ggccccucagggucccuggug

SEQ ID NO: 1718250 - RNA, 20 nt, Human
ggccccucagggucccuggu

SEQ ID NO: 1718251 - RNA, 19 nt, Human
ggccccucagggucccugg

SEQ ID NO: 1718252 - RNA, 16 nt, Human
ggccccucaggguccc

SEQ ID NO: 1718253 - RNA, 20 nt, Human
ggaggacgcucucuggccuu

SEQ ID NO: 1718254 - RNA, 21 nt, Human
ggaggacgcucucuggccuuc

SEQ ID NO: 1718255 - RNA, 19 nt, Human
ggaggacgcucucuggccu

SEQ ID NO: 1718256 - RNA, 21 nt, Human
ggaggaucucuugagccuggg

SEQ ID NO: 1718257 - RNA, 17 nt, Human
ggaggaucucuugagcc

SEQ ID NO: 1718258 - RNA, 23 nt, Human
ggaggaucacuugaguccagaag

SEQ ID NO: 1718259 - RNA, 15 nt, Human
ggaggauguucuggg

SEQ ID NO: 1718260 - RNA, 12 nt, Human
ggagggagggcu

SEQ ID NO: 1718261 - RNA, 13 nt, Human
ggagggcuccaga

SEQ ID NO: 1718262 - RNA, 12 nt, Human
ggagggcuccag

SEQ ID NO: 1718263 - RNA, 21 nt, Human
ggagugaguugauagcacaga

SEQ ID NO: 1718264 - RNA, 14 nt, Human
ggagugagcugguu

SEQ ID NO: 1718265 - RNA, 12 nt, Human
ggagugagcugg

SEQ ID NO: 1718266 - RNA, 21 nt, Human
ggagugacagaggcagcccca

SEQ ID NO: 1718267 - RNA, 19 nt, Human
ggagugacagaggcagccc

SEQ ID NO: 1718268 - RNA, 18 nt, Human
ggagugacagaggcagcc

SEQ ID NO: 1718269 - RNA, 17 nt, Human
ggagugacagaggcagc

SEQ ID NO: 1718270 - RNA, 23 nt, Human
ggagugaguugauagcacagacc

SEQ ID NO: 1718271 - RNA, 16 nt, Human
ggaucacagccucuga

SEQ ID NO: 1718272 - RNA, 15 nt, Human
ggagggcuccagaca

SEQ ID NO: 1718273 - RNA, 14 nt, Human
ggagggcuccagac

SEQ ID NO: 1718274 - RNA, 17 nt, Human
ggagggcuccagacaca

SEQ ID NO: 1718275 - RNA, 21 nt, Human
ggagucccaccuuggcugcag

SEQ ID NO: 1718276 - RNA, 20 nt, Human
ggagucccaccuuggcugca

SEQ ID NO: 1718277 - RNA, 16 nt, Human
ggagugacagaggcag

SEQ ID NO: 1718278 - RNA, 11 nt, Human
ggagugacaga

SEQ ID NO: 1718279 - RNA, 20 nt, Human
ggaagccagcaggcucucag

SEQ ID NO: 1718280 - RNA, 12 nt, Human
ggacuccucugu

SEQ ID NO: 1718281 - RNA, 14 nt, Human
ggacuccucugucc

SEQ ID NO: 1718282 - RNA, 15 nt, Human
ggacuccucugucca

SEQ ID NO: 1718283 - RNA, 11 nt, Human
ggacucugccu

SEQ ID NO: 1718284 - RNA, 13 nt, Human
ggacucuaaaguc

SEQ ID NO: 1718285 - RNA, 21 nt, Human
ggagagcuagcagcagggagg

SEQ ID NO: 1718286 - RNA, 17 nt, Human
ggagagcuagcagcagg

SEQ ID NO: 1718287 - RNA, 21 nt, Human
ggacugccagucccccugccc

SEQ ID NO: 1718288 - RNA, 21 nt, Human
ggagaccccuuggggagcagg

SEQ ID NO: 1718289 - RNA, 15 nt, Human
ggagaggggcacagg

SEQ ID NO: 1718290 - RNA, 20 nt, Human
ggagauuuacaacuggggga

SEQ ID NO: 1718291 - RNA, 20 nt, Human
ggagcaaaaucgaugcagug

SEQ ID NO: 1718292 - RNA, 13 nt, Human
ggagcccugggag

SEQ ID NO: 1718293 - RNA, 12 nt, Human
ggagcccuggga

SEQ ID NO: 1718294 - RNA, 23 nt, Human
ggaacuagacucccaagcuggac

SEQ ID NO: 1718295 - RNA, 20 nt, Human
ggaacagacuggaagcacag

SEQ ID NO: 1718296 - RNA, 19 nt, Human
ggaacagacuggaagcaca

SEQ ID NO: 1718297 - RNA, 14 nt, Human
ggaaaauaaauuau

SEQ ID NO: 1718298 - RNA, 15 nt, Human
ggaaaaucagccugc

SEQ ID NO: 1718299 - RNA, 17 nt, Human
ggaacagacuggaagca

SEQ ID NO: 1718300 - RNA, 14 nt, Human
ggaagccagcaggc

SEQ ID NO: 1718301 - RNA, 13 nt, Human
ggaagccagcagg

SEQ ID NO: 1718302 - RNA, 18 nt, Human
ggaagccagcaggcucuc

SEQ ID NO: 1718303 - RNA, 17 nt, Human
ggaagccagcaggcucu

SEQ ID NO: 1718304 - RNA, 16 nt, Human
ggaagccagcaggcuc

SEQ ID NO: 1718305 - RNA, 15 nt, Human
ggaagccagcaggcu

SEQ ID NO: 1718306 - RNA, 22 nt, Human
ggaagcacaugccucucucagg

SEQ ID NO: 1718307 - RNA, 21 nt, Human
ggaagcacaugccucucucag

SEQ ID NO: 1718308 - RNA, 23 nt, Human
ggaagcacaugccucucucaggc

SEQ ID NO: 1718309 - RNA, 13 nt, Human
ggaagcagcuuuc

SEQ ID NO: 1718310 - RNA, 17 nt, Human
ggaagcacaugccucuc

SEQ ID NO: 1718311 - RNA, 15 nt, Human
ggaagcacaugccuc

SEQ ID NO: 1718312 - RNA, 14 nt, Human
ggaagcacaugccu

SEQ ID NO: 1718313 - RNA, 13 nt, Human
ggaagcacaugcc

SEQ ID NO: 1718314 - RNA, 17 nt, Human
ggaagcacagcuucauu

SEQ ID NO: 1718315 - RNA, 13 nt, Human
ggaagagccuugc

SEQ ID NO: 1718316 - RNA, 20 nt, Human
ggaaaaaauaacaaugaaag

SEQ ID NO: 1718317 - RNA, 14 nt, Human
gcuuuuacuuaaac

SEQ ID NO: 1718318 - RNA, 16 nt, Human
gcuuugggcugcccug

SEQ ID NO: 1718319 - RNA, 15 nt, Human
gcuuugggcugcccu

SEQ ID NO: 1718320 - RNA, 15 nt, Human
ggaaaaauagccugc

SEQ ID NO: 1718321 - RNA, 22 nt, Human
ggaaaaccaagccguggcuucc

SEQ ID NO: 1718322 - RNA, 14 nt, Human
ggaaaaacugauuu

SEQ ID NO: 1718323 - RNA, 19 nt, Human
ggaaaaaccacccccaaau

SEQ ID NO: 1718324 - RNA, 13 nt, Human
ggaaaaauagccu

SEQ ID NO: 1718325 - RNA, 14 nt, Human
gcuuugggcugccc

SEQ ID NO: 1718326 - RNA, 17 nt, Human
gcuugcccuggugccuc

SEQ ID NO: 1718327 - RNA, 19 nt, Human
gcuugcccuggugccucac

SEQ ID NO: 1718328 - RNA, 13 nt, Human
gcuuggaggaagg

SEQ ID NO: 1718329 - RNA, 15 nt, Human
gcuuggaggaaggaa

SEQ ID NO: 1718330 - RNA, 14 nt, Human
gcuuggaggaagga

SEQ ID NO: 1718331 - RNA, 22 nt, Human
gcuugcagagaugaggccgcca

SEQ ID NO: 1718332 - RNA, 16 nt, Human
gcuucuguugcugccu

SEQ ID NO: 1718333 - RNA, 13 nt, Human
gcuguucagcugg

SEQ ID NO: 1718334 - RNA, 20 nt, Human
gcuuccagugaggcucugcc

SEQ ID NO: 1718335 - RNA, 19 nt, Human
gcuuccagugaggcucugc

SEQ ID NO: 1718336 - RNA, 21 nt, Human
gcuuccagugaggcucugccc

SEQ ID NO: 1718337 - RNA, 17 nt, Human
gcuucucacugccaugc

SEQ ID NO: 1718338 - RNA, 20 nt, Human
gcuggucccacucaguccau

SEQ ID NO: 1718339 - RNA, 18 nt, Human
gcuggugucaccugaaga

SEQ ID NO: 1718340 - RNA, 16 nt, Human
gcuggugucaccugaa

SEQ ID NO: 1718341 - RNA, 22 nt, Human
gcugguucaggguuggccccug

SEQ ID NO: 1718342 - RNA, 16 nt, Human
gcugucaauuacagga

SEQ ID NO: 1718343 - RNA, 14 nt, Human
gcugucaaggcuca

SEQ ID NO: 1718344 - RNA, 15 nt, Human
gcugguucaggguug

SEQ ID NO: 1718345 - RNA, 21 nt, Human
gcugguuagagguucccuuug

SEQ ID NO: 1718346 - RNA, 23 nt, Human
gcugucaauuacaggaaguacug

SEQ ID NO: 1718347 - RNA, 22 nt, Human
gcugucaauuacaggaaguacu

SEQ ID NO: 1718348 - RNA, 19 nt, Human
gcugucaauuacaggaagu

SEQ ID NO: 1718349 - RNA, 17 nt, Human
gcugucaauuacaggaa

SEQ ID NO: 1718350 - RNA, 21 nt, Human
gcugucccuuacgugaguccu

SEQ ID NO: 1718351 - RNA, 22 nt, Human
gcugucccuuacgugaguccug

SEQ ID NO: 1718352 - RNA, 19 nt, Human
gcugucccuuacgugaguc

SEQ ID NO: 1718353 - RNA, 17 nt, Human
gcugucuccauguuuga

SEQ ID NO: 1718354 - RNA, 23 nt, Human
gcugucuguuguauucauugugg

SEQ ID NO: 1718355 - RNA, 18 nt, Human
gcugggagagccuuccag

SEQ ID NO: 1718356 - RNA, 17 nt, Human
gcugggagagccuucca

SEQ ID NO: 1718357 - RNA, 13 nt, Human
gcugggagagccu

SEQ ID NO: 1718358 - RNA, 12 nt, Human
gcugggagagcc

SEQ ID NO: 1718359 - RNA, 22 nt, Human
gcugggagagccuuccaggggu

SEQ ID NO: 1718360 - RNA, 19 nt, Human
gcugggagagccuuccagg

SEQ ID NO: 1718361 - RNA, 17 nt, Human
gcugggcuucaguggca

SEQ ID NO: 1718362 - RNA, 21 nt, Human
gcugggauuacaggcuccugc

SEQ ID NO: 1718363 - RNA, 20 nt, Human
gcugggauuacaggcuccug

SEQ ID NO: 1718364 - RNA, 19 nt, Human
gcugggauuacaggcuccu

SEQ ID NO: 1718365 - RNA, 18 nt, Human
gcugggauuacaggcgug

SEQ ID NO: 1718366 - RNA, 17 nt, Human
gcugggauuacaggcgu

SEQ ID NO: 1718367 - RNA, 15 nt, Human
gcugggagcucugca

SEQ ID NO: 1718368 - RNA, 16 nt, Human
gcugggagcucugcag

SEQ ID NO: 1718369 - RNA, 20 nt, Human
gcugggggccucagugccac

SEQ ID NO: 1718370 - RNA, 19 nt, Human
gcugggggccucagugcca

SEQ ID NO: 1718371 - RNA, 19 nt, Human
gcuggucccacucagucca

SEQ ID NO: 1718372 - RNA, 15 nt, Human
gcuggucccacucag

SEQ ID NO: 1718373 - RNA, 13 nt, Human
gcugggggccuca

SEQ ID NO: 1718374 - RNA, 23 nt, Human
gcugggggaagaagcucucuccu

SEQ ID NO: 1718375 - RNA, 12 nt, Human
gcuggggccagu

SEQ ID NO: 1718376 - RNA, 19 nt, Human
gcugggcuucaguggcagc

SEQ ID NO: 1718377 - RNA, 18 nt, Human
gcugggcuucaguggcag

SEQ ID NO: 1718378 - RNA, 19 nt, Human
gcuggggccaggcuggguc

SEQ ID NO: 1718379 - RNA, 16 nt, Human
gcuggggccaggcugg

SEQ ID NO: 1718380 - RNA, 22 nt, Human
gcuagcagcagggagggcuucu

SEQ ID NO: 1718381 - RNA, 19 nt, Human
gcugcccuggugcugccac

SEQ ID NO: 1718382 - RNA, 18 nt, Human
gcugcccuggugcugcca

SEQ ID NO: 1718383 - RNA, 11 nt, Human
gcugcccugug

SEQ ID NO: 1718384 - RNA, 22 nt, Human
gcugcccuggugcugccacacu

SEQ ID NO: 1718385 - RNA, 20 nt, Human
gcugcccuggugcugccaca

SEQ ID NO: 1718386 - RNA, 14 nt, Human
gcugcccugugagu

SEQ ID NO: 1718387 - RNA, 12 nt, Human
gcugcccuguga

SEQ ID NO: 1718388 - RNA, 23 nt, Human
gcugcccuggugcugccacacuu

SEQ ID NO: 1718389 - RNA, 17 nt, Human
gcugcccuuucugggca

SEQ ID NO: 1718390 - RNA, 16 nt, Human
gcugcuugggcuucau

SEQ ID NO: 1718391 - RNA, 22 nt, Human
gcugcuucaaggauccugagcc

SEQ ID NO: 1718392 - RNA, 21 nt, Human
gcugcuucaaggauccugagc

SEQ ID NO: 1718393 - RNA, 23 nt, Human
gcugcuucaaggauccugagcca

SEQ ID NO: 1718394 - RNA, 18 nt, Human
gcugcgguccacccagga

SEQ ID NO: 1718395 - RNA, 17 nt, Human
gcugcgguccacccagg

SEQ ID NO: 1718396 - RNA, 19 nt, Human
gcugcgguccacccaggag

SEQ ID NO: 1718397 - RNA, 13 nt, Human
gcugcuucaagga

SEQ ID NO: 1718398 - RNA, 22 nt, Human
gcuggaccuugaacuggguacu

SEQ ID NO: 1718399 - RNA, 21 nt, Human
gcuggaccuugaacuggguac

SEQ ID NO: 1718400 - RNA, 22 nt, Human
gcugcuugggcuucauccuccu

SEQ ID NO: 1718401 - RNA, 17 nt, Human
gcugcuugggcuucauc

SEQ ID NO: 1718402 - RNA, 18 nt, Human
gcuggaccuugaacuggg

SEQ ID NO: 1718403 - RNA, 16 nt, Human
gcuggauuacaggcau

SEQ ID NO: 1718404 - RNA, 20 nt, Human
gcugggacuacaggcaccca

SEQ ID NO: 1718405 - RNA, 19 nt, Human
gcugggacuacaggcaccc

SEQ ID NO: 1718406 - RNA, 18 nt, Human
gcugggacuacaggcacc

SEQ ID NO: 1718407 - RNA, 13 nt, Human
gcugggacuacag

SEQ ID NO: 1718408 - RNA, 19 nt, Human
gcugggacuacagguguga

SEQ ID NO: 1718409 - RNA, 20 nt, Human
gcugggacaugggaaagggg

SEQ ID NO: 1718410 - RNA, 17 nt, Human
gcuggccgggagccuga

SEQ ID NO: 1718411 - RNA, 13 nt, Human
gcuggcccugccc

SEQ ID NO: 1718412 - RNA, 13 nt, Human
gcuggccgggacc

SEQ ID NO: 1718413 - RNA, 12 nt, Human
gcuggcccugcc

SEQ ID NO: 1718414 - RNA, 16 nt, Human
gggaagggggcuggga

SEQ ID NO: 1718415 - RNA, 14 nt, Human
gggaagggggcugg

SEQ ID NO: 1718416 - RNA, 17 nt, Human
gggaagggggcugggac

SEQ ID NO: 1718417 - RNA, 14 nt, Human
ggcuuuugugcauu

SEQ ID NO: 1718418 - RNA, 21 nt, Human
gggaaggauacaaaagcaugu

SEQ ID NO: 1718419 - RNA, 23 nt, Human
gggaaggauacaaaagcauguga

SEQ ID NO: 1718420 - RNA, 22 nt, Human
gggaaggcagggagggccuggg

SEQ ID NO: 1718421 - RNA, 15 nt, Human
gggaccucaggccug

SEQ ID NO: 1718422 - RNA, 13 nt, Human
gggaccucaggcc

SEQ ID NO: 1718423 - RNA, 12 nt, Human
gggaccucaggc

SEQ ID NO: 1718424 - RNA, 16 nt, Human
gggacucaaugcacug

SEQ ID NO: 1718425 - RNA, 17 nt, Human
gggacuacaggcaccca

SEQ ID NO: 1718426 - RNA, 14 nt, Human
gggaccccugagcu

SEQ ID NO: 1718427 - RNA, 20 nt, Human
gggaccccgagccuggcucc

SEQ ID NO: 1718428 - RNA, 18 nt, Human
gggaccccgagccuggcu

SEQ ID NO: 1718429 - RNA, 17 nt, Human
gggaauuucuucaacuc

SEQ ID NO: 1718430 - RNA, 23 nt, Human
gggacaaggacuaggguccuggg

SEQ ID NO: 1718431 - RNA, 22 nt, Human
ggcuugaguuuaaauuguaaua

SEQ ID NO: 1718432 - RNA, 21 nt, Human
ggcuuggggaccagagcugcc

SEQ ID NO: 1718433 - RNA, 10 nt, Human
ggcuuuugug

SEQ ID NO: 1718434 - RNA, 22 nt, Human
ggcuuuucacugcuggcugccu

SEQ ID NO: 1718435 - RNA, 19 nt, Human
ggcuuuucacugcuggcug

SEQ ID NO: 1718436 - RNA, 17 nt, Human
ggcuuuucacugcuggc

SEQ ID NO: 1718437 - RNA, 15 nt, Human
ggcuuuucacugcug

SEQ ID NO: 1718438 - RNA, 14 nt, Human
ggcuuuucacugcu

SEQ ID NO: 1718439 - RNA, 21 nt, Human
ggcuuagucacugagacagcc

SEQ ID NO: 1718440 - RNA, 12 nt, Human
ggcugggcuuca

SEQ ID NO: 1718441 - RNA, 18 nt, Human
ggcugggcucccuuccca

SEQ ID NO: 1718442 - RNA, 17 nt, Human
ggcugggcucccuuccc

SEQ ID NO: 1718443 - RNA, 17 nt, Human
ggcugggcuucaguggc

SEQ ID NO: 1718444 - RNA, 13 nt, Human
ggcugggcuucag

SEQ ID NO: 1718445 - RNA, 18 nt, Human
ggcugggcuucaguggca

SEQ ID NO: 1718446 - RNA, 18 nt, Human
ggcugcaaaggguaucag

SEQ ID NO: 1718447 - RNA, 23 nt, Human
ggcugcaaaggguaucaggugcu

SEQ ID NO: 1718448 - RNA, 22 nt, Human
ggcugcaaaggguaucaggugc

SEQ ID NO: 1718449 - RNA, 19 nt, Human
ggcugcaccggcuggccug

SEQ ID NO: 1718450 - RNA, 18 nt, Human
ggcugcaccggcuggccu

SEQ ID NO: 1718451 - RNA, 17 nt, Human
ggcugcaccggcuggcc

SEQ ID NO: 1718452 - RNA, 24 nt, Human
ggcugcaaaggguaucaggugcug

SEQ ID NO: 1718453 - RNA, 15 nt, Human
ggcugaggugggagg

SEQ ID NO: 1718454 - RNA, 13 nt, Human
ggcugagguggga

SEQ ID NO: 1718455 - RNA, 17 nt, Human
ggccccugcccggcugc

SEQ ID NO: 1718456 - RNA, 16 nt, Human
ggccccugcccggcug

SEQ ID NO: 1718457 - RNA, 20 nt, Human
ggccccugcccggcugcgga

SEQ ID NO: 1718458 - RNA, 14 nt, Human
ggcucuggagccca

SEQ ID NO: 1718459 - RNA, 13 nt, Human
ggcucuggagccc

SEQ ID NO: 1718460 - RNA, 23 nt, Human
ggcugcuucaaggauccugagcc

SEQ ID NO: 1718461 - RNA, 19 nt, Human
ggcugggagagccuuccag

SEQ ID NO: 1718462 - RNA, 23 nt, Human
ggcugggagagccuuccaggggu

SEQ ID NO: 1718463 - RNA, 20 nt, Human
ggcugggagagccuuccagg

SEQ ID NO: 1718464 - RNA, 14 nt, Human
ggcugggcagagga

SEQ ID NO: 1718465 - RNA, 13 nt, Human
ggcugggcagagg

SEQ ID NO: 1718466 - RNA, 19 nt, Human
ggcugggcagaggaaagca

SEQ ID NO: 1718467 - RNA, 15 nt, Human
ggcugggcagaggaa

SEQ ID NO: 1718468 - RNA, 17 nt, Human
ggcugcugaaggcucga

SEQ ID NO: 1718469 - RNA, 15 nt, Human
ggcugcugaaggcuc

SEQ ID NO: 1718470 - RNA, 18 nt, Human
ggcugcugaaggcucgag

SEQ ID NO: 1718471 - RNA, 14 nt, Human
ggcugcugaaggcu

SEQ ID NO: 1718472 - RNA, 13 nt, Human
ggcugcagggagu

SEQ ID NO: 1718473 - RNA, 12 nt, Human
ggcugcagggag

SEQ ID NO: 1718474 - RNA, 22 nt, Human
ggcugcuucaaggauccugagc

SEQ ID NO: 1718475 - RNA, 14 nt, Human
ggcugcuucaagga

SEQ ID NO: 1718476 - RNA, 12 nt, Human
ggcugcuucaag

SEQ ID NO: 1718477 - RNA, 11 nt, Human
ggcugcuucaa

SEQ ID NO: 1718478 - RNA, 21 nt, Human
gggcacagaaaauggaagaca

SEQ ID NO: 1718479 - RNA, 20 nt, Human
gggcacagaaaauggaagac

SEQ ID NO: 1718480 - RNA, 18 nt, Human
gggcacagaaaauggaag

SEQ ID NO: 1718481 - RNA, 23 nt, Human
gggcacaccgggcacucagaaga

SEQ ID NO: 1718482 - RNA, 16 nt, Human
gggcacagggucucua

SEQ ID NO: 1718483 - RNA, 13 nt, Human
gggcacagggucu

SEQ ID NO: 1718484 - RNA, 19 nt, Human
gggcacucagaagacacug

SEQ ID NO: 1718485 - RNA, 16 nt, Human
gggcacucagaagaca

SEQ ID NO: 1718486 - RNA, 14 nt, Human
gggcaccggggccu

SEQ ID NO: 1718487 - RNA, 18 nt, Human
gggcagaaggaagacuuc

SEQ ID NO: 1718488 - RNA, 14 nt, Human
gggcagaaggaaga

SEQ ID NO: 1718489 - RNA, 20 nt, Human
gggcacucagaagacacuga

SEQ ID NO: 1718490 - RNA, 16 nt, Human
gggcacugguggcccg

SEQ ID NO: 1718491 - RNA, 13 nt, Human
gggcacugguggc

SEQ ID NO: 1718492 - RNA, 12 nt, Human
gggcagagcaga

SEQ ID NO: 1718493 - RNA, 11 nt, Human
gggcagagcag

SEQ ID NO: 1718494 - RNA, 17 nt, Human
gggcagguugguggggg

SEQ ID NO: 1718495 - RNA, 14 nt, Human
gggagugagcuggu

SEQ ID NO: 1718496 - RNA, 11 nt, Human
gggagugagcu

SEQ ID NO: 1718497 - RNA, 18 nt, Human
gggagugacagaggcagc

SEQ ID NO: 1718498 - RNA, 16 nt, Human
gggaggugaccccagg

SEQ ID NO: 1718499 - RNA, 17 nt, Human
gggaggugggauccucc

SEQ ID NO: 1718500 - RNA, 13 nt, Human
gggacugagaaau

SEQ ID NO: 1718501 - RNA, 13 nt, Human
gggauagagagag

SEQ ID NO: 1718502 - RNA, 21 nt, Human
gggauaugauuuaaaucagcc

SEQ ID NO: 1718503 - RNA, 16 nt, Human
gggauccuccaggugc

SEQ ID NO: 1718504 - RNA, 15 nt, Human
gggauccuccaggug

SEQ ID NO: 1718505 - RNA, 18 nt, Human
gggcaacccuggugacca

SEQ ID NO: 1718506 - RNA, 23 nt, Human
gggauccuggaguucugguuccu

SEQ ID NO: 1718507 - RNA, 17 nt, Human
gggcccagagagggugg

SEQ ID NO: 1718508 - RNA, 16 nt, Human
gggccacagagaaagu

SEQ ID NO: 1718509 - RNA, 23 nt, Human
gggccacagagaaaguacuucuc

SEQ ID NO: 1718510 - RNA, 12 nt, Human
gggcaugacacg

SEQ ID NO: 1718511 - RNA, 20 nt, Human
gggcauggccagguggccac

SEQ ID NO: 1718512 - RNA, 17 nt, Human
gggcauggccagguggc

SEQ ID NO: 1718513 - RNA, 15 nt, Human
gggcauggccaggug

SEQ ID NO: 1718514 - RNA, 13 nt, Human
gggccuggcuccc

SEQ ID NO: 1718515 - RNA, 17 nt, Human
gggccuggcucaggugg

SEQ ID NO: 1718516 - RNA, 18 nt, Human
gggccuggccugagcugg

SEQ ID NO: 1718517 - RNA, 14 nt, Human
gggccuggccugag

SEQ ID NO: 1718518 - RNA, 19 nt, Human
gggccuggccugagcuggg

SEQ ID NO: 1718519 - RNA, 13 nt, Human
gggccuggccuga

SEQ ID NO: 1718520 - RNA, 13 nt, Human
gggcccugccucc

SEQ ID NO: 1718521 - RNA, 22 nt, Human
gggccccugccucucugcaggu

SEQ ID NO: 1718522 - RNA, 21 nt, Human
gggccccugccucucugcagg

SEQ ID NO: 1718523 - RNA, 19 nt, Human
gggccccugccucucugca

SEQ ID NO: 1718524 - RNA, 18 nt, Human
gggccccugccucucugc

SEQ ID NO: 1718525 - RNA, 17 nt, Human
gggccccugccucucug

SEQ ID NO: 1718526 - RNA, 15 nt, Human
gggccccugccucuc

SEQ ID NO: 1718527 - RNA, 13 nt, Human
gggccccugccuc

SEQ ID NO: 1718528 - RNA, 14 nt, Human
gggccccagaggcu

SEQ ID NO: 1718529 - RNA, 14 nt, Human
gggucucacucugu

SEQ ID NO: 1718530 - RNA, 17 nt, Human
ggguaagugagagaggg

SEQ ID NO: 1718531 - RNA, 21 nt, Human
gggucugaggaauccagaccc

SEQ ID NO: 1718532 - RNA, 12 nt, Human
gggucugaggaa

SEQ ID NO: 1718533 - RNA, 12 nt, Human
gggguggccucc

SEQ ID NO: 1718534 - RNA, 18 nt, Human
ggggugcugggccccugc

SEQ ID NO: 1718535 - RNA, 17 nt, Human
gggguggggaccucagg

SEQ ID NO: 1718536 - RNA, 20 nt, Human
gggguggggggggugcuggg

SEQ ID NO: 1718537 - RNA, 22 nt, Human
ggggcugcaccggcuggccugg

SEQ ID NO: 1718538 - RNA, 21 nt, Human
ggggcugcaccggcuggccug

SEQ ID NO: 1718539 - RNA, 12 nt, Human
ggggcugcaccg

SEQ ID NO: 1718540 - RNA, 19 nt, Human
ggggcugaggugggaggau

SEQ ID NO: 1718541 - RNA, 23 nt, Human
ggggcugcaccggcuggccuggc

SEQ ID NO: 1718542 - RNA, 22 nt, Human
gggggaggugggauccuccagg

SEQ ID NO: 1718543 - RNA, 18 nt, Human
ggggaggggcugugggcg

SEQ ID NO: 1718544 - RNA, 24 nt, Human
ggggaaaaucagccugcuccagcu

SEQ ID NO: 1718545 - RNA, 21 nt, Human
ggggaaaaucagccugcucca

SEQ ID NO: 1718546 - RNA, 19 nt, Human
ggggaaaaucagccugcuc

SEQ ID NO: 1718547 - RNA, 17 nt, Human
ggggaaaaucagccugc

SEQ ID NO: 1718548 - RNA, 16 nt, Human
ggggaaaaucagccug

SEQ ID NO: 1718549 - RNA, 11 nt, Human
gggccugggcc

SEQ ID NO: 1718550 - RNA, 16 nt, Human
ggggcaacccugguga

SEQ ID NO: 1718551 - RNA, 17 nt, Human
ggggcugaggugggagg

SEQ ID NO: 1718552 - RNA, 19 nt, Human
ggguuccuuccucugagcc

SEQ ID NO: 1718553 - RNA, 12 nt, Human
ggguucuaccca

SEQ ID NO: 1718554 - RNA, 21 nt, Human
ggguuccuuccucugagccuu

SEQ ID NO: 1718555 - RNA, 20 nt, Human
ggguuccuuccucugagccu

SEQ ID NO: 1718556 - RNA, 17 nt, Human
ggguucuacccaggugc

SEQ ID NO: 1718557 - RNA, 16 nt, Human
ggguucuuucuuccuc

SEQ ID NO: 1718558 - RNA, 17 nt, Human
ggguucuuucuuccucu

SEQ ID NO: 1718559 - RNA, 19 nt, Human
ggguucuuucuuccucugc

SEQ ID NO: 1718560 - RNA, 23 nt, Human
ggguucaagcgauucuucugcuu

SEQ ID NO: 1718561 - RNA, 22 nt, Human
ggguucaagcgauucuucugcu

SEQ ID NO: 1718562 - RNA, 18 nt, Human
gggugcugggccccugcc

SEQ ID NO: 1718563 - RNA, 17 nt, Human
gggugcugggccccugc

SEQ ID NO: 1718564 - RNA, 19 nt, Human
gggugacagagcaagugag

SEQ ID NO: 1718565 - RNA, 17 nt, Human
gggugaagugaagacaa

SEQ ID NO: 1718566 - RNA, 12 nt, Human
ggucacucuggc

SEQ ID NO: 1718567 - RNA, 18 nt, Human
ggucacaggacucugccu

SEQ ID NO: 1718568 - RNA, 16 nt, Human
ggucacaggacucugc

SEQ ID NO: 1718569 - RNA, 11 nt, Human
ggucagagccu

SEQ ID NO: 1718570 - RNA, 16 nt, Human
ggucccaccccacaca

SEQ ID NO: 1718571 - RNA, 15 nt, Human
ggucccaccccacac

SEQ ID NO: 1718572 - RNA, 17 nt, Human
gguacuuguggacacag

SEQ ID NO: 1718573 - RNA, 16 nt, Human
gguacuuguggacaca

SEQ ID NO: 1718574 - RNA, 22 nt, Human
gguagaaauaucugaaaaugua

SEQ ID NO: 1718575 - RNA, 20 nt, Human
gguacuuguggacacagcuc

SEQ ID NO: 1718576 - RNA, 13 nt, Human
gguacccacugcu

SEQ ID NO: 1718577 - RNA, 16 nt, Human
gguacccacugcucug

SEQ ID NO: 1718578 - RNA, 11 nt, Human
gguacccacug

SEQ ID NO: 1718579 - RNA, 22 nt, Human
gguagaagcccuucuaccuucc

SEQ ID NO: 1718580 - RNA, 23 nt, Human
gguagaaauaucugaaaauguau

SEQ ID NO: 1718581 - RNA, 13 nt, Human
gguugagguuuca

SEQ ID NO: 1718582 - RNA, 18 nt, Human
gguucuuucauuugcuuu

SEQ ID NO: 1718583 - RNA, 16 nt, Human
gguucuuucuuccucu

SEQ ID NO: 1718584 - RNA, 14 nt, Human
gguucuuucuuccu

SEQ ID NO: 1718585 - RNA, 21 nt, Human
gguucaaagauauuuugcuuu

SEQ ID NO: 1718586 - RNA, 13 nt, Human
gguucaaagauau

SEQ ID NO: 1718587 - RNA, 23 nt, Human
gguuauuuugauguaaagauguu

SEQ ID NO: 1718588 - RNA, 21 nt, Human
gguuacccaguuagcucucaa

SEQ ID NO: 1718589 - RNA, 13 nt, Human
gguuauggagagg

SEQ ID NO: 1718590 - RNA, 22 nt, Human
gguuaguggauggaaggggcug

SEQ ID NO: 1718591 - RNA, 21 nt, Human
gguuaguggauggaaggggcu

SEQ ID NO: 1718592 - RNA, 17 nt, Human
gguuaggcauuguggga

SEQ ID NO: 1718593 - RNA, 17 nt, Human
ggugucaagagggucug

SEQ ID NO: 1718594 - RNA, 19 nt, Human
ggugucaagagggucugag

SEQ ID NO: 1718595 - RNA, 19 nt, Human
ggugucaccugaagacuca

SEQ ID NO: 1718596 - RNA, 15 nt, Human
ggugguuuucuguuc

SEQ ID NO: 1718597 - RNA, 18 nt, Human
ggugguuuucuguucuuu

SEQ ID NO: 1718598 - RNA, 21 nt, Human
ggugguuauggagaggguguc

SEQ ID NO: 1718599 - RNA, 17 nt, Human
ggugguuucagaaaugu

SEQ ID NO: 1718600 - RNA, 18 nt, Human
ggugguuucagaaaugug

SEQ ID NO: 1718601 - RNA, 12 nt, Human
gguggcuggguu

SEQ ID NO: 1718602 - RNA, 15 nt, Human
gguggugaccucugc

SEQ ID NO: 1718603 - RNA, 14 nt, Human
gguggugaccucug

SEQ ID NO: 1718604 - RNA, 16 nt, Human
gguggugaccucugcc

SEQ ID NO: 1718605 - RNA, 15 nt, Human
ggugagaagcagagg

SEQ ID NO: 1718606 - RNA, 16 nt, Human
ggugagaggggaacag

SEQ ID NO: 1718607 - RNA, 15 nt, Human
ggugcgaucuggguu

SEQ ID NO: 1718608 - RNA, 20 nt, Human
ggugcuaucucccccagccc

SEQ ID NO: 1718609 - RNA, 19 nt, Human
ggugcuaucucccccagcc

SEQ ID NO: 1718610 - RNA, 17 nt, Human
ggugcuaucucccccag

SEQ ID NO: 1718611 - RNA, 16 nt, Human
ggugcuaucuccccca

SEQ ID NO: 1718612 - RNA, 22 nt, Human
gguggccucccaacucacccca

SEQ ID NO: 1718613 - RNA, 23 nt, Human
gguggccacuccagaccccuggc

SEQ ID NO: 1718614 - RNA, 22 nt, Human
gguggccacuccagaccccugg

SEQ ID NO: 1718615 - RNA, 21 nt, Human
gguggccacuccagaccccug

SEQ ID NO: 1718616 - RNA, 20 nt, Human
gguggccacuccagaccccu

SEQ ID NO: 1718617 - RNA, 23 nt, Human
gguggccucccaacucaccccag

SEQ ID NO: 1718618 - RNA, 22 nt, Human
gguggcagugggagcugccugu

SEQ ID NO: 1718619 - RNA, 19 nt, Human
gguggcagugggagcugcc

SEQ ID NO: 1718620 - RNA, 21 nt, Human
ggugcugccauccagguucag

SEQ ID NO: 1718621 - RNA, 21 nt, Human
ggugcuaucucccccagcccc

SEQ ID NO: 1718622 - RNA, 15 nt, Human
ggugcugccauccag

SEQ ID NO: 1718623 - RNA, 22 nt, Human
ggugaccagcaccaucucuccu

SEQ ID NO: 1718624 - RNA, 14 nt, Human
ggucugacccacug

SEQ ID NO: 1718625 - RNA, 23 nt, Human
ggucucacucugucgcccagucu

SEQ ID NO: 1718626 - RNA, 22 nt, Human
ggucucacucugucgcccaguc

SEQ ID NO: 1718627 - RNA, 21 nt, Human
ggucucacuauguugcccagg

SEQ ID NO: 1718628 - RNA, 17 nt, Human
ggucccaccccacacac

SEQ ID NO: 1718629 - RNA, 17 nt, Human
ggucucaaacuccugac

SEQ ID NO: 1718630 - RNA, 19 nt, Human
gccuucggccuccauccug

SEQ ID NO: 1718631 - RNA, 18 nt, Human
gccuucggccuccauccu

SEQ ID NO: 1718632 - RNA, 13 nt, Human
gccuucagcucua

SEQ ID NO: 1718633 - RNA, 16 nt, Human
gccuucagcucuacag

SEQ ID NO: 1718634 - RNA, 18 nt, Human
gccuguaaucacagcuac

SEQ ID NO: 1718635 - RNA, 17 nt, Human
gccugguggcagcugcg

SEQ ID NO: 1718636 - RNA, 16 nt, Human
gccugguggcagcugc

SEQ ID NO: 1718637 - RNA, 15 nt, Human
gccugguggcagcug

SEQ ID NO: 1718638 - RNA, 22 nt, Human
gccuuauggaacacucugagac

SEQ ID NO: 1718639 - RNA, 21 nt, Human
gccuuauggaacacucugaga

SEQ ID NO: 1718640 - RNA, 23 nt, Human
gccuuauggaacacucugagacu

SEQ ID NO: 1718641 - RNA, 17 nt, Human
gccuuagaaccuuucuu

SEQ ID NO: 1718642 - RNA, 20 nt, Human
gccuuagaagucacacagua

SEQ ID NO: 1718643 - RNA, 16 nt, Human
gccuuagaaccuuucu

SEQ ID NO: 1718644 - RNA, 19 nt, Human
gccuuacccucauguucuu

SEQ ID NO: 1718645 - RNA, 22 nt, Human
gcuagacgagcaggcuucuucc

SEQ ID NO: 1718646 - RNA, 21 nt, Human
gcuagacgagcaggcuucuuc

SEQ ID NO: 1718647 - RNA, 18 nt, Human
gcuaacauggaaguacua

SEQ ID NO: 1718648 - RNA, 17 nt, Human
gcuaacauggaaguacu

SEQ ID NO: 1718649 - RNA, 15 nt, Human
gcgugagccacugca

SEQ ID NO: 1718650 - RNA, 16 nt, Human
gcgugagccacugcac

SEQ ID NO: 1718651 - RNA, 16 nt, Human
gcgugagaccugcccc

SEQ ID NO: 1718652 - RNA, 14 nt, Human
gcgugagccacugc

SEQ ID NO: 1718653 - RNA, 22 nt, Human
gcuacacaggggaaaagaggag

SEQ ID NO: 1718654 - RNA, 23 nt, Human
gcgguccacccaggagccccgag

SEQ ID NO: 1718655 - RNA, 23 nt, Human
gcggggacagcuccuucuguccu

SEQ ID NO: 1718656 - RNA, 19 nt, Human
gcggggacagcuccuucug

SEQ ID NO: 1718657 - RNA, 23 nt, Human
gcggacagccacggccaggccag

SEQ ID NO: 1718658 - RNA, 19 nt, Human
gcggacagccacggccagg

SEQ ID NO: 1718659 - RNA, 19 nt, Human
gcggaaugaaccacaucuu

SEQ ID NO: 1718660 - RNA, 17 nt, Human
gcgcugccccuggcagc

SEQ ID NO: 1718661 - RNA, 19 nt, Human
gcgcuggccgggaccccga

SEQ ID NO: 1718662 - RNA, 14 nt, Human
gcgcugccccuggc

SEQ ID NO: 1718663 - RNA, 21 nt, Human
gcgccuacaggagugagcacu

SEQ ID NO: 1718664 - RNA, 20 nt, Human
gcgccuacaggagugagcac

SEQ ID NO: 1718665 - RNA, 15 nt, Human
gccucugacacacag

SEQ ID NO: 1718666 - RNA, 16 nt, Human
gccucugcacuccccu

SEQ ID NO: 1718667 - RNA, 16 nt, Human
gccucugacacacagc

SEQ ID NO: 1718668 - RNA, 20 nt, Human
gccucugcacuccccugcug

SEQ ID NO: 1718669 - RNA, 19 nt, Human
gccucugcacuccccugcu

SEQ ID NO: 1718670 - RNA, 18 nt, Human
gccucugcacuccccugc

SEQ ID NO: 1718671 - RNA, 17 nt, Human
gccucugcacuccccug

SEQ ID NO: 1718672 - RNA, 15 nt, Human
gccugaagucacaca

SEQ ID NO: 1718673 - RNA, 21 nt, Human
gccucugcacuccccugcugg

SEQ ID NO: 1718674 - RNA, 12 nt, Human
gccucugcauuc

SEQ ID NO: 1718675 - RNA, 15 nt, Human
gccucugcauucagg

SEQ ID NO: 1718676 - RNA, 12 nt, Human
gccugcccaggc

SEQ ID NO: 1718677 - RNA, 11 nt, Human
gccugcccagg

SEQ ID NO: 1718678 - RNA, 14 nt, Human
gccuggacccugug

SEQ ID NO: 1718679 - RNA, 20 nt, Human
gccucccgaauagcugggac

SEQ ID NO: 1718680 - RNA, 23 nt, Human
gccucccgaguagcugggacuac

SEQ ID NO: 1718681 - RNA, 21 nt, Human
gccucccgaguagcugggacu

SEQ ID NO: 1718682 - RNA, 19 nt, Human
gccucccgaauagcuggga

SEQ ID NO: 1718683 - RNA, 18 nt, Human
gccucccgaauagcuggg

SEQ ID NO: 1718684 - RNA, 22 nt, Human
gccucagccucccaaagugcug

SEQ ID NO: 1718685 - RNA, 14 nt, Human
gccucagccuccca

SEQ ID NO: 1718686 - RNA, 12 nt, Human
gccucagccucc

SEQ ID NO: 1718687 - RNA, 15 nt, Human
gccucucccaucacu

SEQ ID NO: 1718688 - RNA, 18 nt, Human
gccucucugcaggucccu

SEQ ID NO: 1718689 - RNA, 17 nt, Human
gccucucugcagguccc

SEQ ID NO: 1718690 - RNA, 16 nt, Human
gccucucugcaggucc

SEQ ID NO: 1718691 - RNA, 14 nt, Human
gccucucugcaggu

SEQ ID NO: 1718692 - RNA, 10 nt, Human
gccucucugc

SEQ ID NO: 1718693 - RNA, 15 nt, Human
gccguggcuucccgc

SEQ ID NO: 1718694 - RNA, 13 nt, Human
gccguggcuuccc

SEQ ID NO: 1718695 - RNA, 12 nt, Human
gccguggcuucc

SEQ ID NO: 1718696 - RNA, 11 nt, Human
gccguggcuuc

SEQ ID NO: 1718697 - RNA, 23 nt, Human
gccgucuaccugaggggccucuu

SEQ ID NO: 1718698 - RNA, 22 nt, Human
gccgucuaccugaggggccucu

SEQ ID NO: 1718699 - RNA, 20 nt, Human
gccgucuaccugaggggccu

SEQ ID NO: 1718700 - RNA, 18 nt, Human
gccgucuaccugaggggc

SEQ ID NO: 1718701 - RNA, 14 nt, Human
gccuaaggcugaac

SEQ ID NO: 1718702 - RNA, 17 nt, Human
gccuauuuuaauaaaca

SEQ ID NO: 1718703 - RNA, 21 nt, Human
gccucagcauccuggcacccg

SEQ ID NO: 1718704 - RNA, 18 nt, Human
gccucagcauccuggcac

SEQ ID NO: 1718705 - RNA, 24 nt, Human
gccucaagugauucuccugccuca

SEQ ID NO: 1718706 - RNA, 22 nt, Human
gccucaagugauucuccugccu

SEQ ID NO: 1718707 - RNA, 13 nt, Human
gcccuucucucca

SEQ ID NO: 1718708 - RNA, 22 nt, Human
gcccuuccucuccacugccuuc

SEQ ID NO: 1718709 - RNA, 16 nt, Human
gccgagauagccaagg

SEQ ID NO: 1718710 - RNA, 19 nt, Human
gccgcagcccugcagaggg

SEQ ID NO: 1718711 - RNA, 12 nt, Human
gccgggguggau

SEQ ID NO: 1718712 - RNA, 17 nt, Human
gccgcagcccugcagag

SEQ ID NO: 1718713 - RNA, 16 nt, Human
gccgcagcccugcaga

SEQ ID NO: 1718714 - RNA, 15 nt, Human
gccgcagcccugcag

SEQ ID NO: 1718715 - RNA, 19 nt, Human
gccgagauagccaaggcca

SEQ ID NO: 1718716 - RNA, 17 nt, Human
gccgagauagccaaggc

SEQ ID NO: 1718717 - RNA, 17 nt, Human
gccccgugggguuccuc

SEQ ID NO: 1718718 - RNA, 21 nt, Human
gccccgucccccucuggcucc

SEQ ID NO: 1718719 - RNA, 17 nt, Human
gccccgucccccucugg

SEQ ID NO: 1718720 - RNA, 23 nt, Human
gccccgaggccuucucugaagga

SEQ ID NO: 1718721 - RNA, 23 nt, Human
gccccauucugccugcccaggcc

SEQ ID NO: 1718722 - RNA, 22 nt, Human
gccccauucugccugcccaggc

SEQ ID NO: 1718723 - RNA, 14 nt, Human
gccccgcccaggcu

SEQ ID NO: 1718724 - RNA, 19 nt, Human
gccccugcacuccagccug

SEQ ID NO: 1718725 - RNA, 23 nt, Human
gccccuggcagccccuguucugg

SEQ ID NO: 1718726 - RNA, 13 nt, Human
gccccugcacaaa

SEQ ID NO: 1718727 - RNA, 18 nt, Human
gccccucccacagcgcug

SEQ ID NO: 1718728 - RNA, 17 nt, Human
gccccuucccccuccaa

SEQ ID NO: 1718729 - RNA, 21 nt, Human
gccccucagggucccuggugg

SEQ ID NO: 1718730 - RNA, 19 nt, Human
gccccucagggucccuggu

SEQ ID NO: 1718731 - RNA, 23 nt, Human
gccccucaacucuccuccagagu

SEQ ID NO: 1718732 - RNA, 22 nt, Human
gcccucugcccacucccugcaa

SEQ ID NO: 1718733 - RNA, 20 nt, Human
gcccgggcucugccucccau

SEQ ID NO: 1718734 - RNA, 19 nt, Human
gcccgggcucugccuccca

SEQ ID NO: 1718735 - RNA, 21 nt, Human
gcccgggcucugccucccauc

SEQ ID NO: 1718736 - RNA, 15 nt, Human
gcccucccugccccu

SEQ ID NO: 1718737 - RNA, 18 nt, Human
gcccgggcucugccuccc

SEQ ID NO: 1718738 - RNA, 15 nt, Human
gcccgggcucugccu

SEQ ID NO: 1718739 - RNA, 14 nt, Human
gcccgggcucugcc

SEQ ID NO: 1718740 - RNA, 13 nt, Human
gcccgggcucugc

SEQ ID NO: 1718741 - RNA, 12 nt, Human
gcccgggcucug

SEQ ID NO: 1718742 - RNA, 15 nt, Human
gcccggcuccaggcu

SEQ ID NO: 1718743 - RNA, 14 nt, Human
gcccggcuccaggc

SEQ ID NO: 1718744 - RNA, 13 nt, Human
gcccggcuccagg

SEQ ID NO: 1718745 - RNA, 20 nt, Human
gccccuucugacccaugcug

SEQ ID NO: 1718746 - RNA, 19 nt, Human
gccccuucugacccaugcu

SEQ ID NO: 1718747 - RNA, 18 nt, Human
gcccaggccuccuacagc

SEQ ID NO: 1718748 - RNA, 16 nt, Human
gcccaggaaaggcucc

SEQ ID NO: 1718749 - RNA, 15 nt, Human
gcccaggaaaggcuc

SEQ ID NO: 1718750 - RNA, 12 nt, Human
gcccaggaaagg

SEQ ID NO: 1718751 - RNA, 11 nt, Human
gcccaggcugg

SEQ ID NO: 1718752 - RNA, 17 nt, Human
gcccaggccugccuguu

SEQ ID NO: 1718753 - RNA, 15 nt, Human
gcccaggcuggcgug

SEQ ID NO: 1718754 - RNA, 14 nt, Human
gcccaggcuggcgu

SEQ ID NO: 1718755 - RNA, 16 nt, Human
gcccaggcuggcgugc

SEQ ID NO: 1718756 - RNA, 22 nt, Human
gcccagucuggaaugcaguggu

SEQ ID NO: 1718757 - RNA, 15 nt, Human
gcccaguugggugga

SEQ ID NO: 1718758 - RNA, 21 nt, Human
gccccauucugccugcccagg

SEQ ID NO: 1718759 - RNA, 20 nt, Human
gccccauucugccugcccag

SEQ ID NO: 1718760 - RNA, 18 nt, Human
gccccauucugccugccc

SEQ ID NO: 1718761 - RNA, 17 nt, Human
gccccauucugccugcc

SEQ ID NO: 1718762 - RNA, 23 nt, Human
gccccauccucuguacagagccc

SEQ ID NO: 1718763 - RNA, 21 nt, Human
gccccagugcccacaggauca

SEQ ID NO: 1718764 - RNA, 17 nt, Human
gccccagugcccacagg

SEQ ID NO: 1718765 - RNA, 16 nt, Human
gccccagugcccacag

SEQ ID NO: 1718766 - RNA, 22 nt, Human
gcccaucugggggccucuucug

SEQ ID NO: 1718767 - RNA, 16 nt, Human
gcccaaagaugcagcc

SEQ ID NO: 1718768 - RNA, 15 nt, Human
gcccaaagaugcagc

SEQ ID NO: 1718769 - RNA, 16 nt, Human
gccauuuguguuuaua

SEQ ID NO: 1718770 - RNA, 19 nt, Human
gcccaaagugguauagaaa

SEQ ID NO: 1718771 - RNA, 15 nt, Human
gcccaccccucaaca

SEQ ID NO: 1718772 - RNA, 18 nt, Human
gcccacaggaucagucug

SEQ ID NO: 1718773 - RNA, 13 nt, Human
gcccacaggauca

SEQ ID NO: 1718774 - RNA, 19 nt, Human
gcccacaggaucagucuga

SEQ ID NO: 1718775 - RNA, 14 nt, Human
gccaugggacaggg

SEQ ID NO: 1718776 - RNA, 19 nt, Human
gccaugggacagggaggac

SEQ ID NO: 1718777 - RNA, 17 nt, Human
gccauuucuuccacaag

SEQ ID NO: 1718778 - RNA, 22 nt, Human
gccauuucuuccacaagagccc

SEQ ID NO: 1718779 - RNA, 20 nt, Human
gccauuucuuccacaagagc

SEQ ID NO: 1718780 - RNA, 17 nt, Human
gccaucccagccccaau

SEQ ID NO: 1718781 - RNA, 16 nt, Human
gccaucccagccccaa

SEQ ID NO: 1718782 - RNA, 15 nt, Human
gccaucccagcccca

SEQ ID NO: 1718783 - RNA, 14 nt, Human
gccaucccagcccc

SEQ ID NO: 1718784 - RNA, 13 nt, Human
gccaucccagccc

SEQ ID NO: 1718785 - RNA, 20 nt, Human
gccauccagguucagcuugu

SEQ ID NO: 1718786 - RNA, 19 nt, Human
gccauccagguucagcuug

SEQ ID NO: 1718787 - RNA, 18 nt, Human
gccagguggccacuccag

SEQ ID NO: 1718788 - RNA, 22 nt, Human
gccaggggaaaaucagccugcu

SEQ ID NO: 1718789 - RNA, 21 nt, Human
gccaggggaaaaucagccugc

SEQ ID NO: 1718790 - RNA, 17 nt, Human
gccaggggaaaaucagc

SEQ ID NO: 1718791 - RNA, 23 nt, Human
gccaggggaaaaucagccugcuc

SEQ ID NO: 1718792 - RNA, 18 nt, Human
gccaggaagccagcaggc

SEQ ID NO: 1718793 - RNA, 17 nt, Human
gccaggaagccagcagg

SEQ ID NO: 1718794 - RNA, 11 nt, Human
gccaggaagcc

SEQ ID NO: 1718795 - RNA, 19 nt, Human
gccaggaagccagcaggcu

SEQ ID NO: 1718796 - RNA, 20 nt, Human
gccaggaagccagcaggcuc

SEQ ID NO: 1718797 - RNA, 22 nt, Human
gccacguucuuacuaguuuccc

SEQ ID NO: 1718798 - RNA, 16 nt, Human
gccacggccaggccag

SEQ ID NO: 1718799 - RNA, 17 nt, Human
gccacggccaggccaga

SEQ ID NO: 1718800 - RNA, 21 nt, Human
gccacuauuguuagucucuug

SEQ ID NO: 1718801 - RNA, 15 nt, Human
gccacggccaggcca

SEQ ID NO: 1718802 - RNA, 14 nt, Human
gccacggccaggcc

SEQ ID NO: 1718803 - RNA, 18 nt, Human
gccacugcaccgggccac

SEQ ID NO: 1718804 - RNA, 17 nt, Human
gccacugcaccgggcca

SEQ ID NO: 1718805 - RNA, 19 nt, Human
gccacugcaccgggccaca

SEQ ID NO: 1718806 - RNA, 19 nt, Human
gccacuccagaccccuggc

SEQ ID NO: 1718807 - RNA, 18 nt, Human
gccacuccagaccccugg

SEQ ID NO: 1718808 - RNA, 16 nt, Human
gccacuccagaccccu

SEQ ID NO: 1718809 - RNA, 18 nt, Human
gccagagggagugacaga

SEQ ID NO: 1718810 - RNA, 15 nt, Human
gccagagacacaagc

SEQ ID NO: 1718811 - RNA, 12 nt, Human
gccagagacaca

SEQ ID NO: 1718812 - RNA, 15 nt, Human
gccagcugcuugggc

SEQ ID NO: 1718813 - RNA, 16 nt, Human
gccagcugcuugggcu

SEQ ID NO: 1718814 - RNA, 14 nt, Human
gccagcugcuuggg

SEQ ID NO: 1718815 - RNA, 22 nt, Human
gccagccuugaccauucuccac

SEQ ID NO: 1718816 - RNA, 21 nt, Human
gccagccuugaccauucucca

SEQ ID NO: 1718817 - RNA, 20 nt, Human
gccagccuugaccauucucc

SEQ ID NO: 1718818 - RNA, 14 nt, Human
gccagccuugacca

SEQ ID NO: 1718819 - RNA, 12 nt, Human
gccagccuugac

SEQ ID NO: 1718820 - RNA, 20 nt, Human
gccagccgagauagccaagg

SEQ ID NO: 1718821 - RNA, 21 nt, Human
gccagccgagauagccaaggc

SEQ ID NO: 1718822 - RNA, 16 nt, Human
gccagauucuuuccug

SEQ ID NO: 1718823 - RNA, 20 nt, Human
gccagagggagugacagagg

SEQ ID NO: 1718824 - RNA, 19 nt, Human
gccagagggagugacagag

SEQ ID NO: 1718825 - RNA, 19 nt, Human
gccagauucuuuccugagg

SEQ ID NO: 1718826 - RNA, 17 nt, Human
gccagauucuuuccuga

SEQ ID NO: 1718827 - RNA, 22 nt, Human
gcauuuugcuaaaugugaauga

SEQ ID NO: 1718828 - RNA, 12 nt, Human
gcauuuuguaau

SEQ ID NO: 1718829 - RNA, 20 nt, Human
gccaaaggaagcacaugccu

SEQ ID NO: 1718830 - RNA, 16 nt, Human
gccaaaggaagcacau

SEQ ID NO: 1718831 - RNA, 14 nt, Human
gccaaaggaagcac

SEQ ID NO: 1718832 - RNA, 19 nt, Human
gccaaacucaccugccccu

SEQ ID NO: 1718833 - RNA, 21 nt, Human
gccaaacucaccugccccuca

SEQ ID NO: 1718834 - RNA, 17 nt, Human
gcauuuuacuguacaga

SEQ ID NO: 1718835 - RNA, 16 nt, Human
gcauuuuacuguacag

SEQ ID NO: 1718836 - RNA, 21 nt, Human
gcauuuggugguuucagaaau

SEQ ID NO: 1718837 - RNA, 23 nt, Human
gcauuugcugaauacagaggcaa

SEQ ID NO: 1718838 - RNA, 12 nt, Human
gcauuccccacu

SEQ ID NO: 1718839 - RNA, 12 nt, Human
gcauuccccagg

SEQ ID NO: 1718840 - RNA, 15 nt, Human
gcauucucacuccua

SEQ ID NO: 1718841 - RNA, 13 nt, Human
gcauucucacucc

SEQ ID NO: 1718842 - RNA, 18 nt, Human
gcauucucacuccuaccu

SEQ ID NO: 1718843 - RNA, 20 nt, Human
gcauuagauuucucauuugc

SEQ ID NO: 1718844 - RNA, 15 nt, Human
gcaugcugucccuua

SEQ ID NO: 1718845 - RNA, 17 nt, Human
gcauguuugugauugac

SEQ ID NO: 1718846 - RNA, 15 nt, Human
gcaugaauuugugaa

SEQ ID NO: 1718847 - RNA, 17 nt, Human
gcaucaggccaggcccu

SEQ ID NO: 1718848 - RNA, 16 nt, Human
gcaucaggccaggccc

SEQ ID NO: 1718849 - RNA, 15 nt, Human
gcaucaggccaggcc

SEQ ID NO: 1718850 - RNA, 13 nt, Human
gcaucaggccagg

SEQ ID NO: 1718851 - RNA, 20 nt, Human
gcaugacacgaauauugcug

SEQ ID NO: 1718852 - RNA, 17 nt, Human
gcaugaauuugugaagg

SEQ ID NO: 1718853 - RNA, 22 nt, Human
gcaugccuggauggggcugcac

SEQ ID NO: 1718854 - RNA, 17 nt, Human
gcaugccuggauggggc

SEQ ID NO: 1718855 - RNA, 18 nt, Human
gcagugggagcugccugu

SEQ ID NO: 1718856 - RNA, 17 nt, Human
gcagugggagcugccug

SEQ ID NO: 1718857 - RNA, 15 nt, Human
gcauauucaggaagc

SEQ ID NO: 1718858 - RNA, 23 nt, Human
gcauauuauuuuauguugcauag

SEQ ID NO: 1718859 - RNA, 18 nt, Human
gcauauuauuuuauguug

SEQ ID NO: 1718860 - RNA, 20 nt, Human
gcauauucaggaagcucagg

SEQ ID NO: 1718861 - RNA, 18 nt, Human
gcauauucaggaagcuca

SEQ ID NO: 1718862 - RNA, 17 nt, Human
gcauauucaggaagcuc

SEQ ID NO: 1718863 - RNA, 21 nt, Human
gcaucaagaugugacauguuu

SEQ ID NO: 1718864 - RNA, 19 nt, Human
gcauauuuauaaaaauaaa

SEQ ID NO: 1718865 - RNA, 17 nt, Human
gcagggagggccugggc

SEQ ID NO: 1718866 - RNA, 14 nt, Human
gcagggagggccug

SEQ ID NO: 1718867 - RNA, 20 nt, Human
gcaggauucuuccucccucc

SEQ ID NO: 1718868 - RNA, 12 nt, Human
gcagggcucagc

SEQ ID NO: 1718869 - RNA, 14 nt, Human
gcagggcucagcgg

SEQ ID NO: 1718870 - RNA, 16 nt, Human
gcagggagggcuucug

SEQ ID NO: 1718871 - RNA, 22 nt, Human
gcagggagggccugggccccag

SEQ ID NO: 1718872 - RNA, 18 nt, Human
gcagggagggccugggcc

SEQ ID NO: 1718873 - RNA, 16 nt, Human
gcagugggagcugccu

SEQ ID NO: 1718874 - RNA, 23 nt, Human
gcagugcuuccaaggauggacca

SEQ ID NO: 1718875 - RNA, 11 nt, Human
gcaggucccua

SEQ ID NO: 1718876 - RNA, 10 nt, Human
gcaggucccu

SEQ ID NO: 1718877 - RNA, 13 nt, Human
gcaggucccuaau

SEQ ID NO: 1718878 - RNA, 12 nt, Human
gcaggucccuaa

SEQ ID NO: 1718879 - RNA, 14 nt, Human
gcagaagacaguau

SEQ ID NO: 1718880 - RNA, 14 nt, Human
gcagaaggaagacu

SEQ ID NO: 1718881 - RNA, 13 nt, Human
gcagaaggaagac

SEQ ID NO: 1718882 - RNA, 12 nt, Human
gcagaaggaaga

SEQ ID NO: 1718883 - RNA, 23 nt, Human
gcacugggcuuggggaccagagc

SEQ ID NO: 1718884 - RNA, 22 nt, Human
gcacugggcuuggggaccagag

SEQ ID NO: 1718885 - RNA, 18 nt, Human
gcacccggccccugcugg

SEQ ID NO: 1718886 - RNA, 17 nt, Human
gcacuaaggugugcucu

SEQ ID NO: 1718887 - RNA, 18 nt, Human
gcacuaaggugugcucug

SEQ ID NO: 1718888 - RNA, 19 nt, Human
gcacuaaggugugcucuga

SEQ ID NO: 1718889 - RNA, 17 nt, Human
gcacugaggaccagcca

SEQ ID NO: 1718890 - RNA, 14 nt, Human
gcaaugaccuuuca

SEQ ID NO: 1718891 - RNA, 13 nt, Human
gcaaugaccuuuc

SEQ ID NO: 1718892 - RNA, 19 nt, Human
gcacagcuaacauggaagu

SEQ ID NO: 1718893 - RNA, 16 nt, Human
gcacagcuucauuucc

SEQ ID NO: 1718894 - RNA, 21 nt, Human
gcacagcuucauuuccugugu

SEQ ID NO: 1718895 - RNA, 19 nt, Human
gcaccacugcacuccagcc

SEQ ID NO: 1718896 - RNA, 15 nt, Human
gcaccuccugccucg

SEQ ID NO: 1718897 - RNA, 14 nt, Human
gcaccuccugccuc

SEQ ID NO: 1718898 - RNA, 17 nt, Human
gcacccggccccugcug

SEQ ID NO: 1718899 - RNA, 15 nt, Human
gcacccggccccugc

SEQ ID NO: 1718900 - RNA, 14 nt, Human
gcacccggccccug

SEQ ID NO: 1718901 - RNA, 17 nt, Human
gcagaguugaagacaga

SEQ ID NO: 1718902 - RNA, 16 nt, Human
gcagaguugaagacag

SEQ ID NO: 1718903 - RNA, 19 nt, Human
gcagaguugaagacagagc

SEQ ID NO: 1718904 - RNA, 20 nt, Human
gcagaguugaagacagagcu

SEQ ID NO: 1718905 - RNA, 12 nt, Human
gcagcaauaaag

SEQ ID NO: 1718906 - RNA, 15 nt, Human
gcagcacagcugaga

SEQ ID NO: 1718907 - RNA, 19 nt, Human
gcagagaccaucccugaag

SEQ ID NO: 1718908 - RNA, 17 nt, Human
gcagagaccaucccuga

SEQ ID NO: 1718909 - RNA, 15 nt, Human
gcagagaccaucccu

SEQ ID NO: 1718910 - RNA, 14 nt, Human
gcagagaccauccc

SEQ ID NO: 1718911 - RNA, 15 nt, Human
gcagaguugaagaca

SEQ ID NO: 1718912 - RNA, 21 nt, Human
gcagagaauucucuuauccaa

SEQ ID NO: 1718913 - RNA, 23 nt, Human
gcagagaaugaaagggcccagag

SEQ ID NO: 1718914 - RNA, 22 nt, Human
gcagagaaugaaagggcccaga

SEQ ID NO: 1718915 - RNA, 21 nt, Human
gcagagaaugaaagggcccag

SEQ ID NO: 1718916 - RNA, 20 nt, Human
gcagagaaugaaagggccca

SEQ ID NO: 1718917 - RNA, 19 nt, Human
gcagagaaugaaagggccc

SEQ ID NO: 1718918 - RNA, 18 nt, Human
gcagaaggaagacuucau

SEQ ID NO: 1718919 - RNA, 20 nt, Human
gcaggaggaucacuugaguc

SEQ ID NO: 1718920 - RNA, 21 nt, Human
gcaggaguuucguuuucaaaa

SEQ ID NO: 1718921 - RNA, 20 nt, Human
gcaggaguuucguuuucaaa

SEQ ID NO: 1718922 - RNA, 18 nt, Human
gcagccgugccuucagcu

SEQ ID NO: 1718923 - RNA, 22 nt, Human
gcagccucaaccuccugggcua

SEQ ID NO: 1718924 - RNA, 21 nt, Human
gcagccucaaccuccugggcu

SEQ ID NO: 1718925 - RNA, 14 nt, Human
gcagccuggacccu

SEQ ID NO: 1718926 - RNA, 20 nt, Human
gcagccucaaccuccugggc

SEQ ID NO: 1718927 - RNA, 19 nt, Human
gcagccucaaccuccuggg

SEQ ID NO: 1718928 - RNA, 14 nt, Human
gcagccgugccuuc

SEQ ID NO: 1718929 - RNA, 17 nt, Human
gcagccgugccuucagc

SEQ ID NO: 1718930 - RNA, 15 nt, Human
gcagccgugccuuca

SEQ ID NO: 1718931 - RNA, 22 nt, Human
gauuucuguuuagauaauacac

SEQ ID NO: 1718932 - RNA, 21 nt, Human
gauuucuguuuagauaauaca

SEQ ID NO: 1718933 - RNA, 16 nt, Human
gauugggaauccgccc

SEQ ID NO: 1718934 - RNA, 16 nt, Human
gauugcaacaggcugg

SEQ ID NO: 1718935 - RNA, 22 nt, Human
gauucuuuccugaggcugggcu

SEQ ID NO: 1718936 - RNA, 20 nt, Human
gauucuuuccugaggcuggg

SEQ ID NO: 1718937 - RNA, 18 nt, Human
gauucccaagcucugcuc

SEQ ID NO: 1718938 - RNA, 19 nt, Human
gauucuuuccugaggcugg

SEQ ID NO: 1718939 - RNA, 17 nt, Human
gauucccaagcucugcu

SEQ ID NO: 1718940 - RNA, 16 nt, Human
gauucccaagcucugc

SEQ ID NO: 1718941 - RNA, 18 nt, Human
gauugcuugagcucagga

SEQ ID NO: 1718942 - RNA, 18 nt, Human
gauugcaacaggcugggc

SEQ ID NO: 1718943 - RNA, 17 nt, Human
gauugcaacaggcuggg

SEQ ID NO: 1718944 - RNA, 20 nt, Human
gaugccugugaacugaacuc

SEQ ID NO: 1718945 - RNA, 17 nt, Human
gaugccugguggcagcu

SEQ ID NO: 1718946 - RNA, 16 nt, Human
gaugcuagaacucccu

SEQ ID NO: 1718947 - RNA, 18 nt, Human
gauguucuagcauggcug

SEQ ID NO: 1718948 - RNA, 21 nt, Human
gauguuuuaaggaugcuugua

SEQ ID NO: 1718949 - RNA, 14 nt, Human
gauguucugggaca

SEQ ID NO: 1718950 - RNA, 18 nt, Human
gauguucuggauaccauu

SEQ ID NO: 1718951 - RNA, 18 nt, Human
gauucagacagcugccug

SEQ ID NO: 1718952 - RNA, 17 nt, Human
gauucagacagcugccu

SEQ ID NO: 1718953 - RNA, 14 nt, Human
gauucagacagcug

SEQ ID NO: 1718954 - RNA, 13 nt, Human
gauucagacagcu

SEQ ID NO: 1718955 - RNA, 21 nt, Human
gauuacaagcgugagccacug

SEQ ID NO: 1718956 - RNA, 13 nt, Human
gauuacaagcgug

SEQ ID NO: 1718957 - RNA, 15 nt, Human
gauucccaagcucug

SEQ ID NO: 1718958 - RNA, 17 nt, Human
gcaauccugcaagaaca

SEQ ID NO: 1718959 - RNA, 18 nt, Human
gcaaggcugucaauuaca

SEQ ID NO: 1718960 - RNA, 14 nt, Human
gcaaggcugucaau

SEQ ID NO: 1718961 - RNA, 21 nt, Human
gcaagggaauuucuucaacuc

SEQ ID NO: 1718962 - RNA, 22 nt, Human
gcaacuuuguauaaaagggacu

SEQ ID NO: 1718963 - RNA, 20 nt, Human
gcaagcaccuccugccucga

SEQ ID NO: 1718964 - RNA, 18 nt, Human
gcaagcaccuccugccuc

SEQ ID NO: 1718965 - RNA, 16 nt, Human
gcaagcaccuccugcc

SEQ ID NO: 1718966 - RNA, 15 nt, Human
gcaagcaccuccugc

SEQ ID NO: 1718967 - RNA, 18 nt, Human
gcaagcaagaaacacugg

SEQ ID NO: 1718968 - RNA, 14 nt, Human
gcaaauggccucau

SEQ ID NO: 1718969 - RNA, 12 nt, Human
gcaaaugugaau

SEQ ID NO: 1718970 - RNA, 18 nt, Human
gcaacugcauuggcuuug

SEQ ID NO: 1718971 - RNA, 20 nt, Human
gcaaacuuuauuuuguguuu

SEQ ID NO: 1718972 - RNA, 23 nt, Human
gcaaaguucccuacuuccuguga

SEQ ID NO: 1718973 - RNA, 21 nt, Human
gcaaaccaucauugaaaucuu

SEQ ID NO: 1718974 - RNA, 20 nt, Human
gcaaaccaucauugaaaucu

SEQ ID NO: 1718975 - RNA, 19 nt, Human
gcaaaccaucauugaaauc

SEQ ID NO: 1718976 - RNA, 17 nt, Human
gcaaaccaucauugaaa

SEQ ID NO: 1718977 - RNA, 16 nt, Human
gcaaaccaucauugaa

SEQ ID NO: 1718978 - RNA, 18 nt, Human
gcaaacuuuauuuugugu

SEQ ID NO: 1718979 - RNA, 16 nt, Human
gaugaaauguaaauac

SEQ ID NO: 1718980 - RNA, 21 nt, Human
gaugaaaugaggucagagccu

SEQ ID NO: 1718981 - RNA, 15 nt, Human
gaugaaaugagguca

SEQ ID NO: 1718982 - RNA, 19 nt, Human
gaucuucuuuauaauucua

SEQ ID NO: 1718983 - RNA, 22 nt, Human
gaucuucuguggguuucuaaag

SEQ ID NO: 1718984 - RNA, 23 nt, Human
gaugcaccagcccuuagcaggga

SEQ ID NO: 1718985 - RNA, 15 nt, Human
gaugcaccagcccuu

SEQ ID NO: 1718986 - RNA, 14 nt, Human
gaugagaggaaauc

SEQ ID NO: 1718987 - RNA, 20 nt, Human
gaugaccuugaaugaugcca

SEQ ID NO: 1718988 - RNA, 18 nt, Human
gaugaccuugaaugaugc

SEQ ID NO: 1718989 - RNA, 16 nt, Human
gaugccugguggcagc

SEQ ID NO: 1718990 - RNA, 15 nt, Human
gaugccugguggcag

SEQ ID NO: 1718991 - RNA, 14 nt, Human
gaugcagugcuucc

SEQ ID NO: 1718992 - RNA, 14 nt, Human
gaugccugguggca

SEQ ID NO: 1718993 - RNA, 16 nt, Human
gaugagaggaaaucac

SEQ ID NO: 1718994 - RNA, 20 nt, Human
gaucuaggaagacuuuggaa

SEQ ID NO: 1718995 - RNA, 18 nt, Human
gaucuaggaagacuuugg

SEQ ID NO: 1718996 - RNA, 14 nt, Human
gaucuaggaagacu

SEQ ID NO: 1718997 - RNA, 13 nt, Human
gaucuaggaagac

SEQ ID NO: 1718998 - RNA, 12 nt, Human
gauccugagcca

SEQ ID NO: 1718999 - RNA, 16 nt, Human
gauccucccaggcuuc

SEQ ID NO: 1719000 - RNA, 16 nt, Human
gaucauccacugugcc

SEQ ID NO: 1719001 - RNA, 13 nt, Human
gaucauccacugu

SEQ ID NO: 1719002 - RNA, 18 nt, Human
gauccucccaccucagcc

SEQ ID NO: 1719003 - RNA, 17 nt, Human
gauccucccaccucagc

SEQ ID NO: 1719004 - RNA, 16 nt, Human
gauccucccaccucag

SEQ ID NO: 1719005 - RNA, 14 nt, Human
gauccuccaggugc

SEQ ID NO: 1719006 - RNA, 18 nt, Human
gauccuaggcauuugcug

SEQ ID NO: 1719007 - RNA, 23 nt, Human
gauccuaaugaaugcauaaaaug

SEQ ID NO: 1719008 - RNA, 17 nt, Human
gauaggucagugcaaau

SEQ ID NO: 1719009 - RNA, 17 nt, Human
gauacaaaagcauguga

SEQ ID NO: 1719010 - RNA, 16 nt, Human
gauacaaaagcaugug

SEQ ID NO: 1719011 - RNA, 18 nt, Human
gauaauucuagcuuugag

SEQ ID NO: 1719012 - RNA, 20 nt, Human
gauagugucccacggugccu

SEQ ID NO: 1719013 - RNA, 18 nt, Human
gauauaaaagacugacca

SEQ ID NO: 1719014 - RNA, 18 nt, Human
gauauaugcucugcaugu

SEQ ID NO: 1719015 - RNA, 23 nt, Human
gaucacggcucacugcagccuca

SEQ ID NO: 1719016 - RNA, 16 nt, Human
gaucacauguggacuu

SEQ ID NO: 1719017 - RNA, 12 nt, Human
gauaauacacca

SEQ ID NO: 1719018 - RNA, 23 nt, Human
gauaauacaccacuacauucugu

SEQ ID NO: 1719019 - RNA, 24 nt, Human
gauaauacaccacuacauucuguu

SEQ ID NO: 1719020 - RNA, 13 nt, Human
gauaaacaguagu

SEQ ID NO: 1719021 - RNA, 13 nt, Human
gaguucugguucc

SEQ ID NO: 1719022 - RNA, 22 nt, Human
gaaugguuuucaaaauaaaaau

SEQ ID NO: 1719023 - RNA, 14 nt, Human
gaaugucaguguga

SEQ ID NO: 1719024 - RNA, 23 nt, Human
gaaugaaccacaucuugcucugc

SEQ ID NO: 1719025 - RNA, 22 nt, Human
gaaugaaccacaucuugcucug

SEQ ID NO: 1719026 - RNA, 11 nt, Human
gaaugcagugg

SEQ ID NO: 1719027 - RNA, 14 nt, Human
gaaugcauaaaaug

SEQ ID NO: 1719028 - RNA, 13 nt, Human
gaaugcuuuagga

SEQ ID NO: 1719029 - RNA, 21 nt, Human
gaaugucagugugacugaucu

SEQ ID NO: 1719030 - RNA, 20 nt, Human
gaaugucagugugacugauc

SEQ ID NO: 1719031 - RNA, 17 nt, Human
gaauucucagaaucuca

SEQ ID NO: 1719032 - RNA, 17 nt, Human
gaauucucuaguuugau

SEQ ID NO: 1719033 - RNA, 19 nt, Human
gaauucucuaguuugauua

SEQ ID NO: 1719034 - RNA, 14 nt, Human
gaauugaagcagga

SEQ ID NO: 1719035 - RNA, 14 nt, Human
gaauugaaaaacca

SEQ ID NO: 1719036 - RNA, 15 nt, Human
gaauuucccaaagca

SEQ ID NO: 1719037 - RNA, 22 nt, Human
gaauuguaaggaaugauuaauu

SEQ ID NO: 1719038 - RNA, 23 nt, Human
gaauuguguuuauaauuuuaaau

SEQ ID NO: 1719039 - RNA, 15 nt, Human
gaauuguguuuauaa

SEQ ID NO: 1719040 - RNA, 22 nt, Human
gaauagcugggacuacaggugu

SEQ ID NO: 1719041 - RNA, 23 nt, Human
gaauagcugggacuacaggugug

SEQ ID NO: 1719042 - RNA, 22 nt, Human
gaauagcuuuaaugauaugcuu

SEQ ID NO: 1719043 - RNA, 15 nt, Human
gaauaccuguccccc

SEQ ID NO: 1719044 - RNA, 13 nt, Human
gaauaccuguccc

SEQ ID NO: 1719045 - RNA, 21 nt, Human
gaauacagaggcaacugcauu

SEQ ID NO: 1719046 - RNA, 17 nt, Human
gaauaauacaguaucuc

SEQ ID NO: 1719047 - RNA, 19 nt, Human
gaauaacauguaauuaagu

SEQ ID NO: 1719048 - RNA, 18 nt, Human
gaauaacauguaauuaag

SEQ ID NO: 1719049 - RNA, 20 nt, Human
gaaguuugagaucagccugg

SEQ ID NO: 1719050 - RNA, 14 nt, Human
gaaguauccuucag

SEQ ID NO: 1719051 - RNA, 23 nt, Human
gaaguaguggagccccugcucug

SEQ ID NO: 1719052 - RNA, 16 nt, Human
gaaguauccuucagcc

SEQ ID NO: 1719053 - RNA, 20 nt, Human
gaaguuucugccgcagcccu

SEQ ID NO: 1719054 - RNA, 15 nt, Human
gaagucuuagaugua

SEQ ID NO: 1719055 - RNA, 21 nt, Human
gaaguuucugccgcagcccug

SEQ ID NO: 1719056 - RNA, 18 nt, Human
gaagucuuagauguauau

SEQ ID NO: 1719057 - RNA, 19 nt, Human
gaagggggcugggacaugg

SEQ ID NO: 1719058 - RNA, 16 nt, Human
gaagggggcugggaca

SEQ ID NO: 1719059 - RNA, 22 nt, Human
gaaguaauaugcacacauuuuu

SEQ ID NO: 1719060 - RNA, 18 nt, Human
gaaguacuauaauuuacc

SEQ ID NO: 1719061 - RNA, 15 nt, Human
gaaguacuggagaaa

SEQ ID NO: 1719062 - RNA, 20 nt, Human
gaagauaauauuaaggaaga

SEQ ID NO: 1719063 - RNA, 18 nt, Human
gaagauguagaggagaaa

SEQ ID NO: 1719064 - RNA, 18 nt, Human
gaagcauuuacuuugugu

SEQ ID NO: 1719065 - RNA, 17 nt, Human
gaagcauuuacuuugug

SEQ ID NO: 1719066 - RNA, 23 nt, Human
gaagcccuucuaccuuccugcaa

SEQ ID NO: 1719067 - RNA, 19 nt, Human
gaagcccaggaaaggcucc

SEQ ID NO: 1719068 - RNA, 16 nt, Human
gaagcccaggaaaggc

SEQ ID NO: 1719069 - RNA, 15 nt, Human
gaagcccaggaaagg

SEQ ID NO: 1719070 - RNA, 13 nt, Human
gaagcccaggaaa

SEQ ID NO: 1719071 - RNA, 22 nt, Human
gaagccagcaggcucucaggcc

SEQ ID NO: 1719072 - RNA, 21 nt, Human
gaagccagcaggcucucaggc

SEQ ID NO: 1719073 - RNA, 20 nt, Human
gaagccagcaggcucucagg

SEQ ID NO: 1719074 - RNA, 19 nt, Human
gaagagaaugcacaaacag

SEQ ID NO: 1719075 - RNA, 20 nt, Human
gaagacuuuucuuucagcca

SEQ ID NO: 1719076 - RNA, 17 nt, Human
gaagacuuuggaaagag

SEQ ID NO: 1719077 - RNA, 14 nt, Human
gaagacuuuggaaa

SEQ ID NO: 1719078 - RNA, 13 nt, Human
gaagacuuuggaa

SEQ ID NO: 1719079 - RNA, 11 nt, Human
gaagacuuugg

SEQ ID NO: 1719080 - RNA, 23 nt, Human
gaacuuugaccucugcagcaaua

SEQ ID NO: 1719081 - RNA, 21 nt, Human
gaacucaucuagguaaauuac

SEQ ID NO: 1719082 - RNA, 20 nt, Human
gaacucaucuagguaaauua

SEQ ID NO: 1719083 - RNA, 22 nt, Human
gaacucaucuagguaaauuaca

SEQ ID NO: 1719084 - RNA, 12 nt, Human
gaacguuuuucc

SEQ ID NO: 1719085 - RNA, 15 nt, Human
gaacguuuuuccugu

SEQ ID NO: 1719086 - RNA, 22 nt, Human
gaaccuuuugagugccuuacac

SEQ ID NO: 1719087 - RNA, 14 nt, Human
gaacuacugaggau

SEQ ID NO: 1719088 - RNA, 21 nt, Human
gaaccuuuugagugccuuaca

SEQ ID NO: 1719089 - RNA, 19 nt, Human
gaaccuuuugagugccuua

SEQ ID NO: 1719090 - RNA, 18 nt, Human
gaaccuuuugagugccuu

SEQ ID NO: 1719091 - RNA, 14 nt, Human
gaacaucccuccug

SEQ ID NO: 1719092 - RNA, 13 nt, Human
gaacauugcaaua

SEQ ID NO: 1719093 - RNA, 15 nt, Human
gaacauugcaauaga

SEQ ID NO: 1719094 - RNA, 17 nt, Human
gaacauugcaauagaaa

SEQ ID NO: 1719095 - RNA, 15 nt, Human
gaacauugguucuuu

SEQ ID NO: 1719096 - RNA, 16 nt, Human
gaaauuguauuacaaa

SEQ ID NO: 1719097 - RNA, 23 nt, Human
gaaaauaaaucaaugcuauaacu

SEQ ID NO: 1719098 - RNA, 18 nt, Human
gaaauuguauuacaaauc

SEQ ID NO: 1719099 - RNA, 17 nt, Human
gaaauuuauaaacuuuu

SEQ ID NO: 1719100 - RNA, 16 nt, Human
gaaauuuauaaacuuu

SEQ ID NO: 1719101 - RNA, 14 nt, Human
gaacacucugagac

SEQ ID NO: 1719102 - RNA, 13 nt, Human
gaacacucugaga

SEQ ID NO: 1719103 - RNA, 16 nt, Human
gaacagugauuaccag

SEQ ID NO: 1719104 - RNA, 20 nt, Human
gaacagugauuaccagggac

SEQ ID NO: 1719105 - RNA, 15 nt, Human
gaacacucugagacu

SEQ ID NO: 1719106 - RNA, 23 nt, Human
gacuaacuugucuuuggacccug

SEQ ID NO: 1719107 - RNA, 16 nt, Human
gacuaacuugucuuug

SEQ ID NO: 1719108 - RNA, 15 nt, Human
gacguguuaugacuc

SEQ ID NO: 1719109 - RNA, 14 nt, Human
gacguguuaugacu

SEQ ID NO: 1719110 - RNA, 11 nt, Human
gacguguuaug

SEQ ID NO: 1719111 - RNA, 13 nt, Human
gacggagucccac

SEQ ID NO: 1719112 - RNA, 22 nt, Human
gacgcugugcugcccugcccac

SEQ ID NO: 1719113 - RNA, 20 nt, Human
gaccuuucaauaggaaaaac

SEQ ID NO: 1719114 - RNA, 19 nt, Human
gaccuuucaauaggaaaaa

SEQ ID NO: 1719115 - RNA, 11 nt, Human
gaccuuucaau

SEQ ID NO: 1719116 - RNA, 22 nt, Human
gaccuuuaagagaaaugagcug

SEQ ID NO: 1719117 - RNA, 16 nt, Human
gacgugauuuugcugu

SEQ ID NO: 1719118 - RNA, 17 nt, Human
gacgugauuuugcugua

SEQ ID NO: 1719119 - RNA, 14 nt, Human
gaccuugaacuggg

SEQ ID NO: 1719120 - RNA, 21 nt, Human
gaccuucuccuucaccuuugu

SEQ ID NO: 1719121 - RNA, 20 nt, Human
gaccuucuccuucaccuuug

SEQ ID NO: 1719122 - RNA, 16 nt, Human
gaccuucuccuucacc

SEQ ID NO: 1719123 - RNA, 15 nt, Human
gaccuucuccuucac

SEQ ID NO: 1719124 - RNA, 14 nt, Human
gaccuucuccuuca

SEQ ID NO: 1719125 - RNA, 15 nt, Human
gacccuugugguccc

SEQ ID NO: 1719126 - RNA, 23 nt, Human
gacccuugccgucuaccugaggg

SEQ ID NO: 1719127 - RNA, 20 nt, Human
gacccuugccgucuaccuga

SEQ ID NO: 1719128 - RNA, 19 nt, Human
gacccuugccgucuaccug

SEQ ID NO: 1719129 - RNA, 19 nt, Human
gaccuguggccaaguucuu

SEQ ID NO: 1719130 - RNA, 14 nt, Human
gaccuuaaaugcaa

SEQ ID NO: 1719131 - RNA, 23 nt, Human
gacuggccaagguuuggggaaga

SEQ ID NO: 1719132 - RNA, 17 nt, Human
gacuggauguaccacca

SEQ ID NO: 1719133 - RNA, 15 nt, Human
gacuuacuguacaug

SEQ ID NO: 1719134 - RNA, 16 nt, Human
gacuuacuguacauga

SEQ ID NO: 1719135 - RNA, 12 nt, Human
gacuuacuguac

SEQ ID NO: 1719136 - RNA, 18 nt, Human
gacuuacuguacaugaaa

SEQ ID NO: 1719137 - RNA, 23 nt, Human
gacuuacuguacaugaaaacaca

SEQ ID NO: 1719138 - RNA, 20 nt, Human
gacuucaucccucuggggcu

SEQ ID NO: 1719139 - RNA, 12 nt, Human
gacuucaucccu

SEQ ID NO: 1719140 - RNA, 14 nt, Human
gacuucagcucugu

SEQ ID NO: 1719141 - RNA, 15 nt, Human
gacuuagcugggaga

SEQ ID NO: 1719142 - RNA, 16 nt, Human
gacuuauuuauauaaa

SEQ ID NO: 1719143 - RNA, 20 nt, Human
gacugccagucccccugccc

SEQ ID NO: 1719144 - RNA, 16 nt, Human
gacugaggggagggga

SEQ ID NO: 1719145 - RNA, 18 nt, Human
gacugaguacguugugca

SEQ ID NO: 1719146 - RNA, 13 nt, Human
gacugagaaauuu

SEQ ID NO: 1719147 - RNA, 21 nt, Human
gacuccugcaggcagccaggc

SEQ ID NO: 1719148 - RNA, 20 nt, Human
gacuccugcaggcagccagg

SEQ ID NO: 1719149 - RNA, 19 nt, Human
gacuccugcaggcagccag

SEQ ID NO: 1719150 - RNA, 18 nt, Human
gacuccugcaggcagcca

SEQ ID NO: 1719151 - RNA, 15 nt, Human
gacuacaggcaccca

SEQ ID NO: 1719152 - RNA, 13 nt, Human
gacuacaggcacc

SEQ ID NO: 1719153 - RNA, 18 nt, Human
gacuacaggcacccacca

SEQ ID NO: 1719154 - RNA, 15 nt, Human
gacucuacagaggcc

SEQ ID NO: 1719155 - RNA, 15 nt, Human
gacucuaaagucugu

SEQ ID NO: 1719156 - RNA, 21 nt, Human
gacucuacagaggccaugggc

SEQ ID NO: 1719157 - RNA, 11 nt, Human
gacugagaaau

SEQ ID NO: 1719158 - RNA, 21 nt, Human
gacugaccaauauuguacagu

SEQ ID NO: 1719159 - RNA, 22 nt, Human
gacugaccaauauuguacaguu

SEQ ID NO: 1719160 - RNA, 20 nt, Human
gacccaaaaggcagaagcaa

SEQ ID NO: 1719161 - RNA, 19 nt, Human
gacccacuggacucaccuc

SEQ ID NO: 1719162 - RNA, 18 nt, Human
gacccaaaaggcagaagc

SEQ ID NO: 1719163 - RNA, 19 nt, Human
gacccaaaaggcagaagca

SEQ ID NO: 1719164 - RNA, 20 nt, Human
gacccaugcugcccugugag

SEQ ID NO: 1719165 - RNA, 19 nt, Human
gacccaugcugcccuguga

SEQ ID NO: 1719166 - RNA, 18 nt, Human
gacccaugcugcccugug

SEQ ID NO: 1719167 - RNA, 13 nt, Human
gacccaugcugcc

SEQ ID NO: 1719168 - RNA, 22 nt, Human
gacccugcccugugggccccca

SEQ ID NO: 1719169 - RNA, 20 nt, Human
gacccugcccugugggcccc

SEQ ID NO: 1719170 - RNA, 18 nt, Human
gacccugaggcccagagg

SEQ ID NO: 1719171 - RNA, 16 nt, Human
gacccugaggcccaga

SEQ ID NO: 1719172 - RNA, 12 nt, Human
gacccugaggcc

SEQ ID NO: 1719173 - RNA, 11 nt, Human
gacccugaggc

SEQ ID NO: 1719174 - RNA, 16 nt, Human
gaccacugcagaagac

SEQ ID NO: 1719175 - RNA, 18 nt, Human
gaccacugcagaagacag

SEQ ID NO: 1719176 - RNA, 22 nt, Human
gaccagacaccuugacagggca

SEQ ID NO: 1719177 - RNA, 21 nt, Human
gaccagcaccaucucuccucc

SEQ ID NO: 1719178 - RNA, 20 nt, Human
gaccagcaccaucucuccuc

SEQ ID NO: 1719179 - RNA, 24 nt, Human
gaccagacaccuugacagggcaca

SEQ ID NO: 1719180 - RNA, 23 nt, Human
gaccagacaccuugacagggcac

SEQ ID NO: 1719181 - RNA, 21 nt, Human
gaccagagcugccaccugccu

SEQ ID NO: 1719182 - RNA, 18 nt, Human
gaccacaaaacuuuucua

SEQ ID NO: 1719183 - RNA, 17 nt, Human
gaccaauauuguacagu

SEQ ID NO: 1719184 - RNA, 18 nt, Human
gaccaauauuguacaguu

SEQ ID NO: 1719185 - RNA, 19 nt, Human
gaccaauauuguacaguuu

SEQ ID NO: 1719186 - RNA, 21 nt, Human
gaccaauauuguacaguuuuu

SEQ ID NO: 1719187 - RNA, 22 nt, Human
gaccacacuccagcugggauca

SEQ ID NO: 1719188 - RNA, 16 nt, Human
gaccacacuccagcug

SEQ ID NO: 1719189 - RNA, 14 nt, Human
gaccacacuccagc

SEQ ID NO: 1719190 - RNA, 18 nt, Human
gacaggcaagcaccuccu

SEQ ID NO: 1719191 - RNA, 17 nt, Human
gacaggcaagcaccucc

SEQ ID NO: 1719192 - RNA, 13 nt, Human
gacaggcaagcac

SEQ ID NO: 1719193 - RNA, 19 nt, Human
gacaggcaaugcuggcugu

SEQ ID NO: 1719194 - RNA, 18 nt, Human
gacaggcaaugcuggcug

SEQ ID NO: 1719195 - RNA, 21 nt, Human
gacaggcaagcaccuccugcc

SEQ ID NO: 1719196 - RNA, 20 nt, Human
gacaggcaagcaccuccugc

SEQ ID NO: 1719197 - RNA, 21 nt, Human
gacaggcauguucucugagga

SEQ ID NO: 1719198 - RNA, 20 nt, Human
gacaggcauguucucugagg

SEQ ID NO: 1719199 - RNA, 23 nt, Human
gacaggcaaugcuggcuguuggc

SEQ ID NO: 1719200 - RNA, 24 nt, Human
gacaggcaaugcuggcuguuggcu

SEQ ID NO: 1719201 - RNA, 16 nt, Human
gacaucaacugcauca

SEQ ID NO: 1719202 - RNA, 23 nt, Human
gacaucaacugcaucaagaugug

SEQ ID NO: 1719203 - RNA, 22 nt, Human
gacaggcauguucucugaggac

SEQ ID NO: 1719204 - RNA, 14 nt, Human
gacagggcauggcc

SEQ ID NO: 1719205 - RNA, 22 nt, Human
gacagggcauggccagguggcc

SEQ ID NO: 1719206 - RNA, 20 nt, Human
gacagggcauggccaggugg

SEQ ID NO: 1719207 - RNA, 15 nt, Human
gacagggcauggcca

SEQ ID NO: 1719208 - RNA, 16 nt, Human
gacagagugagacucu

SEQ ID NO: 1719209 - RNA, 21 nt, Human
gacagagucucacuguugccc

SEQ ID NO: 1719210 - RNA, 19 nt, Human
gacagagugagacucuguc

SEQ ID NO: 1719211 - RNA, 13 nt, Human
gacagagggggug

SEQ ID NO: 1719212 - RNA, 23 nt, Human
gacagaggcagccccauucugcc

SEQ ID NO: 1719213 - RNA, 20 nt, Human
gacagagcuacacaggggaa

SEQ ID NO: 1719214 - RNA, 12 nt, Human
gacagaggcagc

SEQ ID NO: 1719215 - RNA, 16 nt, Human
gacagacagcccucca

SEQ ID NO: 1719216 - RNA, 18 nt, Human
gaauuucccaaagcagug

SEQ ID NO: 1719217 - RNA, 16 nt, Human
gaauuucccaaagcag

SEQ ID NO: 1719218 - RNA, 22 nt, Human
gaauuucccaaagcagugcaug

SEQ ID NO: 1719219 - RNA, 22 nt, Human
gacacgaauauugcugauggug

SEQ ID NO: 1719220 - RNA, 22 nt, Human
gacagacacaggcccggcucca

SEQ ID NO: 1719221 - RNA, 20 nt, Human
gacagacacaggcccggcuc

SEQ ID NO: 1719222 - RNA, 17 nt, Human
gacagacacaggcccgg

SEQ ID NO: 1719223 - RNA, 16 nt, Human
gacacuagaagauuuu

SEQ ID NO: 1719224 - RNA, 20 nt, Human
cuugcuugauuguauggugg

SEQ ID NO: 1719225 - RNA, 20 nt, Human
cuuggaagcuccgcuuucua

SEQ ID NO: 1719226 - RNA, 22 nt, Human
cuugcucugcugacagacacag

SEQ ID NO: 1719227 - RNA, 19 nt, Human
cuugcucuugaugccuggc

SEQ ID NO: 1719228 - RNA, 18 nt, Human
cuugcucuugaugccugg

SEQ ID NO: 1719229 - RNA, 17 nt, Human
cuugcucuugaugccug

SEQ ID NO: 1719230 - RNA, 18 nt, Human
cuugcccuggugccucac

SEQ ID NO: 1719231 - RNA, 13 nt, Human
cuugccacugccu

SEQ ID NO: 1719232 - RNA, 14 nt, Human
cuugcaugaggcua

SEQ ID NO: 1719233 - RNA, 13 nt, Human
cuugcaugaggcu

SEQ ID NO: 1719234 - RNA, 17 nt, Human
cuugcaugaggcuagug

SEQ ID NO: 1719235 - RNA, 15 nt, Human
cuugagccugggagg

SEQ ID NO: 1719236 - RNA, 12 nt, Human
cuugagccuggg

SEQ ID NO: 1719237 - RNA, 17 nt, Human
cuugaggguugggcugg

SEQ ID NO: 1719238 - RNA, 15 nt, Human
cuugaggguugggcu

SEQ ID NO: 1719239 - RNA, 17 nt, Human
cuucuggcacuuggaga

SEQ ID NO: 1719240 - RNA, 21 nt, Human
cuugcagacucuacagaggcc

SEQ ID NO: 1719241 - RNA, 18 nt, Human
cuugcaauggcagccuug

SEQ ID NO: 1719242 - RNA, 17 nt, Human
cuugcaauggcagccuu

SEQ ID NO: 1719243 - RNA, 16 nt, Human
cuugcaauggcagccu

SEQ ID NO: 1719244 - RNA, 15 nt, Human
cuugcaauggcagcc

SEQ ID NO: 1719245 - RNA, 19 nt, Human
cuugaguugauucagcucu

SEQ ID NO: 1719246 - RNA, 18 nt, Human
cuugaguugauucagcuc

SEQ ID NO: 1719247 - RNA, 20 nt, Human
cuugaguugauucagcucug

SEQ ID NO: 1719248 - RNA, 21 nt, Human
cuugaguugauucagcucugc

SEQ ID NO: 1719249 - RNA, 19 nt, Human
cuuuaccuuuuuuauacau

SEQ ID NO: 1719250 - RNA, 20 nt, Human
cuuuaccuuuuuuauacaua

SEQ ID NO: 1719251 - RNA, 17 nt, Human
cuuuaccuuuuuuauac

SEQ ID NO: 1719252 - RNA, 21 nt, Human
cuuuaaaaagcuccaaaugca

SEQ ID NO: 1719253 - RNA, 22 nt, Human
cuuuaaaaaauuaaucugggcc

SEQ ID NO: 1719254 - RNA, 19 nt, Human
cuuguggucccaccccaca

SEQ ID NO: 1719255 - RNA, 16 nt, Human
cuuguggucccacccc

SEQ ID NO: 1719256 - RNA, 16 nt, Human
cuuguuaagauaguua

SEQ ID NO: 1719257 - RNA, 15 nt, Human
cuuguggucccaccc

SEQ ID NO: 1719258 - RNA, 15 nt, Human
cuuggggccuaugca

SEQ ID NO: 1719259 - RNA, 20 nt, Human
cuugguuuguaaauuaacuu

SEQ ID NO: 1719260 - RNA, 14 nt, Human
cuugguuuguaaau

SEQ ID NO: 1719261 - RNA, 15 nt, Human
cuugguuuguaaauu

SEQ ID NO: 1719262 - RNA, 22 nt, Human
cuuggagccaauggagacuguc

SEQ ID NO: 1719263 - RNA, 20 nt, Human
cuugggccacugugaagaga

SEQ ID NO: 1719264 - RNA, 19 nt, Human
gaaaauaacaauaaaagac

SEQ ID NO: 1719265 - RNA, 22 nt, Human
gaaaagucaaggguaggguggg

SEQ ID NO: 1719266 - RNA, 14 nt, Human
gaaaacguggcugc

SEQ ID NO: 1719267 - RNA, 19 nt, Human
gaaaacaugcuacacacug

SEQ ID NO: 1719268 - RNA, 22 nt, Human
gaaaacacuguucucugcccuc

SEQ ID NO: 1719269 - RNA, 19 nt, Human
gaaaacacuguucucugcc

SEQ ID NO: 1719270 - RNA, 21 nt, Human
gaaaacacuguucucugcccu

SEQ ID NO: 1719271 - RNA, 20 nt, Human
gaaaacacuguucucugccc

SEQ ID NO: 1719272 - RNA, 16 nt, Human
gaaaacaugcuacaca

SEQ ID NO: 1719273 - RNA, 18 nt, Human
gaaaacaugcuacacacu

SEQ ID NO: 1719274 - RNA, 16 nt, Human
cuuuuuuagaguugau

SEQ ID NO: 1719275 - RNA, 15 nt, Human
cuuuucuguuugcua

SEQ ID NO: 1719276 - RNA, 21 nt, Human
cuuuguuuguugucagcugaa

SEQ ID NO: 1719277 - RNA, 17 nt, Human
cuuuguuuuacugucuu

SEQ ID NO: 1719278 - RNA, 22 nt, Human
cuuuuguucuugguuuguaaau

SEQ ID NO: 1719279 - RNA, 23 nt, Human
cuuuggaaagacuuuuccaaccc

SEQ ID NO: 1719280 - RNA, 12 nt, Human
cuuuggaaagac

SEQ ID NO: 1719281 - RNA, 14 nt, Human
cuuugcuugaaaga

SEQ ID NO: 1719282 - RNA, 19 nt, Human
cuuugacaaagguaaauca

SEQ ID NO: 1719283 - RNA, 12 nt, Human
cuuugugauuuu

SEQ ID NO: 1719284 - RNA, 13 nt, Human
cuuuguggcuucc

SEQ ID NO: 1719285 - RNA, 21 nt, Human
cuuuguucuggcucuuccagg

SEQ ID NO: 1719286 - RNA, 16 nt, Human
cuuuguucuggcucuu

SEQ ID NO: 1719287 - RNA, 23 nt, Human
cuuugggaggccaaggugggagg

SEQ ID NO: 1719288 - RNA, 23 nt, Human
cuuugugaggaagccgcuggggc

SEQ ID NO: 1719289 - RNA, 17 nt, Human
cuuugggccuggcuccc

SEQ ID NO: 1719290 - RNA, 19 nt, Human
cuuuccucaaaacuucaga

SEQ ID NO: 1719291 - RNA, 16 nt, Human
cuuuccucuuuggucu

SEQ ID NO: 1719292 - RNA, 13 nt, Human
cuuucugaaauaa

SEQ ID NO: 1719293 - RNA, 17 nt, Human
cuuugacaaagguaaau

SEQ ID NO: 1719294 - RNA, 19 nt, Human
cuuucuuuuuuuuuuuuga

SEQ ID NO: 1719295 - RNA, 16 nt, Human
cuuucuuccucugcug

SEQ ID NO: 1719296 - RNA, 15 nt, Human
cuuucugcagaaaca

SEQ ID NO: 1719297 - RNA, 13 nt, Human
cuucgcuccugug

SEQ ID NO: 1719298 - RNA, 15 nt, Human
cuucgcuccuguguc

SEQ ID NO: 1719299 - RNA, 14 nt, Human
cuucgcuccugugu

SEQ ID NO: 1719300 - RNA, 16 nt, Human
cuucgcuccugugucu

SEQ ID NO: 1719301 - RNA, 17 nt, Human
cuucggccuccauccug

SEQ ID NO: 1719302 - RNA, 18 nt, Human
cuucggccuccauccuga

SEQ ID NO: 1719303 - RNA, 19 nt, Human
cuucggccuccauccugag

SEQ ID NO: 1719304 - RNA, 21 nt, Human
cuucgggaggucgaggcagga

SEQ ID NO: 1719305 - RNA, 20 nt, Human
cuucgggaggucgaggcagg

SEQ ID NO: 1719306 - RNA, 17 nt, Human
cuucugccauauucugu

SEQ ID NO: 1719307 - RNA, 15 nt, Human
cuucugccauauucu

SEQ ID NO: 1719308 - RNA, 20 nt, Human
cuucugccauuucugagauc

SEQ ID NO: 1719309 - RNA, 21 nt, Human
cuucugccauauucuguuggc

SEQ ID NO: 1719310 - RNA, 17 nt, Human
cuucugcuucagccucc

SEQ ID NO: 1719311 - RNA, 16 nt, Human
cuucugcuucagccuc

SEQ ID NO: 1719312 - RNA, 18 nt, Human
cuucugcuucagccuccc

SEQ ID NO: 1719313 - RNA, 22 nt, Human
cuucuccuucaccuuugucccc

SEQ ID NO: 1719314 - RNA, 17 nt, Human
cuucuccuuucacaacc

SEQ ID NO: 1719315 - RNA, 14 nt, Human
cuucuccuuucaca

SEQ ID NO: 1719316 - RNA, 22 nt, Human
cuucuccuuucacaaccuucug

SEQ ID NO: 1719317 - RNA, 20 nt, Human
cuucuccuuucacaaccuuc

SEQ ID NO: 1719318 - RNA, 15 nt, Human
cuucuccacccugcu

SEQ ID NO: 1719319 - RNA, 14 nt, Human
cuucuccacccugc

SEQ ID NO: 1719320 - RNA, 16 nt, Human
cuucuccacccugcuc

SEQ ID NO: 1719321 - RNA, 17 nt, Human
cuucuccaggcuguauc

SEQ ID NO: 1719322 - RNA, 11 nt, Human
cuucagcugac

SEQ ID NO: 1719323 - RNA, 14 nt, Human
cuucaggcucuucu

SEQ ID NO: 1719324 - RNA, 18 nt, Human
cuucaggcucuucuccuu

SEQ ID NO: 1719325 - RNA, 17 nt, Human
cuucaggcucuucuccu

SEQ ID NO: 1719326 - RNA, 16 nt, Human
cuucaggcucuucucc

SEQ ID NO: 1719327 - RNA, 15 nt, Human
cuucaggcucuucuc

SEQ ID NO: 1719328 - RNA, 12 nt, Human
cuucagugccuu

SEQ ID NO: 1719329 - RNA, 11 nt, Human
cuucagugccu

SEQ ID NO: 1719330 - RNA, 14 nt, Human
cuucagugccuuau

SEQ ID NO: 1719331 - RNA, 13 nt, Human
cuucagugccuua

SEQ ID NO: 1719332 - RNA, 18 nt, Human
cuucauuuccugugucuu

SEQ ID NO: 1719333 - RNA, 22 nt, Human
cuuccacaagagcccaggccuc

SEQ ID NO: 1719334 - RNA, 23 nt, Human
cuuccacaagagcccaggccucc

SEQ ID NO: 1719335 - RNA, 14 nt, Human
cuucauuuggagau

SEQ ID NO: 1719336 - RNA, 13 nt, Human
cuucauuuggaga

SEQ ID NO: 1719337 - RNA, 24 nt, Human
cuuccaggggugggacacccugug

SEQ ID NO: 1719338 - RNA, 22 nt, Human
cuuccaggggugggacacccug

SEQ ID NO: 1719339 - RNA, 14 nt, Human
cuuccagugaggcu

SEQ ID NO: 1719340 - RNA, 15 nt, Human
cuuccagugaggcuc

SEQ ID NO: 1719341 - RNA, 18 nt, Human
cuucccgcucagcccucc

SEQ ID NO: 1719342 - RNA, 17 nt, Human
cuucccgcucagcccuc

SEQ ID NO: 1719343 - RNA, 16 nt, Human
cuucccgcucagcccu

SEQ ID NO: 1719344 - RNA, 15 nt, Human
cuucccgcucagccc

SEQ ID NO: 1719345 - RNA, 14 nt, Human
cuuaucaaaggaca

SEQ ID NO: 1719346 - RNA, 16 nt, Human
cuuaucaaaggacacc

SEQ ID NO: 1719347 - RNA, 15 nt, Human
cuuauuuaaugaaag

SEQ ID NO: 1719348 - RNA, 23 nt, Human
cuuaugauagcaaauggccucau

SEQ ID NO: 1719349 - RNA, 13 nt, Human
cuuauaauuuaaa

SEQ ID NO: 1719350 - RNA, 20 nt, Human
cuuaggugauccacucgccu

SEQ ID NO: 1719351 - RNA, 17 nt, Human
cuuagguuggcaaaaag

SEQ ID NO: 1719352 - RNA, 14 nt, Human
cuuauaauuuaaaa

SEQ ID NO: 1719353 - RNA, 19 nt, Human
cuuauaggaauugacccac

SEQ ID NO: 1719354 - RNA, 15 nt, Human
cuuauacauuugaua

SEQ ID NO: 1719355 - RNA, 19 nt, Human
cuuacuaguuucccuugca

SEQ ID NO: 1719356 - RNA, 15 nt, Human
cuuacgugaguccug

SEQ ID NO: 1719357 - RNA, 16 nt, Human
cuuacuguacaugaaa

SEQ ID NO: 1719358 - RNA, 14 nt, Human
cuuacuuaguguua

SEQ ID NO: 1719359 - RNA, 18 nt, Human
cuuagacagucccugcca

SEQ ID NO: 1719360 - RNA, 17 nt, Human
cuuagacagucccugcc

SEQ ID NO: 1719361 - RNA, 19 nt, Human
cuuagacagucccugccaa

SEQ ID NO: 1719362 - RNA, 16 nt, Human
cuuagacagucccugc

SEQ ID NO: 1719363 - RNA, 15 nt, Human
cuuagacagucccug

SEQ ID NO: 1719364 - RNA, 14 nt, Human
cuuagacagucccu

SEQ ID NO: 1719365 - RNA, 15 nt, Human
cuuagaagucacaca

SEQ ID NO: 1719366 - RNA, 17 nt, Human
cuuagaaauugcauuuc

SEQ ID NO: 1719367 - RNA, 15 nt, Human
cuuagaaccuuucuu

SEQ ID NO: 1719368 - RNA, 18 nt, Human
cuguuuguuucugaaagg

SEQ ID NO: 1719369 - RNA, 12 nt, Human
cuguuuagauaa

SEQ ID NO: 1719370 - RNA, 17 nt, Human
cugguugaugccuguga

SEQ ID NO: 1719371 - RNA, 23 nt, Human
cuguuuguuucugaaagggacgc

SEQ ID NO: 1719372 - RNA, 21 nt, Human
cuguuuguuucugaaagggac

SEQ ID NO: 1719373 - RNA, 21 nt, Human
cuguuuuauuuuaauucaguu

SEQ ID NO: 1719374 - RNA, 14 nt, Human
cuguuuucucuuga

SEQ ID NO: 1719375 - RNA, 17 nt, Human
cuguuuucucuugagag

SEQ ID NO: 1719376 - RNA, 18 nt, Human
cuuaaugccacuaaauug

SEQ ID NO: 1719377 - RNA, 14 nt, Human
cuuaaucuaaaugg

SEQ ID NO: 1719378 - RNA, 16 nt, Human
cuuaaucuaaauggaa

SEQ ID NO: 1719379 - RNA, 16 nt, Human
cuuaaguuuauacucu

SEQ ID NO: 1719380 - RNA, 19 nt, Human
cuuaaguuaguuccacuga

SEQ ID NO: 1719381 - RNA, 21 nt, Human
cuuaaguuaguuccacugaga

SEQ ID NO: 1719382 - RNA, 12 nt, Human
cuuaacuucaca

SEQ ID NO: 1719383 - RNA, 14 nt, Human
cuuaacuucacaua

SEQ ID NO: 1719384 - RNA, 15 nt, Human
cuuaacuucacauau

SEQ ID NO: 1719385 - RNA, 16 nt, Human
cuuaacuucacauauu

SEQ ID NO: 1719386 - RNA, 17 nt, Human
cuuaacuucacauauug

SEQ ID NO: 1719387 - RNA, 22 nt, Human
cuuaacuucacauauugauuuc

SEQ ID NO: 1719388 - RNA, 22 nt, Human
cuuaaaugcaaccauuugaaac

SEQ ID NO: 1719389 - RNA, 21 nt, Human
cugacauuguuggccaaagcc

SEQ ID NO: 1719390 - RNA, 11 nt, Human
cugacccacug

SEQ ID NO: 1719391 - RNA, 19 nt, Human
cugacaggcaaugcuggcu

SEQ ID NO: 1719392 - RNA, 18 nt, Human
cugacaggcaaugcuggc

SEQ ID NO: 1719393 - RNA, 17 nt, Human
cugacaggcaaugcugg

SEQ ID NO: 1719394 - RNA, 16 nt, Human
cugacaggcaaugcug

SEQ ID NO: 1719395 - RNA, 20 nt, Human
cugacaggcaaugcuggcug

SEQ ID NO: 1719396 - RNA, 21 nt, Human
cugacaggcaaugcuggcugu

SEQ ID NO: 1719397 - RNA, 17 nt, Human
cugacauuguuggccaa

SEQ ID NO: 1719398 - RNA, 21 nt, Human
cugacagacacaggcccggcu

SEQ ID NO: 1719399 - RNA, 19 nt, Human
cugacagacagcccuccau

SEQ ID NO: 1719400 - RNA, 17 nt, Human
cugacagacagcccucc

SEQ ID NO: 1719401 - RNA, 11 nt, Human
cugacaggcaa

SEQ ID NO: 1719402 - RNA, 19 nt, Human
cugacagacacaggcccgg

SEQ ID NO: 1719403 - RNA, 21 nt, Human
cugaauauugccauuaugcuu

SEQ ID NO: 1719404 - RNA, 16 nt, Human
cugaagucacacagug

SEQ ID NO: 1719405 - RNA, 15 nt, Human
cugaagucacacagu

SEQ ID NO: 1719406 - RNA, 14 nt, Human
cugaagucacacag

SEQ ID NO: 1719407 - RNA, 24 nt, Human
cugaagucuuuguacagacaacaa

SEQ ID NO: 1719408 - RNA, 22 nt, Human
cugaagucacugcacagugcau

SEQ ID NO: 1719409 - RNA, 16 nt, Human
cugaagucacugcaca

SEQ ID NO: 1719410 - RNA, 17 nt, Human
cugaagucacugcacag

SEQ ID NO: 1719411 - RNA, 16 nt, Human
cugaauacagaggcaa

SEQ ID NO: 1719412 - RNA, 21 nt, Human
cugaacuuggcgcugccccug

SEQ ID NO: 1719413 - RNA, 16 nt, Human
cugaacuuggcgcugc

SEQ ID NO: 1719414 - RNA, 15 nt, Human
cugaacuuggcgcug

SEQ ID NO: 1719415 - RNA, 21 nt, Human
cugaagacucauucuucugua

SEQ ID NO: 1719416 - RNA, 21 nt, Human
cucuuuggucuacacugugcu

SEQ ID NO: 1719417 - RNA, 19 nt, Human
cucuuuggucuacacugug

SEQ ID NO: 1719418 - RNA, 18 nt, Human
cucuuugggccuggcucc

SEQ ID NO: 1719419 - RNA, 21 nt, Human
cugaaccuggguaacuaggga

SEQ ID NO: 1719420 - RNA, 23 nt, Human
cucuucaguuaagccuuuggaaa

SEQ ID NO: 1719421 - RNA, 20 nt, Human
cucuucaguuaagccuuugg

SEQ ID NO: 1719422 - RNA, 19 nt, Human
cucuucaguuaagccuuug

SEQ ID NO: 1719423 - RNA, 24 nt, Human
cucuuaaaacccaagugccuuagc

SEQ ID NO: 1719424 - RNA, 13 nt, Human
cucuuaaaaccca

SEQ ID NO: 1719425 - RNA, 19 nt, Human
cucuggcagcucagagagg

SEQ ID NO: 1719426 - RNA, 20 nt, Human
cucuggcagcucagagaggg

SEQ ID NO: 1719427 - RNA, 19 nt, Human
cucuguucugcacacagca

SEQ ID NO: 1719428 - RNA, 21 nt, Human
cucuguucugcacacagcacg

SEQ ID NO: 1719429 - RNA, 20 nt, Human
cucuguucugcacacagcac

SEQ ID NO: 1719430 - RNA, 18 nt, Human
cucuggcagcucagagag

SEQ ID NO: 1719431 - RNA, 17 nt, Human
cucuggcagcucagaga

SEQ ID NO: 1719432 - RNA, 15 nt, Human
cucuggagcccacug

SEQ ID NO: 1719433 - RNA, 12 nt, Human
cucuucuccagg

SEQ ID NO: 1719434 - RNA, 19 nt, Human
cucuucuccacuggaugga

SEQ ID NO: 1719435 - RNA, 14 nt, Human
cucuucuccacugg

SEQ ID NO: 1719436 - RNA, 17 nt, Human
cucuucuccacuggaug

SEQ ID NO: 1719437 - RNA, 15 nt, Human
cucuucuccacugga

SEQ ID NO: 1719438 - RNA, 21 nt, Human
cucuuccaggcugggagagcc

SEQ ID NO: 1719439 - RNA, 22 nt, Human
cucuuccaggcugggagagccu

SEQ ID NO: 1719440 - RNA, 23 nt, Human
cucuuccaggcugggagagccuu

SEQ ID NO: 1719441 - RNA, 16 nt, Human
cucuucuccuuucaca

SEQ ID NO: 1719442 - RNA, 15 nt, Human
cucuucuccuuucac

SEQ ID NO: 1719443 - RNA, 13 nt, Human
cucuucuccuuuc

SEQ ID NO: 1719444 - RNA, 18 nt, Human
cucuuuggacacucacac

SEQ ID NO: 1719445 - RNA, 15 nt, Human
cucuuuggacacuca

SEQ ID NO: 1719446 - RNA, 13 nt, Human
cucuuucccuccc

SEQ ID NO: 1719447 - RNA, 17 nt, Human
cucuuuccaucuacccu

SEQ ID NO: 1719448 - RNA, 15 nt, Human
cucuugaccucaggu

SEQ ID NO: 1719449 - RNA, 13 nt, Human
cucuugaccucag

SEQ ID NO: 1719450 - RNA, 16 nt, Human
cucuugaccucaggug

SEQ ID NO: 1719451 - RNA, 18 nt, Human
cucuucuggguuccuucc

SEQ ID NO: 1719452 - RNA, 18 nt, Human
cucuugaacuccugaccu

SEQ ID NO: 1719453 - RNA, 19 nt, Human
cucuugguccugcugcagu

SEQ ID NO: 1719454 - RNA, 18 nt, Human
cucuugguccugcugcag

SEQ ID NO: 1719455 - RNA, 23 nt, Human
cucucaggccagcugcuugggcu

SEQ ID NO: 1719456 - RNA, 16 nt, Human
cucuccacugccuucg

SEQ ID NO: 1719457 - RNA, 21 nt, Human
cucuccauucccguggaacgu

SEQ ID NO: 1719458 - RNA, 13 nt, Human
cucuccagccccu

SEQ ID NO: 1719459 - RNA, 12 nt, Human
cucuccagcccc

SEQ ID NO: 1719460 - RNA, 18 nt, Human
cucucccaucacuucccu

SEQ ID NO: 1719461 - RNA, 14 nt, Human
cucucccaucacuu

SEQ ID NO: 1719462 - RNA, 20 nt, Human
cucucccaucacuucccuac

SEQ ID NO: 1719463 - RNA, 13 nt, Human
cucucccaucacu

SEQ ID NO: 1719464 - RNA, 13 nt, Human
cucuccuguaccu

SEQ ID NO: 1719465 - RNA, 14 nt, Human
cucuccuguaccuc

SEQ ID NO: 1719466 - RNA, 15 nt, Human
cucuccuguaccucu

SEQ ID NO: 1719467 - RNA, 13 nt, Human
cucuccccagcaa

SEQ ID NO: 1719468 - RNA, 22 nt, Human
cucuccuguaccucuugagccu

SEQ ID NO: 1719469 - RNA, 17 nt, Human
cucuccuguaccucuug

SEQ ID NO: 1719470 - RNA, 18 nt, Human
cucuccuguaccucuuga

SEQ ID NO: 1719471 - RNA, 13 nt, Human
cucucucaggcca

SEQ ID NO: 1719472 - RNA, 12 nt, Human
cucucucaggcc

SEQ ID NO: 1719473 - RNA, 16 nt, Human
cucucucacuccuuga

SEQ ID NO: 1719474 - RNA, 15 nt, Human
cucucucacuccuug

SEQ ID NO: 1719475 - RNA, 22 nt, Human
cucucugcaggucccuaauaaa

SEQ ID NO: 1719476 - RNA, 19 nt, Human
cucucugcaggucccuaau

SEQ ID NO: 1719477 - RNA, 17 nt, Human
cucucugcaggucccua

SEQ ID NO: 1719478 - RNA, 16 nt, Human
cucucugcaggucccu

SEQ ID NO: 1719479 - RNA, 14 nt, Human
cucucugcaggucc

SEQ ID NO: 1719480 - RNA, 13 nt, Human
cucucugcagguc

SEQ ID NO: 1719481 - RNA, 12 nt, Human
cucucugcaggu

SEQ ID NO: 1719482 - RNA, 10 nt, Human
cucugcacaa

SEQ ID NO: 1719483 - RNA, 23 nt, Human
cucugcauacucauuaggauggc

SEQ ID NO: 1719484 - RNA, 23 nt, Human
cucugcaggucccuaauaaagcu

SEQ ID NO: 1719485 - RNA, 22 nt, Human
cucugcaagaauugaagcagga

SEQ ID NO: 1719486 - RNA, 17 nt, Human
cucugaugaagaggagu

SEQ ID NO: 1719487 - RNA, 20 nt, Human
cucugagacucgcgacaaug

SEQ ID NO: 1719488 - RNA, 21 nt, Human
cucucugcccuaaugcgcagg

SEQ ID NO: 1719489 - RNA, 13 nt, Human
cucucugcccuaa

SEQ ID NO: 1719490 - RNA, 12 nt, Human
cucucugcccua

SEQ ID NO: 1719491 - RNA, 16 nt, Human
cucugagcaaaugugg

SEQ ID NO: 1719492 - RNA, 15 nt, Human
cucugagccuuggga

SEQ ID NO: 1719493 - RNA, 23 nt, Human
cucugcccuccaagaccuucucc

SEQ ID NO: 1719494 - RNA, 16 nt, Human
cucugcccuccaagac

SEQ ID NO: 1719495 - RNA, 15 nt, Human
cucugcccuccaaga

SEQ ID NO: 1719496 - RNA, 14 nt, Human
cucugcccuccaag

SEQ ID NO: 1719497 - RNA, 12 nt, Human
cucugcccuugg

SEQ ID NO: 1719498 - RNA, 12 nt, Human
cucugcccugcg

SEQ ID NO: 1719499 - RNA, 14 nt, Human
cucugccuccucuu

SEQ ID NO: 1719500 - RNA, 11 nt, Human
cucugcccugc

SEQ ID NO: 1719501 - RNA, 23 nt, Human
cucugcccuaaugcgcaggcugg

SEQ ID NO: 1719502 - RNA, 16 nt, Human
cucugccucugacaca

SEQ ID NO: 1719503 - RNA, 14 nt, Human
cucugccucugaca

SEQ ID NO: 1719504 - RNA, 16 nt, Human
cucugccuccucuuca

SEQ ID NO: 1719505 - RNA, 15 nt, Human
cucugccuccucuuc

SEQ ID NO: 1719506 - RNA, 14 nt, Human
cucuggaauuugaa

SEQ ID NO: 1719507 - RNA, 15 nt, Human
cucugcuuuggaaau

SEQ ID NO: 1719508 - RNA, 14 nt, Human
cucuggacaggcau

SEQ ID NO: 1719509 - RNA, 12 nt, Human
cucuggagccca

SEQ ID NO: 1719510 - RNA, 14 nt, Human
cucauucuucugua

SEQ ID NO: 1719511 - RNA, 13 nt, Human
cucauucuucugu

SEQ ID NO: 1719512 - RNA, 18 nt, Human
cucauuccaccuucccau

SEQ ID NO: 1719513 - RNA, 21 nt, Human
cucauuccaccuucccaugcc

SEQ ID NO: 1719514 - RNA, 15 nt, Human
cucauugaccugagg

SEQ ID NO: 1719515 - RNA, 13 nt, Human
cucauugaccuga

SEQ ID NO: 1719516 - RNA, 23 nt, Human
cucauucuucuguacgucugaca

SEQ ID NO: 1719517 - RNA, 16 nt, Human
cucauugaccugaggc

SEQ ID NO: 1719518 - RNA, 17 nt, Human
cucauuaggauggcuag

SEQ ID NO: 1719519 - RNA, 18 nt, Human
cucauuaggauggcuagu

SEQ ID NO: 1719520 - RNA, 21 nt, Human
cucauuagcauuuugcuaaau

SEQ ID NO: 1719521 - RNA, 17 nt, Human
cucaucuccccaucauu

SEQ ID NO: 1719522 - RNA, 21 nt, Human
cucaucuagguaaauuacagu

SEQ ID NO: 1719523 - RNA, 15 nt, Human
cucauacccaccccc

SEQ ID NO: 1719524 - RNA, 19 nt, Human
cucauaguaugguggcugg

SEQ ID NO: 1719525 - RNA, 18 nt, Human
cucauaguaugguggcug

SEQ ID NO: 1719526 - RNA, 20 nt, Human
cucauaguaugguggcuggg

SEQ ID NO: 1719527 - RNA, 14 nt, Human
cucaggugagaagc

SEQ ID NO: 1719528 - RNA, 19 nt, Human
cucaggugucccugcacuu

SEQ ID NO: 1719529 - RNA, 18 nt, Human
cucaggugucccugcacu

SEQ ID NO: 1719530 - RNA, 17 nt, Human
cucaggugucccugcac

SEQ ID NO: 1719531 - RNA, 16 nt, Human
cucaggugucccugca

SEQ ID NO: 1719532 - RNA, 15 nt, Human
cucaggugucccugc

SEQ ID NO: 1719533 - RNA, 23 nt, Human
cucagguggggucacucuggcag

SEQ ID NO: 1719534 - RNA, 22 nt, Human
cucagguggggucacucuggca

SEQ ID NO: 1719535 - RNA, 14 nt, Human
cucagggucccugg

SEQ ID NO: 1719536 - RNA, 18 nt, Human
cucaggucccugcagggc

SEQ ID NO: 1719537 - RNA, 17 nt, Human
cucaggucccugcaggg

SEQ ID NO: 1719538 - RNA, 15 nt, Human
cucaggucuguuuuc

SEQ ID NO: 1719539 - RNA, 12 nt, Human
cucagggucccu

SEQ ID NO: 1719540 - RNA, 23 nt, Human
cuaaaagguaugcaaucaaaucu

SEQ ID NO: 1719541 - RNA, 23 nt, Human
cuccauccugaggcuccacuugg

SEQ ID NO: 1719542 - RNA, 17 nt, Human
cuccaucuaaacugccc

SEQ ID NO: 1719543 - RNA, 20 nt, Human
cuccaucgcugucaucucag

SEQ ID NO: 1719544 - RNA, 13 nt, Human
cuccaucuccacu

SEQ ID NO: 1719545 - RNA, 18 nt, Human
cuccaucuaaacugcccc

SEQ ID NO: 1719546 - RNA, 21 nt, Human
cuccauccugaggcuccacuu

SEQ ID NO: 1719547 - RNA, 11 nt, Human
cuccaggcucc

SEQ ID NO: 1719548 - RNA, 19 nt, Human
cuccagcuguucagcuggu

SEQ ID NO: 1719549 - RNA, 18 nt, Human
cuccagcuguucagcugg

SEQ ID NO: 1719550 - RNA, 13 nt, Human
cuccagcuguuca

SEQ ID NO: 1719551 - RNA, 19 nt, Human
cuccagcuggguuggaaaa

SEQ ID NO: 1719552 - RNA, 14 nt, Human
cucccaggcgcccc

SEQ ID NO: 1719553 - RNA, 22 nt, Human
cucccaggcauuccccaggagg

SEQ ID NO: 1719554 - RNA, 21 nt, Human
cucccaggcauuccccaggag

SEQ ID NO: 1719555 - RNA, 20 nt, Human
cucccaggcauuccccagga

SEQ ID NO: 1719556 - RNA, 19 nt, Human
cucccaggcauuccccagg

SEQ ID NO: 1719557 - RNA, 17 nt, Human
cucccaggcauucccca

SEQ ID NO: 1719558 - RNA, 22 nt, Human
cucccaaggggcccaaauucuu

SEQ ID NO: 1719559 - RNA, 21 nt, Human
cucccaaggggcccaaauucu

SEQ ID NO: 1719560 - RNA, 14 nt, Human
cuccaugugggcua

SEQ ID NO: 1719561 - RNA, 24 nt, Human
cuccauucccguggaacguuuuuc

SEQ ID NO: 1719562 - RNA, 17 nt, Human
cuccaccugccagggac

SEQ ID NO: 1719563 - RNA, 21 nt, Human
cuccaccugccagggacagag

SEQ ID NO: 1719564 - RNA, 18 nt, Human
cuccaccugccagggaca

SEQ ID NO: 1719565 - RNA, 12 nt, Human
cuccacccugcu

SEQ ID NO: 1719566 - RNA, 11 nt, Human
cuccacccugc

SEQ ID NO: 1719567 - RNA, 20 nt, Human
cuccacauauuucagugagg

SEQ ID NO: 1719568 - RNA, 20 nt, Human
cuccagcucaccagccccag

SEQ ID NO: 1719569 - RNA, 19 nt, Human
cuccagcucaccagcccca

SEQ ID NO: 1719570 - RNA, 11 nt, Human
cuccacugccu

SEQ ID NO: 1719571 - RNA, 20 nt, Human
cuccagaccccuggcuuuuc

SEQ ID NO: 1719572 - RNA, 19 nt, Human
cuccagaccccuggcuuuu

SEQ ID NO: 1719573 - RNA, 18 nt, Human
cuccagaccccuggcuuu

SEQ ID NO: 1719574 - RNA, 17 nt, Human
cuccagaccccuggcuu

SEQ ID NO: 1719575 - RNA, 15 nt, Human
cuccagaccccuggc

SEQ ID NO: 1719576 - RNA, 17 nt, Human
cucgagguuucucaaag

SEQ ID NO: 1719577 - RNA, 16 nt, Human
cucgaguuacagacaa

SEQ ID NO: 1719578 - RNA, 20 nt, Human
cucgaguuacagacaaagcg

SEQ ID NO: 1719579 - RNA, 15 nt, Human
cucgcgacaaugcaa

SEQ ID NO: 1719580 - RNA, 19 nt, Human
cucgcuauugucaccaggg

SEQ ID NO: 1719581 - RNA, 13 nt, Human
cucgcgacaaugc

SEQ ID NO: 1719582 - RNA, 19 nt, Human
cucggacuuagcugggaga

SEQ ID NO: 1719583 - RNA, 18 nt, Human
cucggacuuagcugggag

SEQ ID NO: 1719584 - RNA, 21 nt, Human
cucgcuauugucaccagggcu

SEQ ID NO: 1719585 - RNA, 22 nt, Human
cucgcuauugucaccagggcug

SEQ ID NO: 1719586 - RNA, 22 nt, Human
cucuaaagucuguugauuaaag

SEQ ID NO: 1719587 - RNA, 19 nt, Human
cucuaacaguggacaaagu

SEQ ID NO: 1719588 - RNA, 15 nt, Human
cucuaacaguggaca

SEQ ID NO: 1719589 - RNA, 22 nt, Human
cucggccucccaaagugcuggg

SEQ ID NO: 1719590 - RNA, 23 nt, Human
cucggccucccaaagugcuggga

SEQ ID NO: 1719591 - RNA, 20 nt, Human
cuccuucuguccuacucugu

SEQ ID NO: 1719592 - RNA, 15 nt, Human
cuccuucuguccuac

SEQ ID NO: 1719593 - RNA, 14 nt, Human
cuccuucuguccua

SEQ ID NO: 1719594 - RNA, 21 nt, Human
cuccuugaaaacacuguucuc

SEQ ID NO: 1719595 - RNA, 11 nt, Human
cuccuucuucc

SEQ ID NO: 1719596 - RNA, 11 nt, Human
cuccugugugu

SEQ ID NO: 1719597 - RNA, 23 nt, Human
cuccugugucuugcaauggcagc

SEQ ID NO: 1719598 - RNA, 15 nt, Human
cuccugugucuugca

SEQ ID NO: 1719599 - RNA, 11 nt, Human
cuccugccacc

SEQ ID NO: 1719600 - RNA, 21 nt, Human
cuccugcaggcagccaggcca

SEQ ID NO: 1719601 - RNA, 15 nt, Human
cuccugcaggcagcc

SEQ ID NO: 1719602 - RNA, 22 nt, Human
cuccugcaggcagccaggccac

SEQ ID NO: 1719603 - RNA, 16 nt, Human
cuccugcaggcagcca

SEQ ID NO: 1719604 - RNA, 21 nt, Human
cuccuucaccuuuguccccac

SEQ ID NO: 1719605 - RNA, 19 nt, Human
cuccuucaccuuugucccc

SEQ ID NO: 1719606 - RNA, 16 nt, Human
cuccuucaccuuuguc

SEQ ID NO: 1719607 - RNA, 14 nt, Human
cuccuucaccuuug

SEQ ID NO: 1719608 - RNA, 14 nt, Human
cuccugugugugcg

SEQ ID NO: 1719609 - RNA, 22 nt, Human
cuccuaucagaaguuucucagc

SEQ ID NO: 1719610 - RNA, 12 nt, Human
cuccucagaucu

SEQ ID NO: 1719611 - RNA, 14 nt, Human
cuccucagaucuuc

SEQ ID NO: 1719612 - RNA, 19 nt, Human
cuccucuugccacugccuc

SEQ ID NO: 1719613 - RNA, 14 nt, Human
cuccugcaggcagc

SEQ ID NO: 1719614 - RNA, 13 nt, Human
cuccugcaggcag

SEQ ID NO: 1719615 - RNA, 22 nt, Human
cuccugaguagcugggauuaca

SEQ ID NO: 1719616 - RNA, 17 nt, Human
cuccugaguagcuggga

SEQ ID NO: 1719617 - RNA, 21 nt, Human
cuccugaguagcuggauuaca

SEQ ID NO: 1719618 - RNA, 14 nt, Human
cuccugaccuuagg

SEQ ID NO: 1719619 - RNA, 14 nt, Human
cuccugaccucagg

SEQ ID NO: 1719620 - RNA, 13 nt, Human
cucccuuucaaca

SEQ ID NO: 1719621 - RNA, 20 nt, Human
cucccuuggauuguccccga

SEQ ID NO: 1719622 - RNA, 17 nt, Human
cucccuuggauuguccc

SEQ ID NO: 1719623 - RNA, 17 nt, Human
cucccuuucuucccuac

SEQ ID NO: 1719624 - RNA, 16 nt, Human
cucccuucucuucaca

SEQ ID NO: 1719625 - RNA, 13 nt, Human
cucccuuccucuu

SEQ ID NO: 1719626 - RNA, 14 nt, Human
cucccuuccucuuu

SEQ ID NO: 1719627 - RNA, 23 nt, Human
cucccuucccaccucucucacuc

SEQ ID NO: 1719628 - RNA, 10 nt, Human
cucccuuccu

SEQ ID NO: 1719629 - RNA, 20 nt, Human
cucccuucaaccauucccca

SEQ ID NO: 1719630 - RNA, 19 nt, Human
cucccuucaaccauucccc

SEQ ID NO: 1719631 - RNA, 18 nt, Human
cucccuucaaccauuccc

SEQ ID NO: 1719632 - RNA, 12 nt, Human
cucccuucaacc

SEQ ID NO: 1719633 - RNA, 18 nt, Human
cucccaucucacacauga

SEQ ID NO: 1719634 - RNA, 15 nt, Human
cucccaucucacaca

SEQ ID NO: 1719635 - RNA, 21 nt, Human
cucccaucucacacaugagca

SEQ ID NO: 1719636 - RNA, 14 nt, Human
cucccaucucacac

SEQ ID NO: 1719637 - RNA, 14 nt, Human
cucccaucacccgc

SEQ ID NO: 1719638 - RNA, 23 nt, Human
cuggaauaauccuaaacauauga

SEQ ID NO: 1719639 - RNA, 21 nt, Human
cuggaagugcuaauuuugaaa

SEQ ID NO: 1719640 - RNA, 18 nt, Human
cuggaagcacagcuucau

SEQ ID NO: 1719641 - RNA, 15 nt, Human
cuggaagcacagcuu

SEQ ID NO: 1719642 - RNA, 15 nt, Human
cuggaaugcaguggu

SEQ ID NO: 1719643 - RNA, 14 nt, Human
cuggaaugcagugg

SEQ ID NO: 1719644 - RNA, 18 nt, Human
cugcuuugggcugcccug

SEQ ID NO: 1719645 - RNA, 20 nt, Human
cugcuuugggcugcccuggu

SEQ ID NO: 1719646 - RNA, 19 nt, Human
cugcuuugggcugcccugg

SEQ ID NO: 1719647 - RNA, 23 nt, Human
cugcuuugggcugcccuggugcu

SEQ ID NO: 1719648 - RNA, 22 nt, Human
cugcuuugggcugcccuggugc

SEQ ID NO: 1719649 - RNA, 21 nt, Human
cugcuuugggcugcccuggug

SEQ ID NO: 1719650 - RNA, 12 nt, Human
cugcucugauga

SEQ ID NO: 1719651 - RNA, 21 nt, Human
cuggagcccacuguacuugcu

SEQ ID NO: 1719652 - RNA, 20 nt, Human
cuggagcccacuguacuugc

SEQ ID NO: 1719653 - RNA, 17 nt, Human
cuggagcccacuguacu

SEQ ID NO: 1719654 - RNA, 16 nt, Human
cuggagcccacuguac

SEQ ID NO: 1719655 - RNA, 15 nt, Human
cuggagcccacugua

SEQ ID NO: 1719656 - RNA, 13 nt, Human
cuggagcccacug

SEQ ID NO: 1719657 - RNA, 16 nt, Human
cuggacucaccucccc

SEQ ID NO: 1719658 - RNA, 23 nt, Human
cuggcacuauaauguaagcucua

SEQ ID NO: 1719659 - RNA, 14 nt, Human
cuggcacugcuucc

SEQ ID NO: 1719660 - RNA, 13 nt, Human
cuggcacugcuuc

SEQ ID NO: 1719661 - RNA, 17 nt, Human
cuggcacagggcagugg

SEQ ID NO: 1719662 - RNA, 15 nt, Human
cuggauggggcugca

SEQ ID NO: 1719663 - RNA, 21 nt, Human
cuggauggaggaaaaccaagc

SEQ ID NO: 1719664 - RNA, 16 nt, Human
cuggauggggcugcac

SEQ ID NO: 1719665 - RNA, 15 nt, Human
cuggauguaccacca

SEQ ID NO: 1719666 - RNA, 13 nt, Human
cuggauuaaacuu

SEQ ID NO: 1719667 - RNA, 23 nt, Human
cuggauuaaacuuaaucuaaaug

SEQ ID NO: 1719668 - RNA, 17 nt, Human
cuggauuauauuaugaa

SEQ ID NO: 1719669 - RNA, 23 nt, Human
cuggauuauucaaaaugauguau

SEQ ID NO: 1719670 - RNA, 16 nt, Human
cuggccaacgggguga

SEQ ID NO: 1719671 - RNA, 16 nt, Human
cuggccagaugcacca

SEQ ID NO: 1719672 - RNA, 18 nt, Human
cuggcacugcuuccagug

SEQ ID NO: 1719673 - RNA, 17 nt, Human
cuggcacugcuuccagu

SEQ ID NO: 1719674 - RNA, 16 nt, Human
cuggcacugcuuccag

SEQ ID NO: 1719675 - RNA, 15 nt, Human
cuggcacugcuucca

SEQ ID NO: 1719676 - RNA, 20 nt, Human
cuggccagaugcaccagccc

SEQ ID NO: 1719677 - RNA, 19 nt, Human
cuggccagaugcaccagcc

SEQ ID NO: 1719678 - RNA, 18 nt, Human
cuggccagaugcaccagc

SEQ ID NO: 1719679 - RNA, 17 nt, Human
cuggccagaugcaccag

SEQ ID NO: 1719680 - RNA, 21 nt, Human
cuggccagaugcaccagcccu

SEQ ID NO: 1719681 - RNA, 22 nt, Human
cuggccagaugcaccagcccuu

SEQ ID NO: 1719682 - RNA, 17 nt, Human
cuggccuagcauacgua

SEQ ID NO: 1719683 - RNA, 13 nt, Human
cuggcccacugca

SEQ ID NO: 1719684 - RNA, 12 nt, Human
cuggcccacugc

SEQ ID NO: 1719685 - RNA, 23 nt, Human
cuggccuagcauacguacacauu

SEQ ID NO: 1719686 - RNA, 22 nt, Human
cuggccucaagugauucuccug

SEQ ID NO: 1719687 - RNA, 18 nt, Human
cuggucccacucagucca

SEQ ID NO: 1719688 - RNA, 15 nt, Human
cuggucccacucagu

SEQ ID NO: 1719689 - RNA, 21 nt, Human
cugguccauagagagcaagac

SEQ ID NO: 1719690 - RNA, 18 nt, Human
cugguccauagagagcaa

SEQ ID NO: 1719691 - RNA, 19 nt, Human
cuggguucuacccaggugc

SEQ ID NO: 1719692 - RNA, 17 nt, Human
cugguccauagagagca

SEQ ID NO: 1719693 - RNA, 15 nt, Human
cugguccauagagag

SEQ ID NO: 1719694 - RNA, 13 nt, Human
cuggguuggaggg

SEQ ID NO: 1719695 - RNA, 18 nt, Human
cuggguuggaaaacagua

SEQ ID NO: 1719696 - RNA, 13 nt, Human
cuggguuggaaaa

SEQ ID NO: 1719697 - RNA, 23 nt, Human
cugguggcagugggagcugccug

SEQ ID NO: 1719698 - RNA, 19 nt, Human
cugguggcagugggagcug

SEQ ID NO: 1719699 - RNA, 18 nt, Human
cuggucucaaacuccuga

SEQ ID NO: 1719700 - RNA, 19 nt, Human
cugggcucccuucccaccu

SEQ ID NO: 1719701 - RNA, 21 nt, Human
cugggcuuggggaccagagcu

SEQ ID NO: 1719702 - RNA, 20 nt, Human
cugggcuuggggaccagagc

SEQ ID NO: 1719703 - RNA, 17 nt, Human
cugggcuuggggaccag

SEQ ID NO: 1719704 - RNA, 13 nt, Human
cugggcuugggga

SEQ ID NO: 1719705 - RNA, 23 nt, Human
cugggcuucaguggcagcugcuu

SEQ ID NO: 1719706 - RNA, 22 nt, Human
cugggcuucaguggcagcugcu

SEQ ID NO: 1719707 - RNA, 21 nt, Human
cugggcuucaguggcagcugc

SEQ ID NO: 1719708 - RNA, 20 nt, Human
cugggcuucaguggcagcug

SEQ ID NO: 1719709 - RNA, 19 nt, Human
cugggcuucaguggcagcu

SEQ ID NO: 1719710 - RNA, 18 nt, Human
cugggcuucaguggcagc

SEQ ID NO: 1719711 - RNA, 19 nt, Human
cugggccccugccucucug

SEQ ID NO: 1719712 - RNA, 18 nt, Human
cugggggccucagugcca

SEQ ID NO: 1719713 - RNA, 17 nt, Human
cugggggccucagugcc

SEQ ID NO: 1719714 - RNA, 13 nt, Human
cugggggccucag

SEQ ID NO: 1719715 - RNA, 19 nt, Human
cugggguggggaccucagg

SEQ ID NO: 1719716 - RNA, 18 nt, Human
cugggguggggaccucag

SEQ ID NO: 1719717 - RNA, 17 nt, Human
cugggguggggaccuca

SEQ ID NO: 1719718 - RNA, 20 nt, Human
cuggguacuuguggacacag

SEQ ID NO: 1719719 - RNA, 23 nt, Human
cugggguggggaccucaggccug

SEQ ID NO: 1719720 - RNA, 22 nt, Human
cugggguggggaccucaggccu

SEQ ID NO: 1719721 - RNA, 21 nt, Human
cugggguggggaccucaggcc

SEQ ID NO: 1719722 - RNA, 23 nt, Human
cuggguacuuguggacacagcuc

SEQ ID NO: 1719723 - RNA, 21 nt, Human
cuggguacuuguggacacagc

SEQ ID NO: 1719724 - RNA, 15 nt, Human
cugggagcucugcag

SEQ ID NO: 1719725 - RNA, 14 nt, Human
cugggagcucugca

SEQ ID NO: 1719726 - RNA, 13 nt, Human
cugggagcucugc

SEQ ID NO: 1719727 - RNA, 18 nt, Human
cugggaggucaaggcugc

SEQ ID NO: 1719728 - RNA, 16 nt, Human
cugggaggcucuggag

SEQ ID NO: 1719729 - RNA, 15 nt, Human
cugggaggcucugga

SEQ ID NO: 1719730 - RNA, 16 nt, Human
cugggaggcagugaug

SEQ ID NO: 1719731 - RNA, 14 nt, Human
cugggaggcaguga

SEQ ID NO: 1719732 - RNA, 13 nt, Human
cugggagugagcu

SEQ ID NO: 1719733 - RNA, 16 nt, Human
cugggagugagcuggu

SEQ ID NO: 1719734 - RNA, 23 nt, Human
cugggauuacaggcuccugccac

SEQ ID NO: 1719735 - RNA, 22 nt, Human
cugggauuacaggcuccugcca

SEQ ID NO: 1719736 - RNA, 21 nt, Human
cugggauuacaggcuccugcc

SEQ ID NO: 1719737 - RNA, 21 nt, Human
cugggauuacaggcgugagcc

SEQ ID NO: 1719738 - RNA, 20 nt, Human
cugggauuacaggcuccugc

SEQ ID NO: 1719739 - RNA, 19 nt, Human
cugggauuacaggcuccug

SEQ ID NO: 1719740 - RNA, 20 nt, Human
cugggcaaugugauaaaacc

SEQ ID NO: 1719741 - RNA, 10 nt, Human
cugggccccu

SEQ ID NO: 1719742 - RNA, 17 nt, Human
cugggccccugccucuc

SEQ ID NO: 1719743 - RNA, 16 nt, Human
cugggccccugccucu

SEQ ID NO: 1719744 - RNA, 12 nt, Human
cugggccccugc

SEQ ID NO: 1719745 - RNA, 15 nt, Human
cuggccugagcuggg

SEQ ID NO: 1719746 - RNA, 17 nt, Human
cuggcucuuccaggcug

SEQ ID NO: 1719747 - RNA, 13 nt, Human
cuggccugagcug

SEQ ID NO: 1719748 - RNA, 19 nt, Human
cuggcucuuccaggcuggg

SEQ ID NO: 1719749 - RNA, 18 nt, Human
cuggcucuuccaggcugg

SEQ ID NO: 1719750 - RNA, 20 nt, Human
cuggcucuuccaggcuggga

SEQ ID NO: 1719751 - RNA, 19 nt, Human
cuggcugccuuagaaccuu

SEQ ID NO: 1719752 - RNA, 14 nt, Human
cuggcugccuuaga

SEQ ID NO: 1719753 - RNA, 19 nt, Human
cuggcuguuggcugggggc

SEQ ID NO: 1719754 - RNA, 22 nt, Human
cuggcuggguggcaccagcagc

SEQ ID NO: 1719755 - RNA, 21 nt, Human
cuggcuggguggcaccagcag

SEQ ID NO: 1719756 - RNA, 20 nt, Human
cuggcuguuggcugggggcc

SEQ ID NO: 1719757 - RNA, 14 nt, Human
cuggcuucacagau

SEQ ID NO: 1719758 - RNA, 16 nt, Human
cuggcuuuucacugcu

SEQ ID NO: 1719759 - RNA, 15 nt, Human
cuggcuuuucacugc

SEQ ID NO: 1719760 - RNA, 19 nt, Human
cugggaacaccauagguca

SEQ ID NO: 1719761 - RNA, 22 nt, Human
cuggcuuuucacugcuggcugc

SEQ ID NO: 1719762 - RNA, 20 nt, Human
cuggcuuuucacugcuggcu

SEQ ID NO: 1719763 - RNA, 19 nt, Human
cuggcuuuucacugcuggc

SEQ ID NO: 1719764 - RNA, 17 nt, Human
cuggcuuuucacugcug

SEQ ID NO: 1719765 - RNA, 15 nt, Human
cugauucccaagcuc

SEQ ID NO: 1719766 - RNA, 18 nt, Human
cugauucccaagcucugc

SEQ ID NO: 1719767 - RNA, 17 nt, Human
cugauucccaagcucug

SEQ ID NO: 1719768 - RNA, 20 nt, Human
cugauucccaagcucugcuc

SEQ ID NO: 1719769 - RNA, 19 nt, Human
cugauucccaagcucugcu

SEQ ID NO: 1719770 - RNA, 22 nt, Human
cugauucccaagcucugcuccu

SEQ ID NO: 1719771 - RNA, 21 nt, Human
cugauaaagaugagugagcau

SEQ ID NO: 1719772 - RNA, 14 nt, Human
cugaucucucguga

SEQ ID NO: 1719773 - RNA, 16 nt, Human
cugagucugaaggcug

SEQ ID NO: 1719774 - RNA, 15 nt, Human
cugagucugaaggcu

SEQ ID NO: 1719775 - RNA, 14 nt, Human
cugagucugaaggc

SEQ ID NO: 1719776 - RNA, 13 nt, Human
cugagucugaagg

SEQ ID NO: 1719777 - RNA, 17 nt, Human
cugagucugaaggcugg

SEQ ID NO: 1719778 - RNA, 14 nt, Human
cugagugccuuuug

SEQ ID NO: 1719779 - RNA, 13 nt, Human
cugauaaagauga

SEQ ID NO: 1719780 - RNA, 22 nt, Human
cugagugggggaucacagccuc

SEQ ID NO: 1719781 - RNA, 16 nt, Human
cugagugccuuuuggu

SEQ ID NO: 1719782 - RNA, 15 nt, Human
cugagugccuuuugg

SEQ ID NO: 1719783 - RNA, 12 nt, Human
cugacccacugc

SEQ ID NO: 1719784 - RNA, 22 nt, Human
cugcacagugcaucucagccca

SEQ ID NO: 1719785 - RNA, 21 nt, Human
cugcacagugcaucucagccc

SEQ ID NO: 1719786 - RNA, 18 nt, Human
cugcacccucaggcaggu

SEQ ID NO: 1719787 - RNA, 17 nt, Human
cugcacccucaggcagg

SEQ ID NO: 1719788 - RNA, 16 nt, Human
cugcacaagcugcacc

SEQ ID NO: 1719789 - RNA, 15 nt, Human
cugcacaagcugcac

SEQ ID NO: 1719790 - RNA, 14 nt, Human
cugcacaagcugca

SEQ ID NO: 1719791 - RNA, 13 nt, Human
cugcacaagcugc

SEQ ID NO: 1719792 - RNA, 18 nt, Human
cugcacaagcugcacccu

SEQ ID NO: 1719793 - RNA, 18 nt, Human
cugcacagugcaucucag

SEQ ID NO: 1719794 - RNA, 13 nt, Human
cugcacaaagccc

SEQ ID NO: 1719795 - RNA, 21 nt, Human
cugcacaaagcccuuccaugu

SEQ ID NO: 1719796 - RNA, 20 nt, Human
cugcacaaagcccuuccaug

SEQ ID NO: 1719797 - RNA, 18 nt, Human
cugcacaaagcccuucca

SEQ ID NO: 1719798 - RNA, 23 nt, Human
cugcagaagacaguauggcagcu

SEQ ID NO: 1719799 - RNA, 13 nt, Human
cugcagaagacag

SEQ ID NO: 1719800 - RNA, 20 nt, Human
cugcagagcaggaaacauga

SEQ ID NO: 1719801 - RNA, 20 nt, Human
cugcaccggcuggccuggcc

SEQ ID NO: 1719802 - RNA, 19 nt, Human
cugcaccggcuggccuggc

SEQ ID NO: 1719803 - RNA, 18 nt, Human
cugcaccggcuggccugg

SEQ ID NO: 1719804 - RNA, 17 nt, Human
cugcaccggcuggccug

SEQ ID NO: 1719805 - RNA, 17 nt, Human
cugcacuugcagacucu

SEQ ID NO: 1719806 - RNA, 16 nt, Human
cugcacuugcagacuc

SEQ ID NO: 1719807 - RNA, 14 nt, Human
cugcacuugcagac

SEQ ID NO: 1719808 - RNA, 11 nt, Human
cugcagccuca

SEQ ID NO: 1719809 - RNA, 20 nt, Human
cugcagccucaaccuccugg

SEQ ID NO: 1719810 - RNA, 19 nt, Human
cugcagccucaaccuccug

SEQ ID NO: 1719811 - RNA, 22 nt, Human
cugcagccucaaccuccugggc

SEQ ID NO: 1719812 - RNA, 22 nt, Human
cugcagggaguccgaaagggac

SEQ ID NO: 1719813 - RNA, 16 nt, Human
cugcagggccaagcac

SEQ ID NO: 1719814 - RNA, 17 nt, Human
cugcagggacugccagu

SEQ ID NO: 1719815 - RNA, 15 nt, Human
cugcagggacugcca

SEQ ID NO: 1719816 - RNA, 15 nt, Human
cugccuaagugcagc

SEQ ID NO: 1719817 - RNA, 13 nt, Human
cugccuauuuuaa

SEQ ID NO: 1719818 - RNA, 22 nt, Human
cugcccugggaggcagugaugg

SEQ ID NO: 1719819 - RNA, 15 nt, Human
cugcccugggaggca

SEQ ID NO: 1719820 - RNA, 11 nt, Human
cugcccuggga

SEQ ID NO: 1719821 - RNA, 13 nt, Human
cugcccugggagg

SEQ ID NO: 1719822 - RNA, 12 nt, Human
cugcccugggag

SEQ ID NO: 1719823 - RNA, 13 nt, Human
cugccucagccuc

SEQ ID NO: 1719824 - RNA, 14 nt, Human
cugccucagccucc

SEQ ID NO: 1719825 - RNA, 15 nt, Human
cugccugcccaggcc

SEQ ID NO: 1719826 - RNA, 14 nt, Human
cugccugcccaggc

SEQ ID NO: 1719827 - RNA, 13 nt, Human
cugccugcccagg

SEQ ID NO: 1719828 - RNA, 14 nt, Human
cugccucuucucua

SEQ ID NO: 1719829 - RNA, 13 nt, Human
cugccucuucucu

SEQ ID NO: 1719830 - RNA, 12 nt, Human
cugccucuuccu

SEQ ID NO: 1719831 - RNA, 14 nt, Human
cugccucucugcag

SEQ ID NO: 1719832 - RNA, 13 nt, Human
cugccucucugca

SEQ ID NO: 1719833 - RNA, 12 nt, Human
cugccucucugc

SEQ ID NO: 1719834 - RNA, 18 nt, Human
cugcuccucuccccagca

SEQ ID NO: 1719835 - RNA, 17 nt, Human
cugcuccucuccccagc

SEQ ID NO: 1719836 - RNA, 16 nt, Human
cugcuccucuccccag

SEQ ID NO: 1719837 - RNA, 15 nt, Human
cugcuccagcuguuc

SEQ ID NO: 1719838 - RNA, 19 nt, Human
cugcuccccuaaagccuca

SEQ ID NO: 1719839 - RNA, 14 nt, Human
cugcuccagcuguu

SEQ ID NO: 1719840 - RNA, 16 nt, Human
cugcgguccacccagg

SEQ ID NO: 1719841 - RNA, 17 nt, Human
cugcgguccacccagga

SEQ ID NO: 1719842 - RNA, 21 nt, Human
cugcggaaugaaccacaucuu

SEQ ID NO: 1719843 - RNA, 15 nt, Human
cugcgguccacccag

SEQ ID NO: 1719844 - RNA, 20 nt, Human
cugcggaaugaaccacaucu

SEQ ID NO: 1719845 - RNA, 20 nt, Human
cugccacccuggggagaaag

SEQ ID NO: 1719846 - RNA, 16 nt, Human
cugccacccuggggag

SEQ ID NO: 1719847 - RNA, 15 nt, Human
cugccacccugggga

SEQ ID NO: 1719848 - RNA, 19 nt, Human
cugccaccacgcccggcua

SEQ ID NO: 1719849 - RNA, 22 nt, Human
cugccacacuucaggcucuucu

SEQ ID NO: 1719850 - RNA, 17 nt, Human
cugccacacuucaggcu

SEQ ID NO: 1719851 - RNA, 13 nt, Human
cugccacacuuca

SEQ ID NO: 1719852 - RNA, 19 nt, Human
cugccaggaagccagcagg

SEQ ID NO: 1719853 - RNA, 18 nt, Human
cugccaggaagccagcag

SEQ ID NO: 1719854 - RNA, 16 nt, Human
cugccaggaagccagc

SEQ ID NO: 1719855 - RNA, 15 nt, Human
cugccaggaagccag

SEQ ID NO: 1719856 - RNA, 19 nt, Human
cugccagccgagauagcca

SEQ ID NO: 1719857 - RNA, 19 nt, Human
cugccaugccagcuuaucu

SEQ ID NO: 1719858 - RNA, 17 nt, Human
cugccaugccagcuuau

SEQ ID NO: 1719859 - RNA, 16 nt, Human
cugccauuucugagau

SEQ ID NO: 1719860 - RNA, 17 nt, Human
cugcccaaccugcucuc

SEQ ID NO: 1719861 - RNA, 13 nt, Human
cugcccaggcccc

SEQ ID NO: 1719862 - RNA, 19 nt, Human
cugcccaaccugcucuccu

SEQ ID NO: 1719863 - RNA, 17 nt, Human
cugccccuggcagcccc

SEQ ID NO: 1719864 - RNA, 16 nt, Human
cugccccuggcagccc

SEQ ID NO: 1719865 - RNA, 15 nt, Human
cugccccuggcagcc

SEQ ID NO: 1719866 - RNA, 14 nt, Human
cugccccuggcagc

SEQ ID NO: 1719867 - RNA, 18 nt, Human
cugcccaggccugccugu

SEQ ID NO: 1719868 - RNA, 19 nt, Human
cugcccaggccugccuguu

SEQ ID NO: 1719869 - RNA, 15 nt, Human
cugcccggcugcgga

SEQ ID NO: 1719870 - RNA, 19 nt, Human
cugcccuccaagaccuucu

SEQ ID NO: 1719871 - RNA, 11 nt, Human
cugcccggcug

SEQ ID NO: 1719872 - RNA, 16 nt, Human
cugcccugcccaccug

SEQ ID NO: 1719873 - RNA, 15 nt, Human
cugcccugcccaccu

SEQ ID NO: 1719874 - RNA, 14 nt, Human
cugcccugcccacc

SEQ ID NO: 1719875 - RNA, 13 nt, Human
cugcccugcccac

SEQ ID NO: 1719876 - RNA, 17 nt, Human
ccucacaguccuuacca

SEQ ID NO: 1719877 - RNA, 17 nt, Human
ccuaucagaaguuucuc

SEQ ID NO: 1719878 - RNA, 12 nt, Human
ccucaccccacu

SEQ ID NO: 1719879 - RNA, 22 nt, Human
ccucacaguccuuaccagcaga

SEQ ID NO: 1719880 - RNA, 20 nt, Human
ccucacaguccuuaccagca

SEQ ID NO: 1719881 - RNA, 15 nt, Human
ccucaccccacugug

SEQ ID NO: 1719882 - RNA, 17 nt, Human
ccucaccuuucccaucu

SEQ ID NO: 1719883 - RNA, 22 nt, Human
ccgggaggcagagguugcagug

SEQ ID NO: 1719884 - RNA, 13 nt, Human
ccggcuggccugg

SEQ ID NO: 1719885 - RNA, 15 nt, Human
ccgggcacucagaag

SEQ ID NO: 1719886 - RNA, 15 nt, Human
ccggcuggccuggcc

SEQ ID NO: 1719887 - RNA, 12 nt, Human
ccggcuggccug

SEQ ID NO: 1719888 - RNA, 12 nt, Human
ccggcugcccuu

SEQ ID NO: 1719889 - RNA, 17 nt, Human
ccgugccuucagcucua

SEQ ID NO: 1719890 - RNA, 16 nt, Human
ccgugccuucagcucu

SEQ ID NO: 1719891 - RNA, 15 nt, Human
ccgugccuucagcuc

SEQ ID NO: 1719892 - RNA, 14 nt, Human
ccgugccuucagcu

SEQ ID NO: 1719893 - RNA, 20 nt, Human
ccgggcacucagaagacacu

SEQ ID NO: 1719894 - RNA, 19 nt, Human
ccgggccuggagaacuaga

SEQ ID NO: 1719895 - RNA, 23 nt, Human
ccguggcuucccgcucagcccuc

SEQ ID NO: 1719896 - RNA, 21 nt, Human
ccguggcuucccgcucagccc

SEQ ID NO: 1719897 - RNA, 15 nt, Human
ccguggcuucccgcu

SEQ ID NO: 1719898 - RNA, 14 nt, Human
ccuaaaguguauuu

SEQ ID NO: 1719899 - RNA, 13 nt, Human
ccuaaagccucaa

SEQ ID NO: 1719900 - RNA, 19 nt, Human
ccuaaagccucaaaacaaa

SEQ ID NO: 1719901 - RNA, 12 nt, Human
ccuaaagagaua

SEQ ID NO: 1719902 - RNA, 17 nt, Human
ccuaauuccacagcugc

SEQ ID NO: 1719903 - RNA, 16 nt, Human
ccuaauuccacagcug

SEQ ID NO: 1719904 - RNA, 15 nt, Human
ccuaauuccacagcu

SEQ ID NO: 1719905 - RNA, 14 nt, Human
ccuaauuccacagc

SEQ ID NO: 1719906 - RNA, 17 nt, Human
ccuaauucuaugccugu

SEQ ID NO: 1719907 - RNA, 12 nt, Human
ccuaccugguaa

SEQ ID NO: 1719908 - RNA, 20 nt, Human
cccuuccucuccacugccuu

SEQ ID NO: 1719909 - RNA, 21 nt, Human
cccuuccucuccacugccuuc

SEQ ID NO: 1719910 - RNA, 17 nt, Human
cccuuccucuccacugc

SEQ ID NO: 1719911 - RNA, 16 nt, Human
cccuuccucuccacug

SEQ ID NO: 1719912 - RNA, 19 nt, Human
cccuuaccucggugccuuc

SEQ ID NO: 1719913 - RNA, 21 nt, Human
cccuuaccacugcucugauga

SEQ ID NO: 1719914 - RNA, 17 nt, Human
cccuuaccacugcucug

SEQ ID NO: 1719915 - RNA, 13 nt, Human
cccuuccucucca

SEQ ID NO: 1719916 - RNA, 18 nt, Human
cccuugccgucuaccuga

SEQ ID NO: 1719917 - RNA, 17 nt, Human
cccuugccgucuaccug

SEQ ID NO: 1719918 - RNA, 22 nt, Human
cccuugccgucuaccugagggg

SEQ ID NO: 1719919 - RNA, 20 nt, Human
cccuuugacgccaucccagc

SEQ ID NO: 1719920 - RNA, 22 nt, Human
cccuuucugggcaccggggccu

SEQ ID NO: 1719921 - RNA, 16 nt, Human
cccuuguggucccacc

SEQ ID NO: 1719922 - RNA, 14 nt, Human
cccuugugguccca

SEQ ID NO: 1719923 - RNA, 18 nt, Human
cccuuggggagcaggcuc

SEQ ID NO: 1719924 - RNA, 18 nt, Human
cccuuguggucccacccc

SEQ ID NO: 1719925 - RNA, 20 nt, Human
cccuuguggucccaccccac

SEQ ID NO: 1719926 - RNA, 18 nt, Human
ccgagaucacgccacugc

SEQ ID NO: 1719927 - RNA, 16 nt, Human
ccgagccuggcuccaa

SEQ ID NO: 1719928 - RNA, 19 nt, Human
ccgagccuggcuccaaacc

SEQ ID NO: 1719929 - RNA, 22 nt, Human
ccgagucucuucuccacuggau

SEQ ID NO: 1719930 - RNA, 13 nt, Human
cccuuuucuguuu

SEQ ID NO: 1719931 - RNA, 11 nt, Human
cccuuuuccuu

SEQ ID NO: 1719932 - RNA, 18 nt, Human
cccuuuuuuggcugcuga

SEQ ID NO: 1719933 - RNA, 17 nt, Human
cccuuuuuuggcugcug

SEQ ID NO: 1719934 - RNA, 22 nt, Human
ccgagauagccaaggccaaagg

SEQ ID NO: 1719935 - RNA, 19 nt, Human
ccgagauagccaaggccaa

SEQ ID NO: 1719936 - RNA, 17 nt, Human
ccgagaaggaagccucc

SEQ ID NO: 1719937 - RNA, 19 nt, Human
cccuuuuuuggcugcugaa

SEQ ID NO: 1719938 - RNA, 23 nt, Human
cccccaaccaaguggcucccaca

SEQ ID NO: 1719939 - RNA, 22 nt, Human
ccccaggaggccagccuugacc

SEQ ID NO: 1719940 - RNA, 21 nt, Human
ccccaggaggccagccuugac

SEQ ID NO: 1719941 - RNA, 15 nt, Human
ccccaggaggccagc

SEQ ID NO: 1719942 - RNA, 14 nt, Human
ccccaggaggccag

SEQ ID NO: 1719943 - RNA, 13 nt, Human
ccccaggaggcca

SEQ ID NO: 1719944 - RNA, 14 nt, Human
ccccacuggugaca

SEQ ID NO: 1719945 - RNA, 13 nt, Human
ccccacuggugac

SEQ ID NO: 1719946 - RNA, 12 nt, Human
ccccacugguga

SEQ ID NO: 1719947 - RNA, 21 nt, Human
cccccgcugucagccauuccu

SEQ ID NO: 1719948 - RNA, 16 nt, Human
cccccucugcccugcg

SEQ ID NO: 1719949 - RNA, 14 nt, Human
cccccucugcccug

SEQ ID NO: 1719950 - RNA, 13 nt, Human
cccccucugcccu

SEQ ID NO: 1719951 - RNA, 21 nt, Human
ccccgucucugguuccucccc

SEQ ID NO: 1719952 - RNA, 20 nt, Human
ccccgucccccucuggcucc

SEQ ID NO: 1719953 - RNA, 16 nt, Human
ccccgucccccucugg

SEQ ID NO: 1719954 - RNA, 12 nt, Human
cccccagcccca

SEQ ID NO: 1719955 - RNA, 16 nt, Human
cccccaucucuucugg

SEQ ID NO: 1719956 - RNA, 16 nt, Human
cccuguuuguuucuga

SEQ ID NO: 1719957 - RNA, 15 nt, Human
cccuguuuguuucug

SEQ ID NO: 1719958 - RNA, 16 nt, Human
cccuguuucagaggcu

SEQ ID NO: 1719959 - RNA, 19 nt, Human
cccuguuucagaggcucag

SEQ ID NO: 1719960 - RNA, 18 nt, Human
cccugugggcccccaaau

SEQ ID NO: 1719961 - RNA, 16 nt, Human
cccugugggcccccaa

SEQ ID NO: 1719962 - RNA, 21 nt, Human
cccuguagagugggagcugag

SEQ ID NO: 1719963 - RNA, 23 nt, Human
cccugguuuccugcccugggagg

SEQ ID NO: 1719964 - RNA, 22 nt, Human
cccugguuuccugcccugggag

SEQ ID NO: 1719965 - RNA, 19 nt, Human
cccugguggcagugggagc

SEQ ID NO: 1719966 - RNA, 16 nt, Human
cccugguggcaguggg

SEQ ID NO: 1719967 - RNA, 21 nt, Human
cccugguggcagugggagcug

SEQ ID NO: 1719968 - RNA, 21 nt, Human
cccugguuuccugcccuggga

SEQ ID NO: 1719969 - RNA, 20 nt, Human
ccccucagggucccuggugg

SEQ ID NO: 1719970 - RNA, 18 nt, Human
ccccucagggucccuggu

SEQ ID NO: 1719971 - RNA, 17 nt, Human
ccccucagggucccugg

SEQ ID NO: 1719972 - RNA, 19 nt, Human
ccccuaaagccucaaaaca

SEQ ID NO: 1719973 - RNA, 19 nt, Human
ccugaagucacacagugag

SEQ ID NO: 1719974 - RNA, 17 nt, Human
ccugaagucacacagug

SEQ ID NO: 1719975 - RNA, 16 nt, Human
ccugaagucacacagu

SEQ ID NO: 1719976 - RNA, 15 nt, Human
ccugaagucacacag

SEQ ID NO: 1719977 - RNA, 13 nt, Human
ccugaaggccccg

SEQ ID NO: 1719978 - RNA, 20 nt, Human
ccugaagcuaucguaaaauu

SEQ ID NO: 1719979 - RNA, 21 nt, Human
ccugaagacucauucuucugu

SEQ ID NO: 1719980 - RNA, 23 nt, Human
ccugaagcuaucguaaaauuaag

SEQ ID NO: 1719981 - RNA, 22 nt, Human
ccugaagcuaucguaaaauuaa

SEQ ID NO: 1719982 - RNA, 18 nt, Human
ccugaaagaggaaugaag

SEQ ID NO: 1719983 - RNA, 23 nt, Human
ccugaaagaggaaugaaguacuc

SEQ ID NO: 1719984 - RNA, 22 nt, Human
ccucuuuggucuacacugugcu

SEQ ID NO: 1719985 - RNA, 19 nt, Human
ccucuuccucccucauucc

SEQ ID NO: 1719986 - RNA, 16 nt, Human
ccucuuccucccucau

SEQ ID NO: 1719987 - RNA, 15 nt, Human
ccucuuccucccuca

SEQ ID NO: 1719988 - RNA, 17 nt, Human
ccucuuaugggcugggu

SEQ ID NO: 1719989 - RNA, 14 nt, Human
ccucuuaugggcug

SEQ ID NO: 1719990 - RNA, 16 nt, Human
ccucuuaugggcuggg

SEQ ID NO: 1719991 - RNA, 15 nt, Human
ccucuuaugggcugg

SEQ ID NO: 1719992 - RNA, 14 nt, Human
ccucuuagaaaaac

SEQ ID NO: 1719993 - RNA, 21 nt, Human
ccucuguucugcacacagcac

SEQ ID NO: 1719994 - RNA, 23 nt, Human
ccucuguacagagcccacgcccc

SEQ ID NO: 1719995 - RNA, 18 nt, Human
ccucuguacagagcccac

SEQ ID NO: 1719996 - RNA, 17 nt, Human
ccucuguacagagccca

SEQ ID NO: 1719997 - RNA, 16 nt, Human
ccucuguacagagccc

SEQ ID NO: 1719998 - RNA, 15 nt, Human
ccucuguacagagcc

SEQ ID NO: 1719999 - RNA, 14 nt, Human
ccucuguacagagc

SEQ ID NO: 1720000 - RNA, 17 nt, Human
ccucuguccaggcacug

SEQ ID NO: 1720001 - RNA, 23 nt, Human
ccugauugugucucuugguccug

SEQ ID NO: 1720002 - RNA, 18 nt, Human
ccugaugcuucuucagag

SEQ ID NO: 1720003 - RNA, 17 nt, Human
ccugaugcuucuucaga

SEQ ID NO: 1720004 - RNA, 18 nt, Human
ccugaggcuccacuuggu

SEQ ID NO: 1720005 - RNA, 20 nt, Human
ccugaggcuccacuuggucu

SEQ ID NO: 1720006 - RNA, 14 nt, Human
ccugaugcuucuuc

SEQ ID NO: 1720007 - RNA, 20 nt, Human
ccugaggcccuucucuccag

SEQ ID NO: 1720008 - RNA, 19 nt, Human
ccugaggcccuucucucca

SEQ ID NO: 1720009 - RNA, 17 nt, Human
ccugaggcccuucucuc

SEQ ID NO: 1720010 - RNA, 16 nt, Human
ccugaggcccuucucu

SEQ ID NO: 1720011 - RNA, 22 nt, Human
ccugaggcccuucucuccagcc

SEQ ID NO: 1720012 - RNA, 21 nt, Human
ccugaggcccuucucuccagc

SEQ ID NO: 1720013 - RNA, 23 nt, Human
ccugaggcccuucucuccagccc

SEQ ID NO: 1720014 - RNA, 16 nt, Human
ccugacaacacucauu

SEQ ID NO: 1720015 - RNA, 15 nt, Human
ccugacaacacucau

SEQ ID NO: 1720016 - RNA, 14 nt, Human
ccugacaacacuca

SEQ ID NO: 1720017 - RNA, 12 nt, Human
ccugacaacacu

SEQ ID NO: 1720018 - RNA, 14 nt, Human
ccugaggcccagag

SEQ ID NO: 1720019 - RNA, 13 nt, Human
ccugaggcccaga

SEQ ID NO: 1720020 - RNA, 12 nt, Human
ccugaggcccag

SEQ ID NO: 1720021 - RNA, 23 nt, Human
ccugacaacacucauugaccuga

SEQ ID NO: 1720022 - RNA, 21 nt, Human
ccucacuaucccggcugcccu

SEQ ID NO: 1720023 - RNA, 21 nt, Human
ccucacuaggcuucugguuga

SEQ ID NO: 1720024 - RNA, 22 nt, Human
ccucacuaucccggcugcccuu

SEQ ID NO: 1720025 - RNA, 17 nt, Human
ccucagcauccuggcac

SEQ ID NO: 1720026 - RNA, 16 nt, Human
ccucagcauccuggca

SEQ ID NO: 1720027 - RNA, 14 nt, Human
ccucagggucccug

SEQ ID NO: 1720028 - RNA, 23 nt, Human
ccucaggccugggggcugggcag

SEQ ID NO: 1720029 - RNA, 21 nt, Human
ccucaggccugggggcugggc

SEQ ID NO: 1720030 - RNA, 14 nt, Human
ccucaggccugggg

SEQ ID NO: 1720031 - RNA, 11 nt, Human
ccucaggccug

SEQ ID NO: 1720032 - RNA, 14 nt, Human
ccucagucucccuc

SEQ ID NO: 1720033 - RNA, 15 nt, Human
ccucagucuggcccu

SEQ ID NO: 1720034 - RNA, 15 nt, Human
ccucagggucccugg

SEQ ID NO: 1720035 - RNA, 21 nt, Human
ccucagguaaucgaccugccu

SEQ ID NO: 1720036 - RNA, 16 nt, Human
ccucaggugagaagca

SEQ ID NO: 1720037 - RNA, 23 nt, Human
ccucagguaaucgaccugccucg

SEQ ID NO: 1720038 - RNA, 22 nt, Human
ccucagguaaucgaccugccuc

SEQ ID NO: 1720039 - RNA, 19 nt, Human
ccucaggugauccacccac

SEQ ID NO: 1720040 - RNA, 17 nt, Human
ccucaggugauccaccc

SEQ ID NO: 1720041 - RNA, 22 nt, Human
ccucaggugauccacccaccuc

SEQ ID NO: 1720042 - RNA, 16 nt, Human
ccucccucccucuuuc

SEQ ID NO: 1720043 - RNA, 13 nt, Human
ccucccugccccu

SEQ ID NO: 1720044 - RNA, 13 nt, Human
ccucccggugccc

SEQ ID NO: 1720045 - RNA, 15 nt, Human
ccucccucccucuuu

SEQ ID NO: 1720046 - RNA, 13 nt, Human
ccucccucccucu

SEQ ID NO: 1720047 - RNA, 16 nt, Human
ccucccggugcccaag

SEQ ID NO: 1720048 - RNA, 13 nt, Human
ccuccugccucga

SEQ ID NO: 1720049 - RNA, 14 nt, Human
ccuccuccuggacu

SEQ ID NO: 1720050 - RNA, 22 nt, Human
ccuccugugugugcgccuacag

SEQ ID NO: 1720051 - RNA, 15 nt, Human
ccuccugugugugcg

SEQ ID NO: 1720052 - RNA, 13 nt, Human
ccuccugugugug

SEQ ID NO: 1720053 - RNA, 13 nt, Human
ccuccugggcuaa

SEQ ID NO: 1720054 - RNA, 17 nt, Human
ccuccugggaaugaagc

SEQ ID NO: 1720055 - RNA, 13 nt, Human
ccuccuggacucc

SEQ ID NO: 1720056 - RNA, 13 nt, Human
ccucucugcccua

SEQ ID NO: 1720057 - RNA, 16 nt, Human
ccucugacacacagcu

SEQ ID NO: 1720058 - RNA, 23 nt, Human
ccucugaaaaccaauguucucuc

SEQ ID NO: 1720059 - RNA, 12 nt, Human
ccucucccauca

SEQ ID NO: 1720060 - RNA, 19 nt, Human
ccucuccacugccuucgau

SEQ ID NO: 1720061 - RNA, 16 nt, Human
ccucuccacugccuuc

SEQ ID NO: 1720062 - RNA, 14 nt, Human
ccucuccacugccu

SEQ ID NO: 1720063 - RNA, 13 nt, Human
ccucuccacugcc

SEQ ID NO: 1720064 - RNA, 12 nt, Human
ccucuccacugc

SEQ ID NO: 1720065 - RNA, 23 nt, Human
ccuccugugugugcgccuacagg

SEQ ID NO: 1720066 - RNA, 20 nt, Human
ccuccuuaucaaaggacacc

SEQ ID NO: 1720067 - RNA, 18 nt, Human
ccuccuuaucaaaggaca

SEQ ID NO: 1720068 - RNA, 12 nt, Human
ccucugggacug

SEQ ID NO: 1720069 - RNA, 17 nt, Human
ccucuggcuccagcugg

SEQ ID NO: 1720070 - RNA, 16 nt, Human
ccucuggcuccagcug

SEQ ID NO: 1720071 - RNA, 15 nt, Human
ccucugcacaagcug

SEQ ID NO: 1720072 - RNA, 11 nt, Human
ccucugcacaa

SEQ ID NO: 1720073 - RNA, 18 nt, Human
ccucugacacacagcucu

SEQ ID NO: 1720074 - RNA, 17 nt, Human
ccucugacacacagcuc

SEQ ID NO: 1720075 - RNA, 19 nt, Human
ccucugcacaagcugcacc

SEQ ID NO: 1720076 - RNA, 17 nt, Human
ccucugcacaagcugca

SEQ ID NO: 1720077 - RNA, 20 nt, Human
ccucugcacaagcugcaccc

SEQ ID NO: 1720078 - RNA, 21 nt, Human
ccucugcacuccccugcuggg

SEQ ID NO: 1720079 - RNA, 20 nt, Human
ccucugcacuccccugcugg

SEQ ID NO: 1720080 - RNA, 15 nt, Human
ccucugcacuccccu

SEQ ID NO: 1720081 - RNA, 14 nt, Human
ccucugcacucccc

SEQ ID NO: 1720082 - RNA, 22 nt, Human
ccucugcacuccccugcugggu

SEQ ID NO: 1720083 - RNA, 17 nt, Human
ccugugccucugggacu

SEQ ID NO: 1720084 - RNA, 15 nt, Human
ccugugccucuggga

SEQ ID NO: 1720085 - RNA, 19 nt, Human
ccugugccucugggacugg

SEQ ID NO: 1720086 - RNA, 19 nt, Human
ccugugauggggcccugcc

SEQ ID NO: 1720087 - RNA, 18 nt, Human
ccugugauggggcccugc

SEQ ID NO: 1720088 - RNA, 17 nt, Human
ccugugauggggcccug

SEQ ID NO: 1720089 - RNA, 21 nt, Human
ccugugauggggcccugccuc

SEQ ID NO: 1720090 - RNA, 20 nt, Human
ccugugauggggcccugccu

SEQ ID NO: 1720091 - RNA, 22 nt, Human
ccugugauggggcccugccucc

SEQ ID NO: 1720092 - RNA, 18 nt, Human
ccuguccccgcacugggc

SEQ ID NO: 1720093 - RNA, 17 nt, Human
ccugucccccugacaac

SEQ ID NO: 1720094 - RNA, 20 nt, Human
ccugugaguacuacaguccu

SEQ ID NO: 1720095 - RNA, 22 nt, Human
ccugugagcuaggaauuguguu

SEQ ID NO: 1720096 - RNA, 23 nt, Human
ccuguagagugggagcugagugg

SEQ ID NO: 1720097 - RNA, 21 nt, Human
ccuguagagugggagcugagu

SEQ ID NO: 1720098 - RNA, 15 nt, Human
ccuggugcugccaca

SEQ ID NO: 1720099 - RNA, 21 nt, Human
ccuggugcugccacacuucag

SEQ ID NO: 1720100 - RNA, 18 nt, Human
ccuggugcugccacacuu

SEQ ID NO: 1720101 - RNA, 13 nt, Human
ccugguggcagcu

SEQ ID NO: 1720102 - RNA, 12 nt, Human
ccugguggcagc

SEQ ID NO: 1720103 - RNA, 20 nt, Human
ccuguaauccuagcacuuug

SEQ ID NO: 1720104 - RNA, 18 nt, Human
ccugguggcagcucaccu

SEQ ID NO: 1720105 - RNA, 17 nt, Human
ccugguggcagcucacc

SEQ ID NO: 1720106 - RNA, 16 nt, Human
ccugguggcagcucac

SEQ ID NO: 1720107 - RNA, 14 nt, Human
ccugguggcagcuc

SEQ ID NO: 1720108 - RNA, 16 nt, Human
ccuggccccucagggu

SEQ ID NO: 1720109 - RNA, 14 nt, Human
ccuggccccucagg

SEQ ID NO: 1720110 - RNA, 12 nt, Human
ccuggcggggug

SEQ ID NO: 1720111 - RNA, 20 nt, Human
ccuggcuccaaacccucgag

SEQ ID NO: 1720112 - RNA, 23 nt, Human
ccuggcaugggaaugaaugucag

SEQ ID NO: 1720113 - RNA, 18 nt, Human
ccuggcaugggaaugaau

SEQ ID NO: 1720114 - RNA, 15 nt, Human
ccugggcagaaggaa

SEQ ID NO: 1720115 - RNA, 14 nt, Human
ccugggcagaagga

SEQ ID NO: 1720116 - RNA, 12 nt, Human
ccugggcagaag

SEQ ID NO: 1720117 - RNA, 20 nt, Human
ccugggaucccucauccuca

SEQ ID NO: 1720118 - RNA, 16 nt, Human
ccugggaucccucauc

SEQ ID NO: 1720119 - RNA, 20 nt, Human
ccugggaggucaaggcugca

SEQ ID NO: 1720120 - RNA, 21 nt, Human
ccugggaggcucuggagccca

SEQ ID NO: 1720121 - RNA, 13 nt, Human
ccugggaggcucu

SEQ ID NO: 1720122 - RNA, 13 nt, Human
ccugggaggcagu

SEQ ID NO: 1720123 - RNA, 17 nt, Human
ccuggcaugggaaugaa

SEQ ID NO: 1720124 - RNA, 16 nt, Human
ccuggcaugggaauga

SEQ ID NO: 1720125 - RNA, 19 nt, Human
ccuggcagccgugccuuca

SEQ ID NO: 1720126 - RNA, 18 nt, Human
ccuggcagccgugccuuc

SEQ ID NO: 1720127 - RNA, 12 nt, Human
ccuggcagccgu

SEQ ID NO: 1720128 - RNA, 21 nt, Human
ccuggcacugcuuccagugag

SEQ ID NO: 1720129 - RNA, 16 nt, Human
ccuggcagccccuguu

SEQ ID NO: 1720130 - RNA, 17 nt, Human
ccuggcacugcuuccag

SEQ ID NO: 1720131 - RNA, 20 nt, Human
ccuggcacugcuuccaguga

SEQ ID NO: 1720132 - RNA, 14 nt, Human
ccuggacccugugg

SEQ ID NO: 1720133 - RNA, 13 nt, Human
ccuggacccugug

SEQ ID NO: 1720134 - RNA, 20 nt, Human
ccuggacugugugcucagga

SEQ ID NO: 1720135 - RNA, 17 nt, Human
ccuggacugugugcuca

SEQ ID NO: 1720136 - RNA, 14 nt, Human
ccuggacuccugca

SEQ ID NO: 1720137 - RNA, 17 nt, Human
ccugcuuugggcugccc

SEQ ID NO: 1720138 - RNA, 19 nt, Human
ccugcuuugggcugcccug

SEQ ID NO: 1720139 - RNA, 18 nt, Human
ccugcuuugggcugcccu

SEQ ID NO: 1720140 - RNA, 20 nt, Human
ccugcuuuuuauggccugug

SEQ ID NO: 1720141 - RNA, 19 nt, Human
ccugcugguucaggguugg

SEQ ID NO: 1720142 - RNA, 13 nt, Human
ccugcugguucag

SEQ ID NO: 1720143 - RNA, 22 nt, Human
ccugcuccagcuguucagcugg

SEQ ID NO: 1720144 - RNA, 14 nt, Human
ccugcuccagcugu

SEQ ID NO: 1720145 - RNA, 13 nt, Human
ccugcuccagcug

SEQ ID NO: 1720146 - RNA, 12 nt, Human
ccugcuccagcu

SEQ ID NO: 1720147 - RNA, 17 nt, Human
ccugcuaauuccccaga

SEQ ID NO: 1720148 - RNA, 23 nt, Human
ccugcgucucauacucaccucac

SEQ ID NO: 1720149 - RNA, 16 nt, Human
ccugcaaccugauugu

SEQ ID NO: 1720150 - RNA, 19 nt, Human
ccugcaacaccuuguuucc

SEQ ID NO: 1720151 - RNA, 18 nt, Human
ccugcaacaccuuguuuc

SEQ ID NO: 1720152 - RNA, 19 nt, Human
ccuugaacuuugaccucug

SEQ ID NO: 1720153 - RNA, 17 nt, Human
ccuugaaugaugccaug

SEQ ID NO: 1720154 - RNA, 16 nt, Human
ccuugaacuggguacu

SEQ ID NO: 1720155 - RNA, 17 nt, Human
ccuugaacuuugaccuc

SEQ ID NO: 1720156 - RNA, 14 nt, Human
ccuugaacugggua

SEQ ID NO: 1720157 - RNA, 22 nt, Human
ccuugaaaacacuguucucugc

SEQ ID NO: 1720158 - RNA, 21 nt, Human
ccuugaaaacacuguucucug

SEQ ID NO: 1720159 - RNA, 19 nt, Human
ccuugaaaacacuguucuc

SEQ ID NO: 1720160 - RNA, 18 nt, Human
ccuucgcuccugugucuu

SEQ ID NO: 1720161 - RNA, 15 nt, Human
ccuucgcuccugugu

SEQ ID NO: 1720162 - RNA, 14 nt, Human
ccuucgcuccugug

SEQ ID NO: 1720163 - RNA, 13 nt, Human
ccuucgcuccugu

SEQ ID NO: 1720164 - RNA, 15 nt, Human
ccuugaaaacacugu

SEQ ID NO: 1720165 - RNA, 16 nt, Human
ccuucuuuuucuucuu

SEQ ID NO: 1720166 - RNA, 14 nt, Human
ccuucuuuuucuuc

SEQ ID NO: 1720167 - RNA, 23 nt, Human
ccuugaguugauucagcucugca

SEQ ID NO: 1720168 - RNA, 22 nt, Human
ccuugaguugauucagcucugc

SEQ ID NO: 1720169 - RNA, 21 nt, Human
ccuugaccauucuccaccugc

SEQ ID NO: 1720170 - RNA, 22 nt, Human
ccuugaccauucuccaccugcc

SEQ ID NO: 1720171 - RNA, 20 nt, Human
ccuugaccauucuccaccug

SEQ ID NO: 1720172 - RNA, 19 nt, Human
ccuugaccauucuccaccu

SEQ ID NO: 1720173 - RNA, 17 nt, Human
ccuugacagggcacacc

SEQ ID NO: 1720174 - RNA, 15 nt, Human
ccuugacagggcaca

SEQ ID NO: 1720175 - RNA, 14 nt, Human
ccuugacagggcac

SEQ ID NO: 1720176 - RNA, 13 nt, Human
ccuugacagggca

SEQ ID NO: 1720177 - RNA, 11 nt, Human
ccuuuggcuuc

SEQ ID NO: 1720178 - RNA, 19 nt, Human
ccuucagugccuuauggaa

SEQ ID NO: 1720179 - RNA, 17 nt, Human
ccuuagacagucccugc

SEQ ID NO: 1720180 - RNA, 16 nt, Human
ccuuagacagucccug

SEQ ID NO: 1720181 - RNA, 18 nt, Human
ccuuagaaccuuucuuac

SEQ ID NO: 1720182 - RNA, 16 nt, Human
ccuuagaaccuuucuu

SEQ ID NO: 1720183 - RNA, 15 nt, Human
ccuuagaaccuuucu

SEQ ID NO: 1720184 - RNA, 14 nt, Human
ccuuagaaccuuuc

SEQ ID NO: 1720185 - RNA, 19 nt, Human
ccuuagacagucccugcca

SEQ ID NO: 1720186 - RNA, 18 nt, Human
ccuuagacagucccugcc

SEQ ID NO: 1720187 - RNA, 21 nt, Human
ccuuagacagucccugccaau

SEQ ID NO: 1720188 - RNA, 14 nt, Human
ccuucaaccauucc

SEQ ID NO: 1720189 - RNA, 19 nt, Human
ccuucaaagcaaaugucuu

SEQ ID NO: 1720190 - RNA, 15 nt, Human
ccuucaaagcaaaug

SEQ ID NO: 1720191 - RNA, 14 nt, Human
ccuuaccugccagg

SEQ ID NO: 1720192 - RNA, 20 nt, Human
ccuuaccucggugccuuccu

SEQ ID NO: 1720193 - RNA, 16 nt, Human
ccuuaccagcagagca

SEQ ID NO: 1720194 - RNA, 15 nt, Human
ccuuaccagcagagc

SEQ ID NO: 1720195 - RNA, 17 nt, Human
ccuuaccagcagagcac

SEQ ID NO: 1720196 - RNA, 14 nt, Human
ccuuaccagcagag

SEQ ID NO: 1720197 - RNA, 20 nt, Human
ccuguggccaaguucuuagu

SEQ ID NO: 1720198 - RNA, 14 nt, Human
ccuuccucuuucca

SEQ ID NO: 1720199 - RNA, 13 nt, Human
ccuucgccaccug

SEQ ID NO: 1720200 - RNA, 23 nt, Human
ccuucgauacaccgggccuggag

SEQ ID NO: 1720201 - RNA, 22 nt, Human
ccuucgauacaccgggccugga

SEQ ID NO: 1720202 - RNA, 20 nt, Human
ccuucgauacaccgggccug

SEQ ID NO: 1720203 - RNA, 15 nt, Human
ccuucgauacaccgg

SEQ ID NO: 1720204 - RNA, 22 nt, Human
ccuuccaggggugggacacccu

SEQ ID NO: 1720205 - RNA, 18 nt, Human
ccuuccaggggugggaca

SEQ ID NO: 1720206 - RNA, 23 nt, Human
ccuuccaugucgccucugcauuc

SEQ ID NO: 1720207 - RNA, 21 nt, Human
ccuuccaugucgccucugcau

SEQ ID NO: 1720208 - RNA, 20 nt, Human
ccuuccaugucgccucugca

SEQ ID NO: 1720209 - RNA, 19 nt, Human
ccuuccaugucgccucugc

SEQ ID NO: 1720210 - RNA, 16 nt, Human
ccuuccagggguggga

SEQ ID NO: 1720211 - RNA, 15 nt, Human
ccuuccagggguggg

SEQ ID NO: 1720212 - RNA, 14 nt, Human
ccuucagugccuua

SEQ ID NO: 1720213 - RNA, 13 nt, Human
ccuucagugccuu

SEQ ID NO: 1720214 - RNA, 10 nt, Human
ccuucagugc

SEQ ID NO: 1720215 - RNA, 15 nt, Human
ccuucagugccuuau

SEQ ID NO: 1720216 - RNA, 20 nt, Human
ccuucagugccuuauggaac

SEQ ID NO: 1720217 - RNA, 22 nt, Human
cguuccuucaaagcaaaugucu

SEQ ID NO: 1720218 - RNA, 12 nt, Human
cguucucugccu

SEQ ID NO: 1720219 - RNA, 20 nt, Human
cguuucuaugacacaugcaa

SEQ ID NO: 1720220 - RNA, 19 nt, Human
cguuucuaaaggcuaccuu

SEQ ID NO: 1720221 - RNA, 21 nt, Human
cguuucuaaaggcuaccuuug

SEQ ID NO: 1720222 - RNA, 17 nt, Human
cguggcugcuucaagga

SEQ ID NO: 1720223 - RNA, 15 nt, Human
cguggcugcuucaag

SEQ ID NO: 1720224 - RNA, 14 nt, Human
cguggcugcuucaa

SEQ ID NO: 1720225 - RNA, 12 nt, Human
cguggcugcuuc

SEQ ID NO: 1720226 - RNA, 16 nt, Human
cgugccuggccacgcc

SEQ ID NO: 1720227 - RNA, 12 nt, Human
cgugccuggcca

SEQ ID NO: 1720228 - RNA, 18 nt, Human
cgugccuucagcucuaca

SEQ ID NO: 1720229 - RNA, 16 nt, Human
cgugccuucagcucua

SEQ ID NO: 1720230 - RNA, 15 nt, Human
cgugccuucagcucu

SEQ ID NO: 1720231 - RNA, 13 nt, Human
cgugccuucagcu

SEQ ID NO: 1720232 - RNA, 14 nt, Human
cgucuaccugaggg

SEQ ID NO: 1720233 - RNA, 14 nt, Human
cgucugacaggcaa

SEQ ID NO: 1720234 - RNA, 13 nt, Human
cgucugacaggca

SEQ ID NO: 1720235 - RNA, 14 nt, Human
cguccccugucccc

SEQ ID NO: 1720236 - RNA, 11 nt, Human
cguccccuguc

SEQ ID NO: 1720237 - RNA, 22 nt, Human
cgucccccucuggcuccagcug

SEQ ID NO: 1720238 - RNA, 19 nt, Human
cgugcauaccacuuuuguu

SEQ ID NO: 1720239 - RNA, 22 nt, Human
cgugcacacaccagagcccacc

SEQ ID NO: 1720240 - RNA, 14 nt, Human
cgugcauaccacuu

SEQ ID NO: 1720241 - RNA, 18 nt, Human
cgugcauaccacuuuugu

SEQ ID NO: 1720242 - RNA, 21 nt, Human
cgugcacacaccagagcccac

SEQ ID NO: 1720243 - RNA, 20 nt, Human
cgugcacacaccagagccca

SEQ ID NO: 1720244 - RNA, 12 nt, Human
cgugacaacacu

SEQ ID NO: 1720245 - RNA, 23 nt, Human
cggugcuaucucccccagcccca

SEQ ID NO: 1720246 - RNA, 22 nt, Human
cguauaaaagccuguuuaagag

SEQ ID NO: 1720247 - RNA, 21 nt, Human
cguauaaaagccuguuuaaga

SEQ ID NO: 1720248 - RNA, 17 nt, Human
cguauaaaagccuguuu

SEQ ID NO: 1720249 - RNA, 16 nt, Human
cguauaaaagccuguu

SEQ ID NO: 1720250 - RNA, 22 nt, Human
cguauaugucucaggucccugc

SEQ ID NO: 1720251 - RNA, 21 nt, Human
cgucccccucuggcuccagcu

SEQ ID NO: 1720252 - RNA, 14 nt, Human
cgucccccucuggc

SEQ ID NO: 1720253 - RNA, 14 nt, Human
cgucauaacuagaa

SEQ ID NO: 1720254 - RNA, 16 nt, Human
cgucauaacuagaacu

SEQ ID NO: 1720255 - RNA, 17 nt, Human
cgucauaacuagaacug

SEQ ID NO: 1720256 - RNA, 19 nt, Human
cggaucuuuggacagaagc

SEQ ID NO: 1720257 - RNA, 16 nt, Human
cggaucuuuggacaga

SEQ ID NO: 1720258 - RNA, 20 nt, Human
cggacagccacggccaggcc

SEQ ID NO: 1720259 - RNA, 13 nt, Human
cgcuccugugucu

SEQ ID NO: 1720260 - RNA, 17 nt, Human
cgcuauugucaccaggg

SEQ ID NO: 1720261 - RNA, 18 nt, Human
cggacagccacggccagg

SEQ ID NO: 1720262 - RNA, 16 nt, Human
cggacagccacggcca

SEQ ID NO: 1720263 - RNA, 15 nt, Human
cggacagccacggcc

SEQ ID NO: 1720264 - RNA, 20 nt, Human
cggaaugaaccacaucuugc

SEQ ID NO: 1720265 - RNA, 16 nt, Human
cggccuccauccugag

SEQ ID NO: 1720266 - RNA, 17 nt, Human
cggccuccauccugagg

SEQ ID NO: 1720267 - RNA, 19 nt, Human
cggcuggccuggccccuca

SEQ ID NO: 1720268 - RNA, 18 nt, Human
cggcuggccuggccccuc

SEQ ID NO: 1720269 - RNA, 16 nt, Human
cggcuggccuggcccc

SEQ ID NO: 1720270 - RNA, 15 nt, Human
cggcuggccuggccc

SEQ ID NO: 1720271 - RNA, 15 nt, Human
cggccuuuggcuuca

SEQ ID NO: 1720272 - RNA, 14 nt, Human
cggccucccaaagu

SEQ ID NO: 1720273 - RNA, 12 nt, Human
cgggcaugacac

SEQ ID NO: 1720274 - RNA, 15 nt, Human
cgggcaugacacgaa

SEQ ID NO: 1720275 - RNA, 17 nt, Human
cgggaggucgaggcagg

SEQ ID NO: 1720276 - RNA, 16 nt, Human
cgggaggucgaggcag

SEQ ID NO: 1720277 - RNA, 20 nt, Human
cgggaggauguucugggaca

SEQ ID NO: 1720278 - RNA, 21 nt, Human
cgggagccugaucaccugccc

SEQ ID NO: 1720279 - RNA, 22 nt, Human
cgggagccugaucaccugcccu

SEQ ID NO: 1720280 - RNA, 21 nt, Human
cgggaggauguucugggacac

SEQ ID NO: 1720281 - RNA, 14 nt, Human
ccuuuaagagaaau

SEQ ID NO: 1720282 - RNA, 13 nt, Human
ccuuuaagagaaa

SEQ ID NO: 1720283 - RNA, 19 nt, Human
ccuuguggucccaccccac

SEQ ID NO: 1720284 - RNA, 16 nt, Human
ccuuguggucccaccc

SEQ ID NO: 1720285 - RNA, 20 nt, Human
ccuuguggucccaccccaca

SEQ ID NO: 1720286 - RNA, 14 nt, Human
ccuuggcugcaggg

SEQ ID NO: 1720287 - RNA, 13 nt, Human
ccuuggcugcagg

SEQ ID NO: 1720288 - RNA, 12 nt, Human
ccuuggcugcag

SEQ ID NO: 1720289 - RNA, 16 nt, Human
ccuuugcuugaaagaa

SEQ ID NO: 1720290 - RNA, 14 nt, Human
ccuuugacaaaggu

SEQ ID NO: 1720291 - RNA, 11 nt, Human
cgcaaugugac

SEQ ID NO: 1720292 - RNA, 12 nt, Human
cgauuucuguuu

SEQ ID NO: 1720293 - RNA, 19 nt, Human
cgauucuucugcuucagcc

SEQ ID NO: 1720294 - RNA, 13 nt, Human
cgauucuucugcu

SEQ ID NO: 1720295 - RNA, 21 nt, Human
cgauucuucugcuucagccuc

SEQ ID NO: 1720296 - RNA, 19 nt, Human
cgaucuggguucacugcaa

SEQ ID NO: 1720297 - RNA, 19 nt, Human
cgaggccuucucugaagga

SEQ ID NO: 1720298 - RNA, 18 nt, Human
cgaggccuucucugaagg

SEQ ID NO: 1720299 - RNA, 12 nt, Human
cgaggacaggga

SEQ ID NO: 1720300 - RNA, 13 nt, Human
cgaggacagggag

SEQ ID NO: 1720301 - RNA, 14 nt, Human
cgaggacagggagg

SEQ ID NO: 1720302 - RNA, 15 nt, Human
ccuuuguauucucuc

SEQ ID NO: 1720303 - RNA, 18 nt, Human
ccuuuguauucucuccug

SEQ ID NO: 1720304 - RNA, 20 nt, Human
ccuuuguauucucuccugua

SEQ ID NO: 1720305 - RNA, 14 nt, Human
cgcuaagagggagg

SEQ ID NO: 1720306 - RNA, 16 nt, Human
cgcuaagagggaggga

SEQ ID NO: 1720307 - RNA, 15 nt, Human
cgcuaagagggaggg

SEQ ID NO: 1720308 - RNA, 21 nt, Human
cgcuaagagggagggagggcu

SEQ ID NO: 1720309 - RNA, 20 nt, Human
cgcuacuaugauuuaauuug

SEQ ID NO: 1720310 - RNA, 20 nt, Human
cgcgugcacacaccagagcc

SEQ ID NO: 1720311 - RNA, 19 nt, Human
cgcgugcacacaccagagc

SEQ ID NO: 1720312 - RNA, 16 nt, Human
cgcgugcacacaccag

SEQ ID NO: 1720313 - RNA, 17 nt, Human
cgcgacaaugcaaacca

SEQ ID NO: 1720314 - RNA, 16 nt, Human
cgcgacaaugcaaacc

SEQ ID NO: 1720315 - RNA, 15 nt, Human
cgcccccacugguga

SEQ ID NO: 1720316 - RNA, 12 nt, Human
cgcccaggcugg

SEQ ID NO: 1720317 - RNA, 20 nt, Human
cgcccaggcuggagugcaau

SEQ ID NO: 1720318 - RNA, 19 nt, Human
cgcccaggcuggagugcaa

SEQ ID NO: 1720319 - RNA, 14 nt, Human
cgcagacaggacca

SEQ ID NO: 1720320 - RNA, 13 nt, Human
cgcagacaggacc

SEQ ID NO: 1720321 - RNA, 18 nt, Human
cccaaaaggcagaagcaa

SEQ ID NO: 1720322 - RNA, 13 nt, Human
cccaaaaggcaga

SEQ ID NO: 1720323 - RNA, 20 nt, Human
ccauuuugggguacccacug

SEQ ID NO: 1720324 - RNA, 23 nt, Human
ccauuuuggauucuuauggacaa

SEQ ID NO: 1720325 - RNA, 22 nt, Human
ccauuuugggguacccacugcu

SEQ ID NO: 1720326 - RNA, 15 nt, Human
cccaaagaugcagcc

SEQ ID NO: 1720327 - RNA, 12 nt, Human
cccaaagaugca

SEQ ID NO: 1720328 - RNA, 16 nt, Human
cccaaagcagugcaug

SEQ ID NO: 1720329 - RNA, 18 nt, Human
ccauucugccugcccagg

SEQ ID NO: 1720330 - RNA, 17 nt, Human
ccauucugccugcccag

SEQ ID NO: 1720331 - RNA, 18 nt, Human
ccauucuccaccugccag

SEQ ID NO: 1720332 - RNA, 17 nt, Human
ccauucuccaccugcca

SEQ ID NO: 1720333 - RNA, 20 nt, Human
ccauucugccugcccaggcc

SEQ ID NO: 1720334 - RNA, 19 nt, Human
ccauucugccugcccaggc

SEQ ID NO: 1720335 - RNA, 21 nt, Human
ccauucugccugcccaggccc

SEQ ID NO: 1720336 - RNA, 16 nt, Human
ccauucuccaccugcc

SEQ ID NO: 1720337 - RNA, 15 nt, Human
ccauucuccaccugc

SEQ ID NO: 1720338 - RNA, 14 nt, Human
ccauggacuuuguu

SEQ ID NO: 1720339 - RNA, 13 nt, Human
ccauggacuuugu

SEQ ID NO: 1720340 - RNA, 21 nt, Human
cccacaaaggagagcuagcag

SEQ ID NO: 1720341 - RNA, 18 nt, Human
ccaugauguuuuccauga

SEQ ID NO: 1720342 - RNA, 21 nt, Human
ccaugauuaaccacuucagcu

SEQ ID NO: 1720343 - RNA, 19 nt, Human
ccaugauuaaccacuucag

SEQ ID NO: 1720344 - RNA, 14 nt, Human
ccaugaagauguag

SEQ ID NO: 1720345 - RNA, 13 nt, Human
ccaugcugcccug

SEQ ID NO: 1720346 - RNA, 11 nt, Human
ccaugcugccc

SEQ ID NO: 1720347 - RNA, 13 nt, Human
ccaugcuccuggc

SEQ ID NO: 1720348 - RNA, 14 nt, Human
ccaugcugcccugu

SEQ ID NO: 1720349 - RNA, 22 nt, Human
ccaucauugaaaucuuuuugcu

SEQ ID NO: 1720350 - RNA, 19 nt, Human
ccauccucuguacagagcc

SEQ ID NO: 1720351 - RNA, 12 nt, Human
ccauccucugua

SEQ ID NO: 1720352 - RNA, 13 nt, Human
ccaucaccagaca

SEQ ID NO: 1720353 - RNA, 19 nt, Human
ccagugaggcucugcccuu

SEQ ID NO: 1720354 - RNA, 18 nt, Human
ccagugaggcucugcccu

SEQ ID NO: 1720355 - RNA, 20 nt, Human
ccagugaggcucugcccuug

SEQ ID NO: 1720356 - RNA, 23 nt, Human
ccauacuaauuauacccccugca

SEQ ID NO: 1720357 - RNA, 13 nt, Human
ccauacuaauuau

SEQ ID NO: 1720358 - RNA, 12 nt, Human
ccauacuaauua

SEQ ID NO: 1720359 - RNA, 20 nt, Human
ccauccucuguacagagccc

SEQ ID NO: 1720360 - RNA, 15 nt, Human
ccagguucagcuugu

SEQ ID NO: 1720361 - RNA, 14 nt, Human
ccagguucagcuug

SEQ ID NO: 1720362 - RNA, 21 nt, Human
ccaggugcuaggaacacuccu

SEQ ID NO: 1720363 - RNA, 20 nt, Human
ccagugaaaucaguuacucu

SEQ ID NO: 1720364 - RNA, 13 nt, Human
ccaguaucuugaa

SEQ ID NO: 1720365 - RNA, 19 nt, Human
ccaggugcuaggaacacuc

SEQ ID NO: 1720366 - RNA, 13 nt, Human
ccaggccccugcc

SEQ ID NO: 1720367 - RNA, 19 nt, Human
ccaggcuggucucaaacuc

SEQ ID NO: 1720368 - RNA, 21 nt, Human
ccaggcuggucucgaacuccu

SEQ ID NO: 1720369 - RNA, 20 nt, Human
ccaggcuguaucccaugagc

SEQ ID NO: 1720370 - RNA, 12 nt, Human
ccagggaagggg

SEQ ID NO: 1720371 - RNA, 19 nt, Human
ccaggcuuuuuuaucaugu

SEQ ID NO: 1720372 - RNA, 16 nt, Human
ccaggagcagccacau

SEQ ID NO: 1720373 - RNA, 15 nt, Human
ccaggagcagccaca

SEQ ID NO: 1720374 - RNA, 15 nt, Human
ccaggagccccgagg

SEQ ID NO: 1720375 - RNA, 19 nt, Human
ccaggagccuccugcccuu

SEQ ID NO: 1720376 - RNA, 16 nt, Human
ccaggagccccgaggc

SEQ ID NO: 1720377 - RNA, 18 nt, Human
ccaggagccuccugcccu

SEQ ID NO: 1720378 - RNA, 14 nt, Human
ccaggagccuccug

SEQ ID NO: 1720379 - RNA, 13 nt, Human
ccaggagccuccu

SEQ ID NO: 1720380 - RNA, 12 nt, Human
ccaggaggccag

SEQ ID NO: 1720381 - RNA, 13 nt, Human
ccaggaggccagc

SEQ ID NO: 1720382 - RNA, 14 nt, Human
ccaggaggccagcc

SEQ ID NO: 1720383 - RNA, 22 nt, Human
ccaggcauuccccaggaggcca

SEQ ID NO: 1720384 - RNA, 23 nt, Human
ccaggcauuccccaggaggccag

SEQ ID NO: 1720385 - RNA, 24 nt, Human
ccaggcauuccccaggaggccagc

SEQ ID NO: 1720386 - RNA, 21 nt, Human
ccaggccacaagacccuugug

SEQ ID NO: 1720387 - RNA, 14 nt, Human
ccaggcauucccca

SEQ ID NO: 1720388 - RNA, 17 nt, Human
ccaggcauuccccagga

SEQ ID NO: 1720389 - RNA, 13 nt, Human
ccaggcauggugg

SEQ ID NO: 1720390 - RNA, 22 nt, Human
ccaggaagccagcaggcucuca

SEQ ID NO: 1720391 - RNA, 23 nt, Human
ccagcuggggccaggcugggucg

SEQ ID NO: 1720392 - RNA, 22 nt, Human
ccagcuggggccaggcuggguc

SEQ ID NO: 1720393 - RNA, 21 nt, Human
ccagcuggggccaggcugggu

SEQ ID NO: 1720394 - RNA, 20 nt, Human
ccagcuggggccaggcuggg

SEQ ID NO: 1720395 - RNA, 19 nt, Human
ccagcuggggccaggcugg

SEQ ID NO: 1720396 - RNA, 18 nt, Human
ccagcuggggccaggcug

SEQ ID NO: 1720397 - RNA, 17 nt, Human
ccagcuggggccaggcu

SEQ ID NO: 1720398 - RNA, 16 nt, Human
ccagcgagcccuggug

SEQ ID NO: 1720399 - RNA, 15 nt, Human
ccagcgagcccuggu

SEQ ID NO: 1720400 - RNA, 14 nt, Human
ccagcgagcccugg

SEQ ID NO: 1720401 - RNA, 22 nt, Human
ccagccuugaccauucuccacc

SEQ ID NO: 1720402 - RNA, 13 nt, Human
ccagcucuggucc

SEQ ID NO: 1720403 - RNA, 12 nt, Human
ccagcucugguc

SEQ ID NO: 1720404 - RNA, 11 nt, Human
ccagcucuggu

SEQ ID NO: 1720405 - RNA, 20 nt, Human
ccagccuugaccauucucca

SEQ ID NO: 1720406 - RNA, 19 nt, Human
ccagccuugaccauucucc

SEQ ID NO: 1720407 - RNA, 16 nt, Human
ccagagcccaccuugg

SEQ ID NO: 1720408 - RNA, 22 nt, Human
ccagagcccaccuuggcucaag

SEQ ID NO: 1720409 - RNA, 24 nt, Human
ccagcuggagaaauaugguacuca

SEQ ID NO: 1720410 - RNA, 23 nt, Human
ccagcugcuugggcuucauccuc

SEQ ID NO: 1720411 - RNA, 20 nt, Human
ccagcugcuugggcuucauc

SEQ ID NO: 1720412 - RNA, 22 nt, Human
ccagcucugguccauagagagc

SEQ ID NO: 1720413 - RNA, 21 nt, Human
ccagcucugguccauagagag

SEQ ID NO: 1720414 - RNA, 17 nt, Human
ccagcucugguccauag

SEQ ID NO: 1720415 - RNA, 14 nt, Human
ccagcucuggucca

SEQ ID NO: 1720416 - RNA, 22 nt, Human
cccaggugcuaggaacacuccu

SEQ ID NO: 1720417 - RNA, 23 nt, Human
cccaggugcuaggaacacuccuu

SEQ ID NO: 1720418 - RNA, 20 nt, Human
cccagucuggaaugcagugg

SEQ ID NO: 1720419 - RNA, 13 nt, Human
cccagugcccaca

SEQ ID NO: 1720420 - RNA, 18 nt, Human
cccaggccuccuacagcu

SEQ ID NO: 1720421 - RNA, 17 nt, Human
cccaggccuccuacagc

SEQ ID NO: 1720422 - RNA, 14 nt, Human
cccaggcugagccu

SEQ ID NO: 1720423 - RNA, 18 nt, Human
cccaggcgccccuucccc

SEQ ID NO: 1720424 - RNA, 16 nt, Human
cccaggccugccuguu

SEQ ID NO: 1720425 - RNA, 15 nt, Human
cccaggccugccugu

SEQ ID NO: 1720426 - RNA, 22 nt, Human
cccaggaggccagccuugacca

SEQ ID NO: 1720427 - RNA, 13 nt, Human
cccaggaggccag

SEQ ID NO: 1720428 - RNA, 21 nt, Human
cccaggagccccgaggccuuc

SEQ ID NO: 1720429 - RNA, 13 nt, Human
cccaggcaggucu

SEQ ID NO: 1720430 - RNA, 11 nt, Human
cccaggcaggu

SEQ ID NO: 1720431 - RNA, 22 nt, Human
cccaggccccugccacccuggg

SEQ ID NO: 1720432 - RNA, 21 nt, Human
cccaggccccugccacccugg

SEQ ID NO: 1720433 - RNA, 18 nt, Human
cccaggccccugccaccc

SEQ ID NO: 1720434 - RNA, 16 nt, Human
cccaggccccugccac

SEQ ID NO: 1720435 - RNA, 11 nt, Human
cccaggccccu

SEQ ID NO: 1720436 - RNA, 21 nt, Human
cccaggcauuccccaggaggc

SEQ ID NO: 1720437 - RNA, 20 nt, Human
cccaggcauuccccaggagg

SEQ ID NO: 1720438 - RNA, 17 nt, Human
cccaggcaggucuugaa

SEQ ID NO: 1720439 - RNA, 23 nt, Human
cccaggcauuccccaggaggcca

SEQ ID NO: 1720440 - RNA, 22 nt, Human
cccaggcauuccccaggaggcc

SEQ ID NO: 1720441 - RNA, 18 nt, Human
cccagcgagcccuggugg

SEQ ID NO: 1720442 - RNA, 17 nt, Human
cccagcgagcccuggug

SEQ ID NO: 1720443 - RNA, 23 nt, Human
cccagcgagcccugguggcagug

SEQ ID NO: 1720444 - RNA, 19 nt, Human
cccagcgagcccugguggc

SEQ ID NO: 1720445 - RNA, 11 nt, Human
cccagccccuu

SEQ ID NO: 1720446 - RNA, 23 nt, Human
cccagauugcaacaggcugggcu

SEQ ID NO: 1720447 - RNA, 23 nt, Human
cccagcaagugagagcugggugu

SEQ ID NO: 1720448 - RNA, 22 nt, Human
cccagcaagugagagcugggug

SEQ ID NO: 1720449 - RNA, 21 nt, Human
cccagcaagugagagcugggu

SEQ ID NO: 1720450 - RNA, 20 nt, Human
cccagcaagugagagcuggg

SEQ ID NO: 1720451 - RNA, 19 nt, Human
cccagcaagugagagcugg

SEQ ID NO: 1720452 - RNA, 12 nt, Human
cccagccugcua

SEQ ID NO: 1720453 - RNA, 18 nt, Human
cccagccccuucugaccc

SEQ ID NO: 1720454 - RNA, 18 nt, Human
cccagcaagugagagcug

SEQ ID NO: 1720455 - RNA, 16 nt, Human
cccagcaagugagagc

SEQ ID NO: 1720456 - RNA, 22 nt, Human
cccagauugcaacaggcugggc

SEQ ID NO: 1720457 - RNA, 21 nt, Human
cccagauugcaacaggcuggg

SEQ ID NO: 1720458 - RNA, 20 nt, Human
cccagauugcaacaggcugg

SEQ ID NO: 1720459 - RNA, 20 nt, Human
cccagagggccugcaaggga

SEQ ID NO: 1720460 - RNA, 23 nt, Human
cccaagggccuggccugagcugg

SEQ ID NO: 1720461 - RNA, 19 nt, Human
cccaagggccuggccugag

SEQ ID NO: 1720462 - RNA, 18 nt, Human
cccaagggccuggccuga

SEQ ID NO: 1720463 - RNA, 13 nt, Human
cccaacacaaaga

SEQ ID NO: 1720464 - RNA, 22 nt, Human
ccccucagggucccugguggca

SEQ ID NO: 1720465 - RNA, 17 nt, Human
ccccaggaggccagccu

SEQ ID NO: 1720466 - RNA, 21 nt, Human
ccccacccaagggccuggccu

SEQ ID NO: 1720467 - RNA, 20 nt, Human
ccccacccaagggccuggcc

SEQ ID NO: 1720468 - RNA, 14 nt, Human
ccccacccaagggc

SEQ ID NO: 1720469 - RNA, 14 nt, Human
ccccaagccuggca

SEQ ID NO: 1720470 - RNA, 13 nt, Human
ccccaagccuggc

SEQ ID NO: 1720471 - RNA, 22 nt, Human
ccccaaauggaaaugggcagag

SEQ ID NO: 1720472 - RNA, 13 nt, Human
cccauucugccug

SEQ ID NO: 1720473 - RNA, 18 nt, Human
cccagugccgagaaggaa

SEQ ID NO: 1720474 - RNA, 20 nt, Human
cccagugcccacaggaucag

SEQ ID NO: 1720475 - RNA, 15 nt, Human
cccagugcccacagg

SEQ ID NO: 1720476 - RNA, 16 nt, Human
cccaugcugcccugug

SEQ ID NO: 1720477 - RNA, 15 nt, Human
cccaugcugcccugu

SEQ ID NO: 1720478 - RNA, 18 nt, Human
cccaugcugcccugugag

SEQ ID NO: 1720479 - RNA, 17 nt, Human
cccaugcugcccuguga

SEQ ID NO: 1720480 - RNA, 12 nt, Human
ccacacuccagc

SEQ ID NO: 1720481 - RNA, 16 nt, Human
ccacaggaucagucug

SEQ ID NO: 1720482 - RNA, 16 nt, Human
ccacaggcccuuccuc

SEQ ID NO: 1720483 - RNA, 15 nt, Human
ccacaggcccuuccu

SEQ ID NO: 1720484 - RNA, 23 nt, Human
ccacaggcccuuccucuccacug

SEQ ID NO: 1720485 - RNA, 22 nt, Human
ccacaggcccuuccucuccacu

SEQ ID NO: 1720486 - RNA, 19 nt, Human
ccacaggcccuuccucucc

SEQ ID NO: 1720487 - RNA, 18 nt, Human
ccacaggcccuuccucuc

SEQ ID NO: 1720488 - RNA, 17 nt, Human
ccacaggcccuuccucu

SEQ ID NO: 1720489 - RNA, 22 nt, Human
ccacacccagcccacuucugcc

SEQ ID NO: 1720490 - RNA, 21 nt, Human
ccacacccagcccacuucugc

SEQ ID NO: 1720491 - RNA, 15 nt, Human
ccacacccagcccac

SEQ ID NO: 1720492 - RNA, 20 nt, Human
ccacacccagcccacuucug

SEQ ID NO: 1720493 - RNA, 21 nt, Human
ccaccaacauacucccaucug

SEQ ID NO: 1720494 - RNA, 15 nt, Human
ccaccaacccucaga

SEQ ID NO: 1720495 - RNA, 16 nt, Human
ccacauuccugaugcu

SEQ ID NO: 1720496 - RNA, 16 nt, Human
ccacaugugcacaugc

SEQ ID NO: 1720497 - RNA, 17 nt, Human
ccacaucuugcucugcu

SEQ ID NO: 1720498 - RNA, 18 nt, Human
ccacaucuugcucugcug

SEQ ID NO: 1720499 - RNA, 19 nt, Human
ccacaucuugcucugcuga

SEQ ID NO: 1720500 - RNA, 20 nt, Human
ccacaucuugcucugcugac

SEQ ID NO: 1720501 - RNA, 20 nt, Human
ccacaguggaaccagcccag

SEQ ID NO: 1720502 - RNA, 16 nt, Human
ccaauauucauagcag

SEQ ID NO: 1720503 - RNA, 17 nt, Human
ccacccccacccaaggg

SEQ ID NO: 1720504 - RNA, 23 nt, Human
ccacccaggagccccgaggccuu

SEQ ID NO: 1720505 - RNA, 13 nt, Human
ccacugcagaaga

SEQ ID NO: 1720506 - RNA, 18 nt, Human
ccacugcagaagacagua

SEQ ID NO: 1720507 - RNA, 19 nt, Human
ccacuuagaaauugcauuu

SEQ ID NO: 1720508 - RNA, 14 nt, Human
ccacuucagcugac

SEQ ID NO: 1720509 - RNA, 13 nt, Human
ccacuucagcuga

SEQ ID NO: 1720510 - RNA, 21 nt, Human
ccacuuagaaauugcauuucc

SEQ ID NO: 1720511 - RNA, 18 nt, Human
ccagaauuucccaaagca

SEQ ID NO: 1720512 - RNA, 22 nt, Human
ccagaaguuugagaucagccug

SEQ ID NO: 1720513 - RNA, 23 nt, Human
ccagaaguuugagaucagccugg

SEQ ID NO: 1720514 - RNA, 19 nt, Human
ccagaauuucccaaagcag

SEQ ID NO: 1720515 - RNA, 12 nt, Human
ccagaauuuccc

SEQ ID NO: 1720516 - RNA, 13 nt, Human
ccagaauuucaaa

SEQ ID NO: 1720517 - RNA, 23 nt, Human
ccagaauggucuuucuaaugugu

SEQ ID NO: 1720518 - RNA, 16 nt, Human
ccagaaugcuuuagga

SEQ ID NO: 1720519 - RNA, 21 nt, Human
ccagacaccuugacagggcac

SEQ ID NO: 1720520 - RNA, 21 nt, Human
ccagaauuucccaaagcagug

SEQ ID NO: 1720521 - RNA, 14 nt, Human
ccagaccccuggcu

SEQ ID NO: 1720522 - RNA, 18 nt, Human
ccagaccccuggcuuuuc

SEQ ID NO: 1720523 - RNA, 17 nt, Human
ccagaccccuggcuuuu

SEQ ID NO: 1720524 - RNA, 16 nt, Human
ccagaccccuggcuuu

SEQ ID NO: 1720525 - RNA, 15 nt, Human
ccagaccccuggcuu

SEQ ID NO: 1720526 - RNA, 20 nt, Human
ccacuccagaccccuggcuu

SEQ ID NO: 1720527 - RNA, 18 nt, Human
ccacucaguccauagcag

SEQ ID NO: 1720528 - RNA, 22 nt, Human
ccacuccagaccccuggcuuuu

SEQ ID NO: 1720529 - RNA, 21 nt, Human
ccacuccagaccccuggcuuu

SEQ ID NO: 1720530 - RNA, 11 nt, Human
ccacucagguc

SEQ ID NO: 1720531 - RNA, 16 nt, Human
ccacucaggucuguuu

SEQ ID NO: 1720532 - RNA, 16 nt, Human
ccacuacauucuguua

SEQ ID NO: 1720533 - RNA, 17 nt, Human
ccacuacauucuguuaa

SEQ ID NO: 1720534 - RNA, 17 nt, Human
ccacuagacccacugga

SEQ ID NO: 1720535 - RNA, 15 nt, Human
ccacuagacccacug

SEQ ID NO: 1720536 - RNA, 11 nt, Human
ccacuacauuc

SEQ ID NO: 1720537 - RNA, 15 nt, Human
ccacuacauucuguu

SEQ ID NO: 1720538 - RNA, 14 nt, Human
ccacuacauucugu

SEQ ID NO: 1720539 - RNA, 15 nt, Human
ccaccccacacacgc

SEQ ID NO: 1720540 - RNA, 15 nt, Human
ccacccccacccaag

SEQ ID NO: 1720541 - RNA, 16 nt, Human
ccacgcuggagugcag

SEQ ID NO: 1720542 - RNA, 18 nt, Human
ccacggccaggccagagg

SEQ ID NO: 1720543 - RNA, 16 nt, Human
ccacggccaggccaga

SEQ ID NO: 1720544 - RNA, 19 nt, Human
ccacgcuggagugcaguga

SEQ ID NO: 1720545 - RNA, 18 nt, Human
ccacgcuggagugcagug

SEQ ID NO: 1720546 - RNA, 23 nt, Human
ccacggccaggccagagggagug

SEQ ID NO: 1720547 - RNA, 14 nt, Human
ccacgguguucugu

SEQ ID NO: 1720548 - RNA, 20 nt, Human
ccaaacucaccugccccuca

SEQ ID NO: 1720549 - RNA, 19 nt, Human
ccaaagcagugcaugcugu

SEQ ID NO: 1720550 - RNA, 19 nt, Human
ccaaagccaaagcuaggcc

SEQ ID NO: 1720551 - RNA, 23 nt, Human
ccaaagcagugcaugcugucccu

SEQ ID NO: 1720552 - RNA, 22 nt, Human
ccaaagccuccuccagccgcca

SEQ ID NO: 1720553 - RNA, 17 nt, Human
ccaaagccuccuccagc

SEQ ID NO: 1720554 - RNA, 23 nt, Human
ccaaaggaagcacaugccucucu

SEQ ID NO: 1720555 - RNA, 15 nt, Human
ccaaaggaagcacau

SEQ ID NO: 1720556 - RNA, 15 nt, Human
ccaaagcuaggccug

SEQ ID NO: 1720557 - RNA, 17 nt, Human
ccaaagcuaggccuggc

SEQ ID NO: 1720558 - RNA, 16 nt, Human
ccaaagcuaggccugg

SEQ ID NO: 1720559 - RNA, 21 nt, Human
ccaaagcuaggccuggccaga

SEQ ID NO: 1720560 - RNA, 20 nt, Human
ccaaaguacacuguuucaaa

SEQ ID NO: 1720561 - RNA, 17 nt, Human
ccaaauuuucuuuuuau

SEQ ID NO: 1720562 - RNA, 15 nt, Human
ccaaaguacacuguu

SEQ ID NO: 1720563 - RNA, 18 nt, Human
ccaaaguacacuguuuca

SEQ ID NO: 1720564 - RNA, 16 nt, Human
ccaacauacucccauc

SEQ ID NO: 1720565 - RNA, 20 nt, Human
ccaacauacucccaucugug

SEQ ID NO: 1720566 - RNA, 19 nt, Human
ccaacauacucccaucugu

SEQ ID NO: 1720567 - RNA, 18 nt, Human
ccaacauacucccaucug

SEQ ID NO: 1720568 - RNA, 17 nt, Human
ccaacauacucccaucu

SEQ ID NO: 1720569 - RNA, 22 nt, Human
ccaacauacucccaucugugaa

SEQ ID NO: 1720570 - RNA, 21 nt, Human
ccaacauacucccaucuguga

SEQ ID NO: 1720571 - RNA, 13 nt, Human
ccaacaucaacau

SEQ ID NO: 1720572 - RNA, 20 nt, Human
ccaaccaaguggcucccaca

SEQ ID NO: 1720573 - RNA, 23 nt, Human
ccaagcagagguugggaggccau

SEQ ID NO: 1720574 - RNA, 20 nt, Human
ccaagaagcccaggaaaggc

SEQ ID NO: 1720575 - RNA, 19 nt, Human
ccaagaagcccaggaaagg

SEQ ID NO: 1720576 - RNA, 19 nt, Human
ccaagaauagaugcugacu

SEQ ID NO: 1720577 - RNA, 20 nt, Human
ccaagaauagaugcugacug

SEQ ID NO: 1720578 - RNA, 12 nt, Human
ccaacccucauc

SEQ ID NO: 1720579 - RNA, 15 nt, Human
ccaagaagcccagga

SEQ ID NO: 1720580 - RNA, 15 nt, Human
ccaacccucagagcc

SEQ ID NO: 1720581 - RNA, 14 nt, Human
ccaacccucagagc

SEQ ID NO: 1720582 - RNA, 17 nt, Human
ccaaggccaaaggaagc

SEQ ID NO: 1720583 - RNA, 22 nt, Human
ccaagcucccaggcauucccca

SEQ ID NO: 1720584 - RNA, 16 nt, Human
ccaagcucccaggcau

SEQ ID NO: 1720585 - RNA, 15 nt, Human
ccaagcucccaggca

SEQ ID NO: 1720586 - RNA, 14 nt, Human
ccaagcucccaggc

SEQ ID NO: 1720587 - RNA, 22 nt, Human
ccaagccuacuuuugccauuga

SEQ ID NO: 1720588 - RNA, 13 nt, Human
ccaagccguggcu

SEQ ID NO: 1720589 - RNA, 15 nt, Human
ccaagccuggcaagg

SEQ ID NO: 1720590 - RNA, 21 nt, Human
ccaaggccaaaggaagcacau

SEQ ID NO: 1720591 - RNA, 18 nt, Human
ccaaggccaaaggaagca

SEQ ID NO: 1720592 - RNA, 15 nt, Human
ccaagggccuggccu

SEQ ID NO: 1720593 - RNA, 18 nt, Human
ccaagggccuggccugag

SEQ ID NO: 1720594 - RNA, 16 nt, Human
ccaagggccuggccug

SEQ ID NO: 1720595 - RNA, 19 nt, Human
ccaagggccuggccugagc

SEQ ID NO: 1720596 - RNA, 22 nt, Human
ccaaggggaauguuugccucug

SEQ ID NO: 1720597 - RNA, 23 nt, Human
ccaagguuuggggaagaacgaag

SEQ ID NO: 1720598 - RNA, 13 nt, Human
ccaaggugggagg

SEQ ID NO: 1720599 - RNA, 18 nt, Human
ccaaggugggaggauugc

SEQ ID NO: 1720600 - RNA, 20 nt, Human
ccaagucaagugaaaaagga

SEQ ID NO: 1720601 - RNA, 22 nt, Human
ccaauaguuguugauuggcagg

SEQ ID NO: 1720602 - RNA, 13 nt, Human
cauugugggaagg

SEQ ID NO: 1720603 - RNA, 17 nt, Human
cauuguuggccaaagcc

SEQ ID NO: 1720604 - RNA, 18 nt, Human
cauuguuggccaaagcca

SEQ ID NO: 1720605 - RNA, 23 nt, Human
cauuguauucagaguugaugguu

SEQ ID NO: 1720606 - RNA, 15 nt, Human
cacccaagggccugg

SEQ ID NO: 1720607 - RNA, 14 nt, Human
cacccaagggccug

SEQ ID NO: 1720608 - RNA, 21 nt, Human
cauuguagagcuucuggcacu

SEQ ID NO: 1720609 - RNA, 19 nt, Human
cauuguagagcuucuggca

SEQ ID NO: 1720610 - RNA, 17 nt, Human
cauuguagagcuucugg

SEQ ID NO: 1720611 - RNA, 16 nt, Human
cauuguagagcuucug

SEQ ID NO: 1720612 - RNA, 15 nt, Human
cauuguagagcuucu

SEQ ID NO: 1720613 - RNA, 22 nt, Human
cauuuaauggggaggacaaaau

SEQ ID NO: 1720614 - RNA, 17 nt, Human
cauuuaggccaugggac

SEQ ID NO: 1720615 - RNA, 20 nt, Human
cauuuccugacagaaggacu

SEQ ID NO: 1720616 - RNA, 13 nt, Human
cauuuccugacag

SEQ ID NO: 1720617 - RNA, 15 nt, Human
cauuuccuaaauaua

SEQ ID NO: 1720618 - RNA, 21 nt, Human
cauuuaaaagauacaguuacu

SEQ ID NO: 1720619 - RNA, 21 nt, Human
cauuuaaaacauuaaaauaua

SEQ ID NO: 1720620 - RNA, 12 nt, Human
cauuuaaaagau

SEQ ID NO: 1720621 - RNA, 20 nt, Human
cauuuaaaacauuaaaauau

SEQ ID NO: 1720622 - RNA, 15 nt, Human
cauuuaaaagauaca

SEQ ID NO: 1720623 - RNA, 16 nt, Human
cauuuaaaagauacag

SEQ ID NO: 1720624 - RNA, 13 nt, Human
cauuuccuguguc

SEQ ID NO: 1720625 - RNA, 12 nt, Human
cauuuccugugu

SEQ ID NO: 1720626 - RNA, 13 nt, Human
cauuuuguaauaa

SEQ ID NO: 1720627 - RNA, 16 nt, Human
cauuuuguaauaauaa

SEQ ID NO: 1720628 - RNA, 12 nt, Human
cauuuuguaaua

SEQ ID NO: 1720629 - RNA, 23 nt, Human
cauuuuucuuagggaaggauaca

SEQ ID NO: 1720630 - RNA, 20 nt, Human
cauuuuucagauauaaaaga

SEQ ID NO: 1720631 - RNA, 18 nt, Human
cauuuuucagauauaaaa

SEQ ID NO: 1720632 - RNA, 17 nt, Human
ccaaacucaccugcccc

SEQ ID NO: 1720633 - RNA, 20 nt, Human
ccaaacauccuacaagacac

SEQ ID NO: 1720634 - RNA, 19 nt, Human
ccaaacauccuacaagaca

SEQ ID NO: 1720635 - RNA, 14 nt, Human
cauuugcuccuuuc

SEQ ID NO: 1720636 - RNA, 13 nt, Human
cauuugcuccuuu

SEQ ID NO: 1720637 - RNA, 17 nt, Human
cauuuguuugaacugau

SEQ ID NO: 1720638 - RNA, 13 nt, Human
cauuugcugaaua

SEQ ID NO: 1720639 - RNA, 20 nt, Human
cauuuguuugaacugauaaa

SEQ ID NO: 1720640 - RNA, 22 nt, Human
cauuuguuugaacugauaaaga

SEQ ID NO: 1720641 - RNA, 18 nt, Human
cauuugagcagggcucag

SEQ ID NO: 1720642 - RNA, 17 nt, Human
cauuugagcagggcuca

SEQ ID NO: 1720643 - RNA, 20 nt, Human
cauuugagcagggcucagcg

SEQ ID NO: 1720644 - RNA, 22 nt, Human
cauuugaaaauuuugauguuuu

SEQ ID NO: 1720645 - RNA, 20 nt, Human
cauuugaaaauuuugauguu

SEQ ID NO: 1720646 - RNA, 19 nt, Human
cauuugaaaccccuguagg

SEQ ID NO: 1720647 - RNA, 21 nt, Human
cauuugaaaccccuguaggcc

SEQ ID NO: 1720648 - RNA, 13 nt, Human
uuuuuucuuacug

SEQ ID NO: 1720649 - RNA, 13 nt, Human
cugcauguuacau

SEQ ID NO: 1720650 - RNA, 15 nt, Human
cugcauguuugugau

SEQ ID NO: 1720651 - RNA, 20 nt, Human
cugcauuuaaaagauacagu

SEQ ID NO: 1720652 - RNA, 22 nt, Human
cugcauuuaaaagauacaguua

SEQ ID NO: 1720653 - RNA, 13 nt, Human
cugcauuugugaa

SEQ ID NO: 1720654 - RNA, 20 nt, Human
cugcauucaggaucaaaccc

SEQ ID NO: 1720655 - RNA, 17 nt, Human
cugccaaugggagcuca

SEQ ID NO: 1720656 - RNA, 15 nt, Human
cugccaaugggagcu

SEQ ID NO: 1720657 - RNA, 22 nt, Human
cugcauuugugaaaugauggug

SEQ ID NO: 1720658 - RNA, 17 nt, Human
cugcauuugugaaauga

SEQ ID NO: 1720659 - RNA, 15 nt, Human
cugcauuugugaaau

SEQ ID NO: 1720660 - RNA, 14 nt, Human
cugcauuugugaaa

SEQ ID NO: 1720661 - RNA, 23 nt, Human
cugccauauucuguuggccagug

SEQ ID NO: 1720662 - RNA, 22 nt, Human
cugccauauucuguuggccagu

SEQ ID NO: 1720663 - RNA, 21 nt, Human
cugccauauucuguuggccag

SEQ ID NO: 1720664 - RNA, 20 nt, Human
cugccauauucuguuggcca

SEQ ID NO: 1720665 - RNA, 15 nt, Human
cugccagggacagag

SEQ ID NO: 1720666 - RNA, 12 nt, Human
cugccagggaca

SEQ ID NO: 1720667 - RNA, 11 nt, Human
cugccagggac

SEQ ID NO: 1720668 - RNA, 12 nt, Human
cugccauccagg

SEQ ID NO: 1720669 - RNA, 19 nt, Human
cugccccagggcucccggc

SEQ ID NO: 1720670 - RNA, 15 nt, Human
cugcccccucugccc

SEQ ID NO: 1720671 - RNA, 14 nt, Human
cugcccccucugcc

SEQ ID NO: 1720672 - RNA, 18 nt, Human
cugcccugugggccccca

SEQ ID NO: 1720673 - RNA, 16 nt, Human
cugcccugugggcccc

SEQ ID NO: 1720674 - RNA, 15 nt, Human
cugcccugugggccc

SEQ ID NO: 1720675 - RNA, 13 nt, Human
cugcccugugagu

SEQ ID NO: 1720676 - RNA, 12 nt, Human
cugcccugugag

SEQ ID NO: 1720677 - RNA, 23 nt, Human
cugcccugguuuccugcccuggg

SEQ ID NO: 1720678 - RNA, 22 nt, Human
cugcccugguuuccugcccugg

SEQ ID NO: 1720679 - RNA, 21 nt, Human
cugcccuggugcugccacacu

SEQ ID NO: 1720680 - RNA, 20 nt, Human
cugcccuggugcugccacac

SEQ ID NO: 1720681 - RNA, 22 nt, Human
cugccccucaacucuccuccag

SEQ ID NO: 1720682 - RNA, 14 nt, Human
cugccccucaacuc

SEQ ID NO: 1720683 - RNA, 19 nt, Human
cugcccccucugcccugcg

SEQ ID NO: 1720684 - RNA, 18 nt, Human
cugcccccucugcccugc

SEQ ID NO: 1720685 - RNA, 17 nt, Human
cugcccccucugcccug

SEQ ID NO: 1720686 - RNA, 16 nt, Human
cugcccccucugcccu

SEQ ID NO: 1720687 - RNA, 19 nt, Human
cugcccuggugcugccaca

SEQ ID NO: 1720688 - RNA, 18 nt, Human
cugcccuggugcugccac

SEQ ID NO: 1720689 - RNA, 16 nt, Human
cugcccuggugcugcc

SEQ ID NO: 1720690 - RNA, 17 nt, Human
cugcccuggugcugcca

SEQ ID NO: 1720691 - RNA, 19 nt, Human
cugagacucgcgacaaugc

SEQ ID NO: 1720692 - RNA, 17 nt, Human
cugagacucgcgacaau

SEQ ID NO: 1720693 - RNA, 20 nt, Human
cugagacucgcgacaaugca

SEQ ID NO: 1720694 - RNA, 16 nt, Human
cuggaaauauuaagaa

SEQ ID NO: 1720695 - RNA, 23 nt, Human
cugcuucagccucccgaguagcu

SEQ ID NO: 1720696 - RNA, 18 nt, Human
cugcuuuuuauggccugu

SEQ ID NO: 1720697 - RNA, 17 nt, Human
cuggaacacuaaugagg

SEQ ID NO: 1720698 - RNA, 13 nt, Human
cuggacugugugc

SEQ ID NO: 1720699 - RNA, 13 nt, Human
cugcuuaacuuca

SEQ ID NO: 1720700 - RNA, 13 nt, Human
cugcuucagccuc

SEQ ID NO: 1720701 - RNA, 15 nt, Human
cugcuuaacuucaca

SEQ ID NO: 1720702 - RNA, 17 nt, Human
cugcuuaacuucacaua

SEQ ID NO: 1720703 - RNA, 16 nt, Human
cugcuucagccucccg

SEQ ID NO: 1720704 - RNA, 14 nt, Human
cugcuucagccucc

SEQ ID NO: 1720705 - RNA, 22 nt, Human
cugcuuuuuaaagaaugcucuu

SEQ ID NO: 1720706 - RNA, 17 nt, Human
cugcuuuuuauggccug

SEQ ID NO: 1720707 - RNA, 11 nt, Human
cugcugacagu

SEQ ID NO: 1720708 - RNA, 23 nt, Human
cugcugacagacacaggcccggc

SEQ ID NO: 1720709 - RNA, 21 nt, Human
cugcugacagacacaggcccg

SEQ ID NO: 1720710 - RNA, 20 nt, Human
cugcugacagacacaggccc

SEQ ID NO: 1720711 - RNA, 19 nt, Human
cugcugacagacacaggcc

SEQ ID NO: 1720712 - RNA, 18 nt, Human
cugcugacagacacaggc

SEQ ID NO: 1720713 - RNA, 15 nt, Human
cugcugacagacaca

SEQ ID NO: 1720714 - RNA, 19 nt, Human
cugcccugugggcccccaa

SEQ ID NO: 1720715 - RNA, 19 nt, Human
cugccucgaacuggcugca

SEQ ID NO: 1720716 - RNA, 18 nt, Human
cugccucgaacuggcugc

SEQ ID NO: 1720717 - RNA, 17 nt, Human
cugccucgaacuggcug

SEQ ID NO: 1720718 - RNA, 15 nt, Human
cugccucgaacuggc

SEQ ID NO: 1720719 - RNA, 23 nt, Human
cugccugggaucccucauccuca

SEQ ID NO: 1720720 - RNA, 15 nt, Human
cugccuguucagcuc

SEQ ID NO: 1720721 - RNA, 14 nt, Human
cugccuguucagcu

SEQ ID NO: 1720722 - RNA, 19 nt, Human
cugccuguugggccaggag

SEQ ID NO: 1720723 - RNA, 18 nt, Human
cugccuguugggccagga

SEQ ID NO: 1720724 - RNA, 14 nt, Human
cugccuguugggcc

SEQ ID NO: 1720725 - RNA, 16 nt, Human
cugccuguugggccag

SEQ ID NO: 1720726 - RNA, 16 nt, Human
cugcuaauuccccaga

SEQ ID NO: 1720727 - RNA, 15 nt, Human
cugcuacagagcaga

SEQ ID NO: 1720728 - RNA, 22 nt, Human
cuggguuccuuccucugagccu

SEQ ID NO: 1720729 - RNA, 18 nt, Human
cuggguuccuuccucuga

SEQ ID NO: 1720730 - RNA, 14 nt, Human
cuggguucacugca

SEQ ID NO: 1720731 - RNA, 22 nt, Human
cuggguuccagcaauucuccug

SEQ ID NO: 1720732 - RNA, 21 nt, Human
cuggugacuuuccucuuuggu

SEQ ID NO: 1720733 - RNA, 20 nt, Human
cuggugacuuuccucuuugg

SEQ ID NO: 1720734 - RNA, 15 nt, Human
cuggugacuuuccuc

SEQ ID NO: 1720735 - RNA, 14 nt, Human
cuggguucuaccca

SEQ ID NO: 1720736 - RNA, 23 nt, Human
cuggguuccuuccucugagccuu

SEQ ID NO: 1720737 - RNA, 17 nt, Human
cuggguguggcgcagca

SEQ ID NO: 1720738 - RNA, 16 nt, Human
cuggguguggcgcagc

SEQ ID NO: 1720739 - RNA, 22 nt, Human
cuggguggcaccagcagccugg

SEQ ID NO: 1720740 - RNA, 23 nt, Human
cuggguggcaccagcagccugga

SEQ ID NO: 1720741 - RNA, 23 nt, Human
cuggugacuuuccucuuuggucu

SEQ ID NO: 1720742 - RNA, 17 nt, Human
cugggcagaaggaagac

SEQ ID NO: 1720743 - RNA, 17 nt, Human
cuggggaaccugacccc

SEQ ID NO: 1720744 - RNA, 16 nt, Human
cuggggaaccugaccc

SEQ ID NO: 1720745 - RNA, 15 nt, Human
cuggggaaccugacc

SEQ ID NO: 1720746 - RNA, 18 nt, Human
cugggcagaaggaagacu

SEQ ID NO: 1720747 - RNA, 16 nt, Human
cuggggccgaaagaac

SEQ ID NO: 1720748 - RNA, 18 nt, Human
cuggggccaggcuggguc

SEQ ID NO: 1720749 - RNA, 13 nt, Human
cugggacacaguu

SEQ ID NO: 1720750 - RNA, 12 nt, Human
cugggacacagu

SEQ ID NO: 1720751 - RNA, 20 nt, Human
cuggcuccagcuggccggga

SEQ ID NO: 1720752 - RNA, 18 nt, Human
cuggcuccagcuggccgg

SEQ ID NO: 1720753 - RNA, 14 nt, Human
cuggcuccagcugg

SEQ ID NO: 1720754 - RNA, 13 nt, Human
cuggcuccagcug

SEQ ID NO: 1720755 - RNA, 15 nt, Human
cuggcucccacaggc

SEQ ID NO: 1720756 - RNA, 21 nt, Human
cuggccccucagggucccugg

SEQ ID NO: 1720757 - RNA, 20 nt, Human
cuggccccucagggucccug

SEQ ID NO: 1720758 - RNA, 18 nt, Human
cuggccccucaggguccc

SEQ ID NO: 1720759 - RNA, 17 nt, Human
cuggccccucagggucc

SEQ ID NO: 1720760 - RNA, 20 nt, Human
cuggcuccaaacccucgagg

SEQ ID NO: 1720761 - RNA, 19 nt, Human
cuggcuccaaacccucgag

SEQ ID NO: 1720762 - RNA, 13 nt, Human
cuggcucaucucu

SEQ ID NO: 1720763 - RNA, 15 nt, Human
cuggcagcucagaga

SEQ ID NO: 1720764 - RNA, 13 nt, Human
cuggccccucagg

SEQ ID NO: 1720765 - RNA, 14 nt, Human
cuggcagcucagag

SEQ ID NO: 1720766 - RNA, 13 nt, Human
cuggcagcucaga

SEQ ID NO: 1720767 - RNA, 12 nt, Human
cuggcagcucag

SEQ ID NO: 1720768 - RNA, 16 nt, Human
cuggacugugugcuca

SEQ ID NO: 1720769 - RNA, 21 nt, Human
cuguaggaagguuaauguuca

SEQ ID NO: 1720770 - RNA, 12 nt, Human
cuguaggccuca

SEQ ID NO: 1720771 - RNA, 13 nt, Human
cuguaggccucag

SEQ ID NO: 1720772 - RNA, 22 nt, Human
cuguaggccucaggugaaacuc

SEQ ID NO: 1720773 - RNA, 23 nt, Human
cuguacuugcucuugaugccugg

SEQ ID NO: 1720774 - RNA, 22 nt, Human
cuguacuugcucuugaugccug

SEQ ID NO: 1720775 - RNA, 18 nt, Human
cugucagccauuccuguu

SEQ ID NO: 1720776 - RNA, 16 nt, Human
cugucauuugagcagg

SEQ ID NO: 1720777 - RNA, 18 nt, Human
cugucauuugagcagggc

SEQ ID NO: 1720778 - RNA, 17 nt, Human
cugucauuugagcaggg

SEQ ID NO: 1720779 - RNA, 20 nt, Human
cugucauuugagcagggcuc

SEQ ID NO: 1720780 - RNA, 12 nt, Human
cuguccugccua

SEQ ID NO: 1720781 - RNA, 21 nt, Human
cugguuuccugcccugggagg

SEQ ID NO: 1720782 - RNA, 18 nt, Human
cugguuuccugcccuggg

SEQ ID NO: 1720783 - RNA, 22 nt, Human
cugguuuccugcccugggaggc

SEQ ID NO: 1720784 - RNA, 15 nt, Human
cugugaagagaacca

SEQ ID NO: 1720785 - RNA, 16 nt, Human
cugugagaugcuagaa

SEQ ID NO: 1720786 - RNA, 21 nt, Human
cugugagaugcuagaacuccc

SEQ ID NO: 1720787 - RNA, 15 nt, Human
cugugcucuggacag

SEQ ID NO: 1720788 - RNA, 14 nt, Human
cugugcucuggaca

SEQ ID NO: 1720789 - RNA, 13 nt, Human
cugucgcccaguc

SEQ ID NO: 1720790 - RNA, 16 nt, Human
cugucgcccaggcugg

SEQ ID NO: 1720791 - RNA, 15 nt, Human
cuucacuguaaaaua

SEQ ID NO: 1720792 - RNA, 17 nt, Human
cuucagagacuccugca

SEQ ID NO: 1720793 - RNA, 19 nt, Human
cuucagagacuccugcagg

SEQ ID NO: 1720794 - RNA, 18 nt, Human
cuucagagacuccugcag

SEQ ID NO: 1720795 - RNA, 20 nt, Human
cuucagagacuccugcaggc

SEQ ID NO: 1720796 - RNA, 21 nt, Human
cuuccagugaggcucugcccu

SEQ ID NO: 1720797 - RNA, 23 nt, Human
cuuccagugaggcucugcccuug

SEQ ID NO: 1720798 - RNA, 22 nt, Human
cuuccagugaggcucugcccuu

SEQ ID NO: 1720799 - RNA, 23 nt, Human
cuucccaccucucucacuccuug

SEQ ID NO: 1720800 - RNA, 21 nt, Human
cuucccaccucucucacuccu

SEQ ID NO: 1720801 - RNA, 11 nt, Human
cuucccaccuc

SEQ ID NO: 1720802 - RNA, 21 nt, Human
cuuccauaaucuggacuccuc

SEQ ID NO: 1720803 - RNA, 11 nt, Human
cuuccauaauc

SEQ ID NO: 1720804 - RNA, 16 nt, Human
cuuauggaacacucug

SEQ ID NO: 1720805 - RNA, 13 nt, Human
cuuauggaacacu

SEQ ID NO: 1720806 - RNA, 21 nt, Human
cuuauggaacacucugagacu

SEQ ID NO: 1720807 - RNA, 20 nt, Human
cuuauggaacacucugagac

SEQ ID NO: 1720808 - RNA, 19 nt, Human
cuuauggaacacucugaga

SEQ ID NO: 1720809 - RNA, 17 nt, Human
cuuauggaacacucuga

SEQ ID NO: 1720810 - RNA, 19 nt, Human
cuucacggaagagccuugc

SEQ ID NO: 1720811 - RNA, 15 nt, Human
cuucacggaagagcc

SEQ ID NO: 1720812 - RNA, 22 nt, Human
cuucaccuuuguccccaccgca

SEQ ID NO: 1720813 - RNA, 21 nt, Human
cuucaccuuuguccccaccgc

SEQ ID NO: 1720814 - RNA, 19 nt, Human
cugugcugagucugaaggc

SEQ ID NO: 1720815 - RNA, 14 nt, Human
cugugcugagucug

SEQ ID NO: 1720816 - RNA, 12 nt, Human
cugugcugaguc

SEQ ID NO: 1720817 - RNA, 12 nt, Human
cuugaugccugg

SEQ ID NO: 1720818 - RNA, 13 nt, Human
cuugaugccuggc

SEQ ID NO: 1720819 - RNA, 20 nt, Human
cuuggcgcugccccuggcag

SEQ ID NO: 1720820 - RNA, 17 nt, Human
cuuggcgcugccccugg

SEQ ID NO: 1720821 - RNA, 14 nt, Human
cuuggcgcugcccc

SEQ ID NO: 1720822 - RNA, 12 nt, Human
cuuggcgcugcc

SEQ ID NO: 1720823 - RNA, 20 nt, Human
cuugacagggcacaccgggc

SEQ ID NO: 1720824 - RNA, 13 nt, Human
cuugacagggcac

SEQ ID NO: 1720825 - RNA, 15 nt, Human
cuugacagggcacac

SEQ ID NO: 1720826 - RNA, 14 nt, Human
cuugacagggcaca

SEQ ID NO: 1720827 - RNA, 19 nt, Human
cuugaauuguaaggaauga

SEQ ID NO: 1720828 - RNA, 23 nt, Human
cuucugacccaugcugcccugug

SEQ ID NO: 1720829 - RNA, 22 nt, Human
cuucugacccaugcugcccugu

SEQ ID NO: 1720830 - RNA, 21 nt, Human
cuucugacccaugcugcccug

SEQ ID NO: 1720831 - RNA, 20 nt, Human
cuucugacccaugcugcccu

SEQ ID NO: 1720832 - RNA, 21 nt, Human
cuucuguugcugccucaugcu

SEQ ID NO: 1720833 - RNA, 23 nt, Human
cuucuucagagacuccugcaggc

SEQ ID NO: 1720834 - RNA, 20 nt, Human
cuucuguugcugccucaugc

SEQ ID NO: 1720835 - RNA, 19 nt, Human
cuucuguugcugccucaug

SEQ ID NO: 1720836 - RNA, 18 nt, Human
cuucuguugcugccucau

SEQ ID NO: 1720837 - RNA, 17 nt, Human
cuucuguugcugccuca

SEQ ID NO: 1720838 - RNA, 17 nt, Human
cuuccugcaacaccuug

SEQ ID NO: 1720839 - RNA, 13 nt, Human
cuucuagaaccag

SEQ ID NO: 1720840 - RNA, 17 nt, Human
cuucuagaaccaggcaa

SEQ ID NO: 1720841 - RNA, 22 nt, Human
gaaaggcuccaggagcagccac

SEQ ID NO: 1720842 - RNA, 21 nt, Human
gaaaggcuccaggagcagcca

SEQ ID NO: 1720843 - RNA, 20 nt, Human
gaaagacuaucuaaauguug

SEQ ID NO: 1720844 - RNA, 21 nt, Human
gaaagaaaauaccaaggaaca

SEQ ID NO: 1720845 - RNA, 22 nt, Human
gaaagggacuuggaagcuccgc

SEQ ID NO: 1720846 - RNA, 19 nt, Human
gaaagggacuuggaagcuc

SEQ ID NO: 1720847 - RNA, 20 nt, Human
gaaagggacgcuacccggga

SEQ ID NO: 1720848 - RNA, 19 nt, Human
gaaaucaccgaaaacgugg

SEQ ID NO: 1720849 - RNA, 13 nt, Human
cuuuuggagucag

SEQ ID NO: 1720850 - RNA, 16 nt, Human
cuuuugccguuauuaa

SEQ ID NO: 1720851 - RNA, 23 nt, Human
cuuuugcccacacuugggagcaa

SEQ ID NO: 1720852 - RNA, 13 nt, Human
cuuuugccauuga

SEQ ID NO: 1720853 - RNA, 15 nt, Human
cuuuuggcauuuuac

SEQ ID NO: 1720854 - RNA, 21 nt, Human
cuuuugguuaugaauacuuug

SEQ ID NO: 1720855 - RNA, 18 nt, Human
cuuuugucuaugggacuc

SEQ ID NO: 1720856 - RNA, 23 nt, Human
cuuuuuuggcugcugaaggcucg

SEQ ID NO: 1720857 - RNA, 12 nt, Human
cuuuugugcauu

SEQ ID NO: 1720858 - RNA, 13 nt, Human
cuuuugugcauua

SEQ ID NO: 1720859 - RNA, 20 nt, Human
cuuuuuuuuuuuugagacag

SEQ ID NO: 1720860 - RNA, 21 nt, Human
cuuuuuuuuuuuugagacaga

SEQ ID NO: 1720861 - RNA, 22 nt, Human
cuuuuuuuuuuuuuaaagacag

SEQ ID NO: 1720862 - RNA, 23 nt, Human
cuuuuuuuuuuuuuaaagacaga

SEQ ID NO: 1720863 - RNA, 14 nt, Human
gaaaauuuuaaaaa

SEQ ID NO: 1720864 - RNA, 14 nt, Human
gaaaaacugauuuu

SEQ ID NO: 1720865 - RNA, 21 nt, Human
gaaaauggaagacagcucuua

SEQ ID NO: 1720866 - RNA, 23 nt, Human
gaaaaugcuguauuagucacaga

SEQ ID NO: 1720867 - RNA, 18 nt, Human
gaaaagaaaaaugagccu

SEQ ID NO: 1720868 - RNA, 23 nt, Human
gaaaauggacguguuaugacucc

SEQ ID NO: 1720869 - RNA, 19 nt, Human
gaaaauggacguguuauga

SEQ ID NO: 1720870 - RNA, 15 nt, Human
gaaaauguaugugua

SEQ ID NO: 1720871 - RNA, 13 nt, Human
cuuuuauaaacuu

SEQ ID NO: 1720872 - RNA, 14 nt, Human
cuuuuauaaacuuu

SEQ ID NO: 1720873 - RNA, 18 nt, Human
cuuuuaugugaaacaugu

SEQ ID NO: 1720874 - RNA, 14 nt, Human
cuuuuaugugaaac

SEQ ID NO: 1720875 - RNA, 16 nt, Human
cuuucuagccagagga

SEQ ID NO: 1720876 - RNA, 22 nt, Human
cuuugauauuuucaacgcagcc

SEQ ID NO: 1720877 - RNA, 15 nt, Human
cuuucuagccagagg

SEQ ID NO: 1720878 - RNA, 13 nt, Human
cuuuguaaugaaa

SEQ ID NO: 1720879 - RNA, 15 nt, Human
cuuuguaaauuguca

SEQ ID NO: 1720880 - RNA, 21 nt, Human
cuuugggcugcccuggugcug

SEQ ID NO: 1720881 - RNA, 20 nt, Human
cuuugggcugcccuggugcu

SEQ ID NO: 1720882 - RNA, 19 nt, Human
cuuugggcugcccuggugc

SEQ ID NO: 1720883 - RNA, 15 nt, Human
cuuugggcugcccug

SEQ ID NO: 1720884 - RNA, 14 nt, Human
cuuugggcugcccu

SEQ ID NO: 1720885 - RNA, 22 nt, Human
cuuuccugaggcugggcucccu

SEQ ID NO: 1720886 - RNA, 20 nt, Human
cuuucagccaagaauucuua

SEQ ID NO: 1720887 - RNA, 23 nt, Human
cuuucagccaagaauucuuaaau

SEQ ID NO: 1720888 - RNA, 16 nt, Human
cuuucacaaccuucug

SEQ ID NO: 1720889 - RNA, 14 nt, Human
cuuucacaaccuuc

SEQ ID NO: 1720890 - RNA, 22 nt, Human
gagaggcauccaguaucuugaa

SEQ ID NO: 1720891 - RNA, 21 nt, Human
gagaugaugccaugggcccuc

SEQ ID NO: 1720892 - RNA, 16 nt, Human
gagacuccugcaggca

SEQ ID NO: 1720893 - RNA, 15 nt, Human
gagacuccugcaggc

SEQ ID NO: 1720894 - RNA, 18 nt, Human
gagacuccugcaggcagc

SEQ ID NO: 1720895 - RNA, 17 nt, Human
gagacuccugcaggcag

SEQ ID NO: 1720896 - RNA, 14 nt, Human
gagaggcauccagu

SEQ ID NO: 1720897 - RNA, 13 nt, Human
gagauuuacaacu

SEQ ID NO: 1720898 - RNA, 18 nt, Human
gagauugcaccacugcac

SEQ ID NO: 1720899 - RNA, 21 nt, Human
gagauugcaccacugcacucc

SEQ ID NO: 1720900 - RNA, 14 nt, Human
gagauguagccccu

SEQ ID NO: 1720901 - RNA, 21 nt, Human
gagcggagaaaggaagggcug

SEQ ID NO: 1720902 - RNA, 18 nt, Human
gagcggagaaaggaaggg

SEQ ID NO: 1720903 - RNA, 22 nt, Human
gagcugccuguucagcuccagc

SEQ ID NO: 1720904 - RNA, 21 nt, Human
gagcugccuguucagcuccag

SEQ ID NO: 1720905 - RNA, 17 nt, Human
gagccuuccaggggugg

SEQ ID NO: 1720906 - RNA, 16 nt, Human
gagccuuccaggggug

SEQ ID NO: 1720907 - RNA, 15 nt, Human
gagccuuccaggggu

SEQ ID NO: 1720908 - RNA, 14 nt, Human
gagccuuccagggg

SEQ ID NO: 1720909 - RNA, 13 nt, Human
gagccccgaggcc

SEQ ID NO: 1720910 - RNA, 22 nt, Human
gagccuugaacuuugaccucug

SEQ ID NO: 1720911 - RNA, 18 nt, Human
gagcugggugucaagagg

SEQ ID NO: 1720912 - RNA, 14 nt, Human
gagcagggcucagc

SEQ ID NO: 1720913 - RNA, 21 nt, Human
gagcagggcucagcggggaca

SEQ ID NO: 1720914 - RNA, 12 nt, Human
gagcaucaggcc

SEQ ID NO: 1720915 - RNA, 22 nt, Human
gagcaugccuggauggggcugc

SEQ ID NO: 1720916 - RNA, 13 nt, Human
gagcaucaggcca

SEQ ID NO: 1720917 - RNA, 11 nt, Human
gacuuuccucu

SEQ ID NO: 1720918 - RNA, 21 nt, Human
gacuuuucuuuguggcuuccu

SEQ ID NO: 1720919 - RNA, 23 nt, Human
gacuuuucuuucagccaagaauu

SEQ ID NO: 1720920 - RNA, 15 nt, Human
gagaaucacuugaac

SEQ ID NO: 1720921 - RNA, 14 nt, Human
gagaaucacuugaa

SEQ ID NO: 1720922 - RNA, 13 nt, Human
gagaccugccccu

SEQ ID NO: 1720923 - RNA, 12 nt, Human
gagaccugcccc

SEQ ID NO: 1720924 - RNA, 11 nt, Human
gagaccugccc

SEQ ID NO: 1720925 - RNA, 21 nt, Human
gagacccugucucaaaaaaag

SEQ ID NO: 1720926 - RNA, 15 nt, Human
gagaagcggcuggca

SEQ ID NO: 1720927 - RNA, 13 nt, Human
gagaagcggcugg

SEQ ID NO: 1720928 - RNA, 16 nt, Human
gagaagcggcuggcag

SEQ ID NO: 1720929 - RNA, 12 nt, Human
gagaaggaagcc

SEQ ID NO: 1720930 - RNA, 20 nt, Human
gagaaggacccggaggggcc

SEQ ID NO: 1720931 - RNA, 23 nt, Human
gagaaggacccggaggggccugg

SEQ ID NO: 1720932 - RNA, 22 nt, Human
gagaaggacccggaggggccug

SEQ ID NO: 1720933 - RNA, 12 nt, Human
gacucugucuca

SEQ ID NO: 1720934 - RNA, 22 nt, Human
gacuaucuaaauguugaaagau

SEQ ID NO: 1720935 - RNA, 18 nt, Human
gacuaggguccuggggaa

SEQ ID NO: 1720936 - RNA, 16 nt, Human
gacuaggguccugggg

SEQ ID NO: 1720937 - RNA, 15 nt, Human
gacuaggguccuggg

SEQ ID NO: 1720938 - RNA, 14 nt, Human
gacagugaaagaaa

SEQ ID NO: 1720939 - RNA, 11 nt, Human
gacagcuccuu

SEQ ID NO: 1720940 - RNA, 19 nt, Human
gacagccuggcacagggca

SEQ ID NO: 1720941 - RNA, 13 nt, Human
gacagccuggcac

SEQ ID NO: 1720942 - RNA, 13 nt, Human
gacagcccuccau

SEQ ID NO: 1720943 - RNA, 22 nt, Human
gacaggguuuugccauguuggc

SEQ ID NO: 1720944 - RNA, 20 nt, Human
gacaggguuuugccauguug

SEQ ID NO: 1720945 - RNA, 16 nt, Human
gacacuuaaaaauggu

SEQ ID NO: 1720946 - RNA, 15 nt, Human
gacacugaugggcaa

SEQ ID NO: 1720947 - RNA, 13 nt, Human
gacacugaugggc

SEQ ID NO: 1720948 - RNA, 23 nt, Human
gacagcccgggcucugccuccca

SEQ ID NO: 1720949 - RNA, 22 nt, Human
gacagcccgggcucugccuccc

SEQ ID NO: 1720950 - RNA, 21 nt, Human
gacagcccgggcucugccucc

SEQ ID NO: 1720951 - RNA, 12 nt, Human
gacagacacagg

SEQ ID NO: 1720952 - RNA, 21 nt, Human
gacacacagcucuguccuggg

SEQ ID NO: 1720953 - RNA, 14 nt, Human
gacacacagcucug

SEQ ID NO: 1720954 - RNA, 19 nt, Human
gacacacagcucuguccug

SEQ ID NO: 1720955 - RNA, 18 nt, Human
gacacacagcucuguccu

SEQ ID NO: 1720956 - RNA, 17 nt, Human
gacacacagcucugucc

SEQ ID NO: 1720957 - RNA, 15 nt, Human
gacacacagcucugu

SEQ ID NO: 1720958 - RNA, 21 nt, Human
gaauuuugugcccccauguaa

SEQ ID NO: 1720959 - RNA, 20 nt, Human
gaauuuugugcccccaugua

SEQ ID NO: 1720960 - RNA, 23 nt, Human
gaauuuuggcugugucucccuuc

SEQ ID NO: 1720961 - RNA, 19 nt, Human
gaauuuuggcugugucucc

SEQ ID NO: 1720962 - RNA, 21 nt, Human
gaauuuuauuuuuugggaaaa

SEQ ID NO: 1720963 - RNA, 18 nt, Human
gaauuuuauugacacagu

SEQ ID NO: 1720964 - RNA, 17 nt, Human
gaaggcucgagcaugcc

SEQ ID NO: 1720965 - RNA, 16 nt, Human
gaaggcucgagcaugc

SEQ ID NO: 1720966 - RNA, 19 nt, Human
gaaggcucgagcaugccug

SEQ ID NO: 1720967 - RNA, 18 nt, Human
gaagucuuuguacagaca

SEQ ID NO: 1720968 - RNA, 20 nt, Human
gaagucuuuguacagacaac

SEQ ID NO: 1720969 - RNA, 19 nt, Human
gaagucuuuguacagacaa

SEQ ID NO: 1720970 - RNA, 15 nt, Human
gaaguggggacagag

SEQ ID NO: 1720971 - RNA, 15 nt, Human
gaagcucagggccug

SEQ ID NO: 1720972 - RNA, 14 nt, Human
gaagcucagggccu

SEQ ID NO: 1720973 - RNA, 19 nt, Human
gaagcucagggccuggcuc

SEQ ID NO: 1720974 - RNA, 18 nt, Human
gaagcucagggccuggcu

SEQ ID NO: 1720975 - RNA, 17 nt, Human
gaagcucagggccuggc

SEQ ID NO: 1720976 - RNA, 16 nt, Human
gaagcucagggccugg

SEQ ID NO: 1720977 - RNA, 21 nt, Human
gaagcucagggccuggcucag

SEQ ID NO: 1720978 - RNA, 20 nt, Human
gaagcucagggccuggcuca

SEQ ID NO: 1720979 - RNA, 23 nt, Human
gaagcucagggccuggcucaggu

SEQ ID NO: 1720980 - RNA, 18 nt, Human
gaaauccagggugguggu

SEQ ID NO: 1720981 - RNA, 13 nt, Human
gaaauccagggug

SEQ ID NO: 1720982 - RNA, 22 nt, Human
gaaugaaugucagugugacuga

SEQ ID NO: 1720983 - RNA, 18 nt, Human
gaaugaaugucaguguga

SEQ ID NO: 1720984 - RNA, 14 nt, Human
gaaugaaugucagu

SEQ ID NO: 1720985 - RNA, 11 nt, Human
gaaugaauguc

SEQ ID NO: 1720986 - RNA, 23 nt, Human
gcagagcaccuuagacagucccu

SEQ ID NO: 1720987 - RNA, 22 nt, Human
gcagagcaccuuagacaguccc

SEQ ID NO: 1720988 - RNA, 19 nt, Human
gcagagcaccuuagacagu

SEQ ID NO: 1720989 - RNA, 15 nt, Human
gcagagcagagacca

SEQ ID NO: 1720990 - RNA, 14 nt, Human
gcagagcagagacc

SEQ ID NO: 1720991 - RNA, 12 nt, Human
gcagagcagaga

SEQ ID NO: 1720992 - RNA, 24 nt, Human
gcagagcaccuuagacagucccug

SEQ ID NO: 1720993 - RNA, 20 nt, Human
gcagagcagagaccaucccu

SEQ ID NO: 1720994 - RNA, 19 nt, Human
gcagagcagagaccauccc

SEQ ID NO: 1720995 - RNA, 12 nt, Human
gcacugacauug

SEQ ID NO: 1720996 - RNA, 13 nt, Human
gcaagugagagcu

SEQ ID NO: 1720997 - RNA, 14 nt, Human
gcacaagcugcacc

SEQ ID NO: 1720998 - RNA, 23 nt, Human
gcacaagcuccaagcucccaggc

SEQ ID NO: 1720999 - RNA, 22 nt, Human
gcacaagcuccaagcucccagg

SEQ ID NO: 1721000 - RNA, 23 nt, Human
gcaauaaggggagaguaacccug

SEQ ID NO: 1721001 - RNA, 15 nt, Human
gcaagugagagcugg

SEQ ID NO: 1721002 - RNA, 23 nt, Human
gauucugaccuuaaaugcaacca

SEQ ID NO: 1721003 - RNA, 20 nt, Human
gauucugaccuuaaaugcaa

SEQ ID NO: 1721004 - RNA, 21 nt, Human
gauucugaccuuaaaugcaac

SEQ ID NO: 1721005 - RNA, 21 nt, Human
gcacaaucucggcucacugca

SEQ ID NO: 1721006 - RNA, 22 nt, Human
gcacaaucucggcucacugcau

SEQ ID NO: 1721007 - RNA, 13 nt, Human
gcacaugccucuc

SEQ ID NO: 1721008 - RNA, 19 nt, Human
gcacaucagcacgauuucu

SEQ ID NO: 1721009 - RNA, 20 nt, Human
gcacaucagcacgauuucug

SEQ ID NO: 1721010 - RNA, 21 nt, Human
gcacaucagcacgauuucugu

SEQ ID NO: 1721011 - RNA, 22 nt, Human
gcacaugccucucucaggccaa

SEQ ID NO: 1721012 - RNA, 21 nt, Human
gcacaugccucucucaggcca

SEQ ID NO: 1721013 - RNA, 20 nt, Human
gcacaugccucucucaggcc

SEQ ID NO: 1721014 - RNA, 19 nt, Human
gcacaugccucucucaggc

SEQ ID NO: 1721015 - RNA, 18 nt, Human
gcacaugccucucucagg

SEQ ID NO: 1721016 - RNA, 17 nt, Human
gcacaugccucucucag

SEQ ID NO: 1721017 - RNA, 14 nt, Human
gcacaugccucucu

SEQ ID NO: 1721018 - RNA, 19 nt, Human
gcaccggcuggccuggccc

SEQ ID NO: 1721019 - RNA, 23 nt, Human
gcaccggcuggccuggccccuca

SEQ ID NO: 1721020 - RNA, 21 nt, Human
gcaccggcuggccuggccccu

SEQ ID NO: 1721021 - RNA, 13 nt, Human
gcagggagggccu

SEQ ID NO: 1721022 - RNA, 10 nt, Human
gcagggaggg

SEQ ID NO: 1721023 - RNA, 19 nt, Human
gcagggacuugaacccaua

SEQ ID NO: 1721024 - RNA, 13 nt, Human
gcagggaaacagc

SEQ ID NO: 1721025 - RNA, 22 nt, Human
gcaggcucucaggccagcugcu

SEQ ID NO: 1721026 - RNA, 20 nt, Human
gcaggcucucaggccagcug

SEQ ID NO: 1721027 - RNA, 19 nt, Human
gcagcugcgguccacccag

SEQ ID NO: 1721028 - RNA, 17 nt, Human
gcagcugcgguccaccc

SEQ ID NO: 1721029 - RNA, 23 nt, Human
gcaggcucucaggccagcugcuu

SEQ ID NO: 1721030 - RNA, 14 nt, Human
gcaggcuggcccug

SEQ ID NO: 1721031 - RNA, 18 nt, Human
gcaggcuggcccugcccu

SEQ ID NO: 1721032 - RNA, 17 nt, Human
gcaggcuggcccugccc

SEQ ID NO: 1721033 - RNA, 16 nt, Human
gcaggcuggcccugcc

SEQ ID NO: 1721034 - RNA, 15 nt, Human
gcaggcuggcccugc

SEQ ID NO: 1721035 - RNA, 21 nt, Human
gcaggcuggcccugcccuggu

SEQ ID NO: 1721036 - RNA, 20 nt, Human
gcaggcuggcccugcccugg

SEQ ID NO: 1721037 - RNA, 19 nt, Human
gcaggcuggcccugcccug

SEQ ID NO: 1721038 - RNA, 22 nt, Human
gcauaacguauaaaagccuguu

SEQ ID NO: 1721039 - RNA, 17 nt, Human
gcauaccacuuuuguuc

SEQ ID NO: 1721040 - RNA, 20 nt, Human
gcauaccacuuuuguucuug

SEQ ID NO: 1721041 - RNA, 14 nt, Human
gcauacguacacau

SEQ ID NO: 1721042 - RNA, 14 nt, Human
gcagccaggccaca

SEQ ID NO: 1721043 - RNA, 13 nt, Human
gcagccaggccac

SEQ ID NO: 1721044 - RNA, 16 nt, Human
gcagccaggccacaag

SEQ ID NO: 1721045 - RNA, 12 nt, Human
gcagccaggcca

SEQ ID NO: 1721046 - RNA, 14 nt, Human
gcagccacuauugu

SEQ ID NO: 1721047 - RNA, 16 nt, Human
gcagccacauuccuga

SEQ ID NO: 1721048 - RNA, 14 nt, Human
gauuaccagggacu

SEQ ID NO: 1721049 - RNA, 18 nt, Human
gauuacugccuauuuuaa

SEQ ID NO: 1721050 - RNA, 20 nt, Human
gauuacaggugugagccacc

SEQ ID NO: 1721051 - RNA, 20 nt, Human
gauuacaggugugaaccacc

SEQ ID NO: 1721052 - RNA, 18 nt, Human
gaucucuugagccuggga

SEQ ID NO: 1721053 - RNA, 17 nt, Human
gaucucuugagccuggg

SEQ ID NO: 1721054 - RNA, 16 nt, Human
gaucucuugagccugg

SEQ ID NO: 1721055 - RNA, 12 nt, Human
gaucucuugagc

SEQ ID NO: 1721056 - RNA, 15 nt, Human
gaucucuaacuucac

SEQ ID NO: 1721057 - RNA, 16 nt, Human
gauauuuugcuuugug

SEQ ID NO: 1721058 - RNA, 15 nt, Human
gauauuuuuuucuuu

SEQ ID NO: 1721059 - RNA, 17 nt, Human
gauauuuuuuucuuuuc

SEQ ID NO: 1721060 - RNA, 21 nt, Human
gaugaucuuugcagacaggca

SEQ ID NO: 1721061 - RNA, 20 nt, Human
gaugaucuuugcagacaggc

SEQ ID NO: 1721062 - RNA, 21 nt, Human
gaugaugaaaugaggucagag

SEQ ID NO: 1721063 - RNA, 20 nt, Human
gauauguaccuaacgaagua

SEQ ID NO: 1721064 - RNA, 17 nt, Human
gauacuugaaaauuaac

SEQ ID NO: 1721065 - RNA, 18 nt, Human
gauaugcaguuuuccuua

SEQ ID NO: 1721066 - RNA, 12 nt, Human
gauaugcuugua

SEQ ID NO: 1721067 - RNA, 22 nt, Human
gauaugcuuguaacuaaaauaa

SEQ ID NO: 1721068 - RNA, 16 nt, Human
gauacuugaaaauuaa

SEQ ID NO: 1721069 - RNA, 14 nt, Human
gauacccaucccau

SEQ ID NO: 1721070 - RNA, 13 nt, Human
gauacccauccca

SEQ ID NO: 1721071 - RNA, 16 nt, Human
gauacuacaguuuguu

SEQ ID NO: 1721072 - RNA, 11 nt, Human
gauacuacagu

SEQ ID NO: 1721073 - RNA, 17 nt, Human
gauacgacaacuugcac

SEQ ID NO: 1721074 - RNA, 16 nt, Human
gaguuguuacauuuuu

SEQ ID NO: 1721075 - RNA, 20 nt, Human
gaguuguuacauuuuuaagu

SEQ ID NO: 1721076 - RNA, 13 nt, Human
gagugcagugagc

SEQ ID NO: 1721077 - RNA, 20 nt, Human
gaguuugggguaugggagag

SEQ ID NO: 1721078 - RNA, 13 nt, Human
gaggucuguucuu

SEQ ID NO: 1721079 - RNA, 14 nt, Human
gaggucuguucuuu

SEQ ID NO: 1721080 - RNA, 11 nt, Human
gaggugggagg

SEQ ID NO: 1721081 - RNA, 12 nt, Human
gaggugggaucc

SEQ ID NO: 1721082 - RNA, 12 nt, Human
gagugagcuggu

SEQ ID NO: 1721083 - RNA, 21 nt, Human
gagucccaccuuggcugcagg

SEQ ID NO: 1721084 - RNA, 24 nt, Human
gagugagcacuaaggugugcucug

SEQ ID NO: 1721085 - RNA, 12 nt, Human
gagugcagugag

SEQ ID NO: 1721086 - RNA, 11 nt, Human
gagugcaguga

SEQ ID NO: 1721087 - RNA, 14 nt, Human
gagucaccaagccc

SEQ ID NO: 1721088 - RNA, 13 nt, Human
gagucaccaagcc

SEQ ID NO: 1721089 - RNA, 15 nt, Human
gagucaccaagccca

SEQ ID NO: 1721090 - RNA, 20 nt, Human
gagucccaccuuggcugcag

SEQ ID NO: 1721091 - RNA, 16 nt, Human
gagucccaccuuggcu

SEQ ID NO: 1721092 - RNA, 14 nt, Human
ggucggaaaacaug

SEQ ID NO: 1721093 - RNA, 18 nt, Human
ggucgcuugggaauuuua

SEQ ID NO: 1721094 - RNA, 17 nt, Human
ggucuacacugugcuga

SEQ ID NO: 1721095 - RNA, 13 nt, Human
ggucggaaaacau

SEQ ID NO: 1721096 - RNA, 13 nt, Human
aaagcaaaggaga

SEQ ID NO: 1721097 - RNA, 22 nt, Human
aaagauucugaccuuaaaugca

SEQ ID NO: 1721098 - RNA, 23 nt, Human
gguccugcugcaguugccaguca

SEQ ID NO: 1721099 - RNA, 21 nt, Human
gguccugcugcaguugccagu

SEQ ID NO: 1721100 - RNA, 13 nt, Human
aaagcaaaugucu

SEQ ID NO: 1721101 - RNA, 17 nt, Human
aaagcagggacuugaac

SEQ ID NO: 1721102 - RNA, 19 nt, Human
aaagcaggcagaacucauc

SEQ ID NO: 1721103 - RNA, 17 nt, Human
aaagcaggcagaacuca

SEQ ID NO: 1721104 - RNA, 16 nt, Human
aaagcagcguuucuau

SEQ ID NO: 1721105 - RNA, 18 nt, Human
aaagcagcguuucuauga

SEQ ID NO: 1721106 - RNA, 22 nt, Human
aaagcagcguuucuaugacaca

SEQ ID NO: 1721107 - RNA, 21 nt, Human
gguggaugccugguggcagcu

SEQ ID NO: 1721108 - RNA, 14 nt, Human
gguggaugccuggu

SEQ ID NO: 1721109 - RNA, 20 nt, Human
ggugcugggccccugccucu

SEQ ID NO: 1721110 - RNA, 20 nt, Human
ggugcaaugaccuuucaaua

SEQ ID NO: 1721111 - RNA, 19 nt, Human
ggugcaaugaccuuucaau

SEQ ID NO: 1721112 - RNA, 18 nt, Human
ggugcaaugaccuuucaa

SEQ ID NO: 1721113 - RNA, 17 nt, Human
ggguuucuaaagcugcc

SEQ ID NO: 1721114 - RNA, 20 nt, Human
gguaacaggcagauacagga

SEQ ID NO: 1721115 - RNA, 14 nt, Human
gguaacaggcagau

SEQ ID NO: 1721116 - RNA, 18 nt, Human
gguaacuagggaagauaa

SEQ ID NO: 1721117 - RNA, 23 nt, Human
gguacaaccuguucugcuuuccu

SEQ ID NO: 1721118 - RNA, 24 nt, Human
gguacaaccuguucugcuuuccuc

SEQ ID NO: 1721119 - RNA, 18 nt, Human
gguaaucgaccugccucg

SEQ ID NO: 1721120 - RNA, 17 nt, Human
gguaaucgaccugccuc

SEQ ID NO: 1721121 - RNA, 14 nt, Human
gguaaucgaccugc

SEQ ID NO: 1721122 - RNA, 15 nt, Human
ggguggcaccagcag

SEQ ID NO: 1721123 - RNA, 17 nt, Human
ggguggaugccuggugg

SEQ ID NO: 1721124 - RNA, 13 nt, Human
ggguggaugccug

SEQ ID NO: 1721125 - RNA, 12 nt, Human
ggggccuggcag

SEQ ID NO: 1721126 - RNA, 11 nt, Human
ggggccuggca

SEQ ID NO: 1721127 - RNA, 20 nt, Human
ggguggggaccucaggccug

SEQ ID NO: 1721128 - RNA, 19 nt, Human
ggguggcaccagcagccug

SEQ ID NO: 1721129 - RNA, 17 nt, Human
ggguguggcgcagcaua

SEQ ID NO: 1721130 - RNA, 12 nt, Human
ggguggugaccu

SEQ ID NO: 1721131 - RNA, 18 nt, Human
ggguggggggggugcugg

SEQ ID NO: 1721132 - RNA, 17 nt, Human
aaagacuaucuaaaugu

SEQ ID NO: 1721133 - RNA, 19 nt, Human
aaagacaccuacugagugg

SEQ ID NO: 1721134 - RNA, 13 nt, Human
aaagacaccuacu

SEQ ID NO: 1721135 - RNA, 16 nt, Human
aaagaauagaagcuaa

SEQ ID NO: 1721136 - RNA, 15 nt, Human
gguccauagagagca

SEQ ID NO: 1721137 - RNA, 17 nt, Human
aaacuuuaccuuuuuua

SEQ ID NO: 1721138 - RNA, 22 nt, Human
aaacuuuaccuuuuuuauacau

SEQ ID NO: 1721139 - RNA, 18 nt, Human
aaacuuuacuauggcccu

SEQ ID NO: 1721140 - RNA, 12 nt, Human
aaacuuuacuau

SEQ ID NO: 1721141 - RNA, 18 nt, Human
aaagaaguggggacagag

SEQ ID NO: 1721142 - RNA, 16 nt, Human
gguccacccaggagcc

SEQ ID NO: 1721143 - RNA, 15 nt, Human
gguccacccaggagc

SEQ ID NO: 1721144 - RNA, 13 nt, Human
gguccacccagga

SEQ ID NO: 1721145 - RNA, 12 nt, Human
gguccacccagg

SEQ ID NO: 1721146 - RNA, 17 nt, Human
gguccacccaggagccc

SEQ ID NO: 1721147 - RNA, 14 nt, Human
gguaugcaaucaaa

SEQ ID NO: 1721148 - RNA, 22 nt, Human
gguaugaucacggcucacugca

SEQ ID NO: 1721149 - RNA, 16 nt, Human
gguccacaacacacag

SEQ ID NO: 1721150 - RNA, 14 nt, Human
gguagcuuuucccu

SEQ ID NO: 1721151 - RNA, 16 nt, Human
gguuuagaaagcuugc

SEQ ID NO: 1721152 - RNA, 20 nt, Human
gguuccuuccucugagccuu

SEQ ID NO: 1721153 - RNA, 19 nt, Human
gguuccuuccucugagccu

SEQ ID NO: 1721154 - RNA, 14 nt, Human
gguuucagaaaugu

SEQ ID NO: 1721155 - RNA, 15 nt, Human
gguuucagaaaugug

SEQ ID NO: 1721156 - RNA, 12 nt, Human
gguuucagaaau

SEQ ID NO: 1721157 - RNA, 13 nt, Human
gguuucagaaaug

SEQ ID NO: 1721158 - RNA, 19 nt, Human
gguuucaccauguuggcca

SEQ ID NO: 1721159 - RNA, 21 nt, Human
gguucccuuugacgccauccc

SEQ ID NO: 1721160 - RNA, 22 nt, Human
gguucccuuugacgccauccca

SEQ ID NO: 1721161 - RNA, 16 nt, Human
gguuccuccccuccuc

SEQ ID NO: 1721162 - RNA, 24 nt, Human
gguuccagcaauucuccugccuca

SEQ ID NO: 1721163 - RNA, 15 nt, Human
gguuccccuguucac

SEQ ID NO: 1721164 - RNA, 23 nt, Human
gguuccagcaauucuccugccuc

SEQ ID NO: 1721165 - RNA, 21 nt, Human
gguucaggguuggccccugcc

SEQ ID NO: 1721166 - RNA, 18 nt, Human
gguucaggguuggccccu

SEQ ID NO: 1721167 - RNA, 22 nt, Human
gguucaggguuggccccugccc

SEQ ID NO: 1721168 - RNA, 13 nt, Human
ggugugcucugau

SEQ ID NO: 1721169 - RNA, 21 nt, Human
ggugugcggccuuuggcuuca

SEQ ID NO: 1721170 - RNA, 12 nt, Human
gguguggaagag

SEQ ID NO: 1721171 - RNA, 16 nt, Human
ggugugaccacugcag

SEQ ID NO: 1721172 - RNA, 16 nt, Human
ggugugacugaauuuc

SEQ ID NO: 1721173 - RNA, 18 nt, Human
ggugugagucaccaagcc

SEQ ID NO: 1721174 - RNA, 16 nt, Human
ggugucgggcaugaca

SEQ ID NO: 1721175 - RNA, 13 nt, Human
ggugucgggcaug

SEQ ID NO: 1721176 - RNA, 23 nt, Human
gguggggucacucuggcagcuca

SEQ ID NO: 1721177 - RNA, 15 nt, Human
gguggggucacucug

SEQ ID NO: 1721178 - RNA, 17 nt, Human
gguggggggggugcugg

SEQ ID NO: 1721179 - RNA, 17 nt, Human
gguggggcagcuugagg

SEQ ID NO: 1721180 - RNA, 13 nt, Human
gguggggcagcuu

SEQ ID NO: 1721181 - RNA, 19 nt, Human
ggugggauccuccaggugc

SEQ ID NO: 1721182 - RNA, 15 nt, Human
ggugggauccuccag

SEQ ID NO: 1721183 - RNA, 14 nt, Human
ggugggauccucca

SEQ ID NO: 1721184 - RNA, 20 nt, Human
ggugggaggauugcuugagc

SEQ ID NO: 1721185 - RNA, 18 nt, Human
aaagccuguuuaagagac

SEQ ID NO: 1721186 - RNA, 16 nt, Human
aaagccuguuuaagag

SEQ ID NO: 1721187 - RNA, 13 nt, Human
aaauaaugugaaa

SEQ ID NO: 1721188 - RNA, 12 nt, Human
aaauaaugugaa

SEQ ID NO: 1721189 - RNA, 23 nt, Human
aaaguucccuacuuccugugacu

SEQ ID NO: 1721190 - RNA, 23 nt, Human
aaaguuucucuuuucaaaacauu

SEQ ID NO: 1721191 - RNA, 21 nt, Human
aaaguuucucuuuucaaaaca

SEQ ID NO: 1721192 - RNA, 16 nt, Human
aaaguuuguugaaaca

SEQ ID NO: 1721193 - RNA, 14 nt, Human
aaaguuuguuugcu

SEQ ID NO: 1721194 - RNA, 21 nt, Human
aaaguucccuacuuccuguga

SEQ ID NO: 1721195 - RNA, 12 nt, Human
aaaguggugaga

SEQ ID NO: 1721196 - RNA, 22 nt, Human
aaacauccuacaagacacagug

SEQ ID NO: 1721197 - RNA, 18 nt, Human
aaacauccuacaagacac

SEQ ID NO: 1721198 - RNA, 20 nt, Human
ggggacagcuccuucugucc

SEQ ID NO: 1721199 - RNA, 14 nt, Human
ggggacagcuccuu

SEQ ID NO: 1721200 - RNA, 12 nt, Human
ggggacagcucc

SEQ ID NO: 1721201 - RNA, 20 nt, Human
aaacaagcacuaaacaaaga

SEQ ID NO: 1721202 - RNA, 16 nt, Human
aaacacauuuuucuua

SEQ ID NO: 1721203 - RNA, 20 nt, Human
aaacaagaccacguuucuaa

SEQ ID NO: 1721204 - RNA, 12 nt, Human
aaaaugugugug

SEQ ID NO: 1721205 - RNA, 15 nt, Human
aaaaugugauaugua

SEQ ID NO: 1721206 - RNA, 22 nt, Human
gggcuggguucuacccaggugc

SEQ ID NO: 1721207 - RNA, 13 nt, Human
aaaaugucuuuau

SEQ ID NO: 1721208 - RNA, 18 nt, Human
gggcugcaugcgggcuuc

SEQ ID NO: 1721209 - RNA, 21 nt, Human
gggcugcaugcgggcuuccuc

SEQ ID NO: 1721210 - RNA, 18 nt, Human
gggcucagcaaaagaugc

SEQ ID NO: 1721211 - RNA, 22 nt, Human
gggcugcaccggcuggccuggc

SEQ ID NO: 1721212 - RNA, 10 nt, Human
gggcucagca

SEQ ID NO: 1721213 - RNA, 20 nt, Human
gggcuggguucuacccaggu

SEQ ID NO: 1721214 - RNA, 12 nt, Human
gggcugggcaga

SEQ ID NO: 1721215 - RNA, 18 nt, Human
gggcugggagcucugcag

SEQ ID NO: 1721216 - RNA, 16 nt, Human
gggcugggagcucugc

SEQ ID NO: 1721217 - RNA, 21 nt, Human
gggcugcccuggugcugccac

SEQ ID NO: 1721218 - RNA, 15 nt, Human
gggcugcccuggugc

SEQ ID NO: 1721219 - RNA, 14 nt, Human
gggcugcccuggug

SEQ ID NO: 1721220 - RNA, 13 nt, Human
gggcugcccuggu

SEQ ID NO: 1721221 - RNA, 21 nt, Human
aaaaugcuguauuagucacag

SEQ ID NO: 1721222 - RNA, 11 nt, Human
gggccaggagc

SEQ ID NO: 1721223 - RNA, 13 nt, Human
gggccaggcuggg

SEQ ID NO: 1721224 - RNA, 12 nt, Human
gggccaggagcc

SEQ ID NO: 1721225 - RNA, 21 nt, Human
gggccaggcugggucgcccug

SEQ ID NO: 1721226 - RNA, 15 nt, Human
gggccaggcuggguc

SEQ ID NO: 1721227 - RNA, 14 nt, Human
gggccaggcugggu

SEQ ID NO: 1721228 - RNA, 21 nt, Human
aaaaugagccuggcaagaaug

SEQ ID NO: 1721229 - RNA, 14 nt, Human
aaaaugagccuggc

SEQ ID NO: 1721230 - RNA, 23 nt, Human
gggccaguuggucccccuuccau

SEQ ID NO: 1721231 - RNA, 22 nt, Human
gggccaguuggucccccuucca

SEQ ID NO: 1721232 - RNA, 18 nt, Human
gggccaguuggucccccu

SEQ ID NO: 1721233 - RNA, 14 nt, Human
gggccaguuggucc

SEQ ID NO: 1721234 - RNA, 20 nt, Human
gggccucuuaugggcugggu

SEQ ID NO: 1721235 - RNA, 13 nt, Human
gggccuccugugu

SEQ ID NO: 1721236 - RNA, 15 nt, Human
gggccuccugugugu

SEQ ID NO: 1721237 - RNA, 22 nt, Human
gggccucggacuuagcugggag

SEQ ID NO: 1721238 - RNA, 15 nt, Human
gggcgggaggauguu

SEQ ID NO: 1721239 - RNA, 23 nt, Human
gggcuacaccuuagccugcccuc

SEQ ID NO: 1721240 - RNA, 19 nt, Human
gggaggucgaggcaggagg

SEQ ID NO: 1721241 - RNA, 18 nt, Human
gggaggucgaggcaggag

SEQ ID NO: 1721242 - RNA, 17 nt, Human
gggaggucgaggcagga

SEQ ID NO: 1721243 - RNA, 18 nt, Human
gggagggcuccagacaca

SEQ ID NO: 1721244 - RNA, 17 nt, Human
gggagggcuccagacac

SEQ ID NO: 1721245 - RNA, 15 nt, Human
gggagggcuccagac

SEQ ID NO: 1721246 - RNA, 14 nt, Human
gggagggcuccaga

SEQ ID NO: 1721247 - RNA, 22 nt, Human
gggaggcucuggagcccacugu

SEQ ID NO: 1721248 - RNA, 23 nt, Human
gggcagagcagagaccaucccug

SEQ ID NO: 1721249 - RNA, 14 nt, Human
gggcagaggaaagc

SEQ ID NO: 1721250 - RNA, 22 nt, Human
gggcagagcagagaccaucccu

SEQ ID NO: 1721251 - RNA, 17 nt, Human
gggcagagcagagacca

SEQ ID NO: 1721252 - RNA, 16 nt, Human
gggcagagcagagacc

SEQ ID NO: 1721253 - RNA, 20 nt, Human
gggcaacccccagccugcua

SEQ ID NO: 1721254 - RNA, 18 nt, Human
gggcaacccccagccugc

SEQ ID NO: 1721255 - RNA, 16 nt, Human
gggcaacccccagccu

SEQ ID NO: 1721256 - RNA, 16 nt, Human
gggauuguaaaauggu

SEQ ID NO: 1721257 - RNA, 17 nt, Human
gggauuguaaaauggug

SEQ ID NO: 1721258 - RNA, 15 nt, Human
gggauuacaggugug

SEQ ID NO: 1721259 - RNA, 12 nt, Human
gggauuacaggu

SEQ ID NO: 1721260 - RNA, 21 nt, Human
gggauuacaggcuccugccac

SEQ ID NO: 1721261 - RNA, 16 nt, Human
gggauuacaggcuccu

SEQ ID NO: 1721262 - RNA, 13 nt, Human
gggauuacaggcu

SEQ ID NO: 1721263 - RNA, 14 nt, Human
gggauuacaggcgu

SEQ ID NO: 1721264 - RNA, 19 nt, Human
aaaagguaugcaaucaaau

SEQ ID NO: 1721265 - RNA, 23 nt, Human
aaaaauaugaccacacuccagcu

SEQ ID NO: 1721266 - RNA, 21 nt, Human
aaaaauaugaccacacuccag

SEQ ID NO: 1721267 - RNA, 21 nt, Human
gggacagcuccuucuguccua

SEQ ID NO: 1721268 - RNA, 23 nt, Human
gggacagaggggguggccuccca

SEQ ID NO: 1721269 - RNA, 22 nt, Human
gggacagaggggguggccuccc

SEQ ID NO: 1721270 - RNA, 13 nt, Human
gggacagaggggg

SEQ ID NO: 1721271 - RNA, 13 nt, Human
gggaaggauacaa

SEQ ID NO: 1721272 - RNA, 16 nt, Human
gggaaggauacaaaag

SEQ ID NO: 1721273 - RNA, 14 nt, Human
aaaaaucucaaauu

SEQ ID NO: 1721274 - RNA, 17 nt, Human
aaaaaucucaaauuucu

SEQ ID NO: 1721275 - RNA, 21 nt, Human
aaaaccaauguucucucuucu

SEQ ID NO: 1721276 - RNA, 15 nt, Human
aaaacaugcuacaca

SEQ ID NO: 1721277 - RNA, 13 nt, Human
aaaagaugcuucu

SEQ ID NO: 1721278 - RNA, 23 nt, Human
aaaacugcugacuguuuucucuu

SEQ ID NO: 1721279 - RNA, 22 nt, Human
aaaacugcugacuguuuucucu

SEQ ID NO: 1721280 - RNA, 15 nt, Human
aaaacccagauaaag

SEQ ID NO: 1721281 - RNA, 21 nt, Human
ggaguuggaagugugugaucu

SEQ ID NO: 1721282 - RNA, 14 nt, Human
ggaguggccacaga

SEQ ID NO: 1721283 - RNA, 15 nt, Human
ggaguucugguuccu

SEQ ID NO: 1721284 - RNA, 14 nt, Human
ggauccugagccag

SEQ ID NO: 1721285 - RNA, 13 nt, Human
ggauccugagcca

SEQ ID NO: 1721286 - RNA, 14 nt, Human
ggauccuccaggug

SEQ ID NO: 1721287 - RNA, 15 nt, Human
ggauccuccaggugc

SEQ ID NO: 1721288 - RNA, 18 nt, Human
ggauggauuuccagccaa

SEQ ID NO: 1721289 - RNA, 16 nt, Human
ggauggggcugcaccg

SEQ ID NO: 1721290 - RNA, 21 nt, Human
ggauguacaaggacagccccu

SEQ ID NO: 1721291 - RNA, 15 nt, Human
ggagugcagugagcc

SEQ ID NO: 1721292 - RNA, 22 nt, Human
ggauguugaaaaaguucugcag

SEQ ID NO: 1721293 - RNA, 16 nt, Human
ggauguucugggacac

SEQ ID NO: 1721294 - RNA, 15 nt, Human
ggauguucugggaca

SEQ ID NO: 1721295 - RNA, 24 nt, Human
ggcacagaaaauggaagacagcuc

SEQ ID NO: 1721296 - RNA, 22 nt, Human
ggcacaaucucggcucacugca

SEQ ID NO: 1721297 - RNA, 16 nt, Human
ggcacagggcaguggg

SEQ ID NO: 1721298 - RNA, 16 nt, Human
ggagcaucagugcccu

SEQ ID NO: 1721299 - RNA, 20 nt, Human
ggaggucaaggcugcaguga

SEQ ID NO: 1721300 - RNA, 14 nt, Human
ggaggugaccccag

SEQ ID NO: 1721301 - RNA, 14 nt, Human
ggaggucgaggcag

SEQ ID NO: 1721302 - RNA, 16 nt, Human
ggaggggggagguggg

SEQ ID NO: 1721303 - RNA, 21 nt, Human
ggagcugccuguucagcucca

SEQ ID NO: 1721304 - RNA, 12 nt, Human
ggagcugccugu

SEQ ID NO: 1721305 - RNA, 22 nt, Human
ggagccccgaggccuucucuga

SEQ ID NO: 1721306 - RNA, 16 nt, Human
ggagccccgaggccuu

SEQ ID NO: 1721307 - RNA, 16 nt, Human
ggagccaauggagacu

SEQ ID NO: 1721308 - RNA, 19 nt, Human
ggaggaaggaaacccagcu

SEQ ID NO: 1721309 - RNA, 23 nt, Human
ggaggaaggaaacccagcucugg

SEQ ID NO: 1721310 - RNA, 20 nt, Human
ggaggaaggaaacccagcuc

SEQ ID NO: 1721311 - RNA, 11 nt, Human
ggaggccagcc

SEQ ID NO: 1721312 - RNA, 12 nt, Human
ggaggccagccu

SEQ ID NO: 1721313 - RNA, 23 nt, Human
ggccuucggccuccauccugagg

SEQ ID NO: 1721314 - RNA, 12 nt, Human
ggccuucucuga

SEQ ID NO: 1721315 - RNA, 21 nt, Human
ggccugugucuaguuguuuga

SEQ ID NO: 1721316 - RNA, 20 nt, Human
ggccuguggaucaaauccag

SEQ ID NO: 1721317 - RNA, 21 nt, Human
ggccuggccagaugcaccagc

SEQ ID NO: 1721318 - RNA, 14 nt, Human
ggccuuuggcuuca

SEQ ID NO: 1721319 - RNA, 13 nt, Human
ggccuuuggcuuc

SEQ ID NO: 1721320 - RNA, 16 nt, Human
ggccuucucugaagga

SEQ ID NO: 1721321 - RNA, 15 nt, Human
ggccuucucugaagg

SEQ ID NO: 1721322 - RNA, 13 nt, Human
ggccuccauccug

SEQ ID NO: 1721323 - RNA, 23 nt, Human
ggccuccaaguccacaguggaac

SEQ ID NO: 1721324 - RNA, 15 nt, Human
ggccugagcugggau

SEQ ID NO: 1721325 - RNA, 23 nt, Human
ggcucagcggggacagcuccuuc

SEQ ID NO: 1721326 - RNA, 22 nt, Human
ggcucagcggggacagcuccuu

SEQ ID NO: 1721327 - RNA, 21 nt, Human
ggcucagcggggacagcuccu

SEQ ID NO: 1721328 - RNA, 23 nt, Human
ggcucagcaaaagaugcuucuca

SEQ ID NO: 1721329 - RNA, 19 nt, Human
ggcgugcaguggugcgauc

SEQ ID NO: 1721330 - RNA, 14 nt, Human
ggcgugcaguggug

SEQ ID NO: 1721331 - RNA, 16 nt, Human
ggcucacugcagccuc

SEQ ID NO: 1721332 - RNA, 17 nt, Human
ggcucacugcagccuca

SEQ ID NO: 1721333 - RNA, 19 nt, Human
ggcucacugcauccuccgc

SEQ ID NO: 1721334 - RNA, 16 nt, Human
ggcucacugcauccuc

SEQ ID NO: 1721335 - RNA, 18 nt, Human
ggcccuucucuccagccc

SEQ ID NO: 1721336 - RNA, 19 nt, Human
ggcccuucucuccagcccc

SEQ ID NO: 1721337 - RNA, 17 nt, Human
ggcccuuccucuccacu

SEQ ID NO: 1721338 - RNA, 17 nt, Human
ggcccuucucuccagcc

SEQ ID NO: 1721339 - RNA, 16 nt, Human
ggcccuucucuccagc

SEQ ID NO: 1721340 - RNA, 18 nt, Human
ggcccuuccucuccacug

SEQ ID NO: 1721341 - RNA, 15 nt, Human
ggcccuuccucucca

SEQ ID NO: 1721342 - RNA, 13 nt, Human
ggcccuuccucuc

SEQ ID NO: 1721343 - RNA, 15 nt, Human
ggcccgacagccugg

SEQ ID NO: 1721344 - RNA, 18 nt, Human
ggcauuuuacuguacaga

SEQ ID NO: 1721345 - RNA, 19 nt, Human
ggcagugggagcugccugu

SEQ ID NO: 1721346 - RNA, 18 nt, Human
ggcagugggagcugccug

SEQ ID NO: 1721347 - RNA, 18 nt, Human
ggcauccaguaucuugaa

SEQ ID NO: 1721348 - RNA, 17 nt, Human
ggcagugggagcugccu

SEQ ID NO: 1721349 - RNA, 24 nt, Human
ggcacugcuuccagugaggcucug

SEQ ID NO: 1721350 - RNA, 16 nt, Human
ggcaccagcagccugg

SEQ ID NO: 1721351 - RNA, 15 nt, Human
ggcaccagcagccug

SEQ ID NO: 1721352 - RNA, 16 nt, Human
ggccagugugacaagg

SEQ ID NO: 1721353 - RNA, 17 nt, Human
ggccaaacucaccugcc

SEQ ID NO: 1721354 - RNA, 21 nt, Human
ggccaaacucaccugccccuc

SEQ ID NO: 1721355 - RNA, 14 nt, Human
ggccaggcuggucu

SEQ ID NO: 1721356 - RNA, 18 nt, Human
ggccaggcuggucucaaa

SEQ ID NO: 1721357 - RNA, 16 nt, Human
ggccaggcuggucuca

SEQ ID NO: 1721358 - RNA, 12 nt, Human
gcugcugacagu

SEQ ID NO: 1721359 - RNA, 16 nt, Human
gcugccccuggcagcc

SEQ ID NO: 1721360 - RNA, 15 nt, Human
gcugccccuggcagc

SEQ ID NO: 1721361 - RNA, 13 nt, Human
gcugccccuggca

SEQ ID NO: 1721362 - RNA, 17 nt, Human
gcugccauccagguuca

SEQ ID NO: 1721363 - RNA, 17 nt, Human
gcugccccuggcagccc

SEQ ID NO: 1721364 - RNA, 15 nt, Human
gcugcacccucaggc

SEQ ID NO: 1721365 - RNA, 13 nt, Human
gcugcacccucag

SEQ ID NO: 1721366 - RNA, 16 nt, Human
gcugcacccucaggca

SEQ ID NO: 1721367 - RNA, 13 nt, Human
gcugccauccagg

SEQ ID NO: 1721368 - RNA, 12 nt, Human
gcugccauccag

SEQ ID NO: 1721369 - RNA, 14 nt, Human
gcucuguccuggga

SEQ ID NO: 1721370 - RNA, 23 nt, Human
gcucugucgcccaggcuggagug

SEQ ID NO: 1721371 - RNA, 17 nt, Human
gcucuggagcccacugu

SEQ ID NO: 1721372 - RNA, 13 nt, Human
gcugacagacaca

SEQ ID NO: 1721373 - RNA, 16 nt, Human
gcugagccucagucuc

SEQ ID NO: 1721374 - RNA, 12 nt, Human
gcugagccucag

SEQ ID NO: 1721375 - RNA, 22 nt, Human
gcugaauacagaggcaacugca

SEQ ID NO: 1721376 - RNA, 17 nt, Human
gcugaauacagaggcaa

SEQ ID NO: 1721377 - RNA, 23 nt, Human
gcugaaggcucgagcaugccugg

SEQ ID NO: 1721378 - RNA, 20 nt, Human
gcugaacuuguuuucuggga

SEQ ID NO: 1721379 - RNA, 21 nt, Human
gcucugcccauccugccccug

SEQ ID NO: 1721380 - RNA, 16 nt, Human
gcucuggagcccacug

SEQ ID NO: 1721381 - RNA, 15 nt, Human
gcucuggagcccacu

SEQ ID NO: 1721382 - RNA, 15 nt, Human
gcucugcccauccug

SEQ ID NO: 1721383 - RNA, 22 nt, Human
gcucugaucauccacugugcca

SEQ ID NO: 1721384 - RNA, 21 nt, Human
gcucugaucauccacugugcc

SEQ ID NO: 1721385 - RNA, 20 nt, Human
gcucugaucauccacugugc

SEQ ID NO: 1721386 - RNA, 20 nt, Human
gcuccacuuggucugugaga

SEQ ID NO: 1721387 - RNA, 9 nt, Human
gcuccagac

SEQ ID NO: 1721388 - RNA, 23 nt, Human
gcuccagacacauguccaagaag

SEQ ID NO: 1721389 - RNA, 21 nt, Human
gcuccagacacauguccaaga

SEQ ID NO: 1721390 - RNA, 18 nt, Human
gcuccagacacaugucca

SEQ ID NO: 1721391 - RNA, 14 nt, Human
gcuccagcucacca

SEQ ID NO: 1721392 - RNA, 13 nt, Human
gcuccagcucacc

SEQ ID NO: 1721393 - RNA, 17 nt, Human
gcuccagcucaccagcc

SEQ ID NO: 1721394 - RNA, 15 nt, Human
gcuccucuccccagc

SEQ ID NO: 1721395 - RNA, 19 nt, Human
gcuccucccggugcccaag

SEQ ID NO: 1721396 - RNA, 20 nt, Human
gcucucaggccagcugcuug

SEQ ID NO: 1721397 - RNA, 19 nt, Human
gcucucaggccagcugcuu

SEQ ID NO: 1721398 - RNA, 18 nt, Human
gcucucaggccagcugcu

SEQ ID NO: 1721399 - RNA, 17 nt, Human
gcucucaggccagcugc

SEQ ID NO: 1721400 - RNA, 19 nt, Human
gcuccucuccccagcaagu

SEQ ID NO: 1721401 - RNA, 16 nt, Human
gcuccucuccccagca

SEQ ID NO: 1721402 - RNA, 19 nt, Human
gcucuacugaggugcuaug

SEQ ID NO: 1721403 - RNA, 18 nt, Human
gcucucaaguuaucaggg

SEQ ID NO: 1721404 - RNA, 19 nt, Human
gcuguauuagucacagaga

SEQ ID NO: 1721405 - RNA, 23 nt, Human
gcugguucaggguuggccccugc

SEQ ID NO: 1721406 - RNA, 15 nt, Human
gcuucaguggcagcu

SEQ ID NO: 1721407 - RNA, 14 nt, Human
gcuucaguggcagc

SEQ ID NO: 1721408 - RNA, 14 nt, Human
gcuucaaggauccu

SEQ ID NO: 1721409 - RNA, 18 nt, Human
gcuucaaggauccugagc

SEQ ID NO: 1721410 - RNA, 16 nt, Human
gcuucaaauuguaagc

SEQ ID NO: 1721411 - RNA, 12 nt, Human
gcugugccucug

SEQ ID NO: 1721412 - RNA, 14 nt, Human
gcuguuggcugggg

SEQ ID NO: 1721413 - RNA, 13 nt, Human
gcuguuggcuggg

SEQ ID NO: 1721414 - RNA, 13 nt, Human
gcuuacaagccag

SEQ ID NO: 1721415 - RNA, 19 nt, Human
gcuuacaagccagcuggag

SEQ ID NO: 1721416 - RNA, 22 nt, Human
gcuuacaagccagcuggagaaa

SEQ ID NO: 1721417 - RNA, 23 nt, Human
gcuuccagugaggcucugcccuu

SEQ ID NO: 1721418 - RNA, 12 nt, Human
gcuucuucagag

SEQ ID NO: 1721419 - RNA, 15 nt, Human
gcuucuucagagacu

SEQ ID NO: 1721420 - RNA, 20 nt, Human
gcuugaccgugaggccagag

SEQ ID NO: 1721421 - RNA, 17 nt, Human
gcuuguaaauagcucag

SEQ ID NO: 1721422 - RNA, 22 nt, Human
gcuugaccuuuaagagaaauga

SEQ ID NO: 1721423 - RNA, 16 nt, Human
gcuugaccgugaggcc

SEQ ID NO: 1721424 - RNA, 18 nt, Human
gcuugaccuuuaagagaa

SEQ ID NO: 1721425 - RNA, 23 nt, Human
gcuugaccgugaggccagagaca

SEQ ID NO: 1721426 - RNA, 19 nt, Human
gcuuguaaauagcucaggu

SEQ ID NO: 1721427 - RNA, 18 nt, Human
gcuuguaaauagcucagg

SEQ ID NO: 1721428 - RNA, 21 nt, Human
gcuuuccccaugucucgacuc

SEQ ID NO: 1721429 - RNA, 22 nt, Human
gcuuuccccaugucucgacuca

SEQ ID NO: 1721430 - RNA, 16 nt, Human
gcuuuccucuuccuga

SEQ ID NO: 1721431 - RNA, 22 nt, Human
gcuuccagugaggcucugcccu

SEQ ID NO: 1721432 - RNA, 14 nt, Human
ggaaaugggcagag

SEQ ID NO: 1721433 - RNA, 22 nt, Human
ggaaaugggcagagcagagacc

SEQ ID NO: 1721434 - RNA, 18 nt, Human
ggaaaugggcagagcaga

SEQ ID NO: 1721435 - RNA, 17 nt, Human
ggaaaugggcagagcag

SEQ ID NO: 1721436 - RNA, 16 nt, Human
ggaaaugggcagagca

SEQ ID NO: 1721437 - RNA, 21 nt, Human
ggaacaaggcaaggcugucaa

SEQ ID NO: 1721438 - RNA, 17 nt, Human
ggaacaaggcaaggcug

SEQ ID NO: 1721439 - RNA, 15 nt, Human
ggaacaaggcaaggc

SEQ ID NO: 1721440 - RNA, 17 nt, Human
ggaaaugucaacaagua

SEQ ID NO: 1721441 - RNA, 19 nt, Human
ggaacacuccuucacagau

SEQ ID NO: 1721442 - RNA, 17 nt, Human
ggaacugaacauuccag

SEQ ID NO: 1721443 - RNA, 15 nt, Human
ggaacacuccuucac

SEQ ID NO: 1721444 - RNA, 23 nt, Human
ggaacaaggcaaggcugucaauu

SEQ ID NO: 1721445 - RNA, 13 nt, Human
ggaacaccuccuc

SEQ ID NO: 1721446 - RNA, 17 nt, Human
ggaacaccauaggucac

SEQ ID NO: 1721447 - RNA, 16 nt, Human
ggaagacaaugugaaa

SEQ ID NO: 1721448 - RNA, 14 nt, Human
ggaagacaauguga

SEQ ID NO: 1721449 - RNA, 12 nt, Human
ggaagacuuugg

SEQ ID NO: 1721450 - RNA, 20 nt, Human
ggaagacuucaucccucugg

SEQ ID NO: 1721451 - RNA, 17 nt, Human
ggaagacuucaucccuc

SEQ ID NO: 1721452 - RNA, 22 nt, Human
ggaagacaaugugaaaagaaaa

SEQ ID NO: 1721453 - RNA, 18 nt, Human
gcuuuugucuaugggacu

SEQ ID NO: 1721454 - RNA, 15 nt, Human
gcuuuuggucugugu

SEQ ID NO: 1721455 - RNA, 12 nt, Human
gcuuuugugcau

SEQ ID NO: 1721456 - RNA, 20 nt, Human
gcuuuuuuaucaugugaaau

SEQ ID NO: 1721457 - RNA, 18 nt, Human
gcuuuuuuaucaugugaa

SEQ ID NO: 1721458 - RNA, 15 nt, Human
gcuuuuuuaucaugu

SEQ ID NO: 1721459 - RNA, 16 nt, Human
ggaaacccagcucugg

SEQ ID NO: 1721460 - RNA, 18 nt, Human
ggaaaauuuuaaaaauac

SEQ ID NO: 1721461 - RNA, 17 nt, Human
gcuuugaucccuucuua

SEQ ID NO: 1721462 - RNA, 14 nt, Human
gcuuugaucccuuc

SEQ ID NO: 1721463 - RNA, 16 nt, Human
gccauaugaaaaggcu

SEQ ID NO: 1721464 - RNA, 21 nt, Human
gccaguuggucccccuuccau

SEQ ID NO: 1721465 - RNA, 20 nt, Human
gccaguuggucccccuucca

SEQ ID NO: 1721466 - RNA, 18 nt, Human
gccaguuggucccccuuc

SEQ ID NO: 1721467 - RNA, 16 nt, Human
gccaguuggucccccu

SEQ ID NO: 1721468 - RNA, 23 nt, Human
gccaguuggucccccuuccaugg

SEQ ID NO: 1721469 - RNA, 22 nt, Human
gccaguuggucccccuuccaug

SEQ ID NO: 1721470 - RNA, 13 nt, Human
gccaguugguccc

SEQ ID NO: 1721471 - RNA, 13 nt, Human
gccagugugacaa

SEQ ID NO: 1721472 - RNA, 15 nt, Human
gccaggcccucugcc

SEQ ID NO: 1721473 - RNA, 14 nt, Human
gccaggcccucugc

SEQ ID NO: 1721474 - RNA, 13 nt, Human
gccaggcccucug

SEQ ID NO: 1721475 - RNA, 22 nt, Human
gccaggccagagggagugacag

SEQ ID NO: 1721476 - RNA, 15 nt, Human
gccaggccagaggga

SEQ ID NO: 1721477 - RNA, 21 nt, Human
gccaggccacaagacccuugu

SEQ ID NO: 1721478 - RNA, 18 nt, Human
gccaggccacaagacccu

SEQ ID NO: 1721479 - RNA, 13 nt, Human
gccaggccacaag

SEQ ID NO: 1721480 - RNA, 15 nt, Human
gccauguguuccaag

SEQ ID NO: 1721481 - RNA, 16 nt, Human
gccauguguuccaagg

SEQ ID NO: 1721482 - RNA, 14 nt, Human
gccaugugccaggu

SEQ ID NO: 1721483 - RNA, 13 nt, Human
gcccaggccccug

SEQ ID NO: 1721484 - RNA, 15 nt, Human
gcccaggccccugcc

SEQ ID NO: 1721485 - RNA, 16 nt, Human
gcccaggcaggucuug

SEQ ID NO: 1721486 - RNA, 14 nt, Human
gcccaggcaggucu

SEQ ID NO: 1721487 - RNA, 13 nt, Human
gcccaggcagguc

SEQ ID NO: 1721488 - RNA, 18 nt, Human
gcccaggccccugccacc

SEQ ID NO: 1721489 - RNA, 17 nt, Human
gcccaggccccugccac

SEQ ID NO: 1721490 - RNA, 15 nt, Human
gccccuggaugcagc

SEQ ID NO: 1721491 - RNA, 16 nt, Human
gcccucacccuggggc

SEQ ID NO: 1721492 - RNA, 17 nt, Human
gcccucacccuggggcu

SEQ ID NO: 1721493 - RNA, 22 nt, Human
gccccugcugguucaggguugg

SEQ ID NO: 1721494 - RNA, 18 nt, Human
gccccugccucucugcag

SEQ ID NO: 1721495 - RNA, 17 nt, Human
gccccugccucucugca

SEQ ID NO: 1721496 - RNA, 16 nt, Human
gccccugccucucugc

SEQ ID NO: 1721497 - RNA, 15 nt, Human
gccccugccucucug

SEQ ID NO: 1721498 - RNA, 20 nt, Human
gcgugguggacaugcacagc

SEQ ID NO: 1721499 - RNA, 14 nt, Human
gcgugcacacacca

SEQ ID NO: 1721500 - RNA, 18 nt, Human
gcgugcacacaccagagc

SEQ ID NO: 1721501 - RNA, 19 nt, Human
gcgugcacacaccagagcc

SEQ ID NO: 1721502 - RNA, 16 nt, Human
gcggccuuuggcuuca

SEQ ID NO: 1721503 - RNA, 17 nt, Human
gcguuucuaugacacau

SEQ ID NO: 1721504 - RNA, 16 nt, Human
gcuaauuuuucauuuu

SEQ ID NO: 1721505 - RNA, 18 nt, Human
gcuaauuuugaaaaacug

SEQ ID NO: 1721506 - RNA, 17 nt, Human
gcuacuugggaggcuga

SEQ ID NO: 1721507 - RNA, 11 nt, Human
gcuagaaauga

SEQ ID NO: 1721508 - RNA, 19 nt, Human
gcuacuguaaggcaaucau

SEQ ID NO: 1721509 - RNA, 18 nt, Human
gcuacuguaaggcaauca

SEQ ID NO: 1721510 - RNA, 20 nt, Human
gcuacuguccuacccacccu

SEQ ID NO: 1721511 - RNA, 19 nt, Human
gcuacuguccuacccaccc

SEQ ID NO: 1721512 - RNA, 14 nt, Human
gcgauucuucugcu

SEQ ID NO: 1721513 - RNA, 17 nt, Human
gcgauucuucugcuuca

SEQ ID NO: 1721514 - RNA, 13 nt, Human
gcgauucuucugc

SEQ ID NO: 1721515 - RNA, 16 nt, Human
gccuccauccugaggc

SEQ ID NO: 1721516 - RNA, 20 nt, Human
gccuccauccugaggcucca

SEQ ID NO: 1721517 - RNA, 21 nt, Human
gccuccuuugugaggaagccg

SEQ ID NO: 1721518 - RNA, 20 nt, Human
gccuccuuugugaggaagcc

SEQ ID NO: 1721519 - RNA, 19 nt, Human
gccuccuuugugaggaagc

SEQ ID NO: 1721520 - RNA, 11 nt, Human
gccuccaugcu

SEQ ID NO: 1721521 - RNA, 17 nt, Human
gccuccaagcuccaucu

SEQ ID NO: 1721522 - RNA, 22 nt, Human
gccuccaauuuuuuaagugaaa

SEQ ID NO: 1721523 - RNA, 13 nt, Human
gccugcuccagcu

SEQ ID NO: 1721524 - RNA, 23 nt, Human
gccugcuaauuccccagauugca

SEQ ID NO: 1721525 - RNA, 17 nt, Human
gccugcuaauuccccag

SEQ ID NO: 1721526 - RNA, 13 nt, Human
gccucggacuuag

SEQ ID NO: 1721527 - RNA, 14 nt, Human
cugacagaaggacu

SEQ ID NO: 1721528 - RNA, 15 nt, Human
cugacagacacaggc

SEQ ID NO: 1721529 - RNA, 14 nt, Human
cugacagacacagg

SEQ ID NO: 1721530 - RNA, 12 nt, Human
cugacagacaca

SEQ ID NO: 1721531 - RNA, 20 nt, Human
cugacccaugcugcccugug

SEQ ID NO: 1721532 - RNA, 19 nt, Human
cugacccaugcugcccugu

SEQ ID NO: 1721533 - RNA, 17 nt, Human
cugacccaugcugcccu

SEQ ID NO: 1721534 - RNA, 18 nt, Human
cugacccaugcugcccug

SEQ ID NO: 1721535 - RNA, 23 nt, Human
cugacccugcuucaaauauuucc

SEQ ID NO: 1721536 - RNA, 15 nt, Human
cugaccuuaaaugca

SEQ ID NO: 1721537 - RNA, 19 nt, Human
cugaccuuaaaugcaacca

SEQ ID NO: 1721538 - RNA, 16 nt, Human
cucuugccacugccuc

SEQ ID NO: 1721539 - RNA, 20 nt, Human
cucuugccacugccucuucc

SEQ ID NO: 1721540 - RNA, 19 nt, Human
cucuugccacugccucuuc

SEQ ID NO: 1721541 - RNA, 18 nt, Human
cucuugccacugccucuu

SEQ ID NO: 1721542 - RNA, 17 nt, Human
cucuugccacugccucu

SEQ ID NO: 1721543 - RNA, 18 nt, Human
cugaaggccccgcccagg

SEQ ID NO: 1721544 - RNA, 17 nt, Human
cugaaggccccgcccag

SEQ ID NO: 1721545 - RNA, 14 nt, Human
cugaaggccccgcc

SEQ ID NO: 1721546 - RNA, 13 nt, Human
cugaaggccccgc

SEQ ID NO: 1721547 - RNA, 21 nt, Human
cugaaggacauugcggacagc

SEQ ID NO: 1721548 - RNA, 20 nt, Human
cugaaggacauugcggacag

SEQ ID NO: 1721549 - RNA, 19 nt, Human
cugaaggacauugcggaca

SEQ ID NO: 1721550 - RNA, 16 nt, Human
cugaaaauguaugugu

SEQ ID NO: 1721551 - RNA, 22 nt, Human
cugaaggaauaaauugcuccuu

SEQ ID NO: 1721552 - RNA, 21 nt, Human
cucuguacagagcccacgccc

SEQ ID NO: 1721553 - RNA, 17 nt, Human
cucuguacagagcccac

SEQ ID NO: 1721554 - RNA, 20 nt, Human
cucugcugacagacacaggc

SEQ ID NO: 1721555 - RNA, 19 nt, Human
cucugcugacagacacagg

SEQ ID NO: 1721556 - RNA, 18 nt, Human
cucugcugacagacacag

SEQ ID NO: 1721557 - RNA, 17 nt, Human
cucugcugacagacaca

SEQ ID NO: 1721558 - RNA, 18 nt, Human
cucugguccauagagagc

SEQ ID NO: 1721559 - RNA, 16 nt, Human
cucugguccauagaga

SEQ ID NO: 1721560 - RNA, 19 nt, Human
cucugguccauagagagca

SEQ ID NO: 1721561 - RNA, 14 nt, Human
cucugguuccuccc

SEQ ID NO: 1721562 - RNA, 23 nt, Human
cucugcagcaauaaagcagcguu

SEQ ID NO: 1721563 - RNA, 18 nt, Human
cucugcagcaauaaagca

SEQ ID NO: 1721564 - RNA, 19 nt, Human
cucugcagcaauaaagcag

SEQ ID NO: 1721565 - RNA, 14 nt, Human
cucugcacuccccu

SEQ ID NO: 1721566 - RNA, 14 nt, Human
cucucacuccuuga

SEQ ID NO: 1721567 - RNA, 12 nt, Human
cucucacuccuu

SEQ ID NO: 1721568 - RNA, 19 nt, Human
cucucagauuguaccauug

SEQ ID NO: 1721569 - RNA, 15 nt, Human
cucucacuccuugaa

SEQ ID NO: 1721570 - RNA, 12 nt, Human
cucucuggccuu

SEQ ID NO: 1721571 - RNA, 11 nt, Human
cucucuggccu

SEQ ID NO: 1721572 - RNA, 12 nt, Human
cucuccuccaga

SEQ ID NO: 1721573 - RNA, 15 nt, Human
cucugaaggacauug

SEQ ID NO: 1721574 - RNA, 20 nt, Human
cucgggauuaguacacacuu

SEQ ID NO: 1721575 - RNA, 21 nt, Human
cuccagugagacagcucugca

SEQ ID NO: 1721576 - RNA, 13 nt, Human
cucccaccucagc

SEQ ID NO: 1721577 - RNA, 12 nt, Human
cucccaccucag

SEQ ID NO: 1721578 - RNA, 19 nt, Human
cuccgcuuucuacccagcg

SEQ ID NO: 1721579 - RNA, 19 nt, Human
cuccagacacauguccaag

SEQ ID NO: 1721580 - RNA, 17 nt, Human
cuccagacacaugucca

SEQ ID NO: 1721581 - RNA, 21 nt, Human
cuccagaauuucccaaagcag

SEQ ID NO: 1721582 - RNA, 18 nt, Human
cuccagaauuucccaaag

SEQ ID NO: 1721583 - RNA, 15 nt, Human
cuccagaauuuccca

SEQ ID NO: 1721584 - RNA, 22 nt, Human
cuccacuuucuagccagaggag

SEQ ID NO: 1721585 - RNA, 21 nt, Human
cuccaagaccuucuccuucac

SEQ ID NO: 1721586 - RNA, 18 nt, Human
cuccaagaccuucuccuu

SEQ ID NO: 1721587 - RNA, 17 nt, Human
cuccaagaccuucuccu

SEQ ID NO: 1721588 - RNA, 16 nt, Human
cuccaagaccuucucc

SEQ ID NO: 1721589 - RNA, 14 nt, Human
cuccagaccccugg

SEQ ID NO: 1721590 - RNA, 11 nt, Human
cuccaggugca

SEQ ID NO: 1721591 - RNA, 21 nt, Human
cucaggccugggggcugggca

SEQ ID NO: 1721592 - RNA, 20 nt, Human
cucaggccugggggcugggc

SEQ ID NO: 1721593 - RNA, 14 nt, Human
cucaggccuggggg

SEQ ID NO: 1721594 - RNA, 22 nt, Human
cucaggccagcugcuugggcuu

SEQ ID NO: 1721595 - RNA, 21 nt, Human
cucaggccagcugcuugggcu

SEQ ID NO: 1721596 - RNA, 15 nt, Human
cucaggccagcugcu

SEQ ID NO: 1721597 - RNA, 14 nt, Human
cucaggccagcugc

SEQ ID NO: 1721598 - RNA, 13 nt, Human
cucagcggggaca

SEQ ID NO: 1721599 - RNA, 14 nt, Human
cucagcgaaugaau

SEQ ID NO: 1721600 - RNA, 13 nt, Human
cucaggccagcug

SEQ ID NO: 1721601 - RNA, 13 nt, Human
cucagccuccuga

SEQ ID NO: 1721602 - RNA, 12 nt, Human
cucagccuccug

SEQ ID NO: 1721603 - RNA, 14 nt, Human
cucagccuccugag

SEQ ID NO: 1721604 - RNA, 22 nt, Human
cucagccuccugaguagcugga

SEQ ID NO: 1721605 - RNA, 13 nt, Human
cucagccucccaa

SEQ ID NO: 1721606 - RNA, 16 nt, Human
cuaucccggcugcccu

SEQ ID NO: 1721607 - RNA, 15 nt, Human
cuaucccggcugccc

SEQ ID NO: 1721608 - RNA, 16 nt, Human
cucagccucccaaagu

SEQ ID NO: 1721609 - RNA, 14 nt, Human
cucagccucccaaa

SEQ ID NO: 1721610 - RNA, 21 nt, Human
cucagccucccaaagugcugg

SEQ ID NO: 1721611 - RNA, 17 nt, Human
cuaucccggcugcccuu

SEQ ID NO: 1721612 - RNA, 23 nt, Human
cucagccucccgaauagcuggga

SEQ ID NO: 1721613 - RNA, 13 nt, Human
cucagccucccga

SEQ ID NO: 1721614 - RNA, 22 nt, Human
cucagccucccaaagugcuggg

SEQ ID NO: 1721615 - RNA, 18 nt, Human
cucagucuggcccuuccu

SEQ ID NO: 1721616 - RNA, 17 nt, Human
cucagucuggcccuucc

SEQ ID NO: 1721617 - RNA, 13 nt, Human
cucagugccacua

SEQ ID NO: 1721618 - RNA, 20 nt, Human
cucagucuggcccuuccuuu

SEQ ID NO: 1721619 - RNA, 12 nt, Human
cucauguucuua

SEQ ID NO: 1721620 - RNA, 14 nt, Human
cucauguucuuaau

SEQ ID NO: 1721621 - RNA, 18 nt, Human
cucauguucuuaauucuu

SEQ ID NO: 1721622 - RNA, 19 nt, Human
cucauguucuuaauucuua

SEQ ID NO: 1721623 - RNA, 20 nt, Human
cucaugccucagccuccuga

SEQ ID NO: 1721624 - RNA, 18 nt, Human
cucaugccucagccuccu

SEQ ID NO: 1721625 - RNA, 16 nt, Human
cuccaaagucucugga

SEQ ID NO: 1721626 - RNA, 12 nt, Human
ccuuuuuuauac

SEQ ID NO: 1721627 - RNA, 15 nt, Human
cgacagugagacucu

SEQ ID NO: 1721628 - RNA, 16 nt, Human
cgacagugagacucug

SEQ ID NO: 1721629 - RNA, 17 nt, Human
ccuuuuuuauacauaaa

SEQ ID NO: 1721630 - RNA, 18 nt, Human
ccuuuuuuauacauaaac

SEQ ID NO: 1721631 - RNA, 23 nt, Human
cgaccagacaccuugacagggca

SEQ ID NO: 1721632 - RNA, 14 nt, Human
cgaccaccugccca

SEQ ID NO: 1721633 - RNA, 12 nt, Human
cgaccaccugcc

SEQ ID NO: 1721634 - RNA, 19 nt, Human
ccuuuuuuauacauaaaca

SEQ ID NO: 1721635 - RNA, 20 nt, Human
ccuuuagcgcccaguugggu

SEQ ID NO: 1721636 - RNA, 14 nt, Human
ccuuuagcgcccag

SEQ ID NO: 1721637 - RNA, 20 nt, Human
ccuugccgucuaccugaggg

SEQ ID NO: 1721638 - RNA, 17 nt, Human
ccuugccgucuaccuga

SEQ ID NO: 1721639 - RNA, 20 nt, Human
ccuucugacccaugcugccc

SEQ ID NO: 1721640 - RNA, 17 nt, Human
ccuucugacccaugcug

SEQ ID NO: 1721641 - RNA, 16 nt, Human
ccuucugacccaugcu

SEQ ID NO: 1721642 - RNA, 12 nt, Human
ccuucugaccca

SEQ ID NO: 1721643 - RNA, 15 nt, Human
ccuggccugagcugg

SEQ ID NO: 1721644 - RNA, 14 nt, Human
ccuggccugagcug

SEQ ID NO: 1721645 - RNA, 20 nt, Human
ccuggccugagcugggauga

SEQ ID NO: 1721646 - RNA, 20 nt, Human
ccuucugaaaaaguauccug

SEQ ID NO: 1721647 - RNA, 22 nt, Human
ccuucugacccaugcugcccug

SEQ ID NO: 1721648 - RNA, 21 nt, Human
ccuucugacccaugcugcccu

SEQ ID NO: 1721649 - RNA, 23 nt, Human
ccuucugacccaugcugcccugu

SEQ ID NO: 1721650 - RNA, 22 nt, Human
ccuucuggaauaaggagaauga

SEQ ID NO: 1721651 - RNA, 18 nt, Human
cggcucacugcagccuca

SEQ ID NO: 1721652 - RNA, 17 nt, Human
cggcucacugcauccuc

SEQ ID NO: 1721653 - RNA, 19 nt, Human
cggcucacugcagccucaa

SEQ ID NO: 1721654 - RNA, 21 nt, Human
cggcucacugcauccuccgcc

SEQ ID NO: 1721655 - RNA, 14 nt, Human
cggagucccaccuu

SEQ ID NO: 1721656 - RNA, 18 nt, Human
cggaggggccuggcagcc

SEQ ID NO: 1721657 - RNA, 16 nt, Human
cggaggggccuggcag

SEQ ID NO: 1721658 - RNA, 16 nt, Human
cgaguagcugggacua

SEQ ID NO: 1721659 - RNA, 15 nt, Human
cgaguagcugggacu

SEQ ID NO: 1721660 - RNA, 14 nt, Human
cgaguagcugggac

SEQ ID NO: 1721661 - RNA, 13 nt, Human
cgaguagcuggga

SEQ ID NO: 1721662 - RNA, 18 nt, Human
cgaguuacagacaaagcg

SEQ ID NO: 1721663 - RNA, 17 nt, Human
cgaguuacagacaaagc

SEQ ID NO: 1721664 - RNA, 12 nt, Human
cgccaaggcugg

SEQ ID NO: 1721665 - RNA, 20 nt, Human
cgcaggcuggcccugcccug

SEQ ID NO: 1721666 - RNA, 19 nt, Human
cgcaggcuggcccugcccu

SEQ ID NO: 1721667 - RNA, 18 nt, Human
cgcaggcuggcccugccc

SEQ ID NO: 1721668 - RNA, 17 nt, Human
cgcaggcuggcccugcc

SEQ ID NO: 1721669 - RNA, 15 nt, Human
cgcaggcuggcccug

SEQ ID NO: 1721670 - RNA, 14 nt, Human
cgcaggcuggcccu

SEQ ID NO: 1721671 - RNA, 16 nt, Human
cgccaaggcuggggga

SEQ ID NO: 1721672 - RNA, 13 nt, Human
cgccaaggcuggg

SEQ ID NO: 1721673 - RNA, 23 nt, Human
cgccaaggcugggggaagaagcu

SEQ ID NO: 1721674 - RNA, 14 nt, Human
cgccuacaggagug

SEQ ID NO: 1721675 - RNA, 16 nt, Human
cgaccugccucggccu

SEQ ID NO: 1721676 - RNA, 22 nt, Human
cuaguuccaccaucaagccacc

SEQ ID NO: 1721677 - RNA, 20 nt, Human
cuaguuccaccaucaagcca

SEQ ID NO: 1721678 - RNA, 18 nt, Human
cuaguuccaccaucaagc

SEQ ID NO: 1721679 - RNA, 21 nt, Human
cuagggaaaaaccagcgugug

SEQ ID NO: 1721680 - RNA, 19 nt, Human
cuagggaaaaaccagcgug

SEQ ID NO: 1721681 - RNA, 16 nt, Human
cuagaacucccuuuca

SEQ ID NO: 1721682 - RNA, 17 nt, Human
cuagaacucccuuucaa

SEQ ID NO: 1721683 - RNA, 18 nt, Human
cuagaacucccuuucaac

SEQ ID NO: 1721684 - RNA, 19 nt, Human
cuagaacucccuuucaaca

SEQ ID NO: 1721685 - RNA, 22 nt, Human
cuagcagcagggagggcuucug

SEQ ID NO: 1721686 - RNA, 15 nt, Human
cuagaacugaauuuu

SEQ ID NO: 1721687 - RNA, 17 nt, Human
cuagcauggcugccaau

SEQ ID NO: 1721688 - RNA, 23 nt, Human
cuagcagcagggagggcuucugc

SEQ ID NO: 1721689 - RNA, 19 nt, Human
cuagcauuucccaacacaa

SEQ ID NO: 1721690 - RNA, 19 nt, Human
cuagaaauuccccacccug

SEQ ID NO: 1721691 - RNA, 14 nt, Human
cuaccugaggggcc

SEQ ID NO: 1721692 - RNA, 11 nt, Human
cuaccugaggg

SEQ ID NO: 1721693 - RNA, 15 nt, Human
cuaccugaggggccu

SEQ ID NO: 1721694 - RNA, 18 nt, Human
cuacauacaauuccaaac

SEQ ID NO: 1721695 - RNA, 15 nt, Human
cuacaugagguacug

SEQ ID NO: 1721696 - RNA, 19 nt, Human
cuacaguugaaaaacagcu

SEQ ID NO: 1721697 - RNA, 20 nt, Human
cuacaguguacagucuugua

SEQ ID NO: 1721698 - RNA, 13 nt, Human
cuacaguugaaaa

SEQ ID NO: 1721699 - RNA, 15 nt, Human
cuacaguguacaguc

SEQ ID NO: 1721700 - RNA, 16 nt, Human
cuacaguguacagucu

SEQ ID NO: 1721701 - RNA, 17 nt, Human
cuacaguguacagucuu

SEQ ID NO: 1721702 - RNA, 18 nt, Human
cuacaguccucccaucuc

SEQ ID NO: 1721703 - RNA, 17 nt, Human
cuacaguccucccaucu

SEQ ID NO: 1721704 - RNA, 16 nt, Human
cuacaguccucccauc

SEQ ID NO: 1721705 - RNA, 15 nt, Human
cuacaguccucccau

SEQ ID NO: 1721706 - RNA, 15 nt, Human
cuacaagacacagug

SEQ ID NO: 1721707 - RNA, 22 nt, Human
cuaagugauccucccaccucag

SEQ ID NO: 1721708 - RNA, 20 nt, Human
cuaagugauccucccaccuc

SEQ ID NO: 1721709 - RNA, 18 nt, Human
cuaagugaggaugaaaaa

SEQ ID NO: 1721710 - RNA, 20 nt, Human
cuaagugaaauaagccagac

SEQ ID NO: 1721711 - RNA, 23 nt, Human
cuaagugaaauaagccagacauc

SEQ ID NO: 1721712 - RNA, 23 nt, Human
cuaaacugcccccucugcccugc

SEQ ID NO: 1721713 - RNA, 22 nt, Human
cuaaacugcccccucugcccug

SEQ ID NO: 1721714 - RNA, 23 nt, Human
cgugagccaccgugccuggccac

SEQ ID NO: 1721715 - RNA, 16 nt, Human
cgugagaccugccccu

SEQ ID NO: 1721716 - RNA, 14 nt, Human
cgugagaccugccc

SEQ ID NO: 1721717 - RNA, 13 nt, Human
cgugagaccugcc

SEQ ID NO: 1721718 - RNA, 17 nt, Human
cggcucuggccuccaag

SEQ ID NO: 1721719 - RNA, 15 nt, Human
cuaacuucaccauau

SEQ ID NO: 1721720 - RNA, 16 nt, Human
cuaacuucaccauauu

SEQ ID NO: 1721721 - RNA, 16 nt, Human
ccguagguuauuuuca

SEQ ID NO: 1721722 - RNA, 19 nt, Human
ccggcuaauuuuuguauuu

SEQ ID NO: 1721723 - RNA, 17 nt, Human
ccggcuaugggggcacu

SEQ ID NO: 1721724 - RNA, 23 nt, Human
ccggcuaugggggcacugaggac

SEQ ID NO: 1721725 - RNA, 22 nt, Human
ccggcuaugggggcacugagga

SEQ ID NO: 1721726 - RNA, 12 nt, Human
ccggcuccaggc

SEQ ID NO: 1721727 - RNA, 23 nt, Human
ccuaauaaagcuguguggcaguc

SEQ ID NO: 1721728 - RNA, 14 nt, Human
ccuaauaaagcugu

SEQ ID NO: 1721729 - RNA, 18 nt, Human
ccgucucugguuccuccc

SEQ ID NO: 1721730 - RNA, 23 nt, Human
ccuaggcauuugcugaauacaga

SEQ ID NO: 1721731 - RNA, 15 nt, Human
ccucauguccacugg

SEQ ID NO: 1721732 - RNA, 13 nt, Human
ccucagccuccug

SEQ ID NO: 1721733 - RNA, 22 nt, Human
ccucagccucccgaauagcugg

SEQ ID NO: 1721734 - RNA, 23 nt, Human
ccucagccucccaaagugcuggg

SEQ ID NO: 1721735 - RNA, 20 nt, Human
ccucauguccacugguucuu

SEQ ID NO: 1721736 - RNA, 14 nt, Human
ccucagccuccuga

SEQ ID NO: 1721737 - RNA, 13 nt, Human
ccucauguucuua

SEQ ID NO: 1721738 - RNA, 18 nt, Human
ccucauuagcauuuugcu

SEQ ID NO: 1721739 - RNA, 22 nt, Human
ccuccaagcuccaucuccacuc

SEQ ID NO: 1721740 - RNA, 21 nt, Human
ccuccaagcuccaucuccacu

SEQ ID NO: 1721741 - RNA, 19 nt, Human
ccucauguucuuaauucuu

SEQ ID NO: 1721742 - RNA, 22 nt, Human
ccucccaaggggcccaaauucu

SEQ ID NO: 1721743 - RNA, 22 nt, Human
ccuccaaucccaccaacccuca

SEQ ID NO: 1721744 - RNA, 18 nt, Human
ccuccaaguccacagugg

SEQ ID NO: 1721745 - RNA, 21 nt, Human
ccuccaaguccacaguggaac

SEQ ID NO: 1721746 - RNA, 20 nt, Human
ccucccaggcgccccuuccc

SEQ ID NO: 1721747 - RNA, 14 nt, Human
ccucccaggcgccc

SEQ ID NO: 1721748 - RNA, 22 nt, Human
ccucagccucccaaagugcugg

SEQ ID NO: 1721749 - RNA, 11 nt, Human
ccucagccucc

SEQ ID NO: 1721750 - RNA, 15 nt, Human
ccucaagagaaggca

SEQ ID NO: 1721751 - RNA, 15 nt, Human
ccucaacucuccucc

SEQ ID NO: 1721752 - RNA, 15 nt, Human
ccuauuuuaauaaac

SEQ ID NO: 1721753 - RNA, 16 nt, Human
cccuggcagccccugu

SEQ ID NO: 1721754 - RNA, 14 nt, Human
cccuggcagccccu

SEQ ID NO: 1721755 - RNA, 19 nt, Human
cccuggcucccacaggccc

SEQ ID NO: 1721756 - RNA, 17 nt, Human
cccuggcucccacaggc

SEQ ID NO: 1721757 - RNA, 17 nt, Human
cccuggcuuuucacugc

SEQ ID NO: 1721758 - RNA, 13 nt, Human
cccuggcuuuuca

SEQ ID NO: 1721759 - RNA, 13 nt, Human
cccugcccugugg

SEQ ID NO: 1721760 - RNA, 12 nt, Human
cccugcccugug

SEQ ID NO: 1721761 - RNA, 15 nt, Human
cccucacccuggggc

SEQ ID NO: 1721762 - RNA, 20 nt, Human
cccugcccugugggccccca

SEQ ID NO: 1721763 - RNA, 16 nt, Human
cccugcccugugggcc

SEQ ID NO: 1721764 - RNA, 15 nt, Human
cccugcccugugggc

SEQ ID NO: 1721765 - RNA, 14 nt, Human
cccugcccuguggg

SEQ ID NO: 1721766 - RNA, 13 nt, Human
cccuggcagcccc

SEQ ID NO: 1721767 - RNA, 12 nt, Human
cccuggcagccc

SEQ ID NO: 1721768 - RNA, 21 nt, Human
cccugcccugugggcccccaa

SEQ ID NO: 1721769 - RNA, 20 nt, Human
ccgaauagcugggacuacag

SEQ ID NO: 1721770 - RNA, 17 nt, Human
ccgccaaggcuggggga

SEQ ID NO: 1721771 - RNA, 16 nt, Human
ccgacccuugccgucu

SEQ ID NO: 1721772 - RNA, 20 nt, Human
ccgcccaggcuuagucacug

SEQ ID NO: 1721773 - RNA, 16 nt, Human
ccgccaugcuccuggc

SEQ ID NO: 1721774 - RNA, 18 nt, Human
cccuucgcuccugugucu

SEQ ID NO: 1721775 - RNA, 16 nt, Human
cccuucgcuccugugu

SEQ ID NO: 1721776 - RNA, 16 nt, Human
cccuucuaccuuccug

SEQ ID NO: 1721777 - RNA, 23 nt, Human
cccuucugacccaugcugcccug

SEQ ID NO: 1721778 - RNA, 22 nt, Human
cccuucugacccaugcugcccu

SEQ ID NO: 1721779 - RNA, 21 nt, Human
cccuucugacccaugcugccc

SEQ ID NO: 1721780 - RNA, 18 nt, Human
ccucugcugcuggcuggu

SEQ ID NO: 1721781 - RNA, 17 nt, Human
ccucugcugcuggcugg

SEQ ID NO: 1721782 - RNA, 16 nt, Human
ccucugcugcuggcug

SEQ ID NO: 1721783 - RNA, 15 nt, Human
ccucugcugcuggcu

SEQ ID NO: 1721784 - RNA, 14 nt, Human
ccucugcugcuggc

SEQ ID NO: 1721785 - RNA, 13 nt, Human
ccucugcugcugg

SEQ ID NO: 1721786 - RNA, 18 nt, Human
ccucugcugauccuccca

SEQ ID NO: 1721787 - RNA, 15 nt, Human
ccucugcugauccuc

SEQ ID NO: 1721788 - RNA, 22 nt, Human
ccucugccugaagucacacagu

SEQ ID NO: 1721789 - RNA, 12 nt, Human
ccucugccuguc

SEQ ID NO: 1721790 - RNA, 22 nt, Human
ccucucugcaggucccuaauaa

SEQ ID NO: 1721791 - RNA, 21 nt, Human
ccucucugcaggucccuaaua

SEQ ID NO: 1721792 - RNA, 23 nt, Human
ccucucugcaggucccuaauaaa

SEQ ID NO: 1721793 - RNA, 12 nt, Human
ccucucugcccu

SEQ ID NO: 1721794 - RNA, 12 nt, Human
ccucucucaggc

SEQ ID NO: 1721795 - RNA, 17 nt, Human
ccucucucacuccuuga

SEQ ID NO: 1721796 - RNA, 15 nt, Human
ccucucucacuccuu

SEQ ID NO: 1721797 - RNA, 14 nt, Human
ccucucucacuccu

SEQ ID NO: 1721798 - RNA, 13 nt, Human
ccucucucacucc

SEQ ID NO: 1721799 - RNA, 14 nt, Human
ccucucucaggcca

SEQ ID NO: 1721800 - RNA, 15 nt, Human
ccucucugcaggucc

SEQ ID NO: 1721801 - RNA, 13 nt, Human
ccucucugcaggu

SEQ ID NO: 1721802 - RNA, 22 nt, Human
ccugcacuugcagacucuacag

SEQ ID NO: 1721803 - RNA, 20 nt, Human
ccugaguagcuggauuacag

SEQ ID NO: 1721804 - RNA, 15 nt, Human
ccugaguagcuggau

SEQ ID NO: 1721805 - RNA, 19 nt, Human
ccugaguagcuggauuaca

SEQ ID NO: 1721806 - RNA, 13 nt, Human
ccucuugagccuu

SEQ ID NO: 1721807 - RNA, 19 nt, Human
ccucuugagccuugaacuu

SEQ ID NO: 1721808 - RNA, 13 nt, Human
ccucuuggguuca

SEQ ID NO: 1721809 - RNA, 14 nt, Human
ccucuugccacugc

SEQ ID NO: 1721810 - RNA, 15 nt, Human
ccuggccucugcacu

SEQ ID NO: 1721811 - RNA, 14 nt, Human
ccuggccucugcac

SEQ ID NO: 1721812 - RNA, 13 nt, Human
ccuggccugagcu

SEQ ID NO: 1721813 - RNA, 16 nt, Human
ccuggccucugcacuc

SEQ ID NO: 1721814 - RNA, 12 nt, Human
ccuggccucugc

SEQ ID NO: 1721815 - RNA, 18 nt, Human
ccuggcacccggccccug

SEQ ID NO: 1721816 - RNA, 18 nt, Human
ccuggcacagggcagugg

SEQ ID NO: 1721817 - RNA, 17 nt, Human
ccuggcacagggcagug

SEQ ID NO: 1721818 - RNA, 16 nt, Human
ccuggcacagggcagu

SEQ ID NO: 1721819 - RNA, 13 nt, Human
ccuggaugcagcc

SEQ ID NO: 1721820 - RNA, 21 nt, Human
ccuggauccaucaggccacuu

SEQ ID NO: 1721821 - RNA, 17 nt, Human
ccuggaugcagccucac

SEQ ID NO: 1721822 - RNA, 14 nt, Human
ccuggaugcagccu

SEQ ID NO: 1721823 - RNA, 19 nt, Human
ccuggaugcagccucacag

SEQ ID NO: 1721824 - RNA, 17 nt, Human
ccuggaguucugguucc

SEQ ID NO: 1721825 - RNA, 16 nt, Human
ccuggaguucugguuc

SEQ ID NO: 1721826 - RNA, 15 nt, Human
ccuggaguucugguu

SEQ ID NO: 1721827 - RNA, 18 nt, Human
ccugcccaggccccugcc

SEQ ID NO: 1721828 - RNA, 16 nt, Human
ccugcccaggccccug

SEQ ID NO: 1721829 - RNA, 15 nt, Human
ccugcccaggccccu

SEQ ID NO: 1721830 - RNA, 14 nt, Human
ccugcccaggcccc

SEQ ID NO: 1721831 - RNA, 20 nt, Human
ccugcuggguguggcgcagc

SEQ ID NO: 1721832 - RNA, 14 nt, Human
ccugcugggugugg

SEQ ID NO: 1721833 - RNA, 21 nt, Human
ccugcuggguguggcgcagca

SEQ ID NO: 1721834 - RNA, 12 nt, Human
ccugcugggugu

SEQ ID NO: 1721835 - RNA, 23 nt, Human
ccccaaaacucuccucugcugcu

SEQ ID NO: 1721836 - RNA, 22 nt, Human
cccauuguggucacaggaagua

SEQ ID NO: 1721837 - RNA, 23 nt, Human
cccauuguggucacaggaaguag

SEQ ID NO: 1721838 - RNA, 22 nt, Human
ccccaaaacucuccucugcugc

SEQ ID NO: 1721839 - RNA, 22 nt, Human
ccccagcaagugagagcugggu

SEQ ID NO: 1721840 - RNA, 13 nt, Human
ccccagaggcugg

SEQ ID NO: 1721841 - RNA, 22 nt, Human
cccccaaauggaaaugggcaga

SEQ ID NO: 1721842 - RNA, 23 nt, Human
ccccgacccuugccgucuaccug

SEQ ID NO: 1721843 - RNA, 23 nt, Human
ccccgaggccuucucugaaggac

SEQ ID NO: 1721844 - RNA, 23 nt, Human
cccgggaggcagagguugcagug

SEQ ID NO: 1721845 - RNA, 18 nt, Human
cccuauuagagaagagau

SEQ ID NO: 1721846 - RNA, 17 nt, Human
cccuauugguaaagaau

SEQ ID NO: 1721847 - RNA, 17 nt, Human
cccggccaccugcggug

SEQ ID NO: 1721848 - RNA, 16 nt, Human
cccggcuccaggcucc

SEQ ID NO: 1721849 - RNA, 15 nt, Human
cccggcuccaggcuc

SEQ ID NO: 1721850 - RNA, 14 nt, Human
cccggcuccaggcu

SEQ ID NO: 1721851 - RNA, 13 nt, Human
cccggcuccaggc

SEQ ID NO: 1721852 - RNA, 12 nt, Human
cccggcuccagg

SEQ ID NO: 1721853 - RNA, 14 nt, Human
cccggccaccugcg

SEQ ID NO: 1721854 - RNA, 13 nt, Human
cccggccaccugc

SEQ ID NO: 1721855 - RNA, 14 nt, Human
cccgaauagcuggg

SEQ ID NO: 1721856 - RNA, 19 nt, Human
ccccucuggcuccagcugg

SEQ ID NO: 1721857 - RNA, 20 nt, Human
cccauauuuguacaccaaua

SEQ ID NO: 1721858 - RNA, 17 nt, Human
cccaggcuggcgugcag

SEQ ID NO: 1721859 - RNA, 13 nt, Human
cccaggcuggcgu

SEQ ID NO: 1721860 - RNA, 15 nt, Human
cccagcuugaaaccu

SEQ ID NO: 1721861 - RNA, 13 nt, Human
cccauccucugua

SEQ ID NO: 1721862 - RNA, 23 nt, Human
cccagcucugguccauagagagc

SEQ ID NO: 1721863 - RNA, 12 nt, Human
cccacucccugc

SEQ ID NO: 1721864 - RNA, 18 nt, Human
cccacuagacccacugga

SEQ ID NO: 1721865 - RNA, 13 nt, Human
cccacugcucugg

SEQ ID NO: 1721866 - RNA, 12 nt, Human
cccacugcucug

SEQ ID NO: 1721867 - RNA, 19 nt, Human
cccacugcuuuuggucugu

SEQ ID NO: 1721868 - RNA, 22 nt, Human
cccacugcuuuuggucugugug

SEQ ID NO: 1721869 - RNA, 22 nt, Human
cccacccaagggccuggccuga

SEQ ID NO: 1721870 - RNA, 21 nt, Human
cccacccaagggccuggccug

SEQ ID NO: 1721871 - RNA, 20 nt, Human
cccacccaagggccuggccu

SEQ ID NO: 1721872 - RNA, 15 nt, Human
cccacccccacccaa

SEQ ID NO: 1721873 - RNA, 17 nt, Human
cccacccccacccaagg

SEQ ID NO: 1721874 - RNA, 18 nt, Human
cccacccugaaagcccug

SEQ ID NO: 1721875 - RNA, 20 nt, Human
ccauggucggaaaacaugcu

SEQ ID NO: 1721876 - RNA, 23 nt, Human
ccaugagccucagcauccuggca

SEQ ID NO: 1721877 - RNA, 21 nt, Human
ccaugagccucagcauccugg

SEQ ID NO: 1721878 - RNA, 20 nt, Human
ccaucccugaaggccccgcc

SEQ ID NO: 1721879 - RNA, 17 nt, Human
ccaucccugaaggcccc

SEQ ID NO: 1721880 - RNA, 15 nt, Human
ccaucccugaaggcc

SEQ ID NO: 1721881 - RNA, 14 nt, Human
ccaucccugaaggc

SEQ ID NO: 1721882 - RNA, 15 nt, Human
ccaucccagccccaa

SEQ ID NO: 1721883 - RNA, 14 nt, Human
ccaucccagcccca

SEQ ID NO: 1721884 - RNA, 23 nt, Human
ccaguuggucccccuuccaugga

SEQ ID NO: 1721885 - RNA, 23 nt, Human
ccaguuggguggaugccuggugg

SEQ ID NO: 1721886 - RNA, 21 nt, Human
ccaguuguuagauuaagaaau

SEQ ID NO: 1721887 - RNA, 20 nt, Human
ccaguuggguggaugccugg

SEQ ID NO: 1721888 - RNA, 19 nt, Human
ccaguuggguggaugccug

SEQ ID NO: 1721889 - RNA, 17 nt, Human
ccaguuggguggaugcc

SEQ ID NO: 1721890 - RNA, 17 nt, Human
ccaggggugggacaccc

SEQ ID NO: 1721891 - RNA, 14 nt, Human
ccaggggugggaca

SEQ ID NO: 1721892 - RNA, 19 nt, Human
ccaggggugggacacccug

SEQ ID NO: 1721893 - RNA, 13 nt, Human
ccaggggugggac

SEQ ID NO: 1721894 - RNA, 20 nt, Human
ccaggggaaaaucagccugc

SEQ ID NO: 1721895 - RNA, 19 nt, Human
ccaggggaaaaucagccug

SEQ ID NO: 1721896 - RNA, 18 nt, Human
ccaggcuggcgugcagug

SEQ ID NO: 1721897 - RNA, 17 nt, Human
ccaggcuggcgugcagu

SEQ ID NO: 1721898 - RNA, 19 nt, Human
ccaggcuggcgugcagugg

SEQ ID NO: 1721899 - RNA, 21 nt, Human
ccaggcuccuuuagcgcccag

SEQ ID NO: 1721900 - RNA, 20 nt, Human
ccaggcuccuuuagcgccca

SEQ ID NO: 1721901 - RNA, 18 nt, Human
ccaggcacugcugcccag

SEQ ID NO: 1721902 - RNA, 16 nt, Human
ccaggcacugcugccc

SEQ ID NO: 1721903 - RNA, 15 nt, Human
ccagcaggcucucag

SEQ ID NO: 1721904 - RNA, 13 nt, Human
ccagcaggcucuc

SEQ ID NO: 1721905 - RNA, 16 nt, Human
ccagcuguucagcugg

SEQ ID NO: 1721906 - RNA, 22 nt, Human
ccagcucaccagccccagugcc

SEQ ID NO: 1721907 - RNA, 16 nt, Human
ccagcucaccagcccc

SEQ ID NO: 1721908 - RNA, 15 nt, Human
ccagcucaccagccc

SEQ ID NO: 1721909 - RNA, 19 nt, Human
ccagcuuaaaggggcuaga

SEQ ID NO: 1721910 - RNA, 16 nt, Human
ccagcuuaucucaggg

SEQ ID NO: 1721911 - RNA, 17 nt, Human
ccagcuguucagcuggu

SEQ ID NO: 1721912 - RNA, 12 nt, Human
ccagccccugga

SEQ ID NO: 1721913 - RNA, 11 nt, Human
ccagccccugg

SEQ ID NO: 1721914 - RNA, 13 nt, Human
ccaggaagccagc

SEQ ID NO: 1721915 - RNA, 14 nt, Human
ccaggaagccagca

SEQ ID NO: 1721916 - RNA, 12 nt, Human
ccaggaagccag

SEQ ID NO: 1721917 - RNA, 15 nt, Human
ccaggaaaggcucca

SEQ ID NO: 1721918 - RNA, 14 nt, Human
ccaggaaaggcucc

SEQ ID NO: 1721919 - RNA, 16 nt, Human
ccaggaaaggcuccag

SEQ ID NO: 1721920 - RNA, 19 nt, Human
ccagagggccugcaaggga

SEQ ID NO: 1721921 - RNA, 18 nt, Human
ccagagggccugcaaggg

SEQ ID NO: 1721922 - RNA, 17 nt, Human
ccagagggccugcaagg

SEQ ID NO: 1721923 - RNA, 16 nt, Human
ccaccuuggcucaagu

SEQ ID NO: 1721924 - RNA, 20 nt, Human
ccagagggccugcaagggag

SEQ ID NO: 1721925 - RNA, 15 nt, Human
ccagaugcaccagcc

SEQ ID NO: 1721926 - RNA, 17 nt, Human
ccagaugcaccagcccu

SEQ ID NO: 1721927 - RNA, 18 nt, Human
ccagaugcaccagcccuu

SEQ ID NO: 1721928 - RNA, 23 nt, Human
ccagaugcaccagcccuuagcag

SEQ ID NO: 1721929 - RNA, 23 nt, Human
cagguuuuuggucugacccacug

SEQ ID NO: 1721930 - RNA, 21 nt, Human
caggguuggccccugcccggc

SEQ ID NO: 1721931 - RNA, 17 nt, Human
caggguuggccccugcc

SEQ ID NO: 1721932 - RNA, 14 nt, Human
caggugcugccauc

SEQ ID NO: 1721933 - RNA, 13 nt, Human
caggugcugccau

SEQ ID NO: 1721934 - RNA, 17 nt, Human
cagucaccccggccacc

SEQ ID NO: 1721935 - RNA, 16 nt, Human
cagucaccccggccac

SEQ ID NO: 1721936 - RNA, 14 nt, Human
cagucaccccggcc

SEQ ID NO: 1721937 - RNA, 19 nt, Human
caguaaaugggggugcauu

SEQ ID NO: 1721938 - RNA, 20 nt, Human
caguaaaugggggugcauuu

SEQ ID NO: 1721939 - RNA, 18 nt, Human
caguaaaugggggugcau

SEQ ID NO: 1721940 - RNA, 23 nt, Human
cagggucucacucugucgcccag

SEQ ID NO: 1721941 - RNA, 21 nt, Human
cagggucucuaccauccccug

SEQ ID NO: 1721942 - RNA, 16 nt, Human
caggguuggccccugc

SEQ ID NO: 1721943 - RNA, 15 nt, Human
caggguuggccccug

SEQ ID NO: 1721944 - RNA, 22 nt, Human
cagggaggacgcucucuggccu

SEQ ID NO: 1721945 - RNA, 15 nt, Human
caggcugggcuucag

SEQ ID NO: 1721946 - RNA, 14 nt, Human
caggcugggcuuca

SEQ ID NO: 1721947 - RNA, 15 nt, Human
cagggcucagcgggg

SEQ ID NO: 1721948 - RNA, 12 nt, Human
cagggcucagcg

SEQ ID NO: 1721949 - RNA, 20 nt, Human
cagggcucagcggggacagc

SEQ ID NO: 1721950 - RNA, 16 nt, Human
cagggagggcuucugc

SEQ ID NO: 1721951 - RNA, 18 nt, Human
cagggagggccugggccc

SEQ ID NO: 1721952 - RNA, 17 nt, Human
cagggagggccugggcc

SEQ ID NO: 1721953 - RNA, 20 nt, Human
caggcugggagagccuucca

SEQ ID NO: 1721954 - RNA, 19 nt, Human
caggcugggagagccuucc

SEQ ID NO: 1721955 - RNA, 18 nt, Human
caggcugggagagccuuc

SEQ ID NO: 1721956 - RNA, 16 nt, Human
caggcugggagagccu

SEQ ID NO: 1721957 - RNA, 19 nt, Human
caggcuggcgugcaguggu

SEQ ID NO: 1721958 - RNA, 18 nt, Human
caggcuggcgugcagugg

SEQ ID NO: 1721959 - RNA, 17 nt, Human
caggcuggcgugcagug

SEQ ID NO: 1721960 - RNA, 23 nt, Human
caggccugggggcugggcagagg

SEQ ID NO: 1721961 - RNA, 22 nt, Human
caggccugggggcugggcagag

SEQ ID NO: 1721962 - RNA, 20 nt, Human
caggccugggggcugggcag

SEQ ID NO: 1721963 - RNA, 13 nt, Human
caggaccucaggu

SEQ ID NO: 1721964 - RNA, 21 nt, Human
caggaccagggauuuccauga

SEQ ID NO: 1721965 - RNA, 13 nt, Human
caggaccagggau

SEQ ID NO: 1721966 - RNA, 16 nt, Human
caggccaggcccucug

SEQ ID NO: 1721967 - RNA, 15 nt, Human
caggccaggcccucu

SEQ ID NO: 1721968 - RNA, 14 nt, Human
caggccaggcccuc

SEQ ID NO: 1721969 - RNA, 13 nt, Human
caggccaggcccu

SEQ ID NO: 1721970 - RNA, 15 nt, Human
caggccagcugcuug

SEQ ID NO: 1721971 - RNA, 13 nt, Human
caggccagcugcu

SEQ ID NO: 1721972 - RNA, 23 nt, Human
caggcacugcugcccagccucca

SEQ ID NO: 1721973 - RNA, 20 nt, Human
caggcaaugcuggcuguugg

SEQ ID NO: 1721974 - RNA, 19 nt, Human
caggcaaugcuggcuguug

SEQ ID NO: 1721975 - RNA, 13 nt, Human
caggaggccagcc

SEQ ID NO: 1721976 - RNA, 12 nt, Human
caggaggccagc

SEQ ID NO: 1721977 - RNA, 21 nt, Human
caggcaaugcuggcuguuggc

SEQ ID NO: 1721978 - RNA, 17 nt, Human
caggcacugcugcccag

SEQ ID NO: 1721979 - RNA, 16 nt, Human
caggcacugcugccca

SEQ ID NO: 1721980 - RNA, 16 nt, Human
cagcuuauucacaaga

SEQ ID NO: 1721981 - RNA, 17 nt, Human
cagcuuauucacaagac

SEQ ID NO: 1721982 - RNA, 19 nt, Human
cagcuguucagcugguuga

SEQ ID NO: 1721983 - RNA, 16 nt, Human
cagcuguucagcuggu

SEQ ID NO: 1721984 - RNA, 15 nt, Human
cagcuguucagcugg

SEQ ID NO: 1721985 - RNA, 20 nt, Human
caggaaaagcugcugacagu

SEQ ID NO: 1721986 - RNA, 19 nt, Human
caggaaaagcugcugacag

SEQ ID NO: 1721987 - RNA, 22 nt, Human
caggaaaggcuccaggagcagc

SEQ ID NO: 1721988 - RNA, 21 nt, Human
caggaaaggcuccaggagcag

SEQ ID NO: 1721989 - RNA, 23 nt, Human
caggaaaggcuccaggagcagcc

SEQ ID NO: 1721990 - RNA, 16 nt, Human
cagaucauugugaaau

SEQ ID NO: 1721991 - RNA, 22 nt, Human
cagaucauugugaaauuauuca

SEQ ID NO: 1721992 - RNA, 23 nt, Human
cagauacaggaaaagcugcugac

SEQ ID NO: 1721993 - RNA, 20 nt, Human
cagagacuccugcaggcagc

SEQ ID NO: 1721994 - RNA, 22 nt, Human
cagagacuccugcaggcagcca

SEQ ID NO: 1721995 - RNA, 21 nt, Human
cagagacuccugcaggcagcc

SEQ ID NO: 1721996 - RNA, 23 nt, Human
cagagacuccugcaggcagccag

SEQ ID NO: 1721997 - RNA, 22 nt, Human
cagagagggugggagugggccc

SEQ ID NO: 1721998 - RNA, 20 nt, Human
cagagagggugggagugggc

SEQ ID NO: 1721999 - RNA, 14 nt, Human
cagagccugcaguu

SEQ ID NO: 1722000 - RNA, 23 nt, Human
cagagagggugggagugggccca

SEQ ID NO: 1722001 - RNA, 16 nt, Human
cagagagggugggagu

SEQ ID NO: 1722002 - RNA, 22 nt, Human
cagagcuacacaggggaaaaga

SEQ ID NO: 1722003 - RNA, 17 nt, Human
cagagcuacacagggga

SEQ ID NO: 1722004 - RNA, 19 nt, Human
cagccccgugggguuccuc

SEQ ID NO: 1722005 - RNA, 13 nt, Human
cagccccugcaca

SEQ ID NO: 1722006 - RNA, 22 nt, Human
cagccccauucugccugcccag

SEQ ID NO: 1722007 - RNA, 20 nt, Human
cagccccauucugccugccc

SEQ ID NO: 1722008 - RNA, 19 nt, Human
cagccccauucugccugcc

SEQ ID NO: 1722009 - RNA, 24 nt, Human
cagccccauucugccugcccaggc

SEQ ID NO: 1722010 - RNA, 23 nt, Human
cagccccauucugccugcccagg

SEQ ID NO: 1722011 - RNA, 23 nt, Human
cagccugagcgacagugagacuc

SEQ ID NO: 1722012 - RNA, 17 nt, Human
cagccucugaaaaccaa

SEQ ID NO: 1722013 - RNA, 23 nt, Human
cagccgccaugcuccuggcccac

SEQ ID NO: 1722014 - RNA, 15 nt, Human
cagcccuuagcaggg

SEQ ID NO: 1722015 - RNA, 13 nt, Human
cagcccuuagcag

SEQ ID NO: 1722016 - RNA, 14 nt, Human
cagcggggacagcu

SEQ ID NO: 1722017 - RNA, 19 nt, Human
cagcguuucuaugacacau

SEQ ID NO: 1722018 - RNA, 16 nt, Human
cagcguuucuaugaca

SEQ ID NO: 1722019 - RNA, 14 nt, Human
cagcguuucuauga

SEQ ID NO: 1722020 - RNA, 18 nt, Human
cagcauauucaggaagcu

SEQ ID NO: 1722021 - RNA, 17 nt, Human
cagcauauucaggaagc

SEQ ID NO: 1722022 - RNA, 16 nt, Human
cagcauauucaggaag

SEQ ID NO: 1722023 - RNA, 21 nt, Human
cagauugcaacaggcugggcu

SEQ ID NO: 1722024 - RNA, 19 nt, Human
cagauuucacucuccuugg

SEQ ID NO: 1722025 - RNA, 18 nt, Human
cagauuucacucuccuug

SEQ ID NO: 1722026 - RNA, 16 nt, Human
cagauuucacucuccu

SEQ ID NO: 1722027 - RNA, 15 nt, Human
cagauuucacucucc

SEQ ID NO: 1722028 - RNA, 14 nt, Human
cagauuugagcuca

SEQ ID NO: 1722029 - RNA, 13 nt, Human
cagauuugagcuc

SEQ ID NO: 1722030 - RNA, 16 nt, Human
cagauuugagcucagc

SEQ ID NO: 1722031 - RNA, 13 nt, Human
cagauuuggaaag

SEQ ID NO: 1722032 - RNA, 17 nt, Human
ccaaaacucuccucugc

SEQ ID NO: 1722033 - RNA, 22 nt, Human
cauuuggugguuucagaaaugu

SEQ ID NO: 1722034 - RNA, 23 nt, Human
cauuuggugguuucagaaaugug

SEQ ID NO: 1722035 - RNA, 20 nt, Human
cauuuuugaauacaggcaua

SEQ ID NO: 1722036 - RNA, 18 nt, Human
cauuuuugaauacaggca

SEQ ID NO: 1722037 - RNA, 16 nt, Human
cauuuauucugcucac

SEQ ID NO: 1722038 - RNA, 18 nt, Human
cauuucauuugugccaga

SEQ ID NO: 1722039 - RNA, 21 nt, Human
cauugcggacagccacggcca

SEQ ID NO: 1722040 - RNA, 17 nt, Human
cauugcggacagccacg

SEQ ID NO: 1722041 - RNA, 15 nt, Human
cauugcggacagcca

SEQ ID NO: 1722042 - RNA, 14 nt, Human
cauugcggacagcc

SEQ ID NO: 1722043 - RNA, 18 nt, Human
cauugcugggcuugucug

SEQ ID NO: 1722044 - RNA, 16 nt, Human
cauucuccuuguguua

SEQ ID NO: 1722045 - RNA, 18 nt, Human
cauuaucuagauacugua

SEQ ID NO: 1722046 - RNA, 13 nt, Human
cauuaugaugugu

SEQ ID NO: 1722047 - RNA, 16 nt, Human
cauucucacuccuacc

SEQ ID NO: 1722048 - RNA, 17 nt, Human
cauucucacuccuaccu

SEQ ID NO: 1722049 - RNA, 15 nt, Human
cauuaggauggcuag

SEQ ID NO: 1722050 - RNA, 12 nt, Human
cauuaucuagau

SEQ ID NO: 1722051 - RNA, 16 nt, Human
cauuaucuagauacug

SEQ ID NO: 1722052 - RNA, 17 nt, Human
cauuaucuagauacugu

SEQ ID NO: 1722053 - RNA, 15 nt, Human
cauguucucugagga

SEQ ID NO: 1722054 - RNA, 22 nt, Human
cauggcugccaaugggagcuca

SEQ ID NO: 1722055 - RNA, 20 nt, Human
ccaauguucucucuucucca

SEQ ID NO: 1722056 - RNA, 22 nt, Human
ccaaugcacuuuguucuggcuc

SEQ ID NO: 1722057 - RNA, 20 nt, Human
ccaaugcacuuuguucuggc

SEQ ID NO: 1722058 - RNA, 23 nt, Human
ccaaugcacuuuguucuggcucu

SEQ ID NO: 1722059 - RNA, 22 nt, Human
ccaaagugcugggauuacaggc

SEQ ID NO: 1722060 - RNA, 22 nt, Human
ccaaagugcugggauuacaggg

SEQ ID NO: 1722061 - RNA, 19 nt, Human
ccaaagugcugggauuaca

SEQ ID NO: 1722062 - RNA, 12 nt, Human
ccaaaugcagcu

SEQ ID NO: 1722063 - RNA, 22 nt, Human
ccaaagugcugggauuacaggu

SEQ ID NO: 1722064 - RNA, 19 nt, Human
ccaaagugguauagaaaug

SEQ ID NO: 1722065 - RNA, 22 nt, Human
ccaaagugguauagaaaugcug

SEQ ID NO: 1722066 - RNA, 11 nt, Human
ccaacuuguaa

SEQ ID NO: 1722067 - RNA, 17 nt, Human
ccaccaucaagccacca

SEQ ID NO: 1722068 - RNA, 16 nt, Human
ccaccaucaagccacc

SEQ ID NO: 1722069 - RNA, 22 nt, Human
ccacacuucaggcucuucuccu

SEQ ID NO: 1722070 - RNA, 17 nt, Human
ccaccgcagacaggacc

SEQ ID NO: 1722071 - RNA, 14 nt, Human
ccaccgcagacagg

SEQ ID NO: 1722072 - RNA, 20 nt, Human
ccaccaucaagccaccaaca

SEQ ID NO: 1722073 - RNA, 18 nt, Human
ccaccaucaccagacagg

SEQ ID NO: 1722074 - RNA, 13 nt, Human
ccacccugcucuc

SEQ ID NO: 1722075 - RNA, 15 nt, Human
ccaccuuggcucaag

SEQ ID NO: 1722076 - RNA, 14 nt, Human
ccaccuuggcucaa

SEQ ID NO: 1722077 - RNA, 18 nt, Human
ccaccgcagacaggacca

SEQ ID NO: 1722078 - RNA, 19 nt, Human
ccaccgcagacaggaccag

SEQ ID NO: 1722079 - RNA, 23 nt, Human
ccaccgggcugggagcucugcag

SEQ ID NO: 1722080 - RNA, 14 nt, Human
caugacacgaauau

SEQ ID NO: 1722081 - RNA, 14 nt, Human
caugaauuugugaa

SEQ ID NO: 1722082 - RNA, 18 nt, Human
caugacacgaauauugcu

SEQ ID NO: 1722083 - RNA, 17 nt, Human
caugacacgaauauugc

SEQ ID NO: 1722084 - RNA, 18 nt, Human
caugcugcccugugagua

SEQ ID NO: 1722085 - RNA, 16 nt, Human
caugcugcccugugag

SEQ ID NO: 1722086 - RNA, 19 nt, Human
cauggccuuugcuugaaag

SEQ ID NO: 1722087 - RNA, 22 nt, Human
cauggccuuugcuugaaagaaa

SEQ ID NO: 1722088 - RNA, 14 nt, Human
caugcugccuccag

SEQ ID NO: 1722089 - RNA, 12 nt, Human
caugcugccucc

SEQ ID NO: 1722090 - RNA, 17 nt, Human
caugcaaggucauuuuu

SEQ ID NO: 1722091 - RNA, 18 nt, Human
caugcaaggucauuuuuu

SEQ ID NO: 1722092 - RNA, 22 nt, Human
caugcaaggucauuuuuuuuaa

SEQ ID NO: 1722093 - RNA, 19 nt, Human
caucagcacgauuucuguu

SEQ ID NO: 1722094 - RNA, 13 nt, Human
caucaggccaggc

SEQ ID NO: 1722095 - RNA, 17 nt, Human
caucagcacgauuucug

SEQ ID NO: 1722096 - RNA, 18 nt, Human
caucagcacgauuucugu

SEQ ID NO: 1722097 - RNA, 23 nt, Human
caucaggccaggcccucugccca

SEQ ID NO: 1722098 - RNA, 22 nt, Human
caucaggccaggcccucugccc

SEQ ID NO: 1722099 - RNA, 21 nt, Human
caucaggccaggcccucugcc

SEQ ID NO: 1722100 - RNA, 14 nt, Human
caucaggccaggcc

SEQ ID NO: 1722101 - RNA, 14 nt, Human
caucccagccccaa

SEQ ID NO: 1722102 - RNA, 13 nt, Human
caucccagcccca

SEQ ID NO: 1722103 - RNA, 16 nt, Human
caucccagccccaaug

SEQ ID NO: 1722104 - RNA, 17 nt, Human
caucccagccccaauga

SEQ ID NO: 1722105 - RNA, 22 nt, Human
caucuuagguuggcaaaaaggc

SEQ ID NO: 1722106 - RNA, 21 nt, Human
caucuuagguuggcaaaaagg

SEQ ID NO: 1722107 - RNA, 19 nt, Human
caucugugaaaggaaagag

SEQ ID NO: 1722108 - RNA, 18 nt, Human
caucugugaaaggaaaga

SEQ ID NO: 1722109 - RNA, 12 nt, Human
caucgcaaugua

SEQ ID NO: 1722110 - RNA, 15 nt, Human
cauacaauuccaaac

SEQ ID NO: 1722111 - RNA, 21 nt, Human
cauaaugcgugcauaccacuu

SEQ ID NO: 1722112 - RNA, 12 nt, Human
cauagcccucac

SEQ ID NO: 1722113 - RNA, 19 nt, Human
cauagcccucacccugggg

SEQ ID NO: 1722114 - RNA, 15 nt, Human
cauagcccucacccu

SEQ ID NO: 1722115 - RNA, 17 nt, Human
cauauuaccacagacau

SEQ ID NO: 1722116 - RNA, 20 nt, Human
cauauuaccacagacauacu

SEQ ID NO: 1722117 - RNA, 21 nt, Human
cauauuaccacagacauacua

SEQ ID NO: 1722118 - RNA, 22 nt, Human
cauauuaccacagacauacuaa

SEQ ID NO: 1722119 - RNA, 21 nt, Human
caguuuguuaguaugaggcau

SEQ ID NO: 1722120 - RNA, 19 nt, Human
cauaaucuggacuccucug

SEQ ID NO: 1722121 - RNA, 20 nt, Human
cauaaucuggacuccucugu

SEQ ID NO: 1722122 - RNA, 22 nt, Human
cauaaucuggacuccucugucc

SEQ ID NO: 1722123 - RNA, 21 nt, Human
cauaaucuggacuccucuguc

SEQ ID NO: 1722124 - RNA, 14 nt, Human
cauaaugcgugcau

SEQ ID NO: 1722125 - RNA, 17 nt, Human
cauaaugcgugcauacc

SEQ ID NO: 1722126 - RNA, 23 nt, Human
cauaaucuggacuccucugucca

SEQ ID NO: 1722127 - RNA, 12 nt, Human
caguuugcuuug

SEQ ID NO: 1722128 - RNA, 21 nt, Human
caguuugcuuuguaugcacuu

SEQ ID NO: 1722129 - RNA, 14 nt, Human
caguuugcuuugua

SEQ ID NO: 1722130 - RNA, 18 nt, Human
cagucaccccggccaccu

SEQ ID NO: 1722131 - RNA, 14 nt, Human
cacaagagcccagg

SEQ ID NO: 1722132 - RNA, 13 nt, Human
caauuuauuaugg

SEQ ID NO: 1722133 - RNA, 15 nt, Human
cacaagcuccaagcu

SEQ ID NO: 1722134 - RNA, 14 nt, Human
cacaagcuccaagc

SEQ ID NO: 1722135 - RNA, 13 nt, Human
cacaagcuccaag

SEQ ID NO: 1722136 - RNA, 16 nt, Human
cacaagagcccaggcc

SEQ ID NO: 1722137 - RNA, 23 nt, Human
cacaagcugcacccucaggcagg

SEQ ID NO: 1722138 - RNA, 17 nt, Human
cacaagcugcacccuca

SEQ ID NO: 1722139 - RNA, 23 nt, Human
cacaagcuccaagcucccaggca

SEQ ID NO: 1722140 - RNA, 17 nt, Human
cacaagcuccaagcucc

SEQ ID NO: 1722141 - RNA, 17 nt, Human
cacaagagcccaggccu

SEQ ID NO: 1722142 - RNA, 15 nt, Human
caauucuugccaaau

SEQ ID NO: 1722143 - RNA, 12 nt, Human
caauggcagccu

SEQ ID NO: 1722144 - RNA, 11 nt, Human
caauggcagcc

SEQ ID NO: 1722145 - RNA, 20 nt, Human
caauggagacugucucaaga

SEQ ID NO: 1722146 - RNA, 20 nt, Human
cacacagcucuguccuggga

SEQ ID NO: 1722147 - RNA, 17 nt, Human
cacacagcucuguccug

SEQ ID NO: 1722148 - RNA, 20 nt, Human
cacacaugagcaucaggcca

SEQ ID NO: 1722149 - RNA, 23 nt, Human
cacacagugagucgaggacaggg

SEQ ID NO: 1722150 - RNA, 21 nt, Human
cacacagugagucgaggacag

SEQ ID NO: 1722151 - RNA, 15 nt, Human
cacacauacacacac

SEQ ID NO: 1722152 - RNA, 23 nt, Human
cacacaguauuacuucugcuaca

SEQ ID NO: 1722153 - RNA, 20 nt, Human
cacacaguauuacuucugcu

SEQ ID NO: 1722154 - RNA, 18 nt, Human
cacacagugagucgagga

SEQ ID NO: 1722155 - RNA, 22 nt, Human
cacagaaaauggaagacagcuc

SEQ ID NO: 1722156 - RNA, 20 nt, Human
cacagaaaauggaagacagc

SEQ ID NO: 1722157 - RNA, 19 nt, Human
cacagaaaauggaagacag

SEQ ID NO: 1722158 - RNA, 18 nt, Human
cacagaaaauggaagaca

SEQ ID NO: 1722159 - RNA, 22 nt, Human
cacacaugagcaucaggccagg

SEQ ID NO: 1722160 - RNA, 21 nt, Human
cacacaugagcaucaggccag

SEQ ID NO: 1722161 - RNA, 19 nt, Human
cacagaaaauucuucucca

SEQ ID NO: 1722162 - RNA, 23 nt, Human
cacagaaaauggaagacagcucu

SEQ ID NO: 1722163 - RNA, 13 nt, Human
cacagacccugcc

SEQ ID NO: 1722164 - RNA, 11 nt, Human
cacagccucug

SEQ ID NO: 1722165 - RNA, 19 nt, Human
cacagacauacuaaccagc

SEQ ID NO: 1722166 - RNA, 21 nt, Human
cacagacauacuaaccagcag

SEQ ID NO: 1722167 - RNA, 23 nt, Human
cacaggcccuuccucuccacugc

SEQ ID NO: 1722168 - RNA, 22 nt, Human
cacagcgcuggccgggaccccg

SEQ ID NO: 1722169 - RNA, 19 nt, Human
cacagcgcuggccgggacc

SEQ ID NO: 1722170 - RNA, 18 nt, Human
cacaggggaaaagaggag

SEQ ID NO: 1722171 - RNA, 17 nt, Human
cacaggggaaaagagga

SEQ ID NO: 1722172 - RNA, 19 nt, Human
cacaggggaaaagaggagu

SEQ ID NO: 1722173 - RNA, 21 nt, Human
cacaguauuacuucugcuaca

SEQ ID NO: 1722174 - RNA, 20 nt, Human
cacaguauuacuucugcuac

SEQ ID NO: 1722175 - RNA, 17 nt, Human
caaguccacaguggaac

SEQ ID NO: 1722176 - RNA, 17 nt, Human
caagucaagugaaaaag

SEQ ID NO: 1722177 - RNA, 13 nt, Human
caagucaagugaa

SEQ ID NO: 1722178 - RNA, 21 nt, Human
caaguaugaauaaagacaccu

SEQ ID NO: 1722179 - RNA, 19 nt, Human
caaguaugaauaaagacac

SEQ ID NO: 1722180 - RNA, 16 nt, Human
caaggccaaaggaagc

SEQ ID NO: 1722181 - RNA, 15 nt, Human
caaggccaaaggaag

SEQ ID NO: 1722182 - RNA, 18 nt, Human
caaggccaaaggaagcac

SEQ ID NO: 1722183 - RNA, 17 nt, Human
caaggccaaaggaagca

SEQ ID NO: 1722184 - RNA, 16 nt, Human
caaguaugaauaaaga

SEQ ID NO: 1722185 - RNA, 18 nt, Human
caagcugcacccucaggc

SEQ ID NO: 1722186 - RNA, 14 nt, Human
caagcugcacccuc

SEQ ID NO: 1722187 - RNA, 14 nt, Human
caagcucugcuccu

SEQ ID NO: 1722188 - RNA, 13 nt, Human
caagcugcacccu

SEQ ID NO: 1722189 - RNA, 20 nt, Human
caagcugcacccucaggcag

SEQ ID NO: 1722190 - RNA, 12 nt, Human
caagcuccaagc

SEQ ID NO: 1722191 - RNA, 13 nt, Human
caagcucugcucc

SEQ ID NO: 1722192 - RNA, 19 nt, Human
caagcucuaucaccaagga

SEQ ID NO: 1722193 - RNA, 19 nt, Human
caauaaagcagcguuucua

SEQ ID NO: 1722194 - RNA, 16 nt, Human
cacuccagccugggug

SEQ ID NO: 1722195 - RNA, 16 nt, Human
cacuccagugagacag

SEQ ID NO: 1722196 - RNA, 15 nt, Human
cacuccagcugggau

SEQ ID NO: 1722197 - RNA, 12 nt, Human
cacuccagcugg

SEQ ID NO: 1722198 - RNA, 11 nt, Human
cacuccagcug

SEQ ID NO: 1722199 - RNA, 14 nt, Human
cacuaggcuucugg

SEQ ID NO: 1722200 - RNA, 15 nt, Human
cacuccccugcuggg

SEQ ID NO: 1722201 - RNA, 14 nt, Human
cacuccccugcugg

SEQ ID NO: 1722202 - RNA, 13 nt, Human
cacuccccugcug

SEQ ID NO: 1722203 - RNA, 12 nt, Human
cacuccccugcu

SEQ ID NO: 1722204 - RNA, 21 nt, Human
cacugcagaagacaguauggc

SEQ ID NO: 1722205 - RNA, 12 nt, Human
cacugcagccuc

SEQ ID NO: 1722206 - RNA, 20 nt, Human
cacugcacuccagccugggu

SEQ ID NO: 1722207 - RNA, 19 nt, Human
cacugcacuccagccuggg

SEQ ID NO: 1722208 - RNA, 18 nt, Human
cacugcacuccagccugg

SEQ ID NO: 1722209 - RNA, 16 nt, Human
cacugcacuccagccu

SEQ ID NO: 1722210 - RNA, 15 nt, Human
cacugcacuccagcc

SEQ ID NO: 1722211 - RNA, 19 nt, Human
cacugcacuauagccuagg

SEQ ID NO: 1722212 - RNA, 13 nt, Human
cacugcagccuca

SEQ ID NO: 1722213 - RNA, 16 nt, Human
cacugcauguuuguga

SEQ ID NO: 1722214 - RNA, 16 nt, Human
cacugcauccuccgcc

SEQ ID NO: 1722215 - RNA, 14 nt, Human
cacugcauccuccg

SEQ ID NO: 1722216 - RNA, 18 nt, Human
cacugcauccuccgccuc

SEQ ID NO: 1722217 - RNA, 18 nt, Human
cacugggagaaaugaaaa

SEQ ID NO: 1722218 - RNA, 24 nt, Human
cacuuagaaauugcauuuccugac

SEQ ID NO: 1722219 - RNA, 23 nt, Human
cacuuaggaacguaaucgugucc

SEQ ID NO: 1722220 - RNA, 22 nt, Human
cacugguucuucuuggucucag

SEQ ID NO: 1722221 - RNA, 23 nt, Human
cacugguggcccgacagccuggc

SEQ ID NO: 1722222 - RNA, 18 nt, Human
cacuuacacuuuaugcac

SEQ ID NO: 1722223 - RNA, 16 nt, Human
cacuuacacuuuaugc

SEQ ID NO: 1722224 - RNA, 11 nt, Human
caccccagccc

SEQ ID NO: 1722225 - RNA, 13 nt, Human
caccuuggcugca

SEQ ID NO: 1722226 - RNA, 15 nt, Human
caccuuggcucaagu

SEQ ID NO: 1722227 - RNA, 14 nt, Human
caccuuggcugcag

SEQ ID NO: 1722228 - RNA, 24 nt, Human
caccugccuguugggccaggagcc

SEQ ID NO: 1722229 - RNA, 19 nt, Human
caccugccuguugggccag

SEQ ID NO: 1722230 - RNA, 17 nt, Human
caccugccuguugggcc

SEQ ID NO: 1722231 - RNA, 14 nt, Human
cacccucaggcagg

SEQ ID NO: 1722232 - RNA, 16 nt, Human
cacccuggggagaaag

SEQ ID NO: 1722233 - RNA, 15 nt, Human
cacccuggggagaaa

SEQ ID NO: 1722234 - RNA, 17 nt, Human
cacccugaaagcccuga

SEQ ID NO: 1722235 - RNA, 13 nt, Human
caccucagccucc

SEQ ID NO: 1722236 - RNA, 20 nt, Human
caccuacaguguacagucuu

SEQ ID NO: 1722237 - RNA, 23 nt, Human
caccuacaguguacagucuugua

SEQ ID NO: 1722238 - RNA, 14 nt, Human
caccucagccuccc

SEQ ID NO: 1722239 - RNA, 17 nt, Human
cacccuggggagaaagu

SEQ ID NO: 1722240 - RNA, 13 nt, Human
caccuacagugua

SEQ ID NO: 1722241 - RNA, 16 nt, Human
caccuacaguguacag

SEQ ID NO: 1722242 - RNA, 17 nt, Human
caccuacaguguacagu

SEQ ID NO: 1722243 - RNA, 16 nt, Human
caccugccccucaacu

SEQ ID NO: 1722244 - RNA, 15 nt, Human
caccugccccucaac

SEQ ID NO: 1722245 - RNA, 14 nt, Human
caccugccccucaa

SEQ ID NO: 1722246 - RNA, 23 nt, Human
caccugccucggccucccaaagu

SEQ ID NO: 1722247 - RNA, 20 nt, Human
caaaaaaaaaaaaaaauuag

SEQ ID NO: 1722248 - RNA, 16 nt, Human
caaaagaugcuucuca

SEQ ID NO: 1722249 - RNA, 15 nt, Human
caaaaggcagaagca

SEQ ID NO: 1722250 - RNA, 18 nt, Human
caaaagaugcuucucacu

SEQ ID NO: 1722251 - RNA, 19 nt, Human
caaaccaucauugaaaucu

SEQ ID NO: 1722252 - RNA, 21 nt, Human
caaaccaucauugaaaucuuu

SEQ ID NO: 1722253 - RNA, 20 nt, Human
caaagauauuuugcuuugug

SEQ ID NO: 1722254 - RNA, 20 nt, Human
caaauggaaaugggcagagc

SEQ ID NO: 1722255 - RNA, 22 nt, Human
caaauggaaaugggcagagcag

SEQ ID NO: 1722256 - RNA, 21 nt, Human
caaauggaaaugggcagagca

SEQ ID NO: 1722257 - RNA, 20 nt, Human
caacaccucugcacaagcug

SEQ ID NO: 1722258 - RNA, 22 nt, Human
caacacucacauuuauucugcu

SEQ ID NO: 1722259 - RNA, 14 nt, Human
caacacuaacauga

SEQ ID NO: 1722260 - RNA, 22 nt, Human
caaagauauuuugcuuugugau

SEQ ID NO: 1722261 - RNA, 23 nt, Human
caaagauauuuugcuuugugauu

SEQ ID NO: 1722262 - RNA, 17 nt, Human
caaagcagugcaugcug

SEQ ID NO: 1722263 - RNA, 15 nt, Human
caaagcagugcaugc

SEQ ID NO: 1722264 - RNA, 22 nt, Human
caaaguacacuguuucaaacuu

SEQ ID NO: 1722265 - RNA, 21 nt, Human
caaaguagaagucuuagaugu

SEQ ID NO: 1722266 - RNA, 14 nt, Human
caaaguagaagucu

SEQ ID NO: 1722267 - RNA, 21 nt, Human
caaagucucuggaauuugaaa

SEQ ID NO: 1722268 - RNA, 15 nt, Human
auuugccaauaauaa

SEQ ID NO: 1722269 - RNA, 16 nt, Human
auuugccaauaauaau

SEQ ID NO: 1722270 - RNA, 22 nt, Human
auuuguuugaacugauaaagau

SEQ ID NO: 1722271 - RNA, 23 nt, Human
auuuguuugaacugauaaagaug

SEQ ID NO: 1722272 - RNA, 17 nt, Human
auuuuauagcuacuaau

SEQ ID NO: 1722273 - RNA, 19 nt, Human
auuuuauagcuacuaauuu

SEQ ID NO: 1722274 - RNA, 18 nt, Human
auuuguuucuuucucuga

SEQ ID NO: 1722275 - RNA, 17 nt, Human
auuugugauacaaugcu

SEQ ID NO: 1722276 - RNA, 20 nt, Human
auuugugauacaaugcugug

SEQ ID NO: 1722277 - RNA, 14 nt, Human
auuugugccagaau

SEQ ID NO: 1722278 - RNA, 13 nt, Human
auuugcuccuuuc

SEQ ID NO: 1722279 - RNA, 12 nt, Human
auuuggaaaaua

SEQ ID NO: 1722280 - RNA, 13 nt, Human
auuuggaaaauaa

SEQ ID NO: 1722281 - RNA, 14 nt, Human
auuugcuuuggaag

SEQ ID NO: 1722282 - RNA, 15 nt, Human
auuugcuuuggaagu

SEQ ID NO: 1722283 - RNA, 13 nt, Human
auuugcuuuggaa

SEQ ID NO: 1722284 - RNA, 17 nt, Human
auuagcaguuugcuuug

SEQ ID NO: 1722285 - RNA, 19 nt, Human
auuagcauuugucaacaaa

SEQ ID NO: 1722286 - RNA, 23 nt, Human
auuagauuucucauuugccaaua

SEQ ID NO: 1722287 - RNA, 17 nt, Human
auuacaggaaguacugg

SEQ ID NO: 1722288 - RNA, 22 nt, Human
auuacaagcgugagccacugca

SEQ ID NO: 1722289 - RNA, 18 nt, Human
auguuugccucugccucu

SEQ ID NO: 1722290 - RNA, 23 nt, Human
auguuugggagacugcugaguca

SEQ ID NO: 1722291 - RNA, 23 nt, Human
auuaugcaugaaguaauaugcac

SEQ ID NO: 1722292 - RNA, 19 nt, Human
auucacaagacccaaaagg

SEQ ID NO: 1722293 - RNA, 16 nt, Human
auuaggugugacugaa

SEQ ID NO: 1722294 - RNA, 18 nt, Human
auuaggugugacugaauu

SEQ ID NO: 1722295 - RNA, 21 nt, Human
auuaggugugacugaauuucu

SEQ ID NO: 1722296 - RNA, 19 nt, Human
auucauagcagcuuauuca

SEQ ID NO: 1722297 - RNA, 22 nt, Human
auucauagcagcuuauucacaa

SEQ ID NO: 1722298 - RNA, 19 nt, Human
auucauaaugacuuaagca

SEQ ID NO: 1722299 - RNA, 21 nt, Human
auucauaauuauuauuuggcc

SEQ ID NO: 1722300 - RNA, 15 nt, Human
auucauaaugacuua

SEQ ID NO: 1722301 - RNA, 14 nt, Human
auucauaaugacuu

SEQ ID NO: 1722302 - RNA, 14 nt, Human
auuguaaaauggug

SEQ ID NO: 1722303 - RNA, 18 nt, Human
auugcuugagcucaggag

SEQ ID NO: 1722304 - RNA, 23 nt, Human
auugugucucuugguccugcugc

SEQ ID NO: 1722305 - RNA, 21 nt, Human
auugugucucuugguccugcu

SEQ ID NO: 1722306 - RNA, 16 nt, Human
auuguuagucucuuga

SEQ ID NO: 1722307 - RNA, 14 nt, Human
auugcuugagcuca

SEQ ID NO: 1722308 - RNA, 12 nt, Human
auugcugcuuga

SEQ ID NO: 1722309 - RNA, 23 nt, Human
auugcugauggugcaaugaccuu

SEQ ID NO: 1722310 - RNA, 19 nt, Human
auugcugauggugcaauga

SEQ ID NO: 1722311 - RNA, 18 nt, Human
auugcugauggugcaaug

SEQ ID NO: 1722312 - RNA, 16 nt, Human
auugcugauggugcaa

SEQ ID NO: 1722313 - RNA, 15 nt, Human
auugcugauggugca

SEQ ID NO: 1722314 - RNA, 12 nt, Human
auugcuccuuga

SEQ ID NO: 1722315 - RNA, 14 nt, Human
auucuucugcuuca

SEQ ID NO: 1722316 - RNA, 11 nt, Human
auucuuuccug

SEQ ID NO: 1722317 - RNA, 12 nt, Human
auucuucugcuu

SEQ ID NO: 1722318 - RNA, 11 nt, Human
auucuucugcu

SEQ ID NO: 1722319 - RNA, 14 nt, Human
auucugaccuuaaa

SEQ ID NO: 1722320 - RNA, 13 nt, Human
auucuuuccugag

SEQ ID NO: 1722321 - RNA, 21 nt, Human
auugauaagaaccuuuugagu

SEQ ID NO: 1722322 - RNA, 15 nt, Human
auugcuacuguccua

SEQ ID NO: 1722323 - RNA, 17 nt, Human
auugauaugcuuauaca

SEQ ID NO: 1722324 - RNA, 22 nt, Human
auugcuacuguccuacccaccc

SEQ ID NO: 1722325 - RNA, 20 nt, Human
auugcuacuguccuacccac

SEQ ID NO: 1722326 - RNA, 20 nt, Human
augaaugucagugugacuga

SEQ ID NO: 1722327 - RNA, 18 nt, Human
augaagauguagaggaga

SEQ ID NO: 1722328 - RNA, 13 nt, Human
augaaugaauggc

SEQ ID NO: 1722329 - RNA, 15 nt, Human
augaaagggcccaga

SEQ ID NO: 1722330 - RNA, 14 nt, Human
uuggggauauuuuu

SEQ ID NO: 1722331 - RNA, 18 nt, Human
uugggccccagaggcugg

SEQ ID NO: 1722332 - RNA, 22 nt, Human
uuggggggcugaggugggagga

SEQ ID NO: 1722333 - RNA, 23 nt, Human
uuggcgcugccccuggcagcccc

SEQ ID NO: 1722334 - RNA, 18 nt, Human
uuggcuagagguucaaag

SEQ ID NO: 1722335 - RNA, 15 nt, Human
augaaagcagggacu

SEQ ID NO: 1722336 - RNA, 13 nt, Human
aucuuuuuauuca

SEQ ID NO: 1722337 - RNA, 23 nt, Human
aucuuuggacagaagcagcucuu

SEQ ID NO: 1722338 - RNA, 13 nt, Human
uuggcugcaggga

SEQ ID NO: 1722339 - RNA, 22 nt, Human
aucuuuaauuuuacauuuccua

SEQ ID NO: 1722340 - RNA, 21 nt, Human
aucuuuaauuuuacauuuccu

SEQ ID NO: 1722341 - RNA, 16 nt, Human
aucuuuaauuuuacau

SEQ ID NO: 1722342 - RNA, 22 nt, Human
aucuuuggacagaagcagcucu

SEQ ID NO: 1722343 - RNA, 17 nt, Human
augagaaaaugucuuua

SEQ ID NO: 1722344 - RNA, 16 nt, Human
augacuuacuguacau

SEQ ID NO: 1722345 - RNA, 17 nt, Human
augacuuacuguacaug

SEQ ID NO: 1722346 - RNA, 18 nt, Human
augacacgaauauugcug

SEQ ID NO: 1722347 - RNA, 22 nt, Human
augacuuaagcacacuugacau

SEQ ID NO: 1722348 - RNA, 14 nt, Human
augacuuacuguac

SEQ ID NO: 1722349 - RNA, 22 nt, Human
augagaaagguugaagcaccaa

SEQ ID NO: 1722350 - RNA, 21 nt, Human
augagaaagguugaagcacca

SEQ ID NO: 1722351 - RNA, 18 nt, Human
augagaaaucuaaaaaac

SEQ ID NO: 1722352 - RNA, 15 nt, Human
augagaaaucuaaaa

SEQ ID NO: 1722353 - RNA, 23 nt, Human
augagaaaucuaaaaaacgaaaa

SEQ ID NO: 1722354 - RNA, 14 nt, Human
augacacaugcaag

SEQ ID NO: 1722355 - RNA, 22 nt, Human
augacacaugcaaggucauuuu

SEQ ID NO: 1722356 - RNA, 14 nt, Human
aucucagggccugg

SEQ ID NO: 1722357 - RNA, 11 nt, Human
aucucagccca

SEQ ID NO: 1722358 - RNA, 15 nt, Human
aucucacacaugagc

SEQ ID NO: 1722359 - RNA, 16 nt, Human
aucucacacaugagca

SEQ ID NO: 1722360 - RNA, 19 nt, Human
auccuaguuccaccaucaa

SEQ ID NO: 1722361 - RNA, 15 nt, Human
auccuaguuccacca

SEQ ID NO: 1722362 - RNA, 15 nt, Human
aucuccacuccagau

SEQ ID NO: 1722363 - RNA, 13 nt, Human
aucuccaaaauaa

SEQ ID NO: 1722364 - RNA, 13 nt, Human
aucucccccagcc

SEQ ID NO: 1722365 - RNA, 12 nt, Human
aucucccccagc

SEQ ID NO: 1722366 - RNA, 14 nt, Human
aucucccccagccc

SEQ ID NO: 1722367 - RNA, 16 nt, Human
aucuccccaucauugg

SEQ ID NO: 1722368 - RNA, 16 nt, Human
uugauucagacagcug

SEQ ID NO: 1722369 - RNA, 15 nt, Human
uugauucagacagcu

SEQ ID NO: 1722370 - RNA, 19 nt, Human
uugcacaaaccaauuaaac

SEQ ID NO: 1722371 - RNA, 12 nt, Human
uugcaugaggcu

SEQ ID NO: 1722372 - RNA, 14 nt, Human
uugcaccacugcac

SEQ ID NO: 1722373 - RNA, 14 nt, Human
uugcaucugaaaau

SEQ ID NO: 1722374 - RNA, 16 nt, Human
uugaugugugucuagg

SEQ ID NO: 1722375 - RNA, 14 nt, Human
uugauucagacagc

SEQ ID NO: 1722376 - RNA, 23 nt, Human
uugauggugaugaaauguaaaua

SEQ ID NO: 1722377 - RNA, 14 nt, Human
uugauguaaagaug

SEQ ID NO: 1722378 - RNA, 23 nt, Human
uugauguaaagauguucuggaua

SEQ ID NO: 1722379 - RNA, 15 nt, Human
uugaugggauuuggu

SEQ ID NO: 1722380 - RNA, 12 nt, Human
uugaugccuggc

SEQ ID NO: 1722381 - RNA, 19 nt, Human
aucucuucuggguuccuuc

SEQ ID NO: 1722382 - RNA, 18 nt, Human
uugccgucuaccugaggg

SEQ ID NO: 1722383 - RNA, 15 nt, Human
uugccgucuaccuga

SEQ ID NO: 1722384 - RNA, 19 nt, Human
uugccgucuaccugagggg

SEQ ID NO: 1722385 - RNA, 14 nt, Human
uugccguuauuaaa

SEQ ID NO: 1722386 - RNA, 13 nt, Human
uugccgucuaccu

SEQ ID NO: 1722387 - RNA, 18 nt, Human
aucugaugcaagcaagaa

SEQ ID NO: 1722388 - RNA, 19 nt, Human
aucuggguucacugcaacc

SEQ ID NO: 1722389 - RNA, 17 nt, Human
aucuggguucacugcaa

SEQ ID NO: 1722390 - RNA, 19 nt, Human
aucuugcucugcugacaga

SEQ ID NO: 1722391 - RNA, 18 nt, Human
aucuugaauuguaaggaa

SEQ ID NO: 1722392 - RNA, 24 nt, Human
uuuauggcuuuugugcauuaucua

SEQ ID NO: 1722393 - RNA, 22 nt, Human
uuuaugggucagaguuccgacu

SEQ ID NO: 1722394 - RNA, 20 nt, Human
uuuauggcuuuugugcauua

SEQ ID NO: 1722395 - RNA, 16 nt, Human
uuuaguaucuuuuuau

SEQ ID NO: 1722396 - RNA, 17 nt, Human
uuuagauguaauuuugu

SEQ ID NO: 1722397 - RNA, 15 nt, Human
augcuagaacucccu

SEQ ID NO: 1722398 - RNA, 16 nt, Human
augcuagaacucccuu

SEQ ID NO: 1722399 - RNA, 19 nt, Human
augcuagaacucccuuuca

SEQ ID NO: 1722400 - RNA, 22 nt, Human
augcuguaacuuucugaaauaa

SEQ ID NO: 1722401 - RNA, 13 nt, Human
augcugguuuuuc

SEQ ID NO: 1722402 - RNA, 15 nt, Human
augcucugcauguua

SEQ ID NO: 1722403 - RNA, 16 nt, Human
auggaacacucugaga

SEQ ID NO: 1722404 - RNA, 15 nt, Human
auggaagacagcucu

SEQ ID NO: 1722405 - RNA, 15 nt, Human
auggaacacucugag

SEQ ID NO: 1722406 - RNA, 14 nt, Human
auggaacacucuga

SEQ ID NO: 1722407 - RNA, 11 nt, Human
auggaacacuc

SEQ ID NO: 1722408 - RNA, 23 nt, Human
augcugucccuuacgugaguccu

SEQ ID NO: 1722409 - RNA, 19 nt, Human
augcugucccuuacgugag

SEQ ID NO: 1722410 - RNA, 14 nt, Human
auggacaugaucuu

SEQ ID NO: 1722411 - RNA, 19 nt, Human
auggacaugaucuucuuua

SEQ ID NO: 1722412 - RNA, 17 nt, Human
uuucauauuuuaaacag

SEQ ID NO: 1722413 - RNA, 16 nt, Human
auggaagacagcucuu

SEQ ID NO: 1722414 - RNA, 14 nt, Human
uuucacugcuggcu

SEQ ID NO: 1722415 - RNA, 18 nt, Human
uuucacugcuggcugccu

SEQ ID NO: 1722416 - RNA, 17 nt, Human
uuucacugcuggcugcc

SEQ ID NO: 1722417 - RNA, 22 nt, Human
uuucacugcuggcugccuuaga

SEQ ID NO: 1722418 - RNA, 20 nt, Human
uuucacugcuggcugccuua

SEQ ID NO: 1722419 - RNA, 13 nt, Human
uuucagaaaugug

SEQ ID NO: 1722420 - RNA, 20 nt, Human
auggcuaguaucaaaagaaa

SEQ ID NO: 1722421 - RNA, 20 nt, Human
auggccuuugcuugaaagaa

SEQ ID NO: 1722422 - RNA, 21 nt, Human
auggccgggcgcgguggcuca

SEQ ID NO: 1722423 - RNA, 16 nt, Human
auggccagguggccac

SEQ ID NO: 1722424 - RNA, 22 nt, Human
auggccagguggccacuccaga

SEQ ID NO: 1722425 - RNA, 23 nt, Human
auggacguguuaugacuccagaa

SEQ ID NO: 1722426 - RNA, 18 nt, Human
auggauuuccagccaaag

SEQ ID NO: 1722427 - RNA, 20 nt, Human
auggacguguuaugacucca

SEQ ID NO: 1722428 - RNA, 19 nt, Human
auggacguguuaugacucc

SEQ ID NO: 1722429 - RNA, 17 nt, Human
auggcacaucagcacga

SEQ ID NO: 1722430 - RNA, 23 nt, Human
auggcacaucagcacgauuucug

SEQ ID NO: 1722431 - RNA, 22 nt, Human
auggcacaaucucggcucacug

SEQ ID NO: 1722432 - RNA, 19 nt, Human
auggcaaggacugcaggga

SEQ ID NO: 1722433 - RNA, 17 nt, Human
uuuaagugcugcauuua

SEQ ID NO: 1722434 - RNA, 19 nt, Human
uuuaagugcugcauuuaaa

SEQ ID NO: 1722435 - RNA, 15 nt, Human
uuuaagugcugcauu

SEQ ID NO: 1722436 - RNA, 16 nt, Human
uuuaagugcugcauuu

SEQ ID NO: 1722437 - RNA, 12 nt, Human
uuuaauuuuaca

SEQ ID NO: 1722438 - RNA, 15 nt, Human
uuguuuuacugucuu

SEQ ID NO: 1722439 - RNA, 14 nt, Human
uuuaaauguuuuuu

SEQ ID NO: 1722440 - RNA, 16 nt, Human
uuguuuucaguguaca

SEQ ID NO: 1722441 - RNA, 13 nt, Human
uuguuuucagugu

SEQ ID NO: 1722442 - RNA, 15 nt, Human
augcacuuuguucug

SEQ ID NO: 1722443 - RNA, 16 nt, Human
augcacuuuguucugg

SEQ ID NO: 1722444 - RNA, 13 nt, Human
augcagccucaca

SEQ ID NO: 1722445 - RNA, 15 nt, Human
augcagccucacagu

SEQ ID NO: 1722446 - RNA, 14 nt, Human
augcagccucacag

SEQ ID NO: 1722447 - RNA, 17 nt, Human
augcagccucacagucc

SEQ ID NO: 1722448 - RNA, 15 nt, Human
augccacuaaauuga

SEQ ID NO: 1722449 - RNA, 17 nt, Human
augccacuaaauugaca

SEQ ID NO: 1722450 - RNA, 11 nt, Human
augcccagccc

SEQ ID NO: 1722451 - RNA, 15 nt, Human
augcaguuuuccuua

SEQ ID NO: 1722452 - RNA, 19 nt, Human
augauuaaccacuucagcu

SEQ ID NO: 1722453 - RNA, 21 nt, Human
augauuaaccacuucagcuga

SEQ ID NO: 1722454 - RNA, 20 nt, Human
augauuaaccacuucagcug

SEQ ID NO: 1722455 - RNA, 17 nt, Human
augauuucagcucacug

SEQ ID NO: 1722456 - RNA, 21 nt, Human
augauucaacagguuuuccug

SEQ ID NO: 1722457 - RNA, 19 nt, Human
augauuucagcucacugca

SEQ ID NO: 1722458 - RNA, 14 nt, Human
augauuuuuaaaga

SEQ ID NO: 1722459 - RNA, 16 nt, Human
augauuuuuaaagaaa

SEQ ID NO: 1722460 - RNA, 12 nt, Human
augcacuuuguu

SEQ ID NO: 1722461 - RNA, 14 nt, Human
augcaccagcccuu

SEQ ID NO: 1722462 - RNA, 13 nt, Human
augcaccagcccu

SEQ ID NO: 1722463 - RNA, 19 nt, Human
uugugauacaaugcugugc

SEQ ID NO: 1722464 - RNA, 18 nt, Human
uugugauacaaugcugug

SEQ ID NO: 1722465 - RNA, 21 nt, Human
uugugaggaagccgcuggggc

SEQ ID NO: 1722466 - RNA, 13 nt, Human
uugugguuaaucu

SEQ ID NO: 1722467 - RNA, 14 nt, Human
uuguguaagaaaua

SEQ ID NO: 1722468 - RNA, 18 nt, Human
uuguguaagaaauacaga

SEQ ID NO: 1722469 - RNA, 19 nt, Human
uuguucuggcucuuccagg

SEQ ID NO: 1722470 - RNA, 17 nt, Human
uuguguguuuauuguca

SEQ ID NO: 1722471 - RNA, 22 nt, Human
uuguucuggcucuuccaggcug

SEQ ID NO: 1722472 - RNA, 20 nt, Human
uuguucuggcucuuccaggc

SEQ ID NO: 1722473 - RNA, 17 nt, Human
uuccccuguucacucua

SEQ ID NO: 1722474 - RNA, 14 nt, Human
uuccccuguucacu

SEQ ID NO: 1722475 - RNA, 22 nt, Human
uuccccuuccuaauuccacagc

SEQ ID NO: 1722476 - RNA, 17 nt, Human
uucccuacuuccuguga

SEQ ID NO: 1722477 - RNA, 16 nt, Human
uucccuacuuccugug

SEQ ID NO: 1722478 - RNA, 14 nt, Human
uucccuacuuccug

SEQ ID NO: 1722479 - RNA, 20 nt, Human
uucccuuuuuuggcugcuga

SEQ ID NO: 1722480 - RNA, 19 nt, Human
uucccuuuuuuggcugcug

SEQ ID NO: 1722481 - RNA, 18 nt, Human
uucccuuuuuuggcugcu

SEQ ID NO: 1722482 - RNA, 22 nt, Human
uucccccuguuucagaggcuca

SEQ ID NO: 1722483 - RNA, 22 nt, Human
aucaaccccuucgcuccugugu

SEQ ID NO: 1722484 - RNA, 20 nt, Human
aucaaccccuucgcuccugu

SEQ ID NO: 1722485 - RNA, 19 nt, Human
aucaaccccuucgcuccug

SEQ ID NO: 1722486 - RNA, 23 nt, Human
aucaaguuggcuucuaaucaaag

SEQ ID NO: 1722487 - RNA, 22 nt, Human
aucaaguuggcuucuaaucaaa

SEQ ID NO: 1722488 - RNA, 20 nt, Human
uuccuucaaagcaaaugucu

SEQ ID NO: 1722489 - RNA, 12 nt, Human
uuccucuccacu

SEQ ID NO: 1722490 - RNA, 16 nt, Human
uuccucuccacugccu

SEQ ID NO: 1722491 - RNA, 15 nt, Human
uuccucuccacugcc

SEQ ID NO: 1722492 - RNA, 14 nt, Human
uuccucuccacugc

SEQ ID NO: 1722493 - RNA, 13 nt, Human
uuccucuccacug

SEQ ID NO: 1722494 - RNA, 13 nt, Human
uucuauaauuuaa

SEQ ID NO: 1722495 - RNA, 14 nt, Human
uucuauaauuuaaa

SEQ ID NO: 1722496 - RNA, 21 nt, Human
uucucacugccaugccagcuu

SEQ ID NO: 1722497 - RNA, 13 nt, Human
uucucagaaucuc

SEQ ID NO: 1722498 - RNA, 13 nt, Human
uucucagcuccca

SEQ ID NO: 1722499 - RNA, 14 nt, Human
aucaggccaggccc

SEQ ID NO: 1722500 - RNA, 13 nt, Human
aucaggccaggcc

SEQ ID NO: 1722501 - RNA, 19 nt, Human
aucagacuaugaaguuuuu

SEQ ID NO: 1722502 - RNA, 20 nt, Human
uucgauacaccgggccugga

SEQ ID NO: 1722503 - RNA, 21 nt, Human
uucgcaggauucuuccucccu

SEQ ID NO: 1722504 - RNA, 19 nt, Human
uucuaaaucuccaaaauaa

SEQ ID NO: 1722505 - RNA, 13 nt, Human
uucgcuccugugu

SEQ ID NO: 1722506 - RNA, 15 nt, Human
uucuaaaguaaaaac

SEQ ID NO: 1722507 - RNA, 12 nt, Human
uucuugcaaagu

SEQ ID NO: 1722508 - RNA, 13 nt, Human
uucuugcaaagua

SEQ ID NO: 1722509 - RNA, 22 nt, Human
uucuuucuggcuaugcauuuga

SEQ ID NO: 1722510 - RNA, 15 nt, Human
uucuuucuuccucug

SEQ ID NO: 1722511 - RNA, 13 nt, Human
uucuuucuuccuc

SEQ ID NO: 1722512 - RNA, 13 nt, Human
uucuuaauucuua

SEQ ID NO: 1722513 - RNA, 23 nt, Human
uucuuccucccucccucuuuccc

SEQ ID NO: 1722514 - RNA, 13 nt, Human
uucuuccucugcu

SEQ ID NO: 1722515 - RNA, 12 nt, Human
uucuuccucugc

SEQ ID NO: 1722516 - RNA, 11 nt, Human
uucuuccucug

SEQ ID NO: 1722517 - RNA, 20 nt, Human
uucuguuuuucuaggccugg

SEQ ID NO: 1722518 - RNA, 21 nt, Human
uucuguuggccagugugacaa

SEQ ID NO: 1722519 - RNA, 17 nt, Human
uucuguugcugccucau

SEQ ID NO: 1722520 - RNA, 18 nt, Human
uucuguucuuucuggcua

SEQ ID NO: 1722521 - RNA, 16 nt, Human
uucuguugcugccuca

SEQ ID NO: 1722522 - RNA, 15 nt, Human
uucuguugcugccuc

SEQ ID NO: 1722523 - RNA, 16 nt, Human
uugaaaguuuacagga

SEQ ID NO: 1722524 - RNA, 20 nt, Human
uugaaauauaggaacuuaaa

SEQ ID NO: 1722525 - RNA, 11 nt, Human
uugaaaucuuu

SEQ ID NO: 1722526 - RNA, 21 nt, Human
uugaaauauggucuuuugguu

SEQ ID NO: 1722527 - RNA, 21 nt, Human
uugaaauuuuuauuaaauuau

SEQ ID NO: 1722528 - RNA, 18 nt, Human
uugaacccgggaggcaga

SEQ ID NO: 1722529 - RNA, 13 nt, Human
auccuaguuccac

SEQ ID NO: 1722530 - RNA, 21 nt, Human
auccuaggcauuugcugaaua

SEQ ID NO: 1722531 - RNA, 19 nt, Human
auccuaaugaaugcauaaa

SEQ ID NO: 1722532 - RNA, 14 nt, Human
auccuacaagacac

SEQ ID NO: 1722533 - RNA, 13 nt, Human
auccuaaugaaug

SEQ ID NO: 1722534 - RNA, 12 nt, Human
auccuaaugaau

SEQ ID NO: 1722535 - RNA, 13 nt, Human
uucugccgcagcc

SEQ ID NO: 1722536 - RNA, 19 nt, Human
uucugcagccacuauuguu

SEQ ID NO: 1722537 - RNA, 14 nt, Human
uucugacccaugcu

SEQ ID NO: 1722538 - RNA, 16 nt, Human
uucugacccaugcugc

SEQ ID NO: 1722539 - RNA, 15 nt, Human
uucugcacacagcac

SEQ ID NO: 1722540 - RNA, 17 nt, Human
uucucuacucuagggaa

SEQ ID NO: 1722541 - RNA, 16 nt, Human
uucucuuuucaaaaca

SEQ ID NO: 1722542 - RNA, 14 nt, Human
uucuccugccucag

SEQ ID NO: 1722543 - RNA, 13 nt, Human
uucuccugccuca

SEQ ID NO: 1722544 - RNA, 12 nt, Human
uucuccugccuc

SEQ ID NO: 1722545 - RNA, 23 nt, Human
aucaggccaggcccucugcccac

SEQ ID NO: 1722546 - RNA, 22 nt, Human
aucaggccaggcccucugccca

SEQ ID NO: 1722547 - RNA, 21 nt, Human
aucaggccaggcccucugccc

SEQ ID NO: 1722548 - RNA, 21 nt, Human
aucauugaaaucuuuuugcuu

SEQ ID NO: 1722549 - RNA, 15 nt, Human
aucccaccaacccuc

SEQ ID NO: 1722550 - RNA, 15 nt, Human
uucuggcucuuccag

SEQ ID NO: 1722551 - RNA, 16 nt, Human
uucugccgcagcccug

SEQ ID NO: 1722552 - RNA, 15 nt, Human
uucugccgcagcccu

SEQ ID NO: 1722553 - RNA, 14 nt, Human
uucugccgcagccc

SEQ ID NO: 1722554 - RNA, 18 nt, Human
uucuggcuaugcauuuga

SEQ ID NO: 1722555 - RNA, 20 nt, Human
uucuggcuaugcauuugaaa

SEQ ID NO: 1722556 - RNA, 22 nt, Human
uucugguugaugccugugaacu

SEQ ID NO: 1722557 - RNA, 17 nt, Human
uuauuuuuuucugaauu

SEQ ID NO: 1722558 - RNA, 13 nt, Human
uuauuuuuuucug

SEQ ID NO: 1722559 - RNA, 17 nt, Human
uuauuuuuagacagagu

SEQ ID NO: 1722560 - RNA, 18 nt, Human
uuauuuuuagacagaguc

SEQ ID NO: 1722561 - RNA, 21 nt, Human
uucaagcgauucuucugcuuc

SEQ ID NO: 1722562 - RNA, 17 nt, Human
uucaaaauaaaaaugag

SEQ ID NO: 1722563 - RNA, 20 nt, Human
uucaaaaguuuguuugcuua

SEQ ID NO: 1722564 - RNA, 21 nt, Human
uucaaaauuguuacaaauugu

SEQ ID NO: 1722565 - RNA, 23 nt, Human
uucacaagacccaaaaggcagaa

SEQ ID NO: 1722566 - RNA, 17 nt, Human
uucaagugauucucaug

SEQ ID NO: 1722567 - RNA, 20 nt, Human
uucacaguucucuccuucuu

SEQ ID NO: 1722568 - RNA, 15 nt, Human
uucacaguucucucc

SEQ ID NO: 1722569 - RNA, 20 nt, Human
uucacagaugggugcuugga

SEQ ID NO: 1722570 - RNA, 17 nt, Human
auaggcguaacuaauuu

SEQ ID NO: 1722571 - RNA, 17 nt, Human
auaggaaaaacugauuu

SEQ ID NO: 1722572 - RNA, 16 nt, Human
auaggaaaaacugauu

SEQ ID NO: 1722573 - RNA, 14 nt, Human
auaggaaaaacuga

SEQ ID NO: 1722574 - RNA, 12 nt, Human
auaggaaaaacu

SEQ ID NO: 1722575 - RNA, 22 nt, Human
auagcuuuucccuuuuuuuaag

SEQ ID NO: 1722576 - RNA, 22 nt, Human
uucacuuaaguuaguuccacug

SEQ ID NO: 1722577 - RNA, 15 nt, Human
uucacuuacagcacc

SEQ ID NO: 1722578 - RNA, 16 nt, Human
auauaaaagacugacc

SEQ ID NO: 1722579 - RNA, 13 nt, Human
auauauaaccagu

SEQ ID NO: 1722580 - RNA, 12 nt, Human
auauauaaccag

SEQ ID NO: 1722581 - RNA, 17 nt, Human
auaguggcuuaaaacaa

SEQ ID NO: 1722582 - RNA, 15 nt, Human
auaguggugugauuu

SEQ ID NO: 1722583 - RNA, 21 nt, Human
auagugaggcaucgcaaugua

SEQ ID NO: 1722584 - RNA, 20 nt, Human
auaguuguaccgcaauguga

SEQ ID NO: 1722585 - RNA, 22 nt, Human
auaguuggcuaggaccccucca

SEQ ID NO: 1722586 - RNA, 22 nt, Human
auaguuaagcgugcauaaguua

SEQ ID NO: 1722587 - RNA, 23 nt, Human
uuccauaaucuggacuccucugu

SEQ ID NO: 1722588 - RNA, 22 nt, Human
uuccauaaucuggacuccucug

SEQ ID NO: 1722589 - RNA, 19 nt, Human
uuccauaaucuggacuccu

SEQ ID NO: 1722590 - RNA, 23 nt, Human
uucccaaagcagugcaugcuguc

SEQ ID NO: 1722591 - RNA, 22 nt, Human
uuccagugaggcucugcccuug

SEQ ID NO: 1722592 - RNA, 21 nt, Human
uuccagugaggcucugcccuu

SEQ ID NO: 1722593 - RNA, 20 nt, Human
uuccagugaggcucugcccu

SEQ ID NO: 1722594 - RNA, 19 nt, Human
uuccagugaggcucugccc

SEQ ID NO: 1722595 - RNA, 17 nt, Human
uuccagugaggcucugc

SEQ ID NO: 1722596 - RNA, 21 nt, Human
uuccaggggugggacacccug

SEQ ID NO: 1722597 - RNA, 13 nt, Human
uuccaggcuggga

SEQ ID NO: 1722598 - RNA, 13 nt, Human
uucccaacacaaa

SEQ ID NO: 1722599 - RNA, 15 nt, Human
uucccaacacaaaga

SEQ ID NO: 1722600 - RNA, 16 nt, Human
uucccaagcucugcuc

SEQ ID NO: 1722601 - RNA, 15 nt, Human
uucccaagcucugcu

SEQ ID NO: 1722602 - RNA, 14 nt, Human
uucccaagcucugc

SEQ ID NO: 1722603 - RNA, 13 nt, Human
uucccaagcucug

SEQ ID NO: 1722604 - RNA, 18 nt, Human
uucccaagcucugcuccu

SEQ ID NO: 1722605 - RNA, 22 nt, Human
uucccaccucucucacuccuug

SEQ ID NO: 1722606 - RNA, 12 nt, Human
uucccaccucuc

SEQ ID NO: 1722607 - RNA, 19 nt, Human
uuccaccaucaagccacca

SEQ ID NO: 1722608 - RNA, 22 nt, Human
uuccacaagagcccaggccucc

SEQ ID NO: 1722609 - RNA, 17 nt, Human
uuccaggggugggacac

SEQ ID NO: 1722610 - RNA, 13 nt, Human
uuccacagaggac

SEQ ID NO: 1722611 - RNA, 17 nt, Human
uuccaaggguacuaagg

SEQ ID NO: 1722612 - RNA, 15 nt, Human
uuccaaggguacuaa

SEQ ID NO: 1722613 - RNA, 18 nt, Human
uucauuuaggugaggaag

SEQ ID NO: 1722614 - RNA, 16 nt, Human
auauguggaguucauc

SEQ ID NO: 1722615 - RNA, 15 nt, Human
auauguggaguucau

SEQ ID NO: 1722616 - RNA, 14 nt, Human
auauauuuuaagac

SEQ ID NO: 1722617 - RNA, 20 nt, Human
auaucugaaaauguaugugu

SEQ ID NO: 1722618 - RNA, 17 nt, Human
auaucugaaaauguaug

SEQ ID NO: 1722619 - RNA, 16 nt, Human
auaucugaaaauguau

SEQ ID NO: 1722620 - RNA, 14 nt, Human
auaugcacacauuu

SEQ ID NO: 1722621 - RNA, 15 nt, Human
auaugcacacauuuu

SEQ ID NO: 1722622 - RNA, 16 nt, Human
auaugcacacauuuuu

SEQ ID NO: 1722623 - RNA, 22 nt, Human
auaugcacacauuuuuuaaaug

SEQ ID NO: 1722624 - RNA, 16 nt, Human
auauguaacaagccac

SEQ ID NO: 1722625 - RNA, 17 nt, Human
auauguaacaagccacc

SEQ ID NO: 1722626 - RNA, 22 nt, Human
auauguaaaugguaugucauuc

SEQ ID NO: 1722627 - RNA, 11 nt, Human
uucagaaaugu

SEQ ID NO: 1722628 - RNA, 13 nt, Human
uucagaaaugugu

SEQ ID NO: 1722629 - RNA, 13 nt, Human
uucagugccuuau

SEQ ID NO: 1722630 - RNA, 12 nt, Human
uucagugccuua

SEQ ID NO: 1722631 - RNA, 16 nt, Human
uucagugccaaaaaca

SEQ ID NO: 1722632 - RNA, 18 nt, Human
uucagugccuuauggaac

SEQ ID NO: 1722633 - RNA, 19 nt, Human
uucauaauuauuauuuggc

SEQ ID NO: 1722634 - RNA, 13 nt, Human
auauauuuuaaga

SEQ ID NO: 1722635 - RNA, 12 nt, Human
auauauuuuaag

SEQ ID NO: 1722636 - RNA, 17 nt, Human
uucaucccucuggggcu

SEQ ID NO: 1722637 - RNA, 21 nt, Human
uucaucccucuggggcuguuc

SEQ ID NO: 1722638 - RNA, 21 nt, Human
auugacccacaagaaaugaaa

SEQ ID NO: 1722639 - RNA, 18 nt, Human
auugacaggauuauugga

SEQ ID NO: 1722640 - RNA, 15 nt, Human
auugcaacaggcugg

SEQ ID NO: 1722641 - RNA, 13 nt, Human
auugaccugaggc

SEQ ID NO: 1722642 - RNA, 17 nt, Human
auugaccugaggcccuu

SEQ ID NO: 1722643 - RNA, 21 nt, Human
auugcaacaggcugggcuuca

SEQ ID NO: 1722644 - RNA, 16 nt, Human
auugcaacaggcuggg

SEQ ID NO: 1722645 - RNA, 12 nt, Human
auugcaauagaa

SEQ ID NO: 1722646 - RNA, 23 nt, Human
auugccauuucuuccacaagagc

SEQ ID NO: 1722647 - RNA, 17 nt, Human
auugcauuuccugacag

SEQ ID NO: 1722648 - RNA, 21 nt, Human
auugcccacgcuggagugcag

SEQ ID NO: 1722649 - RNA, 17 nt, Human
auugcccacgcuggagu

SEQ ID NO: 1722650 - RNA, 19 nt, Human
auugcggacagccacggcc

SEQ ID NO: 1722651 - RNA, 18 nt, Human
auugcggacagccacggc

SEQ ID NO: 1722652 - RNA, 16 nt, Human
auugcggacagccacg

SEQ ID NO: 1722653 - RNA, 20 nt, Human
auugacacuuaaaaaugguu

SEQ ID NO: 1722654 - RNA, 17 nt, Human
auucuccaccugccagg

SEQ ID NO: 1722655 - RNA, 16 nt, Human
auucuccaccugccag

SEQ ID NO: 1722656 - RNA, 13 nt, Human
auucuccaccugc

SEQ ID NO: 1722657 - RNA, 20 nt, Human
auucucagaaucucaaauaa

SEQ ID NO: 1722658 - RNA, 18 nt, Human
auucucagaaucucaaau

SEQ ID NO: 1722659 - RNA, 16 nt, Human
auucuacuuugagugc

SEQ ID NO: 1722660 - RNA, 13 nt, Human
auucuacuuugag

SEQ ID NO: 1722661 - RNA, 14 nt, Human
auucucagaaucuc

SEQ ID NO: 1722662 - RNA, 18 nt, Human
auucuccaccugccaggg

SEQ ID NO: 1722663 - RNA, 14 nt, Human
auugcuacuguccu

SEQ ID NO: 1722664 - RNA, 19 nt, Human
auuuaaaacauuaaaauau

SEQ ID NO: 1722665 - RNA, 20 nt, Human
auuuaaaacauuaaaauaua

SEQ ID NO: 1722666 - RNA, 21 nt, Human
auuuaaaacauuaaaauauaa

SEQ ID NO: 1722667 - RNA, 20 nt, Human
auuuaacagaaauguacagc

SEQ ID NO: 1722668 - RNA, 17 nt, Human
auuuaacagaaauguac

SEQ ID NO: 1722669 - RNA, 19 nt, Human
auuuaacagaaauguacag

SEQ ID NO: 1722670 - RNA, 15 nt, Human
auuuaacagaaaugu

SEQ ID NO: 1722671 - RNA, 16 nt, Human
auuuaacagaaaugua

SEQ ID NO: 1722672 - RNA, 22 nt, Human
auuuacaacugggggaggguga

SEQ ID NO: 1722673 - RNA, 19 nt, Human
auuuacccuucuuuucuga

SEQ ID NO: 1722674 - RNA, 16 nt, Human
auuuacaaaugggaaa

SEQ ID NO: 1722675 - RNA, 23 nt, Human
auuuaauuuuuuugagacagagu

SEQ ID NO: 1722676 - RNA, 19 nt, Human
auuuaauuuuuuugagaca

SEQ ID NO: 1722677 - RNA, 14 nt, Human
auuguauuacaaau

SEQ ID NO: 1722678 - RNA, 15 nt, Human
auuguauuacaaauc

SEQ ID NO: 1722679 - RNA, 13 nt, Human
auugugccccugc

SEQ ID NO: 1722680 - RNA, 15 nt, Human
auugugaaauuauuc

SEQ ID NO: 1722681 - RNA, 23 nt, Human
auuggcuuuggguugcaggaccu

SEQ ID NO: 1722682 - RNA, 13 nt, Human
auuuaaaagauac

SEQ ID NO: 1722683 - RNA, 15 nt, Human
auuugaggucuguuc

SEQ ID NO: 1722684 - RNA, 23 nt, Human
auuugaggucuguucuuuccaaa

SEQ ID NO: 1722685 - RNA, 17 nt, Human
auuugagcagggcucag

SEQ ID NO: 1722686 - RNA, 20 nt, Human
auuucuuuugccguuauuaa

SEQ ID NO: 1722687 - RNA, 18 nt, Human
auuuggugguuucagaaa

SEQ ID NO: 1722688 - RNA, 20 nt, Human
auuuggugguuucagaaaug

SEQ ID NO: 1722689 - RNA, 17 nt, Human
auuuggugguuucagaa

SEQ ID NO: 1722690 - RNA, 20 nt, Human
auuuauuaaaugcccagccc

SEQ ID NO: 1722691 - RNA, 22 nt, Human
auuuauuaaaugcccagccccu

SEQ ID NO: 1722692 - RNA, 13 nt, Human
auuuauuauggca

SEQ ID NO: 1722693 - RNA, 21 nt, Human
auuucuaaaucuccaaaauaa

SEQ ID NO: 1722694 - RNA, 12 nt, Human
auuucuaaaucu

SEQ ID NO: 1722695 - RNA, 13 nt, Human
auuucuaaaucuc

SEQ ID NO: 1722696 - RNA, 14 nt, Human
auuuccugugucuu

SEQ ID NO: 1722697 - RNA, 16 nt, Human
auuuauuauggcacau

SEQ ID NO: 1722698 - RNA, 17 nt, Human
auuuuauuaugcaugaa

SEQ ID NO: 1722699 - RNA, 14 nt, Human
auuuuauuaugcau

SEQ ID NO: 1722700 - RNA, 15 nt, Human
auuuuauuaugcaug

SEQ ID NO: 1722701 - RNA, 13 nt, Human
auuuuauuaugca

SEQ ID NO: 1722702 - RNA, 21 nt, Human
auuuuacuuuaaaaggagcca

SEQ ID NO: 1722703 - RNA, 18 nt, Human
auuuuauguugcauagaa

SEQ ID NO: 1722704 - RNA, 14 nt, Human
auuuuauguugcau

SEQ ID NO: 1722705 - RNA, 21 nt, Human
auuuuauguugcauagaauaa

SEQ ID NO: 1722706 - RNA, 20 nt, Human
auuuuacuguacagacagaa

SEQ ID NO: 1722707 - RNA, 22 nt, Human
auuuuacuguacagacagaaaa

SEQ ID NO: 1722708 - RNA, 23 nt, Human
auuucuuuugccguuauuaaaaa

SEQ ID NO: 1722709 - RNA, 22 nt, Human
uuuuuguuccacaaguuaaaua

SEQ ID NO: 1722710 - RNA, 19 nt, Human
auuaccacagacauacuaa

SEQ ID NO: 1722711 - RNA, 12 nt, Human
auuaccagggac

SEQ ID NO: 1722712 - RNA, 22 nt, Human
auuaccugaauuuuggcugugu

SEQ ID NO: 1722713 - RNA, 16 nt, Human
auuauauuuacaaaug

SEQ ID NO: 1722714 - RNA, 17 nt, Human
auuauauuuacaaaugg

SEQ ID NO: 1722715 - RNA, 18 nt, Human
auuauuuuauguugcaua

SEQ ID NO: 1722716 - RNA, 16 nt, Human
auuauuuuauguugca

SEQ ID NO: 1722717 - RNA, 23 nt, Human
auuauuuauuaaaugcccagccc

SEQ ID NO: 1722718 - RNA, 16 nt, Human
auucaaaaugauguau

SEQ ID NO: 1722719 - RNA, 14 nt, Human
auucagcucaugga

SEQ ID NO: 1722720 - RNA, 22 nt, Human
auucaggaagcucagggccugg

SEQ ID NO: 1722721 - RNA, 21 nt, Human
auucaggaagcucagggccug

SEQ ID NO: 1722722 - RNA, 18 nt, Human
auucagcucugcaagaau

SEQ ID NO: 1722723 - RNA, 14 nt, Human
auucagcucugcaa

SEQ ID NO: 1722724 - RNA, 16 nt, Human
auucaguuguuagugu

SEQ ID NO: 1722725 - RNA, 23 nt, Human
auucaggaagcucagggccuggc

SEQ ID NO: 1722726 - RNA, 21 nt, Human
auucaguuguuagugugucuu

SEQ ID NO: 1722727 - RNA, 19 nt, Human
auuccccaggaggccagcc

SEQ ID NO: 1722728 - RNA, 16 nt, Human
auuccccaggaggcca

SEQ ID NO: 1722729 - RNA, 20 nt, Human
auuccccagauugcaacagg

SEQ ID NO: 1722730 - RNA, 20 nt, Human
auuccacuuauaggaauuga

SEQ ID NO: 1722731 - RNA, 21 nt, Human
uuuuaaguuacacauuuuuca

SEQ ID NO: 1722732 - RNA, 22 nt, Human
uuuuaaguuacacauuuuucag

SEQ ID NO: 1722733 - RNA, 16 nt, Human
uuuuaagugcugcauu

SEQ ID NO: 1722734 - RNA, 17 nt, Human
uuuuaagugcugcauuu

SEQ ID NO: 1722735 - RNA, 21 nt, Human
uuuuaagugcugcauuuaaaa

SEQ ID NO: 1722736 - RNA, 15 nt, Human
auguugaagccuuug

SEQ ID NO: 1722737 - RNA, 16 nt, Human
auguugaagccuuugu

SEQ ID NO: 1722738 - RNA, 19 nt, Human
auguucaucaaugaaugaa

SEQ ID NO: 1722739 - RNA, 21 nt, Human
auguucaucauccuaagcuau

SEQ ID NO: 1722740 - RNA, 12 nt, Human
uuuuauaaacuu

SEQ ID NO: 1722741 - RNA, 13 nt, Human
uuuuauaaacuuu

SEQ ID NO: 1722742 - RNA, 19 nt, Human
uuuuaguugcaacuuugua

SEQ ID NO: 1722743 - RNA, 23 nt, Human
uuuuagaguugauacuacaguuu

SEQ ID NO: 1722744 - RNA, 16 nt, Human
auguuggccaggcugg

SEQ ID NO: 1722745 - RNA, 16 nt, Human
auguuggccaggcugc

SEQ ID NO: 1722746 - RNA, 14 nt, Human
auguuggccaggcu

SEQ ID NO: 1722747 - RNA, 15 nt, Human
auguugcauagaaua

SEQ ID NO: 1722748 - RNA, 18 nt, Human
uuuuaugugaaacauguu

SEQ ID NO: 1722749 - RNA, 19 nt, Human
uuuuaugugaaacauguuu

SEQ ID NO: 1722750 - RNA, 22 nt, Human
uuuuauguugcauagaauaaaa

SEQ ID NO: 1722751 - RNA, 19 nt, Human
uuuuauaaacuuuaccuuu

SEQ ID NO: 1722752 - RNA, 14 nt, Human
uuuuauaaacuuua

SEQ ID NO: 1722753 - RNA, 17 nt, Human
uuuuauaaacuuuaccu

SEQ ID NO: 1722754 - RNA, 19 nt, Human
uuuuccagguuuaagcugu

SEQ ID NO: 1722755 - RNA, 21 nt, Human
uuuuauucagcucauggacuu

SEQ ID NO: 1722756 - RNA, 22 nt, Human
uuuucagauauaaaagacugac

SEQ ID NO: 1722757 - RNA, 19 nt, Human
uuuucagauauaaaagacu

SEQ ID NO: 1722758 - RNA, 21 nt, Human
uuuucagauauaaaagacuga

SEQ ID NO: 1722759 - RNA, 17 nt, Human
auuaaccacuucagcug

SEQ ID NO: 1722760 - RNA, 20 nt, Human
auuaaccacuucagcugacu

SEQ ID NO: 1722761 - RNA, 18 nt, Human
auuaaccacuucagcuga

SEQ ID NO: 1722762 - RNA, 17 nt, Human
auuaaacuuaaucuaaa

SEQ ID NO: 1722763 - RNA, 16 nt, Human
auuaaacuuaaucuaa

SEQ ID NO: 1722764 - RNA, 19 nt, Human
auuaaacuuaaucuaaaug

SEQ ID NO: 1722765 - RNA, 21 nt, Human
auuaaacuuaaucuaaaugga

SEQ ID NO: 1722766 - RNA, 11 nt, Human
auuaagaaaua

SEQ ID NO: 1722767 - RNA, 12 nt, Human
auuaagaaauag

SEQ ID NO: 1722768 - RNA, 14 nt, Human
auuaagaaagacua

SEQ ID NO: 1722769 - RNA, 13 nt, Human
auuaagaaagacu

SEQ ID NO: 1722770 - RNA, 23 nt, Human
auuaacuuuuauaaacuuuaccu

SEQ ID NO: 1722771 - RNA, 16 nt, Human
auuaacuuuuauaaac

SEQ ID NO: 1722772 - RNA, 17 nt, Human
auuaacuuuuauaaacu

SEQ ID NO: 1722773 - RNA, 19 nt, Human
auuaacuuuuauaaacuuu

SEQ ID NO: 1722774 - RNA, 20 nt, Human
auuaacuuuuauaaacuuua

SEQ ID NO: 1722775 - RNA, 12 nt, Human
auuaacuuuuau

SEQ ID NO: 1722776 - RNA, 14 nt, Human
auguuuuccaugag

SEQ ID NO: 1722777 - RNA, 18 nt, Human
auguuuuucuucucccuc

SEQ ID NO: 1722778 - RNA, 17 nt, Human
auguuuuucuucucccu

SEQ ID NO: 1722779 - RNA, 13 nt, Human
auuaaaauauaau

SEQ ID NO: 1722780 - RNA, 18 nt, Human
auuaaaauauaaucucua

SEQ ID NO: 1722781 - RNA, 21 nt, Human
uuugcuguagaagauggcacu

SEQ ID NO: 1722782 - RNA, 15 nt, Human
uuugcuucaaaaaca

SEQ ID NO: 1722783 - RNA, 22 nt, Human
uuugggaggccaaggugggagg

SEQ ID NO: 1722784 - RNA, 14 nt, Human
uuuggggauauuuu

SEQ ID NO: 1722785 - RNA, 22 nt, Human
uuugccauguuggccaggcugg

SEQ ID NO: 1722786 - RNA, 22 nt, Human
uuugggggaaaauuuagaaaua

SEQ ID NO: 1722787 - RNA, 15 nt, Human
auguaucaaugagua

SEQ ID NO: 1722788 - RNA, 12 nt, Human
auguauguguaa

SEQ ID NO: 1722789 - RNA, 15 nt, Human
auguaucugagcagg

SEQ ID NO: 1722790 - RNA, 20 nt, Human
augucccaacuuguaaaaau

SEQ ID NO: 1722791 - RNA, 16 nt, Human
auguccacugguucuu

SEQ ID NO: 1722792 - RNA, 24 nt, Human
augucccuaccgagucucuucucc

SEQ ID NO: 1722793 - RNA, 23 nt, Human
auguccaagaagcccaggaaagg

SEQ ID NO: 1722794 - RNA, 18 nt, Human
auguccaagaagcccagg

SEQ ID NO: 1722795 - RNA, 19 nt, Human
auguccaagaagcccagga

SEQ ID NO: 1722796 - RNA, 16 nt, Human
augucagugugacuga

SEQ ID NO: 1722797 - RNA, 15 nt, Human
augucagugugacug

SEQ ID NO: 1722798 - RNA, 21 nt, Human
augucagugugacugaucucu

SEQ ID NO: 1722799 - RNA, 16 nt, Human
uuugugagcaggcugu

SEQ ID NO: 1722800 - RNA, 19 nt, Human
uuugugaggaagccgcugg

SEQ ID NO: 1722801 - RNA, 18 nt, Human
uuugugaggaagccgcug

SEQ ID NO: 1722802 - RNA, 17 nt, Human
uuuguuucuuucucuga

SEQ ID NO: 1722803 - RNA, 12 nt, Human
uuuguuugaacu

SEQ ID NO: 1722804 - RNA, 13 nt, Human
uuuguuugaacug

SEQ ID NO: 1722805 - RNA, 14 nt, Human
uuuguuugaacuga

SEQ ID NO: 1722806 - RNA, 13 nt, Human
uuuguagagccag

SEQ ID NO: 1722807 - RNA, 13 nt, Human
uuuguaaauuguc

SEQ ID NO: 1722808 - RNA, 22 nt, Human
uuuuaaaacacuuccauaaucu

SEQ ID NO: 1722809 - RNA, 16 nt, Human
uuuuaaaacacuucca

SEQ ID NO: 1722810 - RNA, 18 nt, Human
uuuguuugaacugauaaa

SEQ ID NO: 1722811 - RNA, 15 nt, Human
uuuuaagaggcaggg

SEQ ID NO: 1722812 - RNA, 16 nt, Human
uuuuaagaggcagggu

SEQ ID NO: 1722813 - RNA, 15 nt, Human
uuuuaagugcugcau

SEQ ID NO: 1722814 - RNA, 16 nt, Human
uuuuaaguaaggaauu

SEQ ID NO: 1722815 - RNA, 23 nt, Human
uuuuaaggguuuguggaaaauga

SEQ ID NO: 1722816 - RNA, 20 nt, Human
uuuuaaggguuuguggaaaa

SEQ ID NO: 1722817 - RNA, 18 nt, Human
uuagccaagugugguaga

SEQ ID NO: 1722818 - RNA, 14 nt, Human
uuagcggagacgga

SEQ ID NO: 1722819 - RNA, 18 nt, Human
uuagcaaauucuguuuuu

SEQ ID NO: 1722820 - RNA, 12 nt, Human
uuagcaccaggg

SEQ ID NO: 1722821 - RNA, 18 nt, Human
auaauuuaccugaagucu

SEQ ID NO: 1722822 - RNA, 20 nt, Human
uuagggaaggauacaaaagc

SEQ ID NO: 1722823 - RNA, 21 nt, Human
uuaggugugacugaauuucuu

SEQ ID NO: 1722824 - RNA, 16 nt, Human
uuaggugaggaagcaa

SEQ ID NO: 1722825 - RNA, 16 nt, Human
uuaggugugacugaau

SEQ ID NO: 1722826 - RNA, 22 nt, Human
uuaguuugcaguuacacuaaaa

SEQ ID NO: 1722827 - RNA, 15 nt, Human
uuaguuucuccaagc

SEQ ID NO: 1722828 - RNA, 18 nt, Human
auaauccuaaacauauga

SEQ ID NO: 1722829 - RNA, 22 nt, Human
auaaucuggacuccucugucca

SEQ ID NO: 1722830 - RNA, 20 nt, Human
auaaucuggacuccucuguc

SEQ ID NO: 1722831 - RNA, 19 nt, Human
auaaucuggacuccucugu

SEQ ID NO: 1722832 - RNA, 18 nt, Human
auaaucuggacuccucug

SEQ ID NO: 1722833 - RNA, 18 nt, Human
auaaucucuccauucccg

SEQ ID NO: 1722834 - RNA, 22 nt, Human
auaauugacaggauuauuggaa

SEQ ID NO: 1722835 - RNA, 15 nt, Human
auaaugaaugaaaca

SEQ ID NO: 1722836 - RNA, 15 nt, Human
auaaugcgugcauac

SEQ ID NO: 1722837 - RNA, 20 nt, Human
auaaugcgugcauaccacuu

SEQ ID NO: 1722838 - RNA, 12 nt, Human
auaauacaccac

SEQ ID NO: 1722839 - RNA, 18 nt, Human
auaauacaccacuacauu

SEQ ID NO: 1722840 - RNA, 20 nt, Human
auaauacaccacuacauucu

SEQ ID NO: 1722841 - RNA, 19 nt, Human
auaauacuugcuuuggaaa

SEQ ID NO: 1722842 - RNA, 14 nt, Human
uuagacagucccug

SEQ ID NO: 1722843 - RNA, 23 nt, Human
auaauaaagaauagcuuuaauga

SEQ ID NO: 1722844 - RNA, 13 nt, Human
auaauaaagaaua

SEQ ID NO: 1722845 - RNA, 14 nt, Human
auaauaaagaauag

SEQ ID NO: 1722846 - RNA, 19 nt, Human
uuacccucauguucuuaau

SEQ ID NO: 1722847 - RNA, 24 nt, Human
uuacaggcgugagccaccgugccu

SEQ ID NO: 1722848 - RNA, 18 nt, Human
uuacaggcuccugccacc

SEQ ID NO: 1722849 - RNA, 16 nt, Human
uuacaggcuccugcca

SEQ ID NO: 1722850 - RNA, 20 nt, Human
uuaccuuugacaaagguaaa

SEQ ID NO: 1722851 - RNA, 13 nt, Human
uuaccuuugacaa

SEQ ID NO: 1722852 - RNA, 13 nt, Human
uuagacagucccu

SEQ ID NO: 1722853 - RNA, 20 nt, Human
uuagacagagucucacuguu

SEQ ID NO: 1722854 - RNA, 13 nt, Human
uuagacagagucu

SEQ ID NO: 1722855 - RNA, 17 nt, Human
uuagaaauugcauuucc

SEQ ID NO: 1722856 - RNA, 23 nt, Human
uuacucuucaguuaagccuuugg

SEQ ID NO: 1722857 - RNA, 11 nt, Human
auaaauuauuu

SEQ ID NO: 1722858 - RNA, 22 nt, Human
auaacgauaaaagacagugaaa

SEQ ID NO: 1722859 - RNA, 14 nt, Human
auaacguauaaaag

SEQ ID NO: 1722860 - RNA, 16 nt, Human
auaacuaaaagguaug

SEQ ID NO: 1722861 - RNA, 13 nt, Human
auaaauaaaaaua

SEQ ID NO: 1722862 - RNA, 17 nt, Human
auaaagguucaugcaaa

SEQ ID NO: 1722863 - RNA, 15 nt, Human
auaaagguucaugca

SEQ ID NO: 1722864 - RNA, 14 nt, Human
auaaauaaaaauaa

SEQ ID NO: 1722865 - RNA, 15 nt, Human
auaaauaguuuauga

SEQ ID NO: 1722866 - RNA, 13 nt, Human
uuaaacagaggau

SEQ ID NO: 1722867 - RNA, 14 nt, Human
uuaaaaaucucaaa

SEQ ID NO: 1722868 - RNA, 15 nt, Human
uuaaaaaucucaaau

SEQ ID NO: 1722869 - RNA, 16 nt, Human
uuaaaaaucucaaauu

SEQ ID NO: 1722870 - RNA, 17 nt, Human
uuaaaaaucucaaauuu

SEQ ID NO: 1722871 - RNA, 15 nt, Human
uuaaauaaugugaaa

SEQ ID NO: 1722872 - RNA, 19 nt, Human
uuaaauaaugugaaacugg

SEQ ID NO: 1722873 - RNA, 16 nt, Human
uuaaauaaugugaaac

SEQ ID NO: 1722874 - RNA, 18 nt, Human
uuaaauaaugugaaacug

SEQ ID NO: 1722875 - RNA, 19 nt, Human
uuaacagaaauguacagca

SEQ ID NO: 1722876 - RNA, 20 nt, Human
uuaacagaaauguacagcaa

SEQ ID NO: 1722877 - RNA, 14 nt, Human
aguuuaaauuguaa

SEQ ID NO: 1722878 - RNA, 13 nt, Human
aguuggucccccu

SEQ ID NO: 1722879 - RNA, 11 nt, Human
aguuggucccc

SEQ ID NO: 1722880 - RNA, 17 nt, Human
aguuggucccccuucca

SEQ ID NO: 1722881 - RNA, 13 nt, Human
uuaaaaaaaaucc

SEQ ID NO: 1722882 - RNA, 14 nt, Human
aguuuaauugacuu

SEQ ID NO: 1722883 - RNA, 15 nt, Human
aguuuaauugacuua

SEQ ID NO: 1722884 - RNA, 18 nt, Human
aguuuaauugacuuauuu

SEQ ID NO: 1722885 - RNA, 23 nt, Human
aguugccagucaccccggccacc

SEQ ID NO: 1722886 - RNA, 13 nt, Human
aguugggcuuccu

SEQ ID NO: 1722887 - RNA, 19 nt, Human
aguugggcuuccucauagu

SEQ ID NO: 1722888 - RNA, 17 nt, Human
aguuggguggaugccug

SEQ ID NO: 1722889 - RNA, 15 nt, Human
uuaagugcugcauuu

SEQ ID NO: 1722890 - RNA, 16 nt, Human
uuaagugcugcauuua

SEQ ID NO: 1722891 - RNA, 19 nt, Human
uuaagugcugcauuuaaaa

SEQ ID NO: 1722892 - RNA, 9 nt, Human
uuaaggugg

SEQ ID NO: 1722893 - RNA, 22 nt, Human
uuaagaaagacuaucuaaaugu

SEQ ID NO: 1722894 - RNA, 22 nt, Human
uuaagaaauagacagcaugaga

SEQ ID NO: 1722895 - RNA, 22 nt, Human
uuaaucauuaggugugacugaa

SEQ ID NO: 1722896 - RNA, 23 nt, Human
uuaaucauuaggugugacugaau

SEQ ID NO: 1722897 - RNA, 21 nt, Human
uuaaucugggccagaauuuca

SEQ ID NO: 1722898 - RNA, 17 nt, Human
uuaaucucuaacagugg

SEQ ID NO: 1722899 - RNA, 13 nt, Human
uuaaucauuaggu

SEQ ID NO: 1722900 - RNA, 22 nt, Human
uuaauauuuauaggucacuuug

SEQ ID NO: 1722901 - RNA, 19 nt, Human
uuaaugaaagacuguacaa

SEQ ID NO: 1722902 - RNA, 21 nt, Human
uuaauugacuuauuuauauaa

SEQ ID NO: 1722903 - RNA, 18 nt, Human
uuaaugaaagacuguaca

SEQ ID NO: 1722904 - RNA, 22 nt, Human
uuaaucugguuuauuuuuguuc

SEQ ID NO: 1722905 - RNA, 18 nt, Human
uuaaucucuaacagugga

SEQ ID NO: 1722906 - RNA, 23 nt, Human
aguuuuuauggcuuuugugcauu

SEQ ID NO: 1722907 - RNA, 12 nt, Human
aguuuuguaaau

SEQ ID NO: 1722908 - RNA, 15 nt, Human
aguuuuguaaauuuc

SEQ ID NO: 1722909 - RNA, 18 nt, Human
auaaaagccuguuuaaga

SEQ ID NO: 1722910 - RNA, 13 nt, Human
auaaaagccuguu

SEQ ID NO: 1722911 - RNA, 15 nt, Human
aguuuuuauugcuug

SEQ ID NO: 1722912 - RNA, 20 nt, Human
aguuuuuauugcuuguugga

SEQ ID NO: 1722913 - RNA, 20 nt, Human
uuaagaaaaaggaugcacag

SEQ ID NO: 1722914 - RNA, 21 nt, Human
uuaagaaaaaggaugcacaga

SEQ ID NO: 1722915 - RNA, 16 nt, Human
aguggaaccagcccag

SEQ ID NO: 1722916 - RNA, 18 nt, Human
uguucuuaguuugcaguu

SEQ ID NO: 1722917 - RNA, 18 nt, Human
uguucuagcauggcugcc

SEQ ID NO: 1722918 - RNA, 21 nt, Human
aguuacucuucaguuaagccu

SEQ ID NO: 1722919 - RNA, 15 nt, Human
uguugcccaggcugg

SEQ ID NO: 1722920 - RNA, 14 nt, Human
uguugcccaggcug

SEQ ID NO: 1722921 - RNA, 21 nt, Human
uguugcccaggcuggagugca

SEQ ID NO: 1722922 - RNA, 13 nt, Human
uguugcccaggcu

SEQ ID NO: 1722923 - RNA, 19 nt, Human
uguucuuucacccuuuucu

SEQ ID NO: 1722924 - RNA, 22 nt, Human
uguucuugguuuguaaauuaac

SEQ ID NO: 1722925 - RNA, 20 nt, Human
uguucuugguuuguaaauua

SEQ ID NO: 1722926 - RNA, 21 nt, Human
aguguucauaaauaaaguuug

SEQ ID NO: 1722927 - RNA, 20 nt, Human
aguucggugagcuacaaaug

SEQ ID NO: 1722928 - RNA, 19 nt, Human
aguucggugagcuacaaau

SEQ ID NO: 1722929 - RNA, 12 nt, Human
aguucucuccuu

SEQ ID NO: 1722930 - RNA, 16 nt, Human
aguucaauucucauuu

SEQ ID NO: 1722931 - RNA, 23 nt, Human
aguuccucauuagcauuuugcua

SEQ ID NO: 1722932 - RNA, 15 nt, Human
aguucccuacuuccu

SEQ ID NO: 1722933 - RNA, 17 nt, Human
uguuuauugucaaagug

SEQ ID NO: 1722934 - RNA, 14 nt, Human
uguuuauugucaaa

SEQ ID NO: 1722935 - RNA, 17 nt, Human
uguuuaguaaucauauu

SEQ ID NO: 1722936 - RNA, 14 nt, Human
uguuuaguaaucau

SEQ ID NO: 1722937 - RNA, 13 nt, Human
uguuuaguaauca

SEQ ID NO: 1722938 - RNA, 12 nt, Human
ugugguuucauu

SEQ ID NO: 1722939 - RNA, 19 nt, Human
ugugucagcauagaaguaa

SEQ ID NO: 1722940 - RNA, 16 nt, Human
agugcuuccaaggaug

SEQ ID NO: 1722941 - RNA, 21 nt, Human
agugccuguaaucacagcuac

SEQ ID NO: 1722942 - RNA, 15 nt, Human
agugccuuacacaau

SEQ ID NO: 1722943 - RNA, 17 nt, Human
agugccuuacacaaugg

SEQ ID NO: 1722944 - RNA, 20 nt, Human
agugcugcauuuaaaagaua

SEQ ID NO: 1722945 - RNA, 19 nt, Human
agugcugggauuacaggug

SEQ ID NO: 1722946 - RNA, 20 nt, Human
agugcugggauuacaggcgu

SEQ ID NO: 1722947 - RNA, 17 nt, Human
agugcugggauuacagg

SEQ ID NO: 1722948 - RNA, 22 nt, Human
agugcugcauuuaaaagauaca

SEQ ID NO: 1722949 - RNA, 20 nt, Human
agugcugggauuacaagcgu

SEQ ID NO: 1722950 - RNA, 21 nt, Human
uguuaacauggacaugaucuu

SEQ ID NO: 1722951 - RNA, 19 nt, Human
uguuaaugauagcuacugu

SEQ ID NO: 1722952 - RNA, 19 nt, Human
aguggaaaaauagccugcc

SEQ ID NO: 1722953 - RNA, 18 nt, Human
aguggaaaaauagccugc

SEQ ID NO: 1722954 - RNA, 11 nt, Human
aguggaaaaau

SEQ ID NO: 1722955 - RNA, 16 nt, Human
ugugucucuugguccu

SEQ ID NO: 1722956 - RNA, 20 nt, Human
ugugucuaggcaggaccugu

SEQ ID NO: 1722957 - RNA, 13 nt, Human
ugugucucuuggu

SEQ ID NO: 1722958 - RNA, 19 nt, Human
ugugucuaggcaggaccug

SEQ ID NO: 1722959 - RNA, 19 nt, Human
ugugucagguggggcagcu

SEQ ID NO: 1722960 - RNA, 17 nt, Human
ugugucagguggggcag

SEQ ID NO: 1722961 - RNA, 20 nt, Human
ugugucagguggggcagcuu

SEQ ID NO: 1722962 - RNA, 14 nt, Human
uguguuaugaagca

SEQ ID NO: 1722963 - RNA, 16 nt, Human
agugcaaugacacagu

SEQ ID NO: 1722964 - RNA, 18 nt, Human
agugcaaugacacagucu

SEQ ID NO: 1722965 - RNA, 24 nt, Human
agugauucuccugccucagccucc

SEQ ID NO: 1722966 - RNA, 22 nt, Human
agugauucuccugccucagccu

SEQ ID NO: 1722967 - RNA, 16 nt, Human
agugagucgaggacag

SEQ ID NO: 1722968 - RNA, 14 nt, Human
agugcccacaggau

SEQ ID NO: 1722969 - RNA, 14 nt, Human
agugcaugcugucc

SEQ ID NO: 1722970 - RNA, 16 nt, Human
agugccaaaaacaaca

SEQ ID NO: 1722971 - RNA, 14 nt, Human
agugcaucucagcc

SEQ ID NO: 1722972 - RNA, 15 nt, Human
agugcaucucagccc

SEQ ID NO: 1722973 - RNA, 17 nt, Human
agugcaucucagcccac

SEQ ID NO: 1722974 - RNA, 16 nt, Human
agugcaucucagccca

SEQ ID NO: 1722975 - RNA, 15 nt, Human
ugugcucuggacagg

SEQ ID NO: 1722976 - RNA, 23 nt, Human
ugugcucugaucauccacugugc

SEQ ID NO: 1722977 - RNA, 22 nt, Human
ugugcucugaucauccacugug

SEQ ID NO: 1722978 - RNA, 13 nt, Human
ugugccucugccu

SEQ ID NO: 1722979 - RNA, 12 nt, Human
ugugccucugcc

SEQ ID NO: 1722980 - RNA, 20 nt, Human
ugugcccuaaaguguauuuu

SEQ ID NO: 1722981 - RNA, 21 nt, Human
ugugcccuaaaguguauuuuu

SEQ ID NO: 1722982 - RNA, 19 nt, Human
agucucacuguugcccagg

SEQ ID NO: 1722983 - RNA, 18 nt, Human
agucucacuguugcccag

SEQ ID NO: 1722984 - RNA, 20 nt, Human
agucucacuguugcccaggc

SEQ ID NO: 1722985 - RNA, 21 nt, Human
agucucacuguugcccaggcu

SEQ ID NO: 1722986 - RNA, 15 nt, Human
ugugcugcccugccc

SEQ ID NO: 1722987 - RNA, 14 nt, Human
ugugcugcccugcc

SEQ ID NO: 1722988 - RNA, 13 nt, Human
ugugcugcccugc

SEQ ID NO: 1722989 - RNA, 19 nt, Human
ugugcucuggacaggcaug

SEQ ID NO: 1722990 - RNA, 18 nt, Human
ugugcucuggacaggcau

SEQ ID NO: 1722991 - RNA, 16 nt, Human
ugugcucuggacaggc

SEQ ID NO: 1722992 - RNA, 15 nt, Human
ugucaagccauaauu

SEQ ID NO: 1722993 - RNA, 19 nt, Human
ugucaagagggucugagga

SEQ ID NO: 1722994 - RNA, 16 nt, Human
uguauuuuuuuacuaa

SEQ ID NO: 1722995 - RNA, 21 nt, Human
ugucaagaauagcauuguaaa

SEQ ID NO: 1722996 - RNA, 14 nt, Human
uguauuuuuuuacu

SEQ ID NO: 1722997 - RNA, 16 nt, Human
aguaggaagacuuugg

SEQ ID NO: 1722998 - RNA, 22 nt, Human
aguaggaagacuuuggaaagac

SEQ ID NO: 1722999 - RNA, 19 nt, Human
aguaggaagacuuuggaaa

SEQ ID NO: 1723000 - RNA, 18 nt, Human
aguaggaagacuuuggaa

SEQ ID NO: 1723001 - RNA, 17 nt, Human
aguaggaagacuuugga

SEQ ID NO: 1723002 - RNA, 23 nt, Human
ugucauuugcuggagcucugccc

SEQ ID NO: 1723003 - RNA, 16 nt, Human
ugucagguggggcagc

SEQ ID NO: 1723004 - RNA, 19 nt, Human
ugucagcugaaccugggua

SEQ ID NO: 1723005 - RNA, 16 nt, Human
ugucagcugaaccugg

SEQ ID NO: 1723006 - RNA, 13 nt, Human
agucacugcacag

SEQ ID NO: 1723007 - RNA, 19 nt, Human
agucacugagacagcccgg

SEQ ID NO: 1723008 - RNA, 14 nt, Human
agucaccaagccca

SEQ ID NO: 1723009 - RNA, 13 nt, Human
agucaccaagccc

SEQ ID NO: 1723010 - RNA, 16 nt, Human
agucagacagaugugg

SEQ ID NO: 1723011 - RNA, 15 nt, Human
ugucgggcaugacac

SEQ ID NO: 1723012 - RNA, 14 nt, Human
ugucgggcaugaca

SEQ ID NO: 1723013 - RNA, 17 nt, Human
ugucguuaaaaacagau

SEQ ID NO: 1723014 - RNA, 15 nt, Human
ugucgcccagucugg

SEQ ID NO: 1723015 - RNA, 14 nt, Human
ugucgcccagucug

SEQ ID NO: 1723016 - RNA, 12 nt, Human
ugucgggcauga

SEQ ID NO: 1723017 - RNA, 13 nt, Human
ugucgccucugca

SEQ ID NO: 1723018 - RNA, 16 nt, Human
uguccuacccacccuc

SEQ ID NO: 1723019 - RNA, 16 nt, Human
ugucgcccaggcugga

SEQ ID NO: 1723020 - RNA, 15 nt, Human
ugucgcccaggcugg

SEQ ID NO: 1723021 - RNA, 14 nt, Human
uguccgagcuuuga

SEQ ID NO: 1723022 - RNA, 13 nt, Human
uguccgagcuuug

SEQ ID NO: 1723023 - RNA, 23 nt, Human
aguccgaaagggacuuggaagcu

SEQ ID NO: 1723024 - RNA, 17 nt, Human
agucucacuguugccca

SEQ ID NO: 1723025 - RNA, 16 nt, Human
agucucacuguugccc

SEQ ID NO: 1723026 - RNA, 12 nt, Human
agucccugccaa

SEQ ID NO: 1723027 - RNA, 22 nt, Human
aguccaggcuuuuuuaucaugu

SEQ ID NO: 1723028 - RNA, 17 nt, Human
aggugguuauggagagg

SEQ ID NO: 1723029 - RNA, 14 nt, Human
agguuggugggggc

SEQ ID NO: 1723030 - RNA, 17 nt, Human
uguaacuuucugaaaua

SEQ ID NO: 1723031 - RNA, 19 nt, Human
uguaagaucguucucugcc

SEQ ID NO: 1723032 - RNA, 20 nt, Human
uguaagaucguucucugccu

SEQ ID NO: 1723033 - RNA, 15 nt, Human
aggugcacaagcucc

SEQ ID NO: 1723034 - RNA, 20 nt, Human
aggugcacaagcuccaagcu

SEQ ID NO: 1723035 - RNA, 18 nt, Human
aggugcacaagcuccaag

SEQ ID NO: 1723036 - RNA, 17 nt, Human
aggugcacaagcuccaa

SEQ ID NO: 1723037 - RNA, 16 nt, Human
aggugcacaagcucca

SEQ ID NO: 1723038 - RNA, 23 nt, Human
aggucuugaacuccuggccucaa

SEQ ID NO: 1723039 - RNA, 10 nt, Human
aggucccuaa

SEQ ID NO: 1723040 - RNA, 21 nt, Human
aggugcacaagcuccaagcuc

SEQ ID NO: 1723041 - RNA, 14 nt, Human
agguggccacucca

SEQ ID NO: 1723042 - RNA, 17 nt, Human
agguggccacuccagac

SEQ ID NO: 1723043 - RNA, 20 nt, Human
aggugggauccuccaggugc

SEQ ID NO: 1723044 - RNA, 20 nt, Human
uguaggaagguuaauguuca

SEQ ID NO: 1723045 - RNA, 18 nt, Human
uguaggaagguuaauguu

SEQ ID NO: 1723046 - RNA, 12 nt, Human
aguagagacagg

SEQ ID NO: 1723047 - RNA, 17 nt, Human
aguagaagucuuagaug

SEQ ID NO: 1723048 - RNA, 16 nt, Human
aguacacuguuucaaa

SEQ ID NO: 1723049 - RNA, 20 nt, Human
aguacacuguuucaaacuuu

SEQ ID NO: 1723050 - RNA, 14 nt, Human
aguacacuguuuca

SEQ ID NO: 1723051 - RNA, 19 nt, Human
aguacuuuuggcauuuuac

SEQ ID NO: 1723052 - RNA, 21 nt, Human
aguaauccaagcaaaugugaa

SEQ ID NO: 1723053 - RNA, 14 nt, Human
aguaauccaccugc

SEQ ID NO: 1723054 - RNA, 15 nt, Human
aguaauccaagcaaa

SEQ ID NO: 1723055 - RNA, 23 nt, Human
aguaaggaauuuuauuuuuuucu

SEQ ID NO: 1723056 - RNA, 18 nt, Human
aguaauaugcacacauuu

SEQ ID NO: 1723057 - RNA, 19 nt, Human
aguaauaugcacacauuuu

SEQ ID NO: 1723058 - RNA, 20 nt, Human
aguaauaugcacacauuuuu

SEQ ID NO: 1723059 - RNA, 12 nt, Human
aguaaaaauaaa

SEQ ID NO: 1723060 - RNA, 15 nt, Human
aguaaaaauaaaauu

SEQ ID NO: 1723061 - RNA, 11 nt, Human
agguuuuccug

SEQ ID NO: 1723062 - RNA, 14 nt, Human
uguaauuugugaua

SEQ ID NO: 1723063 - RNA, 18 nt, Human
uguagaggagaaacugga

SEQ ID NO: 1723064 - RNA, 14 nt, Human
uguagagugggagc

SEQ ID NO: 1723065 - RNA, 13 nt, Human
uguagagugggag

SEQ ID NO: 1723066 - RNA, 13 nt, Human
aggguugggcugg

SEQ ID NO: 1723067 - RNA, 23 nt, Human
aggguuggccccugcccggcugc

SEQ ID NO: 1723068 - RNA, 18 nt, Human
aggguuggccccugcccg

SEQ ID NO: 1723069 - RNA, 23 nt, Human
agguacuuucauauuuuaaacag

SEQ ID NO: 1723070 - RNA, 19 nt, Human
agguagaaauaucugaaaa

SEQ ID NO: 1723071 - RNA, 17 nt, Human
agguagaaauaucugaa

SEQ ID NO: 1723072 - RNA, 23 nt, Human
agguagaaauaucugaaaaugua

SEQ ID NO: 1723073 - RNA, 21 nt, Human
agguaugcaaucaaaucugcu

SEQ ID NO: 1723074 - RNA, 23 nt, Human
agguauaauucacauuguauuca

SEQ ID NO: 1723075 - RNA, 20 nt, Human
agguauaaguggugugugua

SEQ ID NO: 1723076 - RNA, 19 nt, Human
agguauaaguggugugugu

SEQ ID NO: 1723077 - RNA, 12 nt, Human
aggucagagccu

SEQ ID NO: 1723078 - RNA, 17 nt, Human
aggucauuuuuuuuaag

SEQ ID NO: 1723079 - RNA, 20 nt, Human
aggucauuuuuuuuaagaaa

SEQ ID NO: 1723080 - RNA, 18 nt, Human
aggucaccuuuauucugg

SEQ ID NO: 1723081 - RNA, 19 nt, Human
aggucaccuuuauucuggc

SEQ ID NO: 1723082 - RNA, 13 nt, Human
aggguuauaauaa

SEQ ID NO: 1723083 - RNA, 22 nt, Human
aggguguccggucccuguccca

SEQ ID NO: 1723084 - RNA, 17 nt, Human
uggucugacccacugcu

SEQ ID NO: 1723085 - RNA, 16 nt, Human
uggucugacccacugc

SEQ ID NO: 1723086 - RNA, 20 nt, Human
uggucaccaaaucagcugcu

SEQ ID NO: 1723087 - RNA, 22 nt, Human
uggucagauuugaacucuucaa

SEQ ID NO: 1723088 - RNA, 18 nt, Human
uggucaccaaaucagcug

SEQ ID NO: 1723089 - RNA, 15 nt, Human
uggucccaccccaca

SEQ ID NO: 1723090 - RNA, 14 nt, Human
uggucccaccccac

SEQ ID NO: 1723091 - RNA, 13 nt, Human
uggucccacucag

SEQ ID NO: 1723092 - RNA, 16 nt, Human
uggucccaccccacac

SEQ ID NO: 1723093 - RNA, 16 nt, Human
uggucucaaacucuug

SEQ ID NO: 1723094 - RNA, 19 nt, Human
uggucuaucuuugagcgcc

SEQ ID NO: 1723095 - RNA, 23 nt, Human
uggucucaaacucuugaccucag

SEQ ID NO: 1723096 - RNA, 17 nt, Human
uggucucaaacucuuga

SEQ ID NO: 1723097 - RNA, 18 nt, Human
uggucucaaacuccugac

SEQ ID NO: 1723098 - RNA, 16 nt, Human
ugguacuaacuuuccu

SEQ ID NO: 1723099 - RNA, 17 nt, Human
ugguacucauuaaaaaa

SEQ ID NO: 1723100 - RNA, 20 nt, Human
ugguagcuuuucccuucuuu

SEQ ID NO: 1723101 - RNA, 21 nt, Human
ugguagcuuuucccuucuuuu

SEQ ID NO: 1723102 - RNA, 23 nt, Human
uggucacaggacucugccuccuc

SEQ ID NO: 1723103 - RNA, 22 nt, Human
uggucacaggacucugccuccu

SEQ ID NO: 1723104 - RNA, 19 nt, Human
ugggugcuuggaggaagga

SEQ ID NO: 1723105 - RNA, 15 nt, Human
ugggugcuuggagga

SEQ ID NO: 1723106 - RNA, 22 nt, Human
ugggugcuuggaggaaggaaac

SEQ ID NO: 1723107 - RNA, 15 nt, Human
agggugggagugggc

SEQ ID NO: 1723108 - RNA, 21 nt, Human
ugggucgcccuggacugugug

SEQ ID NO: 1723109 - RNA, 22 nt, Human
agggucucacucugucgcccag

SEQ ID NO: 1723110 - RNA, 23 nt, Human
agggucucacuauguugcccagg

SEQ ID NO: 1723111 - RNA, 22 nt, Human
agggucucacuauguugcccag

SEQ ID NO: 1723112 - RNA, 21 nt, Human
agggucucacuauguugccca

SEQ ID NO: 1723113 - RNA, 24 nt, Human
agggguucccuuuuuuggcugcug

SEQ ID NO: 1723114 - RNA, 18 nt, Human
aggggguggccucccaac

SEQ ID NO: 1723115 - RNA, 17 nt, Human
aggggguggccucccaa

SEQ ID NO: 1723116 - RNA, 15 nt, Human
aggggguggccuccc

SEQ ID NO: 1723117 - RNA, 22 nt, Human
aggggugggacacccugugaug

SEQ ID NO: 1723118 - RNA, 20 nt, Human
aggggugggacacccuguga

SEQ ID NO: 1723119 - RNA, 23 nt, Human
aggggagcaaaaucgaugcagug

SEQ ID NO: 1723120 - RNA, 15 nt, Human
aggggccuggcagcc

SEQ ID NO: 1723121 - RNA, 23 nt, Human
aggggccuggcagccgugccuuc

SEQ ID NO: 1723122 - RNA, 18 nt, Human
aggggccuggcagccgug

SEQ ID NO: 1723123 - RNA, 19 nt, Human
uggggucacucuggcagcu

SEQ ID NO: 1723124 - RNA, 20 nt, Human
uggggucacucuggcagcuc

SEQ ID NO: 1723125 - RNA, 14 nt, Human
ugggaguacaaaag

SEQ ID NO: 1723126 - RNA, 16 nt, Human
ugggcaacccccagcc

SEQ ID NO: 1723127 - RNA, 23 nt, Human
ugggaggucaaggcugcagugag

SEQ ID NO: 1723128 - RNA, 20 nt, Human
ugggaggucaaggcugcagu

SEQ ID NO: 1723129 - RNA, 19 nt, Human
ugggaggucaaggcugcag

SEQ ID NO: 1723130 - RNA, 18 nt, Human
ugggaggucaaggcugca

SEQ ID NO: 1723131 - RNA, 16 nt, Human
ugggccaggagccucc

SEQ ID NO: 1723132 - RNA, 14 nt, Human
ugggccaggagccu

SEQ ID NO: 1723133 - RNA, 20 nt, Human
ugggcccaaugcacuuuguu

SEQ ID NO: 1723134 - RNA, 13 nt, Human
ugggccaggagcc

SEQ ID NO: 1723135 - RNA, 18 nt, Human
ugggccagaauuucaaac

SEQ ID NO: 1723136 - RNA, 21 nt, Human
ugggcaacccccagccugcua

SEQ ID NO: 1723137 - RNA, 20 nt, Human
ugggcaacccccagccugcu

SEQ ID NO: 1723138 - RNA, 17 nt, Human
ugggcaacccccagccu

SEQ ID NO: 1723139 - RNA, 17 nt, Human
ugggccagaauuucaaa

SEQ ID NO: 1723140 - RNA, 23 nt, Human
agggcccagagaggguggugacc

SEQ ID NO: 1723141 - RNA, 15 nt, Human
agggagggcuucugc

SEQ ID NO: 1723142 - RNA, 19 nt, Human
agggagugacagaggcagc

SEQ ID NO: 1723143 - RNA, 18 nt, Human
agggagugacagaggcag

SEQ ID NO: 1723144 - RNA, 17 nt, Human
agggagugacagaggca

SEQ ID NO: 1723145 - RNA, 17 nt, Human
agggaggugaccccagg

SEQ ID NO: 1723146 - RNA, 21 nt, Human
ugggcucccuucccaccucuc

SEQ ID NO: 1723147 - RNA, 20 nt, Human
ugggcucccuucccaccucu

SEQ ID NO: 1723148 - RNA, 21 nt, Human
ugggcugcccuggugcugcca

SEQ ID NO: 1723149 - RNA, 20 nt, Human
ugggcugcccuggugcugcc

SEQ ID NO: 1723150 - RNA, 19 nt, Human
ugggcugcccuggugcugc

SEQ ID NO: 1723151 - RNA, 17 nt, Human
ugggcugcccuggugcu

SEQ ID NO: 1723152 - RNA, 19 nt, Human
ugggcucccuucccaccuc

SEQ ID NO: 1723153 - RNA, 18 nt, Human
ugggcucccuucccaccu

SEQ ID NO: 1723154 - RNA, 23 nt, Human
agggcuucugccauuucugagau

SEQ ID NO: 1723155 - RNA, 15 nt, Human
uggggaccagagcug

SEQ ID NO: 1723156 - RNA, 14 nt, Human
uggggaccagagcu

SEQ ID NO: 1723157 - RNA, 17 nt, Human
uggggacagagcagaac

SEQ ID NO: 1723158 - RNA, 18 nt, Human
uggggaccagagcugcca

SEQ ID NO: 1723159 - RNA, 17 nt, Human
uggggaccagagcugcc

SEQ ID NO: 1723160 - RNA, 13 nt, Human
uggggaccucagg

SEQ ID NO: 1723161 - RNA, 19 nt, Human
ugggcuggguucuacccag

SEQ ID NO: 1723162 - RNA, 18 nt, Human
ugggcuggguucuaccca

SEQ ID NO: 1723163 - RNA, 20 nt, Human
uggggcugcaccggcuggcc

SEQ ID NO: 1723164 - RNA, 14 nt, Human
ugggguacccacug

SEQ ID NO: 1723165 - RNA, 15 nt, Human
ugggguaugggagag

SEQ ID NO: 1723166 - RNA, 18 nt, Human
uggggucacucuggcagc

SEQ ID NO: 1723167 - RNA, 17 nt, Human
uggggucacucuggcag

SEQ ID NO: 1723168 - RNA, 16 nt, Human
ugggguacccacugcu

SEQ ID NO: 1723169 - RNA, 15 nt, Human
ugggguacccacugc

SEQ ID NO: 1723170 - RNA, 18 nt, Human
uggggcggugagagggga

SEQ ID NO: 1723171 - RNA, 23 nt, Human
uggggcuaggaaauccagggugg

SEQ ID NO: 1723172 - RNA, 16 nt, Human
uggggcccugccuccu

SEQ ID NO: 1723173 - RNA, 15 nt, Human
uggggcccugccucc

SEQ ID NO: 1723174 - RNA, 23 nt, Human
uggggaccucaggccugggggcu

SEQ ID NO: 1723175 - RNA, 12 nt, Human
uggggagaaagu

SEQ ID NO: 1723176 - RNA, 14 nt, Human
uggggcccugccuc

SEQ ID NO: 1723177 - RNA, 22 nt, Human
ugcggacagccacggccaggcc

SEQ ID NO: 1723178 - RNA, 23 nt, Human
ugcggacagccacggccaggcca

SEQ ID NO: 1723179 - RNA, 21 nt, Human
ugcggugcuaucucccccagc

SEQ ID NO: 1723180 - RNA, 17 nt, Human
ugcggugcuaucucccc

SEQ ID NO: 1723181 - RNA, 18 nt, Human
ugcgguccacccaggagc

SEQ ID NO: 1723182 - RNA, 16 nt, Human
ugcgggucacaggagg

SEQ ID NO: 1723183 - RNA, 14 nt, Human
ugcgggucacagga

SEQ ID NO: 1723184 - RNA, 17 nt, Human
ugcgggucacaggaggg

SEQ ID NO: 1723185 - RNA, 19 nt, Human
ugcggccuuuggcuucacg

SEQ ID NO: 1723186 - RNA, 17 nt, Human
ugcggccuuuggcuuca

SEQ ID NO: 1723187 - RNA, 20 nt, Human
ugcgggcuuccuccuggugu

SEQ ID NO: 1723188 - RNA, 11 nt, Human
ugcuacacacu

SEQ ID NO: 1723189 - RNA, 19 nt, Human
agcuugaccgugaggccag

SEQ ID NO: 1723190 - RNA, 18 nt, Human
agcuuguaaauagcucag

SEQ ID NO: 1723191 - RNA, 22 nt, Human
agcuugaggguugggcuggugu

SEQ ID NO: 1723192 - RNA, 18 nt, Human
agcuugaggguugggcug

SEQ ID NO: 1723193 - RNA, 14 nt, Human
agcuugaggguugg

SEQ ID NO: 1723194 - RNA, 20 nt, Human
agcugccuguucagcuccag

SEQ ID NO: 1723195 - RNA, 15 nt, Human
ugccuggauggggcu

SEQ ID NO: 1723196 - RNA, 14 nt, Human
ugccuggauggggc

SEQ ID NO: 1723197 - RNA, 22 nt, Human
agcugccuguucagcuccagcu

SEQ ID NO: 1723198 - RNA, 21 nt, Human
agcugccuguucagcuccagc

SEQ ID NO: 1723199 - RNA, 21 nt, Human
agcugcuugggcuucauccuc

SEQ ID NO: 1723200 - RNA, 22 nt, Human
agcugcuuuugucuaugggacu

SEQ ID NO: 1723201 - RNA, 21 nt, Human
agcugcuuuugucuaugggac

SEQ ID NO: 1723202 - RNA, 22 nt, Human
agcuggaucuccauucucucag

SEQ ID NO: 1723203 - RNA, 15 nt, Human
ugccucugccucuga

SEQ ID NO: 1723204 - RNA, 14 nt, Human
ugccucugccucug

SEQ ID NO: 1723205 - RNA, 13 nt, Human
ugccucugccucu

SEQ ID NO: 1723206 - RNA, 14 nt, Human
ugcccaggcagguc

SEQ ID NO: 1723207 - RNA, 13 nt, Human
ugcccaggcaggu

SEQ ID NO: 1723208 - RNA, 12 nt, Human
ugcccaggcagg

SEQ ID NO: 1723209 - RNA, 16 nt, Human
ugccugcccaggcccc

SEQ ID NO: 1723210 - RNA, 15 nt, Human
ugccugcccaggccc

SEQ ID NO: 1723211 - RNA, 14 nt, Human
ugccugcccaggcc

SEQ ID NO: 1723212 - RNA, 15 nt, Human
ugccugcccuauucu

SEQ ID NO: 1723213 - RNA, 14 nt, Human
agcuguuacugucu

SEQ ID NO: 1723214 - RNA, 20 nt, Human
ugccuguucagcuccagcuc

SEQ ID NO: 1723215 - RNA, 18 nt, Human
ugccuguucagcuccagc

SEQ ID NO: 1723216 - RNA, 14 nt, Human
agcuguucagcugg

SEQ ID NO: 1723217 - RNA, 13 nt, Human
agcuguucagcug

SEQ ID NO: 1723218 - RNA, 16 nt, Human
ugccuuauggaacacu

SEQ ID NO: 1723219 - RNA, 15 nt, Human
ugccuuauggaacac

SEQ ID NO: 1723220 - RNA, 19 nt, Human
ugccuguugggccaggagc

SEQ ID NO: 1723221 - RNA, 21 nt, Human
ugccuguucagcuccagcuca

SEQ ID NO: 1723222 - RNA, 20 nt, Human
ugccuguugggccaggagcc

SEQ ID NO: 1723223 - RNA, 15 nt, Human
agcugggacuacagg

SEQ ID NO: 1723224 - RNA, 20 nt, Human
agcugugcucuggacaggca

SEQ ID NO: 1723225 - RNA, 23 nt, Human
agcugugcucuggacaggcaugu

SEQ ID NO: 1723226 - RNA, 21 nt, Human
agcugugcucuggacaggcau

SEQ ID NO: 1723227 - RNA, 16 nt, Human
agcuguguggcagucu

SEQ ID NO: 1723228 - RNA, 14 nt, Human
agcuguguggcagu

SEQ ID NO: 1723229 - RNA, 12 nt, Human
aggaagcucagg

SEQ ID NO: 1723230 - RNA, 22 nt, Human
aggaaggaaacccagcucuggu

SEQ ID NO: 1723231 - RNA, 20 nt, Human
aggaaggaaacccagcucug

SEQ ID NO: 1723232 - RNA, 23 nt, Human
aggaaggaaacccagcucugguc

SEQ ID NO: 1723233 - RNA, 23 nt, Human
aggaagccagcaggcucucaggc

SEQ ID NO: 1723234 - RNA, 22 nt, Human
aggaagccagcaggcucucagg

SEQ ID NO: 1723235 - RNA, 21 nt, Human
aggaagccagcaggcucucag

SEQ ID NO: 1723236 - RNA, 22 nt, Human
aggaagcacaugccucucucag

SEQ ID NO: 1723237 - RNA, 20 nt, Human
aggaagccgcuggggccagu

SEQ ID NO: 1723238 - RNA, 19 nt, Human
aggaagccgcuggggccag

SEQ ID NO: 1723239 - RNA, 18 nt, Human
aggaagccgcuggggcca

SEQ ID NO: 1723240 - RNA, 19 nt, Human
aggaaaucaccgaaaacgu

SEQ ID NO: 1723241 - RNA, 15 nt, Human
aggaaaucaccgaaa

SEQ ID NO: 1723242 - RNA, 17 nt, Human
aggaagcacaugccucu

SEQ ID NO: 1723243 - RNA, 16 nt, Human
aggaagcacaugccuc

SEQ ID NO: 1723244 - RNA, 11 nt, Human
aggaagcacau

SEQ ID NO: 1723245 - RNA, 14 nt, Human
aggaaauccagggu

SEQ ID NO: 1723246 - RNA, 16 nt, Human
aggaaaggcuccagga

SEQ ID NO: 1723247 - RNA, 15 nt, Human
aggaaaggcuccagg

SEQ ID NO: 1723248 - RNA, 14 nt, Human
aggaaaggcuccag

SEQ ID NO: 1723249 - RNA, 13 nt, Human
aggaaaggcucca

SEQ ID NO: 1723250 - RNA, 16 nt, Human
ugcugacuguuuucuc

SEQ ID NO: 1723251 - RNA, 22 nt, Human
ugcugacuguacuccucccagg

SEQ ID NO: 1723252 - RNA, 21 nt, Human
ugcugacuguacuccucccag

SEQ ID NO: 1723253 - RNA, 14 nt, Human
ugcucuggacaggc

SEQ ID NO: 1723254 - RNA, 16 nt, Human
ugcucuggacaggcau

SEQ ID NO: 1723255 - RNA, 15 nt, Human
ugcucuggacaggca

SEQ ID NO: 1723256 - RNA, 17 nt, Human
ugcucuggacaggcaug

SEQ ID NO: 1723257 - RNA, 19 nt, Human
ugcugacuguacuccuccc

SEQ ID NO: 1723258 - RNA, 16 nt, Human
ugcugacuguacuccu

SEQ ID NO: 1723259 - RNA, 19 nt, Human
ugcuaucucccccagcccc

SEQ ID NO: 1723260 - RNA, 21 nt, Human
agcuuuaaugauaugcuugua

SEQ ID NO: 1723261 - RNA, 20 nt, Human
ugcuaucucccccagcccca

SEQ ID NO: 1723262 - RNA, 18 nt, Human
ugcugcccugcccaccug

SEQ ID NO: 1723263 - RNA, 17 nt, Human
ugcugcccugcccaccu

SEQ ID NO: 1723264 - RNA, 16 nt, Human
ugcugcccugcccacc

SEQ ID NO: 1723265 - RNA, 13 nt, Human
ugcugcccugccc

SEQ ID NO: 1723266 - RNA, 21 nt, Human
ugcugcccugcccaccuggcc

SEQ ID NO: 1723267 - RNA, 19 nt, Human
ugcugcccugcccaccugg

SEQ ID NO: 1723268 - RNA, 11 nt, Human
ugcugcccugu

SEQ ID NO: 1723269 - RNA, 17 nt, Human
ugcugggauuacaggug

SEQ ID NO: 1723270 - RNA, 21 nt, Human
ugcugggauuacaagcgugag

SEQ ID NO: 1723271 - RNA, 21 nt, Human
ugcuggcuguuggcugggggc

SEQ ID NO: 1723272 - RNA, 19 nt, Human
ugcuggcuguuggcugggg

SEQ ID NO: 1723273 - RNA, 19 nt, Human
ugcugggauuacaagcgug

SEQ ID NO: 1723274 - RNA, 13 nt, Human
ugcuggcugccuu

SEQ ID NO: 1723275 - RNA, 19 nt, Human
aggacacuaaccacgcugg

SEQ ID NO: 1723276 - RNA, 17 nt, Human
aggacagccccuccucc

SEQ ID NO: 1723277 - RNA, 18 nt, Human
aggacacuaaccacgcug

SEQ ID NO: 1723278 - RNA, 16 nt, Human
ugcuuccagugaggcu

SEQ ID NO: 1723279 - RNA, 23 nt, Human
ugcuucaaggauccugagccaga

SEQ ID NO: 1723280 - RNA, 21 nt, Human
ugcuucaaggauccugagcca

SEQ ID NO: 1723281 - RNA, 20 nt, Human
ugcuucaaggauccugagcc

SEQ ID NO: 1723282 - RNA, 12 nt, Human
ugcuucaaggau

SEQ ID NO: 1723283 - RNA, 17 nt, Human
ugcugucccuuacguga

SEQ ID NO: 1723284 - RNA, 15 nt, Human
ugcugucccuuuucc

SEQ ID NO: 1723285 - RNA, 19 nt, Human
ugcugucccuuacgugagu

SEQ ID NO: 1723286 - RNA, 17 nt, Human
ugcugucccuuuuccuu

SEQ ID NO: 1723287 - RNA, 13 nt, Human
ugcugugcaaaug

SEQ ID NO: 1723288 - RNA, 13 nt, Human
ugcuucaaaaaca

SEQ ID NO: 1723289 - RNA, 21 nt, Human
ugcuucaaaaacauucuuaca

SEQ ID NO: 1723290 - RNA, 17 nt, Human
aggccccgcccaggcuu

SEQ ID NO: 1723291 - RNA, 12 nt, Human
aggccccugcca

SEQ ID NO: 1723292 - RNA, 23 nt, Human
uggccagugugacaaggauugcu

SEQ ID NO: 1723293 - RNA, 19 nt, Human
uggccagguggccacucca

SEQ ID NO: 1723294 - RNA, 17 nt, Human
uggccagguggccacuc

SEQ ID NO: 1723295 - RNA, 16 nt, Human
uggccagguggccacu

SEQ ID NO: 1723296 - RNA, 23 nt, Human
uggccaaagccaaagcuaggccu

SEQ ID NO: 1723297 - RNA, 21 nt, Human
uggccaaagccaaagcuaggc

SEQ ID NO: 1723298 - RNA, 15 nt, Human
uggccagguggccac

SEQ ID NO: 1723299 - RNA, 11 nt, Human
uggccaggugg

SEQ ID NO: 1723300 - RNA, 14 nt, Human
uggccuucggccuc

SEQ ID NO: 1723301 - RNA, 18 nt, Human
aggccugggggcugggca

SEQ ID NO: 1723302 - RNA, 12 nt, Human
aggccuggggac

SEQ ID NO: 1723303 - RNA, 20 nt, Human
aggccugggggcugggcaga

SEQ ID NO: 1723304 - RNA, 21 nt, Human
uggccuggccccucagggucc

SEQ ID NO: 1723305 - RNA, 18 nt, Human
uggccuggccccucaggg

SEQ ID NO: 1723306 - RNA, 18 nt, Human
uggccugagcugggauga

SEQ ID NO: 1723307 - RNA, 13 nt, Human
uggcccacgcacu

SEQ ID NO: 1723308 - RNA, 14 nt, Human
uggcccugcccugg

SEQ ID NO: 1723309 - RNA, 13 nt, Human
uggccucuucaga

SEQ ID NO: 1723310 - RNA, 23 nt, Human
uggccgggcgcgguggcucacgc

SEQ ID NO: 1723311 - RNA, 18 nt, Human
uggcacagggcaguggga

SEQ ID NO: 1723312 - RNA, 14 nt, Human
aggccagagggagu

SEQ ID NO: 1723313 - RNA, 19 nt, Human
aggccacaagacccuugug

SEQ ID NO: 1723314 - RNA, 18 nt, Human
aggccacaagacccuugu

SEQ ID NO: 1723315 - RNA, 17 nt, Human
aggccacaagacccuug

SEQ ID NO: 1723316 - RNA, 19 nt, Human
uggcagcucaccucucccu

SEQ ID NO: 1723317 - RNA, 16 nt, Human
aggccacaagacccuu

SEQ ID NO: 1723318 - RNA, 15 nt, Human
uggcagcucaccucu

SEQ ID NO: 1723319 - RNA, 17 nt, Human
uggcagccuuggcaaac

SEQ ID NO: 1723320 - RNA, 21 nt, Human
aggcccagagggccugcaagg

SEQ ID NO: 1723321 - RNA, 20 nt, Human
aggccagagggagugacaga

SEQ ID NO: 1723322 - RNA, 16 nt, Human
aggccccgcccaggcu

SEQ ID NO: 1723323 - RNA, 20 nt, Human
uggagguacgaaaagagggg

SEQ ID NO: 1723324 - RNA, 16 nt, Human
aggccaaggugggagg

SEQ ID NO: 1723325 - RNA, 20 nt, Human
aggccaaaggaagcacaugc

SEQ ID NO: 1723326 - RNA, 19 nt, Human
aggccaaaggaagcacaug

SEQ ID NO: 1723327 - RNA, 18 nt, Human
aggccaaaggaagcacau

SEQ ID NO: 1723328 - RNA, 16 nt, Human
aggccaaaggaagcac

SEQ ID NO: 1723329 - RNA, 17 nt, Human
aggcagccccauucugc

SEQ ID NO: 1723330 - RNA, 16 nt, Human
aggcagccccauucug

SEQ ID NO: 1723331 - RNA, 14 nt, Human
uggaguauauguca

SEQ ID NO: 1723332 - RNA, 15 nt, Human
uggauggaaggggcu

SEQ ID NO: 1723333 - RNA, 13 nt, Human
uggauuguccccg

SEQ ID NO: 1723334 - RNA, 21 nt, Human
uggauuguccccgacccuugc

SEQ ID NO: 1723335 - RNA, 13 nt, Human
uggauuggauuug

SEQ ID NO: 1723336 - RNA, 17 nt, Human
uggauuauauuaugaag

SEQ ID NO: 1723337 - RNA, 18 nt, Human
aggaucucuugagccugg

SEQ ID NO: 1723338 - RNA, 17 nt, Human
aggaucucuugagccug

SEQ ID NO: 1723339 - RNA, 19 nt, Human
aggaucucuugagccuggg

SEQ ID NO: 1723340 - RNA, 14 nt, Human
uggacacagcucuu

SEQ ID NO: 1723341 - RNA, 13 nt, Human
uggacacagcucu

SEQ ID NO: 1723342 - RNA, 22 nt, Human
uggacacagcucuucuccaggc

SEQ ID NO: 1723343 - RNA, 20 nt, Human
uggaccuugaacuggguacu

SEQ ID NO: 1723344 - RNA, 23 nt, Human
uggacccuguggaugauaaaaca

SEQ ID NO: 1723345 - RNA, 21 nt, Human
uggacccugaggcccagaggg

SEQ ID NO: 1723346 - RNA, 20 nt, Human
uggacccugaggcccagagg

SEQ ID NO: 1723347 - RNA, 19 nt, Human
uggacccugaggcccagag

SEQ ID NO: 1723348 - RNA, 18 nt, Human
uggacccugaggcccaga

SEQ ID NO: 1723349 - RNA, 16 nt, Human
uggacccugaggccca

SEQ ID NO: 1723350 - RNA, 23 nt, Human
uggacacagcucuucuccaggcu

SEQ ID NO: 1723351 - RNA, 13 nt, Human
aggcaaucauggu

SEQ ID NO: 1723352 - RNA, 22 nt, Human
aggcacccaccaucaugucugg

SEQ ID NO: 1723353 - RNA, 21 nt, Human
aggcacccaccaucaugucug

SEQ ID NO: 1723354 - RNA, 20 nt, Human
aggcacccaccaucaugucu

SEQ ID NO: 1723355 - RNA, 14 nt, Human
aggcaaugcuggcu

SEQ ID NO: 1723356 - RNA, 20 nt, Human
aggcaccuaccaccacgccc

SEQ ID NO: 1723357 - RNA, 22 nt, Human
uggagaagcggcuggcagccca

SEQ ID NO: 1723358 - RNA, 13 nt, Human
uggagaagcggcu

SEQ ID NO: 1723359 - RNA, 14 nt, Human
uggagaacuagaga

SEQ ID NO: 1723360 - RNA, 15 nt, Human
uggacugugugcuca

SEQ ID NO: 1723361 - RNA, 18 nt, Human
uggaaaugggcagagcag

SEQ ID NO: 1723362 - RNA, 17 nt, Human
uggaaaugggcagagca

SEQ ID NO: 1723363 - RNA, 16 nt, Human
uggaagcacagcuuca

SEQ ID NO: 1723364 - RNA, 18 nt, Human
uggaaguacuauaauuua

SEQ ID NO: 1723365 - RNA, 23 nt, Human
uggaaggggacacgugacagccg

SEQ ID NO: 1723366 - RNA, 14 nt, Human
aggauccugagcca

SEQ ID NO: 1723367 - RNA, 13 nt, Human
aggauccugagcc

SEQ ID NO: 1723368 - RNA, 21 nt, Human
ugcuugaggcaacucaucuua

SEQ ID NO: 1723369 - RNA, 16 nt, Human
ugcuuggaggaaggaa

SEQ ID NO: 1723370 - RNA, 15 nt, Human
ugcuuggaggaagga

SEQ ID NO: 1723371 - RNA, 14 nt, Human
ugcuuggaggaagg

SEQ ID NO: 1723372 - RNA, 12 nt, Human
ugcuuguacaua

SEQ ID NO: 1723373 - RNA, 13 nt, Human
ugcuuguacauaa

SEQ ID NO: 1723374 - RNA, 15 nt, Human
ugcuuguaacuaaaa

SEQ ID NO: 1723375 - RNA, 17 nt, Human
ugcuuuuggucugugug

SEQ ID NO: 1723376 - RNA, 14 nt, Human
ugcuuuuggucugu

SEQ ID NO: 1723377 - RNA, 17 nt, Human
ugcuuugugauuuuugu

SEQ ID NO: 1723378 - RNA, 14 nt, Human
ugcuuguacauaau

SEQ ID NO: 1723379 - RNA, 16 nt, Human
ugcuuguacauaaugc

SEQ ID NO: 1723380 - RNA, 22 nt, Human
ugcuuguacauaaugcgugcau

SEQ ID NO: 1723381 - RNA, 12 nt, Human
ugcuuugugauu

SEQ ID NO: 1723382 - RNA, 14 nt, Human
ugcuuugugauuuu

SEQ ID NO: 1723383 - RNA, 16 nt, Human
ugcuuugugauuuuug

SEQ ID NO: 1723384 - RNA, 23 nt, Human
ugcacuauagccuaggugacaga

SEQ ID NO: 1723385 - RNA, 23 nt, Human
agcccuucuaccuuccugcaaca

SEQ ID NO: 1723386 - RNA, 13 nt, Human
agccguggcuucc

SEQ ID NO: 1723387 - RNA, 21 nt, Human
agccguggcuucccgcucagc

SEQ ID NO: 1723388 - RNA, 14 nt, Human
agccguggcuuccc

SEQ ID NO: 1723389 - RNA, 19 nt, Human
agccguuuguuccccaaga

SEQ ID NO: 1723390 - RNA, 23 nt, Human
agccguggcuucccgcucagccc

SEQ ID NO: 1723391 - RNA, 22 nt, Human
agccguggcuucccgcucagcc

SEQ ID NO: 1723392 - RNA, 20 nt, Human
agccucauguccacugguuc

SEQ ID NO: 1723393 - RNA, 20 nt, Human
agccuccaugcugccuccag

SEQ ID NO: 1723394 - RNA, 18 nt, Human
agccuccaugcugccucc

SEQ ID NO: 1723395 - RNA, 16 nt, Human
agccucccaaagugcu

SEQ ID NO: 1723396 - RNA, 15 nt, Human
agccucauguccacu

SEQ ID NO: 1723397 - RNA, 12 nt, Human
agccucaucucu

SEQ ID NO: 1723398 - RNA, 23 nt, Human
agccucagcauccuggcacccgg

SEQ ID NO: 1723399 - RNA, 22 nt, Human
agccucagcauccuggcacccg

SEQ ID NO: 1723400 - RNA, 21 nt, Human
agccucagcauccuggcaccc

SEQ ID NO: 1723401 - RNA, 20 nt, Human
agccucagcauccuggcacc

SEQ ID NO: 1723402 - RNA, 19 nt, Human
agccucagcauccuggcac

SEQ ID NO: 1723403 - RNA, 17 nt, Human
agccucagcauccuggc

SEQ ID NO: 1723404 - RNA, 22 nt, Human
agccugaaagaggaaugaagua

SEQ ID NO: 1723405 - RNA, 17 nt, Human
agccucccaaagugcug

SEQ ID NO: 1723406 - RNA, 15 nt, Human
ugcagccucacaguc

SEQ ID NO: 1723407 - RNA, 13 nt, Human
ugcagccucacag

SEQ ID NO: 1723408 - RNA, 16 nt, Human
ugcagccucacagucc

SEQ ID NO: 1723409 - RNA, 17 nt, Human
ugcagccucacaguccu

SEQ ID NO: 1723410 - RNA, 17 nt, Human
ugcauaaguuaacuucc

SEQ ID NO: 1723411 - RNA, 14 nt, Human
ugcauaaguuaacu

SEQ ID NO: 1723412 - RNA, 22 nt, Human
ugcauaacguauaaaagccugu

SEQ ID NO: 1723413 - RNA, 23 nt, Human
ugcauaacguauaaaagccuguu

SEQ ID NO: 1723414 - RNA, 16 nt, Human
ugcaggucccuaauaa

SEQ ID NO: 1723415 - RNA, 15 nt, Human
ugcaggucccuaaua

SEQ ID NO: 1723416 - RNA, 14 nt, Human
ugcaggucccuaau

SEQ ID NO: 1723417 - RNA, 12 nt, Human
ugcaggucccua

SEQ ID NO: 1723418 - RNA, 18 nt, Human
ugcaguacuuuaccuccu

SEQ ID NO: 1723419 - RNA, 18 nt, Human
agccccuggaugcagccu

SEQ ID NO: 1723420 - RNA, 17 nt, Human
agccccuggaugcagcc

SEQ ID NO: 1723421 - RNA, 19 nt, Human
agccccuggaugcagccuc

SEQ ID NO: 1723422 - RNA, 22 nt, Human
agccccuggaugcagccucaca

SEQ ID NO: 1723423 - RNA, 16 nt, Human
agccccgaggccuucu

SEQ ID NO: 1723424 - RNA, 22 nt, Human
agccccgaggccuucucugaag

SEQ ID NO: 1723425 - RNA, 17 nt, Human
agccccgaggccuucuc

SEQ ID NO: 1723426 - RNA, 24 nt, Human
agccccaaaacucuccucugcugc

SEQ ID NO: 1723427 - RNA, 18 nt, Human
agcccauggcacucuaug

SEQ ID NO: 1723428 - RNA, 20 nt, Human
agccccaaaacucuccucug

SEQ ID NO: 1723429 - RNA, 22 nt, Human
agccccaaaacucuccucugcu

SEQ ID NO: 1723430 - RNA, 21 nt, Human
agccccaaaacucuccucugc

SEQ ID NO: 1723431 - RNA, 20 nt, Human
ugauucuccugccucagccu

SEQ ID NO: 1723432 - RNA, 19 nt, Human
ugauucuccugccucagcc

SEQ ID NO: 1723433 - RNA, 15 nt, Human
ugauucuccugccuc

SEQ ID NO: 1723434 - RNA, 21 nt, Human
ugcacaagcugcacccucagg

SEQ ID NO: 1723435 - RNA, 18 nt, Human
ugcacaagcugcacccuc

SEQ ID NO: 1723436 - RNA, 24 nt, Human
ugcacacagcacgggggccaagga

SEQ ID NO: 1723437 - RNA, 12 nt, Human
ugcacacagcac

SEQ ID NO: 1723438 - RNA, 23 nt, Human
agcccugguggcagugggagcug

SEQ ID NO: 1723439 - RNA, 22 nt, Human
agcccugguggcagugggagcu

SEQ ID NO: 1723440 - RNA, 15 nt, Human
ugcacaagcugcacc

SEQ ID NO: 1723441 - RNA, 24 nt, Human
agccccuucugacccaugcugccc

SEQ ID NO: 1723442 - RNA, 20 nt, Human
agccccuucugacccaugcu

SEQ ID NO: 1723443 - RNA, 21 nt, Human
agcccugcuuugggcugcccu

SEQ ID NO: 1723444 - RNA, 23 nt, Human
agcccugcuuugggcugcccugg

SEQ ID NO: 1723445 - RNA, 22 nt, Human
agcccugcuuugggcugcccug

SEQ ID NO: 1723446 - RNA, 21 nt, Human
agcccugguggcagugggagc

SEQ ID NO: 1723447 - RNA, 17 nt, Human
ugcacccucaggcaggu

SEQ ID NO: 1723448 - RNA, 16 nt, Human
ugcacccucaggcagg

SEQ ID NO: 1723449 - RNA, 15 nt, Human
ugcacgugugugcac

SEQ ID NO: 1723450 - RNA, 14 nt, Human
ugcacgugugugca

SEQ ID NO: 1723451 - RNA, 10 nt, Human
ugcacacauu

SEQ ID NO: 1723452 - RNA, 20 nt, Human
ugcacacauuuuuuaaaugc

SEQ ID NO: 1723453 - RNA, 20 nt, Human
agcucauucuccuuguguua

SEQ ID NO: 1723454 - RNA, 21 nt, Human
agcucauucuccuuguguuac

SEQ ID NO: 1723455 - RNA, 21 nt, Human
ugcccaagaauagaugcugac

SEQ ID NO: 1723456 - RNA, 23 nt, Human
ugcccaagaauagaugcugacug

SEQ ID NO: 1723457 - RNA, 22 nt, Human
ugcccaagaauagaugcugacu

SEQ ID NO: 1723458 - RNA, 19 nt, Human
ugcccacaggaucagucug

SEQ ID NO: 1723459 - RNA, 20 nt, Human
ugcccacaggaucagucuga

SEQ ID NO: 1723460 - RNA, 20 nt, Human
ugcccagccccuucugaccc

SEQ ID NO: 1723461 - RNA, 21 nt, Human
ugcccagccccuucugaccca

SEQ ID NO: 1723462 - RNA, 21 nt, Human
agcucaggugucccugcacuu

SEQ ID NO: 1723463 - RNA, 20 nt, Human
agcucaggugucccugcacu

SEQ ID NO: 1723464 - RNA, 22 nt, Human
agcucaggugucccugcacuug

SEQ ID NO: 1723465 - RNA, 18 nt, Human
agcucaggugucccugca

SEQ ID NO: 1723466 - RNA, 15 nt, Human
agcuaggccuggcca

SEQ ID NO: 1723467 - RNA, 14 nt, Human
agcuaggccuggcc

SEQ ID NO: 1723468 - RNA, 16 nt, Human
agcuaggccuggccag

SEQ ID NO: 1723469 - RNA, 12 nt, Human
agcuaggccugg

SEQ ID NO: 1723470 - RNA, 18 nt, Human
agcuaggaauuguguuua

SEQ ID NO: 1723471 - RNA, 19 nt, Human
agcuacuaauuuuaaaaug

SEQ ID NO: 1723472 - RNA, 15 nt, Human
agcgugcauaaguua

SEQ ID NO: 1723473 - RNA, 22 nt, Human
agcgugagccacugcaccgggc

SEQ ID NO: 1723474 - RNA, 19 nt, Human
agcgugagccacugcaccg

SEQ ID NO: 1723475 - RNA, 23 nt, Human
ugccacacuucaggcucuucucc

SEQ ID NO: 1723476 - RNA, 22 nt, Human
ugccacacuucaggcucuucuc

SEQ ID NO: 1723477 - RNA, 18 nt, Human
agcuagacgagcaggcuu

SEQ ID NO: 1723478 - RNA, 17 nt, Human
agcuacuugggaggcug

SEQ ID NO: 1723479 - RNA, 18 nt, Human
agcuacuugggaggcuga

SEQ ID NO: 1723480 - RNA, 11 nt, Human
agcuagaaaug

SEQ ID NO: 1723481 - RNA, 12 nt, Human
agcuagaaauga

SEQ ID NO: 1723482 - RNA, 12 nt, Human
ugcauaccacuu

SEQ ID NO: 1723483 - RNA, 17 nt, Human
agccugcuccagcuguu

SEQ ID NO: 1723484 - RNA, 16 nt, Human
agccugcuccagcugu

SEQ ID NO: 1723485 - RNA, 15 nt, Human
agccugcuccagcug

SEQ ID NO: 1723486 - RNA, 14 nt, Human
ugcauaccacuuuu

SEQ ID NO: 1723487 - RNA, 22 nt, Human
agccugcuccagcuguucagcu

SEQ ID NO: 1723488 - RNA, 19 nt, Human
agccugcuccagcuguuca

SEQ ID NO: 1723489 - RNA, 22 nt, Human
agccugggugacagagcaagug

SEQ ID NO: 1723490 - RNA, 21 nt, Human
agccugugccucugggacugg

SEQ ID NO: 1723491 - RNA, 13 nt, Human
agccuguuuaaga

SEQ ID NO: 1723492 - RNA, 22 nt, Human
ugccaauaauaauaccucccuu

SEQ ID NO: 1723493 - RNA, 21 nt, Human
ugccaauaauaauaccucccu

SEQ ID NO: 1723494 - RNA, 16 nt, Human
ugccacacuucaggcu

SEQ ID NO: 1723495 - RNA, 15 nt, Human
ugccacacuucaggc

SEQ ID NO: 1723496 - RNA, 14 nt, Human
ugccacacuucagg

SEQ ID NO: 1723497 - RNA, 13 nt, Human
ugccacacuucag

SEQ ID NO: 1723498 - RNA, 21 nt, Human
ugcauuaucuagauacuguau

SEQ ID NO: 1723499 - RNA, 22 nt, Human
ugcauuaucuagauacuguauc

SEQ ID NO: 1723500 - RNA, 17 nt, Human
agccuuccagggguggg

SEQ ID NO: 1723501 - RNA, 16 nt, Human
agccuuccaggggugg

SEQ ID NO: 1723502 - RNA, 14 nt, Human
agccuuccaggggu

SEQ ID NO: 1723503 - RNA, 11 nt, Human
agccuuccagg

SEQ ID NO: 1723504 - RNA, 18 nt, Human
agcggagacggaguccca

SEQ ID NO: 1723505 - RNA, 20 nt, Human
agcggagaaaggaagggcug

SEQ ID NO: 1723506 - RNA, 20 nt, Human
ugcauuaucuagauacugua

SEQ ID NO: 1723507 - RNA, 16 nt, Human
agcggagaaaggaagg

SEQ ID NO: 1723508 - RNA, 23 nt, Human
agccaguaaaugggggugcauuu

SEQ ID NO: 1723509 - RNA, 22 nt, Human
agccaggccacaagacccuugu

SEQ ID NO: 1723510 - RNA, 21 nt, Human
agccaggccacaagacccuug

SEQ ID NO: 1723511 - RNA, 12 nt, Human
agccagggucuc

SEQ ID NO: 1723512 - RNA, 14 nt, Human
agccaggccacaag

SEQ ID NO: 1723513 - RNA, 12 nt, Human
agccaggccaca

SEQ ID NO: 1723514 - RNA, 21 nt, Human
agcccaggaaaggcuccagga

SEQ ID NO: 1723515 - RNA, 20 nt, Human
agcccaggaaaggcuccagg

SEQ ID NO: 1723516 - RNA, 19 nt, Human
agcccaggaaaggcuccag

SEQ ID NO: 1723517 - RNA, 23 nt, Human
agcccaggaaaggcuccaggagc

SEQ ID NO: 1723518 - RNA, 22 nt, Human
agcccaggaaaggcuccaggag

SEQ ID NO: 1723519 - RNA, 24 nt, Human
agcccaggaaaggcuccaggagca

SEQ ID NO: 1723520 - RNA, 14 nt, Human
ugauucagcucugc

SEQ ID NO: 1723521 - RNA, 13 nt, Human
ugauucagcucug

SEQ ID NO: 1723522 - RNA, 15 nt, Human
ugauucauaaugacu

SEQ ID NO: 1723523 - RNA, 18 nt, Human
ugauucccaagcucugcu

SEQ ID NO: 1723524 - RNA, 16 nt, Human
ugauucccaagcucug

SEQ ID NO: 1723525 - RNA, 15 nt, Human
ugauucccaagcucu

SEQ ID NO: 1723526 - RNA, 21 nt, Human
ugauucccaagcucugcuccu

SEQ ID NO: 1723527 - RNA, 19 nt, Human
ugauucccaagcucugcuc

SEQ ID NO: 1723528 - RNA, 17 nt, Human
ugauguuuuaaggaugc

SEQ ID NO: 1723529 - RNA, 18 nt, Human
ugauguuuuaaggaugcu

SEQ ID NO: 1723530 - RNA, 16 nt, Human
ugauggugcaaugacc

SEQ ID NO: 1723531 - RNA, 23 nt, Human
ugauggugcaaugaccuuucaau

SEQ ID NO: 1723532 - RNA, 17 nt, Human
ugauggugcaaugaccu

SEQ ID NO: 1723533 - RNA, 20 nt, Human
ugaugauccuaggcauuugc

SEQ ID NO: 1723534 - RNA, 14 nt, Human
ugaugauccuaggc

SEQ ID NO: 1723535 - RNA, 22 nt, Human
agccacugcaccgggccacaga

SEQ ID NO: 1723536 - RNA, 21 nt, Human
agccacugcaccgggccacag

SEQ ID NO: 1723537 - RNA, 13 nt, Human
agccacugcaccg

SEQ ID NO: 1723538 - RNA, 12 nt, Human
ugauuaaaccaa

SEQ ID NO: 1723539 - RNA, 15 nt, Human
ugauuaauuaaaaca

SEQ ID NO: 1723540 - RNA, 15 nt, Human
ugauuaaagaugagc

SEQ ID NO: 1723541 - RNA, 22 nt, Human
ugauuaaagaugagcuuugucu

SEQ ID NO: 1723542 - RNA, 14 nt, Human
ugauuaccagggac

SEQ ID NO: 1723543 - RNA, 15 nt, Human
agccacggccaggcc

SEQ ID NO: 1723544 - RNA, 18 nt, Human
ugauccuuuuggagucag

SEQ ID NO: 1723545 - RNA, 14 nt, Human
ugaugaagaggagu

SEQ ID NO: 1723546 - RNA, 13 nt, Human
ugaugaagaggag

SEQ ID NO: 1723547 - RNA, 18 nt, Human
agccacauuccugaugcu

SEQ ID NO: 1723548 - RNA, 14 nt, Human
agccacauuccuga

SEQ ID NO: 1723549 - RNA, 23 nt, Human
agccaccaacauacucccaucug

SEQ ID NO: 1723550 - RNA, 20 nt, Human
agccaccaacauacucccau

SEQ ID NO: 1723551 - RNA, 19 nt, Human
agccaccaacauacuccca

SEQ ID NO: 1723552 - RNA, 14 nt, Human
agccacggccaggc

SEQ ID NO: 1723553 - RNA, 18 nt, Human
agccaccgugccuggcca

SEQ ID NO: 1723554 - RNA, 22 nt, Human
ugaguaacugauuuguaacaag

SEQ ID NO: 1723555 - RNA, 15 nt, Human
ugaguacuacagucc

SEQ ID NO: 1723556 - RNA, 16 nt, Human
agcauauucaggaagc

SEQ ID NO: 1723557 - RNA, 14 nt, Human
agcauauucaggaa

SEQ ID NO: 1723558 - RNA, 13 nt, Human
ugaguagcuggga

SEQ ID NO: 1723559 - RNA, 13 nt, Human
ugaguagcuggau

SEQ ID NO: 1723560 - RNA, 23 nt, Human
ugaguacuacaguccucccaucu

SEQ ID NO: 1723561 - RNA, 22 nt, Human
ugaguacuacaguccucccauc

SEQ ID NO: 1723562 - RNA, 21 nt, Human
ugaguacuacaguccucccau

SEQ ID NO: 1723563 - RNA, 17 nt, Human
ugaguacuacaguccuc

SEQ ID NO: 1723564 - RNA, 15 nt, Human
agcauacguacacau

SEQ ID NO: 1723565 - RNA, 21 nt, Human
agcauaauacuugcuuuggaa

SEQ ID NO: 1723566 - RNA, 12 nt, Human
ugagaauuaccc

SEQ ID NO: 1723567 - RNA, 16 nt, Human
agcauacguacacauu

SEQ ID NO: 1723568 - RNA, 17 nt, Human
agcauacguacacauuu

SEQ ID NO: 1723569 - RNA, 18 nt, Human
agcauacguacacauuuu

SEQ ID NO: 1723570 - RNA, 19 nt, Human
agcauacguacacauuuua

SEQ ID NO: 1723571 - RNA, 20 nt, Human
agcauacguacacauuuuau

SEQ ID NO: 1723572 - RNA, 21 nt, Human
agcauacguacacauuuuauu

SEQ ID NO: 1723573 - RNA, 20 nt, Human
ugauaagaaccuuuugagug

SEQ ID NO: 1723574 - RNA, 17 nt, Human
ugaguucauacccuguu

SEQ ID NO: 1723575 - RNA, 18 nt, Human
ugaguucauacccuguua

SEQ ID NO: 1723576 - RNA, 14 nt, Human
ugauacuacaguuu

SEQ ID NO: 1723577 - RNA, 17 nt, Human
ugauacuacaguuuguu

SEQ ID NO: 1723578 - RNA, 20 nt, Human
ugauacaaugcugugcccua

SEQ ID NO: 1723579 - RNA, 21 nt, Human
ugauacaaugcugugcccuaa

SEQ ID NO: 1723580 - RNA, 21 nt, Human
ugagugggugaauaauacagu

SEQ ID NO: 1723581 - RNA, 20 nt, Human
ugagugccuuacacaauggu

SEQ ID NO: 1723582 - RNA, 17 nt, Human
ugagugccuuacacaau

SEQ ID NO: 1723583 - RNA, 17 nt, Human
ugagucaccaagcccag

SEQ ID NO: 1723584 - RNA, 16 nt, Human
ugagucaccaagccca

SEQ ID NO: 1723585 - RNA, 14 nt, Human
ugagucaccaagcc

SEQ ID NO: 1723586 - RNA, 17 nt, Human
agcaugucgucaaagcu

SEQ ID NO: 1723587 - RNA, 20 nt, Human
agcaugucgucaaagcugaa

SEQ ID NO: 1723588 - RNA, 12 nt, Human
agcauggcugcc

SEQ ID NO: 1723589 - RNA, 20 nt, Human
agcaucaggccaggcccucu

SEQ ID NO: 1723590 - RNA, 19 nt, Human
agcaucaggccaggcccuc

SEQ ID NO: 1723591 - RNA, 18 nt, Human
agcaucaggccaggcccu

SEQ ID NO: 1723592 - RNA, 17 nt, Human
agcaucaggccaggccc

SEQ ID NO: 1723593 - RNA, 16 nt, Human
agcaucaggccaggcc

SEQ ID NO: 1723594 - RNA, 14 nt, Human
agcaucaggccagg

SEQ ID NO: 1723595 - RNA, 17 nt, Human
agcauuguaaaagcauu

SEQ ID NO: 1723596 - RNA, 19 nt, Human
ugaucacggcucacugcag

SEQ ID NO: 1723597 - RNA, 20 nt, Human
agcaucacaugaacuuguaa

SEQ ID NO: 1723598 - RNA, 13 nt, Human
agcaucaggccag

SEQ ID NO: 1723599 - RNA, 21 nt, Human
ugaucacggcucacugcagcc

SEQ ID NO: 1723600 - RNA, 20 nt, Human
ugaucacggcucacugcagc

SEQ ID NO: 1723601 - RNA, 22 nt, Human
agcauauucaggaagcucaggg

SEQ ID NO: 1723602 - RNA, 19 nt, Human
ugauauguugguagauucu

SEQ ID NO: 1723603 - RNA, 23 nt, Human
ugauauuuucaacgcagcccugc

SEQ ID NO: 1723604 - RNA, 22 nt, Human
ugauauuuucaacgcagcccug

SEQ ID NO: 1723605 - RNA, 21 nt, Human
ugauauuuucaacgcagcccu

SEQ ID NO: 1723606 - RNA, 19 nt, Human
ugauauuuucaacgcagcc

SEQ ID NO: 1723607 - RNA, 13 nt, Human
ugacuuacuguac

SEQ ID NO: 1723608 - RNA, 15 nt, Human
ugacuuacuguacau

SEQ ID NO: 1723609 - RNA, 16 nt, Human
ugacuuacuguacaug

SEQ ID NO: 1723610 - RNA, 19 nt, Human
ugaccugaggcccuucucu

SEQ ID NO: 1723611 - RNA, 18 nt, Human
ugaccugaggcccuucuc

SEQ ID NO: 1723612 - RNA, 14 nt, Human
ugaccuuaaaugca

SEQ ID NO: 1723613 - RNA, 16 nt, Human
ugaccuuaaaugcaac

SEQ ID NO: 1723614 - RNA, 15 nt, Human
ugacccaugcugccc

SEQ ID NO: 1723615 - RNA, 14 nt, Human
ugacccaugcugcc

SEQ ID NO: 1723616 - RNA, 21 nt, Human
ugacccaugcugcccugugag

SEQ ID NO: 1723617 - RNA, 16 nt, Human
ugacccaugcugcccu

SEQ ID NO: 1723618 - RNA, 13 nt, Human
agauuaagaaaua

SEQ ID NO: 1723619 - RNA, 16 nt, Human
agaugccgcauuugga

SEQ ID NO: 1723620 - RNA, 23 nt, Human
agaugcugacuguacuccuccca

SEQ ID NO: 1723621 - RNA, 20 nt, Human
agaugcugacuguacuccuc

SEQ ID NO: 1723622 - RNA, 17 nt, Human
ugacacuuaaaaauggu

SEQ ID NO: 1723623 - RNA, 16 nt, Human
ugacacuuaaaaaugg

SEQ ID NO: 1723624 - RNA, 21 nt, Human
agauuuugaaauuuuuauuaa

SEQ ID NO: 1723625 - RNA, 20 nt, Human
agauuucucauuugccaaua

SEQ ID NO: 1723626 - RNA, 17 nt, Human
agauuugaacucuucaa

SEQ ID NO: 1723627 - RNA, 22 nt, Human
agauucauauuuacuucuuaua

SEQ ID NO: 1723628 - RNA, 18 nt, Human
agauuccagagaguggcu

SEQ ID NO: 1723629 - RNA, 19 nt, Human
ugacuuacuguacaugaaa

SEQ ID NO: 1723630 - RNA, 19 nt, Human
agauuccagagaguggcuc

SEQ ID NO: 1723631 - RNA, 13 nt, Human
agauuggaaggaa

SEQ ID NO: 1723632 - RNA, 16 nt, Human
agcaagacgcugugcu

SEQ ID NO: 1723633 - RNA, 13 nt, Human
agcaagacgcugu

SEQ ID NO: 1723634 - RNA, 20 nt, Human
ugagaagcagaggaaggaga

SEQ ID NO: 1723635 - RNA, 14 nt, Human
agcaagauuucaga

SEQ ID NO: 1723636 - RNA, 22 nt, Human
agcaagacgcugugcugcccug

SEQ ID NO: 1723637 - RNA, 21 nt, Human
agcaagacgcugugcugcccu

SEQ ID NO: 1723638 - RNA, 20 nt, Human
agcaagacgcugugcugccc

SEQ ID NO: 1723639 - RNA, 17 nt, Human
agcaagacgcugugcug

SEQ ID NO: 1723640 - RNA, 23 nt, Human
agcaagacgcugugcugcccugc

SEQ ID NO: 1723641 - RNA, 23 nt, Human
ugaauuugugaagguggaaauaa

SEQ ID NO: 1723642 - RNA, 23 nt, Human
ugaauuucuuuugccguuauuaa

SEQ ID NO: 1723643 - RNA, 21 nt, Human
ugaauuugugaagguggaaau

SEQ ID NO: 1723644 - RNA, 13 nt, Human
ugaauuugugaag

SEQ ID NO: 1723645 - RNA, 12 nt, Human
ugacacaugcaa

SEQ ID NO: 1723646 - RNA, 20 nt, Human
ugacacaugcaaggucauuu

SEQ ID NO: 1723647 - RNA, 18 nt, Human
ugacacacagcucugucc

SEQ ID NO: 1723648 - RNA, 16 nt, Human
ugacacacagcucugu

SEQ ID NO: 1723649 - RNA, 19 nt, Human
ugacaaagacugaguacgu

SEQ ID NO: 1723650 - RNA, 20 nt, Human
ugacacacagcucuguccug

SEQ ID NO: 1723651 - RNA, 19 nt, Human
ugacacacagcucuguccu

SEQ ID NO: 1723652 - RNA, 22 nt, Human
ugacacagucuuggcucacugc

SEQ ID NO: 1723653 - RNA, 23 nt, Human
ugacacagucuuggcucacugca

SEQ ID NO: 1723654 - RNA, 17 nt, Human
agauaaggguaucuggu

SEQ ID NO: 1723655 - RNA, 15 nt, Human
agagucacuggaaca

SEQ ID NO: 1723656 - RNA, 22 nt, Human
agagucagaaguuucugccgca

SEQ ID NO: 1723657 - RNA, 17 nt, Human
agaguuguuacauuuuu

SEQ ID NO: 1723658 - RNA, 21 nt, Human
agaguuguuacauuuuuaagu

SEQ ID NO: 1723659 - RNA, 19 nt, Human
agaguuguuacauuuuuaa

SEQ ID NO: 1723660 - RNA, 20 nt, Human
agaguuguuacauuuuuaag

SEQ ID NO: 1723661 - RNA, 11 nt, Human
agauacuguau

SEQ ID NO: 1723662 - RNA, 22 nt, Human
agauacaguuacucagaauucu

SEQ ID NO: 1723663 - RNA, 22 nt, Human
agauaauauuaaggaagacaau

SEQ ID NO: 1723664 - RNA, 18 nt, Human
agauaauauuaaggaaga

SEQ ID NO: 1723665 - RNA, 20 nt, Human
agauacaggaaaagcugcug

SEQ ID NO: 1723666 - RNA, 13 nt, Human
agauacaguuacu

SEQ ID NO: 1723667 - RNA, 20 nt, Human
agauauuuugcuuugugauu

SEQ ID NO: 1723668 - RNA, 21 nt, Human
agauauuuugcuuugugauuu

SEQ ID NO: 1723669 - RNA, 18 nt, Human
agaucaaaagguuaauaa

SEQ ID NO: 1723670 - RNA, 15 nt, Human
agauacuguaucaug

SEQ ID NO: 1723671 - RNA, 16 nt, Human
agauacuguaucauga

SEQ ID NO: 1723672 - RNA, 14 nt, Human
ugaagucacugcac

SEQ ID NO: 1723673 - RNA, 14 nt, Human
ugaagucacacagu

SEQ ID NO: 1723674 - RNA, 16 nt, Human
ugaauaaagacaccua

SEQ ID NO: 1723675 - RNA, 21 nt, Human
ugaagucacugcacagugcau

SEQ ID NO: 1723676 - RNA, 16 nt, Human
ugaagucacugcacag

SEQ ID NO: 1723677 - RNA, 15 nt, Human
ugaagucacugcaca

SEQ ID NO: 1723678 - RNA, 15 nt, Human
ugaauacuuuauaaa

SEQ ID NO: 1723679 - RNA, 18 nt, Human
ugaauauuuaguguucau

SEQ ID NO: 1723680 - RNA, 16 nt, Human
ugaauauugccauuau

SEQ ID NO: 1723681 - RNA, 18 nt, Human
ugaauauugccauuaugc

SEQ ID NO: 1723682 - RNA, 16 nt, Human
agagguggggagcaga

SEQ ID NO: 1723683 - RNA, 15 nt, Human
agagguuaagguggg

SEQ ID NO: 1723684 - RNA, 12 nt, Human
ugaagccuuugu

SEQ ID NO: 1723685 - RNA, 20 nt, Human
ugaagcuaucguaaaauuaa

SEQ ID NO: 1723686 - RNA, 16 nt, Human
agagggagggagggcu

SEQ ID NO: 1723687 - RNA, 20 nt, Human
agagggagggagggcuccag

SEQ ID NO: 1723688 - RNA, 14 nt, Human
agaggcugucuguu

SEQ ID NO: 1723689 - RNA, 21 nt, Human
ucuuccaggcugggagagccu

SEQ ID NO: 1723690 - RNA, 20 nt, Human
ucuuccaggcugggagagcc

SEQ ID NO: 1723691 - RNA, 17 nt, Human
ucuuccaggcugggaga

SEQ ID NO: 1723692 - RNA, 15 nt, Human
ucuuccaggcuggga

SEQ ID NO: 1723693 - RNA, 20 nt, Human
ucuucagagacuccugcagg

SEQ ID NO: 1723694 - RNA, 14 nt, Human
agaaucacuugaac

SEQ ID NO: 1723695 - RNA, 15 nt, Human
ucuucaacucccugc

SEQ ID NO: 1723696 - RNA, 19 nt, Human
ucuucaacugaccagccuc

SEQ ID NO: 1723697 - RNA, 16 nt, Human
ucuucaacugaccagc

SEQ ID NO: 1723698 - RNA, 12 nt, Human
ucuucagagacu

SEQ ID NO: 1723699 - RNA, 18 nt, Human
ucuucagagacuccugca

SEQ ID NO: 1723700 - RNA, 17 nt, Human
ucuucagagacuccugc

SEQ ID NO: 1723701 - RNA, 22 nt, Human
ucuucccuacaguugaaaaaca

SEQ ID NO: 1723702 - RNA, 19 nt, Human
ucuucccuacaguugaaaa

SEQ ID NO: 1723703 - RNA, 14 nt, Human
ucuuccucccuccc

SEQ ID NO: 1723704 - RNA, 15 nt, Human
ucuuccucccucccu

SEQ ID NO: 1723705 - RNA, 14 nt, Human
ucuuccucugcuga

SEQ ID NO: 1723706 - RNA, 12 nt, Human
ucuuccucugcu

SEQ ID NO: 1723707 - RNA, 11 nt, Human
ucuuccucugc

SEQ ID NO: 1723708 - RNA, 21 nt, Human
agacauagaauuaacacauga

SEQ ID NO: 1723709 - RNA, 19 nt, Human
agacauacuaaccagcaga

SEQ ID NO: 1723710 - RNA, 17 nt, Human
agacaucaacagauaaa

SEQ ID NO: 1723711 - RNA, 18 nt, Human
agacaucaacagauaaau

SEQ ID NO: 1723712 - RNA, 20 nt, Human
ucuucuguacgucugacagg

SEQ ID NO: 1723713 - RNA, 15 nt, Human
ucuucuguacgucug

SEQ ID NO: 1723714 - RNA, 18 nt, Human
ucuucuggguuccuuccu

SEQ ID NO: 1723715 - RNA, 20 nt, Human
ucuucuguggguuucuaaag

SEQ ID NO: 1723716 - RNA, 19 nt, Human
ucuucugcuucagccuccc

SEQ ID NO: 1723717 - RNA, 12 nt, Human
ucuucugcuuca

SEQ ID NO: 1723718 - RNA, 21 nt, Human
ucuucugaacuuggcgcugcc

SEQ ID NO: 1723719 - RNA, 19 nt, Human
ucuugguccugcugcaguu

SEQ ID NO: 1723720 - RNA, 17 nt, Human
ucuugguccugcugcag

SEQ ID NO: 1723721 - RNA, 15 nt, Human
ucuugguccugcugc

SEQ ID NO: 1723722 - RNA, 17 nt, Human
ucuuuccugaggcuggg

SEQ ID NO: 1723723 - RNA, 19 nt, Human
ucuuucuaaugugugaauc

SEQ ID NO: 1723724 - RNA, 13 nt, Human
ucuuucucugagg

SEQ ID NO: 1723725 - RNA, 15 nt, Human
ucuuucucugaggac

SEQ ID NO: 1723726 - RNA, 18 nt, Human
ucuuucuaaugugugaau

SEQ ID NO: 1723727 - RNA, 16 nt, Human
ucuuuaugauuuuuaa

SEQ ID NO: 1723728 - RNA, 17 nt, Human
ucuuuauuaaauguaga

SEQ ID NO: 1723729 - RNA, 21 nt, Human
ucuuuauuaaauguagaaagu

SEQ ID NO: 1723730 - RNA, 23 nt, Human
ucuugcaauggcagccuuggcaa

SEQ ID NO: 1723731 - RNA, 22 nt, Human
ucuugcaauggcagccuuggca

SEQ ID NO: 1723732 - RNA, 18 nt, Human
ucuugcaauggcagccuu

SEQ ID NO: 1723733 - RNA, 19 nt, Human
ucuugcaauggcagccuug

SEQ ID NO: 1723734 - RNA, 14 nt, Human
ucuugguccugcug

SEQ ID NO: 1723735 - RNA, 17 nt, Human
ucuuggucagauuugaa

SEQ ID NO: 1723736 - RNA, 23 nt, Human
agaccuucuccuucaccuuuguc

SEQ ID NO: 1723737 - RNA, 21 nt, Human
agaccuucuccuucaccuuug

SEQ ID NO: 1723738 - RNA, 18 nt, Human
agaccuucuccuucaccu

SEQ ID NO: 1723739 - RNA, 15 nt, Human
agaccuucuccuuca

SEQ ID NO: 1723740 - RNA, 11 nt, Human
agaccuucucc

SEQ ID NO: 1723741 - RNA, 14 nt, Human
agaccccuggcuuu

SEQ ID NO: 1723742 - RNA, 16 nt, Human
ucuugagccugggagg

SEQ ID NO: 1723743 - RNA, 13 nt, Human
ucuugagccuggg

SEQ ID NO: 1723744 - RNA, 16 nt, Human
ucuugagccuugaacu

SEQ ID NO: 1723745 - RNA, 13 nt, Human
ucuugauucauaa

SEQ ID NO: 1723746 - RNA, 21 nt, Human
ucuugaugccuggcggggugg

SEQ ID NO: 1723747 - RNA, 17 nt, Human
ugaaacuccagaugcca

SEQ ID NO: 1723748 - RNA, 18 nt, Human
ugaaacuccagaugccac

SEQ ID NO: 1723749 - RNA, 19 nt, Human
ugaaacuccagaugccaca

SEQ ID NO: 1723750 - RNA, 20 nt, Human
ugaaaaucuuauaauuuaaa

SEQ ID NO: 1723751 - RNA, 19 nt, Human
ugaaaaucgugacaacacu

SEQ ID NO: 1723752 - RNA, 17 nt, Human
ugaaaauguauguguaa

SEQ ID NO: 1723753 - RNA, 16 nt, Human
ugaaacgcaaccacca

SEQ ID NO: 1723754 - RNA, 22 nt, Human
ugaaaaaguucugcagauaaac

SEQ ID NO: 1723755 - RNA, 22 nt, Human
ugaaaaaguauccugcuucuga

SEQ ID NO: 1723756 - RNA, 22 nt, Human
ugaaaaaggaggaagagaaaaa

SEQ ID NO: 1723757 - RNA, 20 nt, Human
ugaaaaaggaggaagagaaa

SEQ ID NO: 1723758 - RNA, 16 nt, Human
ugaaaaucgugacaac

SEQ ID NO: 1723759 - RNA, 16 nt, Human
ugaaaaaggaggaaga

SEQ ID NO: 1723760 - RNA, 23 nt, Human
ugaaaaaauauauaucaaauaua

SEQ ID NO: 1723761 - RNA, 21 nt, Human
ucuuucuggcuaugcauuuga

SEQ ID NO: 1723762 - RNA, 21 nt, Human
ucuuucugcagaaacagaaag

SEQ ID NO: 1723763 - RNA, 20 nt, Human
ucuuucuggcuaugcauuug

SEQ ID NO: 1723764 - RNA, 22 nt, Human
ucuuuggucuacacugugcuga

SEQ ID NO: 1723765 - RNA, 16 nt, Human
ucuuuggugaacauug

SEQ ID NO: 1723766 - RNA, 22 nt, Human
ucuuuggugaacauugcaauag

SEQ ID NO: 1723767 - RNA, 23 nt, Human
agagacuccugcaggcagccagg

SEQ ID NO: 1723768 - RNA, 22 nt, Human
agagaucaaccccuucgcuccu

SEQ ID NO: 1723769 - RNA, 23 nt, Human
agagcaagacgcugugcugcccu

SEQ ID NO: 1723770 - RNA, 19 nt, Human
agagcaagacgcugugcug

SEQ ID NO: 1723771 - RNA, 22 nt, Human
agagacuccugcaggcagccag

SEQ ID NO: 1723772 - RNA, 21 nt, Human
agagacuccugcaggcagcca

SEQ ID NO: 1723773 - RNA, 20 nt, Human
agagacuccugcaggcagcc

SEQ ID NO: 1723774 - RNA, 19 nt, Human
agagacuccugcaggcagc

SEQ ID NO: 1723775 - RNA, 18 nt, Human
agagacuccugcaggcag

SEQ ID NO: 1723776 - RNA, 17 nt, Human
agagacuccugcaggca

SEQ ID NO: 1723777 - RNA, 11 nt, Human
agagacuccug

SEQ ID NO: 1723778 - RNA, 16 nt, Human
agagacuccagcuggg

SEQ ID NO: 1723779 - RNA, 15 nt, Human
ugaaagacuguacaa

SEQ ID NO: 1723780 - RNA, 13 nt, Human
ugaaagacuguac

SEQ ID NO: 1723781 - RNA, 23 nt, Human
agagcaccuuagacagucccugc

SEQ ID NO: 1723782 - RNA, 22 nt, Human
agagcaccuuagacagucccug

SEQ ID NO: 1723783 - RNA, 22 nt, Human
agagccuuccaggggugggaca

SEQ ID NO: 1723784 - RNA, 17 nt, Human
agagccuuccaggggug

SEQ ID NO: 1723785 - RNA, 15 nt, Human
agagccuuccagggg

SEQ ID NO: 1723786 - RNA, 13 nt, Human
agagccuuccagg

SEQ ID NO: 1723787 - RNA, 20 nt, Human
agagcuagcagcagggaggg

SEQ ID NO: 1723788 - RNA, 14 nt, Human
agagcugccaccug

SEQ ID NO: 1723789 - RNA, 16 nt, Human
agaacgcugauuuaaa

SEQ ID NO: 1723790 - RNA, 23 nt, Human
agaaccuuuugagugccuuacac

SEQ ID NO: 1723791 - RNA, 19 nt, Human
agaaccuuuugagugccuu

SEQ ID NO: 1723792 - RNA, 17 nt, Human
agaacucccuuucaaca

SEQ ID NO: 1723793 - RNA, 16 nt, Human
agaacucccuuucaac

SEQ ID NO: 1723794 - RNA, 21 nt, Human
agaacugaauuuugucuuuau

SEQ ID NO: 1723795 - RNA, 12 nt, Human
agaaauuaugug

SEQ ID NO: 1723796 - RNA, 23 nt, Human
ucugcaggucccuaauaaagcug

SEQ ID NO: 1723797 - RNA, 22 nt, Human
ucugcaggucccuaauaaagcu

SEQ ID NO: 1723798 - RNA, 19 nt, Human
ucugcaggucccuaauaaa

SEQ ID NO: 1723799 - RNA, 21 nt, Human
ucugcaggucccuaauaaagc

SEQ ID NO: 1723800 - RNA, 23 nt, Human
agaagcccaggaaaggcuccagg

SEQ ID NO: 1723801 - RNA, 20 nt, Human
ucugcccauccugccccuga

SEQ ID NO: 1723802 - RNA, 23 nt, Human
ucugcccacucccugcaaccuga

SEQ ID NO: 1723803 - RNA, 23 nt, Human
ucugcccuugguuaggcauugug

SEQ ID NO: 1723804 - RNA, 12 nt, Human
ucugcccuuggu

SEQ ID NO: 1723805 - RNA, 22 nt, Human
ucugcccugcgggucacaggag

SEQ ID NO: 1723806 - RNA, 16 nt, Human
agaagcagaggaagga

SEQ ID NO: 1723807 - RNA, 19 nt, Human
agaagcaacccaaauguuc

SEQ ID NO: 1723808 - RNA, 13 nt, Human
agaagcagcucuu

SEQ ID NO: 1723809 - RNA, 12 nt, Human
agaagcagcucu

SEQ ID NO: 1723810 - RNA, 10 nt, Human
ucuggccuuc

SEQ ID NO: 1723811 - RNA, 21 nt, Human
ucuggcagcucagagagggug

SEQ ID NO: 1723812 - RNA, 18 nt, Human
ucuggcagcucagagagg

SEQ ID NO: 1723813 - RNA, 23 nt, Human
ucuggcagaguugaagacagagc

SEQ ID NO: 1723814 - RNA, 20 nt, Human
ucuggcagaguugaagacag

SEQ ID NO: 1723815 - RNA, 17 nt, Human
ucuggcagcucagagag

SEQ ID NO: 1723816 - RNA, 23 nt, Human
ucugcuuuuuaaagaaugcucuu

SEQ ID NO: 1723817 - RNA, 22 nt, Human
ucugcuuugggguuuaucagaa

SEQ ID NO: 1723818 - RNA, 14 nt, Human
ucugccugucuccc

SEQ ID NO: 1723819 - RNA, 12 nt, Human
ucugccugucuc

SEQ ID NO: 1723820 - RNA, 22 nt, Human
agaaguuugagaucagccuggg

SEQ ID NO: 1723821 - RNA, 13 nt, Human
agaaguuucuguc

SEQ ID NO: 1723822 - RNA, 23 nt, Human
agaagcucccugaaguaagcaaa

SEQ ID NO: 1723823 - RNA, 18 nt, Human
agaaaaaugagccuggca

SEQ ID NO: 1723824 - RNA, 23 nt, Human
agaaaaaauauuuuccugccagg

SEQ ID NO: 1723825 - RNA, 17 nt, Human
agaaaaaauauuuuccu

SEQ ID NO: 1723826 - RNA, 19 nt, Human
agaaaaaauauuuucccua

SEQ ID NO: 1723827 - RNA, 18 nt, Human
ucucuugguccugcugca

SEQ ID NO: 1723828 - RNA, 17 nt, Human
ucucuugguccugcugc

SEQ ID NO: 1723829 - RNA, 16 nt, Human
ucucuugguccugcug

SEQ ID NO: 1723830 - RNA, 22 nt, Human
ucucugcaggucccuaauaaag

SEQ ID NO: 1723831 - RNA, 21 nt, Human
ucucugcaggucccuaauaaa

SEQ ID NO: 1723832 - RNA, 20 nt, Human
ucucugcaggucccuaauaa

SEQ ID NO: 1723833 - RNA, 19 nt, Human
ucucugcaggucccuaaua

SEQ ID NO: 1723834 - RNA, 16 nt, Human
agaaaugaaaaaauau

SEQ ID NO: 1723835 - RNA, 13 nt, Human
agaaaugaaaaaa

SEQ ID NO: 1723836 - RNA, 12 nt, Human
agaaaugaaaaa

SEQ ID NO: 1723837 - RNA, 15 nt, Human
agaaaugccuuaccc

SEQ ID NO: 1723838 - RNA, 20 nt, Human
agaaaugcugguuuuucagu

SEQ ID NO: 1723839 - RNA, 21 nt, Human
agaaaugcugguuuuucaguu

SEQ ID NO: 1723840 - RNA, 18 nt, Human
ucugaaggcuggguucug

SEQ ID NO: 1723841 - RNA, 20 nt, Human
agaaagcagaacagugauua

SEQ ID NO: 1723842 - RNA, 17 nt, Human
agaaagcagaacaguga

SEQ ID NO: 1723843 - RNA, 18 nt, Human
agaaagcagaacagugau

SEQ ID NO: 1723844 - RNA, 22 nt, Human
agaaagacuaucuaaauguuga

SEQ ID NO: 1723845 - RNA, 20 nt, Human
agaaagacuaucuaaauguu

SEQ ID NO: 1723846 - RNA, 18 nt, Human
acuugucuuuggacccug

SEQ ID NO: 1723847 - RNA, 14 nt, Human
acuuguggacacag

SEQ ID NO: 1723848 - RNA, 16 nt, Human
acuuuaaaaggagcca

SEQ ID NO: 1723849 - RNA, 15 nt, Human
acuuguggacacagc

SEQ ID NO: 1723850 - RNA, 16 nt, Human
acuuguuuucugggaa

SEQ ID NO: 1723851 - RNA, 13 nt, Human
acuuuagggaagu

SEQ ID NO: 1723852 - RNA, 23 nt, Human
acuuuggaaagaguaggaagacu

SEQ ID NO: 1723853 - RNA, 19 nt, Human
acuuuguauaaaagggacu

SEQ ID NO: 1723854 - RNA, 14 nt, Human
acuuuggaaagagu

SEQ ID NO: 1723855 - RNA, 13 nt, Human
acuuuggaaagag

SEQ ID NO: 1723856 - RNA, 12 nt, Human
acuuuggaaaga

SEQ ID NO: 1723857 - RNA, 23 nt, Human
acuuugaggguguauauuuucug

SEQ ID NO: 1723858 - RNA, 22 nt, Human
acuuugcagcacagcugagagg

SEQ ID NO: 1723859 - RNA, 16 nt, Human
acuuuguguucaccuu

SEQ ID NO: 1723860 - RNA, 18 nt, Human
acuuuguguucaccuugu

SEQ ID NO: 1723861 - RNA, 23 nt, Human
ucuccuuggugucgggcaugaca

SEQ ID NO: 1723862 - RNA, 21 nt, Human
ucuccuuggugucgggcauga

SEQ ID NO: 1723863 - RNA, 15 nt, Human
ucuccuuagaagugg

SEQ ID NO: 1723864 - RNA, 21 nt, Human
ucuccuuagaaguggaaguag

SEQ ID NO: 1723865 - RNA, 21 nt, Human
ucucucaggccaaacucaccu

SEQ ID NO: 1723866 - RNA, 14 nt, Human
ucucuccauucccg

SEQ ID NO: 1723867 - RNA, 12 nt, Human
ucucucaggcca

SEQ ID NO: 1723868 - RNA, 15 nt, Human
ucucggcucacugca

SEQ ID NO: 1723869 - RNA, 17 nt, Human
ucucgaacuccugaccu

SEQ ID NO: 1723870 - RNA, 20 nt, Human
ucucgcuauugucaccaggg

SEQ ID NO: 1723871 - RNA, 17 nt, Human
ucucgcucuguugccca

SEQ ID NO: 1723872 - RNA, 23 nt, Human
ucgucacugcuuaacuucacaua

SEQ ID NO: 1723873 - RNA, 13 nt, Human
ucguucucugccu

SEQ ID NO: 1723874 - RNA, 19 nt, Human
ucggggagaggcugaggac

SEQ ID NO: 1723875 - RNA, 21 nt, Human
acuguuaauaguucagguaac

SEQ ID NO: 1723876 - RNA, 17 nt, Human
acuguuaauaguucagg

SEQ ID NO: 1723877 - RNA, 21 nt, Human
ucuacccucuuagaaaaacca

SEQ ID NO: 1723878 - RNA, 13 nt, Human
ucuaaaggcuacc

SEQ ID NO: 1723879 - RNA, 16 nt, Human
ucuaaaggcuaccuuu

SEQ ID NO: 1723880 - RNA, 17 nt, Human
ucuaaagcugccagccg

SEQ ID NO: 1723881 - RNA, 23 nt, Human
ucuaaacugcccccucugcccug

SEQ ID NO: 1723882 - RNA, 22 nt, Human
ucuaaacugcccccucugcccu

SEQ ID NO: 1723883 - RNA, 16 nt, Human
ucuaaacugcccccuc

SEQ ID NO: 1723884 - RNA, 13 nt, Human
ucuaaacugcccc

SEQ ID NO: 1723885 - RNA, 16 nt, Human
acuguaucaugacaaa

SEQ ID NO: 1723886 - RNA, 20 nt, Human
acuguaucaugacaaagacu

SEQ ID NO: 1723887 - RNA, 20 nt, Human
acuguacaugaaaacacauu

SEQ ID NO: 1723888 - RNA, 21 nt, Human
acuguacaugaaaacacauuu

SEQ ID NO: 1723889 - RNA, 15 nt, Human
acuguacuugcucuu

SEQ ID NO: 1723890 - RNA, 20 nt, Human
acuguacuccucccaggcgc

SEQ ID NO: 1723891 - RNA, 14 nt, Human
acuguaucaugaca

SEQ ID NO: 1723892 - RNA, 23 nt, Human
acuguacuugcucuugaugccug

SEQ ID NO: 1723893 - RNA, 22 nt, Human
acuguacaaaguagaagucuua

SEQ ID NO: 1723894 - RNA, 16 nt, Human
acuguacaaaguagaa

SEQ ID NO: 1723895 - RNA, 18 nt, Human
acuggguacuuguggaca

SEQ ID NO: 1723896 - RNA, 17 nt, Human
acuggguacuuguggac

SEQ ID NO: 1723897 - RNA, 19 nt, Human
acuguacaugaaaacacau

SEQ ID NO: 1723898 - RNA, 16 nt, Human
acuguacaugaaaaca

SEQ ID NO: 1723899 - RNA, 18 nt, Human
acuguacagacagaaaaa

SEQ ID NO: 1723900 - RNA, 23 nt, Human
ucgcugugucagcauagaaguaa

SEQ ID NO: 1723901 - RNA, 21 nt, Human
ucgcucuguugcccaggcugg

SEQ ID NO: 1723902 - RNA, 21 nt, Human
acugggcuuggggaccagagc

SEQ ID NO: 1723903 - RNA, 22 nt, Human
acugggcuuggggaccagagcu

SEQ ID NO: 1723904 - RNA, 15 nt, Human
acuggguacuugugg

SEQ ID NO: 1723905 - RNA, 18 nt, Human
ucgcccuggacugugugc

SEQ ID NO: 1723906 - RNA, 16 nt, Human
acuuacuguacaugaa

SEQ ID NO: 1723907 - RNA, 13 nt, Human
acuuacuguacau

SEQ ID NO: 1723908 - RNA, 14 nt, Human
acuuacuguacaug

SEQ ID NO: 1723909 - RNA, 20 nt, Human
acuuagagguggggagcaga

SEQ ID NO: 1723910 - RNA, 15 nt, Human
acuuacuguacauga

SEQ ID NO: 1723911 - RNA, 19 nt, Human
ucuaccugaggggccucuu

SEQ ID NO: 1723912 - RNA, 12 nt, Human
ucuaccugaggg

SEQ ID NO: 1723913 - RNA, 20 nt, Human
acuucaggcucuucuccuuu

SEQ ID NO: 1723914 - RNA, 18 nt, Human
acuucaggcucuucuccu

SEQ ID NO: 1723915 - RNA, 17 nt, Human
acuucaggcucuucucc

SEQ ID NO: 1723916 - RNA, 17 nt, Human
acuuccauaaucuggac

SEQ ID NO: 1723917 - RNA, 17 nt, Human
acuuccacugccauccu

SEQ ID NO: 1723918 - RNA, 18 nt, Human
acuuccaauuuacauacu

SEQ ID NO: 1723919 - RNA, 13 nt, Human
ucuauaauuuaaa

SEQ ID NO: 1723920 - RNA, 23 nt, Human
ucuaguuugauuaaauucuugca

SEQ ID NO: 1723921 - RNA, 24 nt, Human
ucuagauacuguaucaugacaaag

SEQ ID NO: 1723922 - RNA, 23 nt, Human
acuugaacccgggaggcagaggu

SEQ ID NO: 1723923 - RNA, 18 nt, Human
acuugaaaauuaacauga

SEQ ID NO: 1723924 - RNA, 17 nt, Human
acuugaaaauuaacaug

SEQ ID NO: 1723925 - RNA, 19 nt, Human
acuugagaauuacccuuuu

SEQ ID NO: 1723926 - RNA, 14 nt, Human
acuuggaagcuccg

SEQ ID NO: 1723927 - RNA, 14 nt, Human
acuugucuuuggac

SEQ ID NO: 1723928 - RNA, 15 nt, Human
acuuguauuaugugu

SEQ ID NO: 1723929 - RNA, 14 nt, Human
acuuguaugaaaga

SEQ ID NO: 1723930 - RNA, 14 nt, Human
acuuguauuaugug

SEQ ID NO: 1723931 - RNA, 13 nt, Human
acuuguauuaugu

SEQ ID NO: 1723932 - RNA, 18 nt, Human
ucucacuccuaccuggua

SEQ ID NO: 1723933 - RNA, 17 nt, Human
ucucacuccuaccuggu

SEQ ID NO: 1723934 - RNA, 16 nt, Human
ucucacuccuaccugg

SEQ ID NO: 1723935 - RNA, 20 nt, Human
acuucgggaggucgaggcag

SEQ ID NO: 1723936 - RNA, 17 nt, Human
acuucgggaggucgagg

SEQ ID NO: 1723937 - RNA, 22 nt, Human
acuucgggaggucgaggcagga

SEQ ID NO: 1723938 - RNA, 13 nt, Human
ucucacuccuacc

SEQ ID NO: 1723939 - RNA, 16 nt, Human
ucucaaaaaaagaaaa

SEQ ID NO: 1723940 - RNA, 16 nt, Human
ucuauuguuucuuuca

SEQ ID NO: 1723941 - RNA, 23 nt, Human
ucacugagacagcccgggcucug

SEQ ID NO: 1723942 - RNA, 21 nt, Human
ucacuauguugcccaggcagg

SEQ ID NO: 1723943 - RNA, 22 nt, Human
ucaccagccccagugcccacag

SEQ ID NO: 1723944 - RNA, 18 nt, Human
ucacugcaaccuccgccu

SEQ ID NO: 1723945 - RNA, 21 nt, Human
ucacugcaaccuucgccaccu

SEQ ID NO: 1723946 - RNA, 14 nt, Human
ucacuguugcccag

SEQ ID NO: 1723947 - RNA, 15 nt, Human
ucacugcacagugca

SEQ ID NO: 1723948 - RNA, 17 nt, Human
ucacugcaacuucugcc

SEQ ID NO: 1723949 - RNA, 18 nt, Human
ucacugcaacuucugccu

SEQ ID NO: 1723950 - RNA, 15 nt, Human
ucacuguugcccagg

SEQ ID NO: 1723951 - RNA, 22 nt, Human
ucacuuaaguuaguuccacuga

SEQ ID NO: 1723952 - RNA, 16 nt, Human
acccaaauguucauca

SEQ ID NO: 1723953 - RNA, 20 nt, Human
acccaaauguucaucaauga

SEQ ID NO: 1723954 - RNA, 22 nt, Human
accauuuugggguacccacugc

SEQ ID NO: 1723955 - RNA, 20 nt, Human
acccacugcuuuuggucugu

SEQ ID NO: 1723956 - RNA, 17 nt, Human
acccacuggacucaccu

SEQ ID NO: 1723957 - RNA, 14 nt, Human
acccacuggacuca

SEQ ID NO: 1723958 - RNA, 21 nt, Human
acccacuggacucaccucccc

SEQ ID NO: 1723959 - RNA, 21 nt, Human
accauuuugggguacccacug

SEQ ID NO: 1723960 - RNA, 23 nt, Human
accauuuugcugucccuuuuccu

SEQ ID NO: 1723961 - RNA, 22 nt, Human
accauuuugcugucccuuuucc

SEQ ID NO: 1723962 - RNA, 21 nt, Human
accauucuccaccugccaggg

SEQ ID NO: 1723963 - RNA, 20 nt, Human
accauucuccaccugccagg

SEQ ID NO: 1723964 - RNA, 19 nt, Human
accauucuccaccugccag

SEQ ID NO: 1723965 - RNA, 18 nt, Human
accauguuggccaggcug

SEQ ID NO: 1723966 - RNA, 17 nt, Human
acccagcgagcccuggu

SEQ ID NO: 1723967 - RNA, 16 nt, Human
acccagcgagcccugg

SEQ ID NO: 1723968 - RNA, 13 nt, Human
acccagcgagccc

SEQ ID NO: 1723969 - RNA, 15 nt, Human
acccaggagccccga

SEQ ID NO: 1723970 - RNA, 13 nt, Human
acccaggagcccc

SEQ ID NO: 1723971 - RNA, 22 nt, Human
accccagcuggggccaggcugg

SEQ ID NO: 1723972 - RNA, 19 nt, Human
accccagcuggggccaggc

SEQ ID NO: 1723973 - RNA, 23 nt, Human
acccaggugcuaggaacacuccu

SEQ ID NO: 1723974 - RNA, 11 nt, Human
acccaggugcu

SEQ ID NO: 1723975 - RNA, 13 nt, Human
accccagguuucu

SEQ ID NO: 1723976 - RNA, 16 nt, Human
ucagaucucuaacuuc

SEQ ID NO: 1723977 - RNA, 21 nt, Human
ucagaugcugugcaaauguua

SEQ ID NO: 1723978 - RNA, 21 nt, Human
ucagagccaccccuaaagaga

SEQ ID NO: 1723979 - RNA, 23 nt, Human
ucagagacuccugcaggcagcca

SEQ ID NO: 1723980 - RNA, 16 nt, Human
ucagagacuccugcag

SEQ ID NO: 1723981 - RNA, 12 nt, Human
ucagaauucuca

SEQ ID NO: 1723982 - RNA, 10 nt, Human
ucagaauucu

SEQ ID NO: 1723983 - RNA, 20 nt, Human
ucagaauucucagaaucuca

SEQ ID NO: 1723984 - RNA, 16 nt, Human
ucagaauucucuaguu

SEQ ID NO: 1723985 - RNA, 22 nt, Human
ucagagacuccugcaggcagcc

SEQ ID NO: 1723986 - RNA, 15 nt, Human
acccagcccacuucu

SEQ ID NO: 1723987 - RNA, 23 nt, Human
ucagaaguuucugccgcagcccu

SEQ ID NO: 1723988 - RNA, 16 nt, Human
ucagaauagaaauuag

SEQ ID NO: 1723989 - RNA, 23 nt, Human
ucagugccuuauggaacacucug

SEQ ID NO: 1723990 - RNA, 22 nt, Human
ucagugccuuauggaacacucu

SEQ ID NO: 1723991 - RNA, 20 nt, Human
ucagugccuuauggaacacu

SEQ ID NO: 1723992 - RNA, 19 nt, Human
ucagugccuuauggaacac

SEQ ID NO: 1723993 - RNA, 15 nt, Human
ucagugcuucgcaga

SEQ ID NO: 1723994 - RNA, 16 nt, Human
ucaguggcagcugcuu

SEQ ID NO: 1723995 - RNA, 15 nt, Human
ucaguggcagcugcu

SEQ ID NO: 1723996 - RNA, 14 nt, Human
ucaguggcagcugc

SEQ ID NO: 1723997 - RNA, 19 nt, Human
ucaguuguuagugugucuu

SEQ ID NO: 1723998 - RNA, 18 nt, Human
ucauaaauaaaguuuguu

SEQ ID NO: 1723999 - RNA, 13 nt, Human
ucauaacuagaac

SEQ ID NO: 1724000 - RNA, 24 nt, Human
ucauaaagcaggcagaacucaucu

SEQ ID NO: 1724001 - RNA, 15 nt, Human
ucauaacuagaacug

SEQ ID NO: 1724002 - RNA, 22 nt, Human
ucaggugucccugcacuugcag

SEQ ID NO: 1724003 - RNA, 22 nt, Human
ucagguugucugaagucacugc

SEQ ID NO: 1724004 - RNA, 13 nt, Human
ucaguaagccgug

SEQ ID NO: 1724005 - RNA, 13 nt, Human
ucaguaauaacuc

SEQ ID NO: 1724006 - RNA, 15 nt, Human
acccuugugguccca

SEQ ID NO: 1724007 - RNA, 20 nt, Human
accgaaaacguggcugcuuc

SEQ ID NO: 1724008 - RNA, 20 nt, Human
acccuugccgucuaccugag

SEQ ID NO: 1724009 - RNA, 18 nt, Human
ucaggugucccugcacuu

SEQ ID NO: 1724010 - RNA, 17 nt, Human
ucaggugucccugcacu

SEQ ID NO: 1724011 - RNA, 15 nt, Human
ucaggugucccugca

SEQ ID NO: 1724012 - RNA, 23 nt, Human
ucagguggggucacucuggcagc

SEQ ID NO: 1724013 - RNA, 22 nt, Human
accgaaaacguggcugcuucaa

SEQ ID NO: 1724014 - RNA, 21 nt, Human
accgaaaacguggcugcuuca

SEQ ID NO: 1724015 - RNA, 22 nt, Human
ucagguggggucacucuggcag

SEQ ID NO: 1724016 - RNA, 15 nt, Human
acccgggaggcagag

SEQ ID NO: 1724017 - RNA, 21 nt, Human
acccuccuuucaccacaugug

SEQ ID NO: 1724018 - RNA, 20 nt, Human
acccgggaagggggcuggga

SEQ ID NO: 1724019 - RNA, 19 nt, Human
acccgggaagggggcuggg

SEQ ID NO: 1724020 - RNA, 15 nt, Human
acccggaggggccug

SEQ ID NO: 1724021 - RNA, 22 nt, Human
acccgggaagggggcugggaca

SEQ ID NO: 1724022 - RNA, 14 nt, Human
acccucauguucuu

SEQ ID NO: 1724023 - RNA, 15 nt, Human
acccucauguucuua

SEQ ID NO: 1724024 - RNA, 17 nt, Human
acccucauguucuuaau

SEQ ID NO: 1724025 - RNA, 21 nt, Human
acccugaggcccagagggccu

SEQ ID NO: 1724026 - RNA, 19 nt, Human
acccugaggcccagagggc

SEQ ID NO: 1724027 - RNA, 13 nt, Human
acccugaggccca

SEQ ID NO: 1724028 - RNA, 11 nt, Human
acccugaggcc

SEQ ID NO: 1724029 - RNA, 18 nt, Human
acccucgaggcggaucuu

SEQ ID NO: 1724030 - RNA, 14 nt, Human
acccucgaggcgga

SEQ ID NO: 1724031 - RNA, 23 nt, Human
acccugaggcccagagggccugc

SEQ ID NO: 1724032 - RNA, 18 nt, Human
ucaggcaggugggaugga

SEQ ID NO: 1724033 - RNA, 17 nt, Human
ucaggcaggugggaugg

SEQ ID NO: 1724034 - RNA, 13 nt, Human
acccccagccugc

SEQ ID NO: 1724035 - RNA, 12 nt, Human
acccccagccug

SEQ ID NO: 1724036 - RNA, 16 nt, Human
ucaggccaggcccucu

SEQ ID NO: 1724037 - RNA, 15 nt, Human
ucaggccaggcccuc

SEQ ID NO: 1724038 - RNA, 14 nt, Human
ucaggccaggcccu

SEQ ID NO: 1724039 - RNA, 13 nt, Human
ucaggccaggccc

SEQ ID NO: 1724040 - RNA, 14 nt, Human
ucaggccagcugcu

SEQ ID NO: 1724041 - RNA, 13 nt, Human
ucaggccagcugc

SEQ ID NO: 1724042 - RNA, 13 nt, Human
ucaggccacuuga

SEQ ID NO: 1724043 - RNA, 23 nt, Human
ucaggggugugcggccuuuggcu

SEQ ID NO: 1724044 - RNA, 19 nt, Human
ucaggggugugcggccuuu

SEQ ID NO: 1724045 - RNA, 12 nt, Human
ucaggggugugc

SEQ ID NO: 1724046 - RNA, 18 nt, Human
ucaggccaggcccucugc

SEQ ID NO: 1724047 - RNA, 17 nt, Human
ucaggccaggcccucug

SEQ ID NO: 1724048 - RNA, 19 nt, Human
ucaggccaggcccucugcc

SEQ ID NO: 1724049 - RNA, 20 nt, Human
ucaggccaggcccucugccc

SEQ ID NO: 1724050 - RNA, 19 nt, Human
ucaggguuggccccugccc

SEQ ID NO: 1724051 - RNA, 18 nt, Human
ucaggguuggccccugcc

SEQ ID NO: 1724052 - RNA, 23 nt, Human
ucaggguuggccccugcccggcu

SEQ ID NO: 1724053 - RNA, 18 nt, Human
ucagguaaucgaccugcc

SEQ ID NO: 1724054 - RNA, 20 nt, Human
ucagguaaucgaccugccuc

SEQ ID NO: 1724055 - RNA, 19 nt, Human
ucagguaaucgaccugccu

SEQ ID NO: 1724056 - RNA, 19 nt, Human
acccgcuaagagggaggga

SEQ ID NO: 1724057 - RNA, 21 nt, Human
ucagguaaucgaccugccucg

SEQ ID NO: 1724058 - RNA, 17 nt, Human
ucaagagggucugagga

SEQ ID NO: 1724059 - RNA, 21 nt, Human
ucaagagggcacugguggccc

SEQ ID NO: 1724060 - RNA, 20 nt, Human
ucaagagggcacugguggcc

SEQ ID NO: 1724061 - RNA, 11 nt, Human
ucaaggcucag

SEQ ID NO: 1724062 - RNA, 17 nt, Human
ucaagcaagauuucaga

SEQ ID NO: 1724063 - RNA, 22 nt, Human
ucaauaggaaaaacugauuuuu

SEQ ID NO: 1724064 - RNA, 19 nt, Human
ucaauaggaaaaacugauu

SEQ ID NO: 1724065 - RNA, 18 nt, Human
ucaauaggaaaaacugau

SEQ ID NO: 1724066 - RNA, 17 nt, Human
ucaagugauucuccugc

SEQ ID NO: 1724067 - RNA, 16 nt, Human
ucaagugauucuccug

SEQ ID NO: 1724068 - RNA, 22 nt, Human
ucaagugauucucaugccucag

SEQ ID NO: 1724069 - RNA, 21 nt, Human
ucaagugauucucaugccuca

SEQ ID NO: 1724070 - RNA, 19 nt, Human
ucaaguaauccaccugccu

SEQ ID NO: 1724071 - RNA, 18 nt, Human
acauuuuacuuuuuccug

SEQ ID NO: 1724072 - RNA, 22 nt, Human
acauuuaaaacauuaaaauaua

SEQ ID NO: 1724073 - RNA, 13 nt, Human
acauuuuucuuag

SEQ ID NO: 1724074 - RNA, 23 nt, Human
acauuuuucuuagggaaggauac

SEQ ID NO: 1724075 - RNA, 15 nt, Human
acauuuuuaagugcu

SEQ ID NO: 1724076 - RNA, 18 nt, Human
acauuuuuaagugcugca

SEQ ID NO: 1724077 - RNA, 19 nt, Human
acauuuuuaagugcugcau

SEQ ID NO: 1724078 - RNA, 21 nt, Human
acauuuuucagauauaaaaga

SEQ ID NO: 1724079 - RNA, 22 nt, Human
acauugguucuuucauuugcuu

SEQ ID NO: 1724080 - RNA, 14 nt, Human
acauuuaaaacauu

SEQ ID NO: 1724081 - RNA, 18 nt, Human
acauuuaaaacauuaaaa

SEQ ID NO: 1724082 - RNA, 22 nt, Human
acauugcggacagccacggcca

SEQ ID NO: 1724083 - RNA, 21 nt, Human
acauugcggacagccacggcc

SEQ ID NO: 1724084 - RNA, 19 nt, Human
accaaaucagcugcuacua

SEQ ID NO: 1724085 - RNA, 16 nt, Human
accaaaucagcugcua

SEQ ID NO: 1724086 - RNA, 16 nt, Human
accaacauacucccau

SEQ ID NO: 1724087 - RNA, 17 nt, Human
accaacauacucccauc

SEQ ID NO: 1724088 - RNA, 20 nt, Human
accaaccacugcgaccacaa

SEQ ID NO: 1724089 - RNA, 15 nt, Human
accaacccucagagc

SEQ ID NO: 1724090 - RNA, 23 nt, Human
accacacccagcccacuucugcc

SEQ ID NO: 1724091 - RNA, 21 nt, Human
accacacccagcccacuucug

SEQ ID NO: 1724092 - RNA, 20 nt, Human
accacacccagcccacuucu

SEQ ID NO: 1724093 - RNA, 16 nt, Human
accacacccagcccac

SEQ ID NO: 1724094 - RNA, 15 nt, Human
accacacccagccca

SEQ ID NO: 1724095 - RNA, 17 nt, Human
accacacagaggcugcc

SEQ ID NO: 1724096 - RNA, 12 nt, Human
ucaauuuaaaaa

SEQ ID NO: 1724097 - RNA, 13 nt, Human
ucaauuuaaaaaa

SEQ ID NO: 1724098 - RNA, 21 nt, Human
ucacagaacccuuggagccaa

SEQ ID NO: 1724099 - RNA, 16 nt, Human
ucacagccacuuggga

SEQ ID NO: 1724100 - RNA, 14 nt, Human
ucacagaugggugc

SEQ ID NO: 1724101 - RNA, 15 nt, Human
ucacagaugggugcu

SEQ ID NO: 1724102 - RNA, 14 nt, Human
ucacaggaaguaga

SEQ ID NO: 1724103 - RNA, 16 nt, Human
ucacauauugauuucc

SEQ ID NO: 1724104 - RNA, 18 nt, Human
ucacauauugauuuccgu

SEQ ID NO: 1724105 - RNA, 20 nt, Human
ucacauauugauuuccguua

SEQ ID NO: 1724106 - RNA, 17 nt, Human
ucaccagccccagugcc

SEQ ID NO: 1724107 - RNA, 13 nt, Human
acaugagcaucag

SEQ ID NO: 1724108 - RNA, 23 nt, Human
acaugaaaacacauuuuucuuag

SEQ ID NO: 1724109 - RNA, 22 nt, Human
acaugaaaacacauuuuucuua

SEQ ID NO: 1724110 - RNA, 13 nt, Human
ucaaauauauuca

SEQ ID NO: 1724111 - RNA, 16 nt, Human
ucaaaagcugggcagg

SEQ ID NO: 1724112 - RNA, 13 nt, Human
ucaaagauauuuu

SEQ ID NO: 1724113 - RNA, 20 nt, Human
ucaaagauauuuugcuuugu

SEQ ID NO: 1724114 - RNA, 22 nt, Human
ucaaagauauuuugcuuuguga

SEQ ID NO: 1724115 - RNA, 23 nt, Human
ucaaagcaaaugucuuccuggau

SEQ ID NO: 1724116 - RNA, 15 nt, Human
ucaaagcaaaugucu

SEQ ID NO: 1724117 - RNA, 21 nt, Human
acaugucuuuucuugcaugag

SEQ ID NO: 1724118 - RNA, 16 nt, Human
acaugagguacugaga

SEQ ID NO: 1724119 - RNA, 18 nt, Human
acauggaauaacauguaa

SEQ ID NO: 1724120 - RNA, 20 nt, Human
acauggaauaacauguaauu

SEQ ID NO: 1724121 - RNA, 23 nt, Human
acaugagcaucaggccaggcccu

SEQ ID NO: 1724122 - RNA, 19 nt, Human
acauggaguauaugucaag

SEQ ID NO: 1724123 - RNA, 15 nt, Human
acauggaguauaugu

SEQ ID NO: 1724124 - RNA, 14 nt, Human
acauggccuuugcu

SEQ ID NO: 1724125 - RNA, 22 nt, Human
uauuuuaagacgaaacauuugu

SEQ ID NO: 1724126 - RNA, 14 nt, Human
uauuuuaagacgaa

SEQ ID NO: 1724127 - RNA, 15 nt, Human
acaugaaaacacauu

SEQ ID NO: 1724128 - RNA, 16 nt, Human
acaugaaaacacauuu

SEQ ID NO: 1724129 - RNA, 16 nt, Human
acaucuugcucugcug

SEQ ID NO: 1724130 - RNA, 15 nt, Human
acaucuugcucugcu

SEQ ID NO: 1724131 - RNA, 19 nt, Human
uaugugccagauuuaugca

SEQ ID NO: 1724132 - RNA, 14 nt, Human
uaugugccagauuu

SEQ ID NO: 1724133 - RNA, 17 nt, Human
acaucuugcucugcuga

SEQ ID NO: 1724134 - RNA, 22 nt, Human
acaucuugcucugcugacagac

SEQ ID NO: 1724135 - RNA, 19 nt, Human
acaucuuggucagauuuga

SEQ ID NO: 1724136 - RNA, 17 nt, Human
uauuuuaauaaacacuc

SEQ ID NO: 1724137 - RNA, 14 nt, Human
uauuuuaauaaaca

SEQ ID NO: 1724138 - RNA, 20 nt, Human
uauuuugcuuugugauuuuu

SEQ ID NO: 1724139 - RNA, 13 nt, Human
uauuuugcuuugu

SEQ ID NO: 1724140 - RNA, 15 nt, Human
uauuuugcuuuguga

SEQ ID NO: 1724141 - RNA, 17 nt, Human
uauuuugauguaaagau

SEQ ID NO: 1724142 - RNA, 20 nt, Human
uauuuuguguuuaggaacua

SEQ ID NO: 1724143 - RNA, 17 nt, Human
uauuuuguguuuaggaa

SEQ ID NO: 1724144 - RNA, 17 nt, Human
uauuuuuguagagccag

SEQ ID NO: 1724145 - RNA, 15 nt, Human
ucccaaagugcuggg

SEQ ID NO: 1724146 - RNA, 16 nt, Human
ucccaaagugcuggga

SEQ ID NO: 1724147 - RNA, 20 nt, Human
ucccaaagugcugggauuac

SEQ ID NO: 1724148 - RNA, 21 nt, Human
ucccaaagugcugggauuaca

SEQ ID NO: 1724149 - RNA, 14 nt, Human
ucccacaaaggaga

SEQ ID NO: 1724150 - RNA, 22 nt, Human
ucccacaggcccuuccucucca

SEQ ID NO: 1724151 - RNA, 21 nt, Human
ucccacaggcccuuccucucc

SEQ ID NO: 1724152 - RNA, 17 nt, Human
ucccacaggcccuuccu

SEQ ID NO: 1724153 - RNA, 15 nt, Human
ucccacaggcccuuc

SEQ ID NO: 1724154 - RNA, 14 nt, Human
ucccaccccacaca

SEQ ID NO: 1724155 - RNA, 11 nt, Human
ucccaccccac

SEQ ID NO: 1724156 - RNA, 19 nt, Human
ucccaccaacccucagagc

SEQ ID NO: 1724157 - RNA, 17 nt, Human
uccaugaguccccuguu

SEQ ID NO: 1724158 - RNA, 16 nt, Human
uccaugaguccccugu

SEQ ID NO: 1724159 - RNA, 15 nt, Human
uccaugaguccccug

SEQ ID NO: 1724160 - RNA, 11 nt, Human
uccauccugag

SEQ ID NO: 1724161 - RNA, 20 nt, Human
uccaucucuuguuuaaauuc

SEQ ID NO: 1724162 - RNA, 22 nt, Human
uccaugaagauguagaggagaa

SEQ ID NO: 1724163 - RNA, 14 nt, Human
uccagugagacagc

SEQ ID NO: 1724164 - RNA, 17 nt, Human
uccagugaggcucugcc

SEQ ID NO: 1724165 - RNA, 19 nt, Human
uccagugaggcucugcccu

SEQ ID NO: 1724166 - RNA, 18 nt, Human
uccagugaggcucugccc

SEQ ID NO: 1724167 - RNA, 20 nt, Human
uccagugaggcucugcccuu

SEQ ID NO: 1724168 - RNA, 14 nt, Human
acggcucacugcag

SEQ ID NO: 1724169 - RNA, 15 nt, Human
acggcucacugcagc

SEQ ID NO: 1724170 - RNA, 17 nt, Human
acgcuacccgggaaggg

SEQ ID NO: 1724171 - RNA, 13 nt, Human
acgcuacccggga

SEQ ID NO: 1724172 - RNA, 15 nt, Human
acgcucucuggccuu

SEQ ID NO: 1724173 - RNA, 16 nt, Human
acgcucucuggccuuc

SEQ ID NO: 1724174 - RNA, 18 nt, Human
acgcuacccgggaagggg

SEQ ID NO: 1724175 - RNA, 23 nt, Human
acgcgugcacacaccagagccca

SEQ ID NO: 1724176 - RNA, 14 nt, Human
acgcccccacuggu

SEQ ID NO: 1724177 - RNA, 21 nt, Human
acggagucccaccuuggcugc

SEQ ID NO: 1724178 - RNA, 16 nt, Human
acggccaggccagagg

SEQ ID NO: 1724179 - RNA, 17 nt, Human
acgcucucuggccuucg

SEQ ID NO: 1724180 - RNA, 19 nt, Human
acggagucccaccuuggcu

SEQ ID NO: 1724181 - RNA, 14 nt, Human
acgaauauugcuga

SEQ ID NO: 1724182 - RNA, 17 nt, Human
uccaggcugggagagcc

SEQ ID NO: 1724183 - RNA, 14 nt, Human
uccaggcugggaga

SEQ ID NO: 1724184 - RNA, 18 nt, Human
uccaggcugggagagccu

SEQ ID NO: 1724185 - RNA, 18 nt, Human
acgccaggggaaaaucag

SEQ ID NO: 1724186 - RNA, 15 nt, Human
acgacugcccggcag

SEQ ID NO: 1724187 - RNA, 18 nt, Human
acgccaucccagccccaa

SEQ ID NO: 1724188 - RNA, 17 nt, Human
acgccaucccagcccca

SEQ ID NO: 1724189 - RNA, 16 nt, Human
acgccaucccagcccc

SEQ ID NO: 1724190 - RNA, 15 nt, Human
acgccaucccagccc

SEQ ID NO: 1724191 - RNA, 14 nt, Human
acgccaucccagcc

SEQ ID NO: 1724192 - RNA, 11 nt, Human
acgccauccca

SEQ ID NO: 1724193 - RNA, 23 nt, Human
acgccaggggaaaaucagccugc

SEQ ID NO: 1724194 - RNA, 16 nt, Human
ucauaauaaguugcau

SEQ ID NO: 1724195 - RNA, 12 nt, Human
ucauaaugacuu

SEQ ID NO: 1724196 - RNA, 18 nt, Human
accugaagacucauucuu

SEQ ID NO: 1724197 - RNA, 19 nt, Human
accugaauuuuggcugugu

SEQ ID NO: 1724198 - RNA, 12 nt, Human
accugagcccca

SEQ ID NO: 1724199 - RNA, 17 nt, Human
accugagccccaaaagg

SEQ ID NO: 1724200 - RNA, 23 nt, Human
accugaggcccuucucuccagcc

SEQ ID NO: 1724201 - RNA, 22 nt, Human
accugaagcuaucguaaaauua

SEQ ID NO: 1724202 - RNA, 17 nt, Human
accugaccccugacccc

SEQ ID NO: 1724203 - RNA, 14 nt, Human
accugaggggccuc

SEQ ID NO: 1724204 - RNA, 16 nt, Human
accugaggggccucuu

SEQ ID NO: 1724205 - RNA, 14 nt, Human
accugauugugucu

SEQ ID NO: 1724206 - RNA, 17 nt, Human
accugccaggaagccag

SEQ ID NO: 1724207 - RNA, 16 nt, Human
accugccaggaagcca

SEQ ID NO: 1724208 - RNA, 19 nt, Human
accugccaggaagccagca

SEQ ID NO: 1724209 - RNA, 18 nt, Human
accugccaggaagccagc

SEQ ID NO: 1724210 - RNA, 17 nt, Human
accugccucggccuccc

SEQ ID NO: 1724211 - RNA, 18 nt, Human
ucauuuuuuuuaagaaaa

SEQ ID NO: 1724212 - RNA, 14 nt, Human
ucauuuuugaauac

SEQ ID NO: 1724213 - RNA, 19 nt, Human
ucauuuuuaguagagacag

SEQ ID NO: 1724214 - RNA, 14 nt, Human
ucauuugucacaca

SEQ ID NO: 1724215 - RNA, 16 nt, Human
ucauuugcuuuggaag

SEQ ID NO: 1724216 - RNA, 15 nt, Human
ucauuugcuuuggaa

SEQ ID NO: 1724217 - RNA, 16 nt, Human
ucauuugucacacacu

SEQ ID NO: 1724218 - RNA, 20 nt, Human
accuggaauauauaaccagu

SEQ ID NO: 1724219 - RNA, 12 nt, Human
accugcucuccu

SEQ ID NO: 1724220 - RNA, 23 nt, Human
accugccuguugggccaggagcc

SEQ ID NO: 1724221 - RNA, 21 nt, Human
accugcgucucauacucaccu

SEQ ID NO: 1724222 - RNA, 16 nt, Human
accugcggugcuaucu

SEQ ID NO: 1724223 - RNA, 18 nt, Human
uccaaggguacuaaggaa

SEQ ID NO: 1724224 - RNA, 19 nt, Human
uccaaaugcagcuuuaaaa

SEQ ID NO: 1724225 - RNA, 13 nt, Human
accuggccucugc

SEQ ID NO: 1724226 - RNA, 12 nt, Human
accuggccucug

SEQ ID NO: 1724227 - RNA, 20 nt, Human
uccacccaggagccccgagg

SEQ ID NO: 1724228 - RNA, 17 nt, Human
uccacccaccucagccu

SEQ ID NO: 1724229 - RNA, 13 nt, Human
uccacccaccuca

SEQ ID NO: 1724230 - RNA, 12 nt, Human
uccacccaccuc

SEQ ID NO: 1724231 - RNA, 18 nt, Human
uccaccaucaagccacca

SEQ ID NO: 1724232 - RNA, 14 nt, Human
accuuuuuuauaca

SEQ ID NO: 1724233 - RNA, 16 nt, Human
accuuuguccccaccg

SEQ ID NO: 1724234 - RNA, 15 nt, Human
accuuuguccccacc

SEQ ID NO: 1724235 - RNA, 14 nt, Human
accuuuguccccac

SEQ ID NO: 1724236 - RNA, 18 nt, Human
accuuuuuuauacauaaa

SEQ ID NO: 1724237 - RNA, 16 nt, Human
accuuuuuuauacaua

SEQ ID NO: 1724238 - RNA, 17 nt, Human
accuuuuuuauacauaa

SEQ ID NO: 1724239 - RNA, 13 nt, Human
accuuugucccca

SEQ ID NO: 1724240 - RNA, 22 nt, Human
accuucuccuucaccuuugucc

SEQ ID NO: 1724241 - RNA, 21 nt, Human
accuggguaacuagggaagau

SEQ ID NO: 1724242 - RNA, 17 nt, Human
accuucccaugcccugg

SEQ ID NO: 1724243 - RNA, 17 nt, Human
accuucgccaccugggu

SEQ ID NO: 1724244 - RNA, 15 nt, Human
accuucgccaccugg

SEQ ID NO: 1724245 - RNA, 13 nt, Human
uccguuaaaauac

SEQ ID NO: 1724246 - RNA, 15 nt, Human
uccguuaaaauacca

SEQ ID NO: 1724247 - RNA, 21 nt, Human
uccuagccugugccucuggga

SEQ ID NO: 1724248 - RNA, 12 nt, Human
uccuacucugug

SEQ ID NO: 1724249 - RNA, 16 nt, Human
acucgaguuacagaca

SEQ ID NO: 1724250 - RNA, 17 nt, Human
acucuggcagcucagag

SEQ ID NO: 1724251 - RNA, 16 nt, Human
acucuggcagcucaga

SEQ ID NO: 1724252 - RNA, 20 nt, Human
acucuggcagcucagagagg

SEQ ID NO: 1724253 - RNA, 19 nt, Human
acucuggcagcucagagag

SEQ ID NO: 1724254 - RNA, 21 nt, Human
acucuuauugcccacgcugga

SEQ ID NO: 1724255 - RNA, 13 nt, Human
acucuugaaaaau

SEQ ID NO: 1724256 - RNA, 21 nt, Human
acucuucaguuaagccuuugg

SEQ ID NO: 1724257 - RNA, 20 nt, Human
acucuucaguuaagccuuug

SEQ ID NO: 1724258 - RNA, 16 nt, Human
acucgcgacaaugcaa

SEQ ID NO: 1724259 - RNA, 15 nt, Human
acucgcgacaaugca

SEQ ID NO: 1724260 - RNA, 17 nt, Human
acucgcgacaaugcaaa

SEQ ID NO: 1724261 - RNA, 14 nt, Human
acucguauaugucu

SEQ ID NO: 1724262 - RNA, 23 nt, Human
acucugacaacagacuucugaaa

SEQ ID NO: 1724263 - RNA, 22 nt, Human
acucugacaacagacuucugaa

SEQ ID NO: 1724264 - RNA, 20 nt, Human
acucugacaacagacuucug

SEQ ID NO: 1724265 - RNA, 18 nt, Human
acucugacaacagacuuc

SEQ ID NO: 1724266 - RNA, 17 nt, Human
acucugacaacagacuu

SEQ ID NO: 1724267 - RNA, 13 nt, Human
acucugacaacag

SEQ ID NO: 1724268 - RNA, 18 nt, Human
uccucuccacugccuucg

SEQ ID NO: 1724269 - RNA, 17 nt, Human
uccucuccacugccuuc

SEQ ID NO: 1724270 - RNA, 15 nt, Human
uccucucugcccuaa

SEQ ID NO: 1724271 - RNA, 14 nt, Human
uccucucugcccua

SEQ ID NO: 1724272 - RNA, 13 nt, Human
uccucucugcccu

SEQ ID NO: 1724273 - RNA, 12 nt, Human
uccucucugccc

SEQ ID NO: 1724274 - RNA, 12 nt, Human
uccucugagccu

SEQ ID NO: 1724275 - RNA, 17 nt, Human
uccucugagccuuggga

SEQ ID NO: 1724276 - RNA, 13 nt, Human
uccucugagccuu

SEQ ID NO: 1724277 - RNA, 21 nt, Human
uccucccaccucagccucccg

SEQ ID NO: 1724278 - RNA, 20 nt, Human
uccucccaccucagccuccc

SEQ ID NO: 1724279 - RNA, 18 nt, Human
uccucccaccucagccuc

SEQ ID NO: 1724280 - RNA, 16 nt, Human
uccucccaccucagcc

SEQ ID NO: 1724281 - RNA, 15 nt, Human
uccucccaccucagc

SEQ ID NO: 1724282 - RNA, 14 nt, Human
uccucccaccucag

SEQ ID NO: 1724283 - RNA, 21 nt, Human
acucuugaaaaaugcauguug

SEQ ID NO: 1724284 - RNA, 19 nt, Human
acucuugaaaaaugcaugu

SEQ ID NO: 1724285 - RNA, 14 nt, Human
acucuugaaaaaug

SEQ ID NO: 1724286 - RNA, 12 nt, Human
uccucugcugcu

SEQ ID NO: 1724287 - RNA, 19 nt, Human
uccucuugccacugccucu

SEQ ID NO: 1724288 - RNA, 14 nt, Human
uccucugaggcuga

SEQ ID NO: 1724289 - RNA, 15 nt, Human
uccugaagaauugaa

SEQ ID NO: 1724290 - RNA, 17 nt, Human
acuagaacugaauuuug

SEQ ID NO: 1724291 - RNA, 18 nt, Human
acuagaacugaauuuugu

SEQ ID NO: 1724292 - RNA, 19 nt, Human
acuagaacugaauuuuguc

SEQ ID NO: 1724293 - RNA, 23 nt, Human
acuagaacugaauuuugucuuua

SEQ ID NO: 1724294 - RNA, 18 nt, Human
acuacggaauaguuggcu

SEQ ID NO: 1724295 - RNA, 22 nt, Human
acuaccuguaaugacaggccug

SEQ ID NO: 1724296 - RNA, 14 nt, Human
acuacuagggaaau

SEQ ID NO: 1724297 - RNA, 16 nt, Human
acuagaacugaauuuu

SEQ ID NO: 1724298 - RNA, 13 nt, Human
acguacacacaca

SEQ ID NO: 1724299 - RNA, 12 nt, Human
acguacacauuu

SEQ ID NO: 1724300 - RNA, 13 nt, Human
acguacacauuuu

SEQ ID NO: 1724301 - RNA, 14 nt, Human
acguacacauuuua

SEQ ID NO: 1724302 - RNA, 22 nt, Human
uccccacuugagaauuacccuu

SEQ ID NO: 1724303 - RNA, 22 nt, Human
uccccuaaagccucaaaacaaa

SEQ ID NO: 1724304 - RNA, 15 nt, Human
uccccuaaagccuca

SEQ ID NO: 1724305 - RNA, 14 nt, Human
acucaaugcacuga

SEQ ID NO: 1724306 - RNA, 20 nt, Human
acucacauuuauucugcuca

SEQ ID NO: 1724307 - RNA, 19 nt, Human
acucacauuuauucugcuc

SEQ ID NO: 1724308 - RNA, 21 nt, Human
acucacauuuauucugcucac

SEQ ID NO: 1724309 - RNA, 21 nt, Human
acuauaauguaagcucuacug

SEQ ID NO: 1724310 - RNA, 15 nt, Human
acuaugauuuggaaa

SEQ ID NO: 1724311 - RNA, 19 nt, Human
acuaugauuuaauuugaaa

SEQ ID NO: 1724312 - RNA, 16 nt, Human
acuaugauuuggaaaa

SEQ ID NO: 1724313 - RNA, 14 nt, Human
acuauaauguaagc

SEQ ID NO: 1724314 - RNA, 13 nt, Human
acuauaauguaag

SEQ ID NO: 1724315 - RNA, 12 nt, Human
acuauaauguaa

SEQ ID NO: 1724316 - RNA, 12 nt, Human
acuauguaucaa

SEQ ID NO: 1724317 - RNA, 13 nt, Human
acuauguugauaa

SEQ ID NO: 1724318 - RNA, 22 nt, Human
acucauugaccugaggcccuuc

SEQ ID NO: 1724319 - RNA, 18 nt, Human
acucauugaccugaggcc

SEQ ID NO: 1724320 - RNA, 17 nt, Human
acucauugaccugaggc

SEQ ID NO: 1724321 - RNA, 16 nt, Human
acucauugaccugagg

SEQ ID NO: 1724322 - RNA, 12 nt, Human
acucaucuuagg

SEQ ID NO: 1724323 - RNA, 23 nt, Human
acucaucuagguaaauuacaguu

SEQ ID NO: 1724324 - RNA, 14 nt, Human
acucagaauucucu

SEQ ID NO: 1724325 - RNA, 21 nt, Human
acucagaauucucuaguuuga

SEQ ID NO: 1724326 - RNA, 22 nt, Human
acucagaauucucuaguuugau

SEQ ID NO: 1724327 - RNA, 18 nt, Human
acucagaagacacugaug

SEQ ID NO: 1724328 - RNA, 17 nt, Human
acucagaagacacugau

SEQ ID NO: 1724329 - RNA, 16 nt, Human
acucagaagacacuga

SEQ ID NO: 1724330 - RNA, 15 nt, Human
acucagaagacacug

SEQ ID NO: 1724331 - RNA, 14 nt, Human
acucagaagacacu

SEQ ID NO: 1724332 - RNA, 19 nt, Human
acucaccugccccucaacu

SEQ ID NO: 1724333 - RNA, 14 nt, Human
acucaccugccccu

SEQ ID NO: 1724334 - RNA, 21 nt, Human
acucaccugccccucaacucu

SEQ ID NO: 1724335 - RNA, 20 nt, Human
ucccucagucuggcccuucc

SEQ ID NO: 1724336 - RNA, 18 nt, Human
ucccucagucuggcccuu

SEQ ID NO: 1724337 - RNA, 13 nt, Human
ucccucuuucccu

SEQ ID NO: 1724338 - RNA, 11 nt, Human
ucccucuuucc

SEQ ID NO: 1724339 - RNA, 22 nt, Human
ucccugaaggccccgcccaggc

SEQ ID NO: 1724340 - RNA, 21 nt, Human
ucccugaaggccccgcccagg

SEQ ID NO: 1724341 - RNA, 18 nt, Human
ucccugaaggccccgccc

SEQ ID NO: 1724342 - RNA, 23 nt, Human
ucccugaaggccccgcccaggcu

SEQ ID NO: 1724343 - RNA, 17 nt, Human
acucaccccagccccaa

SEQ ID NO: 1724344 - RNA, 20 nt, Human
acucaccucccccaucucuu

SEQ ID NO: 1724345 - RNA, 19 nt, Human
acucaccucccccaucucu

SEQ ID NO: 1724346 - RNA, 17 nt, Human
uagcgcccaguugggug

SEQ ID NO: 1724347 - RNA, 14 nt, Human
uagcgcccaguugg

SEQ ID NO: 1724348 - RNA, 21 nt, Human
uagccuuagaagucacacagu

SEQ ID NO: 1724349 - RNA, 20 nt, Human
uagccuuagaagucacacag

SEQ ID NO: 1724350 - RNA, 14 nt, Human
uaggaaaaacugau

SEQ ID NO: 1724351 - RNA, 13 nt, Human
uaggaaaaacuga

SEQ ID NO: 1724352 - RNA, 13 nt, Human
uagcuuuucccuu

SEQ ID NO: 1724353 - RNA, 23 nt, Human
uagcuuuaaugauaugcuuguaa

SEQ ID NO: 1724354 - RNA, 13 nt, Human
uaggauguugaaa

SEQ ID NO: 1724355 - RNA, 14 nt, Human
uaggcaggaccugu

SEQ ID NO: 1724356 - RNA, 15 nt, Human
uaggcaggaccugug

SEQ ID NO: 1724357 - RNA, 17 nt, Human
uaggaaaaacugauuuu

SEQ ID NO: 1724358 - RNA, 16 nt, Human
uaggaaaaacugauuu

SEQ ID NO: 1724359 - RNA, 13 nt, Human
uagggaagauaau

SEQ ID NO: 1724360 - RNA, 21 nt, Human
uagggaaggauacaaaagcau

SEQ ID NO: 1724361 - RNA, 19 nt, Human
uagggauggggcugugggg

SEQ ID NO: 1724362 - RNA, 21 nt, Human
acaaugcaaaccaucauugaa

SEQ ID NO: 1724363 - RNA, 19 nt, Human
acaaugcaaaccaucauug

SEQ ID NO: 1724364 - RNA, 23 nt, Human
acaaugcaaaccaucauugaaau

SEQ ID NO: 1724365 - RNA, 15 nt, Human
uaggguuauaauaau

SEQ ID NO: 1724366 - RNA, 15 nt, Human
uagggugggccuuca

SEQ ID NO: 1724367 - RNA, 17 nt, Human
uaggguuauaauaaugu

SEQ ID NO: 1724368 - RNA, 19 nt, Human
uaggguaagugagagaggg

SEQ ID NO: 1724369 - RNA, 13 nt, Human
uaggguccugggg

SEQ ID NO: 1724370 - RNA, 18 nt, Human
acaaugcaaaccaucauu

SEQ ID NO: 1724371 - RNA, 17 nt, Human
acaaugcaaaccaucau

SEQ ID NO: 1724372 - RNA, 16 nt, Human
acaaugcaaaccauca

SEQ ID NO: 1724373 - RNA, 11 nt, Human
acaaugcaaac

SEQ ID NO: 1724374 - RNA, 20 nt, Human
acaaugacuuacuguacaug

SEQ ID NO: 1724375 - RNA, 22 nt, Human
acaaugacuuacuguacaugaa

SEQ ID NO: 1724376 - RNA, 22 nt, Human
acacaggcccggcuccaggcuc

SEQ ID NO: 1724377 - RNA, 21 nt, Human
acacaggcccggcuccaggcu

SEQ ID NO: 1724378 - RNA, 20 nt, Human
acacaggcccggcuccaggc

SEQ ID NO: 1724379 - RNA, 19 nt, Human
acacaggcccggcuccagg

SEQ ID NO: 1724380 - RNA, 24 nt, Human
acacaggcccggcuccaggcuccu

SEQ ID NO: 1724381 - RNA, 23 nt, Human
acacaggcccggcuccaggcucc

SEQ ID NO: 1724382 - RNA, 18 nt, Human
acacaggcccggcuccag

SEQ ID NO: 1724383 - RNA, 17 nt, Human
acacaggcccggcucca

SEQ ID NO: 1724384 - RNA, 16 nt, Human
acacaggcccggcucc

SEQ ID NO: 1724385 - RNA, 23 nt, Human
acacacagauuugagcucagccc

SEQ ID NO: 1724386 - RNA, 16 nt, Human
acacaguauuacuucu

SEQ ID NO: 1724387 - RNA, 19 nt, Human
acacaguaccauuuaaugg

SEQ ID NO: 1724388 - RNA, 16 nt, Human
uaguaaaaauaaaauu

SEQ ID NO: 1724389 - RNA, 13 nt, Human
uaguaaaaauaaa

SEQ ID NO: 1724390 - RNA, 22 nt, Human
uaguagagacaggguuuugcca

SEQ ID NO: 1724391 - RNA, 15 nt, Human
uaguagagacagggu

SEQ ID NO: 1724392 - RNA, 14 nt, Human
uagucacugagaca

SEQ ID NO: 1724393 - RNA, 13 nt, Human
uaguagagacggg

SEQ ID NO: 1724394 - RNA, 12 nt, Human
uaguaaucauau

SEQ ID NO: 1724395 - RNA, 21 nt, Human
uagacagucccugccaaugga

SEQ ID NO: 1724396 - RNA, 17 nt, Human
uagacagucccugccaa

SEQ ID NO: 1724397 - RNA, 21 nt, Human
uagacagagucucacuguugc

SEQ ID NO: 1724398 - RNA, 18 nt, Human
aauuugggggaaaauuua

SEQ ID NO: 1724399 - RNA, 14 nt, Human
aauuugugauacaa

SEQ ID NO: 1724400 - RNA, 20 nt, Human
aauuugugauacaaugcugu

SEQ ID NO: 1724401 - RNA, 17 nt, Human
aauuugugauacaaugc

SEQ ID NO: 1724402 - RNA, 18 nt, Human
aauuugugauacaaugcu

SEQ ID NO: 1724403 - RNA, 18 nt, Human
uagacaauuuauuauggc

SEQ ID NO: 1724404 - RNA, 10 nt, Human
uagacagagu

SEQ ID NO: 1724405 - RNA, 16 nt, Human
uagacagucccugcca

SEQ ID NO: 1724406 - RNA, 17 nt, Human
uagaacucccuuucaac

SEQ ID NO: 1724407 - RNA, 18 nt, Human
uagaacucccuuucaaca

SEQ ID NO: 1724408 - RNA, 16 nt, Human
uagaacucccuuucaa

SEQ ID NO: 1724409 - RNA, 14 nt, Human
aauuccacagcugc

SEQ ID NO: 1724410 - RNA, 13 nt, Human
aauuccacagcug

SEQ ID NO: 1724411 - RNA, 12 nt, Human
aauuccacagcu

SEQ ID NO: 1724412 - RNA, 13 nt, Human
uacuuuuuccugg

SEQ ID NO: 1724413 - RNA, 15 nt, Human
uagcacagacccugc

SEQ ID NO: 1724414 - RNA, 21 nt, Human
uagcacagacccugcccugug

SEQ ID NO: 1724415 - RNA, 20 nt, Human
uagcacagacccugcccugu

SEQ ID NO: 1724416 - RNA, 14 nt, Human
uagcacagacccug

SEQ ID NO: 1724417 - RNA, 24 nt, Human
uagcacagacccugcccugugggc

SEQ ID NO: 1724418 - RNA, 22 nt, Human
uagcacagacccugcccugugg

SEQ ID NO: 1724419 - RNA, 12 nt, Human
uagccaaggcca

SEQ ID NO: 1724420 - RNA, 13 nt, Human
uagccaaggccaa

SEQ ID NO: 1724421 - RNA, 14 nt, Human
uagccaaggccaaa

SEQ ID NO: 1724422 - RNA, 14 nt, Human
uagagccagggucu

SEQ ID NO: 1724423 - RNA, 22 nt, Human
uagagcggagaaaggaagggcu

SEQ ID NO: 1724424 - RNA, 12 nt, Human
aauuuuacauuu

SEQ ID NO: 1724425 - RNA, 22 nt, Human
acagcuaaucagcauucucacu

SEQ ID NO: 1724426 - RNA, 10 nt, Human
uaugggagag

SEQ ID NO: 1724427 - RNA, 23 nt, Human
uaugggacucaaugcacugacau

SEQ ID NO: 1724428 - RNA, 16 nt, Human
uaugggacucaaugca

SEQ ID NO: 1724429 - RNA, 20 nt, Human
uauggcccuggccuagcaua

SEQ ID NO: 1724430 - RNA, 21 nt, Human
uauggcccuggccuagcauac

SEQ ID NO: 1724431 - RNA, 22 nt, Human
uauggcccuggccuagcauacg

SEQ ID NO: 1724432 - RNA, 14 nt, Human
uaugaucacggcuc

SEQ ID NO: 1724433 - RNA, 17 nt, Human
uaugauacuugaaaauu

SEQ ID NO: 1724434 - RNA, 24 nt, Human
uaugauagguuauuuugauguaaa

SEQ ID NO: 1724435 - RNA, 22 nt, Human
uaugcaugaaguaauaugcaca

SEQ ID NO: 1724436 - RNA, 14 nt, Human
uaugcucugcaugu

SEQ ID NO: 1724437 - RNA, 14 nt, Human
uaugaggcauuugu

SEQ ID NO: 1724438 - RNA, 15 nt, Human
uaugaggcauuuguu

SEQ ID NO: 1724439 - RNA, 21 nt, Human
uaugaggcauuuguuugaacu

SEQ ID NO: 1724440 - RNA, 23 nt, Human
uaugaggcauuuguuugaacuga

SEQ ID NO: 1724441 - RNA, 23 nt, Human
uaugaagcuuuuaugugaaacau

SEQ ID NO: 1724442 - RNA, 22 nt, Human
uaugaagcuuuuaugugaaaca

SEQ ID NO: 1724443 - RNA, 20 nt, Human
uaugaagcuuuuaugugaaa

SEQ ID NO: 1724444 - RNA, 16 nt, Human
acagcccgggcucugc

SEQ ID NO: 1724445 - RNA, 23 nt, Human
acagcccuccaucuaaacugccc

SEQ ID NO: 1724446 - RNA, 15 nt, Human
acagcccgggcucug

SEQ ID NO: 1724447 - RNA, 16 nt, Human
acagccccuccuccau

SEQ ID NO: 1724448 - RNA, 14 nt, Human
acagccccuccucc

SEQ ID NO: 1724449 - RNA, 17 nt, Human
acagcagccccugcaca

SEQ ID NO: 1724450 - RNA, 19 nt, Human
acagcacgggggccaagga

SEQ ID NO: 1724451 - RNA, 22 nt, Human
acagauuugagcucagcccugg

SEQ ID NO: 1724452 - RNA, 14 nt, Human
acagauuuggaaag

SEQ ID NO: 1724453 - RNA, 15 nt, Human
acagauuuggaaaga

SEQ ID NO: 1724454 - RNA, 21 nt, Human
acagauuuggaaagacuggac

SEQ ID NO: 1724455 - RNA, 19 nt, Human
acagcuaaugggacacuaa

SEQ ID NO: 1724456 - RNA, 17 nt, Human
acagcuaaugggacacu

SEQ ID NO: 1724457 - RNA, 16 nt, Human
acagcuaaugggacac

SEQ ID NO: 1724458 - RNA, 15 nt, Human
acagcuaaugggaca

SEQ ID NO: 1724459 - RNA, 21 nt, Human
acagcuucauuuccugugucu

SEQ ID NO: 1724460 - RNA, 19 nt, Human
acagcuucauuuccugugu

SEQ ID NO: 1724461 - RNA, 17 nt, Human
acagcuucauuuccugu

SEQ ID NO: 1724462 - RNA, 21 nt, Human
acagcuugaccgugaggccag

SEQ ID NO: 1724463 - RNA, 20 nt, Human
acagcuugaccgugaggcca

SEQ ID NO: 1724464 - RNA, 17 nt, Human
acagcuugaccgugagg

SEQ ID NO: 1724465 - RNA, 21 nt, Human
acaggaaaagcugcugacagu

SEQ ID NO: 1724466 - RNA, 20 nt, Human
acaggaaaagcugcugacag

SEQ ID NO: 1724467 - RNA, 19 nt, Human
acaggaaaagcugcugaca

SEQ ID NO: 1724468 - RNA, 23 nt, Human
acagcuugaccgugaggccagag

SEQ ID NO: 1724469 - RNA, 22 nt, Human
acagcuugaccgugaggccaga

SEQ ID NO: 1724470 - RNA, 20 nt, Human
acaggaaaauuuuaaaaaua

SEQ ID NO: 1724471 - RNA, 15 nt, Human
acaggcagauacagg

SEQ ID NO: 1724472 - RNA, 15 nt, Human
acaggacucugccuc

SEQ ID NO: 1724473 - RNA, 16 nt, Human
acaggacucugccucc

SEQ ID NO: 1724474 - RNA, 17 nt, Human
acaggcccggcuccagg

SEQ ID NO: 1724475 - RNA, 16 nt, Human
acaggcccggcuccag

SEQ ID NO: 1724476 - RNA, 13 nt, Human
acaggcaggucca

SEQ ID NO: 1724477 - RNA, 22 nt, Human
acaggcccggcuccaggcuccu

SEQ ID NO: 1724478 - RNA, 21 nt, Human
acaggcccggcuccaggcucc

SEQ ID NO: 1724479 - RNA, 20 nt, Human
acaggcccggcuccaggcuc

SEQ ID NO: 1724480 - RNA, 18 nt, Human
acaggcccggcuccaggc

SEQ ID NO: 1724481 - RNA, 22 nt, Human
acaggcccuuccucuccacugc

SEQ ID NO: 1724482 - RNA, 15 nt, Human
acaggcccuuccucu

SEQ ID NO: 1724483 - RNA, 13 nt, Human
acaggcccuuccu

SEQ ID NO: 1724484 - RNA, 21 nt, Human
uaugucucgugguaggacugu

SEQ ID NO: 1724485 - RNA, 16 nt, Human
acacucauugaccuga

SEQ ID NO: 1724486 - RNA, 18 nt, Human
uauagccuaggugacaga

SEQ ID NO: 1724487 - RNA, 12 nt, Human
uauaggaauuga

SEQ ID NO: 1724488 - RNA, 23 nt, Human
uauaggaacuuaaauaaugugaa

SEQ ID NO: 1724489 - RNA, 15 nt, Human
uauaggcaccuacca

SEQ ID NO: 1724490 - RNA, 22 nt, Human
uauacacuuacacuuuaugcac

SEQ ID NO: 1724491 - RNA, 21 nt, Human
uauaauuuaccugaagucuuu

SEQ ID NO: 1724492 - RNA, 18 nt, Human
uauaauuuaccugaaguc

SEQ ID NO: 1724493 - RNA, 19 nt, Human
uauaagugauugcugguuu

SEQ ID NO: 1724494 - RNA, 21 nt, Human
acacucaaaagcugggcaggu

SEQ ID NO: 1724495 - RNA, 22 nt, Human
acacuaaugaggaaacugcacu

SEQ ID NO: 1724496 - RNA, 15 nt, Human
acacuaaugaggaaa

SEQ ID NO: 1724497 - RNA, 20 nt, Human
uagucacugagacagcccgg

SEQ ID NO: 1724498 - RNA, 17 nt, Human
uagucacugagacagcc

SEQ ID NO: 1724499 - RNA, 18 nt, Human
acagacauacuaaccagc

SEQ ID NO: 1724500 - RNA, 19 nt, Human
acagacauacuaaccagca

SEQ ID NO: 1724501 - RNA, 13 nt, Human
acagaaauguaca

SEQ ID NO: 1724502 - RNA, 16 nt, Human
acagaaagguuuucuu

SEQ ID NO: 1724503 - RNA, 16 nt, Human
acacuuacacuuuaug

SEQ ID NO: 1724504 - RNA, 20 nt, Human
acacuguuucaaacuuuacu

SEQ ID NO: 1724505 - RNA, 23 nt, Human
acacuguuucaaacuuuacuaug

SEQ ID NO: 1724506 - RNA, 19 nt, Human
acacucauugaccugaggc

SEQ ID NO: 1724507 - RNA, 17 nt, Human
acacucauugaccugag

SEQ ID NO: 1724508 - RNA, 17 nt, Human
acacuguuucaaacuuu

SEQ ID NO: 1724509 - RNA, 18 nt, Human
acacuguuucaaacuuua

SEQ ID NO: 1724510 - RNA, 21 nt, Human
acacuuacacuuuaugcacaa

SEQ ID NO: 1724511 - RNA, 18 nt, Human
acacuuacacuuuaugca

SEQ ID NO: 1724512 - RNA, 14 nt, Human
acacuuccauaauc

SEQ ID NO: 1724513 - RNA, 22 nt, Human
acacuucaggcucuucuccuuu

SEQ ID NO: 1724514 - RNA, 19 nt, Human
acacuucaggcucuucucc

SEQ ID NO: 1724515 - RNA, 15 nt, Human
acacuucaggcucuu

SEQ ID NO: 1724516 - RNA, 23 nt, Human
uaucaaauacauuuaaaacauua

SEQ ID NO: 1724517 - RNA, 19 nt, Human
uaucacccagaagaaaaua

SEQ ID NO: 1724518 - RNA, 22 nt, Human
uaucacccagaagaaaauagug

SEQ ID NO: 1724519 - RNA, 17 nt, Human
uaucagaauucucagaa

SEQ ID NO: 1724520 - RNA, 19 nt, Human
uauccaacaucaacaucuu

SEQ ID NO: 1724521 - RNA, 15 nt, Human
uaucccggcugcccu

SEQ ID NO: 1724522 - RNA, 22 nt, Human
aauuaugugccagauuuaugca

SEQ ID NO: 1724523 - RNA, 21 nt, Human
aauuauuuauuaaaugcccag

SEQ ID NO: 1724524 - RNA, 22 nt, Human
aauuauuuauuaaaugcccagc

SEQ ID NO: 1724525 - RNA, 11 nt, Human
aauucaguugu

SEQ ID NO: 1724526 - RNA, 22 nt, Human
aauucaguuguuagugugucuu

SEQ ID NO: 1724527 - RNA, 17 nt, Human
aauucaguuguuagugu

SEQ ID NO: 1724528 - RNA, 16 nt, Human
uaccugaagucuuugu

SEQ ID NO: 1724529 - RNA, 15 nt, Human
uaccugaggggccuc

SEQ ID NO: 1724530 - RNA, 13 nt, Human
uaccugaggggcc

SEQ ID NO: 1724531 - RNA, 14 nt, Human
uaccugaagucuuu

SEQ ID NO: 1724532 - RNA, 13 nt, Human
uaccugaagucuu

SEQ ID NO: 1724533 - RNA, 23 nt, Human
uaccugaagcuaucguaaaauua

SEQ ID NO: 1724534 - RNA, 15 nt, Human
uacccucauguucuu

SEQ ID NO: 1724535 - RNA, 22 nt, Human
uaccucuugagccuugaacuuu

SEQ ID NO: 1724536 - RNA, 23 nt, Human
uaccucuugagccuugaacuuug

SEQ ID NO: 1724537 - RNA, 23 nt, Human
uacccgggaagggggcugggaca

SEQ ID NO: 1724538 - RNA, 20 nt, Human
aauuacaggaaguacuggag

SEQ ID NO: 1724539 - RNA, 19 nt, Human
aauuacaggaaguacugga

SEQ ID NO: 1724540 - RNA, 17 nt, Human
aauuacaggaaguacug

SEQ ID NO: 1724541 - RNA, 16 nt, Human
uaccugaggggccucu

SEQ ID NO: 1724542 - RNA, 16 nt, Human
uaccugccaggaagcc

SEQ ID NO: 1724543 - RNA, 13 nt, Human
aauguucaucaau

SEQ ID NO: 1724544 - RNA, 23 nt, Human
uacagagcccacgcccccacugg

SEQ ID NO: 1724545 - RNA, 21 nt, Human
aaugugcugaaugguuuucaa

SEQ ID NO: 1724546 - RNA, 16 nt, Human
aauguucaucaaugaa

SEQ ID NO: 1724547 - RNA, 20 nt, Human
aauguucaucaaugaaugaa

SEQ ID NO: 1724548 - RNA, 21 nt, Human
aauguucucucuucuccaccu

SEQ ID NO: 1724549 - RNA, 12 nt, Human
aauuaacuuuua

SEQ ID NO: 1724550 - RNA, 13 nt, Human
aauuaacuuuuau

SEQ ID NO: 1724551 - RNA, 17 nt, Human
aauuaaguacuauguau

SEQ ID NO: 1724552 - RNA, 16 nt, Human
aauuaaguacuaugua

SEQ ID NO: 1724553 - RNA, 15 nt, Human
aauuaacuuuuauaa

SEQ ID NO: 1724554 - RNA, 16 nt, Human
aauuaacuuuuauaaa

SEQ ID NO: 1724555 - RNA, 12 nt, Human
uacauucuguua

SEQ ID NO: 1724556 - RNA, 13 nt, Human
uacauuuccuaaa

SEQ ID NO: 1724557 - RNA, 12 nt, Human
uaccagcagagc

SEQ ID NO: 1724558 - RNA, 14 nt, Human
uaccagcagagcac

SEQ ID NO: 1724559 - RNA, 13 nt, Human
uaccagcagagca

SEQ ID NO: 1724560 - RNA, 22 nt, Human
uaccagcagagcaccuuagaca

SEQ ID NO: 1724561 - RNA, 18 nt, Human
uaccagccaguaaauggg

SEQ ID NO: 1724562 - RNA, 19 nt, Human
uaccagggacugaggggag

SEQ ID NO: 1724563 - RNA, 23 nt, Human
uacccccugcaaagcccagcuug

SEQ ID NO: 1724564 - RNA, 19 nt, Human
uacccccugcaaagcccag

SEQ ID NO: 1724565 - RNA, 15 nt, Human
uacccccugcaaagc

SEQ ID NO: 1724566 - RNA, 22 nt, Human
uaauuccguagguuauuuucag

SEQ ID NO: 1724567 - RNA, 13 nt, Human
aaugcaccuggaa

SEQ ID NO: 1724568 - RNA, 16 nt, Human
aaugauuucauucaau

SEQ ID NO: 1724569 - RNA, 11 nt, Human
aaugcaaacca

SEQ ID NO: 1724570 - RNA, 12 nt, Human
aaugcaaaccau

SEQ ID NO: 1724571 - RNA, 14 nt, Human
aaugcaaaccauca

SEQ ID NO: 1724572 - RNA, 22 nt, Human
aaugagaaaucuaaaaaacgaa

SEQ ID NO: 1724573 - RNA, 12 nt, Human
aaugagaaaucu

SEQ ID NO: 1724574 - RNA, 11 nt, Human
aaugagccugg

SEQ ID NO: 1724575 - RNA, 21 nt, Human
aaugaccuuucaauaggaaaa

SEQ ID NO: 1724576 - RNA, 20 nt, Human
aaugagaaaaugucuuuauu

SEQ ID NO: 1724577 - RNA, 13 nt, Human
aaugagccuggca

SEQ ID NO: 1724578 - RNA, 12 nt, Human
aaugagccuggc

SEQ ID NO: 1724579 - RNA, 14 nt, Human
aaugagccuggcaa

SEQ ID NO: 1724580 - RNA, 18 nt, Human
aaugaggucagagccugc

SEQ ID NO: 1724581 - RNA, 16 nt, Human
aaugaggucagagccu

SEQ ID NO: 1724582 - RNA, 24 nt, Human
aaugauuucagcucacugcaaccu

SEQ ID NO: 1724583 - RNA, 15 nt, Human
uacagacaaagcgug

SEQ ID NO: 1724584 - RNA, 14 nt, Human
uacagacaaagcgu

SEQ ID NO: 1724585 - RNA, 13 nt, Human
uacagacaaagcg

SEQ ID NO: 1724586 - RNA, 17 nt, Human
uacaccgggccuggaga

SEQ ID NO: 1724587 - RNA, 15 nt, Human
uacaccgggccugga

SEQ ID NO: 1724588 - RNA, 17 nt, Human
uacagagacagaaagca

SEQ ID NO: 1724589 - RNA, 19 nt, Human
uacagacaaagcguggugg

SEQ ID NO: 1724590 - RNA, 22 nt, Human
uacagagcccacgcccccacug

SEQ ID NO: 1724591 - RNA, 19 nt, Human
uacagagcccacgccccca

SEQ ID NO: 1724592 - RNA, 23 nt, Human
uacagagcagacaguuaagagaa

SEQ ID NO: 1724593 - RNA, 12 nt, Human
aauguaaauaaa

SEQ ID NO: 1724594 - RNA, 16 nt, Human
aaugguuuucuugugu

SEQ ID NO: 1724595 - RNA, 16 nt, Human
aaugguuuucaaaaua

SEQ ID NO: 1724596 - RNA, 14 nt, Human
aaugguuuucaaaa

SEQ ID NO: 1724597 - RNA, 16 nt, Human
aauggaagacagcucu

SEQ ID NO: 1724598 - RNA, 18 nt, Human
aauggaagacagcucuua

SEQ ID NO: 1724599 - RNA, 18 nt, Human
aaugcugguuuuucaguu

SEQ ID NO: 1724600 - RNA, 13 nt, Human
aauggaagacagc

SEQ ID NO: 1724601 - RNA, 22 nt, Human
aaugcuggcuguuggcuggggg

SEQ ID NO: 1724602 - RNA, 21 nt, Human
aaugcuggcuguuggcugggg

SEQ ID NO: 1724603 - RNA, 21 nt, Human
uacaaaaaaaaaaaaaaauua

SEQ ID NO: 1724604 - RNA, 22 nt, Human
uaauuuuuuuuuuccuuuuaaa

SEQ ID NO: 1724605 - RNA, 18 nt, Human
uaauuuuuuugagacaga

SEQ ID NO: 1724606 - RNA, 15 nt, Human
uaauuuuuguauuuu

SEQ ID NO: 1724607 - RNA, 13 nt, Human
uacaaugcugugc

SEQ ID NO: 1724608 - RNA, 14 nt, Human
uacaaugcugugcc

SEQ ID NO: 1724609 - RNA, 16 nt, Human
uacaaugcugugcccu

SEQ ID NO: 1724610 - RNA, 17 nt, Human
aaucccauuuaaaaaaa

SEQ ID NO: 1724611 - RNA, 12 nt, Human
aaucccaggaug

SEQ ID NO: 1724612 - RNA, 20 nt, Human
aauccucaguuuuugugaaa

SEQ ID NO: 1724613 - RNA, 18 nt, Human
aaucugggccagaauuuc

SEQ ID NO: 1724614 - RNA, 13 nt, Human
aaucucaaauaac

SEQ ID NO: 1724615 - RNA, 18 nt, Human
uaaggaugcuuguacaua

SEQ ID NO: 1724616 - RNA, 17 nt, Human
uaaguguguguuuuuca

SEQ ID NO: 1724617 - RNA, 17 nt, Human
uaaguuaguuccacuga

SEQ ID NO: 1724618 - RNA, 19 nt, Human
uaaguuaguuccacugaga

SEQ ID NO: 1724619 - RNA, 21 nt, Human
uaaguuacacauuuuucagau

SEQ ID NO: 1724620 - RNA, 20 nt, Human
uaaguuaguuccacugagac

SEQ ID NO: 1724621 - RNA, 21 nt, Human
uaagcuauucaguaauaacuc

SEQ ID NO: 1724622 - RNA, 15 nt, Human
uaagcaaaaugugau

SEQ ID NO: 1724623 - RNA, 21 nt, Human
uaagcaaaaugugauauguac

SEQ ID NO: 1724624 - RNA, 14 nt, Human
uaagcaaaauguga

SEQ ID NO: 1724625 - RNA, 14 nt, Human
uaagauucauauuu

SEQ ID NO: 1724626 - RNA, 9 nt, Human
uaaggaaua

SEQ ID NO: 1724627 - RNA, 13 nt, Human
uaaggaagacaau

SEQ ID NO: 1724628 - RNA, 18 nt, Human
uaaggaauaccugucccc

SEQ ID NO: 1724629 - RNA, 17 nt, Human
uaaggaauaccuguccc

SEQ ID NO: 1724630 - RNA, 22 nt, Human
uaaggaauuuuauuuuuuucug

SEQ ID NO: 1724631 - RNA, 21 nt, Human
aaucacguaaagcuagaaaug

SEQ ID NO: 1724632 - RNA, 20 nt, Human
aaucacguaaagcuagaaau

SEQ ID NO: 1724633 - RNA, 15 nt, Human
aauauuuauagguca

SEQ ID NO: 1724634 - RNA, 11 nt, Human
aaucagccugc

SEQ ID NO: 1724635 - RNA, 19 nt, Human
aaucagcauucucacuccu

SEQ ID NO: 1724636 - RNA, 18 nt, Human
aaucagcauucucacucc

SEQ ID NO: 1724637 - RNA, 18 nt, Human
aaucagccugcuccagcu

SEQ ID NO: 1724638 - RNA, 13 nt, Human
aaucagccugcuc

SEQ ID NO: 1724639 - RNA, 19 nt, Human
aaucagccugcuccagcug

SEQ ID NO: 1724640 - RNA, 21 nt, Human
aauaccugucccccugacaac

SEQ ID NO: 1724641 - RNA, 19 nt, Human
aauaccugucccccugaca

SEQ ID NO: 1724642 - RNA, 18 nt, Human
aauaccugucccccugac

SEQ ID NO: 1724643 - RNA, 15 nt, Human
aauaccugucccccu

SEQ ID NO: 1724644 - RNA, 18 nt, Human
aauagcgucauaacuaga

SEQ ID NO: 1724645 - RNA, 12 nt, Human
aauaccaaggaa

SEQ ID NO: 1724646 - RNA, 14 nt, Human
aauacauuuaaaac

SEQ ID NO: 1724647 - RNA, 17 nt, Human
aauacauuuaaaacauu

SEQ ID NO: 1724648 - RNA, 20 nt, Human
aauacauuuaaaacauuaaa

SEQ ID NO: 1724649 - RNA, 21 nt, Human
aauacauuuaaaacauuaaaa

SEQ ID NO: 1724650 - RNA, 22 nt, Human
aauacauuuaaaacauuaaaau

SEQ ID NO: 1724651 - RNA, 23 nt, Human
aauacauuuaaaacauuaaaaua

SEQ ID NO: 1724652 - RNA, 19 nt, Human
aauaccagccaguaaaugg

SEQ ID NO: 1724653 - RNA, 17 nt, Human
aauaccagccaguaaau

SEQ ID NO: 1724654 - RNA, 15 nt, Human
aauacagacuggaug

SEQ ID NO: 1724655 - RNA, 13 nt, Human
aauacagaggcaa

SEQ ID NO: 1724656 - RNA, 21 nt, Human
uaaauuaacuuuuauaaacuu

SEQ ID NO: 1724657 - RNA, 22 nt, Human
uaaauuaacuuuuauaaacuuu

SEQ ID NO: 1724658 - RNA, 18 nt, Human
aaguguauuuuuuuacua

SEQ ID NO: 1724659 - RNA, 21 nt, Human
aaguguauuuuuuuacuaaua

SEQ ID NO: 1724660 - RNA, 18 nt, Human
uaaaugaaaaucgugaca

SEQ ID NO: 1724661 - RNA, 19 nt, Human
uaaauuaacuuuuauaaac

SEQ ID NO: 1724662 - RNA, 20 nt, Human
uaaauuaacuuuuauaaacu

SEQ ID NO: 1724663 - RNA, 13 nt, Human
uaaaugugguaaa

SEQ ID NO: 1724664 - RNA, 17 nt, Human
uaacguauaaaagccug

SEQ ID NO: 1724665 - RNA, 13 nt, Human
uaacguauaaaag

SEQ ID NO: 1724666 - RNA, 13 nt, Human
uaacuucacauau

SEQ ID NO: 1724667 - RNA, 13 nt, Human
uaagaagugaaaa

SEQ ID NO: 1724668 - RNA, 20 nt, Human
uaacuugucuuuggacccug

SEQ ID NO: 1724669 - RNA, 16 nt, Human
uaacuugucuuuggac

SEQ ID NO: 1724670 - RNA, 21 nt, Human
aauauauuuuaagacgaaaca

SEQ ID NO: 1724671 - RNA, 21 nt, Human
aauaguucagguaacaggcag

SEQ ID NO: 1724672 - RNA, 21 nt, Human
aauauauucagccuggcuuca

SEQ ID NO: 1724673 - RNA, 19 nt, Human
uaacaugugaaaagaauag

SEQ ID NO: 1724674 - RNA, 19 nt, Human
uaacauguaauuaaguacu

SEQ ID NO: 1724675 - RNA, 14 nt, Human
uaacaugaauauuu

SEQ ID NO: 1724676 - RNA, 21 nt, Human
uaacaugaauauuuaguguuc

SEQ ID NO: 1724677 - RNA, 20 nt, Human
uaacaugaauauuuaguguu

SEQ ID NO: 1724678 - RNA, 19 nt, Human
uaacaugaauauuuagugu

SEQ ID NO: 1724679 - RNA, 11 nt, Human
gugccuuaugg

SEQ ID NO: 1724680 - RNA, 19 nt, Human
aagaccuucuccuucaccu

SEQ ID NO: 1724681 - RNA, 18 nt, Human
aagaccuucuccuucacc

SEQ ID NO: 1724682 - RNA, 15 nt, Human
aagaccuucuccuuc

SEQ ID NO: 1724683 - RNA, 13 nt, Human
aagacgcugugcu

SEQ ID NO: 1724684 - RNA, 19 nt, Human
aagacgcugugcugcccug

SEQ ID NO: 1724685 - RNA, 18 nt, Human
aagacgcugugcugcccu

SEQ ID NO: 1724686 - RNA, 17 nt, Human
aagacgcugugcugccc

SEQ ID NO: 1724687 - RNA, 15 nt, Human
aagacgcugugcugc

SEQ ID NO: 1724688 - RNA, 23 nt, Human
aagacugaguacguugugcauuu

SEQ ID NO: 1724689 - RNA, 20 nt, Human
aagacgcugugcugcccugc

SEQ ID NO: 1724690 - RNA, 16 nt, Human
aagacgugauuuugcu

SEQ ID NO: 1724691 - RNA, 22 nt, Human
aagacgugauuuugcuguagaa

SEQ ID NO: 1724692 - RNA, 23 nt, Human
aagacgugauuuugcuguagaag

SEQ ID NO: 1724693 - RNA, 16 nt, Human
aagacuuuggaaagac

SEQ ID NO: 1724694 - RNA, 16 nt, Human
aagacuuccagagccu

SEQ ID NO: 1724695 - RNA, 18 nt, Human
aagacuuccagagccuca

SEQ ID NO: 1724696 - RNA, 23 nt, Human
aagaggaaugaaguacucauaca

SEQ ID NO: 1724697 - RNA, 22 nt, Human
guggccucccaacucaccccag

SEQ ID NO: 1724698 - RNA, 21 nt, Human
guggccucccaacucacccca

SEQ ID NO: 1724699 - RNA, 23 nt, Human
gugggaggaucucuugagccugg

SEQ ID NO: 1724700 - RNA, 17 nt, Human
gugggaagggcuacacc

SEQ ID NO: 1724701 - RNA, 18 nt, Human
gugggagcugccuguuca

SEQ ID NO: 1724702 - RNA, 15 nt, Human
gugggagcugccugu

SEQ ID NO: 1724703 - RNA, 15 nt, Human
guggggucacucugg

SEQ ID NO: 1724704 - RNA, 22 nt, Human
guggcgcagcauauucaggaag

SEQ ID NO: 1724705 - RNA, 15 nt, Human
gugggacacccugug

SEQ ID NO: 1724706 - RNA, 14 nt, Human
gugggagcugccug

SEQ ID NO: 1724707 - RNA, 13 nt, Human
gugggacacccug

SEQ ID NO: 1724708 - RNA, 21 nt, Human
gugugaccacugcagaagaca

SEQ ID NO: 1724709 - RNA, 22 nt, Human
gugugacaaggauugcuacugu

SEQ ID NO: 1724710 - RNA, 16 nt, Human
gugugguagagugugc

SEQ ID NO: 1724711 - RNA, 20 nt, Human
gugugugaaaaugugugugu

SEQ ID NO: 1724712 - RNA, 13 nt, Human
aagauguagagga

SEQ ID NO: 1724713 - RNA, 20 nt, Human
gugucaagagggucugagga

SEQ ID NO: 1724714 - RNA, 17 nt, Human
guguauuuuuuuacuaa

SEQ ID NO: 1724715 - RNA, 23 nt, Human
guguauuuuuuuacuaauagaca

SEQ ID NO: 1724716 - RNA, 16 nt, Human
gugucagcauagaagu

SEQ ID NO: 1724717 - RNA, 14 nt, Human
aagaguaggaagac

SEQ ID NO: 1724718 - RNA, 13 nt, Human
aagaguaggaaga

SEQ ID NO: 1724719 - RNA, 16 nt, Human
aagaucguucucugcc

SEQ ID NO: 1724720 - RNA, 17 nt, Human
aagaucguucucugccu

SEQ ID NO: 1724721 - RNA, 16 nt, Human
aagaugcuucucacug

SEQ ID NO: 1724722 - RNA, 17 nt, Human
aagaugcuucucacugc

SEQ ID NO: 1724723 - RNA, 18 nt, Human
aagauggcugugccucug

SEQ ID NO: 1724724 - RNA, 19 nt, Human
aagaugcuucucacugcca

SEQ ID NO: 1724725 - RNA, 23 nt, Human
aagauggcugugccucugccugu

SEQ ID NO: 1724726 - RNA, 21 nt, Human
aagauggcugugccucugccu

SEQ ID NO: 1724727 - RNA, 20 nt, Human
aagauggcugugccucugcc

SEQ ID NO: 1724728 - RNA, 22 nt, Human
guggggucacucuggcagcuca

SEQ ID NO: 1724729 - RNA, 21 nt, Human
guggggucacucuggcagcuc

SEQ ID NO: 1724730 - RNA, 20 nt, Human
guggggucacucuggcagcu

SEQ ID NO: 1724731 - RNA, 17 nt, Human
guggggucacucuggca

SEQ ID NO: 1724732 - RNA, 23 nt, Human
aagagggagggagggcuccagac

SEQ ID NO: 1724733 - RNA, 22 nt, Human
aagagggucugaggaauccaga

SEQ ID NO: 1724734 - RNA, 12 nt, Human
aagaguaggaag

SEQ ID NO: 1724735 - RNA, 23 nt, Human
guuauuuuuauuuauuuaaauuu

SEQ ID NO: 1724736 - RNA, 20 nt, Human
guuauuuugauguaaagaug

SEQ ID NO: 1724737 - RNA, 20 nt, Human
guucaaagauauuuugcuuu

SEQ ID NO: 1724738 - RNA, 21 nt, Human
guucaaagauauuuugcuuug

SEQ ID NO: 1724739 - RNA, 22 nt, Human
guucaaagauauuuugcuuugu

SEQ ID NO: 1724740 - RNA, 18 nt, Human
guucaagcgauucuucug

SEQ ID NO: 1724741 - RNA, 12 nt, Human
guuaagagaaau

SEQ ID NO: 1724742 - RNA, 11 nt, Human
guuaagagaaa

SEQ ID NO: 1724743 - RNA, 18 nt, Human
guuaagagaaaugagcuu

SEQ ID NO: 1724744 - RNA, 20 nt, Human
guuaggcauugugggaaggg

SEQ ID NO: 1724745 - RNA, 19 nt, Human
guuaggcauugugggaagg

SEQ ID NO: 1724746 - RNA, 18 nt, Human
aagcuccaagcucccagg

SEQ ID NO: 1724747 - RNA, 17 nt, Human
aagcuccaagcucccag

SEQ ID NO: 1724748 - RNA, 19 nt, Human
aagcucagggccuggcuca

SEQ ID NO: 1724749 - RNA, 18 nt, Human
aagcucagggccuggcuc

SEQ ID NO: 1724750 - RNA, 20 nt, Human
aagcucagggccuggcucag

SEQ ID NO: 1724751 - RNA, 17 nt, Human
aagcucagggccuggcu

SEQ ID NO: 1724752 - RNA, 16 nt, Human
aagcucagggccuggc

SEQ ID NO: 1724753 - RNA, 13 nt, Human
aagcucagggccu

SEQ ID NO: 1724754 - RNA, 12 nt, Human
aagcucagggcc

SEQ ID NO: 1724755 - RNA, 20 nt, Human
aagccugaguuugcuuucaa

SEQ ID NO: 1724756 - RNA, 16 nt, Human
aagcuaggccuggcca

SEQ ID NO: 1724757 - RNA, 12 nt, Human
aagcuaggccug

SEQ ID NO: 1724758 - RNA, 13 nt, Human
guucagcuccagc

SEQ ID NO: 1724759 - RNA, 15 nt, Human
guucagcuccagcuc

SEQ ID NO: 1724760 - RNA, 15 nt, Human
aagccucaaaacaaa

SEQ ID NO: 1724761 - RNA, 16 nt, Human
aagccucaaaacaaag

SEQ ID NO: 1724762 - RNA, 18 nt, Human
aagccucaaaacaaaggc

SEQ ID NO: 1724763 - RNA, 21 nt, Human
gugugugcgccuacaggagug

SEQ ID NO: 1724764 - RNA, 12 nt, Human
aagcagugcaug

SEQ ID NO: 1724765 - RNA, 20 nt, Human
aagcagugcaugcugucccu

SEQ ID NO: 1724766 - RNA, 15 nt, Human
aagcagugcaugcug

SEQ ID NO: 1724767 - RNA, 14 nt, Human
aagcagugcaugcu

SEQ ID NO: 1724768 - RNA, 16 nt, Human
aagcauuuacuuugug

SEQ ID NO: 1724769 - RNA, 17 nt, Human
aagcauuuuguaauaau

SEQ ID NO: 1724770 - RNA, 14 nt, Human
aagcauuuuguaau

SEQ ID NO: 1724771 - RNA, 22 nt, Human
aagccaaagcuaggccuggcca

SEQ ID NO: 1724772 - RNA, 17 nt, Human
aagcccaggaaaggcuc

SEQ ID NO: 1724773 - RNA, 14 nt, Human
aagcccaggaaagg

SEQ ID NO: 1724774 - RNA, 22 nt, Human
aagcccaggaaaggcuccagga

SEQ ID NO: 1724775 - RNA, 19 nt, Human
aagcccaggaaaggcucca

SEQ ID NO: 1724776 - RNA, 20 nt, Human
aagccgcuggggccaguugg

SEQ ID NO: 1724777 - RNA, 23 nt, Human
aagcccuuccaugucgccucugc

SEQ ID NO: 1724778 - RNA, 20 nt, Human
aagcccuuccaugucgccuc

SEQ ID NO: 1724779 - RNA, 15 nt, Human
aagcccuuccauguc

SEQ ID NO: 1724780 - RNA, 19 nt, Human
aagcccugagcuuucugcu

SEQ ID NO: 1724781 - RNA, 20 nt, Human
uaaaagacagugaaagaaaa

SEQ ID NO: 1724782 - RNA, 13 nt, Human
uaaaagacuuuuu

SEQ ID NO: 1724783 - RNA, 13 nt, Human
uaaaauaauuuug

SEQ ID NO: 1724784 - RNA, 14 nt, Human
uaaaauaauuuugu

SEQ ID NO: 1724785 - RNA, 22 nt, Human
uaaaauaccagccaguaaaugg

SEQ ID NO: 1724786 - RNA, 15 nt, Human
uaaaauaauuuugua

SEQ ID NO: 1724787 - RNA, 16 nt, Human
uaaaauaauuuuguaa

SEQ ID NO: 1724788 - RNA, 21 nt, Human
uaaaauaauuuuguaauguau

SEQ ID NO: 1724789 - RNA, 18 nt, Human
aagugauucuccugccuc

SEQ ID NO: 1724790 - RNA, 17 nt, Human
aagugauucuccugccu

SEQ ID NO: 1724791 - RNA, 16 nt, Human
aagugauucuccugcc

SEQ ID NO: 1724792 - RNA, 15 nt, Human
aagugauucuccugc

SEQ ID NO: 1724793 - RNA, 19 nt, Human
aagugauucuccugccuca

SEQ ID NO: 1724794 - RNA, 20 nt, Human
aagugauucuccugccucag

SEQ ID NO: 1724795 - RNA, 21 nt, Human
aagugauucucaugccucagc

SEQ ID NO: 1724796 - RNA, 16 nt, Human
aagugaggaugaaaaa

SEQ ID NO: 1724797 - RNA, 20 nt, Human
aagugauucucaugccucag

SEQ ID NO: 1724798 - RNA, 22 nt, Human
uaaaauauuccugcauuuguga

SEQ ID NO: 1724799 - RNA, 13 nt, Human
uaaaauauuccug

SEQ ID NO: 1724800 - RNA, 19 nt, Human
uaaaaaucucaaauuucua

SEQ ID NO: 1724801 - RNA, 20 nt, Human
uaaaaaucucaaauuucuaa

SEQ ID NO: 1724802 - RNA, 21 nt, Human
uaaaaaucucaaauuucuaaa

SEQ ID NO: 1724803 - RNA, 22 nt, Human
uaaaacuugauguguuaucucu

SEQ ID NO: 1724804 - RNA, 20 nt, Human
uaaaacuugauguguuaucu

SEQ ID NO: 1724805 - RNA, 15 nt, Human
guuuuucuucucccu

SEQ ID NO: 1724806 - RNA, 15 nt, Human
uaaaaaguggaaaaa

SEQ ID NO: 1724807 - RNA, 19 nt, Human
uaaaaauaaaaaacacugg

SEQ ID NO: 1724808 - RNA, 18 nt, Human
uaaaaauaaaaaacacug

SEQ ID NO: 1724809 - RNA, 15 nt, Human
uaaaaaucucaaauu

SEQ ID NO: 1724810 - RNA, 16 nt, Human
uaaaaaucucaaauuu

SEQ ID NO: 1724811 - RNA, 17 nt, Human
uaaaaaucucaaauuuc

SEQ ID NO: 1724812 - RNA, 21 nt, Human
uaaaaauaaaaaacacuggga

SEQ ID NO: 1724813 - RNA, 16 nt, Human
aagucuuucacauuua

SEQ ID NO: 1724814 - RNA, 21 nt, Human
aagucaugcguuuaaucacau

SEQ ID NO: 1724815 - RNA, 19 nt, Human
guuuuuccuguucuuaaga

SEQ ID NO: 1724816 - RNA, 14 nt, Human
aagugagagcuggg

SEQ ID NO: 1724817 - RNA, 12 nt, Human
aagugagagagg

SEQ ID NO: 1724818 - RNA, 15 nt, Human
aagugagagcugggu

SEQ ID NO: 1724819 - RNA, 15 nt, Human
guuuuucauaaagca

SEQ ID NO: 1724820 - RNA, 21 nt, Human
aagugaaaaaggaggaagaga

SEQ ID NO: 1724821 - RNA, 12 nt, Human
aagugaaaacuu

SEQ ID NO: 1724822 - RNA, 12 nt, Human
aagugaaaauau

SEQ ID NO: 1724823 - RNA, 14 nt, Human
aagugaaaauauag

SEQ ID NO: 1724824 - RNA, 17 nt, Human
aagugaagacaaugacu

SEQ ID NO: 1724825 - RNA, 19 nt, Human
aagugaagacaaugacuua

SEQ ID NO: 1724826 - RNA, 18 nt, Human
aagugagacuuugagggu

SEQ ID NO: 1724827 - RNA, 23 nt, Human
aaguacacuguuucaaacuuuac

SEQ ID NO: 1724828 - RNA, 19 nt, Human
aaguacacuguuucaaacu

SEQ ID NO: 1724829 - RNA, 20 nt, Human
aaguacacuguuucaaacuu

SEQ ID NO: 1724830 - RNA, 13 nt, Human
aaguacacuguuu

SEQ ID NO: 1724831 - RNA, 18 nt, Human
aaguacacuguuucaaac

SEQ ID NO: 1724832 - RNA, 21 nt, Human
aaguaauccaccugccucggc

SEQ ID NO: 1724833 - RNA, 22 nt, Human
guuuugccauguuggccaggcu

SEQ ID NO: 1724834 - RNA, 21 nt, Human
guuuugccauguuggccaggc

SEQ ID NO: 1724835 - RNA, 20 nt, Human
guuuugccauguuggccagg

SEQ ID NO: 1724836 - RNA, 16 nt, Human
guuuugccauguuggc

SEQ ID NO: 1724837 - RNA, 15 nt, Human
guuucugccgcagcc

SEQ ID NO: 1724838 - RNA, 18 nt, Human
guuucugccgcagcccug

SEQ ID NO: 1724839 - RNA, 14 nt, Human
guuucugccgcagc

SEQ ID NO: 1724840 - RNA, 23 nt, Human
aaggcucugagcaaauguggcuc

SEQ ID NO: 1724841 - RNA, 22 nt, Human
aaggggcccaaauucuuucagu

SEQ ID NO: 1724842 - RNA, 18 nt, Human
aagguacuuucauauuuu

SEQ ID NO: 1724843 - RNA, 19 nt, Human
aagguacuuucauauuuua

SEQ ID NO: 1724844 - RNA, 22 nt, Human
aagguacuuucauauuuuaaac

SEQ ID NO: 1724845 - RNA, 20 nt, Human
aagguagaaauaucugaaaa

SEQ ID NO: 1724846 - RNA, 18 nt, Human
guuucugaaagggacgcu

SEQ ID NO: 1724847 - RNA, 19 nt, Human
guuucuauguguagggcgg

SEQ ID NO: 1724848 - RNA, 14 nt, Human
guuucucaaagaaa

SEQ ID NO: 1724849 - RNA, 17 nt, Human
guuucucaaagaaauuu

SEQ ID NO: 1724850 - RNA, 18 nt, Human
guuucucaaagaaauuuc

SEQ ID NO: 1724851 - RNA, 12 nt, Human
aaggucauuuuu

SEQ ID NO: 1724852 - RNA, 16 nt, Human
aaguaaggaauuuuau

SEQ ID NO: 1724853 - RNA, 13 nt, Human
aaguaagcaaaga

SEQ ID NO: 1724854 - RNA, 13 nt, Human
guuuauugucaaa

SEQ ID NO: 1724855 - RNA, 15 nt, Human
guugggcugguguca

SEQ ID NO: 1724856 - RNA, 17 nt, Human
guugggccaggagccuc

SEQ ID NO: 1724857 - RNA, 15 nt, Human
guugggccaggagcc

SEQ ID NO: 1724858 - RNA, 13 nt, Human
guugggcuggugu

SEQ ID NO: 1724859 - RNA, 17 nt, Human
guuucaaacuuuacuau

SEQ ID NO: 1724860 - RNA, 15 nt, Human
aaggcuccaggagca

SEQ ID NO: 1724861 - RNA, 18 nt, Human
aaggcuccaggagcagcc

SEQ ID NO: 1724862 - RNA, 16 nt, Human
aaggcuccaggagcag

SEQ ID NO: 1724863 - RNA, 14 nt, Human
guuucaaacuuuac

SEQ ID NO: 1724864 - RNA, 16 nt, Human
guuucaaacuuuacua

SEQ ID NO: 1724865 - RNA, 13 nt, Human
guuucaaacuuua

SEQ ID NO: 1724866 - RNA, 18 nt, Human
aaggcucgagcaugccug

SEQ ID NO: 1724867 - RNA, 16 nt, Human
aaggcucgagcaugcc

SEQ ID NO: 1724868 - RNA, 22 nt, Human
aaggcuccaggagcagccacau

SEQ ID NO: 1724869 - RNA, 19 nt, Human
aaggcuccaggagcagcca

SEQ ID NO: 1724870 - RNA, 20 nt, Human
aaggcucgagcaugccugga

SEQ ID NO: 1724871 - RNA, 19 nt, Human
aaggcucgagcaugccugg

SEQ ID NO: 1724872 - RNA, 22 nt, Human
aaggcucgagcaugccuggaug

SEQ ID NO: 1724873 - RNA, 13 nt, Human
guugcccaggcug

SEQ ID NO: 1724874 - RNA, 12 nt, Human
guugcccaggcu

SEQ ID NO: 1724875 - RNA, 23 nt, Human
guugcccaggcaggucuugaacu

SEQ ID NO: 1724876 - RNA, 22 nt, Human
aaggccuaauucuaugccuguc

SEQ ID NO: 1724877 - RNA, 16 nt, Human
aaggccaaaggaagca

SEQ ID NO: 1724878 - RNA, 13 nt, Human
aaggauacaaaag

SEQ ID NO: 1724879 - RNA, 21 nt, Human
aaggauacaaaagcaugugag

SEQ ID NO: 1724880 - RNA, 17 nt, Human
aaggagauuuacaacug

SEQ ID NO: 1724881 - RNA, 14 nt, Human
aaggagauuuacaa

SEQ ID NO: 1724882 - RNA, 18 nt, Human
aaggaauaccuguccccc

SEQ ID NO: 1724883 - RNA, 11 nt, Human
aaggagagcua

SEQ ID NO: 1724884 - RNA, 18 nt, Human
aaggaggaagagaaaaaa

SEQ ID NO: 1724885 - RNA, 20 nt, Human
aaggaggggauagagagaga

SEQ ID NO: 1724886 - RNA, 13 nt, Human
aaggaagcacaug

SEQ ID NO: 1724887 - RNA, 15 nt, Human
aaggaagacuucauc

SEQ ID NO: 1724888 - RNA, 14 nt, Human
aaggaagacuucau

SEQ ID NO: 1724889 - RNA, 16 nt, Human
aaggaagcacaugccu

SEQ ID NO: 1724890 - RNA, 17 nt, Human
aaggaauaccugucccc

SEQ ID NO: 1724891 - RNA, 21 nt, Human
aaggaauaaauugcuccuuga

SEQ ID NO: 1724892 - RNA, 15 nt, Human
aaggaaagagggagg

SEQ ID NO: 1724893 - RNA, 20 nt, Human
aagcuccaucuccacuccag

SEQ ID NO: 1724894 - RNA, 14 nt, Human
aagcuccaucucca

SEQ ID NO: 1724895 - RNA, 16 nt, Human
aacaaggcaaggcugu

SEQ ID NO: 1724896 - RNA, 18 nt, Human
aaauuuugauguuuuaag

SEQ ID NO: 1724897 - RNA, 23 nt, Human
aaauuuugauguuuuaaggaugc

SEQ ID NO: 1724898 - RNA, 12 nt, Human
aacaauaaaaga

SEQ ID NO: 1724899 - RNA, 21 nt, Human
aacaaggcaaggcugucaauu

SEQ ID NO: 1724900 - RNA, 18 nt, Human
aacaaggcaaggcuguca

SEQ ID NO: 1724901 - RNA, 22 nt, Human
gucacacaguauuacuucugcu

SEQ ID NO: 1724902 - RNA, 21 nt, Human
gucacacaguauuacuucugc

SEQ ID NO: 1724903 - RNA, 17 nt, Human
gucagaauagaaauuag

SEQ ID NO: 1724904 - RNA, 13 nt, Human
gucagaauagaaa

SEQ ID NO: 1724905 - RNA, 18 nt, Human
aaauuuguuauaaugaau

SEQ ID NO: 1724906 - RNA, 13 nt, Human
gucauaacuagaa

SEQ ID NO: 1724907 - RNA, 19 nt, Human
gucauuuuuuuuaagaaaa

SEQ ID NO: 1724908 - RNA, 21 nt, Human
gucauuuuuuuuaagaaaaag

SEQ ID NO: 1724909 - RNA, 18 nt, Human
guccaagaagcccaggaa

SEQ ID NO: 1724910 - RNA, 17 nt, Human
guccaagaagcccagga

SEQ ID NO: 1724911 - RNA, 20 nt, Human
guccaagaagcccaggaaag

SEQ ID NO: 1724912 - RNA, 16 nt, Human
guccaagaagcccagg

SEQ ID NO: 1724913 - RNA, 15 nt, Human
guccaagaagcccag

SEQ ID NO: 1724914 - RNA, 13 nt, Human
guccaagaagccc

SEQ ID NO: 1724915 - RNA, 16 nt, Human
gucccaccuuggcugc

SEQ ID NO: 1724916 - RNA, 15 nt, Human
gucccaccuuggcug

SEQ ID NO: 1724917 - RNA, 14 nt, Human
gucccaccuuggcu

SEQ ID NO: 1724918 - RNA, 21 nt, Human
gucccaccccacacacgccag

SEQ ID NO: 1724919 - RNA, 14 nt, Human
guccauagagagca

SEQ ID NO: 1724920 - RNA, 13 nt, Human
guccauagagagc

SEQ ID NO: 1724921 - RNA, 15 nt, Human
aacagugauuaccag

SEQ ID NO: 1724922 - RNA, 22 nt, Human
aacagugauuaccagggacuga

SEQ ID NO: 1724923 - RNA, 16 nt, Human
aacagauaaauaguuu

SEQ ID NO: 1724924 - RNA, 13 nt, Human
guccuacucugug

SEQ ID NO: 1724925 - RNA, 18 nt, Human
gucccccuuccauggacu

SEQ ID NO: 1724926 - RNA, 16 nt, Human
gucccccuuccaugga

SEQ ID NO: 1724927 - RNA, 14 nt, Human
gucccccuuccaug

SEQ ID NO: 1724928 - RNA, 12 nt, Human
guccuacucugu

SEQ ID NO: 1724929 - RNA, 16 nt, Human
guccuacccacccucc

SEQ ID NO: 1724930 - RNA, 12 nt, Human
aacagaaaugua

SEQ ID NO: 1724931 - RNA, 13 nt, Human
aacagaaauguac

SEQ ID NO: 1724932 - RNA, 14 nt, Human
aacagaaauguaca

SEQ ID NO: 1724933 - RNA, 15 nt, Human
aacagaaauguacag

SEQ ID NO: 1724934 - RNA, 13 nt, Human
guaucaaauacau

SEQ ID NO: 1724935 - RNA, 14 nt, Human
guaucaaauacauu

SEQ ID NO: 1724936 - RNA, 18 nt, Human
guaucaggugcugccauc

SEQ ID NO: 1724937 - RNA, 16 nt, Human
guaucaggugcugcca

SEQ ID NO: 1724938 - RNA, 16 nt, Human
guauauuuuauaucaa

SEQ ID NO: 1724939 - RNA, 22 nt, Human
guauauuuguauuuaaaugaaa

SEQ ID NO: 1724940 - RNA, 15 nt, Human
guauaaguggugugu

SEQ ID NO: 1724941 - RNA, 14 nt, Human
guaugguggcuggg

SEQ ID NO: 1724942 - RNA, 16 nt, Human
guaugguggcuggguu

SEQ ID NO: 1724943 - RNA, 15 nt, Human
guaugguggcugggu

SEQ ID NO: 1724944 - RNA, 21 nt, Human
guaucccaugagccucagcau

SEQ ID NO: 1724945 - RNA, 15 nt, Human
guaugcgugugugug

SEQ ID NO: 1724946 - RNA, 22 nt, Human
guaucaggugcugccauccagg

SEQ ID NO: 1724947 - RNA, 19 nt, Human
guaucaaauacauuuaaaa

SEQ ID NO: 1724948 - RNA, 19 nt, Human
guaucccaugagccucagc

SEQ ID NO: 1724949 - RNA, 12 nt, Human
guaacaggcaga

SEQ ID NO: 1724950 - RNA, 22 nt, Human
guaacaggaaaauuuuaaaaau

SEQ ID NO: 1724951 - RNA, 19 nt, Human
guauaaaagggacugagaa

SEQ ID NO: 1724952 - RNA, 14 nt, Human
aaauguaagaucgu

SEQ ID NO: 1724953 - RNA, 22 nt, Human
aaauguaagaucguucucugcc

SEQ ID NO: 1724954 - RNA, 20 nt, Human
aaauuguaagcaugcacaaa

SEQ ID NO: 1724955 - RNA, 18 nt, Human
aaauucugucucuggauu

SEQ ID NO: 1724956 - RNA, 19 nt, Human
aaauuguaagcaugcacaa

SEQ ID NO: 1724957 - RNA, 16 nt, Human
aaauucugucucugga

SEQ ID NO: 1724958 - RNA, 22 nt, Human
guauuuuguuuuugucuuaaaa

SEQ ID NO: 1724959 - RNA, 17 nt, Human
gucaacacuaacaugau

SEQ ID NO: 1724960 - RNA, 21 nt, Human
gucaacaaguaugaauaaaga

SEQ ID NO: 1724961 - RNA, 14 nt, Human
gucaaacgugaaaa

SEQ ID NO: 1724962 - RNA, 17 nt, Human
gucaaacgugaaaaugc

SEQ ID NO: 1724963 - RNA, 15 nt, Human
gucaaacgugaaaau

SEQ ID NO: 1724964 - RNA, 24 nt, Human
aaaugucuaguuguaacaccauga

SEQ ID NO: 1724965 - RNA, 19 nt, Human
aaaugucuaguuguaacac

SEQ ID NO: 1724966 - RNA, 14 nt, Human
aaauuaagaaagga

SEQ ID NO: 1724967 - RNA, 12 nt, Human
aaaugugugugu

SEQ ID NO: 1724968 - RNA, 20 nt, Human
aacuacuaccuguaaugaca

SEQ ID NO: 1724969 - RNA, 18 nt, Human
aaccuugaaaacuuuaug

SEQ ID NO: 1724970 - RNA, 12 nt, Human
aaccugugucuc

SEQ ID NO: 1724971 - RNA, 20 nt, Human
aacuagacucccaagcugga

SEQ ID NO: 1724972 - RNA, 23 nt, Human
aacuagacucccaagcuggacua

SEQ ID NO: 1724973 - RNA, 21 nt, Human
aacuaugauuuggaaaauaaa

SEQ ID NO: 1724974 - RNA, 16 nt, Human
aacuaugauuuggaaa

SEQ ID NO: 1724975 - RNA, 22 nt, Human
aacucaucuagguaaauuacag

SEQ ID NO: 1724976 - RNA, 12 nt, Human
aacuccuggccu

SEQ ID NO: 1724977 - RNA, 23 nt, Human
gugaaccaccacacccagcccac

SEQ ID NO: 1724978 - RNA, 22 nt, Human
gugaaccaccacacccagccca

SEQ ID NO: 1724979 - RNA, 18 nt, Human
aacucuccuccagaguca

SEQ ID NO: 1724980 - RNA, 15 nt, Human
aacucuccuccagag

SEQ ID NO: 1724981 - RNA, 16 nt, Human
aacucuccucugcugc

SEQ ID NO: 1724982 - RNA, 17 nt, Human
aacucuccucugcugcu

SEQ ID NO: 1724983 - RNA, 16 nt, Human
gucuuucacauuuaaa

SEQ ID NO: 1724984 - RNA, 16 nt, Human
gucuuuggugaacauu

SEQ ID NO: 1724985 - RNA, 16 nt, Human
gucuuuugguuaugaa

SEQ ID NO: 1724986 - RNA, 20 nt, Human
aaccugagccccaaaaggua

SEQ ID NO: 1724987 - RNA, 14 nt, Human
gucuggcccuuccu

SEQ ID NO: 1724988 - RNA, 15 nt, Human
aaccaagucaaguga

SEQ ID NO: 1724989 - RNA, 20 nt, Human
aaccacauuggagauguuua

SEQ ID NO: 1724990 - RNA, 19 nt, Human
aaccaccacacccagccca

SEQ ID NO: 1724991 - RNA, 18 nt, Human
aaccaagccguggcuucc

SEQ ID NO: 1724992 - RNA, 16 nt, Human
aaccaagccguggcuu

SEQ ID NO: 1724993 - RNA, 19 nt, Human
gucucgaacuccugaccuu

SEQ ID NO: 1724994 - RNA, 18 nt, Human
gucucgaacuccugaccu

SEQ ID NO: 1724995 - RNA, 13 nt, Human
gucucgaacuccu

SEQ ID NO: 1724996 - RNA, 19 nt, Human
aaccauuugaaaccccugu

SEQ ID NO: 1724997 - RNA, 23 nt, Human
aacccaaauguucaucaaugaau

SEQ ID NO: 1724998 - RNA, 23 nt, Human
aaccauuuugcugucccuuuucc

SEQ ID NO: 1724999 - RNA, 13 nt, Human
aacccaauaguug

SEQ ID NO: 1725000 - RNA, 21 nt, Human
aaccaccacacccagcccacu

SEQ ID NO: 1725001 - RNA, 12 nt, Human
aaccaucauuga

SEQ ID NO: 1725002 - RNA, 18 nt, Human
aaccaucauugaaaucuu

SEQ ID NO: 1725003 - RNA, 17 nt, Human
aaccaucauugaaaucu

SEQ ID NO: 1725004 - RNA, 21 nt, Human
aaccucgagguuucucaaaga

SEQ ID NO: 1725005 - RNA, 22 nt, Human
aaccucgagguuucucaaagaa

SEQ ID NO: 1725006 - RNA, 18 nt, Human
aaccugagccccaaaagg

SEQ ID NO: 1725007 - RNA, 11 nt, Human
aaccugacccc

SEQ ID NO: 1725008 - RNA, 16 nt, Human
aacccgggaggcagag

SEQ ID NO: 1725009 - RNA, 17 nt, Human
aaccccuguaggccuca

SEQ ID NO: 1725010 - RNA, 10 nt, Human
aacccagcuc

SEQ ID NO: 1725011 - RNA, 14 nt, Human
aacccagauaaagg

SEQ ID NO: 1725012 - RNA, 15 nt, Human
aacugcugacuguuu

SEQ ID NO: 1725013 - RNA, 21 nt, Human
aacugcugacuguuuucucuu

SEQ ID NO: 1725014 - RNA, 20 nt, Human
aacugcugacuguuuucucu

SEQ ID NO: 1725015 - RNA, 23 nt, Human
aacugcugacuguuuucucuuga

SEQ ID NO: 1725016 - RNA, 21 nt, Human
aacuggguacuuguggacaca

SEQ ID NO: 1725017 - RNA, 16 nt, Human
aacuggguacuugugg

SEQ ID NO: 1725018 - RNA, 21 nt, Human
aacugggggagggugaaguga

SEQ ID NO: 1725019 - RNA, 22 nt, Human
aacugggggagggugaagugaa

SEQ ID NO: 1725020 - RNA, 15 nt, Human
aacuggauuaaacuu

SEQ ID NO: 1725021 - RNA, 16 nt, Human
aacuggauuaaacuua

SEQ ID NO: 1725022 - RNA, 11 nt, Human
aacuggcugca

SEQ ID NO: 1725023 - RNA, 21 nt, Human
gugagaugcuagaacucccuu

SEQ ID NO: 1725024 - RNA, 19 nt, Human
gugaacuugggccacugug

SEQ ID NO: 1725025 - RNA, 17 nt, Human
gugaacuugggccacug

SEQ ID NO: 1725026 - RNA, 22 nt, Human
gugaggccagagacacaagccu

SEQ ID NO: 1725027 - RNA, 17 nt, Human
gugaggccagagacaca

SEQ ID NO: 1725028 - RNA, 15 nt, Human
gugagcaauccugca

SEQ ID NO: 1725029 - RNA, 18 nt, Human
gugaggguaaguauuuuc

SEQ ID NO: 1725030 - RNA, 21 nt, Human
aacucuucaaucucuugcacu

SEQ ID NO: 1725031 - RNA, 22 nt, Human
aacucuguuacacuuuuuggaa

SEQ ID NO: 1725032 - RNA, 23 nt, Human
aacucuguuacacuuuuuggaag

SEQ ID NO: 1725033 - RNA, 22 nt, Human
gugagucgaggacagggaggug

SEQ ID NO: 1725034 - RNA, 20 nt, Human
aacucugacaacagacuucu

SEQ ID NO: 1725035 - RNA, 23 nt, Human
aacucugacaacagacuucugaa

SEQ ID NO: 1725036 - RNA, 22 nt, Human
aacucugacaacagacuucuga

SEQ ID NO: 1725037 - RNA, 22 nt, Human
gugcaugcugucccuuacguga

SEQ ID NO: 1725038 - RNA, 21 nt, Human
gugcacacaccagagcccacc

SEQ ID NO: 1725039 - RNA, 19 nt, Human
gugauggggcccugccucc

SEQ ID NO: 1725040 - RNA, 16 nt, Human
gugaugguuccccugu

SEQ ID NO: 1725041 - RNA, 14 nt, Human
gugaugguuccccu

SEQ ID NO: 1725042 - RNA, 22 nt, Human
gugaugguuccccuguucacuc

SEQ ID NO: 1725043 - RNA, 23 nt, Human
gugcauuaucuagauacuguauc

SEQ ID NO: 1725044 - RNA, 19 nt, Human
gugcauguguguucaugca

SEQ ID NO: 1725045 - RNA, 15 nt, Human
gugcauuaucuagau

SEQ ID NO: 1725046 - RNA, 19 nt, Human
gugcauuaucuagauacug

SEQ ID NO: 1725047 - RNA, 12 nt, Human
gugccucugccu

SEQ ID NO: 1725048 - RNA, 13 nt, Human
aacuuccaauuua

SEQ ID NO: 1725049 - RNA, 22 nt, Human
gugaugcgcaugucacggaggg

SEQ ID NO: 1725050 - RNA, 18 nt, Human
gugauggggcccugccuc

SEQ ID NO: 1725051 - RNA, 17 nt, Human
gugauggggcccugccu

SEQ ID NO: 1725052 - RNA, 16 nt, Human
gugauggggcccugcc

SEQ ID NO: 1725053 - RNA, 14 nt, Human
gugauggggcccug

SEQ ID NO: 1725054 - RNA, 16 nt, Human
gugaugagaggaaauc

SEQ ID NO: 1725055 - RNA, 14 nt, Human
gugaugagaggaaa

SEQ ID NO: 1725056 - RNA, 11 nt, Human
acguggcugcu

SEQ ID NO: 1725057 - RNA, 15 nt, Human
acuaauagacaauuu

SEQ ID NO: 1725058 - RNA, 23 nt, Human
acgucugacaggcaaugcuggcu

SEQ ID NO: 1725059 - RNA, 19 nt, Human
acggacgaaccuugaaaac

SEQ ID NO: 1725060 - RNA, 15 nt, Human
acggaauaguuggcu

SEQ ID NO: 1725061 - RNA, 16 nt, Human
acggaagagccuugcg

SEQ ID NO: 1725062 - RNA, 15 nt, Human
acggaagagccuugc

SEQ ID NO: 1725063 - RNA, 19 nt, Human
acgcuggagugcagugagc

SEQ ID NO: 1725064 - RNA, 11 nt, Human
accugugucuc

SEQ ID NO: 1725065 - RNA, 19 nt, Human
accuguggccaaguucuua

SEQ ID NO: 1725066 - RNA, 16 nt, Human
acuauuguuagucucu

SEQ ID NO: 1725067 - RNA, 17 nt, Human
acuauugcuugcacaaa

SEQ ID NO: 1725068 - RNA, 17 nt, Human
acuagggaagauaauau

SEQ ID NO: 1725069 - RNA, 14 nt, Human
acuaaucuuucugc

SEQ ID NO: 1725070 - RNA, 17 nt, Human
acccuguuaccauuuug

SEQ ID NO: 1725071 - RNA, 16 nt, Human
accccacacacgccag

SEQ ID NO: 1725072 - RNA, 22 nt, Human
acccugugauggggcccugccu

SEQ ID NO: 1725073 - RNA, 15 nt, Human
acccaugcugcccug

SEQ ID NO: 1725074 - RNA, 14 nt, Human
acccaugcugcccu

SEQ ID NO: 1725075 - RNA, 16 nt, Human
acccaugcugcccugu

SEQ ID NO: 1725076 - RNA, 14 nt, Human
accgugaggccaga

SEQ ID NO: 1725077 - RNA, 19 nt, Human
accgggccacagagaaagu

SEQ ID NO: 1725078 - RNA, 15 nt, Human
accgggccacagaga

SEQ ID NO: 1725079 - RNA, 20 nt, Human
accgggccacagagaaagua

SEQ ID NO: 1725080 - RNA, 19 nt, Human
accggcuggccuggccccu

SEQ ID NO: 1725081 - RNA, 20 nt, Human
accgggcacucagaagacac

SEQ ID NO: 1725082 - RNA, 18 nt, Human
accggcuggccuggcccc

SEQ ID NO: 1725083 - RNA, 17 nt, Human
accggcuggccuggccc

SEQ ID NO: 1725084 - RNA, 15 nt, Human
accggcuggccuggc

SEQ ID NO: 1725085 - RNA, 14 nt, Human
accggcuggccugg

SEQ ID NO: 1725086 - RNA, 13 nt, Human
accucaggccugg

SEQ ID NO: 1725087 - RNA, 12 nt, Human
accucaggccug

SEQ ID NO: 1725088 - RNA, 17 nt, Human
accgugaggccagagac

SEQ ID NO: 1725089 - RNA, 16 nt, Human
accgugaggccagaga

SEQ ID NO: 1725090 - RNA, 22 nt, Human
accucaggccugggggcugggc

SEQ ID NO: 1725091 - RNA, 14 nt, Human
accucaggccuggg

SEQ ID NO: 1725092 - RNA, 22 nt, Human
accucagguaaucgaccugccu

SEQ ID NO: 1725093 - RNA, 18 nt, Human
accucaggugagaagcag

SEQ ID NO: 1725094 - RNA, 23 nt, Human
accucagguaaucgaccugccuc

SEQ ID NO: 1725095 - RNA, 23 nt, Human
accugccccuccucucugcccua

SEQ ID NO: 1725096 - RNA, 13 nt, Human
accugcccaaccu

SEQ ID NO: 1725097 - RNA, 11 nt, Human
accugccaggg

SEQ ID NO: 1725098 - RNA, 13 nt, Human
accugccagggac

SEQ ID NO: 1725099 - RNA, 12 nt, Human
accugccaggga

SEQ ID NO: 1725100 - RNA, 18 nt, Human
accugccagggacagagg

SEQ ID NO: 1725101 - RNA, 16 nt, Human
accugccagggacaga

SEQ ID NO: 1725102 - RNA, 15 nt, Human
accugccagggacag

SEQ ID NO: 1725103 - RNA, 17 nt, Human
accucuugagccuugaa

SEQ ID NO: 1725104 - RNA, 19 nt, Human
accucuugagccuugaacu

SEQ ID NO: 1725105 - RNA, 20 nt, Human
accucuugagccuugaacuu

SEQ ID NO: 1725106 - RNA, 21 nt, Human
accucuugagccuugaacuuu

SEQ ID NO: 1725107 - RNA, 22 nt, Human
acuuucaggccacauggcuaaa

SEQ ID NO: 1725108 - RNA, 12 nt, Human
acuuuaugcuaa

SEQ ID NO: 1725109 - RNA, 17 nt, Human
acuuuaugcuaagugaa

SEQ ID NO: 1725110 - RNA, 15 nt, Human
acuuuauuuuguguu

SEQ ID NO: 1725111 - RNA, 22 nt, Human
acuugggaggcugagaugggag

SEQ ID NO: 1725112 - RNA, 20 nt, Human
acuucugccauauucuguug

SEQ ID NO: 1725113 - RNA, 13 nt, Human
acuucagcucugu

SEQ ID NO: 1725114 - RNA, 18 nt, Human
acuucuuauacauuugau

SEQ ID NO: 1725115 - RNA, 17 nt, Human
acuucuuauacauuuga

SEQ ID NO: 1725116 - RNA, 13 nt, Human
acuucugccucuu

SEQ ID NO: 1725117 - RNA, 14 nt, Human
acuuaaauaaugug

SEQ ID NO: 1725118 - RNA, 22 nt, Human
acuuaaaauauuccugcauuug

SEQ ID NO: 1725119 - RNA, 21 nt, Human
acuuaaaaaugguuuaaaugg

SEQ ID NO: 1725120 - RNA, 13 nt, Human
acuuaaaaauggu

SEQ ID NO: 1725121 - RNA, 14 nt, Human
acuuaaaaaugguu

SEQ ID NO: 1725122 - RNA, 23 nt, Human
acugaugggcaacccccagccug

SEQ ID NO: 1725123 - RNA, 22 nt, Human
acugauuuuuuuuuccuucagu

SEQ ID NO: 1725124 - RNA, 21 nt, Human
acugauuuuuuuuuccuucag

SEQ ID NO: 1725125 - RNA, 23 nt, Human
acugauuuuuuuuuccuucagug

SEQ ID NO: 1725126 - RNA, 22 nt, Human
acugaugggcaacccccagccu

SEQ ID NO: 1725127 - RNA, 12 nt, Human
acugaugggcaa

SEQ ID NO: 1725128 - RNA, 22 nt, Human
acugauggcuaauguacugcau

SEQ ID NO: 1725129 - RNA, 13 nt, Human
acugaucucucgu

SEQ ID NO: 1725130 - RNA, 23 nt, Human
acugaccagccuccaugcugccu

SEQ ID NO: 1725131 - RNA, 23 nt, Human
acugacauuguuggccaaagcca

SEQ ID NO: 1725132 - RNA, 13 nt, Human
acugaccagccuc

SEQ ID NO: 1725133 - RNA, 20 nt, Human
acugaccagccuccaugcug

SEQ ID NO: 1725134 - RNA, 15 nt, Human
acugaccagccucca

SEQ ID NO: 1725135 - RNA, 22 nt, Human
acugaccaauauuguacaguuu

SEQ ID NO: 1725136 - RNA, 20 nt, Human
acugaccaauauuguacagu

SEQ ID NO: 1725137 - RNA, 21 nt, Human
acugaccaauauuguacaguu

SEQ ID NO: 1725138 - RNA, 15 nt, Human
acucugucucagucc

SEQ ID NO: 1725139 - RNA, 17 nt, Human
acucugucucaguccau

SEQ ID NO: 1725140 - RNA, 19 nt, Human
acucugugucagguggggc

SEQ ID NO: 1725141 - RNA, 21 nt, Human
acucugugucagguggggcag

SEQ ID NO: 1725142 - RNA, 19 nt, Human
acucugucucaaaaaaaca

SEQ ID NO: 1725143 - RNA, 20 nt, Human
acucuacuuagcaugucccu

SEQ ID NO: 1725144 - RNA, 21 nt, Human
acucuacuuagcaugucccua

SEQ ID NO: 1725145 - RNA, 14 nt, Human
acucuaaagucugu

SEQ ID NO: 1725146 - RNA, 14 nt, Human
acuauuuuucagaa

SEQ ID NO: 1725147 - RNA, 15 nt, Human
acugcuuuuggucug

SEQ ID NO: 1725148 - RNA, 22 nt, Human
acugcccggcaggguccuagaa

SEQ ID NO: 1725149 - RNA, 20 nt, Human
acugcuuuuggucuguguga

SEQ ID NO: 1725150 - RNA, 16 nt, Human
acugcuuuuggucugu

SEQ ID NO: 1725151 - RNA, 15 nt, Human
acugcccggcagggu

SEQ ID NO: 1725152 - RNA, 18 nt, Human
acugccagucccccugcc

SEQ ID NO: 1725153 - RNA, 19 nt, Human
acugccagucccccugccc

SEQ ID NO: 1725154 - RNA, 18 nt, Human
aauuuucaucuaggauuu

SEQ ID NO: 1725155 - RNA, 14 nt, Human
aauuuugauguuuu

SEQ ID NO: 1725156 - RNA, 16 nt, Human
aauuuugugcccccau

SEQ ID NO: 1725157 - RNA, 22 nt, Human
acaagaaaugaaagcagggacu

SEQ ID NO: 1725158 - RNA, 15 nt, Human
acaagaaaugaaagc

SEQ ID NO: 1725159 - RNA, 16 nt, Human
acaagaaaugaaagca

SEQ ID NO: 1725160 - RNA, 18 nt, Human
acaaccuucuguggcuca

SEQ ID NO: 1725161 - RNA, 22 nt, Human
acaaaaugaaacgcaaccacca

SEQ ID NO: 1725162 - RNA, 13 nt, Human
acaaaaugaaacg

SEQ ID NO: 1725163 - RNA, 16 nt, Human
acaaagaaauuaugug

SEQ ID NO: 1725164 - RNA, 14 nt, Human
acaaagaaauuaug

SEQ ID NO: 1725165 - RNA, 12 nt, Human
acaaagaaauua

SEQ ID NO: 1725166 - RNA, 20 nt, Human
aauuuauuuaugggauccug

SEQ ID NO: 1725167 - RNA, 19 nt, Human
aaugucacaggcaggucca

SEQ ID NO: 1725168 - RNA, 16 nt, Human
aaugucacaggcaggu

SEQ ID NO: 1725169 - RNA, 16 nt, Human
aauuguaaggaaugau

SEQ ID NO: 1725170 - RNA, 12 nt, Human
aauuguaaggaa

SEQ ID NO: 1725171 - RNA, 14 nt, Human
acaauuuauuaugg

SEQ ID NO: 1725172 - RNA, 13 nt, Human
acaauuuauuaug

SEQ ID NO: 1725173 - RNA, 16 nt, Human
acaaggauugcuacug

SEQ ID NO: 1725174 - RNA, 20 nt, Human
acaaggaugaucuaggaaga

SEQ ID NO: 1725175 - RNA, 21 nt, Human
acacgaauauugcugauggug

SEQ ID NO: 1725176 - RNA, 15 nt, Human
acacgaauauugcug

SEQ ID NO: 1725177 - RNA, 21 nt, Human
acaccacuacauucuguuaau

SEQ ID NO: 1725178 - RNA, 16 nt, Human
acacauuuuuuaaaug

SEQ ID NO: 1725179 - RNA, 18 nt, Human
acacauuuuuuaaaugca

SEQ ID NO: 1725180 - RNA, 19 nt, Human
acacauuuuuuaaaugcac

SEQ ID NO: 1725181 - RNA, 15 nt, Human
acaccacuacauucu

SEQ ID NO: 1725182 - RNA, 14 nt, Human
acacgaauauugcu

SEQ ID NO: 1725183 - RNA, 12 nt, Human
acacgaauauug

SEQ ID NO: 1725184 - RNA, 17 nt, Human
acaccacuacauucugu

SEQ ID NO: 1725185 - RNA, 20 nt, Human
acaccacuacauucuguuaa

SEQ ID NO: 1725186 - RNA, 21 nt, Human
acacagcucuucuccaggcug

SEQ ID NO: 1725187 - RNA, 20 nt, Human
acacagcucuucuccaggcu

SEQ ID NO: 1725188 - RNA, 22 nt, Human
acacagcucuucuccaggcugu

SEQ ID NO: 1725189 - RNA, 14 nt, Human
acacauuuuuuaaa

SEQ ID NO: 1725190 - RNA, 19 nt, Human
acacaaaaguuucucuuuu

SEQ ID NO: 1725191 - RNA, 14 nt, Human
acagacaaagcgug

SEQ ID NO: 1725192 - RNA, 23 nt, Human
acagaggccaugggccuccugug

SEQ ID NO: 1725193 - RNA, 21 nt, Human
acagaggccaugggccuccug

SEQ ID NO: 1725194 - RNA, 17 nt, Human
acagaggccaugggccu

SEQ ID NO: 1725195 - RNA, 13 nt, Human
acagaggcagccc

SEQ ID NO: 1725196 - RNA, 16 nt, Human
acagaggacacagaga

SEQ ID NO: 1725197 - RNA, 17 nt, Human
acacugugcugagucug

SEQ ID NO: 1725198 - RNA, 22 nt, Human
acacugugcugagucugaaggc

SEQ ID NO: 1725199 - RNA, 20 nt, Human
acacugggagaaaugaaaaa

SEQ ID NO: 1725200 - RNA, 16 nt, Human
acaugcaaggucauuu

SEQ ID NO: 1725201 - RNA, 15 nt, Human
acauccuacaagaca

SEQ ID NO: 1725202 - RNA, 18 nt, Human
acaugccucucucaggcc

SEQ ID NO: 1725203 - RNA, 17 nt, Human
acaugccucucucaggc

SEQ ID NO: 1725204 - RNA, 16 nt, Human
acaugccucucucagg

SEQ ID NO: 1725205 - RNA, 15 nt, Human
acaugccucucucag

SEQ ID NO: 1725206 - RNA, 18 nt, Human
acaugcaaggucauuuuu

SEQ ID NO: 1725207 - RNA, 17 nt, Human
acaugcaaggucauuuu

SEQ ID NO: 1725208 - RNA, 20 nt, Human
acauaauucaggaagcagcu

SEQ ID NO: 1725209 - RNA, 16 nt, Human
acauaagauaaaugug

SEQ ID NO: 1725210 - RNA, 21 nt, Human
acagugauuaccagggacuga

SEQ ID NO: 1725211 - RNA, 23 nt, Human
acagugagucgaggacagggagg

SEQ ID NO: 1725212 - RNA, 20 nt, Human
acagugauuaccagggacug

SEQ ID NO: 1725213 - RNA, 12 nt, Human
acaguguacagu

SEQ ID NO: 1725214 - RNA, 13 nt, Human
acaguguacaguc

SEQ ID NO: 1725215 - RNA, 15 nt, Human
acaguguacagucuu

SEQ ID NO: 1725216 - RNA, 17 nt, Human
acaguguacagucuugu

SEQ ID NO: 1725217 - RNA, 18 nt, Human
acaguguacagucuugua

SEQ ID NO: 1725218 - RNA, 14 nt, Human
acaggcaaugcugg

SEQ ID NO: 1725219 - RNA, 23 nt, Human
acaggugugagucaccaagccca

SEQ ID NO: 1725220 - RNA, 22 nt, Human
acaggugugagucaccaagccc

SEQ ID NO: 1725221 - RNA, 19 nt, Human
acaggugugaaccaccaca

SEQ ID NO: 1725222 - RNA, 22 nt, Human
acagugagucgaggacagggag

SEQ ID NO: 1725223 - RNA, 14 nt, Human
acagcucuguccug

SEQ ID NO: 1725224 - RNA, 23 nt, Human
acagcuccuucuguccuacucug

SEQ ID NO: 1725225 - RNA, 18 nt, Human
acagcuccuucuguccua

SEQ ID NO: 1725226 - RNA, 16 nt, Human
acagcuccuucugucc

SEQ ID NO: 1725227 - RNA, 21 nt, Human
acagaggggguggccucccaa

SEQ ID NO: 1725228 - RNA, 19 nt, Human
acagaggggguggccuccc

SEQ ID NO: 1725229 - RNA, 18 nt, Human
acagaggggguggccucc

SEQ ID NO: 1725230 - RNA, 17 nt, Human
acagaggggguggccuc

SEQ ID NO: 1725231 - RNA, 17 nt, Human
acagcucuguccuggga

SEQ ID NO: 1725232 - RNA, 16 nt, Human
acagcucuguccuggg

SEQ ID NO: 1725233 - RNA, 23 nt, Human
acaggcaagcaccuccugccucg

SEQ ID NO: 1725234 - RNA, 20 nt, Human
acaggcaagcaccuccugcc

SEQ ID NO: 1725235 - RNA, 13 nt, Human
acagcugccuggg

SEQ ID NO: 1725236 - RNA, 16 nt, Human
acagcugccugcagua

SEQ ID NO: 1725237 - RNA, 12 nt, Human
acagcugccugc

SEQ ID NO: 1725238 - RNA, 12 nt, Human
accaccugccca

SEQ ID NO: 1725239 - RNA, 20 nt, Human
accaaggcugauuaaaccaa

SEQ ID NO: 1725240 - RNA, 19 nt, Human
accaaggcugauuaaacca

SEQ ID NO: 1725241 - RNA, 20 nt, Human
accagccccagugcccacag

SEQ ID NO: 1725242 - RNA, 19 nt, Human
accagccccagugcccaca

SEQ ID NO: 1725243 - RNA, 18 nt, Human
accagccccagugcccac

SEQ ID NO: 1725244 - RNA, 17 nt, Human
accagccccagugccca

SEQ ID NO: 1725245 - RNA, 16 nt, Human
accagccccagugccc

SEQ ID NO: 1725246 - RNA, 13 nt, Human
accagcagccugg

SEQ ID NO: 1725247 - RNA, 13 nt, Human
accagcagagcac

SEQ ID NO: 1725248 - RNA, 12 nt, Human
accagcagagca

SEQ ID NO: 1725249 - RNA, 14 nt, Human
accagcagaaaugc

SEQ ID NO: 1725250 - RNA, 20 nt, Human
acaugccucucucaggccaa

SEQ ID NO: 1725251 - RNA, 19 nt, Human
acaugccucucucaggcca

SEQ ID NO: 1725252 - RNA, 23 nt, Human
acaugucuuuucuugcaugaggc

SEQ ID NO: 1725253 - RNA, 14 nt, Human
acaugugaaaagaa

SEQ ID NO: 1725254 - RNA, 17 nt, Human
acaugugaaaagaauag

SEQ ID NO: 1725255 - RNA, 18 nt, Human
acaugugaaaagaauaga

SEQ ID NO: 1725256 - RNA, 14 nt, Human
acauuuauucugcu

SEQ ID NO: 1725257 - RNA, 17 nt, Human
acauuuccuaaauauau

SEQ ID NO: 1725258 - RNA, 16 nt, Human
acauuuccuaaauaua

SEQ ID NO: 1725259 - RNA, 23 nt, Human
accaucauugaaaucuuuuugcu

SEQ ID NO: 1725260 - RNA, 16 nt, Human
accaucccugaaggcc

SEQ ID NO: 1725261 - RNA, 15 nt, Human
accaucaagccacca

SEQ ID NO: 1725262 - RNA, 15 nt, Human
accaucauugaaauc

SEQ ID NO: 1725263 - RNA, 14 nt, Human
accaucaagccacc

SEQ ID NO: 1725264 - RNA, 17 nt, Human
accauaggucaccuuua

SEQ ID NO: 1725265 - RNA, 21 nt, Human
accauacuaauuauacccccu

SEQ ID NO: 1725266 - RNA, 16 nt, Human
accauacuaauuauac

SEQ ID NO: 1725267 - RNA, 13 nt, Human
accauacuaauua

SEQ ID NO: 1725268 - RNA, 15 nt, Human
acccacccuccuuuc

SEQ ID NO: 1725269 - RNA, 13 nt, Human
acccaugcugccc

SEQ ID NO: 1725270 - RNA, 15 nt, Human
acccacccccaccca

SEQ ID NO: 1725271 - RNA, 17 nt, Human
acccacccccacccaag

SEQ ID NO: 1725272 - RNA, 20 nt, Human
aagauucauauuuacuucuu

SEQ ID NO: 1725273 - RNA, 17 nt, Human
aagauucaaucccagga

SEQ ID NO: 1725274 - RNA, 15 nt, Human
aagcagggacuugaa

SEQ ID NO: 1725275 - RNA, 19 nt, Human
aagccaccaacauacuccc

SEQ ID NO: 1725276 - RNA, 19 nt, Human
aagauuuugaaauuuuuau

SEQ ID NO: 1725277 - RNA, 23 nt, Human
aagacagugaaagaaaauaacaa

SEQ ID NO: 1725278 - RNA, 16 nt, Human
aagacuuuggaaagag

SEQ ID NO: 1725279 - RNA, 14 nt, Human
aacuuacuuagugu

SEQ ID NO: 1725280 - RNA, 17 nt, Human
aagacuuuuccaacccu

SEQ ID NO: 1725281 - RNA, 15 nt, Human
aagacuuuuaugaua

SEQ ID NO: 1725282 - RNA, 20 nt, Human
aagggacuuggaagcuccgc

SEQ ID NO: 1725283 - RNA, 17 nt, Human
aagggacugagaaauuu

SEQ ID NO: 1725284 - RNA, 15 nt, Human
aagggacugagaaau

SEQ ID NO: 1725285 - RNA, 12 nt, Human
aaguagaggagg

SEQ ID NO: 1725286 - RNA, 13 nt, Human
aaggacuaggguc

SEQ ID NO: 1725287 - RNA, 12 nt, Human
aaggaauuuuau

SEQ ID NO: 1725288 - RNA, 22 nt, Human
aaggacccggaggggccuggca

SEQ ID NO: 1725289 - RNA, 22 nt, Human
aagcugccagccgagauagcca

SEQ ID NO: 1725290 - RNA, 14 nt, Human
aagcugcugacagu

SEQ ID NO: 1725291 - RNA, 12 nt, Human
aagcugccagcc

SEQ ID NO: 1725292 - RNA, 11 nt, Human
aagcugccagc

SEQ ID NO: 1725293 - RNA, 20 nt, Human
aagcgugagccacugcaccg

SEQ ID NO: 1725294 - RNA, 17 nt, Human
aagcgugagccacugca

SEQ ID NO: 1725295 - RNA, 21 nt, Human
aagcgugagccacugcaccgg

SEQ ID NO: 1725296 - RNA, 23 nt, Human
aaggaaugauuaauuaaaacaca

SEQ ID NO: 1725297 - RNA, 16 nt, Human
aagcugcugacagugu

SEQ ID NO: 1725298 - RNA, 21 nt, Human
aagccaccaacauacucccau

SEQ ID NO: 1725299 - RNA, 18 nt, Human
aagccagcaggcucucag

SEQ ID NO: 1725300 - RNA, 19 nt, Human
aagccagcaggcucucagg

SEQ ID NO: 1725301 - RNA, 15 nt, Human
aagccagcaggcucu

SEQ ID NO: 1725302 - RNA, 17 nt, Human
aagcgauucuucugcuu

SEQ ID NO: 1725303 - RNA, 16 nt, Human
aagcgauucuucugcu

SEQ ID NO: 1725304 - RNA, 14 nt, Human
aagcgauucuucug

SEQ ID NO: 1725305 - RNA, 15 nt, Human
aagcgauucuucugc

SEQ ID NO: 1725306 - RNA, 17 nt, Human
aauccagacccggcugc

SEQ ID NO: 1725307 - RNA, 18 nt, Human
aauccaccugccucggcc

SEQ ID NO: 1725308 - RNA, 19 nt, Human
aauccaccugccucggccu

SEQ ID NO: 1725309 - RNA, 23 nt, Human
aaucucgcucugucgcccaggcu

SEQ ID NO: 1725310 - RNA, 18 nt, Human
aaucucggcucacugcau

SEQ ID NO: 1725311 - RNA, 20 nt, Human
aaucuggacuccucugucca

SEQ ID NO: 1725312 - RNA, 18 nt, Human
aaucuggacuccucuguc

SEQ ID NO: 1725313 - RNA, 17 nt, Human
aaucuggacuccucugu

SEQ ID NO: 1725314 - RNA, 16 nt, Human
aaucuggacuccucug

SEQ ID NO: 1725315 - RNA, 15 nt, Human
aaucuggacuccucu

SEQ ID NO: 1725316 - RNA, 13 nt, Human
aaugauuaauuaa

SEQ ID NO: 1725317 - RNA, 12 nt, Human
aaugauuaauua

SEQ ID NO: 1725318 - RNA, 16 nt, Human
aaugauuaauuaaaac

SEQ ID NO: 1725319 - RNA, 15 nt, Human
aaugauagcuacugu

SEQ ID NO: 1725320 - RNA, 15 nt, Human
aaugauaugcuugua

SEQ ID NO: 1725321 - RNA, 17 nt, Human
aaugauaugcuuguaac

SEQ ID NO: 1725322 - RNA, 23 nt, Human
aaugauguauguugaagccuuug

SEQ ID NO: 1725323 - RNA, 19 nt, Human
aaugauaugcuuguaacua

SEQ ID NO: 1725324 - RNA, 18 nt, Human
aaugauaugcuuguaacu

SEQ ID NO: 1725325 - RNA, 23 nt, Human
aaugcucuuuacuucauggacuu

SEQ ID NO: 1725326 - RNA, 14 nt, Human
aaugggagcucaug

SEQ ID NO: 1725327 - RNA, 13 nt, Human
aaugggacacuaa

SEQ ID NO: 1725328 - RNA, 15 nt, Human
aaugggggugcauuu

SEQ ID NO: 1725329 - RNA, 17 nt, Human
aaugggggugcauuuga

SEQ ID NO: 1725330 - RNA, 21 nt, Human
aaugcgugcauaccacuuuug

SEQ ID NO: 1725331 - RNA, 23 nt, Human
aaugcgugcauaccacuuuuguu

SEQ ID NO: 1725332 - RNA, 21 nt, Human
aaugcgcaggcuggcccugcc

SEQ ID NO: 1725333 - RNA, 14 nt, Human
aaugcgcaggcugg

SEQ ID NO: 1725334 - RNA, 15 nt, Human
aaugcgcaggcuggc

SEQ ID NO: 1725335 - RNA, 20 nt, Human
aaugcgcaggcuggcccugc

SEQ ID NO: 1725336 - RNA, 19 nt, Human
aaugcgcaggcuggcccug

SEQ ID NO: 1725337 - RNA, 18 nt, Human
aaugcgcaggcuggcccu

SEQ ID NO: 1725338 - RNA, 17 nt, Human
aaugcgcaggcuggccc

SEQ ID NO: 1725339 - RNA, 22 nt, Human
aauagaagcuaagguuuagaua

SEQ ID NO: 1725340 - RNA, 17 nt, Human
aauagaaauggggaacu

SEQ ID NO: 1725341 - RNA, 16 nt, Human
aauagaaauccaauug

SEQ ID NO: 1725342 - RNA, 16 nt, Human
aauauaggaacuuaaa

SEQ ID NO: 1725343 - RNA, 14 nt, Human
aagugcugcauuua

SEQ ID NO: 1725344 - RNA, 13 nt, Human
aagugcugcauuu

SEQ ID NO: 1725345 - RNA, 15 nt, Human
aaguggggacagagc

SEQ ID NO: 1725346 - RNA, 22 nt, Human
aaguucuuaguugcuguauguc

SEQ ID NO: 1725347 - RNA, 15 nt, Human
aaguucuuaguugcu

SEQ ID NO: 1725348 - RNA, 19 nt, Human
aauaaagcuguguggcagu

SEQ ID NO: 1725349 - RNA, 11 nt, Human
aauaaagcugu

SEQ ID NO: 1725350 - RNA, 10 nt, Human
aauaaaccau

SEQ ID NO: 1725351 - RNA, 12 nt, Human
aauaaaauuuuu

SEQ ID NO: 1725352 - RNA, 18 nt, Human
aaguugauggugaugaaa

SEQ ID NO: 1725353 - RNA, 14 nt, Human
aaauggacguguua

SEQ ID NO: 1725354 - RNA, 17 nt, Human
aaauggacguguuauga

SEQ ID NO: 1725355 - RNA, 15 nt, Human
aaauggacguguuau

SEQ ID NO: 1725356 - RNA, 18 nt, Human
aaaucugcuuuuuaaaga

SEQ ID NO: 1725357 - RNA, 22 nt, Human
aaaucuccaaaauaaaacuuuu

SEQ ID NO: 1725358 - RNA, 21 nt, Human
aacacauacaggaagguagaa

SEQ ID NO: 1725359 - RNA, 22 nt, Human
aacaaaccuguuucugcagcca

SEQ ID NO: 1725360 - RNA, 22 nt, Human
aacaaaggccuaauucuaugcc

SEQ ID NO: 1725361 - RNA, 19 nt, Human
aacaccucugcacaagcug

SEQ ID NO: 1725362 - RNA, 17 nt, Human
aacacuaacaugauuug

SEQ ID NO: 1725363 - RNA, 18 nt, Human
aaauugaugggauuuggu

SEQ ID NO: 1725364 - RNA, 13 nt, Human
aaauuaacuuuua

SEQ ID NO: 1725365 - RNA, 14 nt, Human
aaauuaacuuuuau

SEQ ID NO: 1725366 - RNA, 19 nt, Human
aaauuaacuuuuauaaacu

SEQ ID NO: 1725367 - RNA, 12 nt, Human
aaauuaacuuuu

SEQ ID NO: 1725368 - RNA, 22 nt, Human
aaauguuuuuuuuuaaagacuu

SEQ ID NO: 1725369 - RNA, 20 nt, Human
aaauguucaucaaugaauga

SEQ ID NO: 1725370 - RNA, 21 nt, Human
aaauguuuuuuuuuaaagacu

SEQ ID NO: 1725371 - RNA, 18 nt, Human
aaauguuuuuuuuuaaag

SEQ ID NO: 1725372 - RNA, 13 nt, Human
aacccuucagugc

SEQ ID NO: 1725373 - RNA, 19 nt, Human
aaccaguguuguggauuua

SEQ ID NO: 1725374 - RNA, 22 nt, Human
aacaugcuacacacugcauguu

SEQ ID NO: 1725375 - RNA, 15 nt, Human
aacauggaaguacua

SEQ ID NO: 1725376 - RNA, 16 nt, Human
aacagcuaaugggaca

SEQ ID NO: 1725377 - RNA, 13 nt, Human
aacagauuuggaa

SEQ ID NO: 1725378 - RNA, 14 nt, Human
aacagauuuggaaa

SEQ ID NO: 1725379 - RNA, 15 nt, Human
aacagauuuggaaag

SEQ ID NO: 1725380 - RNA, 22 nt, Human
aacauccuacaagacacaguga

SEQ ID NO: 1725381 - RNA, 15 nt, Human
aacauccuacaagac

SEQ ID NO: 1725382 - RNA, 14 nt, Human
aacugaauuuuguc

SEQ ID NO: 1725383 - RNA, 13 nt, Human
aacgucugugcca

SEQ ID NO: 1725384 - RNA, 15 nt, Human
aacguauaaaagccu

SEQ ID NO: 1725385 - RNA, 18 nt, Human
aacucaccccagccccaa

SEQ ID NO: 1725386 - RNA, 17 nt, Human
aacucaccccagcccca

SEQ ID NO: 1725387 - RNA, 16 nt, Human
aacucaccccagcccc

SEQ ID NO: 1725388 - RNA, 17 nt, Human
aacucaaacucuuaaaa

SEQ ID NO: 1725389 - RNA, 11 nt, Human
aaauaaauuau

SEQ ID NO: 1725390 - RNA, 19 nt, Human
aaaggcagaagcaacccaa

SEQ ID NO: 1725391 - RNA, 18 nt, Human
aaagcccaaagugguaua

SEQ ID NO: 1725392 - RNA, 17 nt, Human
aaaggcuaccuuuguau

SEQ ID NO: 1725393 - RNA, 14 nt, Human
aaaggcuaccuuug

SEQ ID NO: 1725394 - RNA, 14 nt, Human
aaaggcuccaggag

SEQ ID NO: 1725395 - RNA, 22 nt, Human
aaaggcuccaggagcagccaca

SEQ ID NO: 1725396 - RNA, 21 nt, Human
aaaggcuccaggagcagccac

SEQ ID NO: 1725397 - RNA, 15 nt, Human
aaagccaaagcuagg

SEQ ID NO: 1725398 - RNA, 21 nt, Human
aaagcauuuuguaauaauaaa

SEQ ID NO: 1725399 - RNA, 13 nt, Human
aaagcauuuugua

SEQ ID NO: 1725400 - RNA, 14 nt, Human
aaagcauuuuguaa

SEQ ID NO: 1725401 - RNA, 15 nt, Human
aaagcauuuuguaau

SEQ ID NO: 1725402 - RNA, 17 nt, Human
aaaccccaucucuacaa

SEQ ID NO: 1725403 - RNA, 21 nt, Human
aaacccugucucuacuaaaaa

SEQ ID NO: 1725404 - RNA, 14 nt, Human
aaacccuucagugc

SEQ ID NO: 1725405 - RNA, 17 nt, Human
aaacucuugaccucagg

SEQ ID NO: 1725406 - RNA, 20 nt, Human
aaagaacgcugauuuaaaga

SEQ ID NO: 1725407 - RNA, 15 nt, Human
aaagaacgcugauuu

SEQ ID NO: 1725408 - RNA, 18 nt, Human
aaagaacgcugauuuaaa

SEQ ID NO: 1725409 - RNA, 19 nt, Human
aaacugauuuuuuuuuccu

SEQ ID NO: 1725410 - RNA, 13 nt, Human
aaacugauuuuuu

SEQ ID NO: 1725411 - RNA, 20 nt, Human
aaacugauuuuuuuuuccuu

SEQ ID NO: 1725412 - RNA, 11 nt, Human
aaagagguuuu

SEQ ID NO: 1725413 - RNA, 18 nt, Human
aaagaggucgcuugggaa

SEQ ID NO: 1725414 - RNA, 15 nt, Human
aaagauacaguuacu

SEQ ID NO: 1725415 - RNA, 19 nt, Human
aaaauuaggauuucaugau

SEQ ID NO: 1725416 - RNA, 15 nt, Human
aaaauuagccaagug

SEQ ID NO: 1725417 - RNA, 12 nt, Human
aaaauuaagaaa

SEQ ID NO: 1725418 - RNA, 22 nt, Human
aaaauuaacaugaauauuuagu

SEQ ID NO: 1725419 - RNA, 22 nt, Human
aaaaucccuuaccucggugccu

SEQ ID NO: 1725420 - RNA, 23 nt, Human
aaaauuaaucugggccagaauuu

SEQ ID NO: 1725421 - RNA, 20 nt, Human
aaaauuaagaaaggauaaag

SEQ ID NO: 1725422 - RNA, 13 nt, Human
aaaauuaagaaag

SEQ ID NO: 1725423 - RNA, 15 nt, Human
aaaauaaaaaacacu

SEQ ID NO: 1725424 - RNA, 21 nt, Human
aaaauccacuuuaucuugaau

SEQ ID NO: 1725425 - RNA, 17 nt, Human
aaacagcuaaugggaca

SEQ ID NO: 1725426 - RNA, 22 nt, Human
aggacccggaggggccuggcag

SEQ ID NO: 1725427 - RNA, 21 nt, Human
aggacccggaggggccuggca

SEQ ID NO: 1725428 - RNA, 20 nt, Human
aggacccggaggggccuggc

SEQ ID NO: 1725429 - RNA, 18 nt, Human
aggacccggaggggccug

SEQ ID NO: 1725430 - RNA, 21 nt, Human
aggaccuguggccaaguucuu

SEQ ID NO: 1725431 - RNA, 16 nt, Human
aggaccuguggccaag

SEQ ID NO: 1725432 - RNA, 18 nt, Human
agcuucacuguaaaauaa

SEQ ID NO: 1725433 - RNA, 18 nt, Human
agcuucauuuccuguguc

SEQ ID NO: 1725434 - RNA, 19 nt, Human
agcuucauuuccugugucu

SEQ ID NO: 1725435 - RNA, 23 nt, Human
agcuuuguuuguugucagcugaa

SEQ ID NO: 1725436 - RNA, 16 nt, Human
agcuuuuaaacccuau

SEQ ID NO: 1725437 - RNA, 23 nt, Human
aggaacuuaaauaaugugaaacu

SEQ ID NO: 1725438 - RNA, 22 nt, Human
aggaaggcugagaggagagaga

SEQ ID NO: 1725439 - RNA, 18 nt, Human
aggaauaccugucccccu

SEQ ID NO: 1725440 - RNA, 15 nt, Human
aggaauaccuguccc

SEQ ID NO: 1725441 - RNA, 22 nt, Human
aggaauaccugucccccugaca

SEQ ID NO: 1725442 - RNA, 20 nt, Human
aggaauaaauugcuccuuga

SEQ ID NO: 1725443 - RNA, 19 nt, Human
aggaauaaauugcuccuug

SEQ ID NO: 1725444 - RNA, 23 nt, Human
aggaacaaggcaaggcugucaau

SEQ ID NO: 1725445 - RNA, 20 nt, Human
aggaacaaggcaaggcuguc

SEQ ID NO: 1725446 - RNA, 21 nt, Human
aggaacuuaaauaaugugaaa

SEQ ID NO: 1725447 - RNA, 19 nt, Human
aggaacaaggcaaggcugu

SEQ ID NO: 1725448 - RNA, 17 nt, Human
aggaacaaggcaaggcu

SEQ ID NO: 1725449 - RNA, 16 nt, Human
aggaacaaggcaaggc

SEQ ID NO: 1725450 - RNA, 13 nt, Human
aggaacaaggcaa

SEQ ID NO: 1725451 - RNA, 12 nt, Human
aggaacaaggca

SEQ ID NO: 1725452 - RNA, 21 nt, Human
agcuuuuaugugaaacauguu

SEQ ID NO: 1725453 - RNA, 15 nt, Human
agcuuuuaugugaaa

SEQ ID NO: 1725454 - RNA, 16 nt, Human
agcucaccagccccag

SEQ ID NO: 1725455 - RNA, 16 nt, Human
agcuaaucagcauucu

SEQ ID NO: 1725456 - RNA, 21 nt, Human
agcuaaucagcauucucacuc

SEQ ID NO: 1725457 - RNA, 18 nt, Human
agcuaauaacaugugaaa

SEQ ID NO: 1725458 - RNA, 19 nt, Human
agcucaccucucccuugga

SEQ ID NO: 1725459 - RNA, 18 nt, Human
agcucaccucucccuugg

SEQ ID NO: 1725460 - RNA, 15 nt, Human
agcucaccucucccu

SEQ ID NO: 1725461 - RNA, 20 nt, Human
agcucaccagccccagugcc

SEQ ID NO: 1725462 - RNA, 19 nt, Human
agcucaccagccccagugc

SEQ ID NO: 1725463 - RNA, 12 nt, Human
agcucaccucuc

SEQ ID NO: 1725464 - RNA, 14 nt, Human
agcucagagagggu

SEQ ID NO: 1725465 - RNA, 18 nt, Human
agcucagagaggguggga

SEQ ID NO: 1725466 - RNA, 12 nt, Human
agcucagagagg

SEQ ID NO: 1725467 - RNA, 19 nt, Human
agcgagcccugguggcagu

SEQ ID NO: 1725468 - RNA, 13 nt, Human
agcgagcccuggu

SEQ ID NO: 1725469 - RNA, 15 nt, Human
agccuuuggaaacag

SEQ ID NO: 1725470 - RNA, 20 nt, Human
agccugggaggucaaggcug

SEQ ID NO: 1725471 - RNA, 12 nt, Human
agccugggaggu

SEQ ID NO: 1725472 - RNA, 18 nt, Human
agccuggcuucaaauugu

SEQ ID NO: 1725473 - RNA, 17 nt, Human
agccuggcuucaaauug

SEQ ID NO: 1725474 - RNA, 22 nt, Human
agccuggcuccaaacccucgag

SEQ ID NO: 1725475 - RNA, 23 nt, Human
agcccucccugccccucccuuca

SEQ ID NO: 1725476 - RNA, 22 nt, Human
agcccucccugccccucccuuc

SEQ ID NO: 1725477 - RNA, 20 nt, Human
agccuggcuccaaacccucg

SEQ ID NO: 1725478 - RNA, 13 nt, Human
agccuggcuccaa

SEQ ID NO: 1725479 - RNA, 19 nt, Human
agcccucccugccccuccc

SEQ ID NO: 1725480 - RNA, 17 nt, Human
agcccucccugccccuc

SEQ ID NO: 1725481 - RNA, 16 nt, Human
agcccucccugccccu

SEQ ID NO: 1725482 - RNA, 15 nt, Human
agcccucccugcccc

SEQ ID NO: 1725483 - RNA, 15 nt, Human
agcugaaccugggua

SEQ ID NO: 1725484 - RNA, 18 nt, Human
agcugcgguccacccagg

SEQ ID NO: 1725485 - RNA, 17 nt, Human
agcugcgguccacccag

SEQ ID NO: 1725486 - RNA, 16 nt, Human
agcugcgguccaccca

SEQ ID NO: 1725487 - RNA, 13 nt, Human
agcugcgguccac

SEQ ID NO: 1725488 - RNA, 20 nt, Human
agcugcgguccacccaggag

SEQ ID NO: 1725489 - RNA, 19 nt, Human
agcugcgguccacccagga

SEQ ID NO: 1725490 - RNA, 12 nt, Human
agcugcugacag

SEQ ID NO: 1725491 - RNA, 21 nt, Human
agcugcgguccacccaggagc

SEQ ID NO: 1725492 - RNA, 17 nt, Human
agcuggucccacucagu

SEQ ID NO: 1725493 - RNA, 16 nt, Human
agcuggucccacucag

SEQ ID NO: 1725494 - RNA, 14 nt, Human
agcugcugacagug

SEQ ID NO: 1725495 - RNA, 13 nt, Human
agcugcugacagu

SEQ ID NO: 1725496 - RNA, 19 nt, Human
agcuggucccacucagucc

SEQ ID NO: 1725497 - RNA, 18 nt, Human
agcuggucccacucaguc

SEQ ID NO: 1725498 - RNA, 22 nt, Human
agcugguuuuuagcggagacgg

SEQ ID NO: 1725499 - RNA, 23 nt, Human
aggucccuaauaaagcugugugg

SEQ ID NO: 1725500 - RNA, 14 nt, Human
agguacucuccugg

SEQ ID NO: 1725501 - RNA, 13 nt, Human
agguacucuccug

SEQ ID NO: 1725502 - RNA, 14 nt, Human
agguaacaggcaga

SEQ ID NO: 1725503 - RNA, 13 nt, Human
agguaacaggcag

SEQ ID NO: 1725504 - RNA, 16 nt, Human
agguaacaggcagaua

SEQ ID NO: 1725505 - RNA, 23 nt, Human
aggguuuugccauguuggccagg

SEQ ID NO: 1725506 - RNA, 22 nt, Human
aggguuuugccauguuggccag

SEQ ID NO: 1725507 - RNA, 20 nt, Human
agggucucacuauguugccc

SEQ ID NO: 1725508 - RNA, 14 nt, Human
agggccugcaaggg

SEQ ID NO: 1725509 - RNA, 13 nt, Human
agggccuggccug

SEQ ID NO: 1725510 - RNA, 12 nt, Human
agggccuggccu

SEQ ID NO: 1725511 - RNA, 15 nt, Human
agggccugcaaggga

SEQ ID NO: 1725512 - RNA, 22 nt, Human
agggucccugguggcagcucac

SEQ ID NO: 1725513 - RNA, 20 nt, Human
agggucccugguggcagcuc

SEQ ID NO: 1725514 - RNA, 17 nt, Human
agggucccugguggcag

SEQ ID NO: 1725515 - RNA, 16 nt, Human
agggucccugguggca

SEQ ID NO: 1725516 - RNA, 13 nt, Human
aggguauuccaga

SEQ ID NO: 1725517 - RNA, 21 nt, Human
aggguaucuggugacuuuccu

SEQ ID NO: 1725518 - RNA, 12 nt, Human
aggggccuggca

SEQ ID NO: 1725519 - RNA, 13 nt, Human
aggggccuggcag

SEQ ID NO: 1725520 - RNA, 14 nt, Human
agggucccuggugg

SEQ ID NO: 1725521 - RNA, 12 nt, Human
agggucccuggu

SEQ ID NO: 1725522 - RNA, 22 nt, Human
aggggcccaaauucuuucagug

SEQ ID NO: 1725523 - RNA, 14 nt, Human
agggccuggccuga

SEQ ID NO: 1725524 - RNA, 23 nt, Human
aggcccucugcccacucccugca

SEQ ID NO: 1725525 - RNA, 22 nt, Human
aggcccucugcccacucccugc

SEQ ID NO: 1725526 - RNA, 19 nt, Human
aggcccuucucuccagccc

SEQ ID NO: 1725527 - RNA, 15 nt, Human
aggcccuucucucca

SEQ ID NO: 1725528 - RNA, 12 nt, Human
aggcccuucucu

SEQ ID NO: 1725529 - RNA, 22 nt, Human
aggcccuuccucuccacugccu

SEQ ID NO: 1725530 - RNA, 15 nt, Human
aggccaggcccucug

SEQ ID NO: 1725531 - RNA, 14 nt, Human
aggccaggcccucu

SEQ ID NO: 1725532 - RNA, 13 nt, Human
aggccaggcccuc

SEQ ID NO: 1725533 - RNA, 20 nt, Human
aggcauuccccaggaggcca

SEQ ID NO: 1725534 - RNA, 19 nt, Human
aggcauuccccaggaggcc

SEQ ID NO: 1725535 - RNA, 18 nt, Human
aggcauuccccaggaggc

SEQ ID NO: 1725536 - RNA, 19 nt, Human
aggcauguucucugaggac

SEQ ID NO: 1725537 - RNA, 18 nt, Human
aggcauguucucugagga

SEQ ID NO: 1725538 - RNA, 17 nt, Human
aggcauguucucugagg

SEQ ID NO: 1725539 - RNA, 21 nt, Human
aggcaugugaugagaggaaau

SEQ ID NO: 1725540 - RNA, 20 nt, Human
aggcaugugaugagaggaaa

SEQ ID NO: 1725541 - RNA, 19 nt, Human
aggcaugugaugagaggaa

SEQ ID NO: 1725542 - RNA, 15 nt, Human
aggcaugguggccca

SEQ ID NO: 1725543 - RNA, 17 nt, Human
aggcaugugaugagagg

SEQ ID NO: 1725544 - RNA, 14 nt, Human
aggagaggggcaca

SEQ ID NO: 1725545 - RNA, 15 nt, Human
agggacugaggggag

SEQ ID NO: 1725546 - RNA, 23 nt, Human
agggacugccagucccccugccc

SEQ ID NO: 1725547 - RNA, 15 nt, Human
agggacccuccacca

SEQ ID NO: 1725548 - RNA, 21 nt, Human
aggcuuagucacugagacagc

SEQ ID NO: 1725549 - RNA, 18 nt, Human
aggcuuagucacugagac

SEQ ID NO: 1725550 - RNA, 17 nt, Human
aggcuuagucacugaga

SEQ ID NO: 1725551 - RNA, 22 nt, Human
aggcuguaucccaugagccuca

SEQ ID NO: 1725552 - RNA, 21 nt, Human
aggcuguaucccaugagccuc

SEQ ID NO: 1725553 - RNA, 20 nt, Human
aggcuguaucccaugagccu

SEQ ID NO: 1725554 - RNA, 23 nt, Human
aggcuggucucgaacuccugacc

SEQ ID NO: 1725555 - RNA, 22 nt, Human
aggcuggucucaaacuccugac

SEQ ID NO: 1725556 - RNA, 18 nt, Human
aggcuggguucugauccu

SEQ ID NO: 1725557 - RNA, 15 nt, Human
aggcuaccuuuguau

SEQ ID NO: 1725558 - RNA, 13 nt, Human
aggcuaccuuugu

SEQ ID NO: 1725559 - RNA, 14 nt, Human
aggcuaccuuugua

SEQ ID NO: 1725560 - RNA, 16 nt, Human
agcacagacccugccc

SEQ ID NO: 1725561 - RNA, 17 nt, Human
agcacgauuucuguuua

SEQ ID NO: 1725562 - RNA, 19 nt, Human
agcacgauuucuguuuaga

SEQ ID NO: 1725563 - RNA, 21 nt, Human
agcacgauuucuguuuagaua

SEQ ID NO: 1725564 - RNA, 12 nt, Human
agcacagacccu

SEQ ID NO: 1725565 - RNA, 15 nt, Human
agcacagacccugcc

SEQ ID NO: 1725566 - RNA, 14 nt, Human
agcacagacccugc

SEQ ID NO: 1725567 - RNA, 16 nt, Human
agauguagaggagaaa

SEQ ID NO: 1725568 - RNA, 19 nt, Human
agauguagaggagaaacug

SEQ ID NO: 1725569 - RNA, 14 nt, Human
agaugagugagcau

SEQ ID NO: 1725570 - RNA, 23 nt, Human
agaggggguggccucccaacuca

SEQ ID NO: 1725571 - RNA, 18 nt, Human
agcaaaagaugcuucuca

SEQ ID NO: 1725572 - RNA, 21 nt, Human
agauugcaacaggcugggcuu

SEQ ID NO: 1725573 - RNA, 20 nt, Human
agauugcaacaggcugggcu

SEQ ID NO: 1725574 - RNA, 23 nt, Human
agauugcaacaggcugggcuuca

SEQ ID NO: 1725575 - RNA, 21 nt, Human
agauucuuuccugaggcuggg

SEQ ID NO: 1725576 - RNA, 19 nt, Human
agauucuuuccugaggcug

SEQ ID NO: 1725577 - RNA, 20 nt, Human
agauugaaccugaauauugc

SEQ ID NO: 1725578 - RNA, 20 nt, Human
agcaaaggagauuggaagga

SEQ ID NO: 1725579 - RNA, 15 nt, Human
agcaaauggccucau

SEQ ID NO: 1725580 - RNA, 20 nt, Human
agcaaauggccucaugucaa

SEQ ID NO: 1725581 - RNA, 16 nt, Human
agcaaauguggcuccu

SEQ ID NO: 1725582 - RNA, 20 nt, Human
agcaaaugucuuccuggauu

SEQ ID NO: 1725583 - RNA, 17 nt, Human
agcaaaugucuuccugg

SEQ ID NO: 1725584 - RNA, 18 nt, Human
agcauccuggcacccggc

SEQ ID NO: 1725585 - RNA, 17 nt, Human
agcauccuggcacccgg

SEQ ID NO: 1725586 - RNA, 14 nt, Human
agcauccuggcacc

SEQ ID NO: 1725587 - RNA, 18 nt, Human
agccaaagcuaggccugg

SEQ ID NO: 1725588 - RNA, 16 nt, Human
agccaaagcuaggccu

SEQ ID NO: 1725589 - RNA, 15 nt, Human
agccagaggagagag

SEQ ID NO: 1725590 - RNA, 13 nt, Human
agccagaggagag

SEQ ID NO: 1725591 - RNA, 20 nt, Human
agccaaggccaaaggaagca

SEQ ID NO: 1725592 - RNA, 18 nt, Human
agccagaggagagaggac

SEQ ID NO: 1725593 - RNA, 17 nt, Human
agccagaggagagagga

SEQ ID NO: 1725594 - RNA, 14 nt, Human
agccagcaggcucu

SEQ ID NO: 1725595 - RNA, 15 nt, Human
agcccacgcccccac

SEQ ID NO: 1725596 - RNA, 14 nt, Human
agcccacgccccca

SEQ ID NO: 1725597 - RNA, 23 nt, Human
agcccacgcccccacuggugaca

SEQ ID NO: 1725598 - RNA, 17 nt, Human
agccagcaggcucucag

SEQ ID NO: 1725599 - RNA, 16 nt, Human
agccagcaggcucuca

SEQ ID NO: 1725600 - RNA, 14 nt, Human
agcccaccuuggcu

SEQ ID NO: 1725601 - RNA, 16 nt, Human
agcccaccuuggcuca

SEQ ID NO: 1725602 - RNA, 15 nt, Human
agcccaccccucaac

SEQ ID NO: 1725603 - RNA, 13 nt, Human
agcauccuggcac

SEQ ID NO: 1725604 - RNA, 21 nt, Human
agcccgggcucugccucccau

SEQ ID NO: 1725605 - RNA, 20 nt, Human
agcccgggcucugccuccca

SEQ ID NO: 1725606 - RNA, 18 nt, Human
agcccgggcucugccucc

SEQ ID NO: 1725607 - RNA, 17 nt, Human
agcccgggcucugccuc

SEQ ID NO: 1725608 - RNA, 20 nt, Human
agccccauucugccugccca

SEQ ID NO: 1725609 - RNA, 21 nt, Human
agcccuccaucuaaacugccc

SEQ ID NO: 1725610 - RNA, 23 nt, Human
agcccuccaucuaaacugccccc

SEQ ID NO: 1725611 - RNA, 13 nt, Human
agcccucccugcc

SEQ ID NO: 1725612 - RNA, 12 nt, Human
agcccucccugc

SEQ ID NO: 1725613 - RNA, 23 nt, Human
agccccauccucuguacagagcc

SEQ ID NO: 1725614 - RNA, 17 nt, Human
agccccauccucuguac

SEQ ID NO: 1725615 - RNA, 15 nt, Human
agccccauccucugu

SEQ ID NO: 1725616 - RNA, 19 nt, Human
agccccauucugccugccc

SEQ ID NO: 1725617 - RNA, 18 nt, Human
agccccauucugccugcc

SEQ ID NO: 1725618 - RNA, 17 nt, Human
agccccauucugccugc

SEQ ID NO: 1725619 - RNA, 19 nt, Human
agacccaaaaggcagaagc

SEQ ID NO: 1725620 - RNA, 21 nt, Human
agacagagucucacuguugcc

SEQ ID NO: 1725621 - RNA, 23 nt, Human
agacagagucucacuguugccca

SEQ ID NO: 1725622 - RNA, 22 nt, Human
agacagauacuccuccaagguu

SEQ ID NO: 1725623 - RNA, 22 nt, Human
agacagccaacuauggccugug

SEQ ID NO: 1725624 - RNA, 15 nt, Human
agaccacguuucuaa

SEQ ID NO: 1725625 - RNA, 20 nt, Human
agacagagucucacuguugc

SEQ ID NO: 1725626 - RNA, 19 nt, Human
agacagagucucacuguug

SEQ ID NO: 1725627 - RNA, 11 nt, Human
agacagagucu

SEQ ID NO: 1725628 - RNA, 21 nt, Human
agacaaugacuuacuguacau

SEQ ID NO: 1725629 - RNA, 22 nt, Human
agacaaugacuuacuguacaug

SEQ ID NO: 1725630 - RNA, 15 nt, Human
agacagagcuacaca

SEQ ID NO: 1725631 - RNA, 23 nt, Human
agacaaugacuuacuguacauga

SEQ ID NO: 1725632 - RNA, 20 nt, Human
agacaaugacuuacuguaca

SEQ ID NO: 1725633 - RNA, 18 nt, Human
agaaugaaagggcccaga

SEQ ID NO: 1725634 - RNA, 21 nt, Human
agaagugaaaaucuacacucc

SEQ ID NO: 1725635 - RNA, 22 nt, Human
agaaugcacaaacagaggccgc

SEQ ID NO: 1725636 - RNA, 19 nt, Human
agaaugcacaaacagaggc

SEQ ID NO: 1725637 - RNA, 21 nt, Human
agaagagauugugguuucauu

SEQ ID NO: 1725638 - RNA, 21 nt, Human
acuuuccucuuuggucuacac

SEQ ID NO: 1725639 - RNA, 21 nt, Human
acuuuccucuuagucgagcca

SEQ ID NO: 1725640 - RNA, 21 nt, Human
agaagacacugaugggcaacc

SEQ ID NO: 1725641 - RNA, 13 nt, Human
agaagacacugau

SEQ ID NO: 1725642 - RNA, 14 nt, Human
agaaguaacuuacu

SEQ ID NO: 1725643 - RNA, 18 nt, Human
agaagguuucagaaagaa

SEQ ID NO: 1725644 - RNA, 13 nt, Human
agaggaaugaagu

SEQ ID NO: 1725645 - RNA, 19 nt, Human
agaggggguggccucccaa

SEQ ID NO: 1725646 - RNA, 17 nt, Human
agaggggguggccuccc

SEQ ID NO: 1725647 - RNA, 16 nt, Human
agagggccugcaaggg

SEQ ID NO: 1725648 - RNA, 13 nt, Human
agagggccugcaa

SEQ ID NO: 1725649 - RNA, 23 nt, Human
agaggacuuuucuuuguggcuuc

SEQ ID NO: 1725650 - RNA, 23 nt, Human
agaggagggagcaucagugcccu

SEQ ID NO: 1725651 - RNA, 22 nt, Human
agaggacuuuucuuuguggcuu

SEQ ID NO: 1725652 - RNA, 21 nt, Human
agaggacuuuucuuuguggcu

SEQ ID NO: 1725653 - RNA, 18 nt, Human
agacucugucucagucca

SEQ ID NO: 1725654 - RNA, 20 nt, Human
agacugaguacguugugcau

SEQ ID NO: 1725655 - RNA, 22 nt, Human
agacugaccaauauuguacagu

SEQ ID NO: 1725656 - RNA, 22 nt, Human
agacugaguacguugugcauuu

SEQ ID NO: 1725657 - RNA, 18 nt, Human
agacucugucucaaaaaa

SEQ ID NO: 1725658 - RNA, 16 nt, Human
agacgcugugcugccc

SEQ ID NO: 1725659 - RNA, 16 nt, Human
agagagaccacuuuuc

SEQ ID NO: 1725660 - RNA, 16 nt, Human
agacuggaagcacagc

SEQ ID NO: 1725661 - RNA, 13 nt, Human
agagccagggucu

SEQ ID NO: 1725662 - RNA, 13 nt, Human
agagcccaccuug

SEQ ID NO: 1725663 - RNA, 15 nt, Human
agagcccuucauuug

SEQ ID NO: 1725664 - RNA, 14 nt, Human
agagccucaaauga

SEQ ID NO: 1725665 - RNA, 17 nt, Human
agagccucaaaugagaa

SEQ ID NO: 1725666 - RNA, 15 nt, Human
aguaucucagggccu

SEQ ID NO: 1725667 - RNA, 20 nt, Human
aguaugaggcauuuguuuga

SEQ ID NO: 1725668 - RNA, 21 nt, Human
aguaugaggcauuuguuugaa

SEQ ID NO: 1725669 - RNA, 23 nt, Human
aguaugaggcauuuguuugaacu

SEQ ID NO: 1725670 - RNA, 17 nt, Human
aguaugaggcauuuguu

SEQ ID NO: 1725671 - RNA, 22 nt, Human
agucacacaguauuacuucugc

SEQ ID NO: 1725672 - RNA, 13 nt, Human
aguacucauacau

SEQ ID NO: 1725673 - RNA, 14 nt, Human
aguacuauguauca

SEQ ID NO: 1725674 - RNA, 12 nt, Human
aguacuauguau

SEQ ID NO: 1725675 - RNA, 12 nt, Human
aguacuucuuuu

SEQ ID NO: 1725676 - RNA, 19 nt, Human
aguacuucuccacccugcu

SEQ ID NO: 1725677 - RNA, 17 nt, Human
aguacuucuccacccug

SEQ ID NO: 1725678 - RNA, 16 nt, Human
aguacguugugcauuu

SEQ ID NO: 1725679 - RNA, 17 nt, Human
aguacguugugcauuug

SEQ ID NO: 1725680 - RNA, 18 nt, Human
aguacguugugcauuugg

SEQ ID NO: 1725681 - RNA, 22 nt, Human
aguacuacaguccucccaucuc

SEQ ID NO: 1725682 - RNA, 19 nt, Human
aguacuacaguccucccau

SEQ ID NO: 1725683 - RNA, 14 nt, Human
aguacuauaauuua

SEQ ID NO: 1725684 - RNA, 20 nt, Human
aguaagccgugauuuucauu

SEQ ID NO: 1725685 - RNA, 18 nt, Human
aguaaaugggggugcauu

SEQ ID NO: 1725686 - RNA, 13 nt, Human
aggucuguucuuu

SEQ ID NO: 1725687 - RNA, 15 nt, Human
aggucuguucuuucc

SEQ ID NO: 1725688 - RNA, 16 nt, Human
aggucuguucuuucca

SEQ ID NO: 1725689 - RNA, 15 nt, Human
aguacguugugcauu

SEQ ID NO: 1725690 - RNA, 14 nt, Human
aguacguugugcau

SEQ ID NO: 1725691 - RNA, 18 nt, Human
agugaccucagcuuugau

SEQ ID NO: 1725692 - RNA, 16 nt, Human
agucuguugauuaaag

SEQ ID NO: 1725693 - RNA, 17 nt, Human
agugaccucagcuuuga

SEQ ID NO: 1725694 - RNA, 19 nt, Human
aguccucuuuucugagagg

SEQ ID NO: 1725695 - RNA, 20 nt, Human
aguccuuaccagcagagcac

SEQ ID NO: 1725696 - RNA, 22 nt, Human
aguccucuuuucugagaggacu

SEQ ID NO: 1725697 - RNA, 19 nt, Human
agucaugcguuuaaucaca

SEQ ID NO: 1725698 - RNA, 19 nt, Human
agugucaaugcagccccca

SEQ ID NO: 1725699 - RNA, 21 nt, Human
agugggacagggcauggccag

SEQ ID NO: 1725700 - RNA, 19 nt, Human
agugggacagggcauggcc

SEQ ID NO: 1725701 - RNA, 24 nt, Human
agugauccucccaccucagccucc

SEQ ID NO: 1725702 - RNA, 19 nt, Human
agugauccucccaccucag

SEQ ID NO: 1725703 - RNA, 18 nt, Human
agugauccucccaccuca

SEQ ID NO: 1725704 - RNA, 15 nt, Human
agugauccucccacc

SEQ ID NO: 1725705 - RNA, 14 nt, Human
agugauccucccac

SEQ ID NO: 1725706 - RNA, 18 nt, Human
agugccuuacacaauggu

SEQ ID NO: 1725707 - RNA, 17 nt, Human
agugauucuccugccuc

SEQ ID NO: 1725708 - RNA, 15 nt, Human
agugauucuccugcc

SEQ ID NO: 1725709 - RNA, 14 nt, Human
agugauucuccugc

SEQ ID NO: 1725710 - RNA, 21 nt, Human
agugauucucaugccucagcc

SEQ ID NO: 1725711 - RNA, 20 nt, Human
agugauggguuaguggaugg

SEQ ID NO: 1725712 - RNA, 15 nt, Human
agugccuuauggaac

SEQ ID NO: 1725713 - RNA, 14 nt, Human
agugccuuauggaa

SEQ ID NO: 1725714 - RNA, 13 nt, Human
agugccuuaugga

SEQ ID NO: 1725715 - RNA, 10 nt, Human
agugccuuau

SEQ ID NO: 1725716 - RNA, 18 nt, Human
agugccuuauggaacacu

SEQ ID NO: 1725717 - RNA, 16 nt, Human
agugccuuauggaaca

SEQ ID NO: 1725718 - RNA, 15 nt, Human
agugcuaauuuugaa

SEQ ID NO: 1725719 - RNA, 20 nt, Human
agugcuaauuuugaaaaacu

SEQ ID NO: 1725720 - RNA, 18 nt, Human
agugcuaauuuugaaaaa

SEQ ID NO: 1725721 - RNA, 22 nt, Human
aguucaucuugaauuguaagga

SEQ ID NO: 1725722 - RNA, 16 nt, Human
aguugauacuacaguu

SEQ ID NO: 1725723 - RNA, 14 nt, Human
aguugauagcacag

SEQ ID NO: 1725724 - RNA, 19 nt, Human
aguucaucuugaauuguaa

SEQ ID NO: 1725725 - RNA, 15 nt, Human
aguucaucuugaauu

SEQ ID NO: 1725726 - RNA, 13 nt, Human
aguucaucuugaa

SEQ ID NO: 1725727 - RNA, 18 nt, Human
aguucagguaacaggcag

SEQ ID NO: 1725728 - RNA, 21 nt, Human
auaagccagacaucaacagau

SEQ ID NO: 1725729 - RNA, 22 nt, Human
auaagccagacaucaacagaua

SEQ ID NO: 1725730 - RNA, 18 nt, Human
auaaggguaucuggugac

SEQ ID NO: 1725731 - RNA, 13 nt, Human
auaauggucagag

SEQ ID NO: 1725732 - RNA, 14 nt, Human
auaauguaagcucu

SEQ ID NO: 1725733 - RNA, 15 nt, Human
auaauguaaauaaag

SEQ ID NO: 1725734 - RNA, 22 nt, Human
auacacuuacacuuuaugcaca

SEQ ID NO: 1725735 - RNA, 13 nt, Human
auacacuuacacu

SEQ ID NO: 1725736 - RNA, 14 nt, Human
auacaaugcugugc

SEQ ID NO: 1725737 - RNA, 17 nt, Human
auacaaugcugugcccu

SEQ ID NO: 1725738 - RNA, 17 nt, Human
auacccacccccaccca

SEQ ID NO: 1725739 - RNA, 19 nt, Human
auacccccugcaaagccca

SEQ ID NO: 1725740 - RNA, 17 nt, Human
auacccccugcaaagcc

SEQ ID NO: 1725741 - RNA, 16 nt, Human
auacccacccccaccc

SEQ ID NO: 1725742 - RNA, 14 nt, Human
auacccacccccac

SEQ ID NO: 1725743 - RNA, 13 nt, Human
auacccaccccca

SEQ ID NO: 1725744 - RNA, 17 nt, Human
auaccugucccccugac

SEQ ID NO: 1725745 - RNA, 20 nt, Human
auacccccugcaaagcccag

SEQ ID NO: 1725746 - RNA, 16 nt, Human
auaccugucccccuga

SEQ ID NO: 1725747 - RNA, 15 nt, Human
auaccugucccccug

SEQ ID NO: 1725748 - RNA, 14 nt, Human
auaccugucccccu

SEQ ID NO: 1725749 - RNA, 21 nt, Human
auacccccugcaaagcccagc

SEQ ID NO: 1725750 - RNA, 14 nt, Human
auaacaaugaaagu

SEQ ID NO: 1725751 - RNA, 20 nt, Human
auaacauguaauuaaguacu

SEQ ID NO: 1725752 - RNA, 18 nt, Human
auaacauguaauuaagua

SEQ ID NO: 1725753 - RNA, 13 nt, Human
auaacauguaauu

SEQ ID NO: 1725754 - RNA, 12 nt, Human
auaacauguaau

SEQ ID NO: 1725755 - RNA, 23 nt, Human
aguuugauuaaauucuugcaaag

SEQ ID NO: 1725756 - RNA, 19 nt, Human
aguuugagaucagccuggg

SEQ ID NO: 1725757 - RNA, 18 nt, Human
aguuugagaucagccugg

SEQ ID NO: 1725758 - RNA, 20 nt, Human
aguuugagaucagccugggc

SEQ ID NO: 1725759 - RNA, 16 nt, Human
aguuugauuaaauucu

SEQ ID NO: 1725760 - RNA, 17 nt, Human
aguuugauuaaauucuu

SEQ ID NO: 1725761 - RNA, 18 nt, Human
aguuugauuaaauucuug

SEQ ID NO: 1725762 - RNA, 20 nt, Human
aguuugauuaaauucuugca

SEQ ID NO: 1725763 - RNA, 22 nt, Human
aguuugauuaaauucuugcaaa

SEQ ID NO: 1725764 - RNA, 19 nt, Human
aguuguuacauuuuuaagu

SEQ ID NO: 1725765 - RNA, 20 nt, Human
aguuguuacauuuuuaagug

SEQ ID NO: 1725766 - RNA, 22 nt, Human
aguuguuacauuuuuaagugcu

SEQ ID NO: 1725767 - RNA, 15 nt, Human
aguuguuagauuaag

SEQ ID NO: 1725768 - RNA, 22 nt, Human
auacuuugcagcacagcugaga

SEQ ID NO: 1725769 - RNA, 18 nt, Human
auagcagcuuauucacaa

SEQ ID NO: 1725770 - RNA, 15 nt, Human
auagcagcuuauuca

SEQ ID NO: 1725771 - RNA, 15 nt, Human
auagcauuguaaaag

SEQ ID NO: 1725772 - RNA, 18 nt, Human
auagcacagacccugccc

SEQ ID NO: 1725773 - RNA, 17 nt, Human
auagcacagacccugcc

SEQ ID NO: 1725774 - RNA, 17 nt, Human
auagccuaggugacaga

SEQ ID NO: 1725775 - RNA, 15 nt, Human
auagccuaggugaca

SEQ ID NO: 1725776 - RNA, 14 nt, Human
auaguaaaaauaaa

SEQ ID NO: 1725777 - RNA, 13 nt, Human
auaguaaaaauaa

SEQ ID NO: 1725778 - RNA, 22 nt, Human
auauuauuuuauguugcauaga

SEQ ID NO: 1725779 - RNA, 15 nt, Human
auauuauuuuauguu

SEQ ID NO: 1725780 - RNA, 19 nt, Human
auauucaggaagcucaggg

SEQ ID NO: 1725781 - RNA, 17 nt, Human
auaugcucugcauguua

SEQ ID NO: 1725782 - RNA, 16 nt, Human
auaugcucugcauguu

SEQ ID NO: 1725783 - RNA, 20 nt, Human
auaugcucugcauguuacau

SEQ ID NO: 1725784 - RNA, 16 nt, Human
auaugcaguuuuccuu

SEQ ID NO: 1725785 - RNA, 17 nt, Human
auccucauacccacccc

SEQ ID NO: 1725786 - RNA, 19 nt, Human
auccucaguuuuugugaaa

SEQ ID NO: 1725787 - RNA, 15 nt, Human
aucccggcugcccuu

SEQ ID NO: 1725788 - RNA, 18 nt, Human
auccccaagccuggcaag

SEQ ID NO: 1725789 - RNA, 19 nt, Human
aucccaugagccucagcau

SEQ ID NO: 1725790 - RNA, 19 nt, Human
auccagacccggcugcgug

SEQ ID NO: 1725791 - RNA, 13 nt, Human
auccacucgccuu

SEQ ID NO: 1725792 - RNA, 14 nt, Human
aucaugucuggcua

SEQ ID NO: 1725793 - RNA, 12 nt, Human
aucaugugaaau

SEQ ID NO: 1725794 - RNA, 23 nt, Human
aucaaagagguuuuaaaaaaauc

SEQ ID NO: 1725795 - RNA, 20 nt, Human
aucaaagagguuuuaaaaaa

SEQ ID NO: 1725796 - RNA, 14 nt, Human
aucaaauauauuca

SEQ ID NO: 1725797 - RNA, 13 nt, Human
aucaccagacagg

SEQ ID NO: 1725798 - RNA, 23 nt, Human
aucacccgcuaagagggagggag

SEQ ID NO: 1725799 - RNA, 22 nt, Human
aucaaauauauucagccuggcu

SEQ ID NO: 1725800 - RNA, 13 nt, Human
aucacagccucug

SEQ ID NO: 1725801 - RNA, 21 nt, Human
aucucccuuuuccaugacugu

SEQ ID NO: 1725802 - RNA, 21 nt, Human
aucuauaggaagauugaaccu

SEQ ID NO: 1725803 - RNA, 18 nt, Human
aucugggggccucuucug

SEQ ID NO: 1725804 - RNA, 16 nt, Human
aucucugcuuuggaaa

SEQ ID NO: 1725805 - RNA, 22 nt, Human
aucuggacuccucuguccaggc

SEQ ID NO: 1725806 - RNA, 21 nt, Human
augaaguacucauacauguua

SEQ ID NO: 1725807 - RNA, 15 nt, Human
augaccacacuccag

SEQ ID NO: 1725808 - RNA, 18 nt, Human
augaccacacuccagcug

SEQ ID NO: 1725809 - RNA, 13 nt, Human
augaggcauuugu

SEQ ID NO: 1725810 - RNA, 14 nt, Human
augaggcauuuguu

SEQ ID NO: 1725811 - RNA, 21 nt, Human
augaggcauuuguuugaacug

SEQ ID NO: 1725812 - RNA, 22 nt, Human
augaggcauuuguuugaacuga

SEQ ID NO: 1725813 - RNA, 16 nt, Human
augaaaacacauuuuu

SEQ ID NO: 1725814 - RNA, 14 nt, Human
augaaaacacauuu

SEQ ID NO: 1725815 - RNA, 15 nt, Human
augaaaacacauuuu

SEQ ID NO: 1725816 - RNA, 23 nt, Human
augcacaaauucugucucuggau

SEQ ID NO: 1725817 - RNA, 22 nt, Human
augcacaaauucugucucugga

SEQ ID NO: 1725818 - RNA, 15 nt, Human
augcacaaauucugu

SEQ ID NO: 1725819 - RNA, 18 nt, Human
augcacaaacagaggccg

SEQ ID NO: 1725820 - RNA, 15 nt, Human
augaugauccuaggc

SEQ ID NO: 1725821 - RNA, 18 nt, Human
augaugaaaugaggucag

SEQ ID NO: 1725822 - RNA, 23 nt, Human
augaugaaaugaggucagagccu

SEQ ID NO: 1725823 - RNA, 17 nt, Human
augaucuuugcagacag

SEQ ID NO: 1725824 - RNA, 21 nt, Human
augaucuuugcagacaggcaa

SEQ ID NO: 1725825 - RNA, 19 nt, Human
augaucuuugcagacaggc

SEQ ID NO: 1725826 - RNA, 18 nt, Human
augaucuuugcagacagg

SEQ ID NO: 1725827 - RNA, 13 nt, Human
augcacacauuuu

SEQ ID NO: 1725828 - RNA, 14 nt, Human
augcacacauuuuu

SEQ ID NO: 1725829 - RNA, 15 nt, Human
augcacacauuuuuu

SEQ ID NO: 1725830 - RNA, 19 nt, Human
augcacagaguuguuacau

SEQ ID NO: 1725831 - RNA, 21 nt, Human
augcacagaguuguuacauuu

SEQ ID NO: 1725832 - RNA, 22 nt, Human
augcacagaguuguuacauuuu

SEQ ID NO: 1725833 - RNA, 23 nt, Human
augcacagaguuguuacauuuuu

SEQ ID NO: 1725834 - RNA, 20 nt, Human
augccuggauggggcugcac

SEQ ID NO: 1725835 - RNA, 19 nt, Human
augccuggauggggcugca

SEQ ID NO: 1725836 - RNA, 19 nt, Human
augccugucuuaauuuucu

SEQ ID NO: 1725837 - RNA, 18 nt, Human
auggauaggcacaggaaa

SEQ ID NO: 1725838 - RNA, 17 nt, Human
auggauaggcacaggaa

SEQ ID NO: 1725839 - RNA, 18 nt, Human
auggcugugccucugccu

SEQ ID NO: 1725840 - RNA, 17 nt, Human
auggcugugccucugcc

SEQ ID NO: 1725841 - RNA, 16 nt, Human
auggcugugccucugc

SEQ ID NO: 1725842 - RNA, 15 nt, Human
auggcugugccucug

SEQ ID NO: 1725843 - RNA, 18 nt, Human
augcuuuaggauguacag

SEQ ID NO: 1725844 - RNA, 16 nt, Human
augcuuguacauaaug

SEQ ID NO: 1725845 - RNA, 15 nt, Human
augcuuguacauaau

SEQ ID NO: 1725846 - RNA, 21 nt, Human
augcuuuaggauguacaguua

SEQ ID NO: 1725847 - RNA, 18 nt, Human
auggcuuuugugcauuau

SEQ ID NO: 1725848 - RNA, 16 nt, Human
auggcuuuugugcauu

SEQ ID NO: 1725849 - RNA, 17 nt, Human
auggcuuuugugcauua

SEQ ID NO: 1725850 - RNA, 19 nt, Human
augcugacuguacuccucc

SEQ ID NO: 1725851 - RNA, 21 nt, Human
augcugacuguacuccuccca

SEQ ID NO: 1725852 - RNA, 20 nt, Human
augcugacuguacuccuccc

SEQ ID NO: 1725853 - RNA, 15 nt, Human
augcugcccugugag

SEQ ID NO: 1725854 - RNA, 14 nt, Human
augcugcccuguga

SEQ ID NO: 1725855 - RNA, 13 nt, Human
augcugcccugug

SEQ ID NO: 1725856 - RNA, 16 nt, Human
augcugcccugugagu

SEQ ID NO: 1725857 - RNA, 15 nt, Human
augcugccuccagaa

SEQ ID NO: 1725858 - RNA, 12 nt, Human
augcugccucca

SEQ ID NO: 1725859 - RNA, 12 nt, Human
auguaauuuugu

SEQ ID NO: 1725860 - RNA, 13 nt, Human
augucacaggcag

SEQ ID NO: 1725861 - RNA, 15 nt, Human
auguaauuuugugua

SEQ ID NO: 1725862 - RNA, 16 nt, Human
auguaauuuuguguaa

SEQ ID NO: 1725863 - RNA, 17 nt, Human
auguaauuuuguguaag

SEQ ID NO: 1725864 - RNA, 22 nt, Human
auguaauuuuguguaagaaaua

SEQ ID NO: 1725865 - RNA, 23 nt, Human
auguaauuuuguguaagaaauac

SEQ ID NO: 1725866 - RNA, 18 nt, Human
augugaaaucauucauuu

SEQ ID NO: 1725867 - RNA, 17 nt, Human
augugaaaucauucauu

SEQ ID NO: 1725868 - RNA, 19 nt, Human
augucacaggcagguccag

SEQ ID NO: 1725869 - RNA, 14 nt, Human
augucacaggcagg

SEQ ID NO: 1725870 - RNA, 14 nt, Human
augugaaacauguu

SEQ ID NO: 1725871 - RNA, 23 nt, Human
augggugcuuggaggaaggaaac

SEQ ID NO: 1725872 - RNA, 21 nt, Human
augggugcuuggaggaaggaa

SEQ ID NO: 1725873 - RNA, 20 nt, Human
augggugcuuggaggaagga

SEQ ID NO: 1725874 - RNA, 13 nt, Human
auguguaaguauu

SEQ ID NO: 1725875 - RNA, 13 nt, Human
auguucucugagg

SEQ ID NO: 1725876 - RNA, 17 nt, Human
auguucucucuucucca

SEQ ID NO: 1725877 - RNA, 14 nt, Human
auguucugggacac

SEQ ID NO: 1725878 - RNA, 17 nt, Human
auguucucugaggacac

SEQ ID NO: 1725879 - RNA, 15 nt, Human
auguucugggacaca

SEQ ID NO: 1725880 - RNA, 14 nt, Human
auguuugccucugc

SEQ ID NO: 1725881 - RNA, 17 nt, Human
auguuugccucugccuc

SEQ ID NO: 1725882 - RNA, 15 nt, Human
auguuugccucugcc

SEQ ID NO: 1725883 - RNA, 14 nt, Human
auguucuuaauucu

SEQ ID NO: 1725884 - RNA, 19 nt, Human
caauagauauuuaccuuuu

SEQ ID NO: 1725885 - RNA, 18 nt, Human
caauaauaauaccucccu

SEQ ID NO: 1725886 - RNA, 17 nt, Human
caauaggaaaaacugau

SEQ ID NO: 1725887 - RNA, 16 nt, Human
caauaggaaaaacuga

SEQ ID NO: 1725888 - RNA, 15 nt, Human
caauaggaaaaacug

SEQ ID NO: 1725889 - RNA, 19 nt, Human
caaggguagggugggccuu

SEQ ID NO: 1725890 - RNA, 18 nt, Human
caaggcugggggaagaag

SEQ ID NO: 1725891 - RNA, 18 nt, Human
caaggaaaaaauaacaau

SEQ ID NO: 1725892 - RNA, 23 nt, Human
caagcuggucccacucaguccau

SEQ ID NO: 1725893 - RNA, 22 nt, Human
caagcuggucccacucagucca

SEQ ID NO: 1725894 - RNA, 20 nt, Human
caaggaaaaaauaacaauga

SEQ ID NO: 1725895 - RNA, 22 nt, Human
caaggcugcagugagccgagau

SEQ ID NO: 1725896 - RNA, 17 nt, Human
caaggcugcagugagcc

SEQ ID NO: 1725897 - RNA, 20 nt, Human
caaggauccugagccagauu

SEQ ID NO: 1725898 - RNA, 22 nt, Human
caaggauccugagccagauuuc

SEQ ID NO: 1725899 - RNA, 19 nt, Human
caaggauccugagccagau

SEQ ID NO: 1725900 - RNA, 18 nt, Human
caaggauccugagccaga

SEQ ID NO: 1725901 - RNA, 16 nt, Human
caaggagauuuacaac

SEQ ID NO: 1725902 - RNA, 21 nt, Human
caagcugcacccucaggcagg

SEQ ID NO: 1725903 - RNA, 18 nt, Human
caagcgauucuucugcuu

SEQ ID NO: 1725904 - RNA, 17 nt, Human
caagcgauucuucugcu

SEQ ID NO: 1725905 - RNA, 15 nt, Human
caagcgauucuucug

SEQ ID NO: 1725906 - RNA, 21 nt, Human
caagcuggucccacucagucc

SEQ ID NO: 1725907 - RNA, 22 nt, Human
caagcugcacccucaggcaggu

SEQ ID NO: 1725908 - RNA, 18 nt, Human
caauaggaaaaacugauu

SEQ ID NO: 1725909 - RNA, 18 nt, Human
caauuacaggaaguacug

SEQ ID NO: 1725910 - RNA, 20 nt, Human
caauuuuuuaagugaaaaua

SEQ ID NO: 1725911 - RNA, 21 nt, Human
caauuuuuuaagugaaaauau

SEQ ID NO: 1725912 - RNA, 14 nt, Human
cacaaacagaggcc

SEQ ID NO: 1725913 - RNA, 15 nt, Human
cacaaacagaggccg

SEQ ID NO: 1725914 - RNA, 18 nt, Human
cacaaagcccuuccaugu

SEQ ID NO: 1725915 - RNA, 13 nt, Human
cacaaacagaggc

SEQ ID NO: 1725916 - RNA, 22 nt, Human
caaugugacuuaaugccacuaa

SEQ ID NO: 1725917 - RNA, 22 nt, Human
caaugugaaaagaaaaaugagc

SEQ ID NO: 1725918 - RNA, 21 nt, Human
caauaucuuuuuuuuaauaaa

SEQ ID NO: 1725919 - RNA, 17 nt, Human
caauuacaggaaguacu

SEQ ID NO: 1725920 - RNA, 20 nt, Human
cacaagaaaugaaagcaggg

SEQ ID NO: 1725921 - RNA, 21 nt, Human
cacaagaaaugaaagcaggga

SEQ ID NO: 1725922 - RNA, 18 nt, Human
cacaagaaaugaaagcag

SEQ ID NO: 1725923 - RNA, 13 nt, Human
cacaaaggagagc

SEQ ID NO: 1725924 - RNA, 17 nt, Human
cacacacgcgugcacac

SEQ ID NO: 1725925 - RNA, 14 nt, Human
cacacuccagcugg

SEQ ID NO: 1725926 - RNA, 21 nt, Human
cacagagaaaguacuucucca

SEQ ID NO: 1725927 - RNA, 20 nt, Human
cacagagaaaguacuucucc

SEQ ID NO: 1725928 - RNA, 19 nt, Human
cacagagaaaguacuucuc

SEQ ID NO: 1725929 - RNA, 13 nt, Human
cacagaggcugcc

SEQ ID NO: 1725930 - RNA, 15 nt, Human
cacagaggacacaga

SEQ ID NO: 1725931 - RNA, 19 nt, Human
cacagaggacacagagaag

SEQ ID NO: 1725932 - RNA, 22 nt, Human
cacagaguuguuacauuuuuaa

SEQ ID NO: 1725933 - RNA, 23 nt, Human
cacagaugggugcuuggaggaag

SEQ ID NO: 1725934 - RNA, 22 nt, Human
cacagauuugagcucagcccug

SEQ ID NO: 1725935 - RNA, 18 nt, Human
cacagauuugagcucagc

SEQ ID NO: 1725936 - RNA, 17 nt, Human
cacagauuugagcucag

SEQ ID NO: 1725937 - RNA, 16 nt, Human
cacagauuugagcuca

SEQ ID NO: 1725938 - RNA, 14 nt, Human
cacagcugagaggc

SEQ ID NO: 1725939 - RNA, 21 nt, Human
caaaaucgaugcagugcuucc

SEQ ID NO: 1725940 - RNA, 16 nt, Human
caaaauaaaacuuuuu

SEQ ID NO: 1725941 - RNA, 20 nt, Human
caaaauaaaacuuuuuaaaa

SEQ ID NO: 1725942 - RNA, 19 nt, Human
caaaacucuccucugcugc

SEQ ID NO: 1725943 - RNA, 14 nt, Human
caaaaguuucucuu

SEQ ID NO: 1725944 - RNA, 18 nt, Human
caaaaguuuguuugcuua

SEQ ID NO: 1725945 - RNA, 16 nt, Human
caaaacucuccucugc

SEQ ID NO: 1725946 - RNA, 15 nt, Human
caaaacucuccucug

SEQ ID NO: 1725947 - RNA, 21 nt, Human
caaaacgguuuuacugcagcu

SEQ ID NO: 1725948 - RNA, 15 nt, Human
caaaacgguuuuacu

SEQ ID NO: 1725949 - RNA, 18 nt, Human
auuuuauuuuauuaugca

SEQ ID NO: 1725950 - RNA, 15 nt, Human
caaacagaggccgcc

SEQ ID NO: 1725951 - RNA, 13 nt, Human
caaacagaggccg

SEQ ID NO: 1725952 - RNA, 22 nt, Human
caaaaugaaacgcaaccaccac

SEQ ID NO: 1725953 - RNA, 11 nt, Human
caaaaugaaac

SEQ ID NO: 1725954 - RNA, 21 nt, Human
caaaaugagcccuguccugcc

SEQ ID NO: 1725955 - RNA, 12 nt, Human
caaagaaauuuc

SEQ ID NO: 1725956 - RNA, 18 nt, Human
caaagaaauuuccacuca

SEQ ID NO: 1725957 - RNA, 19 nt, Human
caaagaaauuuccacucag

SEQ ID NO: 1725958 - RNA, 21 nt, Human
caaacucuugaccucagguga

SEQ ID NO: 1725959 - RNA, 20 nt, Human
caaacucuugaccucaggug

SEQ ID NO: 1725960 - RNA, 19 nt, Human
caaacucuugaccucaggu

SEQ ID NO: 1725961 - RNA, 17 nt, Human
caaacucuugaccucag

SEQ ID NO: 1725962 - RNA, 13 nt, Human
caacaggcugggc

SEQ ID NO: 1725963 - RNA, 15 nt, Human
caaauuucuaaaucu

SEQ ID NO: 1725964 - RNA, 22 nt, Human
caaauuucuaaaucuccaaaau

SEQ ID NO: 1725965 - RNA, 19 nt, Human
caacauacucccaucugug

SEQ ID NO: 1725966 - RNA, 17 nt, Human
caacauacucccaucug

SEQ ID NO: 1725967 - RNA, 12 nt, Human
caacaggcuggg

SEQ ID NO: 1725968 - RNA, 16 nt, Human
caaccuucuguggcuc

SEQ ID NO: 1725969 - RNA, 16 nt, Human
caaccuggucacagga

SEQ ID NO: 1725970 - RNA, 20 nt, Human
caaccuucuguggcucacag

SEQ ID NO: 1725971 - RNA, 19 nt, Human
caaccuucuguggcucaca

SEQ ID NO: 1725972 - RNA, 17 nt, Human
caaccuucuguggcuca

SEQ ID NO: 1725973 - RNA, 20 nt, Human
caacauacucccaucuguga

SEQ ID NO: 1725974 - RNA, 18 nt, Human
caaccugcucuccucuug

SEQ ID NO: 1725975 - RNA, 23 nt, Human
caaccugcucuccucuugccacu

SEQ ID NO: 1725976 - RNA, 21 nt, Human
caaccugcucuccucuugcca

SEQ ID NO: 1725977 - RNA, 18 nt, Human
caaauguucaucaaugaa

SEQ ID NO: 1725978 - RNA, 14 nt, Human
caaauguucaucaa

SEQ ID NO: 1725979 - RNA, 23 nt, Human
caaauggaaaugggcagagcaga

SEQ ID NO: 1725980 - RNA, 23 nt, Human
caaauauauucagccuggcuuca

SEQ ID NO: 1725981 - RNA, 19 nt, Human
caaagugcugggauuacaa

SEQ ID NO: 1725982 - RNA, 13 nt, Human
caaagugcuggga

SEQ ID NO: 1725983 - RNA, 20 nt, Human
caaaguucccuacuuccugu

SEQ ID NO: 1725984 - RNA, 23 nt, Human
caaagugcugggauuacaagcgu

SEQ ID NO: 1725985 - RNA, 18 nt, Human
caaagugcugggauuaca

SEQ ID NO: 1725986 - RNA, 17 nt, Human
caagaaaugaaagcagg

SEQ ID NO: 1725987 - RNA, 19 nt, Human
caagaaaugaaagcaggga

SEQ ID NO: 1725988 - RNA, 13 nt, Human
caagaagcccagg

SEQ ID NO: 1725989 - RNA, 14 nt, Human
caagaagcccagga

SEQ ID NO: 1725990 - RNA, 16 nt, Human
caacuuguaaaugugg

SEQ ID NO: 1725991 - RNA, 12 nt, Human
caacuugggaac

SEQ ID NO: 1725992 - RNA, 13 nt, Human
caagagcccaggc

SEQ ID NO: 1725993 - RNA, 17 nt, Human
caagagcuuaacagugu

SEQ ID NO: 1725994 - RNA, 15 nt, Human
caagacgcugugcug

SEQ ID NO: 1725995 - RNA, 13 nt, Human
caagacgcugugc

SEQ ID NO: 1725996 - RNA, 23 nt, Human
caagaccuucuccuucaccuuug

SEQ ID NO: 1725997 - RNA, 21 nt, Human
caagaccuucuccuucaccuu

SEQ ID NO: 1725998 - RNA, 17 nt, Human
cacaguucaauucucau

SEQ ID NO: 1725999 - RNA, 13 nt, Human
cacaguggaacca

SEQ ID NO: 1726000 - RNA, 19 nt, Human
cacaguggaaccagcccag

SEQ ID NO: 1726001 - RNA, 19 nt, Human
cacagugcaucucagccca

SEQ ID NO: 1726002 - RNA, 18 nt, Human
cacagugcaucucagccc

SEQ ID NO: 1726003 - RNA, 22 nt, Human
cacaggcccuuccucuccacug

SEQ ID NO: 1726004 - RNA, 21 nt, Human
cacaggcccuuccucuccacu

SEQ ID NO: 1726005 - RNA, 12 nt, Human
cacagcugcuca

SEQ ID NO: 1726006 - RNA, 22 nt, Human
cacagcugcucaauaaaguaca

SEQ ID NO: 1726007 - RNA, 13 nt, Human
cacaggaaaccag

SEQ ID NO: 1726008 - RNA, 19 nt, Human
cacaggcccuuccucucca

SEQ ID NO: 1726009 - RNA, 18 nt, Human
cacaggcccuuccucucc

SEQ ID NO: 1726010 - RNA, 17 nt, Human
cacaggcccuuccucuc

SEQ ID NO: 1726011 - RNA, 16 nt, Human
cacaggcccuuccucu

SEQ ID NO: 1726012 - RNA, 17 nt, Human
uguuaguaugaggcauu

SEQ ID NO: 1726013 - RNA, 19 nt, Human
uguuaguaugaggcauuug

SEQ ID NO: 1726014 - RNA, 20 nt, Human
uguuaguaugaggcauuugu

SEQ ID NO: 1726015 - RNA, 17 nt, Human
uguucauaaauaaaguu

SEQ ID NO: 1726016 - RNA, 22 nt, Human
uguucagcuccagcucaccagc

SEQ ID NO: 1726017 - RNA, 21 nt, Human
uguucagcuccagcucaccag

SEQ ID NO: 1726018 - RNA, 20 nt, Human
uguucagcuccagcucacca

SEQ ID NO: 1726019 - RNA, 14 nt, Human
uguuacuaaguuuu

SEQ ID NO: 1726020 - RNA, 17 nt, Human
uguuagccccauaauuu

SEQ ID NO: 1726021 - RNA, 18 nt, Human
uguguaugcgugugugug

SEQ ID NO: 1726022 - RNA, 19 nt, Human
ugugugcacguacacacac

SEQ ID NO: 1726023 - RNA, 15 nt, Human
ugugugcuuauguau

SEQ ID NO: 1726024 - RNA, 18 nt, Human
uguguuuuucauaaagca

SEQ ID NO: 1726025 - RNA, 20 nt, Human
uguguuuuuaauaaagacag

SEQ ID NO: 1726026 - RNA, 15 nt, Human
uguguuuuucauaaa

SEQ ID NO: 1726027 - RNA, 15 nt, Human
uguguuuuuaauaaa

SEQ ID NO: 1726028 - RNA, 16 nt, Human
uguguuuauugucaaa

SEQ ID NO: 1726029 - RNA, 19 nt, Human
ugugugugcuuauguauga

SEQ ID NO: 1726030 - RNA, 20 nt, Human
ugugugugcuuauguaugag

SEQ ID NO: 1726031 - RNA, 17 nt, Human
ugugugugaaaaugugu

SEQ ID NO: 1726032 - RNA, 19 nt, Human
uguucaucauccuaagcua

SEQ ID NO: 1726033 - RNA, 16 nt, Human
uguucucucuucucca

SEQ ID NO: 1726034 - RNA, 15 nt, Human
uguucucucuucucc

SEQ ID NO: 1726035 - RNA, 16 nt, Human
uguucuggcucuucca

SEQ ID NO: 1726036 - RNA, 13 nt, Human
uguucuggcucuu

SEQ ID NO: 1726037 - RNA, 12 nt, Human
uguucuggcucu

SEQ ID NO: 1726038 - RNA, 13 nt, Human
uguucucugagga

SEQ ID NO: 1726039 - RNA, 16 nt, Human
uguucucugcccucca

SEQ ID NO: 1726040 - RNA, 15 nt, Human
uguucucugcccucc

SEQ ID NO: 1726041 - RNA, 14 nt, Human
uguucucugcccuc

SEQ ID NO: 1726042 - RNA, 13 nt, Human
uguucucugcccu

SEQ ID NO: 1726043 - RNA, 15 nt, Human
uguugaagccuuugu

SEQ ID NO: 1726044 - RNA, 20 nt, Human
uguucuggcucuuccaggcu

SEQ ID NO: 1726045 - RNA, 17 nt, Human
uguucuggcucuuccag

SEQ ID NO: 1726046 - RNA, 21 nt, Human
uguucuggcucuuccaggcug

SEQ ID NO: 1726047 - RNA, 12 nt, Human
uguucugggaca

SEQ ID NO: 1726048 - RNA, 15 nt, Human
uguucugcuuuccuc

SEQ ID NO: 1726049 - RNA, 23 nt, Human
uguucuuucuggcuaugcauuug

SEQ ID NO: 1726050 - RNA, 15 nt, Human
uguugauuaaagaug

SEQ ID NO: 1726051 - RNA, 16 nt, Human
uguugauuaaagauga

SEQ ID NO: 1726052 - RNA, 16 nt, Human
uguuggccaggcuggu

SEQ ID NO: 1726053 - RNA, 15 nt, Human
uguuggccaggcugg

SEQ ID NO: 1726054 - RNA, 15 nt, Human
uguuggccaaagcca

SEQ ID NO: 1726055 - RNA, 14 nt, Human
uguuggcagccucu

SEQ ID NO: 1726056 - RNA, 19 nt, Human
uguuggcugggggccucag

SEQ ID NO: 1726057 - RNA, 17 nt, Human
uguuggcugggggccuc

SEQ ID NO: 1726058 - RNA, 12 nt, Human
uguuuaagagac

SEQ ID NO: 1726059 - RNA, 22 nt, Human
uuaauuaaaacacaacaucuuu

SEQ ID NO: 1726060 - RNA, 15 nt, Human
uuacacauuuuucag

SEQ ID NO: 1726061 - RNA, 16 nt, Human
uuacacuuuuuggaag

SEQ ID NO: 1726062 - RNA, 20 nt, Human
uuacacuuuaugcacaaaau

SEQ ID NO: 1726063 - RNA, 13 nt, Human
uuacacuuuaugc

SEQ ID NO: 1726064 - RNA, 17 nt, Human
uuacacauuuuucagau

SEQ ID NO: 1726065 - RNA, 23 nt, Human
uuacacauuuuucagauauaaaa

SEQ ID NO: 1726066 - RNA, 12 nt, Human
uuacauuuuuaa

SEQ ID NO: 1726067 - RNA, 17 nt, Human
uuacauuuuuaagugcu

SEQ ID NO: 1726068 - RNA, 20 nt, Human
uuaauagcgucauaacuaga

SEQ ID NO: 1726069 - RNA, 14 nt, Human
uuaacuuuuauaaa

SEQ ID NO: 1726070 - RNA, 12 nt, Human
uuaagaguaaaa

SEQ ID NO: 1726071 - RNA, 17 nt, Human
uuaaaugcccagccccu

SEQ ID NO: 1726072 - RNA, 20 nt, Human
uuaaaugcaaccauuugaaa

SEQ ID NO: 1726073 - RNA, 12 nt, Human
uuaacuuuuaua

SEQ ID NO: 1726074 - RNA, 13 nt, Human
uuaacuuuuauaa

SEQ ID NO: 1726075 - RNA, 15 nt, Human
uguuuccuggcacug

SEQ ID NO: 1726076 - RNA, 16 nt, Human
uguuuuaagaggcagg

SEQ ID NO: 1726077 - RNA, 16 nt, Human
uguuuguugucagcug

SEQ ID NO: 1726078 - RNA, 22 nt, Human
uuaaaaaaaaaccugagcccca

SEQ ID NO: 1726079 - RNA, 17 nt, Human
uguuuuaagaggcaggg

SEQ ID NO: 1726080 - RNA, 22 nt, Human
uguuuuaaggaugcuuguacau

SEQ ID NO: 1726081 - RNA, 23 nt, Human
uguuuuaaggaugcuuguacaua

SEQ ID NO: 1726082 - RNA, 18 nt, Human
uuaaagaaaaguuuugua

SEQ ID NO: 1726083 - RNA, 16 nt, Human
uuaaaugcccagcccc

SEQ ID NO: 1726084 - RNA, 15 nt, Human
uuaaaugcccagccc

SEQ ID NO: 1726085 - RNA, 14 nt, Human
uuaaaugcccagcc

SEQ ID NO: 1726086 - RNA, 11 nt, Human
uuaaaugcacc

SEQ ID NO: 1726087 - RNA, 14 nt, Human
uuaaaacccaagug

SEQ ID NO: 1726088 - RNA, 16 nt, Human
ugucccaacuuguaaa

SEQ ID NO: 1726089 - RNA, 16 nt, Human
ugucauuugagcaggg

SEQ ID NO: 1726090 - RNA, 19 nt, Human
ugucauuugagcagggcuc

SEQ ID NO: 1726091 - RNA, 13 nt, Human
ugucaccugaaga

SEQ ID NO: 1726092 - RNA, 22 nt, Human
uguccccaccgcagacaggacc

SEQ ID NO: 1726093 - RNA, 19 nt, Human
uguccccaccgcagacagg

SEQ ID NO: 1726094 - RNA, 18 nt, Human
uguccccaccgcagacag

SEQ ID NO: 1726095 - RNA, 20 nt, Human
uguccuacccacccuccuuu

SEQ ID NO: 1726096 - RNA, 17 nt, Human
uguccccgacccuugcc

SEQ ID NO: 1726097 - RNA, 16 nt, Human
uguccccgacccuugc

SEQ ID NO: 1726098 - RNA, 17 nt, Human
uguccuacucuguguca

SEQ ID NO: 1726099 - RNA, 12 nt, Human
uguccuacucug

SEQ ID NO: 1726100 - RNA, 22 nt, Human
uguauaaaagggacugagaaau

SEQ ID NO: 1726101 - RNA, 22 nt, Human
uguauucucuccuguaccucuu

SEQ ID NO: 1726102 - RNA, 17 nt, Human
ugucacacacuuuggcu

SEQ ID NO: 1726103 - RNA, 12 nt, Human
ugucacaggcag

SEQ ID NO: 1726104 - RNA, 13 nt, Human
ugucacaggcagg

SEQ ID NO: 1726105 - RNA, 20 nt, Human
uguauuuauuuaguauuuau

SEQ ID NO: 1726106 - RNA, 15 nt, Human
uguauuuaaaugaaa

SEQ ID NO: 1726107 - RNA, 14 nt, Human
uguaaucacagcua

SEQ ID NO: 1726108 - RNA, 17 nt, Human
uggucacaggaaguaga

SEQ ID NO: 1726109 - RNA, 16 nt, Human
uguaccgcaaugugac

SEQ ID NO: 1726110 - RNA, 12 nt, Human
uguacaguuuuu

SEQ ID NO: 1726111 - RNA, 21 nt, Human
uguacagucuuguauuaaguu

SEQ ID NO: 1726112 - RNA, 18 nt, Human
uguacagagcccacgccc

SEQ ID NO: 1726113 - RNA, 17 nt, Human
uguacagagcccacgcc

SEQ ID NO: 1726114 - RNA, 16 nt, Human
uguacagagcccacgc

SEQ ID NO: 1726115 - RNA, 17 nt, Human
uguaauuaaguacuaug

SEQ ID NO: 1726116 - RNA, 23 nt, Human
uguacaaggacagccccuccucc

SEQ ID NO: 1726117 - RNA, 20 nt, Human
uguacaaggacagccccucc

SEQ ID NO: 1726118 - RNA, 16 nt, Human
uguacaaggacagccc

SEQ ID NO: 1726119 - RNA, 18 nt, Human
uguagccccucuccugga

SEQ ID NO: 1726120 - RNA, 23 nt, Human
uguagccucaaucgagugagaca

SEQ ID NO: 1726121 - RNA, 15 nt, Human
uguacgucugacagg

SEQ ID NO: 1726122 - RNA, 19 nt, Human
uguacugcauaugaaagga

SEQ ID NO: 1726123 - RNA, 19 nt, Human
ugugcgccuacaggaguga

SEQ ID NO: 1726124 - RNA, 14 nt, Human
ugugcgccuacagg

SEQ ID NO: 1726125 - RNA, 16 nt, Human
ugugcucaggagcccu

SEQ ID NO: 1726126 - RNA, 15 nt, Human
ugugcucaggagccc

SEQ ID NO: 1726127 - RNA, 17 nt, Human
ugugcucaggagcccug

SEQ ID NO: 1726128 - RNA, 20 nt, Human
ugugcucaggagcccuggga

SEQ ID NO: 1726129 - RNA, 14 nt, Human
ugugcuuguuaacu

SEQ ID NO: 1726130 - RNA, 14 nt, Human
ugugcauuaucuag

SEQ ID NO: 1726131 - RNA, 16 nt, Human
ugugcauuaucuagau

SEQ ID NO: 1726132 - RNA, 19 nt, Human
ugugcauuaucuagauacu

SEQ ID NO: 1726133 - RNA, 14 nt, Human
ugugcacguacaca

SEQ ID NO: 1726134 - RNA, 16 nt, Human
ugugcacaugcacgug

SEQ ID NO: 1726135 - RNA, 20 nt, Human
ugugcauuaucuagauacug

SEQ ID NO: 1726136 - RNA, 21 nt, Human
ugugcauuaucuagauacugu

SEQ ID NO: 1726137 - RNA, 23 nt, Human
ugugcauuaucuagauacuguau

SEQ ID NO: 1726138 - RNA, 23 nt, Human
ugugcauuuggugguuucagaaa

SEQ ID NO: 1726139 - RNA, 12 nt, Human
uguguagggcgg

SEQ ID NO: 1726140 - RNA, 16 nt, Human
uguguagggcgggagg

SEQ ID NO: 1726141 - RNA, 22 nt, Human
ugugggcuaguugggcuuccuc

SEQ ID NO: 1726142 - RNA, 22 nt, Human
ugugggcgugagaccugccccu

SEQ ID NO: 1726143 - RNA, 21 nt, Human
ugugggcgugagaccugcccc

SEQ ID NO: 1726144 - RNA, 20 nt, Human
ugugggcgugagaccugccc

SEQ ID NO: 1726145 - RNA, 23 nt, Human
uguggcgcagcauauucaggaag

SEQ ID NO: 1726146 - RNA, 10 nt, Human
uguggcucac

SEQ ID NO: 1726147 - RNA, 19 nt, Human
uguggacacagcucuucuc

SEQ ID NO: 1726148 - RNA, 13 nt, Human
uguggacacagcu

SEQ ID NO: 1726149 - RNA, 18 nt, Human
uguggacacagcucuucu

SEQ ID NO: 1726150 - RNA, 20 nt, Human
ugugaggaagccgcuggggc

SEQ ID NO: 1726151 - RNA, 18 nt, Human
ugugaggaagccgcuggg

SEQ ID NO: 1726152 - RNA, 13 nt, Human
ugugaggaagccg

SEQ ID NO: 1726153 - RNA, 21 nt, Human
ugugagucaccaagcccaguu

SEQ ID NO: 1726154 - RNA, 19 nt, Human
ugugagucaccaagcccag

SEQ ID NO: 1726155 - RNA, 17 nt, Human
ugugagucaccaagccc

SEQ ID NO: 1726156 - RNA, 15 nt, Human
ugugagucaccaagc

SEQ ID NO: 1726157 - RNA, 16 nt, Human
ugugauauaagugugu

SEQ ID NO: 1726158 - RNA, 16 nt, Human
ugucugaagucacugc

SEQ ID NO: 1726159 - RNA, 18 nt, Human
ugucugaagucacugcac

SEQ ID NO: 1726160 - RNA, 17 nt, Human
ugucugaagucacugca

SEQ ID NO: 1726161 - RNA, 20 nt, Human
ugucugaagucacugcacag

SEQ ID NO: 1726162 - RNA, 19 nt, Human
ugucugaagucacugcaca

SEQ ID NO: 1726163 - RNA, 21 nt, Human
ugucuuuucuugcaugaggcu

SEQ ID NO: 1726164 - RNA, 16 nt, Human
ugucuuuggacccuga

SEQ ID NO: 1726165 - RNA, 14 nt, Human
ugucuuuggacccu

SEQ ID NO: 1726166 - RNA, 23 nt, Human
ugucuuuucuugcaugaggcuag

SEQ ID NO: 1726167 - RNA, 23 nt, Human
ugugaaaagaaaaaugagccugg

SEQ ID NO: 1726168 - RNA, 16 nt, Human
ugugaaaaugugugug

SEQ ID NO: 1726169 - RNA, 17 nt, Human
ugugaaaaugugugugu

SEQ ID NO: 1726170 - RNA, 22 nt, Human
ugcucuccucuugccacugccu

SEQ ID NO: 1726171 - RNA, 21 nt, Human
ugcucuccucuugccacugcc

SEQ ID NO: 1726172 - RNA, 18 nt, Human
ugcucuccucuugccacu

SEQ ID NO: 1726173 - RNA, 16 nt, Human
ugcucuccucuugcca

SEQ ID NO: 1726174 - RNA, 18 nt, Human
ugcuccucuccccagcaa

SEQ ID NO: 1726175 - RNA, 17 nt, Human
ugcuccucuccccagca

SEQ ID NO: 1726176 - RNA, 18 nt, Human
ugcuccuuucuuguuuua

SEQ ID NO: 1726177 - RNA, 16 nt, Human
ugcucacauaucuguc

SEQ ID NO: 1726178 - RNA, 15 nt, Human
ugcucacauaucugu

SEQ ID NO: 1726179 - RNA, 17 nt, Human
ugcucagagcaguguuu

SEQ ID NO: 1726180 - RNA, 14 nt, Human
ugcuccucucccca

SEQ ID NO: 1726181 - RNA, 23 nt, Human
ugcugacagacacaggcccggcu

SEQ ID NO: 1726182 - RNA, 22 nt, Human
ugcugacagacacaggcccggc

SEQ ID NO: 1726183 - RNA, 21 nt, Human
ugcugaaggcucgagcaugcc

SEQ ID NO: 1726184 - RNA, 13 nt, Human
ugcugaaggcucg

SEQ ID NO: 1726185 - RNA, 12 nt, Human
ugcugaaggcuc

SEQ ID NO: 1726186 - RNA, 23 nt, Human
ugcugaaggaauaaauugcuccu

SEQ ID NO: 1726187 - RNA, 17 nt, Human
ugcugauggugcaauga

SEQ ID NO: 1726188 - RNA, 15 nt, Human
ugcugauggugcaau

SEQ ID NO: 1726189 - RNA, 13 nt, Human
ugcugauggugca

SEQ ID NO: 1726190 - RNA, 18 nt, Human
ugcugauggugcaaugac

SEQ ID NO: 1726191 - RNA, 14 nt, Human
ugcugcauuuaaaa

SEQ ID NO: 1726192 - RNA, 18 nt, Human
ugcugcaguugccaguca

SEQ ID NO: 1726193 - RNA, 23 nt, Human
ugcugcaguugccagucaccccg

SEQ ID NO: 1726194 - RNA, 13 nt, Human
ugcugcuggcugg

SEQ ID NO: 1726195 - RNA, 18 nt, Human
ugccuguaaucacagcua

SEQ ID NO: 1726196 - RNA, 16 nt, Human
ugccugguggcagcug

SEQ ID NO: 1726197 - RNA, 15 nt, Human
ugccugguggcagcu

SEQ ID NO: 1726198 - RNA, 14 nt, Human
ugccugguggcagc

SEQ ID NO: 1726199 - RNA, 14 nt, Human
ugccugugaacuga

SEQ ID NO: 1726200 - RNA, 18 nt, Human
ugccugggcagaaggaag

SEQ ID NO: 1726201 - RNA, 21 nt, Human
ugccugggaucccucauccuc

SEQ ID NO: 1726202 - RNA, 19 nt, Human
ugccucgaacuggcugcaa

SEQ ID NO: 1726203 - RNA, 18 nt, Human
ugccucgaacuggcugca

SEQ ID NO: 1726204 - RNA, 20 nt, Human
ugccucgaacuggcugcaaa

SEQ ID NO: 1726205 - RNA, 18 nt, Human
ugccccuggcagccccug

SEQ ID NO: 1726206 - RNA, 17 nt, Human
ugccugaagucacacag

SEQ ID NO: 1726207 - RNA, 9 nt, Human
ugccucucu

SEQ ID NO: 1726208 - RNA, 21 nt, Human
ugccugugaacugaacucuga

SEQ ID NO: 1726209 - RNA, 18 nt, Human
ugccugugaacugaacuc

SEQ ID NO: 1726210 - RNA, 17 nt, Human
ugccugugaacugaacu

SEQ ID NO: 1726211 - RNA, 21 nt, Human
ugcgaucuggguucacugcaa

SEQ ID NO: 1726212 - RNA, 20 nt, Human
ugcgaucuggguucacugca

SEQ ID NO: 1726213 - RNA, 19 nt, Human
ugcgaucuggguucacugc

SEQ ID NO: 1726214 - RNA, 15 nt, Human
ugcgaucuggguuca

SEQ ID NO: 1726215 - RNA, 14 nt, Human
ugcgaucuggguuc

SEQ ID NO: 1726216 - RNA, 15 nt, Human
ugcuaaaugugaaug

SEQ ID NO: 1726217 - RNA, 22 nt, Human
ugcgccuacaggagugagcacu

SEQ ID NO: 1726218 - RNA, 16 nt, Human
ugcgccuacaggagug

SEQ ID NO: 1726219 - RNA, 14 nt, Human
ugcgccuacaggag

SEQ ID NO: 1726220 - RNA, 19 nt, Human
ugccaaauauaaauaaaaa

SEQ ID NO: 1726221 - RNA, 22 nt, Human
ugccaaauauaaauaaaaauaa

SEQ ID NO: 1726222 - RNA, 14 nt, Human
ugcaucaagaugug

SEQ ID NO: 1726223 - RNA, 19 nt, Human
ugcaucaagaugugacaug

SEQ ID NO: 1726224 - RNA, 17 nt, Human
ugccaaauauaaauaaa

SEQ ID NO: 1726225 - RNA, 18 nt, Human
ugccaaauauaaauaaaa

SEQ ID NO: 1726226 - RNA, 21 nt, Human
ugcauauuuauaaaaauaaaa

SEQ ID NO: 1726227 - RNA, 20 nt, Human
ugcauauuuauaaaaauaaa

SEQ ID NO: 1726228 - RNA, 20 nt, Human
ugccacccuggggagaaagu

SEQ ID NO: 1726229 - RNA, 22 nt, Human
ugccacuacggaauaguuggcu

SEQ ID NO: 1726230 - RNA, 20 nt, Human
ugccacuaaauugacacuua

SEQ ID NO: 1726231 - RNA, 19 nt, Human
ugccacccuggggagaaag

SEQ ID NO: 1726232 - RNA, 22 nt, Human
ugccagguuuuuggucugaccc

SEQ ID NO: 1726233 - RNA, 19 nt, Human
ugccagguuuuuggucuga

SEQ ID NO: 1726234 - RNA, 18 nt, Human
ugccagguuuuuggucug

SEQ ID NO: 1726235 - RNA, 10 nt, Human
ugccaggcau

SEQ ID NO: 1726236 - RNA, 21 nt, Human
ugccauccagguucagcuugu

SEQ ID NO: 1726237 - RNA, 24 nt, Human
ugccagguuuuuggucugacccac

SEQ ID NO: 1726238 - RNA, 14 nt, Human
ugcccaccuggccu

SEQ ID NO: 1726239 - RNA, 13 nt, Human
ugcccaccuggcc

SEQ ID NO: 1726240 - RNA, 13 nt, Human
ugcccaggcuggc

SEQ ID NO: 1726241 - RNA, 21 nt, Human
ugcccacucccugcaaccuga

SEQ ID NO: 1726242 - RNA, 13 nt, Human
ugcccaggcugga

SEQ ID NO: 1726243 - RNA, 18 nt, Human
ugcccaggcuggagugca

SEQ ID NO: 1726244 - RNA, 20 nt, Human
ugcccaggcuggagugcaau

SEQ ID NO: 1726245 - RNA, 11 nt, Human
ugcccaggcug

SEQ ID NO: 1726246 - RNA, 16 nt, Human
ugcccacucccugcaa

SEQ ID NO: 1726247 - RNA, 15 nt, Human
ugcccacucccugca

SEQ ID NO: 1726248 - RNA, 14 nt, Human
ugcccacucccugc

SEQ ID NO: 1726249 - RNA, 23 nt, Human
ugccccucaacucuccuccagag

SEQ ID NO: 1726250 - RNA, 15 nt, Human
ugccccagggcuccc

SEQ ID NO: 1726251 - RNA, 17 nt, Human
ugccccuggcagccccu

SEQ ID NO: 1726252 - RNA, 13 nt, Human
ugccccucccuuc

SEQ ID NO: 1726253 - RNA, 15 nt, Human
ugcaguugccaguca

SEQ ID NO: 1726254 - RNA, 14 nt, Human
ugcaguugccaguc

SEQ ID NO: 1726255 - RNA, 13 nt, Human
ugcaguugccagu

SEQ ID NO: 1726256 - RNA, 20 nt, Human
ugcaguggugcgaucugggu

SEQ ID NO: 1726257 - RNA, 22 nt, Human
ugcagugguaugaucacggcuc

SEQ ID NO: 1726258 - RNA, 16 nt, Human
ugcagugcuuccaagg

SEQ ID NO: 1726259 - RNA, 14 nt, Human
ugcaggcagccagg

SEQ ID NO: 1726260 - RNA, 13 nt, Human
ugcaggcagccag

SEQ ID NO: 1726261 - RNA, 15 nt, Human
ugcaggcagccaggc

SEQ ID NO: 1726262 - RNA, 15 nt, Human
ugcaccgggccacag

SEQ ID NO: 1726263 - RNA, 14 nt, Human
ugcaccgggccaca

SEQ ID NO: 1726264 - RNA, 23 nt, Human
ugcaccggcuggccuggccccuc

SEQ ID NO: 1726265 - RNA, 19 nt, Human
ugaguccccuguuuguuuc

SEQ ID NO: 1726266 - RNA, 22 nt, Human
ugcaccgggccacagagaaagu

SEQ ID NO: 1726267 - RNA, 17 nt, Human
ugcaccgggccacagag

SEQ ID NO: 1726268 - RNA, 20 nt, Human
ugaguccccuguuuguuucu

SEQ ID NO: 1726269 - RNA, 14 nt, Human
ugcacuuuguucug

SEQ ID NO: 1726270 - RNA, 12 nt, Human
ugcacuuuguuc

SEQ ID NO: 1726271 - RNA, 20 nt, Human
ugcagcaauaaagcagcguu

SEQ ID NO: 1726272 - RNA, 23 nt, Human
ugcagcaauaaagcagcguuucu

SEQ ID NO: 1726273 - RNA, 23 nt, Human
ugcagcacagcugagaggcuguc

SEQ ID NO: 1726274 - RNA, 21 nt, Human
ugcagagcaggaaacaugacu

SEQ ID NO: 1726275 - RNA, 12 nt, Human
ugggacacccug

SEQ ID NO: 1726276 - RNA, 15 nt, Human
uggcuuuugugcauu

SEQ ID NO: 1726277 - RNA, 13 nt, Human
ugggacacccugu

SEQ ID NO: 1726278 - RNA, 14 nt, Human
ugggagcugccugu

SEQ ID NO: 1726279 - RNA, 13 nt, Human
ugggagcugccug

SEQ ID NO: 1726280 - RNA, 12 nt, Human
ugggagcugccu

SEQ ID NO: 1726281 - RNA, 13 nt, Human
ugggagcaaaaga

SEQ ID NO: 1726282 - RNA, 16 nt, Human
ugggauuacaggugug

SEQ ID NO: 1726283 - RNA, 18 nt, Human
ugggauuacaggcuccug

SEQ ID NO: 1726284 - RNA, 13 nt, Human
ugggauccuggag

SEQ ID NO: 1726285 - RNA, 18 nt, Human
ugggauccuccaggugca

SEQ ID NO: 1726286 - RNA, 15 nt, Human
ugggcagaggaaagc

SEQ ID NO: 1726287 - RNA, 17 nt, Human
ugggauuacagguguga

SEQ ID NO: 1726288 - RNA, 21 nt, Human
ugggauuacagggaugagcca

SEQ ID NO: 1726289 - RNA, 22 nt, Human
ugggagcugccuguucagcucc

SEQ ID NO: 1726290 - RNA, 21 nt, Human
ugggagcugccuguucagcuc

SEQ ID NO: 1726291 - RNA, 17 nt, Human
ugggagcugccuguuca

SEQ ID NO: 1726292 - RNA, 15 nt, Human
ugggauccuccaggu

SEQ ID NO: 1726293 - RNA, 15 nt, Human
ugggagugagcuggu

SEQ ID NO: 1726294 - RNA, 21 nt, Human
uggcugggggccucagugcca

SEQ ID NO: 1726295 - RNA, 21 nt, Human
uggcugcuucaaggauccuga

SEQ ID NO: 1726296 - RNA, 21 nt, Human
uggcuugaguuuaaauuguaa

SEQ ID NO: 1726297 - RNA, 14 nt, Human
uggcuuuugugcau

SEQ ID NO: 1726298 - RNA, 20 nt, Human
ugggggaucacagccucuga

SEQ ID NO: 1726299 - RNA, 21 nt, Human
ugggggaucacagccucugaa

SEQ ID NO: 1726300 - RNA, 18 nt, Human
ugggggcugggcagagga

SEQ ID NO: 1726301 - RNA, 17 nt, Human
ugggggcugggcagagg

SEQ ID NO: 1726302 - RNA, 19 nt, Human
ugggggcugggcagaggaa

SEQ ID NO: 1726303 - RNA, 12 nt, Human
ugggggugcauu

SEQ ID NO: 1726304 - RNA, 15 nt, Human
ugggggugcauuuga

SEQ ID NO: 1726305 - RNA, 17 nt, Human
ugggcuucaguggcagc

SEQ ID NO: 1726306 - RNA, 15 nt, Human
ugggcuucaguggca

SEQ ID NO: 1726307 - RNA, 17 nt, Human
ugggcuggugucaccug

SEQ ID NO: 1726308 - RNA, 23 nt, Human
ugggcuggguucuacccaggugc

SEQ ID NO: 1726309 - RNA, 16 nt, Human
ugggcuaguugggcuu

SEQ ID NO: 1726310 - RNA, 22 nt, Human
ugggcuaagugauccucccacc

SEQ ID NO: 1726311 - RNA, 20 nt, Human
ugggcgugagaccugccccu

SEQ ID NO: 1726312 - RNA, 16 nt, Human
ugggcagaggaaagca

SEQ ID NO: 1726313 - RNA, 18 nt, Human
uggguuucuaaagcugcc

SEQ ID NO: 1726314 - RNA, 17 nt, Human
uggguuucuaaagcugc

SEQ ID NO: 1726315 - RNA, 21 nt, Human
uggguuucuaaagcugccagc

SEQ ID NO: 1726316 - RNA, 22 nt, Human
ugguauagaaaugcugguuuuu

SEQ ID NO: 1726317 - RNA, 14 nt, Human
ugguauagaaaugc

SEQ ID NO: 1726318 - RNA, 16 nt, Human
ugguauagaaaugcug

SEQ ID NO: 1726319 - RNA, 13 nt, Human
ugguauagaaaug

SEQ ID NO: 1726320 - RNA, 18 nt, Human
ugguaugaucacggcuca

SEQ ID NO: 1726321 - RNA, 23 nt, Human
ugguauuggcuagagguucaaag

SEQ ID NO: 1726322 - RNA, 16 nt, Human
uggguaacuagggaag

SEQ ID NO: 1726323 - RNA, 19 nt, Human
ugggguuuaucagaauucu

SEQ ID NO: 1726324 - RNA, 16 nt, Human
uggguucuacccaggu

SEQ ID NO: 1726325 - RNA, 15 nt, Human
uggguucuacccagg

SEQ ID NO: 1726326 - RNA, 22 nt, Human
uggguucuacccaggugcuagg

SEQ ID NO: 1726327 - RNA, 14 nt, Human
uggguuaguggaug

SEQ ID NO: 1726328 - RNA, 20 nt, Human
uggauuuaacagaaauguac

SEQ ID NO: 1726329 - RNA, 24 nt, Human
uggauuuaacagaaauguacagca

SEQ ID NO: 1726330 - RNA, 18 nt, Human
uggaggaaggaaacccag

SEQ ID NO: 1726331 - RNA, 12 nt, Human
uggaggaaggaa

SEQ ID NO: 1726332 - RNA, 20 nt, Human
uggaggaaggaaacccagcu

SEQ ID NO: 1726333 - RNA, 15 nt, Human
uggacuccugcacac

SEQ ID NO: 1726334 - RNA, 15 nt, Human
uggacuccucugucc

SEQ ID NO: 1726335 - RNA, 14 nt, Human
uggacucuaaaguc

SEQ ID NO: 1726336 - RNA, 21 nt, Human
uggccagaugcaccagcccuu

SEQ ID NO: 1726337 - RNA, 20 nt, Human
uggccagaugcaccagcccu

SEQ ID NO: 1726338 - RNA, 20 nt, Human
uggccacuccagaccccugg

SEQ ID NO: 1726339 - RNA, 17 nt, Human
uggccacuccagacccc

SEQ ID NO: 1726340 - RNA, 21 nt, Human
uggcacccggccccugcuggu

SEQ ID NO: 1726341 - RNA, 13 nt, Human
uggcagcugcuuu

SEQ ID NO: 1726342 - RNA, 19 nt, Human
uggcaggaguuggaagugu

SEQ ID NO: 1726343 - RNA, 13 nt, Human
uggcagugggagc

SEQ ID NO: 1726344 - RNA, 17 nt, Human
uggaaacagcucgacuu

SEQ ID NO: 1726345 - RNA, 22 nt, Human
uggaaacagcucgacuuuaaaa

SEQ ID NO: 1726346 - RNA, 21 nt, Human
uggaaagacuuuuccaacccu

SEQ ID NO: 1726347 - RNA, 20 nt, Human
uggaaagaguaggaagacuu

SEQ ID NO: 1726348 - RNA, 14 nt, Human
uggaaagaguacuc

SEQ ID NO: 1726349 - RNA, 20 nt, Human
uggaaaaauagccugccucu

SEQ ID NO: 1726350 - RNA, 17 nt, Human
uggaaaaauagccugcc

SEQ ID NO: 1726351 - RNA, 22 nt, Human
uggaauaauccuaaacauauga

SEQ ID NO: 1726352 - RNA, 17 nt, Human
uggaauaaggagaauga

SEQ ID NO: 1726353 - RNA, 15 nt, Human
uggaauauauaacca

SEQ ID NO: 1726354 - RNA, 16 nt, Human
uggaauauauaaccag

SEQ ID NO: 1726355 - RNA, 21 nt, Human
uggaacguuuuuccuguucuu

SEQ ID NO: 1726356 - RNA, 19 nt, Human
uggaauaacauguaauuaa

SEQ ID NO: 1726357 - RNA, 15 nt, Human
uggaauaacauguaa

SEQ ID NO: 1726358 - RNA, 14 nt, Human
uggaauaacaugua

SEQ ID NO: 1726359 - RNA, 19 nt, Human
uggacaugcacagcuaaca

SEQ ID NO: 1726360 - RNA, 13 nt, Human
uggacaugcacag

SEQ ID NO: 1726361 - RNA, 20 nt, Human
uggacucaccucccccaucu

SEQ ID NO: 1726362 - RNA, 18 nt, Human
uggacucaccucccccau

SEQ ID NO: 1726363 - RNA, 16 nt, Human
uggacagaagcagcuc

SEQ ID NO: 1726364 - RNA, 15 nt, Human
uggacagaagcagcu

SEQ ID NO: 1726365 - RNA, 18 nt, Human
uggacagaagcagcucuu

SEQ ID NO: 1726366 - RNA, 17 nt, Human
uggacagaagcagcucu

SEQ ID NO: 1726367 - RNA, 23 nt, Human
ucccuaccgagucucuucuccac

SEQ ID NO: 1726368 - RNA, 22 nt, Human
ucccuaccgagucucuucucca

SEQ ID NO: 1726369 - RNA, 21 nt, Human
ucccuaccgagucucuucucc

SEQ ID NO: 1726370 - RNA, 19 nt, Human
ucccuaccgagucucuucu

SEQ ID NO: 1726371 - RNA, 22 nt, Human
ucccaugagccucagcauccug

SEQ ID NO: 1726372 - RNA, 17 nt, Human
ucccaugagccucagca

SEQ ID NO: 1726373 - RNA, 18 nt, Human
ucccucccuuccucuuuc

SEQ ID NO: 1726374 - RNA, 17 nt, Human
ucccuacuuccugugac

SEQ ID NO: 1726375 - RNA, 14 nt, Human
ucccucccuugggg

SEQ ID NO: 1726376 - RNA, 13 nt, Human
ucccucccuuggg

SEQ ID NO: 1726377 - RNA, 13 nt, Human
ucccucuggggcu

SEQ ID NO: 1726378 - RNA, 17 nt, Human
ucccucuggggcuguuc

SEQ ID NO: 1726379 - RNA, 20 nt, Human
ucccugcacuugcagacucu

SEQ ID NO: 1726380 - RNA, 16 nt, Human
ucccugccaauggacu

SEQ ID NO: 1726381 - RNA, 14 nt, Human
ucccugccaaugga

SEQ ID NO: 1726382 - RNA, 18 nt, Human
ucccugccccucccuuca

SEQ ID NO: 1726383 - RNA, 14 nt, Human
ucccugccccuccc

SEQ ID NO: 1726384 - RNA, 16 nt, Human
ucccugccccccagcc

SEQ ID NO: 1726385 - RNA, 21 nt, Human
ucccuucccacuggaggcaug

SEQ ID NO: 1726386 - RNA, 17 nt, Human
ucccuucccaccucucu

SEQ ID NO: 1726387 - RNA, 16 nt, Human
ucccuucccaccucuc

SEQ ID NO: 1726388 - RNA, 21 nt, Human
uccgcuuucuacccagcgagc

SEQ ID NO: 1726389 - RNA, 21 nt, Human
uccgaaagggacuuggaagcu

SEQ ID NO: 1726390 - RNA, 17 nt, Human
ucccuucuuuuucuucu

SEQ ID NO: 1726391 - RNA, 22 nt, Human
uccgaaagggacuuggaagcuc

SEQ ID NO: 1726392 - RNA, 21 nt, Human
uccuaguuccaccaucaagcc

SEQ ID NO: 1726393 - RNA, 22 nt, Human
uccuaguuccaccaucaagcca

SEQ ID NO: 1726394 - RNA, 17 nt, Human
uccuaguuccaccauca

SEQ ID NO: 1726395 - RNA, 14 nt, Human
uccuaguuccacca

SEQ ID NO: 1726396 - RNA, 18 nt, Human
uccuaagcuauucaguaa

SEQ ID NO: 1726397 - RNA, 16 nt, Human
uccuaagcuauucagu

SEQ ID NO: 1726398 - RNA, 20 nt, Human
uccucaaaacuucagacaua

SEQ ID NO: 1726399 - RNA, 13 nt, Human
uccuccaggugca

SEQ ID NO: 1726400 - RNA, 12 nt, Human
uccuccaggugc

SEQ ID NO: 1726401 - RNA, 22 nt, Human
uccuccaggugcacaagcucca

SEQ ID NO: 1726402 - RNA, 20 nt, Human
uccuccaggugcacaagcuc

SEQ ID NO: 1726403 - RNA, 18 nt, Human
uccuccaggugcacaagc

SEQ ID NO: 1726404 - RNA, 14 nt, Human
uccuccaggugcac

SEQ ID NO: 1726405 - RNA, 12 nt, Human
uccuccucagau

SEQ ID NO: 1726406 - RNA, 15 nt, Human
uccucuggccugugu

SEQ ID NO: 1726407 - RNA, 13 nt, Human
uccucuguacaga

SEQ ID NO: 1726408 - RNA, 15 nt, Human
uccucuguacagagc

SEQ ID NO: 1726409 - RNA, 21 nt, Human
uccuccuuuucacaguucucu

SEQ ID NO: 1726410 - RNA, 13 nt, Human
uccuccuggacuc

SEQ ID NO: 1726411 - RNA, 21 nt, Human
uccucuaggaggucucuaaga

SEQ ID NO: 1726412 - RNA, 15 nt, Human
uccugaggcuccacu

SEQ ID NO: 1726413 - RNA, 21 nt, Human
uccugagccagauuucacucu

SEQ ID NO: 1726414 - RNA, 22 nt, Human
uccucuguccaggcacugcugc

SEQ ID NO: 1726415 - RNA, 19 nt, Human
uccugagccagauuucacu

SEQ ID NO: 1726416 - RNA, 18 nt, Human
uccugagccagauuucac

SEQ ID NO: 1726417 - RNA, 23 nt, Human
uccucuguacagagcccacgccc

SEQ ID NO: 1726418 - RNA, 17 nt, Human
uccugagccagauuuca

SEQ ID NO: 1726419 - RNA, 17 nt, Human
uccucuguccaggcacu

SEQ ID NO: 1726420 - RNA, 16 nt, Human
uccugaggcuccacuu

SEQ ID NO: 1726421 - RNA, 17 nt, Human
uccugaggcuccacuug

SEQ ID NO: 1726422 - RNA, 12 nt, Human
uccugaggcugg

SEQ ID NO: 1726423 - RNA, 19 nt, Human
uccugaggcugggcucccu

SEQ ID NO: 1726424 - RNA, 17 nt, Human
uccugaggcugggcucc

SEQ ID NO: 1726425 - RNA, 16 nt, Human
uccugaggcugggcuc

SEQ ID NO: 1726426 - RNA, 15 nt, Human
uccugaggcugggcu

SEQ ID NO: 1726427 - RNA, 21 nt, Human
uccuuggugucgggcaugaca

SEQ ID NO: 1726428 - RNA, 18 nt, Human
uccuuggugucgggcaug

SEQ ID NO: 1726429 - RNA, 22 nt, Human
uccuuugugaggaagccgcugg

SEQ ID NO: 1726430 - RNA, 18 nt, Human
uccuuugugaggaagccg

SEQ ID NO: 1726431 - RNA, 17 nt, Human
uccuuugugaggaagcc

SEQ ID NO: 1726432 - RNA, 22 nt, Human
uccuuggugucgggcaugacac

SEQ ID NO: 1726433 - RNA, 21 nt, Human
uccuuaccagcagagcaccuu

SEQ ID NO: 1726434 - RNA, 23 nt, Human
uccuugaaaacacuguucucugc

SEQ ID NO: 1726435 - RNA, 22 nt, Human
uccuugaaaacacuguucucug

SEQ ID NO: 1726436 - RNA, 17 nt, Human
uccuuaucaaaggacac

SEQ ID NO: 1726437 - RNA, 15 nt, Human
uccuuaucaaaggac

SEQ ID NO: 1726438 - RNA, 14 nt, Human
uccuuaucaaagga

SEQ ID NO: 1726439 - RNA, 22 nt, Human
uccuuuucgcaggauucuuccu

SEQ ID NO: 1726440 - RNA, 23 nt, Human
ucgcaggauucuuccucccuccc

SEQ ID NO: 1726441 - RNA, 21 nt, Human
ucgcaggauucuuccucccuc

SEQ ID NO: 1726442 - RNA, 17 nt, Human
ucgcaggauucuuccuc

SEQ ID NO: 1726443 - RNA, 15 nt, Human
ucggccuccauccug

SEQ ID NO: 1726444 - RNA, 16 nt, Human
ucggccuccauccuga

SEQ ID NO: 1726445 - RNA, 17 nt, Human
ucggccuccauccugag

SEQ ID NO: 1726446 - RNA, 15 nt, Human
ucggaaaacaugcua

SEQ ID NO: 1726447 - RNA, 18 nt, Human
ucggaaaacaugcuacac

SEQ ID NO: 1726448 - RNA, 23 nt, Human
ucgcccagucuggaaugcagugg

SEQ ID NO: 1726449 - RNA, 19 nt, Human
ucgcccagucuggaaugca

SEQ ID NO: 1726450 - RNA, 14 nt, Human
ucgcccagucugga

SEQ ID NO: 1726451 - RNA, 23 nt, Human
ucucacacaugagcaucaggcca

SEQ ID NO: 1726452 - RNA, 20 nt, Human
ucucacugccaugccagcuu

SEQ ID NO: 1726453 - RNA, 23 nt, Human
ucucacucugucgcccagucugg

SEQ ID NO: 1726454 - RNA, 21 nt, Human
ucucacacaugagcaucaggc

SEQ ID NO: 1726455 - RNA, 16 nt, Human
ucucacacaugagcau

SEQ ID NO: 1726456 - RNA, 18 nt, Human
ucucaaauuucuaaaucu

SEQ ID NO: 1726457 - RNA, 13 nt, Human
ucucaaauuucua

SEQ ID NO: 1726458 - RNA, 22 nt, Human
ucuaucuuugagcgcccacuag

SEQ ID NO: 1726459 - RNA, 14 nt, Human
ucucaaauuucuaa

SEQ ID NO: 1726460 - RNA, 16 nt, Human
ucucaaauuucuaaau

SEQ ID NO: 1726461 - RNA, 15 nt, Human
ucucacuguugccca

SEQ ID NO: 1726462 - RNA, 14 nt, Human
ucucacuguugccc

SEQ ID NO: 1726463 - RNA, 17 nt, Human
ucucacuguugcccagg

SEQ ID NO: 1726464 - RNA, 19 nt, Human
ucuagggaaaaaccagcgu

SEQ ID NO: 1726465 - RNA, 12 nt, Human
ucuagggaaaaa

SEQ ID NO: 1726466 - RNA, 15 nt, Human
ucuagguaaauuaca

SEQ ID NO: 1726467 - RNA, 21 nt, Human
ucuacucgaguuacagacaaa

SEQ ID NO: 1726468 - RNA, 20 nt, Human
ucuacucgaguuacagacaa

SEQ ID NO: 1726469 - RNA, 18 nt, Human
ucuacucuagggaaaaac

SEQ ID NO: 1726470 - RNA, 12 nt, Human
ucuacuaaaaau

SEQ ID NO: 1726471 - RNA, 15 nt, Human
ucuacuaaaaauaca

SEQ ID NO: 1726472 - RNA, 19 nt, Human
ucuacuaaaaauacaaaaa

SEQ ID NO: 1726473 - RNA, 14 nt, Human
ucuacuauuuaugu

SEQ ID NO: 1726474 - RNA, 16 nt, Human
uccaagaagcccagga

SEQ ID NO: 1726475 - RNA, 15 nt, Human
uccaagaagcccagg

SEQ ID NO: 1726476 - RNA, 14 nt, Human
uccaagaagcccag

SEQ ID NO: 1726477 - RNA, 23 nt, Human
ucaugucaaauauuuagauguaa

SEQ ID NO: 1726478 - RNA, 20 nt, Human
uccaagaccuucuccuucac

SEQ ID NO: 1726479 - RNA, 19 nt, Human
uccaagaagcccaggaaag

SEQ ID NO: 1726480 - RNA, 22 nt, Human
uccaagcaggacauggacaagg

SEQ ID NO: 1726481 - RNA, 14 nt, Human
uccaagcaggacau

SEQ ID NO: 1726482 - RNA, 17 nt, Human
uccaagcaaaugugaau

SEQ ID NO: 1726483 - RNA, 15 nt, Human
uccaagcaaauguga

SEQ ID NO: 1726484 - RNA, 20 nt, Human
uccacaagagcccaggccuc

SEQ ID NO: 1726485 - RNA, 21 nt, Human
uccacaagagcccaggccucc

SEQ ID NO: 1726486 - RNA, 18 nt, Human
uccagcaauucuccugcc

SEQ ID NO: 1726487 - RNA, 21 nt, Human
uccagcaauucuccugccuca

SEQ ID NO: 1726488 - RNA, 20 nt, Human
uccagcaauucuccugccuc

SEQ ID NO: 1726489 - RNA, 19 nt, Human
uccagcaauucuccugccu

SEQ ID NO: 1726490 - RNA, 22 nt, Human
uccagauuuuuuacagcugccu

SEQ ID NO: 1726491 - RNA, 15 nt, Human
uccagaugccacaau

SEQ ID NO: 1726492 - RNA, 19 nt, Human
uccagcuggguuggaaaac

SEQ ID NO: 1726493 - RNA, 22 nt, Human
uccagcuggccgggagccugau

SEQ ID NO: 1726494 - RNA, 21 nt, Human
uccagcuggccgggagccuga

SEQ ID NO: 1726495 - RNA, 15 nt, Human
uccagcuggccggga

SEQ ID NO: 1726496 - RNA, 14 nt, Human
uccacccugcucuc

SEQ ID NO: 1726497 - RNA, 13 nt, Human
uccacccugcucu

SEQ ID NO: 1726498 - RNA, 21 nt, Human
uccacccugcucuccgaccag

SEQ ID NO: 1726499 - RNA, 22 nt, Human
uccacugugccaugugccaggu

SEQ ID NO: 1726500 - RNA, 15 nt, Human
uccacuuuaucuuga

SEQ ID NO: 1726501 - RNA, 23 nt, Human
uccacuuagaaauugcauuuccu

SEQ ID NO: 1726502 - RNA, 21 nt, Human
uccacuuagaaauugcauuuc

SEQ ID NO: 1726503 - RNA, 14 nt, Human
uccacuuucuagcc

SEQ ID NO: 1726504 - RNA, 17 nt, Human
uccacuuuaucuugaau

SEQ ID NO: 1726505 - RNA, 19 nt, Human
uccacuuucuagccagagg

SEQ ID NO: 1726506 - RNA, 19 nt, Human
uccagagaguggcuccucc

SEQ ID NO: 1726507 - RNA, 22 nt, Human
uccagagaguggcuccucccgg

SEQ ID NO: 1726508 - RNA, 16 nt, Human
uccaugucgccucugc

SEQ ID NO: 1726509 - RNA, 19 nt, Human
uccaugucgccucugcauu

SEQ ID NO: 1726510 - RNA, 18 nt, Human
uccaugucgccucugcau

SEQ ID NO: 1726511 - RNA, 17 nt, Human
uccaugucgccucugca

SEQ ID NO: 1726512 - RNA, 21 nt, Human
ucccaacucaccccagcccca

SEQ ID NO: 1726513 - RNA, 19 nt, Human
ucccaacucaccccagccc

SEQ ID NO: 1726514 - RNA, 14 nt, Human
ucccaacuuguaaa

SEQ ID NO: 1726515 - RNA, 18 nt, Human
ucccaacucaccccagcc

SEQ ID NO: 1726516 - RNA, 17 nt, Human
ucccaacucaccccagc

SEQ ID NO: 1726517 - RNA, 20 nt, Human
uccauagagagcaagacgcu

SEQ ID NO: 1726518 - RNA, 17 nt, Human
uccauagagagcaagac

SEQ ID NO: 1726519 - RNA, 23 nt, Human
uccauaaucuggacuccucuguc

SEQ ID NO: 1726520 - RNA, 14 nt, Human
ucccacucagucca

SEQ ID NO: 1726521 - RNA, 21 nt, Human
ucccaccuuggcugcagggag

SEQ ID NO: 1726522 - RNA, 19 nt, Human
ucccaccuuggcugcaggg

SEQ ID NO: 1726523 - RNA, 20 nt, Human
ucccaccucucucacuccuu

SEQ ID NO: 1726524 - RNA, 18 nt, Human
ucccaccucagccucccg

SEQ ID NO: 1726525 - RNA, 16 nt, Human
ucccaccucagccucc

SEQ ID NO: 1726526 - RNA, 18 nt, Human
ucccaccucucucacucc

SEQ ID NO: 1726527 - RNA, 17 nt, Human
ucccaccucucucacuc

SEQ ID NO: 1726528 - RNA, 14 nt, Human
ucccaccucucuca

SEQ ID NO: 1726529 - RNA, 16 nt, Human
ucccaugagccucagc

SEQ ID NO: 1726530 - RNA, 15 nt, Human
ucccaugagccucag

SEQ ID NO: 1726531 - RNA, 19 nt, Human
ucccaggcauuccccagga

SEQ ID NO: 1726532 - RNA, 19 nt, Human
ucccaggcugagccucagu

SEQ ID NO: 1726533 - RNA, 16 nt, Human
ucccaggauguacaag

SEQ ID NO: 1726534 - RNA, 18 nt, Human
ucccaggcauuccccagg

SEQ ID NO: 1726535 - RNA, 17 nt, Human
ucccaggcauuccccag

SEQ ID NO: 1726536 - RNA, 14 nt, Human
ucagauauaaaaga

SEQ ID NO: 1726537 - RNA, 15 nt, Human
ucagaucucuaacuu

SEQ ID NO: 1726538 - RNA, 18 nt, Human
ucagcauccuggcacccg

SEQ ID NO: 1726539 - RNA, 17 nt, Human
ucagcauccuggcaccc

SEQ ID NO: 1726540 - RNA, 16 nt, Human
ucagcauccuggcacc

SEQ ID NO: 1726541 - RNA, 15 nt, Human
ucagcauccuggcac

SEQ ID NO: 1726542 - RNA, 13 nt, Human
ucagccucccaaa

SEQ ID NO: 1726543 - RNA, 12 nt, Human
ucagccucccaa

SEQ ID NO: 1726544 - RNA, 15 nt, Human
ucagcacgauuucug

SEQ ID NO: 1726545 - RNA, 16 nt, Human
ucagcacgauuucugu

SEQ ID NO: 1726546 - RNA, 20 nt, Human
ucagcaccuacaguguacag

SEQ ID NO: 1726547 - RNA, 21 nt, Human
ucagcaccuacaguguacagu

SEQ ID NO: 1726548 - RNA, 22 nt, Human
ucagcaccuacaguguacaguc

SEQ ID NO: 1726549 - RNA, 17 nt, Human
ucagcacgauuucuguu

SEQ ID NO: 1726550 - RNA, 18 nt, Human
ucagcacgauuucuguuu

SEQ ID NO: 1726551 - RNA, 15 nt, Human
ucagcugcuacuacu

SEQ ID NO: 1726552 - RNA, 22 nt, Human
ucagcuccagcucaccagcccc

SEQ ID NO: 1726553 - RNA, 21 nt, Human
ucagcuccagcucaccagccc

SEQ ID NO: 1726554 - RNA, 18 nt, Human
ucagcuccagcucaccag

SEQ ID NO: 1726555 - RNA, 16 nt, Human
ucagccugcuccagcu

SEQ ID NO: 1726556 - RNA, 20 nt, Human
ucagccucccgaauagcugg

SEQ ID NO: 1726557 - RNA, 12 nt, Human
ucagccucccga

SEQ ID NO: 1726558 - RNA, 22 nt, Human
ucagccucccaaagugcuggga

SEQ ID NO: 1726559 - RNA, 14 nt, Human
ucaucauccuaagc

SEQ ID NO: 1726560 - RNA, 24 nt, Human
ucauggacuucugccagcauaaua

SEQ ID NO: 1726561 - RNA, 18 nt, Human
ucaguccaugaagaugua

SEQ ID NO: 1726562 - RNA, 15 nt, Human
ucaguccauagcaga

SEQ ID NO: 1726563 - RNA, 18 nt, Human
ucaguccccgugaaggag

SEQ ID NO: 1726564 - RNA, 20 nt, Human
ucagguggggucacucuggc

SEQ ID NO: 1726565 - RNA, 17 nt, Human
ucagguggggucacucu

SEQ ID NO: 1726566 - RNA, 21 nt, Human
ucagguggggucacucuggca

SEQ ID NO: 1726567 - RNA, 17 nt, Human
ucagguggggcagcuug

SEQ ID NO: 1726568 - RNA, 21 nt, Human
ucagguggggcagcuugaggg

SEQ ID NO: 1726569 - RNA, 16 nt, Human
ucagguggggcagcuu

SEQ ID NO: 1726570 - RNA, 15 nt, Human
ucagguggggcagcu

SEQ ID NO: 1726571 - RNA, 20 nt, Human
ucaggugcugccauccaggu

SEQ ID NO: 1726572 - RNA, 18 nt, Human
ucaggugcugccauccag

SEQ ID NO: 1726573 - RNA, 14 nt, Human
ucagguggggcagc

SEQ ID NO: 1726574 - RNA, 18 nt, Human
ucagugugacugaucucu

SEQ ID NO: 1726575 - RNA, 19 nt, Human
ucagucugauucccaagcu

SEQ ID NO: 1726576 - RNA, 17 nt, Human
ucagucugauucccaag

SEQ ID NO: 1726577 - RNA, 17 nt, Human
ucaguuaagccuuugga

SEQ ID NO: 1726578 - RNA, 16 nt, Human
ucaguuaagccuuugg

SEQ ID NO: 1726579 - RNA, 15 nt, Human
ucugccuccucuuca

SEQ ID NO: 1726580 - RNA, 20 nt, Human
ucugccucacauagcuuaca

SEQ ID NO: 1726581 - RNA, 18 nt, Human
ucugccucugacacacag

SEQ ID NO: 1726582 - RNA, 15 nt, Human
ucugccucugacaca

SEQ ID NO: 1726583 - RNA, 21 nt, Human
ucugccucccaucacccgcua

SEQ ID NO: 1726584 - RNA, 20 nt, Human
ucugccucccaucacccgcu

SEQ ID NO: 1726585 - RNA, 17 nt, Human
ucugccucccaucaccc

SEQ ID NO: 1726586 - RNA, 16 nt, Human
ucugccucccaucacc

SEQ ID NO: 1726587 - RNA, 20 nt, Human
ucugccugaagucacacagu

SEQ ID NO: 1726588 - RNA, 19 nt, Human
ucugccugaagucacacag

SEQ ID NO: 1726589 - RNA, 22 nt, Human
ucugccucugacacacagcucu

SEQ ID NO: 1726590 - RNA, 21 nt, Human
ucugccucugacacacagcuc

SEQ ID NO: 1726591 - RNA, 23 nt, Human
ucugccucugacacacagcucug

SEQ ID NO: 1726592 - RNA, 23 nt, Human
ucugccauauucuguuggccagu

SEQ ID NO: 1726593 - RNA, 22 nt, Human
ucugccauauucuguuggccag

SEQ ID NO: 1726594 - RNA, 12 nt, Human
ucugcccacucc

SEQ ID NO: 1726595 - RNA, 16 nt, Human
ucugcccacucccugc

SEQ ID NO: 1726596 - RNA, 14 nt, Human
ucugcccacucccu

SEQ ID NO: 1726597 - RNA, 13 nt, Human
ucugcccacuccc

SEQ ID NO: 1726598 - RNA, 12 nt, Human
ucugccucccau

SEQ ID NO: 1726599 - RNA, 15 nt, Human
ucugccucccaucac

SEQ ID NO: 1726600 - RNA, 13 nt, Human
ucugccucccauc

SEQ ID NO: 1726601 - RNA, 13 nt, Human
ucugcacuccccu

SEQ ID NO: 1726602 - RNA, 21 nt, Human
ucugaggaauccagacccggc

SEQ ID NO: 1726603 - RNA, 18 nt, Human
ucugaggaauccagaccc

SEQ ID NO: 1726604 - RNA, 22 nt, Human
ucugaggaauccagacccggcu

SEQ ID NO: 1726605 - RNA, 23 nt, Human
ucugacccaugcugcccugugag

SEQ ID NO: 1726606 - RNA, 22 nt, Human
ucugacccaugcugcccuguga

SEQ ID NO: 1726607 - RNA, 20 nt, Human
ucugacccaugcugcccugu

SEQ ID NO: 1726608 - RNA, 19 nt, Human
ucugacccaugcugcccug

SEQ ID NO: 1726609 - RNA, 24 nt, Human
ucugagaucaaaacgguuuuacug

SEQ ID NO: 1726610 - RNA, 18 nt, Human
ucugagaggacuuuucuu

SEQ ID NO: 1726611 - RNA, 14 nt, Human
ucugucucagucca

SEQ ID NO: 1726612 - RNA, 13 nt, Human
ucugucuaggaau

SEQ ID NO: 1726613 - RNA, 17 nt, Human
ucugucgcccagucugg

SEQ ID NO: 1726614 - RNA, 12 nt, Human
ucuguccuggga

SEQ ID NO: 1726615 - RNA, 15 nt, Human
ucuguacagagccca

SEQ ID NO: 1726616 - RNA, 14 nt, Human
ucuguacagagccc

SEQ ID NO: 1726617 - RNA, 16 nt, Human
ucuggugacuuuccuc

SEQ ID NO: 1726618 - RNA, 22 nt, Human
ucuggagcccacuguacuugcu

SEQ ID NO: 1726619 - RNA, 16 nt, Human
ucuggagcccacugua

SEQ ID NO: 1726620 - RNA, 12 nt, Human
ucuggagcccac

SEQ ID NO: 1726621 - RNA, 20 nt, Human
ucugccugcccaggccccug

SEQ ID NO: 1726622 - RNA, 18 nt, Human
ucugccugcccaggcccc

SEQ ID NO: 1726623 - RNA, 17 nt, Human
ucugccugcccaggccc

SEQ ID NO: 1726624 - RNA, 13 nt, Human
ucugccugcccag

SEQ ID NO: 1726625 - RNA, 13 nt, Human
ucugcugcuggcu

SEQ ID NO: 1726626 - RNA, 11 nt, Human
ucugcugcugg

SEQ ID NO: 1726627 - RNA, 17 nt, Human
ucugcugacagacacag

SEQ ID NO: 1726628 - RNA, 13 nt, Human
ucugcugaaggaa

SEQ ID NO: 1726629 - RNA, 15 nt, Human
ucugcugcuggcugg

SEQ ID NO: 1726630 - RNA, 14 nt, Human
ucugcugcuggcug

SEQ ID NO: 1726631 - RNA, 17 nt, Human
ucugcugcuggcugguu

SEQ ID NO: 1726632 - RNA, 14 nt, Human
ucuggaauuugaaa

SEQ ID NO: 1726633 - RNA, 18 nt, Human
ucuggacuccucugucca

SEQ ID NO: 1726634 - RNA, 16 nt, Human
ucuggacuccucuguc

SEQ ID NO: 1726635 - RNA, 15 nt, Human
ucuggacuccucugu

SEQ ID NO: 1726636 - RNA, 22 nt, Human
ucuggacuccucuguccaggca

SEQ ID NO: 1726637 - RNA, 21 nt, Human
ugaaaacacauuuuucuuagg

SEQ ID NO: 1726638 - RNA, 23 nt, Human
ugaaaacacuguucucugcccuc

SEQ ID NO: 1726639 - RNA, 22 nt, Human
ugaaaacacuguucucugcccu

SEQ ID NO: 1726640 - RNA, 21 nt, Human
ugaaaacacuguucucugccc

SEQ ID NO: 1726641 - RNA, 20 nt, Human
ugaaaacacuguucucugcc

SEQ ID NO: 1726642 - RNA, 17 nt, Human
ugaaaacacuguucucu

SEQ ID NO: 1726643 - RNA, 16 nt, Human
ucuuuuuauacuauua

SEQ ID NO: 1726644 - RNA, 15 nt, Human
ugaaacacuuugcau

SEQ ID NO: 1726645 - RNA, 12 nt, Human
ugaaaauuuuga

SEQ ID NO: 1726646 - RNA, 14 nt, Human
ugaaaauucagugg

SEQ ID NO: 1726647 - RNA, 20 nt, Human
ugaaaauuaggauuucauga

SEQ ID NO: 1726648 - RNA, 22 nt, Human
ugaaaagaaaaaugagccuggc

SEQ ID NO: 1726649 - RNA, 20 nt, Human
ugaaaagaaaaaugagccug

SEQ ID NO: 1726650 - RNA, 19 nt, Human
ugaaaagaaaaaugagccu

SEQ ID NO: 1726651 - RNA, 18 nt, Human
ugaaaaccacauuggaga

SEQ ID NO: 1726652 - RNA, 13 nt, Human
ucuuguguguuua

SEQ ID NO: 1726653 - RNA, 23 nt, Human
ucuuuccaaaguacacuguuuca

SEQ ID NO: 1726654 - RNA, 12 nt, Human
ucuuucccuccc

SEQ ID NO: 1726655 - RNA, 23 nt, Human
ucuuucccucccuuccucuuucc

SEQ ID NO: 1726656 - RNA, 13 nt, Human
ucuuucccucccu

SEQ ID NO: 1726657 - RNA, 13 nt, Human
ucuuuggacccug

SEQ ID NO: 1726658 - RNA, 15 nt, Human
ucuuuggacccugag

SEQ ID NO: 1726659 - RNA, 14 nt, Human
ucuuuggacccuga

SEQ ID NO: 1726660 - RNA, 16 nt, Human
ucuuuggacccugagg

SEQ ID NO: 1726661 - RNA, 13 nt, Human
ucuuugcagacag

SEQ ID NO: 1726662 - RNA, 23 nt, Human
ucuuugagugaagcugggagaac

SEQ ID NO: 1726663 - RNA, 17 nt, Human
ucuuugcagacaggcaa

SEQ ID NO: 1726664 - RNA, 14 nt, Human
ucuuugcagacagg

SEQ ID NO: 1726665 - RNA, 15 nt, Human
ucuucagaucucuaa

SEQ ID NO: 1726666 - RNA, 20 nt, Human
ucuucaguuaagccuuugga

SEQ ID NO: 1726667 - RNA, 19 nt, Human
ucuucaguuaagccuuugg

SEQ ID NO: 1726668 - RNA, 22 nt, Human
ucuucaguuaagccuuuggaaa

SEQ ID NO: 1726669 - RNA, 22 nt, Human
ucuuauccaacaucaacaucuu

SEQ ID NO: 1726670 - RNA, 14 nt, Human
ucuuauacauuuga

SEQ ID NO: 1726671 - RNA, 21 nt, Human
ucuucagagacuccugcaggc

SEQ ID NO: 1726672 - RNA, 14 nt, Human
ucuucagaucucua

SEQ ID NO: 1726673 - RNA, 13 nt, Human
ucuuauaauuuaa

SEQ ID NO: 1726674 - RNA, 14 nt, Human
ucuuauaauuuaaa

SEQ ID NO: 1726675 - RNA, 23 nt, Human
ucuuagguuggcaaaaaggcagg

SEQ ID NO: 1726676 - RNA, 20 nt, Human
ucuuagguuggcaaaaaggc

SEQ ID NO: 1726677 - RNA, 15 nt, Human
ucuuagauguauaua

SEQ ID NO: 1726678 - RNA, 20 nt, Human
ucugugucagguggggcagc

SEQ ID NO: 1726679 - RNA, 17 nt, Human
ucugugucagguggggc

SEQ ID NO: 1726680 - RNA, 22 nt, Human
ucugugucagguggggcagcuu

SEQ ID NO: 1726681 - RNA, 16 nt, Human
ucuucuuggucucagu

SEQ ID NO: 1726682 - RNA, 20 nt, Human
ucuugaaauauaggaacuua

SEQ ID NO: 1726683 - RNA, 21 nt, Human
ucuugaaauauaggaacuuaa

SEQ ID NO: 1726684 - RNA, 22 nt, Human
ucuugaagacuuuucuuucagc

SEQ ID NO: 1726685 - RNA, 13 nt, Human
ucuugaagacuuu

SEQ ID NO: 1726686 - RNA, 19 nt, Human
ucuugccaaauauaaauaa

SEQ ID NO: 1726687 - RNA, 23 nt, Human
ucuugcauggcaaggacugcagg

SEQ ID NO: 1726688 - RNA, 14 nt, Human
ucuugcucugcuga

SEQ ID NO: 1726689 - RNA, 17 nt, Human
ucuugccacugccucuu

SEQ ID NO: 1726690 - RNA, 16 nt, Human
ucuugccacugccucu

SEQ ID NO: 1726691 - RNA, 23 nt, Human
ucuugcucugcugacagacacag

SEQ ID NO: 1726692 - RNA, 15 nt, Human
ucuugcucugcugac

SEQ ID NO: 1726693 - RNA, 15 nt, Human
ugagaaauaaaguuu

SEQ ID NO: 1726694 - RNA, 22 nt, Human
ugacuuuucuguccgagcuuug

SEQ ID NO: 1726695 - RNA, 14 nt, Human
ugagaggggaacag

SEQ ID NO: 1726696 - RNA, 19 nt, Human
ugagaggcugucuguugua

SEQ ID NO: 1726697 - RNA, 18 nt, Human
ugagaggggaacagacug

SEQ ID NO: 1726698 - RNA, 19 nt, Human
ugagaggggaacagacugg

SEQ ID NO: 1726699 - RNA, 14 nt, Human
ugagaccaaccugg

SEQ ID NO: 1726700 - RNA, 12 nt, Human
ugagaccugccc

SEQ ID NO: 1726701 - RNA, 22 nt, Human
ugagaccugccccuccucucug

SEQ ID NO: 1726702 - RNA, 15 nt, Human
ugagaccugccccuc

SEQ ID NO: 1726703 - RNA, 14 nt, Human
ugagaccugccccu

SEQ ID NO: 1726704 - RNA, 13 nt, Human
ugagaccugcccc

SEQ ID NO: 1726705 - RNA, 13 nt, Human
ugaccauucucca

SEQ ID NO: 1726706 - RNA, 14 nt, Human
ugaccauucuccac

SEQ ID NO: 1726707 - RNA, 16 nt, Human
ugacuuuccucuuugg

SEQ ID NO: 1726708 - RNA, 21 nt, Human
ugacucuuucuauuguuucuu

SEQ ID NO: 1726709 - RNA, 19 nt, Human
ugacucuuggcacagcaug

SEQ ID NO: 1726710 - RNA, 14 nt, Human
ugacucuuggcaca

SEQ ID NO: 1726711 - RNA, 19 nt, Human
ugagcucaggaguuugaga

SEQ ID NO: 1726712 - RNA, 11 nt, Human
ugagcucagga

SEQ ID NO: 1726713 - RNA, 12 nt, Human
ugagcucagccc

SEQ ID NO: 1726714 - RNA, 11 nt, Human
ugagcucagcc

SEQ ID NO: 1726715 - RNA, 20 nt, Human
ugagcucagcccuggugggc

SEQ ID NO: 1726716 - RNA, 22 nt, Human
ugagccgagaucacgccacugc

SEQ ID NO: 1726717 - RNA, 23 nt, Human
ugagcagggcucagcggggacag

SEQ ID NO: 1726718 - RNA, 22 nt, Human
ugagcagggcucagcggggaca

SEQ ID NO: 1726719 - RNA, 20 nt, Human
ugagcagggcucagcgggga

SEQ ID NO: 1726720 - RNA, 23 nt, Human
ugagccgagaucacgccacugca

SEQ ID NO: 1726721 - RNA, 22 nt, Human
ugaggaugaaaaaauaacacug

SEQ ID NO: 1726722 - RNA, 19 nt, Human
ugaggaucagaguaaucca

SEQ ID NO: 1726723 - RNA, 17 nt, Human
ugaggaucagaguaauc

SEQ ID NO: 1726724 - RNA, 13 nt, Human
ugaggaucagagu

SEQ ID NO: 1726725 - RNA, 23 nt, Human
ugagcuuaagaauuuugagcagg

SEQ ID NO: 1726726 - RNA, 19 nt, Human
ugaggucagagccugcagu

SEQ ID NO: 1726727 - RNA, 18 nt, Human
ugaggucagagccugcag

SEQ ID NO: 1726728 - RNA, 21 nt, Human
ugaggcugggcucccuuccca

SEQ ID NO: 1726729 - RNA, 21 nt, Human
ugagucccaggcugagccuca

SEQ ID NO: 1726730 - RNA, 20 nt, Human
ugagucccaggcugagccuc

SEQ ID NO: 1726731 - RNA, 16 nt, Human
ugaggcugggcucccu

SEQ ID NO: 1726732 - RNA, 15 nt, Human
ugaggcugggcuccc

SEQ ID NO: 1726733 - RNA, 18 nt, Human
ugaggcucugcccuuggu

SEQ ID NO: 1726734 - RNA, 16 nt, Human
ugaggcucugcccuug

SEQ ID NO: 1726735 - RNA, 20 nt, Human
ugaagacucauucuucugua

SEQ ID NO: 1726736 - RNA, 19 nt, Human
ugaagacucauucuucugu

SEQ ID NO: 1726737 - RNA, 13 nt, Human
ugaaacauguuuc

SEQ ID NO: 1726738 - RNA, 16 nt, Human
ugaaacacuuugcaua

SEQ ID NO: 1726739 - RNA, 18 nt, Human
ugaaggccccgcccaggc

SEQ ID NO: 1726740 - RNA, 16 nt, Human
ugaagcuuuuauguga

SEQ ID NO: 1726741 - RNA, 21 nt, Human
ugaagcuuuuaugugaaacau

SEQ ID NO: 1726742 - RNA, 20 nt, Human
ugaaggccccgcccaggcuu

SEQ ID NO: 1726743 - RNA, 19 nt, Human
ugaaggccccgcccaggcu

SEQ ID NO: 1726744 - RNA, 15 nt, Human
ugaaugaauggcuaa

SEQ ID NO: 1726745 - RNA, 20 nt, Human
ugaaugaauggcuaagcaaa

SEQ ID NO: 1726746 - RNA, 14 nt, Human
ugaaugcauaaaau

SEQ ID NO: 1726747 - RNA, 16 nt, Human
ugaaucuuggugucua

SEQ ID NO: 1726748 - RNA, 21 nt, Human
ugaaggcuggguucugauccu

SEQ ID NO: 1726749 - RNA, 20 nt, Human
ugaaggcuggguucugaucc

SEQ ID NO: 1726750 - RNA, 23 nt, Human
ugaaucacguaaagcuagaaaug

SEQ ID NO: 1726751 - RNA, 17 nt, Human
ugaaucacguaaagcua

SEQ ID NO: 1726752 - RNA, 15 nt, Human
ugacauauuuuugcu

SEQ ID NO: 1726753 - RNA, 18 nt, Human
ugacagacacaggcccgg

SEQ ID NO: 1726754 - RNA, 17 nt, Human
ugacagacacaggcccg

SEQ ID NO: 1726755 - RNA, 23 nt, Human
ugacaucaacugcaucaagaugu

SEQ ID NO: 1726756 - RNA, 22 nt, Human
ugacagagcaagugagacccug

SEQ ID NO: 1726757 - RNA, 16 nt, Human
ugaccacugcagaaga

SEQ ID NO: 1726758 - RNA, 17 nt, Human
ugaccacugcagaagac

SEQ ID NO: 1726759 - RNA, 18 nt, Human
ugaccacugcagaagaca

SEQ ID NO: 1726760 - RNA, 13 nt, Human
ugacauguuuuau

SEQ ID NO: 1726761 - RNA, 23 nt, Human
ugaccagccuccaugcugccucc

SEQ ID NO: 1726762 - RNA, 22 nt, Human
ugaccagccuccaugcugccuc

SEQ ID NO: 1726763 - RNA, 21 nt, Human
ugaccagccuccaugcugccu

SEQ ID NO: 1726764 - RNA, 19 nt, Human
ugacauguguuggcagccu

SEQ ID NO: 1726765 - RNA, 13 nt, Human
ugaauuguaagga

SEQ ID NO: 1726766 - RNA, 21 nt, Human
ugaauuguaaggaaugauuaa

SEQ ID NO: 1726767 - RNA, 23 nt, Human
ugacaacacucauugaccugagg

SEQ ID NO: 1726768 - RNA, 15 nt, Human
ugacaacagacuucu

SEQ ID NO: 1726769 - RNA, 19 nt, Human
ugacaacagacuucugaaa

SEQ ID NO: 1726770 - RNA, 18 nt, Human
ugacaacagacuucugaa

SEQ ID NO: 1726771 - RNA, 13 nt, Human
ugacaacacucau

SEQ ID NO: 1726772 - RNA, 20 nt, Human
ugacaaagguaaaucagacu

SEQ ID NO: 1726773 - RNA, 23 nt, Human
ugacaaggauugcuacuguccua

SEQ ID NO: 1726774 - RNA, 13 nt, Human
ugacagacacagg

SEQ ID NO: 1726775 - RNA, 16 nt, Human
ugacagacacaggccc

SEQ ID NO: 1726776 - RNA, 14 nt, Human
ugacagacacaggc

SEQ ID NO: 1726777 - RNA, 15 nt, Human
ugacacacagcucug

SEQ ID NO: 1726778 - RNA, 14 nt, Human
ugacacacagcucu

SEQ ID NO: 1726779 - RNA, 13 nt, Human
uacagcugccugc

SEQ ID NO: 1726780 - RNA, 14 nt, Human
uacagcugccugca

SEQ ID NO: 1726781 - RNA, 13 nt, Human
uacaggaaguacu

SEQ ID NO: 1726782 - RNA, 18 nt, Human
uacaggaagguagaaaua

SEQ ID NO: 1726783 - RNA, 20 nt, Human
uacagcuugaccgugaggcc

SEQ ID NO: 1726784 - RNA, 23 nt, Human
uacacugugcugagucugaaggc

SEQ ID NO: 1726785 - RNA, 22 nt, Human
uacacugugcugagucugaagg

SEQ ID NO: 1726786 - RNA, 20 nt, Human
uacacuguuucaaacuuuac

SEQ ID NO: 1726787 - RNA, 16 nt, Human
uacacuuacacuuuau

SEQ ID NO: 1726788 - RNA, 22 nt, Human
uacacuguuucaaacuuuacua

SEQ ID NO: 1726789 - RNA, 18 nt, Human
uacagcuaaucagcauuc

SEQ ID NO: 1726790 - RNA, 16 nt, Human
uacagcuaaucagcau

SEQ ID NO: 1726791 - RNA, 23 nt, Human
uacaguucggugagcuacaaaug

SEQ ID NO: 1726792 - RNA, 20 nt, Human
uacaggaugaugacuaugga

SEQ ID NO: 1726793 - RNA, 15 nt, Human
uacaggagugagcac

SEQ ID NO: 1726794 - RNA, 22 nt, Human
uacaggaaguacuggagaaaau

SEQ ID NO: 1726795 - RNA, 15 nt, Human
uacaggaaguacugg

SEQ ID NO: 1726796 - RNA, 14 nt, Human
uacaggaaguacug

SEQ ID NO: 1726797 - RNA, 19 nt, Human
uacaguugaaaaacagcug

SEQ ID NO: 1726798 - RNA, 17 nt, Human
uacaguugaaaaacagc

SEQ ID NO: 1726799 - RNA, 21 nt, Human
uacagcuugaccgugaggcca

SEQ ID NO: 1726800 - RNA, 20 nt, Human
uacaguugaaaaacagcuga

SEQ ID NO: 1726801 - RNA, 18 nt, Human
uacaguuuguuaguauga

SEQ ID NO: 1726802 - RNA, 17 nt, Human
uacauaagauaaaugug

SEQ ID NO: 1726803 - RNA, 16 nt, Human
uacauaagauaaaugu

SEQ ID NO: 1726804 - RNA, 16 nt, Human
uacaugaaaacacauu

SEQ ID NO: 1726805 - RNA, 17 nt, Human
uacaugaaaacacauuu

SEQ ID NO: 1726806 - RNA, 18 nt, Human
uacaugaaaacacauuuu

SEQ ID NO: 1726807 - RNA, 19 nt, Human
uacaugaaaacacauuuuu

SEQ ID NO: 1726808 - RNA, 23 nt, Human
uacaugaaaacacauuuuucuua

SEQ ID NO: 1726809 - RNA, 19 nt, Human
uacaguuuguuaguaugag

SEQ ID NO: 1726810 - RNA, 21 nt, Human
uacaguuuguuaguaugaggc

SEQ ID NO: 1726811 - RNA, 16 nt, Human
uacauaaacaaguccu

SEQ ID NO: 1726812 - RNA, 22 nt, Human
uacauggaauaacauguaauua

SEQ ID NO: 1726813 - RNA, 19 nt, Human
uacauggaauaacauguaa

SEQ ID NO: 1726814 - RNA, 18 nt, Human
uacauggaauaacaugua

SEQ ID NO: 1726815 - RNA, 14 nt, Human
uacauggaauaaca

SEQ ID NO: 1726816 - RNA, 19 nt, Human
uacauuuuuaagugcugca

SEQ ID NO: 1726817 - RNA, 22 nt, Human
uacauuuuuaagugcugcauuu

SEQ ID NO: 1726818 - RNA, 14 nt, Human
uacauuuuuaagug

SEQ ID NO: 1726819 - RNA, 18 nt, Human
uacaaaguagaagucuua

SEQ ID NO: 1726820 - RNA, 14 nt, Human
uacaaaguagaagu

SEQ ID NO: 1726821 - RNA, 13 nt, Human
uaauuuuguguaa

SEQ ID NO: 1726822 - RNA, 19 nt, Human
uaauuuuguguaagaaaua

SEQ ID NO: 1726823 - RNA, 20 nt, Human
uaauuuuguguaagaaauac

SEQ ID NO: 1726824 - RNA, 15 nt, Human
uaauucuaugccugu

SEQ ID NO: 1726825 - RNA, 11 nt, Human
uacacacacac

SEQ ID NO: 1726826 - RNA, 15 nt, Human
uacacacugcauguu

SEQ ID NO: 1726827 - RNA, 21 nt, Human
uacacugugcugagucugaag

SEQ ID NO: 1726828 - RNA, 16 nt, Human
uacucuacccucuuag

SEQ ID NO: 1726829 - RNA, 21 nt, Human
uacugccuauuuuaauaaaca

SEQ ID NO: 1726830 - RNA, 14 nt, Human
uacugccuauuuua

SEQ ID NO: 1726831 - RNA, 22 nt, Human
uacugcccaggccugccuguuc

SEQ ID NO: 1726832 - RNA, 21 nt, Human
uacugcccaggccugccuguu

SEQ ID NO: 1726833 - RNA, 20 nt, Human
uacugcccaggccugccugu

SEQ ID NO: 1726834 - RNA, 19 nt, Human
uacugcccaggccugccug

SEQ ID NO: 1726835 - RNA, 15 nt, Human
uacuccccuccuuga

SEQ ID NO: 1726836 - RNA, 18 nt, Human
uacucgaguuacagacaa

SEQ ID NO: 1726837 - RNA, 22 nt, Human
uacucgaguuacagacaaagcg

SEQ ID NO: 1726838 - RNA, 12 nt, Human
uacuccucccag

SEQ ID NO: 1726839 - RNA, 22 nt, Human
uacuacaguccucccaucucac

SEQ ID NO: 1726840 - RNA, 13 nt, Human
uacuacaguuugu

SEQ ID NO: 1726841 - RNA, 14 nt, Human
uacuacaguuuguu

SEQ ID NO: 1726842 - RNA, 13 nt, Human
uacuuguggacac

SEQ ID NO: 1726843 - RNA, 20 nt, Human
uacuugcucuugaugccugg

SEQ ID NO: 1726844 - RNA, 19 nt, Human
uacuugcucuugaugccug

SEQ ID NO: 1726845 - RNA, 18 nt, Human
uacuugcucuugaugccu

SEQ ID NO: 1726846 - RNA, 14 nt, Human
uacuugcucuugau

SEQ ID NO: 1726847 - RNA, 13 nt, Human
uacuugcucuuga

SEQ ID NO: 1726848 - RNA, 16 nt, Human
uacuguccuacccacc

SEQ ID NO: 1726849 - RNA, 21 nt, Human
uacugucuucaguaagccgug

SEQ ID NO: 1726850 - RNA, 18 nt, Human
uaccucggugccuuccuc

SEQ ID NO: 1726851 - RNA, 21 nt, Human
uaccucuugagccuugaacuu

SEQ ID NO: 1726852 - RNA, 13 nt, Human
uaccuuuuuuaga

SEQ ID NO: 1726853 - RNA, 19 nt, Human
uaccuuuuuuagaguugau

SEQ ID NO: 1726854 - RNA, 22 nt, Human
uaccuuuuuuagaguugauacu

SEQ ID NO: 1726855 - RNA, 17 nt, Human
uacuaaccagcagaaau

SEQ ID NO: 1726856 - RNA, 20 nt, Human
uacuaauagacaauuuauua

SEQ ID NO: 1726857 - RNA, 21 nt, Human
uacuaauagacaauuuauuau

SEQ ID NO: 1726858 - RNA, 14 nt, Human
uacuaaggaaucuu

SEQ ID NO: 1726859 - RNA, 21 nt, Human
uacgaaaagaggggaagagac

SEQ ID NO: 1726860 - RNA, 18 nt, Human
uacgaaaagaggggaaga

SEQ ID NO: 1726861 - RNA, 13 nt, Human
uaccuuuuuuaua

SEQ ID NO: 1726862 - RNA, 16 nt, Human
uaccuuuuuuauacau

SEQ ID NO: 1726863 - RNA, 17 nt, Human
uaccuuuuuuauacaua

SEQ ID NO: 1726864 - RNA, 15 nt, Human
uaccuacauacaauu

SEQ ID NO: 1726865 - RNA, 22 nt, Human
uaccuaacgaaguauccuucag

SEQ ID NO: 1726866 - RNA, 22 nt, Human
uaccgagucucuucuccacugg

SEQ ID NO: 1726867 - RNA, 16 nt, Human
uacccagcgagcccug

SEQ ID NO: 1726868 - RNA, 17 nt, Human
uaccgagucucuucucc

SEQ ID NO: 1726869 - RNA, 21 nt, Human
uaccgagucucuucuccacug

SEQ ID NO: 1726870 - RNA, 18 nt, Human
uaccgagucucuucucca

SEQ ID NO: 1726871 - RNA, 15 nt, Human
uacccacugcucugg

SEQ ID NO: 1726872 - RNA, 23 nt, Human
uacauuuuuaagugcugcauuua

SEQ ID NO: 1726873 - RNA, 15 nt, Human
uagaauuaacacaug

SEQ ID NO: 1726874 - RNA, 16 nt, Human
uagaauuaacacauga

SEQ ID NO: 1726875 - RNA, 18 nt, Human
uagaauuaacacaugauc

SEQ ID NO: 1726876 - RNA, 23 nt, Human
uagaauuaguggcacuugcuuuu

SEQ ID NO: 1726877 - RNA, 14 nt, Human
uacuuguggacaca

SEQ ID NO: 1726878 - RNA, 20 nt, Human
uagacccacuggacucaccu

SEQ ID NO: 1726879 - RNA, 14 nt, Human
uagaguugauacua

SEQ ID NO: 1726880 - RNA, 17 nt, Human
uagaguugauacuacag

SEQ ID NO: 1726881 - RNA, 12 nt, Human
uagagugggagc

SEQ ID NO: 1726882 - RNA, 14 nt, Human
uagagguucaaaga

SEQ ID NO: 1726883 - RNA, 15 nt, Human
uagagguucaaagau

SEQ ID NO: 1726884 - RNA, 11 nt, Human
uagagacaggg

SEQ ID NO: 1726885 - RNA, 22 nt, Human
uagagaaggacccggaggggcc

SEQ ID NO: 1726886 - RNA, 13 nt, Human
uagagaaggaccc

SEQ ID NO: 1726887 - RNA, 19 nt, Human
uagcugggacuacaggcac

SEQ ID NO: 1726888 - RNA, 17 nt, Human
uagcugggacuacaggc

SEQ ID NO: 1726889 - RNA, 15 nt, Human
uagcugggacuacag

SEQ ID NO: 1726890 - RNA, 21 nt, Human
uagcucaggugucccugcacu

SEQ ID NO: 1726891 - RNA, 20 nt, Human
uagcucaggugucccugcac

SEQ ID NO: 1726892 - RNA, 12 nt, Human
uagcucauucuc

SEQ ID NO: 1726893 - RNA, 20 nt, Human
uagccugugccucugggacu

SEQ ID NO: 1726894 - RNA, 18 nt, Human
uagccugugccucuggga

SEQ ID NO: 1726895 - RNA, 16 nt, Human
uagccuaggugacaga

SEQ ID NO: 1726896 - RNA, 16 nt, Human
uagccccucuccugga

SEQ ID NO: 1726897 - RNA, 16 nt, Human
uagauacuguaucaug

SEQ ID NO: 1726898 - RNA, 11 nt, Human
uagcagggaaa

SEQ ID NO: 1726899 - RNA, 16 nt, Human
uagcauacguacacau

SEQ ID NO: 1726900 - RNA, 17 nt, Human
uagcauacguacacauu

SEQ ID NO: 1726901 - RNA, 18 nt, Human
uagcauacguacacauuu

SEQ ID NO: 1726902 - RNA, 19 nt, Human
uagcauacguacacauuuu

SEQ ID NO: 1726903 - RNA, 17 nt, Human
uaguaugaggcauuugu

SEQ ID NO: 1726904 - RNA, 18 nt, Human
uaguaugaggcauuuguu

SEQ ID NO: 1726905 - RNA, 22 nt, Human
uagguuauuuugauguaaagau

SEQ ID NO: 1726906 - RNA, 17 nt, Human
uaggugugggggaagca

SEQ ID NO: 1726907 - RNA, 13 nt, Human
uagguguggggga

SEQ ID NO: 1726908 - RNA, 19 nt, Human
uaggugugacugaauuucu

SEQ ID NO: 1726909 - RNA, 21 nt, Human
uaggugugacugaauuucuuu

SEQ ID NO: 1726910 - RNA, 23 nt, Human
uaggugugacugaauuucuuuug

SEQ ID NO: 1726911 - RNA, 16 nt, Human
uaggugacagagugag

SEQ ID NO: 1726912 - RNA, 11 nt, Human
uaggugacaga

SEQ ID NO: 1726913 - RNA, 11 nt, Human
uagggaaaaac

SEQ ID NO: 1726914 - RNA, 22 nt, Human
uagcuggucuuauuuguaaagc

SEQ ID NO: 1726915 - RNA, 20 nt, Human
uaguuguuugauucagacag

SEQ ID NO: 1726916 - RNA, 22 nt, Human
uaguuguuugauucagacagcu

SEQ ID NO: 1726917 - RNA, 21 nt, Human
uaguuguuugauucagacagc

SEQ ID NO: 1726918 - RNA, 20 nt, Human
uaguggcuuaaaacaacacu

SEQ ID NO: 1726919 - RNA, 16 nt, Human
uaguaugguggcuggg

SEQ ID NO: 1726920 - RNA, 15 nt, Human
uaguaugaggcauuu

SEQ ID NO: 1726921 - RNA, 16 nt, Human
uaguuugauuaaauuc

SEQ ID NO: 1726922 - RNA, 21 nt, Human
uaguuugauuaaauucuugca

SEQ ID NO: 1726923 - RNA, 15 nt, Human
uaguuugauuaaauu

SEQ ID NO: 1726924 - RNA, 15 nt, Human
uauaaacuuuaccuu

SEQ ID NO: 1726925 - RNA, 16 nt, Human
uauaaacuuuaccuuu

SEQ ID NO: 1726926 - RNA, 17 nt, Human
uauaaacuuuaccuuuu

SEQ ID NO: 1726927 - RNA, 18 nt, Human
uauaaacuuuaccuuuuu

SEQ ID NO: 1726928 - RNA, 13 nt, Human
uauaaacuuuacc

SEQ ID NO: 1726929 - RNA, 14 nt, Human
uauaaacuuuaccu

SEQ ID NO: 1726930 - RNA, 11 nt, Human
uauaaacuuua

SEQ ID NO: 1726931 - RNA, 21 nt, Human
uauauuuuuuguuaaaugauu

SEQ ID NO: 1726932 - RNA, 14 nt, Human
uaucaaaagaaaga

SEQ ID NO: 1726933 - RNA, 19 nt, Human
uaucaggugcugccaucca

SEQ ID NO: 1726934 - RNA, 20 nt, Human
uaucaggugcugccauccag

SEQ ID NO: 1726935 - RNA, 11 nt, Human
uauagaaaugc

SEQ ID NO: 1726936 - RNA, 11 nt, Human
uaauguuuccu

SEQ ID NO: 1726937 - RNA, 20 nt, Human
uaauuaaguacuauguauca

SEQ ID NO: 1726938 - RNA, 17 nt, Human
uaauuaaguacuaugua

SEQ ID NO: 1726939 - RNA, 14 nt, Human
uaauuaaguacuau

SEQ ID NO: 1726940 - RNA, 15 nt, Human
uaaugcgugcauacc

SEQ ID NO: 1726941 - RNA, 19 nt, Human
uaaugcgugcauaccacuu

SEQ ID NO: 1726942 - RNA, 22 nt, Human
uaaugcgugcauaccacuuuug

SEQ ID NO: 1726943 - RNA, 23 nt, Human
uaaugcgugcauaccacuuuugu

SEQ ID NO: 1726944 - RNA, 15 nt, Human
uaauggggcggugag

SEQ ID NO: 1726945 - RNA, 19 nt, Human
uaauaugcacacauuuuuu

SEQ ID NO: 1726946 - RNA, 15 nt, Human
uaauaugcacacauu

SEQ ID NO: 1726947 - RNA, 16 nt, Human
uaauaugcacacauuu

SEQ ID NO: 1726948 - RNA, 17 nt, Human
uaauaugcacacauuuu

SEQ ID NO: 1726949 - RNA, 18 nt, Human
uaauaugcacacauuuuu

SEQ ID NO: 1726950 - RNA, 20 nt, Human
uaauauuaaggaagacaaug

SEQ ID NO: 1726951 - RNA, 20 nt, Human
uaauccucuaggaggucucu

SEQ ID NO: 1726952 - RNA, 12 nt, Human
uaaucuaaaugg

SEQ ID NO: 1726953 - RNA, 13 nt, Human
uaaucuaaaugga

SEQ ID NO: 1726954 - RNA, 23 nt, Human
uaaucugggccagaauuucaaac

SEQ ID NO: 1726955 - RNA, 18 nt, Human
uaaucugggccagaauuu

SEQ ID NO: 1726956 - RNA, 22 nt, Human
uaaucuggacuccucuguccag

SEQ ID NO: 1726957 - RNA, 21 nt, Human
uaaucuggacuccucugucca

SEQ ID NO: 1726958 - RNA, 20 nt, Human
uaaucuggacuccucugucc

SEQ ID NO: 1726959 - RNA, 19 nt, Human
uaaucuggacuccucuguc

SEQ ID NO: 1726960 - RNA, 15 nt, Human
uaaucuggacuccuc

SEQ ID NO: 1726961 - RNA, 18 nt, Human
uaaucuggacuccucugu

SEQ ID NO: 1726962 - RNA, 17 nt, Human
uaaucuggacuccucug

SEQ ID NO: 1726963 - RNA, 17 nt, Human
uaaggguaucuggugac

SEQ ID NO: 1726964 - RNA, 20 nt, Human
uaaguauuuuccuguuguca

SEQ ID NO: 1726965 - RNA, 21 nt, Human
uaaguauuuuccuguugucaa

SEQ ID NO: 1726966 - RNA, 20 nt, Human
uaagguggguacgggagggu

SEQ ID NO: 1726967 - RNA, 15 nt, Human
uaaggugugcucuga

SEQ ID NO: 1726968 - RNA, 14 nt, Human
uaagcuauucagua

SEQ ID NO: 1726969 - RNA, 16 nt, Human
uaaggauguucuagca

SEQ ID NO: 1726970 - RNA, 14 nt, Human
uaaggcaaucaugg

SEQ ID NO: 1726971 - RNA, 15 nt, Human
uaagaggcagggucu

SEQ ID NO: 1726972 - RNA, 12 nt, Human
uaagaggcaggg

SEQ ID NO: 1726973 - RNA, 15 nt, Human
uaagccaugggagac

SEQ ID NO: 1726974 - RNA, 12 nt, Human
uaauaaagcugu

SEQ ID NO: 1726975 - RNA, 16 nt, Human
uaagugguguguguau

SEQ ID NO: 1726976 - RNA, 15 nt, Human
uaaguggugugugua

SEQ ID NO: 1726977 - RNA, 15 nt, Human
uaagugcugcauuua

SEQ ID NO: 1726978 - RNA, 16 nt, Human
uaagugcugcauuuaa

SEQ ID NO: 1726979 - RNA, 18 nt, Human
uaagugcugcauuuaaaa

SEQ ID NO: 1726980 - RNA, 22 nt, Human
uaagugcugcauuuaaaagaua

SEQ ID NO: 1726981 - RNA, 13 nt, Human
uaagugaaauaag

SEQ ID NO: 1726982 - RNA, 15 nt, Human
uaagugaaaauauag

SEQ ID NO: 1726983 - RNA, 14 nt, Human
uaagugcugcauuu

SEQ ID NO: 1726984 - RNA, 23 nt, Human
uaagugaggaugaaaaaauaaca

SEQ ID NO: 1726985 - RNA, 12 nt, Human
uaagugagagag

SEQ ID NO: 1726986 - RNA, 22 nt, Human
uaagugauugcugguuuuaguu

SEQ ID NO: 1726987 - RNA, 16 nt, Human
uaacuauguugauaaa

SEQ ID NO: 1726988 - RNA, 23 nt, Human
uaaccaguguuguggauuuaaca

SEQ ID NO: 1726989 - RNA, 16 nt, Human
uaaccacuucagcuga

SEQ ID NO: 1726990 - RNA, 13 nt, Human
uaaccagaucauu

SEQ ID NO: 1726991 - RNA, 11 nt, Human
uaacagaaaug

SEQ ID NO: 1726992 - RNA, 12 nt, Human
uaacagaaaugu

SEQ ID NO: 1726993 - RNA, 19 nt, Human
uaagaaaaaggaugcacag

SEQ ID NO: 1726994 - RNA, 23 nt, Human
uaagaaaaaggaugcacagaguu

SEQ ID NO: 1726995 - RNA, 16 nt, Human
uaagaaaaaggaugca

SEQ ID NO: 1726996 - RNA, 18 nt, Human
uaagaaaaaggaugcaca

SEQ ID NO: 1726997 - RNA, 19 nt, Human
uaagaaccuuuugagugcc

SEQ ID NO: 1726998 - RNA, 24 nt, Human
uaagaaagacuaucuaaauguuga

SEQ ID NO: 1726999 - RNA, 11 nt, Human
uaaauuauuuu

SEQ ID NO: 1727000 - RNA, 17 nt, Human
uaaauucuugcaaagua

SEQ ID NO: 1727001 - RNA, 18 nt, Human
uaaauucuugcaaaguau

SEQ ID NO: 1727002 - RNA, 22 nt, Human
uaaauucuugcaaaguaucccu

SEQ ID NO: 1727003 - RNA, 16 nt, Human
uaaauucuugcaaagu

SEQ ID NO: 1727004 - RNA, 20 nt, Human
uaaauugacacuuaaaaaug

SEQ ID NO: 1727005 - RNA, 23 nt, Human
uaaauugacacuuaaaaaugguu

SEQ ID NO: 1727006 - RNA, 18 nt, Human
uaacaccaugauuaacca

SEQ ID NO: 1727007 - RNA, 18 nt, Human
uaaaugggggugcauuug

SEQ ID NO: 1727008 - RNA, 19 nt, Human
uaaaugggggugcauuuga

SEQ ID NO: 1727009 - RNA, 14 nt, Human
uaaaugggggugca

SEQ ID NO: 1727010 - RNA, 17 nt, Human
uaaaugggggugcauuu

SEQ ID NO: 1727011 - RNA, 22 nt, Human
uaaaugucucuuuaaugucaca

SEQ ID NO: 1727012 - RNA, 20 nt, Human
uaaaugucuaguuguaacac

SEQ ID NO: 1727013 - RNA, 15 nt, Human
uaaauguagaaagug

SEQ ID NO: 1727014 - RNA, 13 nt, Human
uaaaugcccagcc

SEQ ID NO: 1727015 - RNA, 17 nt, Human
uaaaguugguaaaccuu

SEQ ID NO: 1727016 - RNA, 16 nt, Human
uaaaguugguaaaccu

SEQ ID NO: 1727017 - RNA, 17 nt, Human
uaaaugcccagccccuu

SEQ ID NO: 1727018 - RNA, 16 nt, Human
uaaaugcccagccccu

SEQ ID NO: 1727019 - RNA, 15 nt, Human
uaaaugcccagcccc

SEQ ID NO: 1727020 - RNA, 14 nt, Human
uaaaugcccagccc

SEQ ID NO: 1727021 - RNA, 16 nt, Human
uaaauggaaccacucu

SEQ ID NO: 1727022 - RNA, 18 nt, Human
uaaacacucuugaaaaau

SEQ ID NO: 1727023 - RNA, 17 nt, Human
uaaacacucuugaaaaa

SEQ ID NO: 1727024 - RNA, 15 nt, Human
uaaacacucuugaaa

SEQ ID NO: 1727025 - RNA, 21 nt, Human
uaaacaagaccacguuucuaa

SEQ ID NO: 1727026 - RNA, 22 nt, Human
uaaacaagaccacguuucuaaa

SEQ ID NO: 1727027 - RNA, 20 nt, Human
uaaacaagaccacguuucua

SEQ ID NO: 1727028 - RNA, 16 nt, Human
uaaaaucuugaaaaug

SEQ ID NO: 1727029 - RNA, 22 nt, Human
uaaacuugguuuuuaaaaaacu

SEQ ID NO: 1727030 - RNA, 14 nt, Human
uaaaguguuugaaa

SEQ ID NO: 1727031 - RNA, 17 nt, Human
uaaaggcuaccuuugua

SEQ ID NO: 1727032 - RNA, 15 nt, Human
uaaaggcuaccuuug

SEQ ID NO: 1727033 - RNA, 20 nt, Human
uaaagccugaguuugcuuuc

SEQ ID NO: 1727034 - RNA, 14 nt, Human
uaaagcugaaaacu

SEQ ID NO: 1727035 - RNA, 11 nt, Human
uaaagccucaa

SEQ ID NO: 1727036 - RNA, 16 nt, Human
uaaagcagcguuucua

SEQ ID NO: 1727037 - RNA, 17 nt, Human
uaaagcagcguuucuau

SEQ ID NO: 1727038 - RNA, 19 nt, Human
uaaagcagcguuucuauga

SEQ ID NO: 1727039 - RNA, 18 nt, Human
uaaagcaggcagaacuca

SEQ ID NO: 1727040 - RNA, 12 nt, Human
uaaagaaaacug

SEQ ID NO: 1727041 - RNA, 16 nt, Human
uaaagaaaaguuuugu

SEQ ID NO: 1727042 - RNA, 22 nt, Human
uaaagaaaaguuuuguaaauuu

SEQ ID NO: 1727043 - RNA, 15 nt, Human
uaaaacaacacucac

SEQ ID NO: 1727044 - RNA, 22 nt, Human
uaaaacaagcacuaaacaaaga

SEQ ID NO: 1727045 - RNA, 23 nt, Human
uaaaacacaacaucuuuuucuac

SEQ ID NO: 1727046 - RNA, 22 nt, Human
uaaaacacaacaucuuuuucua

SEQ ID NO: 1727047 - RNA, 17 nt, Human
uaaaacacaacaucuuu

SEQ ID NO: 1727048 - RNA, 19 nt, Human
uaaaacacuuccauaaucu

SEQ ID NO: 1727049 - RNA, 19 nt, Human
uaaaaaugguuuaaauggu

SEQ ID NO: 1727050 - RNA, 18 nt, Human
uaaaaaugguuuaaaugg

SEQ ID NO: 1727051 - RNA, 20 nt, Human
uaaaaacagauuuggaaaga

SEQ ID NO: 1727052 - RNA, 22 nt, Human
uaaaaacagauuuggaaagacu

SEQ ID NO: 1727053 - RNA, 17 nt, Human
uaaaaacaaagaaauua

SEQ ID NO: 1727054 - RNA, 21 nt, Human
uaaaaacaaagaaauuaugug

SEQ ID NO: 1727055 - RNA, 21 nt, Human
guuuuuaaggguuuguggaaa

SEQ ID NO: 1727056 - RNA, 17 nt, Human
guuuuuaauaaagacag

SEQ ID NO: 1727057 - RNA, 12 nt, Human
uaaaacauuaaa

SEQ ID NO: 1727058 - RNA, 15 nt, Human
uaaaacauuaaaaua

SEQ ID NO: 1727059 - RNA, 16 nt, Human
uaaaacauuaaaauau

SEQ ID NO: 1727060 - RNA, 19 nt, Human
uaaaacauuaaaauauaau

SEQ ID NO: 1727061 - RNA, 14 nt, Human
uaaaagauacaguu

SEQ ID NO: 1727062 - RNA, 17 nt, Human
uaaaagauacaguuacu

SEQ ID NO: 1727063 - RNA, 20 nt, Human
uaaaagauacaguuacucag

SEQ ID NO: 1727064 - RNA, 21 nt, Human
uaaaagauacaguuacucaga

SEQ ID NO: 1727065 - RNA, 12 nt, Human
uaaaaggugacc

SEQ ID NO: 1727066 - RNA, 19 nt, Human
uaaaaggugaccaaugaug

SEQ ID NO: 1727067 - RNA, 21 nt, Human
uaaaagguaugcaaucaaauc

SEQ ID NO: 1727068 - RNA, 12 nt, Human
uaaaaggagcca

SEQ ID NO: 1727069 - RNA, 16 nt, Human
guuuuaaaaugagaaa

SEQ ID NO: 1727070 - RNA, 15 nt, Human
guuuuaaaaugagaa

SEQ ID NO: 1727071 - RNA, 20 nt, Human
guuuguuucugaaagggacg

SEQ ID NO: 1727072 - RNA, 12 nt, Human
guuuucacucuu

SEQ ID NO: 1727073 - RNA, 11 nt, Human
guuuucacucu

SEQ ID NO: 1727074 - RNA, 24 nt, Human
guuuucaggaguggguugauuuca

SEQ ID NO: 1727075 - RNA, 17 nt, Human
guuuucaaaauaaaaau

SEQ ID NO: 1727076 - RNA, 20 nt, Human
guuuucaaaauuguuacaaa

SEQ ID NO: 1727077 - RNA, 17 nt, Human
guuuuaaaaugagaaau

SEQ ID NO: 1727078 - RNA, 12 nt, Human
guuuuguaaauu

SEQ ID NO: 1727079 - RNA, 14 nt, Human
guuuuguaaauuuc

SEQ ID NO: 1727080 - RNA, 20 nt, Human
guuuuccaugaguccccugu

SEQ ID NO: 1727081 - RNA, 19 nt, Human
guuuuccaugaguccccug

SEQ ID NO: 1727082 - RNA, 20 nt, Human
guuuuccagguuuaagcugu

SEQ ID NO: 1727083 - RNA, 13 nt, Human
guuuuccugaaga

SEQ ID NO: 1727084 - RNA, 18 nt, Human
guuuguuucugaaaggga

SEQ ID NO: 1727085 - RNA, 21 nt, Human
guuugauucagacagcugccu

SEQ ID NO: 1727086 - RNA, 20 nt, Human
guuugauucagacagcugcc

SEQ ID NO: 1727087 - RNA, 16 nt, Human
guuugauucagacagc

SEQ ID NO: 1727088 - RNA, 18 nt, Human
guuugagaucagccuggg

SEQ ID NO: 1727089 - RNA, 23 nt, Human
guuugauuaaauucuugcaaagu

SEQ ID NO: 1727090 - RNA, 17 nt, Human
guuugagaucagccugg

SEQ ID NO: 1727091 - RNA, 19 nt, Human
guuucuuuguaaugaaaac

SEQ ID NO: 1727092 - RNA, 18 nt, Human
guuucuuuguaaugaaaa

SEQ ID NO: 1727093 - RNA, 16 nt, Human
guuucuuuaguuuuug

SEQ ID NO: 1727094 - RNA, 12 nt, Human
guuggcuggggg

SEQ ID NO: 1727095 - RNA, 14 nt, Human
guuggccccugccc

SEQ ID NO: 1727096 - RNA, 13 nt, Human
guuggccccugcc

SEQ ID NO: 1727097 - RNA, 20 nt, Human
guuggccccugcccggcugc

SEQ ID NO: 1727098 - RNA, 19 nt, Human
guuggcugggggccucagu

SEQ ID NO: 1727099 - RNA, 23 nt, Human
guuggcugggggccucagugcca

SEQ ID NO: 1727100 - RNA, 14 nt, Human
guugucaagaauag

SEQ ID NO: 1727101 - RNA, 18 nt, Human
guugucaagaauagcauu

SEQ ID NO: 1727102 - RNA, 22 nt, Human
guugucaagaauagcauuguaa

SEQ ID NO: 1727103 - RNA, 12 nt, Human
guugucagcuga

SEQ ID NO: 1727104 - RNA, 22 nt, Human
guugucugaagucacugcacag

SEQ ID NO: 1727105 - RNA, 19 nt, Human
guugucugaagucacugca

SEQ ID NO: 1727106 - RNA, 14 nt, Human
guugugguuaaucu

SEQ ID NO: 1727107 - RNA, 22 nt, Human
guuguggauuuaacagaaaugu

SEQ ID NO: 1727108 - RNA, 15 nt, Human
guuguuaauaaaagu

SEQ ID NO: 1727109 - RNA, 14 nt, Human
guuguuacauuuuu

SEQ ID NO: 1727110 - RNA, 15 nt, Human
guuguuacauuuuua

SEQ ID NO: 1727111 - RNA, 20 nt, Human
guuguuugauucagacagcu

SEQ ID NO: 1727112 - RNA, 14 nt, Human
guuuagauaauaca

SEQ ID NO: 1727113 - RNA, 15 nt, Human
guuuagauaauacac

SEQ ID NO: 1727114 - RNA, 20 nt, Human
guuuaggauguugaaaaagu

SEQ ID NO: 1727115 - RNA, 19 nt, Human
guuuaggaacuacugagga

SEQ ID NO: 1727116 - RNA, 16 nt, Human
guugcaacuuuguaua

SEQ ID NO: 1727117 - RNA, 14 nt, Human
guugcaacuuugua

SEQ ID NO: 1727118 - RNA, 23 nt, Human
guugauuucagcaccuacagugu

SEQ ID NO: 1727119 - RNA, 15 nt, Human
guugcaggaccucag

SEQ ID NO: 1727120 - RNA, 14 nt, Human
guugauuaaagaug

SEQ ID NO: 1727121 - RNA, 14 nt, Human
guugaagccuuugu

SEQ ID NO: 1727122 - RNA, 13 nt, Human
guugaagccuuug

SEQ ID NO: 1727123 - RNA, 16 nt, Human
guugaagacagagcua

SEQ ID NO: 1727124 - RNA, 18 nt, Human
guuggcaaaaaggcagga

SEQ ID NO: 1727125 - RNA, 20 nt, Human
guuggauuuuugucuugugu

SEQ ID NO: 1727126 - RNA, 14 nt, Human
guuggcaaaaaggc

SEQ ID NO: 1727127 - RNA, 14 nt, Human
guuggauuuuuguc

SEQ ID NO: 1727128 - RNA, 23 nt, Human
guuggccaaagccaaagcuaggc

SEQ ID NO: 1727129 - RNA, 14 nt, Human
guuggccaguguga

SEQ ID NO: 1727130 - RNA, 19 nt, Human
guuggccaggcuggucuca

SEQ ID NO: 1727131 - RNA, 17 nt, Human
guuggccaggcuggucu

SEQ ID NO: 1727132 - RNA, 18 nt, Human
guuggccaggcuggucuc

SEQ ID NO: 1727133 - RNA, 19 nt, Human
guuggccaggcugcucuug

SEQ ID NO: 1727134 - RNA, 14 nt, Human
guuggccaggcugg

SEQ ID NO: 1727135 - RNA, 15 nt, Human
guuggccaggcuggu

SEQ ID NO: 1727136 - RNA, 13 nt, Human
guuggccaggcug

SEQ ID NO: 1727137 - RNA, 14 nt, Human
guuggccaggcugc

SEQ ID NO: 1727138 - RNA, 23 nt, Human
guugccagucaccccggccaccu

SEQ ID NO: 1727139 - RNA, 18 nt, Human
guugccagucaccccggc

SEQ ID NO: 1727140 - RNA, 17 nt, Human
guugccagucaccccgg

SEQ ID NO: 1727141 - RNA, 16 nt, Human
guugccagucaccccg

SEQ ID NO: 1727142 - RNA, 14 nt, Human
guugccagucaccc

SEQ ID NO: 1727143 - RNA, 13 nt, Human
guugccagucacc

SEQ ID NO: 1727144 - RNA, 14 nt, Human
guugcccaggcagg

SEQ ID NO: 1727145 - RNA, 15 nt, Human
guugcccaggcaggu

SEQ ID NO: 1727146 - RNA, 12 nt, Human
guugcccaggca

SEQ ID NO: 1727147 - RNA, 19 nt, Human
guucugauccuaguuccac

SEQ ID NO: 1727148 - RNA, 16 nt, Human
guucugcacacagcac

SEQ ID NO: 1727149 - RNA, 15 nt, Human
guucugcacacagca

SEQ ID NO: 1727150 - RNA, 17 nt, Human
guuccuuccucugagcc

SEQ ID NO: 1727151 - RNA, 19 nt, Human
guuccuuccucugagccuu

SEQ ID NO: 1727152 - RNA, 18 nt, Human
guuccuuccucugagccu

SEQ ID NO: 1727153 - RNA, 14 nt, Human
guucuaaagaugga

SEQ ID NO: 1727154 - RNA, 17 nt, Human
guucuaaagauggaaaa

SEQ ID NO: 1727155 - RNA, 20 nt, Human
guucuaaagauggaaaaacc

SEQ ID NO: 1727156 - RNA, 23 nt, Human
guucuaaagauggaaaaaccacc

SEQ ID NO: 1727157 - RNA, 17 nt, Human
guugaaaaacagcugag

SEQ ID NO: 1727158 - RNA, 13 nt, Human
guucuuuccaaag

SEQ ID NO: 1727159 - RNA, 14 nt, Human
guucuuuccaaagu

SEQ ID NO: 1727160 - RNA, 18 nt, Human
guucuuuccaaaguacac

SEQ ID NO: 1727161 - RNA, 20 nt, Human
guucuuuccaaaguacacug

SEQ ID NO: 1727162 - RNA, 15 nt, Human
guucuuucuuccucu

SEQ ID NO: 1727163 - RNA, 14 nt, Human
guucuuucuuccuc

SEQ ID NO: 1727164 - RNA, 20 nt, Human
guucuuucauuugcuuugga

SEQ ID NO: 1727165 - RNA, 22 nt, Human
guucuuucauuugcuuuggaag

SEQ ID NO: 1727166 - RNA, 19 nt, Human
guucuuucuuccucugcug

SEQ ID NO: 1727167 - RNA, 18 nt, Human
guucuuucuuccucugcu

SEQ ID NO: 1727168 - RNA, 17 nt, Human
guucuuucuuccucugc

SEQ ID NO: 1727169 - RNA, 16 nt, Human
guucuuucuuccucug

SEQ ID NO: 1727170 - RNA, 18 nt, Human
guucuuucacccuuuucu

SEQ ID NO: 1727171 - RNA, 23 nt, Human
guucugggacacaguucaauucu

SEQ ID NO: 1727172 - RNA, 16 nt, Human
guucugggacacaguu

SEQ ID NO: 1727173 - RNA, 15 nt, Human
guucugggacacagu

SEQ ID NO: 1727174 - RNA, 14 nt, Human
guucugggacacag

SEQ ID NO: 1727175 - RNA, 12 nt, Human
guucugggacac

SEQ ID NO: 1727176 - RNA, 11 nt, Human
guucugggaca

SEQ ID NO: 1727177 - RNA, 20 nt, Human
guucuggcucuuccaggcug

SEQ ID NO: 1727178 - RNA, 16 nt, Human
guucuggcucuuccag

SEQ ID NO: 1727179 - RNA, 12 nt, Human
guucuggcucuu

SEQ ID NO: 1727180 - RNA, 23 nt, Human
guucuggcagaguugaagacaga

SEQ ID NO: 1727181 - RNA, 23 nt, Human
guuccuccccuccuccuggacuc

SEQ ID NO: 1727182 - RNA, 14 nt, Human
guuccuaauccucu

SEQ ID NO: 1727183 - RNA, 22 nt, Human
guuccucauuagcauuuugcua

SEQ ID NO: 1727184 - RNA, 23 nt, Human
guuccuagugauggcuuaugaua

SEQ ID NO: 1727185 - RNA, 20 nt, Human
guuccaccaucaagccacca

SEQ ID NO: 1727186 - RNA, 17 nt, Human
guuccaccaucaagcca

SEQ ID NO: 1727187 - RNA, 14 nt, Human
guuccacagaggac

SEQ ID NO: 1727188 - RNA, 12 nt, Human
guuccacugaga

SEQ ID NO: 1727189 - RNA, 13 nt, Human
guuccacugagac

SEQ ID NO: 1727190 - RNA, 21 nt, Human
guuccagcaauucuccugccu

SEQ ID NO: 1727191 - RNA, 20 nt, Human
guuccagcaauucuccugcc

SEQ ID NO: 1727192 - RNA, 14 nt, Human
guuccacugagacc

SEQ ID NO: 1727193 - RNA, 23 nt, Human
guuccagcaauucuccugccuca

SEQ ID NO: 1727194 - RNA, 16 nt, Human
guucaucaaugaauga

SEQ ID NO: 1727195 - RNA, 17 nt, Human
guucaucauccuaagcu

SEQ ID NO: 1727196 - RNA, 13 nt, Human
guucaucuugaau

SEQ ID NO: 1727197 - RNA, 12 nt, Human
guucaucuugaa

SEQ ID NO: 1727198 - RNA, 18 nt, Human
guucaucuugaauuguaa

SEQ ID NO: 1727199 - RNA, 19 nt, Human
guucacugcaaccuccgcc

SEQ ID NO: 1727200 - RNA, 24 nt, Human
guucacucuacuuagcaugucccu

SEQ ID NO: 1727201 - RNA, 15 nt, Human
guuacucagaauucu

SEQ ID NO: 1727202 - RNA, 22 nt, Human
guuacuaaguuuuuauggcuuu

SEQ ID NO: 1727203 - RNA, 19 nt, Human
guuaguuucuccaagcagg

SEQ ID NO: 1727204 - RNA, 16 nt, Human
guuaguuucuccaagc

SEQ ID NO: 1727205 - RNA, 22 nt, Human
guuaguuucuccaagcaggaca

SEQ ID NO: 1727206 - RNA, 16 nt, Human
guuaguuccacugaga

SEQ ID NO: 1727207 - RNA, 21 nt, Human
guuacauuuuuaagugcugca

SEQ ID NO: 1727208 - RNA, 23 nt, Human
guuaccauuuugggguacccacu

SEQ ID NO: 1727209 - RNA, 19 nt, Human
guuacauaagauaaaugug

SEQ ID NO: 1727210 - RNA, 18 nt, Human
guuacauaagauaaaugu

SEQ ID NO: 1727211 - RNA, 17 nt, Human
guuacagacaaagcgug

SEQ ID NO: 1727212 - RNA, 15 nt, Human
guuacagacaaagcg

SEQ ID NO: 1727213 - RNA, 17 nt, Human
guuauuauauuuacaaa

SEQ ID NO: 1727214 - RNA, 19 nt, Human
guucaagcgauucuucugc

SEQ ID NO: 1727215 - RNA, 19 nt, Human
guuauuaaaaaucucaaau

SEQ ID NO: 1727216 - RNA, 23 nt, Human
guucaagugauucucaugccuca

SEQ ID NO: 1727217 - RNA, 20 nt, Human
guucaagcgauucuucugcu

SEQ ID NO: 1727218 - RNA, 16 nt, Human
guucaauucucauuug

SEQ ID NO: 1727219 - RNA, 23 nt, Human
guucaauucucauuugucacaca

SEQ ID NO: 1727220 - RNA, 21 nt, Human
guuaugacuccagaauuuccc

SEQ ID NO: 1727221 - RNA, 23 nt, Human
guggguuucuaaagcugccagcc

SEQ ID NO: 1727222 - RNA, 17 nt, Human
guggggcagcuugaggg

SEQ ID NO: 1727223 - RNA, 13 nt, Human
guggggcagcuug

SEQ ID NO: 1727224 - RNA, 18 nt, Human
guggggaccucaggccug

SEQ ID NO: 1727225 - RNA, 15 nt, Human
guggggaccucaggc

SEQ ID NO: 1727226 - RNA, 13 nt, Human
guggggaggggcu

SEQ ID NO: 1727227 - RNA, 15 nt, Human
gugggcuaguugggc

SEQ ID NO: 1727228 - RNA, 12 nt, Human
gugggcuaagca

SEQ ID NO: 1727229 - RNA, 19 nt, Human
gugggccuucagggaguga

SEQ ID NO: 1727230 - RNA, 22 nt, Human
gugggcgugagaccugccccuc

SEQ ID NO: 1727231 - RNA, 21 nt, Human
gugggcgugagaccugccccu

SEQ ID NO: 1727232 - RNA, 18 nt, Human
gugggcgugagaccugcc

SEQ ID NO: 1727233 - RNA, 17 nt, Human
gugggcccaaugcacuu

SEQ ID NO: 1727234 - RNA, 14 nt, Human
guggcucacgccug

SEQ ID NO: 1727235 - RNA, 15 nt, Human
gugcuaauuuugaaa

SEQ ID NO: 1727236 - RNA, 13 nt, Human
gugcuaauuuuga

SEQ ID NO: 1727237 - RNA, 14 nt, Human
guggcugcuucaag

SEQ ID NO: 1727238 - RNA, 12 nt, Human
guggcugcuuca

SEQ ID NO: 1727239 - RNA, 20 nt, Human
guggcuccucccggugccca

SEQ ID NO: 1727240 - RNA, 13 nt, Human
guggcuccucccg

SEQ ID NO: 1727241 - RNA, 22 nt, Human
guggcuuaaaacaacacucaca

SEQ ID NO: 1727242 - RNA, 20 nt, Human
guggcuucccgcucagcccu

SEQ ID NO: 1727243 - RNA, 19 nt, Human
guggcuucccgcucagccc

SEQ ID NO: 1727244 - RNA, 18 nt, Human
guggcuucccgcucagcc

SEQ ID NO: 1727245 - RNA, 22 nt, Human
guggcugcuucaaggauccuga

SEQ ID NO: 1727246 - RNA, 19 nt, Human
guggcugcuucaaggaucc

SEQ ID NO: 1727247 - RNA, 16 nt, Human
guggcugcuucaagga

SEQ ID NO: 1727248 - RNA, 15 nt, Human
guggcugcuucaagg

SEQ ID NO: 1727249 - RNA, 23 nt, Human
guggcugcuucaaggauccugag

SEQ ID NO: 1727250 - RNA, 19 nt, Human
guggcuggguuggagggug

SEQ ID NO: 1727251 - RNA, 18 nt, Human
gugucccugcacuugcag

SEQ ID NO: 1727252 - RNA, 16 nt, Human
gugucccugcacuugc

SEQ ID NO: 1727253 - RNA, 13 nt, Human
gugucccugcacu

SEQ ID NO: 1727254 - RNA, 17 nt, Human
guguacauggaauaaca

SEQ ID NO: 1727255 - RNA, 22 nt, Human
guguacagucuuguauuaaguu

SEQ ID NO: 1727256 - RNA, 13 nt, Human
guguacagucuug

SEQ ID NO: 1727257 - RNA, 16 nt, Human
guguacagucuuguau

SEQ ID NO: 1727258 - RNA, 22 nt, Human
guguacauggaauaacauguaa

SEQ ID NO: 1727259 - RNA, 14 nt, Human
gugguauagaaaug

SEQ ID NO: 1727260 - RNA, 19 nt, Human
gugguaugaucacggcuca

SEQ ID NO: 1727261 - RNA, 17 nt, Human
gugguagagugugccug

SEQ ID NO: 1727262 - RNA, 18 nt, Human
gugguccuaaucuucuga

SEQ ID NO: 1727263 - RNA, 17 nt, Human
guggucccaccccacac

SEQ ID NO: 1727264 - RNA, 16 nt, Human
guggucccaccccaca

SEQ ID NO: 1727265 - RNA, 15 nt, Human
guggucccaccccac

SEQ ID NO: 1727266 - RNA, 14 nt, Human
guggucccacccca

SEQ ID NO: 1727267 - RNA, 21 nt, Human
guggugagaggcauccaguau

SEQ ID NO: 1727268 - RNA, 17 nt, Human
guggugaccucugccug

SEQ ID NO: 1727269 - RNA, 14 nt, Human
guggugaccucugc

SEQ ID NO: 1727270 - RNA, 19 nt, Human
guggugcgaucuggguuca

SEQ ID NO: 1727271 - RNA, 21 nt, Human
guguaaguauucuuauuuaau

SEQ ID NO: 1727272 - RNA, 20 nt, Human
guuaaaaacagauuuggaaa

SEQ ID NO: 1727273 - RNA, 22 nt, Human
guuaaaauaccagccaguaaau

SEQ ID NO: 1727274 - RNA, 19 nt, Human
guuaaacuuacuuaguguu

SEQ ID NO: 1727275 - RNA, 18 nt, Human
guuaaaggugaacauugg

SEQ ID NO: 1727276 - RNA, 13 nt, Human
guuacagacaaag

SEQ ID NO: 1727277 - RNA, 17 nt, Human
guuacacuuuuuggaag

SEQ ID NO: 1727278 - RNA, 18 nt, Human
guuacacuuuuuggaagu

SEQ ID NO: 1727279 - RNA, 22 nt, Human
guuacacuuuuuggaagugaaa

SEQ ID NO: 1727280 - RNA, 17 nt, Human
guuacacauuuuucaga

SEQ ID NO: 1727281 - RNA, 16 nt, Human
guuacacuaaaaggug

SEQ ID NO: 1727282 - RNA, 15 nt, Human
guuacacuaaaaggu

SEQ ID NO: 1727283 - RNA, 18 nt, Human
guuaacugagugccuuuu

SEQ ID NO: 1727284 - RNA, 14 nt, Human
guguuacuaaguuu

SEQ ID NO: 1727285 - RNA, 12 nt, Human
guguuacuaagu

SEQ ID NO: 1727286 - RNA, 18 nt, Human
guguuaugacuccagaau

SEQ ID NO: 1727287 - RNA, 14 nt, Human
guguguuuuucaua

SEQ ID NO: 1727288 - RNA, 19 nt, Human
guguguuuuaaaaugagaa

SEQ ID NO: 1727289 - RNA, 16 nt, Human
guguguuuuaaaauga

SEQ ID NO: 1727290 - RNA, 13 nt, Human
guguguuuuaaaa

SEQ ID NO: 1727291 - RNA, 18 nt, Human
guguuuuucauaaagcag

SEQ ID NO: 1727292 - RNA, 13 nt, Human
guguucugugaua

SEQ ID NO: 1727293 - RNA, 14 nt, Human
guguccggucccug

SEQ ID NO: 1727294 - RNA, 23 nt, Human
gugucccugcacuugcagacucu

SEQ ID NO: 1727295 - RNA, 20 nt, Human
guguccuccugggguucuuu

SEQ ID NO: 1727296 - RNA, 15 nt, Human
gugucgggcaugaca

SEQ ID NO: 1727297 - RNA, 14 nt, Human
gugucucuuggucc

SEQ ID NO: 1727298 - RNA, 17 nt, Human
gugucucccuucauccu

SEQ ID NO: 1727299 - RNA, 19 nt, Human
gugucuaggcaggaccugu

SEQ ID NO: 1727300 - RNA, 21 nt, Human
gugucucuugguccugcugca

SEQ ID NO: 1727301 - RNA, 20 nt, Human
gugucucuugguccugcugc

SEQ ID NO: 1727302 - RNA, 19 nt, Human
gugucucuugguccugcug

SEQ ID NO: 1727303 - RNA, 18 nt, Human
gugucucuugguccugcu

SEQ ID NO: 1727304 - RNA, 22 nt, Human
gugucucuugguccugcugcag

SEQ ID NO: 1727305 - RNA, 20 nt, Human
gugugagucaccaagcccag

SEQ ID NO: 1727306 - RNA, 13 nt, Human
guguggagaagcg

SEQ ID NO: 1727307 - RNA, 21 nt, Human
guguggagaagcggcuggcag

SEQ ID NO: 1727308 - RNA, 12 nt, Human
guguguuuuaaa

SEQ ID NO: 1727309 - RNA, 15 nt, Human
guguguuucugaucu

SEQ ID NO: 1727310 - RNA, 22 nt, Human
gugugcucugaucauccacugu

SEQ ID NO: 1727311 - RNA, 15 nt, Human
gugugcucugaucau

SEQ ID NO: 1727312 - RNA, 12 nt, Human
gugugcucugau

SEQ ID NO: 1727313 - RNA, 19 nt, Human
gugugcucaggagcccugg

SEQ ID NO: 1727314 - RNA, 18 nt, Human
gugugcucaggagcccug

SEQ ID NO: 1727315 - RNA, 17 nt, Human
gugugcucaggagcccu

SEQ ID NO: 1727316 - RNA, 16 nt, Human
gugugcucaggagccc

SEQ ID NO: 1727317 - RNA, 12 nt, Human
gugauuuucauu

SEQ ID NO: 1727318 - RNA, 13 nt, Human
gugauuuuuguaa

SEQ ID NO: 1727319 - RNA, 18 nt, Human
gugauuuuuguaauuuuu

SEQ ID NO: 1727320 - RNA, 24 nt, Human
gugauccacccaccucagccuccc

SEQ ID NO: 1727321 - RNA, 23 nt, Human
gugauccacccaccucagccucc

SEQ ID NO: 1727322 - RNA, 22 nt, Human
gugcauaccacuuuuguucuug

SEQ ID NO: 1727323 - RNA, 14 nt, Human
gugcaucucagccc

SEQ ID NO: 1727324 - RNA, 13 nt, Human
gugcaucucagcc

SEQ ID NO: 1727325 - RNA, 23 nt, Human
gugcaguggugcgaucuggguuc

SEQ ID NO: 1727326 - RNA, 20 nt, Human
gugcaguggugcgaucuggg

SEQ ID NO: 1727327 - RNA, 14 nt, Human
gugcgccuacagga

SEQ ID NO: 1727328 - RNA, 14 nt, Human
gugcggccuuuggc

SEQ ID NO: 1727329 - RNA, 21 nt, Human
gugcgaucuggguucacugca

SEQ ID NO: 1727330 - RNA, 15 nt, Human
gugccuucagcucua

SEQ ID NO: 1727331 - RNA, 16 nt, Human
gugccaugugccaggu

SEQ ID NO: 1727332 - RNA, 14 nt, Human
gugccaugugccag

SEQ ID NO: 1727333 - RNA, 20 nt, Human
gugcccaagaauagaugcug

SEQ ID NO: 1727334 - RNA, 19 nt, Human
gugagccgagaucacgcca

SEQ ID NO: 1727335 - RNA, 17 nt, Human
gugaggaugaaaaaaua

SEQ ID NO: 1727336 - RNA, 18 nt, Human
gugaggagcuugaaaccc

SEQ ID NO: 1727337 - RNA, 20 nt, Human
gugagccacugcaccgggcc

SEQ ID NO: 1727338 - RNA, 15 nt, Human
gugagccacugcacc

SEQ ID NO: 1727339 - RNA, 19 nt, Human
gugauauaaguguguguuu

SEQ ID NO: 1727340 - RNA, 17 nt, Human
gugaguugauagcacag

SEQ ID NO: 1727341 - RNA, 15 nt, Human
gugauacaaugcugu

SEQ ID NO: 1727342 - RNA, 17 nt, Human
gugauacaaugcugugc

SEQ ID NO: 1727343 - RNA, 21 nt, Human
gugaacaaauuuacagagaca

SEQ ID NO: 1727344 - RNA, 20 nt, Human
gugacaaggauugcuacugu

SEQ ID NO: 1727345 - RNA, 21 nt, Human
gugaaugaugauccuaggcau

SEQ ID NO: 1727346 - RNA, 15 nt, Human
gugaccucugccuga

SEQ ID NO: 1727347 - RNA, 14 nt, Human
gugaccucugccug

SEQ ID NO: 1727348 - RNA, 13 nt, Human
gugaccucugccu

SEQ ID NO: 1727349 - RNA, 15 nt, Human
gugacagaggcagcc

SEQ ID NO: 1727350 - RNA, 12 nt, Human
gugaccucugcc

SEQ ID NO: 1727351 - RNA, 14 nt, Human
gugacagaggcagc

SEQ ID NO: 1727352 - RNA, 13 nt, Human
gugacagaggcag

SEQ ID NO: 1727353 - RNA, 12 nt, Human
gugacagaggca

SEQ ID NO: 1727354 - RNA, 14 nt, Human
gucuguucuuucca

SEQ ID NO: 1727355 - RNA, 17 nt, Human
gucuguucuuuccaaag

SEQ ID NO: 1727356 - RNA, 13 nt, Human
gucuguugauuaa

SEQ ID NO: 1727357 - RNA, 16 nt, Human
gucuguugauuaaaga

SEQ ID NO: 1727358 - RNA, 19 nt, Human
gucuguugauuaaagauga

SEQ ID NO: 1727359 - RNA, 22 nt, Human
gucugugagaugcuagaacucc

SEQ ID NO: 1727360 - RNA, 23 nt, Human
gucugugagaugcuagaacuccc

SEQ ID NO: 1727361 - RNA, 18 nt, Human
gucugugccauuuuguau

SEQ ID NO: 1727362 - RNA, 15 nt, Human
gucugugagaugcua

SEQ ID NO: 1727363 - RNA, 16 nt, Human
gucugugagaugcuag

SEQ ID NO: 1727364 - RNA, 17 nt, Human
gucugugagaugcuaga

SEQ ID NO: 1727365 - RNA, 21 nt, Human
gucugugagaugcuagaacuc

SEQ ID NO: 1727366 - RNA, 21 nt, Human
gucuugcaauggcagccuugg

SEQ ID NO: 1727367 - RNA, 20 nt, Human
gucuugcaauggcagccuug

SEQ ID NO: 1727368 - RNA, 23 nt, Human
gucuugcaauggcagccuuggca

SEQ ID NO: 1727369 - RNA, 16 nt, Human
gucuuuuuucacuaca

SEQ ID NO: 1727370 - RNA, 17 nt, Human
gucuugaacuccuggcc

SEQ ID NO: 1727371 - RNA, 16 nt, Human
gucuugaacuccuggc

SEQ ID NO: 1727372 - RNA, 21 nt, Human
gucuuaaaaaguggaaaaaua

SEQ ID NO: 1727373 - RNA, 19 nt, Human
gucuugcaauggcagccuu

SEQ ID NO: 1727374 - RNA, 18 nt, Human
gucuugcaauggcagccu

SEQ ID NO: 1727375 - RNA, 17 nt, Human
gucuugcaauggcagcc

SEQ ID NO: 1727376 - RNA, 16 nt, Human
gucuugcaauggcagc

SEQ ID NO: 1727377 - RNA, 20 nt, Human
gucuugaacuccuggccuca

SEQ ID NO: 1727378 - RNA, 18 nt, Human
gucuugaacuccuggccu

SEQ ID NO: 1727379 - RNA, 21 nt, Human
gucuugaacuccuggccucaa

SEQ ID NO: 1727380 - RNA, 18 nt, Human
gucgucaaagcugaaaug

SEQ ID NO: 1727381 - RNA, 19 nt, Human
gucucacuauguugcccag

SEQ ID NO: 1727382 - RNA, 11 nt, Human
gucucacucug

SEQ ID NO: 1727383 - RNA, 18 nt, Human
gucucacuauguugccca

SEQ ID NO: 1727384 - RNA, 16 nt, Human
gucgggcaugacacga

SEQ ID NO: 1727385 - RNA, 21 nt, Human
gucggaaaacaugcuacacac

SEQ ID NO: 1727386 - RNA, 19 nt, Human
guccuuaccagcagagcac

SEQ ID NO: 1727387 - RNA, 18 nt, Human
guccuuaccagcagagca

SEQ ID NO: 1727388 - RNA, 21 nt, Human
guccuuaccagcagagcaccu

SEQ ID NO: 1727389 - RNA, 14 nt, Human
gucccugccaaugg

SEQ ID NO: 1727390 - RNA, 11 nt, Human
gucccugccaa

SEQ ID NO: 1727391 - RNA, 15 nt, Human
gucccugccaaugga

SEQ ID NO: 1727392 - RNA, 22 nt, Human
gucucacucugucgcccagucu

SEQ ID NO: 1727393 - RNA, 19 nt, Human
gucucacucugucgcccag

SEQ ID NO: 1727394 - RNA, 18 nt, Human
gucucacucugucgccca

SEQ ID NO: 1727395 - RNA, 16 nt, Human
gucucacucugucgcc

SEQ ID NO: 1727396 - RNA, 15 nt, Human
gucucacucugucgc

SEQ ID NO: 1727397 - RNA, 19 nt, Human
gucucgugguaggacugua

SEQ ID NO: 1727398 - RNA, 13 nt, Human
gucucugagcauu

SEQ ID NO: 1727399 - RNA, 17 nt, Human
gucucuggaauuugaaa

SEQ ID NO: 1727400 - RNA, 13 nt, Human
gucucuugguccu

SEQ ID NO: 1727401 - RNA, 21 nt, Human
gucucuggauuauauuaugaa

SEQ ID NO: 1727402 - RNA, 18 nt, Human
gucucuucuccacuggau

SEQ ID NO: 1727403 - RNA, 17 nt, Human
gucucugguuccucccc

SEQ ID NO: 1727404 - RNA, 16 nt, Human
gucucugguuccuccc

SEQ ID NO: 1727405 - RNA, 22 nt, Human
gucagaugcugugcaaauguua

SEQ ID NO: 1727406 - RNA, 14 nt, Human
gucagagccugcag

SEQ ID NO: 1727407 - RNA, 16 nt, Human
gucagagccugcaguu

SEQ ID NO: 1727408 - RNA, 15 nt, Human
gucagagccugcagu

SEQ ID NO: 1727409 - RNA, 16 nt, Human
gucacucuggcagcuc

SEQ ID NO: 1727410 - RNA, 14 nt, Human
gucacucuggcagc

SEQ ID NO: 1727411 - RNA, 13 nt, Human
gucacucuggcag

SEQ ID NO: 1727412 - RNA, 12 nt, Human
gucacucuggca

SEQ ID NO: 1727413 - RNA, 19 nt, Human
gucacucuggcagcucaga

SEQ ID NO: 1727414 - RNA, 17 nt, Human
gucacucuggcagcuca

SEQ ID NO: 1727415 - RNA, 22 nt, Human
gucacucuggcagcucagagag

SEQ ID NO: 1727416 - RNA, 18 nt, Human
gucaccccggccaccugc

SEQ ID NO: 1727417 - RNA, 17 nt, Human
gucaccccggccaccug

SEQ ID NO: 1727418 - RNA, 22 nt, Human
gucaccccggccaccugcggug

SEQ ID NO: 1727419 - RNA, 19 nt, Human
guauuuuguuuuugucuua

SEQ ID NO: 1727420 - RNA, 15 nt, Human
gucaagugaaaaagg

SEQ ID NO: 1727421 - RNA, 15 nt, Human
gucaaugcagccccc

SEQ ID NO: 1727422 - RNA, 22 nt, Human
guauuaaguuguuaauaaaagu

SEQ ID NO: 1727423 - RNA, 13 nt, Human
guauuuuaaucac

SEQ ID NO: 1727424 - RNA, 14 nt, Human
guauuuuacuaaua

SEQ ID NO: 1727425 - RNA, 21 nt, Human
gucauucgcuacuaugauuua

SEQ ID NO: 1727426 - RNA, 16 nt, Human
guccacaguggaacca

SEQ ID NO: 1727427 - RNA, 19 nt, Human
guccacaguggaaccagcc

SEQ ID NO: 1727428 - RNA, 21 nt, Human
guccacaguggaaccagccca

SEQ ID NO: 1727429 - RNA, 21 nt, Human
gucccaccuuggcugcaggga

SEQ ID NO: 1727430 - RNA, 23 nt, Human
guccacccaggagccccgaggcc

SEQ ID NO: 1727431 - RNA, 12 nt, Human
guccacccagga

SEQ ID NO: 1727432 - RNA, 13 nt, Human
guccacccaggag

SEQ ID NO: 1727433 - RNA, 23 nt, Human
gucccaccuuggcugcagggagu

SEQ ID NO: 1727434 - RNA, 17 nt, Human
gucccaggcugagccuc

SEQ ID NO: 1727435 - RNA, 16 nt, Human
gucccaggcugagccu

SEQ ID NO: 1727436 - RNA, 15 nt, Human
gucccaggcugagcc

SEQ ID NO: 1727437 - RNA, 21 nt, Human
gucccaggcugagccucaguc

SEQ ID NO: 1727438 - RNA, 19 nt, Human
gucccaggcugagccucag

SEQ ID NO: 1727439 - RNA, 18 nt, Human
gucccaggcugagccuca

SEQ ID NO: 1727440 - RNA, 17 nt, Human
guccccaccgcagacag

SEQ ID NO: 1727441 - RNA, 17 nt, Human
gucccuaauaaagcugu

SEQ ID NO: 1727442 - RNA, 16 nt, Human
gucccuaauaaagcug

SEQ ID NO: 1727443 - RNA, 21 nt, Human
gucccugcacuugcagacucu

SEQ ID NO: 1727444 - RNA, 19 nt, Human
gucccugcacuugcagacu

SEQ ID NO: 1727445 - RNA, 16 nt, Human
gucccugcacuugcag

SEQ ID NO: 1727446 - RNA, 20 nt, Human
gucccuaauaaagcugugug

SEQ ID NO: 1727447 - RNA, 18 nt, Human
gucccuaauaaagcugug

SEQ ID NO: 1727448 - RNA, 23 nt, Human
gucccuaccgagucucuucucca

SEQ ID NO: 1727449 - RNA, 22 nt, Human
gucccuaccgagucucuucucc

SEQ ID NO: 1727450 - RNA, 21 nt, Human
gucccuaccgagucucuucuc

SEQ ID NO: 1727451 - RNA, 22 nt, Human
guauaugucaagccauaauugu

SEQ ID NO: 1727452 - RNA, 16 nt, Human
guauauguugggugca

SEQ ID NO: 1727453 - RNA, 21 nt, Human
guauaugucucaggucccugc

SEQ ID NO: 1727454 - RNA, 15 nt, Human
guauaugucucaggu

SEQ ID NO: 1727455 - RNA, 13 nt, Human
guauaugucucag

SEQ ID NO: 1727456 - RNA, 23 nt, Human
guauagaaaugcugguuuuucag

SEQ ID NO: 1727457 - RNA, 14 nt, Human
guauagaaaugcug

SEQ ID NO: 1727458 - RNA, 15 nt, Human
guauagaaaugcugg

SEQ ID NO: 1727459 - RNA, 22 nt, Human
guauagaaaugcugguuuuuca

SEQ ID NO: 1727460 - RNA, 23 nt, Human
guaugaaagauggcugugccucu

SEQ ID NO: 1727461 - RNA, 22 nt, Human
guaugaaagauggcugugccuc

SEQ ID NO: 1727462 - RNA, 19 nt, Human
guaucuggugacuuuccuc

SEQ ID NO: 1727463 - RNA, 12 nt, Human
guaucuggugac

SEQ ID NO: 1727464 - RNA, 12 nt, Human
guaucugagcag

SEQ ID NO: 1727465 - RNA, 19 nt, Human
guaugaauaaagacaccua

SEQ ID NO: 1727466 - RNA, 18 nt, Human
guaugaauaaagacaccu

SEQ ID NO: 1727467 - RNA, 13 nt, Human
guaugaggcauuu

SEQ ID NO: 1727468 - RNA, 15 nt, Human
guaugaggcauuugu

SEQ ID NO: 1727469 - RNA, 24 nt, Human
guaugauagguuauuuugauguaa

SEQ ID NO: 1727470 - RNA, 20 nt, Human
guaugaucacggcucacugc

SEQ ID NO: 1727471 - RNA, 17 nt, Human
guaugaggcauuuguuu

SEQ ID NO: 1727472 - RNA, 20 nt, Human
guaugaggcauuuguuugaa

SEQ ID NO: 1727473 - RNA, 22 nt, Human
guaugaucacggcucacugcag

SEQ ID NO: 1727474 - RNA, 21 nt, Human
guaugaucacggcucacugca

SEQ ID NO: 1727475 - RNA, 17 nt, Human
guauguugaagccuuug

SEQ ID NO: 1727476 - RNA, 16 nt, Human
guaggguuauaauaau

SEQ ID NO: 1727477 - RNA, 22 nt, Human
guagggugggccuucagggagu

SEQ ID NO: 1727478 - RNA, 17 nt, Human
guagggugggccuucag

SEQ ID NO: 1727479 - RNA, 14 nt, Human
guagggugggccuu

SEQ ID NO: 1727480 - RNA, 14 nt, Human
guagucaggugccu

SEQ ID NO: 1727481 - RNA, 22 nt, Human
guaguaugauagguuauuuuga

SEQ ID NO: 1727482 - RNA, 17 nt, Human
guauaauucacauugua

SEQ ID NO: 1727483 - RNA, 15 nt, Human
guagagugugccuga

SEQ ID NO: 1727484 - RNA, 16 nt, Human
guagggcgggaggaug

SEQ ID NO: 1727485 - RNA, 22 nt, Human
guagggcgggaggauguucugg

SEQ ID NO: 1727486 - RNA, 21 nt, Human
guagggcgggaggauguucug

SEQ ID NO: 1727487 - RNA, 23 nt, Human
guagggcgggaggauguucuggg

SEQ ID NO: 1727488 - RNA, 14 nt, Human
uuaccacagacaua

SEQ ID NO: 1727489 - RNA, 17 nt, Human
uuaccacagacauacua

SEQ ID NO: 1727490 - RNA, 16 nt, Human
uuuccugaggcugggc

SEQ ID NO: 1727491 - RNA, 13 nt, Human
uuuccugcccugg

SEQ ID NO: 1727492 - RNA, 12 nt, Human
uuuccugcccug

SEQ ID NO: 1727493 - RNA, 20 nt, Human
uuucuguucuuucuggcuau

SEQ ID NO: 1727494 - RNA, 20 nt, Human
uuucuaaaggcuaccuuugu

SEQ ID NO: 1727495 - RNA, 21 nt, Human
uuucuaaaggcuaccuuugua

SEQ ID NO: 1727496 - RNA, 14 nt, Human
uuucuaaaguaaaa

SEQ ID NO: 1727497 - RNA, 12 nt, Human
uuucuaaaguaa

SEQ ID NO: 1727498 - RNA, 23 nt, Human
uuucuacucgaguuacagacaaa

SEQ ID NO: 1727499 - RNA, 18 nt, Human
uuugaaucaucaagucuu

SEQ ID NO: 1727500 - RNA, 22 nt, Human
uuugaagaugccgcauuuggau

SEQ ID NO: 1727501 - RNA, 14 nt, Human
uuugaacucuucaa

SEQ ID NO: 1727502 - RNA, 15 nt, Human
uuugaacugauaaag

SEQ ID NO: 1727503 - RNA, 17 nt, Human
uuugaacugauaaagau

SEQ ID NO: 1727504 - RNA, 19 nt, Human
uuugaacugauaaagauga

SEQ ID NO: 1727505 - RNA, 18 nt, Human
uuucuuagggaaggauac

SEQ ID NO: 1727506 - RNA, 23 nt, Human
uuucuuagggaaggauacaaaag

SEQ ID NO: 1727507 - RNA, 12 nt, Human
uuucuucucccu

SEQ ID NO: 1727508 - RNA, 16 nt, Human
uuucuuccucugcuga

SEQ ID NO: 1727509 - RNA, 14 nt, Human
uuucuuccucugcu

SEQ ID NO: 1727510 - RNA, 13 nt, Human
uuucuucucccuc

SEQ ID NO: 1727511 - RNA, 13 nt, Human
uuucuuccucugc

SEQ ID NO: 1727512 - RNA, 11 nt, Human
uuucuuccucu

SEQ ID NO: 1727513 - RNA, 20 nt, Human
uuuggagucagacagaugug

SEQ ID NO: 1727514 - RNA, 21 nt, Human
uuuggaauuuugugcccccau

SEQ ID NO: 1727515 - RNA, 23 nt, Human
uuuggugaacauugcaauagaaa

SEQ ID NO: 1727516 - RNA, 22 nt, Human
uuuggugaacauugcaauagaa

SEQ ID NO: 1727517 - RNA, 19 nt, Human
uuuggugguuucagaaaug

SEQ ID NO: 1727518 - RNA, 14 nt, Human
uuuggaauuuugug

SEQ ID NO: 1727519 - RNA, 15 nt, Human
uuugcuuugugauuu

SEQ ID NO: 1727520 - RNA, 16 nt, Human
uuugcuuugugauuuu

SEQ ID NO: 1727521 - RNA, 15 nt, Human
uuugcaucugaaaau

SEQ ID NO: 1727522 - RNA, 17 nt, Human
uuuuaaagaaugcucuu

SEQ ID NO: 1727523 - RNA, 14 nt, Human
uuuuaaagaaaagu

SEQ ID NO: 1727524 - RNA, 18 nt, Human
uuuuaaagacuuuuauga

SEQ ID NO: 1727525 - RNA, 15 nt, Human
uuuuaaagaaaaguu

SEQ ID NO: 1727526 - RNA, 21 nt, Human
uuuguucuggcucuuccaggc

SEQ ID NO: 1727527 - RNA, 21 nt, Human
uuuuaaucucuaacaguggac

SEQ ID NO: 1727528 - RNA, 11 nt, Human
uuuuaaaugca

SEQ ID NO: 1727529 - RNA, 12 nt, Human
uuuuaaaugcac

SEQ ID NO: 1727530 - RNA, 21 nt, Human
uuuuaaaugcaccuggaauau

SEQ ID NO: 1727531 - RNA, 13 nt, Human
uuuuuaagugaaa

SEQ ID NO: 1727532 - RNA, 20 nt, Human
uuuuuaagugaaaauauagc

SEQ ID NO: 1727533 - RNA, 11 nt, Human
uuuuuccuuca

SEQ ID NO: 1727534 - RNA, 11 nt, Human
uuuuuaaaugc

SEQ ID NO: 1727535 - RNA, 19 nt, Human
uuuuuccuucagugccuua

SEQ ID NO: 1727536 - RNA, 11 nt, Human
uuuuuccuuuu

SEQ ID NO: 1727537 - RNA, 12 nt, Human
uuuuuuguuuca

SEQ ID NO: 1727538 - RNA, 13 nt, Human
uuuuuuguuucau

SEQ ID NO: 1727539 - RNA, 20 nt, Human
uuuugacaaggggcaguggu

SEQ ID NO: 1727540 - RNA, 15 nt, Human
uuuuggucuguguga

SEQ ID NO: 1727541 - RNA, 14 nt, Human
uuuuggcugcugaa

SEQ ID NO: 1727542 - RNA, 18 nt, Human
uuuucuaaaguaaaaaca

SEQ ID NO: 1727543 - RNA, 17 nt, Human
uuuuguaauaauaaaga

SEQ ID NO: 1727544 - RNA, 19 nt, Human
uuuuguaauaauaaagaau

SEQ ID NO: 1727545 - RNA, 19 nt, Human
uuuuguagagccagggucu

SEQ ID NO: 1727546 - RNA, 16 nt, Human
uuuugucauauaagau

SEQ ID NO: 1727547 - RNA, 13 nt, Human
uuuugucuugugu

SEQ ID NO: 1727548 - RNA, 18 nt, Human
uuuuuaaagacuuuuaug

SEQ ID NO: 1727549 - RNA, 13 nt, Human
uuuuuaaagacuu

SEQ ID NO: 1727550 - RNA, 12 nt, Human
uuuuuaaagacu

SEQ ID NO: 1727551 - RNA, 12 nt, Human
uuuuuaaagaaa

SEQ ID NO: 1727552 - RNA, 20 nt, Human
uuuuuaaagaaaaguuuugu

SEQ ID NO: 1727553 - RNA, 17 nt, Human
uuuuuaaagacagaguc

SEQ ID NO: 1727554 - RNA, 23 nt, Human
gccaguaaaugggggugcauuug

SEQ ID NO: 1727555 - RNA, 15 nt, Human
gccaggcuggucuca

SEQ ID NO: 1727556 - RNA, 13 nt, Human
gccaggcuggucu

SEQ ID NO: 1727557 - RNA, 23 nt, Human
gccaggcugggucgcccuggacu

SEQ ID NO: 1727558 - RNA, 17 nt, Human
gccaggcugggucgccc

SEQ ID NO: 1727559 - RNA, 14 nt, Human
gccauccagguuca

SEQ ID NO: 1727560 - RNA, 14 nt, Human
gccaugcuccuggc

SEQ ID NO: 1727561 - RNA, 24 nt, Human
gccaugcuccuggcccacugcauc

SEQ ID NO: 1727562 - RNA, 16 nt, Human
gccaugggccuccugu

SEQ ID NO: 1727563 - RNA, 15 nt, Human
gccaugggccuccug

SEQ ID NO: 1727564 - RNA, 24 nt, Human
gcccaaccugcucuccucuugcca

SEQ ID NO: 1727565 - RNA, 22 nt, Human
gcccaagaauagaugcugacug

SEQ ID NO: 1727566 - RNA, 21 nt, Human
gcccaagaauagaugcugacu

SEQ ID NO: 1727567 - RNA, 20 nt, Human
gcccacauagugaugguucc

SEQ ID NO: 1727568 - RNA, 17 nt, Human
gcccaccuuggcucaag

SEQ ID NO: 1727569 - RNA, 16 nt, Human
gcccaccuuggcucaa

SEQ ID NO: 1727570 - RNA, 15 nt, Human
gcccaccuuggcuca

SEQ ID NO: 1727571 - RNA, 13 nt, Human
gcccaccuuggcu

SEQ ID NO: 1727572 - RNA, 14 nt, Human
gcccacuucugcca

SEQ ID NO: 1727573 - RNA, 24 nt, Human
gcccaccuggccucugcacucccc

SEQ ID NO: 1727574 - RNA, 21 nt, Human
gcccaccuggccucugcacuc

SEQ ID NO: 1727575 - RNA, 20 nt, Human
gcccaccuggccucugcacu

SEQ ID NO: 1727576 - RNA, 17 nt, Human
gcccaccuggccucugc

SEQ ID NO: 1727577 - RNA, 16 nt, Human
gcccaccuggccucug

SEQ ID NO: 1727578 - RNA, 15 nt, Human
gcccaccuggccucu

SEQ ID NO: 1727579 - RNA, 21 nt, Human
gccagagacacaagccuucgg

SEQ ID NO: 1727580 - RNA, 22 nt, Human
gccacugcaccgggccacagag

SEQ ID NO: 1727581 - RNA, 22 nt, Human
gccagagacacaagccuucggc

SEQ ID NO: 1727582 - RNA, 21 nt, Human
gccacugcaccgggccacaga

SEQ ID NO: 1727583 - RNA, 20 nt, Human
gccacugcaccgggccacag

SEQ ID NO: 1727584 - RNA, 22 nt, Human
gccacuccagaccccuggcuuu

SEQ ID NO: 1727585 - RNA, 24 nt, Human
gccaaggccaaaggaagcacaugc

SEQ ID NO: 1727586 - RNA, 20 nt, Human
gccacuccagaccccuggcu

SEQ ID NO: 1727587 - RNA, 21 nt, Human
gccacuccagaccccuggcuu

SEQ ID NO: 1727588 - RNA, 20 nt, Human
gccaaggccaaaggaagcac

SEQ ID NO: 1727589 - RNA, 13 nt, Human
gccagauuucacu

SEQ ID NO: 1727590 - RNA, 24 nt, Human
gccagauucuuuccugaggcuggg

SEQ ID NO: 1727591 - RNA, 20 nt, Human
gccagauucuuuccugaggc

SEQ ID NO: 1727592 - RNA, 15 nt, Human
gccagaugcaccagc

SEQ ID NO: 1727593 - RNA, 22 nt, Human
gccagccgagauagccaaggcc

SEQ ID NO: 1727594 - RNA, 17 nt, Human
gccagagggagugacag

SEQ ID NO: 1727595 - RNA, 14 nt, Human
gccagaugcaccag

SEQ ID NO: 1727596 - RNA, 14 nt, Human
gccaggaagccagc

SEQ ID NO: 1727597 - RNA, 13 nt, Human
gccaggaagccag

SEQ ID NO: 1727598 - RNA, 12 nt, Human
gccaggaagcca

SEQ ID NO: 1727599 - RNA, 20 nt, Human
gccagcugcuugggcuucau

SEQ ID NO: 1727600 - RNA, 18 nt, Human
gccagcugcuugggcuuc

SEQ ID NO: 1727601 - RNA, 17 nt, Human
gccagcugcuugggcuu

SEQ ID NO: 1727602 - RNA, 15 nt, Human
gccaggaagccagca

SEQ ID NO: 1727603 - RNA, 13 nt, Human
gccagcuggagaa

SEQ ID NO: 1727604 - RNA, 16 nt, Human
gccaggagccuccugc

SEQ ID NO: 1727605 - RNA, 14 nt, Human
gccaggagccuccu

SEQ ID NO: 1727606 - RNA, 20 nt, Human
gccaggagccuccugcccuu

SEQ ID NO: 1727607 - RNA, 19 nt, Human
gccaggagccuccugcccu

SEQ ID NO: 1727608 - RNA, 12 nt, Human
gcccaggcuggc

SEQ ID NO: 1727609 - RNA, 23 nt, Human
gcccaggccccugccacccuggg

SEQ ID NO: 1727610 - RNA, 21 nt, Human
gcccagagaggguggugaccu

SEQ ID NO: 1727611 - RNA, 13 nt, Human
gcccaggccuccu

SEQ ID NO: 1727612 - RNA, 20 nt, Human
gcccaggcuggagugcaaug

SEQ ID NO: 1727613 - RNA, 15 nt, Human
gcccaggcuggagug

SEQ ID NO: 1727614 - RNA, 12 nt, Human
gccccagugccc

SEQ ID NO: 1727615 - RNA, 18 nt, Human
gccccaucccaaacccuu

SEQ ID NO: 1727616 - RNA, 21 nt, Human
gccccauaauuuuuuuuuucc

SEQ ID NO: 1727617 - RNA, 19 nt, Human
gccccaguuguauuuauuu

SEQ ID NO: 1727618 - RNA, 14 nt, Human
gccccagugcccac

SEQ ID NO: 1727619 - RNA, 13 nt, Human
gccccagugccca

SEQ ID NO: 1727620 - RNA, 15 nt, Human
gccccagugcccaca

SEQ ID NO: 1727621 - RNA, 22 nt, Human
gccccauccucuguacagagcc

SEQ ID NO: 1727622 - RNA, 14 nt, Human
gccccauccucugu

SEQ ID NO: 1727623 - RNA, 13 nt, Human
gccccauccucug

SEQ ID NO: 1727624 - RNA, 14 nt, Human
gccccauucugccu

SEQ ID NO: 1727625 - RNA, 15 nt, Human
gccccauucugccug

SEQ ID NO: 1727626 - RNA, 14 nt, Human
gcccugcagagggc

SEQ ID NO: 1727627 - RNA, 13 nt, Human
gcccugcagaggg

SEQ ID NO: 1727628 - RNA, 15 nt, Human
gcccugcagagggca

SEQ ID NO: 1727629 - RNA, 16 nt, Human
gcccugcagagggcac

SEQ ID NO: 1727630 - RNA, 14 nt, Human
gcccugagcuuucu

SEQ ID NO: 1727631 - RNA, 19 nt, Human
gcccucugcccacucccug

SEQ ID NO: 1727632 - RNA, 18 nt, Human
gcccucugcccacucccu

SEQ ID NO: 1727633 - RNA, 16 nt, Human
gcccucugcccacucc

SEQ ID NO: 1727634 - RNA, 13 nt, Human
gcccucugcccac

SEQ ID NO: 1727635 - RNA, 21 nt, Human
gcccucccugccccucccuuc

SEQ ID NO: 1727636 - RNA, 23 nt, Human
gcccuccaagaccuucuccuuca

SEQ ID NO: 1727637 - RNA, 22 nt, Human
gcccuccaagaccuucuccuuc

SEQ ID NO: 1727638 - RNA, 21 nt, Human
gcccuccaucuaaacugcccc

SEQ ID NO: 1727639 - RNA, 20 nt, Human
gcccuccaucuaaacugccc

SEQ ID NO: 1727640 - RNA, 21 nt, Human
gcccuccaagaccuucuccuu

SEQ ID NO: 1727641 - RNA, 19 nt, Human
gcccuccaagaccuucucc

SEQ ID NO: 1727642 - RNA, 22 nt, Human
gccccgaggccuucucugaagg

SEQ ID NO: 1727643 - RNA, 18 nt, Human
gccccgaggccuucucug

SEQ ID NO: 1727644 - RNA, 14 nt, Human
gccccucagggucc

SEQ ID NO: 1727645 - RNA, 15 nt, Human
gccccgaggccuucu

SEQ ID NO: 1727646 - RNA, 18 nt, Human
gccccucagggucccugg

SEQ ID NO: 1727647 - RNA, 16 nt, Human
gccccucagggucccu

SEQ ID NO: 1727648 - RNA, 17 nt, Human
gccccuguucuggcaga

SEQ ID NO: 1727649 - RNA, 15 nt, Human
gcccgacagccuggc

SEQ ID NO: 1727650 - RNA, 14 nt, Human
gcccgacagccugg

SEQ ID NO: 1727651 - RNA, 12 nt, Human
gcccgacagccu

SEQ ID NO: 1727652 - RNA, 13 nt, Human
gccuuuggcuuca

SEQ ID NO: 1727653 - RNA, 23 nt, Human
gcgacaaugcaaaccaucauuga

SEQ ID NO: 1727654 - RNA, 22 nt, Human
gccuuuggaaacagcucgacuu

SEQ ID NO: 1727655 - RNA, 20 nt, Human
gccuuauggaacacucugag

SEQ ID NO: 1727656 - RNA, 19 nt, Human
gccuuauggaacacucuga

SEQ ID NO: 1727657 - RNA, 18 nt, Human
gccuuauggaacacucug

SEQ ID NO: 1727658 - RNA, 16 nt, Human
gccuuauggaacacuc

SEQ ID NO: 1727659 - RNA, 12 nt, Human
gccuuccagggg

SEQ ID NO: 1727660 - RNA, 13 nt, Human
gccuucaucuccc

SEQ ID NO: 1727661 - RNA, 21 nt, Human
gccuucagggagugagggauu

SEQ ID NO: 1727662 - RNA, 13 nt, Human
gccuucagggagu

SEQ ID NO: 1727663 - RNA, 21 nt, Human
gccuuccaggggugggacacc

SEQ ID NO: 1727664 - RNA, 16 nt, Human
gccuuccagggguggg

SEQ ID NO: 1727665 - RNA, 15 nt, Human
gccuuccaggggugg

SEQ ID NO: 1727666 - RNA, 22 nt, Human
gccuucgauacaccgggccugg

SEQ ID NO: 1727667 - RNA, 18 nt, Human
gccuucgauacaccgggc

SEQ ID NO: 1727668 - RNA, 23 nt, Human
gccuucgauacaccgggccugga

SEQ ID NO: 1727669 - RNA, 22 nt, Human
gccugggggcugggcagaggaa

SEQ ID NO: 1727670 - RNA, 21 nt, Human
gccugguggcagcugcggucc

SEQ ID NO: 1727671 - RNA, 19 nt, Human
gccugguggcagcugcggu

SEQ ID NO: 1727672 - RNA, 18 nt, Human
gccugguggcagcugcgg

SEQ ID NO: 1727673 - RNA, 14 nt, Human
gccugguggcagcu

SEQ ID NO: 1727674 - RNA, 13 nt, Human
gccugguggcagc

SEQ ID NO: 1727675 - RNA, 14 nt, Human
gccuuauggaacac

SEQ ID NO: 1727676 - RNA, 10 nt, Human
gccuuaugga

SEQ ID NO: 1727677 - RNA, 18 nt, Human
gccuuagaagucacacag

SEQ ID NO: 1727678 - RNA, 17 nt, Human
gccuuagaagucacaca

SEQ ID NO: 1727679 - RNA, 19 nt, Human
gccuuagaagucacacagu

SEQ ID NO: 1727680 - RNA, 20 nt, Human
gccuuacacaaugguuuucu

SEQ ID NO: 1727681 - RNA, 21 nt, Human
gccuuacacaaugguuuucuu

SEQ ID NO: 1727682 - RNA, 18 nt, Human
gccuuacccucauguucu

SEQ ID NO: 1727683 - RNA, 13 nt, Human
gccuguuuaagag

SEQ ID NO: 1727684 - RNA, 12 nt, Human
gccuguuuaaga

SEQ ID NO: 1727685 - RNA, 13 nt, Human
gcuaagagggagg

SEQ ID NO: 1727686 - RNA, 14 nt, Human
gcuacacaggggaa

SEQ ID NO: 1727687 - RNA, 13 nt, Human
gcuacacacugca

SEQ ID NO: 1727688 - RNA, 20 nt, Human
gcuacacacugcauguuugu

SEQ ID NO: 1727689 - RNA, 20 nt, Human
gcuaagagggagggagggcu

SEQ ID NO: 1727690 - RNA, 21 nt, Human
gcuaagagggagggagggcuc

SEQ ID NO: 1727691 - RNA, 19 nt, Human
gcuagaacucccuuucaac

SEQ ID NO: 1727692 - RNA, 16 nt, Human
gcuaccuuuguauucu

SEQ ID NO: 1727693 - RNA, 20 nt, Human
gcuaccuuuguauucucucc

SEQ ID NO: 1727694 - RNA, 16 nt, Human
gcuaggaacacuccuu

SEQ ID NO: 1727695 - RNA, 22 nt, Human
gcuaggaaauccaggguggugg

SEQ ID NO: 1727696 - RNA, 15 nt, Human
gcuaggaacacuccu

SEQ ID NO: 1727697 - RNA, 19 nt, Human
gcuaggaaauccagggugg

SEQ ID NO: 1727698 - RNA, 22 nt, Human
gcgacagugagacucugucuca

SEQ ID NO: 1727699 - RNA, 12 nt, Human
gcgacagugaga

SEQ ID NO: 1727700 - RNA, 15 nt, Human
gcgccuacaggagug

SEQ ID NO: 1727701 - RNA, 18 nt, Human
gcgccuacaggagugagc

SEQ ID NO: 1727702 - RNA, 13 nt, Human
gcggacagccacg

SEQ ID NO: 1727703 - RNA, 11 nt, Human
gcggacagcca

SEQ ID NO: 1727704 - RNA, 19 nt, Human
gcgucucauacucaccuca

SEQ ID NO: 1727705 - RNA, 20 nt, Human
gcgggucacaggagggaggg

SEQ ID NO: 1727706 - RNA, 19 nt, Human
gcgggucacaggagggagg

SEQ ID NO: 1727707 - RNA, 15 nt, Human
gcggacagccacggc

SEQ ID NO: 1727708 - RNA, 16 nt, Human
gcggacagccacggcc

SEQ ID NO: 1727709 - RNA, 15 nt, Human
gcgggucacaggagg

SEQ ID NO: 1727710 - RNA, 13 nt, Human
gcgggucacagga

SEQ ID NO: 1727711 - RNA, 18 nt, Human
gcccugcuuugggcugcc

SEQ ID NO: 1727712 - RNA, 16 nt, Human
gcccugcuuugggcug

SEQ ID NO: 1727713 - RNA, 18 nt, Human
gcccuucucuccagcccc

SEQ ID NO: 1727714 - RNA, 17 nt, Human
gcccuucucuccagccc

SEQ ID NO: 1727715 - RNA, 16 nt, Human
gcccuucucuccagcc

SEQ ID NO: 1727716 - RNA, 14 nt, Human
gcccuucucuccag

SEQ ID NO: 1727717 - RNA, 20 nt, Human
gccgggcgugguggugagug

SEQ ID NO: 1727718 - RNA, 21 nt, Human
gccgggcgcgguggcucacgc

SEQ ID NO: 1727719 - RNA, 18 nt, Human
gccgggaccccgagccug

SEQ ID NO: 1727720 - RNA, 23 nt, Human
gccgggaccccgagccuggcucc

SEQ ID NO: 1727721 - RNA, 19 nt, Human
gccgggaccccgagccugg

SEQ ID NO: 1727722 - RNA, 13 nt, Human
gccgcagcccugc

SEQ ID NO: 1727723 - RNA, 12 nt, Human
gccgcagcccug

SEQ ID NO: 1727724 - RNA, 11 nt, Human
gccgcagcccu

SEQ ID NO: 1727725 - RNA, 21 nt, Human
gccgagaucacgccacugcac

SEQ ID NO: 1727726 - RNA, 20 nt, Human
gccgagaucacgccacugca

SEQ ID NO: 1727727 - RNA, 22 nt, Human
gccgagaucacgccacugcacu

SEQ ID NO: 1727728 - RNA, 17 nt, Human
gccucacaguccuuacc

SEQ ID NO: 1727729 - RNA, 13 nt, Human
gccucacaguccu

SEQ ID NO: 1727730 - RNA, 19 nt, Human
gccucaaccuccugggcua

SEQ ID NO: 1727731 - RNA, 18 nt, Human
gccucaaccuccugggcu

SEQ ID NO: 1727732 - RNA, 22 nt, Human
gccuaugugcaugcagcaucua

SEQ ID NO: 1727733 - RNA, 20 nt, Human
gccguguaaccauggaccca

SEQ ID NO: 1727734 - RNA, 22 nt, Human
gccguggcuucccgcucagccc

SEQ ID NO: 1727735 - RNA, 21 nt, Human
gccguggcuucccgcucagcc

SEQ ID NO: 1727736 - RNA, 19 nt, Human
gccguggcuucccgcucag

SEQ ID NO: 1727737 - RNA, 19 nt, Human
gccgugccuucagcucuac

SEQ ID NO: 1727738 - RNA, 17 nt, Human
gccgugccuucagcucu

SEQ ID NO: 1727739 - RNA, 15 nt, Human
gccgugccuucagcu

SEQ ID NO: 1727740 - RNA, 14 nt, Human
gccgugccuucagc

SEQ ID NO: 1727741 - RNA, 17 nt, Human
gccgucuaccugagggg

SEQ ID NO: 1727742 - RNA, 16 nt, Human
gccgucuaccugaggg

SEQ ID NO: 1727743 - RNA, 15 nt, Human
gccgucuaccugagg

SEQ ID NO: 1727744 - RNA, 17 nt, Human
gccucccaucacccgcu

SEQ ID NO: 1727745 - RNA, 19 nt, Human
gccucccgaguagcuggga

SEQ ID NO: 1727746 - RNA, 18 nt, Human
gccucccgaguagcuggg

SEQ ID NO: 1727747 - RNA, 20 nt, Human
gccucccgaguagcugggac

SEQ ID NO: 1727748 - RNA, 19 nt, Human
gccucccaacucaccccag

SEQ ID NO: 1727749 - RNA, 18 nt, Human
gccucccaacucacccca

SEQ ID NO: 1727750 - RNA, 17 nt, Human
gccucccaacucacccc

SEQ ID NO: 1727751 - RNA, 16 nt, Human
gccucccaacucaccc

SEQ ID NO: 1727752 - RNA, 16 nt, Human
gccucccaucacccgc

SEQ ID NO: 1727753 - RNA, 14 nt, Human
gccucccaucaccc

SEQ ID NO: 1727754 - RNA, 13 nt, Human
gccucccaacuca

SEQ ID NO: 1727755 - RNA, 19 nt, Human
gccucccaaagugcuggga

SEQ ID NO: 1727756 - RNA, 18 nt, Human
gccucccaaagugcuggg

SEQ ID NO: 1727757 - RNA, 17 nt, Human
gccucagcauccuggca

SEQ ID NO: 1727758 - RNA, 16 nt, Human
gccucagcauccuggc

SEQ ID NO: 1727759 - RNA, 15 nt, Human
gccucagcauccugg

SEQ ID NO: 1727760 - RNA, 18 nt, Human
gccucacaguccuuacca

SEQ ID NO: 1727761 - RNA, 21 nt, Human
gccucacaguccuuaccagca

SEQ ID NO: 1727762 - RNA, 15 nt, Human
gccugcaagggagug

SEQ ID NO: 1727763 - RNA, 13 nt, Human
gccugcaagggag

SEQ ID NO: 1727764 - RNA, 13 nt, Human
gccucugccucug

SEQ ID NO: 1727765 - RNA, 12 nt, Human
gccucugccucu

SEQ ID NO: 1727766 - RNA, 15 nt, Human
gccucugcacucccc

SEQ ID NO: 1727767 - RNA, 18 nt, Human
gccucugccucugacaca

SEQ ID NO: 1727768 - RNA, 21 nt, Human
gccucugacacacagcucugu

SEQ ID NO: 1727769 - RNA, 20 nt, Human
gccucugacacacagcucug

SEQ ID NO: 1727770 - RNA, 19 nt, Human
gccucugacacacagcucu

SEQ ID NO: 1727771 - RNA, 14 nt, Human
gccucugcacuccc

SEQ ID NO: 1727772 - RNA, 18 nt, Human
gccucugacacacagcuc

SEQ ID NO: 1727773 - RNA, 17 nt, Human
gccucugacacacagcu

SEQ ID NO: 1727774 - RNA, 16 nt, Human
gccucucucaggccaa

SEQ ID NO: 1727775 - RNA, 14 nt, Human
gccucucucaggcc

SEQ ID NO: 1727776 - RNA, 13 nt, Human
gccucucucaggc

SEQ ID NO: 1727777 - RNA, 17 nt, Human
gcaagaauugaagcagg

SEQ ID NO: 1727778 - RNA, 22 nt, Human
gcaagacgcugugcugcccugc

SEQ ID NO: 1727779 - RNA, 21 nt, Human
gcaagacgcugugcugcccug

SEQ ID NO: 1727780 - RNA, 20 nt, Human
gcaagacgcugugcugcccu

SEQ ID NO: 1727781 - RNA, 14 nt, Human
gcaagacgcugugc

SEQ ID NO: 1727782 - RNA, 23 nt, Human
gcaagacgcugugcugcccugcc

SEQ ID NO: 1727783 - RNA, 13 nt, Human
gcaaagcccagcu

SEQ ID NO: 1727784 - RNA, 21 nt, Human
gcaaagcccagcuugaaaccu

SEQ ID NO: 1727785 - RNA, 15 nt, Human
gauuuuugucuugug

SEQ ID NO: 1727786 - RNA, 16 nt, Human
gcaaaguaucccuacu

SEQ ID NO: 1727787 - RNA, 18 nt, Human
gcaaggagauuuacaacu

SEQ ID NO: 1727788 - RNA, 13 nt, Human
gcaaggcugucaa

SEQ ID NO: 1727789 - RNA, 11 nt, Human
gcaaggcuguc

SEQ ID NO: 1727790 - RNA, 23 nt, Human
gcaaugcuggcuguuggcugggg

SEQ ID NO: 1727791 - RNA, 22 nt, Human
gcaaugcuggcuguuggcuggg

SEQ ID NO: 1727792 - RNA, 14 nt, Human
gcaaugcuggcugu

SEQ ID NO: 1727793 - RNA, 13 nt, Human
gcaaugcuggcug

SEQ ID NO: 1727794 - RNA, 23 nt, Human
gcaaugaccuuucaauaggaaaa

SEQ ID NO: 1727795 - RNA, 22 nt, Human
gcaaugaccuuucaauaggaaa

SEQ ID NO: 1727796 - RNA, 20 nt, Human
gcaaugaccuuucaauagga

SEQ ID NO: 1727797 - RNA, 17 nt, Human
gcaaugaccuuucaaua

SEQ ID NO: 1727798 - RNA, 15 nt, Human
gcaaugaccuuucaa

SEQ ID NO: 1727799 - RNA, 17 nt, Human
gcaaucaaaucugcuuu

SEQ ID NO: 1727800 - RNA, 15 nt, Human
gcaaucaaaucugcu

SEQ ID NO: 1727801 - RNA, 14 nt, Human
gcaaggucauuuuu

SEQ ID NO: 1727802 - RNA, 19 nt, Human
gauuuguuaaugauagcua

SEQ ID NO: 1727803 - RNA, 20 nt, Human
gauuugucuuuggugaacau

SEQ ID NO: 1727804 - RNA, 22 nt, Human
gauuugucuuuggugaacauug

SEQ ID NO: 1727805 - RNA, 11 nt, Human
gauuucuguuu

SEQ ID NO: 1727806 - RNA, 19 nt, Human
gauuucuguuuagauaaua

SEQ ID NO: 1727807 - RNA, 22 nt, Human
gauuuggucaacacuaacauga

SEQ ID NO: 1727808 - RNA, 15 nt, Human
gauuuccguuaaaau

SEQ ID NO: 1727809 - RNA, 18 nt, Human
gauuuccguuaaaauacc

SEQ ID NO: 1727810 - RNA, 20 nt, Human
gauugcaacaggcugggcuu

SEQ ID NO: 1727811 - RNA, 18 nt, Human
gauucuuuccugaggcug

SEQ ID NO: 1727812 - RNA, 17 nt, Human
gauucuuuccugaggcu

SEQ ID NO: 1727813 - RNA, 16 nt, Human
gauucuuuccugaggc

SEQ ID NO: 1727814 - RNA, 23 nt, Human
gauugcaccacugcacuccagcc

SEQ ID NO: 1727815 - RNA, 16 nt, Human
gauugcaccacugcac

SEQ ID NO: 1727816 - RNA, 21 nt, Human
gauugcaacaggcugggcuuc

SEQ ID NO: 1727817 - RNA, 12 nt, Human
gauucuuuccug

SEQ ID NO: 1727818 - RNA, 20 nt, Human
gauucccaagcucugcuccu

SEQ ID NO: 1727819 - RNA, 19 nt, Human
gauucccaagcucugcucc

SEQ ID NO: 1727820 - RNA, 21 nt, Human
gauucccaagcucugcuccuc

SEQ ID NO: 1727821 - RNA, 23 nt, Human
gauggggcugcaccggcuggccu

SEQ ID NO: 1727822 - RNA, 15 nt, Human
gauucagcucugcaa

SEQ ID NO: 1727823 - RNA, 13 nt, Human
gauucagcucugc

SEQ ID NO: 1727824 - RNA, 19 nt, Human
gauucagacagcugccugg

SEQ ID NO: 1727825 - RNA, 19 nt, Human
gauucauauuuacuucuua

SEQ ID NO: 1727826 - RNA, 18 nt, Human
gauucauauuuacuucuu

SEQ ID NO: 1727827 - RNA, 17 nt, Human
gauucauauuuacuucu

SEQ ID NO: 1727828 - RNA, 22 nt, Human
gauuccagagaguggcuccucc

SEQ ID NO: 1727829 - RNA, 20 nt, Human
gauuccagagaguggcuccu

SEQ ID NO: 1727830 - RNA, 19 nt, Human
gauuccagagaguggcucc

SEQ ID NO: 1727831 - RNA, 23 nt, Human
gauagauaggucagugcaaauac

SEQ ID NO: 1727832 - RNA, 19 nt, Human
gauacaccgggccuggaga

SEQ ID NO: 1727833 - RNA, 14 nt, Human
gauaauacaccacu

SEQ ID NO: 1727834 - RNA, 18 nt, Human
gauaauacaccacuacau

SEQ ID NO: 1727835 - RNA, 21 nt, Human
gauaauacaccacuacauucu

SEQ ID NO: 1727836 - RNA, 22 nt, Human
gauaauacaccacuacauucug

SEQ ID NO: 1727837 - RNA, 22 nt, Human
gauagcacagacccugcccugu

SEQ ID NO: 1727838 - RNA, 21 nt, Human
gauagcacagacccugcccug

SEQ ID NO: 1727839 - RNA, 19 nt, Human
gauacaggaaaagcugcug

SEQ ID NO: 1727840 - RNA, 18 nt, Human
gauacaggaaaagcugcu

SEQ ID NO: 1727841 - RNA, 22 nt, Human
gauaaauaguuuaugauuccac

SEQ ID NO: 1727842 - RNA, 16 nt, Human
gauaaauaacuuuuuu

SEQ ID NO: 1727843 - RNA, 21 nt, Human
gauaaauaacuuuuuuuuaag

SEQ ID NO: 1727844 - RNA, 21 nt, Human
gauaaauauugagcagaucua

SEQ ID NO: 1727845 - RNA, 21 nt, Human
gaggaaggaaacccagcucug

SEQ ID NO: 1727846 - RNA, 20 nt, Human
gaggaaggaaacccagcucu

SEQ ID NO: 1727847 - RNA, 19 nt, Human
gaggaaggaaacccagcuc

SEQ ID NO: 1727848 - RNA, 13 nt, Human
gaggaaggaaacc

SEQ ID NO: 1727849 - RNA, 19 nt, Human
gauaaaguugguaaaccuu

SEQ ID NO: 1727850 - RNA, 18 nt, Human
gaucacgccacugcacua

SEQ ID NO: 1727851 - RNA, 16 nt, Human
gaucacgccacugcac

SEQ ID NO: 1727852 - RNA, 15 nt, Human
gaucagccugggcaa

SEQ ID NO: 1727853 - RNA, 12 nt, Human
gaucagccuggg

SEQ ID NO: 1727854 - RNA, 22 nt, Human
gaucagucugauucccaagcuc

SEQ ID NO: 1727855 - RNA, 12 nt, Human
gaucacggcuca

SEQ ID NO: 1727856 - RNA, 21 nt, Human
gaucauccacugugccaugug

SEQ ID NO: 1727857 - RNA, 19 nt, Human
gaucauccacugugccaug

SEQ ID NO: 1727858 - RNA, 17 nt, Human
gaucauccacugugcca

SEQ ID NO: 1727859 - RNA, 20 nt, Human
gauccccaagccuggcaagg

SEQ ID NO: 1727860 - RNA, 20 nt, Human
gaucauugugaaauuauuca

SEQ ID NO: 1727861 - RNA, 14 nt, Human
gaucauugugaaau

SEQ ID NO: 1727862 - RNA, 21 nt, Human
gaugcacagaguuguuacauu

SEQ ID NO: 1727863 - RNA, 22 nt, Human
gaugcacagaguuguuacauuu

SEQ ID NO: 1727864 - RNA, 13 nt, Human
gaugcaccagccc

SEQ ID NO: 1727865 - RNA, 14 nt, Human
gaugcaccagcccu

SEQ ID NO: 1727866 - RNA, 12 nt, Human
gaugcagccuca

SEQ ID NO: 1727867 - RNA, 14 nt, Human
gaugcagccucaca

SEQ ID NO: 1727868 - RNA, 19 nt, Human
gaugcagccucacaguccu

SEQ ID NO: 1727869 - RNA, 21 nt, Human
gauggcuaguaucaaaagaaa

SEQ ID NO: 1727870 - RNA, 19 nt, Human
gauggcugugccucugccu

SEQ ID NO: 1727871 - RNA, 18 nt, Human
gauggcugugccucugcc

SEQ ID NO: 1727872 - RNA, 17 nt, Human
gauggcugugccucugc

SEQ ID NO: 1727873 - RNA, 13 nt, Human
gauggcugugccu

SEQ ID NO: 1727874 - RNA, 22 nt, Human
gauggggcccugccuccuuugu

SEQ ID NO: 1727875 - RNA, 14 nt, Human
gauggggcccugcc

SEQ ID NO: 1727876 - RNA, 13 nt, Human
gauggggcccugc

SEQ ID NO: 1727877 - RNA, 20 nt, Human
gauggcugugccucugccug

SEQ ID NO: 1727878 - RNA, 19 nt, Human
gaugccugguggcagcugc

SEQ ID NO: 1727879 - RNA, 18 nt, Human
gaugccugguggcagcug

SEQ ID NO: 1727880 - RNA, 20 nt, Human
gaugccugguggcagcugcg

SEQ ID NO: 1727881 - RNA, 22 nt, Human
gauggauuuccagccaaagccu

SEQ ID NO: 1727882 - RNA, 22 nt, Human
gauccugagccagauuucacuc

SEQ ID NO: 1727883 - RNA, 21 nt, Human
gauccugagccagauuucacu

SEQ ID NO: 1727884 - RNA, 16 nt, Human
gaucccucauccucau

SEQ ID NO: 1727885 - RNA, 15 nt, Human
gaucccucauccuca

SEQ ID NO: 1727886 - RNA, 14 nt, Human
gauccccagcuguu

SEQ ID NO: 1727887 - RNA, 18 nt, Human
gaucuuugcagacaggca

SEQ ID NO: 1727888 - RNA, 13 nt, Human
gaucuuuggacag

SEQ ID NO: 1727889 - RNA, 21 nt, Human
gaucuuuggacagaagcagcu

SEQ ID NO: 1727890 - RNA, 19 nt, Human
gcauuaucuagauacugua

SEQ ID NO: 1727891 - RNA, 17 nt, Human
gcauuaucuagauacug

SEQ ID NO: 1727892 - RNA, 13 nt, Human
gcauuugcugaau

SEQ ID NO: 1727893 - RNA, 17 nt, Human
gcauuugcugaauacag

SEQ ID NO: 1727894 - RNA, 14 nt, Human
gcauuugcugaaua

SEQ ID NO: 1727895 - RNA, 16 nt, Human
gcauuuguuugaacug

SEQ ID NO: 1727896 - RNA, 12 nt, Human
gccaaaggaagc

SEQ ID NO: 1727897 - RNA, 22 nt, Human
gccaaagcuaggccuggccaga

SEQ ID NO: 1727898 - RNA, 16 nt, Human
gccaaagcuaggccug

SEQ ID NO: 1727899 - RNA, 19 nt, Human
gccaaagccuccuccagcc

SEQ ID NO: 1727900 - RNA, 16 nt, Human
gccaaagccuccucca

SEQ ID NO: 1727901 - RNA, 20 nt, Human
gccaaagccaaagcuaggcc

SEQ ID NO: 1727902 - RNA, 13 nt, Human
gccaaagccaaag

SEQ ID NO: 1727903 - RNA, 16 nt, Human
gccaaacucaccugcc

SEQ ID NO: 1727904 - RNA, 14 nt, Human
gccaaacucaccug

SEQ ID NO: 1727905 - RNA, 18 nt, Human
gcauuuguuugaacugau

SEQ ID NO: 1727906 - RNA, 22 nt, Human
gcauuuguuucuuucucugagg

SEQ ID NO: 1727907 - RNA, 22 nt, Human
gcauguucucugaggacacuaa

SEQ ID NO: 1727908 - RNA, 21 nt, Human
gcauguucucugaggacacua

SEQ ID NO: 1727909 - RNA, 15 nt, Human
gcauguucucugagg

SEQ ID NO: 1727910 - RNA, 20 nt, Human
gcauggcaaggacugcaggg

SEQ ID NO: 1727911 - RNA, 18 nt, Human
gcaugcgggcuuccuccu

SEQ ID NO: 1727912 - RNA, 16 nt, Human
gcaucugaaaauugau

SEQ ID NO: 1727913 - RNA, 18 nt, Human
gcaugaaguaauaugcac

SEQ ID NO: 1727914 - RNA, 17 nt, Human
gcaguuauuaacacuaa

SEQ ID NO: 1727915 - RNA, 13 nt, Human
gcauagaaguaaa

SEQ ID NO: 1727916 - RNA, 15 nt, Human
gcagugggagcugcc

SEQ ID NO: 1727917 - RNA, 14 nt, Human
gcagugggagcugc

SEQ ID NO: 1727918 - RNA, 13 nt, Human
gcagugggagcug

SEQ ID NO: 1727919 - RNA, 23 nt, Human
gcaguggugguuuucuguucuuu

SEQ ID NO: 1727920 - RNA, 17 nt, Human
gcauagguuuaauaauu

SEQ ID NO: 1727921 - RNA, 21 nt, Human
gcagggcucagcggggacagc

SEQ ID NO: 1727922 - RNA, 19 nt, Human
gcagggcucagcggggaca

SEQ ID NO: 1727923 - RNA, 16 nt, Human
gcaggcagccaggcca

SEQ ID NO: 1727924 - RNA, 15 nt, Human
gcaggcagccaggcc

SEQ ID NO: 1727925 - RNA, 18 nt, Human
gcagggucucacucuguc

SEQ ID NO: 1727926 - RNA, 17 nt, Human
gcagggucucacucugu

SEQ ID NO: 1727927 - RNA, 22 nt, Human
gcagggcucagcggggacagcu

SEQ ID NO: 1727928 - RNA, 20 nt, Human
gcaggucuugaacuccuggc

SEQ ID NO: 1727929 - RNA, 19 nt, Human
gcaggucuugaacuccugg

SEQ ID NO: 1727930 - RNA, 22 nt, Human
gcagguccaggguuugaguuca

SEQ ID NO: 1727931 - RNA, 16 nt, Human
gcagugcaugcugucc

SEQ ID NO: 1727932 - RNA, 15 nt, Human
gcagugcaugcuguc

SEQ ID NO: 1727933 - RNA, 15 nt, Human
gcagacaggaccagg

SEQ ID NO: 1727934 - RNA, 13 nt, Human
gcagacaggacca

SEQ ID NO: 1727935 - RNA, 12 nt, Human
gcagacaggacc

SEQ ID NO: 1727936 - RNA, 19 nt, Human
gcagacaggcaagcaccuc

SEQ ID NO: 1727937 - RNA, 18 nt, Human
gcagacaggaccagggau

SEQ ID NO: 1727938 - RNA, 23 nt, Human
gcagacaggcaagcaccuccugc

SEQ ID NO: 1727939 - RNA, 14 nt, Human
gcacguauuuuaau

SEQ ID NO: 1727940 - RNA, 15 nt, Human
gcacguauuuuaaua

SEQ ID NO: 1727941 - RNA, 20 nt, Human
gcacugcuuccagugaggcu

SEQ ID NO: 1727942 - RNA, 22 nt, Human
gcacugcuuccagugaggcucu

SEQ ID NO: 1727943 - RNA, 12 nt, Human
gcacugcugccc

SEQ ID NO: 1727944 - RNA, 24 nt, Human
gcacugguggcccgacagccuggc

SEQ ID NO: 1727945 - RNA, 23 nt, Human
gcacugguggcccgacagccugg

SEQ ID NO: 1727946 - RNA, 22 nt, Human
gcacugguggcccgacagccug

SEQ ID NO: 1727947 - RNA, 18 nt, Human
gcacugcuuccagugagg

SEQ ID NO: 1727948 - RNA, 16 nt, Human
gcacugcuuccaguga

SEQ ID NO: 1727949 - RNA, 12 nt, Human
gcacgauuucug

SEQ ID NO: 1727950 - RNA, 18 nt, Human
gcaccuuagacagucccu

SEQ ID NO: 1727951 - RNA, 19 nt, Human
gcaccuuagacagucccug

SEQ ID NO: 1727952 - RNA, 17 nt, Human
gcaccuuagacaguccc

SEQ ID NO: 1727953 - RNA, 14 nt, Human
gcaccuuagacagu

SEQ ID NO: 1727954 - RNA, 22 nt, Human
gcaccuggaauauauaaccagu

SEQ ID NO: 1727955 - RNA, 15 nt, Human
gcacccucaggcagg

SEQ ID NO: 1727956 - RNA, 18 nt, Human
gcaccuggaauauauaac

SEQ ID NO: 1727957 - RNA, 21 nt, Human
gcaccuggaauauauaaccag

SEQ ID NO: 1727958 - RNA, 14 nt, Human
gcaauggcagccuu

SEQ ID NO: 1727959 - RNA, 20 nt, Human
gcaccacugcacuccagccu

SEQ ID NO: 1727960 - RNA, 13 nt, Human
gcaauggcagccu

SEQ ID NO: 1727961 - RNA, 12 nt, Human
gcaauggcagcc

SEQ ID NO: 1727962 - RNA, 22 nt, Human
gcaccacugcacuccagccugg

SEQ ID NO: 1727963 - RNA, 21 nt, Human
gcaccacugcacuccagccug

SEQ ID NO: 1727964 - RNA, 15 nt, Human
gcaccagcagccugg

SEQ ID NO: 1727965 - RNA, 19 nt, Human
gcacccggccccugcuggu

SEQ ID NO: 1727966 - RNA, 22 nt, Human
gcacccaccaucaugucuggcu

SEQ ID NO: 1727967 - RNA, 16 nt, Human
gcaccagcagccugga

SEQ ID NO: 1727968 - RNA, 23 nt, Human
gcaggaggaucacuugaguccag

SEQ ID NO: 1727969 - RNA, 20 nt, Human
gcaggaaggcugagaggaga

SEQ ID NO: 1727970 - RNA, 14 nt, Human
gcaggcagccaggc

SEQ ID NO: 1727971 - RNA, 13 nt, Human
gcaggcagccagg

SEQ ID NO: 1727972 - RNA, 12 nt, Human
gcaggcagccag

SEQ ID NO: 1727973 - RNA, 14 nt, Human
gcagcucaccucuc

SEQ ID NO: 1727974 - RNA, 15 nt, Human
gcagccuuggcaaac

SEQ ID NO: 1727975 - RNA, 15 nt, Human
gcagcucaccucucc

SEQ ID NO: 1727976 - RNA, 17 nt, Human
gcagcccugcagagggc

SEQ ID NO: 1727977 - RNA, 16 nt, Human
gcagcccugcagaggg

SEQ ID NO: 1727978 - RNA, 15 nt, Human
gcagcccugcagagg

SEQ ID NO: 1727979 - RNA, 14 nt, Human
gcagcccugcagag

SEQ ID NO: 1727980 - RNA, 13 nt, Human
gcagcccugcuuu

SEQ ID NO: 1727981 - RNA, 20 nt, Human
gcagccccgugggguuccuc

SEQ ID NO: 1727982 - RNA, 21 nt, Human
gcagccccuguucuggcagag

SEQ ID NO: 1727983 - RNA, 20 nt, Human
gcagccccuguucuggcaga

SEQ ID NO: 1727984 - RNA, 13 nt, Human
gcagcccugcaga

SEQ ID NO: 1727985 - RNA, 24 nt, Human
gcagccccauucugccugcccagg

SEQ ID NO: 1727986 - RNA, 21 nt, Human
gcagccccauucugccugccc

SEQ ID NO: 1727987 - RNA, 19 nt, Human
gcagccccauucugccugc

SEQ ID NO: 1727988 - RNA, 18 nt, Human
gcagccccauucugccug

SEQ ID NO: 1727989 - RNA, 16 nt, Human
gcagcaauaaagcagc

SEQ ID NO: 1727990 - RNA, 23 nt, Human
gcagcaauaaagcagcguuucua

SEQ ID NO: 1727991 - RNA, 17 nt, Human
gcagccccauucugccu

SEQ ID NO: 1727992 - RNA, 22 nt, Human
gcagauacaggaaaagcugcug

SEQ ID NO: 1727993 - RNA, 18 nt, Human
gcagauaaacaguaguga

SEQ ID NO: 1727994 - RNA, 21 nt, Human
gcagaguugaagacagagcua

SEQ ID NO: 1727995 - RNA, 17 nt, Human
gcagacaguuaagagaa

SEQ ID NO: 1727996 - RNA, 21 nt, Human
gaccuuucaauaggaaaaacu

SEQ ID NO: 1727997 - RNA, 23 nt, Human
gaccuugaacuggguacuugugg

SEQ ID NO: 1727998 - RNA, 19 nt, Human
gaccugccucggccuccca

SEQ ID NO: 1727999 - RNA, 20 nt, Human
gacguguuaugacuccagaa

SEQ ID NO: 1728000 - RNA, 17 nt, Human
gacguguuaugacucca

SEQ ID NO: 1728001 - RNA, 18 nt, Human
gacggagucccaccuugg

SEQ ID NO: 1728002 - RNA, 14 nt, Human
gacggagucccacc

SEQ ID NO: 1728003 - RNA, 21 nt, Human
gacggagucccaccuuggcug

SEQ ID NO: 1728004 - RNA, 23 nt, Human
gacggagucccaccuuggcugca

SEQ ID NO: 1728005 - RNA, 17 nt, Human
gacgggguuucaccaug

SEQ ID NO: 1728006 - RNA, 16 nt, Human
gacuccugcaggcagc

SEQ ID NO: 1728007 - RNA, 15 nt, Human
gacuccugcaggcag

SEQ ID NO: 1728008 - RNA, 14 nt, Human
gacuccugcaggca

SEQ ID NO: 1728009 - RNA, 15 nt, Human
gacucagguugucug

SEQ ID NO: 1728010 - RNA, 15 nt, Human
gacucaguggggagg

SEQ ID NO: 1728011 - RNA, 22 nt, Human
gacguguuaugacuccagaauu

SEQ ID NO: 1728012 - RNA, 17 nt, Human
gacuacucccccaggug

SEQ ID NO: 1728013 - RNA, 12 nt, Human
gacuacaggcac

SEQ ID NO: 1728014 - RNA, 23 nt, Human
gaccugauuucugagcauuuaau

SEQ ID NO: 1728015 - RNA, 15 nt, Human
gaccugccucggccu

SEQ ID NO: 1728016 - RNA, 21 nt, Human
gaccugccccuccucucugcc

SEQ ID NO: 1728017 - RNA, 15 nt, Human
gaccugaggcccuuc

SEQ ID NO: 1728018 - RNA, 13 nt, Human
gaccucaggccug

SEQ ID NO: 1728019 - RNA, 12 nt, Human
gaccucaggccu

SEQ ID NO: 1728020 - RNA, 11 nt, Human
gaccucaggcc

SEQ ID NO: 1728021 - RNA, 21 nt, Human
gaccugaggcccuucucucca

SEQ ID NO: 1728022 - RNA, 18 nt, Human
gaccugaggcccuucucu

SEQ ID NO: 1728023 - RNA, 17 nt, Human
gacccugcccugugggc

SEQ ID NO: 1728024 - RNA, 15 nt, Human
gaccgugaggccaga

SEQ ID NO: 1728025 - RNA, 14 nt, Human
gaccgugaggccag

SEQ ID NO: 1728026 - RNA, 17 nt, Human
gacccaugcugcccugu

SEQ ID NO: 1728027 - RNA, 16 nt, Human
gacccaugcugcccug

SEQ ID NO: 1728028 - RNA, 15 nt, Human
gacccaugcugcccu

SEQ ID NO: 1728029 - RNA, 14 nt, Human
gacccaugcugccc

SEQ ID NO: 1728030 - RNA, 12 nt, Human
gacccacugcuu

SEQ ID NO: 1728031 - RNA, 11 nt, Human
gacccacugcu

SEQ ID NO: 1728032 - RNA, 13 nt, Human
gaccccuccaugu

SEQ ID NO: 1728033 - RNA, 23 nt, Human
gaccccucauagcccucacccug

SEQ ID NO: 1728034 - RNA, 22 nt, Human
gaccccucauagcccucacccu

SEQ ID NO: 1728035 - RNA, 20 nt, Human
gaccccgagccuggcuccaa

SEQ ID NO: 1728036 - RNA, 23 nt, Human
gacccugucucaaaaaaagaaaa

SEQ ID NO: 1728037 - RNA, 16 nt, Human
gacccugcccuguggg

SEQ ID NO: 1728038 - RNA, 15 nt, Human
gacccugcccugugg

SEQ ID NO: 1728039 - RNA, 13 nt, Human
gacccugcccugu

SEQ ID NO: 1728040 - RNA, 21 nt, Human
gacccugaggcccagagggcc

SEQ ID NO: 1728041 - RNA, 20 nt, Human
gacccugaggcccagagggc

SEQ ID NO: 1728042 - RNA, 19 nt, Human
gacccugaggcccagaggg

SEQ ID NO: 1728043 - RNA, 17 nt, Human
gacaugucuuuucuugc

SEQ ID NO: 1728044 - RNA, 21 nt, Human
gacaugucuuuucuugcauga

SEQ ID NO: 1728045 - RNA, 23 nt, Human
gacauacuaaccagcagaaaugc

SEQ ID NO: 1728046 - RNA, 14 nt, Human
gacaucaacagaua

SEQ ID NO: 1728047 - RNA, 15 nt, Human
gacauacuaaccagc

SEQ ID NO: 1728048 - RNA, 16 nt, Human
gacauacuaaccagca

SEQ ID NO: 1728049 - RNA, 16 nt, Human
gacagacacaggcccg

SEQ ID NO: 1728050 - RNA, 15 nt, Human
gacagacacaggccc

SEQ ID NO: 1728051 - RNA, 23 nt, Human
gacagaucucugcuuuggaaauc

SEQ ID NO: 1728052 - RNA, 21 nt, Human
gacagaucucugcuuuggaaa

SEQ ID NO: 1728053 - RNA, 19 nt, Human
gacagaucucugcuuugga

SEQ ID NO: 1728054 - RNA, 21 nt, Human
gacacuaaccacgcuggaccu

SEQ ID NO: 1728055 - RNA, 20 nt, Human
gacacuaaccacgcuggacc

SEQ ID NO: 1728056 - RNA, 14 nt, Human
gacagacacaggcc

SEQ ID NO: 1728057 - RNA, 13 nt, Human
gacagcugccugg

SEQ ID NO: 1728058 - RNA, 12 nt, Human
gacagcugccug

SEQ ID NO: 1728059 - RNA, 13 nt, Human
gacagccacggcc

SEQ ID NO: 1728060 - RNA, 22 nt, Human
gacagccaacuauggccugugg

SEQ ID NO: 1728061 - RNA, 19 nt, Human
gacagccaacuauggccug

SEQ ID NO: 1728062 - RNA, 12 nt, Human
gacagcaugaga

SEQ ID NO: 1728063 - RNA, 15 nt, Human
gacagcugccuggga

SEQ ID NO: 1728064 - RNA, 14 nt, Human
gacagcugccuggg

SEQ ID NO: 1728065 - RNA, 19 nt, Human
gacaggcauguucucugag

SEQ ID NO: 1728066 - RNA, 18 nt, Human
gacaggcauguucucuga

SEQ ID NO: 1728067 - RNA, 17 nt, Human
gacaggcaaugcuggcu

SEQ ID NO: 1728068 - RNA, 16 nt, Human
gacaggcaaugcuggc

SEQ ID NO: 1728069 - RNA, 14 nt, Human
gacaggcaaugcug

SEQ ID NO: 1728070 - RNA, 22 nt, Human
gacaaggauugcuacuguccua

SEQ ID NO: 1728071 - RNA, 16 nt, Human
gaagucuuuguacaga

SEQ ID NO: 1728072 - RNA, 14 nt, Human
gaagucuuuguaca

SEQ ID NO: 1728073 - RNA, 16 nt, Human
gacaaugacccagugg

SEQ ID NO: 1728074 - RNA, 17 nt, Human
gacacaggcccggcucc

SEQ ID NO: 1728075 - RNA, 15 nt, Human
gacacaggcccggcu

SEQ ID NO: 1728076 - RNA, 13 nt, Human
gacacacagcucu

SEQ ID NO: 1728077 - RNA, 13 nt, Human
gacaauuuauuau

SEQ ID NO: 1728078 - RNA, 19 nt, Human
gacaauuuauuauggcaca

SEQ ID NO: 1728079 - RNA, 17 nt, Human
gacaaugacuuacugua

SEQ ID NO: 1728080 - RNA, 20 nt, Human
gacaaugacuuacuguacau

SEQ ID NO: 1728081 - RNA, 12 nt, Human
gacaaugcaaac

SEQ ID NO: 1728082 - RNA, 21 nt, Human
gacaaugacuuacuguacaug

SEQ ID NO: 1728083 - RNA, 18 nt, Human
gacaaugcaaaccaucau

SEQ ID NO: 1728084 - RNA, 16 nt, Human
gacaaugcaaaccauc

SEQ ID NO: 1728085 - RNA, 12 nt, Human
gacaauuuauua

SEQ ID NO: 1728086 - RNA, 18 nt, Human
gacacuaaccacgcugga

SEQ ID NO: 1728087 - RNA, 17 nt, Human
gacacuaaccacgcugg

SEQ ID NO: 1728088 - RNA, 16 nt, Human
gacacuaaccacgcug

SEQ ID NO: 1728089 - RNA, 15 nt, Human
gacacuaaccacgcu

SEQ ID NO: 1728090 - RNA, 18 nt, Human
gacacgaauauugcugau

SEQ ID NO: 1728091 - RNA, 17 nt, Human
gacacgaauauugcuga

SEQ ID NO: 1728092 - RNA, 19 nt, Human
gacacgaauauugcugaug

SEQ ID NO: 1728093 - RNA, 17 nt, Human
gacaccuugacagggca

SEQ ID NO: 1728094 - RNA, 15 nt, Human
gacaccuugacaggg

SEQ ID NO: 1728095 - RNA, 20 nt, Human
gacaccuugacagggcacac

SEQ ID NO: 1728096 - RNA, 18 nt, Human
gacaccuugacagggcac

SEQ ID NO: 1728097 - RNA, 15 nt, Human
gacacgaauauugcu

SEQ ID NO: 1728098 - RNA, 18 nt, Human
gacacaggcccggcucca

SEQ ID NO: 1728099 - RNA, 17 nt, Human
gacacagugaccauacu

SEQ ID NO: 1728100 - RNA, 13 nt, Human
gacacccugugau

SEQ ID NO: 1728101 - RNA, 12 nt, Human
gacacccuguga

SEQ ID NO: 1728102 - RNA, 23 nt, Human
gacacccugugauggggcccugc

SEQ ID NO: 1728103 - RNA, 22 nt, Human
gacacccugugauggggcccug

SEQ ID NO: 1728104 - RNA, 17 nt, Human
gacaccuacugaguggc

SEQ ID NO: 1728105 - RNA, 17 nt, Human
gagauacagaauuuuau

SEQ ID NO: 1728106 - RNA, 19 nt, Human
gagagugaacaaauuuaca

SEQ ID NO: 1728107 - RNA, 15 nt, Human
gagagugaacaaauu

SEQ ID NO: 1728108 - RNA, 14 nt, Human
gagagccuuccagg

SEQ ID NO: 1728109 - RNA, 13 nt, Human
gagagccuuccag

SEQ ID NO: 1728110 - RNA, 18 nt, Human
gagaggggaacagacugg

SEQ ID NO: 1728111 - RNA, 13 nt, Human
gagaggggaacag

SEQ ID NO: 1728112 - RNA, 21 nt, Human
gagagggugggagugggccca

SEQ ID NO: 1728113 - RNA, 17 nt, Human
gagagaagagaaugcac

SEQ ID NO: 1728114 - RNA, 15 nt, Human
gagacagcucugcau

SEQ ID NO: 1728115 - RNA, 18 nt, Human
gagacagcucugcauacu

SEQ ID NO: 1728116 - RNA, 13 nt, Human
gagacagcucugc

SEQ ID NO: 1728117 - RNA, 24 nt, Human
gagacagcccgggcucugccuccc

SEQ ID NO: 1728118 - RNA, 23 nt, Human
gagacagcccgggcucugccucc

SEQ ID NO: 1728119 - RNA, 22 nt, Human
gagacagcccgggcucugccuc

SEQ ID NO: 1728120 - RNA, 21 nt, Human
gagacagcccgggcucugccu

SEQ ID NO: 1728121 - RNA, 20 nt, Human
gagacagcccgggcucugcc

SEQ ID NO: 1728122 - RNA, 19 nt, Human
gagacagcccgggcucugc

SEQ ID NO: 1728123 - RNA, 18 nt, Human
gagacagcccgggcucug

SEQ ID NO: 1728124 - RNA, 17 nt, Human
gagacagcccgggcucu

SEQ ID NO: 1728125 - RNA, 14 nt, Human
gagacagcccgggc

SEQ ID NO: 1728126 - RNA, 14 nt, Human
gagacucugucuca

SEQ ID NO: 1728127 - RNA, 22 nt, Human
gagacugucucaagagggcacu

SEQ ID NO: 1728128 - RNA, 13 nt, Human
gagacuuguauga

SEQ ID NO: 1728129 - RNA, 23 nt, Human
gagacugucucaagagggcacug

SEQ ID NO: 1728130 - RNA, 18 nt, Human
gagacucgcgacaaugca

SEQ ID NO: 1728131 - RNA, 16 nt, Human
gagacucgcgacaaug

SEQ ID NO: 1728132 - RNA, 12 nt, Human
gagaccaucccu

SEQ ID NO: 1728133 - RNA, 21 nt, Human
gagaaaauggacguguuauga

SEQ ID NO: 1728134 - RNA, 18 nt, Human
gacucgcgacaaugcaaa

SEQ ID NO: 1728135 - RNA, 17 nt, Human
gacuccugcaggcagcc

SEQ ID NO: 1728136 - RNA, 19 nt, Human
gacucgcgacaaugcaaac

SEQ ID NO: 1728137 - RNA, 16 nt, Human
gacuuggaagcuccgc

SEQ ID NO: 1728138 - RNA, 15 nt, Human
gacuuggaagcuccg

SEQ ID NO: 1728139 - RNA, 14 nt, Human
gacuuggaagcucc

SEQ ID NO: 1728140 - RNA, 23 nt, Human
gagaaaguacuucuccacccugc

SEQ ID NO: 1728141 - RNA, 14 nt, Human
gagaaauuuauaaa

SEQ ID NO: 1728142 - RNA, 12 nt, Human
gagaaaugaaaa

SEQ ID NO: 1728143 - RNA, 21 nt, Human
gagaaugcacaaacagaggcc

SEQ ID NO: 1728144 - RNA, 20 nt, Human
gagaaugcacaaacagaggc

SEQ ID NO: 1728145 - RNA, 22 nt, Human
gagaaugcacaaacagaggccg

SEQ ID NO: 1728146 - RNA, 17 nt, Human
gagacacaagccuucgg

SEQ ID NO: 1728147 - RNA, 15 nt, Human
gagacacaagccuuc

SEQ ID NO: 1728148 - RNA, 19 nt, Human
gagacagaguuuucacucu

SEQ ID NO: 1728149 - RNA, 17 nt, Human
gagacagacuagaaguu

SEQ ID NO: 1728150 - RNA, 12 nt, Human
gagacagcccgg

SEQ ID NO: 1728151 - RNA, 16 nt, Human
gagacagccaacuaug

SEQ ID NO: 1728152 - RNA, 15 nt, Human
gagacagacuagaag

SEQ ID NO: 1728153 - RNA, 18 nt, Human
gaggaagccgcuggggcc

SEQ ID NO: 1728154 - RNA, 17 nt, Human
gaggaagccgcuggggc

SEQ ID NO: 1728155 - RNA, 14 nt, Human
gaggaagccgcugg

SEQ ID NO: 1728156 - RNA, 13 nt, Human
gaggaagccgcug

SEQ ID NO: 1728157 - RNA, 17 nt, Human
gaggaagagaaaaaaua

SEQ ID NO: 1728158 - RNA, 16 nt, Human
gaggaacaaggcaagg

SEQ ID NO: 1728159 - RNA, 14 nt, Human
gaggaacaaggcaa

SEQ ID NO: 1728160 - RNA, 22 nt, Human
gagcuugaaacccguggcgcuu

SEQ ID NO: 1728161 - RNA, 22 nt, Human
gagcuuucugcuaucaaagagg

SEQ ID NO: 1728162 - RNA, 20 nt, Human
gagcuuugaaaauucagugg

SEQ ID NO: 1728163 - RNA, 17 nt, Human
gaggaaagcaaaggaga

SEQ ID NO: 1728164 - RNA, 16 nt, Human
gaggaaagcaaaggag

SEQ ID NO: 1728165 - RNA, 23 nt, Human
gagcuuugucuacuucaaaaguu

SEQ ID NO: 1728166 - RNA, 23 nt, Human
gaggaaaaccaagccguggcuuc

SEQ ID NO: 1728167 - RNA, 21 nt, Human
gaggaaaaccaagccguggcu

SEQ ID NO: 1728168 - RNA, 20 nt, Human
gaggaaaaccaagccguggc

SEQ ID NO: 1728169 - RNA, 15 nt, Human
gagcugaguggggga

SEQ ID NO: 1728170 - RNA, 17 nt, Human
gagcuagcagcagggag

SEQ ID NO: 1728171 - RNA, 15 nt, Human
gagcuagcagcaggg

SEQ ID NO: 1728172 - RNA, 15 nt, Human
gagccugcaguuauu

SEQ ID NO: 1728173 - RNA, 20 nt, Human
gagccgagaucacgccacug

SEQ ID NO: 1728174 - RNA, 19 nt, Human
gagccgagaucacgccacu

SEQ ID NO: 1728175 - RNA, 18 nt, Human
gagcccacgcccccacug

SEQ ID NO: 1728176 - RNA, 21 nt, Human
gagcccacuguacuugcucuu

SEQ ID NO: 1728177 - RNA, 18 nt, Human
gagcccacuguacuugcu

SEQ ID NO: 1728178 - RNA, 22 nt, Human
gagccgagaucacgccacugca

SEQ ID NO: 1728179 - RNA, 21 nt, Human
gagccgagaucacgccacugc

SEQ ID NO: 1728180 - RNA, 15 nt, Human
gagccucagcauccu

SEQ ID NO: 1728181 - RNA, 14 nt, Human
gagccucagcaucc

SEQ ID NO: 1728182 - RNA, 17 nt, Human
gagccucagcauccugg

SEQ ID NO: 1728183 - RNA, 19 nt, Human
gagccucagucucccuccc

SEQ ID NO: 1728184 - RNA, 13 nt, Human
gagccucagcauc

SEQ ID NO: 1728185 - RNA, 13 nt, Human
gagccuccugccc

SEQ ID NO: 1728186 - RNA, 12 nt, Human
gagccugcaguu

SEQ ID NO: 1728187 - RNA, 16 nt, Human
gagcagagaccauccc

SEQ ID NO: 1728188 - RNA, 18 nt, Human
gagcagagaccaucccug

SEQ ID NO: 1728189 - RNA, 17 nt, Human
gagcagagaccaucccu

SEQ ID NO: 1728190 - RNA, 21 nt, Human
gagauagccaaggccaaagga

SEQ ID NO: 1728191 - RNA, 20 nt, Human
gagauagccaaggccaaagg

SEQ ID NO: 1728192 - RNA, 21 nt, Human
gagcagagaccaucccugaag

SEQ ID NO: 1728193 - RNA, 19 nt, Human
gagcagagaccaucccuga

SEQ ID NO: 1728194 - RNA, 23 nt, Human
gagcagagaccaucccugaaggc

SEQ ID NO: 1728195 - RNA, 22 nt, Human
gagcagccacauuccugaugcu

SEQ ID NO: 1728196 - RNA, 21 nt, Human
gagcagccacauuccugaugc

SEQ ID NO: 1728197 - RNA, 19 nt, Human
gagccagauuucacucucc

SEQ ID NO: 1728198 - RNA, 18 nt, Human
gagccagauuucacucuc

SEQ ID NO: 1728199 - RNA, 15 nt, Human
gagccagauuucacu

SEQ ID NO: 1728200 - RNA, 20 nt, Human
gagccacugcaccgggccac

SEQ ID NO: 1728201 - RNA, 19 nt, Human
gagccacugcaccgggcca

SEQ ID NO: 1728202 - RNA, 18 nt, Human
gagccacugcaccgggcc

SEQ ID NO: 1728203 - RNA, 17 nt, Human
gagcccaccuuggcuca

SEQ ID NO: 1728204 - RNA, 15 nt, Human
gagcccaccuuggcu

SEQ ID NO: 1728205 - RNA, 13 nt, Human
gagcccaccuugg

SEQ ID NO: 1728206 - RNA, 16 nt, Human
gaaaggaaagaggcuc

SEQ ID NO: 1728207 - RNA, 11 nt, Human
gaaaggaaaga

SEQ ID NO: 1728208 - RNA, 16 nt, Human
gaaaguuuacaggaaa

SEQ ID NO: 1728209 - RNA, 14 nt, Human
gaaaguuuacagga

SEQ ID NO: 1728210 - RNA, 20 nt, Human
gaaacuaggugcauauuuau

SEQ ID NO: 1728211 - RNA, 16 nt, Human
gaaaaaugagccuggc

SEQ ID NO: 1728212 - RNA, 13 nt, Human
gaaagcagaacag

SEQ ID NO: 1728213 - RNA, 14 nt, Human
gaaagcagaacagu

SEQ ID NO: 1728214 - RNA, 23 nt, Human
gaaagauggcugugccucugccu

SEQ ID NO: 1728215 - RNA, 16 nt, Human
gaaagaucaaaagguu

SEQ ID NO: 1728216 - RNA, 22 nt, Human
gaaagauggcugugccucugcc

SEQ ID NO: 1728217 - RNA, 17 nt, Human
gaaagacuguacaaagu

SEQ ID NO: 1728218 - RNA, 16 nt, Human
gaacacuccuucacag

SEQ ID NO: 1728219 - RNA, 15 nt, Human
gaacacuccuucaca

SEQ ID NO: 1728220 - RNA, 17 nt, Human
gaacacuccuucacaga

SEQ ID NO: 1728221 - RNA, 20 nt, Human
gaacagacuggaagcacagc

SEQ ID NO: 1728222 - RNA, 23 nt, Human
gaaauuaguacuccccuccuuga

SEQ ID NO: 1728223 - RNA, 20 nt, Human
gaaauuuccacucaggucug

SEQ ID NO: 1728224 - RNA, 19 nt, Human
gaaauuuccacucaggucu

SEQ ID NO: 1728225 - RNA, 22 nt, Human
gaacagacuggaagcacagcuu

SEQ ID NO: 1728226 - RNA, 20 nt, Human
gaaauaucugaaaauguaug

SEQ ID NO: 1728227 - RNA, 19 nt, Human
gaaauaucugaaaauguau

SEQ ID NO: 1728228 - RNA, 18 nt, Human
gaaauaucugaaaaugua

SEQ ID NO: 1728229 - RNA, 17 nt, Human
gaaauauaggaacuuaa

SEQ ID NO: 1728230 - RNA, 19 nt, Human
gaaaugggcagagcagaga

SEQ ID NO: 1728231 - RNA, 17 nt, Human
gaaaugggcagagcaga

SEQ ID NO: 1728232 - RNA, 17 nt, Human
gaaauguacagcaagga

SEQ ID NO: 1728233 - RNA, 15 nt, Human
gaaaugggcagagca

SEQ ID NO: 1728234 - RNA, 16 nt, Human
gaaaugggcagagcag

SEQ ID NO: 1728235 - RNA, 18 nt, Human
gaaaugaggucagagccu

SEQ ID NO: 1728236 - RNA, 11 nt, Human
gaaaugagcug

SEQ ID NO: 1728237 - RNA, 15 nt, Human
gaagggggcugggac

SEQ ID NO: 1728238 - RNA, 13 nt, Human
gaagggggcuggg

SEQ ID NO: 1728239 - RNA, 18 nt, Human
gaaggcagggagggccug

SEQ ID NO: 1728240 - RNA, 23 nt, Human
gaaggcagggagggccugggccc

SEQ ID NO: 1728241 - RNA, 22 nt, Human
gaaggcagggagggccugggcc

SEQ ID NO: 1728242 - RNA, 20 nt, Human
gaaggcagggagggccuggg

SEQ ID NO: 1728243 - RNA, 15 nt, Human
gaagucacugcacag

SEQ ID NO: 1728244 - RNA, 21 nt, Human
gaaggugaggagcuugaaacc

SEQ ID NO: 1728245 - RNA, 19 nt, Human
gaaguaauaugcacacauu

SEQ ID NO: 1728246 - RNA, 20 nt, Human
gaaguaauaugcacacauuu

SEQ ID NO: 1728247 - RNA, 13 nt, Human
gaagucacacagu

SEQ ID NO: 1728248 - RNA, 21 nt, Human
gaaguaauaugcacacauuuu

SEQ ID NO: 1728249 - RNA, 14 nt, Human
gaagccgcuggggc

SEQ ID NO: 1728250 - RNA, 21 nt, Human
gaagccgcuggggccaguugg

SEQ ID NO: 1728251 - RNA, 20 nt, Human
gaagccgcuggggccaguug

SEQ ID NO: 1728252 - RNA, 18 nt, Human
gaagccgcuggggccagu

SEQ ID NO: 1728253 - RNA, 20 nt, Human
gaaggaaacccagcucuggu

SEQ ID NO: 1728254 - RNA, 19 nt, Human
gaaggaaacccagcucugg

SEQ ID NO: 1728255 - RNA, 21 nt, Human
gaaggacauugcggacagcca

SEQ ID NO: 1728256 - RNA, 20 nt, Human
gaaggacauugcggacagcc

SEQ ID NO: 1728257 - RNA, 19 nt, Human
gaaggacauugcggacagc

SEQ ID NO: 1728258 - RNA, 22 nt, Human
gaaggaauaaauugcuccuuga

SEQ ID NO: 1728259 - RNA, 22 nt, Human
gaaggacccggaggggccuggc

SEQ ID NO: 1728260 - RNA, 15 nt, Human
gaaggaacguccccu

SEQ ID NO: 1728261 - RNA, 22 nt, Human
gaaggaaacccagcucuggucc

SEQ ID NO: 1728262 - RNA, 21 nt, Human
gaaggaaacccagcucugguc

SEQ ID NO: 1728263 - RNA, 19 nt, Human
gaaggaagacuucaucccu

SEQ ID NO: 1728264 - RNA, 17 nt, Human
gaagauguagaggagaa

SEQ ID NO: 1728265 - RNA, 23 nt, Human
gaagauuuugaaauuuuuauuaa

SEQ ID NO: 1728266 - RNA, 22 nt, Human
gaagauugagauguguucacaa

SEQ ID NO: 1728267 - RNA, 17 nt, Human
gaagauugagauguguu

SEQ ID NO: 1728268 - RNA, 19 nt, Human
gaagacuucaucccucugg

SEQ ID NO: 1728269 - RNA, 17 nt, Human
gaagacuucaucccucu

SEQ ID NO: 1728270 - RNA, 12 nt, Human
gaagagccuugc

SEQ ID NO: 1728271 - RNA, 16 nt, Human
gaagacuucaucccuc

SEQ ID NO: 1728272 - RNA, 15 nt, Human
gaagacuucaucccu

SEQ ID NO: 1728273 - RNA, 22 nt, Human
gaacuuguaaaggaauuuaaaa

SEQ ID NO: 1728274 - RNA, 17 nt, Human
gaacuugggccacugug

SEQ ID NO: 1728275 - RNA, 18 nt, Human
gaacuuggcgcugccccu

SEQ ID NO: 1728276 - RNA, 15 nt, Human
gaacuuguuuucugg

SEQ ID NO: 1728277 - RNA, 12 nt, Human
gaacuugguucc

SEQ ID NO: 1728278 - RNA, 17 nt, Human
gaacuuuccaggaaggc

SEQ ID NO: 1728279 - RNA, 16 nt, Human
gaacuuugaccucugc

SEQ ID NO: 1728280 - RNA, 22 nt, Human
gaacuuugaccucugcagcaau

SEQ ID NO: 1728281 - RNA, 17 nt, Human
gaacuuggcgcugcccc

SEQ ID NO: 1728282 - RNA, 14 nt, Human
gaacuuaaauaaug

SEQ ID NO: 1728283 - RNA, 17 nt, Human
gaacuuaaauaauguga

SEQ ID NO: 1728284 - RNA, 18 nt, Human
gaaccacaucuugcucug

SEQ ID NO: 1728285 - RNA, 20 nt, Human
gaaccacaucuugcucugcu

SEQ ID NO: 1728286 - RNA, 16 nt, Human
gaacucccuuucaaca

SEQ ID NO: 1728287 - RNA, 15 nt, Human
gaacuccuaaaucaa

SEQ ID NO: 1728288 - RNA, 13 nt, Human
gaacuccugaccu

SEQ ID NO: 1728289 - RNA, 16 nt, Human
gaacuccuaaaucaag

SEQ ID NO: 1728290 - RNA, 17 nt, Human
cuugccaaauauaaaua

SEQ ID NO: 1728291 - RNA, 13 nt, Human
cuugcuugcuuuu

SEQ ID NO: 1728292 - RNA, 15 nt, Human
cuugcuuuuaaaauc

SEQ ID NO: 1728293 - RNA, 13 nt, Human
cuuggcugcaggg

SEQ ID NO: 1728294 - RNA, 12 nt, Human
cuuggcugcagg

SEQ ID NO: 1728295 - RNA, 14 nt, Human
cuuggauugucccc

SEQ ID NO: 1728296 - RNA, 13 nt, Human
cuuggauuguccc

SEQ ID NO: 1728297 - RNA, 23 nt, Human
cuuggcucaaguccucuuuucug

SEQ ID NO: 1728298 - RNA, 24 nt, Human
cuuggcucacugcaacuucugccu

SEQ ID NO: 1728299 - RNA, 18 nt, Human
cuuguaaaggaauuuaaa

SEQ ID NO: 1728300 - RNA, 18 nt, Human
cuuguaaaaauuaaaagu

SEQ ID NO: 1728301 - RNA, 19 nt, Human
cuuggggaccagagcugcc

SEQ ID NO: 1728302 - RNA, 18 nt, Human
cuuggggaccagagcugc

SEQ ID NO: 1728303 - RNA, 17 nt, Human
cuuggggaccagagcug

SEQ ID NO: 1728304 - RNA, 14 nt, Human
cuuggcugcaggga

SEQ ID NO: 1728305 - RNA, 18 nt, Human
cuuguauuauguguguuu

SEQ ID NO: 1728306 - RNA, 18 nt, Human
cuuguggacacagcucuu

SEQ ID NO: 1728307 - RNA, 17 nt, Human
cuuguggacacagcucu

SEQ ID NO: 1728308 - RNA, 13 nt, Human
cuuguauuaaguu

SEQ ID NO: 1728309 - RNA, 17 nt, Human
cuuguauuaaguuguua

SEQ ID NO: 1728310 - RNA, 13 nt, Human
cuuguauuaugug

SEQ ID NO: 1728311 - RNA, 22 nt, Human
cuuguauuaaguuguuaauaaa

SEQ ID NO: 1728312 - RNA, 23 nt, Human
cuuguauuaaguuguuaauaaaa

SEQ ID NO: 1728313 - RNA, 21 nt, Human
cuuguaugaaagauggcugug

SEQ ID NO: 1728314 - RNA, 14 nt, Human
cuuguaacuaaaau

SEQ ID NO: 1728315 - RNA, 16 nt, Human
cuuguaacuaaaauaa

SEQ ID NO: 1728316 - RNA, 17 nt, Human
cuuguaacuaaaauaau

SEQ ID NO: 1728317 - RNA, 22 nt, Human
cuuguaacuaaaauaauuuugu

SEQ ID NO: 1728318 - RNA, 18 nt, Human
cuugcagacucuacagag

SEQ ID NO: 1728319 - RNA, 20 nt, Human
cuugcagacucuacagaggc

SEQ ID NO: 1728320 - RNA, 21 nt, Human
cuugcaugguuuagaaagcuu

SEQ ID NO: 1728321 - RNA, 21 nt, Human
cuugcaugaggcuaguguggu

SEQ ID NO: 1728322 - RNA, 14 nt, Human
cuugcaauggcagc

SEQ ID NO: 1728323 - RNA, 19 nt, Human
cuugcacguauuuuaauag

SEQ ID NO: 1728324 - RNA, 22 nt, Human
cuugcaaaguaucccuacugua

SEQ ID NO: 1728325 - RNA, 21 nt, Human
cuugaccauucuccaccugcc

SEQ ID NO: 1728326 - RNA, 14 nt, Human
cuugagagggugga

SEQ ID NO: 1728327 - RNA, 20 nt, Human
cuugaccauucuccaccugc

SEQ ID NO: 1728328 - RNA, 17 nt, Human
cuugaccauucuccacc

SEQ ID NO: 1728329 - RNA, 19 nt, Human
cuugagccuugaacuuuga

SEQ ID NO: 1728330 - RNA, 20 nt, Human
cuugagccuugaacuuugac

SEQ ID NO: 1728331 - RNA, 22 nt, Human
cuugagccuugaacuuugaccu

SEQ ID NO: 1728332 - RNA, 13 nt, Human
cuugagcucagga

SEQ ID NO: 1728333 - RNA, 14 nt, Human
cuugaacccgggag

SEQ ID NO: 1728334 - RNA, 19 nt, Human
cuugaacccgggaggcaga

SEQ ID NO: 1728335 - RNA, 20 nt, Human
cuugaacccgggaggcagag

SEQ ID NO: 1728336 - RNA, 18 nt, Human
cuugaacuccuggccuca

SEQ ID NO: 1728337 - RNA, 17 nt, Human
cuugaacuccuggccuc

SEQ ID NO: 1728338 - RNA, 15 nt, Human
cuugaacuccuggcc

SEQ ID NO: 1728339 - RNA, 14 nt, Human
cuugaacuccuggc

SEQ ID NO: 1728340 - RNA, 20 nt, Human
cuugaacuggguacuugugg

SEQ ID NO: 1728341 - RNA, 18 nt, Human
cuugaacuggguacuugu

SEQ ID NO: 1728342 - RNA, 15 nt, Human
cuugaacuuugaccu

SEQ ID NO: 1728343 - RNA, 16 nt, Human
cuugaacuggguacuu

SEQ ID NO: 1728344 - RNA, 19 nt, Human
cuugaacuccuggccucaa

SEQ ID NO: 1728345 - RNA, 19 nt, Human
cuugaaauauaggaacuua

SEQ ID NO: 1728346 - RNA, 17 nt, Human
cuucuuuuuuugugaug

SEQ ID NO: 1728347 - RNA, 16 nt, Human
cuuuucacugcuggcu

SEQ ID NO: 1728348 - RNA, 14 nt, Human
cuuuucccuucuuu

SEQ ID NO: 1728349 - RNA, 21 nt, Human
cuuuucgcaggauucuuccuc

SEQ ID NO: 1728350 - RNA, 20 nt, Human
cuuuucgcaggauucuuccu

SEQ ID NO: 1728351 - RNA, 23 nt, Human
cuuuuccaacccucaucaccaac

SEQ ID NO: 1728352 - RNA, 13 nt, Human
cuuuuccaacccu

SEQ ID NO: 1728353 - RNA, 22 nt, Human
cuuuucauuuaggugaggaagc

SEQ ID NO: 1728354 - RNA, 12 nt, Human
cuuuucacugcu

SEQ ID NO: 1728355 - RNA, 18 nt, Human
cuuuuaaaacacuuccau

SEQ ID NO: 1728356 - RNA, 22 nt, Human
cuuuuuaauauugauaugcuua

SEQ ID NO: 1728357 - RNA, 13 nt, Human
cuuuucuuuucuu

SEQ ID NO: 1728358 - RNA, 17 nt, Human
cuuuucuuucagccaag

SEQ ID NO: 1728359 - RNA, 16 nt, Human
cuuuuuuauacauaaa

SEQ ID NO: 1728360 - RNA, 17 nt, Human
cuuuuuuauacauaaac

SEQ ID NO: 1728361 - RNA, 15 nt, Human
cuuuuuuauacauaa

SEQ ID NO: 1728362 - RNA, 18 nt, Human
cuuuuuuauacauaaaca

SEQ ID NO: 1728363 - RNA, 19 nt, Human
cuuuuuuaucaugugaaau

SEQ ID NO: 1728364 - RNA, 16 nt, Human
gaaaaagaaaaaauau

SEQ ID NO: 1728365 - RNA, 11 nt, Human
gaaaaagaaaa

SEQ ID NO: 1728366 - RNA, 21 nt, Human
cuuuccgguguuuaagacauu

SEQ ID NO: 1728367 - RNA, 15 nt, Human
cuuuccaggaaggcu

SEQ ID NO: 1728368 - RNA, 21 nt, Human
cuuuccccaugucucgacuca

SEQ ID NO: 1728369 - RNA, 20 nt, Human
cuuuccccaugucucgacuc

SEQ ID NO: 1728370 - RNA, 15 nt, Human
cuuuccccaugucuc

SEQ ID NO: 1728371 - RNA, 14 nt, Human
cuuuccaggaaggc

SEQ ID NO: 1728372 - RNA, 16 nt, Human
cuuuccaaaguacacu

SEQ ID NO: 1728373 - RNA, 16 nt, Human
cuuuccaaaugcccag

SEQ ID NO: 1728374 - RNA, 22 nt, Human
cuuuccaaaguacacuguuuca

SEQ ID NO: 1728375 - RNA, 21 nt, Human
cuuguggacacagcucuucuc

SEQ ID NO: 1728376 - RNA, 20 nt, Human
cuuguguguuuauugucaaa

SEQ ID NO: 1728377 - RNA, 19 nt, Human
cuuuauuuuguguuuagga

SEQ ID NO: 1728378 - RNA, 15 nt, Human
cuuugcagacaggca

SEQ ID NO: 1728379 - RNA, 14 nt, Human
cuuugcagacaggc

SEQ ID NO: 1728380 - RNA, 23 nt, Human
cuuuggaaagaguaggaagacuu

SEQ ID NO: 1728381 - RNA, 19 nt, Human
cuuuggaaagaguaggaag

SEQ ID NO: 1728382 - RNA, 16 nt, Human
cuuugcagacaggcaa

SEQ ID NO: 1728383 - RNA, 21 nt, Human
cuuuccugaggcugggcuccc

SEQ ID NO: 1728384 - RNA, 20 nt, Human
cuuuccugaggcugggcucc

SEQ ID NO: 1728385 - RNA, 16 nt, Human
cuuuccugaggcuggg

SEQ ID NO: 1728386 - RNA, 17 nt, Human
cuuuccugaggcugggc

SEQ ID NO: 1728387 - RNA, 14 nt, Human
cugcaccggcuggc

SEQ ID NO: 1728388 - RNA, 23 nt, Human
cugaggcccuucucuccagcccc

SEQ ID NO: 1728389 - RNA, 22 nt, Human
cugaggcccuucucuccagccc

SEQ ID NO: 1728390 - RNA, 15 nt, Human
cugcaccgggccaca

SEQ ID NO: 1728391 - RNA, 14 nt, Human
cugcaccgggccac

SEQ ID NO: 1728392 - RNA, 16 nt, Human
cugcaccggcuggccu

SEQ ID NO: 1728393 - RNA, 15 nt, Human
cugcaccggcuggcc

SEQ ID NO: 1728394 - RNA, 20 nt, Human
cugcacuccccugcugggug

SEQ ID NO: 1728395 - RNA, 19 nt, Human
cugcacuccccugcugggu

SEQ ID NO: 1728396 - RNA, 13 nt, Human
cugcacuccccug

SEQ ID NO: 1728397 - RNA, 14 nt, Human
cugcacuccccugc

SEQ ID NO: 1728398 - RNA, 20 nt, Human
cugcaccgggccacagagaa

SEQ ID NO: 1728399 - RNA, 18 nt, Human
cugcaccgggccacagag

SEQ ID NO: 1728400 - RNA, 20 nt, Human
cugcacuccagccuggguga

SEQ ID NO: 1728401 - RNA, 21 nt, Human
cugcacuccccugcugggugu

SEQ ID NO: 1728402 - RNA, 13 nt, Human
cugcagagggcac

SEQ ID NO: 1728403 - RNA, 15 nt, Human
cugcagcaauaaagc

SEQ ID NO: 1728404 - RNA, 16 nt, Human
cugcagcaauaaagca

SEQ ID NO: 1728405 - RNA, 10 nt, Human
cugcagaggg

SEQ ID NO: 1728406 - RNA, 17 nt, Human
cugcagcaauaaagcag

SEQ ID NO: 1728407 - RNA, 18 nt, Human
cugcaggucccuaauaaa

SEQ ID NO: 1728408 - RNA, 17 nt, Human
cugcaggucccuaauaa

SEQ ID NO: 1728409 - RNA, 16 nt, Human
cugcaggucccuaaua

SEQ ID NO: 1728410 - RNA, 15 nt, Human
cugcaggucccuaau

SEQ ID NO: 1728411 - RNA, 14 nt, Human
cugcaggucccuaa

SEQ ID NO: 1728412 - RNA, 13 nt, Human
cugcaggucccua

SEQ ID NO: 1728413 - RNA, 12 nt, Human
cugcaggucccu

SEQ ID NO: 1728414 - RNA, 11 nt, Human
cugcagguccc

SEQ ID NO: 1728415 - RNA, 16 nt, Human
cugcaguugccaguca

SEQ ID NO: 1728416 - RNA, 13 nt, Human
cugcaguugccag

SEQ ID NO: 1728417 - RNA, 17 nt, Human
cugcaguugccagucac

SEQ ID NO: 1728418 - RNA, 23 nt, Human
cugcaggucccuaauaaagcugu

SEQ ID NO: 1728419 - RNA, 22 nt, Human
cugcaggucccuaauaaagcug

SEQ ID NO: 1728420 - RNA, 21 nt, Human
cugcaggucccuaauaaagcu

SEQ ID NO: 1728421 - RNA, 20 nt, Human
cugcaggucccuaauaaagc

SEQ ID NO: 1728422 - RNA, 19 nt, Human
cugcaggucccuaauaaag

SEQ ID NO: 1728423 - RNA, 20 nt, Human
cugcaucaagaugugacaug

SEQ ID NO: 1728424 - RNA, 15 nt, Human
cugcauaugaaagga

SEQ ID NO: 1728425 - RNA, 14 nt, Human
cugccacccugggg

SEQ ID NO: 1728426 - RNA, 12 nt, Human
cugccacccugg

SEQ ID NO: 1728427 - RNA, 21 nt, Human
cugccacccuggggagaaagu

SEQ ID NO: 1728428 - RNA, 21 nt, Human
cugccaggaagccagcaggcu

SEQ ID NO: 1728429 - RNA, 20 nt, Human
cugccaggaagccagcaggc

SEQ ID NO: 1728430 - RNA, 14 nt, Human
cugccaggaagcca

SEQ ID NO: 1728431 - RNA, 13 nt, Human
cugccaggaagcc

SEQ ID NO: 1728432 - RNA, 15 nt, Human
cugccauccucccaa

SEQ ID NO: 1728433 - RNA, 21 nt, Human
cugccauccagguucagcuug

SEQ ID NO: 1728434 - RNA, 22 nt, Human
cugccaggaagccagcaggcuc

SEQ ID NO: 1728435 - RNA, 20 nt, Human
cugcccaggccccugccacc

SEQ ID NO: 1728436 - RNA, 19 nt, Human
cugcccaggccccugccac

SEQ ID NO: 1728437 - RNA, 18 nt, Human
cugcccaggccccugcca

SEQ ID NO: 1728438 - RNA, 16 nt, Human
cugcccaggccccugc

SEQ ID NO: 1728439 - RNA, 17 nt, Human
cugcccaggccugccug

SEQ ID NO: 1728440 - RNA, 15 nt, Human
cugcccaggccccug

SEQ ID NO: 1728441 - RNA, 14 nt, Human
cugcccaggccccu

SEQ ID NO: 1728442 - RNA, 12 nt, Human
cugcccaccugg

SEQ ID NO: 1728443 - RNA, 15 nt, Human
cugccauuucugaga

SEQ ID NO: 1728444 - RNA, 20 nt, Human
cugcccggcaggguccuaga

SEQ ID NO: 1728445 - RNA, 13 nt, Human
cugcccggcaggg

SEQ ID NO: 1728446 - RNA, 18 nt, Human
cugccccuggcagccccu

SEQ ID NO: 1728447 - RNA, 19 nt, Human
cugccccuggcagccccug

SEQ ID NO: 1728448 - RNA, 22 nt, Human
cugcccuaaugcgcaggcuggc

SEQ ID NO: 1728449 - RNA, 21 nt, Human
cugcccuaaugcgcaggcugg

SEQ ID NO: 1728450 - RNA, 20 nt, Human
cugcccuaaugcgcaggcug

SEQ ID NO: 1728451 - RNA, 21 nt, Human
cugcuugaggcaacucaucuu

SEQ ID NO: 1728452 - RNA, 20 nt, Human
cugcuugaggcaacucaucu

SEQ ID NO: 1728453 - RNA, 13 nt, Human
cugcuugaggcaa

SEQ ID NO: 1728454 - RNA, 17 nt, Human
cugcuggguguggcgca

SEQ ID NO: 1728455 - RNA, 15 nt, Human
cugcuggguguggcg

SEQ ID NO: 1728456 - RNA, 14 nt, Human
cugcuggguguggc

SEQ ID NO: 1728457 - RNA, 14 nt, Human
cugcugcuggcugg

SEQ ID NO: 1728458 - RNA, 13 nt, Human
cugcuggcugccu

SEQ ID NO: 1728459 - RNA, 15 nt, Human
cugcuggcugccuua

SEQ ID NO: 1728460 - RNA, 14 nt, Human
cugcuggcugccuu

SEQ ID NO: 1728461 - RNA, 13 nt, Human
cugcugcuggcug

SEQ ID NO: 1728462 - RNA, 12 nt, Human
cugcugcuggcu

SEQ ID NO: 1728463 - RNA, 15 nt, Human
cugcuuuuggucugu

SEQ ID NO: 1728464 - RNA, 17 nt, Human
cugcuuugggcugcccu

SEQ ID NO: 1728465 - RNA, 13 nt, Human
cugcuuuggaaau

SEQ ID NO: 1728466 - RNA, 16 nt, Human
cugcuuugggcugccc

SEQ ID NO: 1728467 - RNA, 17 nt, Human
cugcuuuuggucugugu

SEQ ID NO: 1728468 - RNA, 19 nt, Human
cugcuuuugucuaugggac

SEQ ID NO: 1728469 - RNA, 20 nt, Human
cugcuugcuugcuuuuuaau

SEQ ID NO: 1728470 - RNA, 22 nt, Human
cugcuugaggcaacucaucuua

SEQ ID NO: 1728471 - RNA, 18 nt, Human
cugcuugggcuucauccu

SEQ ID NO: 1728472 - RNA, 17 nt, Human
cugcuugggcuucaucc

SEQ ID NO: 1728473 - RNA, 15 nt, Human
cugcuugggcuucau

SEQ ID NO: 1728474 - RNA, 13 nt, Human
cugcuugggcuuc

SEQ ID NO: 1728475 - RNA, 19 nt, Human
cugcuugugaaaggaaaga

SEQ ID NO: 1728476 - RNA, 19 nt, Human
cugcuugggcuucauccuc

SEQ ID NO: 1728477 - RNA, 17 nt, Human
cugcccugcccaccugg

SEQ ID NO: 1728478 - RNA, 20 nt, Human
cugcccugcccaccuggccu

SEQ ID NO: 1728479 - RNA, 21 nt, Human
cugcccugcccaccuggccuc

SEQ ID NO: 1728480 - RNA, 16 nt, Human
cugccugaagucacac

SEQ ID NO: 1728481 - RNA, 18 nt, Human
cugccugaagucacacag

SEQ ID NO: 1728482 - RNA, 19 nt, Human
cugccugaagucacacagu

SEQ ID NO: 1728483 - RNA, 23 nt, Human
cugccugaagucacacagugagu

SEQ ID NO: 1728484 - RNA, 21 nt, Human
cugccugcaguacuuuaccuc

SEQ ID NO: 1728485 - RNA, 20 nt, Human
cugccugcaguacuuuaccu

SEQ ID NO: 1728486 - RNA, 19 nt, Human
cugcggugcuaucuccccc

SEQ ID NO: 1728487 - RNA, 18 nt, Human
cugcggugcuaucucccc

SEQ ID NO: 1728488 - RNA, 23 nt, Human
cugcgguccacccaggagccccg

SEQ ID NO: 1728489 - RNA, 23 nt, Human
cugcgggucacaggagggagggg

SEQ ID NO: 1728490 - RNA, 22 nt, Human
cugcgggucacaggagggaggg

SEQ ID NO: 1728491 - RNA, 21 nt, Human
cugcgggucacaggagggagg

SEQ ID NO: 1728492 - RNA, 15 nt, Human
cugcgggucacagga

SEQ ID NO: 1728493 - RNA, 22 nt, Human
cugccugcuuuuuauggccugu

SEQ ID NO: 1728494 - RNA, 19 nt, Human
cugcucuccgaccagacac

SEQ ID NO: 1728495 - RNA, 15 nt, Human
cugcucuccgaccag

SEQ ID NO: 1728496 - RNA, 20 nt, Human
cugcuccucuccccagcaag

SEQ ID NO: 1728497 - RNA, 19 nt, Human
cugcuccucuccccagcaa

SEQ ID NO: 1728498 - RNA, 23 nt, Human
cugcuccucuccccagcaaguga

SEQ ID NO: 1728499 - RNA, 23 nt, Human
cugcggugcuaucucccccagcc

SEQ ID NO: 1728500 - RNA, 22 nt, Human
cugcggugcuaucucccccagc

SEQ ID NO: 1728501 - RNA, 21 nt, Human
cugcggugcuaucucccccag

SEQ ID NO: 1728502 - RNA, 20 nt, Human
cugcggugcuaucuccccca

SEQ ID NO: 1728503 - RNA, 20 nt, Human
cugcucugaugaagaggagu

SEQ ID NO: 1728504 - RNA, 12 nt, Human
cugcucugguua

SEQ ID NO: 1728505 - RNA, 19 nt, Human
cugcucuugaacuccugac

SEQ ID NO: 1728506 - RNA, 18 nt, Human
cugcucuugaacuccuga

SEQ ID NO: 1728507 - RNA, 16 nt, Human
cugcucuugaacuccu

SEQ ID NO: 1728508 - RNA, 13 nt, Human
cugcugcaguugc

SEQ ID NO: 1728509 - RNA, 10 nt, Human
cugcugcagu

SEQ ID NO: 1728510 - RNA, 14 nt, Human
cugcugcaguugcc

SEQ ID NO: 1728511 - RNA, 15 nt, Human
cugcugcaguugcca

SEQ ID NO: 1728512 - RNA, 23 nt, Human
cugcugccugcuuuuuauggccu

SEQ ID NO: 1728513 - RNA, 14 nt, Human
cugcugccugcuuu

SEQ ID NO: 1728514 - RNA, 18 nt, Human
cuguaucccaugagccuc

SEQ ID NO: 1728515 - RNA, 19 nt, Human
cuguaucccaugagccuca

SEQ ID NO: 1728516 - RNA, 20 nt, Human
cuguaugucucgugguagga

SEQ ID NO: 1728517 - RNA, 22 nt, Human
cuguaccucuugagccuugaac

SEQ ID NO: 1728518 - RNA, 15 nt, Human
cuguaucccaugagc

SEQ ID NO: 1728519 - RNA, 14 nt, Human
cuguaucccaugag

SEQ ID NO: 1728520 - RNA, 22 nt, Human
cugucccagugccgagaaggaa

SEQ ID NO: 1728521 - RNA, 19 nt, Human
cuguccaggcacugcugcc

SEQ ID NO: 1728522 - RNA, 18 nt, Human
cuguccaggcacugcugc

SEQ ID NO: 1728523 - RNA, 22 nt, Human
cuguccaggcacugcugcccag

SEQ ID NO: 1728524 - RNA, 21 nt, Human
cuguccaggcacugcugccca

SEQ ID NO: 1728525 - RNA, 20 nt, Human
cuguccaggcacugcugccc

SEQ ID NO: 1728526 - RNA, 18 nt, Human
cugucucuacuaaaaaua

SEQ ID NO: 1728527 - RNA, 22 nt, Human
cugucucaaaaaaagaaaaaga

SEQ ID NO: 1728528 - RNA, 21 nt, Human
cuguccuacucugugucaggu

SEQ ID NO: 1728529 - RNA, 14 nt, Human
cuguccgagcuuug

SEQ ID NO: 1728530 - RNA, 21 nt, Human
cugucucaagagggcacuggu

SEQ ID NO: 1728531 - RNA, 20 nt, Human
cugucucaagagggcacugg

SEQ ID NO: 1728532 - RNA, 19 nt, Human
cugucucaagagggcacug

SEQ ID NO: 1728533 - RNA, 18 nt, Human
cugucucaagagggcacu

SEQ ID NO: 1728534 - RNA, 20 nt, Human
cuguccuacucugugucagg

SEQ ID NO: 1728535 - RNA, 18 nt, Human
cuguccuacucuguguca

SEQ ID NO: 1728536 - RNA, 17 nt, Human
cuguccuacucuguguc

SEQ ID NO: 1728537 - RNA, 16 nt, Human
cuguccuacucugugu

SEQ ID NO: 1728538 - RNA, 14 nt, Human
cugucccccugaca

SEQ ID NO: 1728539 - RNA, 13 nt, Human
cugucccccugac

SEQ ID NO: 1728540 - RNA, 13 nt, Human
cuggucccacuca

SEQ ID NO: 1728541 - RNA, 14 nt, Human
cuggucccacucag

SEQ ID NO: 1728542 - RNA, 23 nt, Human
cuggucucaaacucuugaccuca

SEQ ID NO: 1728543 - RNA, 23 nt, Human
cuggucacaggacucugccuccu

SEQ ID NO: 1728544 - RNA, 22 nt, Human
cuggucacaggacucugccucc

SEQ ID NO: 1728545 - RNA, 21 nt, Human
cuggucacaggacucugccuc

SEQ ID NO: 1728546 - RNA, 20 nt, Human
cuggucacaggacucugccu

SEQ ID NO: 1728547 - RNA, 19 nt, Human
cuggucacaggacucugcc

SEQ ID NO: 1728548 - RNA, 16 nt, Human
cuggguacuuguggac

SEQ ID NO: 1728549 - RNA, 18 nt, Human
cuggguacuuguggacac

SEQ ID NO: 1728550 - RNA, 19 nt, Human
cuggguacuuguggacaca

SEQ ID NO: 1728551 - RNA, 22 nt, Human
cugggcucccuucccaccucuc

SEQ ID NO: 1728552 - RNA, 21 nt, Human
cugggcucccuucccaccucu

SEQ ID NO: 1728553 - RNA, 20 nt, Human
cugggcucccuucccaccuc

SEQ ID NO: 1728554 - RNA, 15 nt, Human
cuggguuggagggug

SEQ ID NO: 1728555 - RNA, 22 nt, Human
cugggucgcccuggacugugug

SEQ ID NO: 1728556 - RNA, 18 nt, Human
cugggucgcccuggacug

SEQ ID NO: 1728557 - RNA, 17 nt, Human
cugggucgcccuggacu

SEQ ID NO: 1728558 - RNA, 21 nt, Human
cuguaccucuugagccuugaa

SEQ ID NO: 1728559 - RNA, 22 nt, Human
cuguacaugaaaacacauuuuu

SEQ ID NO: 1728560 - RNA, 23 nt, Human
cuguacaugaaaacacauuuuuc

SEQ ID NO: 1728561 - RNA, 23 nt, Human
cuguacagagcccacgcccccac

SEQ ID NO: 1728562 - RNA, 21 nt, Human
cuguaauuugugauacaaugc

SEQ ID NO: 1728563 - RNA, 22 nt, Human
cuguaauuugugauacaaugcu

SEQ ID NO: 1728564 - RNA, 18 nt, Human
cuguaauuugugauacaa

SEQ ID NO: 1728565 - RNA, 17 nt, Human
cuguaauuugugauaca

SEQ ID NO: 1728566 - RNA, 14 nt, Human
cugguggcagcuca

SEQ ID NO: 1728567 - RNA, 13 nt, Human
cugguggcagcuc

SEQ ID NO: 1728568 - RNA, 16 nt, Human
cugguggcagcucacc

SEQ ID NO: 1728569 - RNA, 12 nt, Human
cugguggcagcu

SEQ ID NO: 1728570 - RNA, 16 nt, Human
cuggucucgaacuccu

SEQ ID NO: 1728571 - RNA, 20 nt, Human
cugguucaggguuggccccu

SEQ ID NO: 1728572 - RNA, 23 nt, Human
cugguuaauauuuauaggucacu

SEQ ID NO: 1728573 - RNA, 16 nt, Human
cugguuccauggccuc

SEQ ID NO: 1728574 - RNA, 18 nt, Human
cuguaaggcaaucauggu

SEQ ID NO: 1728575 - RNA, 20 nt, Human
cuggcugguuagagguuccc

SEQ ID NO: 1728576 - RNA, 17 nt, Human
cuggcuguuggcugggg

SEQ ID NO: 1728577 - RNA, 16 nt, Human
cuggcuguuggcuggg

SEQ ID NO: 1728578 - RNA, 20 nt, Human
cugggagagccuuccagggg

SEQ ID NO: 1728579 - RNA, 19 nt, Human
cugggagagccuuccaggg

SEQ ID NO: 1728580 - RNA, 21 nt, Human
cugggagagccuuccaggggu

SEQ ID NO: 1728581 - RNA, 18 nt, Human
cugggagagccuuccagg

SEQ ID NO: 1728582 - RNA, 17 nt, Human
cugggagagccuuccag

SEQ ID NO: 1728583 - RNA, 18 nt, Human
cuggcuguuggcuggggg

SEQ ID NO: 1728584 - RNA, 23 nt, Human
cuggcuuuucacugcuggcugcc

SEQ ID NO: 1728585 - RNA, 17 nt, Human
cugggauuacaggugug

SEQ ID NO: 1728586 - RNA, 20 nt, Human
cugggauuacaggugugaac

SEQ ID NO: 1728587 - RNA, 18 nt, Human
cugggauuacagguguga

SEQ ID NO: 1728588 - RNA, 16 nt, Human
cugggauuacaggugu

SEQ ID NO: 1728589 - RNA, 18 nt, Human
cugggaugauuggagggg

SEQ ID NO: 1728590 - RNA, 20 nt, Human
cugggaucacauguggacuu

SEQ ID NO: 1728591 - RNA, 20 nt, Human
cugggaucccucauccucau

SEQ ID NO: 1728592 - RNA, 12 nt, Human
cugggagugagc

SEQ ID NO: 1728593 - RNA, 19 nt, Human
cugggccccaguuguauuu

SEQ ID NO: 1728594 - RNA, 15 nt, Human
cugggccccaguugu

SEQ ID NO: 1728595 - RNA, 21 nt, Human
cugggaggucaaggcugcagu

SEQ ID NO: 1728596 - RNA, 19 nt, Human
cugggaggucaaggcugca

SEQ ID NO: 1728597 - RNA, 22 nt, Human
cugggaggcucuggagcccacu

SEQ ID NO: 1728598 - RNA, 17 nt, Human
cugggaggcucuggagc

SEQ ID NO: 1728599 - RNA, 21 nt, Human
cugggaggcucuggagcccac

SEQ ID NO: 1728600 - RNA, 20 nt, Human
cugggaggcucuggagccca

SEQ ID NO: 1728601 - RNA, 18 nt, Human
cugggaggcucuggagcc

SEQ ID NO: 1728602 - RNA, 16 nt, Human
cuggccuucggccucc

SEQ ID NO: 1728603 - RNA, 17 nt, Human
cuggccuucggccucca

SEQ ID NO: 1728604 - RNA, 18 nt, Human
cuggccuucggccuccau

SEQ ID NO: 1728605 - RNA, 21 nt, Human
cuggccuucggccuccauccu

SEQ ID NO: 1728606 - RNA, 15 nt, Human
cuggccuucggccuc

SEQ ID NO: 1728607 - RNA, 19 nt, Human
cuggccuggccccucaggg

SEQ ID NO: 1728608 - RNA, 17 nt, Human
cuggccuggccccucag

SEQ ID NO: 1728609 - RNA, 16 nt, Human
cuggccuggccccuca

SEQ ID NO: 1728610 - RNA, 16 nt, Human
cuggccugagcuggga

SEQ ID NO: 1728611 - RNA, 16 nt, Human
cuggccucugcacucc

SEQ ID NO: 1728612 - RNA, 14 nt, Human
cuggccucugcacu

SEQ ID NO: 1728613 - RNA, 13 nt, Human
cuggccucugcac

SEQ ID NO: 1728614 - RNA, 18 nt, Human
cuggccugagcugggaug

SEQ ID NO: 1728615 - RNA, 14 nt, Human
cuggccuggccccu

SEQ ID NO: 1728616 - RNA, 23 nt, Human
cuggccucaagugauucuccugc

SEQ ID NO: 1728617 - RNA, 12 nt, Human
cuggccucugca

SEQ ID NO: 1728618 - RNA, 22 nt, Human
cuggcaugggaaugaaugucag

SEQ ID NO: 1728619 - RNA, 19 nt, Human
cuggcaugggaaugaaugu

SEQ ID NO: 1728620 - RNA, 18 nt, Human
cuggcaugggaaugaaug

SEQ ID NO: 1728621 - RNA, 16 nt, Human
cuggcaugggaaugaa

SEQ ID NO: 1728622 - RNA, 22 nt, Human
cuggcacuauaauguaagcucu

SEQ ID NO: 1728623 - RNA, 16 nt, Human
cuggcacuauaaugua

SEQ ID NO: 1728624 - RNA, 15 nt, Human
cuggcacuauaaugu

SEQ ID NO: 1728625 - RNA, 24 nt, Human
cuggcaugggaaugaaugucagug

SEQ ID NO: 1728626 - RNA, 19 nt, Human
cuggcacccggccccugcu

SEQ ID NO: 1728627 - RNA, 18 nt, Human
cuggcacccggccccugc

SEQ ID NO: 1728628 - RNA, 17 nt, Human
cuggcacccggccccug

SEQ ID NO: 1728629 - RNA, 16 nt, Human
cuggcacccggccccu

SEQ ID NO: 1728630 - RNA, 16 nt, Human
cuggcacagggcagug

SEQ ID NO: 1728631 - RNA, 15 nt, Human
cuggcacagggcagu

SEQ ID NO: 1728632 - RNA, 14 nt, Human
cuggcaagaaugug

SEQ ID NO: 1728633 - RNA, 18 nt, Human
cuggaauauauaaccagu

SEQ ID NO: 1728634 - RNA, 20 nt, Human
cuggaagugcuaauuuugaa

SEQ ID NO: 1728635 - RNA, 22 nt, Human
cucuugaaauauaggaacuuaa

SEQ ID NO: 1728636 - RNA, 19 nt, Human
cucuuggguucaagcgauu

SEQ ID NO: 1728637 - RNA, 15 nt, Human
cucuugaacuccuga

SEQ ID NO: 1728638 - RNA, 21 nt, Human
cucuuggguucaagcgauucu

SEQ ID NO: 1728639 - RNA, 19 nt, Human
cucuuggguucaagugauu

SEQ ID NO: 1728640 - RNA, 23 nt, Human
cucuuuaaugucacaggcagguc

SEQ ID NO: 1728641 - RNA, 22 nt, Human
cucuuuaaugucacaggcaggu

SEQ ID NO: 1728642 - RNA, 21 nt, Human
cucuuuaaugucacaggcagg

SEQ ID NO: 1728643 - RNA, 20 nt, Human
cucuuuaaugucacaggcag

SEQ ID NO: 1728644 - RNA, 17 nt, Human
cucuuucccucccuucc

SEQ ID NO: 1728645 - RNA, 17 nt, Human
cucuugguccugcugca

SEQ ID NO: 1728646 - RNA, 16 nt, Human
cucuugguccugcugc

SEQ ID NO: 1728647 - RNA, 15 nt, Human
cucuugguccugcug

SEQ ID NO: 1728648 - RNA, 13 nt, Human
cucuugguccugc

SEQ ID NO: 1728649 - RNA, 18 nt, Human
cucuuuaaugucacaggc

SEQ ID NO: 1728650 - RNA, 19 nt, Human
cugaagaauugaaaaacca

SEQ ID NO: 1728651 - RNA, 17 nt, Human
cugaacucugacaacag

SEQ ID NO: 1728652 - RNA, 16 nt, Human
cugaacucugacaaca

SEQ ID NO: 1728653 - RNA, 15 nt, Human
cugaaagcccugagc

SEQ ID NO: 1728654 - RNA, 17 nt, Human
cucuuucuauuguuucu

SEQ ID NO: 1728655 - RNA, 19 nt, Human
cugaaagcccugagcuuuc

SEQ ID NO: 1728656 - RNA, 18 nt, Human
cugaaagcccugagcuuu

SEQ ID NO: 1728657 - RNA, 17 nt, Human
cugaaagcccugagcuu

SEQ ID NO: 1728658 - RNA, 16 nt, Human
cugaaagcccugagcu

SEQ ID NO: 1728659 - RNA, 23 nt, Human
cugaaagcccugagcuuucugcu

SEQ ID NO: 1728660 - RNA, 22 nt, Human
cugaaauagacccacaagaggc

SEQ ID NO: 1728661 - RNA, 22 nt, Human
cucuggcuccagcuggccggga

SEQ ID NO: 1728662 - RNA, 15 nt, Human
cucuuccaggcuggg

SEQ ID NO: 1728663 - RNA, 14 nt, Human
cucuuccaggcugg

SEQ ID NO: 1728664 - RNA, 13 nt, Human
cucuuccaggcug

SEQ ID NO: 1728665 - RNA, 15 nt, Human
cucuuagaaaaacca

SEQ ID NO: 1728666 - RNA, 13 nt, Human
cucuuagaaaaac

SEQ ID NO: 1728667 - RNA, 15 nt, Human
cucugugucaggugg

SEQ ID NO: 1728668 - RNA, 19 nt, Human
cucugugucagguggggca

SEQ ID NO: 1728669 - RNA, 22 nt, Human
cucuguuacacuuuuuggaagu

SEQ ID NO: 1728670 - RNA, 12 nt, Human
cucuggccuucg

SEQ ID NO: 1728671 - RNA, 16 nt, Human
cucuggcagcucagag

SEQ ID NO: 1728672 - RNA, 15 nt, Human
cucuggcagcucaga

SEQ ID NO: 1728673 - RNA, 19 nt, Human
cucuggccuucggccucca

SEQ ID NO: 1728674 - RNA, 16 nt, Human
cucuggcuccagcugg

SEQ ID NO: 1728675 - RNA, 15 nt, Human
cucuggcuccagcug

SEQ ID NO: 1728676 - RNA, 14 nt, Human
cucuggcagcucag

SEQ ID NO: 1728677 - RNA, 12 nt, Human
cucuggcagcuc

SEQ ID NO: 1728678 - RNA, 22 nt, Human
cucuggacaggcauguucucug

SEQ ID NO: 1728679 - RNA, 16 nt, Human
cucuggacaggcaugu

SEQ ID NO: 1728680 - RNA, 19 nt, Human
cucuggagcccacuguacu

SEQ ID NO: 1728681 - RNA, 15 nt, Human
cucuggacaggcaug

SEQ ID NO: 1728682 - RNA, 22 nt, Human
cucugccugaagucacacagug

SEQ ID NO: 1728683 - RNA, 21 nt, Human
cucugccugaagucacacagu

SEQ ID NO: 1728684 - RNA, 13 nt, Human
cucucuccucccu

SEQ ID NO: 1728685 - RNA, 16 nt, Human
cugagcgacagugaga

SEQ ID NO: 1728686 - RNA, 20 nt, Human
cugagcgacagugagacucu

SEQ ID NO: 1728687 - RNA, 22 nt, Human
cugagccucagucucccucccu

SEQ ID NO: 1728688 - RNA, 21 nt, Human
cugagccagauuucacucucc

SEQ ID NO: 1728689 - RNA, 20 nt, Human
cugagccagauuucacucuc

SEQ ID NO: 1728690 - RNA, 19 nt, Human
cugagccagauuucacucu

SEQ ID NO: 1728691 - RNA, 18 nt, Human
cugagccagauuucacuc

SEQ ID NO: 1728692 - RNA, 17 nt, Human
cugagccagauuucacu

SEQ ID NO: 1728693 - RNA, 18 nt, Human
cugagacagcccgggcuc

SEQ ID NO: 1728694 - RNA, 17 nt, Human
cugagacagcccgggcu

SEQ ID NO: 1728695 - RNA, 16 nt, Human
cugagacagcccgggc

SEQ ID NO: 1728696 - RNA, 21 nt, Human
cugagccucagucucccuccc

SEQ ID NO: 1728697 - RNA, 16 nt, Human
cugagccucagucucc

SEQ ID NO: 1728698 - RNA, 20 nt, Human
cugaggcccuucucuccagc

SEQ ID NO: 1728699 - RNA, 19 nt, Human
cugaggcccuucucuccag

SEQ ID NO: 1728700 - RNA, 18 nt, Human
cugaggcccuucucucca

SEQ ID NO: 1728701 - RNA, 15 nt, Human
cugaggcccuucucu

SEQ ID NO: 1728702 - RNA, 14 nt, Human
cugaggcccuucuc

SEQ ID NO: 1728703 - RNA, 23 nt, Human
cugaggcccagagggccugcaag

SEQ ID NO: 1728704 - RNA, 21 nt, Human
cugaggcccagagggccugca

SEQ ID NO: 1728705 - RNA, 19 nt, Human
cugaggcccagagggccug

SEQ ID NO: 1728706 - RNA, 18 nt, Human
cugaggcccagagggccu

SEQ ID NO: 1728707 - RNA, 17 nt, Human
cugaggcccagagggcc

SEQ ID NO: 1728708 - RNA, 16 nt, Human
cugaggcccagagggc

SEQ ID NO: 1728709 - RNA, 15 nt, Human
cugaggcccagaggg

SEQ ID NO: 1728710 - RNA, 14 nt, Human
cugaggcccagagg

SEQ ID NO: 1728711 - RNA, 13 nt, Human
cugaggcccagag

SEQ ID NO: 1728712 - RNA, 12 nt, Human
cugaggcccaga

SEQ ID NO: 1728713 - RNA, 19 nt, Human
cugaggaucagaguaaucc

SEQ ID NO: 1728714 - RNA, 17 nt, Human
cugaggaucagaguaau

SEQ ID NO: 1728715 - RNA, 19 nt, Human
cugaagacucauucuucug

SEQ ID NO: 1728716 - RNA, 22 nt, Human
cugacauuguuggccaaagcca

SEQ ID NO: 1728717 - RNA, 15 nt, Human
cugaccaauauugua

SEQ ID NO: 1728718 - RNA, 18 nt, Human
cugaccaauauuguacag

SEQ ID NO: 1728719 - RNA, 19 nt, Human
cugaccaauauuguacagu

SEQ ID NO: 1728720 - RNA, 20 nt, Human
cugaccaauauuguacaguu

SEQ ID NO: 1728721 - RNA, 21 nt, Human
cugaccaauauuguacaguuu

SEQ ID NO: 1728722 - RNA, 14 nt, Human
cugacccacugcuu

SEQ ID NO: 1728723 - RNA, 13 nt, Human
cugacccacugcu

SEQ ID NO: 1728724 - RNA, 13 nt, Human
cugacccaugcug

SEQ ID NO: 1728725 - RNA, 15 nt, Human
cugacccaugcugcc

SEQ ID NO: 1728726 - RNA, 14 nt, Human
cugacccaugcugc

SEQ ID NO: 1728727 - RNA, 16 nt, Human
cugacccaugcugccc

SEQ ID NO: 1728728 - RNA, 16 nt, Human
cugacuguuuucucuu

SEQ ID NO: 1728729 - RNA, 18 nt, Human
cugacuguuuucucuuga

SEQ ID NO: 1728730 - RNA, 14 nt, Human
cugagaaauuuaua

SEQ ID NO: 1728731 - RNA, 11 nt, Human
cugagaaauuu

SEQ ID NO: 1728732 - RNA, 15 nt, Human
cugagacagcccggg

SEQ ID NO: 1728733 - RNA, 14 nt, Human
cugagacagcccgg

SEQ ID NO: 1728734 - RNA, 20 nt, Human
cucccggcuaugggggcacu

SEQ ID NO: 1728735 - RNA, 18 nt, Human
cucccgaguagcugggac

SEQ ID NO: 1728736 - RNA, 19 nt, Human
cucccgaauagcugggacu

SEQ ID NO: 1728737 - RNA, 17 nt, Human
cucccgaguagcuggga

SEQ ID NO: 1728738 - RNA, 16 nt, Human
cucccgaguagcuggg

SEQ ID NO: 1728739 - RNA, 18 nt, Human
cucccgaauagcugggac

SEQ ID NO: 1728740 - RNA, 15 nt, Human
cucccgaguagcugg

SEQ ID NO: 1728741 - RNA, 16 nt, Human
cucccgaauagcuggg

SEQ ID NO: 1728742 - RNA, 17 nt, Human
cucccgaauagcuggga

SEQ ID NO: 1728743 - RNA, 14 nt, Human
cuccccugcugggu

SEQ ID NO: 1728744 - RNA, 13 nt, Human
cuccccugcuggg

SEQ ID NO: 1728745 - RNA, 12 nt, Human
cuccccugcugg

SEQ ID NO: 1728746 - RNA, 21 nt, Human
cuccccagcaagugagagcug

SEQ ID NO: 1728747 - RNA, 20 nt, Human
cuccccagcaagugagagcu

SEQ ID NO: 1728748 - RNA, 12 nt, Human
cuccccagcaag

SEQ ID NO: 1728749 - RNA, 11 nt, Human
cuccauccuga

SEQ ID NO: 1728750 - RNA, 16 nt, Human
cuccauccugaggcuc

SEQ ID NO: 1728751 - RNA, 18 nt, Human
cuccauccugaggcucca

SEQ ID NO: 1728752 - RNA, 20 nt, Human
cuccauccugaggcuccacu

SEQ ID NO: 1728753 - RNA, 14 nt, Human
cuccaucuccacuc

SEQ ID NO: 1728754 - RNA, 18 nt, Human
cucacuauguugcccagg

SEQ ID NO: 1728755 - RNA, 13 nt, Human
cuccaugugggcu

SEQ ID NO: 1728756 - RNA, 17 nt, Human
cucccaaagugcuggga

SEQ ID NO: 1728757 - RNA, 22 nt, Human
cuccaugucucugagcauuaga

SEQ ID NO: 1728758 - RNA, 13 nt, Human
cuccaugucucug

SEQ ID NO: 1728759 - RNA, 16 nt, Human
cuccaucuccacucca

SEQ ID NO: 1728760 - RNA, 23 nt, Human
cucccaucugugaaaggaaagag

SEQ ID NO: 1728761 - RNA, 18 nt, Human
cucccaucugugaaagga

SEQ ID NO: 1728762 - RNA, 15 nt, Human
cucccaucugugaaa

SEQ ID NO: 1728763 - RNA, 14 nt, Human
cucccaucugugaa

SEQ ID NO: 1728764 - RNA, 11 nt, Human
cucccaucugu

SEQ ID NO: 1728765 - RNA, 17 nt, Human
cucccaacucaccccag

SEQ ID NO: 1728766 - RNA, 18 nt, Human
cucccaaagugcugggau

SEQ ID NO: 1728767 - RNA, 22 nt, Human
cucccaaagugcugggauuaca

SEQ ID NO: 1728768 - RNA, 22 nt, Human
cucccaacucaccccagcccca

SEQ ID NO: 1728769 - RNA, 13 nt, Human
cucccucauucca

SEQ ID NO: 1728770 - RNA, 15 nt, Human
cuccgaccagacacc

SEQ ID NO: 1728771 - RNA, 15 nt, Human
cuccgccucccgggu

SEQ ID NO: 1728772 - RNA, 22 nt, Human
cuccucuccccagcaagugaga

SEQ ID NO: 1728773 - RNA, 14 nt, Human
cuccucccggugcc

SEQ ID NO: 1728774 - RNA, 17 nt, Human
cuccucccggugcccaa

SEQ ID NO: 1728775 - RNA, 15 nt, Human
cuccucccggugccc

SEQ ID NO: 1728776 - RNA, 11 nt, Human
cuccugcccuu

SEQ ID NO: 1728777 - RNA, 14 nt, Human
cuccugccucagcc

SEQ ID NO: 1728778 - RNA, 13 nt, Human
cuccugccucagc

SEQ ID NO: 1728779 - RNA, 20 nt, Human
cuccugcaggcagccaggcc

SEQ ID NO: 1728780 - RNA, 18 nt, Human
cuccugcaggcagccagg

SEQ ID NO: 1728781 - RNA, 17 nt, Human
cuccugcaggcagccag

SEQ ID NO: 1728782 - RNA, 12 nt, Human
cuccugcaggca

SEQ ID NO: 1728783 - RNA, 11 nt, Human
cuccugcaggc

SEQ ID NO: 1728784 - RNA, 19 nt, Human
cuccugugugugcgccuac

SEQ ID NO: 1728785 - RNA, 16 nt, Human
cuccugugugugcgcc

SEQ ID NO: 1728786 - RNA, 15 nt, Human
cuccugccucagccu

SEQ ID NO: 1728787 - RNA, 16 nt, Human
cuccugccucagccuc

SEQ ID NO: 1728788 - RNA, 23 nt, Human
cucuagggaaaaaccagcgugug

SEQ ID NO: 1728789 - RNA, 13 nt, Human
cucuacccuggca

SEQ ID NO: 1728790 - RNA, 20 nt, Human
cucuaccauccccuguagag

SEQ ID NO: 1728791 - RNA, 16 nt, Human
cucuacuuagcauguc

SEQ ID NO: 1728792 - RNA, 20 nt, Human
cucuacuuagcaugucccua

SEQ ID NO: 1728793 - RNA, 19 nt, Human
cucuacuuagcaugucccu

SEQ ID NO: 1728794 - RNA, 17 nt, Human
cucuacuuagcaugucc

SEQ ID NO: 1728795 - RNA, 17 nt, Human
cuccuucacagaugggu

SEQ ID NO: 1728796 - RNA, 16 nt, Human
cuccuucacagauggg

SEQ ID NO: 1728797 - RNA, 20 nt, Human
cuccugugugugcgccuaca

SEQ ID NO: 1728798 - RNA, 19 nt, Human
cuccuucacagaugggugc

SEQ ID NO: 1728799 - RNA, 13 nt, Human
cuccuucaccuuu

SEQ ID NO: 1728800 - RNA, 18 nt, Human
cucggcucacugcauccu

SEQ ID NO: 1728801 - RNA, 17 nt, Human
cucggcucacugcaucc

SEQ ID NO: 1728802 - RNA, 14 nt, Human
cucggcucacugca

SEQ ID NO: 1728803 - RNA, 16 nt, Human
cucuacagaggccaug

SEQ ID NO: 1728804 - RNA, 14 nt, Human
cucuacagaggcca

SEQ ID NO: 1728805 - RNA, 19 nt, Human
cucuacagaggccaugggc

SEQ ID NO: 1728806 - RNA, 21 nt, Human
cucuacagcuaaucagcauuc

SEQ ID NO: 1728807 - RNA, 13 nt, Human
cucuacagaggcc

SEQ ID NO: 1728808 - RNA, 13 nt, Human
cucuacaaaaagc

SEQ ID NO: 1728809 - RNA, 22 nt, Human
cucuccucuugccacugccucu

SEQ ID NO: 1728810 - RNA, 19 nt, Human
cucuccucuugccacugcc

SEQ ID NO: 1728811 - RNA, 17 nt, Human
cucuccucuugccacug

SEQ ID NO: 1728812 - RNA, 16 nt, Human
cucuccucuugccacu

SEQ ID NO: 1728813 - RNA, 15 nt, Human
cucuccucuugccac

SEQ ID NO: 1728814 - RNA, 14 nt, Human
cucuccucuugcca

SEQ ID NO: 1728815 - RNA, 18 nt, Human
cucuccucugcugcuggc

SEQ ID NO: 1728816 - RNA, 15 nt, Human
cucuccucugcugcu

SEQ ID NO: 1728817 - RNA, 14 nt, Human
cucuccucugcugc

SEQ ID NO: 1728818 - RNA, 13 nt, Human
cucuccucugcug

SEQ ID NO: 1728819 - RNA, 24 nt, Human
cucuccccagcaagugagagcugg

SEQ ID NO: 1728820 - RNA, 12 nt, Human
cucuccucugcu

SEQ ID NO: 1728821 - RNA, 22 nt, Human
cucuccccagcaagugagagcu

SEQ ID NO: 1728822 - RNA, 14 nt, Human
cucuccccagcaag

SEQ ID NO: 1728823 - RNA, 19 nt, Human
cucuccagccccuggaugc

SEQ ID NO: 1728824 - RNA, 15 nt, Human
cucuccacugccuuc

SEQ ID NO: 1728825 - RNA, 12 nt, Human
cucucucacucc

SEQ ID NO: 1728826 - RNA, 14 nt, Human
cucucucacuccuu

SEQ ID NO: 1728827 - RNA, 21 nt, Human
cucuaguuugauuaaauucuu

SEQ ID NO: 1728828 - RNA, 19 nt, Human
cucuaguuugauuaaauuc

SEQ ID NO: 1728829 - RNA, 20 nt, Human
cucuaguuugauuaaauucu

SEQ ID NO: 1728830 - RNA, 15 nt, Human
cucuaguuugauuaa

SEQ ID NO: 1728831 - RNA, 15 nt, Human
cucucaggccagcug

SEQ ID NO: 1728832 - RNA, 13 nt, Human
cucucaggccagc

SEQ ID NO: 1728833 - RNA, 23 nt, Human
cucucaggccaaacucaccugcc

SEQ ID NO: 1728834 - RNA, 22 nt, Human
cucucaggccaaacucaccugc

SEQ ID NO: 1728835 - RNA, 21 nt, Human
cucucaggccaaacucaccug

SEQ ID NO: 1728836 - RNA, 20 nt, Human
cucucaggccaaacucaccu

SEQ ID NO: 1728837 - RNA, 12 nt, Human
cucucaggccaa

SEQ ID NO: 1728838 - RNA, 18 nt, Human
cucuccagccccuggaug

SEQ ID NO: 1728839 - RNA, 17 nt, Human
cucuccagccccuggau

SEQ ID NO: 1728840 - RNA, 16 nt, Human
cucuccagccccugga

SEQ ID NO: 1728841 - RNA, 15 nt, Human
cucuccagccccugg

SEQ ID NO: 1728842 - RNA, 14 nt, Human
cucuccagccccug

SEQ ID NO: 1728843 - RNA, 14 nt, Human
cucuccacugccuu

SEQ ID NO: 1728844 - RNA, 12 nt, Human
cucuccacugcc

SEQ ID NO: 1728845 - RNA, 11 nt, Human
cucuccacugc

SEQ ID NO: 1728846 - RNA, 21 nt, Human
cucucaggccagcugcuuggg

SEQ ID NO: 1728847 - RNA, 19 nt, Human
cucucaggccagcugcuug

SEQ ID NO: 1728848 - RNA, 18 nt, Human
cucucaggccagcugcuu

SEQ ID NO: 1728849 - RNA, 17 nt, Human
cucucaggccagcugcu

SEQ ID NO: 1728850 - RNA, 22 nt, Human
cucucaggccagcugcuugggc

SEQ ID NO: 1728851 - RNA, 17 nt, Human
cggugagcuacaaaugc

SEQ ID NO: 1728852 - RNA, 21 nt, Human
cggugagaggggaacagacug

SEQ ID NO: 1728853 - RNA, 20 nt, Human
cggugagaggggaacagacu

SEQ ID NO: 1728854 - RNA, 20 nt, Human
cgguccacccaggagccccg

SEQ ID NO: 1728855 - RNA, 16 nt, Human
cgguccacccaggagc

SEQ ID NO: 1728856 - RNA, 15 nt, Human
cgguccacccaggag

SEQ ID NO: 1728857 - RNA, 14 nt, Human
cgguccacccagga

SEQ ID NO: 1728858 - RNA, 11 nt, Human
cgggucacagg

SEQ ID NO: 1728859 - RNA, 19 nt, Human
cgggucacaggagggaggg

SEQ ID NO: 1728860 - RNA, 22 nt, Human
cgggcacucagaagacacugau

SEQ ID NO: 1728861 - RNA, 14 nt, Human
cgggcacucagaag

SEQ ID NO: 1728862 - RNA, 22 nt, Human
cggggacagcuccuucuguccu

SEQ ID NO: 1728863 - RNA, 20 nt, Human
cgggaggucgaggcaggagg

SEQ ID NO: 1728864 - RNA, 18 nt, Human
cgggaggucgaggcagga

SEQ ID NO: 1728865 - RNA, 17 nt, Human
cgggauuaguacacacu

SEQ ID NO: 1728866 - RNA, 22 nt, Human
cggcuggccuggccccucaggg

SEQ ID NO: 1728867 - RNA, 23 nt, Human
cggcuggccuggccccucagggu

SEQ ID NO: 1728868 - RNA, 15 nt, Human
cgggggcagagaggg

SEQ ID NO: 1728869 - RNA, 16 nt, Human
cgggguggauuggauu

SEQ ID NO: 1728870 - RNA, 23 nt, Human
cggggacagcuccuucuguccua

SEQ ID NO: 1728871 - RNA, 12 nt, Human
cggccuccaucc

SEQ ID NO: 1728872 - RNA, 14 nt, Human
cggccuccauccug

SEQ ID NO: 1728873 - RNA, 12 nt, Human
cggcugcccuuu

SEQ ID NO: 1728874 - RNA, 11 nt, Human
cggcugcccuu

SEQ ID NO: 1728875 - RNA, 24 nt, Human
cggccaggccagagggagugacag

SEQ ID NO: 1728876 - RNA, 19 nt, Human
cggccccugcugguucagg

SEQ ID NO: 1728877 - RNA, 18 nt, Human
cggccccugcugguucag

SEQ ID NO: 1728878 - RNA, 13 nt, Human
cggccccugcugg

SEQ ID NO: 1728879 - RNA, 17 nt, Human
cggccaccugcggugcu

SEQ ID NO: 1728880 - RNA, 16 nt, Human
cggccaccugcggugc

SEQ ID NO: 1728881 - RNA, 15 nt, Human
cggccaccugcggug

SEQ ID NO: 1728882 - RNA, 11 nt, Human
cggccaccugc

SEQ ID NO: 1728883 - RNA, 13 nt, Human
cggcauuuguuuc

SEQ ID NO: 1728884 - RNA, 14 nt, Human
cggaauaguuggcu

SEQ ID NO: 1728885 - RNA, 13 nt, Human
cggaagagccuug

SEQ ID NO: 1728886 - RNA, 14 nt, Human
cgcucucuggccuu

SEQ ID NO: 1728887 - RNA, 15 nt, Human
cgcucucuggccuuc

SEQ ID NO: 1728888 - RNA, 17 nt, Human
cgcuacccgggaagggg

SEQ ID NO: 1728889 - RNA, 12 nt, Human
cgcucagcccuc

SEQ ID NO: 1728890 - RNA, 21 nt, Human
cgcucagcccucccugccccu

SEQ ID NO: 1728891 - RNA, 16 nt, Human
cgcucagcccucccug

SEQ ID NO: 1728892 - RNA, 16 nt, Human
cgcuacccgggaaggg

SEQ ID NO: 1728893 - RNA, 22 nt, Human
cgcuaagagggagggagggcuc

SEQ ID NO: 1728894 - RNA, 18 nt, Human
cgcucucuggccuucggc

SEQ ID NO: 1728895 - RNA, 22 nt, Human
cgcugucagccauuccuguucc

SEQ ID NO: 1728896 - RNA, 17 nt, Human
cgcugugcugcccugcc

SEQ ID NO: 1728897 - RNA, 16 nt, Human
cgcugugcugcccugc

SEQ ID NO: 1728898 - RNA, 15 nt, Human
cgcugugcugcccug

SEQ ID NO: 1728899 - RNA, 15 nt, Human
cggaaaacaugcuac

SEQ ID NO: 1728900 - RNA, 20 nt, Human
cggaaaacaugcuacacacu

SEQ ID NO: 1728901 - RNA, 18 nt, Human
cgcugugcugcccugccc

SEQ ID NO: 1728902 - RNA, 17 nt, Human
cgccaucccagccccaa

SEQ ID NO: 1728903 - RNA, 16 nt, Human
cgccaucccagcccca

SEQ ID NO: 1728904 - RNA, 14 nt, Human
cgccaucccagccc

SEQ ID NO: 1728905 - RNA, 23 nt, Human
cgccaggggaaaaucagccugcu

SEQ ID NO: 1728906 - RNA, 20 nt, Human
ccucugcccacucccugcaa

SEQ ID NO: 1728907 - RNA, 19 nt, Human
ccucugcccacucccugca

SEQ ID NO: 1728908 - RNA, 17 nt, Human
ccucugcccacucccug

SEQ ID NO: 1728909 - RNA, 22 nt, Human
cgccagauucuuuccugaggcu

SEQ ID NO: 1728910 - RNA, 22 nt, Human
cgcccaggcuuagucacugaga

SEQ ID NO: 1728911 - RNA, 12 nt, Human
cgcccagucugg

SEQ ID NO: 1728912 - RNA, 21 nt, Human
cgccccucccacagcgcuggc

SEQ ID NO: 1728913 - RNA, 19 nt, Human
cgccccucccacagcgcug

SEQ ID NO: 1728914 - RNA, 16 nt, Human
cgcccuggacugugug

SEQ ID NO: 1728915 - RNA, 13 nt, Human
cgccccuuccccc

SEQ ID NO: 1728916 - RNA, 15 nt, Human
cuaacaugauuuggg

SEQ ID NO: 1728917 - RNA, 17 nt, Human
cuaacauggaaguacua

SEQ ID NO: 1728918 - RNA, 15 nt, Human
cuaacauggaaguac

SEQ ID NO: 1728919 - RNA, 23 nt, Human
cuaaauugacacuuaaaaauggu

SEQ ID NO: 1728920 - RNA, 16 nt, Human
cuaaauguugaaagau

SEQ ID NO: 1728921 - RNA, 20 nt, Human
cuaaauauauuuuaagacga

SEQ ID NO: 1728922 - RNA, 18 nt, Human
cuaaauauauuuuaagac

SEQ ID NO: 1728923 - RNA, 18 nt, Human
cuaaauggaaccacucua

SEQ ID NO: 1728924 - RNA, 16 nt, Human
cuaaauggaaccacuc

SEQ ID NO: 1728925 - RNA, 17 nt, Human
cuaaauggaaccacucu

SEQ ID NO: 1728926 - RNA, 15 nt, Human
cuaaauggaaccacu

SEQ ID NO: 1728927 - RNA, 20 nt, Human
cuaaaucuccaaaauaaaac

SEQ ID NO: 1728928 - RNA, 15 nt, Human
cguggaacguuuuuc

SEQ ID NO: 1728929 - RNA, 20 nt, Human
cguggaacguuuuuccuguu

SEQ ID NO: 1728930 - RNA, 21 nt, Human
cguggcuucccgcucagcccu

SEQ ID NO: 1728931 - RNA, 20 nt, Human
cguggcuucccgcucagccc

SEQ ID NO: 1728932 - RNA, 19 nt, Human
cguggcuucccgcucagcc

SEQ ID NO: 1728933 - RNA, 18 nt, Human
cguggcuucccgcucagc

SEQ ID NO: 1728934 - RNA, 19 nt, Human
cgugcacacaccagagccc

SEQ ID NO: 1728935 - RNA, 18 nt, Human
cgugcacacaccagagcc

SEQ ID NO: 1728936 - RNA, 22 nt, Human
cgugcaguggugcgaucugggu

SEQ ID NO: 1728937 - RNA, 21 nt, Human
cgugcaguggugcgaucuggg

SEQ ID NO: 1728938 - RNA, 23 nt, Human
cgugcauaccacuuuuguucuug

SEQ ID NO: 1728939 - RNA, 22 nt, Human
cgucugacaggcaaugcuggcu

SEQ ID NO: 1728940 - RNA, 21 nt, Human
cgucugacaggcaaugcuggc

SEQ ID NO: 1728941 - RNA, 20 nt, Human
cgucugacaggcaaugcugg

SEQ ID NO: 1728942 - RNA, 16 nt, Human
cgugcacacaccagag

SEQ ID NO: 1728943 - RNA, 22 nt, Human
cggugcuaucucccccagcccc

SEQ ID NO: 1728944 - RNA, 21 nt, Human
cggugcuaucucccccagccc

SEQ ID NO: 1728945 - RNA, 20 nt, Human
cggugcuaucucccccagcc

SEQ ID NO: 1728946 - RNA, 18 nt, Human
cggugcuaucucccccag

SEQ ID NO: 1728947 - RNA, 16 nt, Human
cgucuaccugaggggc

SEQ ID NO: 1728948 - RNA, 16 nt, Human
cgucucauacucaccu

SEQ ID NO: 1728949 - RNA, 16 nt, Human
cgucgacguagaaccu

SEQ ID NO: 1728950 - RNA, 13 nt, Human
cucacauuuauau

SEQ ID NO: 1728951 - RNA, 19 nt, Human
cucaccagccccagugccc

SEQ ID NO: 1728952 - RNA, 20 nt, Human
cucacauagcuuacaagcca

SEQ ID NO: 1728953 - RNA, 21 nt, Human
cucaccagccccagugcccac

SEQ ID NO: 1728954 - RNA, 20 nt, Human
cucaccagccccagugccca

SEQ ID NO: 1728955 - RNA, 21 nt, Human
cucaagugauucuccugccuc

SEQ ID NO: 1728956 - RNA, 20 nt, Human
cucaagugauucuccugccu

SEQ ID NO: 1728957 - RNA, 19 nt, Human
cucaagugauucuccugcc

SEQ ID NO: 1728958 - RNA, 18 nt, Human
cucaagugauucuccugc

SEQ ID NO: 1728959 - RNA, 17 nt, Human
cucaccccuugccauaa

SEQ ID NO: 1728960 - RNA, 16 nt, Human
cucacuaggcuucugg

SEQ ID NO: 1728961 - RNA, 13 nt, Human
cucacuaggcuuc

SEQ ID NO: 1728962 - RNA, 17 nt, Human
cucacuauguugcccag

SEQ ID NO: 1728963 - RNA, 16 nt, Human
cucacuauguugccca

SEQ ID NO: 1728964 - RNA, 20 nt, Human
cucacuaggcuucugguuga

SEQ ID NO: 1728965 - RNA, 21 nt, Human
cucacuaucccggcugcccuu

SEQ ID NO: 1728966 - RNA, 20 nt, Human
cucacuaucccggcugcccu

SEQ ID NO: 1728967 - RNA, 13 nt, Human
cucaccccagccc

SEQ ID NO: 1728968 - RNA, 12 nt, Human
cucaccccagcc

SEQ ID NO: 1728969 - RNA, 14 nt, Human
cucaccccagcccc

SEQ ID NO: 1728970 - RNA, 21 nt, Human
cucaacucuccuccagaguca

SEQ ID NO: 1728971 - RNA, 20 nt, Human
cucaacucuccuccagaguc

SEQ ID NO: 1728972 - RNA, 13 nt, Human
cucaaauuucuaa

SEQ ID NO: 1728973 - RNA, 17 nt, Human
cucaagagggcacuggu

SEQ ID NO: 1728974 - RNA, 21 nt, Human
cucaagagggcacugguggcc

SEQ ID NO: 1728975 - RNA, 19 nt, Human
cucaagagggcacuggugg

SEQ ID NO: 1728976 - RNA, 14 nt, Human
cuaugcauuugaaa

SEQ ID NO: 1728977 - RNA, 22 nt, Human
cuauuuuaauaaacacucuuga

SEQ ID NO: 1728978 - RNA, 18 nt, Human
cuauuuuaauaaacacuc

SEQ ID NO: 1728979 - RNA, 11 nt, Human
cuaugcauuug

SEQ ID NO: 1728980 - RNA, 12 nt, Human
cuaugcauuuga

SEQ ID NO: 1728981 - RNA, 21 nt, Human
cuaugcauuugaaaauuuuga

SEQ ID NO: 1728982 - RNA, 23 nt, Human
cuagugugguguuuccuggcacu

SEQ ID NO: 1728983 - RNA, 22 nt, Human
cuagugugguguuuccuggcac

SEQ ID NO: 1728984 - RNA, 21 nt, Human
cuagugugguguuuccuggca

SEQ ID NO: 1728985 - RNA, 19 nt, Human
cuagugugguguuuccugg

SEQ ID NO: 1728986 - RNA, 15 nt, Human
cuaguaucaaaagaa

SEQ ID NO: 1728987 - RNA, 17 nt, Human
cuaguaucaaaagaaag

SEQ ID NO: 1728988 - RNA, 23 nt, Human
cuaguaucaaaagaaagaaaauc

SEQ ID NO: 1728989 - RNA, 21 nt, Human
cuaggcauuugcugaauacag

SEQ ID NO: 1728990 - RNA, 15 nt, Human
cuaggcaggaccugu

SEQ ID NO: 1728991 - RNA, 16 nt, Human
cuaggcaggaccugug

SEQ ID NO: 1728992 - RNA, 12 nt, Human
cuagcagcaggg

SEQ ID NO: 1728993 - RNA, 15 nt, Human
cuaggaacacuccuu

SEQ ID NO: 1728994 - RNA, 13 nt, Human
cuaggaacacucc

SEQ ID NO: 1728995 - RNA, 21 nt, Human
cuaggaagacuuuggaaagag

SEQ ID NO: 1728996 - RNA, 17 nt, Human
cuaggaaauccagggug

SEQ ID NO: 1728997 - RNA, 16 nt, Human
cuaggaaauccagggu

SEQ ID NO: 1728998 - RNA, 17 nt, Human
cuaggaggucucuaaga

SEQ ID NO: 1728999 - RNA, 22 nt, Human
cuaggaccccuccaugugggcu

SEQ ID NO: 1729000 - RNA, 22 nt, Human
cuauauuguuuucaguguacau

SEQ ID NO: 1729001 - RNA, 20 nt, Human
cuauauuuuuuguuaaauga

SEQ ID NO: 1729002 - RNA, 23 nt, Human
cuauauuguuuucaguguacaug

SEQ ID NO: 1729003 - RNA, 22 nt, Human
cuauauuuuuuguuaaaugauu

SEQ ID NO: 1729004 - RNA, 20 nt, Human
cuaucaaguauuauaccuuu

SEQ ID NO: 1729005 - RNA, 14 nt, Human
cuaugacacaugca

SEQ ID NO: 1729006 - RNA, 14 nt, Human
cuaguuccaccauc

SEQ ID NO: 1729007 - RNA, 14 nt, Human
cuaauguacugcau

SEQ ID NO: 1729008 - RNA, 16 nt, Human
cuaauguacugcauau

SEQ ID NO: 1729009 - RNA, 22 nt, Human
cuaaugaaugcauaaaauguua

SEQ ID NO: 1729010 - RNA, 19 nt, Human
cuaaugaaugcauaaaaug

SEQ ID NO: 1729011 - RNA, 16 nt, Human
cuaaggugugcucuga

SEQ ID NO: 1729012 - RNA, 21 nt, Human
cuaauaaaauuuaaaagucuu

SEQ ID NO: 1729013 - RNA, 12 nt, Human
cuaauaaagcug

SEQ ID NO: 1729014 - RNA, 13 nt, Human
cuaauaaagcugu

SEQ ID NO: 1729015 - RNA, 16 nt, Human
cuaauccucuuuuucu

SEQ ID NO: 1729016 - RNA, 19 nt, Human
cuaaucagcauucucacuc

SEQ ID NO: 1729017 - RNA, 17 nt, Human
cuaaucagcauucucac

SEQ ID NO: 1729018 - RNA, 16 nt, Human
cuacacuccagugaga

SEQ ID NO: 1729019 - RNA, 21 nt, Human
cuacacacugcauguuuguga

SEQ ID NO: 1729020 - RNA, 17 nt, Human
cuacacuccagugagac

SEQ ID NO: 1729021 - RNA, 18 nt, Human
cuacacugugcugagucu

SEQ ID NO: 1729022 - RNA, 13 nt, Human
cuacacacugcau

SEQ ID NO: 1729023 - RNA, 15 nt, Human
cuacacacugcaugu

SEQ ID NO: 1729024 - RNA, 15 nt, Human
cuacagaggccaugg

SEQ ID NO: 1729025 - RNA, 19 nt, Human
cuacccagcgagcccuggu

SEQ ID NO: 1729026 - RNA, 20 nt, Human
cuacccagcgagcccuggug

SEQ ID NO: 1729027 - RNA, 12 nt, Human
cuacccaggugc

SEQ ID NO: 1729028 - RNA, 22 nt, Human
cuacccacccuccuuucaccac

SEQ ID NO: 1729029 - RNA, 17 nt, Human
cuacccacccuccuuuc

SEQ ID NO: 1729030 - RNA, 18 nt, Human
cuaccauccccuguagag

SEQ ID NO: 1729031 - RNA, 17 nt, Human
cuacagaggccaugggc

SEQ ID NO: 1729032 - RNA, 17 nt, Human
cuaaccacgcuggaccu

SEQ ID NO: 1729033 - RNA, 16 nt, Human
cuaaccagcagaaaug

SEQ ID NO: 1729034 - RNA, 14 nt, Human
cuaagcaaaaugug

SEQ ID NO: 1729035 - RNA, 17 nt, Human
cuaaccagcagaaaugc

SEQ ID NO: 1729036 - RNA, 15 nt, Human
cuaagcaaaauguga

SEQ ID NO: 1729037 - RNA, 18 nt, Human
cuaagcaaaaugugauau

SEQ ID NO: 1729038 - RNA, 20 nt, Human
cuaagcacgggccauaugaa

SEQ ID NO: 1729039 - RNA, 23 nt, Human
cuaagcacgggccauaugaauaa

SEQ ID NO: 1729040 - RNA, 21 nt, Human
cuaagcuauucaguaauaacu

SEQ ID NO: 1729041 - RNA, 19 nt, Human
cuaagcuauucaguaauaa

SEQ ID NO: 1729042 - RNA, 15 nt, Human
cuaaggugugcucug

SEQ ID NO: 1729043 - RNA, 14 nt, Human
cuaaggcugaacuu

SEQ ID NO: 1729044 - RNA, 15 nt, Human
cuacuugggaggcug

SEQ ID NO: 1729045 - RNA, 18 nt, Human
cuacuugggaggcugaga

SEQ ID NO: 1729046 - RNA, 19 nt, Human
cuacuugggaggcugagau

SEQ ID NO: 1729047 - RNA, 20 nt, Human
cuacuuccccuuccuaauuc

SEQ ID NO: 1729048 - RNA, 15 nt, Human
cuacuuccccuuccu

SEQ ID NO: 1729049 - RNA, 14 nt, Human
cuacuuccccuucc

SEQ ID NO: 1729050 - RNA, 20 nt, Human
cuacuuccugugacuucagc

SEQ ID NO: 1729051 - RNA, 21 nt, Human
cuacccgggaagggggcuggg

SEQ ID NO: 1729052 - RNA, 20 nt, Human
cuacccgggaagggggcugg

SEQ ID NO: 1729053 - RNA, 15 nt, Human
cuacccgggaagggg

SEQ ID NO: 1729054 - RNA, 14 nt, Human
cuacccgggaaggg

SEQ ID NO: 1729055 - RNA, 21 nt, Human
cuacucugugucagguggggc

SEQ ID NO: 1729056 - RNA, 16 nt, Human
cuacucugugucaggu

SEQ ID NO: 1729057 - RNA, 14 nt, Human
cuacugaggugcua

SEQ ID NO: 1729058 - RNA, 17 nt, Human
cuacuguaauuugugau

SEQ ID NO: 1729059 - RNA, 16 nt, Human
cuacuguaauuuguga

SEQ ID NO: 1729060 - RNA, 21 nt, Human
cuacuguaaggcaaucauggu

SEQ ID NO: 1729061 - RNA, 21 nt, Human
cuagacgagcaggcuucuucc

SEQ ID NO: 1729062 - RNA, 20 nt, Human
cuagacgagcaggcuucuuc

SEQ ID NO: 1729063 - RNA, 18 nt, Human
cuagacucccaagcugga

SEQ ID NO: 1729064 - RNA, 15 nt, Human
cuagagguucaaaga

SEQ ID NO: 1729065 - RNA, 21 nt, Human
cuagagugaacuugggccacu

SEQ ID NO: 1729066 - RNA, 17 nt, Human
cuagagugaacuugggc

SEQ ID NO: 1729067 - RNA, 17 nt, Human
cuagcacuuugggaggc

SEQ ID NO: 1729068 - RNA, 21 nt, Human
cuacuguaauuugugauacaa

SEQ ID NO: 1729069 - RNA, 16 nt, Human
ccuaaaauucagugga

SEQ ID NO: 1729070 - RNA, 13 nt, Human
ccuaaacauauga

SEQ ID NO: 1729071 - RNA, 21 nt, Human
ccuaacaacauuguagccuca

SEQ ID NO: 1729072 - RNA, 22 nt, Human
ccuaacaacauuguagccucaa

SEQ ID NO: 1729073 - RNA, 19 nt, Human
ccuacagcuugaccgugag

SEQ ID NO: 1729074 - RNA, 22 nt, Human
ccuacaguugaaaaacagcuga

SEQ ID NO: 1729075 - RNA, 13 nt, Human
ccuacccacccuc

SEQ ID NO: 1729076 - RNA, 18 nt, Human
ccuacaggagugagcacu

SEQ ID NO: 1729077 - RNA, 18 nt, Human
ccuacccacccuccuuuc

SEQ ID NO: 1729078 - RNA, 19 nt, Human
ccuacuguaauuugugaua

SEQ ID NO: 1729079 - RNA, 21 nt, Human
ccuagaaauuccccacccuga

SEQ ID NO: 1729080 - RNA, 13 nt, Human
ccuacuuccccuu

SEQ ID NO: 1729081 - RNA, 16 nt, Human
ccuacuuccccuuccu

SEQ ID NO: 1729082 - RNA, 13 nt, Human
ccuaggugacaga

SEQ ID NO: 1729083 - RNA, 22 nt, Human
ccuagguauaauucacauugua

SEQ ID NO: 1729084 - RNA, 12 nt, Human
ccguuauuaaaa

SEQ ID NO: 1729085 - RNA, 23 nt, Human
ccgggagccugaucaccugcccu

SEQ ID NO: 1729086 - RNA, 16 nt, Human
ccgggagccugaucac

SEQ ID NO: 1729087 - RNA, 17 nt, Human
ccgggaagggggcuggg

SEQ ID NO: 1729088 - RNA, 21 nt, Human
ccggaggggccuggcagccgu

SEQ ID NO: 1729089 - RNA, 17 nt, Human
ccggaggggccuggcag

SEQ ID NO: 1729090 - RNA, 17 nt, Human
cccuuggauuguccccg

SEQ ID NO: 1729091 - RNA, 19 nt, Human
cccuucuuuuucuucuuuu

SEQ ID NO: 1729092 - RNA, 11 nt, Human
cccuucuuuuu

SEQ ID NO: 1729093 - RNA, 21 nt, Human
cccuuccuaauuccacagcug

SEQ ID NO: 1729094 - RNA, 23 nt, Human
cccuugguuaggcauugugggaa

SEQ ID NO: 1729095 - RNA, 22 nt, Human
cccuugguuaggcauuguggga

SEQ ID NO: 1729096 - RNA, 22 nt, Human
cccuuguggucccaccccacac

SEQ ID NO: 1729097 - RNA, 13 nt, Human
cccuucccaccuc

SEQ ID NO: 1729098 - RNA, 12 nt, Human
cccuucccaccu

SEQ ID NO: 1729099 - RNA, 11 nt, Human
cccuucauuug

SEQ ID NO: 1729100 - RNA, 20 nt, Human
cccuuccuaauuccacagcu

SEQ ID NO: 1729101 - RNA, 19 nt, Human
cccuuccuaauuccacagc

SEQ ID NO: 1729102 - RNA, 14 nt, Human
cccuuccuaauucc

SEQ ID NO: 1729103 - RNA, 13 nt, Human
cccuuccuaauuc

SEQ ID NO: 1729104 - RNA, 13 nt, Human
cccuguucacucu

SEQ ID NO: 1729105 - RNA, 22 nt, Human
cccuguucacucuacuuagcau

SEQ ID NO: 1729106 - RNA, 14 nt, Human
cccuguucacucua

SEQ ID NO: 1729107 - RNA, 22 nt, Human
ccucaggugagaagcagaggaa

SEQ ID NO: 1729108 - RNA, 15 nt, Human
ccuaggugacagagu

SEQ ID NO: 1729109 - RNA, 23 nt, Human
ccucacaguccuuaccagcagag

SEQ ID NO: 1729110 - RNA, 24 nt, Human
ccucacaguccuuaccagcagagc

SEQ ID NO: 1729111 - RNA, 16 nt, Human
ccuauuagagaagaga

SEQ ID NO: 1729112 - RNA, 17 nt, Human
ccuauuagagaagagau

SEQ ID NO: 1729113 - RNA, 22 nt, Human
ccucagggucccugguggcagc

SEQ ID NO: 1729114 - RNA, 20 nt, Human
ccucagggucccugguggca

SEQ ID NO: 1729115 - RNA, 17 nt, Human
ccucagggucccuggug

SEQ ID NO: 1729116 - RNA, 16 nt, Human
ccucagggucccuggu

SEQ ID NO: 1729117 - RNA, 16 nt, Human
ccucagaucuucugug

SEQ ID NO: 1729118 - RNA, 14 nt, Human
ccucagcauccugg

SEQ ID NO: 1729119 - RNA, 14 nt, Human
ccucacccuggggc

SEQ ID NO: 1729120 - RNA, 16 nt, Human
ccucagagccaccccu

SEQ ID NO: 1729121 - RNA, 14 nt, Human
ccuccauccugagg

SEQ ID NO: 1729122 - RNA, 16 nt, Human
ccuccaugcugccucc

SEQ ID NO: 1729123 - RNA, 19 nt, Human
ccuccaugcugccuccaga

SEQ ID NO: 1729124 - RNA, 12 nt, Human
ccuccauccuga

SEQ ID NO: 1729125 - RNA, 13 nt, Human
ccuccauccugag

SEQ ID NO: 1729126 - RNA, 14 nt, Human
ccucccaacucacc

SEQ ID NO: 1729127 - RNA, 17 nt, Human
ccucccaaagugcuggg

SEQ ID NO: 1729128 - RNA, 15 nt, Human
ccuccaugugggcua

SEQ ID NO: 1729129 - RNA, 12 nt, Human
ccuccauguggg

SEQ ID NO: 1729130 - RNA, 12 nt, Human
ccuccaggugca

SEQ ID NO: 1729131 - RNA, 11 nt, Human
ccuccaggugc

SEQ ID NO: 1729132 - RNA, 17 nt, Human
ccuccaggugcacaagc

SEQ ID NO: 1729133 - RNA, 20 nt, Human
ccucaggugagaagcagagg

SEQ ID NO: 1729134 - RNA, 18 nt, Human
ccucaggugagaagcaga

SEQ ID NO: 1729135 - RNA, 17 nt, Human
ccucaggugagaagcag

SEQ ID NO: 1729136 - RNA, 12 nt, Human
ccucauacccac

SEQ ID NO: 1729137 - RNA, 15 nt, Human
ccuccccuccuccug

SEQ ID NO: 1729138 - RNA, 18 nt, Human
ccucccgaauagcuggga

SEQ ID NO: 1729139 - RNA, 15 nt, Human
ccucccaacucaccc

SEQ ID NO: 1729140 - RNA, 23 nt, Human
ccucccaaagugcugggauuaca

SEQ ID NO: 1729141 - RNA, 12 nt, Human
ccuccuccagcc

SEQ ID NO: 1729142 - RNA, 11 nt, Human
ccuccucagau

SEQ ID NO: 1729143 - RNA, 13 nt, Human
ccucccucuuucc

SEQ ID NO: 1729144 - RNA, 20 nt, Human
ccucccgaauagcugggacu

SEQ ID NO: 1729145 - RNA, 19 nt, Human
ccucccgaauagcugggac

SEQ ID NO: 1729146 - RNA, 18 nt, Human
ccucccgaguagcuggga

SEQ ID NO: 1729147 - RNA, 17 nt, Human
ccucccgaguagcuggg

SEQ ID NO: 1729148 - RNA, 19 nt, Human
ccucccgaguagcugggac

SEQ ID NO: 1729149 - RNA, 21 nt, Human
ccucccgaauagcugggacua

SEQ ID NO: 1729150 - RNA, 17 nt, Human
ccucugcacuccccugc

SEQ ID NO: 1729151 - RNA, 16 nt, Human
ccucugcacuccccug

SEQ ID NO: 1729152 - RNA, 12 nt, Human
ccucugagccuu

SEQ ID NO: 1729153 - RNA, 11 nt, Human
ccucugagccu

SEQ ID NO: 1729154 - RNA, 13 nt, Human
ccucugaggcuga

SEQ ID NO: 1729155 - RNA, 18 nt, Human
ccucugcacuccccugcu

SEQ ID NO: 1729156 - RNA, 23 nt, Human
ccucugcacuccccugcugggug

SEQ ID NO: 1729157 - RNA, 14 nt, Human
ccucugcagcaaua

SEQ ID NO: 1729158 - RNA, 18 nt, Human
ccucugcagcaauaaagc

SEQ ID NO: 1729159 - RNA, 16 nt, Human
ccucugcccacucccu

SEQ ID NO: 1729160 - RNA, 13 nt, Human
ccucugcccacuc

SEQ ID NO: 1729161 - RNA, 19 nt, Human
ccucugcacuccccugcug

SEQ ID NO: 1729162 - RNA, 19 nt, Human
ccucugcagcaauaaagca

SEQ ID NO: 1729163 - RNA, 20 nt, Human
ccucugacacacagcucugu

SEQ ID NO: 1729164 - RNA, 19 nt, Human
ccucugacacacagcucug

SEQ ID NO: 1729165 - RNA, 14 nt, Human
ccucugacacacag

SEQ ID NO: 1729166 - RNA, 15 nt, Human
ccucugacacacagc

SEQ ID NO: 1729167 - RNA, 13 nt, Human
ccucugacacaca

SEQ ID NO: 1729168 - RNA, 21 nt, Human
ccucugacacacagcucuguc

SEQ ID NO: 1729169 - RNA, 15 nt, Human
ccucuccccagcaag

SEQ ID NO: 1729170 - RNA, 22 nt, Human
ccucucccuuggauuguccccg

SEQ ID NO: 1729171 - RNA, 13 nt, Human
ccucucccuugga

SEQ ID NO: 1729172 - RNA, 20 nt, Human
ccucuccccagcaagugaga

SEQ ID NO: 1729173 - RNA, 21 nt, Human
ccuccuccagccgccaugcuc

SEQ ID NO: 1729174 - RNA, 15 nt, Human
ccuccucucugcccu

SEQ ID NO: 1729175 - RNA, 13 nt, Human
ccuccucucugcc

SEQ ID NO: 1729176 - RNA, 16 nt, Human
ccuccucucugcccua

SEQ ID NO: 1729177 - RNA, 14 nt, Human
ccccuuaccacugc

SEQ ID NO: 1729178 - RNA, 20 nt, Human
ccccuguucuggcagaguug

SEQ ID NO: 1729179 - RNA, 12 nt, Human
ccccuucccccu

SEQ ID NO: 1729180 - RNA, 22 nt, Human
ccccuuccuaauuccacagcug

SEQ ID NO: 1729181 - RNA, 21 nt, Human
ccccuuccuaauuccacagcu

SEQ ID NO: 1729182 - RNA, 20 nt, Human
ccccuuccuaauuccacagc

SEQ ID NO: 1729183 - RNA, 22 nt, Human
ccccuguccccgcacugggcuu

SEQ ID NO: 1729184 - RNA, 15 nt, Human
ccccuguaggccuca

SEQ ID NO: 1729185 - RNA, 23 nt, Human
ccccuggcuuuucacugcuggcu

SEQ ID NO: 1729186 - RNA, 23 nt, Human
cccgcucagcccucccugccccu

SEQ ID NO: 1729187 - RNA, 22 nt, Human
cccgcuaagagggagggagggc

SEQ ID NO: 1729188 - RNA, 19 nt, Human
cccgcucagcccucccugc

SEQ ID NO: 1729189 - RNA, 15 nt, Human
cccgaggccuucucu

SEQ ID NO: 1729190 - RNA, 20 nt, Human
cccgaggccuucucugaagg

SEQ ID NO: 1729191 - RNA, 21 nt, Human
cccgaggccuucucugaagga

SEQ ID NO: 1729192 - RNA, 22 nt, Human
ccccaggugguuauggagaggg

SEQ ID NO: 1729193 - RNA, 14 nt, Human
ccccuggcagcccc

SEQ ID NO: 1729194 - RNA, 12 nt, Human
ccccuggcagcc

SEQ ID NO: 1729195 - RNA, 15 nt, Human
ccccuggcagccccu

SEQ ID NO: 1729196 - RNA, 12 nt, Human
ccccaggaggcc

SEQ ID NO: 1729197 - RNA, 15 nt, Human
ccccagccccauccu

SEQ ID NO: 1729198 - RNA, 19 nt, Human
ccccagcccuccuuaucaa

SEQ ID NO: 1729199 - RNA, 16 nt, Human
ccccagccccauccca

SEQ ID NO: 1729200 - RNA, 13 nt, Human
ccccagccugcua

SEQ ID NO: 1729201 - RNA, 22 nt, Human
ccccagcuggggccaggcuggg

SEQ ID NO: 1729202 - RNA, 21 nt, Human
ccccagcuggggccaggcugg

SEQ ID NO: 1729203 - RNA, 13 nt, Human
cccucccucuuuc

SEQ ID NO: 1729204 - RNA, 14 nt, Human
cccucccuucaacc

SEQ ID NO: 1729205 - RNA, 17 nt, Human
cccuccaugugggcuag

SEQ ID NO: 1729206 - RNA, 19 nt, Human
cccuccaucuaaacugccc

SEQ ID NO: 1729207 - RNA, 20 nt, Human
cccucauccucauacccacc

SEQ ID NO: 1729208 - RNA, 17 nt, Human
cccucauccucauaccc

SEQ ID NO: 1729209 - RNA, 22 nt, Human
cccucaucaccaacgucugugc

SEQ ID NO: 1729210 - RNA, 19 nt, Human
cccucauagcccucacccu

SEQ ID NO: 1729211 - RNA, 20 nt, Human
cccucagucuggcccuuccu

SEQ ID NO: 1729212 - RNA, 21 nt, Human
cccucagggucccugguggca

SEQ ID NO: 1729213 - RNA, 15 nt, Human
cccucauagcccuca

SEQ ID NO: 1729214 - RNA, 13 nt, Human
cccucauagcccu

SEQ ID NO: 1729215 - RNA, 21 nt, Human
cccuccaagaccuucuccuuc

SEQ ID NO: 1729216 - RNA, 22 nt, Human
cccucauuccaccuucccaugc

SEQ ID NO: 1729217 - RNA, 22 nt, Human
cccucauccucauacccacccc

SEQ ID NO: 1729218 - RNA, 16 nt, Human
cccggcaggguccuag

SEQ ID NO: 1729219 - RNA, 18 nt, Human
cccggaggggccuggcag

SEQ ID NO: 1729220 - RNA, 17 nt, Human
cccggaggggccuggca

SEQ ID NO: 1729221 - RNA, 17 nt, Human
cccuaaaguguauuuuu

SEQ ID NO: 1729222 - RNA, 22 nt, Human
cccuaaaguguauuuuuuuacu

SEQ ID NO: 1729223 - RNA, 13 nt, Human
cccuaaagccuca

SEQ ID NO: 1729224 - RNA, 19 nt, Human
cccucagggucccuggugg

SEQ ID NO: 1729225 - RNA, 18 nt, Human
cccucagggucccuggug

SEQ ID NO: 1729226 - RNA, 17 nt, Human
cccucagggucccuggu

SEQ ID NO: 1729227 - RNA, 16 nt, Human
cccucagggucccugg

SEQ ID NO: 1729228 - RNA, 15 nt, Human
cccucagggucccug

SEQ ID NO: 1729229 - RNA, 18 nt, Human
cccuaauaaagcugugug

SEQ ID NO: 1729230 - RNA, 15 nt, Human
cccuaauaaagcugu

SEQ ID NO: 1729231 - RNA, 14 nt, Human
cccuaauaaagcug

SEQ ID NO: 1729232 - RNA, 13 nt, Human
cccuaauaaagcu

SEQ ID NO: 1729233 - RNA, 12 nt, Human
cccuaauaaagc

SEQ ID NO: 1729234 - RNA, 16 nt, Human
cccugcaaccugauug

SEQ ID NO: 1729235 - RNA, 22 nt, Human
cccugcaaccugauugugucuc

SEQ ID NO: 1729236 - RNA, 18 nt, Human
cccugcagagggcacaga

SEQ ID NO: 1729237 - RNA, 20 nt, Human
cccugcagagggcacagaaa

SEQ ID NO: 1729238 - RNA, 12 nt, Human
cccugcagaggg

SEQ ID NO: 1729239 - RNA, 15 nt, Human
cccugccacccuggg

SEQ ID NO: 1729240 - RNA, 14 nt, Human
cccugccacccugg

SEQ ID NO: 1729241 - RNA, 12 nt, Human
cccugccacccu

SEQ ID NO: 1729242 - RNA, 18 nt, Human
cccugccacccuggggag

SEQ ID NO: 1729243 - RNA, 17 nt, Human
cccugccacccugggga

SEQ ID NO: 1729244 - RNA, 14 nt, Human
cccugccuccuuug

SEQ ID NO: 1729245 - RNA, 23 nt, Human
cccugccuccuuugugaggaagc

SEQ ID NO: 1729246 - RNA, 16 nt, Human
cccugccuccuuugug

SEQ ID NO: 1729247 - RNA, 18 nt, Human
cccugccucucugcaggu

SEQ ID NO: 1729248 - RNA, 11 nt, Human
cccugccucuc

SEQ ID NO: 1729249 - RNA, 22 nt, Human
cccugguggcagugggagcugc

SEQ ID NO: 1729250 - RNA, 21 nt, Human
cccuggugcugccacacuuca

SEQ ID NO: 1729251 - RNA, 17 nt, Human
cccuggugcugccacac

SEQ ID NO: 1729252 - RNA, 18 nt, Human
cccugggaggcucuggag

SEQ ID NO: 1729253 - RNA, 17 nt, Human
cccugggaggcucugga

SEQ ID NO: 1729254 - RNA, 16 nt, Human
cccugggaggcucugg

SEQ ID NO: 1729255 - RNA, 20 nt, Human
cccugcugguucaggguugg

SEQ ID NO: 1729256 - RNA, 19 nt, Human
cccugcugguucaggguug

SEQ ID NO: 1729257 - RNA, 23 nt, Human
cccugcuuugggcugcccuggug

SEQ ID NO: 1729258 - RNA, 13 nt, Human
cccugcugguuca

SEQ ID NO: 1729259 - RNA, 22 nt, Human
cccugccucucugcaggucccu

SEQ ID NO: 1729260 - RNA, 21 nt, Human
cccugccucucugcagguccc

SEQ ID NO: 1729261 - RNA, 16 nt, Human
cccugccucucugcag

SEQ ID NO: 1729262 - RNA, 14 nt, Human
cccugguggcagcu

SEQ ID NO: 1729263 - RNA, 23 nt, Human
ccauggcacucuauguucuaaga

SEQ ID NO: 1729264 - RNA, 13 nt, Human
ccaugugccaggu

SEQ ID NO: 1729265 - RNA, 14 nt, Human
ccauguuggccagg

SEQ ID NO: 1729266 - RNA, 13 nt, Human
ccauguuggccag

SEQ ID NO: 1729267 - RNA, 18 nt, Human
ccaugcuccuggcccacu

SEQ ID NO: 1729268 - RNA, 15 nt, Human
ccaugcuccuggccc

SEQ ID NO: 1729269 - RNA, 15 nt, Human
ccaugcugcccugug

SEQ ID NO: 1729270 - RNA, 17 nt, Human
ccaugcugcccugugag

SEQ ID NO: 1729271 - RNA, 16 nt, Human
ccaugcugcccuguga

SEQ ID NO: 1729272 - RNA, 14 nt, Human
ccaugcugccucca

SEQ ID NO: 1729273 - RNA, 14 nt, Human
cccacgcccccacu

SEQ ID NO: 1729274 - RNA, 13 nt, Human
cccacgcccccac

SEQ ID NO: 1729275 - RNA, 15 nt, Human
cccacgcccccacug

SEQ ID NO: 1729276 - RNA, 20 nt, Human
cccaccuuggcugcagggag

SEQ ID NO: 1729277 - RNA, 19 nt, Human
cccaccuuggcugcaggga

SEQ ID NO: 1729278 - RNA, 17 nt, Human
cccaccuuggcugcagg

SEQ ID NO: 1729279 - RNA, 16 nt, Human
cccaccuggccucugc

SEQ ID NO: 1729280 - RNA, 15 nt, Human
cccaccuggccucug

SEQ ID NO: 1729281 - RNA, 12 nt, Human
cccaccuggccu

SEQ ID NO: 1729282 - RNA, 21 nt, Human
ccauguuggccaggcuggucu

SEQ ID NO: 1729283 - RNA, 19 nt, Human
ccauguuggccaggcuggu

SEQ ID NO: 1729284 - RNA, 15 nt, Human
ccauguuggccaggc

SEQ ID NO: 1729285 - RNA, 18 nt, Human
ccauguuggccaggcugg

SEQ ID NO: 1729286 - RNA, 18 nt, Human
cccagcucugguccauag

SEQ ID NO: 1729287 - RNA, 16 nt, Human
cccagcucugguccau

SEQ ID NO: 1729288 - RNA, 15 nt, Human
cccagcucuggucca

SEQ ID NO: 1729289 - RNA, 12 nt, Human
cccagcucuggu

SEQ ID NO: 1729290 - RNA, 14 nt, Human
cccagcucuggucc

SEQ ID NO: 1729291 - RNA, 13 nt, Human
cccagcucugguc

SEQ ID NO: 1729292 - RNA, 14 nt, Human
cccagcgagcccug

SEQ ID NO: 1729293 - RNA, 15 nt, Human
cccagcgagcccugg

SEQ ID NO: 1729294 - RNA, 14 nt, Human
cccaggaggccagc

SEQ ID NO: 1729295 - RNA, 18 nt, Human
cccaggagccccgaggcc

SEQ ID NO: 1729296 - RNA, 14 nt, Human
cccaggagccccga

SEQ ID NO: 1729297 - RNA, 13 nt, Human
cccaggagccccg

SEQ ID NO: 1729298 - RNA, 15 nt, Human
cccagccccauccuc

SEQ ID NO: 1729299 - RNA, 14 nt, Human
cccagccccauccu

SEQ ID NO: 1729300 - RNA, 14 nt, Human
cccagccccauccc

SEQ ID NO: 1729301 - RNA, 13 nt, Human
cccagccccaucc

SEQ ID NO: 1729302 - RNA, 19 nt, Human
cccagccccauccucugua

SEQ ID NO: 1729303 - RNA, 18 nt, Human
cccagccccauccucugu

SEQ ID NO: 1729304 - RNA, 23 nt, Human
cccagcccuccuuaucaaaggac

SEQ ID NO: 1729305 - RNA, 20 nt, Human
cccagccuccaagcuccauc

SEQ ID NO: 1729306 - RNA, 18 nt, Human
cccagccuccaagcucca

SEQ ID NO: 1729307 - RNA, 12 nt, Human
cccagccccauc

SEQ ID NO: 1729308 - RNA, 11 nt, Human
cccagccccau

SEQ ID NO: 1729309 - RNA, 17 nt, Human
cccagccccaaugaaca

SEQ ID NO: 1729310 - RNA, 13 nt, Human
cccagccccaaug

SEQ ID NO: 1729311 - RNA, 16 nt, Human
cccagaggcuggguga

SEQ ID NO: 1729312 - RNA, 18 nt, Human
cccaggaggccagccuug

SEQ ID NO: 1729313 - RNA, 17 nt, Human
cccaugucucgacucau

SEQ ID NO: 1729314 - RNA, 16 nt, Human
cccaugucucgacuca

SEQ ID NO: 1729315 - RNA, 21 nt, Human
ccccaaauggaaaugggcaga

SEQ ID NO: 1729316 - RNA, 20 nt, Human
cccaugagccucagcauccu

SEQ ID NO: 1729317 - RNA, 16 nt, Human
cccaugagccucagca

SEQ ID NO: 1729318 - RNA, 15 nt, Human
cccaugagccucagc

SEQ ID NO: 1729319 - RNA, 13 nt, Human
cccaugcugcccu

SEQ ID NO: 1729320 - RNA, 12 nt, Human
cccaugcugccc

SEQ ID NO: 1729321 - RNA, 14 nt, Human
cccaugcugcccug

SEQ ID NO: 1729322 - RNA, 20 nt, Human
cccaucugugaaaggaaaga

SEQ ID NO: 1729323 - RNA, 13 nt, Human
cccaucucacaca

SEQ ID NO: 1729324 - RNA, 18 nt, Human
cccaucucacacaugagc

SEQ ID NO: 1729325 - RNA, 14 nt, Human
cccaguuagcucuc

SEQ ID NO: 1729326 - RNA, 20 nt, Human
cccagugguuccuaauccuc

SEQ ID NO: 1729327 - RNA, 17 nt, Human
cccagugccgagaagga

SEQ ID NO: 1729328 - RNA, 19 nt, Human
cccagucuggaaugcagug

SEQ ID NO: 1729329 - RNA, 18 nt, Human
cccagucuggaaugcagu

SEQ ID NO: 1729330 - RNA, 10 nt, Human
cccagucugg

SEQ ID NO: 1729331 - RNA, 21 nt, Human
cccagugcccacaggaucagu

SEQ ID NO: 1729332 - RNA, 15 nt, Human
cccagugccgagaag

SEQ ID NO: 1729333 - RNA, 15 nt, Human
cccaggcauucccca

SEQ ID NO: 1729334 - RNA, 23 nt, Human
cccaggcaggucuugaacuccug

SEQ ID NO: 1729335 - RNA, 16 nt, Human
cccaggaggccagccu

SEQ ID NO: 1729336 - RNA, 15 nt, Human
cccaggaggccagcc

SEQ ID NO: 1729337 - RNA, 18 nt, Human
cccaggcauuccccagga

SEQ ID NO: 1729338 - RNA, 17 nt, Human
cccaggcauuccccagg

SEQ ID NO: 1729339 - RNA, 19 nt, Human
cccagggugggaagggcua

SEQ ID NO: 1729340 - RNA, 13 nt, Human
cccagguuucuau

SEQ ID NO: 1729341 - RNA, 22 nt, Human
cccaugagccucagcauccugg

SEQ ID NO: 1729342 - RNA, 16 nt, Human
ccauccugaggcucca

SEQ ID NO: 1729343 - RNA, 15 nt, Human
ccauccugaggcucc

SEQ ID NO: 1729344 - RNA, 21 nt, Human
ccauccucuguacagagccca

SEQ ID NO: 1729345 - RNA, 16 nt, Human
ccaucaugucuggcua

SEQ ID NO: 1729346 - RNA, 14 nt, Human
ccaucaugucuggc

SEQ ID NO: 1729347 - RNA, 16 nt, Human
ccaucgcugucaucuc

SEQ ID NO: 1729348 - RNA, 19 nt, Human
ccauauucuguuggccagu

SEQ ID NO: 1729349 - RNA, 18 nt, Human
ccauauucuguuggccag

SEQ ID NO: 1729350 - RNA, 15 nt, Human
ccauauucuguuggc

SEQ ID NO: 1729351 - RNA, 23 nt, Human
ccauagagagcaagacgcugugc

SEQ ID NO: 1729352 - RNA, 12 nt, Human
ccaucacccgcu

SEQ ID NO: 1729353 - RNA, 23 nt, Human
ccagggacagaggggguggccuc

SEQ ID NO: 1729354 - RNA, 12 nt, Human
ccaggccugccu

SEQ ID NO: 1729355 - RNA, 23 nt, Human
ccauguuggccaggcuggucuca

SEQ ID NO: 1729356 - RNA, 21 nt, Human
ccagcugugcucuggacaggc

SEQ ID NO: 1729357 - RNA, 20 nt, Human
ccagcugugcucuggacagg

SEQ ID NO: 1729358 - RNA, 18 nt, Human
ccagcugugcucuggaca

SEQ ID NO: 1729359 - RNA, 17 nt, Human
ccagcuggguuggaaaa

SEQ ID NO: 1729360 - RNA, 16 nt, Human
ccagcuggguuggaaa

SEQ ID NO: 1729361 - RNA, 15 nt, Human
ccagcugcuugggcu

SEQ ID NO: 1729362 - RNA, 13 nt, Human
ccagcugcuuggg

SEQ ID NO: 1729363 - RNA, 18 nt, Human
ccagcugcuugggcuuca

SEQ ID NO: 1729364 - RNA, 16 nt, Human
ccagcugcuugggcuu

SEQ ID NO: 1729365 - RNA, 12 nt, Human
ccagcuggccgg

SEQ ID NO: 1729366 - RNA, 20 nt, Human
ccagcuggccgggagccuga

SEQ ID NO: 1729367 - RNA, 14 nt, Human
ccagcuggccggga

SEQ ID NO: 1729368 - RNA, 19 nt, Human
ccaggccuccuacagcuug

SEQ ID NO: 1729369 - RNA, 18 nt, Human
ccaggccuccuacagcuu

SEQ ID NO: 1729370 - RNA, 13 nt, Human
ccaggccuccuac

SEQ ID NO: 1729371 - RNA, 19 nt, Human
ccaggcccucugcccacuc

SEQ ID NO: 1729372 - RNA, 18 nt, Human
ccaggcccucugcccacu

SEQ ID NO: 1729373 - RNA, 17 nt, Human
ccaggcccucugcccac

SEQ ID NO: 1729374 - RNA, 23 nt, Human
ccaggccccugccacccugggga

SEQ ID NO: 1729375 - RNA, 21 nt, Human
ccaggccccugccacccuggg

SEQ ID NO: 1729376 - RNA, 21 nt, Human
ccaggccagagggagugacag

SEQ ID NO: 1729377 - RNA, 14 nt, Human
ccaggccagaggga

SEQ ID NO: 1729378 - RNA, 14 nt, Human
ccaggagcagccac

SEQ ID NO: 1729379 - RNA, 13 nt, Human
ccaggagcagcca

SEQ ID NO: 1729380 - RNA, 12 nt, Human
ccaggagcagcc

SEQ ID NO: 1729381 - RNA, 19 nt, Human
ccaggaagccagcaggcuc

SEQ ID NO: 1729382 - RNA, 17 nt, Human
ccaggaagccagcaggc

SEQ ID NO: 1729383 - RNA, 15 nt, Human
ccaggaagccagcag

SEQ ID NO: 1729384 - RNA, 23 nt, Human
ccagcugugcucuggacaggcau

SEQ ID NO: 1729385 - RNA, 22 nt, Human
ccagcugugcucuggacaggca

SEQ ID NO: 1729386 - RNA, 20 nt, Human
ccaggaagccagcaggcucu

SEQ ID NO: 1729387 - RNA, 15 nt, Human
ccaagaccuucuccu

SEQ ID NO: 1729388 - RNA, 15 nt, Human
ccaacccucaucacc

SEQ ID NO: 1729389 - RNA, 13 nt, Human
ccaacccucauca

SEQ ID NO: 1729390 - RNA, 18 nt, Human
ccaacccuggcacccagg

SEQ ID NO: 1729391 - RNA, 22 nt, Human
ccaaauucuuucaguggcuacc

SEQ ID NO: 1729392 - RNA, 15 nt, Human
ccaaauucuuucagu

SEQ ID NO: 1729393 - RNA, 14 nt, Human
ccaacauacuccca

SEQ ID NO: 1729394 - RNA, 16 nt, Human
ccaacaucaacaucuu

SEQ ID NO: 1729395 - RNA, 14 nt, Human
ccaaagaugcagcc

SEQ ID NO: 1729396 - RNA, 13 nt, Human
ccaaagaugcagc

SEQ ID NO: 1729397 - RNA, 18 nt, Human
ccaaggcuagaaccaccu

SEQ ID NO: 1729398 - RNA, 14 nt, Human
ccaagcuccaucuc

SEQ ID NO: 1729399 - RNA, 13 nt, Human
ccaagcucccagg

SEQ ID NO: 1729400 - RNA, 12 nt, Human
ccaagcucccag

SEQ ID NO: 1729401 - RNA, 23 nt, Human
ccaagccguggcuucccgcucag

SEQ ID NO: 1729402 - RNA, 14 nt, Human
ccaagccguggcuu

SEQ ID NO: 1729403 - RNA, 14 nt, Human
ccaagcaggacaug

SEQ ID NO: 1729404 - RNA, 21 nt, Human
ccaagccguggcuucccgcuc

SEQ ID NO: 1729405 - RNA, 17 nt, Human
ccaagccguggcuuccc

SEQ ID NO: 1729406 - RNA, 16 nt, Human
ccaagccguggcuucc

SEQ ID NO: 1729407 - RNA, 15 nt, Human
ccaagccguggcuuc

SEQ ID NO: 1729408 - RNA, 16 nt, Human
ccacaagaaaugaaag

SEQ ID NO: 1729409 - RNA, 22 nt, Human
ccacaagaaaugaaagcaggga

SEQ ID NO: 1729410 - RNA, 13 nt, Human
ccacaagagccca

SEQ ID NO: 1729411 - RNA, 16 nt, Human
ccacaagacccuugug

SEQ ID NO: 1729412 - RNA, 18 nt, Human
ccacaaaggagagcuagc

SEQ ID NO: 1729413 - RNA, 13 nt, Human
ccacaacacacag

SEQ ID NO: 1729414 - RNA, 14 nt, Human
ccaauauuguacag

SEQ ID NO: 1729415 - RNA, 15 nt, Human
ccaauauuguacagu

SEQ ID NO: 1729416 - RNA, 16 nt, Human
ccaauauuguacaguu

SEQ ID NO: 1729417 - RNA, 18 nt, Human
ccaauauuguacaguuuu

SEQ ID NO: 1729418 - RNA, 23 nt, Human
ccaauuuuuuaagugaaaauaua

SEQ ID NO: 1729419 - RNA, 19 nt, Human
ccaaggcugauuaaaccaa

SEQ ID NO: 1729420 - RNA, 16 nt, Human
ccaaggcucugagcaa

SEQ ID NO: 1729421 - RNA, 14 nt, Human
ccaaggcuggggga

SEQ ID NO: 1729422 - RNA, 20 nt, Human
ccaauauucauagcagcuua

SEQ ID NO: 1729423 - RNA, 16 nt, Human
ccaaguggcucccaca

SEQ ID NO: 1729424 - RNA, 13 nt, Human
ccaaguggcuccc

SEQ ID NO: 1729425 - RNA, 20 nt, Human
ccacaaguuaaauaaaucau

SEQ ID NO: 1729426 - RNA, 15 nt, Human
ccacaaguuaaauaa

SEQ ID NO: 1729427 - RNA, 19 nt, Human
ccacaagagcccaggccuc

SEQ ID NO: 1729428 - RNA, 18 nt, Human
ccacaagagcccaggccu

SEQ ID NO: 1729429 - RNA, 17 nt, Human
ccacaagagcccaggcc

SEQ ID NO: 1729430 - RNA, 16 nt, Human
ccacaagagcccaggc

SEQ ID NO: 1729431 - RNA, 21 nt, Human
ccacaagagcccaggccuccu

SEQ ID NO: 1729432 - RNA, 20 nt, Human
ccacaagagcccaggccucc

SEQ ID NO: 1729433 - RNA, 14 nt, Human
cauugcaauagaaa

SEQ ID NO: 1729434 - RNA, 13 nt, Human
cauugcaauagaa

SEQ ID NO: 1729435 - RNA, 15 nt, Human
cauugcaauagaaau

SEQ ID NO: 1729436 - RNA, 21 nt, Human
cauuuacuuuguguucaccuu

SEQ ID NO: 1729437 - RNA, 17 nt, Human
cauuuacuuuguguuca

SEQ ID NO: 1729438 - RNA, 18 nt, Human
cauuucccaacacaaaga

SEQ ID NO: 1729439 - RNA, 21 nt, Human
cauuucuuccacaagagccca

SEQ ID NO: 1729440 - RNA, 19 nt, Human
cauugaaaucuuuuugcuu

SEQ ID NO: 1729441 - RNA, 22 nt, Human
cauugaccugaggcccuucucu

SEQ ID NO: 1729442 - RNA, 13 nt, Human
cauugaccugagg

SEQ ID NO: 1729443 - RNA, 19 nt, Human
cauuuuauuuuauuaugca

SEQ ID NO: 1729444 - RNA, 22 nt, Human
cauuuuauuuuauuaugcauga

SEQ ID NO: 1729445 - RNA, 21 nt, Human
cauuuuauuuuauuaugcaug

SEQ ID NO: 1729446 - RNA, 22 nt, Human
cauuugaggucuguucuuucca

SEQ ID NO: 1729447 - RNA, 24 nt, Human
cauuuugcuaaaugugaaugauga

SEQ ID NO: 1729448 - RNA, 21 nt, Human
cauuuugcuaaaugugaauga

SEQ ID NO: 1729449 - RNA, 18 nt, Human
cauuuugcuaaaugugaa

SEQ ID NO: 1729450 - RNA, 22 nt, Human
cauuuugggguacccacugcuc

SEQ ID NO: 1729451 - RNA, 21 nt, Human
cauuuugggguacccacugcu

SEQ ID NO: 1729452 - RNA, 20 nt, Human
cauuuugggguacccacugc

SEQ ID NO: 1729453 - RNA, 15 nt, Human
cauuuuuaagugcug

SEQ ID NO: 1729454 - RNA, 20 nt, Human
cauuuuuaagugcugcauuu

SEQ ID NO: 1729455 - RNA, 19 nt, Human
cauuuuuaguagagacagg

SEQ ID NO: 1729456 - RNA, 23 nt, Human
cauuuugggguacccacugcucu

SEQ ID NO: 1729457 - RNA, 18 nt, Human
ccaaaauaaaacuuuuua

SEQ ID NO: 1729458 - RNA, 21 nt, Human
ccaaaauaaaacuuuuuaaaa

SEQ ID NO: 1729459 - RNA, 20 nt, Human
cauuuuuaguagagacaggg

SEQ ID NO: 1729460 - RNA, 23 nt, Human
cauuucuuccacaagagcccagg

SEQ ID NO: 1729461 - RNA, 14 nt, Human
cauuugagcagggc

SEQ ID NO: 1729462 - RNA, 16 nt, Human
cauuugagcagggcuc

SEQ ID NO: 1729463 - RNA, 17 nt, Human
cauuugaggucuguucu

SEQ ID NO: 1729464 - RNA, 18 nt, Human
cauuugaggucuguucuu

SEQ ID NO: 1729465 - RNA, 19 nt, Human
cauuugaggucuguucuuu

SEQ ID NO: 1729466 - RNA, 18 nt, Human
cauuagcaguuugcuuug

SEQ ID NO: 1729467 - RNA, 17 nt, Human
cauuagcaguuugcuuu

SEQ ID NO: 1729468 - RNA, 15 nt, Human
cauguuuuguuuacg

SEQ ID NO: 1729469 - RNA, 21 nt, Human
cauuaaagccugaguuugcuu

SEQ ID NO: 1729470 - RNA, 18 nt, Human
cauguuuuucuucucccu

SEQ ID NO: 1729471 - RNA, 21 nt, Human
cauguuucuuuguaaugaaaa

SEQ ID NO: 1729472 - RNA, 23 nt, Human
cauguuugauguaucugagcagg

SEQ ID NO: 1729473 - RNA, 22 nt, Human
cauguuucuuuguaaugaaaac

SEQ ID NO: 1729474 - RNA, 22 nt, Human
caugugccagguuuuuggucug

SEQ ID NO: 1729475 - RNA, 21 nt, Human
caugugccagguuuuuggucu

SEQ ID NO: 1729476 - RNA, 15 nt, Human
caugugcacaugcac

SEQ ID NO: 1729477 - RNA, 16 nt, Human
cauggucggaaaacau

SEQ ID NO: 1729478 - RNA, 21 nt, Human
cauguaauuaaguacuaugua

SEQ ID NO: 1729479 - RNA, 18 nt, Human
cauguaauuaaguacuau

SEQ ID NO: 1729480 - RNA, 15 nt, Human
caugucgccucugca

SEQ ID NO: 1729481 - RNA, 14 nt, Human
caugucgccucugc

SEQ ID NO: 1729482 - RNA, 20 nt, Human
caugucgccucugcauucag

SEQ ID NO: 1729483 - RNA, 18 nt, Human
caugucgccucugcauuc

SEQ ID NO: 1729484 - RNA, 23 nt, Human
caugucuuuucuugcaugaggcu

SEQ ID NO: 1729485 - RNA, 21 nt, Human
caugucuuuucuugcaugagg

SEQ ID NO: 1729486 - RNA, 19 nt, Human
caugucuuuucuugcauga

SEQ ID NO: 1729487 - RNA, 14 nt, Human
caugucuuuucuug

SEQ ID NO: 1729488 - RNA, 17 nt, Human
caugugaaaucauucau

SEQ ID NO: 1729489 - RNA, 16 nt, Human
caugugaaaucauuca

SEQ ID NO: 1729490 - RNA, 15 nt, Human
caugugaaaucauuc

SEQ ID NO: 1729491 - RNA, 22 nt, Human
cauggaaguacuauaauuuacc

SEQ ID NO: 1729492 - RNA, 20 nt, Human
cauggaaguacuauaauuua

SEQ ID NO: 1729493 - RNA, 18 nt, Human
cauggacaugaucuucuu

SEQ ID NO: 1729494 - RNA, 16 nt, Human
cauggaauaacaugua

SEQ ID NO: 1729495 - RNA, 22 nt, Human
caugcugucccuuacgugaguc

SEQ ID NO: 1729496 - RNA, 23 nt, Human
caugccuggauggggcugcaccg

SEQ ID NO: 1729497 - RNA, 21 nt, Human
caugccuggauggggcugcac

SEQ ID NO: 1729498 - RNA, 18 nt, Human
caugccuggauggggcug

SEQ ID NO: 1729499 - RNA, 17 nt, Human
caugggacagggaggac

SEQ ID NO: 1729500 - RNA, 22 nt, Human
caugggaaugaaugucagugug

SEQ ID NO: 1729501 - RNA, 15 nt, Human
caugggccuccugug

SEQ ID NO: 1729502 - RNA, 17 nt, Human
caugggccuccugugug

SEQ ID NO: 1729503 - RNA, 16 nt, Human
caugggccuccugugu

SEQ ID NO: 1729504 - RNA, 17 nt, Human
cauggagguuugaagau

SEQ ID NO: 1729505 - RNA, 13 nt, Human
cauggacuuuguu

SEQ ID NO: 1729506 - RNA, 11 nt, Human
cauggacuuug

SEQ ID NO: 1729507 - RNA, 18 nt, Human
caugggaaugaaugucag

SEQ ID NO: 1729508 - RNA, 16 nt, Human
cauggaguauauguca

SEQ ID NO: 1729509 - RNA, 13 nt, Human
caugccuggaugg

SEQ ID NO: 1729510 - RNA, 19 nt, Human
caugccucucucaggccaa

SEQ ID NO: 1729511 - RNA, 18 nt, Human
caugccucucucaggcca

SEQ ID NO: 1729512 - RNA, 17 nt, Human
caugccucucucaggcc

SEQ ID NO: 1729513 - RNA, 16 nt, Human
caugccucucucaggc

SEQ ID NO: 1729514 - RNA, 15 nt, Human
caugccucucucagg

SEQ ID NO: 1729515 - RNA, 14 nt, Human
caugccucucucag

SEQ ID NO: 1729516 - RNA, 13 nt, Human
caugccccugaac

SEQ ID NO: 1729517 - RNA, 20 nt, Human
caugccagcuuaucucaggg

SEQ ID NO: 1729518 - RNA, 19 nt, Human
caugccagcuuaucucagg

SEQ ID NO: 1729519 - RNA, 19 nt, Human
caguugaaaaacagcugag

SEQ ID NO: 1729520 - RNA, 18 nt, Human
caguugaaaaacagcuga

SEQ ID NO: 1729521 - RNA, 12 nt, Human
caguugaaaaac

SEQ ID NO: 1729522 - RNA, 22 nt, Human
caguucggugagcuacaaaugc

SEQ ID NO: 1729523 - RNA, 15 nt, Human
caguucucuccuucu

SEQ ID NO: 1729524 - RNA, 14 nt, Human
caguucucuccuuc

SEQ ID NO: 1729525 - RNA, 13 nt, Human
caguucucuccuu

SEQ ID NO: 1729526 - RNA, 22 nt, Human
caguucucuccuucuucccccc

SEQ ID NO: 1729527 - RNA, 19 nt, Human
caguguuguggauuuaaca

SEQ ID NO: 1729528 - RNA, 20 nt, Human
caguguuguggauuuaacag

SEQ ID NO: 1729529 - RNA, 22 nt, Human
caguguuguggauuuaacagaa

SEQ ID NO: 1729530 - RNA, 20 nt, Human
caguuaagccuuuggaaaca

SEQ ID NO: 1729531 - RNA, 14 nt, Human
caguuaagagaaau

SEQ ID NO: 1729532 - RNA, 13 nt, Human
caguuaagagaaa

SEQ ID NO: 1729533 - RNA, 17 nt, Human
caguuaagccuuuggaa

SEQ ID NO: 1729534 - RNA, 15 nt, Human
caguuaagccuuugg

SEQ ID NO: 1729535 - RNA, 14 nt, Human
caguuaagccuuug

SEQ ID NO: 1729536 - RNA, 14 nt, Human
caguuacucagaau

SEQ ID NO: 1729537 - RNA, 14 nt, Human
cagugucaaugcag

SEQ ID NO: 1729538 - RNA, 23 nt, Human
caguguacauggaauaacaugua

SEQ ID NO: 1729539 - RNA, 20 nt, Human
caguguacauggaauaacau

SEQ ID NO: 1729540 - RNA, 16 nt, Human
caguguacauggaaua

SEQ ID NO: 1729541 - RNA, 17 nt, Human
caguguacagucuugua

SEQ ID NO: 1729542 - RNA, 18 nt, Human
caguguacagucuuguau

SEQ ID NO: 1729543 - RNA, 12 nt, Human
caguguacaguc

SEQ ID NO: 1729544 - RNA, 15 nt, Human
caguguacagucuug

SEQ ID NO: 1729545 - RNA, 12 nt, Human
cagugugacuga

SEQ ID NO: 1729546 - RNA, 14 nt, Human
cagugugacaagga

SEQ ID NO: 1729547 - RNA, 22 nt, Human
cagugguuccuaauccucuagg

SEQ ID NO: 1729548 - RNA, 16 nt, Human
cagugggacagggcau

SEQ ID NO: 1729549 - RNA, 11 nt, Human
cagugggaacu

SEQ ID NO: 1729550 - RNA, 16 nt, Human
caguggcagcugcuuu

SEQ ID NO: 1729551 - RNA, 15 nt, Human
caguggcagcugcuu

SEQ ID NO: 1729552 - RNA, 14 nt, Human
caguggcagcugcu

SEQ ID NO: 1729553 - RNA, 13 nt, Human
caguggcagcugc

SEQ ID NO: 1729554 - RNA, 12 nt, Human
caguggcagcug

SEQ ID NO: 1729555 - RNA, 16 nt, Human
caguggaaccagccca

SEQ ID NO: 1729556 - RNA, 23 nt, Human
caguugccagucaccccggccac

SEQ ID NO: 1729557 - RNA, 16 nt, Human
caguuggguggaugcc

SEQ ID NO: 1729558 - RNA, 22 nt, Human
caguuggucccccuuccaugga

SEQ ID NO: 1729559 - RNA, 21 nt, Human
caguuggucccccuuccaugg

SEQ ID NO: 1729560 - RNA, 20 nt, Human
caguuggucccccuuccaug

SEQ ID NO: 1729561 - RNA, 19 nt, Human
caguuggucccccuuccau

SEQ ID NO: 1729562 - RNA, 18 nt, Human
caguuggucccccuucca

SEQ ID NO: 1729563 - RNA, 19 nt, Human
caguuggguggaugccugg

SEQ ID NO: 1729564 - RNA, 18 nt, Human
caguuggguggaugccug

SEQ ID NO: 1729565 - RNA, 15 nt, Human
caguuuuuauugcuu

SEQ ID NO: 1729566 - RNA, 17 nt, Human
caguuguuagugugucu

SEQ ID NO: 1729567 - RNA, 19 nt, Human
cauaccacuuuuguucuug

SEQ ID NO: 1729568 - RNA, 12 nt, Human
cauacccacccc

SEQ ID NO: 1729569 - RNA, 11 nt, Human
cauacccaccc

SEQ ID NO: 1729570 - RNA, 13 nt, Human
cauaccacuuuug

SEQ ID NO: 1729571 - RNA, 14 nt, Human
cauaccacuuuugu

SEQ ID NO: 1729572 - RNA, 15 nt, Human
cauaccacuuuuguu

SEQ ID NO: 1729573 - RNA, 18 nt, Human
cauaccacuuuuguucuu

SEQ ID NO: 1729574 - RNA, 15 nt, Human
cauaauacuugcuuu

SEQ ID NO: 1729575 - RNA, 13 nt, Human
cauaacuagaacu

SEQ ID NO: 1729576 - RNA, 14 nt, Human
cauaagauaaaugu

SEQ ID NO: 1729577 - RNA, 16 nt, Human
cauaaccuagccuuag

SEQ ID NO: 1729578 - RNA, 21 nt, Human
cauaaaaauuagccaagugug

SEQ ID NO: 1729579 - RNA, 22 nt, Human
cauaaacaagaccacguuucua

SEQ ID NO: 1729580 - RNA, 20 nt, Human
cauaaacaagaccacguuuc

SEQ ID NO: 1729581 - RNA, 21 nt, Human
cauaaacaagaccacguuucu

SEQ ID NO: 1729582 - RNA, 16 nt, Human
cauaaagcaggcagaa

SEQ ID NO: 1729583 - RNA, 14 nt, Human
cauaaagcaggcag

SEQ ID NO: 1729584 - RNA, 21 nt, Human
cauacccacccccacccaagg

SEQ ID NO: 1729585 - RNA, 18 nt, Human
cauacccacccccaccca

SEQ ID NO: 1729586 - RNA, 17 nt, Human
cauacccacccccaccc

SEQ ID NO: 1729587 - RNA, 14 nt, Human
cauacccaccccca

SEQ ID NO: 1729588 - RNA, 13 nt, Human
cauacguacacau

SEQ ID NO: 1729589 - RNA, 15 nt, Human
cauacguacacauuu

SEQ ID NO: 1729590 - RNA, 16 nt, Human
cauacguacacauuuu

SEQ ID NO: 1729591 - RNA, 17 nt, Human
cauacguacacauuuua

SEQ ID NO: 1729592 - RNA, 18 nt, Human
cauacguacacauuuuau

SEQ ID NO: 1729593 - RNA, 14 nt, Human
cauacuaaccagca

SEQ ID NO: 1729594 - RNA, 21 nt, Human
cauacuaaccagcagaaaugc

SEQ ID NO: 1729595 - RNA, 20 nt, Human
cauacuaauuauacccccug

SEQ ID NO: 1729596 - RNA, 13 nt, Human
caucucagcccac

SEQ ID NO: 1729597 - RNA, 20 nt, Human
caucucacacaugagcauca

SEQ ID NO: 1729598 - RNA, 17 nt, Human
caucucacacaugagca

SEQ ID NO: 1729599 - RNA, 16 nt, Human
caucucacacaugagc

SEQ ID NO: 1729600 - RNA, 18 nt, Human
caucuagguaaauuacag

SEQ ID NO: 1729601 - RNA, 17 nt, Human
caucuagguaaauuaca

SEQ ID NO: 1729602 - RNA, 15 nt, Human
caucuacccuccgau

SEQ ID NO: 1729603 - RNA, 12 nt, Human
caucuaggauuu

SEQ ID NO: 1729604 - RNA, 18 nt, Human
cauccucuguacagagcc

SEQ ID NO: 1729605 - RNA, 15 nt, Human
cauccucuguacaga

SEQ ID NO: 1729606 - RNA, 19 nt, Human
cauccucuguacagagccc

SEQ ID NO: 1729607 - RNA, 21 nt, Human
cauccucuguacagagcccac

SEQ ID NO: 1729608 - RNA, 19 nt, Human
cauccuccucagaucuucu

SEQ ID NO: 1729609 - RNA, 18 nt, Human
cauccuccucagaucuuc

SEQ ID NO: 1729610 - RNA, 16 nt, Human
cauccuccucagaucu

SEQ ID NO: 1729611 - RNA, 15 nt, Human
cauccuccucagauc

SEQ ID NO: 1729612 - RNA, 12 nt, Human
cauccuccucag

SEQ ID NO: 1729613 - RNA, 11 nt, Human
cauccuccuca

SEQ ID NO: 1729614 - RNA, 20 nt, Human
cauccuccgccucccggguu

SEQ ID NO: 1729615 - RNA, 22 nt, Human
cauccucauacccacccccacc

SEQ ID NO: 1729616 - RNA, 21 nt, Human
cauccucauacccacccccac

SEQ ID NO: 1729617 - RNA, 18 nt, Human
cauccucauacccacccc

SEQ ID NO: 1729618 - RNA, 17 nt, Human
cauccucauacccaccc

SEQ ID NO: 1729619 - RNA, 13 nt, Human
cauccucccaagg

SEQ ID NO: 1729620 - RNA, 16 nt, Human
cauccucauacccacc

SEQ ID NO: 1729621 - RNA, 15 nt, Human
cauccucauacccac

SEQ ID NO: 1729622 - RNA, 16 nt, Human
cauccuacaagacaca

SEQ ID NO: 1729623 - RNA, 20 nt, Human
caucuugcucugcugacaga

SEQ ID NO: 1729624 - RNA, 14 nt, Human
caucuugcucugcu

SEQ ID NO: 1729625 - RNA, 15 nt, Human
caucuugcucugcug

SEQ ID NO: 1729626 - RNA, 13 nt, Human
caucuugcucugc

SEQ ID NO: 1729627 - RNA, 22 nt, Human
caucucuucuggguuccuuccu

SEQ ID NO: 1729628 - RNA, 14 nt, Human
caucuccacuccag

SEQ ID NO: 1729629 - RNA, 22 nt, Human
caucuuccaaggguacuaagga

SEQ ID NO: 1729630 - RNA, 16 nt, Human
caucucuuguuuaaau

SEQ ID NO: 1729631 - RNA, 19 nt, Human
caucccucuggggcuguuc

SEQ ID NO: 1729632 - RNA, 13 nt, Human
caucccugaaggc

SEQ ID NO: 1729633 - RNA, 11 nt, Human
caucccugaag

SEQ ID NO: 1729634 - RNA, 17 nt, Human
cauccagguucagcuug

SEQ ID NO: 1729635 - RNA, 15 nt, Human
cauccagguucagcu

SEQ ID NO: 1729636 - RNA, 15 nt, Human
caucaccaacgucug

SEQ ID NO: 1729637 - RNA, 13 nt, Human
caucauugaaauc

SEQ ID NO: 1729638 - RNA, 21 nt, Human
caucauugaaaucuuuuugcu

SEQ ID NO: 1729639 - RNA, 20 nt, Human
caucauugaaaucuuuuugc

SEQ ID NO: 1729640 - RNA, 15 nt, Human
caucauugaaaucuu

SEQ ID NO: 1729641 - RNA, 14 nt, Human
caucauugaaaucu

SEQ ID NO: 1729642 - RNA, 17 nt, Human
cauccuacaagacacag

SEQ ID NO: 1729643 - RNA, 21 nt, Human
caucccugaaggccccgccca

SEQ ID NO: 1729644 - RNA, 19 nt, Human
caucccugaaggccccgcc

SEQ ID NO: 1729645 - RNA, 18 nt, Human
caucccugaaggccccgc

SEQ ID NO: 1729646 - RNA, 17 nt, Human
caucccugaaggccccg

SEQ ID NO: 1729647 - RNA, 22 nt, Human
caucccugaaggccccgcccag

SEQ ID NO: 1729648 - RNA, 14 nt, Human
cauccuaacuccau

SEQ ID NO: 1729649 - RNA, 21 nt, Human
cauccuaacuccaugucucug

SEQ ID NO: 1729650 - RNA, 23 nt, Human
cauagagagcaagacgcugugcu

SEQ ID NO: 1729651 - RNA, 21 nt, Human
cauagagagcaagacgcugug

SEQ ID NO: 1729652 - RNA, 19 nt, Human
cauagagagcaagacgcug

SEQ ID NO: 1729653 - RNA, 20 nt, Human
cauagaauaaaauuuuuaau

SEQ ID NO: 1729654 - RNA, 14 nt, Human
cauagaauaaaauu

SEQ ID NO: 1729655 - RNA, 20 nt, Human
cauacucccaucugugaaag

SEQ ID NO: 1729656 - RNA, 18 nt, Human
cauacucccaucugugaa

SEQ ID NO: 1729657 - RNA, 15 nt, Human
cauacucccaucugu

SEQ ID NO: 1729658 - RNA, 16 nt, Human
cauacucccaucugug

SEQ ID NO: 1729659 - RNA, 11 nt, Human
cauacucugcu

SEQ ID NO: 1729660 - RNA, 22 nt, Human
cauaguggcuuaaaacaacacu

SEQ ID NO: 1729661 - RNA, 22 nt, Human
cauagugaugguuccccuguuc

SEQ ID NO: 1729662 - RNA, 20 nt, Human
cauaguaugguggcuggguu

SEQ ID NO: 1729663 - RNA, 19 nt, Human
cauaguaugguggcugggu

SEQ ID NO: 1729664 - RNA, 18 nt, Human
cauaguaugguggcuggg

SEQ ID NO: 1729665 - RNA, 22 nt, Human
cauauauauguuuuaagaggca

SEQ ID NO: 1729666 - RNA, 23 nt, Human
cauauauauguuuuaagaggcag

SEQ ID NO: 1729667 - RNA, 21 nt, Human
cauaugauguacauguacuga

SEQ ID NO: 1729668 - RNA, 17 nt, Human
cauaugauguacaugua

SEQ ID NO: 1729669 - RNA, 15 nt, Human
cauaugauguacaug

SEQ ID NO: 1729670 - RNA, 22 nt, Human
caucaagucuuucacauuuaaa

SEQ ID NO: 1729671 - RNA, 14 nt, Human
caucaagaugugac

SEQ ID NO: 1729672 - RNA, 18 nt, Human
caucaaugaaugaaugaa

SEQ ID NO: 1729673 - RNA, 13 nt, Human
cauaugccugggc

SEQ ID NO: 1729674 - RNA, 14 nt, Human
cauauuuacuucuu

SEQ ID NO: 1729675 - RNA, 17 nt, Human
cauauuuacuucuuaua

SEQ ID NO: 1729676 - RNA, 16 nt, Human
cauauuuacuucuuau

SEQ ID NO: 1729677 - RNA, 20 nt, Human
cauauuuacuucuuauacau

SEQ ID NO: 1729678 - RNA, 12 nt, Human
cauauuuauaaa

SEQ ID NO: 1729679 - RNA, 17 nt, Human
cauauuuauaaaaauaa

SEQ ID NO: 1729680 - RNA, 15 nt, Human
ccuggauggggcugc

SEQ ID NO: 1729681 - RNA, 18 nt, Human
ccuggauggggcugcacc

SEQ ID NO: 1729682 - RNA, 17 nt, Human
ccuggauggggcugcac

SEQ ID NO: 1729683 - RNA, 18 nt, Human
ccuggccccucagggucc

SEQ ID NO: 1729684 - RNA, 21 nt, Human
ccuggccccucagggucccug

SEQ ID NO: 1729685 - RNA, 20 nt, Human
ccuggccccucagggucccu

SEQ ID NO: 1729686 - RNA, 15 nt, Human
ccuggggagaaagua

SEQ ID NO: 1729687 - RNA, 18 nt, Human
ccuggggaaccugacccc

SEQ ID NO: 1729688 - RNA, 13 nt, Human
ccugguguggaag

SEQ ID NO: 1729689 - RNA, 21 nt, Human
ccugguuuccugcccugggag

SEQ ID NO: 1729690 - RNA, 20 nt, Human
ccugguuuccugcccuggga

SEQ ID NO: 1729691 - RNA, 19 nt, Human
ccugguuuccugcccuggg

SEQ ID NO: 1729692 - RNA, 18 nt, Human
ccugguuuccugcccugg

SEQ ID NO: 1729693 - RNA, 19 nt, Human
ccugguggcagugggagcu

SEQ ID NO: 1729694 - RNA, 18 nt, Human
ccugguggcagugggagc

SEQ ID NO: 1729695 - RNA, 20 nt, Human
ccugguggcagugggagcug

SEQ ID NO: 1729696 - RNA, 17 nt, Human
ccugucucuacuaaaaa

SEQ ID NO: 1729697 - RNA, 22 nt, Human
ccugguuuccugcccugggagg

SEQ ID NO: 1729698 - RNA, 13 nt, Human
ccugcaggcagcc

SEQ ID NO: 1729699 - RNA, 12 nt, Human
ccugcaggcagc

SEQ ID NO: 1729700 - RNA, 14 nt, Human
ccugcaggcagcca

SEQ ID NO: 1729701 - RNA, 18 nt, Human
ccugaccccucauagccc

SEQ ID NO: 1729702 - RNA, 19 nt, Human
ccucuuucccucccuuccu

SEQ ID NO: 1729703 - RNA, 15 nt, Human
ccucuuugagugaag

SEQ ID NO: 1729704 - RNA, 22 nt, Human
ccucuugccacugccucuuccu

SEQ ID NO: 1729705 - RNA, 23 nt, Human
ccucuugccacugccucuuccuc

SEQ ID NO: 1729706 - RNA, 17 nt, Human
ccugcccaccuggccuc

SEQ ID NO: 1729707 - RNA, 15 nt, Human
ccugcccaccuggcc

SEQ ID NO: 1729708 - RNA, 19 nt, Human
ccugcccaggccccugcca

SEQ ID NO: 1729709 - RNA, 19 nt, Human
ccugcccaccuggccucug

SEQ ID NO: 1729710 - RNA, 18 nt, Human
ccugcccaccuggccucu

SEQ ID NO: 1729711 - RNA, 22 nt, Human
ccugcccaggccccugccaccc

SEQ ID NO: 1729712 - RNA, 21 nt, Human
ccugcccaggccccugccacc

SEQ ID NO: 1729713 - RNA, 15 nt, Human
ccugccucagccucc

SEQ ID NO: 1729714 - RNA, 16 nt, Human
ccugccucagccuccc

SEQ ID NO: 1729715 - RNA, 15 nt, Human
ccugccucucugcag

SEQ ID NO: 1729716 - RNA, 14 nt, Human
ccugccucucugca

SEQ ID NO: 1729717 - RNA, 20 nt, Human
ccugcugagucccaggcuga

SEQ ID NO: 1729718 - RNA, 19 nt, Human
ccugcugagucccaggcug

SEQ ID NO: 1729719 - RNA, 18 nt, Human
ccugcugagucccaggcu

SEQ ID NO: 1729720 - RNA, 13 nt, Human
ccugccucucugc

SEQ ID NO: 1729721 - RNA, 17 nt, Human
ccugccucagccucccg

SEQ ID NO: 1729722 - RNA, 16 nt, Human
ccucccuucucuucac

SEQ ID NO: 1729723 - RNA, 20 nt, Human
ccucccuuggggccuaugca

SEQ ID NO: 1729724 - RNA, 14 nt, Human
ccuccgccucuugg

SEQ ID NO: 1729725 - RNA, 13 nt, Human
ccuccgccucuug

SEQ ID NO: 1729726 - RNA, 20 nt, Human
ccucggacuuagcugggaga

SEQ ID NO: 1729727 - RNA, 19 nt, Human
ccucggacuuagcugggag

SEQ ID NO: 1729728 - RNA, 18 nt, Human
ccuccuuuucacaguucu

SEQ ID NO: 1729729 - RNA, 21 nt, Human
ccucgagguuucucaaagaaa

SEQ ID NO: 1729730 - RNA, 23 nt, Human
ccuccuuugugaggaagccgcug

SEQ ID NO: 1729731 - RNA, 19 nt, Human
ccuccuaucagaaguuucu

SEQ ID NO: 1729732 - RNA, 19 nt, Human
ccuccaagaccuucuccuu

SEQ ID NO: 1729733 - RNA, 17 nt, Human
ccuccaagaccuucucc

SEQ ID NO: 1729734 - RNA, 16 nt, Human
ccuccaagaccuucuc

SEQ ID NO: 1729735 - RNA, 12 nt, Human
ccucccaucacc

SEQ ID NO: 1729736 - RNA, 20 nt, Human
ccuccaagaccuucuccuuc

SEQ ID NO: 1729737 - RNA, 17 nt, Human
ccucccaucacccgcua

SEQ ID NO: 1729738 - RNA, 18 nt, Human
ccucaggcaggugggaug

SEQ ID NO: 1729739 - RNA, 12 nt, Human
ccucaggcaggu

SEQ ID NO: 1729740 - RNA, 10 nt, Human
ccucaggccu

SEQ ID NO: 1729741 - RNA, 21 nt, Human
ccucauuccaccuucccaugc

SEQ ID NO: 1729742 - RNA, 20 nt, Human
ccucaagugauucuccugcc

SEQ ID NO: 1729743 - RNA, 16 nt, Human
ccucaaccuccugggc

SEQ ID NO: 1729744 - RNA, 23 nt, Human
ccucaagugauucuccugccuca

SEQ ID NO: 1729745 - RNA, 23 nt, Human
ccucaacucuccuccagagucag

SEQ ID NO: 1729746 - RNA, 21 nt, Human
ccucaacucuccuccagaguc

SEQ ID NO: 1729747 - RNA, 15 nt, Human
ccucaaccuccuggg

SEQ ID NO: 1729748 - RNA, 19 nt, Human
ccucaacucuccuccagag

SEQ ID NO: 1729749 - RNA, 16 nt, Human
ccucaacaccucugca

SEQ ID NO: 1729750 - RNA, 14 nt, Human
ccucaaaugagaaa

SEQ ID NO: 1729751 - RNA, 12 nt, Human
ccgacagccugg

SEQ ID NO: 1729752 - RNA, 14 nt, Human
ccgacagccuggca

SEQ ID NO: 1729753 - RNA, 13 nt, Human
ccgacagccuggc

SEQ ID NO: 1729754 - RNA, 22 nt, Human
ccgacagccuggcacagggcag

SEQ ID NO: 1729755 - RNA, 15 nt, Human
ccgacagccuggcac

SEQ ID NO: 1729756 - RNA, 23 nt, Human
cccuuuuuuggcugcugaaggcu

SEQ ID NO: 1729757 - RNA, 22 nt, Human
cccuuuuuuggcugcugaaggc

SEQ ID NO: 1729758 - RNA, 21 nt, Human
cccuuuuuuggcugcugaagg

SEQ ID NO: 1729759 - RNA, 19 nt, Human
cccuucucuccagccccug

SEQ ID NO: 1729760 - RNA, 14 nt, Human
cccuucucuccagc

SEQ ID NO: 1729761 - RNA, 15 nt, Human
cccugugauggggcc

SEQ ID NO: 1729762 - RNA, 23 nt, Human
cccugugaguacuacaguccucc

SEQ ID NO: 1729763 - RNA, 21 nt, Human
cccugugaguacuacaguccu

SEQ ID NO: 1729764 - RNA, 14 nt, Human
cccuccuuucacca

SEQ ID NO: 1729765 - RNA, 15 nt, Human
cccugugggccccca

SEQ ID NO: 1729766 - RNA, 23 nt, Human
ccgcagcccugcagagggcacag

SEQ ID NO: 1729767 - RNA, 18 nt, Human
ccgcagcccugcagaggg

SEQ ID NO: 1729768 - RNA, 14 nt, Human
ccgcagcccugcag

SEQ ID NO: 1729769 - RNA, 18 nt, Human
ccggccaccugcggugcu

SEQ ID NO: 1729770 - RNA, 17 nt, Human
ccggccaccugcggugc

SEQ ID NO: 1729771 - RNA, 14 nt, Human
ccgucccccucugg

SEQ ID NO: 1729772 - RNA, 19 nt, Human
ccuagccuuagaagucaca

SEQ ID NO: 1729773 - RNA, 23 nt, Human
ccuagccugugccucugggacug

SEQ ID NO: 1729774 - RNA, 22 nt, Human
ccuagccuuagaagucacacag

SEQ ID NO: 1729775 - RNA, 13 nt, Human
ccuaauaaagcug

SEQ ID NO: 1729776 - RNA, 12 nt, Human
ccuaauaaagcu

SEQ ID NO: 1729777 - RNA, 13 nt, Human
ccuaauuccacag

SEQ ID NO: 1729778 - RNA, 21 nt, Human
ccuaaugcgcaggcuggcccu

SEQ ID NO: 1729779 - RNA, 13 nt, Human
ccaguuggucccc

SEQ ID NO: 1729780 - RNA, 21 nt, Human
ccaucccauaugccugggcag

SEQ ID NO: 1729781 - RNA, 20 nt, Human
ccaucccauaugccugggca

SEQ ID NO: 1729782 - RNA, 19 nt, Human
ccaucccauaugccugggc

SEQ ID NO: 1729783 - RNA, 20 nt, Human
ccaucccaaacccuucagug

SEQ ID NO: 1729784 - RNA, 19 nt, Human
ccauccagguucagcuugu

SEQ ID NO: 1729785 - RNA, 18 nt, Human
ccauccagguucagcuug

SEQ ID NO: 1729786 - RNA, 21 nt, Human
ccauaaucuggacuccucugu

SEQ ID NO: 1729787 - RNA, 14 nt, Human
ccauaaucuggacu

SEQ ID NO: 1729788 - RNA, 20 nt, Human
ccaguuggucccccuuccau

SEQ ID NO: 1729789 - RNA, 18 nt, Human
ccaguuggucccccuucc

SEQ ID NO: 1729790 - RNA, 20 nt, Human
ccaugaggaacaaggcaagg

SEQ ID NO: 1729791 - RNA, 23 nt, Human
ccaugaggaacaaggcaaggcug

SEQ ID NO: 1729792 - RNA, 18 nt, Human
ccaugaguccccuguuug

SEQ ID NO: 1729793 - RNA, 12 nt, Human
ccaugucgccuc

SEQ ID NO: 1729794 - RNA, 19 nt, Human
ccaugucgccucugcauuc

SEQ ID NO: 1729795 - RNA, 17 nt, Human
ccaugucgccucugcau

SEQ ID NO: 1729796 - RNA, 16 nt, Human
ccaugucgccucugca

SEQ ID NO: 1729797 - RNA, 15 nt, Human
ccaugucgccucugc

SEQ ID NO: 1729798 - RNA, 20 nt, Human
cccaacuaauuuuuguauuu

SEQ ID NO: 1729799 - RNA, 20 nt, Human
cccaacucaccccagcccca

SEQ ID NO: 1729800 - RNA, 17 nt, Human
cccaacucaccccagcc

SEQ ID NO: 1729801 - RNA, 15 nt, Human
cccaagcucugcucc

SEQ ID NO: 1729802 - RNA, 12 nt, Human
cccaagcucugc

SEQ ID NO: 1729803 - RNA, 14 nt, Human
cccaagcucugcuc

SEQ ID NO: 1729804 - RNA, 13 nt, Human
cccaagcucugcu

SEQ ID NO: 1729805 - RNA, 23 nt, Human
cccacugcuuuuggucuguguga

SEQ ID NO: 1729806 - RNA, 13 nt, Human
cccacucccugca

SEQ ID NO: 1729807 - RNA, 12 nt, Human
cccacccccacc

SEQ ID NO: 1729808 - RNA, 16 nt, Human
cccaacucaccccagc

SEQ ID NO: 1729809 - RNA, 15 nt, Human
cccaacucaccccag

SEQ ID NO: 1729810 - RNA, 22 nt, Human
ccauuucauuugugccagaaug

SEQ ID NO: 1729811 - RNA, 21 nt, Human
ccauuucauuugugccagaau

SEQ ID NO: 1729812 - RNA, 17 nt, Human
ccagccccagugcccac

SEQ ID NO: 1729813 - RNA, 14 nt, Human
ccagcagagcaccu

SEQ ID NO: 1729814 - RNA, 13 nt, Human
ccagcagagcacc

SEQ ID NO: 1729815 - RNA, 12 nt, Human
ccagcagagcac

SEQ ID NO: 1729816 - RNA, 17 nt, Human
ccagccccauccucugu

SEQ ID NO: 1729817 - RNA, 15 nt, Human
ccagccccauccucu

SEQ ID NO: 1729818 - RNA, 18 nt, Human
ccagccccauccucugua

SEQ ID NO: 1729819 - RNA, 12 nt, Human
ccagcagaaaug

SEQ ID NO: 1729820 - RNA, 24 nt, Human
ccagccccuucugacccaugcugc

SEQ ID NO: 1729821 - RNA, 23 nt, Human
ccagccccuucugacccaugcug

SEQ ID NO: 1729822 - RNA, 16 nt, Human
ccaggcuggcgugcag

SEQ ID NO: 1729823 - RNA, 12 nt, Human
ccaggcuggcgu

SEQ ID NO: 1729824 - RNA, 21 nt, Human
ccaggggaaaaucagccugcu

SEQ ID NO: 1729825 - RNA, 14 nt, Human
ccaggcaggucuug

SEQ ID NO: 1729826 - RNA, 12 nt, Human
ccaggcaggucu

SEQ ID NO: 1729827 - RNA, 23 nt, Human
ccaggcaggucuugaacuccugg

SEQ ID NO: 1729828 - RNA, 21 nt, Human
ccaggcugcucuugaacuccu

SEQ ID NO: 1729829 - RNA, 18 nt, Human
ccagucccccugccccag

SEQ ID NO: 1729830 - RNA, 13 nt, Human
ccccugcacucca

SEQ ID NO: 1729831 - RNA, 21 nt, Human
ccccugcaaagcccagcuuga

SEQ ID NO: 1729832 - RNA, 20 nt, Human
ccccugcaaagcccagcuug

SEQ ID NO: 1729833 - RNA, 18 nt, Human
ccccugcaaagcccagcu

SEQ ID NO: 1729834 - RNA, 15 nt, Human
ccccugacaacacuc

SEQ ID NO: 1729835 - RNA, 18 nt, Human
ccccucuggcuccagcug

SEQ ID NO: 1729836 - RNA, 16 nt, Human
ccccucuggcuccagc

SEQ ID NO: 1729837 - RNA, 16 nt, Human
ccccugccacccuggg

SEQ ID NO: 1729838 - RNA, 14 nt, Human
ccccugccacccug

SEQ ID NO: 1729839 - RNA, 23 nt, Human
ccccucugcccugcgggucacag

SEQ ID NO: 1729840 - RNA, 20 nt, Human
ccccucugcccugcggguca

SEQ ID NO: 1729841 - RNA, 15 nt, Human
ccccucugcccugcg

SEQ ID NO: 1729842 - RNA, 16 nt, Human
cccggccccugcuggu

SEQ ID NO: 1729843 - RNA, 15 nt, Human
cccggccccugcugg

SEQ ID NO: 1729844 - RNA, 15 nt, Human
cccgggaagggggcu

SEQ ID NO: 1729845 - RNA, 11 nt, Human
cccggcuccag

SEQ ID NO: 1729846 - RNA, 20 nt, Human
cccggcuaauuuuuguauuu

SEQ ID NO: 1729847 - RNA, 22 nt, Human
cccgaauagcugggacuacagg

SEQ ID NO: 1729848 - RNA, 18 nt, Human
cccgaauagcugggacua

SEQ ID NO: 1729849 - RNA, 17 nt, Human
cccgaauagcugggacu

SEQ ID NO: 1729850 - RNA, 16 nt, Human
cccgaauagcugggac

SEQ ID NO: 1729851 - RNA, 16 nt, Human
ccccuucugacccaug

SEQ ID NO: 1729852 - RNA, 14 nt, Human
ccccuucugaccca

SEQ ID NO: 1729853 - RNA, 13 nt, Human
ccccuucugaccc

SEQ ID NO: 1729854 - RNA, 21 nt, Human
cccgggaagggggcugggaca

SEQ ID NO: 1729855 - RNA, 18 nt, Human
cccgggaagggggcuggg

SEQ ID NO: 1729856 - RNA, 16 nt, Human
cccucaacaccucugc

SEQ ID NO: 1729857 - RNA, 22 nt, Human
cccgggaagggggcugggacau

SEQ ID NO: 1729858 - RNA, 20 nt, Human
cccucaacucuccuccagag

SEQ ID NO: 1729859 - RNA, 16 nt, Human
cccucacccuggggcu

SEQ ID NO: 1729860 - RNA, 16 nt, Human
cccucaacucuccucc

SEQ ID NO: 1729861 - RNA, 15 nt, Human
cccuccucucugccc

SEQ ID NO: 1729862 - RNA, 16 nt, Human
cccuccucucugcccu

SEQ ID NO: 1729863 - RNA, 14 nt, Human
ccccgcacugggcu

SEQ ID NO: 1729864 - RNA, 15 nt, Human
cccauucugccugcc

SEQ ID NO: 1729865 - RNA, 14 nt, Human
cccauucugccugc

SEQ ID NO: 1729866 - RNA, 19 nt, Human
cccauucugccugcccagg

SEQ ID NO: 1729867 - RNA, 15 nt, Human
cccauuugcuccuuu

SEQ ID NO: 1729868 - RNA, 20 nt, Human
ccccagauugcaacaggcug

SEQ ID NO: 1729869 - RNA, 15 nt, Human
ccccagauugcaaca

SEQ ID NO: 1729870 - RNA, 17 nt, Human
ccccagaggcuggguga

SEQ ID NO: 1729871 - RNA, 22 nt, Human
cccauccucuguacagagccca

SEQ ID NO: 1729872 - RNA, 21 nt, Human
cccauccucuguacagagccc

SEQ ID NO: 1729873 - RNA, 18 nt, Human
cccaggaaaggcuccagg

SEQ ID NO: 1729874 - RNA, 17 nt, Human
cccaggaaaggcuccag

SEQ ID NO: 1729875 - RNA, 17 nt, Human
cccaggcugagccucag

SEQ ID NO: 1729876 - RNA, 16 nt, Human
cccaggcugagccuca

SEQ ID NO: 1729877 - RNA, 15 nt, Human
cccaggcugagccuc

SEQ ID NO: 1729878 - RNA, 22 nt, Human
cccaggcuuagucacugagaca

SEQ ID NO: 1729879 - RNA, 20 nt, Human
cccaggcuggagugcaauga

SEQ ID NO: 1729880 - RNA, 18 nt, Human
cccaggcugagccucagu

SEQ ID NO: 1729881 - RNA, 13 nt, Human
cccaggcuggagu

SEQ ID NO: 1729882 - RNA, 16 nt, Human
cccacuggacucaccu

SEQ ID NO: 1729883 - RNA, 16 nt, Human
cccaggaaaggcucca

SEQ ID NO: 1729884 - RNA, 20 nt, Human
cccagcuggggccaggcugg

SEQ ID NO: 1729885 - RNA, 15 nt, Human
cccaggaaaggcucc

SEQ ID NO: 1729886 - RNA, 17 nt, Human
cucccaccucagccucc

SEQ ID NO: 1729887 - RNA, 16 nt, Human
cucccaccucagccuc

SEQ ID NO: 1729888 - RNA, 14 nt, Human
cucccaccucagcc

SEQ ID NO: 1729889 - RNA, 22 nt, Human
cuccaggugcacaagcuccaag

SEQ ID NO: 1729890 - RNA, 20 nt, Human
cuccaggugcacaagcucca

SEQ ID NO: 1729891 - RNA, 19 nt, Human
cuccaggugcacaagcucc

SEQ ID NO: 1729892 - RNA, 18 nt, Human
cuccaggugcacaagcuc

SEQ ID NO: 1729893 - RNA, 23 nt, Human
cuccaggcuguaucccaugagcc

SEQ ID NO: 1729894 - RNA, 17 nt, Human
cucagaaucucaaauaa

SEQ ID NO: 1729895 - RNA, 16 nt, Human
cucagaaucucaaaua

SEQ ID NO: 1729896 - RNA, 11 nt, Human
cuccagacaca

SEQ ID NO: 1729897 - RNA, 22 nt, Human
cuccagaauuucccaaagcagu

SEQ ID NO: 1729898 - RNA, 16 nt, Human
cuccagacacaugucc

SEQ ID NO: 1729899 - RNA, 16 nt, Human
cucccucccucuuucc

SEQ ID NO: 1729900 - RNA, 15 nt, Human
cucccucuuucccuc

SEQ ID NO: 1729901 - RNA, 19 nt, Human
cucccucuuucccucccuu

SEQ ID NO: 1729902 - RNA, 20 nt, Human
cuccgcuuucuacccagcga

SEQ ID NO: 1729903 - RNA, 21 nt, Human
cuccgcuuucuacccagcgag

SEQ ID NO: 1729904 - RNA, 22 nt, Human
cuccgcuuucuacccagcgagc

SEQ ID NO: 1729905 - RNA, 23 nt, Human
cuccgcuuucuacccagcgagcc

SEQ ID NO: 1729906 - RNA, 18 nt, Human
cucguauaugucucaggu

SEQ ID NO: 1729907 - RNA, 11 nt, Human
cucggugccuu

SEQ ID NO: 1729908 - RNA, 20 nt, Human
cucguauaugucucaggucc

SEQ ID NO: 1729909 - RNA, 22 nt, Human
cuccuuuagcgcccaguugggu

SEQ ID NO: 1729910 - RNA, 17 nt, Human
cuccuuuagcgcccagu

SEQ ID NO: 1729911 - RNA, 16 nt, Human
cuccuuuagcgcccag

SEQ ID NO: 1729912 - RNA, 22 nt, Human
cuccuagccugugccucuggga

SEQ ID NO: 1729913 - RNA, 24 nt, Human
cuccuuuucacaguucucuccuuc

SEQ ID NO: 1729914 - RNA, 13 nt, Human
cucgaacuccuga

SEQ ID NO: 1729915 - RNA, 17 nt, Human
cucgaacuccugaccuu

SEQ ID NO: 1729916 - RNA, 16 nt, Human
cucgaacuccugaccu

SEQ ID NO: 1729917 - RNA, 19 nt, Human
cucucuggccuucggccuc

SEQ ID NO: 1729918 - RNA, 22 nt, Human
cucucuggccuucggccuccau

SEQ ID NO: 1729919 - RNA, 17 nt, Human
cucucuggccuucggcc

SEQ ID NO: 1729920 - RNA, 10 nt, Human
cucuccucug

SEQ ID NO: 1729921 - RNA, 20 nt, Human
cucuccuccuuuucacaguu

SEQ ID NO: 1729922 - RNA, 13 nt, Human
cucuccuccuuuu

SEQ ID NO: 1729923 - RNA, 16 nt, Human
cucuccgaccagacac

SEQ ID NO: 1729924 - RNA, 21 nt, Human
cucuccgaccagacaccuuga

SEQ ID NO: 1729925 - RNA, 13 nt, Human
cucucccuuggau

SEQ ID NO: 1729926 - RNA, 15 nt, Human
cucgugguaggacug

SEQ ID NO: 1729927 - RNA, 16 nt, Human
cucgugguaggacugu

SEQ ID NO: 1729928 - RNA, 17 nt, Human
cucgugguaggacugua

SEQ ID NO: 1729929 - RNA, 16 nt, Human
cucugcacaagcugca

SEQ ID NO: 1729930 - RNA, 23 nt, Human
cugaggaauccagacccggcugc

SEQ ID NO: 1729931 - RNA, 14 nt, Human
cugaggggccucuu

SEQ ID NO: 1729932 - RNA, 22 nt, Human
cugaggugggaggaucucuuga

SEQ ID NO: 1729933 - RNA, 13 nt, Human
cugaggugggagg

SEQ ID NO: 1729934 - RNA, 14 nt, Human
cugaggaauccaga

SEQ ID NO: 1729935 - RNA, 22 nt, Human
cugagcuugcagagaugaggcc

SEQ ID NO: 1729936 - RNA, 22 nt, Human
cugagcugggaugauuggaggg

SEQ ID NO: 1729937 - RNA, 12 nt, Human
cugagcugggau

SEQ ID NO: 1729938 - RNA, 19 nt, Human
cugacccugcuucaaauau

SEQ ID NO: 1729939 - RNA, 18 nt, Human
cugaucucucgugauuga

SEQ ID NO: 1729940 - RNA, 17 nt, Human
cugaucucucgugauug

SEQ ID NO: 1729941 - RNA, 13 nt, Human
cugaaagaggaau

SEQ ID NO: 1729942 - RNA, 17 nt, Human
cugaaagaggaaugaag

SEQ ID NO: 1729943 - RNA, 22 nt, Human
cucuugccacugccucuuccuc

SEQ ID NO: 1729944 - RNA, 24 nt, Human
cucuugauucauaaugacuuaagc

SEQ ID NO: 1729945 - RNA, 14 nt, Human
cucuugagccuggg

SEQ ID NO: 1729946 - RNA, 13 nt, Human
cucuugagccugg

SEQ ID NO: 1729947 - RNA, 16 nt, Human
cucuugagccugggag

SEQ ID NO: 1729948 - RNA, 15 nt, Human
cucuugagccuggga

SEQ ID NO: 1729949 - RNA, 22 nt, Human
cucuugauucauaaugacuuaa

SEQ ID NO: 1729950 - RNA, 19 nt, Human
cucugcacaagcugcaccc

SEQ ID NO: 1729951 - RNA, 18 nt, Human
cucugcacaagcugcacc

SEQ ID NO: 1729952 - RNA, 17 nt, Human
cucugcacaagcugcac

SEQ ID NO: 1729953 - RNA, 17 nt, Human
cugaccccucauagccc

SEQ ID NO: 1729954 - RNA, 21 nt, Human
cugaccccucauagcccucac

SEQ ID NO: 1729955 - RNA, 20 nt, Human
cugaccccucauagcccuca

SEQ ID NO: 1729956 - RNA, 23 nt, Human
cugacacacagcucuguccuggg

SEQ ID NO: 1729957 - RNA, 22 nt, Human
cugacacacagcucuguccugg

SEQ ID NO: 1729958 - RNA, 21 nt, Human
cugacacacagcucuguccug

SEQ ID NO: 1729959 - RNA, 20 nt, Human
cugacacacagcucuguccu

SEQ ID NO: 1729960 - RNA, 19 nt, Human
cugacacacagcucugucc

SEQ ID NO: 1729961 - RNA, 18 nt, Human
cugacacacagcucuguc

SEQ ID NO: 1729962 - RNA, 17 nt, Human
cugacacacagcucugu

SEQ ID NO: 1729963 - RNA, 16 nt, Human
cugacacacagcucug

SEQ ID NO: 1729964 - RNA, 15 nt, Human
cugacacacagcucu

SEQ ID NO: 1729965 - RNA, 13 nt, Human
cugacacacagcu

SEQ ID NO: 1729966 - RNA, 14 nt, Human
cugaaaauguaugu

SEQ ID NO: 1729967 - RNA, 21 nt, Human
cgagguuucucaaagaaauuu

SEQ ID NO: 1729968 - RNA, 19 nt, Human
cgaguagcugagauuauag

SEQ ID NO: 1729969 - RNA, 21 nt, Human
cgauacaccgggccuggagaa

SEQ ID NO: 1729970 - RNA, 20 nt, Human
cgauacaccgggccuggaga

SEQ ID NO: 1729971 - RNA, 18 nt, Human
cgauacaccgggccugga

SEQ ID NO: 1729972 - RNA, 16 nt, Human
cgccuuaaggauguuc

SEQ ID NO: 1729973 - RNA, 13 nt, Human
cgcugccccuggc

SEQ ID NO: 1729974 - RNA, 17 nt, Human
cgcugccccuggcagcc

SEQ ID NO: 1729975 - RNA, 16 nt, Human
cgcugccccuggcagc

SEQ ID NO: 1729976 - RNA, 23 nt, Human
cgcuggaccuugaacuggguacu

SEQ ID NO: 1729977 - RNA, 19 nt, Human
cgcuggaccuugaacuggg

SEQ ID NO: 1729978 - RNA, 18 nt, Human
cgcugccccuggcagccc

SEQ ID NO: 1729979 - RNA, 20 nt, Human
cgcuggggccaguugguccc

SEQ ID NO: 1729980 - RNA, 17 nt, Human
cgcuggggccaguuggu

SEQ ID NO: 1729981 - RNA, 23 nt, Human
cgcuggccgggaccccgagccug

SEQ ID NO: 1729982 - RNA, 18 nt, Human
cgcuggccgggaccccga

SEQ ID NO: 1729983 - RNA, 14 nt, Human
cguuaccaggcagg

SEQ ID NO: 1729984 - RNA, 13 nt, Human
cguuaaaauacca

SEQ ID NO: 1729985 - RNA, 14 nt, Human
cguuaaaaacagau

SEQ ID NO: 1729986 - RNA, 21 nt, Human
cguuaaaaacagauuuggaaa

SEQ ID NO: 1729987 - RNA, 22 nt, Human
cguguccccuauccuacuuccc

SEQ ID NO: 1729988 - RNA, 22 nt, Human
cuaaaguguauuuuuuuacuaa

SEQ ID NO: 1729989 - RNA, 17 nt, Human
cuaaaggcuaccuuugu

SEQ ID NO: 1729990 - RNA, 19 nt, Human
cuaaaggcuaccuuuguau

SEQ ID NO: 1729991 - RNA, 14 nt, Human
cuaaagcugccagc

SEQ ID NO: 1729992 - RNA, 21 nt, Human
cuaaagaagguuucagaaaga

SEQ ID NO: 1729993 - RNA, 15 nt, Human
cuaaaggcuaccuuu

SEQ ID NO: 1729994 - RNA, 16 nt, Human
cuaaaggcuaccuuug

SEQ ID NO: 1729995 - RNA, 15 nt, Human
cuaaagcugccagcc

SEQ ID NO: 1729996 - RNA, 13 nt, Human
cgguguggagaag

SEQ ID NO: 1729997 - RNA, 13 nt, Human
cguacacauuuua

SEQ ID NO: 1729998 - RNA, 16 nt, Human
cguacacauuuuauuu

SEQ ID NO: 1729999 - RNA, 15 nt, Human
cggagacggaguccc

SEQ ID NO: 1730000 - RNA, 15 nt, Human
cuaggguccugggga

SEQ ID NO: 1730001 - RNA, 14 nt, Human
cuaggguccugggg

SEQ ID NO: 1730002 - RNA, 13 nt, Human
cuaggguccuggg

SEQ ID NO: 1730003 - RNA, 17 nt, Human
cuaguuugauuaaauuc

SEQ ID NO: 1730004 - RNA, 19 nt, Human
cuaguuugauuaaauucuu

SEQ ID NO: 1730005 - RNA, 14 nt, Human
cuagggaagauaau

SEQ ID NO: 1730006 - RNA, 20 nt, Human
cuaguuugauuaaauucuug

SEQ ID NO: 1730007 - RNA, 16 nt, Human
cuagcauacguacaca

SEQ ID NO: 1730008 - RNA, 18 nt, Human
cuagcauacguacacauu

SEQ ID NO: 1730009 - RNA, 19 nt, Human
cuagcauacguacacauuu

SEQ ID NO: 1730010 - RNA, 20 nt, Human
cuagcauacguacacauuuu

SEQ ID NO: 1730011 - RNA, 21 nt, Human
cuagacccacuggacucaccu

SEQ ID NO: 1730012 - RNA, 13 nt, Human
cuaggccuggcca

SEQ ID NO: 1730013 - RNA, 17 nt, Human
cuagccagaggagagag

SEQ ID NO: 1730014 - RNA, 19 nt, Human
cuagccagaggagagagga

SEQ ID NO: 1730015 - RNA, 19 nt, Human
cuaggccuggccagaugca

SEQ ID NO: 1730016 - RNA, 18 nt, Human
cuaggccuggccagaugc

SEQ ID NO: 1730017 - RNA, 15 nt, Human
cuaggccuggccaga

SEQ ID NO: 1730018 - RNA, 14 nt, Human
cuaggccuggccag

SEQ ID NO: 1730019 - RNA, 13 nt, Human
cuaggccugggga

SEQ ID NO: 1730020 - RNA, 12 nt, Human
cuaggccugggg

SEQ ID NO: 1730021 - RNA, 20 nt, Human
cuacuagggaaaugccuuug

SEQ ID NO: 1730022 - RNA, 23 nt, Human
cuaccugaggggccucuuauggg

SEQ ID NO: 1730023 - RNA, 19 nt, Human
cuaccugaggggccucuua

SEQ ID NO: 1730024 - RNA, 16 nt, Human
cuaccugaggggccuc

SEQ ID NO: 1730025 - RNA, 18 nt, Human
cuaccuuccaguuccuca

SEQ ID NO: 1730026 - RNA, 17 nt, Human
cuacuaccuguaaugac

SEQ ID NO: 1730027 - RNA, 17 nt, Human
cucaccucucccuugga

SEQ ID NO: 1730028 - RNA, 16 nt, Human
cucaccucucccuugg

SEQ ID NO: 1730029 - RNA, 15 nt, Human
cucaccucucccuug

SEQ ID NO: 1730030 - RNA, 14 nt, Human
cucaccucucccuu

SEQ ID NO: 1730031 - RNA, 13 nt, Human
cucaccucucccu

SEQ ID NO: 1730032 - RNA, 16 nt, Human
cucaccucccccaucu

SEQ ID NO: 1730033 - RNA, 16 nt, Human
cucaccugccccucaa

SEQ ID NO: 1730034 - RNA, 14 nt, Human
cucaccugccccuc

SEQ ID NO: 1730035 - RNA, 18 nt, Human
cucaccugccccucaacu

SEQ ID NO: 1730036 - RNA, 13 nt, Human
cucaccugccccu

SEQ ID NO: 1730037 - RNA, 14 nt, Human
cucacccuggggcu

SEQ ID NO: 1730038 - RNA, 23 nt, Human
cuaugucauuugcuggagcucug

SEQ ID NO: 1730039 - RNA, 15 nt, Human
cuauguugcccaggc

SEQ ID NO: 1730040 - RNA, 22 nt, Human
cuauguguagggcgggaggaug

SEQ ID NO: 1730041 - RNA, 20 nt, Human
cuaucucccccagccccauc

SEQ ID NO: 1730042 - RNA, 19 nt, Human
cuauguaucaaugaguaac

SEQ ID NO: 1730043 - RNA, 14 nt, Human
cucaaaacaaaggc

SEQ ID NO: 1730044 - RNA, 22 nt, Human
cucaaagaaauuuccacucagg

SEQ ID NO: 1730045 - RNA, 17 nt, Human
cuauguugcccaggcag

SEQ ID NO: 1730046 - RNA, 16 nt, Human
cuauguugcccaggca

SEQ ID NO: 1730047 - RNA, 14 nt, Human
cuauuuuucagaau

SEQ ID NO: 1730048 - RNA, 18 nt, Human
cucaaaaaaagaaaaaga

SEQ ID NO: 1730049 - RNA, 13 nt, Human
cucaaaacaaagg

SEQ ID NO: 1730050 - RNA, 21 nt, Human
cucacacaugagcaucaggcc

SEQ ID NO: 1730051 - RNA, 14 nt, Human
cucacacaugagca

SEQ ID NO: 1730052 - RNA, 12 nt, Human
cucaaauaacua

SEQ ID NO: 1730053 - RNA, 14 nt, Human
cucacaaaggaugc

SEQ ID NO: 1730054 - RNA, 20 nt, Human
caauaaaaucuugaaaaugc

SEQ ID NO: 1730055 - RNA, 15 nt, Human
caaggcucugagcaa

SEQ ID NO: 1730056 - RNA, 20 nt, Human
caaggccaaaggaagcacau

SEQ ID NO: 1730057 - RNA, 19 nt, Human
caaggccaaaggaagcaca

SEQ ID NO: 1730058 - RNA, 21 nt, Human
caaggccaaaggaagcacaug

SEQ ID NO: 1730059 - RNA, 18 nt, Human
caaggcaaggcugucaau

SEQ ID NO: 1730060 - RNA, 17 nt, Human
caaggcaaggcugucaa

SEQ ID NO: 1730061 - RNA, 12 nt, Human
caagauuucaga

SEQ ID NO: 1730062 - RNA, 21 nt, Human
cacaagcuccaagcucccagg

SEQ ID NO: 1730063 - RNA, 20 nt, Human
cacaagcuccaagcucccag

SEQ ID NO: 1730064 - RNA, 21 nt, Human
caaugcuggcuguuggcuggg

SEQ ID NO: 1730065 - RNA, 20 nt, Human
caaugcuggcuguuggcugg

SEQ ID NO: 1730066 - RNA, 13 nt, Human
caaugcuggcugu

SEQ ID NO: 1730067 - RNA, 23 nt, Human
caaucccaccaacccucagagcc

SEQ ID NO: 1730068 - RNA, 22 nt, Human
caaucccaccaacccucagagc

SEQ ID NO: 1730069 - RNA, 17 nt, Human
caaucccaccaacccuc

SEQ ID NO: 1730070 - RNA, 16 nt, Human
caaucccaccaacccu

SEQ ID NO: 1730071 - RNA, 19 nt, Human
cacaagcuccaagcuccca

SEQ ID NO: 1730072 - RNA, 18 nt, Human
cacaagcuccaagcuccc

SEQ ID NO: 1730073 - RNA, 20 nt, Human
cacaagagcccaggccuccu

SEQ ID NO: 1730074 - RNA, 19 nt, Human
cacaagagcccaggccucc

SEQ ID NO: 1730075 - RNA, 18 nt, Human
cacaagagcccaggccuc

SEQ ID NO: 1730076 - RNA, 15 nt, Human
caaugggagcucaug

SEQ ID NO: 1730077 - RNA, 17 nt, Human
cacagacccugcccugu

SEQ ID NO: 1730078 - RNA, 16 nt, Human
cacagacccugcccug

SEQ ID NO: 1730079 - RNA, 14 nt, Human
cacagacccugccc

SEQ ID NO: 1730080 - RNA, 14 nt, Human
cacagcucuguccu

SEQ ID NO: 1730081 - RNA, 11 nt, Human
cacagcucugu

SEQ ID NO: 1730082 - RNA, 18 nt, Human
cacagacccugcccugug

SEQ ID NO: 1730083 - RNA, 19 nt, Human
cacagcucuguccugggag

SEQ ID NO: 1730084 - RNA, 18 nt, Human
cacagcucuguccuggga

SEQ ID NO: 1730085 - RNA, 16 nt, Human
cacagcucuguccugg

SEQ ID NO: 1730086 - RNA, 15 nt, Human
cacagcucuguccug

SEQ ID NO: 1730087 - RNA, 15 nt, Human
cacagcucuucucca

SEQ ID NO: 1730088 - RNA, 14 nt, Human
cacagcucuucucc

SEQ ID NO: 1730089 - RNA, 17 nt, Human
cacagcucuucuccagg

SEQ ID NO: 1730090 - RNA, 12 nt, Human
cacacauuuuuu

SEQ ID NO: 1730091 - RNA, 16 nt, Human
cacacauuuuuuaaau

SEQ ID NO: 1730092 - RNA, 19 nt, Human
cacacauuuuuuaaaugca

SEQ ID NO: 1730093 - RNA, 20 nt, Human
cacacauuuuuuaaaugcac

SEQ ID NO: 1730094 - RNA, 10 nt, Human
cacacauuuu

SEQ ID NO: 1730095 - RNA, 11 nt, Human
cacacauuuuu

SEQ ID NO: 1730096 - RNA, 13 nt, Human
cacagaacccuug

SEQ ID NO: 1730097 - RNA, 16 nt, Human
cacccaggagccccga

SEQ ID NO: 1730098 - RNA, 18 nt, Human
cacccaccucagccuccc

SEQ ID NO: 1730099 - RNA, 16 nt, Human
caccagccccagugcc

SEQ ID NO: 1730100 - RNA, 13 nt, Human
caccagccccagu

SEQ ID NO: 1730101 - RNA, 17 nt, Human
cacccaccucagccucc

SEQ ID NO: 1730102 - RNA, 13 nt, Human
caccagggaaggg

SEQ ID NO: 1730103 - RNA, 21 nt, Human
caccagggaaggggacaagga

SEQ ID NO: 1730104 - RNA, 18 nt, Human
caccagggaaggggacaa

SEQ ID NO: 1730105 - RNA, 14 nt, Human
caccaacgucugug

SEQ ID NO: 1730106 - RNA, 13 nt, Human
caccaacccucag

SEQ ID NO: 1730107 - RNA, 16 nt, Human
caccaacgucugugcc

SEQ ID NO: 1730108 - RNA, 17 nt, Human
caccaacauacucccau

SEQ ID NO: 1730109 - RNA, 17 nt, Human
cacauuuuauuuuauua

SEQ ID NO: 1730110 - RNA, 19 nt, Human
cacauuuuauuuuauuaug

SEQ ID NO: 1730111 - RNA, 20 nt, Human
cacauuuuauuuuauuaugc

SEQ ID NO: 1730112 - RNA, 21 nt, Human
cacauuuuauuuuauuaugca

SEQ ID NO: 1730113 - RNA, 15 nt, Human
cacuuaaaaaugguu

SEQ ID NO: 1730114 - RNA, 23 nt, Human
cacuguugcccaggcuggcgugc

SEQ ID NO: 1730115 - RNA, 19 nt, Human
cacuguugcccaggcuggc

SEQ ID NO: 1730116 - RNA, 18 nt, Human
cacuguugcccaggcugg

SEQ ID NO: 1730117 - RNA, 20 nt, Human
cacugggcuuggggaccaga

SEQ ID NO: 1730118 - RNA, 13 nt, Human
cacugggcuucua

SEQ ID NO: 1730119 - RNA, 19 nt, Human
cacugggagaaaugaaaaa

SEQ ID NO: 1730120 - RNA, 14 nt, Human
cacugcagccucaa

SEQ ID NO: 1730121 - RNA, 19 nt, Human
cacugcagccucaaccucc

SEQ ID NO: 1730122 - RNA, 23 nt, Human
cacugcagccucaaccuccuggg

SEQ ID NO: 1730123 - RNA, 22 nt, Human
cacugcagccucaaccuccugg

SEQ ID NO: 1730124 - RNA, 21 nt, Human
cacugcagccucaaccuccug

SEQ ID NO: 1730125 - RNA, 20 nt, Human
cacugcagccucaaccuccu

SEQ ID NO: 1730126 - RNA, 17 nt, Human
cacugccaugccagcuu

SEQ ID NO: 1730127 - RNA, 18 nt, Human
cacuuguguuaugaagca

SEQ ID NO: 1730128 - RNA, 19 nt, Human
cacuuguugauuaauggaa

SEQ ID NO: 1730129 - RNA, 20 nt, Human
cacuuaaguuaguuccacug

SEQ ID NO: 1730130 - RNA, 22 nt, Human
cacuuaaguuaguuccacugag

SEQ ID NO: 1730131 - RNA, 17 nt, Human
cacuuucuagccagagg

SEQ ID NO: 1730132 - RNA, 16 nt, Human
cacuuucuagccagag

SEQ ID NO: 1730133 - RNA, 18 nt, Human
cacuuucuagccagagga

SEQ ID NO: 1730134 - RNA, 13 nt, Human
cacuuucuagcca

SEQ ID NO: 1730135 - RNA, 11 nt, Human
cagaacaguga

SEQ ID NO: 1730136 - RNA, 12 nt, Human
cagaacagugau

SEQ ID NO: 1730137 - RNA, 17 nt, Human
cagaacagugauuacca

SEQ ID NO: 1730138 - RNA, 18 nt, Human
cagaacagugauuaccag

SEQ ID NO: 1730139 - RNA, 19 nt, Human
cagaaguuucucagcuccc

SEQ ID NO: 1730140 - RNA, 15 nt, Human
cagaaguuucucagc

SEQ ID NO: 1730141 - RNA, 16 nt, Human
cagaaguuucugccgc

SEQ ID NO: 1730142 - RNA, 14 nt, Human
cagaaguuucugcc

SEQ ID NO: 1730143 - RNA, 16 nt, Human
cagaaauguacagcaa

SEQ ID NO: 1730144 - RNA, 20 nt, Human
cagaaagguuuucuucuuuu

SEQ ID NO: 1730145 - RNA, 22 nt, Human
cacucuuauugcccacgcugga

SEQ ID NO: 1730146 - RNA, 21 nt, Human
cacucuuauugcccacgcugg

SEQ ID NO: 1730147 - RNA, 20 nt, Human
cacucuuauugcccacgcug

SEQ ID NO: 1730148 - RNA, 23 nt, Human
cacuccagccugagcgacaguga

SEQ ID NO: 1730149 - RNA, 14 nt, Human
cacuccagccuggg

SEQ ID NO: 1730150 - RNA, 13 nt, Human
cacuccagccugg

SEQ ID NO: 1730151 - RNA, 13 nt, Human
cacuccagccuga

SEQ ID NO: 1730152 - RNA, 12 nt, Human
cacuccagccug

SEQ ID NO: 1730153 - RNA, 21 nt, Human
cacuacauucuguuaaucauu

SEQ ID NO: 1730154 - RNA, 21 nt, Human
cacuacauuauaaaugucucu

SEQ ID NO: 1730155 - RNA, 16 nt, Human
cacuacauucuguuaa

SEQ ID NO: 1730156 - RNA, 17 nt, Human
cacuacauucuguuaau

SEQ ID NO: 1730157 - RNA, 13 nt, Human
cacggccaggcca

SEQ ID NO: 1730158 - RNA, 12 nt, Human
cacggccaggcc

SEQ ID NO: 1730159 - RNA, 14 nt, Human
cacggcucacugca

SEQ ID NO: 1730160 - RNA, 15 nt, Human
cacggcucacugcag

SEQ ID NO: 1730161 - RNA, 14 nt, Human
caccuuucccaucu

SEQ ID NO: 1730162 - RNA, 14 nt, Human
caccuuugaagaag

SEQ ID NO: 1730163 - RNA, 16 nt, Human
caccuuggcugcaggg

SEQ ID NO: 1730164 - RNA, 15 nt, Human
caccuuggcugcagg

SEQ ID NO: 1730165 - RNA, 18 nt, Human
caccuuggcugcagggag

SEQ ID NO: 1730166 - RNA, 23 nt, Human
caccuuuauucuggcagaggagg

SEQ ID NO: 1730167 - RNA, 13 nt, Human
caccugcccaacc

SEQ ID NO: 1730168 - RNA, 19 nt, Human
caccugcccaaccugcucu

SEQ ID NO: 1730169 - RNA, 18 nt, Human
caccugcccaaccugcuc

SEQ ID NO: 1730170 - RNA, 12 nt, Human
caccucagccuc

SEQ ID NO: 1730171 - RNA, 12 nt, Human
caccuacugagu

SEQ ID NO: 1730172 - RNA, 23 nt, Human
caaaugcuguaacuuucugaaau

SEQ ID NO: 1730173 - RNA, 22 nt, Human
caaaugagaaaaugucuuuauu

SEQ ID NO: 1730174 - RNA, 19 nt, Human
caaaguaucccuacuguaa

SEQ ID NO: 1730175 - RNA, 21 nt, Human
caaaguaucccuacuguaauu

SEQ ID NO: 1730176 - RNA, 22 nt, Human
caaaguagaagucuuagaugua

SEQ ID NO: 1730177 - RNA, 22 nt, Human
caaagguaaaucagacuaugaa

SEQ ID NO: 1730178 - RNA, 14 nt, Human
caaagguaaaucag

SEQ ID NO: 1730179 - RNA, 22 nt, Human
caaagcagugcaugcugucccu

SEQ ID NO: 1730180 - RNA, 18 nt, Human
caaagauauuuugcuuug

SEQ ID NO: 1730181 - RNA, 21 nt, Human
caaagcagugcaugcuguccc

SEQ ID NO: 1730182 - RNA, 18 nt, Human
caaagcagugcaugcugu

SEQ ID NO: 1730183 - RNA, 14 nt, Human
caaagauauuuugc

SEQ ID NO: 1730184 - RNA, 16 nt, Human
caaagauauuuugcuu

SEQ ID NO: 1730185 - RNA, 22 nt, Human
caacacacagauuugagcucag

SEQ ID NO: 1730186 - RNA, 21 nt, Human
caacacacagauuugagcuca

SEQ ID NO: 1730187 - RNA, 18 nt, Human
caacucaccccagcccca

SEQ ID NO: 1730188 - RNA, 18 nt, Human
caacuaauuuuuguauuu

SEQ ID NO: 1730189 - RNA, 19 nt, Human
caacuacuaccuguaauga

SEQ ID NO: 1730190 - RNA, 19 nt, Human
caagacccaaaaggcagaa

SEQ ID NO: 1730191 - RNA, 17 nt, Human
caagaccacguuucuaa

SEQ ID NO: 1730192 - RNA, 18 nt, Human
caagaccacguuucuaaa

SEQ ID NO: 1730193 - RNA, 14 nt, Human
caacucuccuccag

SEQ ID NO: 1730194 - RNA, 22 nt, Human
caagaauugaagcaggacuaaa

SEQ ID NO: 1730195 - RNA, 21 nt, Human
caaaaggauaaugaauacuuu

SEQ ID NO: 1730196 - RNA, 14 nt, Human
caaacccuucagug

SEQ ID NO: 1730197 - RNA, 21 nt, Human
caaaccccgaccaccugccca

SEQ ID NO: 1730198 - RNA, 18 nt, Human
caaaccccgaccaccugc

SEQ ID NO: 1730199 - RNA, 18 nt, Human
auuuuuuuuuccuucagu

SEQ ID NO: 1730200 - RNA, 16 nt, Human
auuuuuuugagacaga

SEQ ID NO: 1730201 - RNA, 23 nt, Human
auuuuuuuuuccuucagugccuu

SEQ ID NO: 1730202 - RNA, 22 nt, Human
auuuuuuuuuccuucagugccu

SEQ ID NO: 1730203 - RNA, 20 nt, Human
auuuuuuuuuccuucagugc

SEQ ID NO: 1730204 - RNA, 21 nt, Human
auuuuauaucaauuuaaaaaa

SEQ ID NO: 1730205 - RNA, 16 nt, Human
auuuuuaagugcugca

SEQ ID NO: 1730206 - RNA, 18 nt, Human
auuuuuaagugcugcauu

SEQ ID NO: 1730207 - RNA, 19 nt, Human
auuuuuaagugcugcauuu

SEQ ID NO: 1730208 - RNA, 14 nt, Human
auuuuuagacagag

SEQ ID NO: 1730209 - RNA, 18 nt, Human
auucaacagguuuuccug

SEQ ID NO: 1730210 - RNA, 20 nt, Human
auuaguacuccccuccuuga

SEQ ID NO: 1730211 - RNA, 19 nt, Human
auuaaaugcccagccccuu

SEQ ID NO: 1730212 - RNA, 17 nt, Human
auuaaaugcccagcccc

SEQ ID NO: 1730213 - RNA, 11 nt, Human
auuaaauuaug

SEQ ID NO: 1730214 - RNA, 16 nt, Human
auuaggauuucaugau

SEQ ID NO: 1730215 - RNA, 14 nt, Human
auuaggauuucaug

SEQ ID NO: 1730216 - RNA, 15 nt, Human
auucuugcaaaguau

SEQ ID NO: 1730217 - RNA, 16 nt, Human
auucuugcaaaguauc

SEQ ID NO: 1730218 - RNA, 14 nt, Human
auucuugcaaagua

SEQ ID NO: 1730219 - RNA, 22 nt, Human
auucuucuguacgucugacagg

SEQ ID NO: 1730220 - RNA, 20 nt, Human
auucuucugcuucagccucc

SEQ ID NO: 1730221 - RNA, 19 nt, Human
auucuucugcuucagccuc

SEQ ID NO: 1730222 - RNA, 19 nt, Human
auucucuaguuugauuaaa

SEQ ID NO: 1730223 - RNA, 18 nt, Human
auucuccuuguguuacua

SEQ ID NO: 1730224 - RNA, 19 nt, Human
auucuccuuguguuacuaa

SEQ ID NO: 1730225 - RNA, 21 nt, Human
auucuccuuguguuacuaagu

SEQ ID NO: 1730226 - RNA, 22 nt, Human
auucuccuuguguuacuaaguu

SEQ ID NO: 1730227 - RNA, 17 nt, Human
auucucuaguuugauua

SEQ ID NO: 1730228 - RNA, 18 nt, Human
auucucuaguuugauuaa

SEQ ID NO: 1730229 - RNA, 15 nt, Human
auuccugcauuugug

SEQ ID NO: 1730230 - RNA, 18 nt, Human
auuccugcauuugugaaa

SEQ ID NO: 1730231 - RNA, 14 nt, Human
auugcuugcacaaa

SEQ ID NO: 1730232 - RNA, 16 nt, Human
auugcuuguuggauuu

SEQ ID NO: 1730233 - RNA, 21 nt, Human
auuuaaugaaagacuguacaa

SEQ ID NO: 1730234 - RNA, 20 nt, Human
auuuaaugaaagacuguaca

SEQ ID NO: 1730235 - RNA, 16 nt, Human
auuuaaugaaagacug

SEQ ID NO: 1730236 - RNA, 22 nt, Human
auuuaugcauauuauuuuaugu

SEQ ID NO: 1730237 - RNA, 16 nt, Human
auuuaugcauauuauu

SEQ ID NO: 1730238 - RNA, 15 nt, Human
cagugccaaaaacaa

SEQ ID NO: 1730239 - RNA, 12 nt, Human
cagugcccacag

SEQ ID NO: 1730240 - RNA, 19 nt, Human
cagugggacagggcauggc

SEQ ID NO: 1730241 - RNA, 11 nt, Human
cagugggagcu

SEQ ID NO: 1730242 - RNA, 23 nt, Human
cagugcaugcugucccuuacgug

SEQ ID NO: 1730243 - RNA, 22 nt, Human
cagugcaugcugucccuuacgu

SEQ ID NO: 1730244 - RNA, 19 nt, Human
cagugcaugcugucccuua

SEQ ID NO: 1730245 - RNA, 20 nt, Human
cagucugauucccaagcucu

SEQ ID NO: 1730246 - RNA, 19 nt, Human
cagucugauucccaagcuc

SEQ ID NO: 1730247 - RNA, 14 nt, Human
cagucucccucccu

SEQ ID NO: 1730248 - RNA, 22 nt, Human
cagucaccccggccaccugcgg

SEQ ID NO: 1730249 - RNA, 19 nt, Human
cagucaccccggccaccug

SEQ ID NO: 1730250 - RNA, 20 nt, Human
cagucaccccggccaccugc

SEQ ID NO: 1730251 - RNA, 16 nt, Human
cagguuuaagcuguua

SEQ ID NO: 1730252 - RNA, 21 nt, Human
cagguuggugggggccucggu

SEQ ID NO: 1730253 - RNA, 18 nt, Human
cagguuuaagcuguuacu

SEQ ID NO: 1730254 - RNA, 18 nt, Human
cagggucucacucugucg

SEQ ID NO: 1730255 - RNA, 21 nt, Human
cagggucucacucugucgccc

SEQ ID NO: 1730256 - RNA, 22 nt, Human
cagggucucacucugucgccca

SEQ ID NO: 1730257 - RNA, 17 nt, Human
caggugauccacccacc

SEQ ID NO: 1730258 - RNA, 16 nt, Human
caggugauccacccac

SEQ ID NO: 1730259 - RNA, 12 nt, Human
caggguuggccc

SEQ ID NO: 1730260 - RNA, 14 nt, Human
caggguuggccccu

SEQ ID NO: 1730261 - RNA, 20 nt, Human
caggugauccacccaccuca

SEQ ID NO: 1730262 - RNA, 14 nt, Human
cagguugguggggg

SEQ ID NO: 1730263 - RNA, 20 nt, Human
caggugcuaggaacacuccu

SEQ ID NO: 1730264 - RNA, 18 nt, Human
caggugcuaggaacacuc

SEQ ID NO: 1730265 - RNA, 14 nt, Human
caggugcgaaagga

SEQ ID NO: 1730266 - RNA, 19 nt, Human
cagggaggacgcucucugg

SEQ ID NO: 1730267 - RNA, 13 nt, Human
cagggagggccug

SEQ ID NO: 1730268 - RNA, 12 nt, Human
cagggagggccu

SEQ ID NO: 1730269 - RNA, 17 nt, Human
cagggaggacgcucucu

SEQ ID NO: 1730270 - RNA, 18 nt, Human
cagggaggacgcucucug

SEQ ID NO: 1730271 - RNA, 19 nt, Human
caggcugggcuucaguggc

SEQ ID NO: 1730272 - RNA, 17 nt, Human
caggcugggcuucagug

SEQ ID NO: 1730273 - RNA, 16 nt, Human
caggcugggcuucagu

SEQ ID NO: 1730274 - RNA, 15 nt, Human
caggcuggcgugcag

SEQ ID NO: 1730275 - RNA, 20 nt, Human
caggcuggcccugcccuggu

SEQ ID NO: 1730276 - RNA, 17 nt, Human
caggcgccccuuccccc

SEQ ID NO: 1730277 - RNA, 19 nt, Human
caggcuggcccugcccugg

SEQ ID NO: 1730278 - RNA, 18 nt, Human
caggcuggcccugcccug

SEQ ID NO: 1730279 - RNA, 17 nt, Human
caggcuggcccugcccu

SEQ ID NO: 1730280 - RNA, 15 nt, Human
caggcgccccuuccc

SEQ ID NO: 1730281 - RNA, 20 nt, Human
caggccugccuguucccauu

SEQ ID NO: 1730282 - RNA, 18 nt, Human
cagggaggugaccccagg

SEQ ID NO: 1730283 - RNA, 16 nt, Human
cagggagggccugggc

SEQ ID NO: 1730284 - RNA, 14 nt, Human
cagggagggccugg

SEQ ID NO: 1730285 - RNA, 22 nt, Human
cagggaguccgaaagggacuug

SEQ ID NO: 1730286 - RNA, 15 nt, Human
caggagggaggggga

SEQ ID NO: 1730287 - RNA, 17 nt, Human
caggaggccagccuuga

SEQ ID NO: 1730288 - RNA, 23 nt, Human
caggagggagggggaaggcaggg

SEQ ID NO: 1730289 - RNA, 23 nt, Human
caggcacccaccaucaugucugg

SEQ ID NO: 1730290 - RNA, 22 nt, Human
caggcacccaccaucaugucug

SEQ ID NO: 1730291 - RNA, 18 nt, Human
caggcacccaccaucaug

SEQ ID NO: 1730292 - RNA, 16 nt, Human
caggaggccagccuug

SEQ ID NO: 1730293 - RNA, 15 nt, Human
caggaggccagccuu

SEQ ID NO: 1730294 - RNA, 14 nt, Human
caggaggccagccu

SEQ ID NO: 1730295 - RNA, 21 nt, Human
caggccagagggagugacaga

SEQ ID NO: 1730296 - RNA, 19 nt, Human
caggccagagggagugaca

SEQ ID NO: 1730297 - RNA, 23 nt, Human
caggccagagggagugacagagg

SEQ ID NO: 1730298 - RNA, 21 nt, Human
cagccgagauagccaaggcca

SEQ ID NO: 1730299 - RNA, 21 nt, Human
cagccccuggaugcagccuca

SEQ ID NO: 1730300 - RNA, 19 nt, Human
cagccccuggaugcagccu

SEQ ID NO: 1730301 - RNA, 18 nt, Human
cagccccuggaugcagcc

SEQ ID NO: 1730302 - RNA, 17 nt, Human
cagccccuggaugcagc

SEQ ID NO: 1730303 - RNA, 21 nt, Human
cagcccuuagcagggaaacag

SEQ ID NO: 1730304 - RNA, 16 nt, Human
cagcccuuagcaggga

SEQ ID NO: 1730305 - RNA, 22 nt, Human
cagccccuggaugcagccucac

SEQ ID NO: 1730306 - RNA, 14 nt, Human
cagccccuggaugc

SEQ ID NO: 1730307 - RNA, 13 nt, Human
cagccccuggaug

SEQ ID NO: 1730308 - RNA, 12 nt, Human
cagccccuggau

SEQ ID NO: 1730309 - RNA, 18 nt, Human
cagccugagcgacaguga

SEQ ID NO: 1730310 - RNA, 19 nt, Human
cagccugagcgacagugag

SEQ ID NO: 1730311 - RNA, 22 nt, Human
cagccugagcgacagugagacu

SEQ ID NO: 1730312 - RNA, 17 nt, Human
cagcggggacagcuccu

SEQ ID NO: 1730313 - RNA, 16 nt, Human
cagcggggacagcucc

SEQ ID NO: 1730314 - RNA, 15 nt, Human
cagcggggacagcuc

SEQ ID NO: 1730315 - RNA, 15 nt, Human
caggaaaggcuccag

SEQ ID NO: 1730316 - RNA, 14 nt, Human
caggaaaggcucca

SEQ ID NO: 1730317 - RNA, 19 nt, Human
cagcuucauuuccuguguc

SEQ ID NO: 1730318 - RNA, 18 nt, Human
cagcuucauuuccugugu

SEQ ID NO: 1730319 - RNA, 15 nt, Human
cagcuucauuuccug

SEQ ID NO: 1730320 - RNA, 18 nt, Human
cagcugugcucuggacag

SEQ ID NO: 1730321 - RNA, 19 nt, Human
cagcugugcucuggacagg

SEQ ID NO: 1730322 - RNA, 20 nt, Human
cagcuccagcucaccagccc

SEQ ID NO: 1730323 - RNA, 18 nt, Human
cagcuccagcucaccagc

SEQ ID NO: 1730324 - RNA, 17 nt, Human
cagcuccagcucaccag

SEQ ID NO: 1730325 - RNA, 16 nt, Human
cagcuccagcucacca

SEQ ID NO: 1730326 - RNA, 22 nt, Human
cagcuccagcucaccagcccca

SEQ ID NO: 1730327 - RNA, 21 nt, Human
cagcucccaaggcucugagca

SEQ ID NO: 1730328 - RNA, 15 nt, Human
cagcuccagcucacc

SEQ ID NO: 1730329 - RNA, 14 nt, Human
cagcuccagcucac

SEQ ID NO: 1730330 - RNA, 13 nt, Human
cagcuccagcuca

SEQ ID NO: 1730331 - RNA, 20 nt, Human
cagcaccuacaguguacagu

SEQ ID NO: 1730332 - RNA, 15 nt, Human
cagcaccuacagugu

SEQ ID NO: 1730333 - RNA, 23 nt, Human
cagcauauucaggaagcucaggg

SEQ ID NO: 1730334 - RNA, 22 nt, Human
cagcauauucaggaagcucagg

SEQ ID NO: 1730335 - RNA, 19 nt, Human
cagcauauucaggaagcuc

SEQ ID NO: 1730336 - RNA, 13 nt, Human
cagccaggccaca

SEQ ID NO: 1730337 - RNA, 12 nt, Human
cagccaggccac

SEQ ID NO: 1730338 - RNA, 22 nt, Human
cagccaggccacaagacccuug

SEQ ID NO: 1730339 - RNA, 18 nt, Human
cagagcugccaccugccu

SEQ ID NO: 1730340 - RNA, 16 nt, Human
cagagcugccaccugc

SEQ ID NO: 1730341 - RNA, 23 nt, Human
cagaaguuugagaucagccuggg

SEQ ID NO: 1730342 - RNA, 22 nt, Human
cagaaguuugagaucagccugg

SEQ ID NO: 1730343 - RNA, 20 nt, Human
cagaaguuugagaucagccu

SEQ ID NO: 1730344 - RNA, 19 nt, Human
cagaaguuucugccgcagc

SEQ ID NO: 1730345 - RNA, 22 nt, Human
cagagggccugcaagggaguga

SEQ ID NO: 1730346 - RNA, 20 nt, Human
cagaggggguggccucccaa

SEQ ID NO: 1730347 - RNA, 19 nt, Human
cagaggggguggccuccca

SEQ ID NO: 1730348 - RNA, 18 nt, Human
cagaggggguggccuccc

SEQ ID NO: 1730349 - RNA, 20 nt, Human
cagagucagaaguuucugcc

SEQ ID NO: 1730350 - RNA, 22 nt, Human
cauucgcuacuaugauuuaauu

SEQ ID NO: 1730351 - RNA, 12 nt, Human
cauuccuguucc

SEQ ID NO: 1730352 - RNA, 18 nt, Human
cauucuagguuugcaaga

SEQ ID NO: 1730353 - RNA, 13 nt, Human
cauucucacuccu

SEQ ID NO: 1730354 - RNA, 14 nt, Human
cauucucacuccua

SEQ ID NO: 1730355 - RNA, 23 nt, Human
cauuaucuagauacuguaucaug

SEQ ID NO: 1730356 - RNA, 22 nt, Human
cauuaggugugacugaauuucu

SEQ ID NO: 1730357 - RNA, 13 nt, Human
cauguuggccagg

SEQ ID NO: 1730358 - RNA, 12 nt, Human
cauguuggccag

SEQ ID NO: 1730359 - RNA, 20 nt, Human
cauguccaagaagcccagga

SEQ ID NO: 1730360 - RNA, 19 nt, Human
cauguccaagaagcccagg

SEQ ID NO: 1730361 - RNA, 18 nt, Human
cauguccaagaagcccag

SEQ ID NO: 1730362 - RNA, 16 nt, Human
caugcacgugugugca

SEQ ID NO: 1730363 - RNA, 13 nt, Human
caugcugcccugu

SEQ ID NO: 1730364 - RNA, 12 nt, Human
caugcugcccug

SEQ ID NO: 1730365 - RNA, 13 nt, Human
caugcuccuggcc

SEQ ID NO: 1730366 - RNA, 23 nt, Human
caugauuaaccacuucagcugac

SEQ ID NO: 1730367 - RNA, 22 nt, Human
caugauuaaccacuucagcuga

SEQ ID NO: 1730368 - RNA, 24 nt, Human
caugauuaaccacuucagcugacu

SEQ ID NO: 1730369 - RNA, 12 nt, Human
caugcacaaauu

SEQ ID NO: 1730370 - RNA, 15 nt, Human
caugaaguaauaugc

SEQ ID NO: 1730371 - RNA, 19 nt, Human
caugaaguaauaugcacac

SEQ ID NO: 1730372 - RNA, 22 nt, Human
caugaaguaauaugcacacauu

SEQ ID NO: 1730373 - RNA, 23 nt, Human
caugaaguaauaugcacacauuu

SEQ ID NO: 1730374 - RNA, 23 nt, Human
caugacacgaauauugcugaugg

SEQ ID NO: 1730375 - RNA, 21 nt, Human
caugacacgaauauugcugau

SEQ ID NO: 1730376 - RNA, 15 nt, Human
caugcugcccuguga

SEQ ID NO: 1730377 - RNA, 14 nt, Human
caugcugcccugug

SEQ ID NO: 1730378 - RNA, 13 nt, Human
cauggccaggugg

SEQ ID NO: 1730379 - RNA, 14 nt, Human
cauggccagguggc

SEQ ID NO: 1730380 - RNA, 15 nt, Human
cagugggagcugccu

SEQ ID NO: 1730381 - RNA, 22 nt, Human
cauagcagagaaugaaagggcc

SEQ ID NO: 1730382 - RNA, 19 nt, Human
cauagcagagaaugaaagg

SEQ ID NO: 1730383 - RNA, 22 nt, Human
cauagcaccuaacaacauugua

SEQ ID NO: 1730384 - RNA, 22 nt, Human
cauagcuuacaagccagcugga

SEQ ID NO: 1730385 - RNA, 15 nt, Human
cauauucaggaagcu

SEQ ID NO: 1730386 - RNA, 14 nt, Human
cauauucaggaagc

SEQ ID NO: 1730387 - RNA, 20 nt, Human
cauauucaggaagcucaggg

SEQ ID NO: 1730388 - RNA, 22 nt, Human
cauauucaggaagcucagggcc

SEQ ID NO: 1730389 - RNA, 20 nt, Human
cauaugccugggcagaagga

SEQ ID NO: 1730390 - RNA, 15 nt, Human
cauaugccugggcag

SEQ ID NO: 1730391 - RNA, 22 nt, Human
cauaugccugggcagaaggaag

SEQ ID NO: 1730392 - RNA, 15 nt, Human
caucaggccaggccc

SEQ ID NO: 1730393 - RNA, 19 nt, Human
caucaggccaggcccucug

SEQ ID NO: 1730394 - RNA, 16 nt, Human
caucaggccaggcccu

SEQ ID NO: 1730395 - RNA, 20 nt, Human
caucaggccaggcccucugc

SEQ ID NO: 1730396 - RNA, 19 nt, Human
caucccauaugccugggca

SEQ ID NO: 1730397 - RNA, 14 nt, Human
cauccccuguagag

SEQ ID NO: 1730398 - RNA, 21 nt, Human
cauccccuguagagugggagc

SEQ ID NO: 1730399 - RNA, 15 nt, Human
cauuuggauuggaug

SEQ ID NO: 1730400 - RNA, 17 nt, Human
cauuugucacacacuuu

SEQ ID NO: 1730401 - RNA, 16 nt, Human
cauuugugaaaugaug

SEQ ID NO: 1730402 - RNA, 14 nt, Human
cauuugugaaauga

SEQ ID NO: 1730403 - RNA, 15 nt, Human
cauuuauucugcuca

SEQ ID NO: 1730404 - RNA, 14 nt, Human
cauuuauucugcuc

SEQ ID NO: 1730405 - RNA, 15 nt, Human
cauuguaaaagcauu

SEQ ID NO: 1730406 - RNA, 20 nt, Human
cauuguaaaagcauuuugua

SEQ ID NO: 1730407 - RNA, 21 nt, Human
cauuguaaaagcauuuuguaa

SEQ ID NO: 1730408 - RNA, 22 nt, Human
cauuguaaaagcauuuuguaau

SEQ ID NO: 1730409 - RNA, 23 nt, Human
cauuguaaaagcauuuuguaaua

SEQ ID NO: 1730410 - RNA, 19 nt, Human
cauuuuuuaaaugcaccug

SEQ ID NO: 1730411 - RNA, 15 nt, Human
cauuuuuuaaaugca

SEQ ID NO: 1730412 - RNA, 16 nt, Human
cauuuuuuaaaugcac

SEQ ID NO: 1730413 - RNA, 16 nt, Human
ccaaggccaaaggaag

SEQ ID NO: 1730414 - RNA, 18 nt, Human
ccaaaugcagcuuuaaaa

SEQ ID NO: 1730415 - RNA, 15 nt, Human
ccaaaugcagcuuua

SEQ ID NO: 1730416 - RNA, 13 nt, Human
ccaaaugcagcuu

SEQ ID NO: 1730417 - RNA, 13 nt, Human
ccaagaagcccag

SEQ ID NO: 1730418 - RNA, 16 nt, Human
ccaacgucugugccau

SEQ ID NO: 1730419 - RNA, 15 nt, Human
ccaacgucugugcca

SEQ ID NO: 1730420 - RNA, 13 nt, Human
ccaacgucugugc

SEQ ID NO: 1730421 - RNA, 22 nt, Human
ccaaauggaaaugggcagagca

SEQ ID NO: 1730422 - RNA, 19 nt, Human
ccaagcuggucccacucag

SEQ ID NO: 1730423 - RNA, 12 nt, Human
ccaagcuggucc

SEQ ID NO: 1730424 - RNA, 14 nt, Human
ccaagaagcccagg

SEQ ID NO: 1730425 - RNA, 20 nt, Human
ccaagcuggucccacucagu

SEQ ID NO: 1730426 - RNA, 18 nt, Human
ccaaggaugccccguccc

SEQ ID NO: 1730427 - RNA, 15 nt, Human
ccaaggccaaaggaa

SEQ ID NO: 1730428 - RNA, 21 nt, Human
ccacacuucaggcucuucucc

SEQ ID NO: 1730429 - RNA, 20 nt, Human
ccacacuucaggcucuucuc

SEQ ID NO: 1730430 - RNA, 16 nt, Human
ccacacuucaggcucu

SEQ ID NO: 1730431 - RNA, 15 nt, Human
ccaccacgcccggcu

SEQ ID NO: 1730432 - RNA, 22 nt, Human
ccacagagaaaguacuucucca

SEQ ID NO: 1730433 - RNA, 13 nt, Human
ccacagaggacac

SEQ ID NO: 1730434 - RNA, 13 nt, Human
ccacgcccccacu

SEQ ID NO: 1730435 - RNA, 19 nt, Human
ccaccuuggcugcagggag

SEQ ID NO: 1730436 - RNA, 18 nt, Human
ccaccuuggcugcaggga

SEQ ID NO: 1730437 - RNA, 18 nt, Human
ccacgcuggaccuugaac

SEQ ID NO: 1730438 - RNA, 13 nt, Human
ccacgcuggagug

SEQ ID NO: 1730439 - RNA, 16 nt, Human
ccaccuuggcugcagg

SEQ ID NO: 1730440 - RNA, 15 nt, Human
ccaccuuggcugcag

SEQ ID NO: 1730441 - RNA, 14 nt, Human
ccaccuuggcugca

SEQ ID NO: 1730442 - RNA, 12 nt, Human
ccaccuuggcug

SEQ ID NO: 1730443 - RNA, 22 nt, Human
ccaccgggcugggagcucugca

SEQ ID NO: 1730444 - RNA, 19 nt, Human
ccaccaucaugucuggcua

SEQ ID NO: 1730445 - RNA, 18 nt, Human
ccaccaucaugucuggcu

SEQ ID NO: 1730446 - RNA, 19 nt, Human
ccaccgggcugggagcucu

SEQ ID NO: 1730447 - RNA, 13 nt, Human
cuguagaguggga

SEQ ID NO: 1730448 - RNA, 19 nt, Human
cuguagaaaagggaacuga

SEQ ID NO: 1730449 - RNA, 22 nt, Human
cuggugacaugucuuuucuugc

SEQ ID NO: 1730450 - RNA, 16 nt, Human
cugguuuccugcccug

SEQ ID NO: 1730451 - RNA, 14 nt, Human
cugguuuccugccc

SEQ ID NO: 1730452 - RNA, 13 nt, Human
cugguuuccugcc

SEQ ID NO: 1730453 - RNA, 16 nt, Human
cugucgcccagucugg

SEQ ID NO: 1730454 - RNA, 15 nt, Human
cugucgcccagucug

SEQ ID NO: 1730455 - RNA, 23 nt, Human
cugucaauuacaggaaguacugg

SEQ ID NO: 1730456 - RNA, 20 nt, Human
cugucaauuacaggaaguac

SEQ ID NO: 1730457 - RNA, 19 nt, Human
cugucaauuacaggaagua

SEQ ID NO: 1730458 - RNA, 19 nt, Human
cugugcugcccugcccacc

SEQ ID NO: 1730459 - RNA, 18 nt, Human
cugugcugcccugcccac

SEQ ID NO: 1730460 - RNA, 17 nt, Human
cugugcugcccugccca

SEQ ID NO: 1730461 - RNA, 15 nt, Human
cugugcugcccugcc

SEQ ID NO: 1730462 - RNA, 19 nt, Human
cugugucagcauagaagua

SEQ ID NO: 1730463 - RNA, 17 nt, Human
cugugucagcauagaag

SEQ ID NO: 1730464 - RNA, 21 nt, Human
cugugcugcccugcccaccug

SEQ ID NO: 1730465 - RNA, 14 nt, Human
cugugcugcccugc

SEQ ID NO: 1730466 - RNA, 13 nt, Human
cugugcugcccug

SEQ ID NO: 1730467 - RNA, 12 nt, Human
cugugcugcccu

SEQ ID NO: 1730468 - RNA, 22 nt, Human
cuuagcucauucuccuuguguu

SEQ ID NO: 1730469 - RNA, 16 nt, Human
cuuaccagcagagcac

SEQ ID NO: 1730470 - RNA, 23 nt, Human
cuuagcucauucuccuuguguua

SEQ ID NO: 1730471 - RNA, 13 nt, Human
cuuagcugggaga

SEQ ID NO: 1730472 - RNA, 21 nt, Human
cuuagggaaggauacaaaagc

SEQ ID NO: 1730473 - RNA, 19 nt, Human
cuuagggaaggauacaaaa

SEQ ID NO: 1730474 - RNA, 15 nt, Human
cuuaggaagaauuuu

SEQ ID NO: 1730475 - RNA, 14 nt, Human
cuuaaaacaacacu

SEQ ID NO: 1730476 - RNA, 13 nt, Human
cuuaaauaaugug

SEQ ID NO: 1730477 - RNA, 15 nt, Human
cuuaccagcagagca

SEQ ID NO: 1730478 - RNA, 20 nt, Human
cuuacauuuuacuuuuuccu

SEQ ID NO: 1730479 - RNA, 22 nt, Human
cuuacauuagcaguuugcuuug

SEQ ID NO: 1730480 - RNA, 21 nt, Human
cuuacauuagcaguuugcuuu

SEQ ID NO: 1730481 - RNA, 16 nt, Human
cuuacaagccagcugg

SEQ ID NO: 1730482 - RNA, 17 nt, Human
cuuacaagccagcugga

SEQ ID NO: 1730483 - RNA, 21 nt, Human
cuuaaaaaugguuuaaauggu

SEQ ID NO: 1730484 - RNA, 14 nt, Human
cuguuuaagagaca

SEQ ID NO: 1730485 - RNA, 12 nt, Human
cuguuuaagaga

SEQ ID NO: 1730486 - RNA, 22 nt, Human
cuguuggcugggggccucagug

SEQ ID NO: 1730487 - RNA, 19 nt, Human
cuguuggcugggggccuca

SEQ ID NO: 1730488 - RNA, 14 nt, Human
cuguuggcuggggg

SEQ ID NO: 1730489 - RNA, 11 nt, Human
cugggacacag

SEQ ID NO: 1730490 - RNA, 22 nt, Human
cuggccccucagggucccuggu

SEQ ID NO: 1730491 - RNA, 14 nt, Human
cuggcccugcccug

SEQ ID NO: 1730492 - RNA, 13 nt, Human
cuggcccugcccu

SEQ ID NO: 1730493 - RNA, 11 nt, Human
cuggcccugcc

SEQ ID NO: 1730494 - RNA, 14 nt, Human
cuggccuagcauac

SEQ ID NO: 1730495 - RNA, 16 nt, Human
cuggccgggagccuga

SEQ ID NO: 1730496 - RNA, 15 nt, Human
cuggcccugcccugg

SEQ ID NO: 1730497 - RNA, 18 nt, Human
cuggcagaguugaagaca

SEQ ID NO: 1730498 - RNA, 17 nt, Human
cuggcagaguugaagac

SEQ ID NO: 1730499 - RNA, 13 nt, Human
cuggcagccccug

SEQ ID NO: 1730500 - RNA, 20 nt, Human
cuggcagccgugccuucagc

SEQ ID NO: 1730501 - RNA, 19 nt, Human
cuggcagccgugccuucag

SEQ ID NO: 1730502 - RNA, 22 nt, Human
cuggcagccgugccuucagcuc

SEQ ID NO: 1730503 - RNA, 21 nt, Human
cuggcagccgugccuucagcu

SEQ ID NO: 1730504 - RNA, 12 nt, Human
cuggcagccccu

SEQ ID NO: 1730505 - RNA, 11 nt, Human
cuggcagccca

SEQ ID NO: 1730506 - RNA, 19 nt, Human
cuggcagaguugaagacag

SEQ ID NO: 1730507 - RNA, 14 nt, Human
cuggcagaggaggg

SEQ ID NO: 1730508 - RNA, 20 nt, Human
cugggcaccggggccucgga

SEQ ID NO: 1730509 - RNA, 16 nt, Human
cugggcagaaggaaga

SEQ ID NO: 1730510 - RNA, 15 nt, Human
cugggcagaaggaag

SEQ ID NO: 1730511 - RNA, 12 nt, Human
cugggcagaagg

SEQ ID NO: 1730512 - RNA, 14 nt, Human
cugggccagaauuu

SEQ ID NO: 1730513 - RNA, 12 nt, Human
cugggccagaau

SEQ ID NO: 1730514 - RNA, 20 nt, Human
cuggguucacugcaaccucc

SEQ ID NO: 1730515 - RNA, 18 nt, Human
cuggguucacugcaaccu

SEQ ID NO: 1730516 - RNA, 15 nt, Human
cuggguucacugcaa

SEQ ID NO: 1730517 - RNA, 15 nt, Human
cuggggccaggcugg

SEQ ID NO: 1730518 - RNA, 19 nt, Human
cugcuuuuuaaagaaugcu

SEQ ID NO: 1730519 - RNA, 21 nt, Human
cugcuuuugucuaugggacuc

SEQ ID NO: 1730520 - RNA, 14 nt, Human
cuggaagcacagcu

SEQ ID NO: 1730521 - RNA, 14 nt, Human
cuggagaaaaugga

SEQ ID NO: 1730522 - RNA, 14 nt, Human
cugcuucaaauauu

SEQ ID NO: 1730523 - RNA, 20 nt, Human
cugcuuuugucuaugggacu

SEQ ID NO: 1730524 - RNA, 23 nt, Human
cugcuucaaggauccugagccag

SEQ ID NO: 1730525 - RNA, 22 nt, Human
cugcuucaaggauccugagcca

SEQ ID NO: 1730526 - RNA, 21 nt, Human
cugcuucaaggauccugagcc

SEQ ID NO: 1730527 - RNA, 13 nt, Human
cugcuucaaggau

SEQ ID NO: 1730528 - RNA, 12 nt, Human
cugcuucaagga

SEQ ID NO: 1730529 - RNA, 19 nt, Human
cugcuucaaauauuucccu

SEQ ID NO: 1730530 - RNA, 20 nt, Human
cugaucugaugcaagcaaga

SEQ ID NO: 1730531 - RNA, 19 nt, Human
cugccuguucagcuccagc

SEQ ID NO: 1730532 - RNA, 20 nt, Human
cugccuguugggccaggagc

SEQ ID NO: 1730533 - RNA, 18 nt, Human
cugccuguucagcuccag

SEQ ID NO: 1730534 - RNA, 17 nt, Human
cugccuguucagcucca

SEQ ID NO: 1730535 - RNA, 22 nt, Human
cugccucucccaucacuucccu

SEQ ID NO: 1730536 - RNA, 15 nt, Human
cugccucucccauca

SEQ ID NO: 1730537 - RNA, 23 nt, Human
cugccucucccaucacuucccua

SEQ ID NO: 1730538 - RNA, 24 nt, Human
cugccuccucuucaacugaccagc

SEQ ID NO: 1730539 - RNA, 15 nt, Human
cugccuccucuucaa

SEQ ID NO: 1730540 - RNA, 14 nt, Human
cugccuccucuuca

SEQ ID NO: 1730541 - RNA, 13 nt, Human
cugccuccucuuc

SEQ ID NO: 1730542 - RNA, 21 nt, Human
cugcugacuguuuucucuuga

SEQ ID NO: 1730543 - RNA, 18 nt, Human
cugcugacuguuuucucu

SEQ ID NO: 1730544 - RNA, 22 nt, Human
cugccuguugggccaggagccu

SEQ ID NO: 1730545 - RNA, 21 nt, Human
cugccuguugggccaggagcc

SEQ ID NO: 1730546 - RNA, 23 nt, Human
cugccuguugggccaggagccuc

SEQ ID NO: 1730547 - RNA, 16 nt, Human
gaagacucauucuucu

SEQ ID NO: 1730548 - RNA, 18 nt, Human
gaagacucauucuucugu

SEQ ID NO: 1730549 - RNA, 17 nt, Human
gaagacucauucuucug

SEQ ID NO: 1730550 - RNA, 14 nt, Human
gaagcacagcuuca

SEQ ID NO: 1730551 - RNA, 13 nt, Human
gaagcacagcuuc

SEQ ID NO: 1730552 - RNA, 22 nt, Human
gaagcacaugccucucucaggc

SEQ ID NO: 1730553 - RNA, 14 nt, Human
gaagcacaugccuc

SEQ ID NO: 1730554 - RNA, 16 nt, Human
gaagcaccauaacuuu

SEQ ID NO: 1730555 - RNA, 12 nt, Human
gaagcagcucuu

SEQ ID NO: 1730556 - RNA, 15 nt, Human
gaagacagcucuuau

SEQ ID NO: 1730557 - RNA, 14 nt, Human
gaagacagcucuua

SEQ ID NO: 1730558 - RNA, 13 nt, Human
gaagacagcucuu

SEQ ID NO: 1730559 - RNA, 12 nt, Human
gaagacagcucu

SEQ ID NO: 1730560 - RNA, 15 nt, Human
gaagacagagcuaca

SEQ ID NO: 1730561 - RNA, 13 nt, Human
gaagacagagcua

SEQ ID NO: 1730562 - RNA, 16 nt, Human
gaagacacugaugggc

SEQ ID NO: 1730563 - RNA, 21 nt, Human
gaagacacugaugggcaaccc

SEQ ID NO: 1730564 - RNA, 17 nt, Human
gaacccgggaggcagag

SEQ ID NO: 1730565 - RNA, 19 nt, Human
gaacccgggaggcagaggu

SEQ ID NO: 1730566 - RNA, 13 nt, Human
gaacuccuggccu

SEQ ID NO: 1730567 - RNA, 14 nt, Human
gaacuccugaccuc

SEQ ID NO: 1730568 - RNA, 14 nt, Human
gaacuccuggccuc

SEQ ID NO: 1730569 - RNA, 15 nt, Human
gaacuccuggccuca

SEQ ID NO: 1730570 - RNA, 23 nt, Human
gaaccaccacacccagcccacuu

SEQ ID NO: 1730571 - RNA, 22 nt, Human
gaaccauggucggaaaacaugc

SEQ ID NO: 1730572 - RNA, 22 nt, Human
gaaccaccacacccagcccacu

SEQ ID NO: 1730573 - RNA, 21 nt, Human
gaaccaccacacccagcccac

SEQ ID NO: 1730574 - RNA, 20 nt, Human
gaaccaccacacccagccca

SEQ ID NO: 1730575 - RNA, 18 nt, Human
gaaccaccacacccagcc

SEQ ID NO: 1730576 - RNA, 20 nt, Human
gaacacauaauucaggaagc

SEQ ID NO: 1730577 - RNA, 17 nt, Human
gaacacauaauucagga

SEQ ID NO: 1730578 - RNA, 11 nt, Human
gaaaugaaaaa

SEQ ID NO: 1730579 - RNA, 17 nt, Human
gaaaugaaagcagggac

SEQ ID NO: 1730580 - RNA, 16 nt, Human
gaaagggcccagagag

SEQ ID NO: 1730581 - RNA, 15 nt, Human
gaaagggcccagaga

SEQ ID NO: 1730582 - RNA, 18 nt, Human
gaaagaaaaucaggcugg

SEQ ID NO: 1730583 - RNA, 13 nt, Human
gaaacuggauuaa

SEQ ID NO: 1730584 - RNA, 17 nt, Human
gaaacuggauuaaacuu

SEQ ID NO: 1730585 - RNA, 15 nt, Human
gaaaggcuccaggag

SEQ ID NO: 1730586 - RNA, 14 nt, Human
gaaaggcuccagga

SEQ ID NO: 1730587 - RNA, 13 nt, Human
gaaaggcuccagg

SEQ ID NO: 1730588 - RNA, 16 nt, Human
gaaaggcuccaggagc

SEQ ID NO: 1730589 - RNA, 20 nt, Human
gaaagaacgcugauuuaaag

SEQ ID NO: 1730590 - RNA, 13 nt, Human
gaaagggcccaga

SEQ ID NO: 1730591 - RNA, 21 nt, Human
gaaaacuuuaugcuaagugaa

SEQ ID NO: 1730592 - RNA, 23 nt, Human
gaaaagaaaaaugagccuggcaa

SEQ ID NO: 1730593 - RNA, 22 nt, Human
gaaaacuuguauuauguguguu

SEQ ID NO: 1730594 - RNA, 19 nt, Human
gaaaacuuguauuaugugu

SEQ ID NO: 1730595 - RNA, 15 nt, Human
gaaaaugugugugug

SEQ ID NO: 1730596 - RNA, 12 nt, Human
gaaaaugugugu

SEQ ID NO: 1730597 - RNA, 14 nt, Human
gaaaagaauagaag

SEQ ID NO: 1730598 - RNA, 16 nt, Human
cuugacaucaacugca

SEQ ID NO: 1730599 - RNA, 18 nt, Human
cuugaauuguaaggaaug

SEQ ID NO: 1730600 - RNA, 18 nt, Human
cuugauguguuaucucuu

SEQ ID NO: 1730601 - RNA, 17 nt, Human
cuugauauccucuuuga

SEQ ID NO: 1730602 - RNA, 22 nt, Human
cuugauauccucuuugagugaa

SEQ ID NO: 1730603 - RNA, 12 nt, Human
cuugauucauaa

SEQ ID NO: 1730604 - RNA, 12 nt, Human
cuugcaaaguau

SEQ ID NO: 1730605 - RNA, 24 nt, Human
cuuggauuguccccgacccuugcc

SEQ ID NO: 1730606 - RNA, 23 nt, Human
cuuggauuguccccgacccuugc

SEQ ID NO: 1730607 - RNA, 14 nt, Human
cuucuucagagacu

SEQ ID NO: 1730608 - RNA, 13 nt, Human
cuucuucagagac

SEQ ID NO: 1730609 - RNA, 18 nt, Human
cuucuucagagacuccug

SEQ ID NO: 1730610 - RNA, 13 nt, Human
cuucucacauuua

SEQ ID NO: 1730611 - RNA, 20 nt, Human
cuucucacauuuauauuuuu

SEQ ID NO: 1730612 - RNA, 13 nt, Human
cuuccuccuggug

SEQ ID NO: 1730613 - RNA, 22 nt, Human
cuuccucuuuccaucuacccuc

SEQ ID NO: 1730614 - RNA, 22 nt, Human
cuuccucugaggcugaaauuca

SEQ ID NO: 1730615 - RNA, 21 nt, Human
cuuccucuuuccaucuacccu

SEQ ID NO: 1730616 - RNA, 16 nt, Human
cuuccucugaggcuga

SEQ ID NO: 1730617 - RNA, 15 nt, Human
cuuccucugagccuu

SEQ ID NO: 1730618 - RNA, 14 nt, Human
cuuccucugagccu

SEQ ID NO: 1730619 - RNA, 15 nt, Human
cuuccucuccacugc

SEQ ID NO: 1730620 - RNA, 14 nt, Human
cuuccucuccacug

SEQ ID NO: 1730621 - RNA, 13 nt, Human
cuuccucuccacu

SEQ ID NO: 1730622 - RNA, 19 nt, Human
cuuggucugugagaugcua

SEQ ID NO: 1730623 - RNA, 16 nt, Human
cuuggucugugagaug

SEQ ID NO: 1730624 - RNA, 14 nt, Human
cuugguccugcugc

SEQ ID NO: 1730625 - RNA, 22 nt, Human
cuugguagaagcccuucuaccu

SEQ ID NO: 1730626 - RNA, 23 nt, Human
cuuggguucaagugauucuccug

SEQ ID NO: 1730627 - RNA, 19 nt, Human
cuugucuuuggacccugag

SEQ ID NO: 1730628 - RNA, 18 nt, Human
cuugucuuuggacccuga

SEQ ID NO: 1730629 - RNA, 15 nt, Human
cuugucuuuggaccc

SEQ ID NO: 1730630 - RNA, 13 nt, Human
cuugucuuuggac

SEQ ID NO: 1730631 - RNA, 20 nt, Human
cuuggugucgggcaugacac

SEQ ID NO: 1730632 - RNA, 19 nt, Human
cuuggugucgggcaugaca

SEQ ID NO: 1730633 - RNA, 20 nt, Human
cuuucacccuuuucuguuug

SEQ ID NO: 1730634 - RNA, 15 nt, Human
cuuucacccuuuucu

SEQ ID NO: 1730635 - RNA, 14 nt, Human
cuuucacccuuuuc

SEQ ID NO: 1730636 - RNA, 23 nt, Human
cuuuaaugucacaggcaggucca

SEQ ID NO: 1730637 - RNA, 20 nt, Human
cuuuuauaaacuuuaccuuu

SEQ ID NO: 1730638 - RNA, 21 nt, Human
cuuuuauaaacuuuaccuuuu

SEQ ID NO: 1730639 - RNA, 22 nt, Human
cuuuguauucucuccuguaccu

SEQ ID NO: 1730640 - RNA, 17 nt, Human
cuuuguauucucuccug

SEQ ID NO: 1730641 - RNA, 12 nt, Human
cuuuguaugcac

SEQ ID NO: 1730642 - RNA, 16 nt, Human
cuuuguaaugaaaacc

SEQ ID NO: 1730643 - RNA, 15 nt, Human
cuuuguaaugaaaac

SEQ ID NO: 1730644 - RNA, 14 nt, Human
cuuuguaaugaaaa

SEQ ID NO: 1730645 - RNA, 16 nt, Human
cuuucuacccagcgag

SEQ ID NO: 1730646 - RNA, 15 nt, Human
cuuucuacccagcga

SEQ ID NO: 1730647 - RNA, 17 nt, Human
cuuucuacccagcgagc

SEQ ID NO: 1730648 - RNA, 17 nt, Human
cuuugacgccaucccag

SEQ ID NO: 1730649 - RNA, 16 nt, Human
cuuugacgccauccca

SEQ ID NO: 1730650 - RNA, 18 nt, Human
cuuugacgccaucccagc

SEQ ID NO: 1730651 - RNA, 16 nt, Human
gcacuuuguucuggcu

SEQ ID NO: 1730652 - RNA, 15 nt, Human
gcagcuuauucacaa

SEQ ID NO: 1730653 - RNA, 16 nt, Human
gcagcuugaggguugg

SEQ ID NO: 1730654 - RNA, 20 nt, Human
gcagcugcuuuugucuaugg

SEQ ID NO: 1730655 - RNA, 13 nt, Human
gcagcugcuuuug

SEQ ID NO: 1730656 - RNA, 23 nt, Human
gcagcugcgguccacccaggagc

SEQ ID NO: 1730657 - RNA, 22 nt, Human
gcagcugcgguccacccaggag

SEQ ID NO: 1730658 - RNA, 16 nt, Human
gcaggcucucaggcca

SEQ ID NO: 1730659 - RNA, 15 nt, Human
gcaggcucucaggcc

SEQ ID NO: 1730660 - RNA, 14 nt, Human
gcaggcucucaggc

SEQ ID NO: 1730661 - RNA, 13 nt, Human
gcaggcucucagg

SEQ ID NO: 1730662 - RNA, 12 nt, Human
gcaggcucucag

SEQ ID NO: 1730663 - RNA, 22 nt, Human
gcaggcucgggcuccccagccc

SEQ ID NO: 1730664 - RNA, 21 nt, Human
gcagcuugaggguugggcugg

SEQ ID NO: 1730665 - RNA, 19 nt, Human
gcagcuugaggguugggcu

SEQ ID NO: 1730666 - RNA, 22 nt, Human
gcagggaaacagcuaaugggac

SEQ ID NO: 1730667 - RNA, 13 nt, Human
gcaggcuggcccu

SEQ ID NO: 1730668 - RNA, 17 nt, Human
gcaggcucucaggccag

SEQ ID NO: 1730669 - RNA, 18 nt, Human
gcaggcucucaggccagc

SEQ ID NO: 1730670 - RNA, 23 nt, Human
gcaguugccagucaccccggcca

SEQ ID NO: 1730671 - RNA, 14 nt, Human
gcaguugccaguca

SEQ ID NO: 1730672 - RNA, 15 nt, Human
gcauaaaaauuagcc

SEQ ID NO: 1730673 - RNA, 15 nt, Human
gcauaccacuuuugu

SEQ ID NO: 1730674 - RNA, 16 nt, Human
gcauaccacuuuuguu

SEQ ID NO: 1730675 - RNA, 11 nt, Human
gccaaggccaa

SEQ ID NO: 1730676 - RNA, 17 nt, Human
gccaaggccaaaggaag

SEQ ID NO: 1730677 - RNA, 19 nt, Human
gccaaggccaaaggaagca

SEQ ID NO: 1730678 - RNA, 22 nt, Human
gccaagcaccuagccucgcucu

SEQ ID NO: 1730679 - RNA, 13 nt, Human
gcauggccaggug

SEQ ID NO: 1730680 - RNA, 17 nt, Human
gcauggccagguggcca

SEQ ID NO: 1730681 - RNA, 14 nt, Human
gcauggccaggugg

SEQ ID NO: 1730682 - RNA, 23 nt, Human
gcauccuggcacccggccccugc

SEQ ID NO: 1730683 - RNA, 22 nt, Human
gcauccuggcacccggccccug

SEQ ID NO: 1730684 - RNA, 13 nt, Human
gcaucgcaaugua

SEQ ID NO: 1730685 - RNA, 21 nt, Human
gcauccuggcacccggccccu

SEQ ID NO: 1730686 - RNA, 17 nt, Human
gcauccuggcacccggc

SEQ ID NO: 1730687 - RNA, 18 nt, Human
gcaugugaugagaggaaa

SEQ ID NO: 1730688 - RNA, 20 nt, Human
gcauuguaaaagcauuuugu

SEQ ID NO: 1730689 - RNA, 17 nt, Human
gcaugugaugagaggaa

SEQ ID NO: 1730690 - RNA, 23 nt, Human
gcaugucccuaccgagucucuuc

SEQ ID NO: 1730691 - RNA, 16 nt, Human
gcaugggaaugaaugu

SEQ ID NO: 1730692 - RNA, 13 nt, Human
gcaugggaaugaa

SEQ ID NO: 1730693 - RNA, 19 nt, Human
gcaugggaaugaaugucag

SEQ ID NO: 1730694 - RNA, 14 nt, Human
gcauuugaaaauuu

SEQ ID NO: 1730695 - RNA, 16 nt, Human
gcauuugaaaauuuug

SEQ ID NO: 1730696 - RNA, 12 nt, Human
gcauuuaaaaga

SEQ ID NO: 1730697 - RNA, 15 nt, Human
gcauuuaaaagauac

SEQ ID NO: 1730698 - RNA, 18 nt, Human
gccaagaauucuuaaaua

SEQ ID NO: 1730699 - RNA, 14 nt, Human
gccaagaauucuua

SEQ ID NO: 1730700 - RNA, 21 nt, Human
gccaacuuuccccacguuaaa

SEQ ID NO: 1730701 - RNA, 19 nt, Human
gccaacuauggccugugga

SEQ ID NO: 1730702 - RNA, 15 nt, Human
gccaacuauggccug

SEQ ID NO: 1730703 - RNA, 14 nt, Human
gccaacuauggccu

SEQ ID NO: 1730704 - RNA, 12 nt, Human
gcacuccccugc

SEQ ID NO: 1730705 - RNA, 17 nt, Human
gcacuccagccugggug

SEQ ID NO: 1730706 - RNA, 22 nt, Human
gcacuauagccuaggugacaga

SEQ ID NO: 1730707 - RNA, 23 nt, Human
gcacacagcacgggggccaagga

SEQ ID NO: 1730708 - RNA, 11 nt, Human
gcacacagcac

SEQ ID NO: 1730709 - RNA, 20 nt, Human
gcacacaccagagcccaccu

SEQ ID NO: 1730710 - RNA, 12 nt, Human
gcacacauuuuu

SEQ ID NO: 1730711 - RNA, 11 nt, Human
gcacacauuuu

SEQ ID NO: 1730712 - RNA, 16 nt, Human
gcaccggcuggccugg

SEQ ID NO: 1730713 - RNA, 15 nt, Human
gcaccggcuggccug

SEQ ID NO: 1730714 - RNA, 17 nt, Human
gcaccggcuggccuggc

SEQ ID NO: 1730715 - RNA, 18 nt, Human
gcaccggcuggccuggcc

SEQ ID NO: 1730716 - RNA, 18 nt, Human
gcaccuaccaccacgccc

SEQ ID NO: 1730717 - RNA, 17 nt, Human
gcaccuaccaccacgcc

SEQ ID NO: 1730718 - RNA, 18 nt, Human
gcaccuacaguguacagu

SEQ ID NO: 1730719 - RNA, 19 nt, Human
gcaccuacaguguacaguc

SEQ ID NO: 1730720 - RNA, 21 nt, Human
gcaccuacaguguacagucuu

SEQ ID NO: 1730721 - RNA, 12 nt, Human
gcaccuccugcc

SEQ ID NO: 1730722 - RNA, 21 nt, Human
gcaauaaagcagcguuucuau

SEQ ID NO: 1730723 - RNA, 11 nt, Human
gcaauaaagca

SEQ ID NO: 1730724 - RNA, 19 nt, Human
gcacacaccagagcccacc

SEQ ID NO: 1730725 - RNA, 18 nt, Human
gcacacaccagagcccac

SEQ ID NO: 1730726 - RNA, 17 nt, Human
gcacacaccagagccca

SEQ ID NO: 1730727 - RNA, 16 nt, Human
gcacacaccagagccc

SEQ ID NO: 1730728 - RNA, 15 nt, Human
gcacacaccagagcc

SEQ ID NO: 1730729 - RNA, 14 nt, Human
gcacacaccagagc

SEQ ID NO: 1730730 - RNA, 12 nt, Human
gcacacaccaga

SEQ ID NO: 1730731 - RNA, 19 nt, Human
gcaaccuccgccucuuggg

SEQ ID NO: 1730732 - RNA, 18 nt, Human
gcaaccuccgccucuugg

SEQ ID NO: 1730733 - RNA, 22 nt, Human
gcaacccuggugaccagcacca

SEQ ID NO: 1730734 - RNA, 16 nt, Human
gcaaaagaugcuucuc

SEQ ID NO: 1730735 - RNA, 18 nt, Human
gcaacccccagccugcua

SEQ ID NO: 1730736 - RNA, 15 nt, Human
gcaaaagaugcuucu

SEQ ID NO: 1730737 - RNA, 23 nt, Human
gauuuuuuuuuccuucagugccu

SEQ ID NO: 1730738 - RNA, 22 nt, Human
gauuuuuuuuuccuucagugcc

SEQ ID NO: 1730739 - RNA, 18 nt, Human
gauuucacucuccuuggu

SEQ ID NO: 1730740 - RNA, 17 nt, Human
gauuucacucuccuugg

SEQ ID NO: 1730741 - RNA, 20 nt, Human
gauuucagcucacugcaacc

SEQ ID NO: 1730742 - RNA, 17 nt, Human
gauuucagcucacugca

SEQ ID NO: 1730743 - RNA, 15 nt, Human
gauuucagcucacug

SEQ ID NO: 1730744 - RNA, 16 nt, Human
gauuucacucuccuug

SEQ ID NO: 1730745 - RNA, 13 nt, Human
gauuucacucucc

SEQ ID NO: 1730746 - RNA, 21 nt, Human
gauucuccugccucagccucc

SEQ ID NO: 1730747 - RNA, 20 nt, Human
gauucuccugccucagccuc

SEQ ID NO: 1730748 - RNA, 19 nt, Human
gauucuccugccucagccu

SEQ ID NO: 1730749 - RNA, 23 nt, Human
gauucuuauggacaaugacccag

SEQ ID NO: 1730750 - RNA, 21 nt, Human
gauucuucugcuucagccucc

SEQ ID NO: 1730751 - RNA, 20 nt, Human
gauuuaacagaaauguacag

SEQ ID NO: 1730752 - RNA, 23 nt, Human
gauuuaacagaaauguacagcaa

SEQ ID NO: 1730753 - RNA, 18 nt, Human
gaucuggguucacugcaa

SEQ ID NO: 1730754 - RNA, 22 nt, Human
gaguugauagcacagacccugc

SEQ ID NO: 1730755 - RNA, 20 nt, Human
gaucuggguucacugcaacc

SEQ ID NO: 1730756 - RNA, 19 nt, Human
gauguaauuuuguguaaga

SEQ ID NO: 1730757 - RNA, 13 nt, Human
gauguaauuuugu

SEQ ID NO: 1730758 - RNA, 17 nt, Human
gaugucccaacuuguaa

SEQ ID NO: 1730759 - RNA, 18 nt, Human
gaugucccaacuuguaaa

SEQ ID NO: 1730760 - RNA, 14 nt, Human
gaugcuuguacaua

SEQ ID NO: 1730761 - RNA, 16 nt, Human
gaugcuuguacauaau

SEQ ID NO: 1730762 - RNA, 23 nt, Human
gauggaggaaaaccaagccgugg

SEQ ID NO: 1730763 - RNA, 22 nt, Human
gauggaaaaaccacccccaaau

SEQ ID NO: 1730764 - RNA, 14 nt, Human
gauguaaagauguu

SEQ ID NO: 1730765 - RNA, 13 nt, Human
gauguaaagaugu

SEQ ID NO: 1730766 - RNA, 23 nt, Human
gaugcuucucacugccaugccag

SEQ ID NO: 1730767 - RNA, 14 nt, Human
gaugaugacuaugg

SEQ ID NO: 1730768 - RNA, 13 nt, Human
gaugaggcaaccc

SEQ ID NO: 1730769 - RNA, 22 nt, Human
gagcaucaggccaggcccucug

SEQ ID NO: 1730770 - RNA, 20 nt, Human
gagcaucaggccaggcccuc

SEQ ID NO: 1730771 - RNA, 13 nt, Human
gagcgacagugag

SEQ ID NO: 1730772 - RNA, 15 nt, Human
gagcgacagugagac

SEQ ID NO: 1730773 - RNA, 13 nt, Human
gagccuuccaggg

SEQ ID NO: 1730774 - RNA, 12 nt, Human
gagccuuccagg

SEQ ID NO: 1730775 - RNA, 19 nt, Human
gagcugccuguucagcucc

SEQ ID NO: 1730776 - RNA, 16 nt, Human
gagcugccuguucagc

SEQ ID NO: 1730777 - RNA, 15 nt, Human
gagcugccuguucag

SEQ ID NO: 1730778 - RNA, 17 nt, Human
gagcggagaaaggaagg

SEQ ID NO: 1730779 - RNA, 20 nt, Human
gagcugccuguucagcucca

SEQ ID NO: 1730780 - RNA, 13 nt, Human
gaggugggauccu

SEQ ID NO: 1730781 - RNA, 16 nt, Human
gaggugggauccucca

SEQ ID NO: 1730782 - RNA, 15 nt, Human
gaggugggauccucc

SEQ ID NO: 1730783 - RNA, 21 nt, Human
gagucacuggaacacuaauga

SEQ ID NO: 1730784 - RNA, 14 nt, Human
gagucacuggaaca

SEQ ID NO: 1730785 - RNA, 17 nt, Human
gaggugggauccuccag

SEQ ID NO: 1730786 - RNA, 18 nt, Human
gagugccuuacacaaugg

SEQ ID NO: 1730787 - RNA, 19 nt, Human
gaguugauacuacaguuug

SEQ ID NO: 1730788 - RNA, 21 nt, Human
gaguugauagcacagacccug

SEQ ID NO: 1730789 - RNA, 22 nt, Human
gaguugauacuacaguuuguua

SEQ ID NO: 1730790 - RNA, 18 nt, Human
gagugcagugagccgaga

SEQ ID NO: 1730791 - RNA, 18 nt, Human
gagugagacucugucuca

SEQ ID NO: 1730792 - RNA, 14 nt, Human
gagugagacucugu

SEQ ID NO: 1730793 - RNA, 14 nt, Human
gagugagacagacu

SEQ ID NO: 1730794 - RNA, 18 nt, Human
gagucagaaguuucugcc

SEQ ID NO: 1730795 - RNA, 20 nt, Human
gaggccagagacacaagccu

SEQ ID NO: 1730796 - RNA, 14 nt, Human
gaggcucugcccuu

SEQ ID NO: 1730797 - RNA, 13 nt, Human
gaggcucugcccu

SEQ ID NO: 1730798 - RNA, 12 nt, Human
gaggcucugccc

SEQ ID NO: 1730799 - RNA, 17 nt, Human
gaggcucugcccuuggu

SEQ ID NO: 1730800 - RNA, 15 nt, Human
gaggcucugcccuug

SEQ ID NO: 1730801 - RNA, 19 nt, Human
gaggcucuggagcccacug

SEQ ID NO: 1730802 - RNA, 14 nt, Human
gaggcucuggagcc

SEQ ID NO: 1730803 - RNA, 14 nt, Human
gaggcugccucucc

SEQ ID NO: 1730804 - RNA, 15 nt, Human
gagggcuccagacac

SEQ ID NO: 1730805 - RNA, 14 nt, Human
gagggcuccagaca

SEQ ID NO: 1730806 - RNA, 13 nt, Human
gagggcuccagac

SEQ ID NO: 1730807 - RNA, 12 nt, Human
gagggcuccaga

SEQ ID NO: 1730808 - RNA, 12 nt, Human
gaggggaacaga

SEQ ID NO: 1730809 - RNA, 14 nt, Human
gacagaaagcagaa

SEQ ID NO: 1730810 - RNA, 20 nt, Human
gacagaaagcagaacaguga

SEQ ID NO: 1730811 - RNA, 15 nt, Human
gacagcuccuucugu

SEQ ID NO: 1730812 - RNA, 14 nt, Human
gacagcuccuucug

SEQ ID NO: 1730813 - RNA, 13 nt, Human
gacagcuccuucu

SEQ ID NO: 1730814 - RNA, 12 nt, Human
gacagccuggca

SEQ ID NO: 1730815 - RNA, 11 nt, Human
gacagccuggc

SEQ ID NO: 1730816 - RNA, 16 nt, Human
gacagcuccuucuguc

SEQ ID NO: 1730817 - RNA, 17 nt, Human
gacaggguuucaccaug

SEQ ID NO: 1730818 - RNA, 20 nt, Human
gacaguauggcagcuuuccu

SEQ ID NO: 1730819 - RNA, 15 nt, Human
gaccaucccugaagg

SEQ ID NO: 1730820 - RNA, 14 nt, Human
gaccaucccugaag

SEQ ID NO: 1730821 - RNA, 13 nt, Human
gacccggcugcgu

SEQ ID NO: 1730822 - RNA, 12 nt, Human
gacccggcugcg

SEQ ID NO: 1730823 - RNA, 22 nt, Human
gaccccuggcuuuucacugcug

SEQ ID NO: 1730824 - RNA, 21 nt, Human
gaccccuggcuuuucacugcu

SEQ ID NO: 1730825 - RNA, 16 nt, Human
gacccuauugcugcuu

SEQ ID NO: 1730826 - RNA, 17 nt, Human
gaccauucuccaccugc

SEQ ID NO: 1730827 - RNA, 13 nt, Human
gaccccuggcuuu

SEQ ID NO: 1730828 - RNA, 16 nt, Human
gaccauucuccaccug

SEQ ID NO: 1730829 - RNA, 17 nt, Human
gaccaucccugaaggcc

SEQ ID NO: 1730830 - RNA, 16 nt, Human
gaccaucccugaaggc

SEQ ID NO: 1730831 - RNA, 22 nt, Human
gacuuuguuaguuucuccaagc

SEQ ID NO: 1730832 - RNA, 23 nt, Human
gacuuuucuguccgagcuuugaa

SEQ ID NO: 1730833 - RNA, 21 nt, Human
gacuuuucuguccgagcuuug

SEQ ID NO: 1730834 - RNA, 14 nt, Human
gacuuuggaaagag

SEQ ID NO: 1730835 - RNA, 14 nt, Human
gacuuuggaaagac

SEQ ID NO: 1730836 - RNA, 18 nt, Human
gacuguuuucucuugaga

SEQ ID NO: 1730837 - RNA, 16 nt, Human
gacuguuuucucuuga

SEQ ID NO: 1730838 - RNA, 23 nt, Human
gacugucucaagagggcacuggu

SEQ ID NO: 1730839 - RNA, 22 nt, Human
gacugucucaagagggcacugg

SEQ ID NO: 1730840 - RNA, 21 nt, Human
gacugucucaagagggcacug

SEQ ID NO: 1730841 - RNA, 20 nt, Human
gacugugugcucaggagccc

SEQ ID NO: 1730842 - RNA, 17 nt, Human
gacugugugcucaggag

SEQ ID NO: 1730843 - RNA, 16 nt, Human
gacugugugcucagga

SEQ ID NO: 1730844 - RNA, 14 nt, Human
gacugugugcucag

SEQ ID NO: 1730845 - RNA, 22 nt, Human
gacuguacaaaguagaagucuu

SEQ ID NO: 1730846 - RNA, 17 nt, Human
gacuguacuccucccag

SEQ ID NO: 1730847 - RNA, 16 nt, Human
gacuguacuccuccca

SEQ ID NO: 1730848 - RNA, 17 nt, Human
gacucaaugcacugaca

SEQ ID NO: 1730849 - RNA, 14 nt, Human
gacucaaugcacug

SEQ ID NO: 1730850 - RNA, 17 nt, Human
gagaagcggcuggcagc

SEQ ID NO: 1730851 - RNA, 15 nt, Human
gacgcugugcugccc

SEQ ID NO: 1730852 - RNA, 13 nt, Human
gacgcugugcugc

SEQ ID NO: 1730853 - RNA, 12 nt, Human
gacgcugugcug

SEQ ID NO: 1730854 - RNA, 16 nt, Human
guacuggagaaaaugg

SEQ ID NO: 1730855 - RNA, 19 nt, Human
guacuacaguccucccauc

SEQ ID NO: 1730856 - RNA, 18 nt, Human
guacuacaguccucccau

SEQ ID NO: 1730857 - RNA, 14 nt, Human
guacccacugcucu

SEQ ID NO: 1730858 - RNA, 13 nt, Human
guacccacugcuc

SEQ ID NO: 1730859 - RNA, 13 nt, Human
guacuauguauca

SEQ ID NO: 1730860 - RNA, 17 nt, Human
guacuauguaucaauga

SEQ ID NO: 1730861 - RNA, 15 nt, Human
guacuauguaucaau

SEQ ID NO: 1730862 - RNA, 14 nt, Human
guacucauuaaaaa

SEQ ID NO: 1730863 - RNA, 14 nt, Human
guacuccucccagg

SEQ ID NO: 1730864 - RNA, 19 nt, Human
guacuccacauauuucagu

SEQ ID NO: 1730865 - RNA, 23 nt, Human
guagaaauaucugaaaauguaug

SEQ ID NO: 1730866 - RNA, 21 nt, Human
guagaaauaucugaaaaugua

SEQ ID NO: 1730867 - RNA, 20 nt, Human
guagaaauaucugaaaaugu

SEQ ID NO: 1730868 - RNA, 18 nt, Human
guagaagcccuucuaccu

SEQ ID NO: 1730869 - RNA, 12 nt, Human
guagaagauggc

SEQ ID NO: 1730870 - RNA, 21 nt, Human
guagaagucuuagauguauau

SEQ ID NO: 1730871 - RNA, 11 nt, Human
guagagccagg

SEQ ID NO: 1730872 - RNA, 10 nt, Human
guagagccag

SEQ ID NO: 1730873 - RNA, 13 nt, Human
guagagacagggu

SEQ ID NO: 1730874 - RNA, 18 nt, Human
guagagccagggucucac

SEQ ID NO: 1730875 - RNA, 15 nt, Human
guagagccagggucu

SEQ ID NO: 1730876 - RNA, 21 nt, Human
guagccucaaucgagugagac

SEQ ID NO: 1730877 - RNA, 12 nt, Human
guagagacaggg

SEQ ID NO: 1730878 - RNA, 11 nt, Human
guagagacagg

SEQ ID NO: 1730879 - RNA, 23 nt, Human
guaccaagacuacuagggaaaug

SEQ ID NO: 1730880 - RNA, 20 nt, Human
guaccaagacuacuagggaa

SEQ ID NO: 1730881 - RNA, 12 nt, Human
guacccacugcu

SEQ ID NO: 1730882 - RNA, 23 nt, Human
guaccauuuaauggggaggacaa

SEQ ID NO: 1730883 - RNA, 22 nt, Human
guaccauuuaauggggaggaca

SEQ ID NO: 1730884 - RNA, 14 nt, Human
guacaugaaaacac

SEQ ID NO: 1730885 - RNA, 15 nt, Human
guacaugaaaacaca

SEQ ID NO: 1730886 - RNA, 16 nt, Human
guacaugaaaacacau

SEQ ID NO: 1730887 - RNA, 19 nt, Human
guacauggaauaacaugua

SEQ ID NO: 1730888 - RNA, 17 nt, Human
guacaugaaaacacauu

SEQ ID NO: 1730889 - RNA, 18 nt, Human
guacaugaaaacacauuu

SEQ ID NO: 1730890 - RNA, 19 nt, Human
guacaugaaaacacauuuu

SEQ ID NO: 1730891 - RNA, 20 nt, Human
guacaugaaaacacauuuuu

SEQ ID NO: 1730892 - RNA, 15 nt, Human
aaauccacuuuaucu

SEQ ID NO: 1730893 - RNA, 18 nt, Human
aaaucagccugcuccagc

SEQ ID NO: 1730894 - RNA, 16 nt, Human
aaaucagcugcuacua

SEQ ID NO: 1730895 - RNA, 12 nt, Human
aaaucagccugc

SEQ ID NO: 1730896 - RNA, 19 nt, Human
aaaucagccguguaaccau

SEQ ID NO: 1730897 - RNA, 15 nt, Human
aaauauuccugcauu

SEQ ID NO: 1730898 - RNA, 21 nt, Human
aaaucagacuaugaaguuuuu

SEQ ID NO: 1730899 - RNA, 14 nt, Human
aaaucagacuauga

SEQ ID NO: 1730900 - RNA, 14 nt, Human
guaauaugcacaca

SEQ ID NO: 1730901 - RNA, 16 nt, Human
guaauaugcacacauu

SEQ ID NO: 1730902 - RNA, 17 nt, Human
guaauaugcacacauuu

SEQ ID NO: 1730903 - RNA, 18 nt, Human
guaauaugcacacauuuu

SEQ ID NO: 1730904 - RNA, 21 nt, Human
guaauccaagcaaaugugaau

SEQ ID NO: 1730905 - RNA, 15 nt, Human
guaauccaccugccu

SEQ ID NO: 1730906 - RNA, 20 nt, Human
guaauaggcguaacuaauuu

SEQ ID NO: 1730907 - RNA, 14 nt, Human
guaauuuuguguaa

SEQ ID NO: 1730908 - RNA, 16 nt, Human
guaauuuuguguaaga

SEQ ID NO: 1730909 - RNA, 20 nt, Human
guaauuuuguguaagaaaua

SEQ ID NO: 1730910 - RNA, 17 nt, Human
aaauacagauagauaua

SEQ ID NO: 1730911 - RNA, 15 nt, Human
aaauacagacuggau

SEQ ID NO: 1730912 - RNA, 18 nt, Human
aaauaccagccaguaaau

SEQ ID NO: 1730913 - RNA, 17 nt, Human
aaauacauuuaaaacau

SEQ ID NO: 1730914 - RNA, 17 nt, Human
aaaguugguaaaccuuu

SEQ ID NO: 1730915 - RNA, 16 nt, Human
aaaguugguaaaccuu

SEQ ID NO: 1730916 - RNA, 12 nt, Human
aaauaauuuugu

SEQ ID NO: 1730917 - RNA, 13 nt, Human
aaauaauuuugua

SEQ ID NO: 1730918 - RNA, 14 nt, Human
aaauaauuuuguaa

SEQ ID NO: 1730919 - RNA, 23 nt, Human
aaaguucugcagauaaacaguag

SEQ ID NO: 1730920 - RNA, 16 nt, Human
aaaguuaccagugccu

SEQ ID NO: 1730921 - RNA, 22 nt, Human
aaaguuaccagugccuuaaacu

SEQ ID NO: 1730922 - RNA, 18 nt, Human
aaaguaucccuacuguaa

SEQ ID NO: 1730923 - RNA, 21 nt, Human
aaaguacuucuccacccugcu

SEQ ID NO: 1730924 - RNA, 20 nt, Human
aaaguacuucuccacccugc

SEQ ID NO: 1730925 - RNA, 23 nt, Human
aaaguacuucuccacccugcucu

SEQ ID NO: 1730926 - RNA, 20 nt, Human
aaagguauuuuaaucaccaa

SEQ ID NO: 1730927 - RNA, 20 nt, Human
aaaguacacuguuucaaacu

SEQ ID NO: 1730928 - RNA, 19 nt, Human
aaaguacuucuccacccug

SEQ ID NO: 1730929 - RNA, 16 nt, Human
aaaguacauguuaaac

SEQ ID NO: 1730930 - RNA, 13 nt, Human
gggaugagaaagg

SEQ ID NO: 1730931 - RNA, 19 nt, Human
aaaauuuagaaauauaauu

SEQ ID NO: 1730932 - RNA, 20 nt, Human
aaaauuuugauguuuuaagg

SEQ ID NO: 1730933 - RNA, 15 nt, Human
aaaauuuuuaaucuu

SEQ ID NO: 1730934 - RNA, 20 nt, Human
aaacaaaggccuaauucuau

SEQ ID NO: 1730935 - RNA, 19 nt, Human
aaacacaaacgggcucagc

SEQ ID NO: 1730936 - RNA, 12 nt, Human
aaacacauuuuu

SEQ ID NO: 1730937 - RNA, 11 nt, Human
aaacacauuuu

SEQ ID NO: 1730938 - RNA, 16 nt, Human
ggggaccagagcugcc

SEQ ID NO: 1730939 - RNA, 22 nt, Human
ggggaauguuugccucugccuc

SEQ ID NO: 1730940 - RNA, 18 nt, Human
ggggaauguuugccucug

SEQ ID NO: 1730941 - RNA, 13 nt, Human
ggggaaggcaggg

SEQ ID NO: 1730942 - RNA, 14 nt, Human
aaacaguagugaua

SEQ ID NO: 1730943 - RNA, 16 nt, Human
aaacauggccuuugcu

SEQ ID NO: 1730944 - RNA, 17 nt, Human
aaacauggccuuugcuu

SEQ ID NO: 1730945 - RNA, 11 nt, Human
ggggagaaagu

SEQ ID NO: 1730946 - RNA, 18 nt, Human
gggggccucagugccacu

SEQ ID NO: 1730947 - RNA, 17 nt, Human
gggggccucagugccac

SEQ ID NO: 1730948 - RNA, 15 nt, Human
gggggccucagugcc

SEQ ID NO: 1730949 - RNA, 12 nt, Human
gggggccucagu

SEQ ID NO: 1730950 - RNA, 15 nt, Human
ggggccucagugcca

SEQ ID NO: 1730951 - RNA, 13 nt, Human
aaacucuccucug

SEQ ID NO: 1730952 - RNA, 22 nt, Human
aaacugcccccucugcccugcg

SEQ ID NO: 1730953 - RNA, 19 nt, Human
aaacuguuaauaguucagg

SEQ ID NO: 1730954 - RNA, 16 nt, Human
aaacuuaaucuaaaug

SEQ ID NO: 1730955 - RNA, 17 nt, Human
aaacuuaaucuaaaugg

SEQ ID NO: 1730956 - RNA, 18 nt, Human
aaacuuaaucuaaaugga

SEQ ID NO: 1730957 - RNA, 19 nt, Human
aaacuuaaucuaaauggaa

SEQ ID NO: 1730958 - RNA, 18 nt, Human
aaacuaggugcauauuua

SEQ ID NO: 1730959 - RNA, 22 nt, Human
aaacuaggugcauauuuauaaa

SEQ ID NO: 1730960 - RNA, 15 nt, Human
aaacgggcucagcaa

SEQ ID NO: 1730961 - RNA, 18 nt, Human
aaaccuuuuauauuuagu

SEQ ID NO: 1730962 - RNA, 18 nt, Human
aaaccuuuguuugcaucu

SEQ ID NO: 1730963 - RNA, 23 nt, Human
aaaccaagucaagugaaaaagga

SEQ ID NO: 1730964 - RNA, 15 nt, Human
aaacauuaugaugug

SEQ ID NO: 1730965 - RNA, 15 nt, Human
gggucgcccuggacu

SEQ ID NO: 1730966 - RNA, 13 nt, Human
gggucgcccugga

SEQ ID NO: 1730967 - RNA, 19 nt, Human
gggggugcugggccccugc

SEQ ID NO: 1730968 - RNA, 13 nt, Human
aaagacagugaaa

SEQ ID NO: 1730969 - RNA, 9 nt, Human
aaagacaga

SEQ ID NO: 1730970 - RNA, 19 nt, Human
aaagacugaccaauauugu

SEQ ID NO: 1730971 - RNA, 19 nt, Human
aaacuucagacauagaauu

SEQ ID NO: 1730972 - RNA, 15 nt, Human
ggguggggggggugc

SEQ ID NO: 1730973 - RNA, 14 nt, Human
ggguggccucccaa

SEQ ID NO: 1730974 - RNA, 12 nt, Human
aaacuuuguagu

SEQ ID NO: 1730975 - RNA, 16 nt, Human
aaacuuguauuaugug

SEQ ID NO: 1730976 - RNA, 15 nt, Human
aaagaggaaugaagu

SEQ ID NO: 1730977 - RNA, 14 nt, Human
aaagaugcuucuca

SEQ ID NO: 1730978 - RNA, 17 nt, Human
aaagaugcuucucacug

SEQ ID NO: 1730979 - RNA, 19 nt, Human
aaagaugcuucucacugcc

SEQ ID NO: 1730980 - RNA, 13 nt, Human
aaagacuguacaa

SEQ ID NO: 1730981 - RNA, 23 nt, Human
aaagacugaguacguugugcauu

SEQ ID NO: 1730982 - RNA, 14 nt, Human
aaagacuguacaaa

SEQ ID NO: 1730983 - RNA, 14 nt, Human
gguccugcugcagu

SEQ ID NO: 1730984 - RNA, 12 nt, Human
gguccugcugca

SEQ ID NO: 1730985 - RNA, 11 nt, Human
gguccugcugc

SEQ ID NO: 1730986 - RNA, 23 nt, Human
aaagauggcugugccucugccug

SEQ ID NO: 1730987 - RNA, 22 nt, Human
aaagauggcugugccucugccu

SEQ ID NO: 1730988 - RNA, 21 nt, Human
aaagauggcugugccucugcc

SEQ ID NO: 1730989 - RNA, 14 nt, Human
aaagguaaaucaga

SEQ ID NO: 1730990 - RNA, 22 nt, Human
aaagggacuuggaagcuccgcu

SEQ ID NO: 1730991 - RNA, 20 nt, Human
aaagggacugagaaauuuau

SEQ ID NO: 1730992 - RNA, 21 nt, Human
aaaggagagcuagcagcaggg

SEQ ID NO: 1730993 - RNA, 17 nt, Human
aaaggagauuggaagga

SEQ ID NO: 1730994 - RNA, 22 nt, Human
aaaggaaagagggagguaagga

SEQ ID NO: 1730995 - RNA, 15 nt, Human
aaagcucacuuuacu

SEQ ID NO: 1730996 - RNA, 15 nt, Human
aaagcugaaaacugc

SEQ ID NO: 1730997 - RNA, 15 nt, Human
aaagcuuguuaagau

SEQ ID NO: 1730998 - RNA, 13 nt, Human
aaagcugcugaca

SEQ ID NO: 1730999 - RNA, 12 nt, Human
aaagcugaaaac

SEQ ID NO: 1731000 - RNA, 20 nt, Human
ggucgcccuggacugugugc

SEQ ID NO: 1731001 - RNA, 13 nt, Human
ggugaacagaaca

SEQ ID NO: 1731002 - RNA, 13 nt, Human
ggucgaggcagga

SEQ ID NO: 1731003 - RNA, 14 nt, Human
ggucgcccuggacu

SEQ ID NO: 1731004 - RNA, 16 nt, Human
ggugcaaugaccuuuc

SEQ ID NO: 1731005 - RNA, 13 nt, Human
ggugcaaugaccu

SEQ ID NO: 1731006 - RNA, 12 nt, Human
ggugcaaugacc

SEQ ID NO: 1731007 - RNA, 24 nt, Human
ggugauccacccaccucagccucc

SEQ ID NO: 1731008 - RNA, 23 nt, Human
ggugauccacccaccucagccuc

SEQ ID NO: 1731009 - RNA, 18 nt, Human
ggugauccacccaccuca

SEQ ID NO: 1731010 - RNA, 21 nt, Human
ggugcauuugaggucuguucu

SEQ ID NO: 1731011 - RNA, 21 nt, Human
ggugcauauuuauaaaaauaa

SEQ ID NO: 1731012 - RNA, 16 nt, Human
ggugcugggccccugc

SEQ ID NO: 1731013 - RNA, 15 nt, Human
ggugcugggccccug

SEQ ID NO: 1731014 - RNA, 13 nt, Human
ggugcugggcccc

SEQ ID NO: 1731015 - RNA, 11 nt, Human
ggugcugggcc

SEQ ID NO: 1731016 - RNA, 13 nt, Human
gguggaugccugg

SEQ ID NO: 1731017 - RNA, 19 nt, Human
ggugcugggccccugccuc

SEQ ID NO: 1731018 - RNA, 14 nt, Human
aaaaauaacaauga

SEQ ID NO: 1731019 - RNA, 19 nt, Human
ggcugggggccucagugcc

SEQ ID NO: 1731020 - RNA, 17 nt, Human
ggcugggggccucagug

SEQ ID NO: 1731021 - RNA, 16 nt, Human
ggcugggggccucagu

SEQ ID NO: 1731022 - RNA, 15 nt, Human
ggcugggggccucag

SEQ ID NO: 1731023 - RNA, 21 nt, Human
ggcuggguucuacccaggugc

SEQ ID NO: 1731024 - RNA, 19 nt, Human
ggcuggguucuacccaggu

SEQ ID NO: 1731025 - RNA, 19 nt, Human
ggcuggguggcaccagcag

SEQ ID NO: 1731026 - RNA, 20 nt, Human
ggcugggucgcccuggacug

SEQ ID NO: 1731027 - RNA, 17 nt, Human
ggcugggucgcccugga

SEQ ID NO: 1731028 - RNA, 14 nt, Human
ggcugggucgcccu

SEQ ID NO: 1731029 - RNA, 18 nt, Human
ggcuguaucccaugagcc

SEQ ID NO: 1731030 - RNA, 20 nt, Human
ggcuucaguggcagcugcuu

SEQ ID NO: 1731031 - RNA, 19 nt, Human
ggcuucaguggcagcugcu

SEQ ID NO: 1731032 - RNA, 17 nt, Human
ggcuucaguggcagcug

SEQ ID NO: 1731033 - RNA, 18 nt, Human
ggcuucaguggcagcugc

SEQ ID NO: 1731034 - RNA, 16 nt, Human
ggcuuccucauaguau

SEQ ID NO: 1731035 - RNA, 21 nt, Human
ggcuucccgcucagcccuccc

SEQ ID NO: 1731036 - RNA, 19 nt, Human
ggcuucccgcucagcccuc

SEQ ID NO: 1731037 - RNA, 18 nt, Human
ggcuucccgcucagcccu

SEQ ID NO: 1731038 - RNA, 17 nt, Human
ggcuucccgcucagccc

SEQ ID NO: 1731039 - RNA, 16 nt, Human
ggcuucccgcucagcc

SEQ ID NO: 1731040 - RNA, 15 nt, Human
ggcuucccgcucagc

SEQ ID NO: 1731041 - RNA, 18 nt, Human
ggcuucauccuccucaga

SEQ ID NO: 1731042 - RNA, 22 nt, Human
ggcuucauccuccucagaucuu

SEQ ID NO: 1731043 - RNA, 14 nt, Human
ggcuucccgcucag

SEQ ID NO: 1731044 - RNA, 16 nt, Human
gggacagcuccuucug

SEQ ID NO: 1731045 - RNA, 15 nt, Human
gggacagcuccuucu

SEQ ID NO: 1731046 - RNA, 13 nt, Human
gggacagcuccuu

SEQ ID NO: 1731047 - RNA, 12 nt, Human
gggacagcuccu

SEQ ID NO: 1731048 - RNA, 13 nt, Human
gggacagagcaga

SEQ ID NO: 1731049 - RNA, 13 nt, Human
gggaagagacuug

SEQ ID NO: 1731050 - RNA, 13 nt, Human
gggaaccugaccc

SEQ ID NO: 1731051 - RNA, 18 nt, Human
gggaagaagcucucuccu

SEQ ID NO: 1731052 - RNA, 21 nt, Human
ggcuuccuccugguguggaag

SEQ ID NO: 1731053 - RNA, 22 nt, Human
ggcuucccgcucagcccucccu

SEQ ID NO: 1731054 - RNA, 18 nt, Human
aaaacucuccucugcugc

SEQ ID NO: 1731055 - RNA, 22 nt, Human
aaaacuugauguguuaucucuu

SEQ ID NO: 1731056 - RNA, 15 nt, Human
aaaacuucagacaua

SEQ ID NO: 1731057 - RNA, 12 nt, Human
aaaacccaagug

SEQ ID NO: 1731058 - RNA, 13 nt, Human
aaaacaugcuaca

SEQ ID NO: 1731059 - RNA, 14 nt, Human
aaaacaugcuacac

SEQ ID NO: 1731060 - RNA, 17 nt, Human
aaaaaugguuuaaaugg

SEQ ID NO: 1731061 - RNA, 20 nt, Human
gggaccagagcugccaccug

SEQ ID NO: 1731062 - RNA, 14 nt, Human
gggaccagagcugc

SEQ ID NO: 1731063 - RNA, 19 nt, Human
gggagagccuuccaggggu

SEQ ID NO: 1731064 - RNA, 15 nt, Human
gggagagccuuccag

SEQ ID NO: 1731065 - RNA, 23 nt, Human
gggagcaggcucgggcuccccag

SEQ ID NO: 1731066 - RNA, 16 nt, Human
gggagggagggcucca

SEQ ID NO: 1731067 - RNA, 15 nt, Human
gggagggagggcucc

SEQ ID NO: 1731068 - RNA, 18 nt, Human
gggaggucaaggcugcag

SEQ ID NO: 1731069 - RNA, 15 nt, Human
gggaggucgaggcag

SEQ ID NO: 1731070 - RNA, 23 nt, Human
gggacuuggaagcuccgcuuucu

SEQ ID NO: 1731071 - RNA, 18 nt, Human
gggacuuggaagcuccgc

SEQ ID NO: 1731072 - RNA, 17 nt, Human
gggacuuggaagcuccg

SEQ ID NO: 1731073 - RNA, 15 nt, Human
gggacuuggaagcuc

SEQ ID NO: 1731074 - RNA, 21 nt, Human
gggagaaccaaaaagaggcua

SEQ ID NO: 1731075 - RNA, 23 nt, Human
aaaagccagguuccacagaggac

SEQ ID NO: 1731076 - RNA, 16 nt, Human
aaaagcauuuuguaau

SEQ ID NO: 1731077 - RNA, 14 nt, Human
aaaagcauuuugua

SEQ ID NO: 1731078 - RNA, 15 nt, Human
aaaagcauuuuguaa

SEQ ID NO: 1731079 - RNA, 14 nt, Human
ggcuccacuugguc

SEQ ID NO: 1731080 - RNA, 17 nt, Human
ggcuccaaacccucgag

SEQ ID NO: 1731081 - RNA, 18 nt, Human
ggcucagcggggacagcu

SEQ ID NO: 1731082 - RNA, 19 nt, Human
ggcucagcaaaagaugcuu

SEQ ID NO: 1731083 - RNA, 20 nt, Human
ggcucagguggggucacucu

SEQ ID NO: 1731084 - RNA, 19 nt, Human
ggcucagguggggucacuc

SEQ ID NO: 1731085 - RNA, 20 nt, Human
ggcucagcggggacagcucc

SEQ ID NO: 1731086 - RNA, 19 nt, Human
ggcucagcggggacagcuc

SEQ ID NO: 1731087 - RNA, 16 nt, Human
ggcucagauuguaaua

SEQ ID NO: 1731088 - RNA, 18 nt, Human
ggcugggagagccuucca

SEQ ID NO: 1731089 - RNA, 16 nt, Human
ggcugggagagccuuc

SEQ ID NO: 1731090 - RNA, 15 nt, Human
ggcugggagagccuu

SEQ ID NO: 1731091 - RNA, 14 nt, Human
ggcugggagagccu

SEQ ID NO: 1731092 - RNA, 13 nt, Human
ggcugcugaaggc

SEQ ID NO: 1731093 - RNA, 11 nt, Human
ggcucucaggc

SEQ ID NO: 1731094 - RNA, 13 nt, Human
ggcucucaggcca

SEQ ID NO: 1731095 - RNA, 14 nt, Human
ggcucucaggccag

SEQ ID NO: 1731096 - RNA, 12 nt, Human
ggcucuuccagg

SEQ ID NO: 1731097 - RNA, 14 nt, Human
ggcucuuccaggcu

SEQ ID NO: 1731098 - RNA, 13 nt, Human
ggcucuucuccuu

SEQ ID NO: 1731099 - RNA, 12 nt, Human
ggcucuucuccu

SEQ ID NO: 1731100 - RNA, 20 nt, Human
ggcugccaaugggagcucau

SEQ ID NO: 1731101 - RNA, 19 nt, Human
ggcugccaaugggagcuca

SEQ ID NO: 1731102 - RNA, 16 nt, Human
ggcucuucuccuuuca

SEQ ID NO: 1731103 - RNA, 22 nt, Human
ggcugacagacagcccuccauc

SEQ ID NO: 1731104 - RNA, 23 nt, Human
ggcucuucuccuuucacaaccuu

SEQ ID NO: 1731105 - RNA, 15 nt, Human
ggcucuucuccuuuc

SEQ ID NO: 1731106 - RNA, 14 nt, Human
ggcucuucuccuuu

SEQ ID NO: 1731107 - RNA, 21 nt, Human
ggcugccaaugggagcucaug

SEQ ID NO: 1731108 - RNA, 13 nt, Human
ggcugcccuggug

SEQ ID NO: 1731109 - RNA, 19 nt, Human
ggcugcccuggugcugcca

SEQ ID NO: 1731110 - RNA, 16 nt, Human
ggcugcccuggugcug

SEQ ID NO: 1731111 - RNA, 15 nt, Human
ggcugcccuggugcu

SEQ ID NO: 1731112 - RNA, 14 nt, Human
ggcugcccuggugc

SEQ ID NO: 1731113 - RNA, 22 nt, Human
ggcugcggaaugaaccacaucu

SEQ ID NO: 1731114 - RNA, 16 nt, Human
ggcugccuuagaaccu

SEQ ID NO: 1731115 - RNA, 22 nt, Human
ggcugcccuggugcugccacac

SEQ ID NO: 1731116 - RNA, 15 nt, Human
ggcacugguggcccg

SEQ ID NO: 1731117 - RNA, 11 nt, Human
ggcagccccug

SEQ ID NO: 1731118 - RNA, 23 nt, Human
ggcacagaaaauggaagacagcu

SEQ ID NO: 1731119 - RNA, 23 nt, Human
ggcacucagaagacacugauggg

SEQ ID NO: 1731120 - RNA, 13 nt, Human
ggcacaucagcac

SEQ ID NO: 1731121 - RNA, 19 nt, Human
ggcacagaaaauggaagac

SEQ ID NO: 1731122 - RNA, 21 nt, Human
ggcacagaaaauggaagacag

SEQ ID NO: 1731123 - RNA, 20 nt, Human
ggcacagaaaauggaagaca

SEQ ID NO: 1731124 - RNA, 16 nt, Human
ggagagaagagaaugc

SEQ ID NO: 1731125 - RNA, 22 nt, Human
ggagacugcugagucaacccaa

SEQ ID NO: 1731126 - RNA, 20 nt, Human
ggcaguggugguuuucuguu

SEQ ID NO: 1731127 - RNA, 21 nt, Human
ggcaguggugguuuucuguuc

SEQ ID NO: 1731128 - RNA, 22 nt, Human
ggcagccccuguucuggcagag

SEQ ID NO: 1731129 - RNA, 20 nt, Human
ggccagugugacaaggauug

SEQ ID NO: 1731130 - RNA, 17 nt, Human
ggccaguuggucccccu

SEQ ID NO: 1731131 - RNA, 14 nt, Human
ggccaguugguccc

SEQ ID NO: 1731132 - RNA, 14 nt, Human
ggccuccauccuga

SEQ ID NO: 1731133 - RNA, 15 nt, Human
ggccuccauccugag

SEQ ID NO: 1731134 - RNA, 16 nt, Human
ggccuccauccugagg

SEQ ID NO: 1731135 - RNA, 23 nt, Human
ggcccuucucuccagccccugga

SEQ ID NO: 1731136 - RNA, 22 nt, Human
ggcccuucucuccagccccugg

SEQ ID NO: 1731137 - RNA, 19 nt, Human
ggccucacuaggcuucugg

SEQ ID NO: 1731138 - RNA, 23 nt, Human
ggccccugcugguucaggguugg

SEQ ID NO: 1731139 - RNA, 13 nt, Human
ggcccggcuccag

SEQ ID NO: 1731140 - RNA, 14 nt, Human
ggccccugcugguu

SEQ ID NO: 1731141 - RNA, 13 nt, Human
ggccccugcuggu

SEQ ID NO: 1731142 - RNA, 21 nt, Human
ggcccuucucuccagccccug

SEQ ID NO: 1731143 - RNA, 20 nt, Human
ggcccuucucuccagccccu

SEQ ID NO: 1731144 - RNA, 15 nt, Human
ggcccggcuccaggc

SEQ ID NO: 1731145 - RNA, 15 nt, Human
gcuucacggaagagc

SEQ ID NO: 1731146 - RNA, 17 nt, Human
gcuucacggaagagccu

SEQ ID NO: 1731147 - RNA, 21 nt, Human
gcuucaaggauccugagccag

SEQ ID NO: 1731148 - RNA, 20 nt, Human
gcuucaaggauccugagcca

SEQ ID NO: 1731149 - RNA, 19 nt, Human
gcuucaaggauccugagcc

SEQ ID NO: 1731150 - RNA, 12 nt, Human
gcuucagccucc

SEQ ID NO: 1731151 - RNA, 18 nt, Human
gcuucacggaagagccuu

SEQ ID NO: 1731152 - RNA, 19 nt, Human
gcuucacggaagagccuug

SEQ ID NO: 1731153 - RNA, 22 nt, Human
gcuuccucauaguaugguggcu

SEQ ID NO: 1731154 - RNA, 20 nt, Human
gcuuguaaauagcucaggug

SEQ ID NO: 1731155 - RNA, 14 nt, Human
gcuugagcucagga

SEQ ID NO: 1731156 - RNA, 17 nt, Human
gcuuguaacuaaaauaa

SEQ ID NO: 1731157 - RNA, 22 nt, Human
gcuuguaacuaaaauaauuuug

SEQ ID NO: 1731158 - RNA, 23 nt, Human
gcuuguaacuaaaauaauuuugu

SEQ ID NO: 1731159 - RNA, 12 nt, Human
gcuuguacauaa

SEQ ID NO: 1731160 - RNA, 12 nt, Human
gcugggucgccc

SEQ ID NO: 1731161 - RNA, 23 nt, Human
gcugggccccugccucucugcag

SEQ ID NO: 1731162 - RNA, 22 nt, Human
gcugggccccugccucucugca

SEQ ID NO: 1731163 - RNA, 21 nt, Human
gcugggccccugccucucugc

SEQ ID NO: 1731164 - RNA, 17 nt, Human
gcuggcuguuggcuggg

SEQ ID NO: 1731165 - RNA, 16 nt, Human
gcuggcuguuggcugg

SEQ ID NO: 1731166 - RNA, 15 nt, Human
gcuggcuguuggcug

SEQ ID NO: 1731167 - RNA, 23 nt, Human
gcuggguggcaccagcagccugg

SEQ ID NO: 1731168 - RNA, 22 nt, Human
gcuggguggcaccagcagccug

SEQ ID NO: 1731169 - RNA, 21 nt, Human
gcuggguggcaccagcagccu

SEQ ID NO: 1731170 - RNA, 20 nt, Human
gcuggccuggccccucaggg

SEQ ID NO: 1731171 - RNA, 22 nt, Human
gcuggagugcagugagccgaga

SEQ ID NO: 1731172 - RNA, 17 nt, Human
gcuggagugcagugagc

SEQ ID NO: 1731173 - RNA, 18 nt, Human
gcuggagugcagugagcc

SEQ ID NO: 1731174 - RNA, 20 nt, Human
gcuggcgugcaguggugcga

SEQ ID NO: 1731175 - RNA, 13 nt, Human
gcugcuggcuggu

SEQ ID NO: 1731176 - RNA, 18 nt, Human
gcugcugaaggcucgagc

SEQ ID NO: 1731177 - RNA, 15 nt, Human
gcugcugaaggcucg

SEQ ID NO: 1731178 - RNA, 14 nt, Human
gcugcugaaggcuc

SEQ ID NO: 1731179 - RNA, 13 nt, Human
gcugcugaaggcu

SEQ ID NO: 1731180 - RNA, 23 nt, Human
gcucugguccauagagagcaaga

SEQ ID NO: 1731181 - RNA, 16 nt, Human
gcucugguccauagag

SEQ ID NO: 1731182 - RNA, 15 nt, Human
gcucugguccauaga

SEQ ID NO: 1731183 - RNA, 13 nt, Human
gcucugcccuugg

SEQ ID NO: 1731184 - RNA, 14 nt, Human
ggacuuggaagcuc

SEQ ID NO: 1731185 - RNA, 13 nt, Human
ggagaaacuggaa

SEQ ID NO: 1731186 - RNA, 16 nt, Human
ggagaaaggaagggcu

SEQ ID NO: 1731187 - RNA, 9 nt, Human
ggacuuugu

SEQ ID NO: 1731188 - RNA, 18 nt, Human
ggacucaaugcacugaca

SEQ ID NO: 1731189 - RNA, 16 nt, Human
ggacucaaugcacuga

SEQ ID NO: 1731190 - RNA, 20 nt, Human
ggacuaacuugucuuuggac

SEQ ID NO: 1731191 - RNA, 14 nt, Human
ggacuacaggugug

SEQ ID NO: 1731192 - RNA, 24 nt, Human
ggacuaacuugucuuuggacccug

SEQ ID NO: 1731193 - RNA, 15 nt, Human
ggacucaaugcacug

SEQ ID NO: 1731194 - RNA, 12 nt, Human
ggacccccugaa

SEQ ID NO: 1731195 - RNA, 15 nt, Human
ggaccccgagccugg

SEQ ID NO: 1731196 - RNA, 11 nt, Human
ggacccugagg

SEQ ID NO: 1731197 - RNA, 18 nt, Human
ggaccccgagccuggcuc

SEQ ID NO: 1731198 - RNA, 20 nt, Human
ggacguguuaugacuccaga

SEQ ID NO: 1731199 - RNA, 15 nt, Human
ggaccucaggccugg

SEQ ID NO: 1731200 - RNA, 14 nt, Human
ggaccucaggccug

SEQ ID NO: 1731201 - RNA, 20 nt, Human
ggaccucaggccugggggcu

SEQ ID NO: 1731202 - RNA, 13 nt, Human
ggaccucaggccu

SEQ ID NO: 1731203 - RNA, 13 nt, Human
ggacccugaggcc

SEQ ID NO: 1731204 - RNA, 12 nt, Human
ggacccugaggc

SEQ ID NO: 1731205 - RNA, 23 nt, Human
ggacaggcauguucucugaggac

SEQ ID NO: 1731206 - RNA, 14 nt, Human
ggaacacucugaga

SEQ ID NO: 1731207 - RNA, 12 nt, Human
ggaacacucuga

SEQ ID NO: 1731208 - RNA, 16 nt, Human
ggaacacucugagacu

SEQ ID NO: 1731209 - RNA, 15 nt, Human
ggaacacucugagac

SEQ ID NO: 1731210 - RNA, 13 nt, Human
ggaagagaaaaaa

SEQ ID NO: 1731211 - RNA, 18 nt, Human
ggaagacuuuggaaagag

SEQ ID NO: 1731212 - RNA, 15 nt, Human
ggaagagaaaaaaua

SEQ ID NO: 1731213 - RNA, 14 nt, Human
ggaagacagcucuu

SEQ ID NO: 1731214 - RNA, 13 nt, Human
ggaagacagcucu

SEQ ID NO: 1731215 - RNA, 17 nt, Human
ggaagacuuuggaaaga

SEQ ID NO: 1731216 - RNA, 13 nt, Human
ggaagacuuugga

SEQ ID NO: 1731217 - RNA, 15 nt, Human
ggaagccgcuggggc

SEQ ID NO: 1731218 - RNA, 23 nt, Human
ggaagcucagggccuggcucagg

SEQ ID NO: 1731219 - RNA, 15 nt, Human
ggaagcucagggccu

SEQ ID NO: 1731220 - RNA, 11 nt, Human
ggaagcuccgc

SEQ ID NO: 1731221 - RNA, 16 nt, Human
ggaaggaaacccagcu

SEQ ID NO: 1731222 - RNA, 20 nt, Human
ggaaggaaacccagcucugg

SEQ ID NO: 1731223 - RNA, 19 nt, Human
ggaaggaaacccagcucug

SEQ ID NO: 1731224 - RNA, 20 nt, Human
ggacagcuccuucuguccua

SEQ ID NO: 1731225 - RNA, 19 nt, Human
ggacagcuccuucuguccu

SEQ ID NO: 1731226 - RNA, 22 nt, Human
ggacacuaaccacgcuggaccu

SEQ ID NO: 1731227 - RNA, 17 nt, Human
ggacacuaaccacgcug

SEQ ID NO: 1731228 - RNA, 18 nt, Human
ggacacagcucuucucca

SEQ ID NO: 1731229 - RNA, 15 nt, Human
ggacacagcucuucu

SEQ ID NO: 1731230 - RNA, 21 nt, Human
ggacacagcucuucuccaggc

SEQ ID NO: 1731231 - RNA, 19 nt, Human
ggacaaggacuaggguccu

SEQ ID NO: 1731232 - RNA, 18 nt, Human
ggaauaacauguaauuaa

SEQ ID NO: 1731233 - RNA, 16 nt, Human
ggaauccagacccggc

SEQ ID NO: 1731234 - RNA, 23 nt, Human
ggacaaggaugaucuaggaagac

SEQ ID NO: 1731235 - RNA, 22 nt, Human
ggacaaggaugaucuaggaaga

SEQ ID NO: 1731236 - RNA, 13 nt, Human
ggacaagagcagg

SEQ ID NO: 1731237 - RNA, 18 nt, Human
ggaaugaagcaaugcuuc

SEQ ID NO: 1731238 - RNA, 20 nt, Human
gccuaggugacagagugaga

SEQ ID NO: 1731239 - RNA, 15 nt, Human
gccuaggugacagag

SEQ ID NO: 1731240 - RNA, 14 nt, Human
gccuaggugacaga

SEQ ID NO: 1731241 - RNA, 13 nt, Human
gccuaggugacag

SEQ ID NO: 1731242 - RNA, 20 nt, Human
gccuagcauacguacacauu

SEQ ID NO: 1731243 - RNA, 21 nt, Human
gccuagcauacguacacauuu

SEQ ID NO: 1731244 - RNA, 22 nt, Human
gccuagcauacguacacauuuu

SEQ ID NO: 1731245 - RNA, 23 nt, Human
gccuagcauacguacacauuuua

SEQ ID NO: 1731246 - RNA, 18 nt, Human
gcccugcagagggcacag

SEQ ID NO: 1731247 - RNA, 22 nt, Human
gcccugcccaccuggccucugc

SEQ ID NO: 1731248 - RNA, 21 nt, Human
gcccugcccaccuggccucug

SEQ ID NO: 1731249 - RNA, 20 nt, Human
gcccugcccaccuggccucu

SEQ ID NO: 1731250 - RNA, 17 nt, Human
gcccugcccaccuggcc

SEQ ID NO: 1731251 - RNA, 11 nt, Human
gcccugccucc

SEQ ID NO: 1731252 - RNA, 16 nt, Human
gcccugcccugguuuc

SEQ ID NO: 1731253 - RNA, 12 nt, Human
gcccugcccugg

SEQ ID NO: 1731254 - RNA, 11 nt, Human
gcccugcccug

SEQ ID NO: 1731255 - RNA, 13 nt, Human
gcccugccuccuu

SEQ ID NO: 1731256 - RNA, 12 nt, Human
gcccugccuccu

SEQ ID NO: 1731257 - RNA, 14 nt, Human
gcccugccuccuuu

SEQ ID NO: 1731258 - RNA, 18 nt, Human
gcccugcccugguuuccu

SEQ ID NO: 1731259 - RNA, 20 nt, Human
gcccuuagcagggaaacagc

SEQ ID NO: 1731260 - RNA, 22 nt, Human
gcccuguccugccuaaggcuga

SEQ ID NO: 1731261 - RNA, 20 nt, Human
gccgcagcccugcagagggc

SEQ ID NO: 1731262 - RNA, 22 nt, Human
gcccuuagcagggaaacagcua

SEQ ID NO: 1731263 - RNA, 12 nt, Human
gcccccacuggu

SEQ ID NO: 1731264 - RNA, 16 nt, Human
gccccugccacccugg

SEQ ID NO: 1731265 - RNA, 17 nt, Human
gccccugccacccuggg

SEQ ID NO: 1731266 - RNA, 15 nt, Human
gcccucacccugggg

SEQ ID NO: 1731267 - RNA, 23 nt, Human
gcccuaaugcgcaggcuggcccu

SEQ ID NO: 1731268 - RNA, 20 nt, Human
gcccuaaugcgcaggcuggc

SEQ ID NO: 1731269 - RNA, 19 nt, Human
gcccuaaugcgcaggcugg

SEQ ID NO: 1731270 - RNA, 17 nt, Human
gcccuaaugcgcaggcu

SEQ ID NO: 1731271 - RNA, 16 nt, Human
gcccuaaugcgcaggc

SEQ ID NO: 1731272 - RNA, 23 nt, Human
gcccgggcucugccucccaucac

SEQ ID NO: 1731273 - RNA, 23 nt, Human
gccccugccucucugcagguccc

SEQ ID NO: 1731274 - RNA, 20 nt, Human
gccccugccucucugcaggu

SEQ ID NO: 1731275 - RNA, 15 nt, Human
gccccugcucuggug

SEQ ID NO: 1731276 - RNA, 21 nt, Human
gccuucggccuccauccugag

SEQ ID NO: 1731277 - RNA, 23 nt, Human
gccuucggccuccauccugaggc

SEQ ID NO: 1731278 - RNA, 20 nt, Human
gccuucggccuccauccuga

SEQ ID NO: 1731279 - RNA, 21 nt, Human
gccuguugggccaggagccuc

SEQ ID NO: 1731280 - RNA, 21 nt, Human
gccuugaccauucuccaccug

SEQ ID NO: 1731281 - RNA, 20 nt, Human
gccuugaccauucuccaccu

SEQ ID NO: 1731282 - RNA, 19 nt, Human
gccuugaccauucuccacc

SEQ ID NO: 1731283 - RNA, 17 nt, Human
gccuugaccauucucca

SEQ ID NO: 1731284 - RNA, 15 nt, Human
gcgagcccugguggc

SEQ ID NO: 1731285 - RNA, 17 nt, Human
gcgagcccugguggcag

SEQ ID NO: 1731286 - RNA, 20 nt, Human
gcgcagcauauucaggaagc

SEQ ID NO: 1731287 - RNA, 22 nt, Human
gcgaucuggguucacugcaacc

SEQ ID NO: 1731288 - RNA, 13 nt, Human
gccuggccugagc

SEQ ID NO: 1731289 - RNA, 18 nt, Human
gccuggccugagcuggga

SEQ ID NO: 1731290 - RNA, 14 nt, Human
gccuggccugagcu

SEQ ID NO: 1731291 - RNA, 20 nt, Human
gccuggccugagcugggaug

SEQ ID NO: 1731292 - RNA, 20 nt, Human
gccuguugggccaggagccu

SEQ ID NO: 1731293 - RNA, 18 nt, Human
gccuguugggccaggagc

SEQ ID NO: 1731294 - RNA, 16 nt, Human
gccuguugggccagga

SEQ ID NO: 1731295 - RNA, 15 nt, Human
gccuguugggccagg

SEQ ID NO: 1731296 - RNA, 14 nt, Human
gccuguugggccag

SEQ ID NO: 1731297 - RNA, 23 nt, Human
gccuguucccauucuugcauggc

SEQ ID NO: 1731298 - RNA, 19 nt, Human
gccuguucccauucuugca

SEQ ID NO: 1731299 - RNA, 17 nt, Human
gccugugccucugggac

SEQ ID NO: 1731300 - RNA, 16 nt, Human
gccugugccucuggga

SEQ ID NO: 1731301 - RNA, 13 nt, Human
gccuggcucaggu

SEQ ID NO: 1731302 - RNA, 23 nt, Human
gccuggcuccaaacccucgaggc

SEQ ID NO: 1731303 - RNA, 18 nt, Human
gccugugccucugggacu

SEQ ID NO: 1731304 - RNA, 16 nt, Human
gccucuuaugggcugg

SEQ ID NO: 1731305 - RNA, 18 nt, Human
gccucuuaugggcugggu

SEQ ID NO: 1731306 - RNA, 17 nt, Human
gccucuuaugggcuggg

SEQ ID NO: 1731307 - RNA, 22 nt, Human
gccucgaacuggcugcaaaggg

SEQ ID NO: 1731308 - RNA, 20 nt, Human
gccucgaacuggcugcaaag

SEQ ID NO: 1731309 - RNA, 14 nt, Human
gccugcccaggccc

SEQ ID NO: 1731310 - RNA, 13 nt, Human
gccugcccaggcc

SEQ ID NO: 1731311 - RNA, 21 nt, Human
gccucuuaugggcuggguucu

SEQ ID NO: 1731312 - RNA, 14 nt, Human
gccucuuggguuca

SEQ ID NO: 1731313 - RNA, 12 nt, Human
gccuccauccug

SEQ ID NO: 1731314 - RNA, 17 nt, Human
gccucccaaagugcugg

SEQ ID NO: 1731315 - RNA, 16 nt, Human
gccucccaaagugcug

SEQ ID NO: 1731316 - RNA, 23 nt, Human
gccuccugugugugcgccuacag

SEQ ID NO: 1731317 - RNA, 19 nt, Human
gccuccugugugugcgccu

SEQ ID NO: 1731318 - RNA, 17 nt, Human
gccucgaacuggcugca

SEQ ID NO: 1731319 - RNA, 17 nt, Human
gccugcccaggccccug

SEQ ID NO: 1731320 - RNA, 15 nt, Human
gccugcccaggcccc

SEQ ID NO: 1731321 - RNA, 22 nt, Human
gccugcccaggccccugccacc

SEQ ID NO: 1731322 - RNA, 20 nt, Human
gcuauucaguaauaacucua

SEQ ID NO: 1731323 - RNA, 14 nt, Human
gcucacugcagccu

SEQ ID NO: 1731324 - RNA, 13 nt, Human
gcucacugcagcc

SEQ ID NO: 1731325 - RNA, 12 nt, Human
gcucacugcagc

SEQ ID NO: 1731326 - RNA, 11 nt, Human
gcucacugcag

SEQ ID NO: 1731327 - RNA, 16 nt, Human
gcucacugcagccuca

SEQ ID NO: 1731328 - RNA, 15 nt, Human
gcucacugcagccuc

SEQ ID NO: 1731329 - RNA, 17 nt, Human
gcucacugcagccucaa

SEQ ID NO: 1731330 - RNA, 16 nt, Human
gcucacugcauccucc

SEQ ID NO: 1731331 - RNA, 17 nt, Human
gcucaggugucccugca

SEQ ID NO: 1731332 - RNA, 16 nt, Human
gcucaggugucccugc

SEQ ID NO: 1731333 - RNA, 14 nt, Human
gcucaggugucccu

SEQ ID NO: 1731334 - RNA, 23 nt, Human
gcucagguggggucacucuggca

SEQ ID NO: 1731335 - RNA, 13 nt, Human
gcucagagagggu

SEQ ID NO: 1731336 - RNA, 20 nt, Human
gcucacugcauccuccgccu

SEQ ID NO: 1731337 - RNA, 14 nt, Human
gcucagagagggug

SEQ ID NO: 1731338 - RNA, 16 nt, Human
gcuaggccuggccaga

SEQ ID NO: 1731339 - RNA, 23 nt, Human
gcuaggccuggccagaugcacca

SEQ ID NO: 1731340 - RNA, 17 nt, Human
gcuaggccuggccagau

SEQ ID NO: 1731341 - RNA, 22 nt, Human
gcuagugugguguuuccuggca

SEQ ID NO: 1731342 - RNA, 21 nt, Human
gcuagugugguguuuccuggc

SEQ ID NO: 1731343 - RNA, 12 nt, Human
gcuaugcauuug

SEQ ID NO: 1731344 - RNA, 19 nt, Human
gcuauucaguaauaacucu

SEQ ID NO: 1731345 - RNA, 13 nt, Human
gcuaugcauuuga

SEQ ID NO: 1731346 - RNA, 16 nt, Human
gcuagaacucccuuuc

SEQ ID NO: 1731347 - RNA, 18 nt, Human
gcuagaacucccuuucaa

SEQ ID NO: 1731348 - RNA, 12 nt, Human
gcuagaacuccc

SEQ ID NO: 1731349 - RNA, 13 nt, Human
gcuagaacucccu

SEQ ID NO: 1731350 - RNA, 14 nt, Human
gcuagaacucccuu

SEQ ID NO: 1731351 - RNA, 15 nt, Human
gcuagaacucccuuu

SEQ ID NO: 1731352 - RNA, 20 nt, Human
gcgggaggauguucugggac

SEQ ID NO: 1731353 - RNA, 20 nt, Human
gcgugcacacaccagagccc

SEQ ID NO: 1731354 - RNA, 22 nt, Human
gcgggaggauguucugggacac

SEQ ID NO: 1731355 - RNA, 21 nt, Human
gcgggaggauguucugggaca

SEQ ID NO: 1731356 - RNA, 23 nt, Human
gcgugcacacaccagagcccacc

SEQ ID NO: 1731357 - RNA, 18 nt, Human
gcguuucuaugacacaug

SEQ ID NO: 1731358 - RNA, 13 nt, Human
gcuaaugggacac

SEQ ID NO: 1731359 - RNA, 15 nt, Human
gcuaaugggacacua

SEQ ID NO: 1731360 - RNA, 23 nt, Human
gcuaagugauccucccaccucag

SEQ ID NO: 1731361 - RNA, 14 nt, Human
gcuaaucagcauuc

SEQ ID NO: 1731362 - RNA, 22 nt, Human
gcuaaucagcauucucacuccu

SEQ ID NO: 1731363 - RNA, 17 nt, Human
gcuaaucagcauucuca

SEQ ID NO: 1731364 - RNA, 16 nt, Human
gcuaaucagcauucuc

SEQ ID NO: 1731365 - RNA, 18 nt, Human
gcuccacuuggucuguga

SEQ ID NO: 1731366 - RNA, 19 nt, Human
gcuccacuuggucugugag

SEQ ID NO: 1731367 - RNA, 18 nt, Human
gcuccagcucaccagccc

SEQ ID NO: 1731368 - RNA, 21 nt, Human
gcuccagcucaccagccccag

SEQ ID NO: 1731369 - RNA, 20 nt, Human
gcuccagcucaccagcccca

SEQ ID NO: 1731370 - RNA, 21 nt, Human
gcucccacaggcccuuccucu

SEQ ID NO: 1731371 - RNA, 20 nt, Human
gcucccacaggcccuuccuc

SEQ ID NO: 1731372 - RNA, 17 nt, Human
gcucccacaggcccuuc

SEQ ID NO: 1731373 - RNA, 16 nt, Human
gcucccacaggcccuu

SEQ ID NO: 1731374 - RNA, 17 nt, Human
gcucccaggcauucccc

SEQ ID NO: 1731375 - RNA, 22 nt, Human
gcucccacaggcccuuccucuc

SEQ ID NO: 1731376 - RNA, 18 nt, Human
gcuccugccaccacgccc

SEQ ID NO: 1731377 - RNA, 12 nt, Human
gcuccugccacc

SEQ ID NO: 1731378 - RNA, 19 nt, Human
gcuccuggcccacugcauc

SEQ ID NO: 1731379 - RNA, 18 nt, Human
gcuccuggcccacugcau

SEQ ID NO: 1731380 - RNA, 20 nt, Human
gcuccuggcccacugcaucg

SEQ ID NO: 1731381 - RNA, 15 nt, Human
gcuccuggcccacug

SEQ ID NO: 1731382 - RNA, 14 nt, Human
gcuccuggcccacu

SEQ ID NO: 1731383 - RNA, 21 nt, Human
gcuccugccaccacgcccggc

SEQ ID NO: 1731384 - RNA, 15 nt, Human
gcuccacuuggucug

SEQ ID NO: 1731385 - RNA, 11 nt, Human
gcucugcccuu

SEQ ID NO: 1731386 - RNA, 17 nt, Human
gcucugaucauccacug

SEQ ID NO: 1731387 - RNA, 23 nt, Human
gcucugaucauccacugugccau

SEQ ID NO: 1731388 - RNA, 23 nt, Human
gcucugcaagaauugaagcagga

SEQ ID NO: 1731389 - RNA, 23 nt, Human
auuucuuccacaagagcccaggc

SEQ ID NO: 1731390 - RNA, 20 nt, Human
auuucuuccacaagagccca

SEQ ID NO: 1731391 - RNA, 20 nt, Human
auuucuugagguaaaagcau

SEQ ID NO: 1731392 - RNA, 16 nt, Human
auuugaaaauuuugau

SEQ ID NO: 1731393 - RNA, 18 nt, Human
auuugaaacacuuugcau

SEQ ID NO: 1731394 - RNA, 14 nt, Human
auuuauuuaaauuu

SEQ ID NO: 1731395 - RNA, 12 nt, Human
auuuauuuaaau

SEQ ID NO: 1731396 - RNA, 19 nt, Human
auuucccaaagcagugcau

SEQ ID NO: 1731397 - RNA, 16 nt, Human
auuuccacucaggucu

SEQ ID NO: 1731398 - RNA, 18 nt, Human
auuucccaacacaaagau

SEQ ID NO: 1731399 - RNA, 22 nt, Human
auuuccacucaggucuguuuuc

SEQ ID NO: 1731400 - RNA, 19 nt, Human
auuucccaacacaaagauu

SEQ ID NO: 1731401 - RNA, 15 nt, Human
auuugucaacaaagu

SEQ ID NO: 1731402 - RNA, 13 nt, Human
auuugucaacaaa

SEQ ID NO: 1731403 - RNA, 22 nt, Human
auuuuaaaaauacagauagaua

SEQ ID NO: 1731404 - RNA, 23 nt, Human
auuugugaaaugauggugaaagu

SEQ ID NO: 1731405 - RNA, 21 nt, Human
auuugugaagguggaaauaaa

SEQ ID NO: 1731406 - RNA, 18 nt, Human
auuugugaagguggaaau

SEQ ID NO: 1731407 - RNA, 19 nt, Human
auuggacaguaaaauccac

SEQ ID NO: 1731408 - RNA, 21 nt, Human
auugauuuccguuaaaauacc

SEQ ID NO: 1731409 - RNA, 18 nt, Human
auugguaaagaauggaag

SEQ ID NO: 1731410 - RNA, 16 nt, Human
auuggauuugucuuug

SEQ ID NO: 1731411 - RNA, 13 nt, Human
auugugggaaggg

SEQ ID NO: 1731412 - RNA, 14 nt, Human
auugugggaagggg

SEQ ID NO: 1731413 - RNA, 16 nt, Human
auugucaaagugguga

SEQ ID NO: 1731414 - RNA, 23 nt, Human
auugucaaaguggugagaggcau

SEQ ID NO: 1731415 - RNA, 14 nt, Human
auuguacaguuuuu

SEQ ID NO: 1731416 - RNA, 15 nt, Human
auuguacaguuuuua

SEQ ID NO: 1731417 - RNA, 21 nt, Human
auuguacaguuuuuauugcuu

SEQ ID NO: 1731418 - RNA, 14 nt, Human
auuuaaaagauaca

SEQ ID NO: 1731419 - RNA, 16 nt, Human
auuuaaaagauacagu

SEQ ID NO: 1731420 - RNA, 17 nt, Human
auuuaaaagauacaguu

SEQ ID NO: 1731421 - RNA, 21 nt, Human
auuguuuggggaugagaaagg

SEQ ID NO: 1731422 - RNA, 14 nt, Human
auuuucuauaauuu

SEQ ID NO: 1731423 - RNA, 15 nt, Human
auuuucuauaauuua

SEQ ID NO: 1731424 - RNA, 19 nt, Human
auuuucccuauuagagaag

SEQ ID NO: 1731425 - RNA, 16 nt, Human
auuuuccugccaggca

SEQ ID NO: 1731426 - RNA, 17 nt, Human
auuuuaauaaacacucu

SEQ ID NO: 1731427 - RNA, 16 nt, Human
auuuuaauaaacacuc

SEQ ID NO: 1731428 - RNA, 15 nt, Human
auuuuaauaaacacu

SEQ ID NO: 1731429 - RNA, 15 nt, Human
auuuugauguuuuaa

SEQ ID NO: 1731430 - RNA, 17 nt, Human
auuuugauguaaagaug

SEQ ID NO: 1731431 - RNA, 18 nt, Human
auuuugauguaaagaugu

SEQ ID NO: 1731432 - RNA, 17 nt, Human
auuuugauguuuuaagg

SEQ ID NO: 1731433 - RNA, 19 nt, Human
auuuugauccaagcugguc

SEQ ID NO: 1731434 - RNA, 19 nt, Human
auuuuccuguugucaagaa

SEQ ID NO: 1731435 - RNA, 20 nt, Human
auuuugcuaaaugugaauga

SEQ ID NO: 1731436 - RNA, 21 nt, Human
auuuugcugucccuuuuccuu

SEQ ID NO: 1731437 - RNA, 18 nt, Human
auuuugccagugggaacu

SEQ ID NO: 1731438 - RNA, 17 nt, Human
auuuuguguuuaggaac

SEQ ID NO: 1731439 - RNA, 23 nt, Human
auuuugucauauaagauucauau

SEQ ID NO: 1731440 - RNA, 12 nt, Human
auuuugucuuua

SEQ ID NO: 1731441 - RNA, 19 nt, Human
auuuugugcccccauguaa

SEQ ID NO: 1731442 - RNA, 16 nt, Human
auuuuguguaagaaau

SEQ ID NO: 1731443 - RNA, 17 nt, Human
auuuuguguaagaaaua

SEQ ID NO: 1731444 - RNA, 18 nt, Human
auuuuguguaagaaauac

SEQ ID NO: 1731445 - RNA, 20 nt, Human
auuuuguguaagaaauacag

SEQ ID NO: 1731446 - RNA, 20 nt, Human
auuuuggaaaauaaauuauu

SEQ ID NO: 1731447 - RNA, 19 nt, Human
auuuuggaaaauaaauuau

SEQ ID NO: 1731448 - RNA, 14 nt, Human
auuuuggaaaauaa

SEQ ID NO: 1731449 - RNA, 12 nt, Human
auuuugcuuugu

SEQ ID NO: 1731450 - RNA, 20 nt, Human
auuuugcuguagaagauggc

SEQ ID NO: 1731451 - RNA, 18 nt, Human
auuuugcuuugugauuuu

SEQ ID NO: 1731452 - RNA, 20 nt, Human
auuuugcuuugugauuuuug

SEQ ID NO: 1731453 - RNA, 14 nt, Human
auuuuguaauaaua

SEQ ID NO: 1731454 - RNA, 19 nt, Human
auuuuguaauaauaaagaa

SEQ ID NO: 1731455 - RNA, 22 nt, Human
auuuuguaauaauaaagaauag

SEQ ID NO: 1731456 - RNA, 20 nt, Human
auuuuguaauguaucaaaua

SEQ ID NO: 1731457 - RNA, 23 nt, Human
auuuuguaauguaucaaauacau

SEQ ID NO: 1731458 - RNA, 18 nt, Human
auuuuguauauuuguauu

SEQ ID NO: 1731459 - RNA, 22 nt, Human
auuuuugugauuuugugauuga

SEQ ID NO: 1731460 - RNA, 14 nt, Human
auuuuugucuugug

SEQ ID NO: 1731461 - RNA, 19 nt, Human
auuuuuguagagccagggu

SEQ ID NO: 1731462 - RNA, 12 nt, Human
auuuuuguaauu

SEQ ID NO: 1731463 - RNA, 13 nt, Human
auuuuuuaaaugc

SEQ ID NO: 1731464 - RNA, 14 nt, Human
auuuuuuaaaugca

SEQ ID NO: 1731465 - RNA, 18 nt, Human
auuuuuuaaauugaauuc

SEQ ID NO: 1731466 - RNA, 19 nt, Human
auuuuuuacagcugccugc

SEQ ID NO: 1731467 - RNA, 21 nt, Human
auuuuuuaagugaaaauauag

SEQ ID NO: 1731468 - RNA, 18 nt, Human
auuuuuuguuaaaugauu

SEQ ID NO: 1731469 - RNA, 21 nt, Human
auuuuguuuuugucuuaaaaa

SEQ ID NO: 1731470 - RNA, 21 nt, Human
auuuuucuuagggaaggauac

SEQ ID NO: 1731471 - RNA, 16 nt, Human
auuuuucagauauaaa

SEQ ID NO: 1731472 - RNA, 22 nt, Human
auuuuucuuagggaaggauaca

SEQ ID NO: 1731473 - RNA, 15 nt, Human
auuauauuuacaaau

SEQ ID NO: 1731474 - RNA, 14 nt, Human
auuauauuaugaag

SEQ ID NO: 1731475 - RNA, 19 nt, Human
auuauacccccugcaaagc

SEQ ID NO: 1731476 - RNA, 11 nt, Human
uuuguggaaaa

SEQ ID NO: 1731477 - RNA, 19 nt, Human
auucagacagcugccuggg

SEQ ID NO: 1731478 - RNA, 19 nt, Human
auuaucuaaaaucugcuag

SEQ ID NO: 1731479 - RNA, 14 nt, Human
auuaucuagauacu

SEQ ID NO: 1731480 - RNA, 18 nt, Human
auuaucuagauacuguau

SEQ ID NO: 1731481 - RNA, 15 nt, Human
auuauuauuuggccc

SEQ ID NO: 1731482 - RNA, 20 nt, Human
auucacauuguauucagagu

SEQ ID NO: 1731483 - RNA, 13 nt, Human
auucacauuguau

SEQ ID NO: 1731484 - RNA, 11 nt, Human
auucagacagc

SEQ ID NO: 1731485 - RNA, 13 nt, Human
auucagacagcug

SEQ ID NO: 1731486 - RNA, 12 nt, Human
auucagacagcu

SEQ ID NO: 1731487 - RNA, 17 nt, Human
auucagacagcugccug

SEQ ID NO: 1731488 - RNA, 16 nt, Human
auucagacagcugccu

SEQ ID NO: 1731489 - RNA, 15 nt, Human
auucagacagcugcc

SEQ ID NO: 1731490 - RNA, 14 nt, Human
auucagacagcugc

SEQ ID NO: 1731491 - RNA, 12 nt, Human
auucaggaagcu

SEQ ID NO: 1731492 - RNA, 22 nt, Human
auucaggaagcagcuuucccca

SEQ ID NO: 1731493 - RNA, 18 nt, Human
auucagacagcugccugg

SEQ ID NO: 1731494 - RNA, 22 nt, Human
auuccccacccugaaagcccug

SEQ ID NO: 1731495 - RNA, 23 nt, Human
auuccccgucucugguuccuccc

SEQ ID NO: 1731496 - RNA, 13 nt, Human
auucaggaagcuc

SEQ ID NO: 1731497 - RNA, 19 nt, Human
auuccagagaguggcuccu

SEQ ID NO: 1731498 - RNA, 21 nt, Human
auuccagagaguggcuccucc

SEQ ID NO: 1731499 - RNA, 19 nt, Human
auuccagagcguguaguga

SEQ ID NO: 1731500 - RNA, 14 nt, Human
auucuguuggccag

SEQ ID NO: 1731501 - RNA, 21 nt, Human
auucuguuggccagugugaca

SEQ ID NO: 1731502 - RNA, 19 nt, Human
auucuguuggccaguguga

SEQ ID NO: 1731503 - RNA, 22 nt, Human
auucugcucacauaucugucau

SEQ ID NO: 1731504 - RNA, 21 nt, Human
auucugcucacauaucuguca

SEQ ID NO: 1731505 - RNA, 20 nt, Human
auucugcucacauaucuguc

SEQ ID NO: 1731506 - RNA, 19 nt, Human
auucugcucacauaucugu

SEQ ID NO: 1731507 - RNA, 21 nt, Human
auucugccugcccaggccccu

SEQ ID NO: 1731508 - RNA, 20 nt, Human
auucugccugcccaggcccc

SEQ ID NO: 1731509 - RNA, 18 nt, Human
auucugcucacauaucug

SEQ ID NO: 1731510 - RNA, 15 nt, Human
auucuagcuuugagc

SEQ ID NO: 1731511 - RNA, 21 nt, Human
auucucaugccucagccuccu

SEQ ID NO: 1731512 - RNA, 17 nt, Human
auucucauuugucacac

SEQ ID NO: 1731513 - RNA, 22 nt, Human
auucucaugccucagccuccug

SEQ ID NO: 1731514 - RNA, 19 nt, Human
auucugccugcccaggccc

SEQ ID NO: 1731515 - RNA, 18 nt, Human
auucugccugcccaggcc

SEQ ID NO: 1731516 - RNA, 17 nt, Human
auucugccugcccaggc

SEQ ID NO: 1731517 - RNA, 16 nt, Human
auucugccugcccagg

SEQ ID NO: 1731518 - RNA, 15 nt, Human
auucugccugcccag

SEQ ID NO: 1731519 - RNA, 14 nt, Human
auucugccugccca

SEQ ID NO: 1731520 - RNA, 13 nt, Human
auucugccugccc

SEQ ID NO: 1731521 - RNA, 11 nt, Human
auucugccugc

SEQ ID NO: 1731522 - RNA, 15 nt, Human
auugacacuuaaaaa

SEQ ID NO: 1731523 - RNA, 17 nt, Human
auugacacuuaaaaaug

SEQ ID NO: 1731524 - RNA, 19 nt, Human
auugacacuuaaaaauggu

SEQ ID NO: 1731525 - RNA, 18 nt, Human
auugacacaguaccauuu

SEQ ID NO: 1731526 - RNA, 11 nt, Human
auugacuucuu

SEQ ID NO: 1731527 - RNA, 14 nt, Human
auucuuaaauaugu

SEQ ID NO: 1731528 - RNA, 13 nt, Human
auucuuccucccu

SEQ ID NO: 1731529 - RNA, 18 nt, Human
auugaaaucuuuuugcuu

SEQ ID NO: 1731530 - RNA, 17 nt, Human
auugaaaucuuuuugcu

SEQ ID NO: 1731531 - RNA, 20 nt, Human
auugaaaucuuuuugcuuug

SEQ ID NO: 1731532 - RNA, 15 nt, Human
auugaaaaaccauuu

SEQ ID NO: 1731533 - RNA, 20 nt, Human
augggcuggguucuacccag

SEQ ID NO: 1731534 - RNA, 18 nt, Human
augggccuccugugugug

SEQ ID NO: 1731535 - RNA, 24 nt, Human
auggggcugcaccggcuggccugg

SEQ ID NO: 1731536 - RNA, 14 nt, Human
augggggugcauuu

SEQ ID NO: 1731537 - RNA, 17 nt, Human
augggggcacugaggac

SEQ ID NO: 1731538 - RNA, 15 nt, Human
augggggugcauuug

SEQ ID NO: 1731539 - RNA, 14 nt, Human
uuucugcagaaaca

SEQ ID NO: 1731540 - RNA, 19 nt, Human
uuucugcagccacuauugu

SEQ ID NO: 1731541 - RNA, 15 nt, Human
uuucuggcuaugcau

SEQ ID NO: 1731542 - RNA, 16 nt, Human
uuucuggcuaugcauu

SEQ ID NO: 1731543 - RNA, 18 nt, Human
uuucuggcuaugcauuug

SEQ ID NO: 1731544 - RNA, 19 nt, Human
uuucuggcuaugcauuuga

SEQ ID NO: 1731545 - RNA, 15 nt, Human
augggauccuggagu

SEQ ID NO: 1731546 - RNA, 18 nt, Human
augggcaacccccagccu

SEQ ID NO: 1731547 - RNA, 21 nt, Human
uuucugcagccacuauuguua

SEQ ID NO: 1731548 - RNA, 23 nt, Human
uuucugggcaccggggccucgga

SEQ ID NO: 1731549 - RNA, 17 nt, Human
auggugcaaugaccuuu

SEQ ID NO: 1731550 - RNA, 16 nt, Human
auggugcaaugaccuu

SEQ ID NO: 1731551 - RNA, 19 nt, Human
auggugcaaugaccuuuca

SEQ ID NO: 1731552 - RNA, 15 nt, Human
auggugcaaugaccu

SEQ ID NO: 1731553 - RNA, 13 nt, Human
auggugcaaugac

SEQ ID NO: 1731554 - RNA, 12 nt, Human
auggugcaauga

SEQ ID NO: 1731555 - RNA, 20 nt, Human
auggugagggauacccaucc

SEQ ID NO: 1731556 - RNA, 15 nt, Human
augggugcuuggagg

SEQ ID NO: 1731557 - RNA, 14 nt, Human
auggugaugaaaug

SEQ ID NO: 1731558 - RNA, 17 nt, Human
auggugaugaaauguaa

SEQ ID NO: 1731559 - RNA, 16 nt, Human
auggugaugaaaugua

SEQ ID NO: 1731560 - RNA, 17 nt, Human
augguggcuggguugga

SEQ ID NO: 1731561 - RNA, 15 nt, Human
augguggcuggguug

SEQ ID NO: 1731562 - RNA, 13 nt, Human
augguggcugggu

SEQ ID NO: 1731563 - RNA, 12 nt, Human
augguggcuggg

SEQ ID NO: 1731564 - RNA, 17 nt, Human
auguaaaagacuuuuuu

SEQ ID NO: 1731565 - RNA, 20 nt, Human
augguuccccuguucacucu

SEQ ID NO: 1731566 - RNA, 19 nt, Human
augguuccccuguucacuc

SEQ ID NO: 1731567 - RNA, 13 nt, Human
augguuguacaua

SEQ ID NO: 1731568 - RNA, 15 nt, Human
augguuuucaaaaua

SEQ ID NO: 1731569 - RNA, 14 nt, Human
augguuuucaaaau

SEQ ID NO: 1731570 - RNA, 14 nt, Human
augguuuucuugug

SEQ ID NO: 1731571 - RNA, 16 nt, Human
augguuuucaaaauaa

SEQ ID NO: 1731572 - RNA, 17 nt, Human
auguagaggagaaacug

SEQ ID NO: 1731573 - RNA, 19 nt, Human
auguagaggagaaacugga

SEQ ID NO: 1731574 - RNA, 12 nt, Human
auguagaggaga

SEQ ID NO: 1731575 - RNA, 13 nt, Human
auguagaggagaa

SEQ ID NO: 1731576 - RNA, 12 nt, Human
uuugaccucugc

SEQ ID NO: 1731577 - RNA, 19 nt, Human
auguagccccucuccugga

SEQ ID NO: 1731578 - RNA, 15 nt, Human
uuugccguuauuaaa

SEQ ID NO: 1731579 - RNA, 22 nt, Human
uuugauucagacagcugccugg

SEQ ID NO: 1731580 - RNA, 13 nt, Human
uuugccucugccu

SEQ ID NO: 1731581 - RNA, 22 nt, Human
uuugauguucuuucacccuuuu

SEQ ID NO: 1731582 - RNA, 13 nt, Human
uuugauuaaauuc

SEQ ID NO: 1731583 - RNA, 18 nt, Human
uuugauuaaauucuugca

SEQ ID NO: 1731584 - RNA, 21 nt, Human
uuugauuaaauucuugcaaag

SEQ ID NO: 1731585 - RNA, 21 nt, Human
uuugauucagacagcugccug

SEQ ID NO: 1731586 - RNA, 23 nt, Human
uuugauuaaauucuugcaaagua

SEQ ID NO: 1731587 - RNA, 19 nt, Human
uuugacgccaucccagccc

SEQ ID NO: 1731588 - RNA, 16 nt, Human
uuugacgccaucccag

SEQ ID NO: 1731589 - RNA, 14 nt, Human
uuugacgccauccc

SEQ ID NO: 1731590 - RNA, 13 nt, Human
uuugacgccaucc

SEQ ID NO: 1731591 - RNA, 20 nt, Human
uuugacgccaucccagcccc

SEQ ID NO: 1731592 - RNA, 20 nt, Human
uuugauguaaagauguucug

SEQ ID NO: 1731593 - RNA, 15 nt, Human
augucgccucugcau

SEQ ID NO: 1731594 - RNA, 22 nt, Human
augucucaggucccugcagggc

SEQ ID NO: 1731595 - RNA, 17 nt, Human
augucucaggucccugc

SEQ ID NO: 1731596 - RNA, 14 nt, Human
augucgccucugca

SEQ ID NO: 1731597 - RNA, 13 nt, Human
augucgccucugc

SEQ ID NO: 1731598 - RNA, 15 nt, Human
augucucgugguagg

SEQ ID NO: 1731599 - RNA, 16 nt, Human
augucucgugguagga

SEQ ID NO: 1731600 - RNA, 17 nt, Human
augucucugagcauuag

SEQ ID NO: 1731601 - RNA, 19 nt, Human
augucucgugguaggacug

SEQ ID NO: 1731602 - RNA, 17 nt, Human
auguccacugguucuuc

SEQ ID NO: 1731603 - RNA, 13 nt, Human
augucagugugac

SEQ ID NO: 1731604 - RNA, 12 nt, Human
augucaguguga

SEQ ID NO: 1731605 - RNA, 18 nt, Human
auguaugagguacaaccu

SEQ ID NO: 1731606 - RNA, 19 nt, Human
auguaugaggaauuucugu

SEQ ID NO: 1731607 - RNA, 15 nt, Human
auguauguguaagua

SEQ ID NO: 1731608 - RNA, 16 nt, Human
auguauguguaaguau

SEQ ID NO: 1731609 - RNA, 20 nt, Human
uuugugaagguggaaauaaa

SEQ ID NO: 1731610 - RNA, 22 nt, Human
uuugugaaaugauggugaaagu

SEQ ID NO: 1731611 - RNA, 21 nt, Human
uuugucuuguguuucuuuagu

SEQ ID NO: 1731612 - RNA, 19 nt, Human
uuugucuuuggugaacauu

SEQ ID NO: 1731613 - RNA, 12 nt, Human
uuuguauaaaag

SEQ ID NO: 1731614 - RNA, 14 nt, Human
uuuguaaugaaaac

SEQ ID NO: 1731615 - RNA, 13 nt, Human
uuuguaaugaaaa

SEQ ID NO: 1731616 - RNA, 21 nt, Human
uuuguaauaauaaagaauagc

SEQ ID NO: 1731617 - RNA, 23 nt, Human
augugcacaugcacgugugugca

SEQ ID NO: 1731618 - RNA, 19 nt, Human
uuuguaauaauaaagaaua

SEQ ID NO: 1731619 - RNA, 19 nt, Human
augugaugagaggaaauca

SEQ ID NO: 1731620 - RNA, 17 nt, Human
augugaugagaggaaau

SEQ ID NO: 1731621 - RNA, 16 nt, Human
augugaugagaggaaa

SEQ ID NO: 1731622 - RNA, 23 nt, Human
augucucuuuaaugucacaggca

SEQ ID NO: 1731623 - RNA, 18 nt, Human
uuuaaauauaugcuaagu

SEQ ID NO: 1731624 - RNA, 12 nt, Human
uuuaauucaguu

SEQ ID NO: 1731625 - RNA, 18 nt, Human
augcagccucacaguccu

SEQ ID NO: 1731626 - RNA, 17 nt, Human
augcagcaucuaaguaa

SEQ ID NO: 1731627 - RNA, 16 nt, Human
uuuaauuugaaauaug

SEQ ID NO: 1731628 - RNA, 19 nt, Human
uuuaauuuuuuugagacag

SEQ ID NO: 1731629 - RNA, 23 nt, Human
augcagugguaugaucacggcuc

SEQ ID NO: 1731630 - RNA, 13 nt, Human
augcagugcuucc

SEQ ID NO: 1731631 - RNA, 20 nt, Human
augcgugcauaccacuuuug

SEQ ID NO: 1731632 - RNA, 15 nt, Human
augcccagccccuuc

SEQ ID NO: 1731633 - RNA, 14 nt, Human
augcccagccccuu

SEQ ID NO: 1731634 - RNA, 13 nt, Human
augcccagccccu

SEQ ID NO: 1731635 - RNA, 12 nt, Human
augcccagcccc

SEQ ID NO: 1731636 - RNA, 16 nt, Human
augccucagccuccug

SEQ ID NO: 1731637 - RNA, 14 nt, Human
augcccuggaucca

SEQ ID NO: 1731638 - RNA, 13 nt, Human
uuguguucaccuu

SEQ ID NO: 1731639 - RNA, 21 nt, Human
uuguuccacaaguuaaauaaa

SEQ ID NO: 1731640 - RNA, 13 nt, Human
uuguguuacuaag

SEQ ID NO: 1731641 - RNA, 15 nt, Human
uuguguuacuaaguu

SEQ ID NO: 1731642 - RNA, 20 nt, Human
uuguguuacuaaguuuuuau

SEQ ID NO: 1731643 - RNA, 20 nt, Human
augaucuaggaagacuuugg

SEQ ID NO: 1731644 - RNA, 17 nt, Human
augaucuaggaagacuu

SEQ ID NO: 1731645 - RNA, 17 nt, Human
augauaugcuuguaacu

SEQ ID NO: 1731646 - RNA, 23 nt, Human
augauaugcuuguaacuaaaaua

SEQ ID NO: 1731647 - RNA, 21 nt, Human
augauacuugaaaauuaacau

SEQ ID NO: 1731648 - RNA, 17 nt, Human
augauacuugaaaauua

SEQ ID NO: 1731649 - RNA, 13 nt, Human
uuuaaagaaugcu

SEQ ID NO: 1731650 - RNA, 22 nt, Human
augcaccagcccuuagcaggga

SEQ ID NO: 1731651 - RNA, 13 nt, Human
augcaccuggaau

SEQ ID NO: 1731652 - RNA, 20 nt, Human
augcacuuuguucuggcucu

SEQ ID NO: 1731653 - RNA, 19 nt, Human
augcacuuuguucuggcuc

SEQ ID NO: 1731654 - RNA, 17 nt, Human
augcacuuuguucuggc

SEQ ID NO: 1731655 - RNA, 15 nt, Human
augcaaccauuugaa

SEQ ID NO: 1731656 - RNA, 16 nt, Human
augcuaagacucagug

SEQ ID NO: 1731657 - RNA, 18 nt, Human
uuuaucaugugaaaucau

SEQ ID NO: 1731658 - RNA, 17 nt, Human
uuuaucaugugaaauca

SEQ ID NO: 1731659 - RNA, 20 nt, Human
augcuagaacucccuuucaa

SEQ ID NO: 1731660 - RNA, 21 nt, Human
augcuagaacucccuuucaac

SEQ ID NO: 1731661 - RNA, 22 nt, Human
augcuagaacucccuuucaaca

SEQ ID NO: 1731662 - RNA, 20 nt, Human
uuuauuuuguguuuaggaac

SEQ ID NO: 1731663 - RNA, 16 nt, Human
uuuauuuuguguuuag

SEQ ID NO: 1731664 - RNA, 22 nt, Human
uuucaaaauuguuacaaauugu

SEQ ID NO: 1731665 - RNA, 16 nt, Human
uuucaaacuuuacuau

SEQ ID NO: 1731666 - RNA, 22 nt, Human
uuucaaacuuuacuauggcccu

SEQ ID NO: 1731667 - RNA, 13 nt, Human
augcuucucacug

SEQ ID NO: 1731668 - RNA, 22 nt, Human
augcugugcccuaaaguguauu

SEQ ID NO: 1731669 - RNA, 18 nt, Human
uuuccaugaguccccugu

SEQ ID NO: 1731670 - RNA, 17 nt, Human
uuuccaugaguccccug

SEQ ID NO: 1731671 - RNA, 12 nt, Human
auggacuuuguu

SEQ ID NO: 1731672 - RNA, 11 nt, Human
auggacuuugu

SEQ ID NO: 1731673 - RNA, 19 nt, Human
auggacuaacuugucuuug

SEQ ID NO: 1731674 - RNA, 19 nt, Human
augggagagaagagaaugc

SEQ ID NO: 1731675 - RNA, 15 nt, Human
augggagagaagaga

SEQ ID NO: 1731676 - RNA, 19 nt, Human
auggcuaagcaaaauguga

SEQ ID NO: 1731677 - RNA, 18 nt, Human
auggcuaauguacugcau

SEQ ID NO: 1731678 - RNA, 18 nt, Human
auggagacugucucaaga

SEQ ID NO: 1731679 - RNA, 20 nt, Human
aucauuuuaccuuugacaaa

SEQ ID NO: 1731680 - RNA, 16 nt, Human
auccaguaucuugaag

SEQ ID NO: 1731681 - RNA, 16 nt, Human
auccacccaccucagc

SEQ ID NO: 1731682 - RNA, 15 nt, Human
auccacccaccucag

SEQ ID NO: 1731683 - RNA, 13 nt, Human
auccacccaccuc

SEQ ID NO: 1731684 - RNA, 21 nt, Human
auccaagcuggucccacucag

SEQ ID NO: 1731685 - RNA, 18 nt, Human
auccaagcuggucccacu

SEQ ID NO: 1731686 - RNA, 13 nt, Human
auccaucaggcca

SEQ ID NO: 1731687 - RNA, 21 nt, Human
auccaguaucuugaagacuuu

SEQ ID NO: 1731688 - RNA, 20 nt, Human
aucccaaacccuucagugcc

SEQ ID NO: 1731689 - RNA, 19 nt, Human
aucccaaacccuucagugc

SEQ ID NO: 1731690 - RNA, 18 nt, Human
aucccauaugccugggca

SEQ ID NO: 1731691 - RNA, 17 nt, Human
uucuccuuucacaaccu

SEQ ID NO: 1731692 - RNA, 15 nt, Human
uucucuaguuugauu

SEQ ID NO: 1731693 - RNA, 17 nt, Human
uucucuaguuugauuaa

SEQ ID NO: 1731694 - RNA, 20 nt, Human
uucucuaguuugauuaaauu

SEQ ID NO: 1731695 - RNA, 21 nt, Human
uucuccuuguguuacuaaguu

SEQ ID NO: 1731696 - RNA, 14 nt, Human
aucaggugcugcca

SEQ ID NO: 1731697 - RNA, 18 nt, Human
aucaguagccagcaucug

SEQ ID NO: 1731698 - RNA, 17 nt, Human
uucuggcucuuccaggc

SEQ ID NO: 1731699 - RNA, 16 nt, Human
uucuggcucuuccagg

SEQ ID NO: 1731700 - RNA, 18 nt, Human
uucugccugcccaggccc

SEQ ID NO: 1731701 - RNA, 17 nt, Human
uucugccugcccaggcc

SEQ ID NO: 1731702 - RNA, 21 nt, Human
uucugccugcccaggccccug

SEQ ID NO: 1731703 - RNA, 22 nt, Human
uucugaacuuggcgcugccccu

SEQ ID NO: 1731704 - RNA, 19 nt, Human
uucugaacuuggcgcugcc

SEQ ID NO: 1731705 - RNA, 15 nt, Human
uucugccauauucug

SEQ ID NO: 1731706 - RNA, 23 nt, Human
uucugaacuuggcgcugccccug

SEQ ID NO: 1731707 - RNA, 17 nt, Human
uugaaauuguauuacaa

SEQ ID NO: 1731708 - RNA, 19 nt, Human
uugaacccgggaggcagag

SEQ ID NO: 1731709 - RNA, 12 nt, Human
auccuaagcuau

SEQ ID NO: 1731710 - RNA, 21 nt, Human
auccuaagcuauucaguaaua

SEQ ID NO: 1731711 - RNA, 19 nt, Human
auccuacaagacacaguga

SEQ ID NO: 1731712 - RNA, 18 nt, Human
auccuacaagacacagug

SEQ ID NO: 1731713 - RNA, 16 nt, Human
auccuaggcauuugcu

SEQ ID NO: 1731714 - RNA, 16 nt, Human
auccuccucagaucuu

SEQ ID NO: 1731715 - RNA, 23 nt, Human
aucccucauccucauacccaccc

SEQ ID NO: 1731716 - RNA, 21 nt, Human
aucccucauccucauacccac

SEQ ID NO: 1731717 - RNA, 14 nt, Human
aucccucauccuca

SEQ ID NO: 1731718 - RNA, 13 nt, Human
aucccaugagccu

SEQ ID NO: 1731719 - RNA, 24 nt, Human
aucccauaugccugggcagaagga

SEQ ID NO: 1731720 - RNA, 13 nt, Human
uucuucucccuca

SEQ ID NO: 1731721 - RNA, 21 nt, Human
uucuuaagacgugauuuugcu

SEQ ID NO: 1731722 - RNA, 23 nt, Human
uucuuaagacgugauuuugcugu

SEQ ID NO: 1731723 - RNA, 15 nt, Human
uucuucugcuucagc

SEQ ID NO: 1731724 - RNA, 13 nt, Human
uucuucugcuuca

SEQ ID NO: 1731725 - RNA, 14 nt, Human
uucuucucccucag

SEQ ID NO: 1731726 - RNA, 20 nt, Human
uucuucugcuucagccuccc

SEQ ID NO: 1731727 - RNA, 17 nt, Human
uucuucuuuuugcuuca

SEQ ID NO: 1731728 - RNA, 21 nt, Human
uucuucuuuuugcuucaaaaa

SEQ ID NO: 1731729 - RNA, 16 nt, Human
uucuuuguaaugaaaa

SEQ ID NO: 1731730 - RNA, 15 nt, Human
uucuuuguaaugaaa

SEQ ID NO: 1731731 - RNA, 14 nt, Human
uucuuuuuuuguga

SEQ ID NO: 1731732 - RNA, 19 nt, Human
uuccguagguuauuuucag

SEQ ID NO: 1731733 - RNA, 14 nt, Human
uuccguuaaaauac

SEQ ID NO: 1731734 - RNA, 16 nt, Human
uuccguuaaaauacca

SEQ ID NO: 1731735 - RNA, 20 nt, Human
uucccucaccuuucccaucu

SEQ ID NO: 1731736 - RNA, 23 nt, Human
uucccguggaacguuuuuccugu

SEQ ID NO: 1731737 - RNA, 15 nt, Human
uucccuauuagagaa

SEQ ID NO: 1731738 - RNA, 22 nt, Human
uucccgcucagcccucccugcc

SEQ ID NO: 1731739 - RNA, 21 nt, Human
uucccgcucagcccucccugc

SEQ ID NO: 1731740 - RNA, 18 nt, Human
uucccgcucagcccuccc

SEQ ID NO: 1731741 - RNA, 16 nt, Human
uucccgcucagcccuc

SEQ ID NO: 1731742 - RNA, 22 nt, Human
uuccucuuuccaucuacccucc

SEQ ID NO: 1731743 - RNA, 17 nt, Human
uuccucuuuccaucuac

SEQ ID NO: 1731744 - RNA, 13 nt, Human
uuccucuuuccau

SEQ ID NO: 1731745 - RNA, 18 nt, Human
uuccugaagaauugaaaa

SEQ ID NO: 1731746 - RNA, 14 nt, Human
uuccugaaccgaug

SEQ ID NO: 1731747 - RNA, 20 nt, Human
uuccuaaauauauuuuaaga

SEQ ID NO: 1731748 - RNA, 18 nt, Human
uuccuaauuccacagcug

SEQ ID NO: 1731749 - RNA, 17 nt, Human
uuccuaauuccacagcu

SEQ ID NO: 1731750 - RNA, 16 nt, Human
uuccuaauuccacagc

SEQ ID NO: 1731751 - RNA, 21 nt, Human
uuccucugaggcugaaauuca

SEQ ID NO: 1731752 - RNA, 17 nt, Human
uuccucugagccuuggg

SEQ ID NO: 1731753 - RNA, 14 nt, Human
uuccucugagccuu

SEQ ID NO: 1731754 - RNA, 11 nt, Human
uuccugugucu

SEQ ID NO: 1731755 - RNA, 20 nt, Human
auauuuuuuguuaaaugauu

SEQ ID NO: 1731756 - RNA, 18 nt, Human
auauuuuuuguuaaauga

SEQ ID NO: 1731757 - RNA, 14 nt, Human
aucaacagauaaau

SEQ ID NO: 1731758 - RNA, 14 nt, Human
aucaaugaguaaca

SEQ ID NO: 1731759 - RNA, 15 nt, Human
aucacggcucacugc

SEQ ID NO: 1731760 - RNA, 14 nt, Human
aucacgccacugca

SEQ ID NO: 1731761 - RNA, 13 nt, Human
aucacgccacugc

SEQ ID NO: 1731762 - RNA, 19 nt, Human
aucacggcucacugcagcc

SEQ ID NO: 1731763 - RNA, 18 nt, Human
aucacggcucacugcagc

SEQ ID NO: 1731764 - RNA, 20 nt, Human
aucaggccaggcccucugcc

SEQ ID NO: 1731765 - RNA, 12 nt, Human
aucagaauucuc

SEQ ID NO: 1731766 - RNA, 18 nt, Human
aucaggccaggcccucug

SEQ ID NO: 1731767 - RNA, 16 nt, Human
aucaggccaggcccuc

SEQ ID NO: 1731768 - RNA, 15 nt, Human
aucaggccaggcccu

SEQ ID NO: 1731769 - RNA, 13 nt, Human
aucagcacgauuu

SEQ ID NO: 1731770 - RNA, 11 nt, Human
aucagaauucu

SEQ ID NO: 1731771 - RNA, 18 nt, Human
aucagaaguuucucagcu

SEQ ID NO: 1731772 - RNA, 16 nt, Human
uucucacuccuaccug

SEQ ID NO: 1731773 - RNA, 18 nt, Human
uucucacuccuaccuggu

SEQ ID NO: 1731774 - RNA, 15 nt, Human
uucggccuccauccu

SEQ ID NO: 1731775 - RNA, 19 nt, Human
uucuaaaggcuaccuuugu

SEQ ID NO: 1731776 - RNA, 20 nt, Human
uucuaaaggcuaccuuugua

SEQ ID NO: 1731777 - RNA, 21 nt, Human
uucuaaaggcuaccuuuguau

SEQ ID NO: 1731778 - RNA, 21 nt, Human
uucuaaaucuccaaaauaaaa

SEQ ID NO: 1731779 - RNA, 13 nt, Human
uucuaaaguaaaa

SEQ ID NO: 1731780 - RNA, 14 nt, Human
uucggccuccaucc

SEQ ID NO: 1731781 - RNA, 19 nt, Human
uucgcuccugugucuugca

SEQ ID NO: 1731782 - RNA, 15 nt, Human
uucgcuccugugucu

SEQ ID NO: 1731783 - RNA, 23 nt, Human
uucuaagaagugaaaaucuacac

SEQ ID NO: 1731784 - RNA, 13 nt, Human
uucuaagaaguga

SEQ ID NO: 1731785 - RNA, 16 nt, Human
uucuagcauggcugcc

SEQ ID NO: 1731786 - RNA, 15 nt, Human
aucucuugagccugg

SEQ ID NO: 1731787 - RNA, 14 nt, Human
aucugaaaauguau

SEQ ID NO: 1731788 - RNA, 18 nt, Human
aucucuugagccugggag

SEQ ID NO: 1731789 - RNA, 22 nt, Human
aucugaaaauguauguguaagu

SEQ ID NO: 1731790 - RNA, 20 nt, Human
aucugaaaauguauguguaa

SEQ ID NO: 1731791 - RNA, 19 nt, Human
aucugaaaauguaugugua

SEQ ID NO: 1731792 - RNA, 16 nt, Human
aucugaaaauguaugu

SEQ ID NO: 1731793 - RNA, 21 nt, Human
aucucuucuggguuccuuccu

SEQ ID NO: 1731794 - RNA, 21 nt, Human
aucucccccagccccauccuc

SEQ ID NO: 1731795 - RNA, 17 nt, Human
aucucccccagccccau

SEQ ID NO: 1731796 - RNA, 16 nt, Human
aucucccccagcccca

SEQ ID NO: 1731797 - RNA, 15 nt, Human
aucucccccagcccc

SEQ ID NO: 1731798 - RNA, 14 nt, Human
aucuccaaaauaaa

SEQ ID NO: 1731799 - RNA, 17 nt, Human
aucuccaaaauaaaacu

SEQ ID NO: 1731800 - RNA, 20 nt, Human
aucuccaaaauaaaacuuuu

SEQ ID NO: 1731801 - RNA, 21 nt, Human
aucuccaaaauaaaacuuuuu

SEQ ID NO: 1731802 - RNA, 16 nt, Human
aucucagggccugguc

SEQ ID NO: 1731803 - RNA, 18 nt, Human
uugcaccacugcacucca

SEQ ID NO: 1731804 - RNA, 16 nt, Human
uugcaccacugcacuc

SEQ ID NO: 1731805 - RNA, 15 nt, Human
uugcaccacugcacu

SEQ ID NO: 1731806 - RNA, 19 nt, Human
uugcaauggcagccuuggc

SEQ ID NO: 1731807 - RNA, 17 nt, Human
uugcaauggcagccuug

SEQ ID NO: 1731808 - RNA, 16 nt, Human
uugcaauggcagccuu

SEQ ID NO: 1731809 - RNA, 23 nt, Human
aucugaaaauguauguguaagua

SEQ ID NO: 1731810 - RNA, 13 nt, Human
uugauuaaauucu

SEQ ID NO: 1731811 - RNA, 13 nt, Human
uugauuaaagaug

SEQ ID NO: 1731812 - RNA, 23 nt, Human
uugauguuuuaaggaugcuugua

SEQ ID NO: 1731813 - RNA, 14 nt, Human
uugauuaaauucuu

SEQ ID NO: 1731814 - RNA, 14 nt, Human
uugauuaaagauga

SEQ ID NO: 1731815 - RNA, 17 nt, Human
uugaagggaaauuucag

SEQ ID NO: 1731816 - RNA, 13 nt, Human
uugaagccuuugu

SEQ ID NO: 1731817 - RNA, 13 nt, Human
uugaaucacagua

SEQ ID NO: 1731818 - RNA, 19 nt, Human
aucuaaauggaaccacucu

SEQ ID NO: 1731819 - RNA, 17 nt, Human
aucuaaauggaaccacu

SEQ ID NO: 1731820 - RNA, 18 nt, Human
aucuaaauggaaccacuc

SEQ ID NO: 1731821 - RNA, 13 nt, Human
aucuaaauggaac

SEQ ID NO: 1731822 - RNA, 14 nt, Human
aucguucucugccu

SEQ ID NO: 1731823 - RNA, 17 nt, Human
auccucuguacagagcc

SEQ ID NO: 1731824 - RNA, 16 nt, Human
auccucuguacagagc

SEQ ID NO: 1731825 - RNA, 18 nt, Human
aucuacacuccagugaga

SEQ ID NO: 1731826 - RNA, 20 nt, Human
aucuaauauguaacaagcca

SEQ ID NO: 1731827 - RNA, 19 nt, Human
aucuacacuccagugagac

SEQ ID NO: 1731828 - RNA, 18 nt, Human
aucuaauauguaacaagc

SEQ ID NO: 1731829 - RNA, 15 nt, Human
uugauacuacaguuu

SEQ ID NO: 1731830 - RNA, 20 nt, Human
uugagugaagcugggagaac

SEQ ID NO: 1731831 - RNA, 20 nt, Human
uugaguugauucagcucugc

SEQ ID NO: 1731832 - RNA, 16 nt, Human
uugagaucagccuggg

SEQ ID NO: 1731833 - RNA, 15 nt, Human
uugagaucagccugg

SEQ ID NO: 1731834 - RNA, 16 nt, Human
uugagauguguucaca

SEQ ID NO: 1731835 - RNA, 12 nt, Human
uugagacagagu

SEQ ID NO: 1731836 - RNA, 19 nt, Human
augaaagggcccagagagg

SEQ ID NO: 1731837 - RNA, 11 nt, Human
augaagaggag

SEQ ID NO: 1731838 - RNA, 16 nt, Human
augaauauuuaguguu

SEQ ID NO: 1731839 - RNA, 18 nt, Human
augaacuuguaaaggaau

SEQ ID NO: 1731840 - RNA, 23 nt, Human
augaauggcuaagcaaaauguga

SEQ ID NO: 1731841 - RNA, 21 nt, Human
augaauauuuaguguucauaa

SEQ ID NO: 1731842 - RNA, 18 nt, Human
uuggggaccagagcugcc

SEQ ID NO: 1731843 - RNA, 11 nt, Human
uuggagacaga

SEQ ID NO: 1731844 - RNA, 14 nt, Human
uugcuugaaagaaa

SEQ ID NO: 1731845 - RNA, 18 nt, Human
uuggccccugcccggcug

SEQ ID NO: 1731846 - RNA, 16 nt, Human
uuggagggugucccaa

SEQ ID NO: 1731847 - RNA, 18 nt, Human
augaaagggcccagagag

SEQ ID NO: 1731848 - RNA, 17 nt, Human
aucuuugcagacaggca

SEQ ID NO: 1731849 - RNA, 22 nt, Human
aucuuuucauuuaggugaggaa

SEQ ID NO: 1731850 - RNA, 18 nt, Human
aucuuugcagacaggcaa

SEQ ID NO: 1731851 - RNA, 12 nt, Human
uugcuccuugac

SEQ ID NO: 1731852 - RNA, 18 nt, Human
aucugugaaaggaaagag

SEQ ID NO: 1731853 - RNA, 23 nt, Human
aucugugaaaggaaagagggagg

SEQ ID NO: 1731854 - RNA, 14 nt, Human
aucuuauaauuuaa

SEQ ID NO: 1731855 - RNA, 20 nt, Human
aucuuggucagauuugaacu

SEQ ID NO: 1731856 - RNA, 13 nt, Human
aucuugcucugcu

SEQ ID NO: 1731857 - RNA, 20 nt, Human
aucugcuagggaauaucaau

SEQ ID NO: 1731858 - RNA, 17 nt, Human
aucugugaaaggaaaga

SEQ ID NO: 1731859 - RNA, 17 nt, Human
aucuggugacuuuccuc

SEQ ID NO: 1731860 - RNA, 16 nt, Human
aucuggugacuuuccu

SEQ ID NO: 1731861 - RNA, 10 nt, Human
aucuggugac

SEQ ID NO: 1731862 - RNA, 19 nt, Human
uuaguacuccccuccuuga

SEQ ID NO: 1731863 - RNA, 13 nt, Human
uuaguagagacag

SEQ ID NO: 1731864 - RNA, 14 nt, Human
uuaguagagacagg

SEQ ID NO: 1731865 - RNA, 17 nt, Human
uuaguagagacaggguu

SEQ ID NO: 1731866 - RNA, 18 nt, Human
uuaguuuuugugaaguuu

SEQ ID NO: 1731867 - RNA, 15 nt, Human
uuauaaaaauaaaaa

SEQ ID NO: 1731868 - RNA, 21 nt, Human
uuaguuuuugugaaguuuaau

SEQ ID NO: 1731869 - RNA, 13 nt, Human
uuauaaacuuuac

SEQ ID NO: 1731870 - RNA, 22 nt, Human
uuauaaaaauaaaaaacacugg

SEQ ID NO: 1731871 - RNA, 21 nt, Human
uuauaaaaauaaaaaacacug

SEQ ID NO: 1731872 - RNA, 15 nt, Human
uuagauuaagaaaua

SEQ ID NO: 1731873 - RNA, 19 nt, Human
uuagauuaagaaauagaca

SEQ ID NO: 1731874 - RNA, 15 nt, Human
uuaggugaggaagca

SEQ ID NO: 1731875 - RNA, 19 nt, Human
uuaggugugggggaagcac

SEQ ID NO: 1731876 - RNA, 18 nt, Human
uuagguuggcaaaaaggc

SEQ ID NO: 1731877 - RNA, 13 nt, Human
uuaguaaucauau

SEQ ID NO: 1731878 - RNA, 14 nt, Human
uuaguaaucauauu

SEQ ID NO: 1731879 - RNA, 14 nt, Human
auaagccagacauc

SEQ ID NO: 1731880 - RNA, 22 nt, Human
auaagccaaaaaaugcuugcuu

SEQ ID NO: 1731881 - RNA, 21 nt, Human
auaagauucauauuuacuucu

SEQ ID NO: 1731882 - RNA, 23 nt, Human
auaauucacauuguauucagagu

SEQ ID NO: 1731883 - RNA, 20 nt, Human
auaauucaggaagcagcuuu

SEQ ID NO: 1731884 - RNA, 14 nt, Human
auaauuuuaaaugu

SEQ ID NO: 1731885 - RNA, 13 nt, Human
auaauuuuaaaug

SEQ ID NO: 1731886 - RNA, 12 nt, Human
auaauuuuaaau

SEQ ID NO: 1731887 - RNA, 18 nt, Human
uuaccagugccuuaaacu

SEQ ID NO: 1731888 - RNA, 15 nt, Human
uuacugcagcuuugu

SEQ ID NO: 1731889 - RNA, 13 nt, Human
uuacuguacauga

SEQ ID NO: 1731890 - RNA, 14 nt, Human
uuacuguacaugaa

SEQ ID NO: 1731891 - RNA, 22 nt, Human
uuacuguacaugaaaacacauu

SEQ ID NO: 1731892 - RNA, 23 nt, Human
uuacuguacaugaaaacacauuu

SEQ ID NO: 1731893 - RNA, 12 nt, Human
uuacuguacaug

SEQ ID NO: 1731894 - RNA, 23 nt, Human
uuacuguacagacagaaaaaacu

SEQ ID NO: 1731895 - RNA, 18 nt, Human
auaacuuuuuuuuaaguu

SEQ ID NO: 1731896 - RNA, 14 nt, Human
auaagauucauauu

SEQ ID NO: 1731897 - RNA, 16 nt, Human
uuagaagucacacagu

SEQ ID NO: 1731898 - RNA, 16 nt, Human
auaaauugcuccuuga

SEQ ID NO: 1731899 - RNA, 13 nt, Human
auaaauugcuccu

SEQ ID NO: 1731900 - RNA, 18 nt, Human
auaaauugcuccuugaca

SEQ ID NO: 1731901 - RNA, 15 nt, Human
auaacuauguugaua

SEQ ID NO: 1731902 - RNA, 14 nt, Human
uuacaggugugaac

SEQ ID NO: 1731903 - RNA, 20 nt, Human
uuacagggaugagccaccgc

SEQ ID NO: 1731904 - RNA, 19 nt, Human
uuaccagcagagcaccuua

SEQ ID NO: 1731905 - RNA, 15 nt, Human
uuaaucuaaauggaa

SEQ ID NO: 1731906 - RNA, 22 nt, Human
uuaagacgaaacauuuguucua

SEQ ID NO: 1731907 - RNA, 16 nt, Human
uuaauaaaaguacaug

SEQ ID NO: 1731908 - RNA, 17 nt, Human
uuaaucuuuaauuuuac

SEQ ID NO: 1731909 - RNA, 13 nt, Human
uuaaucuuuaauu

SEQ ID NO: 1731910 - RNA, 13 nt, Human
uuaauuugaaaua

SEQ ID NO: 1731911 - RNA, 15 nt, Human
uuaauuugaaauaug

SEQ ID NO: 1731912 - RNA, 18 nt, Human
uuaagacauuuuuggaag

SEQ ID NO: 1731913 - RNA, 23 nt, Human
uuaagacauuuuuggaaggggac

SEQ ID NO: 1731914 - RNA, 19 nt, Human
uuaagacgaaacauuuguu

SEQ ID NO: 1731915 - RNA, 19 nt, Human
uuaagaaaaaggaugcaca

SEQ ID NO: 1731916 - RNA, 23 nt, Human
uuaacuuuuauaaacuuuaccuu

SEQ ID NO: 1731917 - RNA, 22 nt, Human
uuaacuuuuauaaacuuuaccu

SEQ ID NO: 1731918 - RNA, 22 nt, Human
auaaaagggacugagaaauuua

SEQ ID NO: 1731919 - RNA, 20 nt, Human
auaaaagccuguuuaagaga

SEQ ID NO: 1731920 - RNA, 19 nt, Human
auaaaagccuguuuaagag

SEQ ID NO: 1731921 - RNA, 15 nt, Human
aguuuuuuuuauaca

SEQ ID NO: 1731922 - RNA, 17 nt, Human
aguuuaaauuguaauag

SEQ ID NO: 1731923 - RNA, 20 nt, Human
aguuuaaauuguaauaggcg

SEQ ID NO: 1731924 - RNA, 19 nt, Human
uuaaaaugagaaaucuaaa

SEQ ID NO: 1731925 - RNA, 12 nt, Human
uuaaaaugagaa

SEQ ID NO: 1731926 - RNA, 19 nt, Human
uuaaaaaucucaaauuucu

SEQ ID NO: 1731927 - RNA, 20 nt, Human
uuaaaaaucucaaauuucua

SEQ ID NO: 1731928 - RNA, 19 nt, Human
aguuucugccgcagcccug

SEQ ID NO: 1731929 - RNA, 22 nt, Human
aguuuguuaguaugaggcauuu

SEQ ID NO: 1731930 - RNA, 15 nt, Human
aguuuguugaaacac

SEQ ID NO: 1731931 - RNA, 14 nt, Human
aguuucucuuuuca

SEQ ID NO: 1731932 - RNA, 15 nt, Human
aguuucucagcuccc

SEQ ID NO: 1731933 - RNA, 13 nt, Human
aguuucucagcuc

SEQ ID NO: 1731934 - RNA, 15 nt, Human
aguuucugccgcagc

SEQ ID NO: 1731935 - RNA, 12 nt, Human
uuaacagaaaug

SEQ ID NO: 1731936 - RNA, 13 nt, Human
uuaacagaaaugu

SEQ ID NO: 1731937 - RNA, 14 nt, Human
uuaacagaaaugua

SEQ ID NO: 1731938 - RNA, 16 nt, Human
uuaacagaaauguaca

SEQ ID NO: 1731939 - RNA, 17 nt, Human
auacagaggcaacugca

SEQ ID NO: 1731940 - RNA, 16 nt, Human
auacagaggcaacugc

SEQ ID NO: 1731941 - RNA, 17 nt, Human
uuauaaacuuuaccuuu

SEQ ID NO: 1731942 - RNA, 18 nt, Human
uuauaaacuuuaccuuuu

SEQ ID NO: 1731943 - RNA, 16 nt, Human
uuauaaacuuuuuucu

SEQ ID NO: 1731944 - RNA, 12 nt, Human
uuauaaacuuuu

SEQ ID NO: 1731945 - RNA, 22 nt, Human
uuauaaacuuuuuucuuacugu

SEQ ID NO: 1731946 - RNA, 20 nt, Human
auacaguuacucagaauucu

SEQ ID NO: 1731947 - RNA, 23 nt, Human
auacaggaaaagcugcugacagu

SEQ ID NO: 1731948 - RNA, 23 nt, Human
auacagauagauauaugcucugc

SEQ ID NO: 1731949 - RNA, 18 nt, Human
auacaguuacucagaauu

SEQ ID NO: 1731950 - RNA, 21 nt, Human
auacaggaugaugacuaugga

SEQ ID NO: 1731951 - RNA, 13 nt, Human
auacuaaccagca

SEQ ID NO: 1731952 - RNA, 19 nt, Human
auacuaaccagcagaaaug

SEQ ID NO: 1731953 - RNA, 20 nt, Human
auacuaaccagcagaaaugc

SEQ ID NO: 1731954 - RNA, 13 nt, Human
auacguacacauu

SEQ ID NO: 1731955 - RNA, 13 nt, Human
auacgauaaauaa

SEQ ID NO: 1731956 - RNA, 14 nt, Human
auacguacacauuu

SEQ ID NO: 1731957 - RNA, 15 nt, Human
auacguacacauuuu

SEQ ID NO: 1731958 - RNA, 16 nt, Human
auacguacacauuuua

SEQ ID NO: 1731959 - RNA, 17 nt, Human
auaccacuuuuguucuu

SEQ ID NO: 1731960 - RNA, 18 nt, Human
auaccacuuuuguucuug

SEQ ID NO: 1731961 - RNA, 17 nt, Human
auaccagccaguaaaug

SEQ ID NO: 1731962 - RNA, 14 nt, Human
auaccuuuuuuaga

SEQ ID NO: 1731963 - RNA, 19 nt, Human
uuauggcuuuugugcauua

SEQ ID NO: 1731964 - RNA, 13 nt, Human
uuaugggcugggu

SEQ ID NO: 1731965 - RNA, 22 nt, Human
uuaugggcuggguucuacccag

SEQ ID NO: 1731966 - RNA, 22 nt, Human
uuaugugccagauuuaugcaua

SEQ ID NO: 1731967 - RNA, 15 nt, Human
uuaugugaaacaugu

SEQ ID NO: 1731968 - RNA, 13 nt, Human
uuaugugaaacau

SEQ ID NO: 1731969 - RNA, 11 nt, Human
uuaugacucca

SEQ ID NO: 1731970 - RNA, 22 nt, Human
uuaugauagcaaauggccucau

SEQ ID NO: 1731971 - RNA, 20 nt, Human
uuaugauacuugaaaauuaa

SEQ ID NO: 1731972 - RNA, 20 nt, Human
uuaugaagcuuuuaugugaa

SEQ ID NO: 1731973 - RNA, 17 nt, Human
uuaucacccagaagaaa

SEQ ID NO: 1731974 - RNA, 18 nt, Human
uuaucacccagaagaaaa

SEQ ID NO: 1731975 - RNA, 19 nt, Human
uuaucacccagaagaaaau

SEQ ID NO: 1731976 - RNA, 21 nt, Human
uuaucacccagaagaaaauag

SEQ ID NO: 1731977 - RNA, 16 nt, Human
auacucauuaggaugg

SEQ ID NO: 1731978 - RNA, 11 nt, Human
auacucccauc

SEQ ID NO: 1731979 - RNA, 14 nt, Human
auacucccaucugu

SEQ ID NO: 1731980 - RNA, 17 nt, Human
auacuccuccaagguua

SEQ ID NO: 1731981 - RNA, 16 nt, Human
auacucugcuuagaau

SEQ ID NO: 1731982 - RNA, 18 nt, Human
auacucuuauagacaaca

SEQ ID NO: 1731983 - RNA, 12 nt, Human
uuauucauaauu

SEQ ID NO: 1731984 - RNA, 20 nt, Human
uuauucacuuuuauuuagca

SEQ ID NO: 1731985 - RNA, 13 nt, Human
uuauuaugcauga

SEQ ID NO: 1731986 - RNA, 14 nt, Human
uuauuauauuuaca

SEQ ID NO: 1731987 - RNA, 15 nt, Human
uuauuauauuuacaa

SEQ ID NO: 1731988 - RNA, 12 nt, Human
uuauuaugcaug

SEQ ID NO: 1731989 - RNA, 16 nt, Human
auagacaauuuauuau

SEQ ID NO: 1731990 - RNA, 22 nt, Human
auagacaauuuauuauggcaca

SEQ ID NO: 1731991 - RNA, 23 nt, Human
auagacaauuuauuauggcacau

SEQ ID NO: 1731992 - RNA, 15 nt, Human
auagacagcaugaga

SEQ ID NO: 1731993 - RNA, 17 nt, Human
auagaauuaacacauga

SEQ ID NO: 1731994 - RNA, 22 nt, Human
auagaauaaaauuuuuaaucuu

SEQ ID NO: 1731995 - RNA, 19 nt, Human
auagaauaaaauuuuuaau

SEQ ID NO: 1731996 - RNA, 14 nt, Human
auagaauaaaauuu

SEQ ID NO: 1731997 - RNA, 13 nt, Human
auagaaguaaaaa

SEQ ID NO: 1731998 - RNA, 22 nt, Human
auagaaaugcugguuuuucagu

SEQ ID NO: 1731999 - RNA, 19 nt, Human
auagaaaugcugguuuuuc

SEQ ID NO: 1732000 - RNA, 13 nt, Human
auagaaaugcugg

SEQ ID NO: 1732001 - RNA, 18 nt, Human
auagacccacaagaggca

SEQ ID NO: 1732002 - RNA, 14 nt, Human
auagagagagacca

SEQ ID NO: 1732003 - RNA, 18 nt, Human
auagauaggucagugcaa

SEQ ID NO: 1732004 - RNA, 17 nt, Human
agugcagugagccgaga

SEQ ID NO: 1732005 - RNA, 16 nt, Human
agugcaugcugucccu

SEQ ID NO: 1732006 - RNA, 14 nt, Human
agugccaaaaacaa

SEQ ID NO: 1732007 - RNA, 13 nt, Human
agugaggcucugc

SEQ ID NO: 1732008 - RNA, 12 nt, Human
agugaggcucug

SEQ ID NO: 1732009 - RNA, 16 nt, Human
agugaggaugaaaaaa

SEQ ID NO: 1732010 - RNA, 21 nt, Human
ugugcugcccugcccaccugg

SEQ ID NO: 1732011 - RNA, 20 nt, Human
ugugcugcccugcccaccug

SEQ ID NO: 1732012 - RNA, 19 nt, Human
ugugcugcccugcccaccu

SEQ ID NO: 1732013 - RNA, 18 nt, Human
ugugcugcccugcccacc

SEQ ID NO: 1732014 - RNA, 19 nt, Human
uguggauuuaacagaaaug

SEQ ID NO: 1732015 - RNA, 20 nt, Human
uguggauuuaacagaaaugu

SEQ ID NO: 1732016 - RNA, 23 nt, Human
agugagcugguuuuuagcggaga

SEQ ID NO: 1732017 - RNA, 22 nt, Human
uguggauuuaacagaaauguac

SEQ ID NO: 1732018 - RNA, 14 nt, Human
uguggaugauaaaa

SEQ ID NO: 1732019 - RNA, 21 nt, Human
uguggaucaaauccagccugc

SEQ ID NO: 1732020 - RNA, 12 nt, Human
ugugcugcccug

SEQ ID NO: 1732021 - RNA, 19 nt, Human
ugugcugagucugaaggcu

SEQ ID NO: 1732022 - RNA, 18 nt, Human
ugugcugagucugaaggc

SEQ ID NO: 1732023 - RNA, 12 nt, Human
ugugcucugauc

SEQ ID NO: 1732024 - RNA, 21 nt, Human
ugugcucaggagcccugggag

SEQ ID NO: 1732025 - RNA, 18 nt, Human
agucuuucacauuuaaau

SEQ ID NO: 1732026 - RNA, 21 nt, Human
agugaacaaauuuacagagac

SEQ ID NO: 1732027 - RNA, 16 nt, Human
agucuuucacauuuaa

SEQ ID NO: 1732028 - RNA, 22 nt, Human
agugaacaaauuuacagagaca

SEQ ID NO: 1732029 - RNA, 23 nt, Human
agugaacaaauuuacagagacag

SEQ ID NO: 1732030 - RNA, 16 nt, Human
agugaacuugggccac

SEQ ID NO: 1732031 - RNA, 21 nt, Human
agugacugauggcuaauguac

SEQ ID NO: 1732032 - RNA, 12 nt, Human
agugagcugguu

SEQ ID NO: 1732033 - RNA, 19 nt, Human
ugugaugagaggaaaucac

SEQ ID NO: 1732034 - RNA, 22 nt, Human
ugugaugaugaaaugaggucag

SEQ ID NO: 1732035 - RNA, 22 nt, Human
agugagcacuaaggugugcucu

SEQ ID NO: 1732036 - RNA, 14 nt, Human
agugagcacuaagg

SEQ ID NO: 1732037 - RNA, 23 nt, Human
agucuuagauguauauauuuccu

SEQ ID NO: 1732038 - RNA, 16 nt, Human
agucuuagauguauau

SEQ ID NO: 1732039 - RNA, 14 nt, Human
agucuuagauguau

SEQ ID NO: 1732040 - RNA, 13 nt, Human
agucuuagaugua

SEQ ID NO: 1732041 - RNA, 12 nt, Human
agucugaaggcu

SEQ ID NO: 1732042 - RNA, 17 nt, Human
agucucuugauucauaa

SEQ ID NO: 1732043 - RNA, 16 nt, Human
agucucuugauucaua

SEQ ID NO: 1732044 - RNA, 21 nt, Human
agucucuucuccacuggaugg

SEQ ID NO: 1732045 - RNA, 19 nt, Human
agucucuucuccacuggau

SEQ ID NO: 1732046 - RNA, 19 nt, Human
agucucgcucuguugccca

SEQ ID NO: 1732047 - RNA, 12 nt, Human
ugugaggaagcc

SEQ ID NO: 1732048 - RNA, 11 nt, Human
ugugaggaagc

SEQ ID NO: 1732049 - RNA, 16 nt, Human
ugugacugaucucucg

SEQ ID NO: 1732050 - RNA, 19 nt, Human
ugugacuucagcucuguuu

SEQ ID NO: 1732051 - RNA, 18 nt, Human
ugugacuucagcucuguu

SEQ ID NO: 1732052 - RNA, 18 nt, Human
agugguauagaaaugcug

SEQ ID NO: 1732053 - RNA, 14 nt, Human
agugguauagaaau

SEQ ID NO: 1732054 - RNA, 15 nt, Human
agugguauagaaaug

SEQ ID NO: 1732055 - RNA, 16 nt, Human
agugguauagaaaugc

SEQ ID NO: 1732056 - RNA, 20 nt, Human
agugugacugaucucucgug

SEQ ID NO: 1732057 - RNA, 21 nt, Human
agugugccugaagucccagau

SEQ ID NO: 1732058 - RNA, 19 nt, Human
uguuccacaaguuaaauaa

SEQ ID NO: 1732059 - RNA, 22 nt, Human
agugugguguuuccuggcacug

SEQ ID NO: 1732060 - RNA, 17 nt, Human
uguuaugacuccagaau

SEQ ID NO: 1732061 - RNA, 13 nt, Human
uguuaugacucca

SEQ ID NO: 1732062 - RNA, 15 nt, Human
uguucuaagaaguga

SEQ ID NO: 1732063 - RNA, 15 nt, Human
uguugcauagaauaa

SEQ ID NO: 1732064 - RNA, 20 nt, Human
uguugcccaggcuggcgugc

SEQ ID NO: 1732065 - RNA, 23 nt, Human
uguugcccaggcuggcgugcagu

SEQ ID NO: 1732066 - RNA, 19 nt, Human
aguguuguggauuuaacag

SEQ ID NO: 1732067 - RNA, 20 nt, Human
aguguuguggauuuaacaga

SEQ ID NO: 1732068 - RNA, 13 nt, Human
aguuacucagaau

SEQ ID NO: 1732069 - RNA, 23 nt, Human
aguuacuaucaugucaaacguga

SEQ ID NO: 1732070 - RNA, 16 nt, Human
aguguuguggauuuaa

SEQ ID NO: 1732071 - RNA, 19 nt, Human
aguguguguuuuucauaaa

SEQ ID NO: 1732072 - RNA, 18 nt, Human
aguguguguuuuucauaa

SEQ ID NO: 1732073 - RNA, 16 nt, Human
agugcccuccaggaua

SEQ ID NO: 1732074 - RNA, 11 nt, Human
uguguguuuau

SEQ ID NO: 1732075 - RNA, 20 nt, Human
ugugucuugcaauggcagcc

SEQ ID NO: 1732076 - RNA, 23 nt, Human
uguguuaucacccagaagaaaau

SEQ ID NO: 1732077 - RNA, 22 nt, Human
uguguuaucacccagaagaaaa

SEQ ID NO: 1732078 - RNA, 22 nt, Human
uguuaacugagugccuuuuggu

SEQ ID NO: 1732079 - RNA, 16 nt, Human
uguuaacugagugccu

SEQ ID NO: 1732080 - RNA, 19 nt, Human
uguuacauaagauaaaugu

SEQ ID NO: 1732081 - RNA, 18 nt, Human
uguuacacuuuuuggaag

SEQ ID NO: 1732082 - RNA, 18 nt, Human
uguuacaaauuguagaag

SEQ ID NO: 1732083 - RNA, 17 nt, Human
uguuacaaauuguagaa

SEQ ID NO: 1732084 - RNA, 22 nt, Human
uguuaaguugauggugaugaaa

SEQ ID NO: 1732085 - RNA, 13 nt, Human
uguuaauaaaagu

SEQ ID NO: 1732086 - RNA, 18 nt, Human
uguuaauaaaaguacaug

SEQ ID NO: 1732087 - RNA, 19 nt, Human
uguuaauaaaaguacaugu

SEQ ID NO: 1732088 - RNA, 11 nt, Human
aguggcagcug

SEQ ID NO: 1732089 - RNA, 22 nt, Human
agugggcccaaugcacuuuguu

SEQ ID NO: 1732090 - RNA, 14 nt, Human
aguggggaggggcu

SEQ ID NO: 1732091 - RNA, 15 nt, Human
aguggggacagagca

SEQ ID NO: 1732092 - RNA, 17 nt, Human
aguggauggaaggggcu

SEQ ID NO: 1732093 - RNA, 21 nt, Human
uguacauggaauaacauguaa

SEQ ID NO: 1732094 - RNA, 23 nt, Human
aguaaaaacaaagaaauuaugug

SEQ ID NO: 1732095 - RNA, 16 nt, Human
aguaaaaacaaagaaa

SEQ ID NO: 1732096 - RNA, 21 nt, Human
aguacacuguuucaaacuuua

SEQ ID NO: 1732097 - RNA, 23 nt, Human
aguacacuguuucaaacuuuacu

SEQ ID NO: 1732098 - RNA, 22 nt, Human
uguauauauuuccuauauuguu

SEQ ID NO: 1732099 - RNA, 18 nt, Human
uguauauauuuccuauau

SEQ ID NO: 1732100 - RNA, 22 nt, Human
uguagugaaucacguaaagcua

SEQ ID NO: 1732101 - RNA, 17 nt, Human
uguaggguuauaauaau

SEQ ID NO: 1732102 - RNA, 16 nt, Human
uguaggguuauaauaa

SEQ ID NO: 1732103 - RNA, 14 nt, Human
uguacauauaagug

SEQ ID NO: 1732104 - RNA, 16 nt, Human
uguacaugaaaacaca

SEQ ID NO: 1732105 - RNA, 14 nt, Human
uguacaugaaaaca

SEQ ID NO: 1732106 - RNA, 20 nt, Human
uguaauuuuuuuaucgucac

SEQ ID NO: 1732107 - RNA, 15 nt, Human
uguaauuuuguguaa

SEQ ID NO: 1732108 - RNA, 16 nt, Human
uguaauuuuguguaag

SEQ ID NO: 1732109 - RNA, 20 nt, Human
uguaauuuuguguaagaaau

SEQ ID NO: 1732110 - RNA, 19 nt, Human
uguacauaaugcgugcaua

SEQ ID NO: 1732111 - RNA, 20 nt, Human
uguacauaaugcgugcauac

SEQ ID NO: 1732112 - RNA, 20 nt, Human
agguuggcaaaaaggcagga

SEQ ID NO: 1732113 - RNA, 19 nt, Human
agguuucucaaagaaauuu

SEQ ID NO: 1732114 - RNA, 16 nt, Human
agguuucucaaagaaa

SEQ ID NO: 1732115 - RNA, 18 nt, Human
uguaauuaaguacuaugu

SEQ ID NO: 1732116 - RNA, 21 nt, Human
uguaauuaaguacuauguauc

SEQ ID NO: 1732117 - RNA, 19 nt, Human
uguaauuaaguacuaugua

SEQ ID NO: 1732118 - RNA, 23 nt, Human
uguaauuaaguacuauguaucaa

SEQ ID NO: 1732119 - RNA, 14 nt, Human
agguugcagugagc

SEQ ID NO: 1732120 - RNA, 14 nt, Human
agguugaagcacca

SEQ ID NO: 1732121 - RNA, 12 nt, Human
aggugugcucug

SEQ ID NO: 1732122 - RNA, 22 nt, Human
aggugugagucaccaagcccag

SEQ ID NO: 1732123 - RNA, 21 nt, Human
aggugugagucaccaagccca

SEQ ID NO: 1732124 - RNA, 20 nt, Human
aggugucccugcacuugcag

SEQ ID NO: 1732125 - RNA, 16 nt, Human
aggugucccugcacuu

SEQ ID NO: 1732126 - RNA, 12 nt, Human
aggugggaggau

SEQ ID NO: 1732127 - RNA, 16 nt, Human
ugggcugcccuggugc

SEQ ID NO: 1732128 - RNA, 15 nt, Human
ugggcugcccuggug

SEQ ID NO: 1732129 - RNA, 14 nt, Human
ugggcugcccuggu

SEQ ID NO: 1732130 - RNA, 13 nt, Human
ugggcugcccugg

SEQ ID NO: 1732131 - RNA, 23 nt, Human
agucucacuguugcccaggcugg

SEQ ID NO: 1732132 - RNA, 16 nt, Human
aguccucccaucucac

SEQ ID NO: 1732133 - RNA, 14 nt, Human
aguccucccaucuc

SEQ ID NO: 1732134 - RNA, 16 nt, Human
agucccccugccccag

SEQ ID NO: 1732135 - RNA, 22 nt, Human
agucagaaguuucugccgcagc

SEQ ID NO: 1732136 - RNA, 23 nt, Human
ugucccuuacgugaguccuggca

SEQ ID NO: 1732137 - RNA, 19 nt, Human
ugucccuuacgugaguccu

SEQ ID NO: 1732138 - RNA, 14 nt, Human
ugucgccucugcau

SEQ ID NO: 1732139 - RNA, 16 nt, Human
agucccaccuuggcug

SEQ ID NO: 1732140 - RNA, 15 nt, Human
agucccaccuuggcu

SEQ ID NO: 1732141 - RNA, 20 nt, Human
agucccaccuuggcugcagg

SEQ ID NO: 1732142 - RNA, 19 nt, Human
agucccaccuuggcugcag

SEQ ID NO: 1732143 - RNA, 18 nt, Human
agucccaccuuggcugca

SEQ ID NO: 1732144 - RNA, 19 nt, Human
agucccaggcugagccuca

SEQ ID NO: 1732145 - RNA, 18 nt, Human
agucccaggcugagccuc

SEQ ID NO: 1732146 - RNA, 17 nt, Human
agucccaggcugagccu

SEQ ID NO: 1732147 - RNA, 19 nt, Human
aguauucuuauuuaaugaa

SEQ ID NO: 1732148 - RNA, 15 nt, Human
agucaccaagcccag

SEQ ID NO: 1732149 - RNA, 21 nt, Human
aguauuuuccuguugucaaga

SEQ ID NO: 1732150 - RNA, 17 nt, Human
agucaccccggccaccu

SEQ ID NO: 1732151 - RNA, 23 nt, Human
ugucccugcacuugcagacucua

SEQ ID NO: 1732152 - RNA, 22 nt, Human
ugucccugcacuugcagacucu

SEQ ID NO: 1732153 - RNA, 20 nt, Human
ugucccugcacuugcagacu

SEQ ID NO: 1732154 - RNA, 22 nt, Human
uguccaagaagcccaggaaagg

SEQ ID NO: 1732155 - RNA, 18 nt, Human
uguccaagaagcccagga

SEQ ID NO: 1732156 - RNA, 17 nt, Human
uguccaagaagcccagg

SEQ ID NO: 1732157 - RNA, 16 nt, Human
uguccaagaagcccag

SEQ ID NO: 1732158 - RNA, 22 nt, Human
ugucauuugagcagggcucagc

SEQ ID NO: 1732159 - RNA, 21 nt, Human
ugucauuugagcagggcucag

SEQ ID NO: 1732160 - RNA, 20 nt, Human
ugucauuugagcagggcuca

SEQ ID NO: 1732161 - RNA, 20 nt, Human
ugucagguggggcagcuuga

SEQ ID NO: 1732162 - RNA, 18 nt, Human
ugucagguggggcagcuu

SEQ ID NO: 1732163 - RNA, 17 nt, Human
ugucagguggggcagcu

SEQ ID NO: 1732164 - RNA, 15 nt, Human
uguccaagaagccca

SEQ ID NO: 1732165 - RNA, 14 nt, Human
uguccaagaagccc

SEQ ID NO: 1732166 - RNA, 13 nt, Human
agggaaauuucag

SEQ ID NO: 1732167 - RNA, 15 nt, Human
agggacuuggaagcu

SEQ ID NO: 1732168 - RNA, 19 nt, Human
agggacuuggaagcuccgc

SEQ ID NO: 1732169 - RNA, 18 nt, Human
agggacuuggaagcuccg

SEQ ID NO: 1732170 - RNA, 20 nt, Human
agggacuuggaagcuccgcu

SEQ ID NO: 1732171 - RNA, 16 nt, Human
ugggacuacaggugug

SEQ ID NO: 1732172 - RNA, 18 nt, Human
ugggacucaaugcacuga

SEQ ID NO: 1732173 - RNA, 13 nt, Human
ugggacuggccuc

SEQ ID NO: 1732174 - RNA, 15 nt, Human
ugggagaaaugaaaa

SEQ ID NO: 1732175 - RNA, 16 nt, Human
ugggacuggccucugc

SEQ ID NO: 1732176 - RNA, 14 nt, Human
ugggacuggccucu

SEQ ID NO: 1732177 - RNA, 18 nt, Human
ugggacuacaggcaccca

SEQ ID NO: 1732178 - RNA, 18 nt, Human
agggagcaucagugcccu

SEQ ID NO: 1732179 - RNA, 19 nt, Human
ugggaggcugagaugggag

SEQ ID NO: 1732180 - RNA, 23 nt, Human
ugggaggcucuggagcccacugu

SEQ ID NO: 1732181 - RNA, 17 nt, Human
ugggaggcucuggagcc

SEQ ID NO: 1732182 - RNA, 14 nt, Human
ugggaggcucugga

SEQ ID NO: 1732183 - RNA, 21 nt, Human
ugggaggauugcuugagcuca

SEQ ID NO: 1732184 - RNA, 18 nt, Human
ugggaggauugcuugagc

SEQ ID NO: 1732185 - RNA, 22 nt, Human
ugggaggauugcuugagcucag

SEQ ID NO: 1732186 - RNA, 22 nt, Human
ugggagaaccaaaaagaggcua

SEQ ID NO: 1732187 - RNA, 21 nt, Human
ugggagaaccaaaaagaggcu

SEQ ID NO: 1732188 - RNA, 16 nt, Human
ugggagaaaugaaaaa

SEQ ID NO: 1732189 - RNA, 16 nt, Human
ugggauuuggucaaca

SEQ ID NO: 1732190 - RNA, 17 nt, Human
ugggaggucaaggcugc

SEQ ID NO: 1732191 - RNA, 13 nt, Human
ugggcagaaggaa

SEQ ID NO: 1732192 - RNA, 20 nt, Human
ugggcagaaggaagacuuca

SEQ ID NO: 1732193 - RNA, 16 nt, Human
ugggcagaaggaagac

SEQ ID NO: 1732194 - RNA, 23 nt, Human
ugggcagaaggaagacuucaucc

SEQ ID NO: 1732195 - RNA, 15 nt, Human
ugggcucccuuccca

SEQ ID NO: 1732196 - RNA, 14 nt, Human
ugggcucccuuccc

SEQ ID NO: 1732197 - RNA, 18 nt, Human
agggcccagagagggugg

SEQ ID NO: 1732198 - RNA, 14 nt, Human
agggcccagagagg

SEQ ID NO: 1732199 - RNA, 20 nt, Human
agggcuccagacacaugucc

SEQ ID NO: 1732200 - RNA, 16 nt, Human
agggauacccauccca

SEQ ID NO: 1732201 - RNA, 17 nt, Human
agggcacugguggcccg

SEQ ID NO: 1732202 - RNA, 13 nt, Human
agggcccagagag

SEQ ID NO: 1732203 - RNA, 12 nt, Human
agggcccagaga

SEQ ID NO: 1732204 - RNA, 20 nt, Human
agggagugacagaggcagcc

SEQ ID NO: 1732205 - RNA, 20 nt, Human
agggagugaguugauagcac

SEQ ID NO: 1732206 - RNA, 23 nt, Human
agggaguccgaaagggacuugga

SEQ ID NO: 1732207 - RNA, 20 nt, Human
agggaguccgaaagggacuu

SEQ ID NO: 1732208 - RNA, 22 nt, Human
agggagggcuccagacacaugu

SEQ ID NO: 1732209 - RNA, 19 nt, Human
agggagggcuccagacaca

SEQ ID NO: 1732210 - RNA, 13 nt, Human
agggagggcucca

SEQ ID NO: 1732211 - RNA, 12 nt, Human
agggagggcucc

SEQ ID NO: 1732212 - RNA, 15 nt, Human
agggagggccugggc

SEQ ID NO: 1732213 - RNA, 13 nt, Human
agggagggccugg

SEQ ID NO: 1732214 - RNA, 18 nt, Human
ugggaaacaaaaggauaa

SEQ ID NO: 1732215 - RNA, 21 nt, Human
uggcuuuugugcauuaucuag

SEQ ID NO: 1732216 - RNA, 20 nt, Human
uggcuucacggaagagccuu

SEQ ID NO: 1732217 - RNA, 17 nt, Human
uggcuucacggaagagc

SEQ ID NO: 1732218 - RNA, 22 nt, Human
uggcuucacggaagagccuugc

SEQ ID NO: 1732219 - RNA, 16 nt, Human
uggcuuuugugcauua

SEQ ID NO: 1732220 - RNA, 20 nt, Human
ugggaacaccauaggucacc

SEQ ID NO: 1732221 - RNA, 23 nt, Human
uggcugcaaaggguaucaggugc

SEQ ID NO: 1732222 - RNA, 17 nt, Human
uggcugugccucugccu

SEQ ID NO: 1732223 - RNA, 16 nt, Human
uggcugugccucugcc

SEQ ID NO: 1732224 - RNA, 15 nt, Human
uggcugugccucugc

SEQ ID NO: 1732225 - RNA, 14 nt, Human
uggcugugccucug

SEQ ID NO: 1732226 - RNA, 14 nt, Human
uggcuucacggaag

SEQ ID NO: 1732227 - RNA, 23 nt, Human
uggcuguuggcugggggccucag

SEQ ID NO: 1732228 - RNA, 18 nt, Human
uggcuguuggcugggggc

SEQ ID NO: 1732229 - RNA, 16 nt, Human
uggcuguuggcugggg

SEQ ID NO: 1732230 - RNA, 19 nt, Human
uggcugugccucugccugu

SEQ ID NO: 1732231 - RNA, 18 nt, Human
uggcugugccucugccug

SEQ ID NO: 1732232 - RNA, 22 nt, Human
uggcugugccucugccugucuc

SEQ ID NO: 1732233 - RNA, 18 nt, Human
uggcuaagcaaaauguga

SEQ ID NO: 1732234 - RNA, 13 nt, Human
aggcuccugccac

SEQ ID NO: 1732235 - RNA, 23 nt, Human
aggcuccaggagcagccacauuc

SEQ ID NO: 1732236 - RNA, 19 nt, Human
aggcuccaggagcagccac

SEQ ID NO: 1732237 - RNA, 18 nt, Human
aggcuccaggagcagcca

SEQ ID NO: 1732238 - RNA, 17 nt, Human
aggcuccaggagcagcc

SEQ ID NO: 1732239 - RNA, 19 nt, Human
uggcuaauguacugcauau

SEQ ID NO: 1732240 - RNA, 17 nt, Human
uggcuaauguacugcau

SEQ ID NO: 1732241 - RNA, 13 nt, Human
uggcucacgccug

SEQ ID NO: 1732242 - RNA, 21 nt, Human
uggcucacugcaacuucugcc

SEQ ID NO: 1732243 - RNA, 21 nt, Human
aggcuuuuuuaucaugugaaa

SEQ ID NO: 1732244 - RNA, 18 nt, Human
aggcuuuuuuaucaugug

SEQ ID NO: 1732245 - RNA, 15 nt, Human
aggcuuuuuuaucau

SEQ ID NO: 1732246 - RNA, 22 nt, Human
aggcuuagucacugagacagcc

SEQ ID NO: 1732247 - RNA, 23 nt, Human
aggcuuagucacugagacagccc

SEQ ID NO: 1732248 - RNA, 23 nt, Human
aggcuucugguugaugccuguga

SEQ ID NO: 1732249 - RNA, 16 nt, Human
aggcugggagagccuu

SEQ ID NO: 1732250 - RNA, 19 nt, Human
aggcugggagagccuucca

SEQ ID NO: 1732251 - RNA, 21 nt, Human
aggcugggagagccuuccagg

SEQ ID NO: 1732252 - RNA, 20 nt, Human
aggcugggagagccuuccag

SEQ ID NO: 1732253 - RNA, 22 nt, Human
aggcugggagagccuuccaggg

SEQ ID NO: 1732254 - RNA, 23 nt, Human
aggcugggcucccuucccaccuc

SEQ ID NO: 1732255 - RNA, 21 nt, Human
aggcugggcucccuucccacc

SEQ ID NO: 1732256 - RNA, 14 nt, Human
aggcugggcuucag

SEQ ID NO: 1732257 - RNA, 18 nt, Human
aggcugggcucccuuccc

SEQ ID NO: 1732258 - RNA, 14 nt, Human
aggcugggcucccu

SEQ ID NO: 1732259 - RNA, 13 nt, Human
aggcugggcuccc

SEQ ID NO: 1732260 - RNA, 17 nt, Human
aggcugggggaagaagc

SEQ ID NO: 1732261 - RNA, 23 nt, Human
aggcugggcuucaguggcagcug

SEQ ID NO: 1732262 - RNA, 22 nt, Human
aggcugggcuucaguggcagcu

SEQ ID NO: 1732263 - RNA, 21 nt, Human
aggcugggcuucaguggcagc

SEQ ID NO: 1732264 - RNA, 20 nt, Human
aggcugggcuucaguggcag

SEQ ID NO: 1732265 - RNA, 19 nt, Human
aggcugggcuucaguggca

SEQ ID NO: 1732266 - RNA, 18 nt, Human
aggcugggcuucaguggc

SEQ ID NO: 1732267 - RNA, 22 nt, Human
aggcugggggaagaagcucucu

SEQ ID NO: 1732268 - RNA, 10 nt, Human
aggcuggguc

SEQ ID NO: 1732269 - RNA, 18 nt, Human
aggcugggucgcccugga

SEQ ID NO: 1732270 - RNA, 15 nt, Human
aggcugggucgcccu

SEQ ID NO: 1732271 - RNA, 17 nt, Human
aggcuggguucugaucc

SEQ ID NO: 1732272 - RNA, 14 nt, Human
aggcuggguucuga

SEQ ID NO: 1732273 - RNA, 21 nt, Human
aggcugggucgcccuggacug

SEQ ID NO: 1732274 - RNA, 20 nt, Human
aggcugggucgcccuggacu

SEQ ID NO: 1732275 - RNA, 15 nt, Human
uggacaccggaaaca

SEQ ID NO: 1732276 - RNA, 16 nt, Human
aggcaacuugggaacu

SEQ ID NO: 1732277 - RNA, 14 nt, Human
aggcaagcaccucc

SEQ ID NO: 1732278 - RNA, 14 nt, Human
uggaauuugaaaca

SEQ ID NO: 1732279 - RNA, 22 nt, Human
aggauugcuacuguccuaccca

SEQ ID NO: 1732280 - RNA, 18 nt, Human
aggaugcuuguacauaau

SEQ ID NO: 1732281 - RNA, 12 nt, Human
aggaucucuuga

SEQ ID NO: 1732282 - RNA, 15 nt, Human
aggaugcuuguacau

SEQ ID NO: 1732283 - RNA, 16 nt, Human
aggaugcuuguacaua

SEQ ID NO: 1732284 - RNA, 21 nt, Human
aggauccugagccagauuuca

SEQ ID NO: 1732285 - RNA, 12 nt, Human
aggaucagucug

SEQ ID NO: 1732286 - RNA, 12 nt, Human
ugcugcccugcc

SEQ ID NO: 1732287 - RNA, 10 nt, Human
ugcugcccug

SEQ ID NO: 1732288 - RNA, 12 nt, Human
uggaacacucug

SEQ ID NO: 1732289 - RNA, 14 nt, Human
uggaacacucugag

SEQ ID NO: 1732290 - RNA, 13 nt, Human
uggaagcuccgcu

SEQ ID NO: 1732291 - RNA, 20 nt, Human
uggaaguacuauaauuuacc

SEQ ID NO: 1732292 - RNA, 17 nt, Human
uggaaguaguggagccc

SEQ ID NO: 1732293 - RNA, 14 nt, Human
uggaaguaguggag

SEQ ID NO: 1732294 - RNA, 21 nt, Human
aggaguuugagaccaaccugg

SEQ ID NO: 1732295 - RNA, 19 nt, Human
aggaguuucguuuucaaaa

SEQ ID NO: 1732296 - RNA, 15 nt, Human
aggaggccagccuug

SEQ ID NO: 1732297 - RNA, 14 nt, Human
uggaagugcuaauu

SEQ ID NO: 1732298 - RNA, 18 nt, Human
uggaagugaaaacuuugu

SEQ ID NO: 1732299 - RNA, 19 nt, Human
uggaagugaaaacuuugua

SEQ ID NO: 1732300 - RNA, 16 nt, Human
aggcaaugcuggcugu

SEQ ID NO: 1732301 - RNA, 15 nt, Human
aggcaaugcuggcug

SEQ ID NO: 1732302 - RNA, 23 nt, Human
uggaggaaaaccaagccguggcu

SEQ ID NO: 1732303 - RNA, 21 nt, Human
uggaggaaaaccaagccgugg

SEQ ID NO: 1732304 - RNA, 24 nt, Human
uggacuuuguuaguuucuccaagc

SEQ ID NO: 1732305 - RNA, 16 nt, Human
uggagcccacuguacu

SEQ ID NO: 1732306 - RNA, 23 nt, Human
uggagcccacuguacuugcucuu

SEQ ID NO: 1732307 - RNA, 19 nt, Human
uggagcccacuguacuugc

SEQ ID NO: 1732308 - RNA, 11 nt, Human
uggacuuuguu

SEQ ID NO: 1732309 - RNA, 22 nt, Human
uggacuuuguuaguuucuccaa

SEQ ID NO: 1732310 - RNA, 22 nt, Human
aggcagccccauucugccugcc

SEQ ID NO: 1732311 - RNA, 21 nt, Human
aggcagccccauucugccugc

SEQ ID NO: 1732312 - RNA, 20 nt, Human
aggcagccccauucugccug

SEQ ID NO: 1732313 - RNA, 19 nt, Human
aggcagccccauucugccu

SEQ ID NO: 1732314 - RNA, 15 nt, Human
aggcacccaccauca

SEQ ID NO: 1732315 - RNA, 12 nt, Human
aggcaggauggc

SEQ ID NO: 1732316 - RNA, 20 nt, Human
aggcaggaguuucguuuuca

SEQ ID NO: 1732317 - RNA, 16 nt, Human
aggcagggagggccug

SEQ ID NO: 1732318 - RNA, 21 nt, Human
aggcagggucucacucugucg

SEQ ID NO: 1732319 - RNA, 20 nt, Human
aggcagggucucacucuguc

SEQ ID NO: 1732320 - RNA, 18 nt, Human
aggcagggucucacucug

SEQ ID NO: 1732321 - RNA, 19 nt, Human
aggcagggucucacucugu

SEQ ID NO: 1732322 - RNA, 14 nt, Human
aggcagguccaggg

SEQ ID NO: 1732323 - RNA, 22 nt, Human
aggcagggucucacucugucgc

SEQ ID NO: 1732324 - RNA, 21 nt, Human
aggcaggucuugaacuccugg

SEQ ID NO: 1732325 - RNA, 11 nt, Human
aggcuccacuu

SEQ ID NO: 1732326 - RNA, 17 nt, Human
aggcuccacuuggucug

SEQ ID NO: 1732327 - RNA, 21 nt, Human
aggcuccacuuggucugugag

SEQ ID NO: 1732328 - RNA, 22 nt, Human
aggcuccacuuggucugugaga

SEQ ID NO: 1732329 - RNA, 16 nt, Human
aggcuccaggagcagc

SEQ ID NO: 1732330 - RNA, 14 nt, Human
aggcuccaggagca

SEQ ID NO: 1732331 - RNA, 13 nt, Human
aggcuccaggagc

SEQ ID NO: 1732332 - RNA, 18 nt, Human
aggccuucucugaaggac

SEQ ID NO: 1732333 - RNA, 17 nt, Human
aggccuucucugaagga

SEQ ID NO: 1732334 - RNA, 14 nt, Human
aggcgccccuuccc

SEQ ID NO: 1732335 - RNA, 14 nt, Human
uggcccacugcauc

SEQ ID NO: 1732336 - RNA, 13 nt, Human
uggcccacugcau

SEQ ID NO: 1732337 - RNA, 19 nt, Human
uggcccacgcacuucggga

SEQ ID NO: 1732338 - RNA, 22 nt, Human
uggcaugggaaugaaugucagu

SEQ ID NO: 1732339 - RNA, 12 nt, Human
uggcccugcccu

SEQ ID NO: 1732340 - RNA, 19 nt, Human
uggccucugcacuccccug

SEQ ID NO: 1732341 - RNA, 20 nt, Human
uggccucugcacuccccugc

SEQ ID NO: 1732342 - RNA, 21 nt, Human
uggccucugcugauccuccca

SEQ ID NO: 1732343 - RNA, 13 nt, Human
uggcccugcccug

SEQ ID NO: 1732344 - RNA, 18 nt, Human
aggccagagacacaagcc

SEQ ID NO: 1732345 - RNA, 13 nt, Human
aggccagagacac

SEQ ID NO: 1732346 - RNA, 18 nt, Human
uggcagcucagagagggu

SEQ ID NO: 1732347 - RNA, 16 nt, Human
uggcagcucagagagg

SEQ ID NO: 1732348 - RNA, 15 nt, Human
uggcagcucagagag

SEQ ID NO: 1732349 - RNA, 14 nt, Human
uggcagcucagaga

SEQ ID NO: 1732350 - RNA, 21 nt, Human
uggcagccgugccuucagcuc

SEQ ID NO: 1732351 - RNA, 20 nt, Human
uggcagccgugccuucagcu

SEQ ID NO: 1732352 - RNA, 19 nt, Human
uggcagccgugccuucagc

SEQ ID NO: 1732353 - RNA, 18 nt, Human
uggcagccgugccuucag

SEQ ID NO: 1732354 - RNA, 18 nt, Human
aggccaugggccuccugu

SEQ ID NO: 1732355 - RNA, 23 nt, Human
aggccagagacacaagccuucgg

SEQ ID NO: 1732356 - RNA, 22 nt, Human
uggcagccgugccuucagcucu

SEQ ID NO: 1732357 - RNA, 16 nt, Human
aggcccagagggccug

SEQ ID NO: 1732358 - RNA, 15 nt, Human
aggcccagagggccu

SEQ ID NO: 1732359 - RNA, 20 nt, Human
aggccauuccccgucucugg

SEQ ID NO: 1732360 - RNA, 15 nt, Human
uggcacagggcagug

SEQ ID NO: 1732361 - RNA, 16 nt, Human
uggcacagggcagugg

SEQ ID NO: 1732362 - RNA, 17 nt, Human
uggcaccagcagccugg

SEQ ID NO: 1732363 - RNA, 16 nt, Human
uggcaccagcagccug

SEQ ID NO: 1732364 - RNA, 18 nt, Human
uggcaccagcagccugga

SEQ ID NO: 1732365 - RNA, 17 nt, Human
uggcagccgugccuuca

SEQ ID NO: 1732366 - RNA, 21 nt, Human
aggccccugccacccugggga

SEQ ID NO: 1732367 - RNA, 18 nt, Human
aggccccugccacccugg

SEQ ID NO: 1732368 - RNA, 17 nt, Human
aggccccugccacccug

SEQ ID NO: 1732369 - RNA, 15 nt, Human
aggccccugccaccc

SEQ ID NO: 1732370 - RNA, 13 nt, Human
aggccccugccac

SEQ ID NO: 1732371 - RNA, 20 nt, Human
aggcccagagggccugcaag

SEQ ID NO: 1732372 - RNA, 19 nt, Human
aggcccagagggccugcaa

SEQ ID NO: 1732373 - RNA, 16 nt, Human
aggcccggcuccaggc

SEQ ID NO: 1732374 - RNA, 15 nt, Human
aggcccggcuccagg

SEQ ID NO: 1732375 - RNA, 14 nt, Human
aggcccggcuccag

SEQ ID NO: 1732376 - RNA, 17 nt, Human
aggcccggcuccaggcu

SEQ ID NO: 1732377 - RNA, 12 nt, Human
aggccuggccag

SEQ ID NO: 1732378 - RNA, 13 nt, Human
aggccuggccaga

SEQ ID NO: 1732379 - RNA, 19 nt, Human
aggccuaauucuaugccug

SEQ ID NO: 1732380 - RNA, 22 nt, Human
aggccuaauucuaugccugucu

SEQ ID NO: 1732381 - RNA, 17 nt, Human
ugcugacuguuuucucu

SEQ ID NO: 1732382 - RNA, 18 nt, Human
ugcucugcauguuacaua

SEQ ID NO: 1732383 - RNA, 15 nt, Human
ugcucugcauguuac

SEQ ID NO: 1732384 - RNA, 22 nt, Human
ugcucugaucauccacugugcc

SEQ ID NO: 1732385 - RNA, 19 nt, Human
ugcucugaugaagaggagu

SEQ ID NO: 1732386 - RNA, 18 nt, Human
ugcucugaugaagaggag

SEQ ID NO: 1732387 - RNA, 23 nt, Human
aggaaaggcuccaggagcagcca

SEQ ID NO: 1732388 - RNA, 22 nt, Human
aggaaaggcuccaggagcagcc

SEQ ID NO: 1732389 - RNA, 20 nt, Human
aggaaaggcuccaggagcag

SEQ ID NO: 1732390 - RNA, 18 nt, Human
aggaaaggcuccaggagc

SEQ ID NO: 1732391 - RNA, 22 nt, Human
ugcugagucccaggcugagccu

SEQ ID NO: 1732392 - RNA, 18 nt, Human
ugcugagucccaggcuga

SEQ ID NO: 1732393 - RNA, 15 nt, Human
ugcugagucccaggc

SEQ ID NO: 1732394 - RNA, 24 nt, Human
ugcugacuguuuucucuugagagg

SEQ ID NO: 1732395 - RNA, 21 nt, Human
ugcugacuguuuucucuugag

SEQ ID NO: 1732396 - RNA, 19 nt, Human
aggaauugacccacaagaa

SEQ ID NO: 1732397 - RNA, 23 nt, Human
aggaauccagacccggcugcgug

SEQ ID NO: 1732398 - RNA, 15 nt, Human
aggaagacuuuggaa

SEQ ID NO: 1732399 - RNA, 14 nt, Human
aggaagagaaaaaa

SEQ ID NO: 1732400 - RNA, 22 nt, Human
aggaagcucagggccuggcuca

SEQ ID NO: 1732401 - RNA, 18 nt, Human
aggaagcucagggccugg

SEQ ID NO: 1732402 - RNA, 17 nt, Human
aggaagcucagggccug

SEQ ID NO: 1732403 - RNA, 15 nt, Human
ugcugccauccaggu

SEQ ID NO: 1732404 - RNA, 14 nt, Human
ugcugccauccagg

SEQ ID NO: 1732405 - RNA, 13 nt, Human
ugcugccauccag

SEQ ID NO: 1732406 - RNA, 12 nt, Human
ugcugccaucca

SEQ ID NO: 1732407 - RNA, 22 nt, Human
ugcugccauccagguucagcuu

SEQ ID NO: 1732408 - RNA, 21 nt, Human
ugcugccauccagguucagcu

SEQ ID NO: 1732409 - RNA, 16 nt, Human
ugcugcccagccucca

SEQ ID NO: 1732410 - RNA, 14 nt, Human
ugcugcccagccuc

SEQ ID NO: 1732411 - RNA, 11 nt, Human
ugcugccaucc

SEQ ID NO: 1732412 - RNA, 22 nt, Human
ugcugccacacuucaggcucuu

SEQ ID NO: 1732413 - RNA, 19 nt, Human
ugcugccacacuucaggcu

SEQ ID NO: 1732414 - RNA, 16 nt, Human
ugcugccacacuucag

SEQ ID NO: 1732415 - RNA, 15 nt, Human
ugcugccacacuuca

SEQ ID NO: 1732416 - RNA, 22 nt, Human
aggaauuuuauuuuuuucugaa

SEQ ID NO: 1732417 - RNA, 21 nt, Human
agcuuguaaauagcucaggug

SEQ ID NO: 1732418 - RNA, 20 nt, Human
agcuuguaaauagcucaggu

SEQ ID NO: 1732419 - RNA, 19 nt, Human
agcuuguaaauagcucagg

SEQ ID NO: 1732420 - RNA, 21 nt, Human
ugcggacagccacggccaggc

SEQ ID NO: 1732421 - RNA, 20 nt, Human
ugcggacagccacggccagg

SEQ ID NO: 1732422 - RNA, 15 nt, Human
agcuuaucucagggg

SEQ ID NO: 1732423 - RNA, 14 nt, Human
agcuuaucucaggg

SEQ ID NO: 1732424 - RNA, 12 nt, Human
agcuuaucucag

SEQ ID NO: 1732425 - RNA, 20 nt, Human
agcuuaaaggggcuagagug

SEQ ID NO: 1732426 - RNA, 13 nt, Human
aggaaagaggcuc

SEQ ID NO: 1732427 - RNA, 12 nt, Human
aggaaagaggcu

SEQ ID NO: 1732428 - RNA, 21 nt, Human
ugcuauaacuauguugauaaa

SEQ ID NO: 1732429 - RNA, 19 nt, Human
aggaaagcaaaggagauug

SEQ ID NO: 1732430 - RNA, 17 nt, Human
aggaaagcaaaggagau

SEQ ID NO: 1732431 - RNA, 16 nt, Human
aggaaagaggcucugg

SEQ ID NO: 1732432 - RNA, 19 nt, Human
agcuuugaaaauucagugg

SEQ ID NO: 1732433 - RNA, 18 nt, Human
agcuuugaaaauucagug

SEQ ID NO: 1732434 - RNA, 16 nt, Human
agcuuugaaaauucag

SEQ ID NO: 1732435 - RNA, 12 nt, Human
agcuuugaaaau

SEQ ID NO: 1732436 - RNA, 17 nt, Human
aggaaacccagcucugg

SEQ ID NO: 1732437 - RNA, 16 nt, Human
aggaaacccagcucug

SEQ ID NO: 1732438 - RNA, 15 nt, Human
aggaaacccagcucu

SEQ ID NO: 1732439 - RNA, 20 nt, Human
aggaaacccagcucuggucc

SEQ ID NO: 1732440 - RNA, 18 nt, Human
aggaaacccagcucuggu

SEQ ID NO: 1732441 - RNA, 21 nt, Human
aggaaacccagcucuggucca

SEQ ID NO: 1732442 - RNA, 13 nt, Human
ugcgaaaggauga

SEQ ID NO: 1732443 - RNA, 18 nt, Human
ugcggacagccacggcca

SEQ ID NO: 1732444 - RNA, 19 nt, Human
ugcgaaaggaugaaaguga

SEQ ID NO: 1732445 - RNA, 17 nt, Human
ugccuguucagcuccag

SEQ ID NO: 1732446 - RNA, 16 nt, Human
ugccuguucagcucca

SEQ ID NO: 1732447 - RNA, 15 nt, Human
ugccuguucagcucc

SEQ ID NO: 1732448 - RNA, 17 nt, Human
ugccuuagaaccuuucu

SEQ ID NO: 1732449 - RNA, 14 nt, Human
ugccuuagaaccuu

SEQ ID NO: 1732450 - RNA, 21 nt, Human
ugccuuagaaccuuucuuaca

SEQ ID NO: 1732451 - RNA, 20 nt, Human
agcuggggccaggcuggguc

SEQ ID NO: 1732452 - RNA, 10 nt, Human
agcugccugu

SEQ ID NO: 1732453 - RNA, 17 nt, Human
agcuggagaaauauggu

SEQ ID NO: 1732454 - RNA, 19 nt, Human
agcugccugggaucccuca

SEQ ID NO: 1732455 - RNA, 13 nt, Human
agcugccugggau

SEQ ID NO: 1732456 - RNA, 21 nt, Human
agcugccugggaucccucauc

SEQ ID NO: 1732457 - RNA, 22 nt, Human
ugccucugacacacagcucugu

SEQ ID NO: 1732458 - RNA, 21 nt, Human
ugccucucugcaggucccuaa

SEQ ID NO: 1732459 - RNA, 23 nt, Human
agcugggaugauuggagggggga

SEQ ID NO: 1732460 - RNA, 21 nt, Human
agcugggauuacaggcuccug

SEQ ID NO: 1732461 - RNA, 18 nt, Human
agcugggauuacaggcuc

SEQ ID NO: 1732462 - RNA, 22 nt, Human
agcugggaucacauguggacuu

SEQ ID NO: 1732463 - RNA, 19 nt, Human
agcugggacuacaggugug

SEQ ID NO: 1732464 - RNA, 17 nt, Human
agcugggacuacaggug

SEQ ID NO: 1732465 - RNA, 14 nt, Human
agcugggcagguug

SEQ ID NO: 1732466 - RNA, 23 nt, Human
agcugggauuacaggcuccugcc

SEQ ID NO: 1732467 - RNA, 22 nt, Human
agcugggauuacaggcuccugc

SEQ ID NO: 1732468 - RNA, 17 nt, Human
agcuggggccaggcugg

SEQ ID NO: 1732469 - RNA, 14 nt, Human
agcucuguccuggg

SEQ ID NO: 1732470 - RNA, 12 nt, Human
agcucuguccug

SEQ ID NO: 1732471 - RNA, 18 nt, Human
agcucuucuccaggcugu

SEQ ID NO: 1732472 - RNA, 22 nt, Human
agcugcacccucaggcaggugg

SEQ ID NO: 1732473 - RNA, 20 nt, Human
agcugcacccucaggcaggu

SEQ ID NO: 1732474 - RNA, 19 nt, Human
agcugcacccucaggcagg

SEQ ID NO: 1732475 - RNA, 18 nt, Human
agcugcacccucaggcag

SEQ ID NO: 1732476 - RNA, 17 nt, Human
agcugcacccucaggca

SEQ ID NO: 1732477 - RNA, 13 nt, Human
agcugcacccuca

SEQ ID NO: 1732478 - RNA, 12 nt, Human
agcucugcuccu

SEQ ID NO: 1732479 - RNA, 20 nt, Human
agcucugguccauagagagc

SEQ ID NO: 1732480 - RNA, 22 nt, Human
agcucugcuccucuccccagca

SEQ ID NO: 1732481 - RNA, 16 nt, Human
agcucucuccucccuu

SEQ ID NO: 1732482 - RNA, 20 nt, Human
ugcccuccaagaccuucucc

SEQ ID NO: 1732483 - RNA, 19 nt, Human
ugcccuccaagaccuucuc

SEQ ID NO: 1732484 - RNA, 22 nt, Human
ugcccuccaagaccuucuccuu

SEQ ID NO: 1732485 - RNA, 17 nt, Human
agcucuaucaccaagga

SEQ ID NO: 1732486 - RNA, 22 nt, Human
agcucuaucaccaaggagccaa

SEQ ID NO: 1732487 - RNA, 13 nt, Human
agcugccaccugc

SEQ ID NO: 1732488 - RNA, 14 nt, Human
agcugccagccgag

SEQ ID NO: 1732489 - RNA, 18 nt, Human
agcugcauacaguuugca

SEQ ID NO: 1732490 - RNA, 15 nt, Human
ugcccuuucugggca

SEQ ID NO: 1732491 - RNA, 14 nt, Human
ugccucucucaggc

SEQ ID NO: 1732492 - RNA, 13 nt, Human
ugccucucucagg

SEQ ID NO: 1732493 - RNA, 19 nt, Human
ugccucccaucacccgcua

SEQ ID NO: 1732494 - RNA, 14 nt, Human
ugccucccaucacc

SEQ ID NO: 1732495 - RNA, 13 nt, Human
ugccucccaucac

SEQ ID NO: 1732496 - RNA, 15 nt, Human
ugccucucucaggcc

SEQ ID NO: 1732497 - RNA, 16 nt, Human
ugccucucucaggcca

SEQ ID NO: 1732498 - RNA, 18 nt, Human
ugccucucugcagguccc

SEQ ID NO: 1732499 - RNA, 16 nt, Human
ugccucucugcagguc

SEQ ID NO: 1732500 - RNA, 21 nt, Human
ugccucugacacacagcucug

SEQ ID NO: 1732501 - RNA, 20 nt, Human
ugccucugacacacagcucu

SEQ ID NO: 1732502 - RNA, 20 nt, Human
ugccucucugcaggucccua

SEQ ID NO: 1732503 - RNA, 19 nt, Human
ugccucucugcaggucccu

SEQ ID NO: 1732504 - RNA, 19 nt, Human
ugcauuugaaaauuuugau

SEQ ID NO: 1732505 - RNA, 23 nt, Human
ugcauuugaaaauuuugauguuu

SEQ ID NO: 1732506 - RNA, 13 nt, Human
ugcauuuccugac

SEQ ID NO: 1732507 - RNA, 14 nt, Human
ugcauuuccugaca

SEQ ID NO: 1732508 - RNA, 22 nt, Human
agcgcccaguuggguggaugcc

SEQ ID NO: 1732509 - RNA, 14 nt, Human
agcgcccaguuggg

SEQ ID NO: 1732510 - RNA, 14 nt, Human
agccugcuccagcu

SEQ ID NO: 1732511 - RNA, 20 nt, Human
agcgcccacuagacccacug

SEQ ID NO: 1732512 - RNA, 23 nt, Human
agcgugguggacaugcacagcua

SEQ ID NO: 1732513 - RNA, 17 nt, Human
agcgugagccacugcac

SEQ ID NO: 1732514 - RNA, 16 nt, Human
agcgugagccacugca

SEQ ID NO: 1732515 - RNA, 20 nt, Human
agcgugguggacaugcacag

SEQ ID NO: 1732516 - RNA, 21 nt, Human
ugccauauucuguuggccagu

SEQ ID NO: 1732517 - RNA, 20 nt, Human
ugccauauucuguuggccag

SEQ ID NO: 1732518 - RNA, 15 nt, Human
agcggggacagcucc

SEQ ID NO: 1732519 - RNA, 17 nt, Human
agcggggacagcuccuu

SEQ ID NO: 1732520 - RNA, 16 nt, Human
agcggggacagcuccu

SEQ ID NO: 1732521 - RNA, 15 nt, Human
agcgugagccacugc

SEQ ID NO: 1732522 - RNA, 17 nt, Human
ugccauauucuguuggc

SEQ ID NO: 1732523 - RNA, 16 nt, Human
ugccauauucuguugg

SEQ ID NO: 1732524 - RNA, 15 nt, Human
ugccauauucuguug

SEQ ID NO: 1732525 - RNA, 23 nt, Human
ugccagucaccccggccaccugc

SEQ ID NO: 1732526 - RNA, 22 nt, Human
ugccagucaccccggccaccug

SEQ ID NO: 1732527 - RNA, 17 nt, Human
ugccagucccccugccc

SEQ ID NO: 1732528 - RNA, 20 nt, Human
ugccagucccccugccccag

SEQ ID NO: 1732529 - RNA, 19 nt, Human
ugccagucccccugcccca

SEQ ID NO: 1732530 - RNA, 20 nt, Human
ugccagucaccccggccacc

SEQ ID NO: 1732531 - RNA, 18 nt, Human
ugccagucaccccggcca

SEQ ID NO: 1732532 - RNA, 16 nt, Human
ugccagucaccccggc

SEQ ID NO: 1732533 - RNA, 15 nt, Human
ugccagucaccccgg

SEQ ID NO: 1732534 - RNA, 12 nt, Human
ugccacacuuca

SEQ ID NO: 1732535 - RNA, 23 nt, Human
ugccacugccucuuccucccuca

SEQ ID NO: 1732536 - RNA, 19 nt, Human
agcuauggugucauaggcu

SEQ ID NO: 1732537 - RNA, 19 nt, Human
ugccauguuggccaggcug

SEQ ID NO: 1732538 - RNA, 18 nt, Human
ugccauguuggccaggcu

SEQ ID NO: 1732539 - RNA, 17 nt, Human
ugccauguuggccaggc

SEQ ID NO: 1732540 - RNA, 17 nt, Human
agcucagggccuggcuc

SEQ ID NO: 1732541 - RNA, 16 nt, Human
agcucagggccuggcu

SEQ ID NO: 1732542 - RNA, 15 nt, Human
agcucagggccuggc

SEQ ID NO: 1732543 - RNA, 21 nt, Human
ugccauguuggccaggcuggu

SEQ ID NO: 1732544 - RNA, 20 nt, Human
ugccauguuggccaggcugg

SEQ ID NO: 1732545 - RNA, 18 nt, Human
agcucagggccuggcuca

SEQ ID NO: 1732546 - RNA, 22 nt, Human
ugcccaaccugcucuccucuug

SEQ ID NO: 1732547 - RNA, 18 nt, Human
ugcccaaccugcucuccu

SEQ ID NO: 1732548 - RNA, 24 nt, Human
ugcccaaccugcucuccucuugcc

SEQ ID NO: 1732549 - RNA, 23 nt, Human
ugcccaaccugcucuccucuugc

SEQ ID NO: 1732550 - RNA, 11 nt, Human
ugcccaggccc

SEQ ID NO: 1732551 - RNA, 20 nt, Human
ugcccaggcaggucuugaac

SEQ ID NO: 1732552 - RNA, 17 nt, Human
ugcccaggcaggucuug

SEQ ID NO: 1732553 - RNA, 16 nt, Human
ugcccaggcaggucuu

SEQ ID NO: 1732554 - RNA, 15 nt, Human
ugcccaggcaggucu

SEQ ID NO: 1732555 - RNA, 14 nt, Human
ugcccacaggauca

SEQ ID NO: 1732556 - RNA, 22 nt, Human
ugcccaggccccugccacccug

SEQ ID NO: 1732557 - RNA, 20 nt, Human
ugcccaggccccugccaccc

SEQ ID NO: 1732558 - RNA, 14 nt, Human
ugcccaggccccug

SEQ ID NO: 1732559 - RNA, 16 nt, Human
ugcccacaggaucagu

SEQ ID NO: 1732560 - RNA, 12 nt, Human
ugcccaggcccc

SEQ ID NO: 1732561 - RNA, 17 nt, Human
ugcccaggccugccugu

SEQ ID NO: 1732562 - RNA, 15 nt, Human
ugcccaggccugccu

SEQ ID NO: 1732563 - RNA, 12 nt, Human
ugccccccagcc

SEQ ID NO: 1732564 - RNA, 19 nt, Human
ugccccucaacucuccucc

SEQ ID NO: 1732565 - RNA, 18 nt, Human
ugccccgucccccucugg

SEQ ID NO: 1732566 - RNA, 16 nt, Human
ugccccgucccccucu

SEQ ID NO: 1732567 - RNA, 20 nt, Human
ugcagacucuacagaggcca

SEQ ID NO: 1732568 - RNA, 19 nt, Human
ugcagacucuacagaggcc

SEQ ID NO: 1732569 - RNA, 15 nt, Human
ugcacuccccugcug

SEQ ID NO: 1732570 - RNA, 22 nt, Human
ugcagacucuacagaggccaug

SEQ ID NO: 1732571 - RNA, 14 nt, Human
agcccuucauuugg

SEQ ID NO: 1732572 - RNA, 13 nt, Human
agcccuucauuug

SEQ ID NO: 1732573 - RNA, 23 nt, Human
agcccuuccaugucgccucugca

SEQ ID NO: 1732574 - RNA, 22 nt, Human
agcccuuccaugucgccucugc

SEQ ID NO: 1732575 - RNA, 19 nt, Human
agcccuuccaugucgccuc

SEQ ID NO: 1732576 - RNA, 23 nt, Human
agccguuuguuccccaagacauu

SEQ ID NO: 1732577 - RNA, 15 nt, Human
agccucaaccuccug

SEQ ID NO: 1732578 - RNA, 20 nt, Human
agccucaaaacaaaggccua

SEQ ID NO: 1732579 - RNA, 18 nt, Human
agccucaaaacaaaggcc

SEQ ID NO: 1732580 - RNA, 17 nt, Human
agccuaggugacagagu

SEQ ID NO: 1732581 - RNA, 15 nt, Human
agccuaggugacaga

SEQ ID NO: 1732582 - RNA, 13 nt, Human
ugcacuccccugc

SEQ ID NO: 1732583 - RNA, 12 nt, Human
ugcacuccccug

SEQ ID NO: 1732584 - RNA, 22 nt, Human
ugcacuauagccuaggugacag

SEQ ID NO: 1732585 - RNA, 15 nt, Human
ugcaccacugcacuc

SEQ ID NO: 1732586 - RNA, 17 nt, Human
ugcacguauuuuaauag

SEQ ID NO: 1732587 - RNA, 14 nt, Human
ugcaccacugcacu

SEQ ID NO: 1732588 - RNA, 23 nt, Human
ugcacaagcuccaagcucccagg

SEQ ID NO: 1732589 - RNA, 22 nt, Human
ugcacaagcuccaagcucccag

SEQ ID NO: 1732590 - RNA, 20 nt, Human
ugcacaagcuccaagcuccc

SEQ ID NO: 1732591 - RNA, 18 nt, Human
ugcacaagcuccaagcuc

SEQ ID NO: 1732592 - RNA, 16 nt, Human
ugcacaagcuccaagc

SEQ ID NO: 1732593 - RNA, 15 nt, Human
ugcacaagcuccaag

SEQ ID NO: 1732594 - RNA, 15 nt, Human
ugcacacaccagagc

SEQ ID NO: 1732595 - RNA, 14 nt, Human
ugcacaagcugcac

SEQ ID NO: 1732596 - RNA, 22 nt, Human
ugcauaccacuuuuguucuugg

SEQ ID NO: 1732597 - RNA, 15 nt, Human
ugcaugcugucccuu

SEQ ID NO: 1732598 - RNA, 14 nt, Human
ugcaugcugucccu

SEQ ID NO: 1732599 - RNA, 13 nt, Human
ugcaugcuguccc

SEQ ID NO: 1732600 - RNA, 21 nt, Human
ugcaugaggcuaguguggugu

SEQ ID NO: 1732601 - RNA, 22 nt, Human
ugcaugaaguaauaugcacaca

SEQ ID NO: 1732602 - RNA, 20 nt, Human
ugcaugaaguaauaugcaca

SEQ ID NO: 1732603 - RNA, 19 nt, Human
agccugaucaccugcccug

SEQ ID NO: 1732604 - RNA, 16 nt, Human
ugcaugcugucccuua

SEQ ID NO: 1732605 - RNA, 18 nt, Human
agccugaucaccugcccu

SEQ ID NO: 1732606 - RNA, 23 nt, Human
agccugcaguuauuaacacuaac

SEQ ID NO: 1732607 - RNA, 19 nt, Human
agccugccucuucucuacu

SEQ ID NO: 1732608 - RNA, 16 nt, Human
agccugccucuucucu

SEQ ID NO: 1732609 - RNA, 12 nt, Human
agccugcccucc

SEQ ID NO: 1732610 - RNA, 19 nt, Human
agccugagcgacagugaga

SEQ ID NO: 1732611 - RNA, 19 nt, Human
ugcagccucaaccuccugg

SEQ ID NO: 1732612 - RNA, 18 nt, Human
ugcagccucaaccuccug

SEQ ID NO: 1732613 - RNA, 20 nt, Human
ugcagccucaaccuccuggg

SEQ ID NO: 1732614 - RNA, 18 nt, Human
agccugagcgacagugag

SEQ ID NO: 1732615 - RNA, 19 nt, Human
agccucaaccuccugggcu

SEQ ID NO: 1732616 - RNA, 15 nt, Human
agccucagcauccug

SEQ ID NO: 1732617 - RNA, 16 nt, Human
agccucagcauccugg

SEQ ID NO: 1732618 - RNA, 14 nt, Human
agccucagcauccu

SEQ ID NO: 1732619 - RNA, 13 nt, Human
agccucagcaucc

SEQ ID NO: 1732620 - RNA, 18 nt, Human
agccucaaccuccugggc

SEQ ID NO: 1732621 - RNA, 17 nt, Human
agccucaaccuccuggg

SEQ ID NO: 1732622 - RNA, 14 nt, Human
ugcagugagccgag

SEQ ID NO: 1732623 - RNA, 17 nt, Human
ugcaggucccuaauaaa

SEQ ID NO: 1732624 - RNA, 21 nt, Human
ugcaggucccuaauaaagcug

SEQ ID NO: 1732625 - RNA, 20 nt, Human
ugcaggucccuaauaaagcu

SEQ ID NO: 1732626 - RNA, 19 nt, Human
ugcaggucccuaauaaagc

SEQ ID NO: 1732627 - RNA, 18 nt, Human
ugcaggucccuaauaaag

SEQ ID NO: 1732628 - RNA, 19 nt, Human
ugcagugagccgagauugu

SEQ ID NO: 1732629 - RNA, 12 nt, Human
ugcaguuuuccu

SEQ ID NO: 1732630 - RNA, 11 nt, Human
ugcauaaaaug

SEQ ID NO: 1732631 - RNA, 15 nt, Human
ugcauaauggucaga

SEQ ID NO: 1732632 - RNA, 16 nt, Human
agaagcggcuggcagc

SEQ ID NO: 1732633 - RNA, 15 nt, Human
agaagcggcuggcag

SEQ ID NO: 1732634 - RNA, 18 nt, Human
agaagcuaagguuuagau

SEQ ID NO: 1732635 - RNA, 16 nt, Human
ucuggcagcucagaga

SEQ ID NO: 1732636 - RNA, 15 nt, Human
ucuggcagcucagag

SEQ ID NO: 1732637 - RNA, 14 nt, Human
ucuggcagcucaga

SEQ ID NO: 1732638 - RNA, 18 nt, Human
ucuggauuauauuaugaa

SEQ ID NO: 1732639 - RNA, 12 nt, Human
ucuggauuauau

SEQ ID NO: 1732640 - RNA, 18 nt, Human
ucugcccuccaagaccuu

SEQ ID NO: 1732641 - RNA, 14 nt, Human
ucugcccuccaaga

SEQ ID NO: 1732642 - RNA, 16 nt, Human
ucugcucacauaucug

SEQ ID NO: 1732643 - RNA, 17 nt, Human
ucugcucacauaucugu

SEQ ID NO: 1732644 - RNA, 21 nt, Human
agaacucaugacggaagaguu

SEQ ID NO: 1732645 - RNA, 14 nt, Human
agaacucccuuuca

SEQ ID NO: 1732646 - RNA, 15 nt, Human
agaacucccuuucaa

SEQ ID NO: 1732647 - RNA, 12 nt, Human
ucugcagagcag

SEQ ID NO: 1732648 - RNA, 11 nt, Human
agaaauguguu

SEQ ID NO: 1732649 - RNA, 17 nt, Human
agaaauguacagcaagg

SEQ ID NO: 1732650 - RNA, 16 nt, Human
agaaauguacagcaag

SEQ ID NO: 1732651 - RNA, 15 nt, Human
ucugcagaaacagaa

SEQ ID NO: 1732652 - RNA, 19 nt, Human
ucugacccugcuucaaaua

SEQ ID NO: 1732653 - RNA, 21 nt, Human
ucugauucccaagcucugcuc

SEQ ID NO: 1732654 - RNA, 20 nt, Human
ucugauucccaagcucugcu

SEQ ID NO: 1732655 - RNA, 19 nt, Human
ucugauucccaagcucugc

SEQ ID NO: 1732656 - RNA, 22 nt, Human
ucucuuuaaugucacaggcagg

SEQ ID NO: 1732657 - RNA, 17 nt, Human
ucucuugagccugggag

SEQ ID NO: 1732658 - RNA, 15 nt, Human
ucucuugagccuggg

SEQ ID NO: 1732659 - RNA, 14 nt, Human
ucucuugagccugg

SEQ ID NO: 1732660 - RNA, 13 nt, Human
ucucuugagccug

SEQ ID NO: 1732661 - RNA, 17 nt, Human
agaaaaaugagccuggc

SEQ ID NO: 1732662 - RNA, 19 nt, Human
agaaaaauaugaccacacu

SEQ ID NO: 1732663 - RNA, 13 nt, Human
agaaacuggaacu

SEQ ID NO: 1732664 - RNA, 15 nt, Human
agaaacuggaacucu

SEQ ID NO: 1732665 - RNA, 15 nt, Human
agaaagaagaugaau

SEQ ID NO: 1732666 - RNA, 13 nt, Human
ucucuggccuucg

SEQ ID NO: 1732667 - RNA, 16 nt, Human
ucucuggccuucggcc

SEQ ID NO: 1732668 - RNA, 17 nt, Human
ucucuggccuucggccu

SEQ ID NO: 1732669 - RNA, 22 nt, Human
ucucugcccuaaugcgcaggcu

SEQ ID NO: 1732670 - RNA, 11 nt, Human
ucucugcccua

SEQ ID NO: 1732671 - RNA, 14 nt, Human
ucucuugagagggu

SEQ ID NO: 1732672 - RNA, 21 nt, Human
ucucuucuggguuccuuccuc

SEQ ID NO: 1732673 - RNA, 20 nt, Human
ucucuucuggguuccuuccu

SEQ ID NO: 1732674 - RNA, 19 nt, Human
ucucuucuggguuccuucc

SEQ ID NO: 1732675 - RNA, 18 nt, Human
ucucuucuggguuccuuc

SEQ ID NO: 1732676 - RNA, 20 nt, Human
ucuccuucaccuuugucccc

SEQ ID NO: 1732677 - RNA, 14 nt, Human
ucucuccagccccu

SEQ ID NO: 1732678 - RNA, 13 nt, Human
ucucuccagcccc

SEQ ID NO: 1732679 - RNA, 15 nt, Human
ucucuccagccccug

SEQ ID NO: 1732680 - RNA, 16 nt, Human
ucucuccagccccugg

SEQ ID NO: 1732681 - RNA, 20 nt, Human
ucucuccuguaccucuugag

SEQ ID NO: 1732682 - RNA, 22 nt, Human
ucucuccuguaccucuugagcc

SEQ ID NO: 1732683 - RNA, 18 nt, Human
ucucccuuggauuguccc

SEQ ID NO: 1732684 - RNA, 11 nt, Human
ucucccuugga

SEQ ID NO: 1732685 - RNA, 18 nt, Human
ucucccaaagugcuggga

SEQ ID NO: 1732686 - RNA, 14 nt, Human
ucuccucugcugcu

SEQ ID NO: 1732687 - RNA, 13 nt, Human
ucuccucugcugc

SEQ ID NO: 1732688 - RNA, 21 nt, Human
acuuguugauuaauggaaaug

SEQ ID NO: 1732689 - RNA, 19 nt, Human
acuuguugauuaauggaaa

SEQ ID NO: 1732690 - RNA, 21 nt, Human
ucucccuuggauuguccccga

SEQ ID NO: 1732691 - RNA, 19 nt, Human
ucucccuuggauugucccc

SEQ ID NO: 1732692 - RNA, 12 nt, Human
ucuccucugcug

SEQ ID NO: 1732693 - RNA, 22 nt, Human
acuuuuuuuuuuuaagaguaaa

SEQ ID NO: 1732694 - RNA, 15 nt, Human
acuuuuuuuuaaguu

SEQ ID NO: 1732695 - RNA, 14 nt, Human
acuuuuggcauuuu

SEQ ID NO: 1732696 - RNA, 18 nt, Human
acuuuaccuuuuuuauac

SEQ ID NO: 1732697 - RNA, 19 nt, Human
acuuuaccuuuuuuauaca

SEQ ID NO: 1732698 - RNA, 22 nt, Human
acuuuaccuuuuuuauacauaa

SEQ ID NO: 1732699 - RNA, 23 nt, Human
acuuuaccuuuuuuauacauaaa

SEQ ID NO: 1732700 - RNA, 19 nt, Human
acuuugaccucugcagcaa

SEQ ID NO: 1732701 - RNA, 23 nt, Human
acuuugaccucugcagcaauaaa

SEQ ID NO: 1732702 - RNA, 14 nt, Human
acuuuggaaagacu

SEQ ID NO: 1732703 - RNA, 13 nt, Human
acuuuggaaagac

SEQ ID NO: 1732704 - RNA, 19 nt, Human
acuuugaggguguauauuu

SEQ ID NO: 1732705 - RNA, 17 nt, Human
acuuuggaaagacuuuu

SEQ ID NO: 1732706 - RNA, 23 nt, Human
acuuuggaaagacuuuuccaacc

SEQ ID NO: 1732707 - RNA, 22 nt, Human
ucuuccaggcugggagagccuu

SEQ ID NO: 1732708 - RNA, 17 nt, Human
ucuucaaaaugagcccu

SEQ ID NO: 1732709 - RNA, 14 nt, Human
ucuuaugggcuggg

SEQ ID NO: 1732710 - RNA, 16 nt, Human
ucuuaugggcuggguu

SEQ ID NO: 1732711 - RNA, 15 nt, Human
ucuuaugggcugggu

SEQ ID NO: 1732712 - RNA, 22 nt, Human
ucuuauugcccacgcuggagug

SEQ ID NO: 1732713 - RNA, 18 nt, Human
ucuuauugcccacgcugg

SEQ ID NO: 1732714 - RNA, 18 nt, Human
ucuuaugggcuggguucu

SEQ ID NO: 1732715 - RNA, 14 nt, Human
ucuuauugcccacg

SEQ ID NO: 1732716 - RNA, 23 nt, Human
agacaggcaagcaccuccugccu

SEQ ID NO: 1732717 - RNA, 16 nt, Human
agacaggaccagggau

SEQ ID NO: 1732718 - RNA, 15 nt, Human
agacaggaccaggga

SEQ ID NO: 1732719 - RNA, 21 nt, Human
agacaggguuuugccauguug

SEQ ID NO: 1732720 - RNA, 19 nt, Human
agacaggguuucaccaugu

SEQ ID NO: 1732721 - RNA, 17 nt, Human
agacagucccugccaau

SEQ ID NO: 1732722 - RNA, 16 nt, Human
agacagucccugccaa

SEQ ID NO: 1732723 - RNA, 15 nt, Human
agacagucccugcca

SEQ ID NO: 1732724 - RNA, 19 nt, Human
agacagucccugccaaugg

SEQ ID NO: 1732725 - RNA, 22 nt, Human
agacagaaucucgcucugucgc

SEQ ID NO: 1732726 - RNA, 18 nt, Human
agacagaaucucgcucug

SEQ ID NO: 1732727 - RNA, 14 nt, Human
agacagacuagaag

SEQ ID NO: 1732728 - RNA, 20 nt, Human
ucuguuggccagugugacaa

SEQ ID NO: 1732729 - RNA, 19 nt, Human
ucuguuggccagugugaca

SEQ ID NO: 1732730 - RNA, 18 nt, Human
ucuguuggccagugugac

SEQ ID NO: 1732731 - RNA, 21 nt, Human
ucugugaaaggaaagagggag

SEQ ID NO: 1732732 - RNA, 15 nt, Human
ucugugaaaggaaag

SEQ ID NO: 1732733 - RNA, 24 nt, Human
ucuguccaggcacugcugcccagc

SEQ ID NO: 1732734 - RNA, 22 nt, Human
ucugugaaaggaaagagggagg

SEQ ID NO: 1732735 - RNA, 18 nt, Human
agaauuucccaaagcagu

SEQ ID NO: 1732736 - RNA, 17 nt, Human
agaauuucccaaagcag

SEQ ID NO: 1732737 - RNA, 23 nt, Human
agaauuucccaaagcagugcaug

SEQ ID NO: 1732738 - RNA, 15 nt, Human
ucugucauuugagca

SEQ ID NO: 1732739 - RNA, 23 nt, Human
ucugucauuugagcagggcucag

SEQ ID NO: 1732740 - RNA, 20 nt, Human
ucugucauuugagcagggcu

SEQ ID NO: 1732741 - RNA, 16 nt, Human
ucuggguucacugcaa

SEQ ID NO: 1732742 - RNA, 14 nt, Human
ucuggguucacugc

SEQ ID NO: 1732743 - RNA, 11 nt, Human
ucuggggcugu

SEQ ID NO: 1732744 - RNA, 18 nt, Human
ucugguccauagagagca

SEQ ID NO: 1732745 - RNA, 16 nt, Human
ucuggguuccuuccuc

SEQ ID NO: 1732746 - RNA, 15 nt, Human
ucuuuacuucaugga

SEQ ID NO: 1732747 - RNA, 17 nt, Human
agacuccugcaggcagc

SEQ ID NO: 1732748 - RNA, 16 nt, Human
agacuccugcaggcag

SEQ ID NO: 1732749 - RNA, 15 nt, Human
agacuccugcaggca

SEQ ID NO: 1732750 - RNA, 14 nt, Human
agacuccugcaggc

SEQ ID NO: 1732751 - RNA, 16 nt, Human
ucuuuccugaggcugg

SEQ ID NO: 1732752 - RNA, 15 nt, Human
ucuuuccugaggcug

SEQ ID NO: 1732753 - RNA, 14 nt, Human
ucuuuccugaggcu

SEQ ID NO: 1732754 - RNA, 13 nt, Human
ucuuuccugaggc

SEQ ID NO: 1732755 - RNA, 23 nt, Human
agacuccugcaggcagccaggcc

SEQ ID NO: 1732756 - RNA, 20 nt, Human
agacuccugcaggcagccag

SEQ ID NO: 1732757 - RNA, 19 nt, Human
agacuccugcaggcagcca

SEQ ID NO: 1732758 - RNA, 18 nt, Human
agacuccugcaggcagcc

SEQ ID NO: 1732759 - RNA, 17 nt, Human
agacucuacagaggcca

SEQ ID NO: 1732760 - RNA, 21 nt, Human
agacucgcgacaaugcaaacc

SEQ ID NO: 1732761 - RNA, 19 nt, Human
agacucuacagaggccaug

SEQ ID NO: 1732762 - RNA, 14 nt, Human
agagaccaucccug

SEQ ID NO: 1732763 - RNA, 13 nt, Human
agagaccaucccu

SEQ ID NO: 1732764 - RNA, 15 nt, Human
agagaccaucccuga

SEQ ID NO: 1732765 - RNA, 18 nt, Human
agagaccaucccugaagg

SEQ ID NO: 1732766 - RNA, 15 nt, Human
agacuuuggaaagac

SEQ ID NO: 1732767 - RNA, 18 nt, Human
agagaaugaaagggccca

SEQ ID NO: 1732768 - RNA, 14 nt, Human
agacuuuggaaaga

SEQ ID NO: 1732769 - RNA, 12 nt, Human
agacuuuggaaa

SEQ ID NO: 1732770 - RNA, 17 nt, Human
agacuucaucccucugg

SEQ ID NO: 1732771 - RNA, 14 nt, Human
agacuucaucccuc

SEQ ID NO: 1732772 - RNA, 18 nt, Human
agacucauucuucuguac

SEQ ID NO: 1732773 - RNA, 17 nt, Human
agacucauucuucugua

SEQ ID NO: 1732774 - RNA, 18 nt, Human
agacuaucuaaauguuga

SEQ ID NO: 1732775 - RNA, 17 nt, Human
agacuaucuaaauguug

SEQ ID NO: 1732776 - RNA, 19 nt, Human
agacuaucuaaauguugaa

SEQ ID NO: 1732777 - RNA, 12 nt, Human
agaccugccccu

SEQ ID NO: 1732778 - RNA, 13 nt, Human
agaccugccccuc

SEQ ID NO: 1732779 - RNA, 20 nt, Human
ucuugaugccuggcggggug

SEQ ID NO: 1732780 - RNA, 14 nt, Human
ucuugaugccuggc

SEQ ID NO: 1732781 - RNA, 16 nt, Human
ucuugcaauggcagcc

SEQ ID NO: 1732782 - RNA, 13 nt, Human
ucuugcaauggca

SEQ ID NO: 1732783 - RNA, 17 nt, Human
ucuugcaauggcagccu

SEQ ID NO: 1732784 - RNA, 14 nt, Human
agacccugcccugu

SEQ ID NO: 1732785 - RNA, 13 nt, Human
agacccugcccug

SEQ ID NO: 1732786 - RNA, 12 nt, Human
agacccugcccu

SEQ ID NO: 1732787 - RNA, 23 nt, Human
agacccugcccugugggccccca

SEQ ID NO: 1732788 - RNA, 21 nt, Human
agacccugcccugugggcccc

SEQ ID NO: 1732789 - RNA, 19 nt, Human
agacccugcccugugggcc

SEQ ID NO: 1732790 - RNA, 16 nt, Human
agacccugcccugugg

SEQ ID NO: 1732791 - RNA, 15 nt, Human
agacccuuguggucc

SEQ ID NO: 1732792 - RNA, 13 nt, Human
agacccuuguggu

SEQ ID NO: 1732793 - RNA, 23 nt, Human
agacccuuguggucccaccccac

SEQ ID NO: 1732794 - RNA, 22 nt, Human
agacccuuguggucccacccca

SEQ ID NO: 1732795 - RNA, 20 nt, Human
agacccuuguggucccaccc

SEQ ID NO: 1732796 - RNA, 19 nt, Human
agacccuuguggucccacc

SEQ ID NO: 1732797 - RNA, 19 nt, Human
agaccuaacgagaaauaga

SEQ ID NO: 1732798 - RNA, 19 nt, Human
agauaaggguaucugguga

SEQ ID NO: 1732799 - RNA, 19 nt, Human
agagugagacucugucuca

SEQ ID NO: 1732800 - RNA, 18 nt, Human
agauaauacaccacuaca

SEQ ID NO: 1732801 - RNA, 18 nt, Human
agauaauucuagcuuuga

SEQ ID NO: 1732802 - RNA, 19 nt, Human
agauacaggaaaagcugcu

SEQ ID NO: 1732803 - RNA, 22 nt, Human
agauauuuugcuuugugauuuu

SEQ ID NO: 1732804 - RNA, 19 nt, Human
agaucaaccccuucgcucc

SEQ ID NO: 1732805 - RNA, 14 nt, Human
agaucaaccccuuc

SEQ ID NO: 1732806 - RNA, 21 nt, Human
agaucaaccccuucgcuccug

SEQ ID NO: 1732807 - RNA, 14 nt, Human
agagugaacaaauu

SEQ ID NO: 1732808 - RNA, 22 nt, Human
agagucucacuguugcccaggc

SEQ ID NO: 1732809 - RNA, 20 nt, Human
agagucucacuguugcccag

SEQ ID NO: 1732810 - RNA, 22 nt, Human
agagugaacaaauuuacagaga

SEQ ID NO: 1732811 - RNA, 16 nt, Human
agagugagacucuguc

SEQ ID NO: 1732812 - RNA, 15 nt, Human
agagugagacucugu

SEQ ID NO: 1732813 - RNA, 18 nt, Human
ugaaugucagugugacug

SEQ ID NO: 1732814 - RNA, 15 nt, Human
ugaaugucaguguga

SEQ ID NO: 1732815 - RNA, 14 nt, Human
ugaaugucagugug

SEQ ID NO: 1732816 - RNA, 18 nt, Human
ugaagguggaaauaaacu

SEQ ID NO: 1732817 - RNA, 16 nt, Human
ugaaugcauaaaaugu

SEQ ID NO: 1732818 - RNA, 15 nt, Human
ugaaugcauaaaaug

SEQ ID NO: 1732819 - RNA, 17 nt, Human
ugaagauguagaggaga

SEQ ID NO: 1732820 - RNA, 18 nt, Human
ugaagauguagaggagaa

SEQ ID NO: 1732821 - RNA, 22 nt, Human
agagggagggagggcuccagac

SEQ ID NO: 1732822 - RNA, 15 nt, Human
agagggagguaagga

SEQ ID NO: 1732823 - RNA, 21 nt, Human
agagggagggagggcuccaga

SEQ ID NO: 1732824 - RNA, 17 nt, Human
agaggcuaugugagcac

SEQ ID NO: 1732825 - RNA, 21 nt, Human
agaggcgcaugaauuugugaa

SEQ ID NO: 1732826 - RNA, 11 nt, Human
ugaagacaaug

SEQ ID NO: 1732827 - RNA, 13 nt, Human
ugaagacaaugac

SEQ ID NO: 1732828 - RNA, 17 nt, Human
ugaagacaaugacuuac

SEQ ID NO: 1732829 - RNA, 16 nt, Human
ugaacuuugaccucug

SEQ ID NO: 1732830 - RNA, 17 nt, Human
ugaacuuugaccucugc

SEQ ID NO: 1732831 - RNA, 21 nt, Human
ucuuuggucuacacugugcug

SEQ ID NO: 1732832 - RNA, 14 nt, Human
ucuuuggucuacac

SEQ ID NO: 1732833 - RNA, 12 nt, Human
ucuuuguaauga

SEQ ID NO: 1732834 - RNA, 11 nt, Human
ugaacuuugac

SEQ ID NO: 1732835 - RNA, 15 nt, Human
ucuuuguaaugaaaa

SEQ ID NO: 1732836 - RNA, 13 nt, Human
ucuuuguaaugaa

SEQ ID NO: 1732837 - RNA, 18 nt, Human
agaggcaacugcauuggc

SEQ ID NO: 1732838 - RNA, 21 nt, Human
agaggaaaucaccgaaaacgu

SEQ ID NO: 1732839 - RNA, 12 nt, Human
agaggaaaucac

SEQ ID NO: 1732840 - RNA, 11 nt, Human
agaggaaauca

SEQ ID NO: 1732841 - RNA, 19 nt, Human
agaggaaagcaaaggagau

SEQ ID NO: 1732842 - RNA, 18 nt, Human
agaggaaagcaaaggaga

SEQ ID NO: 1732843 - RNA, 16 nt, Human
agaggaaagcaaagga

SEQ ID NO: 1732844 - RNA, 12 nt, Human
agaggaaagcaa

SEQ ID NO: 1732845 - RNA, 19 nt, Human
agagcugggugucaagagg

SEQ ID NO: 1732846 - RNA, 21 nt, Human
ugaagacaaugacuuacugua

SEQ ID NO: 1732847 - RNA, 15 nt, Human
agagcuucuggcacu

SEQ ID NO: 1732848 - RNA, 21 nt, Human
agagcuucuguugcugccuca

SEQ ID NO: 1732849 - RNA, 20 nt, Human
agagcuucuguugcugccuc

SEQ ID NO: 1732850 - RNA, 19 nt, Human
agagcuucuguugcugccu

SEQ ID NO: 1732851 - RNA, 23 nt, Human
agaugcuagaacucccuuucaac

SEQ ID NO: 1732852 - RNA, 16 nt, Human
agaugcuucucacugc

SEQ ID NO: 1732853 - RNA, 18 nt, Human
agaugcuucucacugcca

SEQ ID NO: 1732854 - RNA, 12 nt, Human
ugaccugaggcc

SEQ ID NO: 1732855 - RNA, 14 nt, Human
ugaccucugccuga

SEQ ID NO: 1732856 - RNA, 23 nt, Human
ugaccccucauagcccucacccu

SEQ ID NO: 1732857 - RNA, 13 nt, Human
ugaccucugccug

SEQ ID NO: 1732858 - RNA, 20 nt, Human
ugaccccucauagcccucac

SEQ ID NO: 1732859 - RNA, 19 nt, Human
ugaccccucauagcccuca

SEQ ID NO: 1732860 - RNA, 22 nt, Human
ugacccccaaccaaguggcucc

SEQ ID NO: 1732861 - RNA, 17 nt, Human
ugaccccucauagcccu

SEQ ID NO: 1732862 - RNA, 12 nt, Human
ugacccaugcug

SEQ ID NO: 1732863 - RNA, 18 nt, Human
agauguguucacaaugga

SEQ ID NO: 1732864 - RNA, 15 nt, Human
agauguguucacaau

SEQ ID NO: 1732865 - RNA, 18 nt, Human
ugacauuguagagcuucu

SEQ ID NO: 1732866 - RNA, 21 nt, Human
agaucauugugaaauuauuca

SEQ ID NO: 1732867 - RNA, 20 nt, Human
ugaccacacuccagcuggga

SEQ ID NO: 1732868 - RNA, 19 nt, Human
ugaccacacuccagcuggg

SEQ ID NO: 1732869 - RNA, 17 nt, Human
ugaccacacuccagcug

SEQ ID NO: 1732870 - RNA, 12 nt, Human
ugaccacacucc

SEQ ID NO: 1732871 - RNA, 16 nt, Human
agauucaaucccagga

SEQ ID NO: 1732872 - RNA, 20 nt, Human
agauuauaggcaccuaccac

SEQ ID NO: 1732873 - RNA, 21 nt, Human
ugacugugguagccagcaucg

SEQ ID NO: 1732874 - RNA, 20 nt, Human
ugacuuauuuauauaaauuu

SEQ ID NO: 1732875 - RNA, 21 nt, Human
ugacuuauuuauauaaauuuu

SEQ ID NO: 1732876 - RNA, 23 nt, Human
ugacuccagaauuucccaaagca

SEQ ID NO: 1732877 - RNA, 20 nt, Human
ugacuccagaauuucccaaa

SEQ ID NO: 1732878 - RNA, 19 nt, Human
ugacuccagaauuucccaa

SEQ ID NO: 1732879 - RNA, 17 nt, Human
ugacuccagaauuuccc

SEQ ID NO: 1732880 - RNA, 15 nt, Human
ugaccugaggcccuu

SEQ ID NO: 1732881 - RNA, 14 nt, Human
ugaccugaggcccu

SEQ ID NO: 1732882 - RNA, 17 nt, Human
ugaccugaggcccuucu

SEQ ID NO: 1732883 - RNA, 21 nt, Human
agcaaaaccaaauauuccaga

SEQ ID NO: 1732884 - RNA, 14 nt, Human
agauuuaugcauau

SEQ ID NO: 1732885 - RNA, 16 nt, Human
agauugugccccugca

SEQ ID NO: 1732886 - RNA, 21 nt, Human
agauugugccccugcacucca

SEQ ID NO: 1732887 - RNA, 17 nt, Human
agauuucacucuccuug

SEQ ID NO: 1732888 - RNA, 14 nt, Human
agauuucacucucc

SEQ ID NO: 1732889 - RNA, 13 nt, Human
agauuucacucuc

SEQ ID NO: 1732890 - RNA, 21 nt, Human
ugagcaucaggccaggcccuc

SEQ ID NO: 1732891 - RNA, 24 nt, Human
ugagcaucaggccaggcccucugc

SEQ ID NO: 1732892 - RNA, 22 nt, Human
ugagcaucaggccaggcccucu

SEQ ID NO: 1732893 - RNA, 14 nt, Human
ugagccaccgugcc

SEQ ID NO: 1732894 - RNA, 15 nt, Human
ugagccaccacgccc

SEQ ID NO: 1732895 - RNA, 16 nt, Human
ugagccagauuucacu

SEQ ID NO: 1732896 - RNA, 14 nt, Human
ugagccagauuuca

SEQ ID NO: 1732897 - RNA, 13 nt, Human
ugagccagauuuc

SEQ ID NO: 1732898 - RNA, 23 nt, Human
ugagccacugcaccgggccacag

SEQ ID NO: 1732899 - RNA, 18 nt, Human
ugagccacugcaccgggc

SEQ ID NO: 1732900 - RNA, 21 nt, Human
ugagccacugcaccgggccac

SEQ ID NO: 1732901 - RNA, 21 nt, Human
ugagccaccgugccuggccac

SEQ ID NO: 1732902 - RNA, 20 nt, Human
ugagccaccgugccuggcca

SEQ ID NO: 1732903 - RNA, 19 nt, Human
ugagccaccgugccuggcc

SEQ ID NO: 1732904 - RNA, 18 nt, Human
ugagccaccgugccuggc

SEQ ID NO: 1732905 - RNA, 15 nt, Human
ugagcaauccugcaa

SEQ ID NO: 1732906 - RNA, 19 nt, Human
ugagcaaauguggcuccug

SEQ ID NO: 1732907 - RNA, 18 nt, Human
ugagcaaauguggcuccu

SEQ ID NO: 1732908 - RNA, 16 nt, Human
ugagcaaauguggcuc

SEQ ID NO: 1732909 - RNA, 23 nt, Human
ugagcacuaaggugugcucugau

SEQ ID NO: 1732910 - RNA, 22 nt, Human
ugagcacuaaggugugcucuga

SEQ ID NO: 1732911 - RNA, 21 nt, Human
ugagcacuaaggugugcucug

SEQ ID NO: 1732912 - RNA, 20 nt, Human
ugagcacuaaggugugcucu

SEQ ID NO: 1732913 - RNA, 16 nt, Human
agcacagcuucauuuc

SEQ ID NO: 1732914 - RNA, 16 nt, Human
agcacaugccucucuc

SEQ ID NO: 1732915 - RNA, 14 nt, Human
agcacaugccucuc

SEQ ID NO: 1732916 - RNA, 13 nt, Human
agcacaugccucu

SEQ ID NO: 1732917 - RNA, 13 nt, Human
agcaagugagagc

SEQ ID NO: 1732918 - RNA, 20 nt, Human
agcaagugagacccugucuc

SEQ ID NO: 1732919 - RNA, 22 nt, Human
ugagccagauuucacucuccuu

SEQ ID NO: 1732920 - RNA, 17 nt, Human
ugagccagauuucacuc

SEQ ID NO: 1732921 - RNA, 14 nt, Human
agcaagugagagcu

SEQ ID NO: 1732922 - RNA, 22 nt, Human
agcaagugagagcuggguguca

SEQ ID NO: 1732923 - RNA, 21 nt, Human
agcacagcagccccugcacaa

SEQ ID NO: 1732924 - RNA, 14 nt, Human
agcagaacagugau

SEQ ID NO: 1732925 - RNA, 19 nt, Human
agcagaaaugccuuacccu

SEQ ID NO: 1732926 - RNA, 12 nt, Human
agcagaaaugcc

SEQ ID NO: 1732927 - RNA, 13 nt, Human
agcagaaaugccu

SEQ ID NO: 1732928 - RNA, 23 nt, Human
agcacuuugggaggccaaggugg

SEQ ID NO: 1732929 - RNA, 22 nt, Human
agcacuuugggaggccaaggug

SEQ ID NO: 1732930 - RNA, 16 nt, Human
agcacgauuucuguuu

SEQ ID NO: 1732931 - RNA, 14 nt, Human
agcacgauuucugu

SEQ ID NO: 1732932 - RNA, 15 nt, Human
agcacgauuucuguu

SEQ ID NO: 1732933 - RNA, 13 nt, Human
agcacgauuucug

SEQ ID NO: 1732934 - RNA, 23 nt, Human
agcaccuuagacagucccugcca

SEQ ID NO: 1732935 - RNA, 22 nt, Human
agcaccuuagacagucccugcc

SEQ ID NO: 1732936 - RNA, 21 nt, Human
agcaccuuagacagucccugc

SEQ ID NO: 1732937 - RNA, 20 nt, Human
agcaccuuagacagucccug

SEQ ID NO: 1732938 - RNA, 19 nt, Human
agcaccuuagacagucccu

SEQ ID NO: 1732939 - RNA, 13 nt, Human
agcaccagggaag

SEQ ID NO: 1732940 - RNA, 12 nt, Human
agcaccagggaa

SEQ ID NO: 1732941 - RNA, 10 nt, Human
agcaccaggg

SEQ ID NO: 1732942 - RNA, 13 nt, Human
ugagcgacaguga

SEQ ID NO: 1732943 - RNA, 14 nt, Human
ugagcgacagugag

SEQ ID NO: 1732944 - RNA, 16 nt, Human
ugagcgacagugagac

SEQ ID NO: 1732945 - RNA, 20 nt, Human
ugagcgacagugagacucug

SEQ ID NO: 1732946 - RNA, 15 nt, Human
ugagccuugaacuuu

SEQ ID NO: 1732947 - RNA, 17 nt, Human
ugagccuugaacuuuga

SEQ ID NO: 1732948 - RNA, 18 nt, Human
ugagccuugaacuuugac

SEQ ID NO: 1732949 - RNA, 19 nt, Human
ugagccuugaacuuugacc

SEQ ID NO: 1732950 - RNA, 14 nt, Human
ugagccuugaacuu

SEQ ID NO: 1732951 - RNA, 22 nt, Human
ugagccugggaggucaaggcug

SEQ ID NO: 1732952 - RNA, 19 nt, Human
ugagccugggaggucaagg

SEQ ID NO: 1732953 - RNA, 14 nt, Human
ugagccugggaggu

SEQ ID NO: 1732954 - RNA, 16 nt, Human
ugagccuggcaagaau

SEQ ID NO: 1732955 - RNA, 11 nt, Human
ugagccuggca

SEQ ID NO: 1732956 - RNA, 10 nt, Human
ugagccuggc

SEQ ID NO: 1732957 - RNA, 16 nt, Human
agcagagaccaucccu

SEQ ID NO: 1732958 - RNA, 15 nt, Human
agcagagaccauccc

SEQ ID NO: 1732959 - RNA, 21 nt, Human
agcagagaauucucuuaucca

SEQ ID NO: 1732960 - RNA, 14 nt, Human
agcagagaauucuc

SEQ ID NO: 1732961 - RNA, 23 nt, Human
agcagagaaugaaagggcccaga

SEQ ID NO: 1732962 - RNA, 22 nt, Human
agcagagaaugaaagggcccag

SEQ ID NO: 1732963 - RNA, 21 nt, Human
agcagagaaugaaagggccca

SEQ ID NO: 1732964 - RNA, 15 nt, Human
ugaggaagcaaaagc

SEQ ID NO: 1732965 - RNA, 21 nt, Human
ugaggaagccgcuggggccag

SEQ ID NO: 1732966 - RNA, 19 nt, Human
ugaggaagccgcuggggcc

SEQ ID NO: 1732967 - RNA, 18 nt, Human
ugaggaagccgcuggggc

SEQ ID NO: 1732968 - RNA, 17 nt, Human
ugaggaagccgcugggg

SEQ ID NO: 1732969 - RNA, 14 nt, Human
ugaggaagccgcug

SEQ ID NO: 1732970 - RNA, 22 nt, Human
ugaggaagcaaaagcaucuaug

SEQ ID NO: 1732971 - RNA, 13 nt, Human
ugagcuacaaaug

SEQ ID NO: 1732972 - RNA, 14 nt, Human
ugagcuacaaaugc

SEQ ID NO: 1732973 - RNA, 16 nt, Human
ugagcuacaaaugcau

SEQ ID NO: 1732974 - RNA, 14 nt, Human
ugagcuaggaauug

SEQ ID NO: 1732975 - RNA, 22 nt, Human
ugaggaauccagacccggcugc

SEQ ID NO: 1732976 - RNA, 21 nt, Human
ugaggaauccagacccggcug

SEQ ID NO: 1732977 - RNA, 13 nt, Human
ugaggacaagaga

SEQ ID NO: 1732978 - RNA, 22 nt, Human
ugaggacaagagaaaaaagcca

SEQ ID NO: 1732979 - RNA, 21 nt, Human
ugaggacacuaaccacgcugg

SEQ ID NO: 1732980 - RNA, 12 nt, Human
ugaggccagaga

SEQ ID NO: 1732981 - RNA, 20 nt, Human
ugaggcccagagggccugca

SEQ ID NO: 1732982 - RNA, 18 nt, Human
ugaggcccagagggccug

SEQ ID NO: 1732983 - RNA, 17 nt, Human
ugaggcccagagggccu

SEQ ID NO: 1732984 - RNA, 15 nt, Human
ugaggcccagagggc

SEQ ID NO: 1732985 - RNA, 22 nt, Human
ugaggcccagagggccugcaag

SEQ ID NO: 1732986 - RNA, 21 nt, Human
ugaggcccagagggccugcaa

SEQ ID NO: 1732987 - RNA, 23 nt, Human
ugaggcccagagggccugcaagg

SEQ ID NO: 1732988 - RNA, 13 nt, Human
ugaggcccagagg

SEQ ID NO: 1732989 - RNA, 12 nt, Human
ugaggcccagag

SEQ ID NO: 1732990 - RNA, 16 nt, Human
ugaggccagagacaca

SEQ ID NO: 1732991 - RNA, 14 nt, Human
ugaggccagagaca

SEQ ID NO: 1732992 - RNA, 20 nt, Human
ugaggccagagacacaagcc

SEQ ID NO: 1732993 - RNA, 19 nt, Human
agcagauggagaccccuug

SEQ ID NO: 1732994 - RNA, 17 nt, Human
agcagaggaaggagagg

SEQ ID NO: 1732995 - RNA, 17 nt, Human
ugagguacugagaguga

SEQ ID NO: 1732996 - RNA, 20 nt, Human
ugaggguugggcugguguca

SEQ ID NO: 1732997 - RNA, 22 nt, Human
ugagguacugagagugaacaaa

SEQ ID NO: 1732998 - RNA, 13 nt, Human
ugaggucagagcc

SEQ ID NO: 1732999 - RNA, 16 nt, Human
ugaggucagagccugc

SEQ ID NO: 1733000 - RNA, 14 nt, Human
ugaggucagagccu

SEQ ID NO: 1733001 - RNA, 19 nt, Human
agcagagaccaucccugaa

SEQ ID NO: 1733002 - RNA, 18 nt, Human
agcagagaccaucccuga

SEQ ID NO: 1733003 - RNA, 17 nt, Human
ugaggucagagccugca

SEQ ID NO: 1733004 - RNA, 17 nt, Human
agcagagaccaucccug

SEQ ID NO: 1733005 - RNA, 20 nt, Human
agcagagcaccuuagacagu

SEQ ID NO: 1733006 - RNA, 20 nt, Human
agcagagaccaucccugaag

SEQ ID NO: 1733007 - RNA, 19 nt, Human
ugagguacaaccuguucug

SEQ ID NO: 1733008 - RNA, 13 nt, Human
ugaggggccucuu

SEQ ID NO: 1733009 - RNA, 14 nt, Human
ugaggguaaguauu

SEQ ID NO: 1733010 - RNA, 12 nt, Human
ugaggggccucu

SEQ ID NO: 1733011 - RNA, 24 nt, Human
ugaggcccuucucuccagccccug

SEQ ID NO: 1733012 - RNA, 23 nt, Human
ugaggcccuucucuccagccccu

SEQ ID NO: 1733013 - RNA, 22 nt, Human
ugaggcccuucucuccagcccc

SEQ ID NO: 1733014 - RNA, 20 nt, Human
ugaggcccuucucuccagcc

SEQ ID NO: 1733015 - RNA, 19 nt, Human
ugaggcccuucucuccagc

SEQ ID NO: 1733016 - RNA, 18 nt, Human
ugaggcccuucucuccag

SEQ ID NO: 1733017 - RNA, 16 nt, Human
ugaggcccuucucucc

SEQ ID NO: 1733018 - RNA, 19 nt, Human
ugagggauacccaucccau

SEQ ID NO: 1733019 - RNA, 15 nt, Human
ugagggauuaucuuu

SEQ ID NO: 1733020 - RNA, 14 nt, Human
accacaucuugcuc

SEQ ID NO: 1733021 - RNA, 21 nt, Human
accacagacauacuaaccagc

SEQ ID NO: 1733022 - RNA, 22 nt, Human
accacagacauacuaaccagca

SEQ ID NO: 1733023 - RNA, 13 nt, Human
accacugcagaag

SEQ ID NO: 1733024 - RNA, 14 nt, Human
accacugcagaaga

SEQ ID NO: 1733025 - RNA, 19 nt, Human
accacugcagaagacagua

SEQ ID NO: 1733026 - RNA, 14 nt, Human
accacuucagcuga

SEQ ID NO: 1733027 - RNA, 13 nt, Human
accacuucagcug

SEQ ID NO: 1733028 - RNA, 15 nt, Human
accacuucagcugac

SEQ ID NO: 1733029 - RNA, 24 nt, Human
accacaucuugcucugcugacaga

SEQ ID NO: 1733030 - RNA, 21 nt, Human
accacaucuugcucugcugac

SEQ ID NO: 1733031 - RNA, 20 nt, Human
accacaucuugcucugcuga

SEQ ID NO: 1733032 - RNA, 16 nt, Human
accacaucuugcucug

SEQ ID NO: 1733033 - RNA, 20 nt, Human
accacucuaucaaguauuau

SEQ ID NO: 1733034 - RNA, 12 nt, Human
accacuuuuguu

SEQ ID NO: 1733035 - RNA, 23 nt, Human
accagacaccuugacagggcaca

SEQ ID NO: 1733036 - RNA, 22 nt, Human
accagacaccuugacagggcac

SEQ ID NO: 1733037 - RNA, 11 nt, Human
accagacaggu

SEQ ID NO: 1733038 - RNA, 22 nt, Human
accagagcccaccuuggcucaa

SEQ ID NO: 1733039 - RNA, 19 nt, Human
accagagcccaccuuggcu

SEQ ID NO: 1733040 - RNA, 12 nt, Human
accagagcugcc

SEQ ID NO: 1733041 - RNA, 23 nt, Human
ucaccugaagacucauucuucug

SEQ ID NO: 1733042 - RNA, 19 nt, Human
ucaccugaagacucauucu

SEQ ID NO: 1733043 - RNA, 15 nt, Human
ucaccucccccaucu

SEQ ID NO: 1733044 - RNA, 13 nt, Human
ucaccucccccau

SEQ ID NO: 1733045 - RNA, 19 nt, Human
accaggcaacuugggaacu

SEQ ID NO: 1733046 - RNA, 21 nt, Human
accaguguuguggauuuaaca

SEQ ID NO: 1733047 - RNA, 12 nt, Human
accagugccuua

SEQ ID NO: 1733048 - RNA, 18 nt, Human
ucacuguugcccaggcug

SEQ ID NO: 1733049 - RNA, 17 nt, Human
ucacuguugcccaggcu

SEQ ID NO: 1733050 - RNA, 19 nt, Human
ucacuguugcccaggcugg

SEQ ID NO: 1733051 - RNA, 12 nt, Human
ucacugcagccu

SEQ ID NO: 1733052 - RNA, 13 nt, Human
ucacugcagccuc

SEQ ID NO: 1733053 - RNA, 24 nt, Human
ucacugcacagugcaucucagccc

SEQ ID NO: 1733054 - RNA, 22 nt, Human
ucacugcacagugcaucucagc

SEQ ID NO: 1733055 - RNA, 20 nt, Human
ucacugcacagugcaucuca

SEQ ID NO: 1733056 - RNA, 16 nt, Human
ucacuguugcccaggc

SEQ ID NO: 1733057 - RNA, 15 nt, Human
ucacugagacagccc

SEQ ID NO: 1733058 - RNA, 14 nt, Human
ucacugagacagcc

SEQ ID NO: 1733059 - RNA, 13 nt, Human
ucacugagacagc

SEQ ID NO: 1733060 - RNA, 16 nt, Human
ucaccugccccucaac

SEQ ID NO: 1733061 - RNA, 18 nt, Human
accauucuccaccugcca

SEQ ID NO: 1733062 - RNA, 16 nt, Human
accauucuccaccugc

SEQ ID NO: 1733063 - RNA, 13 nt, Human
accauucuccacc

SEQ ID NO: 1733064 - RNA, 22 nt, Human
accaugauuaaccacuucagcu

SEQ ID NO: 1733065 - RNA, 23 nt, Human
accaugauuaaccacuucagcug

SEQ ID NO: 1733066 - RNA, 12 nt, Human
accauuccccau

SEQ ID NO: 1733067 - RNA, 15 nt, Human
accauuccccauggg

SEQ ID NO: 1733068 - RNA, 13 nt, Human
acccaaaaggcag

SEQ ID NO: 1733069 - RNA, 15 nt, Human
acccaaaaggcagaa

SEQ ID NO: 1733070 - RNA, 23 nt, Human
accauuuugggguacccacugcu

SEQ ID NO: 1733071 - RNA, 21 nt, Human
acccaaauguucaucaaugaa

SEQ ID NO: 1733072 - RNA, 18 nt, Human
acccaaaaggcagaagca

SEQ ID NO: 1733073 - RNA, 16 nt, Human
acccagaagaaaauag

SEQ ID NO: 1733074 - RNA, 19 nt, Human
acccacuugcuuuuaaaau

SEQ ID NO: 1733075 - RNA, 18 nt, Human
acccagcccacuucugcc

SEQ ID NO: 1733076 - RNA, 17 nt, Human
acccagcccacuucugc

SEQ ID NO: 1733077 - RNA, 16 nt, Human
acccagcccacuucug

SEQ ID NO: 1733078 - RNA, 18 nt, Human
ucagcggggacagcuccu

SEQ ID NO: 1733079 - RNA, 17 nt, Human
ucagcggggacagcucc

SEQ ID NO: 1733080 - RNA, 16 nt, Human
ucagcggggacagcuc

SEQ ID NO: 1733081 - RNA, 15 nt, Human
ucagcggggacagcu

SEQ ID NO: 1733082 - RNA, 20 nt, Human
ucaggaagcucagggccugg

SEQ ID NO: 1733083 - RNA, 19 nt, Human
ucaggaagcucagggccug

SEQ ID NO: 1733084 - RNA, 17 nt, Human
ucaggaagcucagggcc

SEQ ID NO: 1733085 - RNA, 12 nt, Human
ucaggaagcuca

SEQ ID NO: 1733086 - RNA, 16 nt, Human
ucaggaagcucagggc

SEQ ID NO: 1733087 - RNA, 23 nt, Human
ucaggccaaacucaccugccccu

SEQ ID NO: 1733088 - RNA, 20 nt, Human
ucaggccaaacucaccugcc

SEQ ID NO: 1733089 - RNA, 19 nt, Human
accccuucgcuccuguguc

SEQ ID NO: 1733090 - RNA, 16 nt, Human
ucagguaacaggcaga

SEQ ID NO: 1733091 - RNA, 15 nt, Human
ucagguaacaggcag

SEQ ID NO: 1733092 - RNA, 13 nt, Human
ucagguaacaggc

SEQ ID NO: 1733093 - RNA, 18 nt, Human
ucagggucccugguggca

SEQ ID NO: 1733094 - RNA, 14 nt, Human
ucagggucccuggu

SEQ ID NO: 1733095 - RNA, 13 nt, Human
ucagggucccugg

SEQ ID NO: 1733096 - RNA, 12 nt, Human
ucaggccaggcc

SEQ ID NO: 1733097 - RNA, 11 nt, Human
ucaggccaggc

SEQ ID NO: 1733098 - RNA, 20 nt, Human
ucaggccagcugcuugggcu

SEQ ID NO: 1733099 - RNA, 15 nt, Human
ucaggccagcugcuu

SEQ ID NO: 1733100 - RNA, 14 nt, Human
acccucuuagaaaa

SEQ ID NO: 1733101 - RNA, 12 nt, Human
acccugcccugu

SEQ ID NO: 1733102 - RNA, 11 nt, Human
acccugcccug

SEQ ID NO: 1733103 - RNA, 13 nt, Human
acccugcccugug

SEQ ID NO: 1733104 - RNA, 14 nt, Human
acccugcccugugg

SEQ ID NO: 1733105 - RNA, 19 nt, Human
acccuuguggucccacccc

SEQ ID NO: 1733106 - RNA, 17 nt, Human
acccuuguggucccacc

SEQ ID NO: 1733107 - RNA, 16 nt, Human
acccuuguggucccac

SEQ ID NO: 1733108 - RNA, 20 nt, Human
accccuucgcuccugugucu

SEQ ID NO: 1733109 - RNA, 13 nt, Human
ucagaagacacug

SEQ ID NO: 1733110 - RNA, 13 nt, Human
ucagaucuucugu

SEQ ID NO: 1733111 - RNA, 19 nt, Human
ucagcccucccugccccuc

SEQ ID NO: 1733112 - RNA, 18 nt, Human
ucagcccucccugccccu

SEQ ID NO: 1733113 - RNA, 15 nt, Human
acccagcucuggucc

SEQ ID NO: 1733114 - RNA, 13 nt, Human
acccagcucuggu

SEQ ID NO: 1733115 - RNA, 15 nt, Human
acccccagccugcua

SEQ ID NO: 1733116 - RNA, 16 nt, Human
acccccaaauuuucuu

SEQ ID NO: 1733117 - RNA, 14 nt, Human
acccccagccugcu

SEQ ID NO: 1733118 - RNA, 12 nt, Human
accccuggcuuu

SEQ ID NO: 1733119 - RNA, 12 nt, Human
ucagccugggca

SEQ ID NO: 1733120 - RNA, 10 nt, Human
ucagccuggg

SEQ ID NO: 1733121 - RNA, 19 nt, Human
ucagccuggcuucaaauug

SEQ ID NO: 1733122 - RNA, 17 nt, Human
accccuggcuuuucacu

SEQ ID NO: 1733123 - RNA, 15 nt, Human
accccuggcuuuuca

SEQ ID NO: 1733124 - RNA, 13 nt, Human
accuagccuuaga

SEQ ID NO: 1733125 - RNA, 20 nt, Human
accuccgccucuuggguuca

SEQ ID NO: 1733126 - RNA, 10 nt, Human
acccuuuucu

SEQ ID NO: 1733127 - RNA, 18 nt, Human
accgagucucuucuccac

SEQ ID NO: 1733128 - RNA, 22 nt, Human
ucauauuuacuucuuauacauu

SEQ ID NO: 1733129 - RNA, 21 nt, Human
ucauauuuacuucuuauacau

SEQ ID NO: 1733130 - RNA, 20 nt, Human
ucauauuuacuucuuauaca

SEQ ID NO: 1733131 - RNA, 20 nt, Human
accgcagacaggaccaggga

SEQ ID NO: 1733132 - RNA, 24 nt, Human
accgagucucuucuccacuggaug

SEQ ID NO: 1733133 - RNA, 21 nt, Human
accgagucucuucuccacugg

SEQ ID NO: 1733134 - RNA, 20 nt, Human
accgagucucuucuccacug

SEQ ID NO: 1733135 - RNA, 17 nt, Human
accgccaaggcuggggg

SEQ ID NO: 1733136 - RNA, 15 nt, Human
accucucccuuggau

SEQ ID NO: 1733137 - RNA, 14 nt, Human
accucucccuugga

SEQ ID NO: 1733138 - RNA, 13 nt, Human
accucucccuugg

SEQ ID NO: 1733139 - RNA, 19 nt, Human
accucucucacuccuugaa

SEQ ID NO: 1733140 - RNA, 14 nt, Human
accucucucacucc

SEQ ID NO: 1733141 - RNA, 23 nt, Human
accucucccuuggauuguccccg

SEQ ID NO: 1733142 - RNA, 12 nt, Human
accucugcacaa

SEQ ID NO: 1733143 - RNA, 22 nt, Human
ucauugaccugaggcccuucuc

SEQ ID NO: 1733144 - RNA, 21 nt, Human
ucauucuccuuguguuacuaa

SEQ ID NO: 1733145 - RNA, 23 nt, Human
ucauucgcuacuaugauuuaauu

SEQ ID NO: 1733146 - RNA, 17 nt, Human
accucggugccuuccuc

SEQ ID NO: 1733147 - RNA, 13 nt, Human
ucaugucuggcua

SEQ ID NO: 1733148 - RNA, 14 nt, Human
ucaugugaaaucau

SEQ ID NO: 1733149 - RNA, 11 nt, Human
ucauguucuua

SEQ ID NO: 1733150 - RNA, 17 nt, Human
ucauguucuuaauucuu

SEQ ID NO: 1733151 - RNA, 23 nt, Human
ucauccacugugccaugugccag

SEQ ID NO: 1733152 - RNA, 21 nt, Human
ucauccacugugccaugugcc

SEQ ID NO: 1733153 - RNA, 19 nt, Human
ucauccacugugccaugug

SEQ ID NO: 1733154 - RNA, 19 nt, Human
ucaugacaaagacugagua

SEQ ID NO: 1733155 - RNA, 12 nt, Human
accuucuccuuc

SEQ ID NO: 1733156 - RNA, 13 nt, Human
accuucuccuuca

SEQ ID NO: 1733157 - RNA, 14 nt, Human
accuucuccuucac

SEQ ID NO: 1733158 - RNA, 12 nt, Human
accuucuguggc

SEQ ID NO: 1733159 - RNA, 16 nt, Human
accuucuguggcucac

SEQ ID NO: 1733160 - RNA, 15 nt, Human
accuucuguggcuca

SEQ ID NO: 1733161 - RNA, 13 nt, Human
accuucuguggcu

SEQ ID NO: 1733162 - RNA, 14 nt, Human
accuugacagggca

SEQ ID NO: 1733163 - RNA, 15 nt, Human
accuugaaugaugcc

SEQ ID NO: 1733164 - RNA, 15 nt, Human
accuugacagggcac

SEQ ID NO: 1733165 - RNA, 16 nt, Human
accuugacagggcaca

SEQ ID NO: 1733166 - RNA, 17 nt, Human
accuuagacagucccug

SEQ ID NO: 1733167 - RNA, 14 nt, Human
accuuagccugccc

SEQ ID NO: 1733168 - RNA, 15 nt, Human
uccaccaucaagcca

SEQ ID NO: 1733169 - RNA, 23 nt, Human
accuggucacaggacucugccuc

SEQ ID NO: 1733170 - RNA, 22 nt, Human
accuggucacaggacucugccu

SEQ ID NO: 1733171 - RNA, 21 nt, Human
uccagccugagcgacagugag

SEQ ID NO: 1733172 - RNA, 20 nt, Human
uccagccugagcgacaguga

SEQ ID NO: 1733173 - RNA, 22 nt, Human
uccagccccuggaugcagccuc

SEQ ID NO: 1733174 - RNA, 23 nt, Human
uccagaccccuggcuuuucacug

SEQ ID NO: 1733175 - RNA, 21 nt, Human
uccagccccuggaugcagccu

SEQ ID NO: 1733176 - RNA, 19 nt, Human
uccagccccuggaugcagc

SEQ ID NO: 1733177 - RNA, 17 nt, Human
uccagccccuggaugca

SEQ ID NO: 1733178 - RNA, 16 nt, Human
uccagccccuggaugc

SEQ ID NO: 1733179 - RNA, 15 nt, Human
uccagccccuggaug

SEQ ID NO: 1733180 - RNA, 14 nt, Human
uccagacccggcug

SEQ ID NO: 1733181 - RNA, 18 nt, Human
uccagaccccuggcuuuu

SEQ ID NO: 1733182 - RNA, 17 nt, Human
uccagaccccuggcuuu

SEQ ID NO: 1733183 - RNA, 16 nt, Human
uccagaccccuggcuu

SEQ ID NO: 1733184 - RNA, 15 nt, Human
uccagaccccuggcu

SEQ ID NO: 1733185 - RNA, 23 nt, Human
accuuuguauucucuccuguacc

SEQ ID NO: 1733186 - RNA, 15 nt, Human
accuuuguauucucu

SEQ ID NO: 1733187 - RNA, 19 nt, Human
accuuuguauucucuccug

SEQ ID NO: 1733188 - RNA, 22 nt, Human
uccagaaguuugagaucagccu

SEQ ID NO: 1733189 - RNA, 18 nt, Human
accugcggugcuaucucc

SEQ ID NO: 1733190 - RNA, 22 nt, Human
accugaagucuuuguacagaca

SEQ ID NO: 1733191 - RNA, 15 nt, Human
accugaagucuuugu

SEQ ID NO: 1733192 - RNA, 22 nt, Human
accugcggugcuaucuccccca

SEQ ID NO: 1733193 - RNA, 19 nt, Human
accugcggugcuaucuccc

SEQ ID NO: 1733194 - RNA, 23 nt, Human
accugcggugcuaucucccccag

SEQ ID NO: 1733195 - RNA, 17 nt, Human
accugcucuccucuugc

SEQ ID NO: 1733196 - RNA, 18 nt, Human
accugcucuccucuugcc

SEQ ID NO: 1733197 - RNA, 14 nt, Human
accuggaauauaua

SEQ ID NO: 1733198 - RNA, 17 nt, Human
accuggaauauauaacc

SEQ ID NO: 1733199 - RNA, 19 nt, Human
ucauuugagcagggcucag

SEQ ID NO: 1733200 - RNA, 19 nt, Human
accugcucuccucuugcca

SEQ ID NO: 1733201 - RNA, 13 nt, Human
ucauuuuuuuuaa

SEQ ID NO: 1733202 - RNA, 17 nt, Human
ucauuuuuuuuaagaaa

SEQ ID NO: 1733203 - RNA, 23 nt, Human
uccaaagucucuggaauuugaaa

SEQ ID NO: 1733204 - RNA, 14 nt, Human
ucauuugcuuugga

SEQ ID NO: 1733205 - RNA, 18 nt, Human
ucauuugugccagaaugc

SEQ ID NO: 1733206 - RNA, 21 nt, Human
ucauuugagcagggcucagcg

SEQ ID NO: 1733207 - RNA, 16 nt, Human
uccacaguggaaccag

SEQ ID NO: 1733208 - RNA, 20 nt, Human
uccacaguggaaccagccca

SEQ ID NO: 1733209 - RNA, 11 nt, Human
uccaagcuggu

SEQ ID NO: 1733210 - RNA, 14 nt, Human
uccacagugacucc

SEQ ID NO: 1733211 - RNA, 13 nt, Human
uccaagcucccag

SEQ ID NO: 1733212 - RNA, 12 nt, Human
uccaagcuccca

SEQ ID NO: 1733213 - RNA, 15 nt, Human
uccaagcucccaggc

SEQ ID NO: 1733214 - RNA, 14 nt, Human
uccaagcucccagg

SEQ ID NO: 1733215 - RNA, 16 nt, Human
uccaagcucccaggca

SEQ ID NO: 1733216 - RNA, 18 nt, Human
uccaagcuccaucuccac

SEQ ID NO: 1733217 - RNA, 15 nt, Human
uccaaaugcagcuuu

SEQ ID NO: 1733218 - RNA, 14 nt, Human
uccaaaugcagcuu

SEQ ID NO: 1733219 - RNA, 18 nt, Human
uccugugacuucagcucu

SEQ ID NO: 1733220 - RNA, 21 nt, Human
uccugcugcaguugccaguca

SEQ ID NO: 1733221 - RNA, 13 nt, Human
uccugcugcaguu

SEQ ID NO: 1733222 - RNA, 19 nt, Human
uccuggggaaccugacccc

SEQ ID NO: 1733223 - RNA, 18 nt, Human
uccuggggaaccugaccc

SEQ ID NO: 1733224 - RNA, 23 nt, Human
uccuggggguucuuucuuccucu

SEQ ID NO: 1733225 - RNA, 22 nt, Human
uccuggggguucuuucuuccuc

SEQ ID NO: 1733226 - RNA, 21 nt, Human
uccuggggguucuuucuuccu

SEQ ID NO: 1733227 - RNA, 22 nt, Human
acugcagccucaaccuccuggg

SEQ ID NO: 1733228 - RNA, 21 nt, Human
acugcagccucaaccuccugg

SEQ ID NO: 1733229 - RNA, 19 nt, Human
acugcagccucaaccuccu

SEQ ID NO: 1733230 - RNA, 13 nt, Human
acugcacuguuuu

SEQ ID NO: 1733231 - RNA, 23 nt, Human
acugcagccucaaccuccugggc

SEQ ID NO: 1733232 - RNA, 16 nt, Human
acugcagggacugcca

SEQ ID NO: 1733233 - RNA, 18 nt, Human
acugcagggacugccagu

SEQ ID NO: 1733234 - RNA, 17 nt, Human
acugcagggacugccag

SEQ ID NO: 1733235 - RNA, 24 nt, Human
uccugugucuugcaauggcagccu

SEQ ID NO: 1733236 - RNA, 23 nt, Human
uccugugucuugcaauggcagcc

SEQ ID NO: 1733237 - RNA, 14 nt, Human
uccugugugugcgc

SEQ ID NO: 1733238 - RNA, 13 nt, Human
uccugugugugcg

SEQ ID NO: 1733239 - RNA, 18 nt, Human
uccugugugugcgccuac

SEQ ID NO: 1733240 - RNA, 19 nt, Human
uccuguucccaugagauga

SEQ ID NO: 1733241 - RNA, 19 nt, Human
uccuguucuuaagacguga

SEQ ID NO: 1733242 - RNA, 17 nt, Human
uccuguugucaagaaua

SEQ ID NO: 1733243 - RNA, 22 nt, Human
acugcacagugcaucucagccc

SEQ ID NO: 1733244 - RNA, 18 nt, Human
acugcacagugcaucuca

SEQ ID NO: 1733245 - RNA, 16 nt, Human
acugcacagugcaucu

SEQ ID NO: 1733246 - RNA, 20 nt, Human
uccugaguagcugggauuac

SEQ ID NO: 1733247 - RNA, 19 nt, Human
uccugaguagcuggauuac

SEQ ID NO: 1733248 - RNA, 20 nt, Human
uccugccucgaacuggcugc

SEQ ID NO: 1733249 - RNA, 21 nt, Human
uccugccucgaacuggcugca

SEQ ID NO: 1733250 - RNA, 20 nt, Human
uccugcaggcagccaggcca

SEQ ID NO: 1733251 - RNA, 19 nt, Human
uccugcaggcagccaggcc

SEQ ID NO: 1733252 - RNA, 17 nt, Human
uccugcaggcagccagg

SEQ ID NO: 1733253 - RNA, 16 nt, Human
uccugcaggcagccag

SEQ ID NO: 1733254 - RNA, 19 nt, Human
uccugccucagccucccaa

SEQ ID NO: 1733255 - RNA, 22 nt, Human
uccugcaggcagccaggccaca

SEQ ID NO: 1733256 - RNA, 17 nt, Human
acugaggggaggggagc

SEQ ID NO: 1733257 - RNA, 22 nt, Human
acugaggggaggggagcauggg

SEQ ID NO: 1733258 - RNA, 14 nt, Human
acugaggaucagag

SEQ ID NO: 1733259 - RNA, 15 nt, Human
acugaggaccagcca

SEQ ID NO: 1733260 - RNA, 15 nt, Human
uccucuccccagcaa

SEQ ID NO: 1733261 - RNA, 18 nt, Human
acugaguacguugugcau

SEQ ID NO: 1733262 - RNA, 19 nt, Human
acugaguacguugugcauu

SEQ ID NO: 1733263 - RNA, 21 nt, Human
acugaguacguugugcauuug

SEQ ID NO: 1733264 - RNA, 22 nt, Human
acugaguacguugugcauuugg

SEQ ID NO: 1733265 - RNA, 23 nt, Human
acugaguacguugugcauuuggu

SEQ ID NO: 1733266 - RNA, 16 nt, Human
acugagugccuuuugg

SEQ ID NO: 1733267 - RNA, 14 nt, Human
acugcaaccuccgc

SEQ ID NO: 1733268 - RNA, 13 nt, Human
acugcaaccuccg

SEQ ID NO: 1733269 - RNA, 22 nt, Human
acugcaaccuccgccucuuggg

SEQ ID NO: 1733270 - RNA, 16 nt, Human
acugcaaccuccgccu

SEQ ID NO: 1733271 - RNA, 23 nt, Human
acugcaaccuucgccaccugggu

SEQ ID NO: 1733272 - RNA, 20 nt, Human
acugcaaccuucgccaccug

SEQ ID NO: 1733273 - RNA, 20 nt, Human
acuguacagacagaaaaaac

SEQ ID NO: 1733274 - RNA, 15 nt, Human
acuguacaaaguaga

SEQ ID NO: 1733275 - RNA, 14 nt, Human
acuguacaaaguag

SEQ ID NO: 1733276 - RNA, 13 nt, Human
acuguacaaagua

SEQ ID NO: 1733277 - RNA, 19 nt, Human
acuguaauuugugauacaa

SEQ ID NO: 1733278 - RNA, 23 nt, Human
acuguacaugaaaacacauuuuu

SEQ ID NO: 1733279 - RNA, 13 nt, Human
acuguacaugaaa

SEQ ID NO: 1733280 - RNA, 14 nt, Human
acuguacaugaaaa

SEQ ID NO: 1733281 - RNA, 15 nt, Human
acuguacuccuccca

SEQ ID NO: 1733282 - RNA, 23 nt, Human
acuguagaaaagggaacugaaca

SEQ ID NO: 1733283 - RNA, 14 nt, Human
acuguacuccuccc

SEQ ID NO: 1733284 - RNA, 13 nt, Human
acuguacuccucc

SEQ ID NO: 1733285 - RNA, 14 nt, Human
ucgcuccugugucu

SEQ ID NO: 1733286 - RNA, 17 nt, Human
acugggagaaaugaaaa

SEQ ID NO: 1733287 - RNA, 13 nt, Human
ucgcuccuguguc

SEQ ID NO: 1733288 - RNA, 12 nt, Human
ucgcuccugugu

SEQ ID NO: 1733289 - RNA, 19 nt, Human
acuggguacuuguggacac

SEQ ID NO: 1733290 - RNA, 23 nt, Human
acuggguacuuguggacacagcu

SEQ ID NO: 1733291 - RNA, 20 nt, Human
acuggguacuuguggacaca

SEQ ID NO: 1733292 - RNA, 16 nt, Human
acuguaaggcaaucau

SEQ ID NO: 1733293 - RNA, 15 nt, Human
ucgaacuggcugcaa

SEQ ID NO: 1733294 - RNA, 14 nt, Human
ucgaacuggcugca

SEQ ID NO: 1733295 - RNA, 15 nt, Human
uccuuucaccacaug

SEQ ID NO: 1733296 - RNA, 20 nt, Human
uccuuucacaaccuucugug

SEQ ID NO: 1733297 - RNA, 19 nt, Human
uccuuucacaaccuucugu

SEQ ID NO: 1733298 - RNA, 18 nt, Human
uccuuucacaaccuucug

SEQ ID NO: 1733299 - RNA, 16 nt, Human
uccuuucacaaccuuc

SEQ ID NO: 1733300 - RNA, 13 nt, Human
ucgcgacaaugca

SEQ ID NO: 1733301 - RNA, 14 nt, Human
ucgcgacaaugcaa

SEQ ID NO: 1733302 - RNA, 17 nt, Human
ucgaggacagggaggug

SEQ ID NO: 1733303 - RNA, 14 nt, Human
ucgaggacagggag

SEQ ID NO: 1733304 - RNA, 15 nt, Human
ucgagcaugccugga

SEQ ID NO: 1733305 - RNA, 14 nt, Human
ucgagcaugccugg

SEQ ID NO: 1733306 - RNA, 13 nt, Human
ucgaccugccucg

SEQ ID NO: 1733307 - RNA, 21 nt, Human
acugcuugugaaaggaaagag

SEQ ID NO: 1733308 - RNA, 22 nt, Human
acuggauuaaacuuaaucuaaa

SEQ ID NO: 1733309 - RNA, 13 nt, Human
acugcuggcugcc

SEQ ID NO: 1733310 - RNA, 23 nt, Human
acugcuuccagugaggcucugcc

SEQ ID NO: 1733311 - RNA, 22 nt, Human
acugcuuccagugaggcucugc

SEQ ID NO: 1733312 - RNA, 21 nt, Human
acugcuuccagugaggcucug

SEQ ID NO: 1733313 - RNA, 18 nt, Human
acugcuuccagugaggcu

SEQ ID NO: 1733314 - RNA, 21 nt, Human
acugcugcccagccuccaagc

SEQ ID NO: 1733315 - RNA, 18 nt, Human
acugcugcccagccucca

SEQ ID NO: 1733316 - RNA, 16 nt, Human
acugcugcccagccuc

SEQ ID NO: 1733317 - RNA, 12 nt, Human
acugcuggcugc

SEQ ID NO: 1733318 - RNA, 12 nt, Human
acugcucugaug

SEQ ID NO: 1733319 - RNA, 13 nt, Human
uccuucagccuga

SEQ ID NO: 1733320 - RNA, 11 nt, Human
uccuucagugc

SEQ ID NO: 1733321 - RNA, 12 nt, Human
uccuucagugcc

SEQ ID NO: 1733322 - RNA, 20 nt, Human
uccuucagugccuuauggaa

SEQ ID NO: 1733323 - RNA, 13 nt, Human
uccuucagugccu

SEQ ID NO: 1733324 - RNA, 22 nt, Human
uccuucagugccuuauggaaca

SEQ ID NO: 1733325 - RNA, 14 nt, Human
uccuucagugccuu

SEQ ID NO: 1733326 - RNA, 16 nt, Human
uccuuccucugaggcu

SEQ ID NO: 1733327 - RNA, 17 nt, Human
uccuuccucugagccuu

SEQ ID NO: 1733328 - RNA, 16 nt, Human
uccuuccucugagccu

SEQ ID NO: 1733329 - RNA, 23 nt, Human
acuggccucugcugauccuccca

SEQ ID NO: 1733330 - RNA, 22 nt, Human
acuggcugcaaaggguaucagg

SEQ ID NO: 1733331 - RNA, 14 nt, Human
acuaaaauaauuuu

SEQ ID NO: 1733332 - RNA, 20 nt, Human
acuaaaauaauuuuguaaug

SEQ ID NO: 1733333 - RNA, 15 nt, Human
acuaaaauaauuuug

SEQ ID NO: 1733334 - RNA, 16 nt, Human
acuaaaauaauuuugu

SEQ ID NO: 1733335 - RNA, 17 nt, Human
acuaaaauaauuuugua

SEQ ID NO: 1733336 - RNA, 19 nt, Human
acuaaaauaauuuuguaau

SEQ ID NO: 1733337 - RNA, 15 nt, Human
acuacaguccuccca

SEQ ID NO: 1733338 - RNA, 17 nt, Human
acuaaccagcagaaaug

SEQ ID NO: 1733339 - RNA, 23 nt, Human
acuacaggugugagucaccaagc

SEQ ID NO: 1733340 - RNA, 13 nt, Human
acuaaccacgcug

SEQ ID NO: 1733341 - RNA, 16 nt, Human
acuaaccagcagaaau

SEQ ID NO: 1733342 - RNA, 12 nt, Human
acguuucuaaag

SEQ ID NO: 1733343 - RNA, 14 nt, Human
uccagcucaccagc

SEQ ID NO: 1733344 - RNA, 15 nt, Human
uccagcucaccagcc

SEQ ID NO: 1733345 - RNA, 24 nt, Human
uccagccugggugacagagcaagu

SEQ ID NO: 1733346 - RNA, 13 nt, Human
uccagccugggug

SEQ ID NO: 1733347 - RNA, 15 nt, Human
acguuucuaaaggcu

SEQ ID NO: 1733348 - RNA, 14 nt, Human
acguuucuaaaggc

SEQ ID NO: 1733349 - RNA, 13 nt, Human
acuaaaaauacaa

SEQ ID NO: 1733350 - RNA, 22 nt, Human
ucccagugccgagaaggaagcc

SEQ ID NO: 1733351 - RNA, 19 nt, Human
ucccagugccgagaaggaa

SEQ ID NO: 1733352 - RNA, 16 nt, Human
acuacaguccucccau

SEQ ID NO: 1733353 - RNA, 17 nt, Human
acuacaguccucccauc

SEQ ID NO: 1733354 - RNA, 19 nt, Human
ucccaucucacacaugagc

SEQ ID NO: 1733355 - RNA, 14 nt, Human
ucccaucucacaca

SEQ ID NO: 1733356 - RNA, 13 nt, Human
ucccaucucacac

SEQ ID NO: 1733357 - RNA, 16 nt, Human
ucccauaugccugggc

SEQ ID NO: 1733358 - RNA, 15 nt, Human
ucccauaugccuggg

SEQ ID NO: 1733359 - RNA, 15 nt, Human
uccccaagccuggca

SEQ ID NO: 1733360 - RNA, 18 nt, Human
acuauagccuaggugaca

SEQ ID NO: 1733361 - RNA, 17 nt, Human
acuauagccuaggugac

SEQ ID NO: 1733362 - RNA, 23 nt, Human
acuauaauuuaccugaagucuuu

SEQ ID NO: 1733363 - RNA, 24 nt, Human
uccccaccgcagacaggaccaggg

SEQ ID NO: 1733364 - RNA, 23 nt, Human
uccccaggaggccagccuugacc

SEQ ID NO: 1733365 - RNA, 18 nt, Human
acuauguugcccaggcag

SEQ ID NO: 1733366 - RNA, 22 nt, Human
acuaugaaguuuuuuuuauaca

SEQ ID NO: 1733367 - RNA, 18 nt, Human
acuaucccggcugcccuu

SEQ ID NO: 1733368 - RNA, 17 nt, Human
acuaucccggcugcccu

SEQ ID NO: 1733369 - RNA, 16 nt, Human
acuaucccggcugccc

SEQ ID NO: 1733370 - RNA, 22 nt, Human
acuaucaugucaaacgugaaaa

SEQ ID NO: 1733371 - RNA, 23 nt, Human
acuauguugcccaggcaggucuu

SEQ ID NO: 1733372 - RNA, 20 nt, Human
acuauguugcccaggcaggu

SEQ ID NO: 1733373 - RNA, 19 nt, Human
acuauguugcccaggcagg

SEQ ID NO: 1733374 - RNA, 18 nt, Human
ucccuauuagagaagaga

SEQ ID NO: 1733375 - RNA, 18 nt, Human
ucccgaauagcugggacu

SEQ ID NO: 1733376 - RNA, 20 nt, Human
ucccgcucagcccucccugc

SEQ ID NO: 1733377 - RNA, 16 nt, Human
ucccgcucagcccucc

SEQ ID NO: 1733378 - RNA, 15 nt, Human
ucccgcucagcccuc

SEQ ID NO: 1733379 - RNA, 14 nt, Human
ucccgcucagcccu

SEQ ID NO: 1733380 - RNA, 13 nt, Human
ucccgcucagccc

SEQ ID NO: 1733381 - RNA, 16 nt, Human
ucccgaauagcuggga

SEQ ID NO: 1733382 - RNA, 15 nt, Human
ucccgaauagcuggg

SEQ ID NO: 1733383 - RNA, 17 nt, Human
acucaagacuuccagag

SEQ ID NO: 1733384 - RNA, 20 nt, Human
acucaagacuuccagagccu

SEQ ID NO: 1733385 - RNA, 20 nt, Human
acuccagcuggguuggaaaa

SEQ ID NO: 1733386 - RNA, 14 nt, Human
acuccuaccuggua

SEQ ID NO: 1733387 - RNA, 21 nt, Human
ucccucagucuggcccuuccu

SEQ ID NO: 1733388 - RNA, 22 nt, Human
ucccucauccucauacccaccc

SEQ ID NO: 1733389 - RNA, 18 nt, Human
acucaucuagguaaauua

SEQ ID NO: 1733390 - RNA, 16 nt, Human
acucaucuagguaaau

SEQ ID NO: 1733391 - RNA, 23 nt, Human
ucccucauuccaccuucccaugc

SEQ ID NO: 1733392 - RNA, 21 nt, Human
acucaucuagguaaauuacag

SEQ ID NO: 1733393 - RNA, 23 nt, Human
ucccuuugacgccaucccagccc

SEQ ID NO: 1733394 - RNA, 22 nt, Human
ucccuuugacgccaucccagcc

SEQ ID NO: 1733395 - RNA, 14 nt, Human
uccuaggcauuugc

SEQ ID NO: 1733396 - RNA, 20 nt, Human
uccuagcacuuugggaggcc

SEQ ID NO: 1733397 - RNA, 22 nt, Human
ucccuuacgugaguccuggcau

SEQ ID NO: 1733398 - RNA, 18 nt, Human
ucccuuacgugaguccug

SEQ ID NO: 1733399 - RNA, 21 nt, Human
ucccuucaaccauuccccaug

SEQ ID NO: 1733400 - RNA, 11 nt, Human
ucccuucaacc

SEQ ID NO: 1733401 - RNA, 22 nt, Human
ucccuuuccaaaugcccagcuu

SEQ ID NO: 1733402 - RNA, 23 nt, Human
acuccugcacacgcuccuuccuc

SEQ ID NO: 1733403 - RNA, 17 nt, Human
acucuccucugcugcug

SEQ ID NO: 1733404 - RNA, 23 nt, Human
acucgcgacaaugcaaaccauca

SEQ ID NO: 1733405 - RNA, 20 nt, Human
acucgcgacaaugcaaacca

SEQ ID NO: 1733406 - RNA, 19 nt, Human
uccuaggcauuugcugaau

SEQ ID NO: 1733407 - RNA, 18 nt, Human
acucgcgacaaugcaaac

SEQ ID NO: 1733408 - RNA, 19 nt, Human
acucuccucugcugcuggc

SEQ ID NO: 1733409 - RNA, 18 nt, Human
acucuccucugcugcugg

SEQ ID NO: 1733410 - RNA, 21 nt, Human
acucuccucugcugcuggcug

SEQ ID NO: 1733411 - RNA, 19 nt, Human
uccucccucccucuuuccc

SEQ ID NO: 1733412 - RNA, 15 nt, Human
uccucccucccucuu

SEQ ID NO: 1733413 - RNA, 17 nt, Human
uccucccucccucuuuc

SEQ ID NO: 1733414 - RNA, 12 nt, Human
uccucuccccag

SEQ ID NO: 1733415 - RNA, 16 nt, Human
uccucuccacugccuu

SEQ ID NO: 1733416 - RNA, 15 nt, Human
uccucuccacugccu

SEQ ID NO: 1733417 - RNA, 14 nt, Human
uccucuccacugcc

SEQ ID NO: 1733418 - RNA, 13 nt, Human
uccucuccacugc

SEQ ID NO: 1733419 - RNA, 12 nt, Human
uccucuccacug

SEQ ID NO: 1733420 - RNA, 18 nt, Human
uccucauacccaccccca

SEQ ID NO: 1733421 - RNA, 14 nt, Human
uccucauacccacc

SEQ ID NO: 1733422 - RNA, 22 nt, Human
uccucauacccacccccaccca

SEQ ID NO: 1733423 - RNA, 16 nt, Human
uccuccccuccuccug

SEQ ID NO: 1733424 - RNA, 20 nt, Human
uccuccccuccuccuggacu

SEQ ID NO: 1733425 - RNA, 18 nt, Human
uccuccccuccuccugga

SEQ ID NO: 1733426 - RNA, 22 nt, Human
uccuccccuccuccuggacucc

SEQ ID NO: 1733427 - RNA, 19 nt, Human
acucuuauugcccacgcug

SEQ ID NO: 1733428 - RNA, 16 nt, Human
acucuuauugcccacg

SEQ ID NO: 1733429 - RNA, 20 nt, Human
uccucagaucuucugugggu

SEQ ID NO: 1733430 - RNA, 18 nt, Human
uaugcucugcauguuaca

SEQ ID NO: 1733431 - RNA, 19 nt, Human
uaugcucugcauguuacau

SEQ ID NO: 1733432 - RNA, 14 nt, Human
uauggccuguggau

SEQ ID NO: 1733433 - RNA, 22 nt, Human
uauggccugugagcuaggaauu

SEQ ID NO: 1733434 - RNA, 16 nt, Human
uauggcuuuugugcau

SEQ ID NO: 1733435 - RNA, 15 nt, Human
acagccuggcacagg

SEQ ID NO: 1733436 - RNA, 14 nt, Human
acagccuggcacag

SEQ ID NO: 1733437 - RNA, 15 nt, Human
acagcuaacauggaa

SEQ ID NO: 1733438 - RNA, 14 nt, Human
acagcuaacaugga

SEQ ID NO: 1733439 - RNA, 17 nt, Human
acagcuaacauggaagu

SEQ ID NO: 1733440 - RNA, 20 nt, Human
acagcuaaucagcauucuca

SEQ ID NO: 1733441 - RNA, 15 nt, Human
uaucuugaagacuuu

SEQ ID NO: 1733442 - RNA, 15 nt, Human
uaucuugaauaaugu

SEQ ID NO: 1733443 - RNA, 13 nt, Human
uaugaggcauuug

SEQ ID NO: 1733444 - RNA, 23 nt, Human
uaugaucacggcucacugcagcc

SEQ ID NO: 1733445 - RNA, 21 nt, Human
uaugaucacggcucacugcag

SEQ ID NO: 1733446 - RNA, 18 nt, Human
acagaguuuucacucuua

SEQ ID NO: 1733447 - RNA, 15 nt, Human
acagaguuguuacau

SEQ ID NO: 1733448 - RNA, 20 nt, Human
acagaguuuucacucuuauu

SEQ ID NO: 1733449 - RNA, 18 nt, Human
acagcagccccugcacaa

SEQ ID NO: 1733450 - RNA, 17 nt, Human
uaucucccccagcccca

SEQ ID NO: 1733451 - RNA, 18 nt, Human
uaucucccccagccccau

SEQ ID NO: 1733452 - RNA, 19 nt, Human
uaucuagauacuguaucau

SEQ ID NO: 1733453 - RNA, 10 nt, Human
uaucagaauu

SEQ ID NO: 1733454 - RNA, 15 nt, Human
uaucuagauacugua

SEQ ID NO: 1733455 - RNA, 16 nt, Human
uaucuagauacuguau

SEQ ID NO: 1733456 - RNA, 20 nt, Human
acagagcccacgcccccacu

SEQ ID NO: 1733457 - RNA, 16 nt, Human
acagagcuacacaggg

SEQ ID NO: 1733458 - RNA, 18 nt, Human
acagagcuacacagggga

SEQ ID NO: 1733459 - RNA, 21 nt, Human
acagagugagacucugucuca

SEQ ID NO: 1733460 - RNA, 14 nt, Human
acagacuucugaaa

SEQ ID NO: 1733461 - RNA, 13 nt, Human
acagacuucugaa

SEQ ID NO: 1733462 - RNA, 20 nt, Human
acagacuggauguaccacca

SEQ ID NO: 1733463 - RNA, 15 nt, Human
uauauuuacaaaugg

SEQ ID NO: 1733464 - RNA, 21 nt, Human
uaucaaguauuauaccuuuuu

SEQ ID NO: 1733465 - RNA, 14 nt, Human
uauauuuacaaaug

SEQ ID NO: 1733466 - RNA, 18 nt, Human
uaucacccagaagaaaau

SEQ ID NO: 1733467 - RNA, 23 nt, Human
acagacacaggcccggcuccagg

SEQ ID NO: 1733468 - RNA, 13 nt, Human
acacuccuucaca

SEQ ID NO: 1733469 - RNA, 11 nt, Human
acacuccuuca

SEQ ID NO: 1733470 - RNA, 16 nt, Human
acagacccugcccugu

SEQ ID NO: 1733471 - RNA, 17 nt, Human
acagacccugcccugug

SEQ ID NO: 1733472 - RNA, 15 nt, Human
acagacagcccucca

SEQ ID NO: 1733473 - RNA, 13 nt, Human
acagacagcccuc

SEQ ID NO: 1733474 - RNA, 20 nt, Human
acagacccugcccugugggc

SEQ ID NO: 1733475 - RNA, 18 nt, Human
acagacccugcccugugg

SEQ ID NO: 1733476 - RNA, 14 nt, Human
acagacuggaagca

SEQ ID NO: 1733477 - RNA, 16 nt, Human
uauauugauccagaaa

SEQ ID NO: 1733478 - RNA, 23 nt, Human
acaagcugcacccucaggcaggu

SEQ ID NO: 1733479 - RNA, 22 nt, Human
acaagcugcacccucaggcagg

SEQ ID NO: 1733480 - RNA, 21 nt, Human
acaagcugcacccucaggcag

SEQ ID NO: 1733481 - RNA, 19 nt, Human
acaagcugcacccucaggc

SEQ ID NO: 1733482 - RNA, 21 nt, Human
uagucaggugccucaagagaa

SEQ ID NO: 1733483 - RNA, 20 nt, Human
uaguuccucauuagcauuuu

SEQ ID NO: 1733484 - RNA, 17 nt, Human
uauaaaagccuguuuaa

SEQ ID NO: 1733485 - RNA, 14 nt, Human
uauaaaagccuguu

SEQ ID NO: 1733486 - RNA, 12 nt, Human
uauaaaagccug

SEQ ID NO: 1733487 - RNA, 19 nt, Human
acacaugcaaggucauuuu

SEQ ID NO: 1733488 - RNA, 20 nt, Human
acacaugcaaggucauuuuu

SEQ ID NO: 1733489 - RNA, 18 nt, Human
acacaugcaaggucauuu

SEQ ID NO: 1733490 - RNA, 21 nt, Human
acacaugcaaggucauuuuuu

SEQ ID NO: 1733491 - RNA, 21 nt, Human
acacccagcccacuucugcca

SEQ ID NO: 1733492 - RNA, 20 nt, Human
acacccagcccacuucugcc

SEQ ID NO: 1733493 - RNA, 19 nt, Human
acacccagcccacuucugc

SEQ ID NO: 1733494 - RNA, 18 nt, Human
acacccugugauggggcc

SEQ ID NO: 1733495 - RNA, 12 nt, Human
acacccugugau

SEQ ID NO: 1733496 - RNA, 11 nt, Human
acacccuguga

SEQ ID NO: 1733497 - RNA, 19 nt, Human
acacccugugauggggccc

SEQ ID NO: 1733498 - RNA, 16 nt, Human
acaccgggccuggaga

SEQ ID NO: 1733499 - RNA, 13 nt, Human
uauaggaauugac

SEQ ID NO: 1733500 - RNA, 14 nt, Human
uauaggaauugacc

SEQ ID NO: 1733501 - RNA, 19 nt, Human
uauaggaauugacccacaa

SEQ ID NO: 1733502 - RNA, 20 nt, Human
uauagccuaggugacagagu

SEQ ID NO: 1733503 - RNA, 23 nt, Human
acacucauugaccugaggcccuu

SEQ ID NO: 1733504 - RNA, 21 nt, Human
acacucauugaccugaggccc

SEQ ID NO: 1733505 - RNA, 13 nt, Human
uauauaucaaaua

SEQ ID NO: 1733506 - RNA, 14 nt, Human
uauacauuugauaa

SEQ ID NO: 1733507 - RNA, 21 nt, Human
uauacacuuacacuuuaugca

SEQ ID NO: 1733508 - RNA, 13 nt, Human
uauacauaaacaa

SEQ ID NO: 1733509 - RNA, 14 nt, Human
uauacauaaacaag

SEQ ID NO: 1733510 - RNA, 20 nt, Human
uauaaccaguguuguggauu

SEQ ID NO: 1733511 - RNA, 23 nt, Human
acaguucggugagcuacaaaugc

SEQ ID NO: 1733512 - RNA, 16 nt, Human
acaguucucuccuucu

SEQ ID NO: 1733513 - RNA, 19 nt, Human
acaguucggugagcuacaa

SEQ ID NO: 1733514 - RNA, 22 nt, Human
acaguucggugagcuacaaaug

SEQ ID NO: 1733515 - RNA, 13 nt, Human
acaguuacucaga

SEQ ID NO: 1733516 - RNA, 20 nt, Human
acaguuacucagaauucucu

SEQ ID NO: 1733517 - RNA, 20 nt, Human
acaguucaauucucauuugu

SEQ ID NO: 1733518 - RNA, 16 nt, Human
uauucuguuggccagu

SEQ ID NO: 1733519 - RNA, 15 nt, Human
uauucuuauuuaaug

SEQ ID NO: 1733520 - RNA, 20 nt, Human
uauucucuccuguaccucuu

SEQ ID NO: 1733521 - RNA, 24 nt, Human
uauucucuccuguaccucuugagc

SEQ ID NO: 1733522 - RNA, 17 nt, Human
acaguucucuccuucuu

SEQ ID NO: 1733523 - RNA, 17 nt, Human
uauugguguaagguacu

SEQ ID NO: 1733524 - RNA, 18 nt, Human
uauuuacuucuuauacau

SEQ ID NO: 1733525 - RNA, 20 nt, Human
uauuuagcaccagggaaggg

SEQ ID NO: 1733526 - RNA, 23 nt, Human
uauuuaauuuuuuugagacagag

SEQ ID NO: 1733527 - RNA, 14 nt, Human
uauuuaauucaugu

SEQ ID NO: 1733528 - RNA, 14 nt, Human
uauuuauuuaaauu

SEQ ID NO: 1733529 - RNA, 14 nt, Human
uauuuauuuaguau

SEQ ID NO: 1733530 - RNA, 13 nt, Human
uauuuauuuaaau

SEQ ID NO: 1733531 - RNA, 19 nt, Human
uauuuaguguucauaaaua

SEQ ID NO: 1733532 - RNA, 11 nt, Human
uauuguacagu

SEQ ID NO: 1733533 - RNA, 12 nt, Human
uauuguacaguu

SEQ ID NO: 1733534 - RNA, 13 nt, Human
uauuguacaguuu

SEQ ID NO: 1733535 - RNA, 14 nt, Human
uauuguacaguuuu

SEQ ID NO: 1733536 - RNA, 15 nt, Human
uauuguacaguuuuu

SEQ ID NO: 1733537 - RNA, 17 nt, Human
uauuguacaguuuuuau

SEQ ID NO: 1733538 - RNA, 17 nt, Human
uauugucaaagugguga

SEQ ID NO: 1733539 - RNA, 13 nt, Human
uauugucaaagug

SEQ ID NO: 1733540 - RNA, 21 nt, Human
uauuuaaugaaagacuguaca

SEQ ID NO: 1733541 - RNA, 15 nt, Human
uauuuaaugaaagac

SEQ ID NO: 1733542 - RNA, 20 nt, Human
acagugaaagaaaauaacaa

SEQ ID NO: 1733543 - RNA, 15 nt, Human
acagucuuguauuaa

SEQ ID NO: 1733544 - RNA, 18 nt, Human
acagucuuguauuaaguu

SEQ ID NO: 1733545 - RNA, 22 nt, Human
acagucuuguauuaaguuguua

SEQ ID NO: 1733546 - RNA, 14 nt, Human
acagucuuguauua

SEQ ID NO: 1733547 - RNA, 22 nt, Human
acaguccuuaccagcagagcac

SEQ ID NO: 1733548 - RNA, 21 nt, Human
acaguccuuaccagcagagca

SEQ ID NO: 1733549 - RNA, 15 nt, Human
acaguuaagagaaau

SEQ ID NO: 1733550 - RNA, 14 nt, Human
acagugagacucug

SEQ ID NO: 1733551 - RNA, 18 nt, Human
acagugagacucugucuc

SEQ ID NO: 1733552 - RNA, 21 nt, Human
acaguauggcagcuuuccuca

SEQ ID NO: 1733553 - RNA, 22 nt, Human
acagggcacaccgggcacucag

SEQ ID NO: 1733554 - RNA, 22 nt, Human
acagguuuuccugaagaauuga

SEQ ID NO: 1733555 - RNA, 17 nt, Human
acaggcugggcuucagu

SEQ ID NO: 1733556 - RNA, 14 nt, Human
acaggcugggcuuc

SEQ ID NO: 1733557 - RNA, 21 nt, Human
acaggcugggcuucaguggca

SEQ ID NO: 1733558 - RNA, 19 nt, Human
acaguauuacuucugcuac

SEQ ID NO: 1733559 - RNA, 17 nt, Human
acaguauuacuucugcu

SEQ ID NO: 1733560 - RNA, 16 nt, Human
acaguauuacuucugc

SEQ ID NO: 1733561 - RNA, 15 nt, Human
acaguauuacuucug

SEQ ID NO: 1733562 - RNA, 13 nt, Human
acagucccugcca

SEQ ID NO: 1733563 - RNA, 15 nt, Human
acaguccucccaucu

SEQ ID NO: 1733564 - RNA, 14 nt, Human
acaguccucccauc

SEQ ID NO: 1733565 - RNA, 13 nt, Human
acaguccucccau

SEQ ID NO: 1733566 - RNA, 15 nt, Human
acagucccugccaau

SEQ ID NO: 1733567 - RNA, 20 nt, Human
acaguccuuaccagcagagc

SEQ ID NO: 1733568 - RNA, 18 nt, Human
acaguccuuaccagcaga

SEQ ID NO: 1733569 - RNA, 17 nt, Human
acaguccucccaucuca

SEQ ID NO: 1733570 - RNA, 23 nt, Human
uauucauagcagcuuauucacaa

SEQ ID NO: 1733571 - RNA, 22 nt, Human
uauucaggaagcucagggccug

SEQ ID NO: 1733572 - RNA, 18 nt, Human
uauucaggaagcucaggg

SEQ ID NO: 1733573 - RNA, 15 nt, Human
uauucagcucaugga

SEQ ID NO: 1733574 - RNA, 16 nt, Human
uauuaccacagacaua

SEQ ID NO: 1733575 - RNA, 12 nt, Human
uauuagagaaga

SEQ ID NO: 1733576 - RNA, 23 nt, Human
uauuaaaaaucucaaauuucuaa

SEQ ID NO: 1733577 - RNA, 19 nt, Human
uauguuuuaagaggcaggg

SEQ ID NO: 1733578 - RNA, 17 nt, Human
uauguuuuaagaggcag

SEQ ID NO: 1733579 - RNA, 16 nt, Human
uauuaaaaaucucaaa

SEQ ID NO: 1733580 - RNA, 18 nt, Human
uauuaaaaaucucaaauu

SEQ ID NO: 1733581 - RNA, 20 nt, Human
uauuaaaaaucucaaauuuc

SEQ ID NO: 1733582 - RNA, 22 nt, Human
uauuaaaaaucucaaauuucua

SEQ ID NO: 1733583 - RNA, 20 nt, Human
aauuguguuuauaauuuuaa

SEQ ID NO: 1733584 - RNA, 22 nt, Human
aauuguuuggggaugagaaagg

SEQ ID NO: 1733585 - RNA, 12 nt, Human
aauugcuccuug

SEQ ID NO: 1733586 - RNA, 19 nt, Human
aauuuacauacucugcuua

SEQ ID NO: 1733587 - RNA, 13 nt, Human
aauuuaaaagucu

SEQ ID NO: 1733588 - RNA, 20 nt, Human
aauuugaaacacuuugcaua

SEQ ID NO: 1733589 - RNA, 16 nt, Human
aauuucucuacugucu

SEQ ID NO: 1733590 - RNA, 13 nt, Human
aauuucuaaaucu

SEQ ID NO: 1733591 - RNA, 21 nt, Human
aauuucuaaaucuccaaaaua

SEQ ID NO: 1733592 - RNA, 15 nt, Human
aauuuaccugaaguc

SEQ ID NO: 1733593 - RNA, 17 nt, Human
aauuuagaaauauaauu

SEQ ID NO: 1733594 - RNA, 21 nt, Human
aauucuugccaaauauaaaua

SEQ ID NO: 1733595 - RNA, 14 nt, Human
aauucuugcaaagu

SEQ ID NO: 1733596 - RNA, 20 nt, Human
aauucuugcaaaguaucccu

SEQ ID NO: 1733597 - RNA, 22 nt, Human
aauucuucuccacuuucuagcc

SEQ ID NO: 1733598 - RNA, 16 nt, Human
aauugacccacaagaa

SEQ ID NO: 1733599 - RNA, 19 nt, Human
aauugacccacaagaaaug

SEQ ID NO: 1733600 - RNA, 15 nt, Human
uacguacacauuuua

SEQ ID NO: 1733601 - RNA, 16 nt, Human
uacuauguaucaauga

SEQ ID NO: 1733602 - RNA, 16 nt, Human
uacuauaauuuaccug

SEQ ID NO: 1733603 - RNA, 14 nt, Human
uacgucugacaggc

SEQ ID NO: 1733604 - RNA, 14 nt, Human
uacguuaccaggca

SEQ ID NO: 1733605 - RNA, 13 nt, Human
uacguugugcauu

SEQ ID NO: 1733606 - RNA, 14 nt, Human
uacguugugcauuu

SEQ ID NO: 1733607 - RNA, 22 nt, Human
uacucuucaguuaagccuuugg

SEQ ID NO: 1733608 - RNA, 18 nt, Human
uacucuuauagacaacau

SEQ ID NO: 1733609 - RNA, 18 nt, Human
acaagcacuaaacaaaga

SEQ ID NO: 1733610 - RNA, 18 nt, Human
acaagagcccaggccucc

SEQ ID NO: 1733611 - RNA, 17 nt, Human
acaagagcccaggccuc

SEQ ID NO: 1733612 - RNA, 21 nt, Human
acaagcgugagccacugcacc

SEQ ID NO: 1733613 - RNA, 20 nt, Human
acaagcgugagccacugcac

SEQ ID NO: 1733614 - RNA, 13 nt, Human
acaagcugcaccc

SEQ ID NO: 1733615 - RNA, 12 nt, Human
acaagccacccc

SEQ ID NO: 1733616 - RNA, 13 nt, Human
acaagccagcugg

SEQ ID NO: 1733617 - RNA, 15 nt, Human
acaagccagcuggag

SEQ ID NO: 1733618 - RNA, 12 nt, Human
acaacacucaca

SEQ ID NO: 1733619 - RNA, 15 nt, Human
acaacaacaaaauga

SEQ ID NO: 1733620 - RNA, 18 nt, Human
acaaauucugucucugga

SEQ ID NO: 1733621 - RNA, 15 nt, Human
acaacaaccugguca

SEQ ID NO: 1733622 - RNA, 18 nt, Human
uagcauuguaaaagcauu

SEQ ID NO: 1733623 - RNA, 19 nt, Human
uagcauuguaaaagcauuu

SEQ ID NO: 1733624 - RNA, 21 nt, Human
uagcaugucgucaaagcugaa

SEQ ID NO: 1733625 - RNA, 16 nt, Human
uagcaccagggaaggg

SEQ ID NO: 1733626 - RNA, 14 nt, Human
uagcaccagggaag

SEQ ID NO: 1733627 - RNA, 13 nt, Human
uagcaccagggaa

SEQ ID NO: 1733628 - RNA, 19 nt, Human
uagcacagacccugcccug

SEQ ID NO: 1733629 - RNA, 18 nt, Human
uagcacagacccugcccu

SEQ ID NO: 1733630 - RNA, 17 nt, Human
uagcacagacccugccc

SEQ ID NO: 1733631 - RNA, 16 nt, Human
uagcacagacccugcc

SEQ ID NO: 1733632 - RNA, 22 nt, Human
uagauuuuagacccuauugcug

SEQ ID NO: 1733633 - RNA, 16 nt, Human
acaaaaagcauaaaaa

SEQ ID NO: 1733634 - RNA, 15 nt, Human
uagagcuucuggcac

SEQ ID NO: 1733635 - RNA, 13 nt, Human
acaaaaacauggc

SEQ ID NO: 1733636 - RNA, 17 nt, Human
aauuuuuuugagacaga

SEQ ID NO: 1733637 - RNA, 21 nt, Human
aauuuuuuaagugaaaauaua

SEQ ID NO: 1733638 - RNA, 14 nt, Human
aauuuuuguauuuu

SEQ ID NO: 1733639 - RNA, 18 nt, Human
aauuuuuauuaaauuaug

SEQ ID NO: 1733640 - RNA, 17 nt, Human
aauuuuuauuaaauuau

SEQ ID NO: 1733641 - RNA, 14 nt, Human
uagacagucccugc

SEQ ID NO: 1733642 - RNA, 12 nt, Human
uagacagucccu

SEQ ID NO: 1733643 - RNA, 15 nt, Human
uagaacucccuuuca

SEQ ID NO: 1733644 - RNA, 17 nt, Human
uacuucaaaaguuuguu

SEQ ID NO: 1733645 - RNA, 22 nt, Human
uacuucaaaaguuuguuugcuu

SEQ ID NO: 1733646 - RNA, 15 nt, Human
uagaagucacacagu

SEQ ID NO: 1733647 - RNA, 18 nt, Human
uagaagauggcacuuaua

SEQ ID NO: 1733648 - RNA, 13 nt, Human
uagaacugaauuu

SEQ ID NO: 1733649 - RNA, 17 nt, Human
uagaacugaauuuuguc

SEQ ID NO: 1733650 - RNA, 22 nt, Human
uagaacugaauuuugucuuuau

SEQ ID NO: 1733651 - RNA, 16 nt, Human
uagacaauuuauuaug

SEQ ID NO: 1733652 - RNA, 14 nt, Human
uagacagcaugaga

SEQ ID NO: 1733653 - RNA, 19 nt, Human
uagaagucuuagauguaua

SEQ ID NO: 1733654 - RNA, 18 nt, Human
uagaagucuuagauguau

SEQ ID NO: 1733655 - RNA, 20 nt, Human
uagaagucuuagauguauau

SEQ ID NO: 1733656 - RNA, 17 nt, Human
uagaagucuuagaugua

SEQ ID NO: 1733657 - RNA, 16 nt, Human
uagaagucuuagaugu

SEQ ID NO: 1733658 - RNA, 16 nt, Human
uagaagucacacagua

SEQ ID NO: 1733659 - RNA, 13 nt, Human
uaauaccucccuu

SEQ ID NO: 1733660 - RNA, 18 nt, Human
uaauacuugcuuuggaaa

SEQ ID NO: 1733661 - RNA, 20 nt, Human
aauacaguaucucagggccu

SEQ ID NO: 1733662 - RNA, 22 nt, Human
uaauacaccacuacauucuguu

SEQ ID NO: 1733663 - RNA, 21 nt, Human
uaauacaccacuacauucugu

SEQ ID NO: 1733664 - RNA, 23 nt, Human
uaauacaccacuacauucuguua

SEQ ID NO: 1733665 - RNA, 17 nt, Human
uaaucuuuaauuuuaca

SEQ ID NO: 1733666 - RNA, 22 nt, Human
uaauccaagcaaaugugaauca

SEQ ID NO: 1733667 - RNA, 21 nt, Human
uaauauugauaugcuuauaca

SEQ ID NO: 1733668 - RNA, 15 nt, Human
aaugaaugaaugaau

SEQ ID NO: 1733669 - RNA, 14 nt, Human
aaugaaugaaacau

SEQ ID NO: 1733670 - RNA, 14 nt, Human
aaugaaugucagug

SEQ ID NO: 1733671 - RNA, 15 nt, Human
aaugaaugucagugu

SEQ ID NO: 1733672 - RNA, 23 nt, Human
aaucuucugaacuuggcgcugcc

SEQ ID NO: 1733673 - RNA, 13 nt, Human
aaucuugaaaaug

SEQ ID NO: 1733674 - RNA, 15 nt, Human
uaaugucacaggcag

SEQ ID NO: 1733675 - RNA, 17 nt, Human
uaaugucacaggcaggu

SEQ ID NO: 1733676 - RNA, 16 nt, Human
uaaugucacaggcagg

SEQ ID NO: 1733677 - RNA, 12 nt, Human
uaaugugaaacu

SEQ ID NO: 1733678 - RNA, 20 nt, Human
uaaugugaaacuggauuaaa

SEQ ID NO: 1733679 - RNA, 22 nt, Human
uaaugugaaacuggauuaaacu

SEQ ID NO: 1733680 - RNA, 23 nt, Human
uaaugugaaacuggauuaaacuu

SEQ ID NO: 1733681 - RNA, 17 nt, Human
uaauguaagcucuacug

SEQ ID NO: 1733682 - RNA, 16 nt, Human
uaauguaagcucuacu

SEQ ID NO: 1733683 - RNA, 15 nt, Human
uaauguaagacaaau

SEQ ID NO: 1733684 - RNA, 20 nt, Human
uacaauaaaaucuugaaaau

SEQ ID NO: 1733685 - RNA, 21 nt, Human
uacaagcgugagccacugcac

SEQ ID NO: 1733686 - RNA, 20 nt, Human
uacaagcgugagccacugca

SEQ ID NO: 1733687 - RNA, 19 nt, Human
uacaagcgugagccacugc

SEQ ID NO: 1733688 - RNA, 18 nt, Human
uacaagcgugagccacug

SEQ ID NO: 1733689 - RNA, 16 nt, Human
uacaagcgugagccac

SEQ ID NO: 1733690 - RNA, 16 nt, Human
uacaaaaacauggccu

SEQ ID NO: 1733691 - RNA, 15 nt, Human
uacaaaaagcauaaa

SEQ ID NO: 1733692 - RNA, 18 nt, Human
uacaagccagcuggagaa

SEQ ID NO: 1733693 - RNA, 21 nt, Human
uaauuuuuguauuuuuaguag

SEQ ID NO: 1733694 - RNA, 22 nt, Human
uaauuuuuguguuuuuaauaaa

SEQ ID NO: 1733695 - RNA, 13 nt, Human
uaauuuuuuacua

SEQ ID NO: 1733696 - RNA, 18 nt, Human
uaauuuaccugaagucuu

SEQ ID NO: 1733697 - RNA, 17 nt, Human
uaauuuaccugaagucu

SEQ ID NO: 1733698 - RNA, 13 nt, Human
uaauucauguugc

SEQ ID NO: 1733699 - RNA, 16 nt, Human
aaugcacuuuguucug

SEQ ID NO: 1733700 - RNA, 13 nt, Human
aaugcacuuuguu

SEQ ID NO: 1733701 - RNA, 20 nt, Human
aaugcacaaacagaggccgc

SEQ ID NO: 1733702 - RNA, 19 nt, Human
aaugcacaaacagaggccg

SEQ ID NO: 1733703 - RNA, 20 nt, Human
aaugcacuuuguucuggcuc

SEQ ID NO: 1733704 - RNA, 19 nt, Human
aaugcacuuuguucuggcu

SEQ ID NO: 1733705 - RNA, 23 nt, Human
uaauuaguuccucauuagcauuu

SEQ ID NO: 1733706 - RNA, 20 nt, Human
uaauuauacccccugcaaag

SEQ ID NO: 1733707 - RNA, 16 nt, Human
aaugcaaaccaucauu

SEQ ID NO: 1733708 - RNA, 15 nt, Human
aaugaccuuucaaua

SEQ ID NO: 1733709 - RNA, 14 nt, Human
aaugaccuuucaau

SEQ ID NO: 1733710 - RNA, 13 nt, Human
aaugaccuuucaa

SEQ ID NO: 1733711 - RNA, 21 nt, Human
aaugaaugucagugugacuga

SEQ ID NO: 1733712 - RNA, 20 nt, Human
aaugaaugucagugugacug

SEQ ID NO: 1733713 - RNA, 18 nt, Human
aaugcacaaacagaggcc

SEQ ID NO: 1733714 - RNA, 13 nt, Human
aaugcaaccauuu

SEQ ID NO: 1733715 - RNA, 17 nt, Human
aaugcaaccauuugaaa

SEQ ID NO: 1733716 - RNA, 18 nt, Human
aaugcaaccauuugaaac

SEQ ID NO: 1733717 - RNA, 23 nt, Human
aaugcaaaccaucauugaaaucu

SEQ ID NO: 1733718 - RNA, 22 nt, Human
aaugcaaaccaucauugaaauc

SEQ ID NO: 1733719 - RNA, 18 nt, Human
uacaguccucccaucuca

SEQ ID NO: 1733720 - RNA, 17 nt, Human
uacaguccucccaucuc

SEQ ID NO: 1733721 - RNA, 15 nt, Human
uacaguccucccauc

SEQ ID NO: 1733722 - RNA, 12 nt, Human
uacaguccuccc

SEQ ID NO: 1733723 - RNA, 18 nt, Human
uacaguaucucagggccu

SEQ ID NO: 1733724 - RNA, 15 nt, Human
uacauaaugcgugca

SEQ ID NO: 1733725 - RNA, 12 nt, Human
uacagucuugua

SEQ ID NO: 1733726 - RNA, 13 nt, Human
uacagucuuguau

SEQ ID NO: 1733727 - RNA, 13 nt, Human
aaugucacaggca

SEQ ID NO: 1733728 - RNA, 14 nt, Human
aaugucacaggcag

SEQ ID NO: 1733729 - RNA, 22 nt, Human
aaugugaaacuggauuaaacuu

SEQ ID NO: 1733730 - RNA, 21 nt, Human
aauguacagcaaggagauuua

SEQ ID NO: 1733731 - RNA, 23 nt, Human
aauguacagcaaggagauuuaca

SEQ ID NO: 1733732 - RNA, 22 nt, Human
uacagcaaggagauuuacaacu

SEQ ID NO: 1733733 - RNA, 19 nt, Human
uacagacuggauguaccac

SEQ ID NO: 1733734 - RNA, 16 nt, Human
aaugguuuaaaugguc

SEQ ID NO: 1733735 - RNA, 22 nt, Human
aaugguuuucuuguguguuuau

SEQ ID NO: 1733736 - RNA, 18 nt, Human
aaugguuuucuugugugu

SEQ ID NO: 1733737 - RNA, 17 nt, Human
aaugguuuucuugugug

SEQ ID NO: 1733738 - RNA, 15 nt, Human
aauguaagcucuacu

SEQ ID NO: 1733739 - RNA, 13 nt, Human
aauguaagcucua

SEQ ID NO: 1733740 - RNA, 13 nt, Human
aauguaagacaaa

SEQ ID NO: 1733741 - RNA, 20 nt, Human
uacauuagcaguuugcuuug

SEQ ID NO: 1733742 - RNA, 19 nt, Human
uacauuagcaguuugcuuu

SEQ ID NO: 1733743 - RNA, 13 nt, Human
aauuaaguacuau

SEQ ID NO: 1733744 - RNA, 17 nt, Human
uacauguacugauuacu

SEQ ID NO: 1733745 - RNA, 19 nt, Human
aauuaacaugaauauuuag

SEQ ID NO: 1733746 - RNA, 18 nt, Human
aauuaacuuuuauaaacu

SEQ ID NO: 1733747 - RNA, 20 nt, Human
aauuaacuuuuauaaacuuu

SEQ ID NO: 1733748 - RNA, 22 nt, Human
aauuaacuuuuauaaacuuuac

SEQ ID NO: 1733749 - RNA, 20 nt, Human
aauuaagaaaggauaaaguu

SEQ ID NO: 1733750 - RNA, 15 nt, Human
aaugucacaggcagg

SEQ ID NO: 1733751 - RNA, 17 nt, Human
uaccauccccuguagag

SEQ ID NO: 1733752 - RNA, 17 nt, Human
uaccacuuuuguucuug

SEQ ID NO: 1733753 - RNA, 15 nt, Human
uacauuuaaaacauu

SEQ ID NO: 1733754 - RNA, 16 nt, Human
uacauuuaaaacauua

SEQ ID NO: 1733755 - RNA, 19 nt, Human
uacauuuaaaacauuaaaa

SEQ ID NO: 1733756 - RNA, 20 nt, Human
uacauuuaaaacauuaaaau

SEQ ID NO: 1733757 - RNA, 22 nt, Human
uacccuggcacuauaauguaag

SEQ ID NO: 1733758 - RNA, 20 nt, Human
uacccuggcacuauaaugua

SEQ ID NO: 1733759 - RNA, 16 nt, Human
uacccucauguucuua

SEQ ID NO: 1733760 - RNA, 20 nt, Human
uacccgggaagggggcuggg

SEQ ID NO: 1733761 - RNA, 18 nt, Human
guuccccuguucacucua

SEQ ID NO: 1733762 - RNA, 12 nt, Human
guucucugcccu

SEQ ID NO: 1733763 - RNA, 13 nt, Human
guucucugcccuc

SEQ ID NO: 1733764 - RNA, 11 nt, Human
guucucugccc

SEQ ID NO: 1733765 - RNA, 16 nt, Human
guucucugaggacacu

SEQ ID NO: 1733766 - RNA, 23 nt, Human
guugauagcacagacccugcccu

SEQ ID NO: 1733767 - RNA, 22 nt, Human
guguuuaagacauuuuuggaag

SEQ ID NO: 1733768 - RNA, 13 nt, Human
guguuuauuguca

SEQ ID NO: 1733769 - RNA, 11 nt, Human
aagcucccagg

SEQ ID NO: 1733770 - RNA, 22 nt, Human
aagcucccaggcauuccccagg

SEQ ID NO: 1733771 - RNA, 12 nt, Human
aagcucccaggc

SEQ ID NO: 1733772 - RNA, 23 nt, Human
aagcucccaggcauuccccagga

SEQ ID NO: 1733773 - RNA, 16 nt, Human
aaggaaaaaauaacaa

SEQ ID NO: 1733774 - RNA, 19 nt, Human
aaggaaaaaauaacaauga

SEQ ID NO: 1733775 - RNA, 17 nt, Human
guuccccuguucacucu

SEQ ID NO: 1733776 - RNA, 15 nt, Human
guuccccuguucacu

SEQ ID NO: 1733777 - RNA, 16 nt, Human
aagcuuuuaugugaaa

SEQ ID NO: 1733778 - RNA, 18 nt, Human
aagcuguuacugucuuca

SEQ ID NO: 1733779 - RNA, 13 nt, Human
aagcucugcuccu

SEQ ID NO: 1733780 - RNA, 13 nt, Human
aaggauaaugaau

SEQ ID NO: 1733781 - RNA, 23 nt, Human
aaggauaaaguugguaaaccuuu

SEQ ID NO: 1733782 - RNA, 21 nt, Human
aaggauaaaguugguaaaccu

SEQ ID NO: 1733783 - RNA, 20 nt, Human
aaggaggaagagaaaaaaua

SEQ ID NO: 1733784 - RNA, 22 nt, Human
aaggauccugagccagauuuca

SEQ ID NO: 1733785 - RNA, 13 nt, Human
aaggauccugagc

SEQ ID NO: 1733786 - RNA, 12 nt, Human
aaggauccugag

SEQ ID NO: 1733787 - RNA, 11 nt, Human
aaggauccuga

SEQ ID NO: 1733788 - RNA, 11 nt, Human
aaggauaaagu

SEQ ID NO: 1733789 - RNA, 18 nt, Human
aaggagauuuacaacugg

SEQ ID NO: 1733790 - RNA, 22 nt, Human
aaggagcaagucagaauagaaa

SEQ ID NO: 1733791 - RNA, 15 nt, Human
aaggaaacccagcuc

SEQ ID NO: 1733792 - RNA, 16 nt, Human
aaggaaacccagcucu

SEQ ID NO: 1733793 - RNA, 17 nt, Human
guugggcuggugucacc

SEQ ID NO: 1733794 - RNA, 17 nt, Human
guugcccaggcuggcgu

SEQ ID NO: 1733795 - RNA, 16 nt, Human
guugcccaggcuggcg

SEQ ID NO: 1733796 - RNA, 15 nt, Human
guugcccaggcuggc

SEQ ID NO: 1733797 - RNA, 12 nt, Human
guugcugccuca

SEQ ID NO: 1733798 - RNA, 19 nt, Human
aaggaugcccaaagaugca

SEQ ID NO: 1733799 - RNA, 14 nt, Human
aaggaugcccaaag

SEQ ID NO: 1733800 - RNA, 24 nt, Human
aaggaugcacagaguuguuacauu

SEQ ID NO: 1733801 - RNA, 16 nt, Human
aaggccccgcccaggc

SEQ ID NO: 1733802 - RNA, 14 nt, Human
aaggccccgcccag

SEQ ID NO: 1733803 - RNA, 19 nt, Human
aaggccccgcccaggcuua

SEQ ID NO: 1733804 - RNA, 13 nt, Human
aaggcuaccuuug

SEQ ID NO: 1733805 - RNA, 14 nt, Human
guugcccaggcugg

SEQ ID NO: 1733806 - RNA, 15 nt, Human
aaggcuaccuuugua

SEQ ID NO: 1733807 - RNA, 22 nt, Human
aagucuuauauauuguagauaa

SEQ ID NO: 1733808 - RNA, 19 nt, Human
aagucuuagauguauauau

SEQ ID NO: 1733809 - RNA, 18 nt, Human
aagucuuagauguauaua

SEQ ID NO: 1733810 - RNA, 18 nt, Human
guuuuucuaggccugggg

SEQ ID NO: 1733811 - RNA, 15 nt, Human
guuuuuuuuuaaaga

SEQ ID NO: 1733812 - RNA, 16 nt, Human
guuuuugucuuaaaaa

SEQ ID NO: 1733813 - RNA, 19 nt, Human
aaguauucuuauuuaauga

SEQ ID NO: 1733814 - RNA, 18 nt, Human
aaguauucuuauuuaaug

SEQ ID NO: 1733815 - RNA, 21 nt, Human
aagucaagugaaaaaggagga

SEQ ID NO: 1733816 - RNA, 24 nt, Human
aagucacacaguauuacuucugcu

SEQ ID NO: 1733817 - RNA, 19 nt, Human
aagucaaggguaggguggg

SEQ ID NO: 1733818 - RNA, 13 nt, Human
aagucacacagug

SEQ ID NO: 1733819 - RNA, 12 nt, Human
aagucacugcac

SEQ ID NO: 1733820 - RNA, 14 nt, Human
aagucacugcacag

SEQ ID NO: 1733821 - RNA, 23 nt, Human
aaguacuucuccacccugcucuc

SEQ ID NO: 1733822 - RNA, 22 nt, Human
aaguacuucuccacccugcucu

SEQ ID NO: 1733823 - RNA, 21 nt, Human
aaguacuucuccacccugcuc

SEQ ID NO: 1733824 - RNA, 15 nt, Human
aaguacuggagaaaa

SEQ ID NO: 1733825 - RNA, 16 nt, Human
aaguacuauguaucaa

SEQ ID NO: 1733826 - RNA, 13 nt, Human
guuugcuaaguga

SEQ ID NO: 1733827 - RNA, 17 nt, Human
guuugccucugccucug

SEQ ID NO: 1733828 - RNA, 19 nt, Human
guuugcaucugaaaauuga

SEQ ID NO: 1733829 - RNA, 22 nt, Human
guuucugccgcagcccugcaga

SEQ ID NO: 1733830 - RNA, 22 nt, Human
guuucuaugacacaugcaaggu

SEQ ID NO: 1733831 - RNA, 14 nt, Human
guuucucagcuccc

SEQ ID NO: 1733832 - RNA, 18 nt, Human
guuuuacugcagcuuugu

SEQ ID NO: 1733833 - RNA, 16 nt, Human
guuuuacugcagcuuu

SEQ ID NO: 1733834 - RNA, 16 nt, Human
guuuuaagaggcaggg

SEQ ID NO: 1733835 - RNA, 18 nt, Human
guuuuaaggaugcuugua

SEQ ID NO: 1733836 - RNA, 14 nt, Human
guuuuaagaggcag

SEQ ID NO: 1733837 - RNA, 13 nt, Human
aagggcccagaga

SEQ ID NO: 1733838 - RNA, 15 nt, Human
aagggcccagagagg

SEQ ID NO: 1733839 - RNA, 19 nt, Human
aaggcugagaggagagaga

SEQ ID NO: 1733840 - RNA, 13 nt, Human
aagggccuggccu

SEQ ID NO: 1733841 - RNA, 14 nt, Human
aaggcugggggaag

SEQ ID NO: 1733842 - RNA, 16 nt, Human
aaggguaucuggugac

SEQ ID NO: 1733843 - RNA, 19 nt, Human
aaggguaucaggugcugcc

SEQ ID NO: 1733844 - RNA, 14 nt, Human
aaggggcaguggug

SEQ ID NO: 1733845 - RNA, 17 nt, Human
aaggggcaguggugguu

SEQ ID NO: 1733846 - RNA, 19 nt, Human
uaaaauuaaagcugaaaac

SEQ ID NO: 1733847 - RNA, 18 nt, Human
uaaaauuaaagcugaaaa

SEQ ID NO: 1733848 - RNA, 16 nt, Human
uaaaauuaaagcugaa

SEQ ID NO: 1733849 - RNA, 17 nt, Human
uaaaauuuuuaaucuuu

SEQ ID NO: 1733850 - RNA, 19 nt, Human
uaaaccaaggcuagaacca

SEQ ID NO: 1733851 - RNA, 19 nt, Human
uaaaauuuuuaaucuuuaa

SEQ ID NO: 1733852 - RNA, 14 nt, Human
aaguuuaauugacu

SEQ ID NO: 1733853 - RNA, 17 nt, Human
aaguucugcagauaaac

SEQ ID NO: 1733854 - RNA, 14 nt, Human
aaguuaaauaaauc

SEQ ID NO: 1733855 - RNA, 12 nt, Human
aaguuaaauaaa

SEQ ID NO: 1733856 - RNA, 17 nt, Human
aaguuacacauuuuuca

SEQ ID NO: 1733857 - RNA, 17 nt, Human
guuuuuuuuuaaagacu

SEQ ID NO: 1733858 - RNA, 14 nt, Human
uaaagaagguuuca

SEQ ID NO: 1733859 - RNA, 16 nt, Human
uaaagacuuuuaugau

SEQ ID NO: 1733860 - RNA, 15 nt, Human
uaaagacaccuacug

SEQ ID NO: 1733861 - RNA, 9 nt, Human
uaaagacag

SEQ ID NO: 1733862 - RNA, 10 nt, Human
uaaagacaga

SEQ ID NO: 1733863 - RNA, 21 nt, Human
uaaaggcuaccuuuguauucu

SEQ ID NO: 1733864 - RNA, 19 nt, Human
uaaaggcuaccuuuguauu

SEQ ID NO: 1733865 - RNA, 18 nt, Human
uaaagaguuaguuugagu

SEQ ID NO: 1733866 - RNA, 19 nt, Human
uaaagaugagcuuugucua

SEQ ID NO: 1733867 - RNA, 13 nt, Human
uaaagauggaaaa

SEQ ID NO: 1733868 - RNA, 19 nt, Human
uaaacccaguaguggugac

SEQ ID NO: 1733869 - RNA, 18 nt, Human
uaaaccgccaaggcuggg

SEQ ID NO: 1733870 - RNA, 16 nt, Human
uaaaccgccaaggcug

SEQ ID NO: 1733871 - RNA, 12 nt, Human
uaaacugccccc

SEQ ID NO: 1733872 - RNA, 15 nt, Human
aauacaccacuacau

SEQ ID NO: 1733873 - RNA, 16 nt, Human
aauacaccacuacauu

SEQ ID NO: 1733874 - RNA, 18 nt, Human
aauacaccacuacauucu

SEQ ID NO: 1733875 - RNA, 20 nt, Human
aauacaccacuacauucugu

SEQ ID NO: 1733876 - RNA, 21 nt, Human
aauacaccacuacauucuguu

SEQ ID NO: 1733877 - RNA, 13 nt, Human
uaaauaacuuuuu

SEQ ID NO: 1733878 - RNA, 19 nt, Human
uaaaucuccaaaauaaaac

SEQ ID NO: 1733879 - RNA, 20 nt, Human
uaaauaguaaaaauaaaauu

SEQ ID NO: 1733880 - RNA, 19 nt, Human
uaaauaguaaaaauaaaau

SEQ ID NO: 1733881 - RNA, 19 nt, Human
uaaauuuuuuuuguuucau

SEQ ID NO: 1733882 - RNA, 13 nt, Human
uaacaagccaccc

SEQ ID NO: 1733883 - RNA, 22 nt, Human
uaacaacuaugauuuggaaaau

SEQ ID NO: 1733884 - RNA, 21 nt, Human
uaacaacuaugauuuggaaaa

SEQ ID NO: 1733885 - RNA, 16 nt, Human
uaacaacuaugauuug

SEQ ID NO: 1733886 - RNA, 17 nt, Human
uaaaugauuucauucaa

SEQ ID NO: 1733887 - RNA, 22 nt, Human
uaaaucuccaaaauaaaacuuu

SEQ ID NO: 1733888 - RNA, 20 nt, Human
uaaaucuccaaaauaaaacu

SEQ ID NO: 1733889 - RNA, 21 nt, Human
uaaaucuccaaaauaaaacuu

SEQ ID NO: 1733890 - RNA, 23 nt, Human
uaaauguuuuuuuuuaaagacuu

SEQ ID NO: 1733891 - RNA, 20 nt, Human
uaaauguuuuuuuuuaaaga

SEQ ID NO: 1733892 - RNA, 15 nt, Human
aauaacaauaaaaga

SEQ ID NO: 1733893 - RNA, 22 nt, Human
aauaacauguaauuaaguacua

SEQ ID NO: 1733894 - RNA, 19 nt, Human
aauaacauguaauuaagua

SEQ ID NO: 1733895 - RNA, 12 nt, Human
aauaacauguaa

SEQ ID NO: 1733896 - RNA, 12 nt, Human
aauaaauuauuu

SEQ ID NO: 1733897 - RNA, 15 nt, Human
aauaacuaaaaggua

SEQ ID NO: 1733898 - RNA, 12 nt, Human
aauaaaaauaau

SEQ ID NO: 1733899 - RNA, 16 nt, Human
aauaaaaucuugaaaa

SEQ ID NO: 1733900 - RNA, 14 nt, Human
aauaaaguaauuau

SEQ ID NO: 1733901 - RNA, 16 nt, Human
aauaaaguacaagagc

SEQ ID NO: 1733902 - RNA, 20 nt, Human
uaaaguguauuuuuuuacua

SEQ ID NO: 1733903 - RNA, 14 nt, Human
uaaaguguauuuuu

SEQ ID NO: 1733904 - RNA, 15 nt, Human
uaaaguguauuuuuu

SEQ ID NO: 1733905 - RNA, 19 nt, Human
uaaaguguauuuuuuuacu

SEQ ID NO: 1733906 - RNA, 13 nt, Human
uaaagucaggggu

SEQ ID NO: 1733907 - RNA, 21 nt, Human
uaaagucuguugauuaaagau

SEQ ID NO: 1733908 - RNA, 22 nt, Human
uaaagucuguugauuaaagaug

SEQ ID NO: 1733909 - RNA, 13 nt, Human
aagacccaaaagg

SEQ ID NO: 1733910 - RNA, 17 nt, Human
guggcagcugcggucca

SEQ ID NO: 1733911 - RNA, 19 nt, Human
guggcagcugcgguccacc

SEQ ID NO: 1733912 - RNA, 21 nt, Human
guggauuuaacagaaauguac

SEQ ID NO: 1733913 - RNA, 23 nt, Human
guggauuuaacagaaauguacag

SEQ ID NO: 1733914 - RNA, 14 nt, Human
guggcagcugcggu

SEQ ID NO: 1733915 - RNA, 22 nt, Human
guggcagcucaccucucccuug

SEQ ID NO: 1733916 - RNA, 14 nt, Human
guggcaccagcagc

SEQ ID NO: 1733917 - RNA, 13 nt, Human
guggcaccagcag

SEQ ID NO: 1733918 - RNA, 18 nt, Human
guggcaccagcagccugg

SEQ ID NO: 1733919 - RNA, 19 nt, Human
gugcugggccccugccucu

SEQ ID NO: 1733920 - RNA, 16 nt, Human
gugcugggccccugcc

SEQ ID NO: 1733921 - RNA, 20 nt, Human
gugcugcccugcccaccugg

SEQ ID NO: 1733922 - RNA, 19 nt, Human
gugcugcccugcccaccug

SEQ ID NO: 1733923 - RNA, 21 nt, Human
gugcugcccugcccaccuggc

SEQ ID NO: 1733924 - RNA, 18 nt, Human
gugcugcccugcccaccu

SEQ ID NO: 1733925 - RNA, 23 nt, Human
aagaagguuucagaaagaagugg

SEQ ID NO: 1733926 - RNA, 24 nt, Human
guggacacagcucuucuccaggcu

SEQ ID NO: 1733927 - RNA, 17 nt, Human
guggacacagcucuucu

SEQ ID NO: 1733928 - RNA, 15 nt, Human
guggacacagcucuu

SEQ ID NO: 1733929 - RNA, 14 nt, Human
guggacacagcucu

SEQ ID NO: 1733930 - RNA, 16 nt, Human
aagaaaauaccaagga

SEQ ID NO: 1733931 - RNA, 17 nt, Human
aagaagcccaggaaagg

SEQ ID NO: 1733932 - RNA, 16 nt, Human
aagaagcccaggaaag

SEQ ID NO: 1733933 - RNA, 14 nt, Human
aagaagcucucucc

SEQ ID NO: 1733934 - RNA, 15 nt, Human
aagaagcucucuccu

SEQ ID NO: 1733935 - RNA, 13 nt, Human
aacuuguuuucug

SEQ ID NO: 1733936 - RNA, 22 nt, Human
aagaaaaaggaugcacagaguu

SEQ ID NO: 1733937 - RNA, 19 nt, Human
aagaaaaaggaugcacaga

SEQ ID NO: 1733938 - RNA, 20 nt, Human
aagaaaaaggaugcacagag

SEQ ID NO: 1733939 - RNA, 15 nt, Human
aagaaaaguuuugua

SEQ ID NO: 1733940 - RNA, 16 nt, Human
aagaaaaguuuuguaa

SEQ ID NO: 1733941 - RNA, 21 nt, Human
aagaaaaguuuuguaaauuuc

SEQ ID NO: 1733942 - RNA, 22 nt, Human
aagaaaaguuuuguaaauuucu

SEQ ID NO: 1733943 - RNA, 15 nt, Human
gugccucugggacug

SEQ ID NO: 1733944 - RNA, 16 nt, Human
gugccuggccacgccc

SEQ ID NO: 1733945 - RNA, 23 nt, Human
aacuugguucccauuugcuccuu

SEQ ID NO: 1733946 - RNA, 17 nt, Human
aacuuggcgcugccccu

SEQ ID NO: 1733947 - RNA, 15 nt, Human
aacuuguaaaugugg

SEQ ID NO: 1733948 - RNA, 14 nt, Human
aacuuggcgcugcc

SEQ ID NO: 1733949 - RNA, 14 nt, Human
aacuuggaaauagu

SEQ ID NO: 1733950 - RNA, 17 nt, Human
gugcacacaccagagcc

SEQ ID NO: 1733951 - RNA, 18 nt, Human
gugcacguacacacacau

SEQ ID NO: 1733952 - RNA, 14 nt, Human
gugcacacaccaga

SEQ ID NO: 1733953 - RNA, 12 nt, Human
gugcacacacca

SEQ ID NO: 1733954 - RNA, 14 nt, Human
gugccaagcagagg

SEQ ID NO: 1733955 - RNA, 15 nt, Human
gugcauuuggugguu

SEQ ID NO: 1733956 - RNA, 21 nt, Human
gugcauuugaggucuguucuu

SEQ ID NO: 1733957 - RNA, 22 nt, Human
gugcauuugaggucuguucuuu

SEQ ID NO: 1733958 - RNA, 20 nt, Human
gugcauuugaggucuguucu

SEQ ID NO: 1733959 - RNA, 17 nt, Human
aagauauuuugcuuugu

SEQ ID NO: 1733960 - RNA, 20 nt, Human
aagauauuuugcuuugugau

SEQ ID NO: 1733961 - RNA, 20 nt, Human
aagaguaggaagacuuugga

SEQ ID NO: 1733962 - RNA, 22 nt, Human
aagauauuuugcuuugugauuu

SEQ ID NO: 1733963 - RNA, 18 nt, Human
gugguuauggagagggug

SEQ ID NO: 1733964 - RNA, 19 nt, Human
gugguguuuccuggcacug

SEQ ID NO: 1733965 - RNA, 15 nt, Human
aagauauuuugcuuu

SEQ ID NO: 1733966 - RNA, 19 nt, Human
aagaguaggaagacuuugg

SEQ ID NO: 1733967 - RNA, 18 nt, Human
aagaguaggaagacuuug

SEQ ID NO: 1733968 - RNA, 16 nt, Human
aagaguaggaagacuu

SEQ ID NO: 1733969 - RNA, 19 nt, Human
aagauguagaggagaaacu

SEQ ID NO: 1733970 - RNA, 22 nt, Human
aagauguagaggagaaacugga

SEQ ID NO: 1733971 - RNA, 16 nt, Human
aagcaagauuucagau

SEQ ID NO: 1733972 - RNA, 14 nt, Human
aagcaaaugugaau

SEQ ID NO: 1733973 - RNA, 13 nt, Human
aagcaaaugugaa

SEQ ID NO: 1733974 - RNA, 12 nt, Human
aagcaaaugucu

SEQ ID NO: 1733975 - RNA, 14 nt, Human
guguuuaagacauu

SEQ ID NO: 1733976 - RNA, 13 nt, Human
guguuuaagacau

SEQ ID NO: 1733977 - RNA, 19 nt, Human
gugugguguuuccuggcac

SEQ ID NO: 1733978 - RNA, 19 nt, Human
guguguguaugcgugugug

SEQ ID NO: 1733979 - RNA, 20 nt, Human
gugucccaaaaagaaaggag

SEQ ID NO: 1733980 - RNA, 19 nt, Human
gugucuugcaauggcagcc

SEQ ID NO: 1733981 - RNA, 21 nt, Human
gugucuugcaauggcagccuu

SEQ ID NO: 1733982 - RNA, 18 nt, Human
gugugagucaccaagccc

SEQ ID NO: 1733983 - RNA, 13 nt, Human
gugugagucacca

SEQ ID NO: 1733984 - RNA, 15 nt, Human
gugugguguuuccug

SEQ ID NO: 1733985 - RNA, 23 nt, Human
aagacgcugugcugcccugccca

SEQ ID NO: 1733986 - RNA, 22 nt, Human
aagacgcugugcugcccugccc

SEQ ID NO: 1733987 - RNA, 21 nt, Human
aagacgcugugcugcccugcc

SEQ ID NO: 1733988 - RNA, 12 nt, Human
aagaccagucca

SEQ ID NO: 1733989 - RNA, 23 nt, Human
aagaccccuuaccacugcucuga

SEQ ID NO: 1733990 - RNA, 17 nt, Human
aagacucauucuucugu

SEQ ID NO: 1733991 - RNA, 16 nt, Human
guggcccgacagccug

SEQ ID NO: 1733992 - RNA, 19 nt, Human
aagagauugugguuucauu

SEQ ID NO: 1733993 - RNA, 16 nt, Human
aagagauugugguuuc

SEQ ID NO: 1733994 - RNA, 16 nt, Human
aagacuguacaaagua

SEQ ID NO: 1733995 - RNA, 14 nt, Human
aagagcccaggccu

SEQ ID NO: 1733996 - RNA, 12 nt, Human
aagagcccaggc

SEQ ID NO: 1733997 - RNA, 16 nt, Human
aagagcccaggccucc

SEQ ID NO: 1733998 - RNA, 14 nt, Human
guggccucccaacu

SEQ ID NO: 1733999 - RNA, 13 nt, Human
guggccucccaac

SEQ ID NO: 1734000 - RNA, 17 nt, Human
guggcccgacagccugg

SEQ ID NO: 1734001 - RNA, 15 nt, Human
guggccucccaacuc

SEQ ID NO: 1734002 - RNA, 21 nt, Human
guggcuucccgcucagcccuc

SEQ ID NO: 1734003 - RNA, 18 nt, Human
gugggauccuccaggugc

SEQ ID NO: 1734004 - RNA, 15 nt, Human
gugggauccuccagg

SEQ ID NO: 1734005 - RNA, 12 nt, Human
gugggagcugag

SEQ ID NO: 1734006 - RNA, 16 nt, Human
gugguguuuccuggca

SEQ ID NO: 1734007 - RNA, 15 nt, Human
gugguguuuccuggc

SEQ ID NO: 1734008 - RNA, 18 nt, Human
guggggggggugcugggc

SEQ ID NO: 1734009 - RNA, 19 nt, Human
aacagguuuuccugaagaa

SEQ ID NO: 1734010 - RNA, 12 nt, Human
aacagaggauau

SEQ ID NO: 1734011 - RNA, 15 nt, Human
guccuacccacccuc

SEQ ID NO: 1734012 - RNA, 20 nt, Human
aacagacuggaagcacagcu

SEQ ID NO: 1734013 - RNA, 13 nt, Human
guccuacccaccc

SEQ ID NO: 1734014 - RNA, 20 nt, Human
aacauacucccaucugugaa

SEQ ID NO: 1734015 - RNA, 16 nt, Human
aacauacucccaucug

SEQ ID NO: 1734016 - RNA, 18 nt, Human
aacauacucccaucugug

SEQ ID NO: 1734017 - RNA, 22 nt, Human
aacauguuuuucuucucccuca

SEQ ID NO: 1734018 - RNA, 14 nt, Human
aacaucaacaucuu

SEQ ID NO: 1734019 - RNA, 23 nt, Human
guccccuguuuguuucugaaagg

SEQ ID NO: 1734020 - RNA, 16 nt, Human
guccccgcacugggcu

SEQ ID NO: 1734021 - RNA, 15 nt, Human
guccccgcacugggc

SEQ ID NO: 1734022 - RNA, 13 nt, Human
gucccccugacaa

SEQ ID NO: 1734023 - RNA, 18 nt, Human
gucccccugacaacacuc

SEQ ID NO: 1734024 - RNA, 21 nt, Human
guccgaaagggacuuggaagc

SEQ ID NO: 1734025 - RNA, 13 nt, Human
gucccuuuuccuu

SEQ ID NO: 1734026 - RNA, 22 nt, Human
guccgaaagggacuuggaagcu

SEQ ID NO: 1734027 - RNA, 18 nt, Human
gucccaccuuggcugcag

SEQ ID NO: 1734028 - RNA, 17 nt, Human
gucccaccuuggcugca

SEQ ID NO: 1734029 - RNA, 20 nt, Human
gucccaccuuggcugcaggg

SEQ ID NO: 1734030 - RNA, 19 nt, Human
gucccaccuuggcugcagg

SEQ ID NO: 1734031 - RNA, 14 nt, Human
gucccccucuggcu

SEQ ID NO: 1734032 - RNA, 12 nt, Human
gucccccucugg

SEQ ID NO: 1734033 - RNA, 22 nt, Human
guagcucuaggagggcuggcaa

SEQ ID NO: 1734034 - RNA, 22 nt, Human
guagccucaaucgagugagaca

SEQ ID NO: 1734035 - RNA, 23 nt, Human
gucucaguccaugaagauguaga

SEQ ID NO: 1734036 - RNA, 16 nt, Human
gucucaggucccugca

SEQ ID NO: 1734037 - RNA, 15 nt, Human
gucucaggucccugc

SEQ ID NO: 1734038 - RNA, 15 nt, Human
gucuaugggacucaa

SEQ ID NO: 1734039 - RNA, 14 nt, Human
gucuaugggacuca

SEQ ID NO: 1734040 - RNA, 22 nt, Human
gucucaaacucuugaccucagg

SEQ ID NO: 1734041 - RNA, 16 nt, Human
gucucaaacuccugac

SEQ ID NO: 1734042 - RNA, 17 nt, Human
gucucaagagggcacug

SEQ ID NO: 1734043 - RNA, 15 nt, Human
gucucaagagggcac

SEQ ID NO: 1734044 - RNA, 22 nt, Human
gucucaagagggcacugguggc

SEQ ID NO: 1734045 - RNA, 20 nt, Human
gucucaagagggcacuggug

SEQ ID NO: 1734046 - RNA, 16 nt, Human
aacauuuugucauaua

SEQ ID NO: 1734047 - RNA, 13 nt, Human
gucuccauguuug

SEQ ID NO: 1734048 - RNA, 18 nt, Human
aaccacaucuugcucugc

SEQ ID NO: 1734049 - RNA, 13 nt, Human
aaccacaucuugc

SEQ ID NO: 1734050 - RNA, 16 nt, Human
aaccaaauauuccaga

SEQ ID NO: 1734051 - RNA, 16 nt, Human
guccugcugcaguugc

SEQ ID NO: 1734052 - RNA, 13 nt, Human
guccugcugcagu

SEQ ID NO: 1734053 - RNA, 17 nt, Human
guccugcugcaguugcc

SEQ ID NO: 1734054 - RNA, 13 nt, Human
aacauuaaaauau

SEQ ID NO: 1734055 - RNA, 14 nt, Human
gucgaggacaggga

SEQ ID NO: 1734056 - RNA, 14 nt, Human
gucgcccagucugg

SEQ ID NO: 1734057 - RNA, 13 nt, Human
gucgcccagucug

SEQ ID NO: 1734058 - RNA, 14 nt, Human
gucgcccaggcugg

SEQ ID NO: 1734059 - RNA, 20 nt, Human
gucgcccaggcuggagugca

SEQ ID NO: 1734060 - RNA, 15 nt, Human
gucgcccaggcugga

SEQ ID NO: 1734061 - RNA, 23 nt, Human
gucgcccagucuggaaugcagug

SEQ ID NO: 1734062 - RNA, 14 nt, Human
gucgcccuggacug

SEQ ID NO: 1734063 - RNA, 20 nt, Human
gucuaccugaggggccucuu

SEQ ID NO: 1734064 - RNA, 18 nt, Human
gucgcccuggacugugug

SEQ ID NO: 1734065 - RNA, 17 nt, Human
aacuagaacugaauuuu

SEQ ID NO: 1734066 - RNA, 23 nt, Human
aacguggcugcuucaaggauccu

SEQ ID NO: 1734067 - RNA, 16 nt, Human
gucuucaguaagccgu

SEQ ID NO: 1734068 - RNA, 16 nt, Human
gucuuuguacagacaa

SEQ ID NO: 1734069 - RNA, 15 nt, Human
gucuuuguacagaca

SEQ ID NO: 1734070 - RNA, 18 nt, Human
aaccugauugugucucuu

SEQ ID NO: 1734071 - RNA, 19 nt, Human
aaccugauugugucucuug

SEQ ID NO: 1734072 - RNA, 17 nt, Human
aaccuguucugcuuucc

SEQ ID NO: 1734073 - RNA, 13 nt, Human
aaccuguucugcu

SEQ ID NO: 1734074 - RNA, 23 nt, Human
gucugacaggcaaugcuggcugu

SEQ ID NO: 1734075 - RNA, 22 nt, Human
gucugacaggcaaugcuggcug

SEQ ID NO: 1734076 - RNA, 21 nt, Human
gucugacaggcaaugcuggcu

SEQ ID NO: 1734077 - RNA, 19 nt, Human
gucugaagucacugcacag

SEQ ID NO: 1734078 - RNA, 17 nt, Human
gucugaagucacugcac

SEQ ID NO: 1734079 - RNA, 19 nt, Human
gucucuugguccugcugca

SEQ ID NO: 1734080 - RNA, 18 nt, Human
gucucuugguccugcugc

SEQ ID NO: 1734081 - RNA, 20 nt, Human
gucucuugguccugcugcag

SEQ ID NO: 1734082 - RNA, 17 nt, Human
gucucuugguccugcug

SEQ ID NO: 1734083 - RNA, 23 nt, Human
gucucuuuaaugucacaggcagg

SEQ ID NO: 1734084 - RNA, 22 nt, Human
gucucuuuaaugucacaggcag

SEQ ID NO: 1734085 - RNA, 19 nt, Human
gucugaaggcuggguucug

SEQ ID NO: 1734086 - RNA, 16 nt, Human
gucugaagucacugca

SEQ ID NO: 1734087 - RNA, 20 nt, Human
gucucuuuaaugucacaggc

SEQ ID NO: 1734088 - RNA, 19 nt, Human
gucucuuuaaugucacagg

SEQ ID NO: 1734089 - RNA, 18 nt, Human
gucucuuuaaugucacag

SEQ ID NO: 1734090 - RNA, 14 nt, Human
aacugaacucugac

SEQ ID NO: 1734091 - RNA, 15 nt, Human
aacugaacauuccag

SEQ ID NO: 1734092 - RNA, 16 nt, Human
aacucuguuacacuuu

SEQ ID NO: 1734093 - RNA, 21 nt, Human
gugaguacuacaguccuccca

SEQ ID NO: 1734094 - RNA, 19 nt, Human
gugaguacuacaguccucc

SEQ ID NO: 1734095 - RNA, 17 nt, Human
gugaguccuggcauggg

SEQ ID NO: 1734096 - RNA, 15 nt, Human
gugagucgaggacag

SEQ ID NO: 1734097 - RNA, 20 nt, Human
gugaguccuggcaugggaau

SEQ ID NO: 1734098 - RNA, 16 nt, Human
gugagaggggaacaga

SEQ ID NO: 1734099 - RNA, 13 nt, Human
gugagagcugggu

SEQ ID NO: 1734100 - RNA, 12 nt, Human
gugagacagacu

SEQ ID NO: 1734101 - RNA, 17 nt, Human
gugaguacuacaguccu

SEQ ID NO: 1734102 - RNA, 15 nt, Human
gugagcaggcuguga

SEQ ID NO: 1734103 - RNA, 21 nt, Human
gugagcacuaaggugugcucu

SEQ ID NO: 1734104 - RNA, 12 nt, Human
gugaccccaggu

SEQ ID NO: 1734105 - RNA, 12 nt, Human
gugagagcuggg

SEQ ID NO: 1734106 - RNA, 23 nt, Human
gugaagacaaugacuuacuguac

SEQ ID NO: 1734107 - RNA, 14 nt, Human
gugaagugaagaca

SEQ ID NO: 1734108 - RNA, 19 nt, Human
gugacagaggcagccccau

SEQ ID NO: 1734109 - RNA, 18 nt, Human
gugacagaggcagcccca

SEQ ID NO: 1734110 - RNA, 16 nt, Human
gugacagaggcagccc

SEQ ID NO: 1734111 - RNA, 14 nt, Human
gugacaugucuuuu

SEQ ID NO: 1734112 - RNA, 23 nt, Human
gugacagaggcagccccauucug

SEQ ID NO: 1734113 - RNA, 21 nt, Human
gugaccagcaccaucucuccu

SEQ ID NO: 1734114 - RNA, 18 nt, Human
gugaccagcaccaucucu

SEQ ID NO: 1734115 - RNA, 18 nt, Human
gugaccauguuuuguuua

SEQ ID NO: 1734116 - RNA, 17 nt, Human
gugaccaaugaugguca

SEQ ID NO: 1734117 - RNA, 12 nt, Human
aguccuguaaug

SEQ ID NO: 1734118 - RNA, 15 nt, Human
agucugaaggcuggg

SEQ ID NO: 1734119 - RNA, 13 nt, Human
agucugaaggcug

SEQ ID NO: 1734120 - RNA, 16 nt, Human
agucugaaggcugggu

SEQ ID NO: 1734121 - RNA, 17 nt, Human
agucugaaggcuggguu

SEQ ID NO: 1734122 - RNA, 21 nt, Human
aguccuggcaugggaaugaau

SEQ ID NO: 1734123 - RNA, 20 nt, Human
aguccuggcaugggaaugaa

SEQ ID NO: 1734124 - RNA, 22 nt, Human
aguccuggcaugggaaugaaug

SEQ ID NO: 1734125 - RNA, 18 nt, Human
agucuggaaugcaguggu

SEQ ID NO: 1734126 - RNA, 20 nt, Human
agugaacuugggccacugug

SEQ ID NO: 1734127 - RNA, 17 nt, Human
agucuggaaugcagugg

SEQ ID NO: 1734128 - RNA, 18 nt, Human
agucugauucccaagcuc

SEQ ID NO: 1734129 - RNA, 16 nt, Human
agucugauucccaagc

SEQ ID NO: 1734130 - RNA, 20 nt, Human
agucugauucccaagcucug

SEQ ID NO: 1734131 - RNA, 14 nt, Human
agugaagacaauga

SEQ ID NO: 1734132 - RNA, 16 nt, Human
agugaagacaaugacu

SEQ ID NO: 1734133 - RNA, 18 nt, Human
agugaccauacuaauuau

SEQ ID NO: 1734134 - RNA, 14 nt, Human
aguaugguggcugg

SEQ ID NO: 1734135 - RNA, 20 nt, Human
aguaugggacuggccucugc

SEQ ID NO: 1734136 - RNA, 17 nt, Human
aguaugggacuggccuc

SEQ ID NO: 1734137 - RNA, 16 nt, Human
aguaucuuuuuauuca

SEQ ID NO: 1734138 - RNA, 16 nt, Human
aguaugaauaaagaca

SEQ ID NO: 1734139 - RNA, 15 nt, Human
aguaugaggcauuug

SEQ ID NO: 1734140 - RNA, 16 nt, Human
aguaugaggcauuugu

SEQ ID NO: 1734141 - RNA, 15 nt, Human
aguaucuugaagacu

SEQ ID NO: 1734142 - RNA, 12 nt, Human
aguaucuugaag

SEQ ID NO: 1734143 - RNA, 11 nt, Human
aguaucuugaa

SEQ ID NO: 1734144 - RNA, 14 nt, Human
agugggagcugccu

SEQ ID NO: 1734145 - RNA, 15 nt, Human
agugggagcugccug

SEQ ID NO: 1734146 - RNA, 16 nt, Human
agugggagcugccugu

SEQ ID NO: 1734147 - RNA, 17 nt, Human
aguguauuuuuuuacua

SEQ ID NO: 1734148 - RNA, 18 nt, Human
aguguauuuuuuuacuaa

SEQ ID NO: 1734149 - RNA, 23 nt, Human
aguggcuuaaaacaacacucaca

SEQ ID NO: 1734150 - RNA, 21 nt, Human
aguggcuccucccggugccca

SEQ ID NO: 1734151 - RNA, 17 nt, Human
aguggcuccucccggug

SEQ ID NO: 1734152 - RNA, 13 nt, Human
aguggcuccuccc

SEQ ID NO: 1734153 - RNA, 22 nt, Human
aguugaaaaucuuauaauuuaa

SEQ ID NO: 1734154 - RNA, 19 nt, Human
aguucagguaacaggcaga

SEQ ID NO: 1734155 - RNA, 17 nt, Human
aguuacagacaaagcgu

SEQ ID NO: 1734156 - RNA, 20 nt, Human
aguucagguaacaggcagau

SEQ ID NO: 1734157 - RNA, 12 nt, Human
aguuaaauaaau

SEQ ID NO: 1734158 - RNA, 13 nt, Human
aguuaagccuuug

SEQ ID NO: 1734159 - RNA, 14 nt, Human
aguuaagccuuugg

SEQ ID NO: 1734160 - RNA, 16 nt, Human
aguuacagacaaagcg

SEQ ID NO: 1734161 - RNA, 14 nt, Human
aguuacagacaaag

SEQ ID NO: 1734162 - RNA, 16 nt, Human
aguuguuaauaaaagu

SEQ ID NO: 1734163 - RNA, 20 nt, Human
aguuguuugauucagacagc

SEQ ID NO: 1734164 - RNA, 23 nt, Human
aguugaaaaucuuauaauuuaaa

SEQ ID NO: 1734165 - RNA, 14 nt, Human
aguugaagacagag

SEQ ID NO: 1734166 - RNA, 18 nt, Human
auaaaggauuaaugucaa

SEQ ID NO: 1734167 - RNA, 19 nt, Human
auaaauuuuuuuuguuuca

SEQ ID NO: 1734168 - RNA, 22 nt, Human
auaaauuuuuuuuguuucauau

SEQ ID NO: 1734169 - RNA, 17 nt, Human
auaaaacuuuuuaaaau

SEQ ID NO: 1734170 - RNA, 21 nt, Human
auaaacuuuaccuuuuuuaua

SEQ ID NO: 1734171 - RNA, 24 nt, Human
auaaacuuuaccuuuuuuauacau

SEQ ID NO: 1734172 - RNA, 20 nt, Human
auaaacuuuuuucuuacugu

SEQ ID NO: 1734173 - RNA, 15 nt, Human
auaaaacuuuuuaaa

SEQ ID NO: 1734174 - RNA, 11 nt, Human
auaaaacuuuu

SEQ ID NO: 1734175 - RNA, 14 nt, Human
auaaagcagcguuu

SEQ ID NO: 1734176 - RNA, 18 nt, Human
auaaagcagcguuucuau

SEQ ID NO: 1734177 - RNA, 19 nt, Human
auaaagcagcguuucuaug

SEQ ID NO: 1734178 - RNA, 20 nt, Human
auaaagcagcguuucuauga

SEQ ID NO: 1734179 - RNA, 13 nt, Human
auaaagcagcguu

SEQ ID NO: 1734180 - RNA, 11 nt, Human
auaaagacagg

SEQ ID NO: 1734181 - RNA, 12 nt, Human
auaaagacaccu

SEQ ID NO: 1734182 - RNA, 18 nt, Human
auaaagcuguguggcagu

SEQ ID NO: 1734183 - RNA, 15 nt, Human
auaaagcaggcagaa

SEQ ID NO: 1734184 - RNA, 18 nt, Human
auaccugucccccugaca

SEQ ID NO: 1734185 - RNA, 12 nt, Human
auacccaccccc

SEQ ID NO: 1734186 - RNA, 11 nt, Human
auacccacccc

SEQ ID NO: 1734187 - RNA, 15 nt, Human
auaauguaagcucua

SEQ ID NO: 1734188 - RNA, 18 nt, Human
auacaccacuacauucug

SEQ ID NO: 1734189 - RNA, 21 nt, Human
auacaccacuacauucuguua

SEQ ID NO: 1734190 - RNA, 23 nt, Human
auaccauuauauguucccccugu

SEQ ID NO: 1734191 - RNA, 19 nt, Human
auacaccacuacauucugu

SEQ ID NO: 1734192 - RNA, 20 nt, Human
auacaccacuacauucuguu

SEQ ID NO: 1734193 - RNA, 21 nt, Human
auaaugcgugcauaccacuuu

SEQ ID NO: 1734194 - RNA, 15 nt, Human
auagguuuaauaauu

SEQ ID NO: 1734195 - RNA, 12 nt, Human
auagguuauuuu

SEQ ID NO: 1734196 - RNA, 18 nt, Human
auaguaugguggcugggu

SEQ ID NO: 1734197 - RNA, 17 nt, Human
auaguaugguggcuggg

SEQ ID NO: 1734198 - RNA, 21 nt, Human
auagguauaaguggugugugu

SEQ ID NO: 1734199 - RNA, 21 nt, Human
auagccaaggccaaaggaagc

SEQ ID NO: 1734200 - RNA, 15 nt, Human
auagccaaggccaaa

SEQ ID NO: 1734201 - RNA, 14 nt, Human
auauuauuuuaugu

SEQ ID NO: 1734202 - RNA, 19 nt, Human
auauuuacuucuuauacau

SEQ ID NO: 1734203 - RNA, 23 nt, Human
auauuaugaagcuuuuaugugaa

SEQ ID NO: 1734204 - RNA, 22 nt, Human
auauuaccacagacauacuaac

SEQ ID NO: 1734205 - RNA, 15 nt, Human
auaucaauuuaaaaa

SEQ ID NO: 1734206 - RNA, 16 nt, Human
auaucaaauauauuca

SEQ ID NO: 1734207 - RNA, 16 nt, Human
aucaugugaaaucauu

SEQ ID NO: 1734208 - RNA, 14 nt, Human
aucaugugaaauca

SEQ ID NO: 1734209 - RNA, 15 nt, Human
aucaugugaaaucau

SEQ ID NO: 1734210 - RNA, 20 nt, Human
aucaccaacgucugugccau

SEQ ID NO: 1734211 - RNA, 19 nt, Human
aucaccaacgucugugcca

SEQ ID NO: 1734212 - RNA, 18 nt, Human
aucaccaacgucugugcc

SEQ ID NO: 1734213 - RNA, 15 nt, Human
aucacauguggacuu

SEQ ID NO: 1734214 - RNA, 21 nt, Human
aucacagccucugaaaaccaa

SEQ ID NO: 1734215 - RNA, 18 nt, Human
aucagccugcuccagcug

SEQ ID NO: 1734216 - RNA, 17 nt, Human
aucagccugcuccagcu

SEQ ID NO: 1734217 - RNA, 19 nt, Human
aucagccugcuccagcugu

SEQ ID NO: 1734218 - RNA, 20 nt, Human
aucagccugcuccagcuguu

SEQ ID NO: 1734219 - RNA, 21 nt, Human
aucaccgaaaacguggcugcu

SEQ ID NO: 1734220 - RNA, 19 nt, Human
aucaccgaaaacguggcug

SEQ ID NO: 1734221 - RNA, 14 nt, Human
aucaccgaaaacgu

SEQ ID NO: 1734222 - RNA, 19 nt, Human
aucagcacgauuucuguuu

SEQ ID NO: 1734223 - RNA, 20 nt, Human
aucagcacgauuucuguuua

SEQ ID NO: 1734224 - RNA, 23 nt, Human
aucagcacgauuucuguuuagau

SEQ ID NO: 1734225 - RNA, 19 nt, Human
auccucccaccucagccuc

SEQ ID NO: 1734226 - RNA, 18 nt, Human
auccucccaccucagccu

SEQ ID NO: 1734227 - RNA, 20 nt, Human
auccucccaccucagccucc

SEQ ID NO: 1734228 - RNA, 12 nt, Human
auccucccaggc

SEQ ID NO: 1734229 - RNA, 15 nt, Human
aucggcauuuguuuc

SEQ ID NO: 1734230 - RNA, 15 nt, Human
auccucccaccucag

SEQ ID NO: 1734231 - RNA, 23 nt, Human
auccuccaggugcacaagcucca

SEQ ID NO: 1734232 - RNA, 11 nt, Human
auccuccaggu

SEQ ID NO: 1734233 - RNA, 15 nt, Human
auccccuguagagug

SEQ ID NO: 1734234 - RNA, 16 nt, Human
auccccaagccuggca

SEQ ID NO: 1734235 - RNA, 15 nt, Human
aucccauuuaaaaaa

SEQ ID NO: 1734236 - RNA, 13 nt, Human
auccccaagccug

SEQ ID NO: 1734237 - RNA, 14 nt, Human
aucccauuuaaaaa

SEQ ID NO: 1734238 - RNA, 15 nt, Human
auccagacccggcug

SEQ ID NO: 1734239 - RNA, 18 nt, Human
auccagaaagaaaacuug

SEQ ID NO: 1734240 - RNA, 16 nt, Human
auccagaaagaaaacu

SEQ ID NO: 1734241 - RNA, 14 nt, Human
aucuucuuuauaau

SEQ ID NO: 1734242 - RNA, 18 nt, Human
aucuugaagacuuuucuu

SEQ ID NO: 1734243 - RNA, 17 nt, Human
aucuugaauuguaagga

SEQ ID NO: 1734244 - RNA, 18 nt, Human
aucuugaauaauguaaga

SEQ ID NO: 1734245 - RNA, 22 nt, Human
aucugcuuuuuaaagaaugcuc

SEQ ID NO: 1734246 - RNA, 19 nt, Human
aucuggacuccucugucca

SEQ ID NO: 1734247 - RNA, 18 nt, Human
aucuggacuccucugucc

SEQ ID NO: 1734248 - RNA, 17 nt, Human
aucuggacuccucuguc

SEQ ID NO: 1734249 - RNA, 16 nt, Human
aucuggacuccucugu

SEQ ID NO: 1734250 - RNA, 15 nt, Human
aucuggacuccucug

SEQ ID NO: 1734251 - RNA, 17 nt, Human
aucucugcuuuggaaau

SEQ ID NO: 1734252 - RNA, 16 nt, Human
aucucggcucacugca

SEQ ID NO: 1734253 - RNA, 15 nt, Human
aucucggcucacugc

SEQ ID NO: 1734254 - RNA, 14 nt, Human
aucucggcucacug

SEQ ID NO: 1734255 - RNA, 19 nt, Human
augaaagacuguacaaagu

SEQ ID NO: 1734256 - RNA, 17 nt, Human
augaaagacuguacaaa

SEQ ID NO: 1734257 - RNA, 16 nt, Human
augaaagacuguacaa

SEQ ID NO: 1734258 - RNA, 13 nt, Human
augaaagacugua

SEQ ID NO: 1734259 - RNA, 22 nt, Human
augaagcuuuuaugugaaacau

SEQ ID NO: 1734260 - RNA, 19 nt, Human
augaaguuuuuuuuauaca

SEQ ID NO: 1734261 - RNA, 23 nt, Human
augaccuuucaauaggaaaaacu

SEQ ID NO: 1734262 - RNA, 22 nt, Human
augaccuuucaauaggaaaaac

SEQ ID NO: 1734263 - RNA, 21 nt, Human
augaccuuucaauaggaaaaa

SEQ ID NO: 1734264 - RNA, 23 nt, Human
augaaguuuuuuuuauacaggau

SEQ ID NO: 1734265 - RNA, 12 nt, Human
augcugcccugu

SEQ ID NO: 1734266 - RNA, 12 nt, Human
augcuuguacau

SEQ ID NO: 1734267 - RNA, 13 nt, Human
augcuuguacaua

SEQ ID NO: 1734268 - RNA, 14 nt, Human
augcuuguacauaa

SEQ ID NO: 1734269 - RNA, 15 nt, Human
auggauuuccagcca

SEQ ID NO: 1734270 - RNA, 16 nt, Human
auggaggaaaaccaag

SEQ ID NO: 1734271 - RNA, 22 nt, Human
auggaggaaaaccaagccgugg

SEQ ID NO: 1734272 - RNA, 11 nt, Human
augcugcccug

SEQ ID NO: 1734273 - RNA, 16 nt, Human
augcucuuuacuucau

SEQ ID NO: 1734274 - RNA, 20 nt, Human
auggcugugccucugccugu

SEQ ID NO: 1734275 - RNA, 19 nt, Human
auggcugugccucugccug

SEQ ID NO: 1734276 - RNA, 17 nt, Human
augcacagaguuguuac

SEQ ID NO: 1734277 - RNA, 18 nt, Human
augcacagaguuguuaca

SEQ ID NO: 1734278 - RNA, 17 nt, Human
augcacaaacagaggcc

SEQ ID NO: 1734279 - RNA, 16 nt, Human
augcacaaacagaggc

SEQ ID NO: 1734280 - RNA, 16 nt, Human
augcacagaguuguua

SEQ ID NO: 1734281 - RNA, 19 nt, Human
augccucucucaggccaaa

SEQ ID NO: 1734282 - RNA, 16 nt, Human
augcaugaaguaauau

SEQ ID NO: 1734283 - RNA, 20 nt, Human
augcauauuauuuuauguug

SEQ ID NO: 1734284 - RNA, 16 nt, Human
augcauauuauuuuau

SEQ ID NO: 1734285 - RNA, 17 nt, Human
augaugccaugaggaac

SEQ ID NO: 1734286 - RNA, 16 nt, Human
augaugccaugaggaa

SEQ ID NO: 1734287 - RNA, 24 nt, Human
augauguuuuccaugaguccccug

SEQ ID NO: 1734288 - RNA, 15 nt, Human
augcacaaacagagg

SEQ ID NO: 1734289 - RNA, 23 nt, Human
auguaauuaaguacuauguauca

SEQ ID NO: 1734290 - RNA, 17 nt, Human
auguaauuaaguacuau

SEQ ID NO: 1734291 - RNA, 15 nt, Human
auguaauuaaguacu

SEQ ID NO: 1734292 - RNA, 15 nt, Human
auggucggaaaacau

SEQ ID NO: 1734293 - RNA, 19 nt, Human
auggucaccaaaucagcug

SEQ ID NO: 1734294 - RNA, 13 nt, Human
augucuuccugga

SEQ ID NO: 1734295 - RNA, 14 nt, Human
augucuuuucuugc

SEQ ID NO: 1734296 - RNA, 22 nt, Human
augugaaacuggauuaaacuua

SEQ ID NO: 1734297 - RNA, 14 nt, Human
augugaaaucauuc

SEQ ID NO: 1734298 - RNA, 15 nt, Human
augugaaacauguuu

SEQ ID NO: 1734299 - RNA, 20 nt, Human
augugggcuaguugggcuuc

SEQ ID NO: 1734300 - RNA, 17 nt, Human
auguucuaagaagugaa

SEQ ID NO: 1734301 - RNA, 12 nt, Human
auguucugggac

SEQ ID NO: 1734302 - RNA, 11 nt, Human
auguucuggga

SEQ ID NO: 1734303 - RNA, 16 nt, Human
auguucucucuucucc

SEQ ID NO: 1734304 - RNA, 13 nt, Human
auguucugggaca

SEQ ID NO: 1734305 - RNA, 19 nt, Human
auguuugccucugccucug

SEQ ID NO: 1734306 - RNA, 22 nt, Human
auguuugccucugccucugaca

SEQ ID NO: 1734307 - RNA, 13 nt, Human
agguucccuuuga

SEQ ID NO: 1734308 - RNA, 22 nt, Human
agguucccuuugacgccauccc

SEQ ID NO: 1734309 - RNA, 14 nt, Human
agguucaaagauau

SEQ ID NO: 1734310 - RNA, 15 nt, Human
agguucaaagauauu

SEQ ID NO: 1734311 - RNA, 23 nt, Human
agguucccuuugacgccauccca

SEQ ID NO: 1734312 - RNA, 22 nt, Human
aggugcuaggaacacuccuuca

SEQ ID NO: 1734313 - RNA, 19 nt, Human
aggugcuaggaacacuccu

SEQ ID NO: 1734314 - RNA, 23 nt, Human
aggugcuaggaacacuccuucac

SEQ ID NO: 1734315 - RNA, 20 nt, Human
agguaaaagcaucacaugaa

SEQ ID NO: 1734316 - RNA, 18 nt, Human
agguaaaucagacuauga

SEQ ID NO: 1734317 - RNA, 11 nt, Human
aggucccuaau

SEQ ID NO: 1734318 - RNA, 12 nt, Human
aggucccuaaua

SEQ ID NO: 1734319 - RNA, 17 nt, Human
agguacaaccuguucug

SEQ ID NO: 1734320 - RNA, 23 nt, Human
agguaaaucagacuaugaaguuu

SEQ ID NO: 1734321 - RNA, 21 nt, Human
agguaaucgaccugccucggc

SEQ ID NO: 1734322 - RNA, 19 nt, Human
agguaaucgaccugccucg

SEQ ID NO: 1734323 - RNA, 22 nt, Human
aggucuguucuuuccaaaguac

SEQ ID NO: 1734324 - RNA, 23 nt, Human
aggucuguucuuuccaaaguaca

SEQ ID NO: 1734325 - RNA, 18 nt, Human
aggucuguucuuuccaaa

SEQ ID NO: 1734326 - RNA, 16 nt, Human
aggucccuaauaaagc

SEQ ID NO: 1734327 - RNA, 15 nt, Human
aggucccuaauaaag

SEQ ID NO: 1734328 - RNA, 13 nt, Human
aggucccuaauaa

SEQ ID NO: 1734329 - RNA, 11 nt, Human
agggucccugg

SEQ ID NO: 1734330 - RNA, 23 nt, Human
aggguccuggggaaccugacccc

SEQ ID NO: 1734331 - RNA, 21 nt, Human
aggguccuggggaaccugacc

SEQ ID NO: 1734332 - RNA, 15 nt, Human
aggguccuggggaac

SEQ ID NO: 1734333 - RNA, 12 nt, Human
aggguccugggg

SEQ ID NO: 1734334 - RNA, 21 nt, Human
aggggccucuuaugggcuggg

SEQ ID NO: 1734335 - RNA, 20 nt, Human
aggggccucuuaugggcugg

SEQ ID NO: 1734336 - RNA, 19 nt, Human
aggggccucuuaugggcug

SEQ ID NO: 1734337 - RNA, 15 nt, Human
aggguaucuggugac

SEQ ID NO: 1734338 - RNA, 21 nt, Human
aggguaucaggugcugccauc

SEQ ID NO: 1734339 - RNA, 19 nt, Human
aggguaucaggugcugcca

SEQ ID NO: 1734340 - RNA, 21 nt, Human
aggcuagaaccaccugccuau

SEQ ID NO: 1734341 - RNA, 23 nt, Human
aggcuacuguaaggcaaucaugg

SEQ ID NO: 1734342 - RNA, 21 nt, Human
aggcgugagccaccgugccug

SEQ ID NO: 1734343 - RNA, 23 nt, Human
aggcccuucucuccagccccugg

SEQ ID NO: 1734344 - RNA, 22 nt, Human
aggcccuucucuccagccccug

SEQ ID NO: 1734345 - RNA, 19 nt, Human
aggcccuuccucuccacug

SEQ ID NO: 1734346 - RNA, 21 nt, Human
aggcccuucucuccagccccu

SEQ ID NO: 1734347 - RNA, 20 nt, Human
aggcccuucucuccagcccc

SEQ ID NO: 1734348 - RNA, 18 nt, Human
aggcccuuccucuccacu

SEQ ID NO: 1734349 - RNA, 17 nt, Human
aggcccuuccucuccac

SEQ ID NO: 1734350 - RNA, 15 nt, Human
aggcccuuccucucc

SEQ ID NO: 1734351 - RNA, 13 nt, Human
aggcccuuccucu

SEQ ID NO: 1734352 - RNA, 18 nt, Human
aggcuguaucccaugagc

SEQ ID NO: 1734353 - RNA, 13 nt, Human
aggcuguauccca

SEQ ID NO: 1734354 - RNA, 20 nt, Human
aggcugucaauuacaggaag

SEQ ID NO: 1734355 - RNA, 23 nt, Human
agggacagaggggguggccuccc

SEQ ID NO: 1734356 - RNA, 22 nt, Human
agggacagaggggguggccucc

SEQ ID NO: 1734357 - RNA, 21 nt, Human
aggcugucaauuacaggaagu

SEQ ID NO: 1734358 - RNA, 17 nt, Human
agggacgcuacccggga

SEQ ID NO: 1734359 - RNA, 23 nt, Human
agcugcgguccacccaggagccc

SEQ ID NO: 1734360 - RNA, 19 nt, Human
agcuucuguugcugccuca

SEQ ID NO: 1734361 - RNA, 23 nt, Human
agcuccgcuuucuacccagcgag

SEQ ID NO: 1734362 - RNA, 21 nt, Human
agcuccgcuuucuacccagcg

SEQ ID NO: 1734363 - RNA, 20 nt, Human
agcuccgcuuucuacccagc

SEQ ID NO: 1734364 - RNA, 13 nt, Human
agcuccuucuguc

SEQ ID NO: 1734365 - RNA, 12 nt, Human
agcuccuucugu

SEQ ID NO: 1734366 - RNA, 23 nt, Human
agcugagauuauaggcaccuacc

SEQ ID NO: 1734367 - RNA, 16 nt, Human
aggauguucugggaca

SEQ ID NO: 1734368 - RNA, 15 nt, Human
aggauguucugggac

SEQ ID NO: 1734369 - RNA, 22 nt, Human
aggauguucuagcauggcugcc

SEQ ID NO: 1734370 - RNA, 22 nt, Human
aggauguacaaggacagccccu

SEQ ID NO: 1734371 - RNA, 18 nt, Human
aggauguucugggacaca

SEQ ID NO: 1734372 - RNA, 14 nt, Human
aggauuaaauaaug

SEQ ID NO: 1734373 - RNA, 14 nt, Human
aggauuauuggaaa

SEQ ID NO: 1734374 - RNA, 20 nt, Human
aggauuaaauaauguaaaua

SEQ ID NO: 1734375 - RNA, 13 nt, Human
aggaccucaggug

SEQ ID NO: 1734376 - RNA, 21 nt, Human
aggaugcuuguacauaaugcg

SEQ ID NO: 1734377 - RNA, 23 nt, Human
aggaugcuuguacauaaugcgug

SEQ ID NO: 1734378 - RNA, 18 nt, Human
aggaguggguugauuuca

SEQ ID NO: 1734379 - RNA, 17 nt, Human
aggaauccagacccggc

SEQ ID NO: 1734380 - RNA, 21 nt, Human
aggaaucaugugccaagcaga

SEQ ID NO: 1734381 - RNA, 20 nt, Human
aggaauccagacccggcugc

SEQ ID NO: 1734382 - RNA, 21 nt, Human
agcuuuucccuuuuuuuaagu

SEQ ID NO: 1734383 - RNA, 23 nt, Human
agcauccuggcacccggccccug

SEQ ID NO: 1734384 - RNA, 22 nt, Human
agcauccuggcacccggccccu

SEQ ID NO: 1734385 - RNA, 23 nt, Human
agcaugccuggauggggcugcac

SEQ ID NO: 1734386 - RNA, 23 nt, Human
agccaagugugguagagugugcc

SEQ ID NO: 1734387 - RNA, 13 nt, Human
agcagcguuucua

SEQ ID NO: 1734388 - RNA, 18 nt, Human
agcagcguuucuaugaca

SEQ ID NO: 1734389 - RNA, 20 nt, Human
agcagugcaugcugucccuu

SEQ ID NO: 1734390 - RNA, 19 nt, Human
agcagugcaugcugucccu

SEQ ID NO: 1734391 - RNA, 19 nt, Human
agcacagacccugcccugu

SEQ ID NO: 1734392 - RNA, 18 nt, Human
agcacagacccugcccug

SEQ ID NO: 1734393 - RNA, 20 nt, Human
agcacagacccugcccugug

SEQ ID NO: 1734394 - RNA, 17 nt, Human
agcacagacccugcccu

SEQ ID NO: 1734395 - RNA, 23 nt, Human
agcacacuugacaucaacugcau

SEQ ID NO: 1734396 - RNA, 21 nt, Human
agccgggcgugguggugagug

SEQ ID NO: 1734397 - RNA, 16 nt, Human
agccgugccuucagcu

SEQ ID NO: 1734398 - RNA, 15 nt, Human
agccgugccuucagc

SEQ ID NO: 1734399 - RNA, 21 nt, Human
agccucccaaagugcugggau

SEQ ID NO: 1734400 - RNA, 17 nt, Human
agccgugccuucagcuc

SEQ ID NO: 1734401 - RNA, 22 nt, Human
agccucccacgacugcccggca

SEQ ID NO: 1734402 - RNA, 14 nt, Human
agccuccuccagcc

SEQ ID NO: 1734403 - RNA, 19 nt, Human
agccucccgaguagcuggg

SEQ ID NO: 1734404 - RNA, 18 nt, Human
agccucccgaguagcugg

SEQ ID NO: 1734405 - RNA, 20 nt, Human
agccucccgaguagcuggga

SEQ ID NO: 1734406 - RNA, 22 nt, Human
agccucccgaguagcugggacu

SEQ ID NO: 1734407 - RNA, 21 nt, Human
agccgccaugcuccuggccca

SEQ ID NO: 1734408 - RNA, 13 nt, Human
agccgcuggggcc

SEQ ID NO: 1734409 - RNA, 20 nt, Human
agccagcaggcucucaggcc

SEQ ID NO: 1734410 - RNA, 19 nt, Human
agccagcaggcucucaggc

SEQ ID NO: 1734411 - RNA, 18 nt, Human
agccagcaggcucucagg

SEQ ID NO: 1734412 - RNA, 16 nt, Human
agccccauucugccug

SEQ ID NO: 1734413 - RNA, 13 nt, Human
agccccauucugc

SEQ ID NO: 1734414 - RNA, 17 nt, Human
agcccucacccuggggc

SEQ ID NO: 1734415 - RNA, 15 nt, Human
agccccagugcccac

SEQ ID NO: 1734416 - RNA, 14 nt, Human
agccccagugccca

SEQ ID NO: 1734417 - RNA, 13 nt, Human
agccccagugccc

SEQ ID NO: 1734418 - RNA, 17 nt, Human
agacuggaagcacagcu

SEQ ID NO: 1734419 - RNA, 19 nt, Human
agacuggaagcacagcuuc

SEQ ID NO: 1734420 - RNA, 21 nt, Human
agagaggguggugaccucugc

SEQ ID NO: 1734421 - RNA, 20 nt, Human
agagaggguggugaccucug

SEQ ID NO: 1734422 - RNA, 22 nt, Human
agagaggguggugaccucugcc

SEQ ID NO: 1734423 - RNA, 13 nt, Human
agagcccacgccc

SEQ ID NO: 1734424 - RNA, 19 nt, Human
agagcccaccuuggcucaa

SEQ ID NO: 1734425 - RNA, 16 nt, Human
agagcccacgccccca

SEQ ID NO: 1734426 - RNA, 17 nt, Human
agagcccacgcccccac

SEQ ID NO: 1734427 - RNA, 21 nt, Human
agacgcugugcugcccugccc

SEQ ID NO: 1734428 - RNA, 12 nt, Human
agacagcucuua

SEQ ID NO: 1734429 - RNA, 11 nt, Human
agacagcucuu

SEQ ID NO: 1734430 - RNA, 12 nt, Human
agacagcugccu

SEQ ID NO: 1734431 - RNA, 18 nt, Human
agacggagucccaccuug

SEQ ID NO: 1734432 - RNA, 22 nt, Human
agacgcugugcugcccugccca

SEQ ID NO: 1734433 - RNA, 17 nt, Human
agacgugauuuugcugu

SEQ ID NO: 1734434 - RNA, 15 nt, Human
agacagcccgggcuc

SEQ ID NO: 1734435 - RNA, 14 nt, Human
agacagcccgggcu

SEQ ID NO: 1734436 - RNA, 16 nt, Human
agacagcccgggcucu

SEQ ID NO: 1734437 - RNA, 21 nt, Human
agacagauacuccuccaaggu

SEQ ID NO: 1734438 - RNA, 15 nt, Human
agacagauacuccuc

SEQ ID NO: 1734439 - RNA, 14 nt, Human
agauggcugugccu

SEQ ID NO: 1734440 - RNA, 19 nt, Human
agauauaugcucugcaugu

SEQ ID NO: 1734441 - RNA, 14 nt, Human
agagugugccugaa

SEQ ID NO: 1734442 - RNA, 11 nt, Human
agagugggagc

SEQ ID NO: 1734443 - RNA, 23 nt, Human
agaggguggugaccucugccuga

SEQ ID NO: 1734444 - RNA, 19 nt, Human
agaguggcuccucccggug

SEQ ID NO: 1734445 - RNA, 19 nt, Human
agaguggggauaugauuua

SEQ ID NO: 1734446 - RNA, 23 nt, Human
agaguggcuccucccggugccca

SEQ ID NO: 1734447 - RNA, 19 nt, Human
agaggguggugaccucugc

SEQ ID NO: 1734448 - RNA, 22 nt, Human
agaggguggugaccucugccug

SEQ ID NO: 1734449 - RNA, 20 nt, Human
agaggguggugaccucugcc

SEQ ID NO: 1734450 - RNA, 12 nt, Human
agagggcacaga

SEQ ID NO: 1734451 - RNA, 16 nt, Human
agaggaaggagaggag

SEQ ID NO: 1734452 - RNA, 16 nt, Human
agaggagagaggaccc

SEQ ID NO: 1734453 - RNA, 15 nt, Human
agaggagagaggacc

SEQ ID NO: 1734454 - RNA, 14 nt, Human
agaggacuuuucuu

SEQ ID NO: 1734455 - RNA, 14 nt, Human
agagcccaggccuc

SEQ ID NO: 1734456 - RNA, 13 nt, Human
agagcccaggccu

SEQ ID NO: 1734457 - RNA, 15 nt, Human
agagcccaggccucc

SEQ ID NO: 1734458 - RNA, 15 nt, Human
aauccaaugaaauga

SEQ ID NO: 1734459 - RNA, 19 nt, Human
aauccagacccggcugcgu

SEQ ID NO: 1734460 - RNA, 16 nt, Human
aaucucaaauuucuaa

SEQ ID NO: 1734461 - RNA, 15 nt, Human
aaucucaaauuucua

SEQ ID NO: 1734462 - RNA, 13 nt, Human
aauccagccugcu

SEQ ID NO: 1734463 - RNA, 17 nt, Human
aaucucaaauuucuaaa

SEQ ID NO: 1734464 - RNA, 18 nt, Human
aaucucaaauuucuaaau

SEQ ID NO: 1734465 - RNA, 16 nt, Human
aaucucuccauucccg

SEQ ID NO: 1734466 - RNA, 16 nt, Human
aaugauccccagcugu

SEQ ID NO: 1734467 - RNA, 22 nt, Human
aaugauccccagcuguuuaugc

SEQ ID NO: 1734468 - RNA, 19 nt, Human
aaugauccccagcuguuua

SEQ ID NO: 1734469 - RNA, 20 nt, Human
aaugauccccagcuguuuau

SEQ ID NO: 1734470 - RNA, 18 nt, Human
aauccaagcaaaugugaa

SEQ ID NO: 1734471 - RNA, 17 nt, Human
aauccaagcaaauguga

SEQ ID NO: 1734472 - RNA, 13 nt, Human
aauagacaauuua

SEQ ID NO: 1734473 - RNA, 21 nt, Human
aauauuagugaccucagcuuu

SEQ ID NO: 1734474 - RNA, 14 nt, Human
aaucaccgaaaacg

SEQ ID NO: 1734475 - RNA, 19 nt, Human
aaucacauucgaguguuuc

SEQ ID NO: 1734476 - RNA, 15 nt, Human
aaucaccgaaaacgu

SEQ ID NO: 1734477 - RNA, 23 nt, Human
aauacuuugcagcacagcugaga

SEQ ID NO: 1734478 - RNA, 22 nt, Human
aauacucuacccucuuagaaaa

SEQ ID NO: 1734479 - RNA, 20 nt, Human
aauacucuacccucuuagaa

SEQ ID NO: 1734480 - RNA, 22 nt, Human
aauguuuuuuuuuaaagacuuu

SEQ ID NO: 1734481 - RNA, 20 nt, Human
aauguuuuuuuuuaaagacu

SEQ ID NO: 1734482 - RNA, 15 nt, Human
aauguuuuuuuuuaa

SEQ ID NO: 1734483 - RNA, 15 nt, Human
aaugugaaaagaaaa

SEQ ID NO: 1734484 - RNA, 17 nt, Human
aaugugaaaagaaaaau

SEQ ID NO: 1734485 - RNA, 12 nt, Human
aauguuuccuuu

SEQ ID NO: 1734486 - RNA, 22 nt, Human
aauguuuacagauccccaagcc

SEQ ID NO: 1734487 - RNA, 16 nt, Human
aauguuugccucugcc

SEQ ID NO: 1734488 - RNA, 15 nt, Human
aauguuugccucugc

SEQ ID NO: 1734489 - RNA, 13 nt, Human
aauguuuccuuua

SEQ ID NO: 1734490 - RNA, 23 nt, Human
aaugcuauaacuauguugauaaa

SEQ ID NO: 1734491 - RNA, 19 nt, Human
aaugcgugcauaccacuuu

SEQ ID NO: 1734492 - RNA, 18 nt, Human
aaugcgugcauaccacuu

SEQ ID NO: 1734493 - RNA, 22 nt, Human
aaugcgcaggcuggcccugccc

SEQ ID NO: 1734494 - RNA, 23 nt, Human
aaugccuuacccucauguucuua

SEQ ID NO: 1734495 - RNA, 18 nt, Human
aagggacgcuacccggga

SEQ ID NO: 1734496 - RNA, 18 nt, Human
aaggucauuuuuuuuaag

SEQ ID NO: 1734497 - RNA, 19 nt, Human
aaggucauuuuuuuuaaga

SEQ ID NO: 1734498 - RNA, 14 nt, Human
aagucuccaaaguc

SEQ ID NO: 1734499 - RNA, 22 nt, Human
aaguccucuuuucugagaggac

SEQ ID NO: 1734500 - RNA, 18 nt, Human
aaguauccugcuucugau

SEQ ID NO: 1734501 - RNA, 18 nt, Human
aaguccucuuuucugaga

SEQ ID NO: 1734502 - RNA, 14 nt, Human
aaguccacagugga

SEQ ID NO: 1734503 - RNA, 19 nt, Human
aaguccacaguggaaccag

SEQ ID NO: 1734504 - RNA, 21 nt, Human
aaguagaagucuuagauguau

SEQ ID NO: 1734505 - RNA, 18 nt, Human
aaguaucccuacuguaau

SEQ ID NO: 1734506 - RNA, 23 nt, Human
aaguaucccuacuguaauuugug

SEQ ID NO: 1734507 - RNA, 17 nt, Human
aaguaucccuacuguaa

SEQ ID NO: 1734508 - RNA, 15 nt, Human
aaguaguggagcccc

SEQ ID NO: 1734509 - RNA, 20 nt, Human
aaguagaagucuuagaugua

SEQ ID NO: 1734510 - RNA, 19 nt, Human
aaguagaagucuuagaugu

SEQ ID NO: 1734511 - RNA, 20 nt, Human
aaggugaggagcuugaaacc

SEQ ID NO: 1734512 - RNA, 19 nt, Human
aaguggaaaaauagccugc

SEQ ID NO: 1734513 - RNA, 21 nt, Human
aaguggaaaaauagccugccu

SEQ ID NO: 1734514 - RNA, 20 nt, Human
aagucuguugauuaaagaug

SEQ ID NO: 1734515 - RNA, 15 nt, Human
aagucuccaaagucu

SEQ ID NO: 1734516 - RNA, 14 nt, Human
aagauaaaugugcu

SEQ ID NO: 1734517 - RNA, 13 nt, Human
aagauaaaugugc

SEQ ID NO: 1734518 - RNA, 12 nt, Human
aagauaaaugug

SEQ ID NO: 1734519 - RNA, 15 nt, Human
aagauguucuggaua

SEQ ID NO: 1734520 - RNA, 20 nt, Human
aagauguucuggauaccauu

SEQ ID NO: 1734521 - RNA, 14 nt, Human
aagcagcguuucua

SEQ ID NO: 1734522 - RNA, 17 nt, Human
aagcagcguuucuauga

SEQ ID NO: 1734523 - RNA, 20 nt, Human
aagcagcguuucuaugacac

SEQ ID NO: 1734524 - RNA, 21 nt, Human
aagcagcguuucuaugacaca

SEQ ID NO: 1734525 - RNA, 22 nt, Human
aagcagcguuucuaugacacau

SEQ ID NO: 1734526 - RNA, 23 nt, Human
aagccagcaggcucucaggccag

SEQ ID NO: 1734527 - RNA, 20 nt, Human
aagccagcaggcucucaggc

SEQ ID NO: 1734528 - RNA, 19 nt, Human
aaggacagccccuccucca

SEQ ID NO: 1734529 - RNA, 13 nt, Human
aaggacagccccu

SEQ ID NO: 1734530 - RNA, 13 nt, Human
aaggacacuagaa

SEQ ID NO: 1734531 - RNA, 21 nt, Human
aagcuggucccacucagucca

SEQ ID NO: 1734532 - RNA, 18 nt, Human
aagcuggucccacucagu

SEQ ID NO: 1734533 - RNA, 18 nt, Human
aagcuguguggcagucug

SEQ ID NO: 1734534 - RNA, 12 nt, Human
aaggcagggagg

SEQ ID NO: 1734535 - RNA, 15 nt, Human
aaggauugcuacugu

SEQ ID NO: 1734536 - RNA, 15 nt, Human
aaggauguucuagca

SEQ ID NO: 1734537 - RNA, 21 nt, Human
aagcgauucuucugcuucagc

SEQ ID NO: 1734538 - RNA, 17 nt, Human
aaaucuuauaauuuaaa

SEQ ID NO: 1734539 - RNA, 15 nt, Human
aaaugccuuuguacu

SEQ ID NO: 1734540 - RNA, 22 nt, Human
aaauugacacuuaaaaaugguu

SEQ ID NO: 1734541 - RNA, 19 nt, Human
aaauugacacuuaaaaaug

SEQ ID NO: 1734542 - RNA, 14 nt, Human
aaauugcuccuuga

SEQ ID NO: 1734543 - RNA, 13 nt, Human
aaauugcuccuug

SEQ ID NO: 1734544 - RNA, 21 nt, Human
aaauucuugcaaaguaucccu

SEQ ID NO: 1734545 - RNA, 17 nt, Human
aaauuaaagcugaaaac

SEQ ID NO: 1734546 - RNA, 13 nt, Human
aaauuaaagcuga

SEQ ID NO: 1734547 - RNA, 18 nt, Human
aacaaauuuacagagaca

SEQ ID NO: 1734548 - RNA, 17 nt, Human
aaauuuuuuuuguuuca

SEQ ID NO: 1734549 - RNA, 18 nt, Human
aaauuuuuuuuguuucau

SEQ ID NO: 1734550 - RNA, 22 nt, Human
aaccacuggaaaguuuaugguu

SEQ ID NO: 1734551 - RNA, 15 nt, Human
aaccacuucagcuga

SEQ ID NO: 1734552 - RNA, 13 nt, Human
aaccacgcuggac

SEQ ID NO: 1734553 - RNA, 15 nt, Human
aacaucccuccuggg

SEQ ID NO: 1734554 - RNA, 21 nt, Human
aacccuuggagccaauggaga

SEQ ID NO: 1734555 - RNA, 15 nt, Human
aacccuauugguaaa

SEQ ID NO: 1734556 - RNA, 12 nt, Human
aaccagaucauu

SEQ ID NO: 1734557 - RNA, 11 nt, Human
aacgcagcccu

SEQ ID NO: 1734558 - RNA, 15 nt, Human
aacgcugauuuaaag

SEQ ID NO: 1734559 - RNA, 16 nt, Human
aacugagugccuuuug

SEQ ID NO: 1734560 - RNA, 14 nt, Human
aacugauaaagaug

SEQ ID NO: 1734561 - RNA, 18 nt, Human
aacuuaaucuaaauggaa

SEQ ID NO: 1734562 - RNA, 15 nt, Human
aacuuaaucuaaaug

SEQ ID NO: 1734563 - RNA, 16 nt, Human
aacuuaaucuaaaugg

SEQ ID NO: 1734564 - RNA, 21 nt, Human
aacuuuaugcuaagugaaaua

SEQ ID NO: 1734565 - RNA, 20 nt, Human
aacuuuaugcuaagugaaau

SEQ ID NO: 1734566 - RNA, 19 nt, Human
aaauaguggugugauuugg

SEQ ID NO: 1734567 - RNA, 24 nt, Human
aaauagcucaggugucccugcacu

SEQ ID NO: 1734568 - RNA, 19 nt, Human
aaaucaaugcuauaacuau

SEQ ID NO: 1734569 - RNA, 19 nt, Human
aaauaaaacuuuuuaaaau

SEQ ID NO: 1734570 - RNA, 13 nt, Human
aaauaaaacuuuu

SEQ ID NO: 1734571 - RNA, 16 nt, Human
aaauaaaacuuuuuaa

SEQ ID NO: 1734572 - RNA, 13 nt, Human
aaaguggaaaaau

SEQ ID NO: 1734573 - RNA, 20 nt, Human
aaaggcuccaggagcagcca

SEQ ID NO: 1734574 - RNA, 19 nt, Human
aaaggcuccaggagcagcc

SEQ ID NO: 1734575 - RNA, 14 nt, Human
aaaggcagaagcaa

SEQ ID NO: 1734576 - RNA, 16 nt, Human
aaaggcuccaggagca

SEQ ID NO: 1734577 - RNA, 15 nt, Human
aaaggcuccaggagc

SEQ ID NO: 1734578 - RNA, 21 nt, Human
aaaggccuaauucuaugccug

SEQ ID NO: 1734579 - RNA, 16 nt, Human
aaagccuccuccagcc

SEQ ID NO: 1734580 - RNA, 23 nt, Human
aaagcccuuccaugucgccucug

SEQ ID NO: 1734581 - RNA, 22 nt, Human
aaagcccuuccaugucgccucu

SEQ ID NO: 1734582 - RNA, 19 nt, Human
aaagcccuuaggaagaauu

SEQ ID NO: 1734583 - RNA, 18 nt, Human
aaaccaucauugaaaucu

SEQ ID NO: 1734584 - RNA, 18 nt, Human
aaaccccuguaggccuca

SEQ ID NO: 1734585 - RNA, 16 nt, Human
aaacccuauugguaaa

SEQ ID NO: 1734586 - RNA, 18 nt, Human
aaacucuccucugcugcu

SEQ ID NO: 1734587 - RNA, 24 nt, Human
aaacccucgaggcggaucuuugga

SEQ ID NO: 1734588 - RNA, 13 nt, Human
aaacccucgaggc

SEQ ID NO: 1734589 - RNA, 14 nt, Human
aaagaguaggaaga

SEQ ID NO: 1734590 - RNA, 20 nt, Human
aaagaagguuucagaaagaa

SEQ ID NO: 1734591 - RNA, 17 nt, Human
aaagaaauauaccuaaa

SEQ ID NO: 1734592 - RNA, 15 nt, Human
aaagaaauauaccua

SEQ ID NO: 1734593 - RNA, 17 nt, Human
aaagauauuuugcuuug

SEQ ID NO: 1734594 - RNA, 20 nt, Human
aaagauauuuugcuuuguga

SEQ ID NO: 1734595 - RNA, 12 nt, Human
aaagauauuuug

SEQ ID NO: 1734596 - RNA, 16 nt, Human
aaagauauuuugcuuu

SEQ ID NO: 1734597 - RNA, 19 nt, Human
aaaaucucaaauuucuaaa

SEQ ID NO: 1734598 - RNA, 22 nt, Human
aaaaucucaaauuucuaaaucu

SEQ ID NO: 1734599 - RNA, 21 nt, Human
aaaauugaugggauuugguca

SEQ ID NO: 1734600 - RNA, 21 nt, Human
aaacacugggagaaaugaaaa

SEQ ID NO: 1734601 - RNA, 16 nt, Human
aaacacuguucucugc

SEQ ID NO: 1734602 - RNA, 22 nt, Human
aaacacugggagaaaugaaaaa

SEQ ID NO: 1734603 - RNA, 15 nt, Human
aaaaagaaaggaggg

SEQ ID NO: 1734604 - RNA, 18 nt, Human
aaaaguucugcagauaaa

SEQ ID NO: 1734605 - RNA, 17 nt, Human
aaaauaaaacuuuuuaa

SEQ ID NO: 1734606 - RNA, 19 nt, Human
aaaauaaaauuaaagcuga

SEQ ID NO: 1734607 - RNA, 21 nt, Human
aaaaucuacacuccagugaga

SEQ ID NO: 1734608 - RNA, 22 nt, Human
acccccugcaaagcccagcuug

SEQ ID NO: 1734609 - RNA, 20 nt, Human
acccccugcaaagcccagcu

SEQ ID NO: 1734610 - RNA, 18 nt, Human
acccccugcaaagcccag

SEQ ID NO: 1734611 - RNA, 11 nt, Human
acccccugaau

SEQ ID NO: 1734612 - RNA, 17 nt, Human
acccccugcaaagccca

SEQ ID NO: 1734613 - RNA, 14 nt, Human
acccccugcaaagc

SEQ ID NO: 1734614 - RNA, 16 nt, Human
acccaccucagccucc

SEQ ID NO: 1734615 - RNA, 21 nt, Human
acccacaagaaaugaaagcag

SEQ ID NO: 1734616 - RNA, 17 nt, Human
acccacaagaaaugaaa

SEQ ID NO: 1734617 - RNA, 23 nt, Human
acccaagggccuggccugagcug

SEQ ID NO: 1734618 - RNA, 15 nt, Human
acccaccucagccuc

SEQ ID NO: 1734619 - RNA, 14 nt, Human
acccaccucagccu

SEQ ID NO: 1734620 - RNA, 13 nt, Human
acccaccucagcc

SEQ ID NO: 1734621 - RNA, 20 nt, Human
accauauuaccacagacaua

SEQ ID NO: 1734622 - RNA, 22 nt, Human
acccaagggccuggccugagcu

SEQ ID NO: 1734623 - RNA, 19 nt, Human
acccaagggccuggccuga

SEQ ID NO: 1734624 - RNA, 18 nt, Human
acccaagggccuggccug

SEQ ID NO: 1734625 - RNA, 14 nt, Human
accauauuaccaca

SEQ ID NO: 1734626 - RNA, 16 nt, Human
accauauuaccacaga

SEQ ID NO: 1734627 - RNA, 19 nt, Human
accccuccaugugggcuag

SEQ ID NO: 1734628 - RNA, 16 nt, Human
accccuccaugugggc

SEQ ID NO: 1734629 - RNA, 17 nt, Human
accccucauagcccuca

SEQ ID NO: 1734630 - RNA, 18 nt, Human
acaugugcacaugcacgu

SEQ ID NO: 1734631 - RNA, 16 nt, Human
acaugugcacaugcac

SEQ ID NO: 1734632 - RNA, 15 nt, Human
acaucagcacgauuu

SEQ ID NO: 1734633 - RNA, 17 nt, Human
acaucagcacgauuucu

SEQ ID NO: 1734634 - RNA, 18 nt, Human
acaucagcacgauuucug

SEQ ID NO: 1734635 - RNA, 19 nt, Human
acaucagcacgauuucugu

SEQ ID NO: 1734636 - RNA, 19 nt, Human
acaugaucuucuuuauaau

SEQ ID NO: 1734637 - RNA, 22 nt, Human
acauguuucuuuguaaugaaaa

SEQ ID NO: 1734638 - RNA, 19 nt, Human
acauguuucuuuguaauga

SEQ ID NO: 1734639 - RNA, 23 nt, Human
acauguuucuuuguaaugaaaac

SEQ ID NO: 1734640 - RNA, 23 nt, Human
acauaaugcgugcauaccacuuu

SEQ ID NO: 1734641 - RNA, 22 nt, Human
acauaaugcgugcauaccacuu

SEQ ID NO: 1734642 - RNA, 21 nt, Human
acauaaugcgugcauaccacu

SEQ ID NO: 1734643 - RNA, 19 nt, Human
acaggguuuugccauguug

SEQ ID NO: 1734644 - RNA, 23 nt, Human
acaggcaaugcuggcuguuggcu

SEQ ID NO: 1734645 - RNA, 19 nt, Human
acaggcaaugcuggcuguu

SEQ ID NO: 1734646 - RNA, 15 nt, Human
acauuuauucugcuc

SEQ ID NO: 1734647 - RNA, 19 nt, Human
acauuuguucuauagcuuu

SEQ ID NO: 1734648 - RNA, 12 nt, Human
accaagcccagu

SEQ ID NO: 1734649 - RNA, 14 nt, Human
accaauauuguaca

SEQ ID NO: 1734650 - RNA, 17 nt, Human
accagccaguaaauggg

SEQ ID NO: 1734651 - RNA, 15 nt, Human
accagcccagacccu

SEQ ID NO: 1734652 - RNA, 13 nt, Human
accagcagaaaug

SEQ ID NO: 1734653 - RNA, 13 nt, Human
accagaucauugu

SEQ ID NO: 1734654 - RNA, 19 nt, Human
accagagcugccaccugcc

SEQ ID NO: 1734655 - RNA, 13 nt, Human
acaagaaaugaaa

SEQ ID NO: 1734656 - RNA, 17 nt, Human
acaaggauugcuacugu

SEQ ID NO: 1734657 - RNA, 14 nt, Human
acaaggcaaggcug

SEQ ID NO: 1734658 - RNA, 12 nt, Human
acaaggcaaggc

SEQ ID NO: 1734659 - RNA, 22 nt, Human
acaaaauguaggguuauaauaa

SEQ ID NO: 1734660 - RNA, 15 nt, Human
acaaggcaaggcugu

SEQ ID NO: 1734661 - RNA, 18 nt, Human
aauuuuguguaagaaaua

SEQ ID NO: 1734662 - RNA, 22 nt, Human
aauuuuguguaagaaauacaga

SEQ ID NO: 1734663 - RNA, 14 nt, Human
aauuuuguguaaga

SEQ ID NO: 1734664 - RNA, 15 nt, Human
aauuuuguguaagaa

SEQ ID NO: 1734665 - RNA, 17 nt, Human
aauuuuguguaagaaau

SEQ ID NO: 1734666 - RNA, 18 nt, Human
aauuuuguaauguaucaa

SEQ ID NO: 1734667 - RNA, 17 nt, Human
acacgcgugcacacacc

SEQ ID NO: 1734668 - RNA, 15 nt, Human
acacgcgugcacaca

SEQ ID NO: 1734669 - RNA, 14 nt, Human
acacgcuccuuccu

SEQ ID NO: 1734670 - RNA, 16 nt, Human
acacgcuccuuccucu

SEQ ID NO: 1734671 - RNA, 13 nt, Human
acacagcucuucu

SEQ ID NO: 1734672 - RNA, 11 nt, Human
acacagcucuu

SEQ ID NO: 1734673 - RNA, 22 nt, Human
acacauuuuauuuuauuaugca

SEQ ID NO: 1734674 - RNA, 12 nt, Human
acacauuuuucu

SEQ ID NO: 1734675 - RNA, 14 nt, Human
acacauuuuucaga

SEQ ID NO: 1734676 - RNA, 20 nt, Human
acacauuuuuuaaaugcacc

SEQ ID NO: 1734677 - RNA, 22 nt, Human
acacauuuuuuaaaugcaccug

SEQ ID NO: 1734678 - RNA, 19 nt, Human
acacagaggcugccucucc

SEQ ID NO: 1734679 - RNA, 20 nt, Human
acacagcucuguccugggag

SEQ ID NO: 1734680 - RNA, 17 nt, Human
acacagauuugagcuca

SEQ ID NO: 1734681 - RNA, 19 nt, Human
acagagugagacucugucu

SEQ ID NO: 1734682 - RNA, 15 nt, Human
acagagugagacucu

SEQ ID NO: 1734683 - RNA, 14 nt, Human
acagaggggguggc

SEQ ID NO: 1734684 - RNA, 17 nt, Human
acagccaacuauggccu

SEQ ID NO: 1734685 - RNA, 19 nt, Human
acagccaacuauggccugu

SEQ ID NO: 1734686 - RNA, 15 nt, Human
acagaggcagcccca

SEQ ID NO: 1734687 - RNA, 14 nt, Human
acagaggcagcccc

SEQ ID NO: 1734688 - RNA, 14 nt, Human
acagacacaggccc

SEQ ID NO: 1734689 - RNA, 13 nt, Human
acagacacaggcc

SEQ ID NO: 1734690 - RNA, 23 nt, Human
acagaggcagccccauucugccu

SEQ ID NO: 1734691 - RNA, 19 nt, Human
acagaggcagccccauucu

SEQ ID NO: 1734692 - RNA, 15 nt, Human
acagacacaggcccg

SEQ ID NO: 1734693 - RNA, 15 nt, Human
acacuguacugcaau

SEQ ID NO: 1734694 - RNA, 13 nt, Human
acagacaaagcgu

SEQ ID NO: 1734695 - RNA, 11 nt, Human
acagacacagg

SEQ ID NO: 1734696 - RNA, 14 nt, Human
acacugcauguuug

SEQ ID NO: 1734697 - RNA, 15 nt, Human
acacugcauguuugu

SEQ ID NO: 1734698 - RNA, 17 nt, Human
acagccacggccaggcc

SEQ ID NO: 1734699 - RNA, 16 nt, Human
acagccacggccaggc

SEQ ID NO: 1734700 - RNA, 15 nt, Human
acagccacggccagg

SEQ ID NO: 1734701 - RNA, 18 nt, Human
acagccacggccaggcca

SEQ ID NO: 1734702 - RNA, 19 nt, Human
acagccacggccaggccag

SEQ ID NO: 1734703 - RNA, 18 nt, Human
acagcucuucuccaggcu

SEQ ID NO: 1734704 - RNA, 17 nt, Human
acagcucuucuccaggc

SEQ ID NO: 1734705 - RNA, 16 nt, Human
acagcucuucuccagg

SEQ ID NO: 1734706 - RNA, 12 nt, Human
acaggcaagcac

SEQ ID NO: 1734707 - RNA, 18 nt, Human
acaggcaaugcuggcugu

SEQ ID NO: 1734708 - RNA, 21 nt, Human
acaggaugaugacuauggaaa

SEQ ID NO: 1734709 - RNA, 19 nt, Human
acucaguccauagcagaga

SEQ ID NO: 1734710 - RNA, 18 nt, Human
acucaaaagcugggcagg

SEQ ID NO: 1734711 - RNA, 13 nt, Human
acucaaaagcugg

SEQ ID NO: 1734712 - RNA, 18 nt, Human
acuauuuuucagaaucuc

SEQ ID NO: 1734713 - RNA, 17 nt, Human
acucuauguucuaagaa

SEQ ID NO: 1734714 - RNA, 23 nt, Human
acucuaucaaguauuauaccuuu

SEQ ID NO: 1734715 - RNA, 19 nt, Human
acucugucgcccagucugg

SEQ ID NO: 1734716 - RNA, 17 nt, Human
acucuagggaaaaacca

SEQ ID NO: 1734717 - RNA, 15 nt, Human
acucuagggaaaaac

SEQ ID NO: 1734718 - RNA, 14 nt, Human
acgcugugcugccc

SEQ ID NO: 1734719 - RNA, 12 nt, Human
acgcugugcugc

SEQ ID NO: 1734720 - RNA, 11 nt, Human
acgcugugcug

SEQ ID NO: 1734721 - RNA, 15 nt, Human
acgucugacaggcaa

SEQ ID NO: 1734722 - RNA, 14 nt, Human
acgucugacaggca

SEQ ID NO: 1734723 - RNA, 13 nt, Human
acgucugacaggc

SEQ ID NO: 1734724 - RNA, 11 nt, Human
acgugaguccu

SEQ ID NO: 1734725 - RNA, 21 nt, Human
accucugcagcaauaaagcag

SEQ ID NO: 1734726 - RNA, 18 nt, Human
accucugcagcaauaaag

SEQ ID NO: 1734727 - RNA, 20 nt, Human
accucugcagcaauaaagca

SEQ ID NO: 1734728 - RNA, 15 nt, Human
accucugcagcaaua

SEQ ID NO: 1734729 - RNA, 15 nt, Human
accuuuaagagaaau

SEQ ID NO: 1734730 - RNA, 18 nt, Human
accuuucccaucuuccaa

SEQ ID NO: 1734731 - RNA, 13 nt, Human
accuuucccaucu

SEQ ID NO: 1734732 - RNA, 18 nt, Human
accuuggcugcagggagu

SEQ ID NO: 1734733 - RNA, 17 nt, Human
accuuggcugcagggag

SEQ ID NO: 1734734 - RNA, 15 nt, Human
accugucccccugac

SEQ ID NO: 1734735 - RNA, 12 nt, Human
accugucccccu

SEQ ID NO: 1734736 - RNA, 16 nt, Human
accugucccccugaca

SEQ ID NO: 1734737 - RNA, 20 nt, Human
accugcccugcugaguccca

SEQ ID NO: 1734738 - RNA, 22 nt, Human
agaaaguacuucuccacccugc

SEQ ID NO: 1734739 - RNA, 23 nt, Human
agaaaguacuucuccacccugcu

SEQ ID NO: 1734740 - RNA, 22 nt, Human
acuuuauuuucuauaauuuaaa

SEQ ID NO: 1734741 - RNA, 17 nt, Human
acuuuguucuggcucuu

SEQ ID NO: 1734742 - RNA, 16 nt, Human
acuuuguucuggcucu

SEQ ID NO: 1734743 - RNA, 22 nt, Human
acuuuaucuugaauaauguaag

SEQ ID NO: 1734744 - RNA, 19 nt, Human
acuuuguucuggcucuucc

SEQ ID NO: 1734745 - RNA, 20 nt, Human
acuuuguucuggcucuucca

SEQ ID NO: 1734746 - RNA, 13 nt, Human
acuuuuauaaacu

SEQ ID NO: 1734747 - RNA, 16 nt, Human
acuuuuaugauacuug

SEQ ID NO: 1734748 - RNA, 12 nt, Human
acuuuuaugaua

SEQ ID NO: 1734749 - RNA, 16 nt, Human
agaaaaucaggcuggc

SEQ ID NO: 1734750 - RNA, 15 nt, Human
agaaaauaccaagga

SEQ ID NO: 1734751 - RNA, 19 nt, Human
agaaaauaguggugugauu

SEQ ID NO: 1734752 - RNA, 14 nt, Human
acuuuucuuugugg

SEQ ID NO: 1734753 - RNA, 16 nt, Human
acuuuucuuucagcca

SEQ ID NO: 1734754 - RNA, 20 nt, Human
acuuuucauaaccuagccuu

SEQ ID NO: 1734755 - RNA, 23 nt, Human
acuuuuauuuccagugaaaucag

SEQ ID NO: 1734756 - RNA, 23 nt, Human
acuuuuaugauacuugaaaauua

SEQ ID NO: 1734757 - RNA, 18 nt, Human
acuuguaaaggaauuuaa

SEQ ID NO: 1734758 - RNA, 16 nt, Human
acuugguuuuuaaaaa

SEQ ID NO: 1734759 - RNA, 15 nt, Human
acuugggccacugug

SEQ ID NO: 1734760 - RNA, 14 nt, Human
acuugggccacugu

SEQ ID NO: 1734761 - RNA, 12 nt, Human
acuucagacaua

SEQ ID NO: 1734762 - RNA, 20 nt, Human
acugugcugagucugaaggc

SEQ ID NO: 1734763 - RNA, 22 nt, Human
acugugcugagucugaaggcug

SEQ ID NO: 1734764 - RNA, 18 nt, Human
acugguuccauggccucu

SEQ ID NO: 1734765 - RNA, 23 nt, Human
acugucucaagagggcacuggug

SEQ ID NO: 1734766 - RNA, 21 nt, Human
acugucucaagagggcacugg

SEQ ID NO: 1734767 - RNA, 20 nt, Human
acugucucaagagggcacug

SEQ ID NO: 1734768 - RNA, 17 nt, Human
acuggaagcacagcuuc

SEQ ID NO: 1734769 - RNA, 17 nt, Human
acugcccccucugcccu

SEQ ID NO: 1734770 - RNA, 16 nt, Human
acugcccccucugccc

SEQ ID NO: 1734771 - RNA, 19 nt, Human
acuggaagcacagcuucau

SEQ ID NO: 1734772 - RNA, 15 nt, Human
acugcccccucugcc

SEQ ID NO: 1734773 - RNA, 14 nt, Human
acugcccccucugc

SEQ ID NO: 1734774 - RNA, 15 nt, Human
acuggagaaaaugga

SEQ ID NO: 1734775 - RNA, 18 nt, Human
acugguaggaaacuaggu

SEQ ID NO: 1734776 - RNA, 20 nt, Human
acucugucucaguccaugaa

SEQ ID NO: 1734777 - RNA, 18 nt, Human
acucugucucaguccaug

SEQ ID NO: 1734778 - RNA, 18 nt, Human
aaaaacagauuuggaaag

SEQ ID NO: 1734779 - RNA, 15 nt, Human
aaaaaauauuuuccu

SEQ ID NO: 1734780 - RNA, 17 nt, Human
caagugauucuccugcc

SEQ ID NO: 1734781 - RNA, 16 nt, Human
caagugauucuccugc

SEQ ID NO: 1734782 - RNA, 19 nt, Human
caagugaaaaaggaggaag

SEQ ID NO: 1734783 - RNA, 22 nt, Human
caagugauucucaugccucagc

SEQ ID NO: 1734784 - RNA, 22 nt, Human
caagugugguagagugugccug

SEQ ID NO: 1734785 - RNA, 22 nt, Human
caagugauucuccugccucagc

SEQ ID NO: 1734786 - RNA, 14 nt, Human
caagugauucuccu

SEQ ID NO: 1734787 - RNA, 23 nt, Human
caaggugggaggauugcuugagc

SEQ ID NO: 1734788 - RNA, 12 nt, Human
caaggugggagg

SEQ ID NO: 1734789 - RNA, 19 nt, Human
caagggccuggccugagcu

SEQ ID NO: 1734790 - RNA, 19 nt, Human
caaggauugcuacuguccu

SEQ ID NO: 1734791 - RNA, 15 nt, Human
caaggauugcuacug

SEQ ID NO: 1734792 - RNA, 17 nt, Human
caagcacuaaacaaaga

SEQ ID NO: 1734793 - RNA, 18 nt, Human
caagcaccuccugccucg

SEQ ID NO: 1734794 - RNA, 16 nt, Human
caagcgugagccacug

SEQ ID NO: 1734795 - RNA, 17 nt, Human
caagccguggcuucccg

SEQ ID NO: 1734796 - RNA, 16 nt, Human
caagccguggcuuccc

SEQ ID NO: 1734797 - RNA, 15 nt, Human
caagccguggcuucc

SEQ ID NO: 1734798 - RNA, 14 nt, Human
caagccguggcuuc

SEQ ID NO: 1734799 - RNA, 21 nt, Human
caagccaccaacauacuccca

SEQ ID NO: 1734800 - RNA, 18 nt, Human
caagcgugagccacugca

SEQ ID NO: 1734801 - RNA, 17 nt, Human
caagcgugagccacugc

SEQ ID NO: 1734802 - RNA, 21 nt, Human
caaggaugaucuaggaagacu

SEQ ID NO: 1734803 - RNA, 19 nt, Human
caaggaugccccguccccc

SEQ ID NO: 1734804 - RNA, 13 nt, Human
caaggauccugag

SEQ ID NO: 1734805 - RNA, 14 nt, Human
caaggacuaggguc

SEQ ID NO: 1734806 - RNA, 14 nt, Human
caaauuuacagaga

SEQ ID NO: 1734807 - RNA, 18 nt, Human
caaauucugucucuggau

SEQ ID NO: 1734808 - RNA, 15 nt, Human
caaauucugucucug

SEQ ID NO: 1734809 - RNA, 16 nt, Human
caaauuuacagagaca

SEQ ID NO: 1734810 - RNA, 24 nt, Human
caacaggcugggcuucaguggcag

SEQ ID NO: 1734811 - RNA, 15 nt, Human
caaauuuacagagac

SEQ ID NO: 1734812 - RNA, 23 nt, Human
caacaggcugggcuucaguggca

SEQ ID NO: 1734813 - RNA, 15 nt, Human
caacagguuuuccug

SEQ ID NO: 1734814 - RNA, 18 nt, Human
caacaggguuuuuuucca

SEQ ID NO: 1734815 - RNA, 19 nt, Human
caacagguuuuccugaaga

SEQ ID NO: 1734816 - RNA, 22 nt, Human
caacaucuuggucagauuugaa

SEQ ID NO: 1734817 - RNA, 19 nt, Human
caaccccuucgcuccugug

SEQ ID NO: 1734818 - RNA, 18 nt, Human
caaccccuucgcuccugu

SEQ ID NO: 1734819 - RNA, 21 nt, Human
caaccccuucgcuccuguguc

SEQ ID NO: 1734820 - RNA, 21 nt, Human
caacccucagagccaccccua

SEQ ID NO: 1734821 - RNA, 16 nt, Human
caacauuguagccuca

SEQ ID NO: 1734822 - RNA, 12 nt, Human
caacuuuguaua

SEQ ID NO: 1734823 - RNA, 11 nt, Human
caacuuuguau

SEQ ID NO: 1734824 - RNA, 20 nt, Human
caacucuccuccagagucag

SEQ ID NO: 1734825 - RNA, 15 nt, Human
caacccucaucacca

SEQ ID NO: 1734826 - RNA, 12 nt, Human
caacccucauca

SEQ ID NO: 1734827 - RNA, 16 nt, Human
caaccugauugugucu

SEQ ID NO: 1734828 - RNA, 19 nt, Human
caacucuccuccagaguca

SEQ ID NO: 1734829 - RNA, 18 nt, Human
caacgcagcccugcuuug

SEQ ID NO: 1734830 - RNA, 15 nt, Human
caacgcagcccugcu

SEQ ID NO: 1734831 - RNA, 13 nt, Human
caacgcagcccug

SEQ ID NO: 1734832 - RNA, 12 nt, Human
caacgcagcccu

SEQ ID NO: 1734833 - RNA, 22 nt, Human
caagccaccaacauacucccau

SEQ ID NO: 1734834 - RNA, 18 nt, Human
auuuuuuuacuaauagac

SEQ ID NO: 1734835 - RNA, 18 nt, Human
caaagcuaggccuggcca

SEQ ID NO: 1734836 - RNA, 17 nt, Human
caaagcuaggccuggcc

SEQ ID NO: 1734837 - RNA, 16 nt, Human
caaagcuaggccuggc

SEQ ID NO: 1734838 - RNA, 22 nt, Human
caaagccaaagcuaggccuggc

SEQ ID NO: 1734839 - RNA, 21 nt, Human
caaagccaaagcuaggccugg

SEQ ID NO: 1734840 - RNA, 20 nt, Human
caaagccaaagcuaggccug

SEQ ID NO: 1734841 - RNA, 16 nt, Human
caaagcuuguuaagau

SEQ ID NO: 1734842 - RNA, 22 nt, Human
caaauucugcuugcuugcuuuu

SEQ ID NO: 1734843 - RNA, 21 nt, Human
caaauguucaucaaugaauga

SEQ ID NO: 1734844 - RNA, 20 nt, Human
caaauguucaucaaugaaug

SEQ ID NO: 1734845 - RNA, 14 nt, Human
caaauguggcuccu

SEQ ID NO: 1734846 - RNA, 16 nt, Human
caaaucagcugcuacu

SEQ ID NO: 1734847 - RNA, 18 nt, Human
caaaugucuuccuggauu

SEQ ID NO: 1734848 - RNA, 15 nt, Human
caaaugucuuccugg

SEQ ID NO: 1734849 - RNA, 13 nt, Human
caaaucagcugcu

SEQ ID NO: 1734850 - RNA, 21 nt, Human
caaaggaugcccaaagaugca

SEQ ID NO: 1734851 - RNA, 12 nt, Human
caaauauauuca

SEQ ID NO: 1734852 - RNA, 19 nt, Human
caaauacauuuaaaacauu

SEQ ID NO: 1734853 - RNA, 17 nt, Human
cacaccgggcacucaga

SEQ ID NO: 1734854 - RNA, 14 nt, Human
cacacccuguuuua

SEQ ID NO: 1734855 - RNA, 13 nt, Human
cacaccagagccc

SEQ ID NO: 1734856 - RNA, 12 nt, Human
cacaccagagcc

SEQ ID NO: 1734857 - RNA, 15 nt, Human
cacaccagagcccac

SEQ ID NO: 1734858 - RNA, 13 nt, Human
cacacccagccca

SEQ ID NO: 1734859 - RNA, 14 nt, Human
cacacaccagagcc

SEQ ID NO: 1734860 - RNA, 12 nt, Human
cacacagcucug

SEQ ID NO: 1734861 - RNA, 21 nt, Human
cacacagaggcugccucuccc

SEQ ID NO: 1734862 - RNA, 19 nt, Human
cacacagaggcugccucuc

SEQ ID NO: 1734863 - RNA, 17 nt, Human
cacacuucaggcucuuc

SEQ ID NO: 1734864 - RNA, 14 nt, Human
cacacuucaggcuc

SEQ ID NO: 1734865 - RNA, 22 nt, Human
cacacuucaggcucuucuccuu

SEQ ID NO: 1734866 - RNA, 21 nt, Human
cacacuucaggcucuucuccu

SEQ ID NO: 1734867 - RNA, 20 nt, Human
cacacuucaggcucuucucc

SEQ ID NO: 1734868 - RNA, 18 nt, Human
cacacuucaggcucuucu

SEQ ID NO: 1734869 - RNA, 16 nt, Human
cacagaguuguuacau

SEQ ID NO: 1734870 - RNA, 17 nt, Human
cacagaguuguuacauu

SEQ ID NO: 1734871 - RNA, 12 nt, Human
cacagagaaagu

SEQ ID NO: 1734872 - RNA, 21 nt, Human
cacacuugacaucaacugcau

SEQ ID NO: 1734873 - RNA, 21 nt, Human
cacaaauucugucucuggauu

SEQ ID NO: 1734874 - RNA, 22 nt, Human
cacaacacacagauuugagcuc

SEQ ID NO: 1734875 - RNA, 23 nt, Human
cacaaccuucuguggcucacaga

SEQ ID NO: 1734876 - RNA, 19 nt, Human
cacaaccuucuguggcuca

SEQ ID NO: 1734877 - RNA, 18 nt, Human
cacaaccuucuguggcuc

SEQ ID NO: 1734878 - RNA, 17 nt, Human
cacaaccuucuguggcu

SEQ ID NO: 1734879 - RNA, 18 nt, Human
cacaaaaguuucucuuuu

SEQ ID NO: 1734880 - RNA, 16 nt, Human
cacaaaaguuucucuu

SEQ ID NO: 1734881 - RNA, 22 nt, Human
caaugaaugaaugaauggcuaa

SEQ ID NO: 1734882 - RNA, 14 nt, Human
caaugacacagucu

SEQ ID NO: 1734883 - RNA, 19 nt, Human
caaugacacagucuuggcu

SEQ ID NO: 1734884 - RNA, 21 nt, Human
caaugacacagucuuggcuca

SEQ ID NO: 1734885 - RNA, 13 nt, Human
caaugaccuuuca

SEQ ID NO: 1734886 - RNA, 18 nt, Human
caaugcaaaccaucauug

SEQ ID NO: 1734887 - RNA, 17 nt, Human
caaugcaaaccaucauu

SEQ ID NO: 1734888 - RNA, 20 nt, Human
caaugcaaaccaucauugaa

SEQ ID NO: 1734889 - RNA, 19 nt, Human
caaugcaaaccaucauuga

SEQ ID NO: 1734890 - RNA, 23 nt, Human
caaugcacuuuguucuggcucuu

SEQ ID NO: 1734891 - RNA, 20 nt, Human
caauaggaaaaacugauuuu

SEQ ID NO: 1734892 - RNA, 21 nt, Human
caauaggaaaaacugauuuuu

SEQ ID NO: 1734893 - RNA, 19 nt, Human
caaugugaaaagaaaaaug

SEQ ID NO: 1734894 - RNA, 18 nt, Human
cacagaugggugcuugga

SEQ ID NO: 1734895 - RNA, 14 nt, Human
cacagaugggugcu

SEQ ID NO: 1734896 - RNA, 20 nt, Human
cacagaguuguuacauuuuu

SEQ ID NO: 1734897 - RNA, 21 nt, Human
cacagaguuguuacauuuuua

SEQ ID NO: 1734898 - RNA, 20 nt, Human
cacagaugggugcuuggagg

SEQ ID NO: 1734899 - RNA, 20 nt, Human
cacagcacgggggccaagga

SEQ ID NO: 1734900 - RNA, 16 nt, Human
cacagcagccccugca

SEQ ID NO: 1734901 - RNA, 15 nt, Human
cacaggaaguagagg

SEQ ID NO: 1734902 - RNA, 16 nt, Human
cacaggaucagucuga

SEQ ID NO: 1734903 - RNA, 15 nt, Human
cacaggaucagucug

SEQ ID NO: 1734904 - RNA, 12 nt, Human
cacaggaucagu

SEQ ID NO: 1734905 - RNA, 19 nt, Human
cacaggcccggcuccaggc

SEQ ID NO: 1734906 - RNA, 18 nt, Human
cacaggcccggcuccagg

SEQ ID NO: 1734907 - RNA, 17 nt, Human
cacaggcccggcuccag

SEQ ID NO: 1734908 - RNA, 16 nt, Human
cacaggcccggcucca

SEQ ID NO: 1734909 - RNA, 10 nt, Human
cacaggcagg

SEQ ID NO: 1734910 - RNA, 17 nt, Human
cacauacacacacacgc

SEQ ID NO: 1734911 - RNA, 22 nt, Human
cacauaauucaggaagcagcuu

SEQ ID NO: 1734912 - RNA, 23 nt, Human
cacaggcccggcuccaggcuccu

SEQ ID NO: 1734913 - RNA, 20 nt, Human
cacaggcccggcuccaggcu

SEQ ID NO: 1734914 - RNA, 18 nt, Human
cacagugagucgaggaca

SEQ ID NO: 1734915 - RNA, 15 nt, Human
cacaggcccuuccuc

SEQ ID NO: 1734916 - RNA, 20 nt, Human
cacagugagucgaggacagg

SEQ ID NO: 1734917 - RNA, 19 nt, Human
cacagugagucgaggacag

SEQ ID NO: 1734918 - RNA, 21 nt, Human
cacagugagucgaggacaggg

SEQ ID NO: 1734919 - RNA, 15 nt, Human
caccaagcccaguua

SEQ ID NO: 1734920 - RNA, 18 nt, Human
cacauuggagauguuuag

SEQ ID NO: 1734921 - RNA, 17 nt, Human
caccacacccagcccac

SEQ ID NO: 1734922 - RNA, 15 nt, Human
caccacacccagccc

SEQ ID NO: 1734923 - RNA, 13 nt, Human
caccacacccagc

SEQ ID NO: 1734924 - RNA, 19 nt, Human
caccacuacauucuguuaa

SEQ ID NO: 1734925 - RNA, 20 nt, Human
caccacuacauucuguuaau

SEQ ID NO: 1734926 - RNA, 14 nt, Human
caccaccucuuugg

SEQ ID NO: 1734927 - RNA, 16 nt, Human
caccacuacauucugu

SEQ ID NO: 1734928 - RNA, 17 nt, Human
caccacuacauucuguu

SEQ ID NO: 1734929 - RNA, 18 nt, Human
caccacuacauucuguua

SEQ ID NO: 1734930 - RNA, 18 nt, Human
caccacaugugcacaugc

SEQ ID NO: 1734931 - RNA, 15 nt, Human
caccacaugugcaca

SEQ ID NO: 1734932 - RNA, 19 nt, Human
caccacaugugcacaugca

SEQ ID NO: 1734933 - RNA, 18 nt, Human
cacaugccucucucaggc

SEQ ID NO: 1734934 - RNA, 17 nt, Human
cacaugccucucucagg

SEQ ID NO: 1734935 - RNA, 13 nt, Human
cacaugccucucu

SEQ ID NO: 1734936 - RNA, 19 nt, Human
cacaucagcacgauuucug

SEQ ID NO: 1734937 - RNA, 14 nt, Human
cacauaucugucau

SEQ ID NO: 1734938 - RNA, 12 nt, Human
cacauaucuguc

SEQ ID NO: 1734939 - RNA, 18 nt, Human
cacaucagcacgauuucu

SEQ ID NO: 1734940 - RNA, 17 nt, Human
cacauauuucagugagg

SEQ ID NO: 1734941 - RNA, 19 nt, Human
cacaugccucucucaggcc

SEQ ID NO: 1734942 - RNA, 15 nt, Human
cacaugugcacaugc

SEQ ID NO: 1734943 - RNA, 14 nt, Human
cacaugugcacaug

SEQ ID NO: 1734944 - RNA, 17 nt, Human
cacaugugcacaugcac

SEQ ID NO: 1734945 - RNA, 13 nt, Human
cacauguggacuu

SEQ ID NO: 1734946 - RNA, 16 nt, Human
cacauuccugaugcuu

SEQ ID NO: 1734947 - RNA, 22 nt, Human
cacccaccaucaugucuggcua

SEQ ID NO: 1734948 - RNA, 20 nt, Human
cacccaccaucaugucuggc

SEQ ID NO: 1734949 - RNA, 16 nt, Human
cacccaccucagccuc

SEQ ID NO: 1734950 - RNA, 14 nt, Human
cacccaccucagcc

SEQ ID NO: 1734951 - RNA, 13 nt, Human
cacccaccucagc

SEQ ID NO: 1734952 - RNA, 12 nt, Human
cacccaccucag

SEQ ID NO: 1734953 - RNA, 13 nt, Human
caccccagcccca

SEQ ID NO: 1734954 - RNA, 12 nt, Human
caccccagcccc

SEQ ID NO: 1734955 - RNA, 18 nt, Human
cacccaagggccuggccu

SEQ ID NO: 1734956 - RNA, 17 nt, Human
cacccaagggccuggcc

SEQ ID NO: 1734957 - RNA, 16 nt, Human
cacccaagggccuggc

SEQ ID NO: 1734958 - RNA, 23 nt, Human
cacccaagggccuggccugagcu

SEQ ID NO: 1734959 - RNA, 21 nt, Human
cacccaagggccuggccugag

SEQ ID NO: 1734960 - RNA, 20 nt, Human
cacccaagggccuggccuga

SEQ ID NO: 1734961 - RNA, 19 nt, Human
cacccaagggccuggccug

SEQ ID NO: 1734962 - RNA, 22 nt, Human
cacccccacccaagggccuggc

SEQ ID NO: 1734963 - RNA, 17 nt, Human
caccccggccaccugcg

SEQ ID NO: 1734964 - RNA, 16 nt, Human
caccccggccaccugc

SEQ ID NO: 1734965 - RNA, 15 nt, Human
caccccggccaccug

SEQ ID NO: 1734966 - RNA, 14 nt, Human
caccccggccaccu

SEQ ID NO: 1734967 - RNA, 14 nt, Human
caccccuaaagaga

SEQ ID NO: 1734968 - RNA, 15 nt, Human
caccccuaaagagau

SEQ ID NO: 1734969 - RNA, 21 nt, Human
uugaaaaucuuauaauuuaaa

SEQ ID NO: 1734970 - RNA, 21 nt, Human
uucuuuccugaggcugggcuc

SEQ ID NO: 1734971 - RNA, 15 nt, Human
uugaacuuugaccuc

SEQ ID NO: 1734972 - RNA, 18 nt, Human
uugaaaauuaacaugaau

SEQ ID NO: 1734973 - RNA, 16 nt, Human
uugaaugaugccauga

SEQ ID NO: 1734974 - RNA, 12 nt, Human
uugaaugaugcc

SEQ ID NO: 1734975 - RNA, 20 nt, Human
uugaacuuugaccucugcag

SEQ ID NO: 1734976 - RNA, 17 nt, Human
uugaacuuugaccucug

SEQ ID NO: 1734977 - RNA, 18 nt, Human
uugaacuuugaccucugc

SEQ ID NO: 1734978 - RNA, 13 nt, Human
uucugugcagcca

SEQ ID NO: 1734979 - RNA, 20 nt, Human
uucuggcagaguugaagaca

SEQ ID NO: 1734980 - RNA, 15 nt, Human
uucuggcagaggagg

SEQ ID NO: 1734981 - RNA, 16 nt, Human
uucuggcuaugcauuu

SEQ ID NO: 1734982 - RNA, 14 nt, Human
uucuuguguguuua

SEQ ID NO: 1734983 - RNA, 17 nt, Human
uucuuagggaaggauac

SEQ ID NO: 1734984 - RNA, 13 nt, Human
uucuucagagacu

SEQ ID NO: 1734985 - RNA, 17 nt, Human
uucuuauguugcccagu

SEQ ID NO: 1734986 - RNA, 16 nt, Human
uugauaugcuuauaca

SEQ ID NO: 1734987 - RNA, 22 nt, Human
uugauauuuucaacgcagcccu

SEQ ID NO: 1734988 - RNA, 16 nt, Human
uugauucagcucugca

SEQ ID NO: 1734989 - RNA, 23 nt, Human
uugauucagacagcugccuggga

SEQ ID NO: 1734990 - RNA, 21 nt, Human
uugauucagacagcugccugg

SEQ ID NO: 1734991 - RNA, 17 nt, Human
uugauucagacagcugc

SEQ ID NO: 1734992 - RNA, 17 nt, Human
uugauccagaaagaaaa

SEQ ID NO: 1734993 - RNA, 19 nt, Human
uugagccuugaacuuugac

SEQ ID NO: 1734994 - RNA, 13 nt, Human
uugagcucagccc

SEQ ID NO: 1734995 - RNA, 14 nt, Human
uugagccuugaacu

SEQ ID NO: 1734996 - RNA, 15 nt, Human
uugagccuugaacuu

SEQ ID NO: 1734997 - RNA, 16 nt, Human
uugagccuugaacuuu

SEQ ID NO: 1734998 - RNA, 19 nt, Human
uugccauguuggccaggcu

SEQ ID NO: 1734999 - RNA, 18 nt, Human
uugccauguuggccaggc

SEQ ID NO: 1735000 - RNA, 17 nt, Human
uugccauguuggccagg

SEQ ID NO: 1735001 - RNA, 16 nt, Human
uugccauguuggccag

SEQ ID NO: 1735002 - RNA, 13 nt, Human
uugccagucaccc

SEQ ID NO: 1735003 - RNA, 16 nt, Human
uugcauaacguauaaa

SEQ ID NO: 1735004 - RNA, 17 nt, Human
uugauucauaaugacuu

SEQ ID NO: 1735005 - RNA, 13 nt, Human
uugauucauaaug

SEQ ID NO: 1735006 - RNA, 23 nt, Human
uugcagacaggcaagcaccuccu

SEQ ID NO: 1735007 - RNA, 17 nt, Human
uugcagcacagcugaga

SEQ ID NO: 1735008 - RNA, 19 nt, Human
uugcagcgauuaauaacag

SEQ ID NO: 1735009 - RNA, 18 nt, Human
uugcagcgauuaauaaca

SEQ ID NO: 1735010 - RNA, 19 nt, Human
uuggacagaagcagcucuu

SEQ ID NO: 1735011 - RNA, 16 nt, Human
uuggacagaagcagcu

SEQ ID NO: 1735012 - RNA, 19 nt, Human
uuggaagcuccgcuuucua

SEQ ID NO: 1735013 - RNA, 21 nt, Human
uuggacccugaggcccagagg

SEQ ID NO: 1735014 - RNA, 19 nt, Human
uuggacccugaggcccaga

SEQ ID NO: 1735015 - RNA, 18 nt, Human
uuggacccugaggcccag

SEQ ID NO: 1735016 - RNA, 15 nt, Human
uuggacccugaggcc

SEQ ID NO: 1735017 - RNA, 15 nt, Human
uuggauuguccccga

SEQ ID NO: 1735018 - RNA, 21 nt, Human
uugccauguuggccaggcugg

SEQ ID NO: 1735019 - RNA, 20 nt, Human
uugccauguuggccaggcug

SEQ ID NO: 1735020 - RNA, 16 nt, Human
uugcugcuugaggcaa

SEQ ID NO: 1735021 - RNA, 14 nt, Human
uugcugcuugaggc

SEQ ID NO: 1735022 - RNA, 18 nt, Human
uugcugucccuuuuccuu

SEQ ID NO: 1735023 - RNA, 16 nt, Human
uugcugucccuuuucc

SEQ ID NO: 1735024 - RNA, 20 nt, Human
uuggucugacccacugcuuu

SEQ ID NO: 1735025 - RNA, 15 nt, Human
uuggucugugagaug

SEQ ID NO: 1735026 - RNA, 12 nt, Human
uuguaaaauggu

SEQ ID NO: 1735027 - RNA, 13 nt, Human
uuguaaaauggug

SEQ ID NO: 1735028 - RNA, 23 nt, Human
uuggcuucacggaagagccuugc

SEQ ID NO: 1735029 - RNA, 14 nt, Human
uugggaauuuuauu

SEQ ID NO: 1735030 - RNA, 20 nt, Human
uuguaaaauggugugaccac

SEQ ID NO: 1735031 - RNA, 16 nt, Human
uuguaccgcaauguga

SEQ ID NO: 1735032 - RNA, 18 nt, Human
uuguacuuuagggaagua

SEQ ID NO: 1735033 - RNA, 14 nt, Human
uugucuaugggacu

SEQ ID NO: 1735034 - RNA, 22 nt, Human
uugucaaaguggugagaggcau

SEQ ID NO: 1735035 - RNA, 20 nt, Human
uuguaugauccuaaugaaug

SEQ ID NO: 1735036 - RNA, 22 nt, Human
uuguaugaaagauggcugugcc

SEQ ID NO: 1735037 - RNA, 20 nt, Human
uugucuaugggacucaaugc

SEQ ID NO: 1735038 - RNA, 22 nt, Human
uugucaagaauagcauuguaaa

SEQ ID NO: 1735039 - RNA, 18 nt, Human
uugucugaagucacugca

SEQ ID NO: 1735040 - RNA, 17 nt, Human
uugucugaagucacugc

SEQ ID NO: 1735041 - RNA, 13 nt, Human
uuuaacagaaaug

SEQ ID NO: 1735042 - RNA, 12 nt, Human
uuuaaaaugucu

SEQ ID NO: 1735043 - RNA, 16 nt, Human
uuuaaaaugagaaauc

SEQ ID NO: 1735044 - RNA, 13 nt, Human
uuuaaaagauaca

SEQ ID NO: 1735045 - RNA, 20 nt, Human
uuguuuggggaugagaaagg

SEQ ID NO: 1735046 - RNA, 20 nt, Human
uuguuucuuucucugaggac

SEQ ID NO: 1735047 - RNA, 16 nt, Human
uuguuucuuucucuga

SEQ ID NO: 1735048 - RNA, 19 nt, Human
uuguuucuuucucugagga

SEQ ID NO: 1735049 - RNA, 15 nt, Human
uugucuuuggacccu

SEQ ID NO: 1735050 - RNA, 24 nt, Human
uugucuuuggacccugaggcccag

SEQ ID NO: 1735051 - RNA, 20 nt, Human
uugucuuuggacccugaggc

SEQ ID NO: 1735052 - RNA, 19 nt, Human
uugucuuuggugaacauug

SEQ ID NO: 1735053 - RNA, 13 nt, Human
uuuacagagacag

SEQ ID NO: 1735054 - RNA, 13 nt, Human
uuuacagcugccu

SEQ ID NO: 1735055 - RNA, 13 nt, Human
uuuaauaaaccau

SEQ ID NO: 1735056 - RNA, 22 nt, Human
uuuaauaaacacucuugaaaaa

SEQ ID NO: 1735057 - RNA, 14 nt, Human
uuuaacagaaaugu

SEQ ID NO: 1735058 - RNA, 15 nt, Human
uuuaacagaaaugua

SEQ ID NO: 1735059 - RNA, 15 nt, Human
uuuaauaaacacucu

SEQ ID NO: 1735060 - RNA, 14 nt, Human
uuuaauaaacacuc

SEQ ID NO: 1735061 - RNA, 22 nt, Human
uuuagacccuauugcugcuuga

SEQ ID NO: 1735062 - RNA, 18 nt, Human
uuuaguugcaacuuugua

SEQ ID NO: 1735063 - RNA, 17 nt, Human
uuuaguugcaacuuugu

SEQ ID NO: 1735064 - RNA, 19 nt, Human
uuuagacccuauugcugcu

SEQ ID NO: 1735065 - RNA, 18 nt, Human
uuuauaaacuuuaccuuu

SEQ ID NO: 1735066 - RNA, 12 nt, Human
uuuauacauaaa

SEQ ID NO: 1735067 - RNA, 20 nt, Human
uuuauacauaaacaagacca

SEQ ID NO: 1735068 - RNA, 17 nt, Human
uuuccacucaggucugu

SEQ ID NO: 1735069 - RNA, 20 nt, Human
uuuccuaaauauauuuuaag

SEQ ID NO: 1735070 - RNA, 22 nt, Human
uuuaugauacuugaaaauuaac

SEQ ID NO: 1735071 - RNA, 17 nt, Human
uuucagccaagaauucu

SEQ ID NO: 1735072 - RNA, 14 nt, Human
uuucugaaauaaca

SEQ ID NO: 1735073 - RNA, 18 nt, Human
uuucuacccagcgagccc

SEQ ID NO: 1735074 - RNA, 15 nt, Human
uuucuacccagcgag

SEQ ID NO: 1735075 - RNA, 22 nt, Human
uuucuacccagcgagcccuggu

SEQ ID NO: 1735076 - RNA, 19 nt, Human
uuucuaaaucuccaaaaua

SEQ ID NO: 1735077 - RNA, 22 nt, Human
uuucuaaaguaaaaacaaagaa

SEQ ID NO: 1735078 - RNA, 17 nt, Human
uuucuaaaguaaaaaca

SEQ ID NO: 1735079 - RNA, 19 nt, Human
uuuccuggcacugcuucca

SEQ ID NO: 1735080 - RNA, 23 nt, Human
uuuccuggcacugcuuccaguga

SEQ ID NO: 1735081 - RNA, 22 nt, Human
uuuccucuuagucgagccaagu

SEQ ID NO: 1735082 - RNA, 19 nt, Human
uuuggacccugaggcccag

SEQ ID NO: 1735083 - RNA, 15 nt, Human
uuuggacccugaggc

SEQ ID NO: 1735084 - RNA, 14 nt, Human
uuugcuugaaagaa

SEQ ID NO: 1735085 - RNA, 16 nt, Human
uuugcuugaaagaaaa

SEQ ID NO: 1735086 - RNA, 14 nt, Human
uuugauccaagcug

SEQ ID NO: 1735087 - RNA, 15 nt, Human
uuuguauucucuccu

SEQ ID NO: 1735088 - RNA, 16 nt, Human
uuuguaugcacuuugu

SEQ ID NO: 1735089 - RNA, 21 nt, Human
uuugaaauuguauuacaaauc

SEQ ID NO: 1735090 - RNA, 18 nt, Human
uuucuuaaccagaucauu

SEQ ID NO: 1735091 - RNA, 23 nt, Human
uuucugaucugaugcaagcaaga

SEQ ID NO: 1735092 - RNA, 19 nt, Human
uuucuuguguguuuauugu

SEQ ID NO: 1735093 - RNA, 21 nt, Human
uuugaggguguauauuuucug

SEQ ID NO: 1735094 - RNA, 17 nt, Human
uuugagaucagccuggg

SEQ ID NO: 1735095 - RNA, 16 nt, Human
uuugagaucagccugg

SEQ ID NO: 1735096 - RNA, 15 nt, Human
uucacgugguccuaa

SEQ ID NO: 1735097 - RNA, 18 nt, Human
uucacggaagagccuugc

SEQ ID NO: 1735098 - RNA, 20 nt, Human
uucaauaggaaaaacugauu

SEQ ID NO: 1735099 - RNA, 18 nt, Human
uucaauaggaaaaacuga

SEQ ID NO: 1735100 - RNA, 15 nt, Human
uucaauaggaaaaac

SEQ ID NO: 1735101 - RNA, 13 nt, Human
uucaauaggaaaa

SEQ ID NO: 1735102 - RNA, 13 nt, Human
uucacucuccuug

SEQ ID NO: 1735103 - RNA, 16 nt, Human
uucagacauagaauua

SEQ ID NO: 1735104 - RNA, 21 nt, Human
uucagacagcugccugggauc

SEQ ID NO: 1735105 - RNA, 20 nt, Human
uucagacauagaauuaacac

SEQ ID NO: 1735106 - RNA, 19 nt, Human
uucagagacuccugcaggc

SEQ ID NO: 1735107 - RNA, 22 nt, Human
uucagaguugaugguuguacau

SEQ ID NO: 1735108 - RNA, 21 nt, Human
uucagaguugaugguuguaca

SEQ ID NO: 1735109 - RNA, 18 nt, Human
uuauugucaaagugguga

SEQ ID NO: 1735110 - RNA, 17 nt, Human
uuauugucaaaguggug

SEQ ID NO: 1735111 - RNA, 20 nt, Human
uuauuuuauguugcauagaa

SEQ ID NO: 1735112 - RNA, 19 nt, Human
uucaacgcagcccugcuuu

SEQ ID NO: 1735113 - RNA, 16 nt, Human
uucaacgcagcccugc

SEQ ID NO: 1735114 - RNA, 20 nt, Human
uucaacgcagcccugcuuug

SEQ ID NO: 1735115 - RNA, 17 nt, Human
uucaacugaccagccuc

SEQ ID NO: 1735116 - RNA, 13 nt, Human
uuaguugcaacuu

SEQ ID NO: 1735117 - RNA, 14 nt, Human
uuaguuccuugagu

SEQ ID NO: 1735118 - RNA, 16 nt, Human
uuaguuccucauuagc

SEQ ID NO: 1735119 - RNA, 16 nt, Human
uuaucuagauacugua

SEQ ID NO: 1735120 - RNA, 20 nt, Human
uuaguugcaacuuuguauaa

SEQ ID NO: 1735121 - RNA, 13 nt, Human
uuaguugcuguau

SEQ ID NO: 1735122 - RNA, 15 nt, Human
uuaguugcuguaugu

SEQ ID NO: 1735123 - RNA, 20 nt, Human
uuaucuugaauaauguaaga

SEQ ID NO: 1735124 - RNA, 17 nt, Human
uuaucuagauacuguau

SEQ ID NO: 1735125 - RNA, 16 nt, Human
uuauggaacacucuga

SEQ ID NO: 1735126 - RNA, 16 nt, Human
uuaugcaugaaguaau

SEQ ID NO: 1735127 - RNA, 14 nt, Human
uuaugcauagauaa

SEQ ID NO: 1735128 - RNA, 22 nt, Human
uuaugcaugaaguaauaugcac

SEQ ID NO: 1735129 - RNA, 15 nt, Human
uuauugcccacgcug

SEQ ID NO: 1735130 - RNA, 19 nt, Human
uuauugcagcgauuaauaa

SEQ ID NO: 1735131 - RNA, 11 nt, Human
uuauucugcuc

SEQ ID NO: 1735132 - RNA, 14 nt, Human
uucccauucuugca

SEQ ID NO: 1735133 - RNA, 16 nt, Human
uuccccaggaggccag

SEQ ID NO: 1735134 - RNA, 15 nt, Human
uuccccaggaggcca

SEQ ID NO: 1735135 - RNA, 16 nt, Human
uucccauuugcuccuu

SEQ ID NO: 1735136 - RNA, 23 nt, Human
uuccagcaauucuccugccucag

SEQ ID NO: 1735137 - RNA, 22 nt, Human
uuccagcaauucuccugccuca

SEQ ID NO: 1735138 - RNA, 21 nt, Human
uuccagcaauucuccugccuc

SEQ ID NO: 1735139 - RNA, 20 nt, Human
uuccagcaauucuccugccu

SEQ ID NO: 1735140 - RNA, 20 nt, Human
uuccccaggaggccagccuu

SEQ ID NO: 1735141 - RNA, 19 nt, Human
uuccccaggaggccagccu

SEQ ID NO: 1735142 - RNA, 18 nt, Human
uuccccaggaggccagcc

SEQ ID NO: 1735143 - RNA, 17 nt, Human
uuccccaggaggccagc

SEQ ID NO: 1735144 - RNA, 21 nt, Human
uuccccaggaggccagccuug

SEQ ID NO: 1735145 - RNA, 11 nt, Human
uuccccauggg

SEQ ID NO: 1735146 - RNA, 19 nt, Human
uuccccaugucucgacuca

SEQ ID NO: 1735147 - RNA, 20 nt, Human
uucccucccuuccucuuucc

SEQ ID NO: 1735148 - RNA, 17 nt, Human
uucccucccuuccucuu

SEQ ID NO: 1735149 - RNA, 11 nt, Human
uucccucccuu

SEQ ID NO: 1735150 - RNA, 21 nt, Human
uuccagagaguggcuccuccc

SEQ ID NO: 1735151 - RNA, 20 nt, Human
uuccagagaguggcuccucc

SEQ ID NO: 1735152 - RNA, 19 nt, Human
uuccagagaguggcuccuc

SEQ ID NO: 1735153 - RNA, 18 nt, Human
uuccagagaguggcuccu

SEQ ID NO: 1735154 - RNA, 17 nt, Human
uuccagagaguggcucc

SEQ ID NO: 1735155 - RNA, 13 nt, Human
uuccacugagacc

SEQ ID NO: 1735156 - RNA, 18 nt, Human
uuccacucaggucuguuu

SEQ ID NO: 1735157 - RNA, 15 nt, Human
uuccaaauucugcuu

SEQ ID NO: 1735158 - RNA, 16 nt, Human
uucauuugcuuuggaa

SEQ ID NO: 1735159 - RNA, 17 nt, Human
uucaugcaaacuuuauu

SEQ ID NO: 1735160 - RNA, 16 nt, Human
uucauuuccugugucu

SEQ ID NO: 1735161 - RNA, 15 nt, Human
uucauuuccuguguc

SEQ ID NO: 1735162 - RNA, 12 nt, Human
uucauuugcuuu

SEQ ID NO: 1735163 - RNA, 15 nt, Human
uucaggaagcucagg

SEQ ID NO: 1735164 - RNA, 13 nt, Human
uucaggaagcuca

SEQ ID NO: 1735165 - RNA, 11 nt, Human
uucaggaagcu

SEQ ID NO: 1735166 - RNA, 21 nt, Human
uucaucuugaauuguaaggaa

SEQ ID NO: 1735167 - RNA, 15 nt, Human
uuccugaugcuucuu

SEQ ID NO: 1735168 - RNA, 19 nt, Human
uuccugaugcuucuucaga

SEQ ID NO: 1735169 - RNA, 18 nt, Human
uuccugaugcuucuucag

SEQ ID NO: 1735170 - RNA, 23 nt, Human
uuccugaugcuucuucagagacu

SEQ ID NO: 1735171 - RNA, 18 nt, Human
uuccugcauuugugaaau

SEQ ID NO: 1735172 - RNA, 16 nt, Human
uuccugcauuugugaa

SEQ ID NO: 1735173 - RNA, 17 nt, Human
uuccugccaggcauggu

SEQ ID NO: 1735174 - RNA, 20 nt, Human
uuccuugaguugauucagcu

SEQ ID NO: 1735175 - RNA, 14 nt, Human
uuccuggcacugcu

SEQ ID NO: 1735176 - RNA, 17 nt, Human
uucuaaagcugccagcc

SEQ ID NO: 1735177 - RNA, 13 nt, Human
uucuaaagcugcc

SEQ ID NO: 1735178 - RNA, 15 nt, Human
uucuaaagauggaaa

SEQ ID NO: 1735179 - RNA, 20 nt, Human
uucgggaggucgaggcagga

SEQ ID NO: 1735180 - RNA, 20 nt, Human
uucccuuugacgccauccca

SEQ ID NO: 1735181 - RNA, 22 nt, Human
uucccuuugacgccaucccagc

SEQ ID NO: 1735182 - RNA, 21 nt, Human
uucccuuugacgccaucccag

SEQ ID NO: 1735183 - RNA, 13 nt, Human
uuccucauuagca

SEQ ID NO: 1735184 - RNA, 19 nt, Human
uucccccuccaaucccacc

SEQ ID NO: 1735185 - RNA, 18 nt, Human
uuacuuagguguggggga

SEQ ID NO: 1735186 - RNA, 23 nt, Human
uuacuucuuauacauuugauaaa

SEQ ID NO: 1735187 - RNA, 12 nt, Human
uuacuucugcua

SEQ ID NO: 1735188 - RNA, 11 nt, Human
uuacuucugcu

SEQ ID NO: 1735189 - RNA, 21 nt, Human
uuacuuaaaccgccaaggcug

SEQ ID NO: 1735190 - RNA, 19 nt, Human
uuacuauggcccuggccua

SEQ ID NO: 1735191 - RNA, 19 nt, Human
uuacugucuuuuuucuaaa

SEQ ID NO: 1735192 - RNA, 17 nt, Human
uuacugucuuuuuucua

SEQ ID NO: 1735193 - RNA, 17 nt, Human
uuacuaguuucccuugc

SEQ ID NO: 1735194 - RNA, 19 nt, Human
uuacuaucaugucaaacgu

SEQ ID NO: 1735195 - RNA, 21 nt, Human
uuacuaucaugucaaacguga

SEQ ID NO: 1735196 - RNA, 13 nt, Human
uuacuaaguuuuu

SEQ ID NO: 1735197 - RNA, 14 nt, Human
uuacuaaguuuuua

SEQ ID NO: 1735198 - RNA, 16 nt, Human
uuacuaauagacaauu

SEQ ID NO: 1735199 - RNA, 18 nt, Human
uuagacagucccugccaa

SEQ ID NO: 1735200 - RNA, 17 nt, Human
uuagacagucccugcca

SEQ ID NO: 1735201 - RNA, 16 nt, Human
uuagacagucccugcc

SEQ ID NO: 1735202 - RNA, 15 nt, Human
uuagacagucccugc

SEQ ID NO: 1735203 - RNA, 14 nt, Human
uuacuuuguguuca

SEQ ID NO: 1735204 - RNA, 18 nt, Human
uuacuuuaaaaggagcca

SEQ ID NO: 1735205 - RNA, 17 nt, Human
uuacuuuaaaaggagcc

SEQ ID NO: 1735206 - RNA, 18 nt, Human
uuaguaugaggcauuugu

SEQ ID NO: 1735207 - RNA, 16 nt, Human
uuaguaugaggcauuu

SEQ ID NO: 1735208 - RNA, 14 nt, Human
uuaguguucauaaa

SEQ ID NO: 1735209 - RNA, 15 nt, Human
uuaguuccacugaga

SEQ ID NO: 1735210 - RNA, 16 nt, Human
uuaguuccacugagac

SEQ ID NO: 1735211 - RNA, 18 nt, Human
uuaggauguugaaaaagu

SEQ ID NO: 1735212 - RNA, 22 nt, Human
uuaggccaaaaaaauguaagau

SEQ ID NO: 1735213 - RNA, 12 nt, Human
uuagcugggaga

SEQ ID NO: 1735214 - RNA, 22 nt, Human
uuagauaauacaccacuacauu

SEQ ID NO: 1735215 - RNA, 15 nt, Human
uuagauaaauauuga

SEQ ID NO: 1735216 - RNA, 14 nt, Human
uuagaguugauacu

SEQ ID NO: 1735217 - RNA, 20 nt, Human
uguuucauauugaugugugu

SEQ ID NO: 1735218 - RNA, 21 nt, Human
uguuucagaggcucagauugu

SEQ ID NO: 1735219 - RNA, 20 nt, Human
uguuuagauaauacaccacu

SEQ ID NO: 1735220 - RNA, 15 nt, Human
uguuucaaacuuuac

SEQ ID NO: 1735221 - RNA, 16 nt, Human
uguuuagauaauacac

SEQ ID NO: 1735222 - RNA, 13 nt, Human
uguuugugauuga

SEQ ID NO: 1735223 - RNA, 20 nt, Human
uguuuuaagaggcagggucu

SEQ ID NO: 1735224 - RNA, 21 nt, Human
uuaaaauaccagccaguaaau

SEQ ID NO: 1735225 - RNA, 14 nt, Human
uuaaaagauacagu

SEQ ID NO: 1735226 - RNA, 17 nt, Human
uuaaaagauacaguuac

SEQ ID NO: 1735227 - RNA, 18 nt, Human
uguuuuuuuuuaaagacu

SEQ ID NO: 1735228 - RNA, 19 nt, Human
uguuuuuuuuuuccacuua

SEQ ID NO: 1735229 - RNA, 18 nt, Human
uguuuuuuuuuuccacuu

SEQ ID NO: 1735230 - RNA, 19 nt, Human
uguuuuaaggaugcuugua

SEQ ID NO: 1735231 - RNA, 22 nt, Human
uguuuuaagaggcagggucuca

SEQ ID NO: 1735232 - RNA, 18 nt, Human
uguuuuaaggaugcuugu

SEQ ID NO: 1735233 - RNA, 17 nt, Human
uguuuuguuuggagaca

SEQ ID NO: 1735234 - RNA, 11 nt, Human
uuaaagacaga

SEQ ID NO: 1735235 - RNA, 12 nt, Human
uuaaagacagag

SEQ ID NO: 1735236 - RNA, 23 nt, Human
uuaaauguuuuuuuuuaaagacu

SEQ ID NO: 1735237 - RNA, 21 nt, Human
uuaaauguuuuuuuuuaaaga

SEQ ID NO: 1735238 - RNA, 17 nt, Human
uuaaccacuucagcuga

SEQ ID NO: 1735239 - RNA, 18 nt, Human
uuaacuuuuauaaacuuu

SEQ ID NO: 1735240 - RNA, 16 nt, Human
uuaacuuuuauaaacu

SEQ ID NO: 1735241 - RNA, 17 nt, Human
uuaacuuuuauaaacuu

SEQ ID NO: 1735242 - RNA, 15 nt, Human
uuaacuuuuauaaac

SEQ ID NO: 1735243 - RNA, 16 nt, Human
uuaacuucacauauug

SEQ ID NO: 1735244 - RNA, 20 nt, Human
uuacaagcgugagccacugc

SEQ ID NO: 1735245 - RNA, 21 nt, Human
uuacaagcgugagccacugca

SEQ ID NO: 1735246 - RNA, 22 nt, Human
uuaauauugauaugcuuauaca

SEQ ID NO: 1735247 - RNA, 18 nt, Human
uuaauauugauaugcuua

SEQ ID NO: 1735248 - RNA, 21 nt, Human
uuaaugauaugcuuguaacua

SEQ ID NO: 1735249 - RNA, 16 nt, Human
uuaagccuuuggaaac

SEQ ID NO: 1735250 - RNA, 15 nt, Human
uuaagccuuuggaaa

SEQ ID NO: 1735251 - RNA, 17 nt, Human
uuaagcuguuacugucu

SEQ ID NO: 1735252 - RNA, 14 nt, Human
uggacuccucuguc

SEQ ID NO: 1735253 - RNA, 13 nt, Human
uggacuccucugu

SEQ ID NO: 1735254 - RNA, 21 nt, Human
uggagaagcucccugaaguaa

SEQ ID NO: 1735255 - RNA, 23 nt, Human
uggaggaaggaaacccagcucug

SEQ ID NO: 1735256 - RNA, 21 nt, Human
uggaggaaggaaacccagcuc

SEQ ID NO: 1735257 - RNA, 17 nt, Human
uggagacugucucaaga

SEQ ID NO: 1735258 - RNA, 14 nt, Human
uggagacugucuca

SEQ ID NO: 1735259 - RNA, 16 nt, Human
uggcacuauaauguaa

SEQ ID NO: 1735260 - RNA, 15 nt, Human
uggcacuauaaugua

SEQ ID NO: 1735261 - RNA, 12 nt, Human
uggcaaaaaggc

SEQ ID NO: 1735262 - RNA, 17 nt, Human
uggauuuuugucuugug

SEQ ID NO: 1735263 - RNA, 16 nt, Human
uggcaaaaaggcagga

SEQ ID NO: 1735264 - RNA, 18 nt, Human
uggccagaugcaccagcc

SEQ ID NO: 1735265 - RNA, 17 nt, Human
uggccagaugcaccagc

SEQ ID NO: 1735266 - RNA, 19 nt, Human
uggcagaguugaagacaga

SEQ ID NO: 1735267 - RNA, 17 nt, Human
uggcagaguugaagaca

SEQ ID NO: 1735268 - RNA, 21 nt, Human
uggcagaguggauucuugaac

SEQ ID NO: 1735269 - RNA, 15 nt, Human
uggcagaguugaaga

SEQ ID NO: 1735270 - RNA, 12 nt, Human
uggcagaggagg

SEQ ID NO: 1735271 - RNA, 19 nt, Human
uggccagaugcaccagccc

SEQ ID NO: 1735272 - RNA, 17 nt, Human
uggccaggcugcucuug

SEQ ID NO: 1735273 - RNA, 16 nt, Human
uggccaggcugcucuu

SEQ ID NO: 1735274 - RNA, 13 nt, Human
uggccaggcuggu

SEQ ID NO: 1735275 - RNA, 20 nt, Human
uggccaggcugcucuugaac

SEQ ID NO: 1735276 - RNA, 16 nt, Human
uggccccugcccggcu

SEQ ID NO: 1735277 - RNA, 15 nt, Human
uggccccugcccggc

SEQ ID NO: 1735278 - RNA, 20 nt, Human
uggccccugcccggcugcgg

SEQ ID NO: 1735279 - RNA, 23 nt, Human
uggcgcugccccuggcagccccu

SEQ ID NO: 1735280 - RNA, 16 nt, Human
uggcgcugccccuggc

SEQ ID NO: 1735281 - RNA, 23 nt, Human
uggcgcagcauauucaggaagcu

SEQ ID NO: 1735282 - RNA, 22 nt, Human
uggcgcagcauauucaggaagc

SEQ ID NO: 1735283 - RNA, 23 nt, Human
uggccucccaacucaccccagcc

SEQ ID NO: 1735284 - RNA, 16 nt, Human
uggcugcuucaaggau

SEQ ID NO: 1735285 - RNA, 15 nt, Human
uggcugcuucaagga

SEQ ID NO: 1735286 - RNA, 11 nt, Human
uggcugcuuca

SEQ ID NO: 1735287 - RNA, 16 nt, Human
uggcuccucccggugc

SEQ ID NO: 1735288 - RNA, 14 nt, Human
uggcuccucccggu

SEQ ID NO: 1735289 - RNA, 19 nt, Human
uggcuccucccggugccca

SEQ ID NO: 1735290 - RNA, 18 nt, Human
uggcuccucccggugccc

SEQ ID NO: 1735291 - RNA, 15 nt, Human
uggcgggguggggug

SEQ ID NO: 1735292 - RNA, 20 nt, Human
uggcucccacaggcccuucc

SEQ ID NO: 1735293 - RNA, 17 nt, Human
uggcucccacaggcccu

SEQ ID NO: 1735294 - RNA, 14 nt, Human
uggcucccacaggc

SEQ ID NO: 1735295 - RNA, 23 nt, Human
uggucccccuuccauggacuuug

SEQ ID NO: 1735296 - RNA, 18 nt, Human
uggucccccuuccaugga

SEQ ID NO: 1735297 - RNA, 16 nt, Human
uggucccccuuccaug

SEQ ID NO: 1735298 - RNA, 15 nt, Human
uggucccccuuccau

SEQ ID NO: 1735299 - RNA, 19 nt, Human
ugguccuaaucuucugaac

SEQ ID NO: 1735300 - RNA, 17 nt, Human
ugguccuaaucuucuga

SEQ ID NO: 1735301 - RNA, 23 nt, Human
ugguccugcugcaguugccaguc

SEQ ID NO: 1735302 - RNA, 15 nt, Human
ugguccugcugcagu

SEQ ID NO: 1735303 - RNA, 13 nt, Human
ugguccugcugca

SEQ ID NO: 1735304 - RNA, 22 nt, Human
uggucacaggaaguagaggagg

SEQ ID NO: 1735305 - RNA, 18 nt, Human
uggucacaggacucugcc

SEQ ID NO: 1735306 - RNA, 19 nt, Human
uggucacaggacucugccu

SEQ ID NO: 1735307 - RNA, 20 nt, Human
uggucacaggacucugccuc

SEQ ID NO: 1735308 - RNA, 14 nt, Human
uggucccccuucca

SEQ ID NO: 1735309 - RNA, 19 nt, Human
uggugacuuuccucuuugg

SEQ ID NO: 1735310 - RNA, 22 nt, Human
uggugaccucugccugaaguca

SEQ ID NO: 1735311 - RNA, 17 nt, Human
uggugaccucugccuga

SEQ ID NO: 1735312 - RNA, 16 nt, Human
uggugaccucugccug

SEQ ID NO: 1735313 - RNA, 15 nt, Human
uggugaccucugccu

SEQ ID NO: 1735314 - RNA, 21 nt, Human
uggugcaaugaccuuucaaua

SEQ ID NO: 1735315 - RNA, 18 nt, Human
uggucuacacugugcuga

SEQ ID NO: 1735316 - RNA, 17 nt, Human
uggucuacacugugcug

SEQ ID NO: 1735317 - RNA, 16 nt, Human
uggucuacacugugcu

SEQ ID NO: 1735318 - RNA, 15 nt, Human
uggucuacacugugc

SEQ ID NO: 1735319 - RNA, 14 nt, Human
uggugaccucugcc

SEQ ID NO: 1735320 - RNA, 13 nt, Human
uggugaccucugc

SEQ ID NO: 1735321 - RNA, 19 nt, Human
uggucuacacugugcugag

SEQ ID NO: 1735322 - RNA, 14 nt, Human
uggucggaaaacau

SEQ ID NO: 1735323 - RNA, 17 nt, Human
uggucggaaaacaugcu

SEQ ID NO: 1735324 - RNA, 23 nt, Human
ugggcagagcagagaccaucccu

SEQ ID NO: 1735325 - RNA, 14 nt, Human
ugggccuggcuccc

SEQ ID NO: 1735326 - RNA, 11 nt, Human
ugggccuucag

SEQ ID NO: 1735327 - RNA, 23 nt, Human
ugggccccugccucucugcaggu

SEQ ID NO: 1735328 - RNA, 21 nt, Human
ugggccccugccucucugcag

SEQ ID NO: 1735329 - RNA, 20 nt, Human
uggcugggggccucagugcc

SEQ ID NO: 1735330 - RNA, 17 nt, Human
uggcugggggccucagu

SEQ ID NO: 1735331 - RNA, 16 nt, Human
uggcugggggccucag

SEQ ID NO: 1735332 - RNA, 16 nt, Human
ugggagugggcccaau

SEQ ID NO: 1735333 - RNA, 14 nt, Human
ugggagugggccca

SEQ ID NO: 1735334 - RNA, 19 nt, Human
ugggaucacauguggacuu

SEQ ID NO: 1735335 - RNA, 13 nt, Human
ugggauccuccag

SEQ ID NO: 1735336 - RNA, 12 nt, Human
ugggauccucca

SEQ ID NO: 1735337 - RNA, 14 nt, Human
ugggauccuccagg

SEQ ID NO: 1735338 - RNA, 22 nt, Human
ugggcagagcagagaccauccc

SEQ ID NO: 1735339 - RNA, 17 nt, Human
ugggauuacaggcguga

SEQ ID NO: 1735340 - RNA, 22 nt, Human
ugggauuacaagcgugagccac

SEQ ID NO: 1735341 - RNA, 18 nt, Human
uggguacuuguggacaca

SEQ ID NO: 1735342 - RNA, 17 nt, Human
uggguacuuguggacac

SEQ ID NO: 1735343 - RNA, 22 nt, Human
uggggguucuuucuuccucugc

SEQ ID NO: 1735344 - RNA, 20 nt, Human
uggggguucuuucuuccucu

SEQ ID NO: 1735345 - RNA, 19 nt, Human
uggggguucuuucuuccuc

SEQ ID NO: 1735346 - RNA, 15 nt, Human
uggggguucuuucuu

SEQ ID NO: 1735347 - RNA, 16 nt, Human
ugggggaguggccaca

SEQ ID NO: 1735348 - RNA, 13 nt, Human
uggggggggugcu

SEQ ID NO: 1735349 - RNA, 20 nt, Human
uggggccaggcugggucgcc

SEQ ID NO: 1735350 - RNA, 23 nt, Human
uggggaugagaaagguugaagca

SEQ ID NO: 1735351 - RNA, 15 nt, Human
uggggaugagaaagg

SEQ ID NO: 1735352 - RNA, 20 nt, Human
uggggccaguuggucccccu

SEQ ID NO: 1735353 - RNA, 22 nt, Human
uggggccaggcugggucgcccu

SEQ ID NO: 1735354 - RNA, 21 nt, Human
uggggccaggcugggucgccc

SEQ ID NO: 1735355 - RNA, 12 nt, Human
ugggccuucagg

SEQ ID NO: 1735356 - RNA, 15 nt, Human
ugggccuucagggag

SEQ ID NO: 1735357 - RNA, 14 nt, Human
ugccucaagagaag

SEQ ID NO: 1735358 - RNA, 15 nt, Human
ugccucaagagaagg

SEQ ID NO: 1735359 - RNA, 16 nt, Human
ugccuccucuucaacu

SEQ ID NO: 1735360 - RNA, 14 nt, Human
ugccuccucuucaa

SEQ ID NO: 1735361 - RNA, 23 nt, Human
ugcccugugaguacuacaguccu

SEQ ID NO: 1735362 - RNA, 23 nt, Human
ugcccugguuuccugcccuggga

SEQ ID NO: 1735363 - RNA, 20 nt, Human
ugcccugguuuccugcccug

SEQ ID NO: 1735364 - RNA, 19 nt, Human
ugcccugguuuccugcccu

SEQ ID NO: 1735365 - RNA, 18 nt, Human
ugcccugguuuccugccc

SEQ ID NO: 1735366 - RNA, 17 nt, Human
ugcccugguuuccugcc

SEQ ID NO: 1735367 - RNA, 17 nt, Human
ugcccuggugcugccac

SEQ ID NO: 1735368 - RNA, 16 nt, Human
ugcccuggugcugcca

SEQ ID NO: 1735369 - RNA, 14 nt, Human
ugcccuggugcugc

SEQ ID NO: 1735370 - RNA, 12 nt, Human
ugcccuggugcu

SEQ ID NO: 1735371 - RNA, 21 nt, Human
ugcccugcccaccuggccucu

SEQ ID NO: 1735372 - RNA, 13 nt, Human
ugcccugggaggc

SEQ ID NO: 1735373 - RNA, 18 nt, Human
ugcccugggaggcaguga

SEQ ID NO: 1735374 - RNA, 17 nt, Human
ugcccugggaggcagug

SEQ ID NO: 1735375 - RNA, 15 nt, Human
ugcccugggaggcag

SEQ ID NO: 1735376 - RNA, 20 nt, Human
ugcccugcccaccuggccuc

SEQ ID NO: 1735377 - RNA, 16 nt, Human
ugcccugcccaccugg

SEQ ID NO: 1735378 - RNA, 15 nt, Human
ugcccugcccaccug

SEQ ID NO: 1735379 - RNA, 16 nt, Human
ugccccuggcagcccc

SEQ ID NO: 1735380 - RNA, 20 nt, Human
ugccccuccucucugcccua

SEQ ID NO: 1735381 - RNA, 19 nt, Human
ugccccuccucucugcccu

SEQ ID NO: 1735382 - RNA, 18 nt, Human
ugccccuccucucugccc

SEQ ID NO: 1735383 - RNA, 17 nt, Human
ugccccuccucucugcc

SEQ ID NO: 1735384 - RNA, 16 nt, Human
ugccccucccuucaac

SEQ ID NO: 1735385 - RNA, 15 nt, Human
ugccccucccuucaa

SEQ ID NO: 1735386 - RNA, 14 nt, Human
ugcccggcugcgga

SEQ ID NO: 1735387 - RNA, 12 nt, Human
ugcccggcugcg

SEQ ID NO: 1735388 - RNA, 20 nt, Human
ugcccaggcuggcgugcagu

SEQ ID NO: 1735389 - RNA, 19 nt, Human
ugcccaggcuggcgugcag

SEQ ID NO: 1735390 - RNA, 18 nt, Human
ugcccaggcuggcgugca

SEQ ID NO: 1735391 - RNA, 21 nt, Human
ugcaguuacacuaaaagguga

SEQ ID NO: 1735392 - RNA, 21 nt, Human
ugcaguggugcgaucuggguu

SEQ ID NO: 1735393 - RNA, 13 nt, Human
ugcagggaguccg

SEQ ID NO: 1735394 - RNA, 15 nt, Human
ugauuuaauuugaaa

SEQ ID NO: 1735395 - RNA, 16 nt, Human
ugcaguugccagucac

SEQ ID NO: 1735396 - RNA, 18 nt, Human
ugcauauuauuuuauguu

SEQ ID NO: 1735397 - RNA, 16 nt, Human
ugccacuaaauugaca

SEQ ID NO: 1735398 - RNA, 22 nt, Human
ugccaggaagccagcaggcucu

SEQ ID NO: 1735399 - RNA, 20 nt, Human
ugccaggaagccagcaggcu

SEQ ID NO: 1735400 - RNA, 14 nt, Human
ugccaggcauggug

SEQ ID NO: 1735401 - RNA, 21 nt, Human
ugcauuuggugguuucagaaa

SEQ ID NO: 1735402 - RNA, 23 nt, Human
ugcauuuggugguuucagaaaug

SEQ ID NO: 1735403 - RNA, 23 nt, Human
ugcucuccgaccagacaccuuga

SEQ ID NO: 1735404 - RNA, 12 nt, Human
ugcucuccucuu

SEQ ID NO: 1735405 - RNA, 14 nt, Human
ugcucuccucuugc

SEQ ID NO: 1735406 - RNA, 21 nt, Human
ugcuaggaacacuccuucaca

SEQ ID NO: 1735407 - RNA, 22 nt, Human
ugcuaggaacacuccuucacag

SEQ ID NO: 1735408 - RNA, 13 nt, Human
ugcuagaacuccc

SEQ ID NO: 1735409 - RNA, 14 nt, Human
ugcuagaacucccu

SEQ ID NO: 1735410 - RNA, 15 nt, Human
ugcuagaacucccuu

SEQ ID NO: 1735411 - RNA, 17 nt, Human
ugcuagaacucccuuuc

SEQ ID NO: 1735412 - RNA, 20 nt, Human
ugcucaggagcccugggagg

SEQ ID NO: 1735413 - RNA, 19 nt, Human
ugcucaggagcccugggag

SEQ ID NO: 1735414 - RNA, 18 nt, Human
ugcucaggagcccuggga

SEQ ID NO: 1735415 - RNA, 15 nt, Human
ugcucaggagcccug

SEQ ID NO: 1735416 - RNA, 17 nt, Human
ugcucacauaucuguca

SEQ ID NO: 1735417 - RNA, 17 nt, Human
ugcggacagccacggcc

SEQ ID NO: 1735418 - RNA, 22 nt, Human
ugcuacuguccuacccacccuc

SEQ ID NO: 1735419 - RNA, 21 nt, Human
ugcuacuguccuacccacccu

SEQ ID NO: 1735420 - RNA, 22 nt, Human
ugcuaagacucaguggggaggg

SEQ ID NO: 1735421 - RNA, 20 nt, Human
ugccuugcauaauggucaga

SEQ ID NO: 1735422 - RNA, 23 nt, Human
ugcgcaggcuggcccugcccugg

SEQ ID NO: 1735423 - RNA, 22 nt, Human
ugcgcaggcuggcccugcccug

SEQ ID NO: 1735424 - RNA, 21 nt, Human
ugcgcaggcuggcccugcccu

SEQ ID NO: 1735425 - RNA, 12 nt, Human
ugcugcuugagg

SEQ ID NO: 1735426 - RNA, 19 nt, Human
ugcugcuugaggcaacuca

SEQ ID NO: 1735427 - RNA, 20 nt, Human
ugcugggauuacagguguga

SEQ ID NO: 1735428 - RNA, 14 nt, Human
ugcugggccccugc

SEQ ID NO: 1735429 - RNA, 24 nt, Human
ugcugggccccugccucucugcag

SEQ ID NO: 1735430 - RNA, 23 nt, Human
ugcugggccccugccucucugca

SEQ ID NO: 1735431 - RNA, 22 nt, Human
ugcugggccccugccucucugc

SEQ ID NO: 1735432 - RNA, 21 nt, Human
ugcugggccccugccucucug

SEQ ID NO: 1735433 - RNA, 19 nt, Human
ugcugggccccugccucuc

SEQ ID NO: 1735434 - RNA, 18 nt, Human
ugcugggccccugccucu

SEQ ID NO: 1735435 - RNA, 17 nt, Human
ugcugggccccugccuc

SEQ ID NO: 1735436 - RNA, 16 nt, Human
ugcugggccccugccu

SEQ ID NO: 1735437 - RNA, 17 nt, Human
ugcugcauuuaaaagau

SEQ ID NO: 1735438 - RNA, 18 nt, Human
ugcugcauuuaaaagaua

SEQ ID NO: 1735439 - RNA, 19 nt, Human
ugcugcauuuaaaagauac

SEQ ID NO: 1735440 - RNA, 23 nt, Human
ugcugcauuuaaaagauacaguu

SEQ ID NO: 1735441 - RNA, 17 nt, Human
ugcugccugcuuuuuau

SEQ ID NO: 1735442 - RNA, 15 nt, Human
ugcugccugcuuuuu

SEQ ID NO: 1735443 - RNA, 13 nt, Human
ugcuggguguggc

SEQ ID NO: 1735444 - RNA, 20 nt, Human
ugcugggggggauuguaaaa

SEQ ID NO: 1735445 - RNA, 17 nt, Human
ugcugggcuugucugua

SEQ ID NO: 1735446 - RNA, 18 nt, Human
ugcuguaacuuucugaaa

SEQ ID NO: 1735447 - RNA, 16 nt, Human
ugcugguuuuucaguu

SEQ ID NO: 1735448 - RNA, 18 nt, Human
ugcugguuuuucaguuuu

SEQ ID NO: 1735449 - RNA, 13 nt, Human
ugcugguuuuagu

SEQ ID NO: 1735450 - RNA, 12 nt, Human
ugcugguuuuuc

SEQ ID NO: 1735451 - RNA, 15 nt, Human
ugcugguuuuucagu

SEQ ID NO: 1735452 - RNA, 12 nt, Human
ugauucacagug

SEQ ID NO: 1735453 - RNA, 16 nt, Human
ugauucagacagcugc

SEQ ID NO: 1735454 - RNA, 15 nt, Human
ugauucagacagcug

SEQ ID NO: 1735455 - RNA, 14 nt, Human
ugauucagacagcu

SEQ ID NO: 1735456 - RNA, 13 nt, Human
ugauucagacagc

SEQ ID NO: 1735457 - RNA, 20 nt, Human
ugauucaacagguuuuccug

SEQ ID NO: 1735458 - RNA, 13 nt, Human
ugauuauauguca

SEQ ID NO: 1735459 - RNA, 16 nt, Human
ugauuaccagggacug

SEQ ID NO: 1735460 - RNA, 20 nt, Human
ugauguucuuucacccuuuu

SEQ ID NO: 1735461 - RNA, 21 nt, Human
ugauucuccugccucagccuc

SEQ ID NO: 1735462 - RNA, 23 nt, Human
ugauucagacagcugccugggau

SEQ ID NO: 1735463 - RNA, 21 nt, Human
ugauucagacagcugccuggg

SEQ ID NO: 1735464 - RNA, 20 nt, Human
ugauucagacagcugccugg

SEQ ID NO: 1735465 - RNA, 19 nt, Human
ugauucagacagcugccug

SEQ ID NO: 1735466 - RNA, 18 nt, Human
ugauucagacagcugccu

SEQ ID NO: 1735467 - RNA, 21 nt, Human
ugauuggaggggggagguggg

SEQ ID NO: 1735468 - RNA, 13 nt, Human
ugauuggaggggg

SEQ ID NO: 1735469 - RNA, 20 nt, Human
ugauuggcaggaguuggaag

SEQ ID NO: 1735470 - RNA, 16 nt, Human
ugauugugucucuugg

SEQ ID NO: 1735471 - RNA, 16 nt, Human
ugauguguuaucucuu

SEQ ID NO: 1735472 - RNA, 19 nt, Human
ugaugucccaacuuguaaa

SEQ ID NO: 1735473 - RNA, 18 nt, Human
ugaugcuucuucagagac

SEQ ID NO: 1735474 - RNA, 17 nt, Human
ugaugcuucuucagaga

SEQ ID NO: 1735475 - RNA, 16 nt, Human
ugaugcuucuucagag

SEQ ID NO: 1735476 - RNA, 21 nt, Human
ugaugguuguacauauaagug

SEQ ID NO: 1735477 - RNA, 14 nt, Human
ugaugguuguacau

SEQ ID NO: 1735478 - RNA, 13 nt, Human
ugaugguuguaca

SEQ ID NO: 1735479 - RNA, 14 nt, Human
ugaugguuccccug

SEQ ID NO: 1735480 - RNA, 23 nt, Human
ugaugcuacaggauuugaaauug

SEQ ID NO: 1735481 - RNA, 21 nt, Human
ugaugccugugaacugaacuc

SEQ ID NO: 1735482 - RNA, 20 nt, Human
ugaugcuacaggauuugaaa

SEQ ID NO: 1735483 - RNA, 11 nt, Human
ugaugccuggc

SEQ ID NO: 1735484 - RNA, 20 nt, Human
ugaugccugugaacugaacu

SEQ ID NO: 1735485 - RNA, 15 nt, Human
ugaugccugugaacu

SEQ ID NO: 1735486 - RNA, 16 nt, Human
ugaucuuugcagacag

SEQ ID NO: 1735487 - RNA, 18 nt, Human
ugaucuuugcagacaggc

SEQ ID NO: 1735488 - RNA, 19 nt, Human
ugauccacccaccucagcc

SEQ ID NO: 1735489 - RNA, 18 nt, Human
ugauccacccaccucagc

SEQ ID NO: 1735490 - RNA, 17 nt, Human
ugauccacccaccucag

SEQ ID NO: 1735491 - RNA, 17 nt, Human
ugaucucucgugauuga

SEQ ID NO: 1735492 - RNA, 20 nt, Human
ugaucuucuuuauaauucua

SEQ ID NO: 1735493 - RNA, 15 nt, Human
ugaucugugggcaca

SEQ ID NO: 1735494 - RNA, 14 nt, Human
ugauagcacagacc

SEQ ID NO: 1735495 - RNA, 13 nt, Human
ugauagcacagac

SEQ ID NO: 1735496 - RNA, 18 nt, Human
ugauagcaaauggccuca

SEQ ID NO: 1735497 - RNA, 17 nt, Human
ugauccaagcugguccc

SEQ ID NO: 1735498 - RNA, 15 nt, Human
ugauccaagcugguc

SEQ ID NO: 1735499 - RNA, 14 nt, Human
ugauccaagcuggu

SEQ ID NO: 1735500 - RNA, 13 nt, Human
ugauccaagcugg

SEQ ID NO: 1735501 - RNA, 17 nt, Human
ugagcagggcucagcgg

SEQ ID NO: 1735502 - RNA, 16 nt, Human
ugagcagggcucagcg

SEQ ID NO: 1735503 - RNA, 19 nt, Human
ugagcagggcucagcgggg

SEQ ID NO: 1735504 - RNA, 20 nt, Human
ugagcaucaggccaggcccu

SEQ ID NO: 1735505 - RNA, 19 nt, Human
ugagcaucaggccaggccc

SEQ ID NO: 1735506 - RNA, 18 nt, Human
ugagcaucaggccaggcc

SEQ ID NO: 1735507 - RNA, 21 nt, Human
ugagccucagcauccuggcac

SEQ ID NO: 1735508 - RNA, 18 nt, Human
ugagccucagcauccugg

SEQ ID NO: 1735509 - RNA, 22 nt, Human
ugagccucagcauccuggcacc

SEQ ID NO: 1735510 - RNA, 14 nt, Human
ugagccucagucuc

SEQ ID NO: 1735511 - RNA, 17 nt, Human
ugagccucagcauccug

SEQ ID NO: 1735512 - RNA, 21 nt, Human
ugagccgagaucacgccacug

SEQ ID NO: 1735513 - RNA, 19 nt, Human
ugagccgagaucacgccac

SEQ ID NO: 1735514 - RNA, 18 nt, Human
ugagcccuguccugccua

SEQ ID NO: 1735515 - RNA, 16 nt, Human
ugagagugaacaaauu

SEQ ID NO: 1735516 - RNA, 23 nt, Human
ugagacucgcgacaaugcaaacc

SEQ ID NO: 1735517 - RNA, 22 nt, Human
ugagacucgcgacaaugcaaac

SEQ ID NO: 1735518 - RNA, 21 nt, Human
ugagacucgcgacaaugcaaa

SEQ ID NO: 1735519 - RNA, 20 nt, Human
ugagacucgcgacaaugcaa

SEQ ID NO: 1735520 - RNA, 15 nt, Human
ugagcagggcucagc

SEQ ID NO: 1735521 - RNA, 14 nt, Human
ugagcagggcucag

SEQ ID NO: 1735522 - RNA, 13 nt, Human
ugagcagggcuca

SEQ ID NO: 1735523 - RNA, 12 nt, Human
ugagcagggcuc

SEQ ID NO: 1735524 - RNA, 15 nt, Human
ugagaucagccuggg

SEQ ID NO: 1735525 - RNA, 14 nt, Human
ugagaucagccugg

SEQ ID NO: 1735526 - RNA, 15 nt, Human
ugagaucaaaacggu

SEQ ID NO: 1735527 - RNA, 19 nt, Human
ugagacucgcgacaaugca

SEQ ID NO: 1735528 - RNA, 21 nt, Human
ugaccucaggugauccaccca

SEQ ID NO: 1735529 - RNA, 20 nt, Human
ugaccucaggugauccaccc

SEQ ID NO: 1735530 - RNA, 22 nt, Human
ugaccucagcuuugauauuuca

SEQ ID NO: 1735531 - RNA, 17 nt, Human
ugagaaauuuauaaacu

SEQ ID NO: 1735532 - RNA, 18 nt, Human
ugaggcuccacuuggucu

SEQ ID NO: 1735533 - RNA, 20 nt, Human
ugaggcuccacuuggucugu

SEQ ID NO: 1735534 - RNA, 14 nt, Human
ugaggcucugcccu

SEQ ID NO: 1735535 - RNA, 13 nt, Human
ugaggcucugccc

SEQ ID NO: 1735536 - RNA, 17 nt, Human
ugagggaacagagaggu

SEQ ID NO: 1735537 - RNA, 15 nt, Human
ugaggcucugcccuu

SEQ ID NO: 1735538 - RNA, 13 nt, Human
ugaggugggagga

SEQ ID NO: 1735539 - RNA, 12 nt, Human
ugaggugggagg

SEQ ID NO: 1735540 - RNA, 12 nt, Human
ugaggcauuugu

SEQ ID NO: 1735541 - RNA, 23 nt, Human
ugaggcaucgcaauguaagacuc

SEQ ID NO: 1735542 - RNA, 19 nt, Human
ugaggcauuuguuugaacu

SEQ ID NO: 1735543 - RNA, 20 nt, Human
ugaggcauuuguuugaacug

SEQ ID NO: 1735544 - RNA, 17 nt, Human
ugaggcuaguguggugu

SEQ ID NO: 1735545 - RNA, 21 nt, Human
ugaggcauuuguuugaacuga

SEQ ID NO: 1735546 - RNA, 23 nt, Human
ugaggcuagugugguguuuccug

SEQ ID NO: 1735547 - RNA, 23 nt, Human
ugaggcauuuguuugaacugaua

SEQ ID NO: 1735548 - RNA, 13 nt, Human
ugagcugggauga

SEQ ID NO: 1735549 - RNA, 16 nt, Human
ugaggagcuugaaacc

SEQ ID NO: 1735550 - RNA, 23 nt, Human
ugaguuugggccccagaggcugg

SEQ ID NO: 1735551 - RNA, 22 nt, Human
ugaguuugggccccagaggcug

SEQ ID NO: 1735552 - RNA, 20 nt, Human
ugaguugauagcacagaccc

SEQ ID NO: 1735553 - RNA, 16 nt, Human
ugaguugauagcacag

SEQ ID NO: 1735554 - RNA, 14 nt, Human
ugagugagcaugcc

SEQ ID NO: 1735555 - RNA, 18 nt, Human
ugagucugaaggcugggu

SEQ ID NO: 1735556 - RNA, 17 nt, Human
ugagucugaaggcuggg

SEQ ID NO: 1735557 - RNA, 15 nt, Human
ugagucugaaggcug

SEQ ID NO: 1735558 - RNA, 13 nt, Human
ugagucugaaggc

SEQ ID NO: 1735559 - RNA, 19 nt, Human
ugaguccagaaguuugaga

SEQ ID NO: 1735560 - RNA, 21 nt, Human
ugaggugggaggaucucuuga

SEQ ID NO: 1735561 - RNA, 15 nt, Human
ugagucccaggcuga

SEQ ID NO: 1735562 - RNA, 19 nt, Human
ugagucgaggacagggagg

SEQ ID NO: 1735563 - RNA, 19 nt, Human
ugagucccaggcugagccu

SEQ ID NO: 1735564 - RNA, 20 nt, Human
ugaaaagcuccauuuuuagu

SEQ ID NO: 1735565 - RNA, 13 nt, Human
ugaaaauuuugau

SEQ ID NO: 1735566 - RNA, 19 nt, Human
ugaaaauuuugauguuuua

SEQ ID NO: 1735567 - RNA, 21 nt, Human
ugaaaauuuugauguuuuaag

SEQ ID NO: 1735568 - RNA, 14 nt, Human
ugaaacauuuuguc

SEQ ID NO: 1735569 - RNA, 15 nt, Human
ugaaagggcccagag

SEQ ID NO: 1735570 - RNA, 13 nt, Human
ugaaagggcccag

SEQ ID NO: 1735571 - RNA, 23 nt, Human
ugaaagggaguauuacaaaaaca

SEQ ID NO: 1735572 - RNA, 20 nt, Human
ugaaaccccuguaggccuca

SEQ ID NO: 1735573 - RNA, 18 nt, Human
ugaaagcccugagcuuuc

SEQ ID NO: 1735574 - RNA, 18 nt, Human
ugaaagauggcugugccu

SEQ ID NO: 1735575 - RNA, 19 nt, Human
ugaaagauggcugugccuc

SEQ ID NO: 1735576 - RNA, 12 nt, Human
ugaaauuauuca

SEQ ID NO: 1735577 - RNA, 17 nt, Human
ugaaaucaguuacucuu

SEQ ID NO: 1735578 - RNA, 16 nt, Human
ugaaaucaguuacucu

SEQ ID NO: 1735579 - RNA, 16 nt, Human
ugaacuccuggccuca

SEQ ID NO: 1735580 - RNA, 20 nt, Human
ugaaccaccacacccagccc

SEQ ID NO: 1735581 - RNA, 17 nt, Human
ugaaccaccacacccag

SEQ ID NO: 1735582 - RNA, 23 nt, Human
ugaaccacaucuugcucugcuga

SEQ ID NO: 1735583 - RNA, 19 nt, Human
ugaaccacaucuugcucug

SEQ ID NO: 1735584 - RNA, 22 nt, Human
ugaaccaagaacuuuccaggaa

SEQ ID NO: 1735585 - RNA, 20 nt, Human
ugaacauugguucuuucauu

SEQ ID NO: 1735586 - RNA, 12 nt, Human
ucuuugccaagu

SEQ ID NO: 1735587 - RNA, 17 nt, Human
ucuuuggacacucacac

SEQ ID NO: 1735588 - RNA, 19 nt, Human
ucuuuggacagaagcagcu

SEQ ID NO: 1735589 - RNA, 22 nt, Human
ucuuuggacagaagcagcucuu

SEQ ID NO: 1735590 - RNA, 21 nt, Human
ucuuuggacagaagcagcucu

SEQ ID NO: 1735591 - RNA, 17 nt, Human
ucuuuccaaaguacacu

SEQ ID NO: 1735592 - RNA, 21 nt, Human
ucuuucauuugcuuuggaagu

SEQ ID NO: 1735593 - RNA, 21 nt, Human
ucuuucagccaagaauucuua

SEQ ID NO: 1735594 - RNA, 20 nt, Human
ucuuucagccaagaauucuu

SEQ ID NO: 1735595 - RNA, 19 nt, Human
ucuuucagccaagaauucu

SEQ ID NO: 1735596 - RNA, 16 nt, Human
ucuuucagccaagaau

SEQ ID NO: 1735597 - RNA, 13 nt, Human
ucuuuccaaagua

SEQ ID NO: 1735598 - RNA, 14 nt, Human
ucuuuccaaaguac

SEQ ID NO: 1735599 - RNA, 17 nt, Human
ucuccucuugccacugc

SEQ ID NO: 1735600 - RNA, 22 nt, Human
ucuccucuugccacugccucuu

SEQ ID NO: 1735601 - RNA, 20 nt, Human
ucuccucugcugcuggcugg

SEQ ID NO: 1735602 - RNA, 16 nt, Human
ucucccuucauccuuc

SEQ ID NO: 1735603 - RNA, 16 nt, Human
ucuccucuugccacug

SEQ ID NO: 1735604 - RNA, 13 nt, Human
ucuccucuugcca

SEQ ID NO: 1735605 - RNA, 15 nt, Human
ucuugcaugaggcua

SEQ ID NO: 1735606 - RNA, 23 nt, Human
ucuuucacccuuuucuguuugcu

SEQ ID NO: 1735607 - RNA, 21 nt, Human
ucuuguguguuuauugucaaa

SEQ ID NO: 1735608 - RNA, 12 nt, Human
ucuuguguuucu

SEQ ID NO: 1735609 - RNA, 16 nt, Human
ucuuguguguuuauug

SEQ ID NO: 1735610 - RNA, 18 nt, Human
ugacaaggauugcuacug

SEQ ID NO: 1735611 - RNA, 22 nt, Human
ugacagagugagacucugucuc

SEQ ID NO: 1735612 - RNA, 19 nt, Human
ugacagagugagacucugu

SEQ ID NO: 1735613 - RNA, 23 nt, Human
ugacauaaguauuuaauucaugu

SEQ ID NO: 1735614 - RNA, 17 nt, Human
ugacagagugagacucu

SEQ ID NO: 1735615 - RNA, 14 nt, Human
ugacagagugagac

SEQ ID NO: 1735616 - RNA, 23 nt, Human
ugacagaggcagccccauucugc

SEQ ID NO: 1735617 - RNA, 18 nt, Human
ugacagaggcagccccau

SEQ ID NO: 1735618 - RNA, 17 nt, Human
ugacagaggcagcccca

SEQ ID NO: 1735619 - RNA, 16 nt, Human
ugacagaggcagcccc

SEQ ID NO: 1735620 - RNA, 15 nt, Human
ugacagaggcagccc

SEQ ID NO: 1735621 - RNA, 14 nt, Human
ugacagaggcagcc

SEQ ID NO: 1735622 - RNA, 23 nt, Human
ugacagacacaggcccggcucca

SEQ ID NO: 1735623 - RNA, 20 nt, Human
ugacagacacaggcccggcu

SEQ ID NO: 1735624 - RNA, 16 nt, Human
ugacagacagcccucc

SEQ ID NO: 1735625 - RNA, 13 nt, Human
ugacagaggcagc

SEQ ID NO: 1735626 - RNA, 13 nt, Human
ugacaugucuuuu

SEQ ID NO: 1735627 - RNA, 20 nt, Human
ugaccacugcagaagacagu

SEQ ID NO: 1735628 - RNA, 19 nt, Human
ugaccagcaccaucucucc

SEQ ID NO: 1735629 - RNA, 15 nt, Human
ugacaugucuuuucu

SEQ ID NO: 1735630 - RNA, 20 nt, Human
ugaccgugaggccagagaca

SEQ ID NO: 1735631 - RNA, 16 nt, Human
ugaccgugaggccaga

SEQ ID NO: 1735632 - RNA, 14 nt, Human
ugaccgugaggcca

SEQ ID NO: 1735633 - RNA, 13 nt, Human
ugaccgugaggcc

SEQ ID NO: 1735634 - RNA, 19 nt, Human
ugaccauucuccaccugcc

SEQ ID NO: 1735635 - RNA, 18 nt, Human
ugaccauucuccaccugc

SEQ ID NO: 1735636 - RNA, 17 nt, Human
ugaccauucuccaccug

SEQ ID NO: 1735637 - RNA, 16 nt, Human
ugaccauucuccaccu

SEQ ID NO: 1735638 - RNA, 20 nt, Human
ugaccagcaccaucucuccu

SEQ ID NO: 1735639 - RNA, 17 nt, Human
ugaaggccccgcccagg

SEQ ID NO: 1735640 - RNA, 20 nt, Human
ugaaggacauugcggacagc

SEQ ID NO: 1735641 - RNA, 19 nt, Human
ugaaggacauugcggacag

SEQ ID NO: 1735642 - RNA, 22 nt, Human
ugaaggacauugcggacagcca

SEQ ID NO: 1735643 - RNA, 16 nt, Human
ugaaggccccgcccag

SEQ ID NO: 1735644 - RNA, 15 nt, Human
ugaaggccccgccca

SEQ ID NO: 1735645 - RNA, 16 nt, Human
ugaaggagagcccuuc

SEQ ID NO: 1735646 - RNA, 20 nt, Human
ugaaggagagcccuucauuu

SEQ ID NO: 1735647 - RNA, 17 nt, Human
ugaacuccuggccucaa

SEQ ID NO: 1735648 - RNA, 16 nt, Human
ugaacucugacaacag

SEQ ID NO: 1735649 - RNA, 20 nt, Human
ugaaggaauaaauugcuccu

SEQ ID NO: 1735650 - RNA, 16 nt, Human
ugaauuauuuucucuc

SEQ ID NO: 1735651 - RNA, 23 nt, Human
ugaaugaugauccuaggcauuug

SEQ ID NO: 1735652 - RNA, 23 nt, Human
ugaaucauuuuaccuuugacaaa

SEQ ID NO: 1735653 - RNA, 22 nt, Human
ugaaucauuuuaccuuugacaa

SEQ ID NO: 1735654 - RNA, 15 nt, Human
ugaauaaagacaccu

SEQ ID NO: 1735655 - RNA, 14 nt, Human
ugaauaaagacacc

SEQ ID NO: 1735656 - RNA, 13 nt, Human
ucgugacaacacu

SEQ ID NO: 1735657 - RNA, 18 nt, Human
ucggacuuagcugggaga

SEQ ID NO: 1735658 - RNA, 14 nt, Human
uccuuagaagugga

SEQ ID NO: 1735659 - RNA, 18 nt, Human
ucuaaaggcuaccuuugu

SEQ ID NO: 1735660 - RNA, 17 nt, Human
ucuaaaggcuaccuuug

SEQ ID NO: 1735661 - RNA, 19 nt, Human
ucuaaaggcuaccuuugua

SEQ ID NO: 1735662 - RNA, 20 nt, Human
ucuaaaggcuaccuuuguau

SEQ ID NO: 1735663 - RNA, 16 nt, Human
ucguguccccuauccu

SEQ ID NO: 1735664 - RNA, 14 nt, Human
ucgugguaggacug

SEQ ID NO: 1735665 - RNA, 15 nt, Human
ucgugguaggacugu

SEQ ID NO: 1735666 - RNA, 20 nt, Human
ucgugguaggacuguagaaa

SEQ ID NO: 1735667 - RNA, 14 nt, Human
ucuaugacacaugc

SEQ ID NO: 1735668 - RNA, 17 nt, Human
ucuaugacacaugcaag

SEQ ID NO: 1735669 - RNA, 14 nt, Human
ucuaucaccaagga

SEQ ID NO: 1735670 - RNA, 21 nt, Human
ucuaggaagacuuuggaaaga

SEQ ID NO: 1735671 - RNA, 19 nt, Human
ucuaggaagacuuuggaaa

SEQ ID NO: 1735672 - RNA, 16 nt, Human
ucuaggaagacuuugg

SEQ ID NO: 1735673 - RNA, 15 nt, Human
ucuaggaagacuuug

SEQ ID NO: 1735674 - RNA, 16 nt, Human
ucuacagaggccaugg

SEQ ID NO: 1735675 - RNA, 15 nt, Human
ucuacagaggccaug

SEQ ID NO: 1735676 - RNA, 14 nt, Human
ucuaccuuccugca

SEQ ID NO: 1735677 - RNA, 23 nt, Human
ucucaguccaugaagauguagag

SEQ ID NO: 1735678 - RNA, 13 nt, Human
ucuaugggacuca

SEQ ID NO: 1735679 - RNA, 12 nt, Human
ucuaugggacuc

SEQ ID NO: 1735680 - RNA, 19 nt, Human
ucuaugggacucaaugcac

SEQ ID NO: 1735681 - RNA, 23 nt, Human
ucuaugggacucaaugcacugac

SEQ ID NO: 1735682 - RNA, 18 nt, Human
ucucauacucaccucacc

SEQ ID NO: 1735683 - RNA, 16 nt, Human
ucucauacucaccuca

SEQ ID NO: 1735684 - RNA, 16 nt, Human
ucuccaccugccaggg

SEQ ID NO: 1735685 - RNA, 15 nt, Human
ucuccaccugccagg

SEQ ID NO: 1735686 - RNA, 14 nt, Human
ucuccaccugccag

SEQ ID NO: 1735687 - RNA, 19 nt, Human
ucuccaccugccagggaca

SEQ ID NO: 1735688 - RNA, 17 nt, Human
ucuccaccugccaggga

SEQ ID NO: 1735689 - RNA, 22 nt, Human
ucuccaccugccagggacagag

SEQ ID NO: 1735690 - RNA, 13 nt, Human
ucuccacuccaga

SEQ ID NO: 1735691 - RNA, 16 nt, Human
ucuccacccugcucuc

SEQ ID NO: 1735692 - RNA, 14 nt, Human
ucuccacccugcuc

SEQ ID NO: 1735693 - RNA, 17 nt, Human
ucuccacccugcucucc

SEQ ID NO: 1735694 - RNA, 13 nt, Human
ucuccacccugcu

SEQ ID NO: 1735695 - RNA, 19 nt, Human
ucucaugccucagccuccu

SEQ ID NO: 1735696 - RNA, 16 nt, Human
ucucaugccucagccu

SEQ ID NO: 1735697 - RNA, 13 nt, Human
ucucaugccucag

SEQ ID NO: 1735698 - RNA, 13 nt, Human
ucucccccagccc

SEQ ID NO: 1735699 - RNA, 12 nt, Human
ucucccccagcc

SEQ ID NO: 1735700 - RNA, 11 nt, Human
ucuccaggcug

SEQ ID NO: 1735701 - RNA, 23 nt, Human
ucucccucagucuggcccuuccu

SEQ ID NO: 1735702 - RNA, 18 nt, Human
ucucccucagucuggccc

SEQ ID NO: 1735703 - RNA, 14 nt, Human
ucucccucccuugg

SEQ ID NO: 1735704 - RNA, 15 nt, Human
ucuccagccccugga

SEQ ID NO: 1735705 - RNA, 14 nt, Human
ucuccagccccugg

SEQ ID NO: 1735706 - RNA, 13 nt, Human
ucuccagccccug

SEQ ID NO: 1735707 - RNA, 12 nt, Human
ucuccagccccu

SEQ ID NO: 1735708 - RNA, 14 nt, Human
ucuccacugccuuc

SEQ ID NO: 1735709 - RNA, 18 nt, Human
ucuccagccccuggaugc

SEQ ID NO: 1735710 - RNA, 16 nt, Human
ucuccagccccuggau

SEQ ID NO: 1735711 - RNA, 22 nt, Human
ucuccagccccuggaugcagcc

SEQ ID NO: 1735712 - RNA, 23 nt, Human
uccuauauuguuuucaguguaca

SEQ ID NO: 1735713 - RNA, 12 nt, Human
uccuaguuccac

SEQ ID NO: 1735714 - RNA, 18 nt, Human
uccucauuagcauuuugc

SEQ ID NO: 1735715 - RNA, 17 nt, Human
uccuaucagaaguuucu

SEQ ID NO: 1735716 - RNA, 10 nt, Human
uccuccaggu

SEQ ID NO: 1735717 - RNA, 13 nt, Human
uccucccaccuca

SEQ ID NO: 1735718 - RNA, 12 nt, Human
uccucccaccuc

SEQ ID NO: 1735719 - RNA, 16 nt, Human
uccgcuuucuacccag

SEQ ID NO: 1735720 - RNA, 21 nt, Human
uccuaagcuauucaguaauaa

SEQ ID NO: 1735721 - RNA, 20 nt, Human
uccuaagcuauucaguaaua

SEQ ID NO: 1735722 - RNA, 20 nt, Human
uccgcuuucuacccagcgag

SEQ ID NO: 1735723 - RNA, 18 nt, Human
uccgcuuucuacccagcg

SEQ ID NO: 1735724 - RNA, 14 nt, Human
uccgccucuugggu

SEQ ID NO: 1735725 - RNA, 15 nt, Human
ucccccuuccaugga

SEQ ID NO: 1735726 - RNA, 21 nt, Human
ucccccuguuucagaggcuca

SEQ ID NO: 1735727 - RNA, 22 nt, Human
ucccuucaaccauuccccaugg

SEQ ID NO: 1735728 - RNA, 16 nt, Human
ucccuuccucuuucca

SEQ ID NO: 1735729 - RNA, 15 nt, Human
ucccuuccucuuucc

SEQ ID NO: 1735730 - RNA, 23 nt, Human
uccuggcacccggccccugcugg

SEQ ID NO: 1735731 - RNA, 16 nt, Human
uccuggcacugcuucc

SEQ ID NO: 1735732 - RNA, 13 nt, Human
uccuggcacugcu

SEQ ID NO: 1735733 - RNA, 12 nt, Human
uccuggccucaa

SEQ ID NO: 1735734 - RNA, 13 nt, Human
uccuguagcccua

SEQ ID NO: 1735735 - RNA, 11 nt, Human
uccuguagccc

SEQ ID NO: 1735736 - RNA, 17 nt, Human
uccugcccuuaccugcc

SEQ ID NO: 1735737 - RNA, 21 nt, Human
uccugcccugggaggcaguga

SEQ ID NO: 1735738 - RNA, 15 nt, Human
uccugcccugggagg

SEQ ID NO: 1735739 - RNA, 14 nt, Human
uccugcccugggag

SEQ ID NO: 1735740 - RNA, 12 nt, Human
uccugcccuggg

SEQ ID NO: 1735741 - RNA, 11 nt, Human
uccugcccugg

SEQ ID NO: 1735742 - RNA, 20 nt, Human
uccugcccuuaccugccagg

SEQ ID NO: 1735743 - RNA, 14 nt, Human
uccuggaguucugg

SEQ ID NO: 1735744 - RNA, 19 nt, Human
uccugccuaaggcugaacu

SEQ ID NO: 1735745 - RNA, 16 nt, Human
uccugccuaaggcuga

SEQ ID NO: 1735746 - RNA, 21 nt, Human
uccugaggcuccacuuggucu

SEQ ID NO: 1735747 - RNA, 16 nt, Human
uccugcauuugugaaa

SEQ ID NO: 1735748 - RNA, 19 nt, Human
uccugaggcuccacuuggu

SEQ ID NO: 1735749 - RNA, 20 nt, Human
uccugaggcuccacuugguc

SEQ ID NO: 1735750 - RNA, 14 nt, Human
uccugccaggcaug

SEQ ID NO: 1735751 - RNA, 13 nt, Human
uccugccaggcau

SEQ ID NO: 1735752 - RNA, 16 nt, Human
uccugccaccacgccc

SEQ ID NO: 1735753 - RNA, 11 nt, Human
uccugccacca

SEQ ID NO: 1735754 - RNA, 17 nt, Human
uccugccccugagccca

SEQ ID NO: 1735755 - RNA, 18 nt, Human
uccugccccugagcccau

SEQ ID NO: 1735756 - RNA, 10 nt, Human
uccugcccug

SEQ ID NO: 1735757 - RNA, 14 nt, Human
uccaucaggccacu

SEQ ID NO: 1735758 - RNA, 21 nt, Human
uccauaaucuggacuccucug

SEQ ID NO: 1735759 - RNA, 15 nt, Human
uccauagagagcaag

SEQ ID NO: 1735760 - RNA, 14 nt, Human
uccauagagagcaa

SEQ ID NO: 1735761 - RNA, 20 nt, Human
uccaugggccauaugaaaag

SEQ ID NO: 1735762 - RNA, 13 nt, Human
uccauggacuuug

SEQ ID NO: 1735763 - RNA, 15 nt, Human
uccaugcugccucca

SEQ ID NO: 1735764 - RNA, 14 nt, Human
uccaugcugccucc

SEQ ID NO: 1735765 - RNA, 22 nt, Human
uccauaaucuggacuccucugu

SEQ ID NO: 1735766 - RNA, 22 nt, Human
uccaggggugggacacccugug

SEQ ID NO: 1735767 - RNA, 20 nt, Human
uccagguuuaagcuguuacu

SEQ ID NO: 1735768 - RNA, 22 nt, Human
uccagcaauucuccugccucag

SEQ ID NO: 1735769 - RNA, 15 nt, Human
uccaggagcagccac

SEQ ID NO: 1735770 - RNA, 14 nt, Human
uccaggagcagcca

SEQ ID NO: 1735771 - RNA, 13 nt, Human
uccaggagcagcc

SEQ ID NO: 1735772 - RNA, 12 nt, Human
uccaggagcagc

SEQ ID NO: 1735773 - RNA, 20 nt, Human
uccaggggugggacacccug

SEQ ID NO: 1735774 - RNA, 19 nt, Human
uccaggggugggacacccu

SEQ ID NO: 1735775 - RNA, 21 nt, Human
uccacuuggucugugagaugc

SEQ ID NO: 1735776 - RNA, 14 nt, Human
uccaaaguacacug

SEQ ID NO: 1735777 - RNA, 16 nt, Human
uccaaaguacacuguu

SEQ ID NO: 1735778 - RNA, 23 nt, Human
uccacuuggucugugagaugcua

SEQ ID NO: 1735779 - RNA, 21 nt, Human
uccacuuucuagccagaggag

SEQ ID NO: 1735780 - RNA, 20 nt, Human
uccacuuucuagccagagga

SEQ ID NO: 1735781 - RNA, 23 nt, Human
uccagaaagaaaacuuguauuau

SEQ ID NO: 1735782 - RNA, 18 nt, Human
uccccagauugcaacagg

SEQ ID NO: 1735783 - RNA, 13 nt, Human
uccccagauugca

SEQ ID NO: 1735784 - RNA, 20 nt, Human
ucccaugagccucagcaucc

SEQ ID NO: 1735785 - RNA, 22 nt, Human
uccccagcaagugagagcuggg

SEQ ID NO: 1735786 - RNA, 21 nt, Human
uccccagcaagugagagcugg

SEQ ID NO: 1735787 - RNA, 20 nt, Human
uccccagcaagugagagcug

SEQ ID NO: 1735788 - RNA, 23 nt, Human
uccccagauugcaacaggcuggg

SEQ ID NO: 1735789 - RNA, 22 nt, Human
uccccagauugcaacaggcugg

SEQ ID NO: 1735790 - RNA, 20 nt, Human
uccccagauugcaacaggcu

SEQ ID NO: 1735791 - RNA, 19 nt, Human
uccccagauugcaacaggc

SEQ ID NO: 1735792 - RNA, 14 nt, Human
uccccaggaggcca

SEQ ID NO: 1735793 - RNA, 17 nt, Human
uccccaggaggccagcc

SEQ ID NO: 1735794 - RNA, 17 nt, Human
ucccccagccccauccu

SEQ ID NO: 1735795 - RNA, 16 nt, Human
uccccaggaggccagc

SEQ ID NO: 1735796 - RNA, 15 nt, Human
uccccaggaggccag

SEQ ID NO: 1735797 - RNA, 21 nt, Human
ucccccagccccauccucugu

SEQ ID NO: 1735798 - RNA, 20 nt, Human
ucccccagccccauccucug

SEQ ID NO: 1735799 - RNA, 22 nt, Human
ucccccagccccauccucugua

SEQ ID NO: 1735800 - RNA, 18 nt, Human
ucccaccuuggcugcagg

SEQ ID NO: 1735801 - RNA, 20 nt, Human
ucccagcugugcucuggaca

SEQ ID NO: 1735802 - RNA, 17 nt, Human
ucccaccuuggcugcag

SEQ ID NO: 1735803 - RNA, 16 nt, Human
ucccaccuuggcugca

SEQ ID NO: 1735804 - RNA, 13 nt, Human
ucccaccuuggcu

SEQ ID NO: 1735805 - RNA, 22 nt, Human
ucccaccucucucacuccuuga

SEQ ID NO: 1735806 - RNA, 20 nt, Human
uccaugugggcuaguugggc

SEQ ID NO: 1735807 - RNA, 19 nt, Human
ucccaugagccucagcauc

SEQ ID NO: 1735808 - RNA, 18 nt, Human
ucccaugagccucagcau

SEQ ID NO: 1735809 - RNA, 15 nt, Human
ucccaucuuccaagg

SEQ ID NO: 1735810 - RNA, 16 nt, Human
ucccaggcgccccuuc

SEQ ID NO: 1735811 - RNA, 24 nt, Human
ucccaggcauuccccaggaggcca

SEQ ID NO: 1735812 - RNA, 22 nt, Human
ucccagcugugcucuggacagg

SEQ ID NO: 1735813 - RNA, 21 nt, Human
ucccagcugugcucuggacag

SEQ ID NO: 1735814 - RNA, 23 nt, Human
ucccagcugugcucuggacaggc

SEQ ID NO: 1735815 - RNA, 15 nt, Human
ucaggagcccuggga

SEQ ID NO: 1735816 - RNA, 14 nt, Human
ucaggagcccuggg

SEQ ID NO: 1735817 - RNA, 12 nt, Human
ucaggagcccug

SEQ ID NO: 1735818 - RNA, 11 nt, Human
ucaggagcccu

SEQ ID NO: 1735819 - RNA, 21 nt, Human
ucaggccugggggcugggcag

SEQ ID NO: 1735820 - RNA, 15 nt, Human
ucaggcucuucuccu

SEQ ID NO: 1735821 - RNA, 20 nt, Human
ucaggaucaaaccccgacca

SEQ ID NO: 1735822 - RNA, 24 nt, Human
ucagcuccagcucaccagccccag

SEQ ID NO: 1735823 - RNA, 23 nt, Human
ucagcuccagcucaccagcccca

SEQ ID NO: 1735824 - RNA, 23 nt, Human
ucaggaagcucagggccuggcuc

SEQ ID NO: 1735825 - RNA, 23 nt, Human
ucagcucugcaagaauugaagca

SEQ ID NO: 1735826 - RNA, 20 nt, Human
ucagguggggcagcuugagg

SEQ ID NO: 1735827 - RNA, 16 nt, Human
ucagucucccucccuu

SEQ ID NO: 1735828 - RNA, 23 nt, Human
ucagucugauucccaagcucugc

SEQ ID NO: 1735829 - RNA, 22 nt, Human
ucagucugauucccaagcucug

SEQ ID NO: 1735830 - RNA, 21 nt, Human
ucagucugauucccaagcucu

SEQ ID NO: 1735831 - RNA, 19 nt, Human
ucagguggggcagcuugag

SEQ ID NO: 1735832 - RNA, 18 nt, Human
ucagguggggcagcuuga

SEQ ID NO: 1735833 - RNA, 23 nt, Human
ucaggugauccacccaccucagc

SEQ ID NO: 1735834 - RNA, 16 nt, Human
ucaggugauccaccca

SEQ ID NO: 1735835 - RNA, 23 nt, Human
ucaggugagaagcagaggaagga

SEQ ID NO: 1735836 - RNA, 12 nt, Human
ucaggucccugc

SEQ ID NO: 1735837 - RNA, 21 nt, Human
ucaggugaaacuccagaugcc

SEQ ID NO: 1735838 - RNA, 21 nt, Human
ucaggcucuucuccuuucaca

SEQ ID NO: 1735839 - RNA, 16 nt, Human
ucaggcucuucuccuu

SEQ ID NO: 1735840 - RNA, 13 nt, Human
uccaaaguacacu

SEQ ID NO: 1735841 - RNA, 16 nt, Human
ucauuaggauggcuag

SEQ ID NO: 1735842 - RNA, 14 nt, Human
ucauggugcucaga

SEQ ID NO: 1735843 - RNA, 17 nt, Human
ucaucaaugaaugaaug

SEQ ID NO: 1735844 - RNA, 12 nt, Human
ucauagcagcuu

SEQ ID NO: 1735845 - RNA, 11 nt, Human
ucauagcagcu

SEQ ID NO: 1735846 - RNA, 20 nt, Human
ucaguguacauggaauaaca

SEQ ID NO: 1735847 - RNA, 17 nt, Human
ucauccacugugccaug

SEQ ID NO: 1735848 - RNA, 14 nt, Human
ucauccacugugcc

SEQ ID NO: 1735849 - RNA, 18 nt, Human
ucauccacugugccaugu

SEQ ID NO: 1735850 - RNA, 16 nt, Human
ucaucuccccaucauu

SEQ ID NO: 1735851 - RNA, 17 nt, Human
uauuauauuuacaaaug

SEQ ID NO: 1735852 - RNA, 14 nt, Human
uauuauaccuuuuu

SEQ ID NO: 1735853 - RNA, 24 nt, Human
uauuaagaaagacuaucuaaaugu

SEQ ID NO: 1735854 - RNA, 14 nt, Human
uauuaaggaagaca

SEQ ID NO: 1735855 - RNA, 15 nt, Human
uauuaaguuguuaau

SEQ ID NO: 1735856 - RNA, 12 nt, Human
uauuauaccuuu

SEQ ID NO: 1735857 - RNA, 13 nt, Human
uauuauaccuuuu

SEQ ID NO: 1735858 - RNA, 20 nt, Human
uauuauggaggcaggaguuu

SEQ ID NO: 1735859 - RNA, 13 nt, Human
uauguguguuuua

SEQ ID NO: 1735860 - RNA, 14 nt, Human
uauggaggcaggag

SEQ ID NO: 1735861 - RNA, 17 nt, Human
uauguucuaagaaguga

SEQ ID NO: 1735862 - RNA, 22 nt, Human
uauguucuuaguggauguucug

SEQ ID NO: 1735863 - RNA, 21 nt, Human
uauguugcccaggcaggucuu

SEQ ID NO: 1735864 - RNA, 17 nt, Human
uauguugaagccuuugu

SEQ ID NO: 1735865 - RNA, 18 nt, Human
uauguugguagauucuaa

SEQ ID NO: 1735866 - RNA, 19 nt, Human
uauuaaaugcccagccccu

SEQ ID NO: 1735867 - RNA, 17 nt, Human
uauuaaaugcccagccc

SEQ ID NO: 1735868 - RNA, 15 nt, Human
uauuaaaugcccagc

SEQ ID NO: 1735869 - RNA, 16 nt, Human
uauuaagaaagacuau

SEQ ID NO: 1735870 - RNA, 22 nt, Human
uauugcagcgauuaauaacagg

SEQ ID NO: 1735871 - RNA, 20 nt, Human
uauugauaugcuuauacacu

SEQ ID NO: 1735872 - RNA, 18 nt, Human
uauucauuguggucauag

SEQ ID NO: 1735873 - RNA, 15 nt, Human
uauugcccacgcugg

SEQ ID NO: 1735874 - RNA, 14 nt, Human
uauugcccacgcug

SEQ ID NO: 1735875 - RNA, 13 nt, Human
uauugcccacgcu

SEQ ID NO: 1735876 - RNA, 23 nt, Human
uauugcugauggugcaaugaccu

SEQ ID NO: 1735877 - RNA, 21 nt, Human
uauugcuugcacaaaccaauu

SEQ ID NO: 1735878 - RNA, 15 nt, Human
uauugcuugcacaaa

SEQ ID NO: 1735879 - RNA, 22 nt, Human
uauuuauuaaaugcccagcccc

SEQ ID NO: 1735880 - RNA, 17 nt, Human
uauuuaugggauccugg

SEQ ID NO: 1735881 - RNA, 12 nt, Human
ucacauuuaaau

SEQ ID NO: 1735882 - RNA, 22 nt, Human
ucacauuguauucagaguugau

SEQ ID NO: 1735883 - RNA, 18 nt, Human
ucaccaacgucugugcca

SEQ ID NO: 1735884 - RNA, 17 nt, Human
ucaccaacgucugugcc

SEQ ID NO: 1735885 - RNA, 14 nt, Human
ucacauuuauucug

SEQ ID NO: 1735886 - RNA, 18 nt, Human
ucacccgcuaagagggag

SEQ ID NO: 1735887 - RNA, 13 nt, Human
ucaccaagcccag

SEQ ID NO: 1735888 - RNA, 14 nt, Human
ucaccgaaaacgug

SEQ ID NO: 1735889 - RNA, 12 nt, Human
ucacccuuuucu

SEQ ID NO: 1735890 - RNA, 20 nt, Human
ucacccuggggcuaggaaau

SEQ ID NO: 1735891 - RNA, 19 nt, Human
ucacccgcuaagagggagg

SEQ ID NO: 1735892 - RNA, 21 nt, Human
ucaccgaaaacguggcugcuu

SEQ ID NO: 1735893 - RNA, 20 nt, Human
ucaccgaaaacguggcugcu

SEQ ID NO: 1735894 - RNA, 19 nt, Human
ucaccgaaaacguggcugc

SEQ ID NO: 1735895 - RNA, 15 nt, Human
ucaccgaaaacgugg

SEQ ID NO: 1735896 - RNA, 23 nt, Human
ucaccgaaaacguggcugcuuca

SEQ ID NO: 1735897 - RNA, 22 nt, Human
ucaccgaaaacguggcugcuuc

SEQ ID NO: 1735898 - RNA, 22 nt, Human
ucacaagacccaaaaggcagaa

SEQ ID NO: 1735899 - RNA, 23 nt, Human
ucacacaugagcaucaggccagg

SEQ ID NO: 1735900 - RNA, 22 nt, Human
ucacacaugagcaucaggccag

SEQ ID NO: 1735901 - RNA, 15 nt, Human
ucacacacuuuggcu

SEQ ID NO: 1735902 - RNA, 16 nt, Human
ucacaggacucugccu

SEQ ID NO: 1735903 - RNA, 18 nt, Human
ucacaggacucugccucc

SEQ ID NO: 1735904 - RNA, 17 nt, Human
ucacaggacucugccuc

SEQ ID NO: 1735905 - RNA, 19 nt, Human
ucacaggagggagggggaa

SEQ ID NO: 1735906 - RNA, 23 nt, Human
ucacaggacucugccuccucuuc

SEQ ID NO: 1735907 - RNA, 19 nt, Human
ucacaggacucugccuccu

SEQ ID NO: 1735908 - RNA, 20 nt, Human
ucaaaccccgaccaccugcc

SEQ ID NO: 1735909 - RNA, 19 nt, Human
ucaaaccccgaccaccugc

SEQ ID NO: 1735910 - RNA, 23 nt, Human
ucaaaccccgaccaccugcccaa

SEQ ID NO: 1735911 - RNA, 23 nt, Human
ucaaagagguuuuaaaaaaaucc

SEQ ID NO: 1735912 - RNA, 12 nt, Human
ucaaagagguuu

SEQ ID NO: 1735913 - RNA, 19 nt, Human
ucaaccccuucgcuccugu

SEQ ID NO: 1735914 - RNA, 18 nt, Human
ucaaccccuucgcuccug

SEQ ID NO: 1735915 - RNA, 15 nt, Human
ucaaccuccugggcu

SEQ ID NO: 1735916 - RNA, 20 nt, Human
ucaaccccuucgcuccugug

SEQ ID NO: 1735917 - RNA, 16 nt, Human
ucaaccuccugggcua

SEQ ID NO: 1735918 - RNA, 18 nt, Human
ucaacugaccagccucca

SEQ ID NO: 1735919 - RNA, 24 nt, Human
ucaacugaccagccuccaugcugc

SEQ ID NO: 1735920 - RNA, 20 nt, Human
ucaacucuccuccagaguca

SEQ ID NO: 1735921 - RNA, 22 nt, Human
ucaacucccugccccccagccc

SEQ ID NO: 1735922 - RNA, 21 nt, Human
ucaacucccugccccccagcc

SEQ ID NO: 1735923 - RNA, 15 nt, Human
ucaacucccugcccc

SEQ ID NO: 1735924 - RNA, 14 nt, Human
ucaacucccugccc

SEQ ID NO: 1735925 - RNA, 17 nt, Human
ucaaggauccugagcca

SEQ ID NO: 1735926 - RNA, 16 nt, Human
ucaaggauccugagcc

SEQ ID NO: 1735927 - RNA, 15 nt, Human
ucaaggauccugagc

SEQ ID NO: 1735928 - RNA, 14 nt, Human
ucaaggauccugag

SEQ ID NO: 1735929 - RNA, 13 nt, Human
ucaaggauccuga

SEQ ID NO: 1735930 - RNA, 20 nt, Human
ucaagccaccaacauacucc

SEQ ID NO: 1735931 - RNA, 12 nt, Human
ucaagccaccaa

SEQ ID NO: 1735932 - RNA, 19 nt, Human
ucaagcgauucuucugcuu

SEQ ID NO: 1735933 - RNA, 18 nt, Human
ucaagcgauucuucugcu

SEQ ID NO: 1735934 - RNA, 21 nt, Human
ucaagcgauucuucugcuuca

SEQ ID NO: 1735935 - RNA, 16 nt, Human
uaggucagugcaaaua

SEQ ID NO: 1735936 - RNA, 15 nt, Human
uaggucucaauaccu

SEQ ID NO: 1735937 - RNA, 16 nt, Human
uagguaaauuacaguu

SEQ ID NO: 1735938 - RNA, 20 nt, Human
uagguauaaguggugugugu

SEQ ID NO: 1735939 - RNA, 21 nt, Human
uagggaaaaaccagcguguga

SEQ ID NO: 1735940 - RNA, 20 nt, Human
uagggaaaaaccagcgugug

SEQ ID NO: 1735941 - RNA, 19 nt, Human
uagggaaaaaccagcgugu

SEQ ID NO: 1735942 - RNA, 12 nt, Human
uaggaauugacc

SEQ ID NO: 1735943 - RNA, 18 nt, Human
uaggccaugggacaggga

SEQ ID NO: 1735944 - RNA, 16 nt, Human
uaggccaugggacagg

SEQ ID NO: 1735945 - RNA, 18 nt, Human
uaggccuggccagaugca

SEQ ID NO: 1735946 - RNA, 15 nt, Human
uaggccuggccagau

SEQ ID NO: 1735947 - RNA, 20 nt, Human
uaguugcaacuuuguauaaa

SEQ ID NO: 1735948 - RNA, 13 nt, Human
uaguguucauaaa

SEQ ID NO: 1735949 - RNA, 23 nt, Human
uaggugacagagugagacucugu

SEQ ID NO: 1735950 - RNA, 21 nt, Human
uaggugauccacucgccuuca

SEQ ID NO: 1735951 - RNA, 13 nt, Human
uaguaucaaaaga

SEQ ID NO: 1735952 - RNA, 21 nt, Human
uauaugcucugcauguuacau

SEQ ID NO: 1735953 - RNA, 23 nt, Human
uauauaaauuuuuuuuguuucau

SEQ ID NO: 1735954 - RNA, 18 nt, Human
uauacgauaaauaacuuu

SEQ ID NO: 1735955 - RNA, 15 nt, Human
uauaauucacauugu

SEQ ID NO: 1735956 - RNA, 18 nt, Human
uaugcaaucaaaucugcu

SEQ ID NO: 1735957 - RNA, 13 nt, Human
uaugcacacauuu

SEQ ID NO: 1735958 - RNA, 14 nt, Human
uaugcacacauuuu

SEQ ID NO: 1735959 - RNA, 23 nt, Human
uaugauuuuuaaagaaaaguuuu

SEQ ID NO: 1735960 - RNA, 18 nt, Human
uaugauuuggaaaauaaa

SEQ ID NO: 1735961 - RNA, 12 nt, Human
uaugauuuuuaa

SEQ ID NO: 1735962 - RNA, 17 nt, Human
uaugauuuggaaaauaa

SEQ ID NO: 1735963 - RNA, 15 nt, Human
uaugauuuggaaaau

SEQ ID NO: 1735964 - RNA, 17 nt, Human
uaugauuuaauuugaaa

SEQ ID NO: 1735965 - RNA, 18 nt, Human
uaugauuuaauuugaaau

SEQ ID NO: 1735966 - RNA, 23 nt, Human
uaugacuccagaauuucccaaag

SEQ ID NO: 1735967 - RNA, 17 nt, Human
uaugacuccagaauuuc

SEQ ID NO: 1735968 - RNA, 16 nt, Human
uaugacuccagaauuu

SEQ ID NO: 1735969 - RNA, 22 nt, Human
uaugcuuauacacuuacacuuu

SEQ ID NO: 1735970 - RNA, 13 nt, Human
uaugcaugaagua

SEQ ID NO: 1735971 - RNA, 18 nt, Human
uaugcaugaaguaauaug

SEQ ID NO: 1735972 - RNA, 20 nt, Human
uaugcauauuauuuuauguu

SEQ ID NO: 1735973 - RNA, 18 nt, Human
uaugcagagguccacaac

SEQ ID NO: 1735974 - RNA, 18 nt, Human
uaugcuuguaacuaaaau

SEQ ID NO: 1735975 - RNA, 20 nt, Human
uaugcuuguaacuaaaauaa

SEQ ID NO: 1735976 - RNA, 18 nt, Human
uauggaacacucugagac

SEQ ID NO: 1735977 - RNA, 17 nt, Human
uauggaacacucugaga

SEQ ID NO: 1735978 - RNA, 16 nt, Human
uauggaacacucugag

SEQ ID NO: 1735979 - RNA, 13 nt, Human
uauggaacacucu

SEQ ID NO: 1735980 - RNA, 17 nt, Human
uauggacaaugacccag

SEQ ID NO: 1735981 - RNA, 19 nt, Human
uauggaacacucugagacu

SEQ ID NO: 1735982 - RNA, 14 nt, Human
uaucuugaagacuu

SEQ ID NO: 1735983 - RNA, 18 nt, Human
uaugaauaaagacaccua

SEQ ID NO: 1735984 - RNA, 20 nt, Human
uaugaaguuuuuuuuauaca

SEQ ID NO: 1735985 - RNA, 23 nt, Human
uaucugucauuugagcagggcuc

SEQ ID NO: 1735986 - RNA, 21 nt, Human
uaucugucauuugagcagggc

SEQ ID NO: 1735987 - RNA, 20 nt, Human
uaucugucauuugagcaggg

SEQ ID NO: 1735988 - RNA, 22 nt, Human
uaugacacaugcaaggucauuu

SEQ ID NO: 1735989 - RNA, 12 nt, Human
uaugacacaugc

SEQ ID NO: 1735990 - RNA, 19 nt, Human
uaugaccacacuccagcug

SEQ ID NO: 1735991 - RNA, 14 nt, Human
uaugaccacacucc

SEQ ID NO: 1735992 - RNA, 12 nt, Human
uaugaauaacau

SEQ ID NO: 1735993 - RNA, 13 nt, Human
uaugaauacuuug

SEQ ID NO: 1735994 - RNA, 15 nt, Human
uaugaauacuuugca

SEQ ID NO: 1735995 - RNA, 16 nt, Human
uaucgucacugcuuaa

SEQ ID NO: 1735996 - RNA, 21 nt, Human
uaucuaauauguaacaagcca

SEQ ID NO: 1735997 - RNA, 15 nt, Human
uauccuucagccuga

SEQ ID NO: 1735998 - RNA, 14 nt, Human
uauccuucagccug

SEQ ID NO: 1735999 - RNA, 16 nt, Human
uaucuaaauguugaaa

SEQ ID NO: 1736000 - RNA, 18 nt, Human
uaucguaaaauuaagaaa

SEQ ID NO: 1736001 - RNA, 15 nt, Human
uaucguaaaauuaag

SEQ ID NO: 1736002 - RNA, 19 nt, Human
uauauguuuuaagaggcag

SEQ ID NO: 1736003 - RNA, 11 nt, Human
gugcugcccug

SEQ ID NO: 1736004 - RNA, 22 nt, Human
gugcugccauccagguucagcu

SEQ ID NO: 1736005 - RNA, 21 nt, Human
gugcugccacacuucaggcuc

SEQ ID NO: 1736006 - RNA, 15 nt, Human
gugcuuggaggaagg

SEQ ID NO: 1736007 - RNA, 13 nt, Human
gugcuuggaggaa

SEQ ID NO: 1736008 - RNA, 12 nt, Human
gugcuuggagga

SEQ ID NO: 1736009 - RNA, 18 nt, Human
gugcuuauguaugaggua

SEQ ID NO: 1736010 - RNA, 18 nt, Human
guggaaaaauagccugcc

SEQ ID NO: 1736011 - RNA, 21 nt, Human
gugccuuggggacaagagcag

SEQ ID NO: 1736012 - RNA, 22 nt, Human
gugccgagaaggaagccuccca

SEQ ID NO: 1736013 - RNA, 16 nt, Human
gugcucuggacaggca

SEQ ID NO: 1736014 - RNA, 15 nt, Human
gugcucuggacaggc

SEQ ID NO: 1736015 - RNA, 20 nt, Human
gugcugaaugguuuucaaaa

SEQ ID NO: 1736016 - RNA, 19 nt, Human
gugcugaaugguuuucaaa

SEQ ID NO: 1736017 - RNA, 23 nt, Human
gugcugaaugguuuucaaaauaa

SEQ ID NO: 1736018 - RNA, 18 nt, Human
gugcucuggacaggcaug

SEQ ID NO: 1736019 - RNA, 17 nt, Human
gugcucuggacaggcau

SEQ ID NO: 1736020 - RNA, 19 nt, Human
gugcugagucugaaggcug

SEQ ID NO: 1736021 - RNA, 18 nt, Human
gugcugagucugaaggcu

SEQ ID NO: 1736022 - RNA, 17 nt, Human
gugcugagucugaaggc

SEQ ID NO: 1736023 - RNA, 16 nt, Human
gugcugagucugaagg

SEQ ID NO: 1736024 - RNA, 12 nt, Human
gugcugagucug

SEQ ID NO: 1736025 - RNA, 19 nt, Human
gugcugccauccagguuca

SEQ ID NO: 1736026 - RNA, 18 nt, Human
gugcugccauccagguuc

SEQ ID NO: 1736027 - RNA, 15 nt, Human
gugcugccauccagg

SEQ ID NO: 1736028 - RNA, 12 nt, Human
gugcugccacac

SEQ ID NO: 1736029 - RNA, 12 nt, Human
gugcugcauuua

SEQ ID NO: 1736030 - RNA, 19 nt, Human
gugcugcauuuaaaagaua

SEQ ID NO: 1736031 - RNA, 20 nt, Human
gugcugcauuuaaaagauac

SEQ ID NO: 1736032 - RNA, 17 nt, Human
guggaguucaucuugaa

SEQ ID NO: 1736033 - RNA, 18 nt, Human
guggaugccugguggcag

SEQ ID NO: 1736034 - RNA, 16 nt, Human
guggaugccugguggc

SEQ ID NO: 1736035 - RNA, 20 nt, Human
guggagaagcggcuggcagc

SEQ ID NO: 1736036 - RNA, 13 nt, Human
guggacuuuuauu

SEQ ID NO: 1736037 - RNA, 22 nt, Human
guggaacguuuuuccuguucuu

SEQ ID NO: 1736038 - RNA, 18 nt, Human
guggagaggcccggccuc

SEQ ID NO: 1736039 - RNA, 19 nt, Human
guggcagcugcuuuugucu

SEQ ID NO: 1736040 - RNA, 13 nt, Human
guggcagcugcuu

SEQ ID NO: 1736041 - RNA, 12 nt, Human
guggcagcugcu

SEQ ID NO: 1736042 - RNA, 23 nt, Human
guggcagcugcgguccacccagg

SEQ ID NO: 1736043 - RNA, 22 nt, Human
guggcagcugcgguccacccag

SEQ ID NO: 1736044 - RNA, 21 nt, Human
guggcagcugcgguccaccca

SEQ ID NO: 1736045 - RNA, 20 nt, Human
guggaugccugguggcagcu

SEQ ID NO: 1736046 - RNA, 17 nt, Human
guggcagugggagcugc

SEQ ID NO: 1736047 - RNA, 16 nt, Human
guggcagugggagcug

SEQ ID NO: 1736048 - RNA, 15 nt, Human
guggcagugggagcu

SEQ ID NO: 1736049 - RNA, 11 nt, Human
guggcagucug

SEQ ID NO: 1736050 - RNA, 21 nt, Human
guggcagugggagcugccugu

SEQ ID NO: 1736051 - RNA, 19 nt, Human
guggcagugggagcugccu

SEQ ID NO: 1736052 - RNA, 14 nt, Human
guggccaaguucuu

SEQ ID NO: 1736053 - RNA, 21 nt, Human
guggccacuccagaccccugg

SEQ ID NO: 1736054 - RNA, 14 nt, Human
gugagcuacaaaug

SEQ ID NO: 1736055 - RNA, 14 nt, Human
gugagccacugcac

SEQ ID NO: 1736056 - RNA, 22 nt, Human
gugagccaccgugccuggccac

SEQ ID NO: 1736057 - RNA, 16 nt, Human
gugagcuccuaagcca

SEQ ID NO: 1736058 - RNA, 19 nt, Human
gugaggaagccgcuggggc

SEQ ID NO: 1736059 - RNA, 16 nt, Human
gugaggaagccgcugg

SEQ ID NO: 1736060 - RNA, 11 nt, Human
gugaggaagcc

SEQ ID NO: 1736061 - RNA, 17 nt, Human
gugagcaggcugugagu

SEQ ID NO: 1736062 - RNA, 17 nt, Human
gugacugaucucucgug

SEQ ID NO: 1736063 - RNA, 13 nt, Human
gugagccacugca

SEQ ID NO: 1736064 - RNA, 21 nt, Human
gugagccaccgugccuggcca

SEQ ID NO: 1736065 - RNA, 17 nt, Human
gugagccaccgugccug

SEQ ID NO: 1736066 - RNA, 15 nt, Human
gugagccaccacgcc

SEQ ID NO: 1736067 - RNA, 15 nt, Human
gugagccaccgugcc

SEQ ID NO: 1736068 - RNA, 16 nt, Human
gugagccaccacgccc

SEQ ID NO: 1736069 - RNA, 16 nt, Human
gugacaacacuugugu

SEQ ID NO: 1736070 - RNA, 16 nt, Human
gugaccucagcuuuga

SEQ ID NO: 1736071 - RNA, 16 nt, Human
gugacugaauuucuuu

SEQ ID NO: 1736072 - RNA, 18 nt, Human
gugacugaauuucuuuug

SEQ ID NO: 1736073 - RNA, 15 nt, Human
gugacugaauuucuu

SEQ ID NO: 1736074 - RNA, 19 nt, Human
gugaaagaaaauaacaaua

SEQ ID NO: 1736075 - RNA, 12 nt, Human
gugaaacuggau

SEQ ID NO: 1736076 - RNA, 16 nt, Human
gugaaaaugugugugu

SEQ ID NO: 1736077 - RNA, 23 nt, Human
gugaaaagaaaaaugagccuggc

SEQ ID NO: 1736078 - RNA, 14 nt, Human
gugaaaagaaaaau

SEQ ID NO: 1736079 - RNA, 12 nt, Human
gugaaaagaaua

SEQ ID NO: 1736080 - RNA, 14 nt, Human
gugaaucagagcac

SEQ ID NO: 1736081 - RNA, 18 nt, Human
gugaaucacguaaagcua

SEQ ID NO: 1736082 - RNA, 16 nt, Human
gugaaucacguaaagc

SEQ ID NO: 1736083 - RNA, 19 nt, Human
gugaaaggaaagagggagg

SEQ ID NO: 1736084 - RNA, 13 nt, Human
gugaaaucauuca

SEQ ID NO: 1736085 - RNA, 20 nt, Human
gugaaauuauucauaauuau

SEQ ID NO: 1736086 - RNA, 18 nt, Human
gugaaauuauucauaauu

SEQ ID NO: 1736087 - RNA, 22 nt, Human
gugcaaaguucccuacuuccug

SEQ ID NO: 1736088 - RNA, 19 nt, Human
gugcauaaguuaacuucca

SEQ ID NO: 1736089 - RNA, 22 nt, Human
gugccagguuuuuggucugacc

SEQ ID NO: 1736090 - RNA, 20 nt, Human
gugccagguuuuuggucuga

SEQ ID NO: 1736091 - RNA, 18 nt, Human
gugcaucucagcccacau

SEQ ID NO: 1736092 - RNA, 18 nt, Human
gugcaugcagcaucuaag

SEQ ID NO: 1736093 - RNA, 13 nt, Human
gugcauaccacuu

SEQ ID NO: 1736094 - RNA, 14 nt, Human
gugcauaccacuuu

SEQ ID NO: 1736095 - RNA, 21 nt, Human
gugcauaccacuuuuguucuu

SEQ ID NO: 1736096 - RNA, 15 nt, Human
gugcaucucagccca

SEQ ID NO: 1736097 - RNA, 20 nt, Human
gugcccacaggaucagucug

SEQ ID NO: 1736098 - RNA, 23 nt, Human
gugcccaagaauagaugcugacu

SEQ ID NO: 1736099 - RNA, 20 nt, Human
gugauccacccaccucagcc

SEQ ID NO: 1736100 - RNA, 18 nt, Human
gugauccacccaccucag

SEQ ID NO: 1736101 - RNA, 15 nt, Human
gugauccacccaccu

SEQ ID NO: 1736102 - RNA, 13 nt, Human
gugaggccagaga

SEQ ID NO: 1736103 - RNA, 11 nt, Human
gugaggccaga

SEQ ID NO: 1736104 - RNA, 23 nt, Human
gugaggauuaaauaauguaaaua

SEQ ID NO: 1736105 - RNA, 18 nt, Human
gugauccucccaccucag

SEQ ID NO: 1736106 - RNA, 15 nt, Human
gugauccucccaccu

SEQ ID NO: 1736107 - RNA, 14 nt, Human
gugauccucccacc

SEQ ID NO: 1736108 - RNA, 22 nt, Human
gugauccacccaccucagccuc

SEQ ID NO: 1736109 - RNA, 14 nt, Human
gugauccacucgcc

SEQ ID NO: 1736110 - RNA, 22 nt, Human
gugauccucccaccucagccuc

SEQ ID NO: 1736111 - RNA, 20 nt, Human
gugauccucccaccucagcc

SEQ ID NO: 1736112 - RNA, 23 nt, Human
gugauccucccaccucagccucc

SEQ ID NO: 1736113 - RNA, 20 nt, Human
gugauucacagugugaaucu

SEQ ID NO: 1736114 - RNA, 23 nt, Human
gugauucuccugccucagccucc

SEQ ID NO: 1736115 - RNA, 13 nt, Human
gugauucuccugc

SEQ ID NO: 1736116 - RNA, 16 nt, Human
gugauuuugcuguaga

SEQ ID NO: 1736117 - RNA, 22 nt, Human
gugauucuccugccucagccuc

SEQ ID NO: 1736118 - RNA, 20 nt, Human
gugauucuccugccucagcc

SEQ ID NO: 1736119 - RNA, 19 nt, Human
gugauucuccugccucagc

SEQ ID NO: 1736120 - RNA, 18 nt, Human
gugauucuccugccucag

SEQ ID NO: 1736121 - RNA, 17 nt, Human
gugauucuccugccuca

SEQ ID NO: 1736122 - RNA, 16 nt, Human
gugauucuccugccuc

SEQ ID NO: 1736123 - RNA, 14 nt, Human
gugauucuccugcc

SEQ ID NO: 1736124 - RNA, 20 nt, Human
gugauucucaugccucagcc

SEQ ID NO: 1736125 - RNA, 15 nt, Human
gucuacacugugcug

SEQ ID NO: 1736126 - RNA, 17 nt, Human
guccuuaccagcagagc

SEQ ID NO: 1736127 - RNA, 16 nt, Human
guccuuaccagcagag

SEQ ID NO: 1736128 - RNA, 15 nt, Human
guccuuaccagcaga

SEQ ID NO: 1736129 - RNA, 23 nt, Human
gucguuaaaaacagauuuggaaa

SEQ ID NO: 1736130 - RNA, 23 nt, Human
gucucacuguugcccaggcuggc

SEQ ID NO: 1736131 - RNA, 22 nt, Human
gucucacuguugcccaggcugg

SEQ ID NO: 1736132 - RNA, 21 nt, Human
gucucacuguugcccaggcug

SEQ ID NO: 1736133 - RNA, 20 nt, Human
gucucacuguugcccaggcu

SEQ ID NO: 1736134 - RNA, 19 nt, Human
gucucacuguugcccaggc

SEQ ID NO: 1736135 - RNA, 18 nt, Human
gucucacuguugcccagg

SEQ ID NO: 1736136 - RNA, 17 nt, Human
gucucacuguugcccag

SEQ ID NO: 1736137 - RNA, 16 nt, Human
gucucacuguugccca

SEQ ID NO: 1736138 - RNA, 23 nt, Human
gucucacuauguugcccaggcag

SEQ ID NO: 1736139 - RNA, 13 nt, Human
gucucacuguugc

SEQ ID NO: 1736140 - RNA, 21 nt, Human
gucucacuauguugcccaggc

SEQ ID NO: 1736141 - RNA, 20 nt, Human
gucucacuauguugcccagg

SEQ ID NO: 1736142 - RNA, 21 nt, Human
gucugaggaauccagacccgg

SEQ ID NO: 1736143 - RNA, 19 nt, Human
gucugauucccaagcucug

SEQ ID NO: 1736144 - RNA, 18 nt, Human
gucugauucccaagcucu

SEQ ID NO: 1736145 - RNA, 17 nt, Human
gucugauucccaagcuc

SEQ ID NO: 1736146 - RNA, 21 nt, Human
gucugauucccaagcucugcu

SEQ ID NO: 1736147 - RNA, 20 nt, Human
gucugauucccaagcucugc

SEQ ID NO: 1736148 - RNA, 19 nt, Human
gucugaggaauccagaccc

SEQ ID NO: 1736149 - RNA, 18 nt, Human
gucugaggaauccagacc

SEQ ID NO: 1736150 - RNA, 15 nt, Human
gucugacccacugcu

SEQ ID NO: 1736151 - RNA, 17 nt, Human
gucucuucuccacugga

SEQ ID NO: 1736152 - RNA, 14 nt, Human
gucugacccacugc

SEQ ID NO: 1736153 - RNA, 13 nt, Human
gucugacccacug

SEQ ID NO: 1736154 - RNA, 14 nt, Human
gucucuucuccacu

SEQ ID NO: 1736155 - RNA, 16 nt, Human
gucucuucuccacugg

SEQ ID NO: 1736156 - RNA, 15 nt, Human
gucucuucuccacug

SEQ ID NO: 1736157 - RNA, 13 nt, Human
gucucgugguagg

SEQ ID NO: 1736158 - RNA, 12 nt, Human
gucccagugccg

SEQ ID NO: 1736159 - RNA, 17 nt, Human
gucccugguggcagcuc

SEQ ID NO: 1736160 - RNA, 16 nt, Human
gucccugguggcagcu

SEQ ID NO: 1736161 - RNA, 23 nt, Human
guccuacucugugucaggugggg

SEQ ID NO: 1736162 - RNA, 15 nt, Human
guccuacucuguguc

SEQ ID NO: 1736163 - RNA, 23 nt, Human
guccuagaaauuccccacccuga

SEQ ID NO: 1736164 - RNA, 20 nt, Human
guccuggggaaccugacccc

SEQ ID NO: 1736165 - RNA, 19 nt, Human
guccuggggaaccugaccc

SEQ ID NO: 1736166 - RNA, 18 nt, Human
guccugggagugagcugg

SEQ ID NO: 1736167 - RNA, 17 nt, Human
guccugggagugagcug

SEQ ID NO: 1736168 - RNA, 19 nt, Human
guccugggagugagcuggu

SEQ ID NO: 1736169 - RNA, 17 nt, Human
guccuggcaugggaaug

SEQ ID NO: 1736170 - RNA, 16 nt, Human
guccugggagugagcu

SEQ ID NO: 1736171 - RNA, 15 nt, Human
guccugggagugagc

SEQ ID NO: 1736172 - RNA, 23 nt, Human
guccucccaucucacacaugagc

SEQ ID NO: 1736173 - RNA, 14 nt, Human
guccucccaucuca

SEQ ID NO: 1736174 - RNA, 13 nt, Human
guccucccaucuc

SEQ ID NO: 1736175 - RNA, 12 nt, Human
guccucccaucu

SEQ ID NO: 1736176 - RNA, 21 nt, Human
gucaagaauagcauuguaaaa

SEQ ID NO: 1736177 - RNA, 18 nt, Human
gucaagugaaaaaggagg

SEQ ID NO: 1736178 - RNA, 16 nt, Human
gucaagugaaaaagga

SEQ ID NO: 1736179 - RNA, 19 nt, Human
gucaagugaaaaaggagga

SEQ ID NO: 1736180 - RNA, 19 nt, Human
gucaagagggucugaggaa

SEQ ID NO: 1736181 - RNA, 18 nt, Human
gucaagagggucugagga

SEQ ID NO: 1736182 - RNA, 20 nt, Human
gucaccugaagacucauucu

SEQ ID NO: 1736183 - RNA, 15 nt, Human
gucaccccggccacc

SEQ ID NO: 1736184 - RNA, 13 nt, Human
gucaccccggcca

SEQ ID NO: 1736185 - RNA, 15 nt, Human
gucaauuacaggaag

SEQ ID NO: 1736186 - RNA, 13 nt, Human
gucaauuacagga

SEQ ID NO: 1736187 - RNA, 16 nt, Human
gucaauuacaggaagu

SEQ ID NO: 1736188 - RNA, 19 nt, Human
guauuuauuuaguauuuau

SEQ ID NO: 1736189 - RNA, 14 nt, Human
guauuauaccuuuu

SEQ ID NO: 1736190 - RNA, 15 nt, Human
guauuauguguguuu

SEQ ID NO: 1736191 - RNA, 15 nt, Human
guauuacuucugcua

SEQ ID NO: 1736192 - RNA, 14 nt, Human
guauuacuucugcu

SEQ ID NO: 1736193 - RNA, 13 nt, Human
guauuacuucugc

SEQ ID NO: 1736194 - RNA, 13 nt, Human
guagagugggagc

SEQ ID NO: 1736195 - RNA, 15 nt, Human
guagagugggagcug

SEQ ID NO: 1736196 - RNA, 17 nt, Human
gucccagauacuugggg

SEQ ID NO: 1736197 - RNA, 15 nt, Human
gucccacucagucca

SEQ ID NO: 1736198 - RNA, 14 nt, Human
gucccacucagucc

SEQ ID NO: 1736199 - RNA, 16 nt, Human
guccacccaggagccc

SEQ ID NO: 1736200 - RNA, 15 nt, Human
guccacccaggagcc

SEQ ID NO: 1736201 - RNA, 14 nt, Human
guccacccaggagc

SEQ ID NO: 1736202 - RNA, 21 nt, Human
gucauauaagauucauauuua

SEQ ID NO: 1736203 - RNA, 16 nt, Human
gucaucucagcuggau

SEQ ID NO: 1736204 - RNA, 22 nt, Human
gucauaacuagaacugaauuuu

SEQ ID NO: 1736205 - RNA, 17 nt, Human
gucauaacuagaacuga

SEQ ID NO: 1736206 - RNA, 17 nt, Human
ggggaucacagccucug

SEQ ID NO: 1736207 - RNA, 21 nt, Human
gggcuuggggaccagagcugc

SEQ ID NO: 1736208 - RNA, 22 nt, Human
gggcuuggggaccagagcugcc

SEQ ID NO: 1736209 - RNA, 13 nt, Human
ggggaguggccac

SEQ ID NO: 1736210 - RNA, 18 nt, Human
gggcuucaguggcagcug

SEQ ID NO: 1736211 - RNA, 17 nt, Human
gggcuucaguggcagcu

SEQ ID NO: 1736212 - RNA, 16 nt, Human
gggcuucaguggcagc

SEQ ID NO: 1736213 - RNA, 15 nt, Human
gggcuucaguggcag

SEQ ID NO: 1736214 - RNA, 20 nt, Human
gggcuucaguggcagcugcu

SEQ ID NO: 1736215 - RNA, 19 nt, Human
gggcuucaguggcagcugc

SEQ ID NO: 1736216 - RNA, 19 nt, Human
gggcuucauccuccucaga

SEQ ID NO: 1736217 - RNA, 20 nt, Human
gggcuuggggaccagagcug

SEQ ID NO: 1736218 - RNA, 20 nt, Human
gggcuucauccuccucagau

SEQ ID NO: 1736219 - RNA, 23 nt, Human
gggguucccuuuuuuggcugcug

SEQ ID NO: 1736220 - RNA, 22 nt, Human
gggguucuuucuuccucugcug

SEQ ID NO: 1736221 - RNA, 20 nt, Human
gggguucuuucuuccucugc

SEQ ID NO: 1736222 - RNA, 23 nt, Human
ggguagagcggagaaaggaaggg

SEQ ID NO: 1736223 - RNA, 23 nt, Human
ggguacuuguggacacagcucuu

SEQ ID NO: 1736224 - RNA, 22 nt, Human
ggguacuuguggacacagcucu

SEQ ID NO: 1736225 - RNA, 19 nt, Human
ggguacuuguggacacagc

SEQ ID NO: 1736226 - RNA, 15 nt, Human
ggguacccacugcuc

SEQ ID NO: 1736227 - RNA, 13 nt, Human
ggguacccacugc

SEQ ID NO: 1736228 - RNA, 18 nt, Human
ggguacccacugcucugg

SEQ ID NO: 1736229 - RNA, 17 nt, Human
ggggcugggcagaggaa

SEQ ID NO: 1736230 - RNA, 16 nt, Human
ggggcugggcagagga

SEQ ID NO: 1736231 - RNA, 13 nt, Human
ggggcugggacau

SEQ ID NO: 1736232 - RNA, 14 nt, Human
ggggcugccagggg

SEQ ID NO: 1736233 - RNA, 21 nt, Human
ggcucccacaggcccuuccuc

SEQ ID NO: 1736234 - RNA, 20 nt, Human
ggcucccacaggcccuuccu

SEQ ID NO: 1736235 - RNA, 12 nt, Human
gggccuggcuca

SEQ ID NO: 1736236 - RNA, 12 nt, Human
gggccuggccug

SEQ ID NO: 1736237 - RNA, 22 nt, Human
gggccuggcagccgugccuuca

SEQ ID NO: 1736238 - RNA, 10 nt, Human
gggccuggca

SEQ ID NO: 1736239 - RNA, 16 nt, Human
gggccuggcucaggug

SEQ ID NO: 1736240 - RNA, 14 nt, Human
gggccuggcucagg

SEQ ID NO: 1736241 - RNA, 18 nt, Human
gggccuggucguuuucaa

SEQ ID NO: 1736242 - RNA, 23 nt, Human
gggcucccuucccaccucucuca

SEQ ID NO: 1736243 - RNA, 18 nt, Human
gggcucccuucccaccuc

SEQ ID NO: 1736244 - RNA, 17 nt, Human
gggcucccuucccaccu

SEQ ID NO: 1736245 - RNA, 14 nt, Human
gggcucccuuccca

SEQ ID NO: 1736246 - RNA, 13 nt, Human
gggcucccuuccc

SEQ ID NO: 1736247 - RNA, 16 nt, Human
gggcgcgguggcucac

SEQ ID NO: 1736248 - RNA, 14 nt, Human
gggcugcaccggcu

SEQ ID NO: 1736249 - RNA, 16 nt, Human
gggcugaggugggagg

SEQ ID NO: 1736250 - RNA, 17 nt, Human
gggcugcaccggcuggc

SEQ ID NO: 1736251 - RNA, 14 nt, Human
gggcuucaguggca

SEQ ID NO: 1736252 - RNA, 20 nt, Human
gggcucugccucccaucacc

SEQ ID NO: 1736253 - RNA, 17 nt, Human
gggcucugccucccauc

SEQ ID NO: 1736254 - RNA, 16 nt, Human
gggcucugccucccau

SEQ ID NO: 1736255 - RNA, 15 nt, Human
gggcucugccuccca

SEQ ID NO: 1736256 - RNA, 13 nt, Human
gggcucugccucc

SEQ ID NO: 1736257 - RNA, 21 nt, Human
gguacuuguggacacagcucu

SEQ ID NO: 1736258 - RNA, 22 nt, Human
gguacuuguggacacagcucuu

SEQ ID NO: 1736259 - RNA, 15 nt, Human
ggguugggcuggugu

SEQ ID NO: 1736260 - RNA, 17 nt, Human
gguacccacugcucugg

SEQ ID NO: 1736261 - RNA, 20 nt, Human
ggguuucaccauguuggcca

SEQ ID NO: 1736262 - RNA, 22 nt, Human
ggguucuacccaggugcuagga

SEQ ID NO: 1736263 - RNA, 23 nt, Human
ggguucccuuuuuuggcugcuga

SEQ ID NO: 1736264 - RNA, 19 nt, Human
ggguuggccccugcccggc

SEQ ID NO: 1736265 - RNA, 14 nt, Human
ggguucuuucuucc

SEQ ID NO: 1736266 - RNA, 16 nt, Human
ggguuggccccugccc

SEQ ID NO: 1736267 - RNA, 19 nt, Human
gggugcugggccccugccu

SEQ ID NO: 1736268 - RNA, 22 nt, Human
ggguuccagcaauucuccugcc

SEQ ID NO: 1736269 - RNA, 16 nt, Human
ggucagagccugcagu

SEQ ID NO: 1736270 - RNA, 15 nt, Human
ggucagagccugcag

SEQ ID NO: 1736271 - RNA, 14 nt, Human
ggucagagccugca

SEQ ID NO: 1736272 - RNA, 13 nt, Human
ggucagagccugc

SEQ ID NO: 1736273 - RNA, 12 nt, Human
ggucagagccug

SEQ ID NO: 1736274 - RNA, 22 nt, Human
ggucacucuggcagcucagaga

SEQ ID NO: 1736275 - RNA, 20 nt, Human
ggucacucuggcagcucaga

SEQ ID NO: 1736276 - RNA, 16 nt, Human
ggucacucuggcagcu

SEQ ID NO: 1736277 - RNA, 23 nt, Human
ggucccccuuccauggacuuugu

SEQ ID NO: 1736278 - RNA, 18 nt, Human
ggucccccuuccauggac

SEQ ID NO: 1736279 - RNA, 13 nt, Human
ggucccccuucca

SEQ ID NO: 1736280 - RNA, 14 nt, Human
ggucccacucaguc

SEQ ID NO: 1736281 - RNA, 12 nt, Human
ggucccacucag

SEQ ID NO: 1736282 - RNA, 22 nt, Human
ggucccacucaguccauagcag

SEQ ID NO: 1736283 - RNA, 22 nt, Human
ggucccaccccacacacgccag

SEQ ID NO: 1736284 - RNA, 22 nt, Human
ggugcuaucucccccagcccca

SEQ ID NO: 1736285 - RNA, 23 nt, Human
ggugcuaucucccccagccccau

SEQ ID NO: 1736286 - RNA, 13 nt, Human
gguggcagcugcg

SEQ ID NO: 1736287 - RNA, 12 nt, Human
gguggcagcugc

SEQ ID NO: 1736288 - RNA, 11 nt, Human
gguggcagcug

SEQ ID NO: 1736289 - RNA, 13 nt, Human
gguggcagcucac

SEQ ID NO: 1736290 - RNA, 23 nt, Human
gguggcagcugcgguccacccag

SEQ ID NO: 1736291 - RNA, 15 nt, Human
gguggcagcugcggu

SEQ ID NO: 1736292 - RNA, 16 nt, Human
gguggcagugggagcu

SEQ ID NO: 1736293 - RNA, 22 nt, Human
ggugauagguauaaguggugug

SEQ ID NO: 1736294 - RNA, 21 nt, Human
ggugaccucugccugaaguca

SEQ ID NO: 1736295 - RNA, 16 nt, Human
ggugaccucugccuga

SEQ ID NO: 1736296 - RNA, 14 nt, Human
ggugaccucugccu

SEQ ID NO: 1736297 - RNA, 21 nt, Human
ggugacagagugagacucugu

SEQ ID NO: 1736298 - RNA, 18 nt, Human
ggugaagugaagacaaug

SEQ ID NO: 1736299 - RNA, 16 nt, Human
ggugaacuugguuccc

SEQ ID NO: 1736300 - RNA, 19 nt, Human
ggucugaggaauccagacc

SEQ ID NO: 1736301 - RNA, 14 nt, Human
ggugaacauugcaa

SEQ ID NO: 1736302 - RNA, 16 nt, Human
ggucugacccacugcu

SEQ ID NO: 1736303 - RNA, 15 nt, Human
ggucugacccacugc

SEQ ID NO: 1736304 - RNA, 20 nt, Human
ggucucgaacuccugaccuu

SEQ ID NO: 1736305 - RNA, 19 nt, Human
ggucucgaacuccugaccu

SEQ ID NO: 1736306 - RNA, 16 nt, Human
ggucucacucugucgc

SEQ ID NO: 1736307 - RNA, 12 nt, Human
ggucucacucug

SEQ ID NO: 1736308 - RNA, 22 nt, Human
ggucucacuauguugcccaggc

SEQ ID NO: 1736309 - RNA, 23 nt, Human
gguccuagaaauuccccacccug

SEQ ID NO: 1736310 - RNA, 22 nt, Human
ggucccugguggcagcucaccu

SEQ ID NO: 1736311 - RNA, 14 nt, Human
ggucccugguggca

SEQ ID NO: 1736312 - RNA, 18 nt, Human
ggucccuaauaaagcugu

SEQ ID NO: 1736313 - RNA, 17 nt, Human
ggucccuaauaaagcug

SEQ ID NO: 1736314 - RNA, 16 nt, Human
ggucccuaauaaagcu

SEQ ID NO: 1736315 - RNA, 13 nt, Human
ggucccuaauaaa

SEQ ID NO: 1736316 - RNA, 12 nt, Human
ggucccuaauaa

SEQ ID NO: 1736317 - RNA, 23 nt, Human
gguuuugccauguuggccaggcu

SEQ ID NO: 1736318 - RNA, 12 nt, Human
gguuuucuguuc

SEQ ID NO: 1736319 - RNA, 13 nt, Human
gguuuucuguucu

SEQ ID NO: 1736320 - RNA, 15 nt, Human
gguuuucuguucuuu

SEQ ID NO: 1736321 - RNA, 15 nt, Human
guaaaagacuuuuuu

SEQ ID NO: 1736322 - RNA, 20 nt, Human
guaaaaacaaagaaauuaug

SEQ ID NO: 1736323 - RNA, 18 nt, Human
guaaaaacaaagaaauua

SEQ ID NO: 1736324 - RNA, 14 nt, Human
guaaaaauaaaauu

SEQ ID NO: 1736325 - RNA, 13 nt, Human
guaaaaauaaaau

SEQ ID NO: 1736326 - RNA, 21 nt, Human
gguucaagcgauucuucugcu

SEQ ID NO: 1736327 - RNA, 17 nt, Human
gguggccucccaacuca

SEQ ID NO: 1736328 - RNA, 13 nt, Human
gguggccucccaa

SEQ ID NO: 1736329 - RNA, 20 nt, Human
gguggcccgacagccuggca

SEQ ID NO: 1736330 - RNA, 19 nt, Human
gguggcccgacagccuggc

SEQ ID NO: 1736331 - RNA, 18 nt, Human
gguggcccgacagccugg

SEQ ID NO: 1736332 - RNA, 17 nt, Human
gguggcccgacagccug

SEQ ID NO: 1736333 - RNA, 16 nt, Human
gguggcccgacagccu

SEQ ID NO: 1736334 - RNA, 14 nt, Human
gguugaagcaccaa

SEQ ID NO: 1736335 - RNA, 18 nt, Human
gguucuuucuuccucugc

SEQ ID NO: 1736336 - RNA, 17 nt, Human
gguucuuucuuccucug

SEQ ID NO: 1736337 - RNA, 12 nt, Human
gguucagcuugu

SEQ ID NO: 1736338 - RNA, 23 nt, Human
gguucaagcgauucuucugcuuc

SEQ ID NO: 1736339 - RNA, 22 nt, Human
gguucaagcgauucuucugcuu

SEQ ID NO: 1736340 - RNA, 20 nt, Human
gguucacugcaaccuccgcc

SEQ ID NO: 1736341 - RNA, 13 nt, Human
gguuuaagcuguu

SEQ ID NO: 1736342 - RNA, 13 nt, Human
gguuggugggggc

SEQ ID NO: 1736343 - RNA, 18 nt, Human
gguuggcaaaaaggcagg

SEQ ID NO: 1736344 - RNA, 14 nt, Human
gguugggcuggugu

SEQ ID NO: 1736345 - RNA, 16 nt, Human
guaaaugguaugucau

SEQ ID NO: 1736346 - RNA, 15 nt, Human
guaaauuaacuuuua

SEQ ID NO: 1736347 - RNA, 16 nt, Human
guaaauuaacuuuuau

SEQ ID NO: 1736348 - RNA, 17 nt, Human
guaaauuaacuuuuaua

SEQ ID NO: 1736349 - RNA, 21 nt, Human
guaaauuaacuuuuauaaacu

SEQ ID NO: 1736350 - RNA, 22 nt, Human
guaaauuaacuuuuauaaacuu

SEQ ID NO: 1736351 - RNA, 18 nt, Human
guaaaugggggugcauuu

SEQ ID NO: 1736352 - RNA, 19 nt, Human
guaaaugggggugcauuug

SEQ ID NO: 1736353 - RNA, 20 nt, Human
guaaaugggggugcauuuga

SEQ ID NO: 1736354 - RNA, 16 nt, Human
guaaaagcauuuugua

SEQ ID NO: 1736355 - RNA, 22 nt, Human
guaaguauucuuauuuaaugaa

SEQ ID NO: 1736356 - RNA, 13 nt, Human
guaaggaaugauu

SEQ ID NO: 1736357 - RNA, 23 nt, Human
guaaggaauaccugucccccuga

SEQ ID NO: 1736358 - RNA, 21 nt, Human
guaaggaauaccugucccccu

SEQ ID NO: 1736359 - RNA, 20 nt, Human
guaaggaauaccuguccccc

SEQ ID NO: 1736360 - RNA, 18 nt, Human
guaaggaauaccuguccc

SEQ ID NO: 1736361 - RNA, 23 nt, Human
guaaauuaacuuuuauaaacuuu

SEQ ID NO: 1736362 - RNA, 19 nt, Human
guaagaucguucucugccu

SEQ ID NO: 1736363 - RNA, 13 nt, Human
guaagaaauacag

SEQ ID NO: 1736364 - RNA, 16 nt, Human
guaagaaauacagacu

SEQ ID NO: 1736365 - RNA, 15 nt, Human
guacccacugcucug

SEQ ID NO: 1736366 - RNA, 20 nt, Human
guacauaaugcgugcauacc

SEQ ID NO: 1736367 - RNA, 12 nt, Human
guacaguuuuua

SEQ ID NO: 1736368 - RNA, 13 nt, Human
guacaguuuuuau

SEQ ID NO: 1736369 - RNA, 16 nt, Human
guacagucuuguauua

SEQ ID NO: 1736370 - RNA, 13 nt, Human
guacagucuugua

SEQ ID NO: 1736371 - RNA, 14 nt, Human
guacagucuuguau

SEQ ID NO: 1736372 - RNA, 20 nt, Human
guacagcaaggagauuuaca

SEQ ID NO: 1736373 - RNA, 22 nt, Human
guacagagcccacgcccccacu

SEQ ID NO: 1736374 - RNA, 18 nt, Human
guacagagcccacgcccc

SEQ ID NO: 1736375 - RNA, 12 nt, Human
guacagagccca

SEQ ID NO: 1736376 - RNA, 19 nt, Human
guacacuguuucaaacuuu

SEQ ID NO: 1736377 - RNA, 20 nt, Human
guacacuguuucaaacuuua

SEQ ID NO: 1736378 - RNA, 21 nt, Human
guacacuguuucaaacuuuac

SEQ ID NO: 1736379 - RNA, 16 nt, Human
guacagacaacaaacc

SEQ ID NO: 1736380 - RNA, 15 nt, Human
guacagacagaaaaa

SEQ ID NO: 1736381 - RNA, 18 nt, Human
guaaugaugucguuugaa

SEQ ID NO: 1736382 - RNA, 19 nt, Human
guaauguaucaaauacauu

SEQ ID NO: 1736383 - RNA, 13 nt, Human
guaaugaaaacca

SEQ ID NO: 1736384 - RNA, 11 nt, Human
guaaugaaaac

SEQ ID NO: 1736385 - RNA, 15 nt, Human
guaaucguguccccu

SEQ ID NO: 1736386 - RNA, 21 nt, Human
guaauuaaguacuauguauca

SEQ ID NO: 1736387 - RNA, 20 nt, Human
guaauuaaguacuauguauc

SEQ ID NO: 1736388 - RNA, 17 nt, Human
guaauuaaguacuaugu

SEQ ID NO: 1736389 - RNA, 14 nt, Human
guaauuaaguacua

SEQ ID NO: 1736390 - RNA, 18 nt, Human
guacacuguuucaaacuu

SEQ ID NO: 1736391 - RNA, 23 nt, Human
guacuuuauuuucuauaauuuaa

SEQ ID NO: 1736392 - RNA, 21 nt, Human
guacuuguggacacagcucuu

SEQ ID NO: 1736393 - RNA, 22 nt, Human
guacuuucauauuuuaaacaga

SEQ ID NO: 1736394 - RNA, 20 nt, Human
guagaaaagggaacugaaca

SEQ ID NO: 1736395 - RNA, 15 nt, Human
guagaggagaaacug

SEQ ID NO: 1736396 - RNA, 16 nt, Human
guagagcggagaaagg

SEQ ID NO: 1736397 - RNA, 19 nt, Human
guacuucuccacccugcuc

SEQ ID NO: 1736398 - RNA, 18 nt, Human
guacuucuccacccugcu

SEQ ID NO: 1736399 - RNA, 17 nt, Human
guacuucuccacccugc

SEQ ID NO: 1736400 - RNA, 16 nt, Human
guacuucuccacccug

SEQ ID NO: 1736401 - RNA, 21 nt, Human
guacuucuccacccugcucuc

SEQ ID NO: 1736402 - RNA, 20 nt, Human
guacuucuccacccugcucu

SEQ ID NO: 1736403 - RNA, 14 nt, Human
guacuugcucuuga

SEQ ID NO: 1736404 - RNA, 20 nt, Human
guacuuguggacacagcucu

SEQ ID NO: 1736405 - RNA, 16 nt, Human
guacuuguggacacag

SEQ ID NO: 1736406 - RNA, 22 nt, Human
guacuugcucuugaugccuggc

SEQ ID NO: 1736407 - RNA, 19 nt, Human
guacuugcucuugaugccu

SEQ ID NO: 1736408 - RNA, 18 nt, Human
guacuugcucuugaugcc

SEQ ID NO: 1736409 - RNA, 16 nt, Human
guacuugcucuugaug

SEQ ID NO: 1736410 - RNA, 15 nt, Human
guacuugcucuugau

SEQ ID NO: 1736411 - RNA, 15 nt, Human
guaccgcaaugugac

SEQ ID NO: 1736412 - RNA, 16 nt, Human
guacccacugcucugg

SEQ ID NO: 1736413 - RNA, 13 nt, Human
guaccucuugagc

SEQ ID NO: 1736414 - RNA, 21 nt, Human
guaccucuugagccuugaacu

SEQ ID NO: 1736415 - RNA, 22 nt, Human
guaccucuugagccuugaacuu

SEQ ID NO: 1736416 - RNA, 15 nt, Human
guacgucugacaggc

SEQ ID NO: 1736417 - RNA, 14 nt, Human
guacgucugacagg

SEQ ID NO: 1736418 - RNA, 17 nt, Human
guacgucugacaggcaa

SEQ ID NO: 1736419 - RNA, 14 nt, Human
guacguugugcauu

SEQ ID NO: 1736420 - RNA, 15 nt, Human
guacguugugcauuu

SEQ ID NO: 1736421 - RNA, 16 nt, Human
guacguugugcauuug

SEQ ID NO: 1736422 - RNA, 23 nt, Human
guacuaaggaaucuuucugcuuu

SEQ ID NO: 1736423 - RNA, 15 nt, Human
guacuaaggaaucuu

SEQ ID NO: 1736424 - RNA, 17 nt, Human
guacguugugcauuugg

SEQ ID NO: 1736425 - RNA, 15 nt, Human
guacuucuccacccu

SEQ ID NO: 1736426 - RNA, 14 nt, Human
guacuucuccaccc

SEQ ID NO: 1736427 - RNA, 17 nt, Human
guacuacaguccuccca

SEQ ID NO: 1736428 - RNA, 17 nt, Human
gcuaagcaaaaugugau

SEQ ID NO: 1736429 - RNA, 23 nt, Human
gcuaagagggagggagggcucca

SEQ ID NO: 1736430 - RNA, 15 nt, Human
gcuacccgggaaggg

SEQ ID NO: 1736431 - RNA, 14 nt, Human
gcuacccgggaagg

SEQ ID NO: 1736432 - RNA, 18 nt, Human
gcuagagguucaaagaua

SEQ ID NO: 1736433 - RNA, 20 nt, Human
gcuacuaugauuuaauuuga

SEQ ID NO: 1736434 - RNA, 22 nt, Human
gcuacuaugauuuaauuugaaa

SEQ ID NO: 1736435 - RNA, 19 nt, Human
gcuagagguucaaagauau

SEQ ID NO: 1736436 - RNA, 21 nt, Human
gcuagagguucaaagauauuu

SEQ ID NO: 1736437 - RNA, 21 nt, Human
gcuacccgggaagggggcugg

SEQ ID NO: 1736438 - RNA, 18 nt, Human
gcuaucucccccagcccc

SEQ ID NO: 1736439 - RNA, 17 nt, Human
gcuaucucccccagccc

SEQ ID NO: 1736440 - RNA, 16 nt, Human
gcuaucucccccagcc

SEQ ID NO: 1736441 - RNA, 22 nt, Human
gcuaucucccccagccccaucc

SEQ ID NO: 1736442 - RNA, 21 nt, Human
gcuaucucccccagccccauc

SEQ ID NO: 1736443 - RNA, 20 nt, Human
gcuaucucccccagccccau

SEQ ID NO: 1736444 - RNA, 19 nt, Human
gcuaucucccccagcccca

SEQ ID NO: 1736445 - RNA, 23 nt, Human
gcuaucucccccagccccauccu

SEQ ID NO: 1736446 - RNA, 22 nt, Human
gcuaagagggagggagggcucc

SEQ ID NO: 1736447 - RNA, 14 nt, Human
gcuaacauggaagu

SEQ ID NO: 1736448 - RNA, 16 nt, Human
gcuaaaugugaaugau

SEQ ID NO: 1736449 - RNA, 13 nt, Human
gcuaaaugugaau

SEQ ID NO: 1736450 - RNA, 23 nt, Human
gcgugagccacugcaccgggcca

SEQ ID NO: 1736451 - RNA, 18 nt, Human
gcgugagccacugcaccg

SEQ ID NO: 1736452 - RNA, 15 nt, Human
gcgugagaccugccc

SEQ ID NO: 1736453 - RNA, 19 nt, Human
gcgguccacccaggagccc

SEQ ID NO: 1736454 - RNA, 18 nt, Human
gcgguccacccaggagcc

SEQ ID NO: 1736455 - RNA, 20 nt, Human
gcgguccacccaggagcccc

SEQ ID NO: 1736456 - RNA, 16 nt, Human
gcgguccacccaggag

SEQ ID NO: 1736457 - RNA, 13 nt, Human
gcggggacagcuc

SEQ ID NO: 1736458 - RNA, 12 nt, Human
gcggggacagcu

SEQ ID NO: 1736459 - RNA, 15 nt, Human
gcgggcuuccuccug

SEQ ID NO: 1736460 - RNA, 23 nt, Human
gccugugagcuaggaauuguguu

SEQ ID NO: 1736461 - RNA, 17 nt, Human
gccugugaacugaacuc

SEQ ID NO: 1736462 - RNA, 14 nt, Human
gcuccaucuccacu

SEQ ID NO: 1736463 - RNA, 24 nt, Human
gcuccaggcuccuuuagcgcccag

SEQ ID NO: 1736464 - RNA, 20 nt, Human
gcuccagcuguucagcuggu

SEQ ID NO: 1736465 - RNA, 23 nt, Human
gcuccaggcuccuuuagcgccca

SEQ ID NO: 1736466 - RNA, 16 nt, Human
gcuccaggcuccuuua

SEQ ID NO: 1736467 - RNA, 13 nt, Human
gcuccaggcuccu

SEQ ID NO: 1736468 - RNA, 11 nt, Human
gcuccagcugu

SEQ ID NO: 1736469 - RNA, 20 nt, Human
gcuccauuuuuagugaaaua

SEQ ID NO: 1736470 - RNA, 19 nt, Human
gcuccaagcucccaggcau

SEQ ID NO: 1736471 - RNA, 18 nt, Human
gcuccaagcucccaggca

SEQ ID NO: 1736472 - RNA, 17 nt, Human
gcuccaagcucccaggc

SEQ ID NO: 1736473 - RNA, 16 nt, Human
gcuccaagcucccagg

SEQ ID NO: 1736474 - RNA, 21 nt, Human
gcuccaagcucccaggcauuc

SEQ ID NO: 1736475 - RNA, 23 nt, Human
gcuccagcuggccgggagccuga

SEQ ID NO: 1736476 - RNA, 17 nt, Human
gcuccagcuggccggga

SEQ ID NO: 1736477 - RNA, 15 nt, Human
gcuccaagcucccag

SEQ ID NO: 1736478 - RNA, 14 nt, Human
gcuccaagcuccca

SEQ ID NO: 1736479 - RNA, 13 nt, Human
gcuccaagcuccc

SEQ ID NO: 1736480 - RNA, 16 nt, Human
gcuccaaaugcagcuu

SEQ ID NO: 1736481 - RNA, 19 nt, Human
gcuccaaacccucgaggcg

SEQ ID NO: 1736482 - RNA, 18 nt, Human
gcucaggugucccugcac

SEQ ID NO: 1736483 - RNA, 22 nt, Human
gcucagcggggacagcuccuuc

SEQ ID NO: 1736484 - RNA, 21 nt, Human
gcucagcggggacagcuccuu

SEQ ID NO: 1736485 - RNA, 20 nt, Human
gcucagcggggacagcuccu

SEQ ID NO: 1736486 - RNA, 16 nt, Human
gcucagcggggacagc

SEQ ID NO: 1736487 - RNA, 15 nt, Human
gcucagcggggacag

SEQ ID NO: 1736488 - RNA, 19 nt, Human
gcucaggugucccugcacu

SEQ ID NO: 1736489 - RNA, 16 nt, Human
gcuccaaacccucgag

SEQ ID NO: 1736490 - RNA, 18 nt, Human
gcuccaaacccucgaggc

SEQ ID NO: 1736491 - RNA, 17 nt, Human
gcuccaaacccucgagg

SEQ ID NO: 1736492 - RNA, 23 nt, Human
gcucagcaaaagaugcuucucac

SEQ ID NO: 1736493 - RNA, 22 nt, Human
gcucagcaaaagaugcuucuca

SEQ ID NO: 1736494 - RNA, 20 nt, Human
gcucagcaaaagaugcuucu

SEQ ID NO: 1736495 - RNA, 17 nt, Human
gcucagcaaaagaugcu

SEQ ID NO: 1736496 - RNA, 19 nt, Human
gcucaccagccccagugcc

SEQ ID NO: 1736497 - RNA, 23 nt, Human
gcucaccagccccagugcccaca

SEQ ID NO: 1736498 - RNA, 20 nt, Human
gcucaccagccccagugccc

SEQ ID NO: 1736499 - RNA, 11 nt, Human
gcucucuggcc

SEQ ID NO: 1736500 - RNA, 12 nt, Human
gcucucuggccu

SEQ ID NO: 1736501 - RNA, 13 nt, Human
gcucucuggccuu

SEQ ID NO: 1736502 - RNA, 17 nt, Human
gcucuccgaccagacac

SEQ ID NO: 1736503 - RNA, 13 nt, Human
gcucuccgaccag

SEQ ID NO: 1736504 - RNA, 19 nt, Human
gcucuccgaccagacaccu

SEQ ID NO: 1736505 - RNA, 15 nt, Human
gcucuccucuugcca

SEQ ID NO: 1736506 - RNA, 22 nt, Human
gcucuccucuugccacugccuc

SEQ ID NO: 1736507 - RNA, 19 nt, Human
gcucuccucuugccacugc

SEQ ID NO: 1736508 - RNA, 17 nt, Human
gcucgagcaugccugga

SEQ ID NO: 1736509 - RNA, 16 nt, Human
gcucgagcaugccugg

SEQ ID NO: 1736510 - RNA, 21 nt, Human
gcuccuucuguccuacucugu

SEQ ID NO: 1736511 - RNA, 19 nt, Human
gcucccuucccaccucucu

SEQ ID NO: 1736512 - RNA, 18 nt, Human
gcucccuucccaccucuc

SEQ ID NO: 1736513 - RNA, 16 nt, Human
gcucccuucccaccuc

SEQ ID NO: 1736514 - RNA, 15 nt, Human
gcucccuucccaccu

SEQ ID NO: 1736515 - RNA, 14 nt, Human
gcucucuggccuuc

SEQ ID NO: 1736516 - RNA, 15 nt, Human
gcucucuggccuucg

SEQ ID NO: 1736517 - RNA, 19 nt, Human
gcucucuggccuucggccu

SEQ ID NO: 1736518 - RNA, 20 nt, Human
gcucucuggccuucggccuc

SEQ ID NO: 1736519 - RNA, 11 nt, Human
gcucugccucc

SEQ ID NO: 1736520 - RNA, 23 nt, Human
gcucugcccuugguuaggcauug

SEQ ID NO: 1736521 - RNA, 14 nt, Human
gcucugcccuuggu

SEQ ID NO: 1736522 - RNA, 14 nt, Human
gcucugcuccucuc

SEQ ID NO: 1736523 - RNA, 13 nt, Human
gcucugcuccucu

SEQ ID NO: 1736524 - RNA, 22 nt, Human
gcucugccucccaucacccgcu

SEQ ID NO: 1736525 - RNA, 15 nt, Human
gcucugccucccauc

SEQ ID NO: 1736526 - RNA, 14 nt, Human
gcucugccucccau

SEQ ID NO: 1736527 - RNA, 13 nt, Human
gcucugccuccca

SEQ ID NO: 1736528 - RNA, 23 nt, Human
gcucugcugacagacacaggccc

SEQ ID NO: 1736529 - RNA, 20 nt, Human
gcucugcugacagacacagg

SEQ ID NO: 1736530 - RNA, 19 nt, Human
gcucugcugacagacacag

SEQ ID NO: 1736531 - RNA, 18 nt, Human
gcucugcugacagacaca

SEQ ID NO: 1736532 - RNA, 14 nt, Human
gcucugcugacaga

SEQ ID NO: 1736533 - RNA, 13 nt, Human
gcucugcugacag

SEQ ID NO: 1736534 - RNA, 21 nt, Human
gcucugcuccucuccccagca

SEQ ID NO: 1736535 - RNA, 19 nt, Human
gcucugcuccucuccccag

SEQ ID NO: 1736536 - RNA, 22 nt, Human
gcucuggacaggcauguucucu

SEQ ID NO: 1736537 - RNA, 21 nt, Human
gcucuggacaggcauguucuc

SEQ ID NO: 1736538 - RNA, 16 nt, Human
gcucuggacaggcaug

SEQ ID NO: 1736539 - RNA, 15 nt, Human
gcucuggacaggcau

SEQ ID NO: 1736540 - RNA, 14 nt, Human
gcucuggacaggca

SEQ ID NO: 1736541 - RNA, 22 nt, Human
gcucugcuccccuaaagccuca

SEQ ID NO: 1736542 - RNA, 12 nt, Human
gcucuucuccag

SEQ ID NO: 1736543 - RNA, 22 nt, Human
gcucuuccaggcugggagagcc

SEQ ID NO: 1736544 - RNA, 18 nt, Human
gcucuuccaggcugggag

SEQ ID NO: 1736545 - RNA, 19 nt, Human
gcucuuccaggcugggaga

SEQ ID NO: 1736546 - RNA, 16 nt, Human
gcucuucuccaggcug

SEQ ID NO: 1736547 - RNA, 14 nt, Human
gcucuucuccaggc

SEQ ID NO: 1736548 - RNA, 13 nt, Human
gcucuucuccuuu

SEQ ID NO: 1736549 - RNA, 21 nt, Human
gcucuucuccuuucacaaccu

SEQ ID NO: 1736550 - RNA, 17 nt, Human
gcucuucuccuuucaca

SEQ ID NO: 1736551 - RNA, 16 nt, Human
gcucuugaugccuggc

SEQ ID NO: 1736552 - RNA, 15 nt, Human
gcucuugaugccugg

SEQ ID NO: 1736553 - RNA, 14 nt, Human
gcucuugaugccug

SEQ ID NO: 1736554 - RNA, 23 nt, Human
gcucuucuccuuucacaaccuuc

SEQ ID NO: 1736555 - RNA, 21 nt, Human
gcugacagacacaggcccggc

SEQ ID NO: 1736556 - RNA, 17 nt, Human
gcugacagacagcccuc

SEQ ID NO: 1736557 - RNA, 17 nt, Human
gcucuugaugccuggcg

SEQ ID NO: 1736558 - RNA, 19 nt, Human
gcugacuguacuccuccca

SEQ ID NO: 1736559 - RNA, 18 nt, Human
gcugacuguacuccuccc

SEQ ID NO: 1736560 - RNA, 21 nt, Human
gcugauggugcaaugaccuuu

SEQ ID NO: 1736561 - RNA, 18 nt, Human
gcugauggugcaaugacc

SEQ ID NO: 1736562 - RNA, 20 nt, Human
gcugcaguugccagucaccc

SEQ ID NO: 1736563 - RNA, 18 nt, Human
gcugcaguugccagucac

SEQ ID NO: 1736564 - RNA, 21 nt, Human
gcugcaguugccagucacccc

SEQ ID NO: 1736565 - RNA, 17 nt, Human
gcugcauuuaaaagaua

SEQ ID NO: 1736566 - RNA, 19 nt, Human
gcugagucugaaggcuggg

SEQ ID NO: 1736567 - RNA, 18 nt, Human
gcugagucugaaggcugg

SEQ ID NO: 1736568 - RNA, 16 nt, Human
gcugagucugaaggcu

SEQ ID NO: 1736569 - RNA, 15 nt, Human
gcugagucugaaggc

SEQ ID NO: 1736570 - RNA, 22 nt, Human
gcugagucccaggcugagccuc

SEQ ID NO: 1736571 - RNA, 21 nt, Human
gcugagucccaggcugagccu

SEQ ID NO: 1736572 - RNA, 17 nt, Human
gcugagucccaggcuga

SEQ ID NO: 1736573 - RNA, 21 nt, Human
gcugacuguacuccucccagg

SEQ ID NO: 1736574 - RNA, 23 nt, Human
gcugagugggggaucacagccuc

SEQ ID NO: 1736575 - RNA, 22 nt, Human
gcugagugggggaucacagccu

SEQ ID NO: 1736576 - RNA, 16 nt, Human
gcugauggugcaauga

SEQ ID NO: 1736577 - RNA, 15 nt, Human
gcugauggugcaaug

SEQ ID NO: 1736578 - RNA, 15 nt, Human
gccugcuccagcugu

SEQ ID NO: 1736579 - RNA, 18 nt, Human
gccugcuccagcuguuca

SEQ ID NO: 1736580 - RNA, 16 nt, Human
gccugcuccagcuguu

SEQ ID NO: 1736581 - RNA, 22 nt, Human
gccugcuuuuuauggccuguga

SEQ ID NO: 1736582 - RNA, 19 nt, Human
gccugcuuuuuauggccug

SEQ ID NO: 1736583 - RNA, 18 nt, Human
gccugcuuuuuauggccu

SEQ ID NO: 1736584 - RNA, 22 nt, Human
gccugaagucacacagugaguc

SEQ ID NO: 1736585 - RNA, 19 nt, Human
gccucugcugauccuccca

SEQ ID NO: 1736586 - RNA, 13 nt, Human
gccucugccuguc

SEQ ID NO: 1736587 - RNA, 18 nt, Human
gccucugcugauccuccc

SEQ ID NO: 1736588 - RNA, 21 nt, Human
gccucucugcaggucccuaau

SEQ ID NO: 1736589 - RNA, 20 nt, Human
gccucucugcaggucccuaa

SEQ ID NO: 1736590 - RNA, 23 nt, Human
gccucucugcaggucccuaauaa

SEQ ID NO: 1736591 - RNA, 12 nt, Human
gccucugccugu

SEQ ID NO: 1736592 - RNA, 15 nt, Human
gccuggccagaugca

SEQ ID NO: 1736593 - RNA, 14 nt, Human
gccuggccagaugc

SEQ ID NO: 1736594 - RNA, 16 nt, Human
gccuggccagaugcac

SEQ ID NO: 1736595 - RNA, 15 nt, Human
gccugggcagaagga

SEQ ID NO: 1736596 - RNA, 15 nt, Human
gccuggauggggcug

SEQ ID NO: 1736597 - RNA, 14 nt, Human
gccuggauggggcu

SEQ ID NO: 1736598 - RNA, 13 nt, Human
gccuggccacgcc

SEQ ID NO: 1736599 - RNA, 17 nt, Human
gccugggcagaaggaag

SEQ ID NO: 1736600 - RNA, 16 nt, Human
gccugggcagaaggaa

SEQ ID NO: 1736601 - RNA, 18 nt, Human
gccugggcagaaggaaga

SEQ ID NO: 1736602 - RNA, 20 nt, Human
gccugggggcugggcagagg

SEQ ID NO: 1736603 - RNA, 21 nt, Human
gccugggggcugggcagagga

SEQ ID NO: 1736604 - RNA, 22 nt, Human
gccuauauuuuuuguuaaauga

SEQ ID NO: 1736605 - RNA, 17 nt, Human
gccuaagugcagccccg

SEQ ID NO: 1736606 - RNA, 16 nt, Human
gccuaaggcugaacuu

SEQ ID NO: 1736607 - RNA, 21 nt, Human
gccucaagugauucuccugcc

SEQ ID NO: 1736608 - RNA, 20 nt, Human
gccucaagugauucuccugc

SEQ ID NO: 1736609 - RNA, 19 nt, Human
gccucaagugauucuccug

SEQ ID NO: 1736610 - RNA, 17 nt, Human
gccucaaccuccugggc

SEQ ID NO: 1736611 - RNA, 16 nt, Human
gccucaaccuccuggg

SEQ ID NO: 1736612 - RNA, 14 nt, Human
gccucaaccuccug

SEQ ID NO: 1736613 - RNA, 14 nt, Human
gccucagugccacu

SEQ ID NO: 1736614 - RNA, 12 nt, Human
gccucagugcca

SEQ ID NO: 1736615 - RNA, 18 nt, Human
gccucagucucccucccu

SEQ ID NO: 1736616 - RNA, 15 nt, Human
gccucagucucccuc

SEQ ID NO: 1736617 - RNA, 23 nt, Human
gccucagccucccaaagugcugg

SEQ ID NO: 1736618 - RNA, 14 nt, Human
gccucagccucccg

SEQ ID NO: 1736619 - RNA, 16 nt, Human
gccucagccuccugag

SEQ ID NO: 1736620 - RNA, 18 nt, Human
gccucagccuccugagua

SEQ ID NO: 1736621 - RNA, 14 nt, Human
gccucccacgacug

SEQ ID NO: 1736622 - RNA, 21 nt, Human
gccucccacgacugcccggca

SEQ ID NO: 1736623 - RNA, 21 nt, Human
gccucccgaauagcugggacu

SEQ ID NO: 1736624 - RNA, 23 nt, Human
gccucccaacucaccccagcccc

SEQ ID NO: 1736625 - RNA, 22 nt, Human
gccucccaacucaccccagccc

SEQ ID NO: 1736626 - RNA, 15 nt, Human
gccucagugccacua

SEQ ID NO: 1736627 - RNA, 21 nt, Human
gccucccaacucaccccagcc

SEQ ID NO: 1736628 - RNA, 15 nt, Human
gccucccgaguagcu

SEQ ID NO: 1736629 - RNA, 23 nt, Human
gccucccgaauagcugggacuac

SEQ ID NO: 1736630 - RNA, 17 nt, Human
gccucccgaguagcugg

SEQ ID NO: 1736631 - RNA, 21 nt, Human
gccucggacuuagcugggaga

SEQ ID NO: 1736632 - RNA, 20 nt, Human
gccucggacuuagcugggag

SEQ ID NO: 1736633 - RNA, 19 nt, Human
gccucucugcaggucccua

SEQ ID NO: 1736634 - RNA, 16 nt, Human
gcccugagcuuucugc

SEQ ID NO: 1736635 - RNA, 12 nt, Human
gcccucugccca

SEQ ID NO: 1736636 - RNA, 18 nt, Human
gcccggcuccaggcuccu

SEQ ID NO: 1736637 - RNA, 17 nt, Human
gcccggcuccaggcucc

SEQ ID NO: 1736638 - RNA, 22 nt, Human
gcccuggacugugugcucagga

SEQ ID NO: 1736639 - RNA, 16 nt, Human
gcccuggacugugugc

SEQ ID NO: 1736640 - RNA, 12 nt, Human
gcccuggacugu

SEQ ID NO: 1736641 - RNA, 23 nt, Human
gcccugcuuugggcugcccuggu

SEQ ID NO: 1736642 - RNA, 22 nt, Human
gcccugcuuugggcugcccugg

SEQ ID NO: 1736643 - RNA, 19 nt, Human
gcccugcuuugggcugccc

SEQ ID NO: 1736644 - RNA, 21 nt, Human
gcccugcuuugggcugcccug

SEQ ID NO: 1736645 - RNA, 20 nt, Human
gcccugcuuugggcugcccu

SEQ ID NO: 1736646 - RNA, 16 nt, Human
gcccggcuccaggcuc

SEQ ID NO: 1736647 - RNA, 12 nt, Human
gcccggcuccag

SEQ ID NO: 1736648 - RNA, 19 nt, Human
gcccgacagccuggcacag

SEQ ID NO: 1736649 - RNA, 17 nt, Human
gcccgacagccuggcac

SEQ ID NO: 1736650 - RNA, 16 nt, Human
gcccgacagccuggca

SEQ ID NO: 1736651 - RNA, 12 nt, Human
gccccuuccccc

SEQ ID NO: 1736652 - RNA, 21 nt, Human
gccccuguucuggcagaguug

SEQ ID NO: 1736653 - RNA, 15 nt, Human
gccccugccacccug

SEQ ID NO: 1736654 - RNA, 14 nt, Human
gccccugccacccu

SEQ ID NO: 1736655 - RNA, 13 nt, Human
gccccugccaccc

SEQ ID NO: 1736656 - RNA, 15 nt, Human
gcagacucuacagag

SEQ ID NO: 1736657 - RNA, 19 nt, Human
gccccuccucucugcccua

SEQ ID NO: 1736658 - RNA, 18 nt, Human
gccccuccucucugcccu

SEQ ID NO: 1736659 - RNA, 15 nt, Human
gccccucccuucaac

SEQ ID NO: 1736660 - RNA, 14 nt, Human
gccccucccuucaa

SEQ ID NO: 1736661 - RNA, 12 nt, Human
gccccucccuuc

SEQ ID NO: 1736662 - RNA, 19 nt, Human
gcccuucucuccagccccu

SEQ ID NO: 1736663 - RNA, 21 nt, Human
gcccuuccucuccacugccuu

SEQ ID NO: 1736664 - RNA, 19 nt, Human
gcccuuccucuccacugcc

SEQ ID NO: 1736665 - RNA, 18 nt, Human
gcccuuccucuccacugc

SEQ ID NO: 1736666 - RNA, 16 nt, Human
gcccuuccucuccacu

SEQ ID NO: 1736667 - RNA, 17 nt, Human
gcccuuccucuccacug

SEQ ID NO: 1736668 - RNA, 22 nt, Human
gcccuucucuccagccccugga

SEQ ID NO: 1736669 - RNA, 21 nt, Human
gcccuucucuccagccccugg

SEQ ID NO: 1736670 - RNA, 23 nt, Human
gcccuucucuccagccccuggau

SEQ ID NO: 1736671 - RNA, 20 nt, Human
gcccuuccucuccacugccu

SEQ ID NO: 1736672 - RNA, 17 nt, Human
gccgagauugcaccacu

SEQ ID NO: 1736673 - RNA, 18 nt, Human
gccgagauugcaccacug

SEQ ID NO: 1736674 - RNA, 19 nt, Human
gccgagaucacgccacugc

SEQ ID NO: 1736675 - RNA, 18 nt, Human
gccgagaucacgccacug

SEQ ID NO: 1736676 - RNA, 16 nt, Human
gccgagaucacgccac

SEQ ID NO: 1736677 - RNA, 23 nt, Human
gcccugguggcagugggagcugc

SEQ ID NO: 1736678 - RNA, 22 nt, Human
gcccugguggcagugggagcug

SEQ ID NO: 1736679 - RNA, 21 nt, Human
gcccugguggcagugggagcu

SEQ ID NO: 1736680 - RNA, 20 nt, Human
gcccugguggcagugggagc

SEQ ID NO: 1736681 - RNA, 19 nt, Human
gcccugguggcagugggag

SEQ ID NO: 1736682 - RNA, 18 nt, Human
gcccugguggcaguggga

SEQ ID NO: 1736683 - RNA, 17 nt, Human
gcccugguggcaguggg

SEQ ID NO: 1736684 - RNA, 14 nt, Human
gcccugguggcagu

SEQ ID NO: 1736685 - RNA, 15 nt, Human
gcccugguuuccugc

SEQ ID NO: 1736686 - RNA, 14 nt, Human
gcccugguuuccug

SEQ ID NO: 1736687 - RNA, 23 nt, Human
gcccugguuuccugcccugggag

SEQ ID NO: 1736688 - RNA, 21 nt, Human
gcccugguuuccugcccuggg

SEQ ID NO: 1736689 - RNA, 20 nt, Human
gcccugguuuccugcccugg

SEQ ID NO: 1736690 - RNA, 19 nt, Human
gcccugguuuccugcccug

SEQ ID NO: 1736691 - RNA, 18 nt, Human
gcccugguuuccugcccu

SEQ ID NO: 1736692 - RNA, 17 nt, Human
gcccugguuuccugccc

SEQ ID NO: 1736693 - RNA, 21 nt, Human
gcccugggaggcucuggagcc

SEQ ID NO: 1736694 - RNA, 19 nt, Human
gcccugggaggcucuggag

SEQ ID NO: 1736695 - RNA, 18 nt, Human
gcccugggaggcucugga

SEQ ID NO: 1736696 - RNA, 17 nt, Human
gcccugggaggcucugg

SEQ ID NO: 1736697 - RNA, 23 nt, Human
gcccugggaggcucuggagccca

SEQ ID NO: 1736698 - RNA, 16 nt, Human
gcccugggaggcagug

SEQ ID NO: 1736699 - RNA, 21 nt, Human
gcccuggugcugccacacuuc

SEQ ID NO: 1736700 - RNA, 17 nt, Human
gcccuggugcugccaca

SEQ ID NO: 1736701 - RNA, 16 nt, Human
gcccuggugcugccac

SEQ ID NO: 1736702 - RNA, 15 nt, Human
gcccuggugcugcca

SEQ ID NO: 1736703 - RNA, 16 nt, Human
gcccugggaggcucug

SEQ ID NO: 1736704 - RNA, 15 nt, Human
gcccugggaggcucu

SEQ ID NO: 1736705 - RNA, 14 nt, Human
gcccugggaggcuc

SEQ ID NO: 1736706 - RNA, 13 nt, Human
gcccugggaggcu

SEQ ID NO: 1736707 - RNA, 14 nt, Human
gcccugggaggcag

SEQ ID NO: 1736708 - RNA, 11 nt, Human
gcccugggagg

SEQ ID NO: 1736709 - RNA, 20 nt, Human
gcccuggcucccacaggccc

SEQ ID NO: 1736710 - RNA, 19 nt, Human
gcccuggcucccacaggcc

SEQ ID NO: 1736711 - RNA, 15 nt, Human
gcccuggcucccaca

SEQ ID NO: 1736712 - RNA, 16 nt, Human
ggaaguacuggagaaa

SEQ ID NO: 1736713 - RNA, 12 nt, Human
ggaaguacugga

SEQ ID NO: 1736714 - RNA, 18 nt, Human
ggaaguacuggagaaaau

SEQ ID NO: 1736715 - RNA, 20 nt, Human
ggaagugacgguuuaauggg

SEQ ID NO: 1736716 - RNA, 18 nt, Human
ggaagugcuaauuuugaa

SEQ ID NO: 1736717 - RNA, 14 nt, Human
ggaaggcagggagg

SEQ ID NO: 1736718 - RNA, 13 nt, Human
ggaaccugacccc

SEQ ID NO: 1736719 - RNA, 23 nt, Human
ggaaggggagauaaggguaucug

SEQ ID NO: 1736720 - RNA, 17 nt, Human
ggaaggcugagaggaga

SEQ ID NO: 1736721 - RNA, 19 nt, Human
ggaauuuucaucuaggauu

SEQ ID NO: 1736722 - RNA, 12 nt, Human
ggaauuguguuu

SEQ ID NO: 1736723 - RNA, 19 nt, Human
ggaauguuugccucugccu

SEQ ID NO: 1736724 - RNA, 12 nt, Human
ggaaugcagugg

SEQ ID NO: 1736725 - RNA, 24 nt, Human
ggaaugauuaauuaaaacacaaca

SEQ ID NO: 1736726 - RNA, 20 nt, Human
ggacauugcggacagccacg

SEQ ID NO: 1736727 - RNA, 22 nt, Human
ggacagccacggccaggccaga

SEQ ID NO: 1736728 - RNA, 21 nt, Human
ggacagccacggccaggccag

SEQ ID NO: 1736729 - RNA, 20 nt, Human
ggacagccacggccaggcca

SEQ ID NO: 1736730 - RNA, 19 nt, Human
ggacagccacggccaggcc

SEQ ID NO: 1736731 - RNA, 15 nt, Human
ggacagccacggcca

SEQ ID NO: 1736732 - RNA, 22 nt, Human
ggacacucaaaagcugggcagg

SEQ ID NO: 1736733 - RNA, 17 nt, Human
ggacacucaaaagcugg

SEQ ID NO: 1736734 - RNA, 17 nt, Human
ggaccuugaacugggua

SEQ ID NO: 1736735 - RNA, 15 nt, Human
ggaccuugaacuggg

SEQ ID NO: 1736736 - RNA, 20 nt, Human
ggacgcuacccgggaagggg

SEQ ID NO: 1736737 - RNA, 19 nt, Human
ggacgcuacccgggaaggg

SEQ ID NO: 1736738 - RNA, 17 nt, Human
ggacgcuacccgggaag

SEQ ID NO: 1736739 - RNA, 23 nt, Human
ggaccucaggugagaagcagagg

SEQ ID NO: 1736740 - RNA, 19 nt, Human
ggaccucaggugagaagca

SEQ ID NO: 1736741 - RNA, 14 nt, Human
ggaccagagcugcc

SEQ ID NO: 1736742 - RNA, 13 nt, Human
ggaccagagcugc

SEQ ID NO: 1736743 - RNA, 18 nt, Human
ggacuggccucugcugau

SEQ ID NO: 1736744 - RNA, 15 nt, Human
ggacgcucucuggcc

SEQ ID NO: 1736745 - RNA, 13 nt, Human
ggacgcucucugg

SEQ ID NO: 1736746 - RNA, 14 nt, Human
ggacgcucucuggc

SEQ ID NO: 1736747 - RNA, 17 nt, Human
ggacugugugcucagga

SEQ ID NO: 1736748 - RNA, 15 nt, Human
ggagaaucacuugaa

SEQ ID NO: 1736749 - RNA, 19 nt, Human
ggagaaucacuugaacccg

SEQ ID NO: 1736750 - RNA, 18 nt, Human
ggagaagcggcuggcagc

SEQ ID NO: 1736751 - RNA, 17 nt, Human
ggagaagcggcuggcag

SEQ ID NO: 1736752 - RNA, 15 nt, Human
gcuuuguaugcacuu

SEQ ID NO: 1736753 - RNA, 15 nt, Human
gcuuugugauuuuug

SEQ ID NO: 1736754 - RNA, 18 nt, Human
gcuuugucuacuucaaaa

SEQ ID NO: 1736755 - RNA, 20 nt, Human
gcuugaggguugggcuggug

SEQ ID NO: 1736756 - RNA, 18 nt, Human
gcuugaggguugggcugg

SEQ ID NO: 1736757 - RNA, 22 nt, Human
gcuugaggguugggcugguguc

SEQ ID NO: 1736758 - RNA, 13 nt, Human
gcuuuucacugcu

SEQ ID NO: 1736759 - RNA, 18 nt, Human
gcuuuucacugcuggcug

SEQ ID NO: 1736760 - RNA, 14 nt, Human
gcuuuucacugcug

SEQ ID NO: 1736761 - RNA, 21 nt, Human
gcuuuguuuguugucagcuga

SEQ ID NO: 1736762 - RNA, 18 nt, Human
ggaaaacaugcuacacac

SEQ ID NO: 1736763 - RNA, 23 nt, Human
gcuuuucacugcuggcugccuua

SEQ ID NO: 1736764 - RNA, 22 nt, Human
gcuuuucacugcuggcugccuu

SEQ ID NO: 1736765 - RNA, 20 nt, Human
ggaaaagcugcugacagugu

SEQ ID NO: 1736766 - RNA, 18 nt, Human
ggaaaagcugcugacagu

SEQ ID NO: 1736767 - RNA, 14 nt, Human
ggaaaagcugcuga

SEQ ID NO: 1736768 - RNA, 21 nt, Human
ggaaaaccaagccguggcuuc

SEQ ID NO: 1736769 - RNA, 19 nt, Human
ggaaaaucagccugcucca

SEQ ID NO: 1736770 - RNA, 23 nt, Human
ggaaaaucagccugcuccagcug

SEQ ID NO: 1736771 - RNA, 14 nt, Human
ggaaaggcuccagg

SEQ ID NO: 1736772 - RNA, 13 nt, Human
ggaaaggcuccag

SEQ ID NO: 1736773 - RNA, 12 nt, Human
ggaaaggcucca

SEQ ID NO: 1736774 - RNA, 21 nt, Human
ggaaaggcuccaggagcagcc

SEQ ID NO: 1736775 - RNA, 20 nt, Human
ggaaaggcuccaggagcagc

SEQ ID NO: 1736776 - RNA, 19 nt, Human
ggaaaggcuccaggagcag

SEQ ID NO: 1736777 - RNA, 17 nt, Human
ggaaaggcuccaggagc

SEQ ID NO: 1736778 - RNA, 22 nt, Human
ggaaaggcuccaggagcagcca

SEQ ID NO: 1736779 - RNA, 14 nt, Human
ggaaaucaccgaaa

SEQ ID NO: 1736780 - RNA, 21 nt, Human
ggaaaucaccgaaaacguggc

SEQ ID NO: 1736781 - RNA, 16 nt, Human
ggaacaggaaacugau

SEQ ID NO: 1736782 - RNA, 20 nt, Human
gcugccaaugggagcucaug

SEQ ID NO: 1736783 - RNA, 19 nt, Human
gcugccaaugggagcucau

SEQ ID NO: 1736784 - RNA, 16 nt, Human
gcugccaaugggagcu

SEQ ID NO: 1736785 - RNA, 15 nt, Human
gcugccaaugggagc

SEQ ID NO: 1736786 - RNA, 20 nt, Human
gcugugggcgugagaccugc

SEQ ID NO: 1736787 - RNA, 22 nt, Human
gcugugggcgugagaccugccc

SEQ ID NO: 1736788 - RNA, 21 nt, Human
gcugugggcgugagaccugcc

SEQ ID NO: 1736789 - RNA, 14 nt, Human
gcuguucagcuggu

SEQ ID NO: 1736790 - RNA, 17 nt, Human
gcuuagucacugagaca

SEQ ID NO: 1736791 - RNA, 15 nt, Human
gcuuagucacugaga

SEQ ID NO: 1736792 - RNA, 20 nt, Human
gcuuagucacugagacagcc

SEQ ID NO: 1736793 - RNA, 19 nt, Human
gcuuagucacugagacagc

SEQ ID NO: 1736794 - RNA, 21 nt, Human
gcuuagucacugagacagccc

SEQ ID NO: 1736795 - RNA, 16 nt, Human
gcuugaggguugggcu

SEQ ID NO: 1736796 - RNA, 15 nt, Human
gcuuccagugaggcu

SEQ ID NO: 1736797 - RNA, 18 nt, Human
gcuucauuuccugugucu

SEQ ID NO: 1736798 - RNA, 21 nt, Human
gcuucauccuccucagaucuu

SEQ ID NO: 1736799 - RNA, 17 nt, Human
gcuucauuuccuguguc

SEQ ID NO: 1736800 - RNA, 18 nt, Human
gcuuccagugaggcucug

SEQ ID NO: 1736801 - RNA, 16 nt, Human
gcuuccagugaggcuc

SEQ ID NO: 1736802 - RNA, 16 nt, Human
gcuucauuuccugugu

SEQ ID NO: 1736803 - RNA, 13 nt, Human
gcuucauuuccug

SEQ ID NO: 1736804 - RNA, 15 nt, Human
gcuucauccuccuca

SEQ ID NO: 1736805 - RNA, 12 nt, Human
gcuucauccucc

SEQ ID NO: 1736806 - RNA, 18 nt, Human
gcuucaguggcagcugcu

SEQ ID NO: 1736807 - RNA, 17 nt, Human
gcuucaguggcagcugc

SEQ ID NO: 1736808 - RNA, 19 nt, Human
gcuuaucucaggggugugc

SEQ ID NO: 1736809 - RNA, 20 nt, Human
gcuuauacacuuacacuuua

SEQ ID NO: 1736810 - RNA, 12 nt, Human
gcuuauacacuu

SEQ ID NO: 1736811 - RNA, 16 nt, Human
gcuucaguggcagcug

SEQ ID NO: 1736812 - RNA, 23 nt, Human
gcuuaugauagcaaauggccuca

SEQ ID NO: 1736813 - RNA, 23 nt, Human
ggauuacaagcgugagccacugc

SEQ ID NO: 1736814 - RNA, 19 nt, Human
ggauuacaggcuccugcca

SEQ ID NO: 1736815 - RNA, 16 nt, Human
ggauucuuauggacaa

SEQ ID NO: 1736816 - RNA, 16 nt, Human
ggauucuuccucccuc

SEQ ID NO: 1736817 - RNA, 15 nt, Human
ggauuguaaaauggu

SEQ ID NO: 1736818 - RNA, 17 nt, Human
ggcaacccccagccugc

SEQ ID NO: 1736819 - RNA, 16 nt, Human
ggcaacccccagccug

SEQ ID NO: 1736820 - RNA, 17 nt, Human
ggauugcuacuguccua

SEQ ID NO: 1736821 - RNA, 23 nt, Human
ggcacccaccaucaugucuggcu

SEQ ID NO: 1736822 - RNA, 22 nt, Human
ggcacccggccccugcugguuc

SEQ ID NO: 1736823 - RNA, 18 nt, Human
ggcaccggggccucggac

SEQ ID NO: 1736824 - RNA, 23 nt, Human
ggcaaugcuggcuguuggcuggg

SEQ ID NO: 1736825 - RNA, 15 nt, Human
ggcaaugcuggcugu

SEQ ID NO: 1736826 - RNA, 14 nt, Human
ggcaaugcuggcug

SEQ ID NO: 1736827 - RNA, 18 nt, Human
ggcaacccccagccugcu

SEQ ID NO: 1736828 - RNA, 19 nt, Human
ggcaaucauggugcucaga

SEQ ID NO: 1736829 - RNA, 19 nt, Human
ggauuacaagcgugagcca

SEQ ID NO: 1736830 - RNA, 15 nt, Human
ggaugcuuguacaua

SEQ ID NO: 1736831 - RNA, 19 nt, Human
ggaugcagccucacagucc

SEQ ID NO: 1736832 - RNA, 13 nt, Human
ggauccuccaggu

SEQ ID NO: 1736833 - RNA, 12 nt, Human
ggauccuccagg

SEQ ID NO: 1736834 - RNA, 17 nt, Human
ggaugcagccucacagu

SEQ ID NO: 1736835 - RNA, 16 nt, Human
ggaugcagccucacag

SEQ ID NO: 1736836 - RNA, 21 nt, Human
ggaugauuggaggggggaggu

SEQ ID NO: 1736837 - RNA, 23 nt, Human
ggaugcacagaguuguuacauuu

SEQ ID NO: 1736838 - RNA, 17 nt, Human
ggaucccucauccucau

SEQ ID NO: 1736839 - RNA, 13 nt, Human
ggaucccucaucc

SEQ ID NO: 1736840 - RNA, 22 nt, Human
ggaucccucauccucauaccca

SEQ ID NO: 1736841 - RNA, 22 nt, Human
ggaucaaaccccgaccaccugc

SEQ ID NO: 1736842 - RNA, 18 nt, Human
ggauacaaaagcauguga

SEQ ID NO: 1736843 - RNA, 20 nt, Human
ggagugcaaugacacagucu

SEQ ID NO: 1736844 - RNA, 14 nt, Human
ggagugcagugagc

SEQ ID NO: 1736845 - RNA, 12 nt, Human
ggagugcaguga

SEQ ID NO: 1736846 - RNA, 18 nt, Human
ggcaugggaaugaauguc

SEQ ID NO: 1736847 - RNA, 17 nt, Human
ggcauuccccaggaggc

SEQ ID NO: 1736848 - RNA, 22 nt, Human
ggcaugggaaugaaugucagug

SEQ ID NO: 1736849 - RNA, 19 nt, Human
ggcauuccccaggaggcca

SEQ ID NO: 1736850 - RNA, 18 nt, Human
ggcauuccccaggaggcc

SEQ ID NO: 1736851 - RNA, 17 nt, Human
ggccacuccagaccccu

SEQ ID NO: 1736852 - RNA, 17 nt, Human
ggccagcugcuugggcu

SEQ ID NO: 1736853 - RNA, 22 nt, Human
ggccagccuugaccauucucca

SEQ ID NO: 1736854 - RNA, 20 nt, Human
ggccagccuugaccauucuc

SEQ ID NO: 1736855 - RNA, 18 nt, Human
ggccaggcccucugccca

SEQ ID NO: 1736856 - RNA, 23 nt, Human
ggccagcugcuugggcuucaucc

SEQ ID NO: 1736857 - RNA, 16 nt, Human
ggccaugggccuccug

SEQ ID NO: 1736858 - RNA, 16 nt, Human
ggccaggcugcucuug

SEQ ID NO: 1736859 - RNA, 11 nt, Human
ggccaggcugc

SEQ ID NO: 1736860 - RNA, 15 nt, Human
ggccaggcugcucuu

SEQ ID NO: 1736861 - RNA, 14 nt, Human
ggccaggcugcucu

SEQ ID NO: 1736862 - RNA, 21 nt, Human
ggcagcucagagaggguggga

SEQ ID NO: 1736863 - RNA, 16 nt, Human
ggcagcucaccucucc

SEQ ID NO: 1736864 - RNA, 17 nt, Human
ggcagcuugaggguugg

SEQ ID NO: 1736865 - RNA, 22 nt, Human
ggcagcugcuuuugucuauggg

SEQ ID NO: 1736866 - RNA, 14 nt, Human
ggcagcucaccucu

SEQ ID NO: 1736867 - RNA, 12 nt, Human
ggcagcucaccu

SEQ ID NO: 1736868 - RNA, 16 nt, Human
ggcagugggagcugcc

SEQ ID NO: 1736869 - RNA, 21 nt, Human
ggcagugggacagggcauggc

SEQ ID NO: 1736870 - RNA, 14 nt, Human
ggcagugggagcug

SEQ ID NO: 1736871 - RNA, 13 nt, Human
ggcagugggagcu

SEQ ID NO: 1736872 - RNA, 20 nt, Human
ggcagggucucacucugucg

SEQ ID NO: 1736873 - RNA, 19 nt, Human
ggcagggucucacucuguc

SEQ ID NO: 1736874 - RNA, 18 nt, Human
ggcaugacacgaauauug

SEQ ID NO: 1736875 - RNA, 15 nt, Human
ggcaugaagacagau

SEQ ID NO: 1736876 - RNA, 18 nt, Human
ggcauggccagguggcca

SEQ ID NO: 1736877 - RNA, 17 nt, Human
ggcauggccagguggcc

SEQ ID NO: 1736878 - RNA, 17 nt, Human
ggcccucugcccacucc

SEQ ID NO: 1736879 - RNA, 16 nt, Human
ggcccucugcccacuc

SEQ ID NO: 1736880 - RNA, 15 nt, Human
ggcccucugcccacu

SEQ ID NO: 1736881 - RNA, 13 nt, Human
ggcccucugccca

SEQ ID NO: 1736882 - RNA, 20 nt, Human
ggcccucugcccacucccug

SEQ ID NO: 1736883 - RNA, 19 nt, Human
ggcccucugcccacucccu

SEQ ID NO: 1736884 - RNA, 21 nt, Human
ggcccucugcccacucccugc

SEQ ID NO: 1736885 - RNA, 12 nt, Human
ggcccagagagg

SEQ ID NO: 1736886 - RNA, 11 nt, Human
ggcccagagag

SEQ ID NO: 1736887 - RNA, 15 nt, Human
ggcccugccuccuuu

SEQ ID NO: 1736888 - RNA, 14 nt, Human
ggcccugccuccuu

SEQ ID NO: 1736889 - RNA, 22 nt, Human
ggcccugcccugguuuccugcc

SEQ ID NO: 1736890 - RNA, 22 nt, Human
ggcccuggcucccacaggcccu

SEQ ID NO: 1736891 - RNA, 13 nt, Human
ggcccuggcuccc

SEQ ID NO: 1736892 - RNA, 13 nt, Human
ggcccugccuccu

SEQ ID NO: 1736893 - RNA, 20 nt, Human
ggcccugcccugguuuccug

SEQ ID NO: 1736894 - RNA, 13 nt, Human
ggcccugcccugg

SEQ ID NO: 1736895 - RNA, 12 nt, Human
ggcccugcccug

SEQ ID NO: 1736896 - RNA, 11 nt, Human
ggcccugcccu

SEQ ID NO: 1736897 - RNA, 16 nt, Human
ggccucugcacucccc

SEQ ID NO: 1736898 - RNA, 15 nt, Human
ggccucugcacuccc

SEQ ID NO: 1736899 - RNA, 14 nt, Human
ggccucugcacucc

SEQ ID NO: 1736900 - RNA, 13 nt, Human
ggccucugcacuc

SEQ ID NO: 1736901 - RNA, 17 nt, Human
ggccucuuaugggcugg

SEQ ID NO: 1736902 - RNA, 20 nt, Human
ggccucgguguggagaagcg

SEQ ID NO: 1736903 - RNA, 18 nt, Human
ggccucuuaugggcuggg

SEQ ID NO: 1736904 - RNA, 20 nt, Human
ggccucggacuuagcuggga

SEQ ID NO: 1736905 - RNA, 22 nt, Human
ggccucggacuuagcugggaga

SEQ ID NO: 1736906 - RNA, 16 nt, Human
ggcuccaggcuccuuu

SEQ ID NO: 1736907 - RNA, 19 nt, Human
ggcucccacaggcccuucc

SEQ ID NO: 1736908 - RNA, 18 nt, Human
ggcucccacaggcccuuc

SEQ ID NO: 1736909 - RNA, 17 nt, Human
ggcucccacaggcccuu

SEQ ID NO: 1736910 - RNA, 11 nt, Human
ggcuccaggcu

SEQ ID NO: 1736911 - RNA, 21 nt, Human
ggcucaaguccucuuuucuga

SEQ ID NO: 1736912 - RNA, 15 nt, Human
ggcucaaguccucuu

SEQ ID NO: 1736913 - RNA, 19 nt, Human
ggcuccaggagcagccaca

SEQ ID NO: 1736914 - RNA, 13 nt, Human
ggcuccaggagca

SEQ ID NO: 1736915 - RNA, 12 nt, Human
ggcuccaggagc

SEQ ID NO: 1736916 - RNA, 12 nt, Human
ggcuccagcugg

SEQ ID NO: 1736917 - RNA, 15 nt, Human
ggcuaugcauuugaa

SEQ ID NO: 1736918 - RNA, 19 nt, Human
ggcuaugggggcacugagg

SEQ ID NO: 1736919 - RNA, 15 nt, Human
ggcuaguugggcuuc

SEQ ID NO: 1736920 - RNA, 23 nt, Human
ggcuagugugguguuuccuggca

SEQ ID NO: 1736921 - RNA, 16 nt, Human
ggcuaguugggcuucc

SEQ ID NO: 1736922 - RNA, 17 nt, Human
ggcuagagguucaaaga

SEQ ID NO: 1736923 - RNA, 22 nt, Human
ggcuagagguucaaagauauuu

SEQ ID NO: 1736924 - RNA, 16 nt, Human
ggcuaggaccccucca

SEQ ID NO: 1736925 - RNA, 22 nt, Human
ggcuaggaccccuccauguggg

SEQ ID NO: 1736926 - RNA, 19 nt, Human
ggccuggccugagcuggga

SEQ ID NO: 1736927 - RNA, 22 nt, Human
ggccugggggcugggcagagga

SEQ ID NO: 1736928 - RNA, 20 nt, Human
ggccugggggcugggcagag

SEQ ID NO: 1736929 - RNA, 14 nt, Human
ggccugggggcugg

SEQ ID NO: 1736930 - RNA, 11 nt, Human
ggccugugagc

SEQ ID NO: 1736931 - RNA, 18 nt, Human
ggccuguccaacacaucu

SEQ ID NO: 1736932 - RNA, 15 nt, Human
ggcgcgguggcucac

SEQ ID NO: 1736933 - RNA, 23 nt, Human
ggcgcugccccuggcagccccug

SEQ ID NO: 1736934 - RNA, 21 nt, Human
ggcgcugccccuggcagcccc

SEQ ID NO: 1736935 - RNA, 19 nt, Human
ggcgcugccccuggcagcc

SEQ ID NO: 1736936 - RNA, 18 nt, Human
ggcgcugccccuggcagc

SEQ ID NO: 1736937 - RNA, 21 nt, Human
gaguugaagacagagcuacac

SEQ ID NO: 1736938 - RNA, 17 nt, Human
gaguugaagacagagcu

SEQ ID NO: 1736939 - RNA, 15 nt, Human
gaguugaagacagag

SEQ ID NO: 1736940 - RNA, 20 nt, Human
gaguucaucuugaauuguaa

SEQ ID NO: 1736941 - RNA, 19 nt, Human
gaguucaucuugaauugua

SEQ ID NO: 1736942 - RNA, 20 nt, Human
gaguucauacccuguuacca

SEQ ID NO: 1736943 - RNA, 14 nt, Human
gaguucaucuugaa

SEQ ID NO: 1736944 - RNA, 15 nt, Human
gaguuacagacaaag

SEQ ID NO: 1736945 - RNA, 13 nt, Human
gaguuacagacaa

SEQ ID NO: 1736946 - RNA, 12 nt, Human
gaguuacagaca

SEQ ID NO: 1736947 - RNA, 20 nt, Human
gagugugccugaagucccag

SEQ ID NO: 1736948 - RNA, 17 nt, Human
gagugacagaggcagcc

SEQ ID NO: 1736949 - RNA, 13 nt, Human
gagugggugaaua

SEQ ID NO: 1736950 - RNA, 15 nt, Human
gaguggguugauuuc

SEQ ID NO: 1736951 - RNA, 20 nt, Human
gauacaggaaaagcugcuga

SEQ ID NO: 1736952 - RNA, 22 nt, Human
gauaagaaccuuuugagugccu

SEQ ID NO: 1736953 - RNA, 23 nt, Human
gauacaggaaaagcugcugacag

SEQ ID NO: 1736954 - RNA, 21 nt, Human
gauacaggaaaagcugcugac

SEQ ID NO: 1736955 - RNA, 22 nt, Human
gauagccaaggccaaaggaagc

SEQ ID NO: 1736956 - RNA, 15 nt, Human
gauagcacagacccu

SEQ ID NO: 1736957 - RNA, 16 nt, Human
gauagcacagacccug

SEQ ID NO: 1736958 - RNA, 16 nt, Human
gaucacggcucacugc

SEQ ID NO: 1736959 - RNA, 15 nt, Human
gaucacggcucacug

SEQ ID NO: 1736960 - RNA, 20 nt, Human
gaucacggcucacugcagcc

SEQ ID NO: 1736961 - RNA, 14 nt, Human
gaucacagccucug

SEQ ID NO: 1736962 - RNA, 18 nt, Human
gaucacggcucacugcag

SEQ ID NO: 1736963 - RNA, 15 nt, Human
gauauaagugugugu

SEQ ID NO: 1736964 - RNA, 16 nt, Human
gagguuucaaaccucc

SEQ ID NO: 1736965 - RNA, 20 nt, Human
gagguuucucaaagaaauuu

SEQ ID NO: 1736966 - RNA, 17 nt, Human
gagguugggaggccauu

SEQ ID NO: 1736967 - RNA, 15 nt, Human
gagguugggaggcca

SEQ ID NO: 1736968 - RNA, 20 nt, Human
gaggucagagccugcaguua

SEQ ID NO: 1736969 - RNA, 17 nt, Human
gaggucagagccugcag

SEQ ID NO: 1736970 - RNA, 17 nt, Human
gaguaggaagacuuugg

SEQ ID NO: 1736971 - RNA, 13 nt, Human
gaguaggaagacu

SEQ ID NO: 1736972 - RNA, 12 nt, Human
gaguaggaagac

SEQ ID NO: 1736973 - RNA, 22 nt, Human
gaguagcugggacuacaggcac

SEQ ID NO: 1736974 - RNA, 19 nt, Human
gaguagcugggacuacagg

SEQ ID NO: 1736975 - RNA, 23 nt, Human
gaguacuacaguccucccaucuc

SEQ ID NO: 1736976 - RNA, 21 nt, Human
gaguacuacaguccucccauc

SEQ ID NO: 1736977 - RNA, 20 nt, Human
gaguacuacaguccucccau

SEQ ID NO: 1736978 - RNA, 22 nt, Human
gaguaauccaagcaaaugugaa

SEQ ID NO: 1736979 - RNA, 14 nt, Human
gagucgaggacagg

SEQ ID NO: 1736980 - RNA, 19 nt, Human
gaguccgaaagggacuugg

SEQ ID NO: 1736981 - RNA, 16 nt, Human
gagucgaggacaggga

SEQ ID NO: 1736982 - RNA, 15 nt, Human
gagucgaggacaggg

SEQ ID NO: 1736983 - RNA, 19 nt, Human
gaguaggaagacuuuggaa

SEQ ID NO: 1736984 - RNA, 18 nt, Human
gaguaggaagacuuugga

SEQ ID NO: 1736985 - RNA, 11 nt, Human
gaguauauguc

SEQ ID NO: 1736986 - RNA, 16 nt, Human
gagugacagaggcagc

SEQ ID NO: 1736987 - RNA, 15 nt, Human
gagugacagaggcag

SEQ ID NO: 1736988 - RNA, 14 nt, Human
gagugacagaggca

SEQ ID NO: 1736989 - RNA, 17 nt, Human
gagugaagcugggagaa

SEQ ID NO: 1736990 - RNA, 14 nt, Human
gagucugaaggcug

SEQ ID NO: 1736991 - RNA, 15 nt, Human
gagucugaaggcugg

SEQ ID NO: 1736992 - RNA, 13 nt, Human
gagucugaaggcu

SEQ ID NO: 1736993 - RNA, 12 nt, Human
gagucugaaggc

SEQ ID NO: 1736994 - RNA, 19 nt, Human
gaggcagagguugcaguga

SEQ ID NO: 1736995 - RNA, 19 nt, Human
gaggcagccccauucugcc

SEQ ID NO: 1736996 - RNA, 9 nt, Human
gaggcaggg

SEQ ID NO: 1736997 - RNA, 20 nt, Human
gaggcagccccauucugccu

SEQ ID NO: 1736998 - RNA, 21 nt, Human
gaggcagccccauucugccug

SEQ ID NO: 1736999 - RNA, 23 nt, Human
gaggccaugggccuccugugugu

SEQ ID NO: 1737000 - RNA, 21 nt, Human
gaggccaugggccuccugugu

SEQ ID NO: 1737001 - RNA, 20 nt, Human
gaggccaugggccuccugug

SEQ ID NO: 1737002 - RNA, 18 nt, Human
gaggccaugggccuccug

SEQ ID NO: 1737003 - RNA, 17 nt, Human
gaggccaugggccuccu

SEQ ID NO: 1737004 - RNA, 14 nt, Human
gaggccaugggccu

SEQ ID NO: 1737005 - RNA, 19 nt, Human
gaggaucucuugagccugg

SEQ ID NO: 1737006 - RNA, 16 nt, Human
gaggaucucuugagcc

SEQ ID NO: 1737007 - RNA, 22 nt, Human
gaggaucucuugagccugggag

SEQ ID NO: 1737008 - RNA, 13 nt, Human
gaggaucucuuga

SEQ ID NO: 1737009 - RNA, 22 nt, Human
gagcccuguccugccuaaggcu

SEQ ID NO: 1737010 - RNA, 20 nt, Human
gaggauugcuugagcucagg

SEQ ID NO: 1737011 - RNA, 20 nt, Human
gaggcccuucucuccagccc

SEQ ID NO: 1737012 - RNA, 15 nt, Human
gaggcccuucucucc

SEQ ID NO: 1737013 - RNA, 21 nt, Human
gaggcccuucucuccagcccc

SEQ ID NO: 1737014 - RNA, 22 nt, Human
gaggcccuucucuccagccccu

SEQ ID NO: 1737015 - RNA, 16 nt, Human
gaggcccagagggccu

SEQ ID NO: 1737016 - RNA, 15 nt, Human
gaggcccagagggcc

SEQ ID NO: 1737017 - RNA, 19 nt, Human
gaggcccagagggccugca

SEQ ID NO: 1737018 - RNA, 14 nt, Human
gaggcccagagggc

SEQ ID NO: 1737019 - RNA, 13 nt, Human
gaggcccagaggg

SEQ ID NO: 1737020 - RNA, 11 nt, Human
gaggcccagag

SEQ ID NO: 1737021 - RNA, 19 nt, Human
gaggccuucucugaaggac

SEQ ID NO: 1737022 - RNA, 18 nt, Human
gaggccuucucugaagga

SEQ ID NO: 1737023 - RNA, 16 nt, Human
gaggccuucucugaag

SEQ ID NO: 1737024 - RNA, 21 nt, Human
gaggcgcaugaauuugugaag

SEQ ID NO: 1737025 - RNA, 14 nt, Human
gagggucugaggaa

SEQ ID NO: 1737026 - RNA, 13 nt, Human
gagggucugagga

SEQ ID NO: 1737027 - RNA, 21 nt, Human
gagggugaagugaagacaaug

SEQ ID NO: 1737028 - RNA, 12 nt, Human
gaggguggaaua

SEQ ID NO: 1737029 - RNA, 22 nt, Human
gagggugucccaaaaagaaagg

SEQ ID NO: 1737030 - RNA, 21 nt, Human
gaggguggugaccucugccug

SEQ ID NO: 1737031 - RNA, 14 nt, Human
gaggguggugaccu

SEQ ID NO: 1737032 - RNA, 15 nt, Human
gagggugggaguggg

SEQ ID NO: 1737033 - RNA, 13 nt, Human
gaggucagagccu

SEQ ID NO: 1737034 - RNA, 12 nt, Human
gaggucagagcc

SEQ ID NO: 1737035 - RNA, 17 nt, Human
gaggucaaggcugcagu

SEQ ID NO: 1737036 - RNA, 15 nt, Human
gaggguugggcuggu

SEQ ID NO: 1737037 - RNA, 14 nt, Human
gaggguugggcugg

SEQ ID NO: 1737038 - RNA, 21 nt, Human
gagguaaggaauaccuguccc

SEQ ID NO: 1737039 - RNA, 24 nt, Human
gagguaaggaauaccugucccccu

SEQ ID NO: 1737040 - RNA, 13 nt, Human
gaggguaaggcug

SEQ ID NO: 1737041 - RNA, 17 nt, Human
gaggggguggccuccca

SEQ ID NO: 1737042 - RNA, 17 nt, Human
gaggggcugugggcgug

SEQ ID NO: 1737043 - RNA, 18 nt, Human
gagggagugacagaggca

SEQ ID NO: 1737044 - RNA, 20 nt, Human
gagggagggcuccagacaca

SEQ ID NO: 1737045 - RNA, 20 nt, Human
gagggagggggaaggcaggg

SEQ ID NO: 1737046 - RNA, 22 nt, Human
gagggagugacagaggcagccc

SEQ ID NO: 1737047 - RNA, 21 nt, Human
gagggagugacagaggcagcc

SEQ ID NO: 1737048 - RNA, 19 nt, Human
gagggagggcuccagacac

SEQ ID NO: 1737049 - RNA, 20 nt, Human
gaggcugggcucccuuccca

SEQ ID NO: 1737050 - RNA, 13 nt, Human
gcacagugcaucu

SEQ ID NO: 1737051 - RNA, 18 nt, Human
gcacagugcaucucagcc

SEQ ID NO: 1737052 - RNA, 15 nt, Human
gcacagugcaucuca

SEQ ID NO: 1737053 - RNA, 22 nt, Human
gcacagaguuguuacauuuuua

SEQ ID NO: 1737054 - RNA, 16 nt, Human
gcacagaguuguuaca

SEQ ID NO: 1737055 - RNA, 18 nt, Human
gcacagaguuguuacauu

SEQ ID NO: 1737056 - RNA, 19 nt, Human
gcacagaguuguuacauuu

SEQ ID NO: 1737057 - RNA, 21 nt, Human
gcacagaguuguuacauuuuu

SEQ ID NO: 1737058 - RNA, 13 nt, Human
gcacgauuucugu

SEQ ID NO: 1737059 - RNA, 15 nt, Human
gcacgauuucuguuu

SEQ ID NO: 1737060 - RNA, 21 nt, Human
gcaccuuagacagucccugcc

SEQ ID NO: 1737061 - RNA, 20 nt, Human
gcaccuuagacagucccugc

SEQ ID NO: 1737062 - RNA, 12 nt, Human
gcaccauaacuu

SEQ ID NO: 1737063 - RNA, 22 nt, Human
gcaccccagcuggggccaggcu

SEQ ID NO: 1737064 - RNA, 14 nt, Human
gcagacaggcaagc

SEQ ID NO: 1737065 - RNA, 13 nt, Human
gcagacaggcaag

SEQ ID NO: 1737066 - RNA, 12 nt, Human
gcagacaggcaa

SEQ ID NO: 1737067 - RNA, 16 nt, Human
gcacgauuucuguuua

SEQ ID NO: 1737068 - RNA, 20 nt, Human
gcacugcugcccagccucca

SEQ ID NO: 1737069 - RNA, 18 nt, Human
gcacugcugcccagccuc

SEQ ID NO: 1737070 - RNA, 15 nt, Human
gcacugcugcccagc

SEQ ID NO: 1737071 - RNA, 14 nt, Human
gcacugcugcccag

SEQ ID NO: 1737072 - RNA, 23 nt, Human
gcacugcuuccagugaggcucug

SEQ ID NO: 1737073 - RNA, 19 nt, Human
gcacugguggcccgacagc

SEQ ID NO: 1737074 - RNA, 14 nt, Human
gcacugguggcccg

SEQ ID NO: 1737075 - RNA, 20 nt, Human
gcaauucuccugccucagcc

SEQ ID NO: 1737076 - RNA, 19 nt, Human
gcaauucuccugccucagc

SEQ ID NO: 1737077 - RNA, 18 nt, Human
gcaauucuccugccucag

SEQ ID NO: 1737078 - RNA, 17 nt, Human
gcaauucuccugccuca

SEQ ID NO: 1737079 - RNA, 16 nt, Human
gcaauucuccugccuc

SEQ ID NO: 1737080 - RNA, 15 nt, Human
gcaauucuccugccu

SEQ ID NO: 1737081 - RNA, 14 nt, Human
gcaauucuccugcc

SEQ ID NO: 1737082 - RNA, 14 nt, Human
gcacaaacagaggc

SEQ ID NO: 1737083 - RNA, 16 nt, Human
gcacaaacagaggccg

SEQ ID NO: 1737084 - RNA, 15 nt, Human
gcacaaacagaggcc

SEQ ID NO: 1737085 - RNA, 14 nt, Human
gcaaugugauaaaa

SEQ ID NO: 1737086 - RNA, 14 nt, Human
gcaacucaucuuag

SEQ ID NO: 1737087 - RNA, 15 nt, Human
gcaauggcagccuug

SEQ ID NO: 1737088 - RNA, 17 nt, Human
gcacagacccugcccug

SEQ ID NO: 1737089 - RNA, 16 nt, Human
gcacagacccugcccu

SEQ ID NO: 1737090 - RNA, 15 nt, Human
gcacagacccugccc

SEQ ID NO: 1737091 - RNA, 14 nt, Human
gcacagacccugcc

SEQ ID NO: 1737092 - RNA, 23 nt, Human
gcacagaaaauggaagacagcuc

SEQ ID NO: 1737093 - RNA, 22 nt, Human
gcacagaaaauggaagacagcu

SEQ ID NO: 1737094 - RNA, 21 nt, Human
gcacagaaaauggaagacagc

SEQ ID NO: 1737095 - RNA, 21 nt, Human
gcacagacccugcccuguggg

SEQ ID NO: 1737096 - RNA, 20 nt, Human
gcacagacccugcccugugg

SEQ ID NO: 1737097 - RNA, 19 nt, Human
gcacagacccugcccugug

SEQ ID NO: 1737098 - RNA, 18 nt, Human
gcacagacccugcccugu

SEQ ID NO: 1737099 - RNA, 22 nt, Human
gcacagacccugcccugugggc

SEQ ID NO: 1737100 - RNA, 15 nt, Human
gcacagaguuguuac

SEQ ID NO: 1737101 - RNA, 20 nt, Human
gcacagaaaauggaagacag

SEQ ID NO: 1737102 - RNA, 17 nt, Human
gcacaagcuccaagcuc

SEQ ID NO: 1737103 - RNA, 15 nt, Human
gcacaagcuccaagc

SEQ ID NO: 1737104 - RNA, 18 nt, Human
gcacaagcuccaagcucc

SEQ ID NO: 1737105 - RNA, 21 nt, Human
gcacaagcuccaagcucccag

SEQ ID NO: 1737106 - RNA, 23 nt, Human
gcacaaauucugucucuggauua

SEQ ID NO: 1737107 - RNA, 21 nt, Human
gaugguuccccuguucacucu

SEQ ID NO: 1737108 - RNA, 18 nt, Human
gaugguuccccuguucac

SEQ ID NO: 1737109 - RNA, 13 nt, Human
gaugguuccccug

SEQ ID NO: 1737110 - RNA, 16 nt, Human
gauggugcaaugaccu

SEQ ID NO: 1737111 - RNA, 15 nt, Human
gauggugcaaugacc

SEQ ID NO: 1737112 - RNA, 17 nt, Human
gauggugcaaugaccuu

SEQ ID NO: 1737113 - RNA, 14 nt, Human
gauggugcaaugac

SEQ ID NO: 1737114 - RNA, 12 nt, Human
gauggugcaaug

SEQ ID NO: 1737115 - RNA, 22 nt, Human
gauuacaagcgugagccacugc

SEQ ID NO: 1737116 - RNA, 20 nt, Human
gauuaaagaugagcuuuguc

SEQ ID NO: 1737117 - RNA, 15 nt, Human
gauuaaacuuaaucu

SEQ ID NO: 1737118 - RNA, 23 nt, Human
gauuacaagcgugagccacugca

SEQ ID NO: 1737119 - RNA, 17 nt, Human
gauuacaggcuccugcc

SEQ ID NO: 1737120 - RNA, 20 nt, Human
gauuacaggcgugagccacc

SEQ ID NO: 1737121 - RNA, 18 nt, Human
gauuacaggcaugugcca

SEQ ID NO: 1737122 - RNA, 16 nt, Human
gauguuuaguaaucau

SEQ ID NO: 1737123 - RNA, 18 nt, Human
gaugcuagaacucccuuu

SEQ ID NO: 1737124 - RNA, 16 nt, Human
gaugccccgucccccu

SEQ ID NO: 1737125 - RNA, 20 nt, Human
gaugcuagaacucccuuuca

SEQ ID NO: 1737126 - RNA, 22 nt, Human
gaugcuagaacucccuuucaac

SEQ ID NO: 1737127 - RNA, 21 nt, Human
gaugccccgucccccucuggc

SEQ ID NO: 1737128 - RNA, 20 nt, Human
gaugcugacuguacuccucc

SEQ ID NO: 1737129 - RNA, 17 nt, Human
gaugcugacuguacucc

SEQ ID NO: 1737130 - RNA, 19 nt, Human
gaugcccaaagaugcagcc

SEQ ID NO: 1737131 - RNA, 20 nt, Human
gaugcccaaagaugcagccg

SEQ ID NO: 1737132 - RNA, 24 nt, Human
gauggggcccugccuccuuuguga

SEQ ID NO: 1737133 - RNA, 21 nt, Human
gaugggcaacccccagccugc

SEQ ID NO: 1737134 - RNA, 20 nt, Human
gaugggcaacccccagccug

SEQ ID NO: 1737135 - RNA, 22 nt, Human
gauggccgggcgcgguggcuca

SEQ ID NO: 1737136 - RNA, 15 nt, Human
gauggggcugcaccg

SEQ ID NO: 1737137 - RNA, 19 nt, Human
gauggggcugcaccggcug

SEQ ID NO: 1737138 - RNA, 13 nt, Human
gauggggcugcac

SEQ ID NO: 1737139 - RNA, 19 nt, Human
gaugggugcuuggaggaag

SEQ ID NO: 1737140 - RNA, 21 nt, Human
gauuacaggcuccugccacca

SEQ ID NO: 1737141 - RNA, 18 nt, Human
gauuacaggcuccugcca

SEQ ID NO: 1737142 - RNA, 18 nt, Human
gauuacagggaugagcca

SEQ ID NO: 1737143 - RNA, 20 nt, Human
gauuacagggaugagccacc

SEQ ID NO: 1737144 - RNA, 15 nt, Human
gauugcaacaggcug

SEQ ID NO: 1737145 - RNA, 14 nt, Human
gauucuccugccuc

SEQ ID NO: 1737146 - RNA, 16 nt, Human
gauucucaugccucag

SEQ ID NO: 1737147 - RNA, 15 nt, Human
gauuuaacagaaaug

SEQ ID NO: 1737148 - RNA, 22 nt, Human
gauuuccguuaaaauaccagcc

SEQ ID NO: 1737149 - RNA, 16 nt, Human
gauuugagcucagccc

SEQ ID NO: 1737150 - RNA, 13 nt, Human
gauuuaacagaaa

SEQ ID NO: 1737151 - RNA, 14 nt, Human
gauuuaacagaaau

SEQ ID NO: 1737152 - RNA, 12 nt, Human
gauuuaaaucag

SEQ ID NO: 1737153 - RNA, 15 nt, Human
gcaaauguggcuccu

SEQ ID NO: 1737154 - RNA, 23 nt, Human
gcaaaugugaaucauuuuaccuu

SEQ ID NO: 1737155 - RNA, 15 nt, Human
gcaaaccaucauuga

SEQ ID NO: 1737156 - RNA, 19 nt, Human
gauuuugauccaagcuggu

SEQ ID NO: 1737157 - RNA, 21 nt, Human
gauuuugaaauuuuuauuaaa

SEQ ID NO: 1737158 - RNA, 12 nt, Human
gcaaaccaucau

SEQ ID NO: 1737159 - RNA, 16 nt, Human
gauuuugcuguagaag

SEQ ID NO: 1737160 - RNA, 20 nt, Human
gacaaugugaaaagaaaaau

SEQ ID NO: 1737161 - RNA, 19 nt, Human
gacaaugugaaaagaaaaa

SEQ ID NO: 1737162 - RNA, 18 nt, Human
gacaaugugaaaagaaaa

SEQ ID NO: 1737163 - RNA, 12 nt, Human
gacaaugugaaa

SEQ ID NO: 1737164 - RNA, 22 nt, Human
gacaaugcaaaccaucauugaa

SEQ ID NO: 1737165 - RNA, 16 nt, Human
gacaaggaaaaaauaa

SEQ ID NO: 1737166 - RNA, 21 nt, Human
gacaaggauugcuacuguccu

SEQ ID NO: 1737167 - RNA, 19 nt, Human
gacaaggauugcuacuguc

SEQ ID NO: 1737168 - RNA, 18 nt, Human
gacaaggauugcuacugu

SEQ ID NO: 1737169 - RNA, 21 nt, Human
gacaaggaugaucuaggaaga

SEQ ID NO: 1737170 - RNA, 22 nt, Human
gacacaagccuucggcgccuua

SEQ ID NO: 1737171 - RNA, 19 nt, Human
gacacaggcccggcuccag

SEQ ID NO: 1737172 - RNA, 16 nt, Human
gacacaagccuucggc

SEQ ID NO: 1737173 - RNA, 21 nt, Human
gacacaggcccggcuccaggc

SEQ ID NO: 1737174 - RNA, 20 nt, Human
gacacaggcccggcuccagg

SEQ ID NO: 1737175 - RNA, 14 nt, Human
gacacaugcaaggu

SEQ ID NO: 1737176 - RNA, 23 nt, Human
gacacauguccaagaagcccagg

SEQ ID NO: 1737177 - RNA, 20 nt, Human
gacacauguccaagaagccc

SEQ ID NO: 1737178 - RNA, 15 nt, Human
gacacauguccaaga

SEQ ID NO: 1737179 - RNA, 19 nt, Human
gacacaugcaaggucauuu

SEQ ID NO: 1737180 - RNA, 23 nt, Human
gacaacacucauugaccugaggc

SEQ ID NO: 1737181 - RNA, 22 nt, Human
gacaacacucauugaccugagg

SEQ ID NO: 1737182 - RNA, 16 nt, Human
gacaacagacuucuga

SEQ ID NO: 1737183 - RNA, 15 nt, Human
gaauuguaaggaaug

SEQ ID NO: 1737184 - RNA, 22 nt, Human
gaauuucuuuugccguuauuaa

SEQ ID NO: 1737185 - RNA, 21 nt, Human
gaauuucuucaacucccugcc

SEQ ID NO: 1737186 - RNA, 20 nt, Human
gaauuugugaagguggaaau

SEQ ID NO: 1737187 - RNA, 15 nt, Human
gaaugcuguauaugu

SEQ ID NO: 1737188 - RNA, 21 nt, Human
gaaugcacaaacagaggccgc

SEQ ID NO: 1737189 - RNA, 18 nt, Human
gaaugaaccacaucuugc

SEQ ID NO: 1737190 - RNA, 20 nt, Human
gaaugcacaaacagaggccg

SEQ ID NO: 1737191 - RNA, 20 nt, Human
gaauccagacccggcugcgu

SEQ ID NO: 1737192 - RNA, 12 nt, Human
gaaaggcuccag

SEQ ID NO: 1737193 - RNA, 15 nt, Human
gaauguuugccucug

SEQ ID NO: 1737194 - RNA, 16 nt, Human
gaauugacccacaaga

SEQ ID NO: 1737195 - RNA, 21 nt, Human
gaauugacccacaagaaauga

SEQ ID NO: 1737196 - RNA, 13 nt, Human
gaaugucagugug

SEQ ID NO: 1737197 - RNA, 18 nt, Human
gacaugggaaaggggaag

SEQ ID NO: 1737198 - RNA, 14 nt, Human
gaccaccugcccaa

SEQ ID NO: 1737199 - RNA, 13 nt, Human
gaccaccugccca

SEQ ID NO: 1737200 - RNA, 21 nt, Human
gaccacugcagaagacaguau

SEQ ID NO: 1737201 - RNA, 16 nt, Human
gaccacguuucuaaag

SEQ ID NO: 1737202 - RNA, 14 nt, Human
gaccacguuucuaa

SEQ ID NO: 1737203 - RNA, 11 nt, Human
gaccagagcug

SEQ ID NO: 1737204 - RNA, 21 nt, Human
gaccagacaccuugacagggc

SEQ ID NO: 1737205 - RNA, 17 nt, Human
gaccagagcugccaccu

SEQ ID NO: 1737206 - RNA, 15 nt, Human
gaccagagcugccac

SEQ ID NO: 1737207 - RNA, 14 nt, Human
gaccagagcugcca

SEQ ID NO: 1737208 - RNA, 13 nt, Human
gaccagagcugcc

SEQ ID NO: 1737209 - RNA, 19 nt, Human
gaccagagcugccaccugc

SEQ ID NO: 1737210 - RNA, 18 nt, Human
gaccagagcugccaccug

SEQ ID NO: 1737211 - RNA, 20 nt, Human
gaccagccuccaugcugccu

SEQ ID NO: 1737212 - RNA, 22 nt, Human
gaccagccuccaugcugccucc

SEQ ID NO: 1737213 - RNA, 21 nt, Human
gaccagccuccaugcugccuc

SEQ ID NO: 1737214 - RNA, 22 nt, Human
gaccauucuccaccugccaggg

SEQ ID NO: 1737215 - RNA, 21 nt, Human
gaccauucuccaccugccagg

SEQ ID NO: 1737216 - RNA, 20 nt, Human
gaccauucuccaccugccag

SEQ ID NO: 1737217 - RNA, 19 nt, Human
gaccauucuccaccugcca

SEQ ID NO: 1737218 - RNA, 16 nt, Human
gacccaaaaggcagaa

SEQ ID NO: 1737219 - RNA, 15 nt, Human
gacccacaagaaaug

SEQ ID NO: 1737220 - RNA, 22 nt, Human
gacccacaagaaaugaaagcag

SEQ ID NO: 1737221 - RNA, 21 nt, Human
gacccccaaccaaguggcucc

SEQ ID NO: 1737222 - RNA, 12 nt, Human
gacccccaacca

SEQ ID NO: 1737223 - RNA, 12 nt, Human
gacccugcccug

SEQ ID NO: 1737224 - RNA, 23 nt, Human
gacccugaggcccagagggccug

SEQ ID NO: 1737225 - RNA, 22 nt, Human
gacccugaggcccagagggccu

SEQ ID NO: 1737226 - RNA, 21 nt, Human
gaccccuccaugugggcuagu

SEQ ID NO: 1737227 - RNA, 18 nt, Human
gaccccuccaugugggcu

SEQ ID NO: 1737228 - RNA, 14 nt, Human
gaccccuccaugug

SEQ ID NO: 1737229 - RNA, 17 nt, Human
gaccgugaggccagaga

SEQ ID NO: 1737230 - RNA, 16 nt, Human
gaccgugaggccagag

SEQ ID NO: 1737231 - RNA, 18 nt, Human
gaccgugaggccagagac

SEQ ID NO: 1737232 - RNA, 19 nt, Human
gaccgugaggccagagaca

SEQ ID NO: 1737233 - RNA, 21 nt, Human
gacccuuguggucccacccca

SEQ ID NO: 1737234 - RNA, 20 nt, Human
gacccuuguggucccacccc

SEQ ID NO: 1737235 - RNA, 19 nt, Human
gacccuuguggucccaccc

SEQ ID NO: 1737236 - RNA, 12 nt, Human
gacccugucuca

SEQ ID NO: 1737237 - RNA, 20 nt, Human
gacauagaauuaacacauga

SEQ ID NO: 1737238 - RNA, 22 nt, Human
gacaguuaagagaaaugagcuu

SEQ ID NO: 1737239 - RNA, 14 nt, Human
gacaugggaaaggg

SEQ ID NO: 1737240 - RNA, 14 nt, Human
gacaugaucuucuu

SEQ ID NO: 1737241 - RNA, 18 nt, Human
gacagggaggacgcucuc

SEQ ID NO: 1737242 - RNA, 16 nt, Human
gacagggaggugaccc

SEQ ID NO: 1737243 - RNA, 23 nt, Human
gacagggcacaccgggcacucag

SEQ ID NO: 1737244 - RNA, 24 nt, Human
gacagggcacaccgggcacucaga

SEQ ID NO: 1737245 - RNA, 14 nt, Human
gacaguuaagagaa

SEQ ID NO: 1737246 - RNA, 17 nt, Human
gacagggaggacgcucu

SEQ ID NO: 1737247 - RNA, 23 nt, Human
gacaggaccagggauuuccauga

SEQ ID NO: 1737248 - RNA, 15 nt, Human
gacaggaccagggau

SEQ ID NO: 1737249 - RNA, 14 nt, Human
gacaggaccaggga

SEQ ID NO: 1737250 - RNA, 14 nt, Human
gacagagucucacu

SEQ ID NO: 1737251 - RNA, 23 nt, Human
gacagaggggguggccucccaac

SEQ ID NO: 1737252 - RNA, 22 nt, Human
gacagaggggguggccucccaa

SEQ ID NO: 1737253 - RNA, 21 nt, Human
gacagaggggguggccuccca

SEQ ID NO: 1737254 - RNA, 19 nt, Human
gacagaggggguggccucc

SEQ ID NO: 1737255 - RNA, 18 nt, Human
gacagaggggguggccuc

SEQ ID NO: 1737256 - RNA, 15 nt, Human
gacagaggggguggc

SEQ ID NO: 1737257 - RNA, 17 nt, Human
gacagaggcagccccau

SEQ ID NO: 1737258 - RNA, 16 nt, Human
gacagaggcagcccca

SEQ ID NO: 1737259 - RNA, 14 nt, Human
gacagaggcagccc

SEQ ID NO: 1737260 - RNA, 21 nt, Human
gacagagcaagugagacccug

SEQ ID NO: 1737261 - RNA, 19 nt, Human
gacagccacggccaggcca

SEQ ID NO: 1737262 - RNA, 18 nt, Human
gacagccacggccaggcc

SEQ ID NO: 1737263 - RNA, 17 nt, Human
gacagccacggccaggc

SEQ ID NO: 1737264 - RNA, 14 nt, Human
gacagccacggcca

SEQ ID NO: 1737265 - RNA, 22 nt, Human
gacagagugagacucugucuca

SEQ ID NO: 1737266 - RNA, 20 nt, Human
gacagagugagacucugucu

SEQ ID NO: 1737267 - RNA, 17 nt, Human
gacagcugccugggauc

SEQ ID NO: 1737268 - RNA, 16 nt, Human
gacagcugccugggau

SEQ ID NO: 1737269 - RNA, 21 nt, Human
gacagccacggccaggccaga

SEQ ID NO: 1737270 - RNA, 20 nt, Human
gacagccacggccaggccag

SEQ ID NO: 1737271 - RNA, 21 nt, Human
gacagcugccugggaucccuc

SEQ ID NO: 1737272 - RNA, 18 nt, Human
gacagcugccugggaucc

SEQ ID NO: 1737273 - RNA, 13 nt, Human
gacuuggaagcuc

SEQ ID NO: 1737274 - RNA, 19 nt, Human
gacuuaagcacacuugaca

SEQ ID NO: 1737275 - RNA, 19 nt, Human
gacuuaaaauauuccugca

SEQ ID NO: 1737276 - RNA, 16 nt, Human
gagaagcagaggaagg

SEQ ID NO: 1737277 - RNA, 16 nt, Human
gagaagagaaugcaca

SEQ ID NO: 1737278 - RNA, 14 nt, Human
gagaagagaaugca

SEQ ID NO: 1737279 - RNA, 14 nt, Human
gagaaaugagcuug

SEQ ID NO: 1737280 - RNA, 21 nt, Human
gagaaaugaaaaaauauauau

SEQ ID NO: 1737281 - RNA, 16 nt, Human
gagaaagguugaagca

SEQ ID NO: 1737282 - RNA, 22 nt, Human
gagaaaguacuucuccacccug

SEQ ID NO: 1737283 - RNA, 23 nt, Human
gacugaguacguugugcauuugg

SEQ ID NO: 1737284 - RNA, 13 nt, Human
gacugcccggcag

SEQ ID NO: 1737285 - RNA, 15 nt, Human
gacugcccggcaggg

SEQ ID NO: 1737286 - RNA, 21 nt, Human
gacugaguacguugugcauuu

SEQ ID NO: 1737287 - RNA, 22 nt, Human
gacugaguacguugugcauuug

SEQ ID NO: 1737288 - RNA, 17 nt, Human
gacucgcgacaaugcaa

SEQ ID NO: 1737289 - RNA, 18 nt, Human
gacuggaagcacagcuuc

SEQ ID NO: 1737290 - RNA, 16 nt, Human
gacuggaagcacagcu

SEQ ID NO: 1737291 - RNA, 15 nt, Human
gacuggaagcacagc

SEQ ID NO: 1737292 - RNA, 14 nt, Human
gacuggaagcacag

SEQ ID NO: 1737293 - RNA, 13 nt, Human
gacucgcgacaau

SEQ ID NO: 1737294 - RNA, 13 nt, Human
gacuccugcaggc

SEQ ID NO: 1737295 - RNA, 23 nt, Human
gacuccugcacacgcuccuuccu

SEQ ID NO: 1737296 - RNA, 12 nt, Human
gacuccugcagg

SEQ ID NO: 1737297 - RNA, 14 nt, Human
gacuccucugucca

SEQ ID NO: 1737298 - RNA, 11 nt, Human
gacuccucugu

SEQ ID NO: 1737299 - RNA, 13 nt, Human
gacuacaggugug

SEQ ID NO: 1737300 - RNA, 21 nt, Human
gacuacaggugugagucacca

SEQ ID NO: 1737301 - RNA, 18 nt, Human
gacuacaggugugaguca

SEQ ID NO: 1737302 - RNA, 15 nt, Human
gacucauucuucugu

SEQ ID NO: 1737303 - RNA, 14 nt, Human
gacucauucuucug

SEQ ID NO: 1737304 - RNA, 21 nt, Human
gagaguggcuccucccggugc

SEQ ID NO: 1737305 - RNA, 16 nt, Human
gagaguggcuccuccc

SEQ ID NO: 1737306 - RNA, 13 nt, Human
gagaguggcuccu

SEQ ID NO: 1737307 - RNA, 16 nt, Human
gagagggugggagugg

SEQ ID NO: 1737308 - RNA, 20 nt, Human
gagagggugggagugggccc

SEQ ID NO: 1737309 - RNA, 14 nt, Human
gagagggugggagu

SEQ ID NO: 1737310 - RNA, 19 nt, Human
gagaggggaacagacugga

SEQ ID NO: 1737311 - RNA, 13 nt, Human
gagaggggcacag

SEQ ID NO: 1737312 - RNA, 16 nt, Human
gagagcccuucauuug

SEQ ID NO: 1737313 - RNA, 22 nt, Human
gagagagcuucuguugcugccu

SEQ ID NO: 1737314 - RNA, 19 nt, Human
gagagagcuucuguugcug

SEQ ID NO: 1737315 - RNA, 23 nt, Human
gagaaugcacaaacagaggccgc

SEQ ID NO: 1737316 - RNA, 20 nt, Human
gagacagcucugcauacuca

SEQ ID NO: 1737317 - RNA, 22 nt, Human
gagacaggguuuugccauguug

SEQ ID NO: 1737318 - RNA, 21 nt, Human
gagaccaucccugaaggcccc

SEQ ID NO: 1737319 - RNA, 18 nt, Human
gagaccaucccugaaggc

SEQ ID NO: 1737320 - RNA, 14 nt, Human
gagaccaucccuga

SEQ ID NO: 1737321 - RNA, 13 nt, Human
gagacucugucuc

SEQ ID NO: 1737322 - RNA, 22 nt, Human
gagacuccugcaggcagccagg

SEQ ID NO: 1737323 - RNA, 21 nt, Human
gagacucgcgacaaugcaaac

SEQ ID NO: 1737324 - RNA, 20 nt, Human
gagacucgcgacaaugcaaa

SEQ ID NO: 1737325 - RNA, 21 nt, Human
gagacuccugcaggcagccag

SEQ ID NO: 1737326 - RNA, 20 nt, Human
gagacuccugcaggcagcca

SEQ ID NO: 1737327 - RNA, 19 nt, Human
gagacuccugcaggcagcc

SEQ ID NO: 1737328 - RNA, 19 nt, Human
gagccagggucucacuaug

SEQ ID NO: 1737329 - RNA, 23 nt, Human
gagcccacuguacuugcucuuga

SEQ ID NO: 1737330 - RNA, 23 nt, Human
gagccagauuucacucuccuugg

SEQ ID NO: 1737331 - RNA, 14 nt, Human
gagccagggucuca

SEQ ID NO: 1737332 - RNA, 21 nt, Human
gagccagcagccuggcucucc

SEQ ID NO: 1737333 - RNA, 16 nt, Human
gagcagagaauucucu

SEQ ID NO: 1737334 - RNA, 12 nt, Human
gagcagagacca

SEQ ID NO: 1737335 - RNA, 19 nt, Human
gagccaauuuaaagaaaac

SEQ ID NO: 1737336 - RNA, 20 nt, Human
gagccagauuucacucuccu

SEQ ID NO: 1737337 - RNA, 21 nt, Human
gagcauuagauuucucauuug

SEQ ID NO: 1737338 - RNA, 15 nt, Human
gagcauuagauuucu

SEQ ID NO: 1737339 - RNA, 22 nt, Human
gagcaccuuagacagucccugc

SEQ ID NO: 1737340 - RNA, 21 nt, Human
gagcaccuuagacagucccug

SEQ ID NO: 1737341 - RNA, 15 nt, Human
gagcacuaaggugug

SEQ ID NO: 1737342 - RNA, 21 nt, Human
gagcacuaaggugugcucuga

SEQ ID NO: 1737343 - RNA, 20 nt, Human
gagcaccuuagacagucccu

SEQ ID NO: 1737344 - RNA, 23 nt, Human
gagaucaaccccuucgcuccugu

SEQ ID NO: 1737345 - RNA, 16 nt, Human
gagauagccaaggcca

SEQ ID NO: 1737346 - RNA, 14 nt, Human
gagauagccaaggc

SEQ ID NO: 1737347 - RNA, 19 nt, Human
gagaucacgccacugcacu

SEQ ID NO: 1737348 - RNA, 18 nt, Human
gagaucacgccacugcac

SEQ ID NO: 1737349 - RNA, 19 nt, Human
gagauagccaaggccaaag

SEQ ID NO: 1737350 - RNA, 17 nt, Human
gagaugaggccgccaug

SEQ ID NO: 1737351 - RNA, 15 nt, Human
cugccucuucucuac

SEQ ID NO: 1737352 - RNA, 17 nt, Human
cugccugcccaggcccc

SEQ ID NO: 1737353 - RNA, 16 nt, Human
cugccugcccaggccc

SEQ ID NO: 1737354 - RNA, 15 nt, Human
cugccugaagucaca

SEQ ID NO: 1737355 - RNA, 20 nt, Human
cugccugcccaggccccugc

SEQ ID NO: 1737356 - RNA, 22 nt, Human
cugccugggaucccucauccuc

SEQ ID NO: 1737357 - RNA, 21 nt, Human
cugccugggaucccucauccu

SEQ ID NO: 1737358 - RNA, 11 nt, Human
cugccucccau

SEQ ID NO: 1737359 - RNA, 19 nt, Human
cugccucccaucacccgcu

SEQ ID NO: 1737360 - RNA, 16 nt, Human
cugccucccaucaccc

SEQ ID NO: 1737361 - RNA, 14 nt, Human
cugccucccaucac

SEQ ID NO: 1737362 - RNA, 12 nt, Human
cugccucccauc

SEQ ID NO: 1737363 - RNA, 21 nt, Human
cugccucucugcaggucccua

SEQ ID NO: 1737364 - RNA, 20 nt, Human
cugccucucugcaggucccu

SEQ ID NO: 1737365 - RNA, 23 nt, Human
cugccucugacacacagcucugu

SEQ ID NO: 1737366 - RNA, 22 nt, Human
cugccucugacacacagcucug

SEQ ID NO: 1737367 - RNA, 15 nt, Human
cugccucugacacac

SEQ ID NO: 1737368 - RNA, 22 nt, Human
cugccucucugcaggucccuaa

SEQ ID NO: 1737369 - RNA, 20 nt, Human
cugcccugcgggucacagga

SEQ ID NO: 1737370 - RNA, 22 nt, Human
cugcccugcugagucccaggcu

SEQ ID NO: 1737371 - RNA, 17 nt, Human
cucccuucccaccucuc

SEQ ID NO: 1737372 - RNA, 16 nt, Human
cucccuucccaccucu

SEQ ID NO: 1737373 - RNA, 15 nt, Human
cucccuucccaccuc

SEQ ID NO: 1737374 - RNA, 14 nt, Human
cucccuucccaccu

SEQ ID NO: 1737375 - RNA, 12 nt, Human
cugcccuccaag

SEQ ID NO: 1737376 - RNA, 18 nt, Human
cugccgcagcccugcaga

SEQ ID NO: 1737377 - RNA, 17 nt, Human
cugccgcagcccugcag

SEQ ID NO: 1737378 - RNA, 15 nt, Human
cugccgcagcccugc

SEQ ID NO: 1737379 - RNA, 21 nt, Human
cugcccuuucugggcaccggg

SEQ ID NO: 1737380 - RNA, 20 nt, Human
cugcuccagcuguucagcug

SEQ ID NO: 1737381 - RNA, 19 nt, Human
cugcuccagcuguucagcu

SEQ ID NO: 1737382 - RNA, 19 nt, Human
cugcgaccacaagaaggau

SEQ ID NO: 1737383 - RNA, 20 nt, Human
cugcucuccucuugccacug

SEQ ID NO: 1737384 - RNA, 14 nt, Human
cugcucuccucuug

SEQ ID NO: 1737385 - RNA, 12 nt, Human
cugcugaaggcu

SEQ ID NO: 1737386 - RNA, 11 nt, Human
cugcugaaggc

SEQ ID NO: 1737387 - RNA, 21 nt, Human
cugcucuccucuugccacugc

SEQ ID NO: 1737388 - RNA, 18 nt, Human
cugcugaaggaauaaauu

SEQ ID NO: 1737389 - RNA, 17 nt, Human
cugcugaaggaauaaau

SEQ ID NO: 1737390 - RNA, 22 nt, Human
cugcugcccagccuccaagcuc

SEQ ID NO: 1737391 - RNA, 15 nt, Human
cugcugcccagccuc

SEQ ID NO: 1737392 - RNA, 12 nt, Human
cugcugcccagc

SEQ ID NO: 1737393 - RNA, 23 nt, Human
cugcuuccagugaggcucugccc

SEQ ID NO: 1737394 - RNA, 21 nt, Human
cugcuuccagugaggcucugc

SEQ ID NO: 1737395 - RNA, 20 nt, Human
cugcuuccagugaggcucug

SEQ ID NO: 1737396 - RNA, 19 nt, Human
cugcuuccagugaggcucu

SEQ ID NO: 1737397 - RNA, 18 nt, Human
cugcuuccagugaggcuc

SEQ ID NO: 1737398 - RNA, 16 nt, Human
cugcuuccagugaggc

SEQ ID NO: 1737399 - RNA, 15 nt, Human
cugcuuccagugagg

SEQ ID NO: 1737400 - RNA, 23 nt, Human
cugcugguucaggguuggccccu

SEQ ID NO: 1737401 - RNA, 15 nt, Human
cugcugguucagggu

SEQ ID NO: 1737402 - RNA, 13 nt, Human
cugcugguucagg

SEQ ID NO: 1737403 - RNA, 12 nt, Human
cugcuggcugcc

SEQ ID NO: 1737404 - RNA, 15 nt, Human
cugcugcuggcuggu

SEQ ID NO: 1737405 - RNA, 22 nt, Human
cuggccuucggccuccauccug

SEQ ID NO: 1737406 - RNA, 24 nt, Human
cuggccuggccccucagggucccu

SEQ ID NO: 1737407 - RNA, 13 nt, Human
cuggccuggcccc

SEQ ID NO: 1737408 - RNA, 20 nt, Human
cuggccucugcacuccccug

SEQ ID NO: 1737409 - RNA, 18 nt, Human
cuggccucugcacucccc

SEQ ID NO: 1737410 - RNA, 21 nt, Human
cuggccucugcacuccccugc

SEQ ID NO: 1737411 - RNA, 23 nt, Human
cuggccuucggccuccauccuga

SEQ ID NO: 1737412 - RNA, 14 nt, Human
cuggccugugucua

SEQ ID NO: 1737413 - RNA, 15 nt, Human
cuggcgugcaguggu

SEQ ID NO: 1737414 - RNA, 14 nt, Human
cuggcgugcagugg

SEQ ID NO: 1737415 - RNA, 24 nt, Human
cuggcucuuccaggcugggagagc

SEQ ID NO: 1737416 - RNA, 22 nt, Human
cuggcucuuccaggcugggaga

SEQ ID NO: 1737417 - RNA, 21 nt, Human
cuggcucuuccaggcugggag

SEQ ID NO: 1737418 - RNA, 20 nt, Human
cuggagugcagugagccgag

SEQ ID NO: 1737419 - RNA, 21 nt, Human
cuggcacccggccccugcugg

SEQ ID NO: 1737420 - RNA, 20 nt, Human
cuggcacccggccccugcug

SEQ ID NO: 1737421 - RNA, 23 nt, Human
cuggcacugcuuccagugaggcu

SEQ ID NO: 1737422 - RNA, 20 nt, Human
cuggcacugcuuccagugag

SEQ ID NO: 1737423 - RNA, 19 nt, Human
cuggcacugcuuccaguga

SEQ ID NO: 1737424 - RNA, 22 nt, Human
cuggcacccggccccugcuggu

SEQ ID NO: 1737425 - RNA, 21 nt, Human
cuggcacuuggagacuuguau

SEQ ID NO: 1737426 - RNA, 14 nt, Human
cuggcacuuggaga

SEQ ID NO: 1737427 - RNA, 15 nt, Human
cuggcccacugcauc

SEQ ID NO: 1737428 - RNA, 19 nt, Human
cuggcaguggaacuaagaa

SEQ ID NO: 1737429 - RNA, 14 nt, Human
cuggccagaugcac

SEQ ID NO: 1737430 - RNA, 16 nt, Human
cuggagcucugcccau

SEQ ID NO: 1737431 - RNA, 12 nt, Human
cuggagcucugc

SEQ ID NO: 1737432 - RNA, 13 nt, Human
cuggagcucugcc

SEQ ID NO: 1737433 - RNA, 17 nt, Human
cuggagugcagugagcc

SEQ ID NO: 1737434 - RNA, 16 nt, Human
cuggagugcagugagc

SEQ ID NO: 1737435 - RNA, 15 nt, Human
cuggagugcagugag

SEQ ID NO: 1737436 - RNA, 14 nt, Human
cuggagugcaguga

SEQ ID NO: 1737437 - RNA, 22 nt, Human
cuggagguacgaaaagagggga

SEQ ID NO: 1737438 - RNA, 17 nt, Human
cuggagguacgaaaaga

SEQ ID NO: 1737439 - RNA, 21 nt, Human
cuggaccuugaacuggguacu

SEQ ID NO: 1737440 - RNA, 20 nt, Human
cuggaccuugaacuggguac

SEQ ID NO: 1737441 - RNA, 17 nt, Human
cuggaccuugaacuggg

SEQ ID NO: 1737442 - RNA, 20 nt, Human
cuggacuccucuguccaggc

SEQ ID NO: 1737443 - RNA, 19 nt, Human
cuggacuccucuguccagg

SEQ ID NO: 1737444 - RNA, 18 nt, Human
cuggacuccucuguccag

SEQ ID NO: 1737445 - RNA, 17 nt, Human
cuggacuccucugucca

SEQ ID NO: 1737446 - RNA, 14 nt, Human
cuggacuccucugu

SEQ ID NO: 1737447 - RNA, 15 nt, Human
cuggacccuguggau

SEQ ID NO: 1737448 - RNA, 16 nt, Human
cuggaccuugaacugg

SEQ ID NO: 1737449 - RNA, 17 nt, Human
cuggacaggcauguucu

SEQ ID NO: 1737450 - RNA, 14 nt, Human
cuggacaggcaugu

SEQ ID NO: 1737451 - RNA, 23 nt, Human
cuggacaggcauguucucugagg

SEQ ID NO: 1737452 - RNA, 13 nt, Human
cuggaauuugaaa

SEQ ID NO: 1737453 - RNA, 18 nt, Human
cugugccucugggacugg

SEQ ID NO: 1737454 - RNA, 17 nt, Human
cugugccucugggacug

SEQ ID NO: 1737455 - RNA, 22 nt, Human
cugugcugcccugcccaccugg

SEQ ID NO: 1737456 - RNA, 16 nt, Human
cugugccucugggacu

SEQ ID NO: 1737457 - RNA, 14 nt, Human
cugugccucuggga

SEQ ID NO: 1737458 - RNA, 11 nt, Human
cugugccucug

SEQ ID NO: 1737459 - RNA, 14 nt, Human
cugugggcccccaa

SEQ ID NO: 1737460 - RNA, 22 nt, Human
cugugggcgugagaccugcccc

SEQ ID NO: 1737461 - RNA, 21 nt, Human
cugugggcgugagaccugccc

SEQ ID NO: 1737462 - RNA, 18 nt, Human
cuguggccaaguucuuag

SEQ ID NO: 1737463 - RNA, 17 nt, Human
cuguggaugauaaaaca

SEQ ID NO: 1737464 - RNA, 16 nt, Human
cuguggccaaguucuu

SEQ ID NO: 1737465 - RNA, 20 nt, Human
cugugauggggcccugccuc

SEQ ID NO: 1737466 - RNA, 19 nt, Human
cugugauggggcccugccu

SEQ ID NO: 1737467 - RNA, 18 nt, Human
cugugccaugugccaggu

SEQ ID NO: 1737468 - RNA, 16 nt, Human
cugugccaugugccag

SEQ ID NO: 1737469 - RNA, 14 nt, Human
cugugccauuuugu

SEQ ID NO: 1737470 - RNA, 22 nt, Human
cugugccauuuuguauuuuacu

SEQ ID NO: 1737471 - RNA, 17 nt, Human
cugugauggggcccugc

SEQ ID NO: 1737472 - RNA, 18 nt, Human
cugugauggggcccugcc

SEQ ID NO: 1737473 - RNA, 21 nt, Human
cugugaguacuacaguccucc

SEQ ID NO: 1737474 - RNA, 20 nt, Human
cugugaguacuacaguccuc

SEQ ID NO: 1737475 - RNA, 23 nt, Human
cugugaguacuacaguccuccca

SEQ ID NO: 1737476 - RNA, 23 nt, Human
cugucucaagagggcacuggugg

SEQ ID NO: 1737477 - RNA, 18 nt, Human
cugucuccauguuugaug

SEQ ID NO: 1737478 - RNA, 20 nt, Human
cugugugugcgccuacagga

SEQ ID NO: 1737479 - RNA, 23 nt, Human
cugugucuugcaauggcagccuu

SEQ ID NO: 1737480 - RNA, 22 nt, Human
cugugucuugcaauggcagccu

SEQ ID NO: 1737481 - RNA, 21 nt, Human
cugugucuugcaauggcagcc

SEQ ID NO: 1737482 - RNA, 23 nt, Human
cugugggcgugagaccugccccu

SEQ ID NO: 1737483 - RNA, 15 nt, Human
cuguguggcagucug

SEQ ID NO: 1737484 - RNA, 23 nt, Human
cugugugcucaggagcccuggga

SEQ ID NO: 1737485 - RNA, 21 nt, Human
cugugugcucaggagcccugg

SEQ ID NO: 1737486 - RNA, 20 nt, Human
cugugugcucaggagcccug

SEQ ID NO: 1737487 - RNA, 16 nt, Human
cugugugcucaggagc

SEQ ID NO: 1737488 - RNA, 19 nt, Human
cugugugcucaggagcccu

SEQ ID NO: 1737489 - RNA, 13 nt, Human
cuguucucugccc

SEQ ID NO: 1737490 - RNA, 17 nt, Human
cuguucucugcccucca

SEQ ID NO: 1737491 - RNA, 16 nt, Human
cuguucucugcccucc

SEQ ID NO: 1737492 - RNA, 15 nt, Human
cuguucucugcccuc

SEQ ID NO: 1737493 - RNA, 14 nt, Human
cuguucucugcccu

SEQ ID NO: 1737494 - RNA, 19 nt, Human
cuguucucugcccuccaag

SEQ ID NO: 1737495 - RNA, 18 nt, Human
cuguucucugcccuccaa

SEQ ID NO: 1737496 - RNA, 20 nt, Human
cuguucucugcccuccaaga

SEQ ID NO: 1737497 - RNA, 21 nt, Human
cuguucagcugguugagguuu

SEQ ID NO: 1737498 - RNA, 19 nt, Human
cuguucagcugguugaggu

SEQ ID NO: 1737499 - RNA, 13 nt, Human
cuguuacugucuu

SEQ ID NO: 1737500 - RNA, 19 nt, Human
cuguuacacuuuuuggaag

SEQ ID NO: 1737501 - RNA, 18 nt, Human
cuguuacacuuuuuggaa

SEQ ID NO: 1737502 - RNA, 18 nt, Human
cuguucccauucuugcau

SEQ ID NO: 1737503 - RNA, 15 nt, Human
cuguacaaaguagaa

SEQ ID NO: 1737504 - RNA, 13 nt, Human
cuguacaaaguag

SEQ ID NO: 1737505 - RNA, 20 nt, Human
cuguaauccuagcacuuugg

SEQ ID NO: 1737506 - RNA, 23 nt, Human
cuguaaucacagcuacuugggag

SEQ ID NO: 1737507 - RNA, 13 nt, Human
cugguuccucccc

SEQ ID NO: 1737508 - RNA, 12 nt, Human
cugguuccuccc

SEQ ID NO: 1737509 - RNA, 18 nt, Human
cuggucacaggacucugc

SEQ ID NO: 1737510 - RNA, 14 nt, Human
cugguggcagcugc

SEQ ID NO: 1737511 - RNA, 13 nt, Human
cugguggcagcug

SEQ ID NO: 1737512 - RNA, 23 nt, Human
cugguggcccgacagccuggcac

SEQ ID NO: 1737513 - RNA, 22 nt, Human
cugguggcccgacagccuggca

SEQ ID NO: 1737514 - RNA, 21 nt, Human
cugguggcccgacagccuggc

SEQ ID NO: 1737515 - RNA, 20 nt, Human
cugguggcccgacagccugg

SEQ ID NO: 1737516 - RNA, 23 nt, Human
cugguggcagcucaccucucccu

SEQ ID NO: 1737517 - RNA, 22 nt, Human
cuggugcugccacacuucaggc

SEQ ID NO: 1737518 - RNA, 20 nt, Human
cuggugcugccacacuucag

SEQ ID NO: 1737519 - RNA, 13 nt, Human
cuggugcugccac

SEQ ID NO: 1737520 - RNA, 12 nt, Human
cuggugcugcca

SEQ ID NO: 1737521 - RNA, 22 nt, Human
cugggggggauuguaaaauggu

SEQ ID NO: 1737522 - RNA, 19 nt, Human
cugggggcugggcagagga

SEQ ID NO: 1737523 - RNA, 15 nt, Human
cugggggaagaagcu

SEQ ID NO: 1737524 - RNA, 13 nt, Human
cugggggaagaag

SEQ ID NO: 1737525 - RNA, 24 nt, Human
cugggcuucaguggcagcugcuuu

SEQ ID NO: 1737526 - RNA, 17 nt, Human
cuggguucuacccaggu

SEQ ID NO: 1737527 - RNA, 16 nt, Human
cuggguucuacccagg

SEQ ID NO: 1737528 - RNA, 15 nt, Human
cuggguucuacccag

SEQ ID NO: 1737529 - RNA, 14 nt, Human
cuggguacuugugg

SEQ ID NO: 1737530 - RNA, 20 nt, Human
cuggguaacuagggaagaua

SEQ ID NO: 1737531 - RNA, 22 nt, Human
cuggguaacuagggaagauaau

SEQ ID NO: 1737532 - RNA, 22 nt, Human
cugucccuuacgugaguccugg

SEQ ID NO: 1737533 - RNA, 15 nt, Human
cuguccgagcuuuga

SEQ ID NO: 1737534 - RNA, 14 nt, Human
cuguccuacccacc

SEQ ID NO: 1737535 - RNA, 16 nt, Human
cugucucaaaaaaaga

SEQ ID NO: 1737536 - RNA, 23 nt, Human
cugucucaaaaaaacacaaaagu

SEQ ID NO: 1737537 - RNA, 18 nt, Human
cugucucaaaaaaagaaa

SEQ ID NO: 1737538 - RNA, 22 nt, Human
cugucucaagagggcacuggug

SEQ ID NO: 1737539 - RNA, 20 nt, Human
cugucccuuacgugaguccu

SEQ ID NO: 1737540 - RNA, 17 nt, Human
cuguccccgcacugggc

SEQ ID NO: 1737541 - RNA, 22 nt, Human
cuguccccgcacugggcuuggg

SEQ ID NO: 1737542 - RNA, 19 nt, Human
cuguccccgcacugggcuu

SEQ ID NO: 1737543 - RNA, 18 nt, Human
cuguccccgcacugggcu

SEQ ID NO: 1737544 - RNA, 23 nt, Human
cuguaucccaugagccucagcau

SEQ ID NO: 1737545 - RNA, 13 nt, Human
cugucaauuacag

SEQ ID NO: 1737546 - RNA, 13 nt, Human
cugucaaggcuca

SEQ ID NO: 1737547 - RNA, 14 nt, Human
cugucaaggcucag

SEQ ID NO: 1737548 - RNA, 17 nt, Human
cuguccaggcacugcug

SEQ ID NO: 1737549 - RNA, 23 nt, Human
cuguccaggcacugcugcccagc

SEQ ID NO: 1737550 - RNA, 13 nt, Human
cuguacagagccc

SEQ ID NO: 1737551 - RNA, 23 nt, Human
cuucacagaugggugcuuggagg

SEQ ID NO: 1737552 - RNA, 16 nt, Human
cuucaaggauccugag

SEQ ID NO: 1737553 - RNA, 15 nt, Human
cuucaaggauccuga

SEQ ID NO: 1737554 - RNA, 13 nt, Human
cuucaaggauccu

SEQ ID NO: 1737555 - RNA, 10 nt, Human
cuucaaggau

SEQ ID NO: 1737556 - RNA, 16 nt, Human
cuucaacucccugccc

SEQ ID NO: 1737557 - RNA, 20 nt, Human
cuucaaccauuccccauggg

SEQ ID NO: 1737558 - RNA, 16 nt, Human
cuucaaccauucccca

SEQ ID NO: 1737559 - RNA, 18 nt, Human
cuuauuuaaugaaagacu

SEQ ID NO: 1737560 - RNA, 17 nt, Human
cuuauuuaaugaaagac

SEQ ID NO: 1737561 - RNA, 21 nt, Human
cuucaaaaguuuguuugcuua

SEQ ID NO: 1737562 - RNA, 17 nt, Human
cuucaaagcaaaugucu

SEQ ID NO: 1737563 - RNA, 19 nt, Human
cuuagucacugagacagcc

SEQ ID NO: 1737564 - RNA, 18 nt, Human
cuuagucacugagacagc

SEQ ID NO: 1737565 - RNA, 16 nt, Human
cuguucuggcagaguu

SEQ ID NO: 1737566 - RNA, 16 nt, Human
cuguucugcacacagc

SEQ ID NO: 1737567 - RNA, 13 nt, Human
cuuagauguauau

SEQ ID NO: 1737568 - RNA, 16 nt, Human
cuuagucacugagaca

SEQ ID NO: 1737569 - RNA, 19 nt, Human
cuuagauguauauauuucc

SEQ ID NO: 1737570 - RNA, 14 nt, Human
cuuauagacaacau

SEQ ID NO: 1737571 - RNA, 13 nt, Human
cuuauauuaugga

SEQ ID NO: 1737572 - RNA, 17 nt, Human
cuucccuacaguugaaa

SEQ ID NO: 1737573 - RNA, 23 nt, Human
cuucccgcucagcccucccugcc

SEQ ID NO: 1737574 - RNA, 19 nt, Human
cuucccgcucagcccuccc

SEQ ID NO: 1737575 - RNA, 19 nt, Human
cuuccuaauuccacagcug

SEQ ID NO: 1737576 - RNA, 18 nt, Human
cuuccuaauuccacagcu

SEQ ID NO: 1737577 - RNA, 17 nt, Human
cuuccuaauuccacagc

SEQ ID NO: 1737578 - RNA, 13 nt, Human
cuuccuaauucca

SEQ ID NO: 1737579 - RNA, 13 nt, Human
cuuccucccucau

SEQ ID NO: 1737580 - RNA, 21 nt, Human
cuuccaggggugggacacccu

SEQ ID NO: 1737581 - RNA, 17 nt, Human
cuuccaggggugggaca

SEQ ID NO: 1737582 - RNA, 15 nt, Human
cuuccagggguggga

SEQ ID NO: 1737583 - RNA, 14 nt, Human
cuuccagggguggg

SEQ ID NO: 1737584 - RNA, 19 nt, Human
cuuccaggcugggagagcc

SEQ ID NO: 1737585 - RNA, 16 nt, Human
cuuccaggcugggaga

SEQ ID NO: 1737586 - RNA, 15 nt, Human
cuuccaggcugggag

SEQ ID NO: 1737587 - RNA, 16 nt, Human
cuucaguggcagcugc

SEQ ID NO: 1737588 - RNA, 15 nt, Human
cuucaguggcagcug

SEQ ID NO: 1737589 - RNA, 14 nt, Human
cuucaguggcagcu

SEQ ID NO: 1737590 - RNA, 13 nt, Human
cuucaguggcagc

SEQ ID NO: 1737591 - RNA, 22 nt, Human
cuucagugccuuauggaacacu

SEQ ID NO: 1737592 - RNA, 18 nt, Human
cuucagugccuuauggaa

SEQ ID NO: 1737593 - RNA, 23 nt, Human
cuucaguaagccgugauuuucau

SEQ ID NO: 1737594 - RNA, 16 nt, Human
cuucaguaagccguga

SEQ ID NO: 1737595 - RNA, 15 nt, Human
cuucagggagugagg

SEQ ID NO: 1737596 - RNA, 22 nt, Human
cuucaggcucuucuccuuucac

SEQ ID NO: 1737597 - RNA, 19 nt, Human
cuucaggcucuucuccuuu

SEQ ID NO: 1737598 - RNA, 21 nt, Human
cuuccacaagagcccaggccu

SEQ ID NO: 1737599 - RNA, 19 nt, Human
cuuccacaagagcccaggc

SEQ ID NO: 1737600 - RNA, 17 nt, Human
cuuccacaagagcccag

SEQ ID NO: 1737601 - RNA, 17 nt, Human
cuucaguggcagcugcu

SEQ ID NO: 1737602 - RNA, 20 nt, Human
cuucauucaacccaccugcg

SEQ ID NO: 1737603 - RNA, 14 nt, Human
cuuccaggcuggga

SEQ ID NO: 1737604 - RNA, 12 nt, Human
cuuccaggcugg

SEQ ID NO: 1737605 - RNA, 15 nt, Human
cuucuguugcugccu

SEQ ID NO: 1737606 - RNA, 13 nt, Human
cuucuguggcuca

SEQ ID NO: 1737607 - RNA, 21 nt, Human
cuucuguggguuucuaaagcu

SEQ ID NO: 1737608 - RNA, 14 nt, Human
cuucuguggguuuc

SEQ ID NO: 1737609 - RNA, 13 nt, Human
cuucuguggguuu

SEQ ID NO: 1737610 - RNA, 22 nt, Human
cuucuguggcucacagaacccu

SEQ ID NO: 1737611 - RNA, 15 nt, Human
cuucuguggcucaca

SEQ ID NO: 1737612 - RNA, 22 nt, Human
cuucuuuauaauucuacuuuga

SEQ ID NO: 1737613 - RNA, 18 nt, Human
cuugaaaaaugcauguug

SEQ ID NO: 1737614 - RNA, 12 nt, Human
cuugaaaaaugc

SEQ ID NO: 1737615 - RNA, 23 nt, Human
cuugaaaacacuguucucugccc

SEQ ID NO: 1737616 - RNA, 14 nt, Human
cuugaaaacacugu

SEQ ID NO: 1737617 - RNA, 18 nt, Human
cuugaaaauuaacaugaa

SEQ ID NO: 1737618 - RNA, 13 nt, Human
cuugaaaauuaac

SEQ ID NO: 1737619 - RNA, 12 nt, Human
cuugaaaauuaa

SEQ ID NO: 1737620 - RNA, 13 nt, Human
cuugaacuccugg

SEQ ID NO: 1737621 - RNA, 16 nt, Human
cuugaacuccugaccu

SEQ ID NO: 1737622 - RNA, 13 nt, Human
cuugaacuccuga

SEQ ID NO: 1737623 - RNA, 17 nt, Human
cuugaacuuugaccucu

SEQ ID NO: 1737624 - RNA, 21 nt, Human
cuugaacuuugaccucugcag

SEQ ID NO: 1737625 - RNA, 18 nt, Human
cuugaacuccugaccuca

SEQ ID NO: 1737626 - RNA, 13 nt, Human
cuugaccucaggu

SEQ ID NO: 1737627 - RNA, 21 nt, Human
cuugaccgugaggccagagac

SEQ ID NO: 1737628 - RNA, 20 nt, Human
cuugaccgugaggccagaga

SEQ ID NO: 1737629 - RNA, 18 nt, Human
cuugaccgugaggccaga

SEQ ID NO: 1737630 - RNA, 23 nt, Human
cuugaccauucuccaccugccag

SEQ ID NO: 1737631 - RNA, 22 nt, Human
cuugaccauucuccaccugcca

SEQ ID NO: 1737632 - RNA, 17 nt, Human
cuugaccgugaggccag

SEQ ID NO: 1737633 - RNA, 16 nt, Human
cuugaagacuuuucuu

SEQ ID NO: 1737634 - RNA, 20 nt, Human
cuugaggguugggcuggugu

SEQ ID NO: 1737635 - RNA, 19 nt, Human
cuugaggguugggcuggug

SEQ ID NO: 1737636 - RNA, 21 nt, Human
cuugaggguugggcugguguc

SEQ ID NO: 1737637 - RNA, 15 nt, Human
cuugagccuugaacu

SEQ ID NO: 1737638 - RNA, 17 nt, Human
cuugagccuugaacuuu

SEQ ID NO: 1737639 - RNA, 18 nt, Human
cuugagccuugaacuuug

SEQ ID NO: 1737640 - RNA, 16 nt, Human
cuugagccugggaggu

SEQ ID NO: 1737641 - RNA, 21 nt, Human
cuucuguccuacucuguguca

SEQ ID NO: 1737642 - RNA, 19 nt, Human
cuucuguccuacucugugu

SEQ ID NO: 1737643 - RNA, 18 nt, Human
cuucuguccuacucugug

SEQ ID NO: 1737644 - RNA, 17 nt, Human
cuucuguccuacucugu

SEQ ID NO: 1737645 - RNA, 16 nt, Human
cuucuguccuacucug

SEQ ID NO: 1737646 - RNA, 20 nt, Human
cuucuguacgucugacaggc

SEQ ID NO: 1737647 - RNA, 18 nt, Human
cuucuguacgucugacag

SEQ ID NO: 1737648 - RNA, 15 nt, Human
cuucuguacgucuga

SEQ ID NO: 1737649 - RNA, 14 nt, Human
cuucuguacgucug

SEQ ID NO: 1737650 - RNA, 21 nt, Human
cuucuguacgucugacaggca

SEQ ID NO: 1737651 - RNA, 13 nt, Human
cuucugcuucagc

SEQ ID NO: 1737652 - RNA, 23 nt, Human
cuucuggguuccuuccucugagc

SEQ ID NO: 1737653 - RNA, 17 nt, Human
cuucuggguuccuuccu

SEQ ID NO: 1737654 - RNA, 16 nt, Human
cuucuggguuccuucc

SEQ ID NO: 1737655 - RNA, 14 nt, Human
cuucugguugaugc

SEQ ID NO: 1737656 - RNA, 20 nt, Human
cuucuccacuuucuagccag

SEQ ID NO: 1737657 - RNA, 11 nt, Human
cuucuccacuu

SEQ ID NO: 1737658 - RNA, 13 nt, Human
cuucuccacugga

SEQ ID NO: 1737659 - RNA, 15 nt, Human
cuucuccacuggaug

SEQ ID NO: 1737660 - RNA, 14 nt, Human
cuucuccacuggau

SEQ ID NO: 1737661 - RNA, 15 nt, Human
cuuccucccucauuc

SEQ ID NO: 1737662 - RNA, 14 nt, Human
cuucuccaggcugu

SEQ ID NO: 1737663 - RNA, 13 nt, Human
cuucuccaggcug

SEQ ID NO: 1737664 - RNA, 12 nt, Human
cuucuccaggcu

SEQ ID NO: 1737665 - RNA, 17 nt, Human
cuucuccacuggaugga

SEQ ID NO: 1737666 - RNA, 19 nt, Human
cuucucuccagccccugga

SEQ ID NO: 1737667 - RNA, 17 nt, Human
cuucucuccagccccug

SEQ ID NO: 1737668 - RNA, 15 nt, Human
cuucucuccagcccc

SEQ ID NO: 1737669 - RNA, 13 nt, Human
cuucucuccagcc

SEQ ID NO: 1737670 - RNA, 12 nt, Human
cuucucuccagc

SEQ ID NO: 1737671 - RNA, 19 nt, Human
cuucuccuucaccuuuguc

SEQ ID NO: 1737672 - RNA, 20 nt, Human
cuucuccuuagaaguggaag

SEQ ID NO: 1737673 - RNA, 13 nt, Human
cuucucugaagga

SEQ ID NO: 1737674 - RNA, 19 nt, Human
cuuuggcuauuagagauca

SEQ ID NO: 1737675 - RNA, 14 nt, Human
cuuuguccccaccg

SEQ ID NO: 1737676 - RNA, 15 nt, Human
cuuuguccccaccgc

SEQ ID NO: 1737677 - RNA, 23 nt, Human
cuuugucuacuucaaaaguuugu

SEQ ID NO: 1737678 - RNA, 15 nt, Human
cuuugugaggaagcc

SEQ ID NO: 1737679 - RNA, 19 nt, Human
cuuugugaggaagccgcug

SEQ ID NO: 1737680 - RNA, 14 nt, Human
cuuugaccucugca

SEQ ID NO: 1737681 - RNA, 15 nt, Human
cuuugaccucugcag

SEQ ID NO: 1737682 - RNA, 15 nt, Human
cuuucuuccucugcu

SEQ ID NO: 1737683 - RNA, 14 nt, Human
cuuucuuccucugc

SEQ ID NO: 1737684 - RNA, 13 nt, Human
cuuucuuccucug

SEQ ID NO: 1737685 - RNA, 12 nt, Human
cuuucuuccucu

SEQ ID NO: 1737686 - RNA, 17 nt, Human
cuuugaccucugcagca

SEQ ID NO: 1737687 - RNA, 18 nt, Human
cuuugaccucugcagcaa

SEQ ID NO: 1737688 - RNA, 20 nt, Human
cuuugaccucugcagcaaua

SEQ ID NO: 1737689 - RNA, 24 nt, Human
cuuugaccucugcagcaauaaagc

SEQ ID NO: 1737690 - RNA, 20 nt, Human
cuuugcagacaggcaagcac

SEQ ID NO: 1737691 - RNA, 13 nt, Human
cuuugaccucugc

SEQ ID NO: 1737692 - RNA, 22 nt, Human
cuuugcauaacguauaaaagcc

SEQ ID NO: 1737693 - RNA, 15 nt, Human
cuuuccaucuacccu

SEQ ID NO: 1737694 - RNA, 16 nt, Human
cuuucccucccuuccu

SEQ ID NO: 1737695 - RNA, 14 nt, Human
cuuucccucccuuc

SEQ ID NO: 1737696 - RNA, 13 nt, Human
cuuucccucccuu

SEQ ID NO: 1737697 - RNA, 11 nt, Human
cuuucccuccc

SEQ ID NO: 1737698 - RNA, 12 nt, Human
cuuuccugaggc

SEQ ID NO: 1737699 - RNA, 14 nt, Human
cuuucucugaggac

SEQ ID NO: 1737700 - RNA, 15 nt, Human
cuuucucugaggaca

SEQ ID NO: 1737701 - RNA, 15 nt, Human
cuuuccugaggcugg

SEQ ID NO: 1737702 - RNA, 13 nt, Human
cuuuccugaggcu

SEQ ID NO: 1737703 - RNA, 12 nt, Human
cuuucucugagg

SEQ ID NO: 1737704 - RNA, 17 nt, Human
cuuucuggcuaugcauu

SEQ ID NO: 1737705 - RNA, 18 nt, Human
cuuucuggcuaugcauuu

SEQ ID NO: 1737706 - RNA, 19 nt, Human
cuuucuggcuaugcauuug

SEQ ID NO: 1737707 - RNA, 20 nt, Human
cuuucuggcuaugcauuuga

SEQ ID NO: 1737708 - RNA, 20 nt, Human
cuuucugggcaccggggccu

SEQ ID NO: 1737709 - RNA, 11 nt, Human
cuuucuuccuc

SEQ ID NO: 1737710 - RNA, 19 nt, Human
cuugaguuuaaauuguaau

SEQ ID NO: 1737711 - RNA, 23 nt, Human
cuuggggggcugaggugggagga

SEQ ID NO: 1737712 - RNA, 16 nt, Human
cuuguaaauagcucag

SEQ ID NO: 1737713 - RNA, 21 nt, Human
cuuguaaauagcucagguguc

SEQ ID NO: 1737714 - RNA, 22 nt, Human
cuuguacauaaugcgugcauac

SEQ ID NO: 1737715 - RNA, 19 nt, Human
cuuguacauaaugcgugca

SEQ ID NO: 1737716 - RNA, 21 nt, Human
cuuguacauaaugcgugcaua

SEQ ID NO: 1737717 - RNA, 18 nt, Human
cuuguaaauagcucaggu

SEQ ID NO: 1737718 - RNA, 17 nt, Human
cuuguaaauagcucagg

SEQ ID NO: 1737719 - RNA, 15 nt, Human
cuuguacauaaugcg

SEQ ID NO: 1737720 - RNA, 12 nt, Human
cuuguacauaau

SEQ ID NO: 1737721 - RNA, 17 nt, Human
cuuguacuuuauuuucu

SEQ ID NO: 1737722 - RNA, 13 nt, Human
cuuuacuauggcc

SEQ ID NO: 1737723 - RNA, 22 nt, Human
cuuuaccuuuuuuauacauaaa

SEQ ID NO: 1737724 - RNA, 19 nt, Human
cuuuauaauucuacuuuga

SEQ ID NO: 1737725 - RNA, 13 nt, Human
cuuuauaauucua

SEQ ID NO: 1737726 - RNA, 15 nt, Human
cuuuagcgcccaguu

SEQ ID NO: 1737727 - RNA, 14 nt, Human
cuuuagcgcccagu

SEQ ID NO: 1737728 - RNA, 15 nt, Human
cuuuaugcacaaaau

SEQ ID NO: 1737729 - RNA, 23 nt, Human
cuuuaucuugaauaauguaagac

SEQ ID NO: 1737730 - RNA, 21 nt, Human
cuuuaucuugaauaauguaag

SEQ ID NO: 1737731 - RNA, 18 nt, Human
cuuuaucuugaauaaugu

SEQ ID NO: 1737732 - RNA, 20 nt, Human
cuuuuguucuugguuuguaa

SEQ ID NO: 1737733 - RNA, 17 nt, Human
cuuuuuauggccuguga

SEQ ID NO: 1737734 - RNA, 11 nt, Human
cuuuuguucuu

SEQ ID NO: 1737735 - RNA, 12 nt, Human
cuuuuguucuug

SEQ ID NO: 1737736 - RNA, 18 nt, Human
cuuuguuaguuucuccaa

SEQ ID NO: 1737737 - RNA, 22 nt, Human
cuuuuuuggcugcugaaggcuc

SEQ ID NO: 1737738 - RNA, 20 nt, Human
cuuuuuuggcugcugaaggc

SEQ ID NO: 1737739 - RNA, 17 nt, Human
cuuuuuuggcugcugaa

SEQ ID NO: 1737740 - RNA, 18 nt, Human
gaaaacacuguucucugc

SEQ ID NO: 1737741 - RNA, 19 nt, Human
gaaaacacauuuuucuuag

SEQ ID NO: 1737742 - RNA, 18 nt, Human
gaaaacacauuuuucuua

SEQ ID NO: 1737743 - RNA, 15 nt, Human
gaaaaaggaggaaga

SEQ ID NO: 1737744 - RNA, 12 nt, Human
gaaaaaggagga

SEQ ID NO: 1737745 - RNA, 18 nt, Human
gaaaaucuuauaauuuaa

SEQ ID NO: 1737746 - RNA, 22 nt, Human
gaaaaucuacacuccagugaga

SEQ ID NO: 1737747 - RNA, 22 nt, Human
gaaaaucagccugcuccagcug

SEQ ID NO: 1737748 - RNA, 20 nt, Human
gaaaaucagccugcuccagc

SEQ ID NO: 1737749 - RNA, 19 nt, Human
gaaaaguuuuguaaauuuc

SEQ ID NO: 1737750 - RNA, 18 nt, Human
gaaaagggaacugaacau

SEQ ID NO: 1737751 - RNA, 22 nt, Human
gaaaacguggcugcuucaagga

SEQ ID NO: 1737752 - RNA, 20 nt, Human
gaaaacguggcugcuucaag

SEQ ID NO: 1737753 - RNA, 19 nt, Human
gaaaagcugcugacagugu

SEQ ID NO: 1737754 - RNA, 24 nt, Human
gaaaacacuguucucugcccucca

SEQ ID NO: 1737755 - RNA, 15 nt, Human
gaaacuccagaugcc

SEQ ID NO: 1737756 - RNA, 19 nt, Human
gaaacuaggugcauauuua
